United States Patent 7,709,616 (MICRORNAS AND USES THEREOF) - sequence listing, part 11

SEQ ID NO: 299700 - RNA, 64 nt, hsa
aauucugccuuuaauugucuaaaacaaaaacaaaaccagccaaccuauguuacacgugagauua

SEQ ID NO: 299701 - RNA, 64 nt, hsa
gucuccucucucuccuccuuugaccuucuccucgaccagccaucaugacauuuaccaugaauuu

SEQ ID NO: 299702 - RNA, 64 nt, hsa
gcgccugcugcggcucagugacuacaacgugcagaccagccagggugccauccugcaggcccug

SEQ ID NO: 299703 - RNA, 64 nt, hsa
uucccccggguggaacccagcccucaggaccagcaccagccaagggaaugccaccucuucucag

SEQ ID NO: 299704 - RNA, 64 nt, hsa
gccggcuccugcaggguccgagggcugcaucucuaccagccagcccagggcucuucccaggguc

SEQ ID NO: 299705 - RNA, 64 nt, hsa
ccucacccaaggccaaacuccaaacacaaucagaaccagccaaagaagcacuuccugggcacgg

SEQ ID NO: 299706 - RNA, 64 nt, hsa
ccccgcccaagccaaugcagacacugaccucaagaccagccacaccaagucugugcacugccca

SEQ ID NO: 299707 - RNA, 64 nt, hsa
cucuuagcuucucaguaaagaggauacucucccaaccagccaaggaauaaaagcugaucuguau

SEQ ID NO: 299708 - RNA, 64 nt, hsa
ccucccagccucucccaagaccuccccccucgucaccagccaucccucuggaccaggcagaggg

SEQ ID NO: 299709 - RNA, 64 nt, hsa
ugggcaggggccugaggguggcucgggccagcccaccagccaauggaccccuccucaggccgcc

SEQ ID NO: 299710 - RNA, 64 nt, hsa
aaaacaauucccuguuccuucaggcuaugaauggaccagccagggaaacucucgaccuugaucu

SEQ ID NO: 299711 - RNA, 64 nt, hsa
ugcuccaaaaggcccaggcuuccuuuucaaccuaaccagccacagccaagggcccaagcagaag

SEQ ID NO: 299712 - RNA, 64 nt, hsa
cuguaucacagguaucucgggggagcuuugugccuugauggaucaaguucaucauaugcagcac

SEQ ID NO: 299713 - RNA, 64 nt, hsa
caucggucacuucuccaggcugcccuaaauuagguugauggagugagacaugccaaacauccac

SEQ ID NO: 299714 - RNA, 64 nt, hsa
gguauagccagauaagagaaacaaacuauuuuuuuugauggauugcaguaaacgaucacugaag

SEQ ID NO: 299715 - RNA, 64 nt, hsa
augaaagauuauuauacaaaaaauuguauacuacuugauggaaccaacuuuguacaucuuggcc

SEQ ID NO: 299716 - RNA, 64 nt, hsa
guaacagguccuucccagauuuaggguacuuuuauugauggauauguuuuccuuuuauucacau

SEQ ID NO: 299717 - RNA, 64 nt, hsa
ggagcaucuuguaugaucuccguaugaugugauauugauggagauagugguccucauucuuggg

SEQ ID NO: 299718 - RNA, 64 nt, hsa
ucucagaagcagacccacccuuaaguugacaggauugauggaacaugcucuccugcucaaggca

SEQ ID NO: 299719 - RNA, 64 nt, hsa
gagagaugccuggccucugcccaagaaauuagcuuugauggaagccugagcaagucaccugguu

SEQ ID NO: 299720 - RNA, 64 nt, hsa
ugguggcccacuggguacugugaggacugcuacauugauggauguuauuggcuaauccacugca

SEQ ID NO: 299721 - RNA, 64 nt, hsa
ucuguguaacaccuuuuuuggcccauugggugcuuugauggacaucauacuggguaggugacaa

SEQ ID NO: 299722 - RNA, 64 nt, hsa
aauauagcccuuguuuggauuacugcugucugagcacuagaaauuucuaauggaaagaggccuc

SEQ ID NO: 299723 - RNA, 64 nt, hsa
auugaacguaaauaacuuuggaaaacaguuuugacacuagaacaaggucgcuucucuuuuccuc

SEQ ID NO: 299724 - RNA, 64 nt, hsa
aaggcaguuacauaucaauacagagacucaaggucacuagaaaugggccagcugggucaaugug

SEQ ID NO: 299725 - RNA, 64 nt, hsa
cucccgaacccagggucaaccugccuaccacaggcacuagaaggacgaaucugccuacugccca

SEQ ID NO: 299726 - RNA, 64 nt, hsa
ggcccaggagugggagcccaggcccucccuccaggguagagaugcaccgaauggaaauugcacu

SEQ ID NO: 299727 - RNA, 64 nt, hsa
uuccuccuagggggagcugguccccuuccuaugugguagagagacugguguaagaguguggggu

SEQ ID NO: 299728 - RNA, 64 nt, hsa
aaucagaaaggaaacacgaaagaaaagucaggaagguagagagagaaaaagggagggaaggaga

SEQ ID NO: 299729 - RNA, 64 nt, hsa
gaugcgcuucauguuuucucugacucauggaucugguagagaccauagacaugauauagacuaa

SEQ ID NO: 299730 - RNA, 64 nt, hsa
uuacccguuugauucuccuagcaccucccuuggagguagagaucaugaacccauuuaacagacg

SEQ ID NO: 299731 - RNA, 64 nt, hsa
aggccuuacauuuaaucggcuuucucugcggugggguagagaauggagcucccgccuugcgggc

SEQ ID NO: 299732 - RNA, 64 nt, hsa
ugggccccaaggcuugccaagacucauugcuggagguagagaggugucaaccagagaacagcuc

SEQ ID NO: 299733 - RNA, 64 nt, hsa
ugcaguggacggagagccuuggcgagggcagcaggguagagaggacaaagaauguggggcuggu

SEQ ID NO: 299734 - RNA, 64 nt, hsa
ucucuauaggacucuuuaauuuuuuuuuuuuuuugguagagauggggucuugcuguguugccca

SEQ ID NO: 299735 - RNA, 64 nt, hsa
auuuucuaaucucaaagagcuuauauucuagugggguagagauaagugauuuaucuugguguag

SEQ ID NO: 299736 - RNA, 64 nt, hsa
ccugaggaaggcagaagugaauuuggagaacuaggguagagagagguugcuauaaaacgagcau

SEQ ID NO: 299737 - RNA, 64 nt, hsa
agcagucaggagacaagcauaaaccagagcacuggguagagaggaugagggcugguggcugggg

SEQ ID NO: 299738 - RNA, 64 nt, hsa
acuccugccaggaaguguuuauuugccucuaauugggccugagagaccauagggagguuggggc

SEQ ID NO: 299739 - RNA, 64 nt, hsa
cuggcuaguuaccacuaggcuaccaggucucuaggggccugagagaggcccucuagagaaucca

SEQ ID NO: 299740 - RNA, 64 nt, hsa
ggacgcaggagaucaucugaucccagccaaggaggggccugaggcucucccuacucccucagcc

SEQ ID NO: 299741 - RNA, 64 nt, hsa
cagcacccauguaaauaccuucuugcuuuucugugggccugaagguccgacugagaagacugcu

SEQ ID NO: 299742 - RNA, 64 nt, hsa
gcugagcccaccccgcuggcucccagaucagggugggccugaggcaggcagccgaccugaggcc

SEQ ID NO: 299743 - RNA, 64 nt, hsa
gccugggcagcugggugggccugggcagcugggugggccugagcuagggcagcagggccuggcu

SEQ ID NO: 299744 - RNA, 64 nt, hsa
auuuuggggagacaaagggaaaugcagccauagagggccugaugacauccaauacagaguucug

SEQ ID NO: 299745 - RNA, 64 nt, hsa
aauuaagugacuugguaugcuuuauuuaauuguagggccugagguuuuccauucucauuuuucu

SEQ ID NO: 299746 - RNA, 64 nt, hsa
ucuggauauggccaggguggguguguggcuaagugggccugaacagagggaaccuagggcccuu

SEQ ID NO: 299747 - RNA, 64 nt, hsa
ccucaugccaccgccaacccccugccccaggagcgggccugagccacguccucuaggagcagcu

SEQ ID NO: 299748 - RNA, 64 nt, hsa
aggugagauucaaaccuucauccuucugucuccagggccugaucuuuaccacugcaggggcugc

SEQ ID NO: 299749 - RNA, 64 nt, hsa
ugcagagccacguggccgccacgcagugugcuuagggccugaggugugaaagcccagggcucca

SEQ ID NO: 299750 - RNA, 64 nt, hsa
ccccuuggacugugugcagcacgaugcaauuucugggccugaaugucaugcucccuggggcagg

SEQ ID NO: 299751 - RNA, 64 nt, hsa
acccauaaccuggaauucccuguuuccuuguccagggccugaggaaauggcuccccaggucugu

SEQ ID NO: 299752 - RNA, 64 nt, hsa
cccaggggaugaaaaugcaaggaugagucugcuugggccugagaguuugaucugcaggggcagg

SEQ ID NO: 299753 - RNA, 64 nt, hsa
agaacauggcugguagaggcucuagcugugugcggggccugaaggggaguggguucucgcccaa

SEQ ID NO: 299754 - RNA, 64 nt, hsa
gaacagaccaccagacgccagggcugauuggugggggccugagaccccgguugcccauucaugg

SEQ ID NO: 299755 - RNA, 64 nt, hsa
cagcaggcagggagggaggcaaggcaggggaguggggccugagcugagcacugcccccucaccc

SEQ ID NO: 299756 - RNA, 64 nt, hsa
ucuggcuggggucuuggcacugucuuccuggccggggccugaaaccuuagcccccagccggccu

SEQ ID NO: 299757 - RNA, 64 nt, hsa
aaagcacaaugcccuggucacuuggcaagcggcugggccugacggaggccgaggggcagaccgg

SEQ ID NO: 299758 - RNA, 64 nt, hsa
agcagcggccucuagcuccgucucccggggaccugggccugagggagggcuggagucgcacgcg

SEQ ID NO: 299759 - RNA, 64 nt, hsa
ccucugaacaccacagccagguccugccuucugggggccugaauauuccagagcugaugugaug

SEQ ID NO: 299760 - RNA, 64 nt, hsa
cgguccuggacucccgcaggacuccucugaggcagggccugaagucuguacacgugguccagau

SEQ ID NO: 299761 - RNA, 64 nt, hsa
acauuauaugauuuccacgcaggucacaccaucugggccugagguagcagugggucacuuugau

SEQ ID NO: 299762 - RNA, 64 nt, hsa
agaacauuucugagccaaaguaaucuuccuucuggggccugaguuccccaaacuaccccacagc

SEQ ID NO: 299763 - RNA, 64 nt, hsa
ucuggacucuguuccuauaccacaacagcagcaggggccugaaaugugauguccacaagagcua

SEQ ID NO: 299764 - RNA, 64 nt, hsa; identical to SEQ ID NO: 211302

SEQ ID NO: 299765 - RNA, 64 nt, hsa; identical to SEQ ID NO: 211303

SEQ ID NO: 299766 - RNA, 64 nt, hsa; identical to SEQ ID NO: 211304

SEQ ID NO: 299767 - RNA, 64 nt, hsa; identical to SEQ ID NO: 211305

SEQ ID NO: 299768 - RNA, 64 nt, hsa; identical to SEQ ID NO: 211306

SEQ ID NO: 299769 - RNA, 64 nt, hsa; identical to SEQ ID NO: 211307

SEQ ID NO: 299770 - RNA, 64 nt, hsa; identical to SEQ ID NO: 211308

SEQ ID NO: 299771 - RNA, 64 nt, hsa; identical to SEQ ID NO: 211309

SEQ ID NO: 299772 - RNA, 64 nt, hsa; identical to SEQ ID NO: 211310

SEQ ID NO: 299773 - RNA, 64 nt, hsa; identical to SEQ ID NO: 211311

SEQ ID NO: 299774 - RNA, 64 nt, hsa; identical to SEQ ID NO: 211312

SEQ ID NO: 299775 - RNA, 64 nt, hsa; identical to SEQ ID NO: 211313

SEQ ID NO: 299776 - RNA, 64 nt, hsa; identical to SEQ ID NO: 211314

SEQ ID NO: 299777 - RNA, 64 nt, hsa; identical to SEQ ID NO: 211315

SEQ ID NO: 299778 - RNA, 64 nt, hsa; identical to SEQ ID NO: 211316

SEQ ID NO: 299779 - RNA, 64 nt, hsa; identical to SEQ ID NO: 211317

SEQ ID NO: 299780 - RNA, 64 nt, hsa; identical to SEQ ID NO: 211318

SEQ ID NO: 299781 - RNA, 64 nt, hsa; identical to SEQ ID NO: 211319

SEQ ID NO: 299782 - RNA, 64 nt, hsa; identical to SEQ ID NO: 211320

SEQ ID NO: 299783 - RNA, 64 nt, hsa; identical to SEQ ID NO: 211321

SEQ ID NO: 299784 - RNA, 64 nt, hsa; identical to SEQ ID NO: 211322

SEQ ID NO: 299785 - RNA, 64 nt, hsa; identical to SEQ ID NO: 211323

SEQ ID NO: 299786 - RNA, 64 nt, hsa; identical to SEQ ID NO: 211324

SEQ ID NO: 299787 - RNA, 64 nt, hsa; identical to SEQ ID NO: 211325

SEQ ID NO: 299788 - RNA, 57 nt, hsa; identical to SEQ ID NO: 211326

SEQ ID NO: 299789 - RNA, 64 nt, hsa; identical to SEQ ID NO: 211327

SEQ ID NO: 299790 - RNA, 64 nt, hsa; identical to SEQ ID NO: 211328

SEQ ID NO: 299791 - RNA, 64 nt, hsa; identical to SEQ ID NO: 211329

SEQ ID NO: 299792 - RNA, 64 nt, hsa; identical to SEQ ID NO: 211330

SEQ ID NO: 299793 - RNA, 64 nt, hsa; identical to SEQ ID NO: 211331

SEQ ID NO: 299794 - RNA, 64 nt, hsa; identical to SEQ ID NO: 211332

SEQ ID NO: 299795 - RNA, 64 nt, hsa; identical to SEQ ID NO: 211333

SEQ ID NO: 299796 - RNA, 64 nt, hsa; identical to SEQ ID NO: 211334

SEQ ID NO: 299797 - RNA, 64 nt, hsa; identical to SEQ ID NO: 211335

SEQ ID NO: 299798 - RNA, 64 nt, hsa; identical to SEQ ID NO: 211336

SEQ ID NO: 299799 - RNA, 64 nt, hsa; identical to SEQ ID NO: 211337

SEQ ID NO: 299800 - RNA, 64 nt, hsa; identical to SEQ ID NO: 211338

SEQ ID NO: 299801 - RNA, 64 nt, hsa; identical to SEQ ID NO: 211339

SEQ ID NO: 299802 - RNA, 64 nt, hsa; identical to SEQ ID NO: 211340

SEQ ID NO: 299803 - RNA, 64 nt, hsa; identical to SEQ ID NO: 211341

SEQ ID NO: 299804 - RNA, 64 nt, hsa; identical to SEQ ID NO: 211342

SEQ ID NO: 299805 - RNA, 64 nt, hsa; identical to SEQ ID NO: 211343

SEQ ID NO: 299806 - RNA, 64 nt, hsa; identical to SEQ ID NO: 211344

SEQ ID NO: 299807 - RNA, 64 nt, hsa; identical to SEQ ID NO: 211345

SEQ ID NO: 299808 - RNA, 64 nt, hsa; identical to SEQ ID NO: 211346

SEQ ID NO: 299809 - RNA, 64 nt, hsa; identical to SEQ ID NO: 211347

SEQ ID NO: 299810 - RNA, 64 nt, hsa; identical to SEQ ID NO: 211348

SEQ ID NO: 299811 - RNA, 64 nt, hsa; identical to SEQ ID NO: 211349

SEQ ID NO: 299812 - RNA, 64 nt, hsa; identical to SEQ ID NO: 211350

SEQ ID NO: 299813 - RNA, 64 nt, hsa; identical to SEQ ID NO: 211351

SEQ ID NO: 299814 - RNA, 64 nt, hsa; identical to SEQ ID NO: 211352

SEQ ID NO: 299815 - RNA, 64 nt, hsa; identical to SEQ ID NO: 211353

SEQ ID NO: 299816 - RNA, 64 nt, hsa; identical to SEQ ID NO: 211354

SEQ ID NO: 299817 - RNA, 64 nt, hsa; identical to SEQ ID NO: 211355

SEQ ID NO: 299818 - RNA, 64 nt, hsa; identical to SEQ ID NO: 211356

SEQ ID NO: 299819 - RNA, 64 nt, hsa; identical to SEQ ID NO: 211357

SEQ ID NO: 299820 - RNA, 63 nt, hsa
aggguggggagagcuggcaggcccagggcuuguccugcugaccccagcagacccuccuguugg

SEQ ID NO: 299821 - RNA, 63 nt, hsa
aggaucuggccuuguggucacuggcaucugagcccugcugauggcuggggcucucgggcaugc

SEQ ID NO: 299822 - RNA, 63 nt, hsa
guuucuggaggcagcuggucccccacaccgcguccugcugagccugcccccuggauuggcugu

SEQ ID NO: 299823 - RNA, 63 nt, hsa
uuucggaucuucugucccagauccugcucccucccugcugagccugggguuccccuggcauug

SEQ ID NO: 299824 - RNA, 63 nt, hsa
ggagacuguggaggcaguggagacugacuucuuccugcugacagcuggaugucacacaugaag

SEQ ID NO: 299825 - RNA, 63 nt, hsa
cugcugcuuuccugacagcuuacucuuccuccaccugcugagccugugccagacuccauugcu

SEQ ID NO: 299826 - RNA, 61 nt, hsa; identical to SEQ ID NO: 240071

SEQ ID NO: 299827 - RNA, 63 nt, hsa
cuggugguaggugggaagcaugguguccaccugccugcugaccacuggacgcugcuccaugcu

SEQ ID NO: 299828 - RNA, 63 nt, hsa
uagagauauggcagcgaaaggauguaaacagugccugcugaaugauuuccaaagagaaaaaaa

SEQ ID NO: 299829 - RNA, 63 nt, hsa
cuucccaucacuggagcaccaggcacgaacccaccugcugagagacccaaggaggaaaaacag

SEQ ID NO: 299830 - RNA, 63 nt, hsa
ccugggguauccgggaggauggccgcaccccuuccugcugaucacccaaacguggucucccgu

SEQ ID NO: 299831 - RNA, 63 nt, hsa
ugccugggcuucuuuggcgagaugauugcuuugccugcugagguuaguuuugggaagcgcuuc

SEQ ID NO: 299832 - RNA, 63 nt, hsa
gcucaaggccaucgucuccucuuccaaucaggcccugcugaggcaggggaccucugcccgaga

SEQ ID NO: 299833 - RNA, 63 nt, hsa
guucugaugaaaacugacugcuggcccagggccccugcugaggggcgucaggccaggcuugac

SEQ ID NO: 299834 - RNA, 63 nt, hsa
uaucuacuucuuuuaaaguuagaagaaaauuaaccugcugacaggcaacauuuuuggggugcu

SEQ ID NO: 299835 - RNA, 63 nt, hsa
accugggggcucacagcacagaaccuagaagcaccugcugacacucuucaacugauuuuuaaa

SEQ ID NO: 299836 - RNA, 63 nt, hsa
augagcuaaguuguuauuucuuucauucauaucccugcugaaauauugguacuagcaacuuaa

SEQ ID NO: 299837 - RNA, 63 nt, hsa
uggggagcaaagagggcagccugacuagaugccccugcugaaucugguacuuucugcacagcc

SEQ ID NO: 299838 - RNA, 63 nt, hsa
ccuagugccugaguuuggggaugggaugcucugccugcugauguggcccugacaggcagccgu

SEQ ID NO: 299839 - RNA, 63 nt, hsa
gcucccccaugcgaggauccgggucugccuccuccugcugaagacagacaugcagcagcgggc

SEQ ID NO: 299840 - RNA, 63 nt, hsa
caaggacgucugcuuccaccucaagcgcacagcccugcugagccacauggccggcucugugca

SEQ ID NO: 299841 - RNA, 63 nt, hsa
ccuggaggcgcacuaugaggcacugcggcacuuccugcugauggaggacggcgaguucgccca

SEQ ID NO: 299842 - RNA, 64 nt, hsa
gccuccagggcgcagccuccugaguagcugggaggacaggcauaugccaccacaucacugagaa

SEQ ID NO: 299843 - RNA, 64 nt, hsa
ucuacaaaaaauuuaaaaauuagccaaguauggugacaggcaccuaugguuccagcuacucagg

SEQ ID NO: 299844 - RNA, 64 nt, hsa
aaaaugugaaguaauagugaaccuaacagucagagacaggcagcaugcucuuaacuagugcucu

SEQ ID NO: 299845 - RNA, 64 nt, hsa
ugccaggggagccucacugugaagucuaggcucagacaggcaucaacaaaccuauucaccccac

SEQ ID NO: 299846 - RNA, 64 nt, hsa
cuucuccauggcugcuuccugcugaauaaauagggacaggcauaauggauaggaaugaaugaac

SEQ ID NO: 299847 - RNA, 64 nt, hsa
cauagccuuaauagcccuaguugucauccugggagacaggcaacaguagagauauuugagagcc

SEQ ID NO: 299848 - RNA, 64 nt, hsa
acagguagacuugguuuuuagaauucauaaaacugacaggcaggggaaucuuccugagugacag

SEQ ID NO: 299849 - RNA, 64 nt, hsa
gggccugggagcucagugacauaaaugcugaagagacaggcauuguuuuccgugcuguguccuc

SEQ ID NO: 299850 - RNA, 64 nt, hsa
ccuuccuggagcagucauaaugaauuacagucaugacaggcacauguaagaaaccaaaauuugc

SEQ ID NO: 299851 - RNA, 64 nt, hsa
gacgccucagccccuuaacauggaugugccacaugacaggcaauaauauauuggccccauuagc

SEQ ID NO: 299852 - RNA, 64 nt, hsa
cggaucagccugagaugaucccagcugugcucuggacaggcauguucucugaggacacuaacca

SEQ ID NO: 299853 - RNA, 64 nt, hsa
ggugucaccugaagacucauucuucuguacgucugacaggcaaugcuggcuguuggcugggggc

SEQ ID NO: 299854 - RNA, 64 nt, hsa
uccagacccggcugcgugguugaugaucuuugcagacaggcaagcaccuccugccucgaacugg

SEQ ID NO: 299855 - RNA, 64 nt, hsa
gucccgcccacauaugagacaggcacuggcugaagacaggcaacucucgucccaaccaucauuc

SEQ ID NO: 299856 - RNA, 64 nt, hsa
cugccaggcugcucagagucccgcccacauaugagacaggcacuggcugaagacaggcaacucu

SEQ ID NO: 299857 - RNA, 64 nt, hsa
gaccgacgcagccugaaagagacccagacagagagacaggcagacacagccuaaaacagaccug

SEQ ID NO: 299858 - RNA, 64 nt, hsa
gacaggcagacacagccuaaaacagaccuggacagacaggcagacguagucugaaacagaccug

SEQ ID NO: 299859 - RNA, 64 nt, hsa
aucuuuacaauuuauguuuagagauugcaguaaagacaggcauaagaaauuauaaaaguauuaa

SEQ ID NO: 299860 - RNA, 64 nt, hsa
uccucagcugacaggauugagagauuaaaguaaagacaggcauaggaaaucacaaggguauuga

SEQ ID NO: 299861 - RNA, 64 nt, hsa
auguauuuuagacuuccuguagggggcgauauacuaaauguauauaguacauuuauacuaaaug

SEQ ID NO: 299862 - RNA, 64 nt, hsa
ggcgauauacuaaauguauauaguacauuuauacuaaauguauuccuguagggggcgauauacu

SEQ ID NO: 299863 - RNA, 64 nt, hsa
uauacuaaauguauuccuguagggggcgauauacuaaauguauuuuagacuuccuguagggggc

SEQ ID NO: 299864 - RNA, 64 nt, hsa
cuaaguuuccugaguuauuaguaagauugcucccuaaauguaaccagggauuuucccauuaugu

SEQ ID NO: 299865 - RNA, 64 nt, hsa
uauccaccuuguuuuuuuauugucuacaaaccauuaaauguaaauauuguuuuuagagucaguc

SEQ ID NO: 299866 - RNA, 64 nt, hsa
uuuaacgucuuuccucuaguacuaccaguauucauaaauguauaccccuuacuguaauuuguuc

SEQ ID NO: 299867 - RNA, 64 nt, hsa
cuuaaauuuaguucaucuuucuuuaaaagaacauuaaauguaaccauuuugucagauccaugua

SEQ ID NO: 299868 - RNA, 64 nt, hsa
cgauauuugauaauuauauuuguauuucaccaccuaaauguaauguugauuccucaagaaugaa

SEQ ID NO: 299869 - RNA, 64 nt, hsa
ggguuugggacagcaccugguauagaauaaauaauaaauguaaacuauuauuuuugguuaucau

SEQ ID NO: 299870 - RNA, 64 nt, hsa
aucuauaacuuauaaacaccaacuuucaauguaauaaauguauccuaaucuuauguauguuuaa

SEQ ID NO: 299871 - RNA, 64 nt, hsa
cuuaugaauauuuauaacagcauucuugucacaauaaauguauucaaauaccaauaacagaucu

SEQ ID NO: 299872 - RNA, 64 nt, hsa
gcaguaaaaacuguucucuauuagacuuuagaaauaaauguaccugauguaccugaugcuaugg

SEQ ID NO: 299873 - RNA, 64 nt, hsa
uucucacuuuuuauuguauuuuaucuuccgcagauaaauguagaaauacacgauucugucaccu

SEQ ID NO: 299874 - RNA, 64 nt, hsa
uauuuuacuacaguacagaguuuaaaugaauacauaaauguagaaguacugaauguauauauuu

SEQ ID NO: 299875 - RNA, 64 nt, hsa
guguuugugugugaugccauauuucuuuuucagguaaauguagucuuccuuauaaaaaugaaau

SEQ ID NO: 299876 - RNA, 64 nt, hsa
aauuugaaaugcuauguauucacuuuucacucuguaaauguaauucuuuacaaugacuuuauuu

SEQ ID NO: 299877 - RNA, 64 nt, hsa
ucuuuuuuguguuucucuaaagucauuuauacauuaaauguaauuauagcaacugugggguucu

SEQ ID NO: 299878 - RNA, 64 nt, hsa
uuugucuggcuuuuguuuucuuuuucuuuaaaaauaaauguacaguaaaacuacaagcaaaagu

SEQ ID NO: 299879 - RNA, 64 nt, hsa
cuaauaagucuccuagguuacuaacuuacuuaccuaaauguaacacaaugaauuccagcuuucu

SEQ ID NO: 299880 - RNA, 64 nt, hsa
auacaacugugaaauaauaaggccgauuuucauauaaauguaugaaaaucaaccauguuuucuc

SEQ ID NO: 299881 - RNA, 64 nt, hsa
uuuuccaaaacuuaguggacucuaugugauguacuaaauguauacaccuuguaagcaauaguua

SEQ ID NO: 299882 - RNA, 64 nt, hsa
guggcauaaucagugauaucuuuuauaugcuguauaaauguauaaaauauaaggauuacuuuug

SEQ ID NO: 299883 - RNA, 64 nt, hsa
caaacacaauugggaggcaauaguaucaauauccuaaauguagaaauuaaaagauacuguauaa

SEQ ID NO: 299884 - RNA, 64 nt, hsa
uuugggaccagauguauuuggggauagaauucuuuaaauguaugggacuucaugcuuccugauu

SEQ ID NO: 299885 - RNA, 64 nt, hsa
uucucuuguuaccauacugauucuuuucuauuuauaaauguauuuugaugggcaguaaaacaaa

SEQ ID NO: 299886 - RNA, 64 nt, hsa
aucauguuguaauuaauuuuuuggaaguuuccguuaaauguaauauugcuucucuuguuaccau

SEQ ID NO: 299887 - RNA, 64 nt, hsa
auagaaagcccucugcaauauauuaaauguauacuaaauguauauauuuaauaaugucauguau

SEQ ID NO: 299888 - RNA, 64 nt, hsa
caguaugcuaaauagaaagcccucugcaauauauuaaauguauacuaaauguauauauuuaaua

SEQ ID NO: 299889 - RNA, 64 nt, hsa
aggauuugggauuucugugcuauaaaccugauucuaaauguaggacccaaguuucuggacuacu

SEQ ID NO: 299890 - RNA, 64 nt, hsa
auuucuguuuaugccagauuauugaagauaaauauaaauguauguuggugugugaaaugcucug

SEQ ID NO: 299891 - RNA, 64 nt, hsa
agugcuaguaauuuuuuccuccuugaguacacauuaaauguacauaacauagcgcggucaggcu

SEQ ID NO: 299892 - RNA, 64 nt, hsa
auuaaggguugacaauuacuacaucuuuauucucuaaauguaguauaauuugccuuuuaaccuu

SEQ ID NO: 299893 - RNA, 64 nt, hsa
cauaaacuauauucugugacaugcuaauuauuauuaaauguaagucguuaguucgaaagccucu

SEQ ID NO: 299894 - RNA, 64 nt, hsa
cuaggugcuauuuucuuauccuuuguacuguagcuaaauguaccugagacauauuagucuuuga

SEQ ID NO: 299895 - RNA, 64 nt, hsa
guuacuucacugcuuugaauacauacuauggauauaaauguaggcaaaaugaaagauuaugacu

SEQ ID NO: 299896 - RNA, 64 nt, hsa
cuaguggaggaaguuagacaagcauuuuaaguaauaaauguauagagagugucaagugaugagu

SEQ ID NO: 299897 - RNA, 64 nt, hsa
auucuuaauuuucauuaaguuguuauuucaguuuuaaauguaccuucagaauaagcuuccccac

SEQ ID NO: 299898 - RNA, 64 nt, hsa
guuaauauucauuuuuguuauccuuuuuuaaaaguaaauguacaggaugccaguaaaaaaaaaa

SEQ ID NO: 299899 - RNA, 64 nt, hsa
uguuugcaacaucugauaacuucauggccuuugauaaauguauauauguauaugugcauggacu

SEQ ID NO: 299900 - RNA, 64 nt, hsa
cuuauuccaauucuaugcauguuacugguauuuauaaauguaugaguuuuuuugcgguauaaua

SEQ ID NO: 299901 - RNA, 64 nt, hsa
uauuuauaaauguaugaguuuuuuugcgguauaauaaauguaaauuuucuuuguauucuaauug

SEQ ID NO: 299902 - RNA, 64 nt, hsa
uccagaagauagacuucagacccuuaaugccauuuaaauguaguuuuugugguuuaaucuuaug

SEQ ID NO: 299903 - RNA, 64 nt, hsa
uccauuuaauuuaaaugacaaaauugcauagggauaaauguacaguuuuacuaagguuuagcac

SEQ ID NO: 299904 - RNA, 64 nt, hsa
gaacucuaagaccacagaguuuuuuauaaauguauaaauguaucaagccaaaugugcagaugcu

SEQ ID NO: 299905 - RNA, 64 nt, hsa
aguagcaggaacucuaagaccacagaguuuuuuauaaauguauaaauguaucaagccaaaugug

SEQ ID NO: 299906 - RNA, 64 nt, hsa
accgaugcuccauccucguauuucuuuuuccuuguaaauguaaucagaugccauuuuauaugug

SEQ ID NO: 299907 - RNA, 64 nt, hsa
agggcuagaguuuuaacuuuuaauuuuuuauauuuaaauguagacuuuugacacuuuuaaaaaa

SEQ ID NO: 299908 - RNA, 64 nt, hsa
aggugaaaaagcacuauuaucaguucugccuagguaaauguaagauagaauuaaauggcagugc

SEQ ID NO: 299909 - RNA, 64 nt, hsa
aaaguuucaaaagaaaauguuuauuuguucucauuaaauguauuuuagcaaacucagcucuucc

SEQ ID NO: 299910 - RNA, 64 nt, hsa
auuauguuaaugaagaaaagagaaaauugaagcauaaauguauuuuugaaguaguuauucggua

SEQ ID NO: 299911 - RNA, 64 nt, hsa
uuucaaccgaaaaguaagcauuuaacccggugaauaaauguagauccugccauucauugguauu

SEQ ID NO: 299912 - RNA, 64 nt, hsa
uuaaauuucuaaccacaagaccucucuauaaugguaaauguaagacaucaccauuuuaucacuc

SEQ ID NO: 299913 - RNA, 64 nt, hsa
ggcgacugcagaaaauugacaaugccugccuguguaaauguauggcuuacugucaaagcuucau

SEQ ID NO: 299914 - RNA, 64 nt, hsa
agaaguguuugcccacacagcaaaugguccauguuaaauguaaauccuuuuuaguguuaauguc

SEQ ID NO: 299915 - RNA, 64 nt, hsa
auuuaccuuaucaaaccuagaauguguauauuuauaaauguaugucuucauugcuagguacuaa

SEQ ID NO: 299916 - RNA, 64 nt, hsa
uuuuuuuuuuaacuguagaucaugcaugugauuguaaauguaaauuuguacaauguuguuaugg

SEQ ID NO: 299917 - RNA, 64 nt, hsa
acuacaaaaacagaauaauuuugaaguuuuagaauaaauguaauauauuuacuauaauucuaaa

SEQ ID NO: 299918 - RNA, 64 nt, hsa
aaguuucuaaugugguauuuuaaauaaaguaucauaaauguaauaaguaaauauuuauuuagga

SEQ ID NO: 299919 - RNA, 64 nt, hsa
uuugcuaccacuuaaugaaucucaaaauuuugaguaaauguaccucagucuaaucagacuuuuu

SEQ ID NO: 299920 - RNA, 64 nt, hsa
agcaggcugauugcaauagacucagacaugcgaauaaauguaauugagagucuauucaugguga

SEQ ID NO: 299921 - RNA, 64 nt, hsa
aaaauguuugauuccuugggaauggccuuaaaaauaaauguaauaaagucagaguggugguaug

SEQ ID NO: 299922 - RNA, 64 nt, hsa
uggugguaugaaaacauuccuagugaucauguaguaaauguaggguuaagcauggacagccaga

SEQ ID NO: 299923 - RNA, 64 nt, hsa
uguuguuucugguuuuguuugccaaugagcauaauaaauguaaaaccuauauaguaucccugug

SEQ ID NO: 299924 - RNA, 64 nt, hsa
ugcuagaacacacauuuuuaaugaaaagaaguaauaaauguaacuauuaagcuaaaaugcaaau

SEQ ID NO: 299925 - RNA, 64 nt, hsa
uuaugauccaaugcaaauacagcuccaaaaauauuaaauguauauauauuuuaaaaugccugag

SEQ ID NO: 299926 - RNA, 64 nt, hsa
gacaguugguauauguaccagccaaucccuucauuaaauguauacagauuuaguuaaguagcau

SEQ ID NO: 299927 - RNA, 64 nt, hsa
uauaauuccauuuacaugaagcauccagaaaagauaaauguauagggacaaaaaguagauucau

SEQ ID NO: 299928 - RNA, 64 nt, hsa
aaaguuggauuguagagauggcugcacaacucaguaaauguacuaaaaaucuuuuaacuuaaaa

SEQ ID NO: 299929 - RNA, 64 nt, hsa
uacaaaguuauuucuucaucuugaccuguuuuuuuaaauguaaacuuuuaaggacuugagauaa

SEQ ID NO: 299930 - RNA, 64 nt, hsa
gcuaauauacaaaaaagcagauuaaauuacaugauaaauguagcugaucaucaguguuuaauug

SEQ ID NO: 299931 - RNA, 64 nt, hsa
ugcccaauuuuggaguugagaggguuguugguaauaaauguaugauguacacuuaaaacaucug

SEQ ID NO: 299932 - RNA, 64 nt, hsa
aucauauuccauuguaucaguuaacauauaguuuuaaauguauguauuauaaauaucuguaacc

SEQ ID NO: 299933 - RNA, 64 nt, hsa; identical to SEQ ID NO: 299928

SEQ ID NO: 299934 - RNA, 64 nt, hsa; identical to SEQ ID NO: 299927

SEQ ID NO: 299935 - RNA, 64 nt, hsa
aaaaagaugaaaggaaaugcaaacuguaaauguauaaauguauauuguauuguauguacauuuu

SEQ ID NO: 299936 - RNA, 64 nt, hsa
uuugcucaaaaaagaugaaaggaaaugcaaacuguaaauguauaaauguauauuguauuguaug

SEQ ID NO: 299937 - RNA, 64 nt, hsa
auucagcauuagaacaucuauacauauggugaucuaaauguacaaaauguaaaauguauaaguc

SEQ ID NO: 299938 - RNA, 64 nt, hsa
uguauaaaaaguuuauuuugcuauugugaaaaacuaaauguaaaggaaaucaccuacuuucaug

SEQ ID NO: 299939 - RNA, 64 nt, hsa
aacuugggauuguuuuguggguuuuuguuuguuuuaaauguaaauugagaaucuuuuauaagaa

SEQ ID NO: 299940 - RNA, 64 nt, hsa
uuccaaagcuuguaaacacugccaucuucaaauuuaaauguaauuuaggaaauggaagcuuuua

SEQ ID NO: 299941 - RNA, 64 nt, hsa
acuuauaaauacgaauaguuacuacucugacuuguaaauguagcugcuaaaguaugagguauau

SEQ ID NO: 299942 - RNA, 64 nt, hsa
gguuuugaguuagcuggaaaagugaucagauuaauaaauguauauugguaguugaauuuagcaa

SEQ ID NO: 299943 - RNA, 64 nt, hsa
ucuuccaaagcacuauuuguuguaauaacuuuucuaaauguagugccuuuaaaggaaaaaugaa

SEQ ID NO: 299944 - RNA, 64 nt, hsa
cacacugucaaauucuuuuccuuaaggugcacaguaaauguacagauaguuauaggccacuguu

SEQ ID NO: 299945 - RNA, 64 nt, hsa
cauacaugagacugcagauuauauugaaucauauuaaauguacagaaauaaaauauuagauuua

SEQ ID NO: 299946 - RNA, 64 nt, hsa
uaauuauucacaugugcauuuucuuuuuagcuguuaaauguacuaugccaucauccaccauuua

SEQ ID NO: 299947 - RNA, 64 nt, hsa
ucacaauauuccgaaaacaaaaaaaccuaggagauaaauguagagguauugacuuuucguaucu

SEQ ID NO: 299948 - RNA, 64 nt, hsa
uaaucuaugccuguagaacauaaacauuuuccuguaaauguaugugugcauuuggggauaagua

SEQ ID NO: 299949 - RNA, 64 nt, hsa
uaaaugucaagagaguauauccaauauuaggauauaaauguaugugucucaaguuuaacucuac

SEQ ID NO: 299950 - RNA, 64 nt, hsa
auuaaauauuacugaagauuucgacuuccacuguuaaauguacaagauacaugaaauauuaaag

SEQ ID NO: 299951 - RNA, 64 nt, hsa
uagaaaaagaacaaaugcuaaauagaguaacaguuaaauguauguguacacucuucccaaaugc

SEQ ID NO: 299952 - RNA, 64 nt, hsa
uaaauguaaaugguuucaaauggucagcguuguuuaaauguaaucauguuauuuuauucauugu

SEQ ID NO: 299953 - RNA, 64 nt, hsa
uucuguacuaagugucaacagcccuuacaaacauuaaauguaaaugguuucaaauggucagcgu

SEQ ID NO: 299954 - RNA, 64 nt, hsa
aacuuauagcuuuuaaaagaccuuuuaaagacauuaaauguaaacuuaaaaauguuuagaucuu

SEQ ID NO: 299955 - RNA, 64 nt, hsa
aaagaucaauaugagaaauaccauacagauaccuuaaauguaugcauuugugcaacaauuuuug

SEQ ID NO: 299956 - RNA, 64 nt, hsa
ugucaaaaauguuauucagcuggggaaauuucucuaaauguacacugauucugugugugugauu

SEQ ID NO: 299957 - RNA, 64 nt, hsa
cuagggaaaaccaggggguucugcuucacuagguuaaauguagguuuuguagaggagaucugca

SEQ ID NO: 299958 - RNA, 64 nt, hsa
ccuagcuauauauuacguugucuuccuuacuacauaaauguacuucuuuaaucuugugauuaca

SEQ ID NO: 299959 - RNA, 64 nt, hsa
cuguaauucuguuguguguguguguguuauaugauaaauguacauacauggaccacuuguuuau

SEQ ID NO: 299960 - RNA, 64 nt, hsa
ugugaaauuccauguguuugcugagguguaaagguaaauguauucaccccucauccaggcaguu

SEQ ID NO: 299961 - RNA, 64 nt, hsa
aagaguguuuggcucccaguuuggacuuggugaauaaauguaccuuagaacuaggauaaucggu

SEQ ID NO: 299962 - RNA, 64 nt, hsa
cacacauaagaauacacucuggagaaagaccuuauaaauguaagacaugugggaaaggcuuuua

SEQ ID NO: 299963 - RNA, 64 nt, hsa
cacacguaagaaugcacucuguagaaagaccuuauaaauguaagauaugugggaaaggcuuuua

SEQ ID NO: 299964 - RNA, 64 nt, hsa
gucacacaugaauguguaguggagagaaccuugguaaauguaaagagugugggagagccuuuag

SEQ ID NO: 299965 - RNA, 64 nt, hsa
gucauuugaaaacuucuaauacagcaaaauccuauaaauguaaguacuucaaaaagccucaugc

SEQ ID NO: 299966 - RNA, 64 nt, hsa
acagcaucaaauucucacauaacaauauuagcuuuaaauguaaaugggcuaaaugcuccaauua

SEQ ID NO: 299967 - RNA, 64 nt, hsa
gggaugcaaggcugguucaacauacgcaaaucaauaaauguaauccagcauauaaacagaacca

SEQ ID NO: 299968 - RNA, 64 nt, hsa
ccaugugaagaaagugcacgcugaauagaaacuauaaauguaaauaucgaaaguuuuucaauuu

SEQ ID NO: 299969 - RNA, 64 nt, hsa
ugcacaugagaaugcacacuggagagaaaccuuauaaauguaaggauuguggcaacgccuucau

SEQ ID NO: 299970 - RNA, 64 nt, hsa
uguauaagugucaggaauauggagagaagccauauaaauguaagaaaugugggaaacccuucag

SEQ ID NO: 299971 - RNA, 64 nt, hsa
gacaugaaaggacucacacuagggagaaaaucuauaaauguaaaugugggaaagccuuuaguga

SEQ ID NO: 299972 - RNA, 64 nt, hsa
gacacaugauaaggcacacuagagauggaccucauaaauguaagauaugugggaaaggcuuuga

SEQ ID NO: 299973 - RNA, 64 nt, hsa
gacacauggcagugcagcauggagauggaccuuauaaauguaaguugugugggaaagcauuuuu

SEQ ID NO: 299974 - RNA, 64 nt, hsa
cagaucagggaagaucaauacgaaagucacaggauaaauguaagguaauuugcaaucacaagag

SEQ ID NO: 299975 - RNA, 64 nt, hsa
gaagcuuuauaagucgugaggauguuuuuauauuuaaauguagcaaacauacaugacaguucuu

SEQ ID NO: 299976 - RNA, 64 nt, hsa
uaauuuuuacaaaauuuagugcauacaaaauuuuuaaauguaauuccacaauuaguguauuaag

SEQ ID NO: 299977 - RNA, 64 nt, hsa
cuucguuguguuaacaaguugacaccaugacuaguaaauguaaacguguauguauaaaauaaag

SEQ ID NO: 299978 - RNA, 64 nt, hsa
uucugccgugacuguucagguguaugguaguaaguaaauguauuaacauggugaacaguaguaa

SEQ ID NO: 299979 - RNA, 64 nt, hsa
gagaaaucauguaggaaagaaauaauuuguuuaauaaauguauuauucauugugaacuaugaaa

SEQ ID NO: 299980 - RNA, 64 nt, hsa
aaacugugaguauguauagaggaguaaaaucuuauaaauguaaugaauauggaaaauuuuucug

SEQ ID NO: 299981 - RNA, 64 nt, hsa
uacauuuucuuuuguucuugauaguagccaaaguuaaauguaucacauugaagaaggcuagaaa

SEQ ID NO: 299982 - RNA, 64 nt, hsa
cagacauuuauguguugauaauuuuuuaauuauuuaaauguacuuauauuaagaaaaauaucaa

SEQ ID NO: 299983 - RNA, 64 nt, hsa
cuuuucugaugcauuuaaaaauaaauggaacacuuaaauguauauuaccgaugcaaacugugga

SEQ ID NO: 299984 - RNA, 64 nt, hsa
cucuuacauagucuuaagcauuuuugcaauuuuuuaaauguauuaauagagucaauggaacuuu

SEQ ID NO: 299985 - RNA, 64 nt, hsa; identical to SEQ ID NO: 246588

SEQ ID NO: 299986 - RNA, 64 nt, hsa; identical to SEQ ID NO: 246589

SEQ ID NO: 299987 - RNA, 64 nt, hsa; identical to SEQ ID NO: 246590

SEQ ID NO: 299988 - RNA, 64 nt, hsa; identical to SEQ ID NO: 246591

SEQ ID NO: 299989 - RNA, 64 nt, hsa; identical to SEQ ID NO: 246592

SEQ ID NO: 299990 - RNA, 64 nt, hsa; identical to SEQ ID NO: 246593

SEQ ID NO: 299991 - RNA, 64 nt, hsa
acuauguuuucuggagagcuguguaagcugucuuguugcuuaguugcaauauaagaaauaguga

SEQ ID NO: 299992 - RNA, 64 nt, hsa
aacaaauucaaccaagggauauuuacugcuuuauguugcuuaugauaauuauuuugcauuaaua

SEQ ID NO: 299993 - RNA, 64 nt, hsa
ucuuuaauagaugaggaaaaauagcaacaagcaaguugcuuauaauaaaauaauuugugauucu

SEQ ID NO: 299994 - RNA, 64 nt, hsa
gguguguaacucuaaaucuuguauaugcaucuuuguugcuuauuacauauuuacacacacaacc

SEQ ID NO: 299995 - RNA, 59 nt, hsa
uugguaaaauccaagucuuuuuuuuuuuuuccaggaacaacuacauuuucucauauaca

SEQ ID NO: 299996 - RNA, 59 nt, hsa
uguuccugagaaggguggguaacagauauuccaggaaaaagaaugcacauugaauggau

SEQ ID NO: 299997 - RNA, 59 nt, hsa
gcccaaaucaaccucugaaaaaagguuuuuccaggaagauuuacauuuagguuuaauau

SEQ ID NO: 299998 - RNA, 59 nt, hsa
uguguugcuaaaacacaugcuaugagcacuccaggaaacacuauauuuuuuccaaaaaa

SEQ ID NO: 299999 - RNA, 59 nt, hsa
cgcuacuaguuauucagagcguacuuuguuccaggaacuaugcuggaaacugauaguuc

SEQ ID NO: 300000 - RNA, 59 nt, hsa
acuacauaguuauucagagccuacuguguuccaggaacuaugcuagaaacugucucucu

SEQ ID NO: 300001 - RNA, 59 nt, hsa
gccagagaagauaauguucuuuaauguuguccaggaaacccuggcuugcuugccgagcc

SEQ ID NO: 300002 - RNA, 59 nt, hsa
ucuuguagaagauggacucugaaaaacauuccaggaaaccauggcagcauggagagccu

SEQ ID NO: 300003 - RNA, 59 nt, hsa
ccuggaggagauccgcaucuggggaccccuccaggaagaugcugacauccaggucagca

SEQ ID NO: 300004 - RNA, 59 nt, hsa
gugcauggacucugcccucagggugccuguccaggaagagcuguguggccuggcaagca

SEQ ID NO: 300005 - RNA, 59 nt, hsa
guuaaauuggauugagaaugccuuuuguuuccaggaaaauauugaucaccaugaaagaa

SEQ ID NO: 300006 - RNA, 59 nt, hsa
cucucuuagaauuggaggauuugccauuguccaggaaagaaacuugcagcuuuaaccug

SEQ ID NO: 300007 - RNA, 59 nt, hsa
cucuuagcauguuugauuuaagaaaagccuccaggaaaucuugagagccugucuuggca

SEQ ID NO: 300008 - RNA, 59 nt, hsa
gcuccccagucucuaccugucaggaugacuccaggaagacagcuggaguacugcauuug

SEQ ID NO: 300009 - RNA, 59 nt, hsa
uuacauccaccuuugaggcuggucauaccuccaggaacaauacagagccagucaacuuc

SEQ ID NO: 300010 - RNA, 59 nt, hsa
gagcgcaccaccaccuggcguguagaaucuccaggaagccuggcugcagcuucccauuu

SEQ ID NO: 300011 - RNA, 59 nt, hsa
uuuagaucuuggcuacugucaugcaggcuuccaggaacauagacuguuuuaccuccaca

SEQ ID NO: 300012 - RNA, 59 nt, hsa
gagaaugcaggcaguuaacuuaauaucccuccaggaaugguuccuacguuguguauuac

SEQ ID NO: 300013 - RNA, 59 nt, hsa
uuccccgaguggagcuucgacccacccacuccaggaacccagagccacauuagaaguuc

SEQ ID NO: 300014 - RNA, 59 nt, hsa
uuuaaagacagguggccacugacagccacuccaggaacuugaacugcaggggcagagcc

SEQ ID NO: 300015 - RNA, 59 nt, hsa
gcgggaccucuuguaacccaucggcaucuuccaggaauccgccgagugacuugaggaag

SEQ ID NO: 300016 - RNA, 59 nt, hsa
cccugguggccuucaguuucaguuucucauccaggaagguaaccuugggcauuggcagu

SEQ ID NO: 300017 - RNA, 64 nt, hsa; identical to SEQ ID NO: 247720

SEQ ID NO: 300018 - RNA, 64 nt, hsa; identical to SEQ ID NO: 247721

SEQ ID NO: 300019 - RNA, 64 nt, hsa; identical to SEQ ID NO: 247722

SEQ ID NO: 300020 - RNA, 64 nt, hsa; identical to SEQ ID NO: 247723

SEQ ID NO: 300021 - RNA, 64 nt, hsa; identical to SEQ ID NO: 247724

SEQ ID NO: 300022 - RNA, 64 nt, hsa; identical to SEQ ID NO: 247725

SEQ ID NO: 300023 - RNA, 64 nt, hsa; identical to SEQ ID NO: 247726

SEQ ID NO: 300024 - RNA, 64 nt, hsa; identical to SEQ ID NO: 247727

SEQ ID NO: 300025 - RNA, 64 nt, hsa; identical to SEQ ID NO: 247728

SEQ ID NO: 300026 - RNA, 64 nt, hsa; identical to SEQ ID NO: 247729

SEQ ID NO: 300027 - RNA, 64 nt, hsa; identical to SEQ ID NO: 247730

SEQ ID NO: 300028 - RNA, 64 nt, hsa; identical to SEQ ID NO: 247731

SEQ ID NO: 300029 - RNA, 64 nt, hsa; identical to SEQ ID NO: 247732

SEQ ID NO: 300030 - RNA, 64 nt, hsa; identical to SEQ ID NO: 247733

SEQ ID NO: 300031 - RNA, 64 nt, hsa; identical to SEQ ID NO: 247734

SEQ ID NO: 300032 - RNA, 64 nt, hsa; identical to SEQ ID NO: 247735

SEQ ID NO: 300033 - RNA, 64 nt, hsa; identical to SEQ ID NO: 247736

SEQ ID NO: 300034 - RNA, 64 nt, hsa; identical to SEQ ID NO: 247737

SEQ ID NO: 300035 - RNA, 64 nt, hsa; identical to SEQ ID NO: 247738

SEQ ID NO: 300036 - RNA, 64 nt, hsa; identical to SEQ ID NO: 247739

SEQ ID NO: 300037 - RNA, 64 nt, hsa; identical to SEQ ID NO: 247740

SEQ ID NO: 300038 - RNA, 64 nt, hsa; identical to SEQ ID NO: 247741

SEQ ID NO: 300039 - RNA, 64 nt, hsa; identical to SEQ ID NO: 247742

SEQ ID NO: 300040 - RNA, 64 nt, hsa; identical to SEQ ID NO: 247743

SEQ ID NO: 300041 - RNA, 64 nt, hsa; identical to SEQ ID NO: 247744

SEQ ID NO: 300042 - RNA, 64 nt, hsa; identical to SEQ ID NO: 247745

SEQ ID NO: 300043 - RNA, 64 nt, hsa; identical to SEQ ID NO: 247746

SEQ ID NO: 300044 - RNA, 64 nt, hsa; identical to SEQ ID NO: 247747

SEQ ID NO: 300045 - RNA, 64 nt, hsa; identical to SEQ ID NO: 247748

SEQ ID NO: 300046 - RNA, 64 nt, hsa; identical to SEQ ID NO: 247749

SEQ ID NO: 300047 - RNA, 64 nt, hsa; identical to SEQ ID NO: 247750

SEQ ID NO: 300048 - RNA, 64 nt, hsa; identical to SEQ ID NO: 247751

SEQ ID NO: 300049 - RNA, 64 nt, hsa; identical to SEQ ID NO: 247752

SEQ ID NO: 300050 - RNA, 64 nt, hsa; identical to SEQ ID NO: 247753

SEQ ID NO: 300051 - RNA, 64 nt, hsa; identical to SEQ ID NO: 247754

SEQ ID NO: 300052 - RNA, 64 nt, hsa; identical to SEQ ID NO: 247755

SEQ ID NO: 300053 - RNA, 64 nt, hsa; identical to SEQ ID NO: 247756

SEQ ID NO: 300054 - RNA, 64 nt, hsa; identical to SEQ ID NO: 247757

SEQ ID NO: 300055 - RNA, 64 nt, hsa; identical to SEQ ID NO: 247758

SEQ ID NO: 300056 - RNA, 64 nt, hsa; identical to SEQ ID NO: 247759

SEQ ID NO: 300057 - RNA, 64 nt, hsa; identical to SEQ ID NO: 247760

SEQ ID NO: 300058 - RNA, 64 nt, hsa; identical to SEQ ID NO: 247761

SEQ ID NO: 300059 - RNA, 64 nt, hsa; identical to SEQ ID NO: 247762

SEQ ID NO: 300060 - RNA, 64 nt, hsa; identical to SEQ ID NO: 247763

SEQ ID NO: 300061 - RNA, 64 nt, hsa; identical to SEQ ID NO: 247764

SEQ ID NO: 300062 - RNA, 64 nt, hsa; identical to SEQ ID NO: 247765

SEQ ID NO: 300063 - RNA, 64 nt, hsa; identical to SEQ ID NO: 247766

SEQ ID NO: 300064 - RNA, 64 nt, hsa; identical to SEQ ID NO: 247767

SEQ ID NO: 300065 - RNA, 64 nt, hsa; identical to SEQ ID NO: 247768

SEQ ID NO: 300066 - RNA, 64 nt, hsa; identical to SEQ ID NO: 247769

SEQ ID NO: 300067 - RNA, 64 nt, hsa; identical to SEQ ID NO: 247770

SEQ ID NO: 300068 - RNA, 64 nt, hsa; identical to SEQ ID NO: 247771

SEQ ID NO: 300069 - RNA, 64 nt, hsa; identical to SEQ ID NO: 247772

SEQ ID NO: 300070 - RNA, 64 nt, hsa; identical to SEQ ID NO: 247773

SEQ ID NO: 300071 - RNA, 64 nt, hsa; identical to SEQ ID NO: 247774

SEQ ID NO: 300072 - RNA, 64 nt, hsa; identical to SEQ ID NO: 247775

SEQ ID NO: 300073 - RNA, 64 nt, hsa; identical to SEQ ID NO: 247776

SEQ ID NO: 300074 - RNA, 64 nt, hsa; identical to SEQ ID NO: 247777

SEQ ID NO: 300075 - RNA, 64 nt, hsa; identical to SEQ ID NO: 247778

SEQ ID NO: 300076 - RNA, 64 nt, hsa; identical to SEQ ID NO: 247779

SEQ ID NO: 300077 - RNA, 64 nt, hsa; identical to SEQ ID NO: 247780

SEQ ID NO: 300078 - RNA, 64 nt, hsa; identical to SEQ ID NO: 247781

SEQ ID NO: 300079 - RNA, 64 nt, hsa; identical to SEQ ID NO: 247782

SEQ ID NO: 300080 - RNA, 64 nt, hsa; identical to SEQ ID NO: 247783

SEQ ID NO: 300081 - RNA, 64 nt, hsa; identical to SEQ ID NO: 247784

SEQ ID NO: 300082 - RNA, 64 nt, hsa; identical to SEQ ID NO: 247785

SEQ ID NO: 300083 - RNA, 64 nt, hsa; identical to SEQ ID NO: 247786

SEQ ID NO: 300084 - RNA, 64 nt, hsa; identical to SEQ ID NO: 247787

SEQ ID NO: 300085 - RNA, 64 nt, hsa; identical to SEQ ID NO: 247788

SEQ ID NO: 300086 - RNA, 64 nt, hsa; identical to SEQ ID NO: 247789

SEQ ID NO: 300087 - RNA, 64 nt, hsa; identical to SEQ ID NO: 247790

SEQ ID NO: 300088 - RNA, 64 nt, hsa; identical to SEQ ID NO: 247791

SEQ ID NO: 300089 - RNA, 64 nt, hsa; identical to SEQ ID NO: 247792

SEQ ID NO: 300090 - RNA, 64 nt, hsa; identical to SEQ ID NO: 247793

SEQ ID NO: 300091 - RNA, 53 nt, hsa; identical to SEQ ID NO: 247794

SEQ ID NO: 300092 - RNA, 64 nt, hsa
uauguauacacacauauacauauauauauacacauacauacacauacauacauacauacauaua

SEQ ID NO: 300093 - RNA, 64 nt, hsa
cacauauacauauauauauacacauacauacacauacauacauacauacauauauaucugauaa

SEQ ID NO: 300094 - RNA, 64 nt, hsa
uauacauauauauauacacauacauacacauacauacauacauacauauauaucugauaaaauu

SEQ ID NO: 300095 - RNA, 64 nt, hsa
cauauauauauacacauacauacacauacauacauacauacauauauaucugauaaaauuguga

SEQ ID NO: 300096 - RNA, 64 nt, hsa
ccacaccauacauacauacauauauauauacacauacauacaaaccugugugccaagugacagc

SEQ ID NO: 300097 - RNA, 64 nt, hsa
gguaauuuuuaagacuauguacccacaccauacauacauacauauauauauacacauacauaca

SEQ ID NO: 300098 - RNA, 64 nt, hsa
acuggguaauuuuuaagacuauguacccacaccauacauacauacauauauauauacacauaca

SEQ ID NO: 300099 - RNA, 64 nt, hsa
cguuuuccccucauguauccaaguaauuuuuauuuacauacaacuaaauaaauguuguccucuu

SEQ ID NO: 300100 - RNA, 64 nt, hsa
uuggggagauguaaugcuggaagaucuuaaggacuacauacauucuagagaugacaguguuguu

SEQ ID NO: 300101 - RNA, 64 nt, hsa
uacuguacuucuacauacaaauguacuguacuucuacauacaaauguuauguuaaagaauuacu

SEQ ID NO: 300102 - RNA, 64 nt, hsa
uauuguaaauucuuaucucuguauacuguacuucuacauacaaauguacuguacuucuacauac

SEQ ID NO: 300103 - RNA, 64 nt, hsa
uuccuuucuaguaucuucucaaguuggaaaaauauacauacaguccuccuucaccuuacucugu

SEQ ID NO: 300104 - RNA, 64 nt, hsa
auacacagacuaucacuaaaauaauaguuauauauacauacagguguauacuuaugcaugcaua

SEQ ID NO: 300105 - RNA, 64 nt, hsa
uuuaauuuauuaccuuuacaacauuuauuuacauuacauacauacauuuacaacauuuauuaau

SEQ ID NO: 300106 - RNA, 64 nt, hsa
auuuauuaccuuuacaacauuuauuuacauuacauacauacauuuacaacauuuauuaauuuau

SEQ ID NO: 300107 - RNA, 64 nt, hsa
cauacauacauauauauauauauauacauauauauacauacacacauacauauaauuuuuuuuu

SEQ ID NO: 300108 - RNA, 64 nt, hsa
cacacacacacacacacacacacacacacauacauacauacauauauauauauauauacauaua

SEQ ID NO: 300109 - RNA, 64 nt, hsa
uauacacacacacacacacacacacacacacacauacauacauacauauauauauauauauaca

SEQ ID NO: 300110 - RNA, 64 nt, hsa
uuauagguauuuaucagagaugauuauuuugugcuacauacagguuggcuaaugagcucuagug

SEQ ID NO: 300111 - RNA, 64 nt, hsa
aaauuauuuuguaaauccaugacuuaaaacaagauacauacauaguauaacacaccucacagug

SEQ ID NO: 300112 - RNA, 64 nt, hsa
caugggagggagcugagggguuaauauauauacauacauacacauauauauauuuuuguaaaua

SEQ ID NO: 300113 - RNA, 64 nt, hsa
ugaucaugggagggagcugagggguuaauauauauacauacauacacauauauauauuuuugua

SEQ ID NO: 300114 - RNA, 64 nt, hsa
uauacuguacauauguauauguaacuaauauacauacauacagguauguauauguaaugguuau

SEQ ID NO: 300115 - RNA, 64 nt, hsa
uguauauacuguacauauguauauguaacuaauauacauacauacagguauguauauguaaugg

SEQ ID NO: 300116 - RNA, 64 nt, hsa
cacgcagccccuccccgccacagagacacaccauuacauacacagacacacacagaaagacaca

SEQ ID NO: 300117 - RNA, 64 nt, hsa
cacacacacccuccccgccacagagacacaccauuacauacacagacacgcaaucgcagauacg

SEQ ID NO: 300118 - RNA, 64 nt, hsa
cacacacacacccuccccgccacagagacaccauuacauacacagacacacacagaaagacaca

SEQ ID NO: 300119 - RNA, 64 nt, hsa
cacacacacccccuccccaccacagagacaccauuacauacacagacacacacagaaagacaca

SEQ ID NO: 300120 - RNA, 64 nt, hsa
gaaacugacauuccuuuaaaaauauaaauauaaauacauacauacauagauauauacccagacu

SEQ ID NO: 300121 - RNA, 64 nt, hsa
cugacauuccuuuaaaaauauaaauauaaauacauacauacauagauauauacccagacuuggg

SEQ ID NO: 300122 - RNA, 64 nt, hsa
cuuacuauuugaauagaaauguguauguauaauauacauacauacauaagcauauaugugugug

SEQ ID NO: 300123 - RNA, 64 nt, hsa
cuauuugaauagaaauguguauguauaauauacauacauacauaagcauauaugugugugugug

SEQ ID NO: 300124 - RNA, 64 nt, hsa
uggugaaauaacaaccaaaauacugaaucugauguacauacagguuucuacaggaagagauggu

SEQ ID NO: 300125 - RNA, 64 nt, hsa
gaaacacacacagagauaucuauacauauauacauacauacaaacauaggcuaucuuggcacac

SEQ ID NO: 300126 - RNA, 64 nt, hsa
uggggaaacacacacagagauaucuauacauauauacauacauacaaacauaggcuaucuuggc

SEQ ID NO: 300127 - RNA, 64 nt, hsa
cacauauacacauaacaaguguagaaguauauauuacauacauacacucacucugucugguaua

SEQ ID NO: 300128 - RNA, 64 nt, hsa
uauacacauaacaaguguagaaguauauauuacauacauacacucacucugucugguauaggcu

SEQ ID NO: 300129 - RNA, 64 nt, hsa
agagugagauucugucucaaaauaaauacauacauacauacaauaaaaccgaaugagcugguuc

SEQ ID NO: 300130 - RNA, 64 nt, hsa
cgacagagugagauucugucucaaaauaaauacauacauacauacaauaaaaccgaaugagcug

SEQ ID NO: 300131 - RNA, 64 nt, hsa
uggacgacagagugagauucugucucaaaauaaauacauacauacauacaauaaaaccgaauga

SEQ ID NO: 300132 - RNA, 64 nt, hsa
gaagaaauuauacguacauacacacauacauacauacauacaaauauauguauauauauucuca

SEQ ID NO: 300133 - RNA, 64 nt, hsa
agcugaagaaauuauacguacauacacacauacauacauacauacaaauauauguauauauauu

SEQ ID NO: 300134 - RNA, 64 nt, hsa
gcugagcugaagaaauuauacguacauacacacauacauacauacauacaaauauauguauaua

SEQ ID NO: 300135 - RNA, 64 nt, hsa
uucucucugaaugcugagcugaagaaauuauacguacauacacacauacauacauacauacaaa

SEQ ID NO: 300136 - RNA, 64 nt, hsa
guaaauaaggacaugaguuaaauauauuuauauguacauacauauauauaucccuuuacauaua

SEQ ID NO: 300137 - RNA, 64 nt, hsa
augugggugugaguguguauguguggguguguguuacauacacagaaucaggcacuuaccugca

SEQ ID NO: 300138 - RNA, 64 nt, hsa
aauaaaucuacccaaugagacuuuucagccuuuguacauacaaaauucuuccaaaagagagagg

SEQ ID NO: 300139 - RNA, 64 nt, hsa
cauacucacaaacacacacacaagcacuugcacauacauacaaacacaugcaaacauaccuaca

SEQ ID NO: 300140 - RNA, 64 nt, hsa
auccuuuguacaaagcuccucuuuucccuuuuuuuacauacacaagauccucuuggcaggugga

SEQ ID NO: 300141 - RNA, 64 nt, hsa
ugacaacuaagaaguagacaccaugcuaaagacuuacauacaaucuccuugaaucuucucaaua

SEQ ID NO: 300142 - RNA, 64 nt, hsa
uucacauacauauauauauacacacauauauauguacauacacauacauacauauuaccauacu

SEQ ID NO: 300143 - RNA, 64 nt, hsa
uauauauauacacacauauauauguacauacacauacauacauauuaccauacugaagggaaau

SEQ ID NO: 300144 - RNA, 64 nt, hsa
cugauauauauauauauuuuaauucagaguuacauacauacagcuaccauuuuauaugaaaaaa

SEQ ID NO: 300145 - RNA, 64 nt, hsa
gugacugauauauauauauauuuuaauucagaguuacauacauacagcuaccauuuuauaugaa

SEQ ID NO: 300146 - RNA, 64 nt, hsa
aacaaggguuugguguuuuuaaaguguguauacauacauacacauacacacaugcacauauguc

SEQ ID NO: 300147 - RNA, 64 nt, hsa
uauaaacaaggguuugguguuuuuaaaguguguauacauacauacacauacacacaugcacaua

SEQ ID NO: 300148 - RNA, 64 nt, hsa
cucaccacucacucaaccaguggcacaguguccuugugcccacacugagccagcaaguccugcu

SEQ ID NO: 300149 - RNA, 64 nt, hsa
gccuaugaccccacgucugacagccauguccaccugugcccacagcuuccgcccacagaccucc

SEQ ID NO: 300150 - RNA, 64 nt, hsa
acacugcagcucccagugccccaguguccugcccugugcccagccccagcugcauggacucuga

SEQ ID NO: 300151 - RNA, 64 nt, hsa
uccaggcugugcaagccccugaggucuugagagaugugcccacugcccgugcagccuccuucag

SEQ ID NO: 300152 - RNA, 64 nt, hsa
cugcagagacgaacggugaucugugacccgguggugugcccaccgcccagcugcccacacccgg

SEQ ID NO: 300153 - RNA, 64 nt, hsa
gcacugugagaaggugcaguguccccggcuggccugugcccagccugugcgugucaaccccacc

SEQ ID NO: 300154 - RNA, 64 nt, hsa
ucugagcuggcuccugaauauauguucaagugggugugcccauagggccugggcacgugucucu

SEQ ID NO: 300155 - RNA, 64 nt, hsa
gaaugguugcuccuagccaagauguuggccuuucugugcccacccagacuugguuugggccacc

SEQ ID NO: 300156 - RNA, 64 nt, hsa
accguguugcucacgaagaaggcucagcuuugcgugugcccagccgugugcacagcucguccca

SEQ ID NO: 300157 - RNA, 64 nt, hsa
cucccaaagugcugagauuacaggcaugaaccacugugcccagccgaaaacaaccaagaauuuu

SEQ ID NO: 300158 - RNA, 64 nt, hsa
cgcucagcacacaugcauccuccccucuccugcgugugcccacugaacaugcucauguguacac

SEQ ID NO: 300159 - RNA, 64 nt, hsa
uuuucuccuccuauaucacucuuguugugcucuuugugcccaagguaaggaucuggcuuuucuc

SEQ ID NO: 300160 - RNA, 64 nt, hsa
aauguguggcauauggaagggacucccaggacccugugcccagcuuccaugcugacugaugguu

SEQ ID NO: 300161 - RNA, 64 nt, hsa
cucucuaacccacagguguuggcugccuggcccaugugcccacugucucuuccacuuggucugg

SEQ ID NO: 300162 - RNA, 64 nt, hsa
cucacaaaguguugagacuacaggcaugagccacugugcccagccuguucuauguuuuuaagcu

SEQ ID NO: 300163 - RNA, 64 nt, hsa
guauaauuucgccuggcaacuggacugaggggagugugcccaggcagcugccaagcacucccuc

SEQ ID NO: 300164 - RNA, 64 nt, hsa
uucaauccuuggaacugccuaguccccaugacugugugcccaccgagcuccugaguguucucau

SEQ ID NO: 300165 - RNA, 64 nt, hsa
cuaugacucuucacauugucuuuauguacaucucugugcccaaguuuucccuuuuuauuaagac

SEQ ID NO: 300166 - RNA, 64 nt, hsa
agcgagcuccugcuuagggaaggucagcaggcacugugcccaggaagagccugcggccucggcg

SEQ ID NO: 300167 - RNA, 64 nt, hsa
gccgccccucccuguggcagcagcaggacaggugugugcccagcacccucccuaccugggccug

SEQ ID NO: 300168 - RNA, 64 nt, hsa
gggggccccacccuuugccggcaaaugcagggcaugugcccaagaggggccuccccgcaggcac

SEQ ID NO: 300169 - RNA, 64 nt, hsa
caagaggggccuccccgcaggcacuugcccccacugugcccaggagcucucuaggaggggccug

SEQ ID NO: 300170 - RNA, 64 nt, hsa
auuacauaaugacagaaauacugagaagguucugugugcccauuugaaaggagugggaggaaua

SEQ ID NO: 300171 - RNA, 64 nt, hsa
guccugguucgucuguguguggugugaccaauggugugcccagagcacuacucucaaaaucacu

SEQ ID NO: 300172 - RNA, 64 nt, hsa
aucaggguuggcaucaucugauggcauguccaagugugcccagcagcggaugcugaagcaccag

SEQ ID NO: 300173 - RNA, 64 nt, hsa
cagaccugacacccaacggggggaugugguggccugugcccaccuucucucccuccucccgacc

SEQ ID NO: 300174 - RNA, 64 nt, hsa
uggcgggggcuggcagagccacaccccaagugccugugcccagagggcuucagucagccgcuca

SEQ ID NO: 300175 - RNA, 64 nt, hsa
aggcucuuguguccucacucagguuugcuuccccugugcccacugcuguaugaucugggggcca

SEQ ID NO: 300176 - RNA, 64 nt, hsa
ggaaccuccagucacugugcccagcagggugggcugugcccagcaggagucaggcuaagaaacg

SEQ ID NO: 300177 - RNA, 64 nt, hsa
gccagggacugugcagccuggaaccuccagucacugugcccagcagggugggcugugcccagca

SEQ ID NO: 300178 - RNA, 64 nt, hsa
gcagcgucagccaaagcuggccccugaaccacugugugcccauuuccuagggaaggggaaggag

SEQ ID NO: 300179 - RNA, 64 nt, hsa
cacugccagggaggugggcauucaugggguaccuugugcccaggugcugcccacuccugaugcc

SEQ ID NO: 300180 - RNA, 64 nt, hsa
gauggugggauuuuuauccaauaguuuggccuggugugcccacaggaugggaacagggaggcac

SEQ ID NO: 300181 - RNA, 64 nt, hsa
aaguggcgccugcugcgucagagcucaaggaaucugugcccaccaccagcuccugguccguagg

SEQ ID NO: 300182 - RNA, 64 nt, hsa
aauugggaggaaccaagcccucuucaucuguucaugugcccagcauuuauuaagcaccugcugu

SEQ ID NO: 300183 - RNA, 64 nt, hsa
cacccaaagugcuaggguuacaggcaugagccacugugcccagcccaggcucugggaauauuga

SEQ ID NO: 300184 - RNA, 64 nt, hsa
auuccuccuggcuuaguuguagcagacccagaccugugcccagcuuuggucccccuucccaacu

SEQ ID NO: 300185 - RNA, 64 nt, hsa
uaccuggccccauuuguguugaguuuccucuuagugugcccaggagucugaucugcugggguac

SEQ ID NO: 300186 - RNA, 64 nt, hsa
guaauuaauguuauuauuugauuguuauaccauaugugcccauuaaaauucuuuuuaauuaaaa

SEQ ID NO: 300187 - RNA, 64 nt, hsa
aagugaaaaccugccuuuugccacucuuaaaaauugugcccaaaauauaaaaguguggaacuuu

SEQ ID NO: 300188 - RNA, 64 nt, hsa
cccaccccaccgugugggcugccccaaccccaaaugugcccagggaggggggggaacccaaggc

SEQ ID NO: 300189 - RNA, 64 nt, hsa
gagucccccaaagucccuucugucuggccuauccugugcccaccaccuguggcuucauccagcc

SEQ ID NO: 300190 - RNA, 64 nt, hsa
caugaguaaauuuuguucagggcuacugucuguaugugcccagauaaaauuuucaugagaguag

SEQ ID NO: 300191 - RNA, 64 nt, hsa
ugauuuaauaugcuuuuguugaaaccacagcuuuugugcccauuguuuuaacuugugugaaaca

SEQ ID NO: 300192 - RNA, 64 nt, hsa; identical to SEQ ID NO: 153734

SEQ ID NO: 300193 - RNA, 64 nt, hsa; identical to SEQ ID NO: 153735

SEQ ID NO: 300194 - RNA, 64 nt, hsa; identical to SEQ ID NO: 153736

SEQ ID NO: 300195 - RNA, 64 nt, hsa; identical to SEQ ID NO: 153737

SEQ ID NO: 300196 - RNA, 64 nt, hsa; identical to SEQ ID NO: 153738

SEQ ID NO: 300197 - RNA, 64 nt, hsa; identical to SEQ ID NO: 153739

SEQ ID NO: 300198 - RNA, 64 nt, hsa; identical to SEQ ID NO: 153740

SEQ ID NO: 300199 - RNA, 64 nt, hsa; identical to SEQ ID NO: 153741

SEQ ID NO: 300200 - RNA, 64 nt, hsa; identical to SEQ ID NO: 153742

SEQ ID NO: 300201 - RNA, 64 nt, hsa; identical to SEQ ID NO: 153743

SEQ ID NO: 300202 - RNA, 64 nt, hsa; identical to SEQ ID NO: 153744

SEQ ID NO: 300203 - RNA, 64 nt, hsa; identical to SEQ ID NO: 153745

SEQ ID NO: 300204 - RNA, 64 nt, hsa; identical to SEQ ID NO: 153746

SEQ ID NO: 300205 - RNA, 64 nt, hsa; identical to SEQ ID NO: 153747

SEQ ID NO: 300206 - RNA, 64 nt, hsa; identical to SEQ ID NO: 153748

SEQ ID NO: 300207 - RNA, 64 nt, hsa; identical to SEQ ID NO: 153749

SEQ ID NO: 300208 - RNA, 64 nt, hsa; identical to SEQ ID NO: 153750

SEQ ID NO: 300209 - RNA, 64 nt, hsa; identical to SEQ ID NO: 153751

SEQ ID NO: 300210 - RNA, 64 nt, hsa; identical to SEQ ID NO: 153752

SEQ ID NO: 300211 - RNA, 64 nt, hsa; identical to SEQ ID NO: 153753

SEQ ID NO: 300212 - RNA, 64 nt, hsa; identical to SEQ ID NO: 153754

SEQ ID NO: 300213 - RNA, 64 nt, hsa; identical to SEQ ID NO: 153755

SEQ ID NO: 300214 - RNA, 64 nt, hsa; identical to SEQ ID NO: 153756

SEQ ID NO: 300215 - RNA, 64 nt, hsa; identical to SEQ ID NO: 153757

SEQ ID NO: 300216 - RNA, 64 nt, hsa; identical to SEQ ID NO: 153758

SEQ ID NO: 300217 - RNA, 64 nt, hsa; identical to SEQ ID NO: 153759

SEQ ID NO: 300218 - RNA, 64 nt, hsa; identical to SEQ ID NO: 153760

SEQ ID NO: 300219 - RNA, 64 nt, hsa; identical to SEQ ID NO: 153761

SEQ ID NO: 300220 - RNA, 64 nt, hsa; identical to SEQ ID NO: 153762

SEQ ID NO: 300221 - RNA, 64 nt, hsa; identical to SEQ ID NO: 153763

SEQ ID NO: 300222 - RNA, 64 nt, hsa; identical to SEQ ID NO: 153764

SEQ ID NO: 300223 - RNA, 64 nt, hsa; identical to SEQ ID NO: 153765

SEQ ID NO: 300224 - RNA, 64 nt, hsa; identical to SEQ ID NO: 153766

SEQ ID NO: 300225 - RNA, 64 nt, hsa; identical to SEQ ID NO: 153767

SEQ ID NO: 300226 - RNA, 64 nt, hsa; identical to SEQ ID NO: 153768

SEQ ID NO: 300227 - RNA, 64 nt, hsa; identical to SEQ ID NO: 153769

SEQ ID NO: 300228 - RNA, 64 nt, hsa; identical to SEQ ID NO: 153770

SEQ ID NO: 300229 - RNA, 64 nt, hsa; identical to SEQ ID NO: 153771

SEQ ID NO: 300230 - RNA, 64 nt, hsa; identical to SEQ ID NO: 153772

SEQ ID NO: 300231 - RNA, 64 nt, hsa; identical to SEQ ID NO: 153773

SEQ ID NO: 300232 - RNA, 64 nt, hsa; identical to SEQ ID NO: 153774

SEQ ID NO: 300233 - RNA, 64 nt, hsa; identical to SEQ ID NO: 153775

SEQ ID NO: 300234 - RNA, 64 nt, hsa; identical to SEQ ID NO: 153776

SEQ ID NO: 300235 - RNA, 64 nt, hsa; identical to SEQ ID NO: 153777

SEQ ID NO: 300236 - RNA, 64 nt, hsa; identical to SEQ ID NO: 153778

SEQ ID NO: 300237 - RNA, 64 nt, hsa; identical to SEQ ID NO: 153779

SEQ ID NO: 300238 - RNA, 64 nt, hsa; identical to SEQ ID NO: 153780

SEQ ID NO: 300239 - RNA, 64 nt, hsa; identical to SEQ ID NO: 153781

SEQ ID NO: 300240 - RNA, 64 nt, hsa; identical to SEQ ID NO: 153782

SEQ ID NO: 300241 - RNA, 64 nt, hsa; identical to SEQ ID NO: 153783

SEQ ID NO: 300242 - RNA, 64 nt, hsa; identical to SEQ ID NO: 153784

SEQ ID NO: 300243 - RNA, 64 nt, hsa; identical to SEQ ID NO: 153785

SEQ ID NO: 300244 - RNA, 64 nt, hsa; identical to SEQ ID NO: 153786

SEQ ID NO: 300245 - RNA, 64 nt, hsa; identical to SEQ ID NO: 153787

SEQ ID NO: 300246 - RNA, 64 nt, hsa; identical to SEQ ID NO: 153788

SEQ ID NO: 300247 - RNA, 64 nt, hsa; identical to SEQ ID NO: 153789

SEQ ID NO: 300248 - RNA, 64 nt, hsa; identical to SEQ ID NO: 153790

SEQ ID NO: 300249 - RNA, 64 nt, hsa; identical to SEQ ID NO: 153791

SEQ ID NO: 300250 - RNA, 64 nt, hsa; identical to SEQ ID NO: 153792

SEQ ID NO: 300251 - RNA, 64 nt, hsa; identical to SEQ ID NO: 153793

SEQ ID NO: 300252 - RNA, 64 nt, hsa; identical to SEQ ID NO: 153794

SEQ ID NO: 300253 - RNA, 64 nt, hsa; identical to SEQ ID NO: 153795

SEQ ID NO: 300254 - RNA, 64 nt, hsa; identical to SEQ ID NO: 153796

SEQ ID NO: 300255 - RNA, 64 nt, hsa; identical to SEQ ID NO: 153797

SEQ ID NO: 300256 - RNA, 64 nt, hsa; identical to SEQ ID NO: 153798

SEQ ID NO: 300257 - RNA, 64 nt, hsa; identical to SEQ ID NO: 153799

SEQ ID NO: 300258 - RNA, 64 nt, hsa; identical to SEQ ID NO: 153800

SEQ ID NO: 300259 - RNA, 64 nt, hsa; identical to SEQ ID NO: 153801

SEQ ID NO: 300260 - RNA, 64 nt, hsa; identical to SEQ ID NO: 153802

SEQ ID NO: 300261 - RNA, 64 nt, hsa; identical to SEQ ID NO: 153803

SEQ ID NO: 300262 - RNA, 64 nt, hsa; identical to SEQ ID NO: 153804

SEQ ID NO: 300263 - RNA, 64 nt, hsa; identical to SEQ ID NO: 153805

SEQ ID NO: 300264 - RNA, 64 nt, hsa; identical to SEQ ID NO: 153806

SEQ ID NO: 300265 - RNA, 64 nt, hsa; identical to SEQ ID NO: 153807

SEQ ID NO: 300266 - RNA, 64 nt, hsa; identical to SEQ ID NO: 153808

SEQ ID NO: 300267 - RNA, 64 nt, hsa; identical to SEQ ID NO: 153809

SEQ ID NO: 300268 - RNA, 64 nt, hsa; identical to SEQ ID NO: 153810

SEQ ID NO: 300269 - RNA, 64 nt, hsa; identical to SEQ ID NO: 153811

SEQ ID NO: 300270 - RNA, 64 nt, hsa; identical to SEQ ID NO: 153812

SEQ ID NO: 300271 - RNA, 64 nt, hsa; identical to SEQ ID NO: 153813

SEQ ID NO: 300272 - RNA, 64 nt, hsa; identical to SEQ ID NO: 153814

SEQ ID NO: 300273 - RNA, 64 nt, hsa; identical to SEQ ID NO: 153815

SEQ ID NO: 300274 - RNA, 64 nt, hsa; identical to SEQ ID NO: 153816

SEQ ID NO: 300275 - RNA, 64 nt, hsa; identical to SEQ ID NO: 153817

SEQ ID NO: 300276 - RNA, 64 nt, hsa; identical to SEQ ID NO: 153818

SEQ ID NO: 300277 - RNA, 64 nt, hsa; identical to SEQ ID NO: 153819

SEQ ID NO: 300278 - RNA, 64 nt, hsa; identical to SEQ ID NO: 153820

SEQ ID NO: 300279 - RNA, 64 nt, hsa; identical to SEQ ID NO: 153821

SEQ ID NO: 300280 - RNA, 64 nt, hsa; identical to SEQ ID NO: 153822

SEQ ID NO: 300281 - RNA, 64 nt, hsa; identical to SEQ ID NO: 153823

SEQ ID NO: 300282 - RNA, 64 nt, hsa; identical to SEQ ID NO: 153824

SEQ ID NO: 300283 - RNA, 64 nt, hsa; identical to SEQ ID NO: 153825

SEQ ID NO: 300284 - RNA, 64 nt, hsa; identical to SEQ ID NO: 153826

SEQ ID NO: 300285 - RNA, 64 nt, hsa; identical to SEQ ID NO: 153827

SEQ ID NO: 300286 - RNA, 64 nt, hsa; identical to SEQ ID NO: 153828

SEQ ID NO: 300287 - RNA, 64 nt, hsa; identical to SEQ ID NO: 153829

SEQ ID NO: 300288 - RNA, 64 nt, hsa; identical to SEQ ID NO: 153830

SEQ ID NO: 300289 - RNA, 64 nt, hsa; identical to SEQ ID NO: 153831

SEQ ID NO: 300290 - RNA, 64 nt, hsa; identical to SEQ ID NO: 153832

SEQ ID NO: 300291 - RNA, 64 nt, hsa; identical to SEQ ID NO: 153833

SEQ ID NO: 300292 - RNA, 64 nt, hsa; identical to SEQ ID NO: 153834

SEQ ID NO: 300293 - RNA, 64 nt, hsa; identical to SEQ ID NO: 153835

SEQ ID NO: 300294 - RNA, 64 nt, hsa; identical to SEQ ID NO: 153836

SEQ ID NO: 300295 - RNA, 64 nt, hsa; identical to SEQ ID NO: 153837

SEQ ID NO: 300296 - RNA, 64 nt, hsa; identical to SEQ ID NO: 153838

SEQ ID NO: 300297 - RNA, 64 nt, hsa; identical to SEQ ID NO: 153839

SEQ ID NO: 300298 - RNA, 64 nt, hsa; identical to SEQ ID NO: 153840

SEQ ID NO: 300299 - RNA, 64 nt, hsa; identical to SEQ ID NO: 153841

SEQ ID NO: 300300 - RNA, 64 nt, hsa; identical to SEQ ID NO: 153842

SEQ ID NO: 300301 - RNA, 64 nt, hsa; identical to SEQ ID NO: 153843

SEQ ID NO: 300302 - RNA, 64 nt, hsa; identical to SEQ ID NO: 153844

SEQ ID NO: 300303 - RNA, 64 nt, hsa; identical to SEQ ID NO: 153845

SEQ ID NO: 300304 - RNA, 64 nt, hsa; identical to SEQ ID NO: 153846

SEQ ID NO: 300305 - RNA, 64 nt, hsa; identical to SEQ ID NO: 259466

SEQ ID NO: 300306 - RNA, 64 nt, hsa; identical to SEQ ID NO: 259467

SEQ ID NO: 300307 - RNA, 64 nt, hsa; identical to SEQ ID NO: 259468

SEQ ID NO: 300308 - RNA, 64 nt, hsa; identical to SEQ ID NO: 259469

SEQ ID NO: 300309 - RNA, 64 nt, hsa; identical to SEQ ID NO: 259470

SEQ ID NO: 300310 - RNA, 64 nt, hsa; identical to SEQ ID NO: 259471

SEQ ID NO: 300311 - RNA, 64 nt, hsa; identical to SEQ ID NO: 259472

SEQ ID NO: 300312 - RNA, 64 nt, hsa; identical to SEQ ID NO: 259473

SEQ ID NO: 300313 - RNA, 64 nt, hsa; identical to SEQ ID NO: 259474

SEQ ID NO: 300314 - RNA, 64 nt, hsa; identical to SEQ ID NO: 259475

SEQ ID NO: 300315 - RNA, 64 nt, hsa; identical to SEQ ID NO: 259476

SEQ ID NO: 300316 - RNA, 64 nt, hsa; identical to SEQ ID NO: 259477

SEQ ID NO: 300317 - RNA, 64 nt, hsa; identical to SEQ ID NO: 259478

SEQ ID NO: 300318 - RNA, 64 nt, hsa; identical to SEQ ID NO: 259479

SEQ ID NO: 300319 - RNA, 64 nt, hsa; identical to SEQ ID NO: 259480

SEQ ID NO: 300320 - RNA, 64 nt, hsa; identical to SEQ ID NO: 259481

SEQ ID NO: 300321 - RNA, 64 nt, hsa; identical to SEQ ID NO: 259482

SEQ ID NO: 300322 - RNA, 64 nt, hsa; identical to SEQ ID NO: 259483

SEQ ID NO: 300323 - RNA, 64 nt, hsa; identical to SEQ ID NO: 259484

SEQ ID NO: 300324 - RNA, 64 nt, hsa; identical to SEQ ID NO: 259485

SEQ ID NO: 300325 - RNA, 64 nt, hsa; identical to SEQ ID NO: 259486

SEQ ID NO: 300326 - RNA, 64 nt, hsa; identical to SEQ ID NO: 259487

SEQ ID NO: 300327 - RNA, 64 nt, hsa; identical to SEQ ID NO: 259488

SEQ ID NO: 300328 - RNA, 64 nt, hsa; identical to SEQ ID NO: 259489

SEQ ID NO: 300329 - RNA, 64 nt, hsa; identical to SEQ ID NO: 259490

SEQ ID NO: 300330 - RNA, 64 nt, hsa; identical to SEQ ID NO: 259491

SEQ ID NO: 300331 - RNA, 64 nt, hsa; identical to SEQ ID NO: 259492

SEQ ID NO: 300332 - RNA, 64 nt, hsa; identical to SEQ ID NO: 259493

SEQ ID NO: 300333 - RNA, 64 nt, hsa; identical to SEQ ID NO: 259494

SEQ ID NO: 300334 - RNA, 64 nt, hsa; identical to SEQ ID NO: 259495

SEQ ID NO: 300335 - RNA, 64 nt, hsa; identical to SEQ ID NO: 259496

SEQ ID NO: 300336 - RNA, 64 nt, hsa; identical to SEQ ID NO: 259497

SEQ ID NO: 300337 - RNA, 64 nt, hsa; identical to SEQ ID NO: 259498

SEQ ID NO: 300338 - RNA, 64 nt, hsa; identical to SEQ ID NO: 259499

SEQ ID NO: 300339 - RNA, 64 nt, hsa; identical to SEQ ID NO: 259500

SEQ ID NO: 300340 - RNA, 64 nt, hsa; identical to SEQ ID NO: 259501

SEQ ID NO: 300341 - RNA, 64 nt, hsa; identical to SEQ ID NO: 259502

SEQ ID NO: 300342 - RNA, 64 nt, hsa; identical to SEQ ID NO: 259503

SEQ ID NO: 300343 - RNA, 64 nt, hsa; identical to SEQ ID NO: 259504

SEQ ID NO: 300344 - RNA, 64 nt, hsa; identical to SEQ ID NO: 259505

SEQ ID NO: 300345 - RNA, 64 nt, hsa; identical to SEQ ID NO: 259506

SEQ ID NO: 300346 - RNA, 64 nt, hsa; identical to SEQ ID NO: 259507

SEQ ID NO: 300347 - RNA, 64 nt, hsa; identical to SEQ ID NO: 259508

SEQ ID NO: 300348 - RNA, 64 nt, hsa; identical to SEQ ID NO: 259509

SEQ ID NO: 300349 - RNA, 64 nt, hsa; identical to SEQ ID NO: 259510

SEQ ID NO: 300350 - RNA, 64 nt, hsa; identical to SEQ ID NO: 259511

SEQ ID NO: 300351 - RNA, 64 nt, hsa; identical to SEQ ID NO: 259512

SEQ ID NO: 300352 - RNA, 64 nt, hsa; identical to SEQ ID NO: 259513

SEQ ID NO: 300353 - RNA, 64 nt, hsa; identical to SEQ ID NO: 259514

SEQ ID NO: 300354 - RNA, 64 nt, hsa; identical to SEQ ID NO: 259515

SEQ ID NO: 300355 - RNA, 64 nt, hsa; identical to SEQ ID NO: 259516

SEQ ID NO: 300356 - RNA, 64 nt, hsa; identical to SEQ ID NO: 259517

SEQ ID NO: 300357 - RNA, 64 nt, hsa; identical to SEQ ID NO: 259518

SEQ ID NO: 300358 - RNA, 64 nt, hsa; identical to SEQ ID NO: 259519

SEQ ID NO: 300359 - RNA, 64 nt, hsa; identical to SEQ ID NO: 259520

SEQ ID NO: 300360 - RNA, 64 nt, hsa; identical to SEQ ID NO: 259521

SEQ ID NO: 300361 - RNA, 64 nt, hsa; identical to SEQ ID NO: 259522

SEQ ID NO: 300362 - RNA, 64 nt, hsa; identical to SEQ ID NO: 259523

SEQ ID NO: 300363 - RNA, 64 nt, hsa; identical to SEQ ID NO: 259524

SEQ ID NO: 300364 - RNA, 64 nt, hsa; identical to SEQ ID NO: 68703

SEQ ID NO: 300365 - RNA, 64 nt, hsa; identical to SEQ ID NO: 68704

SEQ ID NO: 300366 - RNA, 64 nt, hsa; identical to SEQ ID NO: 68705

SEQ ID NO: 300367 - RNA, 64 nt, hsa; identical to SEQ ID NO: 68706

SEQ ID NO: 300368 - RNA, 64 nt, hsa; identical to SEQ ID NO: 68707

SEQ ID NO: 300369 - RNA, 64 nt, hsa; identical to SEQ ID NO: 68708

SEQ ID NO: 300370 - RNA, 64 nt, hsa; identical to SEQ ID NO: 68709

SEQ ID NO: 300371 - RNA, 64 nt, hsa; identical to SEQ ID NO: 68710

SEQ ID NO: 300372 - RNA, 64 nt, hsa; identical to SEQ ID NO: 68711

SEQ ID NO: 300373 - RNA, 64 nt, hsa; identical to SEQ ID NO: 68712

SEQ ID NO: 300374 - RNA, 64 nt, hsa; identical to SEQ ID NO: 68713

SEQ ID NO: 300375 - RNA, 64 nt, hsa; identical to SEQ ID NO: 68714

SEQ ID NO: 300376 - RNA, 64 nt, hsa; identical to SEQ ID NO: 68715

SEQ ID NO: 300377 - RNA, 64 nt, hsa; identical to SEQ ID NO: 68716

SEQ ID NO: 300378 - RNA, 64 nt, hsa; identical to SEQ ID NO: 68717

SEQ ID NO: 300379 - RNA, 64 nt, hsa; identical to SEQ ID NO: 68718

SEQ ID NO: 300380 - RNA, 64 nt, hsa; identical to SEQ ID NO: 68719

SEQ ID NO: 300381 - RNA, 64 nt, hsa; identical to SEQ ID NO: 68720

SEQ ID NO: 300382 - RNA, 64 nt, hsa; identical to SEQ ID NO: 68721

SEQ ID NO: 300383 - RNA, 64 nt, hsa; identical to SEQ ID NO: 68722

SEQ ID NO: 300384 - RNA, 64 nt, hsa; identical to SEQ ID NO: 68723

SEQ ID NO: 300385 - RNA, 64 nt, hsa; identical to SEQ ID NO: 68724

SEQ ID NO: 300386 - RNA, 64 nt, hsa; identical to SEQ ID NO: 68725

SEQ ID NO: 300387 - RNA, 64 nt, hsa; identical to SEQ ID NO: 68726

SEQ ID NO: 300388 - RNA, 64 nt, hsa; identical to SEQ ID NO: 68727

SEQ ID NO: 300389 - RNA, 64 nt, hsa; identical to SEQ ID NO: 68728

SEQ ID NO: 300390 - RNA, 64 nt, hsa; identical to SEQ ID NO: 68729

SEQ ID NO: 300391 - RNA, 64 nt, hsa; identical to SEQ ID NO: 68730

SEQ ID NO: 300392 - RNA, 64 nt, hsa; identical to SEQ ID NO: 68731

SEQ ID NO: 300393 - RNA, 64 nt, hsa; identical to SEQ ID NO: 68732

SEQ ID NO: 300394 - RNA, 64 nt, hsa; identical to SEQ ID NO: 68733

SEQ ID NO: 300395 - RNA, 64 nt, hsa; identical to SEQ ID NO: 68734

SEQ ID NO: 300396 - RNA, 64 nt, hsa; identical to SEQ ID NO: 68735

SEQ ID NO: 300397 - RNA, 64 nt, hsa; identical to SEQ ID NO: 68736

SEQ ID NO: 300398 - RNA, 64 nt, hsa; identical to SEQ ID NO: 68737

SEQ ID NO: 300399 - RNA, 64 nt, hsa; identical to SEQ ID NO: 68738

SEQ ID NO: 300400 - RNA, 64 nt, hsa; identical to SEQ ID NO: 68739

SEQ ID NO: 300401 - RNA, 64 nt, hsa; identical to SEQ ID NO: 68740

SEQ ID NO: 300402 - RNA, 64 nt, hsa; identical to SEQ ID NO: 68741

SEQ ID NO: 300403 - RNA, 64 nt, hsa; identical to SEQ ID NO: 68742

SEQ ID NO: 300404 - RNA, 64 nt, hsa; identical to SEQ ID NO: 68743

SEQ ID NO: 300405 - RNA, 64 nt, hsa; identical to SEQ ID NO: 68744

SEQ ID NO: 300406 - RNA, 64 nt, hsa; identical to SEQ ID NO: 68745

SEQ ID NO: 300407 - RNA, 64 nt, hsa; identical to SEQ ID NO: 68746

SEQ ID NO: 300408 - RNA, 64 nt, hsa; identical to SEQ ID NO: 156063

SEQ ID NO: 300409 - RNA, 64 nt, hsa; identical to SEQ ID NO: 156064

SEQ ID NO: 300410 - RNA, 64 nt, hsa; identical to SEQ ID NO: 156065

SEQ ID NO: 300411 - RNA, 64 nt, hsa; identical to SEQ ID NO: 156066

SEQ ID NO: 300412 - RNA, 64 nt, hsa; identical to SEQ ID NO: 156067

SEQ ID NO: 300413 - RNA, 64 nt, hsa; identical to SEQ ID NO: 156068

SEQ ID NO: 300414 - RNA, 64 nt, hsa; identical to SEQ ID NO: 156069

SEQ ID NO: 300415 - RNA, 64 nt, hsa; identical to SEQ ID NO: 156070

SEQ ID NO: 300416 - RNA, 64 nt, hsa; identical to SEQ ID NO: 156071

SEQ ID NO: 300417 - RNA, 64 nt, hsa; identical to SEQ ID NO: 156072

SEQ ID NO: 300418 - RNA, 64 nt, hsa; identical to SEQ ID NO: 156073

SEQ ID NO: 300419 - RNA, 64 nt, hsa; identical to SEQ ID NO: 156074

SEQ ID NO: 300420 - RNA, 64 nt, hsa; identical to SEQ ID NO: 156075

SEQ ID NO: 300421 - RNA, 64 nt, hsa; identical to SEQ ID NO: 156076

SEQ ID NO: 300422 - RNA, 64 nt, hsa; identical to SEQ ID NO: 156077

SEQ ID NO: 300423 - RNA, 64 nt, hsa; identical to SEQ ID NO: 156078

SEQ ID NO: 300424 - RNA, 64 nt, hsa; identical to SEQ ID NO: 156079

SEQ ID NO: 300425 - RNA, 64 nt, hsa; identical to SEQ ID NO: 156080

SEQ ID NO: 300426 - RNA, 64 nt, hsa; identical to SEQ ID NO: 156081

SEQ ID NO: 300427 - RNA, 64 nt, hsa; identical to SEQ ID NO: 156082

SEQ ID NO: 300428 - RNA, 64 nt, hsa; identical to SEQ ID NO: 156083

SEQ ID NO: 300429 - RNA, 64 nt, hsa; identical to SEQ ID NO: 156084

SEQ ID NO: 300430 - RNA, 64 nt, hsa; identical to SEQ ID NO: 156085

SEQ ID NO: 300431 - RNA, 64 nt, hsa; identical to SEQ ID NO: 156086

SEQ ID NO: 300432 - RNA, 64 nt, hsa; identical to SEQ ID NO: 156087

SEQ ID NO: 300433 - RNA, 64 nt, hsa; identical to SEQ ID NO: 156088

SEQ ID NO: 300434 - RNA, 64 nt, hsa; identical to SEQ ID NO: 156089

SEQ ID NO: 300435 - RNA, 64 nt, hsa; identical to SEQ ID NO: 156090

SEQ ID NO: 300436 - RNA, 64 nt, hsa; identical to SEQ ID NO: 156091

SEQ ID NO: 300437 - RNA, 64 nt, hsa; identical to SEQ ID NO: 156092

SEQ ID NO: 300438 - RNA, 64 nt, hsa; identical to SEQ ID NO: 156093

SEQ ID NO: 300439 - RNA, 64 nt, hsa; identical to SEQ ID NO: 156094

SEQ ID NO: 300440 - RNA, 64 nt, hsa; identical to SEQ ID NO: 156095

SEQ ID NO: 300441 - RNA, 64 nt, hsa; identical to SEQ ID NO: 156096

SEQ ID NO: 300442 - RNA, 64 nt, hsa; identical to SEQ ID NO: 156097

SEQ ID NO: 300443 - RNA, 64 nt, hsa; identical to SEQ ID NO: 156098

SEQ ID NO: 300444 - RNA, 64 nt, hsa; identical to SEQ ID NO: 156099

SEQ ID NO: 300445 - RNA, 64 nt, hsa; identical to SEQ ID NO: 156100

SEQ ID NO: 300446 - RNA, 64 nt, hsa; identical to SEQ ID NO: 156101

SEQ ID NO: 300447 - RNA, 64 nt, hsa; identical to SEQ ID NO: 156102

SEQ ID NO: 300448 - RNA, 64 nt, hsa; identical to SEQ ID NO: 156103

SEQ ID NO: 300449 - RNA, 64 nt, hsa; identical to SEQ ID NO: 156104

SEQ ID NO: 300450 - RNA, 64 nt, hsa; identical to SEQ ID NO: 156105

SEQ ID NO: 300451 - RNA, 64 nt, hsa; identical to SEQ ID NO: 156106

SEQ ID NO: 300452 - RNA, 64 nt, hsa; identical to SEQ ID NO: 156107

SEQ ID NO: 300453 - RNA, 64 nt, hsa; identical to SEQ ID NO: 156108

SEQ ID NO: 300454 - RNA, 64 nt, hsa; identical to SEQ ID NO: 156109

SEQ ID NO: 300455 - RNA, 64 nt, hsa; identical to SEQ ID NO: 156110

SEQ ID NO: 300456 - RNA, 64 nt, hsa; identical to SEQ ID NO: 156111

SEQ ID NO: 300457 - RNA, 64 nt, hsa
ugggugacagagcaagacccugucuuaaaaaaagaggauucaacacauauuuuuauauuauguu

SEQ ID NO: 300458 - RNA, 64 nt, hsa
uccuaaggacucagauuguaucuuuguacagaagaggauucaaaacgccacguguaguggcuca

SEQ ID NO: 300459 - RNA, 56 nt, hsa
ccagcacuaugagauacugaagaccaaggauucagcauuagaacaucuauacauau

SEQ ID NO: 300460 - RNA, 64 nt, hsa
auuucuugagauuugauggaagugggaguugggaaggauucaccauacuuguguucuccucccu

SEQ ID NO: 300461 - RNA, 64 nt, hsa
ucaaucaacaauucugucuuauugaagaguugcuaggauucagaguaaaacucaaaggauucag

SEQ ID NO: 300462 - RNA, 64 nt, hsa
uugaagaguugcuaggauucagaguaaaacucaaaggauucaguuugagccuagaaugaugguu

SEQ ID NO: 300463 - RNA, 64 nt, hsa
accuggagauaaacgcuggagcaaucuccuuggaaggauucagcacgaguagaugguaaacauu

SEQ ID NO: 300464 - RNA, 64 nt, hsa
cauaauguggauaggauagggaggaugaauuaccaggauucauggagcgggaucagauuaccag

SEQ ID NO: 300465 - RNA, 64 nt, hsa
uuuugccuuuuuuuccccacguguaucugaacauuaagcagauuggcucagacacaaugaaaag

SEQ ID NO: 300466 - RNA, 64 nt, hsa
gguagaaaaaugaugagaaaugaacugagagcauuaagcagagaggguugauaggcuggccgug

SEQ ID NO: 300467 - RNA, 64 nt, hsa
gcucggucagucugccuccguguguccucugaaauaagcagaugaagaugaaagggcaacuuug

SEQ ID NO: 300468 - RNA, 64 nt, hsa
aacuuuguuuucuucuuuuuccugaugugaauguuaagcagaagggagagaguccuuacucccu

SEQ ID NO: 300469 - RNA, 64 nt, hsa
uuggugguuuaguuucacccagugugcuuuuggauaagcagaaauaucuaaaugggauuuugag

SEQ ID NO: 300470 - RNA, 64 nt, hsa
aacuucagggcuucuccauagaccuugaccauuauaagcagaccuuauuucucccuacacuucc

SEQ ID NO: 300471 - RNA, 64 nt, hsa
uuuauuuuagugagggcaauuacagagaaaagaguaagcagaaauguccuucugaguacuggcc

SEQ ID NO: 300472 - RNA, 64 nt, hsa
guuugcugcagaauucacugcauagcaggagauguaagcagaugaguuauuuuuuaagagaauc

SEQ ID NO: 300473 - RNA, 64 nt, hsa
cccagauugcugcaaagaucccaaggcauugauugcacuugauuaagcuuuugucuguagguga

SEQ ID NO: 300474 - RNA, 64 nt, hsa
gaaggagcagucacugggagagguuacccgagaagcacuugagcaugaggaacugcaccuuuag

SEQ ID NO: 300475 - RNA, 64 nt, hsa
cugagggcacuugagcaacugacuuaauuuucaagcacuugauuaacacaacacugcaaacaga

SEQ ID NO: 300476 - RNA, 64 nt, hsa
gguauuuguuucaggaagcucuucuaagcugagggcacuugagcaacugacuuaauuuucaagc

SEQ ID NO: 300477 - RNA, 64 nt, hsa
gaaaaguuuugauuagcacugugguuuuccuuuugcacuugaaggacaaaggugccagccuuua

SEQ ID NO: 300478 - RNA, 64 nt, hsa
gguuuuuuggugaccucccuuacugggcuaaucagcacuugaucggaaguccagguuaguaugu

SEQ ID NO: 300479 - RNA, 64 nt, hsa
cguguagaagcauuuuaaaaaucauuucuagcaagcacuugacaucuagucagcucucuacucc

SEQ ID NO: 300480 - RNA, 64 nt, hsa
uugugccuuguucuaaaacuuuuauuaaguaggugcacuugacaguauugaggucauuuguuau

SEQ ID NO: 300481 - RNA, 64 nt, hsa
agaaacuugaccaaaagacaguacaaaaacacuggcacuugaauguugaaugucaccguaugcg

SEQ ID NO: 300482 - RNA, 64 nt, hsa
guauugugccuuguucuaaaacuuuuaaguaggugcacuugacaguauugaggucauuuguuaa

SEQ ID NO: 300483 - RNA, 64 nt, hsa
gaaacuugaccaaaagacaguacaaaaaacacuggcacuugaauguugaaugucaccguaugug

SEQ ID NO: 300484 - RNA, 64 nt, hsa
ucuuguaauauguugauucaguguuuuguaaaugaagucguauguauuuucagaguauuuuugu

SEQ ID NO: 300485 - RNA, 64 nt, hsa
gauacuucaugauuaaauuauuuuuguugcuuaaaagucguauuagacaagacuaaaucauucu

SEQ ID NO: 300486 - RNA, 64 nt, hsa
cacuaaguacuugagaguuacagucugaauaaugaagucguaccagcugaauagcccagcuugc

SEQ ID NO: 300487 - RNA, 64 nt, hsa
auauauuuucuuacuguacauaaagauguuccuuaagucguacagaagguggcgcggcaaaggg

SEQ ID NO: 300488 - RNA, 64 nt, hsa
ugccuuaucgaaaugcuucuagaacugucuguauaagucguauuucagacaguacuaaauacuu

SEQ ID NO: 300489 - RNA, 64 nt, hsa
gagagaaugcaaauggccacuaaguauaugaaaaaagucguaucuuaacagugaacaacugugu

SEQ ID NO: 300490 - RNA, 64 nt, hsa
cuacgcugccucaacacugaagguugacacaggaaagucguacuguucacacacacaguuugag

SEQ ID NO: 300491 - RNA, 64 nt, hsa
uuggauaaaugggucagaaaguacagauuuaauaaagucguaccucuaauguucagaauuuggu

SEQ ID NO: 300492 - RNA, 64 nt, hsa
uuuuccuagaaaaccaaaaucaaacugagauuucaagucguacuauggaacaccuuucuguuua

SEQ ID NO: 300493 - RNA, 64 nt, hsa
cucauggaggaguggguggagacaaggagggaguaagucguaggaguacaagguuuuuauuuuu

SEQ ID NO: 300494 - RNA, 51 nt, hsa
aaaaguuauuuugugacuagaaagucguaguucccccgcucccugggaaag

SEQ ID NO: 300495 - RNA, 64 nt, hsa
acauugaaucugauucuaccuguuaacuuuuaaaaagucguaaguuuggaugaaagugcaagau

SEQ ID NO: 300496 - RNA, 64 nt, hsa
uuaacauuccuaaaaugcuucacuguacguaguuaagucguagcuauaacuucaaauuuuuuaa

SEQ ID NO: 300497 - RNA, 64 nt, hsa
uugguuguguguuuuauuaaggaucagugcaguuaagucguauuuuaaaguguuaccuccccuc

SEQ ID NO: 300498 - RNA, 64 nt, hsa
cuuaagauagugccuaaaacacuaaauuucagucaagucguaaguaggauuuucuuuuugauca

SEQ ID NO: 300499 - RNA, 64 nt, hsa
ggggguguggauguacagcggauaacaaucuuucaagucguagcacuuuguuucagaacuggaa

SEQ ID NO: 300500 - RNA, 64 nt, hsa
gugauagaguccuugguggguuuagucaucucggaagucguagggcagcuauggaaaccacugg

SEQ ID NO: 300501 - RNA, 64 nt, hsa
ucauggcaguugaaaaagggccucauuggagauaaagucguaggauaaaauugggaacaggaau

SEQ ID NO: 300502 - RNA, 64 nt, hsa
cucgcuaaagguugagaacuacugcuuuagaaugaagucguauaauaaagucucugaaaaggcc

SEQ ID NO: 300503 - RNA, 64 nt, hsa
gggggaggggauuggguuuaggaagagcuagguuaagucguaacgaguggggaaacacugaguc

SEQ ID NO: 300504 - RNA, 64 nt, hsa
aggagugcaguucauuuuuuucacccuguuuuugaagucguauuauucacuuguaaaaaugauu

SEQ ID NO: 300505 - RNA, 64 nt, hsa
gccccaggcugucuggaaguuggagaauucccuaucagcacagggaucucagcucuggccugga

SEQ ID NO: 300506 - RNA, 64 nt, hsa
uuuucuuccaaaucugaguggaauuuucaaaugaucagcacagccacugccaacagauaugaug

SEQ ID NO: 300507 - RNA, 64 nt, hsa
ucauaaagaaucagcuagaguugucaugauaaagucagcacacacaaaaaggcuucuuacacau

SEQ ID NO: 300508 - RNA, 64 nt, hsa
ccugacuuuuuauauccagucauaaaguugacuuucagcacaaaagauacuuauaaacaaauaa

SEQ ID NO: 300509 - RNA, 64 nt, hsa
uuccugaaagcgaaagcuuuaccuccugcaaaugucagcacauguaguaggacaccaguauccu

SEQ ID NO: 300510 - RNA, 64 nt, hsa
acucugaaagacagaagcuucguccagccacucuucagcacauuccuuuacuaagcaguuuaaa

SEQ ID NO: 300511 - RNA, 64 nt, hsa
ggacagcuuccccaucgccuucuggcugcugcagucagcacagagagcggcuuccccaucgccu

SEQ ID NO: 300512 - RNA, 64 nt, hsa
ggacggcuuccccaucgccuucuggccgcugcagucagcacagagagcggcuuccccauugccu

SEQ ID NO: 300513 - RNA, 64 nt, hsa
ccugcuucauacucuugagcacauccuuaaaauaucagcacaaguugggggaggcaggcaaugg

SEQ ID NO: 300514 - RNA, 64 nt, hsa
gagagugcauggcaccugguguguaacgacacaaucagcacaacuggagagaggcauuaaagaa

SEQ ID NO: 300515 - RNA, 64 nt, hsa
acaguuggucugcagucggcccaggacggucuacucagcacaacugacugcuucagugcugcua

SEQ ID NO: 300516 - RNA, 64 nt, hsa
uugaccuuuuuaaaacgaaaagagagacaaagucucagcacauuccaaggagugguagaaacag

SEQ ID NO: 300517 - RNA, 64 nt, hsa
cccaggaaacuugggucuugcugcccauccuuccucagcacagggaacccggaagcccguugca

SEQ ID NO: 300518 - RNA, 64 nt, hsa
cggguucgugcauacaugcggggaccccagacugucagcacagggaagauggaucccauccuaa

SEQ ID NO: 300519 - RNA, 64 nt, hsa
uuuacucugcuacaggguggauuccaaaacuggcucagcacauugcauguaguugagccacauu

SEQ ID NO: 300520 - RNA, 64 nt, hsa
uagguacuggugaaaauuguuuuuguuuaugcugucagcacauuugugugggucucucauuguc

SEQ ID NO: 300521 - RNA, 64 nt, hsa
ugccuguaguccagucucuccagcaucaauuccaucagcacaaagacauaauuuaauuccuucu

SEQ ID NO: 300522 - RNA, 64 nt, hsa
uuaggcauucuaagucacaggaugagacaggaggucagcacaagauacacgucacaaagaccuu

SEQ ID NO: 300523 - RNA, 64 nt, hsa
aggagcacaaggaaaccaagcagcagaggccccaucagcacagagggccucguuccacgaacgu

SEQ ID NO: 300524 - RNA, 64 nt, hsa
acccucucucguccaucucuguugccucugcacaucagcacacacugacuccaccugggcuggc

SEQ ID NO: 300525 - RNA, 64 nt, hsa
cagauugaacaccugcaaaacugcuagcguaaucucagcacauacgcagcuaggaaguuuguca

SEQ ID NO: 300526 - RNA, 64 nt, hsa
gcaugugagaacauagcaguagggaccaaaagucucagcacacuuaccuccgauuaugccuuaa

SEQ ID NO: 300527 - RNA, 64 nt, hsa
uuggaccucccagcccacccagccucagcacagcucagcacagaaggagcagccccagccacag

SEQ ID NO: 300528 - RNA, 64 nt, hsa
cugccaguccuuggaccucccagcccacccagccucagcacagcucagcacagaaggagcagcc

SEQ ID NO: 300529 - RNA, 64 nt, hsa
ugcuuucgaaguggccagcugcggccaccaggucucagcacaagagcgcuuccuuugcacagaa

SEQ ID NO: 300530 - RNA, 64 nt, hsa
gggugugcaggcgucugcuaaguugugugauguaucagcacaggcuuugagacgucuggacccu

SEQ ID NO: 300531 - RNA, 64 nt, hsa
ugaacugcucagagcuugagaugaaaugacauacaagcuucaggguaaaacugucuacuagcaa

SEQ ID NO: 300532 - RNA, 64 nt, hsa
uuuuucucagaauaccucuuaccuuucucaaagaaagcuucaaccaccaucaucagaaagaagg

SEQ ID NO: 300533 - RNA, 64 nt, hsa
guugcucuuuugguuuuuaacuuccuccauacauaagcuucaaggacaauaagauguuaaaaag

SEQ ID NO: 300534 - RNA, 64 nt, hsa
augaaagcauuugaauuuggcuuaucagaauaacaagcuucagugggaaauacagcaauuauuu

SEQ ID NO: 300535 - RNA, 64 nt, hsa
gcuaauagaucauuggauacgaagggcucuuuugaagcuucaguauaccauguuugcauaguuu

SEQ ID NO: 300536 - RNA, 64 nt, hsa
gaggggagagagguaccuagaccaugucaucuacaagcuucaguaacuaaagaaaaaggaacuu

SEQ ID NO: 300537 - RNA, 64 nt, hsa
cagaaauggacuuaccgugaagccaauaaaguucaagcuucagggaucucucuugcacgggccu

SEQ ID NO: 300538 - RNA, 64 nt, hsa
uuuguauuguuuuucuuaaagaggaaccucguauaagcuucaagccucacaaaccuucuagccu

SEQ ID NO: 300539 - RNA, 64 nt, hsa
acccaauuccagcaccguugccuccugacauaccaagcuucaaccucauuggugacagccuguc

SEQ ID NO: 300540 - RNA, 64 nt, hsa
cugugucuuccuagugugacccagccaggagcggaagcuucaggcguuuguaaagugaggucug

SEQ ID NO: 300541 - RNA, 64 nt, hsa
ccccauguuuuauaaggaauuuuguacagucuuugugaaauaaaauaacgugcuucauuugacc

SEQ ID NO: 300542 - RNA, 64 nt, hsa
ccuuccuccuggcucucuauauaccugugaauaugugaaauaguguaaauaugaaagaacuugu

SEQ ID NO: 300543 - RNA, 64 nt, hsa
uuaaauucauaagacuuaauuuguacaauaguuugugaaauaucuuguuacugcuuuuauuuag

SEQ ID NO: 300544 - RNA, 64 nt, hsa
agcagacuguggacuguaauaaaguauauaaauugugaaauauaaaaacuuggaacuuauucaa

SEQ ID NO: 300545 - RNA, 64 nt, hsa
uacguaauuauacuuaaaauauccacuggacacugugaaauacacuaacaggauggcuggguag

SEQ ID NO: 300546 - RNA, 64 nt, hsa
aguucauuuccugagguggauuuacugagagaaggugaaauaaagccauauuuaguauaccaga

SEQ ID NO: 300547 - RNA, 64 nt, hsa
uaucauauguuaaacuaagcuuucaaaaaccuuagugaaauagcaagugacugcuuucaagcag

SEQ ID NO: 300548 - RNA, 64 nt, hsa
gaacacuggcuuggcccugcuccgcugagugucugugaaauaccucuacuuucccucccauauc

SEQ ID NO: 300549 - RNA, 64 nt, hsa
uaauauuucaucuuuugcuuauuucuacaagucagugaaauaaauuguauuuaggaagugucag

SEQ ID NO: 300550 - RNA, 64 nt, hsa
uugucugugucaagaaguucaccuucucaagccagugaaauacagacuuaauuugucaugacug

SEQ ID NO: 300551 - RNA, 64 nt, hsa
uguccuguuauauguauaucaggaauacaaggaugugaaauaaaacuguaaauuugcauaacug

SEQ ID NO: 300552 - RNA, 64 nt, hsa
uguaaauuugcauaacuggauguacuuagauaaugugaaauaaacauuaaagacaaggucuauu

SEQ ID NO: 300553 - RNA, 64 nt, hsa
guccuauauggggaaaaaacguacacaguuuucugugaaauaugaugcuguaugugguugugau

SEQ ID NO: 300554 - RNA, 64 nt, hsa
agggcugucuuccuuucuccccuuuggaugguuggugaaauacuuuaauugcccugucugcuca

SEQ ID NO: 300555 - RNA, 64 nt, hsa
uuuaucaaggguagcuaaugacaugaaaauaauugugaaauauggaauuauuucugacacauga

SEQ ID NO: 300556 - RNA, 64 nt, hsa
guauggagaacucaccaagaaagaauucaauacugugaaauaugcagcaagaagauuggucuuu

SEQ ID NO: 300557 - RNA, 64 nt, hsa
aucuguuuagauuaucuuuaaucuccaugaaaucgugaaauaagacaagaauaguguuucagcu

SEQ ID NO: 300558 - RNA, 64 nt, hsa
ucuuaggcugaaauuugucuuuccauuuuuuaaggugaaauaguacuaccuuacgugauagcau

SEQ ID NO: 300559 - RNA, 64 nt, hsa
acaccaaaaauuuagaugccuuaauaguauauacgugaaauacucagcugucccuuuaaaaaua

SEQ ID NO: 300560 - RNA, 64 nt, hsa
gauuauauauuucccucaauuuagaguuugcuaagugaaauaaacugguucacuaguagagaaa

SEQ ID NO: 300561 - RNA, 64 nt, hsa
gucuacaagacauucacguuuaacaucacuuuuagugaaauaaaaugugccauacuaguaugug

SEQ ID NO: 300562 - RNA, 64 nt, hsa
aaauguguuuugggguggguaacuaaauuuuugagugaaauaucauaagaugagaauggaaaga

SEQ ID NO: 300563 - RNA, 64 nt, hsa
caauuuuaaaaguagcucacauuuaauuucuugugugaaauagaacaugcuuuaaaggaaguau

SEQ ID NO: 300564 - RNA, 64 nt, hsa
ugaauguaguauucaaugauuuuuuaugaucaaggugaaauaaacagucuaaagaagagguguu

SEQ ID NO: 300565 - RNA, 64 nt, hsa
uuuugcuuucuaaauacuagccuucugguucacagugaaauaauuuaauuaucaaucaguagau

SEQ ID NO: 300566 - RNA, 64 nt, hsa
gaaauuuugccauucuguuuuccauuaauaauaggugaaauacaggaaaacuacauuuguuauu

SEQ ID NO: 300567 - RNA, 64 nt, hsa
uaccuaucaaauagcauuuauuacaugucuuucagugaaauacuuaguuguuccaggcaccuaa

SEQ ID NO: 300568 - RNA, 64 nt, hsa
ugcauguuugcaugggguuauugagacauuggaugugaaauaccuaggaagacauguauggaga

SEQ ID NO: 300569 - RNA, 64 nt, hsa
aguacacagguucucccuuguucuuuuaaauuuugugaaauauaacuuacaaauaaguacuuaa

SEQ ID NO: 300570 - RNA, 64 nt, hsa
gaacuuuauaaaaaucuugaguuuguucacuaaugugaaauaagcuauguguccaggguauugc

SEQ ID NO: 300571 - RNA, 64 nt, hsa
uugcauuuguuuauugaaugaugcaucuucuucggugaaauauuuauaugcauaaauggcaaag

SEQ ID NO: 300572 - RNA, 64 nt, hsa
acccuguuugcaccucgauuuguuugcugaaaaugugaaauaguaaaaaugaaauaacuggacc

SEQ ID NO: 300573 - RNA, 64 nt, hsa
uuuauuugacaaaaaauccaguuaauauauuaaugugaaauaaacccuguuugcaccucgauuu

SEQ ID NO: 300574 - RNA, 64 nt, hsa
uuguuuuugaaaguuagcauaauuuuagaugccugugaaauaguacugcacuuacauaaaguga

SEQ ID NO: 300575 - RNA, 64 nt, hsa
agguucugagauaaguguuauguuuguagauagagugaaauauauuuauauauauauaaauaua

SEQ ID NO: 300576 - RNA, 64 nt, hsa
uucacugaaaccagugaaauauuucacugaaacagugaaauaaaaugaaaacaauuuccucccu

SEQ ID NO: 300577 - RNA, 64 nt, hsa
aaauuuucuaaaauuacauguuucacugaaaccagugaaauauuucacugaaacagugaaauaa

SEQ ID NO: 300578 - RNA, 64 nt, hsa
ccagucuggauccaggucugcaaggccagcccgacccugacacugcacgugggcguagugggga

SEQ ID NO: 300579 - RNA, 64 nt, hsa
caagggcuugcugccuuguuuccugccaggagcgcccugacaucccaaaaccaucuucccacau

SEQ ID NO: 300580 - RNA, 64 nt, hsa
ugggagggcgccgagcccaccgucgcccccuagacccugacagcugcagcugccuugccuugcc

SEQ ID NO: 300581 - RNA, 64 nt, hsa
cugcccuggcuuucagcguagaauugggagugcacccugacagucuccuuccagcucucccuaa

SEQ ID NO: 300582 - RNA, 64 nt, hsa
gauaugggaucccuuagccacuuuagucaaacagcccugacagagucuauaauugaguucaggc

SEQ ID NO: 300583 - RNA, 64 nt, hsa
aaaauauguauuucccccauuucucccucuccuucccugacacuucucugggcugcacagcaga

SEQ ID NO: 300584 - RNA, 64 nt, hsa
uggagcaggccucaugauguggggggacucgacccccugacauggggcagcccauagcaggccu

SEQ ID NO: 300585 - RNA, 64 nt, hsa
cauagcaggccuugugcaguggggggacucgacccccugacauggggcugccuggagcaggccg

SEQ ID NO: 300586 - RNA, 64 nt, hsa
ccaagccaccauuugagagggagggguguuggugcccugacagggacugggcaggguguccaaa

SEQ ID NO: 300587 - RNA, 64 nt, hsa
ccuccugagucacuggggucccucaccagcaccucccugacaccugggcuauggagagguuggc

SEQ ID NO: 300588 - RNA, 64 nt, hsa
gcccacacuuuggaggggguccauguccaagagacccugacaaggaaggaguugagcccugggu

SEQ ID NO: 300589 - RNA, 64 nt, hsa
gcugagaucucccuuuguggaacuccgagagccgcccugacagucccagccgccacccaaggag

SEQ ID NO: 300590 - RNA, 64 nt, hsa
gaacuggauccaaaaaaccauucaggccaagugacccugacaugugacaucuaccucccgaccu

SEQ ID NO: 300591 - RNA, 64 nt, hsa
uccugggcuggggcaagacagcagauggugauuucccugacaccauccagugugcauacaucca

SEQ ID NO: 300592 - RNA, 64 nt, hsa
ccuuaccaccccuuuuccugcucggcccuuuaaucccugacagaccuggacuguguggcugaag

SEQ ID NO: 300593 - RNA, 64 nt, hsa
ggcucauuguggcagguuucugccaauagacagccccugacaguggccucaaggagcugcaggu

SEQ ID NO: 300594 - RNA, 64 nt, hsa
accagcagcccaggaagcagcacacgcggccguggggaggcaggcaccgggcaugucggcgccu

SEQ ID NO: 300595 - RNA, 64 nt, hsa
uguacgugugucaagccuagccaccucagcugcagggaggcagaaggcaaggcaggccccacgg

SEQ ID NO: 300596 - RNA, 64 nt, hsa
uugggaggcugaggcaggagaaucgcuugaacccgggaggcacagguuccagugagccaagguu

SEQ ID NO: 300597 - RNA, 64 nt, hsa
uugggaggcugaggcaggagaaucgcuugaaccugggaggcagagguugcaguaagccaagauc

SEQ ID NO: 300598 - RNA, 64 nt, hsa
ucgggaggcugaggcaggagaauugcuugaaccggggaggcagaaguugcagugagccgagauu

SEQ ID NO: 300599 - RNA, 64 nt, hsa
uugggaggcugaggcaggagaauggcaugaaccugggaggcagagcuugcagugagcugagauu

SEQ ID NO: 300600 - RNA, 64 nt, hsa
aagacggcaccucuucccccauggcagggugugagggaggcagguuuggaauggugcgaguaug

SEQ ID NO: 300601 - RNA, 64 nt, hsa
ucuggcugagcccaggguggggagauccugggaagggaggcacuggaggaagacggcaccucuu

SEQ ID NO: 300602 - RNA, 64 nt, hsa
uugggaggcugaggcaggagaaucgcuugaaccugggaggcagaaguugcagugagcugagauu

SEQ ID NO: 300603 - RNA, 64 nt, hsa
guacaguggcucaugccuauaauuccagcacuuugggaggcagaggugggcggaucacaagguc

SEQ ID NO: 300604 - RNA, 64 nt, hsa
cggcgggcgcgacgugaucguggaccugugggaggggaggcacguggcgcgcgugggcccgcug

SEQ ID NO: 300605 - RNA, 64 nt, hsa
uucaguccaggcuggagagguuggggccgggguagggaggcaggagccaugucaguucugaagg

SEQ ID NO: 300606 - RNA, 64 nt, hsa
cagaugauuuguguaaccugaggccaggauuaaggggaggcaaucaaugcaccuagggaaaaaa

SEQ ID NO: 300607 - RNA, 64 nt, hsa
ucaggaggcugaggcaggagaagggugggaacccgggaggcagagcuugcagugagccgagauu

SEQ ID NO: 300608 - RNA, 64 nt, hsa
agugaagggauguaucaagugggguggugggagggggaggcaagguuauaugcacuuucucaug

SEQ ID NO: 300609 - RNA, 64 nt, hsa
agcugguauguucaguaggaacuguacauguguugggaggcauaaagacuaauuagcaaccaua

SEQ ID NO: 300610 - RNA, 64 nt, hsa
gugcaauggcucacaccuguaauuccaacacuuugggaggcagaggcgggaggauugcuugagg

SEQ ID NO: 300611 - RNA, 64 nt, hsa
ucaagaggcugaggcaggagaaucgcuugaaccugggaggcagagguugcagugagccaagauu

SEQ ID NO: 300612 - RNA, 64 nt, hsa
gcuggugcccuauuuccagccaccccagcagcuagggaggcaaagcaggcugcagucagucccu

SEQ ID NO: 300613 - RNA, 64 nt, hsa
ucugugagugugcgucuguacgggaagaggcagagggaggcagccagcggggcgugaugcagug

SEQ ID NO: 300614 - RNA, 64 nt, hsa
cauuuuuggcacauaacaacuuuuuuuuuaauuugggaggcaagcacaaacuaggaagacuagc

SEQ ID NO: 300615 - RNA, 64 nt, hsa
ucauuuauauuuuacaaaugcuagauauuggucugggaggcaacauuaaugguaccagccuguc

SEQ ID NO: 300616 - RNA, 64 nt, hsa
cccaggaaaggacggcugagcauguggagcgagagggaggcagguggacgcugcagaccccagg

SEQ ID NO: 300617 - RNA, 64 nt, hsa
ggggcgcgaugucaaaggucgggacagcugugccgggaggcagccacagggaagcucacacauc

SEQ ID NO: 300618 - RNA, 64 nt, hsa
aucccucccccagcagaauggaggcaggggacaagggaggcaguggcuaguggggugaacagcu

SEQ ID NO: 300619 - RNA, 64 nt, hsa
ccucuuugcccccgacggcugugacgcagccggagggaggcacuagucaccgacagcggccuug

SEQ ID NO: 300620 - RNA, 64 nt, hsa
gcccuggggcggggggcgugccugucacugccuggggaggcauuugccucuguaccaucgccuu

SEQ ID NO: 300621 - RNA, 64 nt, hsa
cgcccccgcucaggugagcccgaaggcaggagccgggaggcacuccucccaaacacuccacuca

SEQ ID NO: 300622 - RNA, 64 nt, hsa
uuugugccgguagaauaaggaaggaagggaggcagggaggcaaagcaugucagaaacggaccuu

SEQ ID NO: 300623 - RNA, 64 nt, hsa
aagaucccuuugugccgguagaauaaggaaggaagggaggcagggaggcaaagcaugucagaaa

SEQ ID NO: 300624 - RNA, 64 nt, hsa
cuugcuggggaggcagcaagcaugcuggugggaagggaggcagggacuggcagcugccaccccc

SEQ ID NO: 300625 - RNA, 64 nt, hsa
cccucaugaccuaaacucugggcuuuucuugcuggggaggcagcaagcaugcuggugggaaggg

SEQ ID NO: 300626 - RNA, 64 nt, hsa
aucuuucuuuuaaggcuguuccugggccuggcgggggaggcaggggugagaggauggaauugug

SEQ ID NO: 300627 - RNA, 64 nt, hsa
cccggccccgcaccugccauuugcacgcccggccgggaggcagagacggggggaggggaagccu

SEQ ID NO: 300628 - RNA, 64 nt, hsa
ucgggaggcugaggcacaagaaucacuugaacccgggaggcagagguuguagugagcccagauu

SEQ ID NO: 300629 - RNA, 64 nt, hsa
agugagcccagauugugccacugcucuccagccugggaggcacagcaaacugucccccaaaaaa

SEQ ID NO: 300630 - RNA, 64 nt, hsa
gaaguccucuucuggaagcugcagaugggggcccgggaggcacacacgagucugggacucauuc

SEQ ID NO: 300631 - RNA, 64 nt, hsa
gcacucugagguuucuaucuuccagacaagagcugggaggcaagauuucugguuucugguuccu

SEQ ID NO: 300632 - RNA, 64 nt, hsa
uggggagccaauccacccagacccgcguccaccugggaggcauuugggguugcaggaccgagac

SEQ ID NO: 300633 - RNA, 64 nt, hsa
ccucugcugaagagggggaugaagugggucuccagggaggcagugggggccuuguuggcagcug

SEQ ID NO: 300634 - RNA, 64 nt, hsa
uggcagcagccccgagggacgcccccagaggaccgggaggcaccccacccuccccaccagugca

SEQ ID NO: 300635 - RNA, 64 nt, hsa
ggagcagaaaacccaagggcagguggagaguccagggaggcaggauggaucaccagacaccuaa

SEQ ID NO: 300636 - RNA, 64 nt, hsa
augcuuagcaucuacucuguauaacgcaugagaggggaggcaaagaagaaaaagacacacagaa

SEQ ID NO: 300637 - RNA, 64 nt, hsa
cguucuucagcccgacuggaggaacagcagcucugggaggcacagagugcaggucucaggggca

SEQ ID NO: 300638 - RNA, 64 nt, hsa
aggauucauggaugaaugaaagcuagaccugauggggaggcauuaugacuaaauaggcccagcc

SEQ ID NO: 300639 - RNA, 64 nt, hsa
ucucucuggauggaacgggcaugggccucucugggggaggcagggcuggaaugggagaccuguu

SEQ ID NO: 300640 - RNA, 64 nt, hsa
uggaauaucuuauauugggcgauuugggggcucggggaggcagagaaucucuugggagucuugg

SEQ ID NO: 300641 - RNA, 64 nt, hsa
gcagcaucuuuagaccuagaucugucuaacucuggggaggcacauugacauuuccauuacacac

SEQ ID NO: 300642 - RNA, 64 nt, hsa
cagggagcagcugagccauuuguucuugaacucugggaggcagaaguccccgcacccaucaugc

SEQ ID NO: 300643 - RNA, 64 nt, hsa
ccuagggcucauggcaugggcccccacugggggagggaggcaucuuguuucuugugguucccug

SEQ ID NO: 300644 - RNA, 64 nt, hsa
cagggaguggaaauggggaagggggccuggagaggggaggcaggggccccugugcucucugaac

SEQ ID NO: 300645 - RNA, 64 nt, hsa
gccuucagcccuggagugggcagagaguauuguggggaggcauggccagugggacuaguguucc

SEQ ID NO: 300646 - RNA, 64 nt, hsa
caggcauggggcuacauuccagugccugacuauagggaggcacuccugauuccauggagcagcc

SEQ ID NO: 300647 - RNA, 64 nt, hsa
gcagcagcagcaggauggugaaguaguaaacugggggaggcagggcacagggagaugcucaggg

SEQ ID NO: 300648 - RNA, 64 nt, hsa
accuuucccucccaggaguccccuagguggcugggggaggcaggcucacuggccauuuucccua

SEQ ID NO: 300649 - RNA, 64 nt, hsa
uccgccagagcuuuuccacugauuguacucagcggggaggcaggggaggcagaggggcagccuc

SEQ ID NO: 300650 - RNA, 64 nt, hsa
gcuuuuccacugauuguacucagcggggaggcaggggaggcagaggggcagccucucuaaugcu

SEQ ID NO: 300651 - RNA, 64 nt, hsa
uugguaggcugaggcaggagaauggcgggaacccgggaggcagagguugcagugagcugagauc

SEQ ID NO: 300652 - RNA, 64 nt, hsa
aggcccaaggagguugucagggacacacagcagggggaggcagcccagaucccugcucaugcgu

SEQ ID NO: 300653 - RNA, 64 nt, hsa
aucucccugccacagguggagcugaccggcuuuggggaggcagguaccccagggcagcaggcuc

SEQ ID NO: 300654 - RNA, 64 nt, hsa
cgggugggggcugaggcugaggccaaaggggcuggggaggcaggccugcugccugcccucgauc

SEQ ID NO: 300655 - RNA, 64 nt, hsa
gggagaaguucuugauucagccaaaugcagggaggggaggcagauggagcccauaggccaccuc

SEQ ID NO: 300656 - RNA, 64 nt, hsa
cugucugcuaggcgcuggggagacugauaacuuggggaggcaagagacugggagccacuucucc

SEQ ID NO: 300657 - RNA, 64 nt, hsa
cucuuuauagaagcacauuucugccaccuccccugggaggcacccagaagccugccacucuuua

SEQ ID NO: 300658 - RNA, 64 nt, hsa
ugucuacccacccugccuccaggccagggggcuggggaggcaaauagagccccccuauuuuagu

SEQ ID NO: 300659 - RNA, 64 nt, hsa
cccuguaagcugggugagcuacugaagccaaggugggaggcagcugacaacaccacccacggcc

SEQ ID NO: 300660 - RNA, 64 nt, hsa
aggcugggagaccagguccucugugcaugggcccgggaggcagaccugccccaagggugaugca

SEQ ID NO: 300661 - RNA, 64 nt, hsa
uucaagauuguuugaaaaaaaaaaaaggggagcagggaggcagaaaguccuggaaaaguaaauu

SEQ ID NO: 300662 - RNA, 64 nt, hsa
guggccaaauaggagggagacugugguaggggcagggaggcaacacugcuguccacaugaccuc

SEQ ID NO: 300663 - RNA, 64 nt, hsa
cugccugaucccugaaccccuggccagcucugaggggaggcaccuccaggcaggccaggcugcc

SEQ ID NO: 300664 - RNA, 64 nt, hsa
gggcuccuuaaccugaaggcaaauugcuacuugcaagacugacugacuucaaggaaucagaaau

SEQ ID NO: 300665 - RNA, 64 nt, hsa
cagccaugauuuugucacugacaucugugagccaaagacugagccuuuuuggcaggaauaauaa

SEQ ID NO: 300666 - RNA, 64 nt, hsa
ucagaugaggcaagaaaauuuuauuggccuggguaagacugaaagcauuccaaauuaggcuuag

SEQ ID NO: 300667 - RNA, 64 nt, hsa
ugaggaugucugaggagggaauaguauugcagggaagacugagaaaacaguaggaugacaguuu

SEQ ID NO: 300668 - RNA, 64 nt, hsa
agcacaaaucucuacuccucaugacaugaagaaaaagacugaaugugaagggaguuucuguacu

SEQ ID NO: 300669 - RNA, 64 nt, hsa
aaaagccggggucaaaaaaaguaguuuaagucuuaagacugaauaugcauuaaaguaugcaggu

SEQ ID NO: 300670 - RNA, 64 nt, hsa
gacccagcacagggucuugggccugggcagucugaagacugauaacuuccccacuccacccuac

SEQ ID NO: 300671 - RNA, 64 nt, hsa
gcccccggcacaccaaaguguccacauuguaccaaagacugacccccgccagcuggggugccca

SEQ ID NO: 300672 - RNA, 64 nt, hsa
uucuucccuauguccaggagagggcaauagagggaagacugaggcugaagaauugacggcucug

SEQ ID NO: 300673 - RNA, 64 nt, hsa
uaagagccucugggcugcagggucagccucucccaagacugaagugcagaggcuggacuugggg

SEQ ID NO: 300674 - RNA, 64 nt, hsa
uuagauauuuugagcuaauaauugcaaaaauuagaagacugaaaauggacccaugagaguauau

SEQ ID NO: 300675 - RNA, 64 nt, hsa
ucacugccuuuccuucccacagaccugagugugaaagacugagaguugaggaguuacuuugugg

SEQ ID NO: 300676 - RNA, 64 nt, hsa
uuucaugauuuuauuucccagcagugcugaugacaagacugaauguuaccuuuucuuucugaca

SEQ ID NO: 300677 - RNA, 64 nt, hsa
accucucauaguagguauauaugaguuuucacagaagacugaaaaauaaugcaugauauuuguu

SEQ ID NO: 300678 - RNA, 64 nt, hsa
guugaaucaggggcaaacggaguacagacgucucaagacugaaacggccccauugccuggucua

SEQ ID NO: 300679 - RNA, 64 nt, hsa
ucaacuuggaaaaagaaagaaacacucaacaauaaagacugagacccguucgcccccaugugac

SEQ ID NO: 300680 - RNA, 64 nt, hsa
aucuauauauuuuuucuuuuugaaagauuucauuaagacugauggguaacuuucaaaugagggu

SEQ ID NO: 300681 - RNA, 64 nt, hsa
aagaucuaaagcucuugaaaaugcccgugaagagaagacugaauguguuaaugaauuuaaugag

SEQ ID NO: 300682 - RNA, 64 nt, hsa
cucaugcuuauuuucauggugauugugguuuuacaagacugaagacccagaguauacuuuuucu

SEQ ID NO: 300683 - RNA, 64 nt, hsa
acuguggcuucuugugcugcagaagcucguugacaagacugaggaggauuucaagagcaaccaa

SEQ ID NO: 300684 - RNA, 64 nt, hsa
auguaucucguguuuaugugcacagugccaaaagaagacugacuggguggaggcucugccuugc

SEQ ID NO: 300685 - RNA, 64 nt, hsa
auuuaaaauuguacagaacaaaaaaauaaaaucaaagacugaucuuguacagauauuaguguua

SEQ ID NO: 300686 - RNA, 64 nt, hsa
ugacaagugguaaugacacagauuuguagcgugaaagacugaauacaguguuuggccaaaaauu

SEQ ID NO: 300687 - RNA, 64 nt, hsa
ucuccuugaugaagccaccgccucuauggacuccaagacugacacccugguucagaacaccauc

SEQ ID NO: 300688 - RNA, 64 nt, hsa
cugggugacagagcgagacuccauuucaaaaaaaaagacugaaacaagcuugugcuaagaugga

SEQ ID NO: 300689 - RNA, 64 nt, hsa
uuaccugugaaugaacaaugaagucguuccucuuaagacugaaacaagcaggccagauguggug

SEQ ID NO: 300690 - RNA, 64 nt, hsa
cuugaaggaaaauacugacuuuaagauguauuuuaagacugaaauuuuguucuuuaguacuuuu

SEQ ID NO: 300691 - RNA, 64 nt, hsa
ccuaucacagacaauggaauucgucaguggugguaagacugaaauccugaugcuuuucacacuu

SEQ ID NO: 300692 - RNA, 64 nt, hsa
ggaacagugcuacugaaaggcaguagucauuuucaagacugaauuccaaacaugguuuauuggu

SEQ ID NO: 300693 - RNA, 64 nt, hsa
agagggccauugaacucugagagauuuggggcuaaagacugaucucaggggucuuaccuugaac

SEQ ID NO: 300694 - RNA, 64 nt, hsa
uuccugcaaaggguuaaaaauuuaacugguuuuuacuacugaugacuugauuuaaaaaaaauac

SEQ ID NO: 300695 - RNA, 64 nt, hsa
agcguuuuguuguuguuguuuuuucaugccccauacuacugaauaaacuaguucugugcgggua

SEQ ID NO: 300696 - RNA, 64 nt, hsa
caaacacuuuuuaaaaaauuguuugcuugaaaauacuacugaauauaaauaagaaugugcacag

SEQ ID NO: 300697 - RNA, 64 nt, hsa
agaacucuucaaaaugggcucuucuaaugaggucacuacugaacaaaauuguucccucuucugu

SEQ ID NO: 300698 - RNA, 64 nt, hsa
cacugggugaccagcuggcagacucgggaccaauacuacugacguccucccugaucccaccccc

SEQ ID NO: 300699 - RNA, 64 nt, hsa
gagccacagucacuggauugacuuugcugucaaaacuacugacagggagcagcccccgggccgc

SEQ ID NO: 300700 - RNA, 64 nt, hsa
auuuccuauccauuuauagcuacuacugaaaaugacuacugaauuuuaucaaauaccuuuuaag

SEQ ID NO: 300701 - RNA, 64 nt, hsa
ccuuuuuaagccuauuuccuauccauuuauagcuacuacugaaaaugacuacugaauuuuauca

SEQ ID NO: 300702 - RNA, 64 nt, hsa
cuucgccccagcuagcuugagcuucugcccuaugaccacugagugcauuuaaauaaaaaccuca

SEQ ID NO: 300703 - RNA, 64 nt, hsa
agucucagccacucugcuuugaugguaauucuucaccacugaucucuccucaccaugcccuucc

SEQ ID NO: 300704 - RNA, 64 nt, hsa
ccacuaguguauaagugaucacuggaacggagugaccacugagaugcugggggucacugggccu

SEQ ID NO: 300705 - RNA, 64 nt, hsa
ugccuggaacagggugauuugcuggaauggaguuaccacugagaugccaaagguugcugggucu

SEQ ID NO: 300706 - RNA, 64 nt, hsa
auauugcagauaaguagauaaggauagaagaucaaccacugacugguaguaaugguuuucugug

SEQ ID NO: 300707 - RNA, 64 nt, hsa
uuauguuaucagauuaugcuauuuuguauaaagcaccacugauagcaaaucucucuccaaaauu

SEQ ID NO: 300708 - RNA, 64 nt, hsa
aacacacaaaauaccaaaggaacuuacgcaacacaccacugaguccucuaacuaaucauaugug

SEQ ID NO: 300709 - RNA, 64 nt, hsa
gguuuguacucucacuuaugucacuguuuauaccaccacugacugcugccugcuuuauuauuuc

SEQ ID NO: 300710 - RNA, 64 nt, hsa
cacucuuccuucucccucuccccgucccaucccaaccacugaucugcucaggcaacuaccaauc

SEQ ID NO: 300711 - RNA, 64 nt, hsa
gggugacuuguguuuuuagguauuuaaauaauaaaauuucaagggauaguuuuuauucaaugua

SEQ ID NO: 300712 - RNA, 64 nt, hsa
acucuagacaaaaccuucuauuuuagcuuuagugaauuucaaaaguaaugggucuuggaguaua

SEQ ID NO: 300713 - RNA, 64 nt, hsa
caagugcaauauaacaauguaaccaaaucuagauaauuucaaaguugucauuaauuuaguaagc

SEQ ID NO: 300714 - RNA, 64 nt, hsa
ggaauguuaaguuacaaaagacuuuucaucagaaaauuucaaacaaaguaaacauggcguuuua

SEQ ID NO: 300715 - RNA, 64 nt, hsa
uuaauuagugacacuccuaauuucuacuauggauaauuucaaaguagaaucacucuaugcuuag

SEQ ID NO: 300716 - RNA, 64 nt, hsa
aaaauaagguaagaaguaaauauguaaaagagauaauuucaagcauaagugcaauguaaauaau

SEQ ID NO: 300717 - RNA, 64 nt, hsa
gacaucugagaacacagaauaauccaucauuuuuaauuucaagauauugguacauuuuauaggu

SEQ ID NO: 300718 - RNA, 64 nt, hsa
aaaaugacacagaacuauauacacacauuguaccaauuucaauuuccugguuuugacauuauag

SEQ ID NO: 300719 - RNA, 64 nt, hsa
guaccaucuuuguaacuuccugugaauuuauaauaauuucaaaauaaaacaaguuaaaaaaaaa

SEQ ID NO: 300720 - RNA, 64 nt, hsa
uaauuugggaauuuguuguguugaaauggcauuuaauuucaaccuaaauacugacugcuggaca

SEQ ID NO: 300721 - RNA, 64 nt, hsa
uacuaaauauauauuaugcaagucaggaaucauuaauuucaaaauuuaaagccaugcuaaaauu

SEQ ID NO: 300722 - RNA, 64 nt, hsa
gggauuuguugaaaucuuuuuuauuauccuucacaauuucaaugcuucuuuuagucagaaauga

SEQ ID NO: 300723 - RNA, 64 nt, hsa
auuugcguaaaugguuuucaacaagccugaaaguaauuucaagaauguuucaguuauagaggua

SEQ ID NO: 300724 - RNA, 64 nt, hsa
cauuggcuuuucagucaucaacagucaacauaaaaauuucaauuuucaguaauuuaguggaaaa

SEQ ID NO: 300725 - RNA, 64 nt, hsa
uguuuacauaacagaaaaggcuaagcagaaaguaaauuucaauaugucaguauagaggcucuac

SEQ ID NO: 300726 - RNA, 64 nt, hsa
cugguauaauuacccccauugugcucuuaauggaaauuucaaaggacgggaguauucuguuggu

SEQ ID NO: 300727 - RNA, 64 nt, hsa
cagcgucacaagccagcaacucucuuugcauuaaaauuucaaaguuuaauuaauauaauuaaaa

SEQ ID NO: 300728 - RNA, 64 nt, hsa
aaguuuugugcauuaaucuuaauucauauuuauuaauuucaagggaauauugaaagguuuuaaa

SEQ ID NO: 300729 - RNA, 64 nt, hsa
aaagagaauuagaaguuaacuguguauguacuuuaauuucaaaugcuuuuuuauaucuaaaaau

SEQ ID NO: 300730 - RNA, 64 nt, hsa
uggagguugaauauccuacuguguaacaggucagaauuucaagcucuggguaauaacugcugau

SEQ ID NO: 300731 - RNA, 64 nt, hsa
caagcucuggguaauaacugcugauauuuuuucuaauuucaaauuuaccucuuuuggcuauguc

SEQ ID NO: 300732 - RNA, 64 nt, hsa
uauuuauccaacuacuguauauuuagguaacuagaauuucaaaauagaaaaaaaaaaacugugu

SEQ ID NO: 300733 - RNA, 64 nt, hsa
aaaucuuuaauuaaaacagugaagacuucucuauaauuucaauuaauggaaguuguagaucaau

SEQ ID NO: 300734 - RNA, 64 nt, hsa
gaaaaaaaugaauuucaagauucucaacuuuuuuaauuucaaaaauuguuuauuguuuugacua

SEQ ID NO: 300735 - RNA, 64 nt, hsa
ugcugcuuauuguuuuauucuacugaaaaaaaugaauuucaagauucucaacuuuuuuaauuuc

SEQ ID NO: 300736 - RNA, 64 nt, hsa
cugcaugucaggauugcacaguauguuacaauacaauuucaaagagaacccacauuugugagau

SEQ ID NO: 300737 - RNA, 64 nt, hsa
uucuacugccaaacuucuggcaaauuuaccugugaauuucaaaauguuauaaaaucucuugaua

SEQ ID NO: 300738 - RNA, 64 nt, hsa
accaucuucagguaugggauuucugaacguuucaaauuucaaucaaugagcacugucaacaccc

SEQ ID NO: 300739 - RNA, 64 nt, hsa
cuuuuguuucaaaauauuauauuauuucauaaauaauuucaagcaaauacagacauccacaaug

SEQ ID NO: 300740 - RNA, 64 nt, hsa
ccucgguuuauuuaucauuuugaaauaaaaucagaauuucaaccuguaauuuuaucuacauuau

SEQ ID NO: 300741 - RNA, 64 nt, hsa
gggucugacuggagcccuccuggacuguuucuuuaauuucaaaagcccugcagacauaguaccu

SEQ ID NO: 300742 - RNA, 64 nt, hsa
ccauguccaagcccagagagaaaacaaugggaacaauuucaagguccucaccacuccuucauuu

SEQ ID NO: 300743 - RNA, 64 nt, hsa
uggguuuccaggguuggcagcccacaccagcauuaauuucaaugaaggggaccuccagcuaaau

SEQ ID NO: 300744 - RNA, 64 nt, hsa
ccagcauuugacaugcauuuuaacuuuuugguucaauuucaagucugcuguggcuaauaguggu

SEQ ID NO: 300745 - RNA, 64 nt, hsa
agccucuggauggcuggcugccuuaaacacaaucaauuucaaagcuccauuucauaaaggggcu

SEQ ID NO: 300746 - RNA, 64 nt, hsa
auugaaauguuugauauggcaagauagguaugguaauuucaaagugaauugggaauuccucugg

SEQ ID NO: 300747 - RNA, 64 nt, hsa
guauucuugagauacaaaaaaaaaaaguaaauacaauuucaaaaaaaaaguuccggaucuguuu

SEQ ID NO: 300748 - RNA, 64 nt, hsa
uuccugcacuucgagaagaaucaaaauguuccugaauuucaaauaccucaugcaaaaugucucc

SEQ ID NO: 300749 - RNA, 64 nt, hsa
uacaauguacaauuguuucauuucagaaaauaaaaauuucaaaucaugaauaccuugugguuuu

SEQ ID NO: 300750 - RNA, 64 nt, hsa
auaucacauccucuugaaaaugaauugucuacaaaauuucaaaugcaaaguauuacagccaaau

SEQ ID NO: 300751 - RNA, 64 nt, hsa
aacuaugagucucuaaaucucucuguaagaaaaaaauuucaaaguaaagauuuuacucuugcaa

SEQ ID NO: 300752 - RNA, 64 nt, hsa
ucauuuucuccuuuuuucggaauugaaacauuuuaauuucaaauucaaauagaacauuuaaaau

SEQ ID NO: 300753 - RNA, 64 nt, hsa
auauuuagaaaauaauaaugaaaagcauccccaaaauuucaaugaugugaauuuuuaaauuacc

SEQ ID NO: 300754 - RNA, 64 nt, hsa
cagauauuacuaauuucaaucuggaaaaagaucgaauuucaaaagaauccggcaaaguuuuuga

SEQ ID NO: 300755 - RNA, 64 nt, hsa
cagugaugaugaagaaacuucuacagauauuacuaauuucaaucuggaaaaagguuagacauuu

SEQ ID NO: 300756 - RNA, 64 nt, hsa
ugucauuaccagcaucugaauuucaaguucuuaaaauuucaaaaauuaaaauuuuucauuauua

SEQ ID NO: 300757 - RNA, 64 nt, hsa
cucuuuuuuauucuggugucauuaccagcaucugaauuucaaguucuuaaaauuucaaaaauua

SEQ ID NO: 300758 - RNA, 64 nt, hsa
gaaguuauaacuuugcuacccuggauucugaugcaauuucaauauaaaaaguuguuccuuucau

SEQ ID NO: 300759 - RNA, 64 nt, hsa
uuccuuccccaccaaaauugggauuguucuaaacaauuucaauuuaauucauugucaacaaaac

SEQ ID NO: 300760 - RNA, 64 nt, hsa
guguucagccacugagggacaaaacuuagcaucuaauuucaauuauagugucaugcagaguauu

SEQ ID NO: 300761 - RNA, 64 nt, hsa
gcucuggucuauaccuuaagaaugccaaagaaugaauuucaacgccugccuuuggcacucugac

SEQ ID NO: 300762 - RNA, 64 nt, hsa
ccuuucuggggagauaguccauaauguucugcuaaauuucaaaugggcucgugacccaaaaaag

SEQ ID NO: 300763 - RNA, 64 nt, hsa; identical to SEQ ID NO: 165047

SEQ ID NO: 300764 - RNA, 64 nt, hsa; identical to SEQ ID NO: 165048

SEQ ID NO: 300765 - RNA, 64 nt, hsa; identical to SEQ ID NO: 165049

SEQ ID NO: 300766 - RNA, 64 nt, hsa; identical to SEQ ID NO: 165050

SEQ ID NO: 300767 - RNA, 64 nt, hsa; identical to SEQ ID NO: 165051

SEQ ID NO: 300768 - RNA, 64 nt, hsa; identical to SEQ ID NO: 165052

SEQ ID NO: 300769 - RNA, 64 nt, hsa; identical to SEQ ID NO: 165053

SEQ ID NO: 300770 - RNA, 64 nt, hsa; identical to SEQ ID NO: 165054

SEQ ID NO: 300771 - RNA, 64 nt, hsa; identical to SEQ ID NO: 165055

SEQ ID NO: 300772 - RNA, 64 nt, hsa; identical to SEQ ID NO: 165056

SEQ ID NO: 300773 - RNA, 64 nt, hsa; identical to SEQ ID NO: 165057

SEQ ID NO: 300774 - RNA, 64 nt, hsa; identical to SEQ ID NO: 165058

SEQ ID NO: 300775 - RNA, 64 nt, hsa; identical to SEQ ID NO: 165059

SEQ ID NO: 300776 - RNA, 64 nt, hsa; identical to SEQ ID NO: 165060

SEQ ID NO: 300777 - RNA, 64 nt, hsa; identical to SEQ ID NO: 165061

SEQ ID NO: 300778 - RNA, 64 nt, hsa; identical to SEQ ID NO: 165062

SEQ ID NO: 300779 - RNA, 63 nt, hsa
cuauccuuccaagucccggguagcagaaggguugccauagaucucaguuugaucaaaaagaag

SEQ ID NO: 300780 - RNA, 63 nt, hsa
aaacauuucgauuuuccuucaucugugacuggugccauagacacagguuuauaguuuuaacuu

SEQ ID NO: 300781 - RNA, 63 nt, hsa
acacuucugcuuugagaccaggaugggguguaagccauagaguaagguuaacaaaaagaauaa

SEQ ID NO: 300782 - RNA, 63 nt, hsa
ucugcucgcuguucucccguuguuuuugccucugccauagagcucaccucauuuugccuugua

SEQ ID NO: 300783 - RNA, 63 nt, hsa
aucagaacugcagccccuggaaaagaagagacagccauagacgaggagccagagugggggcag

SEQ ID NO: 300784 - RNA, 63 nt, hsa
cccugaagagccuguccaugucauuuuccuacugccauagauacccuaagcccagggccccuu

SEQ ID NO: 300785 - RNA, 63 nt, hsa
acacaccaaacaagauguuucacuggguacucugccauagaaauggcagauuaagaagauuga

SEQ ID NO: 300786 - RNA, 63 nt, hsa
accuuuuuauuugguuagagugauauguauuuagccauagauggagaaacaaagcucaggguu

SEQ ID NO: 300787 - RNA, 63 nt, hsa
aauguaaauagaggucuguaaagaaaaauaauugccauagaaaguauaauuucagugcaguaa

SEQ ID NO: 300788 - RNA, 63 nt, hsa
cauaucuggaagggcacuauauuuuugggaggagccauagauuccugguuauccuauuuuuaa

SEQ ID NO: 300789 - RNA, 64 nt, hsa
gaacuaaccuaccccaacucugcccuucucccauccaagagaaaccagcaaaaugauaaagaag

SEQ ID NO: 300790 - RNA, 64 nt, hsa
gaaaauuaauuucaguuucuauugggaguuuauaccaagagauucuucuagaucucauugaucc

SEQ ID NO: 300791 - RNA, 64 nt, hsa
cagcacuucccaaagugcacugaggaagguggccccaagagaagcucucuaaacaaaggaguac

SEQ ID NO: 300792 - RNA, 64 nt, hsa
uacagcaguuuuugucaggggaacauaaaaauauccaagagagguuagggcuuagauuuaaaag

SEQ ID NO: 300793 - RNA, 64 nt, hsa
auguucaugaauaucaaaucuuuugaugcuggacccaagagaggaaaaguuguagcuaaauguu

SEQ ID NO: 300794 - RNA, 64 nt, hsa
uguucacauaccauccaagaggcacauaggcuacccaagagagccuuggauucagugguacacu

SEQ ID NO: 300795 - RNA, 64 nt, hsa
caaauuuguucuuccugauaugauaacuaggucuccaagagaaaauagaaaggcugcuuuagug

SEQ ID NO: 300796 - RNA, 64 nt, hsa
gaccuccaguucucccugaugacaguagcugucuccaagagaaaaauccucacuuauuaacucu

SEQ ID NO: 300797 - RNA, 64 nt, hsa
uggaaaucuucucgcuccagcaagcucgaccaugccaagagacuggccgggacaagauaaacgg

SEQ ID NO: 300798 - RNA, 64 nt, hsa
ccuauggcggcccugagugugaguaucccugccaccaagagagcaaugggcagggaaggaaggg

SEQ ID NO: 300799 - RNA, 64 nt, hsa
auagaagaacauccaaggagaaacagagacaggcccaagagaugaagagugagagggcaugcgc

SEQ ID NO: 300800 - RNA, 64 nt, hsa
gaugaagagugagagggcaugcgcacaaggcugaccaagagagaaagaaguaggcaugagggau

SEQ ID NO: 300801 - RNA, 64 nt, hsa
auaucccagcuuuaaaaagaaaaaaaaagaauuaccaagagaaggggacuucucuuccaguuuc

SEQ ID NO: 300802 - RNA, 64 nt, hsa
ggguuucuuuuuucuuucuuccuuucuuccuuggccaagagaagggcuuacaggcauggacaug

SEQ ID NO: 300803 - RNA, 64 nt, hsa
ucugcaguccaggucucccuucucccacuugccuacccucaaugccacacuguuuuugaagugg

SEQ ID NO: 300804 - RNA, 64 nt, hsa
uccccacuuuauuaguuaauuuaaauuggaaaaaacccucaaacuaauauucuugucuguucca

SEQ ID NO: 300805 - RNA, 64 nt, hsa
cuaguuuugaaucuguucugaauggaguuuuuauacccucaauuucuggccuuuggcuauuuua

SEQ ID NO: 300806 - RNA, 64 nt, hsa
ugagagcaguccucucacccuaccacaguuccacacccucaagguaaacuuauaacuuauaauu

SEQ ID NO: 300807 - RNA, 64 nt, hsa
uuaaaccuguuaaauuaauuuugacaaauaaguuacccucaacucagaucaaaaaugggcagcc

SEQ ID NO: 300808 - RNA, 64 nt, hsa
ugucgaucuuagauugccacugcuuucauugaagacccucaaugccaagaaacgugucccuggc

SEQ ID NO: 300809 - RNA, 64 nt, hsa
gagagaucaccggcguucuguugauuccagaaauacccucaaugaucuccugaagcaucugaau

SEQ ID NO: 300810 - RNA, 64 nt, hsa
uuguaucuuuuuuaaugguacggcauaaaaaguaacccucaagugaagugucucuauacuguuu

SEQ ID NO: 300811 - RNA, 64 nt, hsa
ggacauuaccaccaaccccacagaaauacgaaaaacccucaaagauuacuauaaacaccuguau

SEQ ID NO: 300812 - RNA, 64 nt, hsa
uuuuaauaaaauucaacaucccuucauuuuaaaaacccucaacaaauuacacauugagggaaca

SEQ ID NO: 300813 - RNA, 64 nt, hsa
ccucaccuugcugcuccccugcccuaaguccccaacccucaacuugaaaccccauucccuuaag

SEQ ID NO: 300814 - RNA, 64 nt, hsa
ucacuccaucccucuccuaccccucccucccccaacccucaauguauaaauugcuucuugaugc

SEQ ID NO: 300815 - RNA, 64 nt, hsa; identical to SEQ ID NO: 198310

SEQ ID NO: 300816 - RNA, 64 nt, hsa; identical to SEQ ID NO: 198311

SEQ ID NO: 300817 - RNA, 64 nt, hsa; identical to SEQ ID NO: 198312

SEQ ID NO: 300818 - RNA, 64 nt, hsa; identical to SEQ ID NO: 198313

SEQ ID NO: 300819 - RNA, 64 nt, hsa; identical to SEQ ID NO: 198314

SEQ ID NO: 300820 - RNA, 64 nt, hsa; identical to SEQ ID NO: 198315

SEQ ID NO: 300821 - RNA, 64 nt, hsa; identical to SEQ ID NO: 198316

SEQ ID NO: 300822 - RNA, 64 nt, hsa; identical to SEQ ID NO: 198317

SEQ ID NO: 300823 - RNA, 64 nt, hsa; identical to SEQ ID NO: 198318

SEQ ID NO: 300824 - RNA, 64 nt, hsa; identical to SEQ ID NO: 198319

SEQ ID NO: 300825 - RNA, 64 nt, hsa; identical to SEQ ID NO: 198320

SEQ ID NO: 300826 - RNA, 64 nt, hsa; identical to SEQ ID NO: 198321

SEQ ID NO: 300827 - RNA, 64 nt, hsa; identical to SEQ ID NO: 198322

SEQ ID NO: 300828 - RNA, 64 nt, hsa; identical to SEQ ID NO: 198323

SEQ ID NO: 300829 - RNA, 64 nt, hsa; identical to SEQ ID NO: 198324

SEQ ID NO: 300830 - RNA, 64 nt, hsa; identical to SEQ ID NO: 198325

SEQ ID NO: 300831 - RNA, 64 nt, hsa; identical to SEQ ID NO: 198326

SEQ ID NO: 300832 - RNA, 64 nt, hsa; identical to SEQ ID NO: 198327

SEQ ID NO: 300833 - RNA, 64 nt, hsa; identical to SEQ ID NO: 198328

SEQ ID NO: 300834 - RNA, 64 nt, hsa; identical to SEQ ID NO: 198329

SEQ ID NO: 300835 - RNA, 64 nt, hsa; identical to SEQ ID NO: 198330

SEQ ID NO: 300836 - RNA, 64 nt, hsa; identical to SEQ ID NO: 198331

SEQ ID NO: 300837 - RNA, 64 nt, hsa
uugcauaaaagcagagguuugggggcucagaugggacaagaagccgccucuggacuaucucccc

SEQ ID NO: 300838 - RNA, 64 nt, hsa
ggaugcugcuggcuagagaugaggcuuuaccucagacaagaagagcuggcaccaaaacuagcca

SEQ ID NO: 300839 - RNA, 64 nt, hsa
ccuggccucccaggccaccaaggacggcaagaaggacaagaaggaggaagacaagaagugagac

SEQ ID NO: 300840 - RNA, 64 nt, hsa
caccaaggacggcaagaaggacaagaaggaggaagacaagaagugagacuggagggaaagggua

SEQ ID NO: 300841 - RNA, 64 nt, hsa
uugaucaauuuuaacuacauaaaaauguuuauaggacaagaaaaaccccaccauaacccaaggc

SEQ ID NO: 300842 - RNA, 64 nt, hsa
augccuguaacuccagcuacucgggagacugaaggacaagaaucacuugaaccugggaagccga

SEQ ID NO: 300843 - RNA, 64 nt, hsa
gucuuuggccauugugggaagucauuauucuggagacaagaaaaucaucacucuggugccuugg

SEQ ID NO: 300844 - RNA, 64 nt, hsa
aagcugacuuuucuugccagaaaguuuuccuugugacaagaaauuugcaagcuuuucaaucuca

SEQ ID NO: 300845 - RNA, 64 nt, hsa
aacugauucuaaccagaaguccgcaaguacuguggacaagaaugcuuaaccaugcugcuucagc

SEQ ID NO: 300846 - RNA, 64 nt, hsa
gacagggaugaggguccaaggaauaagcaugaaugacaagaaaacaagggaaagaguuaaccug

SEQ ID NO: 300847 - RNA, 64 nt, hsa
uuauccuuaugaccucaucacccucagacuuuaagacaagaagccaccaucaaaacaaaggaug

SEQ ID NO: 300848 - RNA, 64 nt, hsa
uccuacuuuuuagacaggacagauacucucaacagacaagaaaaaagauuuagcuuaucacaag

SEQ ID NO: 300849 - RNA, 64 nt, hsa
uauguguaaguccucaucaaaugaaaagcagaaagacaagaacaauuagucaagagcaguagcc

SEQ ID NO: 300850 - RNA, 64 nt, hsa
acgugaguuucuuaugugcccuuaaagacuguuagacaagaaaagcauucacuggcuaauaauc

SEQ ID NO: 300851 - RNA, 64 nt, hsa
ucuccagugacaguguccugugacugcaaaaggggacaagaaaaucccucuuccuccaugggau

SEQ ID NO: 300852 - RNA, 64 nt, hsa
cauauaggcccguccacacaggcuugacuggguggacaagaaugaacccaugacagcaccugcu

SEQ ID NO: 300853 - RNA, 64 nt, hsa
gcucacacacaguucagauuuccaccucuuuauagacaagaagugaauuugccuggggcagaac

SEQ ID NO: 300854 - RNA, 64 nt, hsa
gaaggaagaagaaaaaaggauccuugauguuugugacaagaaaaugagaaaguuaguaucugca

SEQ ID NO: 300855 - RNA, 64 nt, hsa; identical to SEQ ID NO: 54296

SEQ ID NO: 300856 - RNA, 64 nt, hsa; identical to SEQ ID NO: 54297

SEQ ID NO: 300857 - RNA, 64 nt, hsa; identical to SEQ ID NO: 54298

SEQ ID NO: 300858 - RNA, 64 nt, hsa; identical to SEQ ID NO: 54299

SEQ ID NO: 300859 - RNA, 64 nt, hsa; identical to SEQ ID NO: 54300

SEQ ID NO: 300860 - RNA, 64 nt, hsa; identical to SEQ ID NO: 54301

SEQ ID NO: 300861 - RNA, 64 nt, hsa; identical to SEQ ID NO: 54302

SEQ ID NO: 300862 - RNA, 64 nt, hsa; identical to SEQ ID NO: 54303

SEQ ID NO: 300863 - RNA, 64 nt, hsa; identical to SEQ ID NO: 54304

SEQ ID NO: 300864 - RNA, 64 nt, hsa; identical to SEQ ID NO: 54305

SEQ ID NO: 300865 - RNA, 64 nt, hsa; identical to SEQ ID NO: 54306

SEQ ID NO: 300866 - RNA, 64 nt, hsa; identical to SEQ ID NO: 54307

SEQ ID NO: 300867 - RNA, 64 nt, hsa; identical to SEQ ID NO: 54308

SEQ ID NO: 300868 - RNA, 64 nt, hsa; identical to SEQ ID NO: 54309

SEQ ID NO: 300869 - RNA, 64 nt, hsa; identical to SEQ ID NO: 54310

SEQ ID NO: 300870 - RNA, 64 nt, hsa; identical to SEQ ID NO: 54311

SEQ ID NO: 300871 - RNA, 64 nt, hsa; identical to SEQ ID NO: 54312

SEQ ID NO: 300872 - RNA, 64 nt, hsa; identical to SEQ ID NO: 54313

SEQ ID NO: 300873 - RNA, 64 nt, hsa; identical to SEQ ID NO: 54314

SEQ ID NO: 300874 - RNA, 64 nt, hsa; identical to SEQ ID NO: 54315

SEQ ID NO: 300875 - RNA, 64 nt, hsa; identical to SEQ ID NO: 54316

SEQ ID NO: 300876 - RNA, 64 nt, hsa; identical to SEQ ID NO: 54317

SEQ ID NO: 300877 - RNA, 64 nt, hsa; identical to SEQ ID NO: 54318

SEQ ID NO: 300878 - RNA, 64 nt, hsa; identical to SEQ ID NO: 54319

SEQ ID NO: 300879 - RNA, 64 nt, hsa; identical to SEQ ID NO: 54320

SEQ ID NO: 300880 - RNA, 64 nt, hsa; identical to SEQ ID NO: 54321

SEQ ID NO: 300881 - RNA, 64 nt, hsa; identical to SEQ ID NO: 54322

SEQ ID NO: 300882 - RNA, 64 nt, hsa; identical to SEQ ID NO: 54323

SEQ ID NO: 300883 - RNA, 64 nt, hsa; identical to SEQ ID NO: 54324

SEQ ID NO: 300884 - RNA, 64 nt, hsa; identical to SEQ ID NO: 54324

SEQ ID NO: 300885 - RNA, 64 nt, hsa; identical to SEQ ID NO: 54326

SEQ ID NO: 300886 - RNA, 64 nt, hsa; identical to SEQ ID NO: 54327

SEQ ID NO: 300887 - RNA, 64 nt, hsa; identical to SEQ ID NO: 250961

SEQ ID NO: 300888 - RNA, 64 nt, hsa; identical to SEQ ID NO: 250962

SEQ ID NO: 300889 - RNA, 64 nt, hsa; identical to SEQ ID NO: 250963

SEQ ID NO: 300890 - RNA, 64 nt, hsa; identical to SEQ ID NO: 250964

SEQ ID NO: 300891 - RNA, 64 nt, hsa; identical to SEQ ID NO: 250965

SEQ ID NO: 300892 - RNA, 64 nt, hsa; identical to SEQ ID NO: 250966

SEQ ID NO: 300893 - RNA, 64 nt, hsa; identical to SEQ ID NO: 250967

SEQ ID NO: 300894 - RNA, 64 nt, hsa; identical to SEQ ID NO: 250968

SEQ ID NO: 300895 - RNA, 64 nt, hsa; identical to SEQ ID NO: 250969

SEQ ID NO: 300896 - RNA, 64 nt, hsa; identical to SEQ ID NO: 250970

SEQ ID NO: 300897 - RNA, 64 nt, hsa; identical to SEQ ID NO: 250971

SEQ ID NO: 300898 - RNA, 64 nt, hsa; identical to SEQ ID NO: 250972

SEQ ID NO: 300899 - RNA, 64 nt, hsa; identical to SEQ ID NO: 250973

SEQ ID NO: 300900 - RNA, 64 nt, hsa; identical to SEQ ID NO: 250974

SEQ ID NO: 300901 - RNA, 64 nt, hsa; identical to SEQ ID NO: 250975

SEQ ID NO: 300902 - RNA, 64 nt, hsa; identical to SEQ ID NO: 250976

SEQ ID NO: 300903 - RNA, 64 nt, hsa; identical to SEQ ID NO: 250977

SEQ ID NO: 300904 - RNA, 64 nt, hsa; identical to SEQ ID NO: 250978

SEQ ID NO: 300905 - RNA, 64 nt, hsa; identical to SEQ ID NO: 250979

SEQ ID NO: 300906 - RNA, 64 nt, hsa; identical to SEQ ID NO: 250980

SEQ ID NO: 300907 - RNA, 64 nt, hsa; identical to SEQ ID NO: 250981

SEQ ID NO: 300908 - RNA, 64 nt, hsa; identical to SEQ ID NO: 250982

SEQ ID NO: 300909 - RNA, 64 nt, hsa; identical to SEQ ID NO: 250983

SEQ ID NO: 300910 - RNA, 64 nt, hsa; identical to SEQ ID NO: 250984

SEQ ID NO: 300911 - RNA, 64 nt, hsa; identical to SEQ ID NO: 250985

SEQ ID NO: 300912 - RNA, 64 nt, hsa; identical to SEQ ID NO: 250986

SEQ ID NO: 300913 - RNA, 64 nt, hsa
ugagaaggcacaccguaagacuaaguaggaaaaauccaaguaaggaguguuucugagacuuuga

SEQ ID NO: 300914 - RNA, 64 nt, hsa
cuuucuuggcccucaguuugcaguauacacacuuuccaaguacucuuguagcauccuguuugua

SEQ ID NO: 300915 - RNA, 64 nt, hsa
gaaucaaacaaaaggaaauguuguggaauauuuuuccaaguaguuuugguucacuauucacagg

SEQ ID NO: 300916 - RNA, 64 nt, hsa
aaaacaguaaaugaacaaaaacaucaacauggaguccaaguaaugaauuuauagaggaaaaugu

SEQ ID NO: 300917 - RNA, 64 nt, hsa
agaacguuguggauugagagagacacuacaugacuccaaguauaugagaaaaggacagagcucu

SEQ ID NO: 300918 - RNA, 64 nt, hsa
ccuacuuaggaaaaaaaggguagcacuuauucauuccaaguacuuuuuuuuuuuuaauuuuuaa

SEQ ID NO: 300919 - RNA, 64 nt, hsa
gagcuccuucccucuagcaauuucuacuaaaauguccaaguagaauguuuccuuuuacaaucaa

SEQ ID NO: 300920 - RNA, 64 nt, hsa
guccaguucuccuccugugcuaucuucucuucuauccaaguagaauguacgccaggagcuccuu

SEQ ID NO: 300921 - RNA, 64 nt, hsa
uucuuggaguucuuuggcuucuggacaaaucuuguccaaguauugcagacagcaaucuucacuc

SEQ ID NO: 300922 - RNA, 64 nt, hsa
ggagacccuuaauuauguuuacaaagacccauguuccaaguaaguuuguauucacaugaucuga

SEQ ID NO: 300923 - RNA, 64 nt, hsa
uuuaucuguucaaaggagcaagaacuuucauauaggaauagaaacaugcuggccgaagauuuca

SEQ ID NO: 300924 - RNA, 64 nt, hsa
uauuuggcaacuacugggacucuucagcacaaaaggaauagaucuaugauugacccugauuuua

SEQ ID NO: 300925 - RNA, 64 nt, hsa
aaaucaaaaggcugccucuauuacaauccucaguggaauagauggcuaucuuucuuggcuaaca

SEQ ID NO: 300926 - RNA, 64 nt, hsa
uuuuaaagcugugacauuuaucuaccugguuuauggaauagaauuuauugcugaaucaugcucc

SEQ ID NO: 300927 - RNA, 64 nt, hsa
ucuccuggccaaggcucugaccaugcuuaguacuggaauagagguggccaggcccccagcgacu

SEQ ID NO: 300928 - RNA, 64 nt, hsa
uccagucaguuuuuaagcaaggcauggggaacagggaauagaaccuuucaaagagguugcccag

SEQ ID NO: 300929 - RNA, 64 nt, hsa
aauuuguguucauaaguucagauggguagcaaauggaauagaacuuacuuaaaaauuggggaga

SEQ ID NO: 300930 - RNA, 64 nt, hsa
uuugauguuauuguugggacuuaagaacauuuuuggaauagauauugaacuguaauaauguuuu

SEQ ID NO: 300931 - RNA, 64 nt, hsa
aguauagccagagaaaacaaggauggagaaaaaucuaggacagugucuucucggaaaaaaccag

SEQ ID NO: 300932 - RNA, 64 nt, hsa
gguauagccagagaaaacaaggauggagaaaaaucuaggacagugucuucugagaaaccaccag

SEQ ID NO: 300933 - RNA, 64 nt, hsa
ugauuuccccaugcucugcauuucuaggauauuucuaggacaccuggauuggcuccaucacauc

SEQ ID NO: 300934 - RNA, 64 nt, hsa
cuuggcuucagccagcccccagccagaguccuggcuaggacagugaccugaucuccuccucaug

SEQ ID NO: 300935 - RNA, 62 nt, hsa
ggacuucguugguuuuuuggagucuugguugugacuccaagagcagagugaggaagaccccc

SEQ ID NO: 300936 - RNA, 62 nt, hsa
gggacuuuguuggcuuuuagaguguuggucaugacuccaagagcagagcagggaagagccca

SEQ ID NO: 300937 - RNA, 64 nt, hsa
gcugcuucucucguaagggucuuggggagaaguaagcccgcagccugccucugcaccucguucc

SEQ ID NO: 300938 - RNA, 64 nt, hsa
ccacccuguccggaggcgggcgugagacaagcccagcccgcacgcgcucaucuuucuucguuuu

SEQ ID NO: 300939 - RNA, 64 nt, hsa
caagccccccgagugaggacgcaccgccgccaccagcccgcaacucuccagccgaagcugcagg

SEQ ID NO: 300940 - RNA, 64 nt, hsa
cucccagcucucuugcacugcaggcccuggggccagcccgcacacaccaugccuccugucucaa

SEQ ID NO: 300941 - RNA, 64 nt, hsa
cauggcccucgcucugucuaugcaggggccccaaagcccgcacuuuguccgugugucuuagccc

SEQ ID NO: 300942 - RNA, 64 nt, hsa
ccaagcgagguggaccccgaaacggacggcccggagcccgcaccagccccgcgccuacccgggc

SEQ ID NO: 300943 - RNA, 64 nt, hsa
ggagcugcucuaaggcgccugcagaggcgagcagagcccgcagcccacgccuucucgaccgcgc

SEQ ID NO: 300944 - RNA, 64 nt, hsa
uccagaacacgccggagauugcugcugcuuucugagcccgcaccugugcgccuaaacugcugau

SEQ ID NO: 300945 - RNA, 64 nt, hsa
aaaaaaaaagcacauaacuuuuaacacuagaaucagcccgcaagaugcuugccccgcuaguggc

SEQ ID NO: 300946 - RNA, 64 nt, hsa
gucuaaaauaaucgcuaguguuaugucaaaguuaagcccgcacgccaggcccaguuaaugcuag

SEQ ID NO: 300947 - RNA, 64 nt, hsa
gaaagcgcugagcugagggacgaggaagagcuggagcccgcagaagccguccacagcccugccu

SEQ ID NO: 300948 - RNA, 64 nt, hsa
guaugacaguauuauacgcuggcaacacagaggcagcccgcacaccugcgccuggguguugaga

SEQ ID NO: 300949 - RNA, 64 nt, hsa
aggauccuggccugagaauugaggggagguggccagcccgcagagguggggugcuggggcugca

SEQ ID NO: 300950 - RNA, 64 nt, hsa
uuuucucuuuuugccaaaauuaacuguuuggugaagcccgcaaaaccuccucgcuuugcaugca

SEQ ID NO: 300951 - RNA, 64 nt, hsa
gccacccggaaugugaagggcgcuccgggcucugagcccgcagcuuuuacgacuucucccugcc

SEQ ID NO: 300952 - RNA, 64 nt, hsa
aaaggacacggcucagcaagggggacauugcccaagcccgcaagcuuuacaagugcccagguca

SEQ ID NO: 300953 - RNA, 64 nt, hsa
agacgaggagcuggacugggccuuggcuucccugagcccgcacuccaaccagcagcuggauucc

SEQ ID NO: 300954 - RNA, 64 nt, hsa
caguauccgagucucgugcagugcugcguagguuagcccgcaucgugcagacaaccucaguccu

SEQ ID NO: 300955 - RNA, 64 nt, hsa
uccccgccgggucccaccuugccuuuugaagaagagcccgcauaaugaguggacggcagacagc

SEQ ID NO: 300956 - RNA, 64 nt, hsa
caggccuuggggacaaccuuggcuuggcccuggcagcccgcaucagcugcucagaucccacuuu

SEQ ID NO: 300957 - RNA, 64 nt, hsa
ccaagguugggacccaaggaucggggggcccagcagcccgcaccgaucgagccggacucucggc

SEQ ID NO: 300958 - RNA, 64 nt, hsa
cuuccugcccauauauuauaccaguugcuucugcagcccgcagaugccagcgaugccaggaaac

SEQ ID NO: 300959 - RNA, 64 nt, hsa
uuuagucccucagcuugauaaagagugaguuuggagcccgcauugggcuggcccacuggguugc

SEQ ID NO: 300960 - RNA, 64 nt, hsa
ucagaugggaaaucugccuaugucauaccgugacagcccgcaggaucaggugacuucuagcaga

SEQ ID NO: 300961 - RNA, 64 nt, hsa
guaacuuauguucaaugugccaacaccaguggggagcccgcaggccuauguggcagcgucacca

SEQ ID NO: 300962 - RNA, 64 nt, hsa
uugucuuuaaacaacccuaaauacacgucuguuuagcccgcaauuggaaaggauauauguggca

SEQ ID NO: 300963 - RNA, 64 nt, hsa
agaaggugaaaccagguuaucugggaaucuuuccagcccgcaggucgccacggccaucccuuug

SEQ ID NO: 300964 - RNA, 64 nt, hsa
gaccccaagcccgcggaggcaccgaugcccgcagagcccgcaccccccggcccugccuccccag

SEQ ID NO: 300965 - RNA, 54 nt, hsa
uggagaacuacugcaacuagacgcagcccgcaggcagccccacacccgccgccu

SEQ ID NO: 300966 - RNA, 64 nt, hsa
uuucaccccccuccccaacaaagaguuauuaaagagcccgcaugcauuuguggcuccacaauua

SEQ ID NO: 300967 - RNA, 64 nt, hsa
ccuugacugcgcucuccugugacgaugccacugcagcccgcaccuugucacugcugggccaaga

SEQ ID NO: 300968 - RNA, 64 nt, hsa
ugagugaaggauuuccacguagacaccuaggaagagcccgcaugcccuagacucacuccagagg

SEQ ID NO: 300969 - RNA, 64 nt, hsa
auuguguuuuccuuguuuucagcccccccacuccagcccgcagcacauuuccgcuguccgucag

SEQ ID NO: 300970 - RNA, 64 nt, hsa
agggaucuugucaggguuccuuacugaccagaggagcccgcagcaaucuccacagccuccuggg

SEQ ID NO: 300971 - RNA, 64 nt, hsa
gccaucaggagacuugaguugguauuuggaccugagcccgcacauuccacucccauucucccuc

SEQ ID NO: 300972 - RNA, 64 nt, hsa
gaguucaccuuggaagggcguucuagguaggaagagcccgcagggccaugcagaccucaugccc

SEQ ID NO: 300973 - RNA, 59 nt, hsa
uaaaggauuucuuccucugaggacaccaaagcccgcaguggacugaugccuucgauggg

SEQ ID NO: 300974 - RNA, 64 nt, hsa
gucgugcuuuguuuuuggaagaucugguaacagcagcccgcauuagcagagagcuguagcugag

SEQ ID NO: 300975 - RNA, 64 nt, hsa
gggcugaggauggagccgcccccagccgacuccaagcccgcagagggcagacgccacccuggac

SEQ ID NO: 300976 - RNA, 64 nt, hsa
ugccccugagaacuucguggugacugccuuugggagcccgcagguggccagaggcagggguagc

SEQ ID NO: 300977 - RNA, 64 nt, hsa
gugcugguuucucauauugucuguaggcucacucagcccgcaguuuaugugugugcuuuuuucu

SEQ ID NO: 300978 - RNA, 64 nt, hsa
gagaacaggugguguggcaggcgagcgggugggcagcccgcaucauccagcacgagauggacca

SEQ ID NO: 300979 - RNA, 64 nt, hsa
gagugccccaccugccacuaggcugggugcccacagcccgcaugcagcagcuugcugcacccca

SEQ ID NO: 300980 - RNA, 64 nt, hsa
uuccgacaaccgaugcuccagccaaccccuguggagcccgcacccccacccuuuggggggggcc

SEQ ID NO: 300981 - RNA, 64 nt, hsa
cccccgaccccucccagauccuggggaccaauaaagcccgcagcgggucucggcuggcguccug

SEQ ID NO: 300982 - RNA, 64 nt, hsa
cgcuuuccaggagccccaggcccggaggaggcgaagcccgcagagcaaagguggaaacacgugc

SEQ ID NO: 300983 - RNA, 64 nt, hsa
gagagggccaaggacaauugggagggcagcaggcagcccgcagaugguggccauguggcacgcu

SEQ ID NO: 300984 - RNA, 64 nt, hsa
cuuucccccgaccuaaacauaaaagacaaggcaaagcccgcauaauuuuaagacgguucuuuag

SEQ ID NO: 300985 - RNA, 64 nt, hsa
acacaugggaugggggaggcagagacugguccagagcccgcaaauggacucggagccgagggcc

SEQ ID NO: 300986 - RNA, 64 nt, hsa
cgaugugacguugacaauuacuggaucugcaaaaagcccgcagccugcuucagagacgaauagu

SEQ ID NO: 300987 - RNA, 64 nt, hsa
cgggcccggggccuuggcuggcaaauaaagcguuagcccgcagcgcgacugugucuguguccca

SEQ ID NO: 300988 - RNA, 64 nt, hsa
cccagaccaagcugaaucacgcuuucuccaagacagcccgcaggcuaagugcauuccuuccccu

SEQ ID NO: 300989 - RNA, 64 nt, hsa
aggggcacaggacccugcccucguguucccucccagcccgcaguauuucagggacaggcucuuc

SEQ ID NO: 300990 - RNA, 64 nt, hsa
acacccugcgagaccuggagcguagggcccagcuagcccgcaccuggauuuccaccguucagag

SEQ ID NO: 300991 - RNA, 64 nt, hsa
gcacuuugggaggccaaggcaggaagaucacuugagcccgcaaguuugagaccacccugggcaa

SEQ ID NO: 300992 - RNA, 64 nt, hsa
augacuaggcguggaccugcccauggugccugucagcccgcagagcccaucuacgcccaacaca

SEQ ID NO: 300993 - RNA, 64 nt, hsa
agcugagcaccgugccgggagguggccaagguacagcccgcaaugggccuguaaauaguccggc

SEQ ID NO: 300994 - RNA, 64 nt, hsa
acaaccccgaugcccugcccgagacgcuggucugagcccgcacccagccgagcccccccugccc

SEQ ID NO: 300995 - RNA, 64 nt, hsa; identical to SEQ ID NO: 245168

SEQ ID NO: 300996 - RNA, 64 nt, hsa; identical to SEQ ID NO: 245169

SEQ ID NO: 300997 - RNA, 64 nt, hsa; identical to SEQ ID NO: 245170

SEQ ID NO: 300998 - RNA, 64 nt, hsa; identical to SEQ ID NO: 245171

SEQ ID NO: 300999 - RNA, 64 nt, hsa; identical to SEQ ID NO: 245172

SEQ ID NO: 301000 - RNA, 55 nt, hsa; identical to SEQ ID NO: 245173

SEQ ID NO: 301001 - RNA, 64 nt, hsa; identical to SEQ ID NO: 245174

SEQ ID NO: 301002 - RNA, 64 nt, hsa; identical to SEQ ID NO: 245175

SEQ ID NO: 301003 - RNA, 64 nt, hsa; identical to SEQ ID NO: 245176

SEQ ID NO: 301004 - RNA, 64 nt, hsa; identical to SEQ ID NO: 245177

SEQ ID NO: 301005 - RNA, 64 nt, hsa; identical to SEQ ID NO: 245178

SEQ ID NO: 301006 - RNA, 64 nt, hsa; identical to SEQ ID NO: 245179

SEQ ID NO: 301007 - RNA, 64 nt, hsa; identical to SEQ ID NO: 245180

SEQ ID NO: 301008 - RNA, 64 nt, hsa; identical to SEQ ID NO: 245181

SEQ ID NO: 301009 - RNA, 64 nt, hsa; identical to SEQ ID NO: 245182

SEQ ID NO: 301010 - RNA, 64 nt, hsa; identical to SEQ ID NO: 245183

SEQ ID NO: 301011 - RNA, 64 nt, hsa; identical to SEQ ID NO: 245184

SEQ ID NO: 301012 - RNA, 64 nt, hsa; identical to SEQ ID NO: 245185

SEQ ID NO: 301013 - RNA, 64 nt, hsa; identical to SEQ ID NO: 245186

SEQ ID NO: 301014 - RNA, 64 nt, hsa; identical to SEQ ID NO: 245187

SEQ ID NO: 301015 - RNA, 64 nt, hsa; identical to SEQ ID NO: 245188

SEQ ID NO: 301016 - RNA, 62 nt, hsa; identical to SEQ ID NO: 245189

SEQ ID NO: 301017 - RNA, 64 nt, hsa; identical to SEQ ID NO: 245190

SEQ ID NO: 301018 - RNA, 64 nt, hsa; identical to SEQ ID NO: 245191

SEQ ID NO: 301019 - RNA, 64 nt, hsa; identical to SEQ ID NO: 245192

SEQ ID NO: 301020 - RNA, 64 nt, hsa; identical to SEQ ID NO: 245193

SEQ ID NO: 301021 - RNA, 64 nt, hsa; identical to SEQ ID NO: 245194

SEQ ID NO: 301022 - RNA, 64 nt, hsa; identical to SEQ ID NO: 245195

SEQ ID NO: 301023 - RNA, 64 nt, hsa; identical to SEQ ID NO: 245196

SEQ ID NO: 301024 - RNA, 64 nt, hsa; identical to SEQ ID NO: 245197

SEQ ID NO: 301025 - RNA, 64 nt, hsa; identical to SEQ ID NO: 245198

SEQ ID NO: 301026 - RNA, 64 nt, hsa; identical to SEQ ID NO: 245199

SEQ ID NO: 301027 - RNA, 64 nt, hsa; identical to SEQ ID NO: 245200

SEQ ID NO: 301028 - RNA, 64 nt, hsa; identical to SEQ ID NO: 245201

SEQ ID NO: 301029 - RNA, 64 nt, hsa; identical to SEQ ID NO: 245202

SEQ ID NO: 301030 - RNA, 64 nt, hsa; identical to SEQ ID NO: 245203

SEQ ID NO: 301031 - RNA, 64 nt, hsa; identical to SEQ ID NO: 245204

SEQ ID NO: 301032 - RNA, 64 nt, hsa; identical to SEQ ID NO: 245205

SEQ ID NO: 301033 - RNA, 64 nt, hsa; identical to SEQ ID NO: 245206

SEQ ID NO: 301034 - RNA, 64 nt, hsa; identical to SEQ ID NO: 245207

SEQ ID NO: 301035 - RNA, 64 nt, hsa; identical to SEQ ID NO: 245208

SEQ ID NO: 301036 - RNA, 64 nt, hsa; identical to SEQ ID NO: 245209

SEQ ID NO: 301037 - RNA, 64 nt, hsa; identical to SEQ ID NO: 245210

SEQ ID NO: 301038 - RNA, 64 nt, hsa; identical to SEQ ID NO: 245211

SEQ ID NO: 301039 - RNA, 64 nt, hsa; identical to SEQ ID NO: 209315

SEQ ID NO: 301040 - RNA, 64 nt, hsa; identical to SEQ ID NO: 209316

SEQ ID NO: 301041 - RNA, 64 nt, hsa; identical to SEQ ID NO: 209317

SEQ ID NO: 301042 - RNA, 64 nt, hsa; identical to SEQ ID NO: 209318

SEQ ID NO: 301043 - RNA, 64 nt, hsa; identical to SEQ ID NO: 209319

SEQ ID NO: 301044 - RNA, 64 nt, hsa; identical to SEQ ID NO: 209320

SEQ ID NO: 301045 - RNA, 64 nt, hsa; identical to SEQ ID NO: 209321

SEQ ID NO: 301046 - RNA, 64 nt, hsa; identical to SEQ ID NO: 209322

SEQ ID NO: 301047 - RNA, 64 nt, hsa; identical to SEQ ID NO: 209323

SEQ ID NO: 301048 - RNA, 64 nt, hsa; identical to SEQ ID NO: 209324

SEQ ID NO: 301049 - RNA, 64 nt, hsa; identical to SEQ ID NO: 209325

SEQ ID NO: 301050 - RNA, 64 nt, hsa; identical to SEQ ID NO: 209326

SEQ ID NO: 301051 - RNA, 64 nt, hsa; identical to SEQ ID NO: 209327

SEQ ID NO: 301052 - RNA, 64 nt, hsa; identical to SEQ ID NO: 209328

SEQ ID NO: 301053 - RNA, 64 nt, hsa; identical to SEQ ID NO: 209329

SEQ ID NO: 301054 - RNA, 64 nt, hsa; identical to SEQ ID NO: 209330

SEQ ID NO: 301055 - RNA, 64 nt, hsa; identical to SEQ ID NO: 209331

SEQ ID NO: 301056 - RNA, 64 nt, hsa; identical to SEQ ID NO: 209332

SEQ ID NO: 301057 - RNA, 64 nt, hsa; identical to SEQ ID NO: 209333

SEQ ID NO: 301058 - RNA, 64 nt, hsa; identical to SEQ ID NO: 209334

SEQ ID NO: 301059 - RNA, 64 nt, hsa; identical to SEQ ID NO: 209335

SEQ ID NO: 301060 - RNA, 64 nt, hsa; identical to SEQ ID NO: 209336

SEQ ID NO: 301061 - RNA, 64 nt, hsa; identical to SEQ ID NO: 209337

SEQ ID NO: 301062 - RNA, 64 nt, hsa; identical to SEQ ID NO: 209338

SEQ ID NO: 301063 - RNA, 64 nt, hsa; identical to SEQ ID NO: 209339

SEQ ID NO: 301064 - RNA, 64 nt, hsa; identical to SEQ ID NO: 209340

SEQ ID NO: 301065 - RNA, 64 nt, hsa; identical to SEQ ID NO: 209341

SEQ ID NO: 301066 - RNA, 64 nt, hsa; identical to SEQ ID NO: 209342

SEQ ID NO: 301067 - RNA, 64 nt, hsa; identical to SEQ ID NO: 209343

SEQ ID NO: 301068 - RNA, 64 nt, hsa; identical to SEQ ID NO: 209344

SEQ ID NO: 301069 - RNA, 64 nt, hsa; identical to SEQ ID NO: 209345

SEQ ID NO: 301070 - RNA, 64 nt, hsa; identical to SEQ ID NO: 209346

SEQ ID NO: 301071 - RNA, 64 nt, hsa; identical to SEQ ID NO: 209347

SEQ ID NO: 301072 - RNA, 64 nt, hsa; identical to SEQ ID NO: 209348

SEQ ID NO: 301073 - RNA, 64 nt, hsa; identical to SEQ ID NO: 209349

SEQ ID NO: 301074 - RNA, 64 nt, hsa; identical to SEQ ID NO: 209350

SEQ ID NO: 301075 - RNA, 64 nt, hsa; identical to SEQ ID NO: 209351

SEQ ID NO: 301076 - RNA, 64 nt, hsa; identical to SEQ ID NO: 209352

SEQ ID NO: 301077 - RNA, 64 nt, hsa; identical to SEQ ID NO: 175237

SEQ ID NO: 301078 - RNA, 64 nt, hsa; identical to SEQ ID NO: 175238

SEQ ID NO: 301079 - RNA, 64 nt, hsa; identical to SEQ ID NO: 175239

SEQ ID NO: 301080 - RNA, 64 nt, hsa; identical to SEQ ID NO: 175240

SEQ ID NO: 301081 - RNA, 64 nt, hsa; identical to SEQ ID NO: 175241

SEQ ID NO: 301082 - RNA, 64 nt, hsa; identical to SEQ ID NO: 175242

SEQ ID NO: 301083 - RNA, 64 nt, hsa; identical to SEQ ID NO: 175243

SEQ ID NO: 301084 - RNA, 64 nt, hsa; identical to SEQ ID NO: 175244

SEQ ID NO: 301085 - RNA, 64 nt, hsa; identical to SEQ ID NO: 175245

SEQ ID NO: 301086 - RNA, 64 nt, hsa; identical to SEQ ID NO: 175246

SEQ ID NO: 301087 - RNA, 64 nt, hsa; identical to SEQ ID NO: 175247

SEQ ID NO: 301088 - RNA, 64 nt, hsa; identical to SEQ ID NO: 175248

SEQ ID NO: 301089 - RNA, 64 nt, hsa; identical to SEQ ID NO: 175249

SEQ ID NO: 301090 - RNA, 64 nt, hsa; identical to SEQ ID NO: 175250

SEQ ID NO: 301091 - RNA, 64 nt, hsa; identical to SEQ ID NO: 175251

SEQ ID NO: 301092 - RNA, 64 nt, hsa; identical to SEQ ID NO: 175252

SEQ ID NO: 301093 - RNA, 64 nt, hsa; identical to SEQ ID NO: 175253

SEQ ID NO: 301094 - RNA, 64 nt, hsa; identical to SEQ ID NO: 175254

SEQ ID NO: 301095 - RNA, 64 nt, hsa; identical to SEQ ID NO: 175255

SEQ ID NO: 301096 - RNA, 64 nt, hsa; identical to SEQ ID NO: 175256

SEQ ID NO: 301097 - RNA, 64 nt, hsa; identical to SEQ ID NO: 175257

SEQ ID NO: 301098 - RNA, 64 nt, hsa; identical to SEQ ID NO: 175258

SEQ ID NO: 301099 - RNA, 64 nt, hsa; identical to SEQ ID NO: 175259

SEQ ID NO: 301100 - RNA, 64 nt, hsa; identical to SEQ ID NO: 175260

SEQ ID NO: 301101 - RNA, 64 nt, hsa; identical to SEQ ID NO: 175261

SEQ ID NO: 301102 - RNA, 64 nt, hsa; identical to SEQ ID NO: 175262

SEQ ID NO: 301103 - RNA, 64 nt, hsa; identical to SEQ ID NO: 175263

SEQ ID NO: 301104 - RNA, 64 nt, hsa; identical to SEQ ID NO: 175264

SEQ ID NO: 301105 - RNA, 64 nt, hsa; identical to SEQ ID NO: 175265

SEQ ID NO: 301106 - RNA, 64 nt, hsa; identical to SEQ ID NO: 175266

SEQ ID NO: 301107 - RNA, 64 nt, hsa; identical to SEQ ID NO: 175267

SEQ ID NO: 301108 - RNA, 64 nt, hsa; identical to SEQ ID NO: 175268

SEQ ID NO: 301109 - RNA, 64 nt, hsa; identical to SEQ ID NO: 175269

SEQ ID NO: 301110 - RNA, 64 nt, hsa; identical to SEQ ID NO: 175270

SEQ ID NO: 301111 - RNA, 64 nt, hsa; identical to SEQ ID NO: 175271

SEQ ID NO: 301112 - RNA, 64 nt, hsa; identical to SEQ ID NO: 175272

SEQ ID NO: 301113 - RNA, 64 nt, hsa; identical to SEQ ID NO: 175273

SEQ ID NO: 301114 - RNA, 64 nt, hsa; identical to SEQ ID NO: 175274

SEQ ID NO: 301115 - RNA, 64 nt, hsa; identical to SEQ ID NO: 175275

SEQ ID NO: 301116 - RNA, 64 nt, hsa; identical to SEQ ID NO: 175276

SEQ ID NO: 301117 - RNA, 64 nt, hsa; identical to SEQ ID NO: 175277

SEQ ID NO: 301118 - RNA, 64 nt, hsa; identical to SEQ ID NO: 175278

SEQ ID NO: 301119 - RNA, 64 nt, hsa; identical to SEQ ID NO: 277339

SEQ ID NO: 301120 - RNA, 64 nt, hsa; identical to SEQ ID NO: 277340

SEQ ID NO: 301121 - RNA, 64 nt, hsa; identical to SEQ ID NO: 277341

SEQ ID NO: 301122 - RNA, 64 nt, hsa; identical to SEQ ID NO: 277342

SEQ ID NO: 301123 - RNA, 64 nt, hsa; identical to SEQ ID NO: 277343

SEQ ID NO: 301124 - RNA, 64 nt, hsa; identical to SEQ ID NO: 277344

SEQ ID NO: 301125 - RNA, 64 nt, hsa; identical to SEQ ID NO: 277345

SEQ ID NO: 301126 - RNA, 64 nt, hsa; identical to SEQ ID NO: 277346

SEQ ID NO: 301127 - RNA, 64 nt, hsa; identical to SEQ ID NO: 277347

SEQ ID NO: 301128 - RNA, 64 nt, hsa; identical to SEQ ID NO: 277348

SEQ ID NO: 301129 - RNA, 64 nt, hsa; identical to SEQ ID NO: 277349

SEQ ID NO: 301130 - RNA, 64 nt, hsa; identical to SEQ ID NO: 277350

SEQ ID NO: 301131 - RNA, 64 nt, hsa; identical to SEQ ID NO: 277351

SEQ ID NO: 301132 - RNA, 64 nt, hsa; identical to SEQ ID NO: 277352

SEQ ID NO: 301133 - RNA, 64 nt, hsa; identical to SEQ ID NO: 277353

SEQ ID NO: 301134 - RNA, 64 nt, hsa; identical to SEQ ID NO: 277354

SEQ ID NO: 301135 - RNA, 64 nt, hsa; identical to SEQ ID NO: 277355

SEQ ID NO: 301136 - RNA, 64 nt, hsa; identical to SEQ ID NO: 277356

SEQ ID NO: 301137 - RNA, 64 nt, hsa; identical to SEQ ID NO: 277357

SEQ ID NO: 301138 - RNA, 64 nt, hsa; identical to SEQ ID NO: 277358

SEQ ID NO: 301139 - RNA, 64 nt, hsa; identical to SEQ ID NO: 277359

SEQ ID NO: 301140 - RNA, 64 nt, hsa; identical to SEQ ID NO: 277360

SEQ ID NO: 301141 - RNA, 64 nt, hsa; identical to SEQ ID NO: 277361

SEQ ID NO: 301142 - RNA, 64 nt, hsa; identical to SEQ ID NO: 277362

SEQ ID NO: 301143 - RNA, 64 nt, hsa; identical to SEQ ID NO: 277363

SEQ ID NO: 301144 - RNA, 64 nt, hsa; identical to SEQ ID NO: 277364

SEQ ID NO: 301145 - RNA, 64 nt, hsa; identical to SEQ ID NO: 277365

SEQ ID NO: 301146 - RNA, 64 nt, hsa; identical to SEQ ID NO: 277366

SEQ ID NO: 301147 - RNA, 64 nt, hsa; identical to SEQ ID NO: 277367

SEQ ID NO: 301148 - RNA, 64 nt, hsa; identical to SEQ ID NO: 277368

SEQ ID NO: 301149 - RNA, 64 nt, hsa; identical to SEQ ID NO: 277369

SEQ ID NO: 301150 - RNA, 64 nt, hsa; identical to SEQ ID NO: 277370

SEQ ID NO: 301151 - RNA, 64 nt, hsa; identical to SEQ ID NO: 277371

SEQ ID NO: 301152 - RNA, 64 nt, hsa; identical to SEQ ID NO: 277372

SEQ ID NO: 301153 - RNA, 64 nt, hsa; identical to SEQ ID NO: 277373

SEQ ID NO: 301154 - RNA, 64 nt, hsa; identical to SEQ ID NO: 277374

SEQ ID NO: 301155 - RNA, 64 nt, hsa; identical to SEQ ID NO: 277375

SEQ ID NO: 301156 - RNA, 64 nt, hsa; identical to SEQ ID NO: 277376

SEQ ID NO: 301157 - RNA, 58 nt, hsa; identical to SEQ ID NO: 277377

SEQ ID NO: 301158 - RNA, 64 nt, hsa; identical to SEQ ID NO: 277378

SEQ ID NO: 301159 - RNA, 64 nt, hsa; identical to SEQ ID NO: 277379

SEQ ID NO: 301160 - RNA, 64 nt, hsa; identical to SEQ ID NO: 277380

SEQ ID NO: 301161 - RNA, 64 nt, hsa; identical to SEQ ID NO: 277381

SEQ ID NO: 301162 - RNA, 64 nt, hsa; identical to SEQ ID NO: 277382

SEQ ID NO: 301163 - RNA, 64 nt, hsa; identical to SEQ ID NO: 277383

SEQ ID NO: 301164 - RNA, 64 nt, hsa; identical to SEQ ID NO: 277384

SEQ ID NO: 301165 - RNA, 64 nt, hsa; identical to SEQ ID NO: 277385

SEQ ID NO: 301166 - RNA, 64 nt, hsa; identical to SEQ ID NO: 277386

SEQ ID NO: 301167 - RNA, 64 nt, hsa; identical to SEQ ID NO: 277387

SEQ ID NO: 301168 - RNA, 64 nt, hsa; identical to SEQ ID NO: 277388

SEQ ID NO: 301169 - RNA, 64 nt, hsa; identical to SEQ ID NO: 277389

SEQ ID NO: 301170 - RNA, 64 nt, hsa; identical to SEQ ID NO: 277390

SEQ ID NO: 301171 - RNA, 64 nt, hsa; identical to SEQ ID NO: 277391

SEQ ID NO: 301172 - RNA, 64 nt, hsa; identical to SEQ ID NO: 277392

SEQ ID NO: 301173 - RNA, 64 nt, hsa; identical to SEQ ID NO: 277393

SEQ ID NO: 301174 - RNA, 64 nt, hsa; identical to SEQ ID NO: 277394

SEQ ID NO: 301175 - RNA, 64 nt, hsa; identical to SEQ ID NO: 277395

SEQ ID NO: 301176 - RNA, 64 nt, hsa; identical to SEQ ID NO: 277396

SEQ ID NO: 301177 - RNA, 64 nt, hsa; identical to SEQ ID NO: 277397

SEQ ID NO: 301178 - RNA, 64 nt, hsa; identical to SEQ ID NO: 277398

SEQ ID NO: 301179 - RNA, 64 nt, hsa; identical to SEQ ID NO: 277399

SEQ ID NO: 301180 - RNA, 64 nt, hsa; identical to SEQ ID NO: 277400

SEQ ID NO: 301181 - RNA, 64 nt, hsa; identical to SEQ ID NO: 277401

SEQ ID NO: 301182 - RNA, 64 nt, hsa; identical to SEQ ID NO: 277402

SEQ ID NO: 301183 - RNA, 64 nt, hsa; identical to SEQ ID NO: 277403

SEQ ID NO: 301184 - RNA, 64 nt, hsa; identical to SEQ ID NO: 277404

SEQ ID NO: 301185 - RNA, 64 nt, hsa; identical to SEQ ID NO: 277405

SEQ ID NO: 301186 - RNA, 64 nt, hsa; identical to SEQ ID NO: 277406

SEQ ID NO: 301187 - RNA, 64 nt, hsa; identical to SEQ ID NO: 277407

SEQ ID NO: 301188 - RNA, 64 nt, hsa; identical to SEQ ID NO: 277408

SEQ ID NO: 301189 - RNA, 64 nt, hsa; identical to SEQ ID NO: 277409

SEQ ID NO: 301190 - RNA, 64 nt, hsa; identical to SEQ ID NO: 277410

SEQ ID NO: 301191 - RNA, 64 nt, hsa; identical to SEQ ID NO: 277411

SEQ ID NO: 301192 - RNA, 64 nt, hsa; identical to SEQ ID NO: 277412

SEQ ID NO: 301193 - RNA, 64 nt, hsa; identical to SEQ ID NO: 277413

SEQ ID NO: 301194 - RNA, 64 nt, hsa; identical to SEQ ID NO: 277414

SEQ ID NO: 301195 - RNA, 64 nt, hsa; identical to SEQ ID NO: 277415

SEQ ID NO: 301196 - RNA, 64 nt, hsa; identical to SEQ ID NO: 277416

SEQ ID NO: 301197 - RNA, 64 nt, hsa; identical to SEQ ID NO: 277417

SEQ ID NO: 301198 - RNA, 64 nt, hsa; identical to SEQ ID NO: 277418

SEQ ID NO: 301199 - RNA, 64 nt, hsa; identical to SEQ ID NO: 277419

SEQ ID NO: 301200 - RNA, 64 nt, hsa; identical to SEQ ID NO: 277420

SEQ ID NO: 301201 - RNA, 60 nt, hsa; identical to SEQ ID NO: 277421

SEQ ID NO: 301202 - RNA, 61 nt, hsa
gagacugauuugcugaauuuccuucuaaaugucacucaaaaauuucuuuuccaugucauuc

SEQ ID NO: 301203 - RNA, 61 nt, hsa
gagccuguuccauuuucccguggaaccuguuucacucaaugccaggcagugcagcauuuag

SEQ ID NO: 301204 - RNA, 61 nt, hsa
cccagcacuuugggaggccgaggcagguggaucacucaaggucacaaguuugagaccaguc

SEQ ID NO: 301205 - RNA, 61 nt, hsa
aaauuuuaaaucuguagccuggguguacguuucacucaaguucuccuacugaggacucuug

SEQ ID NO: 301206 - RNA, 61 nt, hsa
cagccauguaucaauauucacuugacuaaaaucacucaauuaaucaaugauacugugagcu

SEQ ID NO: 301207 - RNA, 61 nt, hsa
ugcguggaucugggucuuaguucugguugauucacucaagaguucagugcucauacguauc

SEQ ID NO: 301208 - RNA, 61 nt, hsa
cugcugccuggcaaacugcaaacaagcagcaucacucaaguuugaaguuucgccgcuuuug

SEQ ID NO: 301209 - RNA, 61 nt, hsa
uaaauaaaugaguacaucuccccuucccacaucacucaaggcauaagcagauuuuacuguu

SEQ ID NO: 301210 - RNA, 61 nt, hsa
guuuaguugcaacaaucucuugugacuaaugucacucaaagcaucuuguaaauccuagggc

SEQ ID NO: 301211 - RNA, 61 nt, hsa
gacucuguccccacacucaaaaagacucagcucacucaaugagagaaugugauuuacuuua

SEQ ID NO: 301212 - RNA, 64 nt, hsa
ggguaaaauguuaugguaagcaugcacaguuugcagucuacaguuuuuuuauguagcacaaaau

SEQ ID NO: 301213 - RNA, 64 nt, hsa
aaaaaccucacauucuacuugauuuacacuuccuagucuacauuacaugugguugaagguuuua

SEQ ID NO: 301214 - RNA, 64 nt, hsa
agaguggggaacagggccagcaagacagaccaccagccagaaaucucugauaucaaccucaugu

SEQ ID NO: 301215 - RNA, 64 nt, hsa
uggggaagaaauaccccagacccaacaaaccuccagccagaaagccagcuauuuugcauuugaa

SEQ ID NO: 301216 - RNA, 64 nt, hsa
uuuccaucugcuuguauuuuccauacacauccccagccagaaguuaguguccgaagaccgaauu

SEQ ID NO: 301217 - RNA, 64 nt, hsa
acagggccuagcuuucauuugacacacagacuacagccagaagcccauggagcagggaugucac

SEQ ID NO: 301218 - RNA, 64 nt, hsa
uacauacacacacaaauacacaaucucuaggguaagccagaaggcaagaucagauuaaaaacac

SEQ ID NO: 301219 - RNA, 64 nt, hsa
acucagggcuaaagucauccagugaaacuuuuagagccagaaguaacuuugucccaguccuaca

SEQ ID NO: 301220 - RNA, 64 nt, hsa
ccguggugaggccauguucucauaaucaggcuccagccagaaaaauaagaaacaccgcaacagg

SEQ ID NO: 301221 - RNA, 64 nt, hsa
ucucacagaagcugcgacucuagaccaggccugcagccagaacgccgauuccgggagcuuggga

SEQ ID NO: 301222 - RNA, 64 nt, hsa
cauagauccgagggcagcagugcuggguggagagagccagaaaacagaucuggaggcagcagug

SEQ ID NO: 301223 - RNA, 64 nt, hsa
gggggcuaaauuaauuggaguggggcgaggagagagccagaaaacauagauccgagggcagcag

SEQ ID NO: 301224 - RNA, 64 nt, hsa
uuaucuagugauaugaccucacugucuugaccaaagccagaauagaaggcaggauuccugaauu

SEQ ID NO: 301225 - RNA, 64 nt, hsa
gaauaauaugcagagaugcauauuaggaaugugaagccagaaugggucaguuguagcugcugca

SEQ ID NO: 301226 - RNA, 64 nt, hsa
uuuccuuugggauaauuuauuuccuguggcaucuagccagaagaaauugaggauguuuccuuuc

SEQ ID NO: 301227 - RNA, 64 nt, hsa
ggaacaguucuuuacuugcaaaaggaugaauacaagccagaaaaggccuugucugaagaggacu

SEQ ID NO: 301228 - RNA, 64 nt, hsa
ugugaguuucugggcucuggccuccugaagaaccagccagaagaagaaaaguagagguggcuuu

SEQ ID NO: 301229 - RNA, 64 nt, hsa
ccagcccucucccuuccacuggugccuugcuuagagccagaagggaugaagccgggggaucuau

SEQ ID NO: 301230 - RNA, 64 nt, hsa
uacaccaaauuaaaauuuucaugucaaacuucaaagccagaaagcugcuaaauacgugucuggc

SEQ ID NO: 301231 - RNA, 64 nt, hsa
uuuauccucccuguuauacuuuggagcacagcacagccagaaaggggcugcauuugugcccagg

SEQ ID NO: 301232 - RNA, 64 nt, hsa
agcuuuauucccuauuaauagaaaaccgucacagugacccuagaucccuccgaguuaaugaguu

SEQ ID NO: 301233 - RNA, 64 nt, hsa
uugaggucaugaccucccacugccgcucaggggcugacccuauuuaggaaaccaaagagggugg

SEQ ID NO: 301234 - RNA, 64 nt, hsa; identical to SEQ ID NO: 58312

SEQ ID NO: 301235 - RNA, 64 nt, hsa; identical to SEQ ID NO: 58313

SEQ ID NO: 301236 - RNA, 64 nt, hsa; identical to SEQ ID NO: 58314

SEQ ID NO: 301237 - RNA, 64 nt, hsa; identical to SEQ ID NO: 58315

SEQ ID NO: 301238 - RNA, 64 nt, hsa; identical to SEQ ID NO: 58316

SEQ ID NO: 301239 - RNA, 64 nt, hsa; identical to SEQ ID NO: 58317

SEQ ID NO: 301240 - RNA, 64 nt, hsa; identical to SEQ ID NO: 58318

SEQ ID NO: 301241 - RNA, 64 nt, hsa; identical to SEQ ID NO: 58319

SEQ ID NO: 301242 - RNA, 64 nt, hsa; identical to SEQ ID NO: 58320

SEQ ID NO: 301243 - RNA, 64 nt, hsa; identical to SEQ ID NO: 58321

SEQ ID NO: 301244 - RNA, 64 nt, hsa; identical to SEQ ID NO: 58322

SEQ ID NO: 301245 - RNA, 64 nt, hsa; identical to SEQ ID NO: 58323

SEQ ID NO: 301246 - RNA, 64 nt, hsa; identical to SEQ ID NO: 58324

SEQ ID NO: 301247 - RNA, 64 nt, hsa; identical to SEQ ID NO: 58325

SEQ ID NO: 301248 - RNA, 64 nt, hsa; identical to SEQ ID NO: 58326

SEQ ID NO: 301249 - RNA, 64 nt, hsa; identical to SEQ ID NO: 58327

SEQ ID NO: 301250 - RNA, 64 nt, hsa; identical to SEQ ID NO: 58328

SEQ ID NO: 301251 - RNA, 64 nt, hsa; identical to SEQ ID NO: 58329

SEQ ID NO: 301252 - RNA, 64 nt, hsa; identical to SEQ ID NO: 58330

SEQ ID NO: 301253 - RNA, 64 nt, hsa; identical to SEQ ID NO: 58331

SEQ ID NO: 301254 - RNA, 64 nt, hsa; identical to SEQ ID NO: 58332

SEQ ID NO: 301255 - RNA, 64 nt, hsa; identical to SEQ ID NO: 58333

SEQ ID NO: 301256 - RNA, 64 nt, hsa; identical to SEQ ID NO: 58334

SEQ ID NO: 301257 - RNA, 64 nt, hsa; identical to SEQ ID NO: 58335

SEQ ID NO: 301258 - RNA, 64 nt, hsa; identical to SEQ ID NO: 58336

SEQ ID NO: 301259 - RNA, 64 nt, hsa; identical to SEQ ID NO: 58337

SEQ ID NO: 301260 - RNA, 64 nt, hsa; identical to SEQ ID NO: 58338

SEQ ID NO: 301261 - RNA, 64 nt, hsa; identical to SEQ ID NO: 58339

SEQ ID NO: 301262 - RNA, 64 nt, hsa; identical to SEQ ID NO: 58340

SEQ ID NO: 301263 - RNA, 64 nt, hsa; identical to SEQ ID NO: 58341

SEQ ID NO: 301264 - RNA, 64 nt, hsa; identical to SEQ ID NO: 58342

SEQ ID NO: 301265 - RNA, 64 nt, hsa; identical to SEQ ID NO: 58343

SEQ ID NO: 301266 - RNA, 64 nt, hsa; identical to SEQ ID NO: 58344

SEQ ID NO: 301267 - RNA, 64 nt, hsa; identical to SEQ ID NO: 58345

SEQ ID NO: 301268 - RNA, 64 nt, hsa; identical to SEQ ID NO: 58346

SEQ ID NO: 301269 - RNA, 64 nt, hsa; identical to SEQ ID NO: 58347

SEQ ID NO: 301270 - RNA, 64 nt, hsa; identical to SEQ ID NO: 58348

SEQ ID NO: 301271 - RNA, 64 nt, hsa; identical to SEQ ID NO: 58349

SEQ ID NO: 301272 - RNA, 64 nt, hsa; identical to SEQ ID NO: 58350

SEQ ID NO: 301273 - RNA, 64 nt, hsa; identical to SEQ ID NO: 58351

SEQ ID NO: 301274 - RNA, 64 nt, hsa; identical to SEQ ID NO: 58352

SEQ ID NO: 301275 - RNA, 64 nt, hsa; identical to SEQ ID NO: 58353

SEQ ID NO: 301276 - RNA, 64 nt, hsa; identical to SEQ ID NO: 58354

SEQ ID NO: 301277 - RNA, 64 nt, hsa; identical to SEQ ID NO: 58355

SEQ ID NO: 301278 - RNA, 64 nt, hsa; identical to SEQ ID NO: 58356

SEQ ID NO: 301279 - RNA, 64 nt, hsa; identical to SEQ ID NO: 58357

SEQ ID NO: 301280 - RNA, 64 nt, hsa; identical to SEQ ID NO: 58358

SEQ ID NO: 301281 - RNA, 64 nt, hsa; identical to SEQ ID NO: 58359

SEQ ID NO: 301282 - RNA, 64 nt, hsa; identical to SEQ ID NO: 58360

SEQ ID NO: 301283 - RNA, 64 nt, hsa; identical to SEQ ID NO: 58361

SEQ ID NO: 301284 - RNA, 64 nt, hsa; identical to SEQ ID NO: 58362

SEQ ID NO: 301285 - RNA, 64 nt, hsa; identical to SEQ ID NO: 58363

SEQ ID NO: 301286 - RNA, 64 nt, hsa; identical to SEQ ID NO: 58364

SEQ ID NO: 301287 - RNA, 64 nt, hsa; identical to SEQ ID NO: 58365

SEQ ID NO: 301288 - RNA, 64 nt, hsa; identical to SEQ ID NO: 58366

SEQ ID NO: 301289 - RNA, 64 nt, hsa; identical to SEQ ID NO: 58367

SEQ ID NO: 301290 - RNA, 64 nt, hsa; identical to SEQ ID NO: 58368

SEQ ID NO: 301291 - RNA, 64 nt, hsa; identical to SEQ ID NO: 58369

SEQ ID NO: 301292 - RNA, 64 nt, hsa; identical to SEQ ID NO: 58370

SEQ ID NO: 301293 - RNA, 64 nt, hsa; identical to SEQ ID NO: 58371

SEQ ID NO: 301294 - RNA, 64 nt, hsa; identical to SEQ ID NO: 58372

SEQ ID NO: 301295 - RNA, 64 nt, hsa; identical to SEQ ID NO: 58373

SEQ ID NO: 301296 - RNA, 64 nt, hsa; identical to SEQ ID NO: 58374

SEQ ID NO: 301297 - RNA, 64 nt, hsa; identical to SEQ ID NO: 58375

SEQ ID NO: 301298 - RNA, 64 nt, hsa; identical to SEQ ID NO: 58376

SEQ ID NO: 301299 - RNA, 64 nt, hsa; identical to SEQ ID NO: 58377

SEQ ID NO: 301300 - RNA, 64 nt, hsa; identical to SEQ ID NO: 58378

SEQ ID NO: 301301 - RNA, 64 nt, hsa; identical to SEQ ID NO: 58379

SEQ ID NO: 301302 - RNA, 64 nt, hsa; identical to SEQ ID NO: 58380

SEQ ID NO: 301303 - RNA, 64 nt, hsa; identical to SEQ ID NO: 58381

SEQ ID NO: 301304 - RNA, 64 nt, hsa; identical to SEQ ID NO: 58382

SEQ ID NO: 301305 - RNA, 64 nt, hsa; identical to SEQ ID NO: 58383

SEQ ID NO: 301306 - RNA, 64 nt, hsa; identical to SEQ ID NO: 58384

SEQ ID NO: 301307 - RNA, 64 nt, hsa; identical to SEQ ID NO: 58385

SEQ ID NO: 301308 - RNA, 64 nt, hsa; identical to SEQ ID NO: 58386

SEQ ID NO: 301309 - RNA, 64 nt, hsa; identical to SEQ ID NO: 58387

SEQ ID NO: 301310 - RNA, 64 nt, hsa; identical to SEQ ID NO: 58388

SEQ ID NO: 301311 - RNA, 64 nt, hsa; identical to SEQ ID NO: 58389

SEQ ID NO: 301312 - RNA, 64 nt, hsa; identical to SEQ ID NO: 58390

SEQ ID NO: 301313 - RNA, 64 nt, hsa; identical to SEQ ID NO: 58391

SEQ ID NO: 301314 - RNA, 64 nt, hsa; identical to SEQ ID NO: 58392

SEQ ID NO: 301315 - RNA, 64 nt, hsa; identical to SEQ ID NO: 58393

SEQ ID NO: 301316 - RNA, 64 nt, hsa; identical to SEQ ID NO: 58394

SEQ ID NO: 301317 - RNA, 64 nt, hsa; identical to SEQ ID NO: 58395

SEQ ID NO: 301318 - RNA, 64 nt, hsa; identical to SEQ ID NO: 58396

SEQ ID NO: 301319 - RNA, 64 nt, hsa; identical to SEQ ID NO: 58397

SEQ ID NO: 301320 - RNA, 64 nt, hsa; identical to SEQ ID NO: 58398

SEQ ID NO: 301321 - RNA, 64 nt, hsa; identical to SEQ ID NO: 58399

SEQ ID NO: 301322 - RNA, 64 nt, hsa; identical to SEQ ID NO: 58400

SEQ ID NO: 301323 - RNA, 64 nt, hsa; identical to SEQ ID NO: 58401

SEQ ID NO: 301324 - RNA, 64 nt, hsa; identical to SEQ ID NO: 58402

SEQ ID NO: 301325 - RNA, 64 nt, hsa; identical to SEQ ID NO: 58403

SEQ ID NO: 301326 - RNA, 64 nt, hsa; identical to SEQ ID NO: 58404

SEQ ID NO: 301327 - RNA, 64 nt, hsa; identical to SEQ ID NO: 58405

SEQ ID NO: 301328 - RNA, 64 nt, hsa; identical to SEQ ID NO: 58406

SEQ ID NO: 301329 - RNA, 64 nt, hsa; identical to SEQ ID NO: 58407

SEQ ID NO: 301330 - RNA, 64 nt, hsa; identical to SEQ ID NO: 58408

SEQ ID NO: 301331 - RNA, 64 nt, hsa; identical to SEQ ID NO: 58409

SEQ ID NO: 301332 - RNA, 64 nt, hsa; identical to SEQ ID NO: 58410

SEQ ID NO: 301333 - RNA, 64 nt, hsa; identical to SEQ ID NO: 58411

SEQ ID NO: 301334 - RNA, 64 nt, hsa; identical to SEQ ID NO: 58412

SEQ ID NO: 301335 - RNA, 64 nt, hsa; identical to SEQ ID NO: 58413

SEQ ID NO: 301336 - RNA, 64 nt, hsa; identical to SEQ ID NO: 58414

SEQ ID NO: 301337 - RNA, 64 nt, hsa; identical to SEQ ID NO: 58415

SEQ ID NO: 301338 - RNA, 64 nt, hsa; identical to SEQ ID NO: 58416

SEQ ID NO: 301339 - RNA, 64 nt, hsa; identical to SEQ ID NO: 58417

SEQ ID NO: 301340 - RNA, 64 nt, hsa; identical to SEQ ID NO: 58418

SEQ ID NO: 301341 - RNA, 64 nt, hsa; identical to SEQ ID NO: 58419

SEQ ID NO: 301342 - RNA, 64 nt, hsa; identical to SEQ ID NO: 58420

SEQ ID NO: 301343 - RNA, 64 nt, hsa; identical to SEQ ID NO: 58421

SEQ ID NO: 301344 - RNA, 64 nt, hsa; identical to SEQ ID NO: 58422

SEQ ID NO: 301345 - RNA, 64 nt, hsa; identical to SEQ ID NO: 58423

SEQ ID NO: 301346 - RNA, 64 nt, hsa; identical to SEQ ID NO: 58424

SEQ ID NO: 301347 - RNA, 64 nt, hsa; identical to SEQ ID NO: 58425

SEQ ID NO: 301348 - RNA, 64 nt, hsa; identical to SEQ ID NO: 58426

SEQ ID NO: 301349 - RNA, 64 nt, hsa; identical to SEQ ID NO: 58427

SEQ ID NO: 301350 - RNA, 64 nt, hsa; identical to SEQ ID NO: 58428

SEQ ID NO: 301351 - RNA, 64 nt, hsa; identical to SEQ ID NO: 58429

SEQ ID NO: 301352 - RNA, 64 nt, hsa; identical to SEQ ID NO: 58430

SEQ ID NO: 301353 - RNA, 64 nt, hsa; identical to SEQ ID NO: 58431

SEQ ID NO: 301354 - RNA, 64 nt, hsa; identical to SEQ ID NO: 58432

SEQ ID NO: 301355 - RNA, 64 nt, hsa; identical to SEQ ID NO: 58433

SEQ ID NO: 301356 - RNA, 64 nt, hsa; identical to SEQ ID NO: 58434

SEQ ID NO: 301357 - RNA, 64 nt, hsa; identical to SEQ ID NO: 58435

SEQ ID NO: 301358 - RNA, 50 nt, hsa; identical to SEQ ID NO: 58436

SEQ ID NO: 301359 - RNA, 64 nt, hsa; identical to SEQ ID NO: 58437

SEQ ID NO: 301360 - RNA, 64 nt, hsa; identical to SEQ ID NO: 58438

SEQ ID NO: 301361 - RNA, 64 nt, hsa; identical to SEQ ID NO: 58439

SEQ ID NO: 301362 - RNA, 64 nt, hsa; identical to SEQ ID NO: 58440

SEQ ID NO: 301363 - RNA, 64 nt, hsa; identical to SEQ ID NO: 58441

SEQ ID NO: 301364 - RNA, 64 nt, hsa; identical to SEQ ID NO: 58442

SEQ ID NO: 301365 - RNA, 64 nt, hsa; identical to SEQ ID NO: 58443

SEQ ID NO: 301366 - RNA, 64 nt, hsa; identical to SEQ ID NO: 58444

SEQ ID NO: 301367 - RNA, 64 nt, hsa; identical to SEQ ID NO: 58445

SEQ ID NO: 301368 - RNA, 64 nt, hsa; identical to SEQ ID NO: 58446

SEQ ID NO: 301369 - RNA, 64 nt, hsa; identical to SEQ ID NO: 58447

SEQ ID NO: 301370 - RNA, 64 nt, hsa; identical to SEQ ID NO: 58448

SEQ ID NO: 301371 - RNA, 64 nt, hsa; identical to SEQ ID NO: 58449

SEQ ID NO: 301372 - RNA, 64 nt, hsa; identical to SEQ ID NO: 58450

SEQ ID NO: 301373 - RNA, 64 nt, hsa; identical to SEQ ID NO: 58451

SEQ ID NO: 301374 - RNA, 64 nt, hsa; identical to SEQ ID NO: 58452

SEQ ID NO: 301375 - RNA, 64 nt, hsa; identical to SEQ ID NO: 58453

SEQ ID NO: 301376 - RNA, 64 nt, hsa; identical to SEQ ID NO: 58454

SEQ ID NO: 301377 - RNA, 64 nt, hsa; identical to SEQ ID NO: 58455

SEQ ID NO: 301378 - RNA, 64 nt, hsa; identical to SEQ ID NO: 58456

SEQ ID NO: 301379 - RNA, 64 nt, hsa; identical to SEQ ID NO: 58457

SEQ ID NO: 301380 - RNA, 64 nt, hsa; identical to SEQ ID NO: 58458

SEQ ID NO: 301381 - RNA, 64 nt, hsa; identical to SEQ ID NO: 58459

SEQ ID NO: 301382 - RNA, 64 nt, hsa; identical to SEQ ID NO: 58460

SEQ ID NO: 301383 - RNA, 64 nt, hsa; identical to SEQ ID NO: 58461

SEQ ID NO: 301384 - RNA, 64 nt, hsa; identical to SEQ ID NO: 58462

SEQ ID NO: 301385 - RNA, 64 nt, hsa; identical to SEQ ID NO: 58463

SEQ ID NO: 301386 - RNA, 64 nt, hsa; identical to SEQ ID NO: 58464

SEQ ID NO: 301387 - RNA, 64 nt, hsa; identical to SEQ ID NO: 58465

SEQ ID NO: 301388 - RNA, 64 nt, hsa; identical to SEQ ID NO: 58466

SEQ ID NO: 301389 - RNA, 64 nt, hsa; identical to SEQ ID NO: 58467

SEQ ID NO: 301390 - RNA, 64 nt, hsa
auguuaaccuuaaacucuaggccuuacuggaagccacugauaggggacacuucacuaccagaug

SEQ ID NO: 301391 - RNA, 64 nt, hsa
acuuaauuuuuucucuguauuuuuguuacaaagccacugauacgugcacaauuguaauuaagua

SEQ ID NO: 301392 - RNA, 64 nt, hsa
guacuaaauaaauaaaaauucaugugaaaaugaucacugauaaauaucuucaugguggggcagg

SEQ ID NO: 301393 - RNA, 64 nt, hsa
guguguuagucuucccuggggagccuuuauaagacacugauacuugggacccacuccagagauu

SEQ ID NO: 301394 - RNA, 64 nt, hsa
aguuguguuugguaaaauucccacuugaaugugacacugauaauaauuaugcugauuuuuagca

SEQ ID NO: 301395 - RNA, 64 nt, hsa
aauaguagcucauucucucuaaaaauuuacugcccacugauaggauguuuuguuuccuugauaa

SEQ ID NO: 301396 - RNA, 64 nt, hsa
agcccucuaugugguccaggcagaauaguagacacacugauauuuaauccuuaaaaccccuuua

SEQ ID NO: 301397 - RNA, 64 nt, hsa
cuucuccaccuucauugcuagauccuucgaacagcacugauacauuucaaggucuuguuuuagg

SEQ ID NO: 301398 - RNA, 64 nt, hsa
cgcugcuucugagacuucucugucaaaacagccccacugauaauauuagacagaacgagaaugc

SEQ ID NO: 301399 - RNA, 64 nt, hsa
uuuuuguucuuuuuuccagcacaacauaacuuaccacugauacucccccuuuaguuauucugaa

SEQ ID NO: 301400 - RNA, 64 nt, hsa
auguuaucagauuaugcuauuuuguauaaagcaccacugauagcaaaucucucuccaaaauucu

SEQ ID NO: 301401 - RNA, 64 nt, hsa
aaaauuaccguuuuagaccagaaugaauagacuacacugauaaaauguacuggauaaugccaca

SEQ ID NO: 301402 - RNA, 64 nt, hsa
ccaucagagcuuugugaaucagcugggguguuuucacugauaaacaacacauagcaggugugca

SEQ ID NO: 301403 - RNA, 64 nt, hsa
auaaauauuccauaguggugacaugucagcugcccacugauacuccuuuggaaaauggugcgcu

SEQ ID NO: 301404 - RNA, 64 nt, hsa
cuucuuagacaaaaacacacaagccauuaguugacacugauaacuccgaauacauaaaauguuu

SEQ ID NO: 301405 - RNA, 64 nt, hsa
ugaacgcauugggaacaauucuauuuuggauguucacugauaauuuuuaaaaacacccuaguug

SEQ ID NO: 301406 - RNA, 64 nt, hsa
uauuagguggaaauuuuauauguaaauguguuagcacugauaguccuuuuuccaauguuuuauu

SEQ ID NO: 301407 - RNA, 64 nt, hsa
ccccucucucccugguccccucccccauccccaccacugauaucauggggaguaauaggaccag

SEQ ID NO: 301408 - RNA, 64 nt, hsa
gaccacugcccaagcccugcccgccucuccccccacgcucaaccugcccacuuguccaggccug

SEQ ID NO: 301409 - RNA, 64 nt, hsa
aauccauccaugcauacauagacacaagacacacacgcucaaaccccuguccacauauacaacc

SEQ ID NO: 301410 - RNA, 64 nt, hsa
cccuugcugcagaguugguggagaacagaaauccacgcucaaucucaggucuucacgcgggggg

SEQ ID NO: 301411 - RNA, 64 nt, hsa
ccuauucugccaugggagaguccaggccugggucacgcucaaggaaggaugccuuaucucuucu

SEQ ID NO: 301412 - RNA, 64 nt, hsa
aaaccuggccccugcaggagucaggccuggucucacgcucaauaaacuccggacugaagaugca

SEQ ID NO: 301413 - RNA, 64 nt, hsa
aggagaguaagaaacagcauggagaaaacccgguacgcucaaaaagaaaaaggaaaaaaaaaaa

SEQ ID NO: 301414 - RNA, 64 nt, hsa
ggcccccauuuuauuagucgguguguucaguaucacgcucaagacaagggccaaccuauuacuu

SEQ ID NO: 301415 - RNA, 64 nt, hsa
gagugugggggguuucaaggguguguuaggaacaacgcucaaaauccuaaggaaacugaacacu

SEQ ID NO: 301416 - RNA, 64 nt, hsa
ugacaucaauuaacagucuuuaaagauguuacauacgcucaaagcaaugugauuaagacuuuuu

SEQ ID NO: 301417 - RNA, 64 nt, hsa
cccugggguaugagcugccaagucuauuuuaaagacgcucaagaauccucugggguucaucuag

SEQ ID NO: 301418 - RNA, 64 nt, hsa
uucuuugucauucaguucuaggccuuuccucugcacgcucaaugcccaguaaaauuucaggauu

SEQ ID NO: 301419 - RNA, 64 nt, hsa
uuaucauuuuggaggauucuuucuagagcaagauacgcucaaauucuccuguuuguauuuugua

SEQ ID NO: 301420 - RNA, 64 nt, hsa
uuagucccgucuuccucaccgccccagcaggggaacgcucaagccugguugaaaugcugccucu

SEQ ID NO: 301421 - RNA, 64 nt, hsa
acuccuggcccucggccccucccuagucccacccacgcucaaccuuuggcccagccaucgccga

SEQ ID NO: 301422 - RNA, 62 nt, hsa
ccagaaggcagaaucaagcuuugcuuucuagaagacgcucaaaggauauggaaacaaaaguu

SEQ ID NO: 301423 - RNA, 64 nt, hsa
guuuuaucaggauaauugucucaugaccaaauccacgcucaauuagagccauucaaaauuccuu

SEQ ID NO: 301424 - RNA, 64 nt, hsa
ugcagucuguagcacugaacaaacaaaaaacaaaacgcucaagccuuacgaccagagaaggauu

SEQ ID NO: 301425 - RNA, 64 nt, hsa
gcucacaugccuucaaaagugaaagcucaacucuacgcucaagcauaugacguauguuacacuu

SEQ ID NO: 301426 - RNA, 64 nt, hsa
caacagcuguucuguucuaucuaccccucauuucacgcucaaggagucauaccuagaauaguua

SEQ ID NO: 301427 - RNA, 64 nt, hsa
ugaguguggggguuucaaggguguauuaggaauaacgcucaaaauccuaaggaaauugaauacu

SEQ ID NO: 301428 - RNA, 64 nt, hsa
caaguauggaggguaggagugcaacccaggagcaacgcucaagguggccgagaugcagggagga

SEQ ID NO: 301429 - RNA, 64 nt, hsa
cccaucuaccugcugacagagcaugacaaagaugacgcucaaaaguaaugccauuacuucuuuu

SEQ ID NO: 301430 - RNA, 64 nt, hsa
gacaugaacacuguacugaacuacaucuucucucacgcucaagucaccaagaagaaucuucugg

SEQ ID NO: 301431 - RNA, 64 nt, hsa
uuccucuacuauuuuucaaugucaucuaaugcaaacgcucaaccuuuuuaaaugguuaauguga

SEQ ID NO: 301432 - RNA, 64 nt, hsa
ccuucacccacggaucugcccaggcugaaggcacacgcucaaugccccacgugccuucuccagg

SEQ ID NO: 301433 - RNA, 64 nt, hsa
cagagaggcagauuccuuccccucccguccccucacgcucaaacccccacuuccugccccaggc

SEQ ID NO: 301434 - RNA, 64 nt, hsa
cagguggggccccuggggcaauggcagugguagaacgcucaacuugguugcgguaccaucagcc

SEQ ID NO: 301435 - RNA, 64 nt, hsa
cgauagcagggagccaugaccuggcaacgauuccacgcucaaaggggcacccggggggcccugg

SEQ ID NO: 301436 - RNA, 64 nt, hsa
gggaacucgccaccugcccacgcuaguuccauccacgcucaagacccgcccuuagaccaggcag

SEQ ID NO: 301437 - RNA, 64 nt, hsa
gacagcacuugcauggucacuugagcccacacacacgcucaaccccaaguccuuuaugcuuugu

SEQ ID NO: 301438 - RNA, 64 nt, hsa
uuccaccucgugcacagcgcucugcacagacaacacgcucaauaaaaguucagccauagcagca

SEQ ID NO: 301439 - RNA, 64 nt, hsa
uuaaagguaauccuuacuuucuuuguauuacuuagguucuuaaauuucuaugauaaacauguau

SEQ ID NO: 301440 - RNA, 64 nt, hsa
uuaaagguaauccuuacuuucuuuguauuacuuagguucuuaauuaaagguaauccuuacuuuc

SEQ ID NO: 301441 - RNA, 64 nt, hsa
aagcaucucauuuugaguagagagcaagggaagugguucuuagauggugaucugggauuaggcc

SEQ ID NO: 301442 - RNA, 64 nt, hsa
aacugauggauaucccuaccuugaaagaagaaaagguucuuacugcuugguccuugauuuauca

SEQ ID NO: 301443 - RNA, 64 nt, hsa
ugugaugagucuugaagcuggaaacuagguaacagguucuuaaauaguucaugugaaaaucaug

SEQ ID NO: 301444 - RNA, 64 nt, hsa
uauaauucuccacuguguuuagaauaacaucugagguucuuaaccuggccuuggaaggguauca

SEQ ID NO: 301445 - RNA, 64 nt, hsa
aggagugguucucauuuggucugccagaauacuggguucuuaguugacaaccuagaaugucaga

SEQ ID NO: 301446 - RNA, 64 nt, hsa
ggagcuacugaugaaaucugcuagaaaguuaggggguucuuauuuugcauuccagaaucuugac

SEQ ID NO: 301447 - RNA, 64 nt, hsa
ccaccaaugccaaaguagcacuucgagcacgccagguucuuauugccucccauuugccaucaua

SEQ ID NO: 301448 - RNA, 64 nt, hsa
uuacucgcuuugggggaaauaaagugauugagaagguucuuauugcuaacaauggcauugcagc

SEQ ID NO: 301449 - RNA, 64 nt, hsa; identical to SEQ ID NO: 111876

SEQ ID NO: 301450 - RNA, 64 nt, hsa; identical to SEQ ID NO: 111877

SEQ ID NO: 301451 - RNA, 64 nt, hsa; identical to SEQ ID NO: 111878

SEQ ID NO: 301452 - RNA, 64 nt, hsa; identical to SEQ ID NO: 111879

SEQ ID NO: 301453 - RNA, 64 nt, hsa; identical to SEQ ID NO: 111880

SEQ ID NO: 301454 - RNA, 64 nt, hsa; identical to SEQ ID NO: 111881

SEQ ID NO: 301455 - RNA, 64 nt, hsa; identical to SEQ ID NO: 24937

SEQ ID NO: 301456 - RNA, 64 nt, hsa; identical to SEQ ID NO: 24938

SEQ ID NO: 301457 - RNA, 64 nt, hsa; identical to SEQ ID NO: 24939

SEQ ID NO: 301458 - RNA, 64 nt, hsa; identical to SEQ ID NO: 24940

SEQ ID NO: 301459 - RNA, 64 nt, hsa; identical to SEQ ID NO: 24941

SEQ ID NO: 301460 - RNA, 64 nt, hsa; identical to SEQ ID NO: 24942

SEQ ID NO: 301461 - RNA, 64 nt, hsa; identical to SEQ ID NO: 24943

SEQ ID NO: 301462 - RNA, 64 nt, hsa; identical to SEQ ID NO: 24944

SEQ ID NO: 301463 - RNA, 64 nt, hsa; identical to SEQ ID NO: 24945

SEQ ID NO: 301464 - RNA, 64 nt, hsa; identical to SEQ ID NO: 24946

SEQ ID NO: 301465 - RNA, 64 nt, hsa; identical to SEQ ID NO: 24947

SEQ ID NO: 301466 - RNA, 64 nt, hsa; identical to SEQ ID NO: 24948

SEQ ID NO: 301467 - RNA, 64 nt, hsa; identical to SEQ ID NO: 24949

SEQ ID NO: 301468 - RNA, 64 nt, hsa; identical to SEQ ID NO: 24950

SEQ ID NO: 301469 - RNA, 64 nt, hsa; identical to SEQ ID NO: 24951

SEQ ID NO: 301470 - RNA, 64 nt, hsa; identical to SEQ ID NO: 24952

SEQ ID NO: 301471 - RNA, 64 nt, hsa; identical to SEQ ID NO: 219184

SEQ ID NO: 301472 - RNA, 64 nt, hsa; identical to SEQ ID NO: 219185

SEQ ID NO: 301473 - RNA, 64 nt, hsa; identical to SEQ ID NO: 219186

SEQ ID NO: 301474 - RNA, 64 nt, hsa; identical to SEQ ID NO: 219187

SEQ ID NO: 301475 - RNA, 64 nt, hsa; identical to SEQ ID NO: 219188

SEQ ID NO: 301476 - RNA, 64 nt, hsa; identical to SEQ ID NO: 219189

SEQ ID NO: 301477 - RNA, 64 nt, hsa; identical to SEQ ID NO: 219190

SEQ ID NO: 301478 - RNA, 64 nt, hsa; identical to SEQ ID NO: 219191

SEQ ID NO: 301479 - RNA, 64 nt, hsa; identical to SEQ ID NO: 219192

SEQ ID NO: 301480 - RNA, 64 nt, hsa; identical to SEQ ID NO: 219193

SEQ ID NO: 301481 - RNA, 64 nt, hsa; identical to SEQ ID NO: 219194

SEQ ID NO: 301482 - RNA, 64 nt, hsa; identical to SEQ ID NO: 219195

SEQ ID NO: 301483 - RNA, 64 nt, hsa; identical to SEQ ID NO: 219196

SEQ ID NO: 301484 - RNA, 64 nt, hsa; identical to SEQ ID NO: 219197

SEQ ID NO: 301485 - RNA, 64 nt, hsa; identical to SEQ ID NO: 219198

SEQ ID NO: 301486 - RNA, 64 nt, hsa; identical to SEQ ID NO: 219199

SEQ ID NO: 301487 - RNA, 64 nt, hsa; identical to SEQ ID NO: 219200

SEQ ID NO: 301488 - RNA, 64 nt, hsa; identical to SEQ ID NO: 219201

SEQ ID NO: 301489 - RNA, 64 nt, hsa; identical to SEQ ID NO: 219202

SEQ ID NO: 301490 - RNA, 64 nt, hsa; identical to SEQ ID NO: 219203

SEQ ID NO: 301491 - RNA, 64 nt, hsa; identical to SEQ ID NO: 219204

SEQ ID NO: 301492 - RNA, 64 nt, hsa; identical to SEQ ID NO: 219205

SEQ ID NO: 301493 - RNA, 64 nt, hsa; identical to SEQ ID NO: 219206

SEQ ID NO: 301494 - RNA, 64 nt, hsa; identical to SEQ ID NO: 219207

SEQ ID NO: 301495 - RNA, 64 nt, hsa; identical to SEQ ID NO: 219208

SEQ ID NO: 301496 - RNA, 64 nt, hsa; identical to SEQ ID NO: 219209

SEQ ID NO: 301497 - RNA, 64 nt, hsa; identical to SEQ ID NO: 219210

SEQ ID NO: 301498 - RNA, 64 nt, hsa; identical to SEQ ID NO: 219211

SEQ ID NO: 301499 - RNA, 64 nt, hsa; identical to SEQ ID NO: 219212

SEQ ID NO: 301500 - RNA, 64 nt, hsa; identical to SEQ ID NO: 219213

SEQ ID NO: 301501 - RNA, 64 nt, hsa
cuccuggaaccaccucucugcuuggucugaccccuuggccuauccaguuuuccugguucccuca

SEQ ID NO: 301502 - RNA, 64 nt, hsa
ccacaaugcuucauggcucugccgcuuaccuagcuuggccuagaguggcaaauggaacuucucu

SEQ ID NO: 301503 - RNA, 64 nt, hsa; identical to SEQ ID NO: 73933

SEQ ID NO: 301504 - RNA, 64 nt, hsa; identical to SEQ ID NO: 73934

SEQ ID NO: 301505 - RNA, 64 nt, hsa; identical to SEQ ID NO: 73935

SEQ ID NO: 301506 - RNA, 64 nt, hsa; identical to SEQ ID NO: 73936

SEQ ID NO: 301507 - RNA, 64 nt, hsa; identical to SEQ ID NO: 73937

SEQ ID NO: 301508 - RNA, 64 nt, hsa; identical to SEQ ID NO: 73938

SEQ ID NO: 301509 - RNA, 64 nt, hsa; identical to SEQ ID NO: 73939

SEQ ID NO: 301510 - RNA, 64 nt, hsa; identical to SEQ ID NO: 73940

SEQ ID NO: 301511 - RNA, 64 nt, hsa; identical to SEQ ID NO: 73941

SEQ ID NO: 301512 - RNA, 64 nt, hsa; identical to SEQ ID NO: 73942

SEQ ID NO: 301513 - RNA, 64 nt, hsa; identical to SEQ ID NO: 73943

SEQ ID NO: 301514 - RNA, 64 nt, hsa; identical to SEQ ID NO: 73944

SEQ ID NO: 301515 - RNA, 64 nt, hsa; identical to SEQ ID NO: 73945

SEQ ID NO: 301516 - RNA, 64 nt, hsa; identical to SEQ ID NO: 73946

SEQ ID NO: 301517 - RNA, 64 nt, hsa; identical to SEQ ID NO: 73947

SEQ ID NO: 301518 - RNA, 64 nt, hsa; identical to SEQ ID NO: 73948

SEQ ID NO: 301519 - RNA, 64 nt, hsa; identical to SEQ ID NO: 73949

SEQ ID NO: 301520 - RNA, 64 nt, hsa; identical to SEQ ID NO: 73950

SEQ ID NO: 301521 - RNA, 64 nt, hsa; identical to SEQ ID NO: 73951

SEQ ID NO: 301522 - RNA, 64 nt, hsa; identical to SEQ ID NO: 73952

SEQ ID NO: 301523 - RNA, 64 nt, hsa; identical to SEQ ID NO: 73953

SEQ ID NO: 301524 - RNA, 64 nt, hsa; identical to SEQ ID NO: 73954

SEQ ID NO: 301525 - RNA, 64 nt, hsa; identical to SEQ ID NO: 73955

SEQ ID NO: 301526 - RNA, 64 nt, hsa
ccuuucccaccuggagagaaacuuccagaccagccccucauaccacagccaagaggggccuuuc

SEQ ID NO: 301527 - RNA, 64 nt, hsa; identical to SEQ ID NO: 301526

SEQ ID NO: 301528 - RNA, 64 nt, hsa
cugacuuuccuaguuguuuuuuuauugagagccacccucauacccuguaauuuugucccaaauc

SEQ ID NO: 301529 - RNA, 64 nt, hsa
guugagcagcauaauaaucccgggagaaugauuccccucauagaaagacaaaagcauccauccc

SEQ ID NO: 301530 - RNA, 64 nt, hsa
ugauuccccucauagaaagacaaaagcauccauccccucauaguuaaguagccacugguguccu

SEQ ID NO: 301531 - RNA, 64 nt, hsa
cccacuuucuaggaucauuuuuauguaaagucacauaucccaggcccucagguugaauccagag

SEQ ID NO: 301532 - RNA, 64 nt, hsa
aaauuuggaaauccuucccaugccugaugaguuuauaucccagaaacauugagccaucagaaug

SEQ ID NO: 301533 - RNA, 64 nt, hsa
gauggaagacuccagggggcaaggaccaagggccauaucccaagugacuuuguacccagaaaau

SEQ ID NO: 301534 - RNA, 64 nt, hsa
uuauuuaccgaacaguuggaaaguaaaacuuugaauaucccagcgaagaaauggauaaauggua

SEQ ID NO: 301535 - RNA, 64 nt, hsa
ggagccuucuucaccagcuccuugggacaauggaauaucccaggguggugacagcagauggagc

SEQ ID NO: 301536 - RNA, 64 nt, hsa
uucucucuugaucuuaaagauuguaucuuauugaauaucccacuguauauuauuuuuauaugua

SEQ ID NO: 301537 - RNA, 64 nt, hsa
acccuuccccacacauaccaccuuggcuucuucuauaucccaccccgaugcucucccagguggg

SEQ ID NO: 301538 - RNA, 64 nt, hsa
uggaucgugaauuuuuuucauguaacuccuauucauaucccauagaucuaguauuguacagcac

SEQ ID NO: 301539 - RNA, 64 nt, hsa
cgaaggcauucuuguuagcuuugcuuuucuccccauaucccaaggcgaagcgcugagauucuuc

SEQ ID NO: 301540 - RNA, 64 nt, hsa
uagccuacucuuguguuuaggggauggugggaacauaucccagugcccuugccucauaauagau

SEQ ID NO: 301541 - RNA, 64 nt, hsa
uuucuaaaaauaugagugagaauggauauggaauauaucccaauuaauaaagagcucacacaga

SEQ ID NO: 301542 - RNA, 64 nt, hsa
ucauuuggauugccuuacuucucuugccuuaaauauaucccauauauuuaauaugucaaaaagg

SEQ ID NO: 301543 - RNA, 64 nt, hsa
aacauaaagaaaagacgaauauuuaaggugacagauaucccaacuacgcugauuugaucuuuac

SEQ ID NO: 301544 - RNA, 64 nt, hsa
ucaagcugccaaacaggucuuaagggaggugcuuauaucccaccaacacucucccagcucccau

SEQ ID NO: 301545 - RNA, 64 nt, hsa
aacuuggaucuaguuuaauuuuuuuuuuugcaacauaucccacucagaaacauucagguuugaa

SEQ ID NO: 301546 - RNA, 64 nt, hsa
cuagaucagggaacaaaauccucuccuuguggaaauaucccaugcaguuuguugauacaacuua

SEQ ID NO: 301547 - RNA, 64 nt, hsa
gcaggaacuggaguaaaugcaauacuguguuguaauaucccaacaaaaaucagacaaaaaaugg

SEQ ID NO: 301548 - RNA, 64 nt, hsa
ucuuguauggcuuugguaggcauacuuggagaacauaucccacauuaggaauugauuuaagccu

SEQ ID NO: 301549 - RNA, 64 nt, hsa
ugcuaagagaaaaaaaagacuuguuucugaucuaauaucccagaaaaaguaacucauugcucug

SEQ ID NO: 301550 - RNA, 64 nt, hsa
accucgguauauauauauguguauaaauauauguauaucccagcggcacuuuauacuguucacu

SEQ ID NO: 301551 - RNA, 64 nt, hsa
guugaaccuucaugaccuuaucaacuuuacacccauaucccagcaaaugccacucauccccacu

SEQ ID NO: 301552 - RNA, 64 nt, hsa
aaucguuacgcaacucuuuggcugcucugauuggauaucccacccacaagaucguauacccaua

SEQ ID NO: 301553 - RNA, 64 nt, hsa
uacugcuacuugggcagcucccugcugagugaacauaucccagaccauugccagcuccacucuc

SEQ ID NO: 301554 - RNA, 64 nt, hsa
ucaagugccccuauuuauuucaauaagaacgcacauaucccagcuguuuuuuguuugucaccuc

SEQ ID NO: 301555 - RNA, 64 nt, hsa
gaaugcaaaauuaauacugcugaggauuuccuucauaucccaugcuguuuaacuaucucuucca

SEQ ID NO: 301556 - RNA, 64 nt, hsa
agucauugcauaccaaaaccauauuuacuggaaaauaucccagguuucuaaauguuauaaaagc

SEQ ID NO: 301557 - RNA, 64 nt, hsa
uuuuacuuuauuuccagguucucuugccacaucaauaucccagaugguaaagacugaagggaaa

SEQ ID NO: 301558 - RNA, 64 nt, hsa
aacugguaacagguuguagauggcuuucuaugguauaucccagucucuugcaaacgauugugaa

SEQ ID NO: 301559 - RNA, 64 nt, hsa
agcaccccaguuccucaccagcuacucuggccauauaucccacaccagaaggaacaaguguggc

SEQ ID NO: 301560 - RNA, 64 nt, hsa
acuguaaaugcaauguaaagacacacagccacacauaucccacagauauuuucauuguguucuu

SEQ ID NO: 301561 - RNA, 60 nt, hsa
caccaccucucacaauuuaggcagaagcugauaucccagaaagacuauauauuguuuuuu

SEQ ID NO: 301562 - RNA, 64 nt, hsa
ucuuaauaggauagauacccacauacaguauaauauaucccauucagguuucagaguuuucuaa

SEQ ID NO: 301563 - RNA, 64 nt, hsa
auuacugccaaacuggaauuuucaaguuauuauaauaucccaggccccuugauaaaagcugagg

SEQ ID NO: 301564 - RNA, 64 nt, hsa
guuccagccggugccaaccugugaacuucccaccauaucccagaaucugcuauuccccaaacca

SEQ ID NO: 301565 - RNA, 64 nt, hsa
uagcccugccacuauuggcuacuuacccucauuaauaucccacuugagaaaaauugugagacua

SEQ ID NO: 301566 - RNA, 64 nt, hsa
uucaacaagccuaggcuaucucguaaguugaaaaauaucccacuauaguugcuucaugaguaug

SEQ ID NO: 301567 - RNA, 64 nt, hsa
uuagaauuugggcuggugagauuaauuuuuuuuaauaucccagcuagagauauggccuuuaacu

SEQ ID NO: 301568 - RNA, 64 nt, hsa
ggauggcgacaagggcagccaagcagggcuuaggauaucccagccuaccaauaugcucauucga

SEQ ID NO: 301569 - RNA, 64 nt, hsa
aaugaccaucgauggcucaaagaguggcuugaauauaucccauggguuaucuguauggacugac

SEQ ID NO: 301570 - RNA, 64 nt, hsa
aguguauuuagccuguagauguugugauaugcaaauaucccauucccugguuacuggcauuccu

SEQ ID NO: 301571 - RNA, 64 nt, hsa
gucaucacuugguccaugaaauauuaccuggccaauaucccaccaucaccucaaacccaaucac

SEQ ID NO: 301572 - RNA, 64 nt, hsa
agguagucauuagggagcaggcacuaccacuaagauaucccagaagaagaggcaagggcaucca

SEQ ID NO: 301573 - RNA, 64 nt, hsa
cagagcuuucaacucucugaauuuguaguccugaauaucccagugguggggguucccagcauug

SEQ ID NO: 301574 - RNA, 64 nt, hsa
auuuccacucugguggauaaguucaauaaaggucauaucccaaacuaguuguguauuaaauuug

SEQ ID NO: 301575 - RNA, 64 nt, hsa
uauauuugucauuuucucuugaauauguauuaaaauaucccaagcaauccaguauaccacccuu

SEQ ID NO: 301576 - RNA, 64 nt, hsa
ugggggcagucaaggaauaaacuacaguguaaacauaucccagaugaaaacugcuguauggaaa

SEQ ID NO: 301577 - RNA, 64 nt, hsa
agcauacgcaggagccuauccugaauuuuguaaaauaucccaacaguucuuaaaugaaaacugg

SEQ ID NO: 301578 - RNA, 64 nt, hsa
auacagcaagugcaccuauauucaccauuaacuuauaucccaaguccauuuuuuccuguacacu

SEQ ID NO: 301579 - RNA, 64 nt, hsa
ugagccccugaguuguggggguagggugaagagcauaucccacaagaggccccacagggagcag

SEQ ID NO: 301580 - RNA, 64 nt, hsa
aagauaauuuggguucuugaguuguuuuggaguaauaucccacaacugggguaggaagcucagg

SEQ ID NO: 301581 - RNA, 64 nt, hsa
gccccgaacacuuucccacuguuauucuuuccucauaucccaacacucagaacucuugugacau

SEQ ID NO: 301582 - RNA, 64 nt, hsa
augggagaguagauggugaaauuuauuaguuaauauaucccagaaauuagaaaccuuaauaugu

SEQ ID NO: 301583 - RNA, 64 nt, hsa
uugagaauccuuuaaaaauuccaaagcucaggccauaucccaggccuauuaaaucacaaucuuu

SEQ ID NO: 301584 - RNA, 64 nt, hsa
auaggcuaggaauugagccaggagaaaagagaagauaucccagaagucaaaaaggcaaaaugaa

SEQ ID NO: 301585 - RNA, 64 nt, hsa
ucccugcuccuugcccauaguaaaacagcuugaaauaucccaugcaagagaguaguuucaagug

SEQ ID NO: 301586 - RNA, 64 nt, hsa
agcccaagaaagauggcucauuuggaaaggccuaauaucccaaguugcuuaccuagaagaacuu

SEQ ID NO: 301587 - RNA, 64 nt, hsa
uuaucaugggaaaagaccagggcuuuucccaggaauaucccaaacuucggaaacaaguuauucu

SEQ ID NO: 301588 - RNA, 64 nt, hsa
ucaaacgagacggauagaagcuacuuuuuaaagaauaucccacugcaucugcaaauuuaguuuu

SEQ ID NO: 301589 - RNA, 64 nt, hsa
ucuacuuuagaaguacuaauuggagaugacuuuuauaucccauuuugguaauuauucauacaua

SEQ ID NO: 301590 - RNA, 64 nt, hsa
gaccaaugcuuaagguggacuuuguucguaaacaauaucccaauagauuuguugacuugagguc

SEQ ID NO: 301591 - RNA, 64 nt, hsa
ucuaacucgaaggcgccugaaaagaucaaauucuauaucccagauaccuuccguaagucuuuau

SEQ ID NO: 301592 - RNA, 64 nt, hsa
agaaaucauugaaugugcugaccaaaggcuugcaauaucccacucccagauugcacaguaaguu

SEQ ID NO: 301593 - RNA, 64 nt, hsa
ucaugggguggggagaugcugaaagggguauuguauaucccacugcacugagagggcucaauca

SEQ ID NO: 301594 - RNA, 64 nt, hsa
gugcaugccuugggcacaaacaagcacauacacuauaucccauaugggagaaguccagugccca

SEQ ID NO: 301595 - RNA, 64 nt, hsa
gauuauuaugauucccauacuccagauacaaaccauaucccagccauugccuaaacagauuaca

SEQ ID NO: 301596 - RNA, 64 nt, hsa
accaagaacauaaacccuccaagggaucugcuugauaucccaaguuggaagggaccccagauac

SEQ ID NO: 301597 - RNA, 64 nt, hsa
caacaggauaagcuggauccccuuggccuucugaauaucccagugucuucagguuucccaagac

SEQ ID NO: 301598 - RNA, 64 nt, hsa
aauagcuauaguauauguauauguuaaaaacugaauaucccaucauccuauuucauguauaguu

SEQ ID NO: 301599 - RNA, 64 nt, hsa
uuuuucugcaggacuuuaaagcuuugaaaggccaauaucccauaggcuaacuuuaaacauguau

SEQ ID NO: 301600 - RNA, 64 nt, hsa
uuacuaaauuggguucauuaucuuuuauuuuucaauaucccaguaaacccauguauauuaucac

SEQ ID NO: 301601 - RNA, 64 nt, hsa
aauuggcacccgaauguugcuguggcucagucacauaucccagggcccucgucccgaggccgug

SEQ ID NO: 301602 - RNA, 64 nt, hsa
aguaaaaaagguuaauuuuuccuuccucuguaagauaucccagcuuuaaaaagaaaaaaaaaga

SEQ ID NO: 301603 - RNA, 64 nt, hsa
acacugagugaagguguuugaaaugcaggagaggauaucccagcaaauugggaucacaugcuuu

SEQ ID NO: 301604 - RNA, 64 nt, hsa
aucuauaggcuuaucguucaaauacagcacuugaauaucccaaguaguucuucuacgcauagcu

SEQ ID NO: 301605 - RNA, 64 nt, hsa
uuuccuggugagcacagaaucagaacaaagaacaauaucccaaagaggcccugugucuaccagg

SEQ ID NO: 301606 - RNA, 64 nt, hsa
ggaaccagaucacgauuuuuagccauggaacaauauaucccaugggagaagaccuuucagugug

SEQ ID NO: 301607 - RNA, 64 nt, hsa
aguacuugguaaguuacuuaaaauuuuuacaaaaauaucccacucaaugccaaaucuuucaguc

SEQ ID NO: 301608 - RNA, 64 nt, hsa
uuuuaggauuauagguugcaaauuauccaaauauauaucccauuuuuuaaagcauaauaucuuu

SEQ ID NO: 301609 - RNA, 64 nt, hsa
ggguuagaucacacauaacaauagggucuaugucauaucccaagugaacuugagcccuguuugg

SEQ ID NO: 301610 - RNA, 64 nt, hsa
aagaaaauugcaugaaacuaggcuucuguaaucaauaucccaacauucugcaauggcagcauuc

SEQ ID NO: 301611 - RNA, 64 nt, hsa
cccaaacuguuuuccaauguggugacacaauuuuauaucccaucaacagggcaugaggguucug

SEQ ID NO: 301612 - RNA, 64 nt, hsa
uggcaccagcaacuacuucuuuauauuguucuucauaucccaaauuagaguuuacagggacagu

SEQ ID NO: 301613 - RNA, 64 nt, hsa
auuauuucuucacuuuuaacacaaguuagaaauuauaucccauuuaguuaagugcgugauuuau

SEQ ID NO: 301614 - RNA, 64 nt, hsa
ccaccuguacauacauuguauaggccaucuguaaauaucccagagaacaaucacuauucuuaag

SEQ ID NO: 301615 - RNA, 64 nt, hsa
uccuggcacuacccagauuuccacagugcugcuaauaucccagcuccagccagcaccccaucug

SEQ ID NO: 301616 - RNA, 64 nt, hsa
accacaaguguauuuuuagucaucuacacgucaaauaucccaagacagauuaugcuaaauacau

SEQ ID NO: 301617 - RNA, 64 nt, hsa
auucauacuguagaaaccagcucauguguaccucauaucccauccuuaagagaagaaauguuau

SEQ ID NO: 301618 - RNA, 64 nt, hsa
uguaugccgggagcuaaguggucuaugggugaacauaucccaccuugcuuccugaguccuuggu

SEQ ID NO: 301619 - RNA, 64 nt, hsa
guagcuuuucaccuuuacuuuagaagcacaguaaauaucccaaacugugaugaagccgaccuua

SEQ ID NO: 301620 - RNA, 64 nt, hsa
uauauuuguuaagaggaaauaaucaagaucacucauaucccaacugaaucugagguuuuauaaa

SEQ ID NO: 301621 - RNA, 64 nt, hsa
uuuaaaaauuggaauaauguauuaaggucaaauaauaucccauaaaauauauauuucugcuaau

SEQ ID NO: 301622 - RNA, 64 nt, hsa
uugacccuagaguagcccugguguuauauuuuagauaucccaagcuauaucagacuuuaccuga

SEQ ID NO: 301623 - RNA, 64 nt, hsa
uucuucacugcaacaugaugagguaguaccuuuuauaucccauuuauagaugggggaaagcaaa

SEQ ID NO: 301624 - RNA, 64 nt, hsa
cucugaccucucaucaaaucuucccauucacucaauaucccauaagcauccaaacuccauuaag

SEQ ID NO: 301625 - RNA, 64 nt, hsa
agcagcugggaaggugucugagguccccaauuacauaucccaaagaguuucuuacuucuguuuc

SEQ ID NO: 301626 - RNA, 64 nt, hsa
auuucuuuuuuuuuuaauugugaauuagacuuguauaucccacugggagcacuuuguaggcauu

SEQ ID NO: 301627 - RNA, 64 nt, hsa
auuccccacccagcgugucuccagauauugucaaauaucccaucgggugcaaaaugaucccugg

SEQ ID NO: 301628 - RNA, 64 nt, hsa
uucagacucagcagggugacuugccucagaggcuauaucccagugggggaacaaagaggagccu

SEQ ID NO: 301629 - RNA, 64 nt, hsa
ggaaugaaccacucccugcccauucccuauaagaauaucccaagacccaggcaauuuugccccu

SEQ ID NO: 301630 - RNA, 64 nt, hsa
uuuuggugcugauacaagagaaauguauuuuuaaauaucccacauccuggaucuuuguugggua

SEQ ID NO: 301631 - RNA, 64 nt, hsa
gggccccugugcccuaaguccacgggcugucuuuauaucccacugcccugcugugugacaguuu

SEQ ID NO: 301632 - RNA, 64 nt, hsa
cuauccuccaagccagcccaccucugccuucaucauaucccaggauacuguuuguaaauaaucu

SEQ ID NO: 301633 - RNA, 64 nt, hsa
cccacggccuuucuagccuggcuauguccuaauaauaucccacugggagaaaggaguuuugcaa

SEQ ID NO: 301634 - RNA, 64 nt, hsa
cagcccaagcagggagugucccccucccagaagcauaucccagaugagugguacauuauauaag

SEQ ID NO: 301635 - RNA, 64 nt, hsa
cuguuuacaaauaaaacucagccagucucauucuauaucccaaacguacugaaugaaacugauu

SEQ ID NO: 301636 - RNA, 64 nt, hsa
cauuuuucaucuuuaauugugauuuacaacccuaauaucccaggcacauacaaaacuuaugaau

SEQ ID NO: 301637 - RNA, 64 nt, hsa
uuuuaaaaacauggacuguaucuuaucuaccacuauaucccaaauaccuaagauagugcuuacg

SEQ ID NO: 301638 - RNA, 64 nt, hsa
cccuuuugccccaagcauuucuauauuuaaagcaauaucccaggagaauauguuagacuuagga

SEQ ID NO: 301639 - RNA, 64 nt, hsa
uucuucuuccagguuguaucacccccgaguuagcauaucccaggcucgcagacucaacacagca

SEQ ID NO: 301640 - RNA, 64 nt, hsa
ucuggaaggccaaguucaucgcagcauguucaccauaucccagccuccaaaucuauccuccuac

SEQ ID NO: 301641 - RNA, 64 nt, hsa
aagucaaaaauauugucaguugaaaauacauuuaauaucccaauuaacccaucauaaaguugaa

SEQ ID NO: 301642 - RNA, 64 nt, hsa
gaguacaagcucauuuuucucggugguuauucugauaucccauuuuggugugucauaauacuuc

SEQ ID NO: 301643 - RNA, 64 nt, hsa
uucgaucucuuccugauguaaaccaugcucacccauaucccacuauacaaaugcaaaugguugc

SEQ ID NO: 301644 - RNA, 64 nt, hsa
gaauuauccuagcaacaacauuguccuagcaaccauaucccaagagccauuuauccuugagacu

SEQ ID NO: 301645 - RNA, 64 nt, hsa
ccuuuaguuuguuacaguagccaauugaaaauguauaucccaaaauuuaaaaaaaaaaguacca

SEQ ID NO: 301646 - RNA, 64 nt, hsa
gaaaaaaaugcaauuugcacuucacuuuguuggaauaucccauagcacucaauaaacucagcug

SEQ ID NO: 301647 - RNA, 64 nt, hsa
gccagaucuuagguauagaggacccuaacacaguauaucccaagugcacuuucuaauguuucug

SEQ ID NO: 301648 - RNA, 64 nt, hsa
cuuccugggccccuagaauuuauaaggucccuagauaucccagaaccugccaccauggccucug

SEQ ID NO: 301649 - RNA, 64 nt, hsa
gguagagaagccagcagggggcagcgugggacccauaucccagccccaggcggaccagaggugg

SEQ ID NO: 301650 - RNA, 64 nt, hsa
uucauuaauuuugauuucaaauggaagauaaauaauaucccaaaugaauuaucuguaacagaaa

SEQ ID NO: 301651 - RNA, 64 nt, hsa
gggaucgagcagccuucuucuuugggaccccucgauaucccauggaaugcucgcacguucucaa

SEQ ID NO: 301652 - RNA, 64 nt, hsa
ccuuuuuaaagcacuuacuguuuucagagcacccauaucccacccuggugagaaggccacucuc

SEQ ID NO: 301653 - RNA, 64 nt, hsa
acaaaacuucagugugguacaagguggagaaagcauaucccaccaaccuccagugucagggucc

SEQ ID NO: 301654 - RNA, 64 nt, hsa
ccaaguagaaauauuaguguuacggaagugccuaauaucccaguccaaauuuuuuuuuuuuuuu

SEQ ID NO: 301655 - RNA, 64 nt, hsa
cuacugcacgaagggaagauccaagcuucgaaagauaucccaaaaauuucagugacuccagaag

SEQ ID NO: 301656 - RNA, 64 nt, hsa
gcaggcuucuuggauggacagugcugagacccccauaucccagaguccccagccucccucaggu

SEQ ID NO: 301657 - RNA, 64 nt, hsa
uguugcagcugucuacuggcugcaugugcugugaauaucccaaggaacuggcuguggaaugcgu

SEQ ID NO: 301658 - RNA, 64 nt, hsa
cucuguccguccucugagcucaagcuaagccaucauaucccagugaccugcacauauacaucca

SEQ ID NO: 301659 - RNA, 64 nt, hsa
uuaagaaaaaaaauaacaugcugaggggugaccuauaucccaugugaguggucacuuuauuuau

SEQ ID NO: 301660 - RNA, 64 nt, hsa
ucagccuucauuaggaggccgagguaggagucuuauaucccaggugaggaauuugaagcucaga

SEQ ID NO: 301661 - RNA, 64 nt, hsa
uggcaggccuaauuugucuuguucuuuccuuuccauaucccaguauaaucucuguuaaucaaca

SEQ ID NO: 301662 - RNA, 64 nt, hsa
caaaaagcugacccagaggccauacagagcaggaauaucccauugcccccuccuccacuggguu

SEQ ID NO: 301663 - RNA, 64 nt, hsa
aaguuucugaaaagaucuaaagccuuuuuaucccauaucccaaauucuuaugagccacucacag

SEQ ID NO: 301664 - RNA, 64 nt, hsa
aagcaaguucaaugaccuggucccuuagagcuccauaucccagucccagcccuucuuugcagcu

SEQ ID NO: 301665 - RNA, 64 nt, hsa
agggacugcuguuugcaaugggcuuaccauccaaauaucccaaaggcuuugaccagcaaccaag

SEQ ID NO: 301666 - RNA, 64 nt, hsa
uguuacugcuugccauaugaugugaaguacagcaauaucccaaguucuugugacugagggagau

SEQ ID NO: 301667 - RNA, 64 nt, hsa
uuucaccccacccuuccccuccuucucccuuuuuauaucccauuuuuauaucgaucucuuauuu

SEQ ID NO: 301668 - RNA, 62 nt, hsa
ugguggggacugcucccuagacuccaggagccauaucccagaccuuugccagcuacagugau

SEQ ID NO: 301669 - RNA, 59 nt, hsa
ggcugccagaacuugacuagcauuucugaauaucccaaggcgaggucauguaacuuccu

SEQ ID NO: 301670 - RNA, 64 nt, hsa
uuaugauuucagacagagcugcuggguccgugccauaucccaggaggaccagcuggcccccugc

SEQ ID NO: 301671 - RNA, 64 nt, hsa
ccuguuugcugccaugaggcccccccccccagcaauaucccaggggcgggcccaaugcccacug

SEQ ID NO: 301672 - RNA, 64 nt, hsa
ucuugguaucccucaucccagaagaggcaucuccauaucccagaaaagaagauccuaucaugaa

SEQ ID NO: 301673 - RNA, 64 nt, hsa
auuucauaucagcugaugagguaugcuugcuuuuauaucccagacuucuccucaaagaggggau

SEQ ID NO: 301674 - RNA, 64 nt, hsa
acuguggggauucaguuuaggcgcuggcccgaggauaucccagcggugguacuucggagacacc

SEQ ID NO: 301675 - RNA, 64 nt, hsa
gaggucagugcuucguggcaaauggcuguacuggauaucccagcucugcugcccuuguuuugcu

SEQ ID NO: 301676 - RNA, 64 nt, hsa
cucuucuaccaauguuugggugaccaccccuccaauaucccagaaugaauaagaacaaucccua

SEQ ID NO: 301677 - RNA, 64 nt, hsa
uuaaucauagggguuugucugcagcaaacgccucauaucccaaaaacggugcaguagaauagac

SEQ ID NO: 301678 - RNA, 64 nt, hsa
gagccacugggcugugggggaaggggucaaggccauaucccaauacguguagggcgaggguccc

SEQ ID NO: 301679 - RNA, 64 nt, hsa
aucaaaaucaccuagggagucggugcaaaacaaaauaucccaguccccuccccugaaacacuga

SEQ ID NO: 301680 - RNA, 64 nt, hsa
aacaaaugauauucuuuuuaaauaagaagcuauaauaucccauuggugucauguauuagaucag

SEQ ID NO: 301681 - RNA, 64 nt, hsa
gaaauaauaauaaauauaucuauauagaauagacauaucccacuguauauuaauugagguuaca

SEQ ID NO: 301682 - RNA, 64 nt, hsa
uccuaagugaauuaaugcaggaacagaaaaugaaauaucccauguucucacuuauaagugggag

SEQ ID NO: 301683 - RNA, 64 nt, hsa
aaaaaaaaagaaaaaaaaaucagggauauaguucauaucccacuucuuuguuuacaccgauguc

SEQ ID NO: 301684 - RNA, 64 nt, hsa
aaacauuacaaaaaggcaaauguacccuuugaccauaucccaaaggauagucuuuaucaguuca

SEQ ID NO: 301685 - RNA, 64 nt, hsa
ugggaaaaucuuuaguaggaauccuccagccauuauaucccagagagcucauuuagggcugaaa

SEQ ID NO: 301686 - RNA, 64 nt, hsa
ggagcucacgcagggcaggaauagccagguucucauaucccagggguucagacuuuggcugaga

SEQ ID NO: 301687 - RNA, 64 nt, hsa
agugccagggaccccucaaggagggagacgcuccauaucccagggcauaggacuugcagguucc

SEQ ID NO: 301688 - RNA, 64 nt, hsa
gucuucccugcuguguuaggaaaaugggggcuggauaucccaagaaucagagguuauauaaaaa

SEQ ID NO: 301689 - RNA, 64 nt, hsa
uuaaacuuuaaaugccauuacuacuuguuuuuucauaucccaagaauaagaacaugucuaugua

SEQ ID NO: 301690 - RNA, 64 nt, hsa
ugagucauauaaagaaacucuauaugggugagguauaucccacuucugugaaaacauuacaaau

SEQ ID NO: 301691 - RNA, 64 nt, hsa
augacaguagaggaaauggacaaggucaguuugaauaucccagaacacagugcucugucuccuc

SEQ ID NO: 301692 - RNA, 64 nt, hsa
auauauuuaucuguuuagcuaauauuaaauucaaauaucccauaucuaaauuuagugcaauauc

SEQ ID NO: 301693 - RNA, 64 nt, hsa
uuucaaaaucaaauuccagaaugauuuuacggagauaucccaggaaaauuaaggcuucucuuaa

SEQ ID NO: 301694 - RNA, 64 nt, hsa
auccuguauuaauuacucuuaguggagaugccagauaucccauacagaauuagcagagaaaaua

SEQ ID NO: 301695 - RNA, 64 nt, hsa
gaagaacuuuagaugaugauguauuuaugcccuuauaucccaaaaaguaaguaacucugaagaa

SEQ ID NO: 301696 - RNA, 64 nt, hsa
uccaguguuggggacugucuacguaugugcaaguauaucccagggcaugugccccgcaggggcc

SEQ ID NO: 301697 - RNA, 64 nt, hsa
auuuuuaguaagccauuauucuccuauucaaauaauaucccaaagagcuaaacaauuccuuaca

SEQ ID NO: 301698 - RNA, 64 nt, hsa
auaugaugcugcuauaagucuggggcucaaauugauaucccaguagcaauaaacauauaauaua

SEQ ID NO: 301699 - RNA, 64 nt, hsa
uuguaguuuuguauguuacucaucuucuuaccugauaucccaugaugaucccaugguaggucuu

SEQ ID NO: 301700 - RNA, 64 nt, hsa
cagaguccucaacuggaccuaggggaagaaggagauaucccacauuuaaaguucuuauuuaaaa

SEQ ID NO: 301701 - RNA, 64 nt, hsa
auccccagcacuggccucccuguggaagaugaacauaucccagccaccuguguacaggggcuca

SEQ ID NO: 301702 - RNA, 64 nt, hsa
auaacacgagccccuccaccuugauagcuccuugauaucccaaucuugcaguccuaacucaggc

SEQ ID NO: 301703 - RNA, 64 nt, hsa; identical to SEQ ID NO: 266386

SEQ ID NO: 301704 - RNA, 64 nt, hsa; identical to SEQ ID NO: 266387

SEQ ID NO: 301705 - RNA, 64 nt, hsa; identical to SEQ ID NO: 266388

SEQ ID NO: 301706 - RNA, 64 nt, hsa; identical to SEQ ID NO: 266389

SEQ ID NO: 301707 - RNA, 64 nt, hsa; identical to SEQ ID NO: 266390

SEQ ID NO: 301708 - RNA, 64 nt, hsa; identical to SEQ ID NO: 266391

SEQ ID NO: 301709 - RNA, 64 nt, hsa; identical to SEQ ID NO: 266392

SEQ ID NO: 301710 - RNA, 64 nt, hsa; identical to SEQ ID NO: 266393

SEQ ID NO: 301711 - RNA, 64 nt, hsa; identical to SEQ ID NO: 266394

SEQ ID NO: 301712 - RNA, 64 nt, hsa; identical to SEQ ID NO: 266395

SEQ ID NO: 301713 - RNA, 64 nt, hsa; identical to SEQ ID NO: 266396

SEQ ID NO: 301714 - RNA, 64 nt, hsa; identical to SEQ ID NO: 266397

SEQ ID NO: 301715 - RNA, 64 nt, hsa; identical to SEQ ID NO: 266398

SEQ ID NO: 301716 - RNA, 64 nt, hsa; identical to SEQ ID NO: 266399

SEQ ID NO: 301717 - RNA, 64 nt, hsa; identical to SEQ ID NO: 266400

SEQ ID NO: 301718 - RNA, 64 nt, hsa; identical to SEQ ID NO: 266401

SEQ ID NO: 301719 - RNA, 64 nt, hsa; identical to SEQ ID NO: 266402

SEQ ID NO: 301720 - RNA, 64 nt, hsa; identical to SEQ ID NO: 266403

SEQ ID NO: 301721 - RNA, 64 nt, hsa; identical to SEQ ID NO: 266404

SEQ ID NO: 301722 - RNA, 64 nt, hsa; identical to SEQ ID NO: 266405

SEQ ID NO: 301723 - RNA, 64 nt, hsa; identical to SEQ ID NO: 266406

SEQ ID NO: 301724 - RNA, 64 nt, hsa; identical to SEQ ID NO: 266407

SEQ ID NO: 301725 - RNA, 64 nt, hsa; identical to SEQ ID NO: 266408

SEQ ID NO: 301726 - RNA, 64 nt, hsa; identical to SEQ ID NO: 266409

SEQ ID NO: 301727 - RNA, 64 nt, hsa; identical to SEQ ID NO: 266410

SEQ ID NO: 301728 - RNA, 64 nt, hsa; identical to SEQ ID NO: 266411

SEQ ID NO: 301729 - RNA, 64 nt, hsa; identical to SEQ ID NO: 266412

SEQ ID NO: 301730 - RNA, 64 nt, hsa; identical to SEQ ID NO: 266413

SEQ ID NO: 301731 - RNA, 64 nt, hsa; identical to SEQ ID NO: 266414

SEQ ID NO: 301732 - RNA, 64 nt, hsa; identical to SEQ ID NO: 266415

SEQ ID NO: 301733 - RNA, 64 nt, hsa; identical to SEQ ID NO: 266416

SEQ ID NO: 301734 - RNA, 64 nt, hsa; identical to SEQ ID NO: 266417

SEQ ID NO: 301735 - RNA, 64 nt, hsa; identical to SEQ ID NO: 266418

SEQ ID NO: 301736 - RNA, 64 nt, hsa; identical to SEQ ID NO: 266419

SEQ ID NO: 301737 - RNA, 64 nt, hsa; identical to SEQ ID NO: 266420

SEQ ID NO: 301738 - RNA, 64 nt, hsa; identical to SEQ ID NO: 266421

SEQ ID NO: 301739 - RNA, 64 nt, hsa; identical to SEQ ID NO: 266422

SEQ ID NO: 301740 - RNA, 64 nt, hsa; identical to SEQ ID NO: 266423

SEQ ID NO: 301741 - RNA, 64 nt, hsa; identical to SEQ ID NO: 266424

SEQ ID NO: 301742 - RNA, 64 nt, hsa; identical to SEQ ID NO: 219214

SEQ ID NO: 301743 - RNA, 64 nt, hsa; identical to SEQ ID NO: 219215

SEQ ID NO: 301744 - RNA, 64 nt, hsa; identical to SEQ ID NO: 219216

SEQ ID NO: 301745 - RNA, 64 nt, hsa; identical to SEQ ID NO: 219217

SEQ ID NO: 301746 - RNA, 64 nt, hsa; identical to SEQ ID NO: 219218

SEQ ID NO: 301747 - RNA, 64 nt, hsa; identical to SEQ ID NO: 219219

SEQ ID NO: 301748 - RNA, 64 nt, hsa; identical to SEQ ID NO: 219220

SEQ ID NO: 301749 - RNA, 64 nt, hsa; identical to SEQ ID NO: 219221

SEQ ID NO: 301750 - RNA, 64 nt, hsa; identical to SEQ ID NO: 219222

SEQ ID NO: 301751 - RNA, 64 nt, hsa; identical to SEQ ID NO: 219223

SEQ ID NO: 301752 - RNA, 64 nt, hsa; identical to SEQ ID NO: 219224

SEQ ID NO: 301753 - RNA, 64 nt, hsa; identical to SEQ ID NO: 219225

SEQ ID NO: 301754 - RNA, 64 nt, hsa; identical to SEQ ID NO: 219226

SEQ ID NO: 301755 - RNA, 64 nt, hsa; identical to SEQ ID NO: 219227

SEQ ID NO: 301756 - RNA, 64 nt, hsa
agugcaagagccugagacuggaaaagguggacuugucucccagucgaggcugguaagggaccuu

SEQ ID NO: 301757 - RNA, 64 nt, hsa
agaaucaggguggagaaguucccugaaccuuccugucucccagggacauguaugcuuccaggga

SEQ ID NO: 301758 - RNA, 64 nt, hsa
gagaaacagggaggaaggggcggagcaccuggacgucucccagaagccccuccacguuugaaaa

SEQ ID NO: 301759 - RNA, 64 nt, hsa
guucuuucaagcuacauguacuaaauugucgaaggucucccaggagcucuguacugaggcagac

SEQ ID NO: 301760 - RNA, 64 nt, hsa
aaaguggaauugcccaguacugccugccagcugggucucccaagcaacuaccccaagacauacc

SEQ ID NO: 301761 - RNA, 64 nt, hsa
aagcuccuuaaccugucuguauuuuuaugccucugucucccauucaguuccuccuugaauaccu

SEQ ID NO: 301762 - RNA, 64 nt, hsa
guuugcaucucuauuuauaccucuguccugcuaggucucccaccuucccuugguuccaaaagcc

SEQ ID NO: 301763 - RNA, 64 nt, hsa
cucagccccacuccccuuccucauccccagcugugucucccaaccucccuucguguuguuuugc

SEQ ID NO: 301764 - RNA, 64 nt, hsa
accuggccaucuugagggguuuucuaacccccaggucucccaggccgaaggucagccuugaguc

SEQ ID NO: 301765 - RNA, 64 nt, hsa
agcugaugucguguuuacagagcaaggcuucccugucucccacggggaggggcucgggccucua

SEQ ID NO: 301766 - RNA, 64 nt, hsa
cauauguauuuuuuugcgacagggucgugcucuugucucccagacuggacugcaguggcacaau

SEQ ID NO: 301767 - RNA, 64 nt, hsa
uucacucugguuacagggaggugcaaaccauucugucucccagccuuucuucucucuuugugug

SEQ ID NO: 301768 - RNA, 64 nt, hsa
ggagaaacugcagccccacuucuguuucccuggagucucccaauggaucauucaggaguguccu

SEQ ID NO: 301769 - RNA, 64 nt, hsa
uguuccucuccugaccccaucuggcugcugccccgucucccaccccuguccccggggcucgcug

SEQ ID NO: 301770 - RNA, 64 nt, hsa
uuuuuuuugauacggggauacggggucuugcucugucucccaggcuggagugcagugacacaau

SEQ ID NO: 301771 - RNA, 64 nt, hsa
aaagagcacugggucauauggaaaaaauguaugugucucccaggugcauuucuugguuuauguc

SEQ ID NO: 301772 - RNA, 64 nt, hsa
gucuuauaaauuauaagucuuauauaauuuauaagucucccacaaucuuccaguucuuacccag

SEQ ID NO: 301773 - RNA, 64 nt, hsa
agccaccgucucaccccugcggaggagcgcucccgucucccacaggugccuuaccgcguucccu

SEQ ID NO: 301774 - RNA, 64 nt, hsa
ucauaaccaccugggaguugccaagaagcagacagucucccagugucugacucucggauauuug

SEQ ID NO: 301775 - RNA, 64 nt, hsa
uuuuuuuuuuuucuuuuugaaacagucuuacucugucucccaggcugcuggagugcaguggcac

SEQ ID NO: 301776 - RNA, 64 nt, hsa
ccuuaaaauuuuucuuaagacagagucuugcucugucucccaggcuggagugcaguggcacaau

SEQ ID NO: 301777 - RNA, 64 nt, hsa
ccuguuugggcucaggagauagaagacaaaaucugucucccacgucugccauggcaucaagggg

SEQ ID NO: 301778 - RNA, 64 nt, hsa
uuuuuuggguggggggugcggggcaguucacucugucucccaggcuggagugcaauggugcaau

SEQ ID NO: 301779 - RNA, 64 nt, hsa
cuagaccaccccuuuucaucauuuugcuuuuuaugucucccauaagaaaugugcuuuuuagagc

SEQ ID NO: 301780 - RNA, 64 nt, hsa
uuagagauaauugauucagggguuuucucucccagucucccagcagggacugauuucauuucug

SEQ ID NO: 301781 - RNA, 64 nt, hsa
ccugaggccacgcugcuauggaggcugccuccuagucucccaccaggucccaggcuguggaaag

SEQ ID NO: 301782 - RNA, 64 nt, hsa
gaugggguuuggggauuagaacuuaccccacugggucucccaaaagccuuggugcucccggcug

SEQ ID NO: 301783 - RNA, 64 nt, hsa
ccuuucucccgccauucuuuuucugaggucuccugucucccacuccuucccuuuccuaggauuu

SEQ ID NO: 301784 - RNA, 64 nt, hsa
uuacgcugaagccauggaucaacuucuuucuugugucucccagcacacgugugcacgcaaggca

SEQ ID NO: 301785 - RNA, 64 nt, hsa
cccuccagcuuagagucugcauuugggcugugacgucucccaccugccccaauaagaucugcuc

SEQ ID NO: 301786 - RNA, 64 nt, hsa
ugaacuccugaccucaaaugagccuccugcuucagucucccaaauugccgggauuacaggcaug

SEQ ID NO: 301787 - RNA, 64 nt, hsa
caaugagaggggagacagaggcagcuagggcuuggucucccaggacagagaguuacagaaaugg

SEQ ID NO: 301788 - RNA, 64 nt, hsa
cucacaccacugcugcucgagucuccugcacugugucucccacacugagaaaccccccaaccca

SEQ ID NO: 301789 - RNA, 64 nt, hsa
gcucaacaaggaaaaaugccacucccuacccaaugucucccacacccacccuuuuuuuggggug

SEQ ID NO: 301790 - RNA, 64 nt, hsa
gcaugaaaaacauuccacgugccccuugucgcgcgucucccauccugaucccagacccauuccu

SEQ ID NO: 301791 - RNA, 64 nt, hsa
cugcugcugugcaugucccugcgaugggagucuugucucccagccugucaguuuccuccccagg

SEQ ID NO: 301792 - RNA, 64 nt, hsa
uccucauagacggcaggugcccaccuuucagggagucucccagcaugggcggaugccgggcaug

SEQ ID NO: 301793 - RNA, 64 nt, hsa
uuuuaaaaugcccuugugucucccagugaggagcccuaagcauugacuucucuacccuaaaacu

SEQ ID NO: 301794 - RNA, 64 nt, hsa
auuuuaugacuuugggccaagaauuaaguauuuuccuaagcacaaaucuuuuucuauauucuca

SEQ ID NO: 301795 - RNA, 64 nt, hsa
ccaaggugacucaagauaacaccagaccacgcaugaucaccaaaaccuucccauccugauucuc

SEQ ID NO: 301796 - RNA, 64 nt, hsa
cugucaucuuacugaaaggaauaacacuucuaaagaucaccauuucugagaaguucuuggaaau

SEQ ID NO: 301797 - RNA, 64 nt, hsa
ccauuuaccuggcaggcagucugcucucucucaggaucaccacgcaucucaggauuggucuaaa

SEQ ID NO: 301798 - RNA, 64 nt, hsa
ccaagaaccugcucaggaagccuuuugauggcaagaucaccaauccagaugguauugcucccuc

SEQ ID NO: 301799 - RNA, 64 nt, hsa
ugacugccacccauacuaggacaaacacagcucagaucaccaggucaagcaccuaggccuggcu

SEQ ID NO: 301800 - RNA, 64 nt, hsa
ucagcuaaguuuccuaacuuguccauccaaaugugaucaccacgauucaacaauuuggggcauu

SEQ ID NO: 301801 - RNA, 64 nt, hsa
ccaaccacagcaaaggcaacacucuuccuccagagaucaccaagccccucuuaccucccucccu

SEQ ID NO: 301802 - RNA, 64 nt, hsa
gcugaugaguaagugagggaugucuccaucuugagaucaccaggcaagagaguugccugcacca

SEQ ID NO: 301803 - RNA, 64 nt, hsa
ccguguccguccaccgagcacucagauggaugcugaucaccagggccgagggggcucccagaag

SEQ ID NO: 301804 - RNA, 64 nt, hsa
auaaaacuuagauggcagcuuguacugucagaaucccguguauccauuuguucuucuguuggag

SEQ ID NO: 301805 - RNA, 64 nt, hsa
cuccugaaacaagcucauuucaguuucuggcaaccccguguauuuccguuuucccccuaaagaa

SEQ ID NO: 301806 - RNA, 55 nt, hsa
cuccgccucucuuuggcugaagcugcccguguaguccccaaccgugucugucugg

SEQ ID NO: 301807 - RNA, 64 nt, hsa
gguacgugacccucugcugaagacuugcccccugcccguguacauagugcauuguuucuguggg

SEQ ID NO: 301808 - RNA, 64 nt, hsa
uguauggaaacauuuugugcccuacucuccauaccccguguacucaaauucucuacuguaugaa

SEQ ID NO: 301809 - RNA, 64 nt, hsa
ucauauucuaugugcuuccccugaagagugaggacccguguaacuggcaguguuacauugaccc

SEQ ID NO: 301810 - RNA, 64 nt, hsa
gucagcaggccauacuguguuggggcaaaggugucccguguagcacucagauaaguauacagcg

SEQ ID NO: 301811 - RNA, 64 nt, hsa
cacucuauagccauacuggacaggaaccaggugccccguguaggcaucgucggucgguuugccg

SEQ ID NO: 301812 - RNA, 64 nt, hsa
cucuacuagcaaagacaugggcaccggaguaggucccguguagcaugcgggugcuguagagaaa

SEQ ID NO: 301813 - RNA, 64 nt, hsa
cacaaaugggcucugugugggucaccccagcugacccguguaugugcagaugcaguuccgaagg

SEQ ID NO: 301814 - RNA, 64 nt, hsa
guuguaugauacuaccuuuguaugucugucuuuucccguguauuuuuaaauaacuggugaucua

SEQ ID NO: 301815 - RNA, 64 nt, hsa
accagccaucuggggcucuucuuccuuucuuccccccguguauguaaaugaauuccugaacccc

SEQ ID NO: 301816 - RNA, 64 nt, hsa
gauccagcugagagcaaucucuugcauuuuuuuacccguguauguacagauaucauuucuugug

SEQ ID NO: 301817 - RNA, 64 nt, hsa
uccaguccucaguucccacugccuaacgucugcccccguguagauacugagaggugguggcagu

SEQ ID NO: 301818 - RNA, 64 nt, hsa
gcccuccgccuagagguccccucacgugaccagccccguguagccccgggcugacccagugugu

SEQ ID NO: 301819 - RNA, 64 nt, hsa
uaaagagauuaauuuuaacguaacucuuucuaugcccguguaaaguaugugaaucgcaaggccu

SEQ ID NO: 301820 - RNA, 64 nt, hsa
aucguaauucaauuuuccucuuauucauucaguucccguguauuucuugugcuucuacuuugua

SEQ ID NO: 301821 - RNA, 64 nt, hsa
cucccggguucacgccauucuccugccucagccucccguguagcugggacuacaggcacgcgcc

SEQ ID NO: 301822 - RNA, 64 nt, hsa
augcaugaaaaaugcuccacauuuaaaggacauacccguguauguuaugaaaacaugguuugau

SEQ ID NO: 301823 - RNA, 64 nt, hsa
aacuucaauauaaaguugcauuugccaaaauuuacccguguagccuguuaauuuucuugaaaua

SEQ ID NO: 301824 - RNA, 64 nt, hsa
cagcauggugaacauuaccaggcaugcuagcuggcccguguaaucccaagacaaggaaaacauu

SEQ ID NO: 301825 - RNA, 64 nt, hsa
gugccaguuccagaugggcugaccggcucuucuccccguguaggggagccccagcauggacuca

SEQ ID NO: 301826 - RNA, 64 nt, hsa
aaucacuccucagugugaccucccaggccucuuccccguguacgucaacaccucacccagccua

SEQ ID NO: 301827 - RNA, 51 nt, hsa
gcaaggucacugccaaauagacccguguacaaugaggagcuggggccuccu

SEQ ID NO: 301828 - RNA, 64 nt, hsa
accucacaagaaguuguaaugaguacagagaauucccguguacccuucaccaagcuuccucuaa

SEQ ID NO: 301829 - RNA, 64 nt, hsa
gcucuuaacugaauugggagccucugccaccugccccguguauccuggcucucagcucaugggg

SEQ ID NO: 301830 - RNA, 64 nt, hsa
gagggcugagcucagugccuccugggagacuugucccguguacagugacccagaaagaugagau

SEQ ID NO: 301831 - RNA, 64 nt, hsa
ucuauauggcagcauuuuugaggcuuuauaucugcccguguacccucaacugccuccuuuuugc

SEQ ID NO: 301832 - RNA, 64 nt, hsa
ugaauauuuguauuuuccagauggaauaaaaaggcccguguaauuaaccuucaccaucagcgcc

SEQ ID NO: 301833 - RNA, 64 nt, hsa
gugugugguggguugucugugugcauauguccugcccguguauaugcacccacaccaugugccc

SEQ ID NO: 301834 - RNA, 64 nt, hsa
cagaggccgaccuccaaggcucuguucuccccuccccguguacauauacucccgguuucccugc

SEQ ID NO: 301835 - RNA, 64 nt, hsa
ugagucugugcagguccuuguguauggaauugcacccguguaaaggaggaaauggucagugugc

SEQ ID NO: 301836 - RNA, 64 nt, hsa
uggggaauacagccaagggcacugcucacuguggcccguguauucauucccacaggcugcacug

SEQ ID NO: 301837 - RNA, 64 nt, hsa
ugcgaaugcauccuaggcgcguccuccucugauccccguguaagacugcccuggugucggcacu

SEQ ID NO: 301838 - RNA, 64 nt, hsa
ugucuuuagaauacccuuugauaagcugagcugucccguguagaugcaauucgguuuaauggca

SEQ ID NO: 301839 - RNA, 64 nt, hsa
cuaaccuucagcguugcccauggcccugccacaucccguguaacauaaguggugcccaccaugu

SEQ ID NO: 301840 - RNA, 64 nt, hsa
acccauggugacgaugacacacccugguggcaugcccguguauguugguuuagcguugucugca

SEQ ID NO: 301841 - RNA, 64 nt, hsa
ggcaugacacaccugggggaaauuggcgaugucacccguguacgguacgcagcccagagcagac

SEQ ID NO: 301842 - RNA, 64 nt, hsa
cggcugugcaguccuggguccuccuuucugagggcccguguaaauauguacauuucucaggcua

SEQ ID NO: 301843 - RNA, 64 nt, hsa
cugacgggaccugccacugcacaccagcccagcucccguguaaauaauuuauuacaagcauaac

SEQ ID NO: 301844 - RNA, 64 nt, hsa
uaaaugucucucuggccaccaugcguuacguguacccguguauauguggggaggcugugcacac

SEQ ID NO: 301845 - RNA, 64 nt, hsa
uguuggggcuuccccaccacauucaugucccucucccguguagguuucacauuauguccaggug

SEQ ID NO: 301846 - RNA, 64 nt, hsa
ccuguuuucucccuccugacccugcaucucccaccccguguaucauagggaacuuucaccuuaa

SEQ ID NO: 301847 - RNA, 64 nt, hsa
aaggcccggcugagccccccaugccccuccccuccccguguaaaaagccuccuugugcaauugu

SEQ ID NO: 301848 - RNA, 64 nt, hsa
ugugugccgagugccgcccaguguucugugaccacccguguagcuacugaaaauggcuggguaa

SEQ ID NO: 301849 - RNA, 64 nt, hsa
ucauauuggcauuuccacgugacuguguuucuaucccguguacagagagauccagagcccuaca

SEQ ID NO: 301850 - RNA, 64 nt, hsa
cgggaguccaucccggcccagcacccccagcauccccguguauggccccccugcaccuccuugu

SEQ ID NO: 301851 - RNA, 64 nt, hsa
uuuccaucccaggcuuuugaaaaacaaacagaaacccguguaucugggauauuuccauauggca

SEQ ID NO: 301852 - RNA, 64 nt, hsa
cccugccuccaugaugcaaacugauguccccuuccccguguaugcccccuuccccaagguagca

SEQ ID NO: 301853 - RNA, 64 nt, hsa
ucaaccagaugauuaaacguuguauuaaaaagaccccguguaaaccugagcccccccguccccc

SEQ ID NO: 301854 - RNA, 64 nt, hsa
gggagaaggggucagaccaaagauggugguuugucccguguaagggaacagguguggggaagag

SEQ ID NO: 301855 - RNA, 64 nt, hsa
uucuguguaccuaguacacaggcaugacugggaucccguguaccgaguacacgacccagguaug

SEQ ID NO: 301856 - RNA, 64 nt, hsa
cagugaauucugugauguuucugagaugcagacucccguguaguuucagauucuugguccaugg

SEQ ID NO: 301857 - RNA, 64 nt, hsa
ccacucccaccaucugcagguggugaaaacaaaccccguguaucucucaauaaagguggccgaa

SEQ ID NO: 301858 - RNA, 64 nt, hsa
gggcauccccagcccccuggccccucccacaucccccguguauucaggaccccaucugcugagc

SEQ ID NO: 301859 - RNA, 64 nt, hsa
cuaggucuacacuccuaggacgcacgcauaucagcccguguacccugugacagugacugucccc

SEQ ID NO: 301860 - RNA, 64 nt, hsa
aggugaugaagacagcccgauccuccccuggacucccguguaggaaccugcacacgagcagaca

SEQ ID NO: 301861 - RNA, 64 nt, hsa
acgcacacacacacccagugcucucuccacccgacccguguacuugcagacagggaagcugagc

SEQ ID NO: 301862 - RNA, 64 nt, hsa
gaucccaagacaaugaaaguuugcacuguaugcuggacggcauuccugcuuaucaauaaaccug

SEQ ID NO: 301863 - RNA, 64 nt, hsa
augcuaugggcucccuggccucccaggccaccaaggacggcaagaaggacaagaaggaggaaga

SEQ ID NO: 301864 - RNA, 64 nt, hsa
ggcaggcauagaggcuucuccgccagccuccucuggacggcaggcucacugccaggccagccuc

SEQ ID NO: 301865 - RNA, 64 nt, hsa
aaauaaugagauucccuaucuccuuuuagaccugggacggcaaaagggaagggaaggaaacuua

SEQ ID NO: 301866 - RNA, 64 nt, hsa
ggcucugauuagccaggccuggucaggguccuggggacggcacccagauaugcagagucacccu

SEQ ID NO: 301867 - RNA, 64 nt, hsa
ccugggaccccgggaaccucuccugccggaagccggacggcagggaugggccccaacuucgccc

SEQ ID NO: 301868 - RNA, 64 nt, hsa
acaaccugcacuucugccaaggccagggccagcaggacggcaggacucuagggagggguguggc

SEQ ID NO: 301869 - RNA, 64 nt, hsa
uggauuucuucaugguguccauuuuauuuagcaaggacggcacccacacacaaagaggaugauu

SEQ ID NO: 301870 - RNA, 53 nt, hsa
agucagagggcucuaccugagaaggacggcaaggcugagguggcuaaggggga

SEQ ID NO: 301871 - RNA, 64 nt, hsa
gauagucuuucaagcccccacaucacaggcuuagggacggcacuaacuuucucccagggaucua

SEQ ID NO: 301872 - RNA, 64 nt, hsa
acugggaggguccccuccuccuucccuacuccugggacggcagcaaggacaugggggcugcugu

SEQ ID NO: 301873 - RNA, 64 nt, hsa
aaucaaagaaaauggaugugacgucugugcagguggacggcaguccgaggggcuuauuucacuu

SEQ ID NO: 301874 - RNA, 64 nt, hsa
ccuuguccaugugaguagcaugggcgggugguggggacggcaguggugaugaagggggugcacc

SEQ ID NO: 301875 - RNA, 64 nt, hsa
gcguucccaguggacagcguggugagccguggccggacggcaggaggagaggggagcccccucu

SEQ ID NO: 301876 - RNA, 64 nt, hsa
ucugugugccgccuccgaacacagaacauuguuuggacggcagccccacugcacauaacagacc

SEQ ID NO: 301877 - RNA, 64 nt, hsa
ugcauccaguaacaccacuggggaugugcuggcuggacggcaccacccuuuccugggaagagau

SEQ ID NO: 301878 - RNA, 64 nt, hsa
gagaaugaguguggauguguacaguacacgcacuggacggcagcgggaggcugggacuuuccau

SEQ ID NO: 301879 - RNA, 64 nt, hsa
gccccucacacgccuucauccugaaacaggaagaggacggcaccaaguugggggugcuggauga

SEQ ID NO: 301880 - RNA, 64 nt, hsa
aacaggcccacuccucugauuaccuccgggggauggacggcaaacagguaaggaguuccaugca

SEQ ID NO: 301881 - RNA, 64 nt, hsa
ccaggacacuacccugagaucugcacagucagaaggacggcaggaguguccuggcugugaaugc

SEQ ID NO: 301882 - RNA, 64 nt, hsa
gcagggguggcugaccccaugcucagccucuaggggacggcaggccaucaggcugggggcugug

SEQ ID NO: 301883 - RNA, 64 nt, hsa
gcccucugcuccccaaugccuuagagagaggaggggacggcacggccgcucaccggaaggcugu

SEQ ID NO: 301884 - RNA, 64 nt, hsa
gcugcuggccuccugcccagguggaggguccuggggacggcagaggauaaagcccccuccucac

SEQ ID NO: 301885 - RNA, 64 nt, hsa
uuaaucuuuauguugggacacagaccacauauuuggacggcagccaugcauccaucgcugaagg

SEQ ID NO: 301886 - RNA, 64 nt, hsa
auggcaagacuuggccccuccaccugucccuaacggacggcaggucaggaaagccaggacucag

SEQ ID NO: 301887 - RNA, 64 nt, hsa
gggcaggggacaccuuggcuccucagcagcccaaggacggcaccauccagcaccuccgucauuc

SEQ ID NO: 301888 - RNA, 64 nt, hsa
ccuccuggccgccccgcagggggcuuggagggcuggacggcaaguccgucuagcucacgggccc

SEQ ID NO: 301889 - RNA, 64 nt, hsa
cugggccgcuccaccucaccggugcagugacccaggacggcaucagcagcccagugagcaccag

SEQ ID NO: 301890 - RNA, 64 nt, hsa
ccccgcuucccagggcuggccaagagagaagacuggacggcagggaggucaacauuaacgagug

SEQ ID NO: 301891 - RNA, 64 nt, hsa
uuucagguguuccuagcauuucugccuccaggcaggacggcaggggugagcagcuuugggagag

SEQ ID NO: 301892 - RNA, 64 nt, hsa
ccuugccuuuugaagaagagcccgcauaaugaguggacggcagacagcuauauuuaguggugcc

SEQ ID NO: 301893 - RNA, 64 nt, hsa
gcacaugagcagugcccaggggcucccugcgugaggacggcaaggugcgauguaugucuaacuu

SEQ ID NO: 301894 - RNA, 64 nt, hsa
acgcagaggugacagugggagcuggccugggccaggacggcagguggcccuggagaugggaaag

SEQ ID NO: 301895 - RNA, 64 nt, hsa
gaggagggcccucagcuggcccuccccacacacaggacggcaggggcacugugaggcuuuucuu

SEQ ID NO: 301896 - RNA, 64 nt, hsa
ucaagaaaccaagaugguuugggguaugggguggggacggcaaaagggguaagagcuggcuucu

SEQ ID NO: 301897 - RNA, 64 nt, hsa
uaaaagucagagcugaagggagucgcuggggccaggacggcaugcaggccuguacccuguuccc

SEQ ID NO: 301898 - RNA, 64 nt, hsa
aaggcuuccuggcagcucucacuacggccaaccaggacggcagggucauccugagccgccaagg

SEQ ID NO: 301899 - RNA, 64 nt, hsa
uggcagccauguauuacagcuacuacaugcuaccggacggcacuuacugccuggcgccgccccc

SEQ ID NO: 301900 - RNA, 64 nt, hsa
ccaauugcugcauggaaauugauguacauucaggggacggcaaaaauagcuguaaaauagugaa

SEQ ID NO: 301901 - RNA, 64 nt, hsa
guggcgucuucugggaaagccugaccguguguucggacggcacuggcuccuuuccgaaguucuc

SEQ ID NO: 301902 - RNA, 64 nt, hsa
acuucuacccccuggaggggggccgggugcugcuggacggcaagcccaucagcgccuacgacca

SEQ ID NO: 301903 - RNA, 64 nt, hsa
ugagccccugaugccgcuuauuugccgugaguuuggacggcaccccugcuggcggauagcaaga

SEQ ID NO: 301904 - RNA, 64 nt, hsa
ggaaccuggaugugugcacgugugucccagguagggacggcacaggagggugcauggggcgugg

SEQ ID NO: 301905 - RNA, 64 nt, hsa
ggaaaaggaagugcuucugaaaacaaaccuuucuggacggcagagcccaaguuucaagcuuucc

SEQ ID NO: 301906 - RNA, 64 nt, hsa
aggacaaggggcgggcccgcggccucacccggagggacggcagccccggucgcgcgcuggcccc

SEQ ID NO: 301907 - RNA, 64 nt, hsa
cgcuccuucccagacacacccccacgcccccacuggacggcauuggaggaagggacagcugcuu

SEQ ID NO: 301908 - RNA, 64 nt, hsa
ccucgccccggccuccgggucugggaaauugaggggacggcaggcccggcugcccuggaacugg

SEQ ID NO: 301909 - RNA, 50 nt, hsa
ugaagcccgaacccaccugaggacggcagugaggaugagcaccucuagca

SEQ ID NO: 301910 - RNA, 64 nt, hsa
accuucaaagcugacugugccccgcugcgggaggggacggcaccccagugguggcagagcuugg

SEQ ID NO: 301911 - RNA, 64 nt, hsa
ccugcuucccuucuggcccuggaagacugagucuggacggcagaguggagggacugggaggcug

SEQ ID NO: 301912 - RNA, 64 nt, hsa
aaaacccguuccggagccgccugcucccggaaccggacggcacagggcguucuugcccacccca

SEQ ID NO: 301913 - RNA, 64 nt, hsa
ucugcuuaggagguggggacuugggcugggauggggacggcauaccccucccaggccucucccu

SEQ ID NO: 301914 - RNA, 64 nt, hsa
ugaacacaagcugcugccggggacuguccuggguggacggcaggugaacacaagcggcugccgc

SEQ ID NO: 301915 - RNA, 64 nt, hsa
uguccucccgcgaggaccaggcaucgcugugugaggacggcacggccagcgccugcugugagug

SEQ ID NO: 301916 - RNA, 64 nt, hsa
acugcgccagugacacauaguuacuuccuggcugggacggcaccuauagaaacuaggguacaaa

SEQ ID NO: 301917 - RNA, 64 nt, hsa
cugcugggccacaccccaagaucaggggcccuggggacggcaagugaauaaagcacauuuccac

SEQ ID NO: 301918 - RNA, 64 nt, hsa
gcugggugcccggaggcggccauggugucucgauggacggcagccaggauggagcacccauggg

SEQ ID NO: 301919 - RNA, 64 nt, hsa
auggugcccgccggccugccgggcucccaccccuggacggcagaggcaaggacggacgggagcu

SEQ ID NO: 301920 - RNA, 64 nt, hsa
gcaaagggcacagccaugcaaaggcccuggggcaggacggcaccugguaugcgggaggaacaga

SEQ ID NO: 301921 - RNA, 64 nt, hsa
cuguccccggggagccaucgccuucagugugcagggacggcaccgaggagucugagccgggggc

SEQ ID NO: 301922 - RNA, 64 nt, hsa
cauucccucuuccaggcccuugucuccccaguugggacggcagagagacaaguucuuauaucug

SEQ ID NO: 301923 - RNA, 64 nt, hsa
gcaauaaaacagucuugucggccagcugcccaggggacggcagcuacagcagccucugcguccu

SEQ ID NO: 301924 - RNA, 64 nt, hsa
ugagcagguguugguccucaggagcuccaaccccggacggcagaugccuuccucagucucgagc

SEQ ID NO: 301925 - RNA, 64 nt, hsa
gcuccacugacugugccgaggggcgggggcaggaggacggcaagaccuauuuauaauauuuagc

SEQ ID NO: 301926 - RNA, 64 nt, hsa
ucgggacccacagucucaccacgucuccuccagaggacggcagaggguacaggugguggccugg

SEQ ID NO: 301927 - RNA, 64 nt, hsa
ucugugagaauuggccauccugaggacacagccaggacggcagaggccuccuggccucagggca

SEQ ID NO: 301928 - RNA, 64 nt, hsa
agaggccacgugaacccacggccacagagaggcaggacggcagagccaugauuucccaccgagc

SEQ ID NO: 301929 - RNA, 64 nt, hsa
aaaacccacccuaccacaguccgcucuuccaaguggacggcagaccugggaggggacgccugug

SEQ ID NO: 301930 - RNA, 64 nt, hsa
gccuagacugagugugguuucgucgugaguggauggacggcaagcuuagcaagccuaagucccc

SEQ ID NO: 301931 - RNA, 64 nt, hsa
gcaucgggccuaaguguccuggggagauuggaggggacggcagcguucugcaugauggaggcgc

SEQ ID NO: 301932 - RNA, 64 nt, hsa
cucccugggagccacgugcuggccauguggccagggacggcaugagcaggaggcggggacgugg

SEQ ID NO: 301933 - RNA, 64 nt, hsa
uucgcccccacgugcucgacaggggaacccgcccggacggcaucgccaggcacuggcuggggug

SEQ ID NO: 301934 - RNA, 64 nt, hsa
accaucuggacacagcagagccagggcggcccagggacggcaggagagcucgcggcaccuuccu

SEQ ID NO: 301935 - RNA, 64 nt, hsa
cuccccugcgaccaugccaggcacgcugggaggaggacggcagcugcucguguccugccccugc

SEQ ID NO: 301936 - RNA, 64 nt, hsa
cagcagaacuccuaaaaaguuacagccauaugcaggacggcaguacucagcauggucuuaugca

SEQ ID NO: 301937 - RNA, 64 nt, hsa
uuuaguaucauuguuucauuuaguauuugguacaaucuaauaaauacuaauccaguccaauacu

SEQ ID NO: 301938 - RNA, 64 nt, hsa
caauacuaauaauacuaacaguaguauugauacaaucuaauaaauaauguguuugacaguguag

SEQ ID NO: 301939 - RNA, 64 nt, hsa
cucuuagauuuuaagaacucuugaauugugugguaucuaauaaaagggaagguaagauggauaa

SEQ ID NO: 301940 - RNA, 64 nt, hsa
cacuggguaucugcaaggcuuauugauuauucuaaucuaauaagacaaguuuguggaaaugcaa

SEQ ID NO: 301941 - RNA, 64 nt, hsa
augggauuugcauuaugacuugaacugggcuuauaucuaauaauacagagcacuaucucuaacc

SEQ ID NO: 301942 - RNA, 64 nt, hsa
gcuagaugucaagaagcccuucagacccagacaaaucuaauauccugagguggccuuuacauac

SEQ ID NO: 301943 - RNA, 64 nt, hsa
acaggaagguggugcuuacauccuuaaaggcaccaucuaauagcggguuacuuucacauacagc

SEQ ID NO: 301944 - RNA, 64 nt, hsa
guggccaaauuauuuguguaauagaaaacugaaaaucuaauauuaaaaauauggaacuucuaau

SEQ ID NO: 301945 - RNA, 64 nt, hsa
aagaaauggguuucugcuaaugaauugagcagacaucuaauauuuuauaugccuuuugagcugu

SEQ ID NO: 301946 - RNA, 64 nt, hsa
uaggaaugccuauaauacaucuuagauuccuuauaucuaauaagaguucaaagaguuaugaguu

SEQ ID NO: 301947 - RNA, 64 nt, hsa
aucauuaauguaguuccucauugaacaugugauaaucuaauaccugugaaaacugacuaaucag

SEQ ID NO: 301948 - RNA, 64 nt, hsa
accugugaaaacugacuaaucagcugccaauaauaucuaauauuuuucaucaugcacgaauuaa

SEQ ID NO: 301949 - RNA, 64 nt, hsa
uguggggaaaaagggcuauugcuaagugagcuuuaucuaauauccuccuaagaguuuuacuagu

SEQ ID NO: 301950 - RNA, 64 nt, hsa
uggcuuauuuaauuuuccagaaccaggaaugaguaucuaauagcuuuuguagaaccuuccagaa

SEQ ID NO: 301951 - RNA, 64 nt, hsa
uaugcugugauaaaaauaggugagagaucauaugaucuaauauuguauugauggaaguauaggu

SEQ ID NO: 301952 - RNA, 64 nt, hsa
agccagucaagcuaguaggcugauugugaagaaaaucuaauaccuuaucuuuaucucaaaccuc

SEQ ID NO: 301953 - RNA, 64 nt, hsa
aaacuauugacuugguaagucuacuguauauaacaucuaauauauauauauuauaggccagcua

SEQ ID NO: 301954 - RNA, 64 nt, hsa
aaacuauugacuugguaagucuacuguauauaacaucuaauauauauauuacaggccaaaugaa

SEQ ID NO: 301955 - RNA, 64 nt, hsa
cgacccuccucccgcgcccggcaaaaaguauccuucccgccauuuuacguaccagggagucgac

SEQ ID NO: 301956 - RNA, 64 nt, hsa
ccucggcucggucuccagcgccucagcccacccuucccgccacccuggccucccugcuugcgcu

SEQ ID NO: 301957 - RNA, 64 nt, hsa
gcacguggucucgccuucccuucuuccugcagguucccgccaagccaugugacagagugcucac

SEQ ID NO: 301958 - RNA, 64 nt, hsa
uuugagugugggagaggagaccaggucacccgauucccgccaagccggaagucccugcagcacc

SEQ ID NO: 301959 - RNA, 50 nt, hsa
auggcccugcaaaccauugagcguaggauuuguugcauuaugcuagagca

SEQ ID NO: 301960 - RNA, 64 nt, hsa
uuccuuugcagggugugaggguuuggcgagguaugcguaggagcaagaagggacagggaauuuc

SEQ ID NO: 301961 - RNA, 64 nt, hsa
aaucaguaguuagcauccaagagacuuugcagaggcguaggaaugaggcuggacagauggcgga

SEQ ID NO: 301962 - RNA, 64 nt, hsa
agucgcugggagcagugcgguuggacacaaguuugcguaggaguguuuuccuuuugucaauaau

SEQ ID NO: 301963 - RNA, 64 nt, hsa
auaucaagaaaagugcaauuucaugcugaaugaagcguaggaacuugacaagcccauagguagc

SEQ ID NO: 301964 - RNA, 64 nt, hsa
auauaacuggcuguuuucuguucuuguuuauccagcguaggaagaaggaaaagaaaaucuuugc

SEQ ID NO: 301965 - RNA, 64 nt, hsa
ucuuucugggaggcauguuuuauccuaucccucugcguaggaauaaccauaauuaucuuacuaa

SEQ ID NO: 301966 - RNA, 64 nt, hsa
uugugagagaaaauacuauuucaagucauauucugcguaggaaaaugaauugguuggggaaagu

SEQ ID NO: 301967 - RNA, 64 nt, hsa
ccugcacacaugagccuuccgggcuggaaggcuggcguaggacuuggggcuguagcaucaucuu

SEQ ID NO: 301968 - RNA, 64 nt, hsa
gucacuugcaauuguuaaucaaagauugaacacugcguaggagagggagaugauccagagacau

SEQ ID NO: 301969 - RNA, 64 nt, hsa
cugaacuaagacacagggaguauuucagaggccagcguaggagucauugacaacaaaaagccga

SEQ ID NO: 301970 - RNA, 64 nt, hsa
cuuauauacuuaucagggccauacugguaagcuugcguaggaggaguuagagggaaguugaaag

SEQ ID NO: 301971 - RNA, 64 nt, hsa
uuuggccuggugcucacugggaccccauaugucugcguaggagcagaacuuuccauggcaguaa

SEQ ID NO: 301972 - RNA, 64 nt, hsa
gccccaggcggaccagagguggaaggcgcggcgggcguaggagggugggcuggcgguacccacc

SEQ ID NO: 301973 - RNA, 64 nt, hsa
gagacaccuacagcguggaugcuguuccgagucagcguaggagaaaggccacuggaaaccagag

SEQ ID NO: 301974 - RNA, 64 nt, hsa
ccgccugggcugacugaugaggcagagccucucagcguaggaagcuggcugcuuaaugagcugg

SEQ ID NO: 301975 - RNA, 64 nt, hsa
auuguaauuauuauaaucgucagccucuucaauggcguaggaaagaagaaacaaaugcuugaau

SEQ ID NO: 301976 - RNA, 64 nt, hsa
ucuaaagguuucacuguucaugaauacguaaacugcguaggagagaacagggaugcuaucucgc

SEQ ID NO: 301977 - RNA, 64 nt, hsa
gagacggcccugcugcggacggagcgcggaaacugcguaggaauucaguggugguggguuuuuu

SEQ ID NO: 301978 - RNA, 64 nt, hsa; identical to SEQ ID NO: 93680

SEQ ID NO: 301979 - RNA, 64 nt, hsa; identical to SEQ ID NO: 93681

SEQ ID NO: 301980 - RNA, 64 nt, hsa; identical to SEQ ID NO: 93682

SEQ ID NO: 301981 - RNA, 64 nt, hsa; identical to SEQ ID NO: 93683

SEQ ID NO: 301982 - RNA, 64 nt, hsa; identical to SEQ ID NO: 93684

SEQ ID NO: 301983 - RNA, 64 nt, hsa; identical to SEQ ID NO: 93685

SEQ ID NO: 301984 - RNA, 64 nt, hsa; identical to SEQ ID NO: 93686

SEQ ID NO: 301985 - RNA, 64 nt, hsa; identical to SEQ ID NO: 93687

SEQ ID NO: 301986 - RNA, 64 nt, hsa; identical to SEQ ID NO: 246057

SEQ ID NO: 301987 - RNA, 64 nt, hsa; identical to SEQ ID NO: 246058

SEQ ID NO: 301988 - RNA, 64 nt, hsa; identical to SEQ ID NO: 246059

SEQ ID NO: 301989 - RNA, 64 nt, hsa; identical to SEQ ID NO: 246060

SEQ ID NO: 301990 - RNA, 64 nt, hsa; identical to SEQ ID NO: 246061

SEQ ID NO: 301991 - RNA, 64 nt, hsa; identical to SEQ ID NO: 246062

SEQ ID NO: 301992 - RNA, 64 nt, hsa; identical to SEQ ID NO: 246063

SEQ ID NO: 301993 - RNA, 64 nt, hsa; identical to SEQ ID NO: 246064

SEQ ID NO: 301994 - RNA, 64 nt, hsa; identical to SEQ ID NO: 246065

SEQ ID NO: 301995 - RNA, 64 nt, hsa; identical to SEQ ID NO: 246066

SEQ ID NO: 301996 - RNA, 64 nt, hsa; identical to SEQ ID NO: 246067

SEQ ID NO: 301997 - RNA, 64 nt, hsa; identical to SEQ ID NO: 246068

SEQ ID NO: 301998 - RNA, 64 nt, hsa; identical to SEQ ID NO: 246069

SEQ ID NO: 301999 - RNA, 64 nt, hsa; identical to SEQ ID NO: 246070

SEQ ID NO: 302000 - RNA, 64 nt, hsa; identical to SEQ ID NO: 246071

SEQ ID NO: 302001 - RNA, 64 nt, hsa; identical to SEQ ID NO: 246072

SEQ ID NO: 302002 - RNA, 64 nt, hsa; identical to SEQ ID NO: 246073

SEQ ID NO: 302003 - RNA, 64 nt, hsa; identical to SEQ ID NO: 246074

SEQ ID NO: 302004 - RNA, 64 nt, hsa
augcuucuaguauuguuuccccacuuaaaauaguccugcuuaaauucacaugguguggucugau

SEQ ID NO: 302005 - RNA, 64 nt, hsa
ugaguuuagucacaacuccugagugucccgcucuccugcuuaccuaggaggugagugccaggaa

SEQ ID NO: 302006 - RNA, 64 nt, hsa
acauguuauuguuuucaaccuagaaaccuuuaucccugcuuaucugaaacuucccaacuucccu

SEQ ID NO: 302007 - RNA, 64 nt, hsa
gauuugguuguuuaaauauaaaucugaucaccccccugcuuagaacccuucugcuuucuauuac

SEQ ID NO: 302008 - RNA, 64 nt, hsa
uuaaaucugacaugguaggagaggggagauguguccugcuuauuaaauguguugguccauugaa

SEQ ID NO: 302009 - RNA, 64 nt, hsa
ccaaugguuucaguuugcuugagcauaugaaaauccugcuuaaugugcuuaagaguauaauaaa

SEQ ID NO: 302010 - RNA, 64 nt, hsa
cuaaaaauugugguuguuuuuucuguuuacguaaccugcuuaguauugacacucucuaccaaga

SEQ ID NO: 302011 - RNA, 64 nt, hsa
gggugacagcaugguaaugaaggacagugaggcuccugcuuauuuauaaaucauuuccuuucuu

SEQ ID NO: 302012 - RNA, 64 nt, hsa; identical to SEQ ID NO: 246041

SEQ ID NO: 302013 - RNA, 64 nt, hsa; identical to SEQ ID NO: 246042

SEQ ID NO: 302014 - RNA, 64 nt, hsa; identical to SEQ ID NO: 246043

SEQ ID NO: 302015 - RNA, 64 nt, hsa; identical to SEQ ID NO: 246044

SEQ ID NO: 302016 - RNA, 64 nt, hsa; identical to SEQ ID NO: 246045

SEQ ID NO: 302017 - RNA, 64 nt, hsa; identical to SEQ ID NO: 246046

SEQ ID NO: 302018 - RNA, 64 nt, hsa; identical to SEQ ID NO: 246047

SEQ ID NO: 302019 - RNA, 64 nt, hsa; identical to SEQ ID NO: 246048

SEQ ID NO: 302020 - RNA, 64 nt, hsa; identical to SEQ ID NO: 246049

SEQ ID NO: 302021 - RNA, 64 nt, hsa; identical to SEQ ID NO: 246050

SEQ ID NO: 302022 - RNA, 64 nt, hsa; identical to SEQ ID NO: 246051

SEQ ID NO: 302023 - RNA, 64 nt, hsa; identical to SEQ ID NO: 246052

SEQ ID NO: 302024 - RNA, 64 nt, hsa; identical to SEQ ID NO: 246053

SEQ ID NO: 302025 - RNA, 64 nt, hsa; identical to SEQ ID NO: 246054

SEQ ID NO: 302026 - RNA, 64 nt, hsa; identical to SEQ ID NO: 246055

SEQ ID NO: 302027 - RNA, 64 nt, hsa; identical to SEQ ID NO: 246056

SEQ ID NO: 302028 - RNA, 64 nt, hsa; identical to SEQ ID NO: 102243

SEQ ID NO: 302029 - RNA, 64 nt, hsa; identical to SEQ ID NO: 102244

SEQ ID NO: 302030 - RNA, 64 nt, hsa; identical to SEQ ID NO: 102245

SEQ ID NO: 302031 - RNA, 64 nt, hsa; identical to SEQ ID NO: 102246

SEQ ID NO: 302032 - RNA, 64 nt, hsa; identical to SEQ ID NO: 102247

SEQ ID NO: 302033 - RNA, 64 nt, hsa; identical to SEQ ID NO: 102248

SEQ ID NO: 302034 - RNA, 64 nt, hsa; identical to SEQ ID NO: 102249

SEQ ID NO: 302035 - RNA, 64 nt, hsa; identical to SEQ ID NO: 102250

SEQ ID NO: 302036 - RNA, 64 nt, hsa; identical to SEQ ID NO: 102251

SEQ ID NO: 302037 - RNA, 64 nt, hsa; identical to SEQ ID NO: 102252

SEQ ID NO: 302038 - RNA, 64 nt, hsa; identical to SEQ ID NO: 102253

SEQ ID NO: 302039 - RNA, 64 nt, hsa; identical to SEQ ID NO: 102254

SEQ ID NO: 302040 - RNA, 64 nt, hsa; identical to SEQ ID NO: 102255

SEQ ID NO: 302041 - RNA, 64 nt, hsa; identical to SEQ ID NO: 102256

SEQ ID NO: 302042 - RNA, 64 nt, hsa; identical to SEQ ID NO: 102257

SEQ ID NO: 302043 - RNA, 64 nt, hsa; identical to SEQ ID NO: 102258

SEQ ID NO: 302044 - RNA, 62 nt, hsa; identical to SEQ ID NO: 103355

SEQ ID NO: 302045 - RNA, 62 nt, hsa; identical to SEQ ID NO: 103356

SEQ ID NO: 302046 - RNA, 62 nt, hsa; identical to SEQ ID NO: 103472

SEQ ID NO: 302047 - RNA, 62 nt, hsa; identical to SEQ ID NO: 103473

SEQ ID NO: 302048 - RNA, 64 nt, hsa
aguaugugaagaaaaucuacuuguaaaaggcucagaucuuaauuaaaagguaauuguagcacau

SEQ ID NO: 302049 - RNA, 64 nt, hsa
agcaaugaauugugccuaguggagaaccucuauagaucuuaaaaaaugaauuauucuuuagcag

SEQ ID NO: 302050 - RNA, 64 nt, hsa
cuuguuuuugugugugcauaaauucauucuguaggaucuuaagaaaaagagucccagaauguug

SEQ ID NO: 302051 - RNA, 64 nt, hsa
agaaagaagaugaauuauagcuccggagaaucaagaucuuaagugaagccuuucuguucagaug

SEQ ID NO: 302052 - RNA, 64 nt, hsa
ggggcugggaauugucucuuuguuccuauaaguagaucuuaauguaaaauaguaaauguccauu

SEQ ID NO: 302053 - RNA, 64 nt, hsa
aggugugagccaccgugcccggcccagauagguugaucuuaauguaacaacccaaaaauaaaug

SEQ ID NO: 302054 - RNA, 64 nt, hsa
agaacucccuuuggcuacuuuugaaaaucaagaugagauauauagauauauauccauacauuuu

SEQ ID NO: 302055 - RNA, 64 nt, hsa
uuucuaauacuaauguuauuucuuaaaauucagugagauauaggauaaaauaaugcuuugagaa

SEQ ID NO: 302056 - RNA, 64 nt, hsa
auauagcugucccaucuucccccauucaggguaggagauauagugacccagacuucaugcaaau

SEQ ID NO: 302057 - RNA, 64 nt, hsa
aguugccagguuuuagcugccaccgcuucaguaugagauauagcugucccaucuucccccauuc

SEQ ID NO: 302058 - RNA, 64 nt, hsa
uuagaaauucaaguauuuucaaggggagucauuugagauauauuuauuuuacuaggagaucuua

SEQ ID NO: 302059 - RNA, 64 nt, hsa
ugagacuuuucagguguuggagccucuaaaauaugagauauaaacagaaacuaauacaaguugu

SEQ ID NO: 302060 - RNA, 64 nt, hsa
agaagccauauauuggcuuuucuucuuaacuugggagauauauugaaacaaggugcuuuauaag

SEQ ID NO: 302061 - RNA, 64 nt, hsa
aaagagugaauaagauuauuagaauucagcaauagagauauaucuauuuucaauucaacuacag

SEQ ID NO: 302062 - RNA, 64 nt, hsa
uuuguacugguuguaacuugcauuagaaaaaaaagagauauauacaccacaaagaaucuaauaa

SEQ ID NO: 302063 - RNA, 64 nt, hsa
acaccacaaagaaucuaauaagaaauuuauuauggagauauagcccuuaaaaugcaauauuaag

SEQ ID NO: 302064 - RNA, 64 nt, hsa; identical to SEQ ID NO: 106125

SEQ ID NO: 302065 - RNA, 64 nt, hsa; identical to SEQ ID NO: 106126

SEQ ID NO: 302066 - RNA, 64 nt, hsa; identical to SEQ ID NO: 106127

SEQ ID NO: 302067 - RNA, 64 nt, hsa; identical to SEQ ID NO: 106128

SEQ ID NO: 302068 - RNA, 64 nt, hsa; identical to SEQ ID NO: 106129

SEQ ID NO: 302069 - RNA, 64 nt, hsa; identical to SEQ ID NO: 106130

SEQ ID NO: 302070 - RNA, 63 nt, hsa
gaugucuaagacaggaggaucacaagagcccaggagguugagaaugcagugagcuuguaauug

SEQ ID NO: 302071 - RNA, 63 nt, hsa
gggaggcugaggcacgagauuccuugaacccaagagguugaggcuauguugagcugagaucac

SEQ ID NO: 302072 - RNA, 63 nt, hsa
aagaugcuuaggcaccuaagcaaauaauacuuagagguugaauuuggucuacaggcuagcagu

SEQ ID NO: 302073 - RNA, 63 nt, hsa
ugauuagggaaccuguauaaggguauugagugugagguugaggugggacauuugcugagcaag

SEQ ID NO: 302074 - RNA, 63 nt, hsa
caguggcucacgccuguaaucccagcacuuugggagguugaggugggcagaucgccugagguc

SEQ ID NO: 302075 - RNA, 63 nt, hsa
cugggacuucggcuagggaggaagguagaguaagagguugaagauaacagagugcaaaguuuc

SEQ ID NO: 302076 - RNA, 63 nt, hsa
cacaucuuuggagccucgggauaaaaugacagugagguugaaaagugaaaacccuagaacuug

SEQ ID NO: 302077 - RNA, 63 nt, hsa
auggauaucaguucugccucacauuucccacuugagguugaggcguacuggagacaacaccuc

SEQ ID NO: 302078 - RNA, 64 nt, hsa
ugguuguaugaaaugaaaaaaggggcagagugcaaagacccacacucacgcacacgcgcuucuu

SEQ ID NO: 302079 - RNA, 64 nt, hsa
gagagagaaagagagagagagcgcgagagagaucaagacccaaguuuugaaucucaaccgaggu

SEQ ID NO: 302080 - RNA, 64 nt, hsa
aaaaauagcuuuccuggcuaaaagacccagguaaaagacccaaccccagcagaaagacaccgcg

SEQ ID NO: 302081 - RNA, 63 nt, hsa
ggauugccaauaaaaaauagcuuuccuggcuaaaagacccagguaaaagacccaaccccagca

SEQ ID NO: 302082 - RNA, 64 nt, hsa
uuaauuauacccauagguaauacaaaaagcucugaagacccaaagaugacauuacuaaugaugu

SEQ ID NO: 302083 - RNA, 64 nt, hsa
cagacucacagagugaauucagcucuucugaaucaagacccacccagucucuuucauucagacc

SEQ ID NO: 302084 - RNA, 64 nt, hsa
gcgagacucugucucaaaacaaacaaacaaacaaaagacccaaucugagucuuaucguuguacu

SEQ ID NO: 302085 - RNA, 64 nt, hsa
gucuaaggcaugaauaagaggggaggucaaaauaaagacccaaucugaggccgggcacgguggc

SEQ ID NO: 302086 - RNA, 64 nt, hsa; identical to SEQ ID NO: 73175

SEQ ID NO: 302087 - RNA, 64 nt, hsa; identical to SEQ ID NO: 73176

SEQ ID NO: 302088 - RNA, 64 nt, hsa; identical to SEQ ID NO: 73177

SEQ ID NO: 302089 - RNA, 64 nt, hsa; identical to SEQ ID NO: 73178

SEQ ID NO: 302090 - RNA, 64 nt, hsa; identical to SEQ ID NO: 73179

SEQ ID NO: 302091 - RNA, 64 nt, hsa; identical to SEQ ID NO: 73180

SEQ ID NO: 302092 - RNA, 64 nt, hsa; identical to SEQ ID NO: 73181

SEQ ID NO: 302093 - RNA, 64 nt, hsa; identical to SEQ ID NO: 73182

SEQ ID NO: 302094 - RNA, 64 nt, hsa; identical to SEQ ID NO: 73183

SEQ ID NO: 302095 - RNA, 64 nt, hsa; identical to SEQ ID NO: 73184

SEQ ID NO: 302096 - RNA, 64 nt, hsa; identical to SEQ ID NO: 74265

SEQ ID NO: 302097 - RNA, 64 nt, hsa; identical to SEQ ID NO: 74266

SEQ ID NO: 302098 - RNA, 64 nt, hsa; identical to SEQ ID NO: 74267

SEQ ID NO: 302099 - RNA, 64 nt, hsa; identical to SEQ ID NO: 74268

SEQ ID NO: 302100 - RNA, 64 nt, hsa; identical to SEQ ID NO: 74269

SEQ ID NO: 302101 - RNA, 64 nt, hsa; identical to SEQ ID NO: 74270

SEQ ID NO: 302102 - RNA, 64 nt, hsa; identical to SEQ ID NO: 74271

SEQ ID NO: 302103 - RNA, 64 nt, hsa; identical to SEQ ID NO: 74272

SEQ ID NO: 302104 - RNA, 64 nt, hsa; identical to SEQ ID NO: 74273

SEQ ID NO: 302105 - RNA, 64 nt, hsa; identical to SEQ ID NO: 74274

SEQ ID NO: 302106 - RNA, 64 nt, hsa; identical to SEQ ID NO: 74272

SEQ ID NO: 302107 - RNA, 64 nt, hsa; identical to SEQ ID NO: 74276

SEQ ID NO: 302108 - RNA, 64 nt, hsa; identical to SEQ ID NO: 74277

SEQ ID NO: 302109 - RNA, 64 nt, hsa; identical to SEQ ID NO: 74278

SEQ ID NO: 302110 - RNA, 64 nt, hsa; identical to SEQ ID NO: 74279

SEQ ID NO: 302111 - RNA, 64 nt, hsa; identical to SEQ ID NO: 74280

SEQ ID NO: 302112 - RNA, 64 nt, hsa; identical to SEQ ID NO: 74281

SEQ ID NO: 302113 - RNA, 64 nt, hsa; identical to SEQ ID NO: 74282

SEQ ID NO: 302114 - RNA, 64 nt, hsa; identical to SEQ ID NO: 74283

SEQ ID NO: 302115 - RNA, 64 nt, hsa; identical to SEQ ID NO: 74284

SEQ ID NO: 302116 - RNA, 64 nt, hsa; identical to SEQ ID NO: 74285

SEQ ID NO: 302117 - RNA, 64 nt, hsa; identical to SEQ ID NO: 74286

SEQ ID NO: 302118 - RNA, 64 nt, hsa; identical to SEQ ID NO: 74287

SEQ ID NO: 302119 - RNA, 64 nt, hsa; identical to SEQ ID NO: 74288

SEQ ID NO: 302120 - RNA, 64 nt, hsa; identical to SEQ ID NO: 74289

SEQ ID NO: 302121 - RNA, 64 nt, hsa
gccucauuauuuggaauuugagagaagguauaggugaucggaucuguuucauuuauaaaagguc

SEQ ID NO: 302122 - RNA, 64 nt, hsa
gguguuugggaaauucugagaugggagugagaucugaucggauccugggaagauguauacccag

SEQ ID NO: 302123 - RNA, 64 nt, hsa
agaugcagccacagauugaucaucugccuuaacgugaucggagaugcuuuguaaucuacugucc

SEQ ID NO: 302124 - RNA, 64 nt, hsa
cuauguuucuuaaugauauuuuguuguguaaaauugaucggauugauuaaaaaacaaauucucu

SEQ ID NO: 302125 - RNA, 64 nt, hsa
gggugaugaucuucugaagcucuuggaugucauuugaucggaauaugcaguggaauaggugacu

SEQ ID NO: 302126 - RNA, 64 nt, hsa
agcaugaauugaggaacagaagaagcagagcagaugaucggagcagcauuuguuucuccccaaa

SEQ ID NO: 302127 - RNA, 64 nt, hsa
gcgccaggccucucccuggccucuuaccugucagugaucggagcacugcccugggcuggccggc

SEQ ID NO: 302128 - RNA, 64 nt, hsa
aauuuaaccuccugauguggauuccucaaagacuugaucggagaauacucuuguuucaccauua

SEQ ID NO: 302129 - RNA, 64 nt, hsa
cagagcaaugaguugggaaaagagguggcauuucugaucggauaauggaauacucucauuuauu

SEQ ID NO: 302130 - RNA, 64 nt, hsa
guguguuuguuguuuguuuuguaucuuguuuuucugaucggagcaucacuacugaccuguugua

SEQ ID NO: 302131 - RNA, 64 nt, hsa
ugaccugaggccaucuucggugaagcaagggugaugaucggagacuacuuacuuucuccagugg

SEQ ID NO: 302132 - RNA, 64 nt, hsa
ugcagaaaauaagcacagaaaauuauaauguaggugaucggagcucuuuccuuugauagagaga

SEQ ID NO: 302133 - RNA, 64 nt, hsa
ucacaguuauuuccaguuuauaaaaaggaaaagcugaucggauccauguuucucucugcgaguc

SEQ ID NO: 302134 - RNA, 64 nt, hsa
agcuaugaugguauuugaguagugagguuacuuuugaucggagcaacauaaugcucauagaauc

SEQ ID NO: 302135 - RNA, 64 nt, hsa
uagauauuuuaauucaaagggauacuggcucucuugaucggaauuucuuguuaucaccauucca

SEQ ID NO: 302136 - RNA, 64 nt, hsa
uuuggugaccucccuuacugggcuaaucagcacuugaucggaaguccagguuaguaugugaagc

SEQ ID NO: 302137 - RNA, 64 nt, hsa
caggaccccaagauacagaaggaaaucaugcgugugaucggaacucagguuuacacaaacugag

SEQ ID NO: 302138 - RNA, 64 nt, hsa
uuagaacagaauauauaccugaacuguagugguuugaucggauggagacagaaaacccgauuuu

SEQ ID NO: 302139 - RNA, 64 nt, hsa
gcggcccuggaggaguucauccacgagggguaccugaucggagaggagggcuacugccucacau

SEQ ID NO: 302140 - RNA, 64 nt, hsa
guaaauguuuuauuaguucauugccugcacuuacugaucggaagagagaaagaacaguuucagu

SEQ ID NO: 302141 - RNA, 64 nt, hsa
uguuucuugagcaucuggucuggggggaccacuuugaucggacccacccuuggaaagcucaggg

SEQ ID NO: 302142 - RNA, 64 nt, hsa
aaagugcguacaguuagaacguccggcacguaacugaucggagcauucugggaagaaguaauuu

SEQ ID NO: 302143 - RNA, 64 nt, hsa
uuuacuugaccuccuaacaaguagcacccuggauugaucggagccuccucucucaaacuggggc

SEQ ID NO: 302144 - RNA, 64 nt, hsa
cccuuagggaguccccaacacucccccccuccuuugaucggaauauguacugugaagaguaggg

SEQ ID NO: 302145 - RNA, 64 nt, hsa
gcuguucaggugggaccauggugcucuuuaagcgugaucggagggaagacacacagcagggcca

SEQ ID NO: 302146 - RNA, 64 nt, hsa
cugucuuagacugcuagcuuucuccuuaccgucuugaucggaaagcucuuccuaaucgcuaauc

SEQ ID NO: 302147 - RNA, 64 nt, hsa
aaaaggggguuaaaaagcagugcuuucaugaaugccauccuacacauauuauugcuauuaccug

SEQ ID NO: 302148 - RNA, 64 nt, hsa
caucacaucuuacugucgaaauuaaaugugugauccauccuaguauuuucuguuccauuccuuu

SEQ ID NO: 302149 - RNA, 64 nt, hsa
aggaggggaggagagauggauauuucagcccucuccauccuagucaacacuggauccaccuagu

SEQ ID NO: 302150 - RNA, 64 nt, hsa
ccuacccaugaccccuacuuggggcagaaaaaacccauccuaaaggcugggcccaugcaagggc

SEQ ID NO: 302151 - RNA, 64 nt, hsa
cccagggccaggccuaagaggcuucuggcagcuuccauccuacccaugaccccuacuuggggca

SEQ ID NO: 302152 - RNA, 64 nt, hsa; identical to SEQ ID NO: 61035

SEQ ID NO: 302153 - RNA, 64 nt, hsa; identical to SEQ ID NO: 61036

SEQ ID NO: 302154 - RNA, 64 nt, hsa; identical to SEQ ID NO: 61037

SEQ ID NO: 302155 - RNA, 64 nt, hsa; identical to SEQ ID NO: 61038

SEQ ID NO: 302156 - RNA, 64 nt, hsa; identical to SEQ ID NO: 61039

SEQ ID NO: 302157 - RNA, 64 nt, hsa; identical to SEQ ID NO: 61040

SEQ ID NO: 302158 - RNA, 64 nt, hsa; identical to SEQ ID NO: 61041

SEQ ID NO: 302159 - RNA, 64 nt, hsa; identical to SEQ ID NO: 61042

SEQ ID NO: 302160 - RNA, 64 nt, hsa; identical to SEQ ID NO: 61043

SEQ ID NO: 302161 - RNA, 64 nt, hsa; identical to SEQ ID NO: 61044

SEQ ID NO: 302162 - RNA, 64 nt, hsa; identical to SEQ ID NO: 61045

SEQ ID NO: 302163 - RNA, 64 nt, hsa; identical to SEQ ID NO: 61046

SEQ ID NO: 302164 - RNA, 64 nt, hsa; identical to SEQ ID NO: 61047

SEQ ID NO: 302165 - RNA, 64 nt, hsa; identical to SEQ ID NO: 61048

SEQ ID NO: 302166 - RNA, 64 nt, hsa; identical to SEQ ID NO: 61049

SEQ ID NO: 302167 - RNA, 64 nt, hsa; identical to SEQ ID NO: 61050

SEQ ID NO: 302168 - RNA, 64 nt, hsa; identical to SEQ ID NO: 61051

SEQ ID NO: 302169 - RNA, 64 nt, hsa; identical to SEQ ID NO: 61052

SEQ ID NO: 302170 - RNA, 64 nt, hsa; identical to SEQ ID NO: 61053

SEQ ID NO: 302171 - RNA, 64 nt, hsa; identical to SEQ ID NO: 61054

SEQ ID NO: 302172 - RNA, 64 nt, hsa; identical to SEQ ID NO: 61055

SEQ ID NO: 302173 - RNA, 64 nt, hsa; identical to SEQ ID NO: 61056

SEQ ID NO: 302174 - RNA, 64 nt, hsa; identical to SEQ ID NO: 61057

SEQ ID NO: 302175 - RNA, 64 nt, hsa; identical to SEQ ID NO: 61058

SEQ ID NO: 302176 - RNA, 64 nt, hsa; identical to SEQ ID NO: 61059

SEQ ID NO: 302177 - RNA, 64 nt, hsa; identical to SEQ ID NO: 61060

SEQ ID NO: 302178 - RNA, 64 nt, hsa; identical to SEQ ID NO: 61061

SEQ ID NO: 302179 - RNA, 64 nt, hsa; identical to SEQ ID NO: 61062

SEQ ID NO: 302180 - RNA, 64 nt, hsa; identical to SEQ ID NO: 61063

SEQ ID NO: 302181 - RNA, 64 nt, hsa; identical to SEQ ID NO: 61064

SEQ ID NO: 302182 - RNA, 64 nt, hsa; identical to SEQ ID NO: 61065

SEQ ID NO: 302183 - RNA, 64 nt, hsa; identical to SEQ ID NO: 61066

SEQ ID NO: 302184 - RNA, 64 nt, hsa; identical to SEQ ID NO: 61067

SEQ ID NO: 302185 - RNA, 64 nt, hsa; identical to SEQ ID NO: 61068

SEQ ID NO: 302186 - RNA, 64 nt, hsa; identical to SEQ ID NO: 61069

SEQ ID NO: 302187 - RNA, 64 nt, hsa; identical to SEQ ID NO: 61070

SEQ ID NO: 302188 - RNA, 64 nt, hsa; identical to SEQ ID NO: 61071

SEQ ID NO: 302189 - RNA, 64 nt, hsa; identical to SEQ ID NO: 61072

SEQ ID NO: 302190 - RNA, 64 nt, hsa; identical to SEQ ID NO: 61073

SEQ ID NO: 302191 - RNA, 64 nt, hsa; identical to SEQ ID NO: 61074

SEQ ID NO: 302192 - RNA, 64 nt, hsa; identical to SEQ ID NO: 61075

SEQ ID NO: 302193 - RNA, 64 nt, hsa; identical to SEQ ID NO: 61076

SEQ ID NO: 302194 - RNA, 64 nt, hsa; identical to SEQ ID NO: 61077

SEQ ID NO: 302195 - RNA, 64 nt, hsa; identical to SEQ ID NO: 61078

SEQ ID NO: 302196 - RNA, 64 nt, hsa; identical to SEQ ID NO: 61079

SEQ ID NO: 302197 - RNA, 64 nt, hsa; identical to SEQ ID NO: 61080

SEQ ID NO: 302198 - RNA, 64 nt, hsa; identical to SEQ ID NO: 61081

SEQ ID NO: 302199 - RNA, 64 nt, hsa; identical to SEQ ID NO: 61082

SEQ ID NO: 302200 - RNA, 64 nt, hsa; identical to SEQ ID NO: 61083

SEQ ID NO: 302201 - RNA, 64 nt, hsa; identical to SEQ ID NO: 61084

SEQ ID NO: 302202 - RNA, 64 nt, hsa; identical to SEQ ID NO: 61085

SEQ ID NO: 302203 - RNA, 64 nt, hsa; identical to SEQ ID NO: 61085

SEQ ID NO: 302204 - RNA, 64 nt, hsa; identical to SEQ ID NO: 61087

SEQ ID NO: 302205 - RNA, 64 nt, hsa; identical to SEQ ID NO: 61088

SEQ ID NO: 302206 - RNA, 64 nt, hsa; identical to SEQ ID NO: 61089

SEQ ID NO: 302207 - RNA, 64 nt, hsa; identical to SEQ ID NO: 61090

SEQ ID NO: 302208 - RNA, 64 nt, hsa; identical to SEQ ID NO: 61091

SEQ ID NO: 302209 - RNA, 50 nt, hsa; identical to SEQ ID NO: 61092

SEQ ID NO: 302210 - RNA, 64 nt, hsa; identical to SEQ ID NO: 61093

SEQ ID NO: 302211 - RNA, 64 nt, hsa; identical to SEQ ID NO: 61094

SEQ ID NO: 302212 - RNA, 64 nt, hsa; identical to SEQ ID NO: 61095

SEQ ID NO: 302213 - RNA, 64 nt, hsa; identical to SEQ ID NO: 61096

SEQ ID NO: 302214 - RNA, 64 nt, hsa; identical to SEQ ID NO: 261635

SEQ ID NO: 302215 - RNA, 64 nt, hsa; identical to SEQ ID NO: 261636

SEQ ID NO: 302216 - RNA, 64 nt, hsa; identical to SEQ ID NO: 261637

SEQ ID NO: 302217 - RNA, 64 nt, hsa; identical to SEQ ID NO: 261638

SEQ ID NO: 302218 - RNA, 64 nt, hsa; identical to SEQ ID NO: 261639

SEQ ID NO: 302219 - RNA, 64 nt, hsa; identical to SEQ ID NO: 261640

SEQ ID NO: 302220 - RNA, 64 nt, hsa; identical to SEQ ID NO: 261641

SEQ ID NO: 302221 - RNA, 64 nt, hsa; identical to SEQ ID NO: 261642

SEQ ID NO: 302222 - RNA, 64 nt, hsa; identical to SEQ ID NO: 261643

SEQ ID NO: 302223 - RNA, 64 nt, hsa; identical to SEQ ID NO: 261644

SEQ ID NO: 302224 - RNA, 64 nt, hsa
auuuuaugcuuaaaaaguuaacaugauacgaaacugugauuagaaaauaucuggucuggaugug

SEQ ID NO: 302225 - RNA, 64 nt, hsa
uacgaaacugugauuagaaaauaucuggucuggaugugauuaguaaggauacaagauaauguuc

SEQ ID NO: 302226 - RNA, 64 nt, hsa
uguugagccuuuucaagaaccaacaaauuaucuuugugauuacaguaguuuaacuaugguuaaa

SEQ ID NO: 302227 - RNA, 64 nt, hsa
cacuguggaacaaaauauaaggguacuguuggggugugauuaugauaacuucaggcuuuuagcu

SEQ ID NO: 302228 - RNA, 64 nt, hsa
acuauuuccaaacuaaaaaugugauagauaaaagugugauuaaucaaaugauaugaucagagua

SEQ ID NO: 302229 - RNA, 64 nt, hsa
cucaugauccacccgccucgaccucccaaagugcugugauuacaggugugagccacugcacccg

SEQ ID NO: 302230 - RNA, 64 nt, hsa
ggauuugaaggaugaaauuaauuguaugaagcaaugugauuauaugaagagacacaaauuaaaa

SEQ ID NO: 302231 - RNA, 64 nt, hsa
aacuaugauguuuaguugcuuuauuuuaccucuaugugauuauuuuucuuaauuguuauuuuuu

SEQ ID NO: 302232 - RNA, 64 nt, hsa
acauaucuugaaagaaaagucugugagaaaacccugugauuagagggcaacuuaaugcaagauc

SEQ ID NO: 302233 - RNA, 64 nt, hsa
uuacugccuuuauucucuccuguauauuggauuuugugauuauauuugagugaauaggagaaaa

SEQ ID NO: 302234 - RNA, 64 nt, hsa
uuucauucucaugacugaacugugauuaggaaguugugauuauagauucugguuuuggccggaa

SEQ ID NO: 302235 - RNA, 64 nt, hsa
auuuccugcuuacuuuucauucucaugacugaacugugauuaggaaguugugauuauagauucu

SEQ ID NO: 302236 - RNA, 64 nt, hsa
aaugaccaagauccaagcaaucugaauuuguuuuugugauuauuugacuggaaugcuucuuaag

SEQ ID NO: 302237 - RNA, 64 nt, hsa
uugucaucacuuauucuagcaucacuguuaaggcugugauuauguuugauauucaccuggauuu

SEQ ID NO: 302238 - RNA, 64 nt, hsa
uaauuuuccugucuugaaacuguauaagaacucaugugauuaaguucacaguuuauuguuuguc

SEQ ID NO: 302239 - RNA, 64 nt, hsa
gagcauguaauaacuaauaaauaaugcagauccaugugauuauuaaaaugacuguagcugagag

SEQ ID NO: 302240 - RNA, 64 nt, hsa
gcaaacaacuauaaauggucucuaggccuuacuuugugauuauacguuaucuccggcuagaaaa

SEQ ID NO: 302241 - RNA, 64 nt, hsa
augugcagcuuuacauuuuauuuuacgugaagcaugugauuaggaaaacucauuuucuuuucaa

SEQ ID NO: 302242 - RNA, 64 nt, hsa
uggauuguauuuguagaguguuacgaguguaucaugugauuaugcuuuaccgguauaagagauu

SEQ ID NO: 302243 - RNA, 64 nt, hsa
ugugauuaugcuuuaccgguauaagagauucuguugugauuauuugaauaguuuuauauuaaua

SEQ ID NO: 302244 - RNA, 64 nt, hsa
uauugucucuuuauaaaugucauuuuacaaauuaugugauuaucuggaagcucuaagaugagag

SEQ ID NO: 302245 - RNA, 64 nt, hsa
caagugggaaaagagaacugccccaugcccagcuugugauuaucguuuuuggagaccugaagcc

SEQ ID NO: 302246 - RNA, 64 nt, hsa
uucauucagaaccuguuagauuaaagcugcacccugugauuauuugaaaagaauuagcuugaga

SEQ ID NO: 302247 - RNA, 64 nt, hsa
gacaaucucauuggaacaugucacaaaaaguuaaugugauuaagauuuaaaaacgaaaaguaug

SEQ ID NO: 302248 - RNA, 64 nt, hsa
ggacaaauguauagaauaaaccuuuuauuuaaguugugauuaccugcugcaugaaaagugcaug

SEQ ID NO: 302249 - RNA, 64 nt, hsa
acuuucauaucuggcucaacaucucaggaaaaucugugauuauuuguguguucuaaugaguaac

SEQ ID NO: 302250 - RNA, 64 nt, hsa
ugcagcagaauuugcauuugcuugaaguauggaaugugauuauagauuauaaaguauuaagaca

SEQ ID NO: 302251 - RNA, 64 nt, hsa
acauggagccaugaaaccuccuucuggccucccuugugauuaauggcauguguuuguaaaaugg

SEQ ID NO: 302252 - RNA, 64 nt, hsa
acacuucuuacauuguggcaagaaaaaaugaggaagaagcaaaagcagaaaccccugauaaacu

SEQ ID NO: 302253 - RNA, 64 nt, hsa
gcacuucuuacauggcagcaagagaaaaugaggaagaagcaaaaguggaaaccccugauaagcc

SEQ ID NO: 302254 - RNA, 64 nt, hsa
gguuuaaagaaauggucugcauaaccugaaugaaagaagcaaaugacuauucucugaagacaac

SEQ ID NO: 302255 - RNA, 64 nt, hsa
gaugcugugguggaugagguuggaguucgaaagaagaagcaagcgcuggccuggccuugaaaga

SEQ ID NO: 302256 - RNA, 64 nt, hsa
aaauaggaauccggcagaagaccuucauuaauuaagaagcaaacaaaaagagagcaacccaacc

SEQ ID NO: 302257 - RNA, 64 nt, hsa
uuccaaacaaugugaauuuaaaaggucacacaaaagaagcaaucgggcuccgccaccacaaaau

SEQ ID NO: 302258 - RNA, 64 nt, hsa
uaauucacaguccucagaagccuauuuuuaaagcagaagcaaaaaagaaaaacaaaauaacaaa

SEQ ID NO: 302259 - RNA, 64 nt, hsa
gggaugauaugugggcaaaaucacuuaugaaaguagaagcaagaaucaguugguuugcuaccac

SEQ ID NO: 302260 - RNA, 64 nt, hsa
cuucuuacauggcggcagcaagagaaaaugagaaagaagcaaaaguggaaaccccuaauaaacc

SEQ ID NO: 302261 - RNA, 64 nt, hsa
cuucguacauggugguggcaagagaaaaugaagaagaagcaaaaguggaaaccccugauaaacc

SEQ ID NO: 302262 - RNA, 64 nt, hsa
guugacuguucuugacuaaauuuucaagaguuucagaagcaacaggacagaccagacguuucau

SEQ ID NO: 302263 - RNA, 64 nt, hsa
uggacuuuuucauuccuguuuuucuuggcaggagagaagcaaggccacuaaaagaggagauggu

SEQ ID NO: 302264 - RNA, 64 nt, hsa
uaucaucuuugaaggacacucaaauuuauaagguagaagcaauuucccagauauaggcugaaca

SEQ ID NO: 302265 - RNA, 64 nt, hsa
uuuuuaaaaaauguaauugaauaagugugaaugcagaagcaaauauugucugcccuguuaaacu

SEQ ID NO: 302266 - RNA, 64 nt, hsa
auaccugccagcacuucugcaagcugaaauuuacagaagcaaauucaccagaagggaaacaucu

SEQ ID NO: 302267 - RNA, 64 nt, hsa
ugcauggcaugcacguauguaaguaaucuggggaagaagcaaagaucuguuucauucuuagccu

SEQ ID NO: 302268 - RNA, 64 nt, hsa
uggaaaacauauauauguuagcaucaaagggggcagaagcaaagaagauacagaucugcacuga

SEQ ID NO: 302269 - RNA, 64 nt, hsa
cauaaaggcuucauccacgaaccauccagcgcacagaagcaagugcaaaaaugacacaagcaca

SEQ ID NO: 302270 - RNA, 64 nt, hsa
ucaggugagccacucacccuccugcuggccuuggagaagcaaaaagccagggugugccaggaga

SEQ ID NO: 302271 - RNA, 64 nt, hsa
aucccuuccccucugccccaguguccugcugguuagaagcaaguucaaguccuucccauacuca

SEQ ID NO: 302272 - RNA, 64 nt, hsa
cugccuggaacaaagaacugcaccuaagcagaccagaagcaaaaugucuucuucacggccugag

SEQ ID NO: 302273 - RNA, 64 nt, hsa
ucagccuccagccauacagaacaaaugagaaauuagaagcaauuccaagaacgugugauggugu

SEQ ID NO: 302274 - RNA, 64 nt, hsa
aacugaacucuauuacuaaugccuuccaaucagaguuccugauggggaugccugugggauggcc

SEQ ID NO: 302275 - RNA, 64 nt, hsa
gauggggugaguuggguaaggaagaugaugcuuaguuccugauagaugcuacagauguaguuug

SEQ ID NO: 302276 - RNA, 64 nt, hsa
auuguaguugaaacacagaaaaugccacuuuucuguuccugaagaggcucuuuugugcauaaua

SEQ ID NO: 302277 - RNA, 64 nt, hsa
uuuguaguuccaaaaacccaucuaaauuucuugaguuccugaauuuugaacaggauuaccugga

SEQ ID NO: 302278 - RNA, 64 nt, hsa
agagggcccgcuaguuccaggggaacugaaagcuguuccugaucagcccguaucaucugaggcc

SEQ ID NO: 302279 - RNA, 64 nt, hsa
uggggcuguuguaagucuugcuggauguuccccuguuccugagccuuaaccccucgcacagcca

SEQ ID NO: 302280 - RNA, 64 nt, hsa
uggggucggaagacaaggggcuucugaaaugggaguuccugagauacaacaaaaugugugccuu

SEQ ID NO: 302281 - RNA, 64 nt, hsa
caaaaggcagcgaggaggcaccucgggucuugagguuccugacaaccgaucuggucuguugguu

SEQ ID NO: 302282 - RNA, 64 nt, hsa
aagcuuuacugcaaagugaaaagaugcuguggcaguuccugaaggugggaagccugaaggcuag

SEQ ID NO: 302283 - RNA, 64 nt, hsa
aaggauuccucccaaaauggaguuuguagguggaguuccugacuaaacugccacuuuaggaugg

SEQ ID NO: 302284 - RNA, 64 nt, hsa
uuagacggaaacagaaauugcuuuuccccucacuguuccugaaugcucuauacuuguuuuaaca

SEQ ID NO: 302285 - RNA, 64 nt, hsa
cuucaguugugaauccuaugguguuauuuauuuuguuccugaaaugggauuuagugcaaaaagu

SEQ ID NO: 302286 - RNA, 64 nt, hsa
guuagcugucuuugaugaggaauuauuguuauugguuccugaauaaaacauuaaccuuuuaagu

SEQ ID NO: 302287 - RNA, 64 nt, hsa
cacaggugcacucaugaaacucugcuuccaccauguuccugacaccuaucuauuaaaccauucu

SEQ ID NO: 302288 - RNA, 64 nt, hsa
cuugguugacuauuuuggaaauaggcauaucaagguuccugauucagcacuuugcucuuuuaau

SEQ ID NO: 302289 - RNA, 64 nt, hsa
aucaacaaguucuuguugacucagggcauaaugaguuccugagacaugcucuuuugggggcugg

SEQ ID NO: 302290 - RNA, 64 nt, hsa
caggcucugaguggggacugcacccacucaugcuguuccugaggccgcccucuccagucccagg

SEQ ID NO: 302291 - RNA, 64 nt, hsa
gccgcccucuccagucccaggagccgugucuagaguuccugaccagccaccuucugccagaacu

SEQ ID NO: 302292 - RNA, 64 nt, hsa
uaccucaguggggaggcuuccuuaccaagaaugaguuccugaaacccagggccagagacaagga

SEQ ID NO: 302293 - RNA, 64 nt, hsa
gggagccacacuggggccccccccccguggaaccguuccugaaaggccaccaggcgcccagugu

SEQ ID NO: 302294 - RNA, 64 nt, hsa
cuguuucuucccacccugucuucuccccuaggugguuccugagcccccacccccaaucccagug

SEQ ID NO: 302295 - RNA, 64 nt, hsa
ccacccacuccaggaacccagagccacauuagaaguuccugagggcuggagaacacugcugggc

SEQ ID NO: 302296 - RNA, 64 nt, hsa
ccgugcccaacgagaaggugcccugggagacggaguuccugaucuaugacccacccuuuuacac

SEQ ID NO: 302297 - RNA, 64 nt, hsa
ccuggcuggcucuucugugcuuuccacaaauaaaguuccugacacguccagggccaggggcugu

SEQ ID NO: 302298 - RNA, 64 nt, hsa
auucuaauuaagaagugaggccgaguuugacuucguuccugaauacaaucuugaguaacuggga

SEQ ID NO: 302299 - RNA, 64 nt, hsa
guucaauaagaaacccagccauuccgcauggcugguuccugaguggcucuggugauacucucca

SEQ ID NO: 302300 - RNA, 64 nt, hsa; identical to SEQ ID NO: 189120

SEQ ID NO: 302301 - RNA, 64 nt, hsa; identical to SEQ ID NO: 189121

SEQ ID NO: 302302 - RNA, 64 nt, hsa; identical to SEQ ID NO: 189122

SEQ ID NO: 302303 - RNA, 64 nt, hsa; identical to SEQ ID NO: 189123

SEQ ID NO: 302304 - RNA, 64 nt, hsa; identical to SEQ ID NO: 189124

SEQ ID NO: 302305 - RNA, 64 nt, hsa; identical to SEQ ID NO: 189125

SEQ ID NO: 302306 - RNA, 64 nt, hsa; identical to SEQ ID NO: 189126

SEQ ID NO: 302307 - RNA, 64 nt, hsa; identical to SEQ ID NO: 189127

SEQ ID NO: 302308 - RNA, 64 nt, hsa; identical to SEQ ID NO: 189128

SEQ ID NO: 302309 - RNA, 64 nt, hsa; identical to SEQ ID NO: 189129

SEQ ID NO: 302310 - RNA, 64 nt, hsa; identical to SEQ ID NO: 189130

SEQ ID NO: 302311 - RNA, 64 nt, hsa; identical to SEQ ID NO: 189131

SEQ ID NO: 302312 - RNA, 64 nt, hsa; identical to SEQ ID NO: 189132

SEQ ID NO: 302313 - RNA, 64 nt, hsa; identical to SEQ ID NO: 189133

SEQ ID NO: 302314 - RNA, 64 nt, hsa; identical to SEQ ID NO: 189134

SEQ ID NO: 302315 - RNA, 64 nt, hsa; identical to SEQ ID NO: 189135

SEQ ID NO: 302316 - RNA, 64 nt, hsa; identical to SEQ ID NO: 189136

SEQ ID NO: 302317 - RNA, 64 nt, hsa; identical to SEQ ID NO: 189137

SEQ ID NO: 302318 - RNA, 64 nt, hsa; identical to SEQ ID NO: 189138

SEQ ID NO: 302319 - RNA, 64 nt, hsa; identical to SEQ ID NO: 189139

SEQ ID NO: 302320 - RNA, 64 nt, hsa; identical to SEQ ID NO: 189140

SEQ ID NO: 302321 - RNA, 64 nt, hsa; identical to SEQ ID NO: 189141

SEQ ID NO: 302322 - RNA, 64 nt, hsa; identical to SEQ ID NO: 189142

SEQ ID NO: 302323 - RNA, 64 nt, hsa; identical to SEQ ID NO: 189143

SEQ ID NO: 302324 - RNA, 64 nt, hsa; identical to SEQ ID NO: 189144

SEQ ID NO: 302325 - RNA, 64 nt, hsa; identical to SEQ ID NO: 189145

SEQ ID NO: 302326 - RNA, 64 nt, hsa; identical to SEQ ID NO: 189146

SEQ ID NO: 302327 - RNA, 64 nt, hsa; identical to SEQ ID NO: 189147

SEQ ID NO: 302328 - RNA, 64 nt, hsa; identical to SEQ ID NO: 189148

SEQ ID NO: 302329 - RNA, 64 nt, hsa; identical to SEQ ID NO: 189149

SEQ ID NO: 302330 - RNA, 64 nt, hsa; identical to SEQ ID NO: 189150

SEQ ID NO: 302331 - RNA, 64 nt, hsa; identical to SEQ ID NO: 189151

SEQ ID NO: 302332 - RNA, 64 nt, hsa; identical to SEQ ID NO: 189152

SEQ ID NO: 302333 - RNA, 64 nt, hsa; identical to SEQ ID NO: 189153

SEQ ID NO: 302334 - RNA, 64 nt, hsa; identical to SEQ ID NO: 189154

SEQ ID NO: 302335 - RNA, 64 nt, hsa; identical to SEQ ID NO: 189155

SEQ ID NO: 302336 - RNA, 64 nt, hsa; identical to SEQ ID NO: 189156

SEQ ID NO: 302337 - RNA, 64 nt, hsa; identical to SEQ ID NO: 189157

SEQ ID NO: 302338 - RNA, 64 nt, hsa; identical to SEQ ID NO: 189158

SEQ ID NO: 302339 - RNA, 64 nt, hsa; identical to SEQ ID NO: 189159

SEQ ID NO: 302340 - RNA, 64 nt, hsa; identical to SEQ ID NO: 189160

SEQ ID NO: 302341 - RNA, 64 nt, hsa; identical to SEQ ID NO: 189161

SEQ ID NO: 302342 - RNA, 64 nt, hsa; identical to SEQ ID NO: 189162

SEQ ID NO: 302343 - RNA, 64 nt, hsa; identical to SEQ ID NO: 189163

SEQ ID NO: 302344 - RNA, 64 nt, hsa; identical to SEQ ID NO: 189164

SEQ ID NO: 302345 - RNA, 64 nt, hsa; identical to SEQ ID NO: 189165

SEQ ID NO: 302346 - RNA, 64 nt, hsa; identical to SEQ ID NO: 189166

SEQ ID NO: 302347 - RNA, 64 nt, hsa; identical to SEQ ID NO: 189167

SEQ ID NO: 302348 - RNA, 64 nt, hsa; identical to SEQ ID NO: 189168

SEQ ID NO: 302349 - RNA, 64 nt, hsa; identical to SEQ ID NO: 189169

SEQ ID NO: 302350 - RNA, 64 nt, hsa; identical to SEQ ID NO: 189170

SEQ ID NO: 302351 - RNA, 64 nt, hsa; identical to SEQ ID NO: 189171

SEQ ID NO: 302352 - RNA, 64 nt, hsa; identical to SEQ ID NO: 189172

SEQ ID NO: 302353 - RNA, 64 nt, hsa; identical to SEQ ID NO: 189173

SEQ ID NO: 302354 - RNA, 64 nt, hsa; identical to SEQ ID NO: 189174

SEQ ID NO: 302355 - RNA, 64 nt, hsa; identical to SEQ ID NO: 189175

SEQ ID NO: 302356 - RNA, 64 nt, hsa; identical to SEQ ID NO: 189176

SEQ ID NO: 302357 - RNA, 64 nt, hsa; identical to SEQ ID NO: 189177

SEQ ID NO: 302358 - RNA, 64 nt, hsa; identical to SEQ ID NO: 189178

SEQ ID NO: 302359 - RNA, 64 nt, hsa; identical to SEQ ID NO: 189179

SEQ ID NO: 302360 - RNA, 64 nt, hsa; identical to SEQ ID NO: 189180

SEQ ID NO: 302361 - RNA, 64 nt, hsa; identical to SEQ ID NO: 189181

SEQ ID NO: 302362 - RNA, 64 nt, hsa; identical to SEQ ID NO: 189182

SEQ ID NO: 302363 - RNA, 64 nt, hsa; identical to SEQ ID NO: 189183

SEQ ID NO: 302364 - RNA, 64 nt, hsa; identical to SEQ ID NO: 189184

SEQ ID NO: 302365 - RNA, 64 nt, hsa; identical to SEQ ID NO: 296855

SEQ ID NO: 302366 - RNA, 64 nt, hsa; identical to SEQ ID NO: 296856

SEQ ID NO: 302367 - RNA, 64 nt, hsa; identical to SEQ ID NO: 296857

SEQ ID NO: 302368 - RNA, 64 nt, hsa; identical to SEQ ID NO: 296858

SEQ ID NO: 302369 - RNA, 64 nt, hsa; identical to SEQ ID NO: 296859

SEQ ID NO: 302370 - RNA, 64 nt, hsa; identical to SEQ ID NO: 296860

SEQ ID NO: 302371 - RNA, 64 nt, hsa; identical to SEQ ID NO: 296861

SEQ ID NO: 302372 - RNA, 64 nt, hsa; identical to SEQ ID NO: 296862

SEQ ID NO: 302373 - RNA, 64 nt, hsa; identical to SEQ ID NO: 296863

SEQ ID NO: 302374 - RNA, 64 nt, hsa; identical to SEQ ID NO: 296864

SEQ ID NO: 302375 - RNA, 64 nt, hsa; identical to SEQ ID NO: 296865

SEQ ID NO: 302376 - RNA, 64 nt, hsa; identical to SEQ ID NO: 296866

SEQ ID NO: 302377 - RNA, 64 nt, hsa; identical to SEQ ID NO: 296867

SEQ ID NO: 302378 - RNA, 64 nt, hsa; identical to SEQ ID NO: 296868

SEQ ID NO: 302379 - RNA, 64 nt, hsa; identical to SEQ ID NO: 296869

SEQ ID NO: 302380 - RNA, 64 nt, hsa; identical to SEQ ID NO: 296870

SEQ ID NO: 302381 - RNA, 64 nt, hsa; identical to SEQ ID NO: 296871

SEQ ID NO: 302382 - RNA, 64 nt, hsa; identical to SEQ ID NO: 296872

SEQ ID NO: 302383 - RNA, 64 nt, hsa; identical to SEQ ID NO: 296873

SEQ ID NO: 302384 - RNA, 64 nt, hsa; identical to SEQ ID NO: 296874

SEQ ID NO: 302385 - RNA, 64 nt, hsa; identical to SEQ ID NO: 296875

SEQ ID NO: 302386 - RNA, 64 nt, hsa; identical to SEQ ID NO: 296876

SEQ ID NO: 302387 - RNA, 64 nt, hsa; identical to SEQ ID NO: 296877

SEQ ID NO: 302388 - RNA, 64 nt, hsa; identical to SEQ ID NO: 296878

SEQ ID NO: 302389 - RNA, 64 nt, hsa; identical to SEQ ID NO: 296879

SEQ ID NO: 302390 - RNA, 64 nt, hsa; identical to SEQ ID NO: 296880

SEQ ID NO: 302391 - RNA, 64 nt, hsa; identical to SEQ ID NO: 296881

SEQ ID NO: 302392 - RNA, 64 nt, hsa; identical to SEQ ID NO: 296882

SEQ ID NO: 302393 - RNA, 64 nt, hsa; identical to SEQ ID NO: 296883

SEQ ID NO: 302394 - RNA, 64 nt, hsa; identical to SEQ ID NO: 296884

SEQ ID NO: 302395 - RNA, 64 nt, hsa; identical to SEQ ID NO: 296885

SEQ ID NO: 302396 - RNA, 64 nt, hsa; identical to SEQ ID NO: 296886

SEQ ID NO: 302397 - RNA, 64 nt, hsa; identical to SEQ ID NO: 296887

SEQ ID NO: 302398 - RNA, 64 nt, hsa; identical to SEQ ID NO: 296888

SEQ ID NO: 302399 - RNA, 64 nt, hsa; identical to SEQ ID NO: 296889

SEQ ID NO: 302400 - RNA, 64 nt, hsa; identical to SEQ ID NO: 296890

SEQ ID NO: 302401 - RNA, 64 nt, hsa; identical to SEQ ID NO: 296891

SEQ ID NO: 302402 - RNA, 64 nt, hsa; identical to SEQ ID NO: 296892

SEQ ID NO: 302403 - RNA, 64 nt, hsa; identical to SEQ ID NO: 296893

SEQ ID NO: 302404 - RNA, 64 nt, hsa; identical to SEQ ID NO: 296894

SEQ ID NO: 302405 - RNA, 64 nt, hsa; identical to SEQ ID NO: 296895

SEQ ID NO: 302406 - RNA, 64 nt, hsa; identical to SEQ ID NO: 296896

SEQ ID NO: 302407 - RNA, 64 nt, hsa; identical to SEQ ID NO: 296897

SEQ ID NO: 302408 - RNA, 64 nt, hsa; identical to SEQ ID NO: 296898

SEQ ID NO: 302409 - RNA, 64 nt, hsa; identical to SEQ ID NO: 296899

SEQ ID NO: 302410 - RNA, 64 nt, hsa; identical to SEQ ID NO: 296900

SEQ ID NO: 302411 - RNA, 64 nt, hsa; identical to SEQ ID NO: 296901

SEQ ID NO: 302412 - RNA, 59 nt, hsa; identical to SEQ ID NO: 296902

SEQ ID NO: 302413 - RNA, 64 nt, hsa; identical to SEQ ID NO: 296903

SEQ ID NO: 302414 - RNA, 64 nt, hsa; identical to SEQ ID NO: 296904

SEQ ID NO: 302415 - RNA, 64 nt, hsa; identical to SEQ ID NO: 296905

SEQ ID NO: 302416 - RNA, 64 nt, hsa; identical to SEQ ID NO: 296906

SEQ ID NO: 302417 - RNA, 64 nt, hsa; identical to SEQ ID NO: 296907

SEQ ID NO: 302418 - RNA, 64 nt, hsa; identical to SEQ ID NO: 296908

SEQ ID NO: 302419 - RNA, 64 nt, hsa; identical to SEQ ID NO: 296909

SEQ ID NO: 302420 - RNA, 64 nt, hsa; identical to SEQ ID NO: 296910

SEQ ID NO: 302421 - RNA, 64 nt, hsa; identical to SEQ ID NO: 296911

SEQ ID NO: 302422 - RNA, 64 nt, hsa; identical to SEQ ID NO: 296912

SEQ ID NO: 302423 - RNA, 64 nt, hsa; identical to SEQ ID NO: 296913

SEQ ID NO: 302424 - RNA, 64 nt, hsa; identical to SEQ ID NO: 296914

SEQ ID NO: 302425 - RNA, 64 nt, hsa; identical to SEQ ID NO: 296915

SEQ ID NO: 302426 - RNA, 64 nt, hsa; identical to SEQ ID NO: 296916

SEQ ID NO: 302427 - RNA, 64 nt, hsa; identical to SEQ ID NO: 296917

SEQ ID NO: 302428 - RNA, 64 nt, hsa; identical to SEQ ID NO: 296918

SEQ ID NO: 302429 - RNA, 64 nt, hsa; identical to SEQ ID NO: 296919

SEQ ID NO: 302430 - RNA, 64 nt, hsa; identical to SEQ ID NO: 296920

SEQ ID NO: 302431 - RNA, 64 nt, hsa; identical to SEQ ID NO: 296921

SEQ ID NO: 302432 - RNA, 64 nt, hsa; identical to SEQ ID NO: 296922

SEQ ID NO: 302433 - RNA, 64 nt, hsa; identical to SEQ ID NO: 296923

SEQ ID NO: 302434 - RNA, 64 nt, hsa
caucugucaguaaugagaggauuggaagaauaauuuugcauacaaaugaggacuuaauuuguug

SEQ ID NO: 302435 - RNA, 64 nt, hsa
cacauguauauagugagaugucuuuauugugugcuuugcauauuuuguaaauauuuugcacguc

SEQ ID NO: 302436 - RNA, 64 nt, hsa
aaaugaaucauuucuuauaucuuauucaugaaaguuugcauacagauguuugcauauaugccuu

SEQ ID NO: 302437 - RNA, 64 nt, hsa
uuauaucuuauucaugaaaguuugcauacagauguuugcauauaugccuuuuugaauuuuugcu

SEQ ID NO: 302438 - RNA, 64 nt, hsa
ucauuuaaaaugcuaaaauagauacaaacucaauuuugcauagaaagguguauuuugaauaguu

SEQ ID NO: 302439 - RNA, 64 nt, hsa
uugaacuugagugaaaagguugaaguuacagacuuuugcauagaugguuugucaauuuaaaauu

SEQ ID NO: 302440 - RNA, 64 nt, hsa
aaucaacuuuuuuuuaugucuaaguaguagauuauuugcauauuuguaaaaacuguuaggucuu

SEQ ID NO: 302441 - RNA, 64 nt, hsa
auuuuauaagggguaguaagaauuggacaauuccuuugcauaucugaacuuggcagguaccguu

SEQ ID NO: 302442 - RNA, 64 nt, hsa
ucuuaaccuguucaggcuuuuaaaaaaaacuguuuuugcauaggguaguacuaagaucuuaaaa

SEQ ID NO: 302443 - RNA, 64 nt, hsa
cugugcuuaaaaaagaaauaauugaccaaguaaguuugcauaaaaugugaauacuaaauguguc

SEQ ID NO: 302444 - RNA, 64 nt, hsa
uguugcuaugugcaagauccucucuuggagcuuuuuugcauagcaauuaaaggugugcuauuug

SEQ ID NO: 302445 - RNA, 64 nt, hsa
cuuuucuuucuuucauucucucuuccugcaguguuuugcauacaucagaagcuagguacauaag

SEQ ID NO: 302446 - RNA, 64 nt, hsa
acuggccugugauugguccauuccaggaccuucauuugcauaagguaucaaaccacaucagccu

SEQ ID NO: 302447 - RNA, 64 nt, hsa
ucuggccaaugauugguucauuccaggacauucauuugcauaaggagucaaaccacaccagucu

SEQ ID NO: 302448 - RNA, 64 nt, hsa
ccuuugauaaaaaguguguauaauguaaaguaguuuugcauauucuugugcugcacaugggcug

SEQ ID NO: 302449 - RNA, 64 nt, hsa
cacuuuauguguacacauaaucauauuuaaguuuuuugcauaaaauaaaugcuucuagauguca

SEQ ID NO: 302450 - RNA, 64 nt, hsa
cauauguauuuuguauuugcauauguauuuuguauuugcauauguauuuuugucauagcagcaa

SEQ ID NO: 302451 - RNA, 64 nt, hsa
uuugucauauguauuuugucauauguauuuuguauuugcauauguauuuuguauuugcauaugu

SEQ ID NO: 302452 - RNA, 64 nt, hsa
uuuuaaguaucuucauuggagaugaacacugacuuuugcauauggucucuuaccucagggaaga

SEQ ID NO: 302453 - RNA, 64 nt, hsa
aggaaauuuuuaaacuuuuauauuguacacuauuuuugcauaaaauaagagcuguagcuaccaa

SEQ ID NO: 302454 - RNA, 64 nt, hsa
ugugcaugaauugauuauugagaaaauguagcaguuugcauauuuaaaaauuaaucauuuugca

SEQ ID NO: 302455 - RNA, 64 nt, hsa
acaauucuggaugcuaaaacuuagagauuuucucuuugcauaaauuuuggcuccauucuuucca

SEQ ID NO: 302456 - RNA, 64 nt, hsa
caaaaacauacugacucagggcucuuuuuuucuuuuugcauaugacaacuguuacuagaaauac

SEQ ID NO: 302457 - RNA, 64 nt, hsa
augacaacuguuacuagaaauacaggcuacugguuuugcauagaucauucaucuuaauuuuggu

SEQ ID NO: 302458 - RNA, 64 nt, hsa
cauacaacucacguaugcgggcaaacacuuuugauuugcauauccuggguguacugagccacau

SEQ ID NO: 302459 - RNA, 64 nt, hsa
auuuucuuuuggguggugacuguuuuuuucugacuuugcauaucccuagacacuagaacuaaag

SEQ ID NO: 302460 - RNA, 64 nt, hsa
guucacugaguaacuaaaauuuagcaaaccuguguuugcauauuuuuuuggagugcagaauauu

SEQ ID NO: 302461 - RNA, 64 nt, hsa
caguauacucaugauugcuaaguguuuuuuuauuuuugcauauuuauugaacugucuaauugaa

SEQ ID NO: 302462 - RNA, 64 nt, hsa
aucauauaucauuuaagcaguuugaaggcauacuuuugcauagaaauaaaaaaaauacugauuu

SEQ ID NO: 302463 - RNA, 64 nt, hsa
uuccaaagguuguugcucuacuuuguaggaagucuuugcauauggcccucccaacuuuaaaguc

SEQ ID NO: 302464 - RNA, 64 nt, hsa
agagcgagaugaauguggcaauugcucauuuuauuuugcauauauuaaauugaguagguucagc

SEQ ID NO: 302465 - RNA, 64 nt, hsa
gcaaacguuuuuccagggaguaaauauuuuacgcuuugcauauauaauuuauggagguguugag

SEQ ID NO: 302466 - RNA, 64 nt, hsa
uauucaaaaauaacaucugacuacuauaaaaauauuugcauauauaaguuugacaaagaaaaga

SEQ ID NO: 302467 - RNA, 64 nt, hsa
uauaaaauucaguuuuucauuuaacauuugcucuuuugcauaugaagagauauuuguauuuuuc

SEQ ID NO: 302468 - RNA, 64 nt, hsa
ugcuucucauucucaucagacucuccuuguuuuguuugcauauuuaauuuuaaauuaaaccaaa

SEQ ID NO: 302469 - RNA, 64 nt, hsa
cacccucucagaagaauccacaguguuugaacaauuugcauaaaggucagcuagcauccugcug

SEQ ID NO: 302470 - RNA, 64 nt, hsa
uuuuaauaguuuuuguuugcaguccucuguuaguuuugcauaguugcacuacaagaagaaugua

SEQ ID NO: 302471 - RNA, 64 nt, hsa
uauguauuuaaugauacacuguuuaauugacaguuuugcauaguuugucuaacuuuagagaauu

SEQ ID NO: 302472 - RNA, 64 nt, hsa
cuuauuacaugcuaaaguuaccuucucuuuguuuuuugcauaucuggaauuacaccuuuaaaga

SEQ ID NO: 302473 - RNA, 64 nt, hsa
aauggauguugacaacaacccaaugaaauaacauuuugcauaucugaaaagaagcauugaauau

SEQ ID NO: 302474 - RNA, 64 nt, hsa
augguuugucuuauuucauucauacugaaaauucuuugcauauuuuuuuucugcuuagacuuac

SEQ ID NO: 302475 - RNA, 64 nt, hsa
ucauuggcuuuaaagggauuuuagaauaucuuacuuugcauaguuucaugagcacuggccagga

SEQ ID NO: 302476 - RNA, 64 nt, hsa
cugcugugcuuauuugcauggacuuugcauaucauuugcauagacaccucugauccccuucagu

SEQ ID NO: 302477 - RNA, 64 nt, hsa
ccuggcucuaccugcugugcuuauuugcauggacuuugcauaucauuugcauagacaccucuga

SEQ ID NO: 302478 - RNA, 64 nt, hsa; identical to SEQ ID NO: 84790

SEQ ID NO: 302479 - RNA, 64 nt, hsa; identical to SEQ ID NO: 84791

SEQ ID NO: 302480 - RNA, 64 nt, hsa; identical to SEQ ID NO: 84792

SEQ ID NO: 302481 - RNA, 64 nt, hsa; identical to SEQ ID NO: 84793

SEQ ID NO: 302482 - RNA, 64 nt, hsa; identical to SEQ ID NO: 84794

SEQ ID NO: 302483 - RNA, 64 nt, hsa; identical to SEQ ID NO: 84795

SEQ ID NO: 302484 - RNA, 64 nt, hsa; identical to SEQ ID NO: 84796

SEQ ID NO: 302485 - RNA, 64 nt, hsa; identical to SEQ ID NO: 84797

SEQ ID NO: 302486 - RNA, 64 nt, hsa; identical to SEQ ID NO: 84798

SEQ ID NO: 302487 - RNA, 64 nt, hsa; identical to SEQ ID NO: 84799

SEQ ID NO: 302488 - RNA, 64 nt, hsa; identical to SEQ ID NO: 84800

SEQ ID NO: 302489 - RNA, 64 nt, hsa; identical to SEQ ID NO: 84801

SEQ ID NO: 302490 - RNA, 64 nt, hsa; identical to SEQ ID NO: 84802

SEQ ID NO: 302491 - RNA, 64 nt, hsa; identical to SEQ ID NO: 84803

SEQ ID NO: 302492 - RNA, 64 nt, hsa; identical to SEQ ID NO: 84804

SEQ ID NO: 302493 - RNA, 64 nt, hsa; identical to SEQ ID NO: 158204

SEQ ID NO: 302494 - RNA, 64 nt, hsa; identical to SEQ ID NO: 158205

SEQ ID NO: 302495 - RNA, 64 nt, hsa; identical to SEQ ID NO: 158206

SEQ ID NO: 302496 - RNA, 64 nt, hsa; identical to SEQ ID NO: 158207

SEQ ID NO: 302497 - RNA, 64 nt, hsa; identical to SEQ ID NO: 158208

SEQ ID NO: 302498 - RNA, 64 nt, hsa; identical to SEQ ID NO: 158209

SEQ ID NO: 302499 - RNA, 64 nt, hsa; identical to SEQ ID NO: 158210

SEQ ID NO: 302500 - RNA, 64 nt, hsa; identical to SEQ ID NO: 158211

SEQ ID NO: 302501 - RNA, 64 nt, hsa; identical to SEQ ID NO: 158212

SEQ ID NO: 302502 - RNA, 64 nt, hsa; identical to SEQ ID NO: 158213

SEQ ID NO: 302503 - RNA, 64 nt, hsa; identical to SEQ ID NO: 158214

SEQ ID NO: 302504 - RNA, 64 nt, hsa; identical to SEQ ID NO: 158215

SEQ ID NO: 302505 - RNA, 64 nt, hsa; identical to SEQ ID NO: 158216

SEQ ID NO: 302506 - RNA, 64 nt, hsa; identical to SEQ ID NO: 158217

SEQ ID NO: 302507 - RNA, 64 nt, hsa; identical to SEQ ID NO: 158218

SEQ ID NO: 302508 - RNA, 64 nt, hsa; identical to SEQ ID NO: 158219

SEQ ID NO: 302509 - RNA, 64 nt, hsa; identical to SEQ ID NO: 158220

SEQ ID NO: 302510 - RNA, 64 nt, hsa; identical to SEQ ID NO: 158221

SEQ ID NO: 302511 - RNA, 64 nt, hsa; identical to SEQ ID NO: 158222

SEQ ID NO: 302512 - RNA, 64 nt, hsa; identical to SEQ ID NO: 158223

SEQ ID NO: 302513 - RNA, 64 nt, hsa; identical to SEQ ID NO: 158224

SEQ ID NO: 302514 - RNA, 64 nt, hsa; identical to SEQ ID NO: 158225

SEQ ID NO: 302515 - RNA, 64 nt, hsa; identical to SEQ ID NO: 158226

SEQ ID NO: 302516 - RNA, 64 nt, hsa; identical to SEQ ID NO: 158227

SEQ ID NO: 302517 - RNA, 64 nt, hsa; identical to SEQ ID NO: 158228

SEQ ID NO: 302518 - RNA, 64 nt, hsa; identical to SEQ ID NO: 158229

SEQ ID NO: 302519 - RNA, 64 nt, hsa; identical to SEQ ID NO: 282714

SEQ ID NO: 302520 - RNA, 64 nt, hsa; identical to SEQ ID NO: 282715

SEQ ID NO: 302521 - RNA, 64 nt, hsa; identical to SEQ ID NO: 282716

SEQ ID NO: 302522 - RNA, 64 nt, hsa; identical to SEQ ID NO: 282717

SEQ ID NO: 302523 - RNA, 64 nt, hsa; identical to SEQ ID NO: 282718

SEQ ID NO: 302524 - RNA, 64 nt, hsa; identical to SEQ ID NO: 282719

SEQ ID NO: 302525 - RNA, 64 nt, hsa; identical to SEQ ID NO: 282720

SEQ ID NO: 302526 - RNA, 64 nt, hsa; identical to SEQ ID NO: 282721

SEQ ID NO: 302527 - RNA, 64 nt, hsa; identical to SEQ ID NO: 282722

SEQ ID NO: 302528 - RNA, 64 nt, hsa; identical to SEQ ID NO: 282723

SEQ ID NO: 302529 - RNA, 64 nt, hsa; identical to SEQ ID NO: 282724

SEQ ID NO: 302530 - RNA, 64 nt, hsa; identical to SEQ ID NO: 282725

SEQ ID NO: 302531 - RNA, 64 nt, hsa; identical to SEQ ID NO: 282726

SEQ ID NO: 302532 - RNA, 64 nt, hsa; identical to SEQ ID NO: 282727

SEQ ID NO: 302533 - RNA, 64 nt, hsa; identical to SEQ ID NO: 282728

SEQ ID NO: 302534 - RNA, 64 nt, hsa; identical to SEQ ID NO: 282729

SEQ ID NO: 302535 - RNA, 64 nt, hsa; identical to SEQ ID NO: 282730

SEQ ID NO: 302536 - RNA, 64 nt, hsa; identical to SEQ ID NO: 282731

SEQ ID NO: 302537 - RNA, 64 nt, hsa; identical to SEQ ID NO: 282732

SEQ ID NO: 302538 - RNA, 64 nt, hsa; identical to SEQ ID NO: 282733

SEQ ID NO: 302539 - RNA, 64 nt, hsa; identical to SEQ ID NO: 282734

SEQ ID NO: 302540 - RNA, 64 nt, hsa; identical to SEQ ID NO: 282735

SEQ ID NO: 302541 - RNA, 64 nt, hsa; identical to SEQ ID NO: 282736

SEQ ID NO: 302542 - RNA, 64 nt, hsa; identical to SEQ ID NO: 282737

SEQ ID NO: 302543 - RNA, 64 nt, hsa; identical to SEQ ID NO: 282738

SEQ ID NO: 302544 - RNA, 64 nt, hsa; identical to SEQ ID NO: 282739

SEQ ID NO: 302545 - RNA, 64 nt, hsa; identical to SEQ ID NO: 282740

SEQ ID NO: 302546 - RNA, 64 nt, hsa; identical to SEQ ID NO: 282741

SEQ ID NO: 302547 - RNA, 64 nt, hsa; identical to SEQ ID NO: 282742

SEQ ID NO: 302548 - RNA, 64 nt, hsa; identical to SEQ ID NO: 282743

SEQ ID NO: 302549 - RNA, 64 nt, hsa; identical to SEQ ID NO: 282744

SEQ ID NO: 302550 - RNA, 64 nt, hsa; identical to SEQ ID NO: 282745

SEQ ID NO: 302551 - RNA, 64 nt, hsa; identical to SEQ ID NO: 282746

SEQ ID NO: 302552 - RNA, 64 nt, hsa; identical to SEQ ID NO: 282747

SEQ ID NO: 302553 - RNA, 64 nt, hsa; identical to SEQ ID NO: 282748

SEQ ID NO: 302554 - RNA, 64 nt, hsa; identical to SEQ ID NO: 282749

SEQ ID NO: 302555 - RNA, 64 nt, hsa; identical to SEQ ID NO: 282750

SEQ ID NO: 302556 - RNA, 64 nt, hsa; identical to SEQ ID NO: 282751

SEQ ID NO: 302557 - RNA, 64 nt, hsa; identical to SEQ ID NO: 282752

SEQ ID NO: 302558 - RNA, 64 nt, hsa; identical to SEQ ID NO: 282753

SEQ ID NO: 302559 - RNA, 64 nt, hsa; identical to SEQ ID NO: 282754

SEQ ID NO: 302560 - RNA, 64 nt, hsa; identical to SEQ ID NO: 282755

SEQ ID NO: 302561 - RNA, 64 nt, hsa; identical to SEQ ID NO: 282754

SEQ ID NO: 302562 - RNA, 64 nt, hsa
aaucauauuuauuuggcuuuuuauuuaaaggauucugucacaagucuuauugaaaaguagauuu

SEQ ID NO: 302563 - RNA, 64 nt, hsa
ucagagucuuguucaagagaaagugaucaccgagcugucacaucagcaaauauguagucaaggc

SEQ ID NO: 302564 - RNA, 64 nt, hsa
ucugguugaauggcuuuucuuagugugguauuugcugucacauaguuuuuccugggugagucug

SEQ ID NO: 302565 - RNA, 64 nt, hsa
uuuacaugucaagaggaaaagcuguaagaaaaugcugucacagacccaucccuguggcaucguc

SEQ ID NO: 302566 - RNA, 64 nt, hsa
aauggacagaguuaucaaggcacauucuccaccacugucacaggaaggacaugucaaucuuggu

SEQ ID NO: 302567 - RNA, 64 nt, hsa
aauggacagaguuaucgaggcacauacuucaccacugucacaggaagaaccugccaagcuuggu

SEQ ID NO: 302568 - RNA, 64 nt, hsa
agugugaggcuccacuucuguugaauaugagcggcugucacacccaugagcaaguuuccuugau

SEQ ID NO: 302569 - RNA, 64 nt, hsa
uccaugccccaguucuaagcccuguggccaggugcugucacacagcaaaggggacuuugcaggu

SEQ ID NO: 302570 - RNA, 64 nt, hsa
agagcuucuacugaggagggcuguggcagagccacugucacacagaaugccggaggggcgcaga

SEQ ID NO: 302571 - RNA, 64 nt, hsa
gcaggggaccagcauacccgggagcugucccugucugucacagcacaguggggccacgaggcug

SEQ ID NO: 302572 - RNA, 64 nt, hsa
cauuuauaauaauauaauuucagucauuucuuaacugucacaucuauugaaaauggauauagau

SEQ ID NO: 302573 - RNA, 64 nt, hsa
gauguaaacuaauguaccucaguaauuaaauaugcugucacaacauuuaggaauuaagacagua

SEQ ID NO: 302574 - RNA, 64 nt, hsa
uugugccaggacugccgugcuccacugagcuccucugucacaccccauucuugccccucacugg

SEQ ID NO: 302575 - RNA, 64 nt, hsa
cuacaccaauaacugcugcaggugugauuuuggucugucacacuguacaucuaucauaaugugc

SEQ ID NO: 302576 - RNA, 64 nt, hsa
acagugaaugugucuggaccucauguuguugaggcugucacaguccugaguguggacuuggcag

SEQ ID NO: 302577 - RNA, 64 nt, hsa
ggugccuguugaaucugagcugcagguuccuuaucugucacaccugugccuccucagaggacag

SEQ ID NO: 302578 - RNA, 64 nt, hsa
ucacacacacccucaugugugaagggcagagacacugucacaaacaggcaugccccuuagaaga

SEQ ID NO: 302579 - RNA, 64 nt, hsa
acgcuuaagacaccucugcaugcagucaaagccacugucacaagccggcaggcacuggugagga

SEQ ID NO: 302580 - RNA, 64 nt, hsa
uauguaauaaaaaaaguuggauuuuuguguaugucugucacauuauuuagagagaaguaaucuu

SEQ ID NO: 302581 - RNA, 64 nt, hsa
guucauguugguucugaaugguucacugcagcuccugucacaagcugggauggauuuaucacau

SEQ ID NO: 302582 - RNA, 65 nt, hsa
agcugagaggccccugccggugggugauggauaucauccccgaacaggugaagggacaacugacu

SEQ ID NO: 302583 - RNA, 65 nt, hsa
ucccucagcuccuccagauggagcaggugcgccggauccccgaggaauacucucuggggcggaug

SEQ ID NO: 302584 - RNA, 65 nt, hsa
cugagagaucauucugcacuaaguuucgggaacuuauccccgacagugacugaacucacugacua

SEQ ID NO: 302585 - RNA, 65 nt, hsa
agauuuacaaucuccauuuucauuaacggggaaacauccccgagccacugagugcugugcuuugu

SEQ ID NO: 302586 - RNA, 65 nt, hsa
gaggaagccagccgggaagagagguugagucacccauccccgagguggcugccccugugugggag

SEQ ID NO: 302587 - RNA, 65 nt, hsa
ucuagaaccuggacccacccagcgcguccuuucuuauccccgaguggauggauggauggauggau

SEQ ID NO: 302588 - RNA, 65 nt, hsa
aggguggacuuagaaagcaggggcuacaagagggaauccccgaaggugcuggaggugggagcagg

SEQ ID NO: 302589 - RNA, 65 nt, hsa
ugcugcugcugcuuguguaggucggggagccagagauccccgaggacgcgcgccggacagucggc

SEQ ID NO: 302590 - RNA, 65 nt, hsa
cggucuuggaggccuggucucugccucgacgggagauccccgaucacuggcauucacccccugca

SEQ ID NO: 302591 - RNA, 65 nt, hsa
uagaauuaaaucaguaaagcaaucuguuauuuccuauccccgaauuaccuuuucuaugccaaaac

SEQ ID NO: 302592 - RNA, 65 nt, hsa
guucccggccccugccacccagccucaugcaagucauccccgacaugaccuucacgaccgcaaug

SEQ ID NO: 302593 - RNA, 65 nt, hsa
uuuuaaacgaagauccgagcgacggcuccuccccgauccccgacaguggcucuccaagcggcccc

SEQ ID NO: 302594 - RNA, 65 nt, hsa
cuagugacaucugaugcuugcugugaacuuuuaagauccccgaauccugagcaccucaaucuuua

SEQ ID NO: 302595 - RNA, 65 nt, hsa
gaagcgaggaugcgugccugccacuaggcaucugcauccccgagcccaagccaggagggauuucc

SEQ ID NO: 302596 - RNA, 65 nt, hsa
ucccccgcacaggacucaacagauguugacuucucauccccgaguucuuucagguacuggagugc

SEQ ID NO: 302597 - RNA, 65 nt, hsa
acucauacccccccuucaacccgcccaaauguccgauccccgaccuuccucgugccguccucccc

SEQ ID NO: 302598 - RNA, 65 nt, hsa
caaggacugggcugggguggcgggaggggagccagauccccgagggaggacccugagggccgcga

SEQ ID NO: 302599 - RNA, 65 nt, hsa
caauuuuccauucaucuuuuuggauguaaacuuuuauccccgacuuuuaaaauuuuaaagcauua

SEQ ID NO: 302600 - RNA, 65 nt, hsa
augcccgcauagaugccgcggaaggucccucagacauccccgauugaaagaaccagagaggcucu

SEQ ID NO: 302601 - RNA, 65 nt, hsa
ugaccuguggcucuggagccccugccccugccugcauccccgagcaccccacccuccaggcucca

SEQ ID NO: 302602 - RNA, 65 nt, hsa
cucauuuauacuauuauuuguuacguucaaucagaauccccgaaaccuccuauaaagcuuagcug

SEQ ID NO: 302603 - RNA, 65 nt, hsa
accuuguccuuggcccugcuggucccugucgccccauccccgaccccaccucacucuuucgugaa

SEQ ID NO: 302604 - RNA, 65 nt, hsa
ggaaaggcccguaugagcggccccgcccguagaucauccccgagggcgggggcaacgauucacag

SEQ ID NO: 302605 - RNA, 65 nt, hsa
ucccuccccaggacacgaaagugaacuccaccgucauccccgagacgcaacugcaggcugaggac

SEQ ID NO: 302606 - RNA, 65 nt, hsa
cagccacacucugggccgguggcuggggaagaacaauccccgagggcugcugcuuugcgucugug

SEQ ID NO: 302607 - RNA, 65 nt, hsa
auaacuggaccagggggagcugcugucacucccccauccccgaggcagcccagucccuagugccc

SEQ ID NO: 302608 - RNA, 65 nt, hsa
uugccugggguucuguauuucuucucugcccuccaauccccgacugcuaugauguuuacuacagu

SEQ ID NO: 302609 - RNA, 65 nt, hsa
cugccgucaugagcuaugccgacagucagcagcugauccccgacagaaacgcagcagaugcagac

SEQ ID NO: 302610 - RNA, 65 nt, hsa
ggaggaggggcagccacgggcagagcaccaugcccauccccgagucucuggugugucugcccccu

SEQ ID NO: 302611 - RNA, 65 nt, hsa
ccauccaggcugaugccaagcaccccuuuuaucccauccccgagcaggccuuacagaccacacug

SEQ ID NO: 302612 - RNA, 65 nt, hsa
cgacaagagaggggccccaggaguggcaggagaggauccccgaccacccuagggaaacuucgugc

SEQ ID NO: 302613 - RNA, 65 nt, hsa
gcccccaggcugcuggacacgucggacagcgaaguauccccgacaggacgggcuugggcuuccau

SEQ ID NO: 302614 - RNA, 65 nt, hsa
guagaccugggcuaugcucaguuagggguugcgggauccccgagugugggcgggacugggacacc

SEQ ID NO: 302615 - RNA, 65 nt, hsa
cuuggagcugugaguucucccuguacaguguuaccauccccgaccaucugauuaaaaugcuuccu

SEQ ID NO: 302616 - RNA, 50 nt, hsa
caguuuacuucagcacuuaaauccccgaggagucugcccugccuagagaa

SEQ ID NO: 302617 - RNA, 65 nt, hsa
acccagaacaaauaacauccuucauuacucaucacauccccgaugcuaaauuaaaaacagaaaac

SEQ ID NO: 302618 - RNA, 65 nt, hsa
cggacaauaaacugggcgaccucaauggugcgugcauccccgagcacccuggcgaccucgugcag

SEQ ID NO: 302619 - RNA, 65 nt, hsa
uuuuuaucuugaccauaauuugucauucuuuuauaauccccgaaguuaaaucuugcuguuauggu

SEQ ID NO: 302620 - RNA, 65 nt, hsa
cgccccucccgcccccauucaacaucucucauccuauccccgacccccuccggggaacaccggga

SEQ ID NO: 302621 - RNA, 65 nt, hsa
uccccguguauggccccccugcaccuccuugucucauccccgaagauccgucccccuggccccuc

SEQ ID NO: 302622 - RNA, 65 nt, hsa
uggucguggaagaaggcaggauggaacucggccucauccccgaggccccaguuccuauaucgggc

SEQ ID NO: 302623 - RNA, 65 nt, hsa
agcagggcuugcuccugccaaccacaauucaaugaauccccgaccccccuaccccaugcuguacu

SEQ ID NO: 302624 - RNA, 65 nt, hsa
cugggaggcgucuccaaggaggugacacuuaagccauccccgaaagaggugaaagagaucacuuu

SEQ ID NO: 302625 - RNA, 65 nt, hsa
acaccccaccccguuuuuccuuaaaagaggccuuaauccccgagcccccgcugccagggcagagg

SEQ ID NO: 302626 - RNA, 65 nt, hsa
gcccggaaggccccugcuguggagaagccggacccauccccgagguccccagcgaggacacacac

SEQ ID NO: 302627 - RNA, 65 nt, hsa
gggaaaaggcugaguccaccgcugugcagcuuaagauccccgagguggagcuggucacgcugggc

SEQ ID NO: 302628 - RNA, 65 nt, hsa
gguugaacauuccagccucugucuccugcucuaggauccccgacucauuaaagcaaagaggcuua

SEQ ID NO: 302629 - RNA, 65 nt, hsa
ugguuuucauugagcauuucucuauuuuuccaguuauccccgaaauuucuauguauuauauuuuu

SEQ ID NO: 302630 - RNA, 65 nt, hsa
agagacggggccuccaucacgccuguuaccagaggauccccgagagccacaccagcucuggacau

SEQ ID NO: 302631 - RNA, 65 nt, hsa
gcagggauuaagaaggaacccggugugcacagcagauccccgaaauuggugggcuugaccuccug

SEQ ID NO: 302632 - RNA, 65 nt, hsa
ccgugguuggcgcgccccgggugcagcgagaggccauccccgagcgcuaccuccccggagcggag

SEQ ID NO: 302633 - RNA, 59 nt, hsa
cgccauuugcucucuacugauuggcugaaauccccgagguguagcaucuucucucccuu

SEQ ID NO: 302634 - RNA, 65 nt, hsa
cacaccagagacaguucuucucuguucaguuuccaauccccgauaauuugcuaaaauaacauugu

SEQ ID NO: 302635 - RNA, 65 nt, hsa
gcagucaccucucauuuucucccagugcccaccccauccccgagccccuggcaaccacuaaucua

SEQ ID NO: 302636 - RNA, 64 nt, hsa
ucuguguuugucauuucugacuggaaaacuucuuacuccauaccuuguucgauauggaggacaa

SEQ ID NO: 302637 - RNA, 64 nt, hsa
agguuaauuucuaucucugaucccuccccaacccacuccauauuugggucauggacaguaaagg

SEQ ID NO: 302638 - RNA, 64 nt, hsa
aagcaauguguuuuuucggacaugcuuuucugccacuccauauuaaaacauaugaccauugagu

SEQ ID NO: 302639 - RNA, 64 nt, hsa
aagguaauggcccaucgaugagcauuuuuaacauacuccauagucuuuuccugugguguuaggu

SEQ ID NO: 302640 - RNA, 64 nt, hsa
guaauucuguugucuaccauuaaugcuacuaccuacuccauaauugccuauuuagcuccucuuu

SEQ ID NO: 302641 - RNA, 64 nt, hsa
ugggacuagggugcuccuguuggauggugaggucacuccauaugccaauacaaacaacaaugcg

SEQ ID NO: 302642 - RNA, 64 nt, hsa
gagguggagagacccauaaagccuugaccacaucacuccauauggggaggagaaggaucccugu

SEQ ID NO: 302643 - RNA, 64 nt, hsa
aggcugagagaauccaauuagcuuguacgauaucacuccauaagagaagcaaaucugagaguaa

SEQ ID NO: 302644 - RNA, 64 nt, hsa
uucugauucugaagucuuaacugccagcagaaaaacuccauacuguucauuguaaaacuaaaag

SEQ ID NO: 302645 - RNA, 64 nt, hsa
auuauaagcagaccuuauuucucccuacacuuccacuccauagguaaauaaacugggugaagcc

SEQ ID NO: 302646 - RNA, 64 nt, hsa
cgugggauagggaagauagcaggaagaaaaguaaacuccauagaagugucauuccacuggguuu

SEQ ID NO: 302647 - RNA, 64 nt, hsa
gagauucugaagcgguuauguuagaugcuuugaaacuccauaucagaagaaauaacuuuauaac

SEQ ID NO: 302648 - RNA, 64 nt, hsa
caugaacucaguuagcugaaucauuuacauuuugacuccauagcuuagggcagacagaagccug

SEQ ID NO: 302649 - RNA, 64 nt, hsa
uuauguaaacagaaggucuucaauaaguaaaguaacuccauauggagugauuguuucaguccag

SEQ ID NO: 302650 - RNA, 64 nt, hsa
auguguguguuauucagagguuuucagucuggacacuccauaggugagugucgugucuucguga

SEQ ID NO: 302651 - RNA, 64 nt, hsa
aaacucuaucugaaaucccaacaaaaaaaauuuaacuccauauguguuccucuuguucuaaucu

SEQ ID NO: 302652 - RNA, 64 nt, hsa
auuugcuucagcuuacuaagaagcuucaaaucuaacuccauacugaacaaggggcuuuaugucc

SEQ ID NO: 302653 - RNA, 64 nt, hsa
gagcuucccaggaucccucccagauccucugcugacuccauauggaggccucacacccagaggg

SEQ ID NO: 302654 - RNA, 64 nt, hsa
ugccugagaagacagucccuuuucuacccaccgcacuccauaaccuccaucuucucccacacug

SEQ ID NO: 302655 - RNA, 64 nt, hsa
uugauaauagucuuauucccaccacauacuaggcacuccauaaauaucuguugaaccuucauga

SEQ ID NO: 302656 - RNA, 64 nt, hsa
guugggccaucucauucuucacuuccuguaaaccacuccauagauuugucuuucuucaagaaau

SEQ ID NO: 302657 - RNA, 64 nt, hsa
uggccucagcagaaggccuugccuuguguaugugacuccauaucccgggagcaguugaccuuug

SEQ ID NO: 302658 - RNA, 64 nt, hsa
agagcaaauuagcagauuaaauaguggucuuaaaacuccauauguuaaugauuagaugguuaua

SEQ ID NO: 302659 - RNA, 64 nt, hsa
gaaaaaaaaaagugggcucguauuuaucuacaggacuccauauagucauauauaggcauauaaa

SEQ ID NO: 302660 - RNA, 64 nt, hsa
guagauugaacggaauaucacagcugcugaguuuacuccauagcuuucaaaccuuuuuuauuuu

SEQ ID NO: 302661 - RNA, 64 nt, hsa
caggcaacagacucauugaaucaggaacagauucacuccauaaaauacagagagugcugcaaug

SEQ ID NO: 302662 - RNA, 64 nt, hsa
ugaacuuucugagccucuuguuuuuccucagcugacuccauauuuuccuacuuguggcagcgac

SEQ ID NO: 302663 - RNA, 64 nt, hsa
uucucaaaaucaguguuauugcuuuagaguauaaacuccauauaaauugauggcaauuggaaau

SEQ ID NO: 302664 - RNA, 64 nt, hsa
uugagaugaggucugugccugauguacaacggauacuccauaaauguuugacaaaccaacgaag

SEQ ID NO: 302665 - RNA, 64 nt, hsa
gcaaaauugcuugcaaaaguggcacagaguuagcacuccauaccccuucaaacauguugcuuug

SEQ ID NO: 302666 - RNA, 64 nt, hsa
agugaugaaucaucaccgguuguccccuuaucuaacuccauaaaagugggaauuucaaaagaac

SEQ ID NO: 302667 - RNA, 64 nt, hsa
aucaauagggaugaaaauuuucuuagaacucaagacuccauaacuauggggguaaaugaaguca

SEQ ID NO: 302668 - RNA, 64 nt, hsa
ucauccauugcugcccugugugugaacaaaugugacuccauauuuauuacacagcaaggacugc

SEQ ID NO: 302669 - RNA, 64 nt, hsa
gucaaaggcaguugacuagaaucgacaaauuguuacuccauauauauauaugugugugugugug

SEQ ID NO: 302670 - RNA, 64 nt, hsa
acacacacacacacacacacacacacacacacacacuccauaccauuuccauucaacucaaucu

SEQ ID NO: 302671 - RNA, 64 nt, hsa
uuagggaaagaagguugcuguggugaggaacgagacuccauagcagagguaugccaucauggaa

SEQ ID NO: 302672 - RNA, 64 nt, hsa
cacgugcuuugaacugcuuuucuauucauggagcacuccauagucucaaacugucccccuuaug

SEQ ID NO: 302673 - RNA, 64 nt, hsa
gcacacuuaaaagcaaaggaaaaaauaaaucagaacuccauaaauauuaaauuaaacuguauug

SEQ ID NO: 302674 - RNA, 64 nt, hsa
cccuggcugaugaccacuaguggggagccguggcacuccauacccucgaagauguuguacucca

SEQ ID NO: 302675 - RNA, 64 nt, hsa
uugaacuuuccccgucucccgucuucugccucccacuccauaccccgccaaggaaaggcaugua

SEQ ID NO: 302676 - RNA, 64 nt, hsa
cagugcaguguaaauaguucuguaguagagguuaacuccauauuucugugaggucacugaggcc

SEQ ID NO: 302677 - RNA, 64 nt, hsa
uaacaagaaaugguauaaauggaaaaaaaauacaacuccauagccuugcaaaaugcaacuugug

SEQ ID NO: 302678 - RNA, 64 nt, hsa
acugcuuuguaauuauuuucuuuauuguugguaaacuccauauuuuaaaaauuuaccuguauac

SEQ ID NO: 302679 - RNA, 64 nt, hsa
cugaacauuucaugguguucaucaacagugagagacuccauaguuugggcuuguaccacuuuug

SEQ ID NO: 302680 - RNA, 64 nt, hsa
gacucaaggaagaauaauuuuaacagacauguauacuccauagaaacuaaacuaaaauaguuua

SEQ ID NO: 302681 - RNA, 64 nt, hsa
auuuagaggauguggcuguaaccugcuggaugggacuccauagcuccuucccaggaccccucag

SEQ ID NO: 302682 - RNA, 64 nt, hsa
gcacuugcacugaguugacucuugcacacucuugacuccauaauaugaugcuuuuuaagaugua

SEQ ID NO: 302683 - RNA, 64 nt, hsa
uguacauacagugaauuguuuugcuguucuccccacuccauauuaaugcaggagccagguuggu

SEQ ID NO: 302684 - RNA, 64 nt, hsa
cuacguauuaggcuuuauguaagauguacauaguacuccauacuccuuuccuuuuccuccuauu

SEQ ID NO: 302685 - RNA, 64 nt, hsa
aguuagaggacggucacuuuuuccaacaaaacccacuccauagccauguggauuuuuauccaaa

SEQ ID NO: 302686 - RNA, 64 nt, hsa
ggggcagaguuucuguguauaaauuaguauguaaacuccauauuuauuguauucauauuagucu

SEQ ID NO: 302687 - RNA, 64 nt, hsa
ccucucuuucuuucccuacgucugccuggggucuacuccauaaggguuuacaaauggcccacaa

SEQ ID NO: 302688 - RNA, 64 nt, hsa
ucccucggguuuggggcucuucucagagagcagcacuccauaucccuuacugucaccuucacuc

SEQ ID NO: 302689 - RNA, 64 nt, hsa
auugacaaaauguuauuucccuacauuaaacaugacuccauagaccuuuucauuuguggguuuu

SEQ ID NO: 302690 - RNA, 64 nt, hsa
ggguucgagcaucacaagcuuuugagcgcauggaacuccauaaacuaacaaauuacauaaacua

SEQ ID NO: 302691 - RNA, 64 nt, hsa
ugacauuguuuuaaagucacugguacuauggacaacuccauagugaauggagauacuugcagag

SEQ ID NO: 302692 - RNA, 64 nt, hsa
cuucauaaacuauugcaggaacagaaaaccaaacacuccauauucucacuuguaagugggagcu

SEQ ID NO: 302693 - RNA, 64 nt, hsa
augaucaaaguucagaaaauggucugcaaaaguuacuccauauacaaccccaaaucuacuacuu

SEQ ID NO: 302694 - RNA, 64 nt, hsa
aaccugccugacuuccugcuccuggccacccaaaacuccauauggcuucucguacacugacauc

SEQ ID NO: 302695 - RNA, 64 nt, hsa
uguaacaaggauuuauuagugaauuaucccaaguacuccauauaucugucugugguuguaugaa

SEQ ID NO: 302696 - RNA, 64 nt, hsa
uguagcaaguaaacaguggagcccagguccccugacuccauaucuuacauucuuuuacuaauaa

SEQ ID NO: 302697 - RNA, 64 nt, hsa
uagggagaaauguuuaaaucucugguauaaguuuacuccauaccagaguaaacuauauauuacu

SEQ ID NO: 302698 - RNA, 64 nt, hsa
uucuguucucuuuacucuucucacagaucagaucacuccauagaagccuguggguuucgauggu

SEQ ID NO: 302699 - RNA, 64 nt, hsa
auuaaaaaaaaaaaaagauuguagugguagucuaacuccauaacgcugaggaaauacaucauuu

SEQ ID NO: 302700 - RNA, 64 nt, hsa
guauauguauauauauauaguaacuacuuuuuauacuccauacauaacuugauauagaaagcug

SEQ ID NO: 302701 - RNA, 64 nt, hsa
cuuauuucuuuaguucugcacuuuuccacauuauacuccauaugaguauuaauccuauggauac

SEQ ID NO: 302702 - RNA, 64 nt, hsa
ggaagauuuucccuugcuucugcauaaaauuuuaacuccauaacuuauaagcucacucuuuauu

SEQ ID NO: 302703 - RNA, 64 nt, hsa
uuaacuggggaaggcaucuaacuaguagccugcuacuccauaguauggcucaauagaugacaca

SEQ ID NO: 302704 - RNA, 64 nt, hsa
gcccgcacaccgguacacucguggacaccuacacacuccauaggagauccuggcuuuccagggu

SEQ ID NO: 302705 - RNA, 64 nt, hsa
cgcagggcaggucacagauaggguuggcugugccacuccauaaaguaucuauuguggaagcagc

SEQ ID NO: 302706 - RNA, 64 nt, hsa
caauauccagcaaaaugucuccugagcacccagaacuccauaccaucggccgggugugguggcu

SEQ ID NO: 302707 - RNA, 64 nt, hsa
agcguggcccuggccccacacucccaaaucugccacuccauagacccacuugccucaaggcuuu

SEQ ID NO: 302708 - RNA, 64 nt, hsa
gacugucacucuggcacuaggaggcugaucuuguacuccauaugaccccaccccuaggaacccc

SEQ ID NO: 302709 - RNA, 64 nt, hsa
cucuuaaagagaagucauuuuaacuguuuuugcuacuccauauauugucauucaaaauauauuu

SEQ ID NO: 302710 - RNA, 64 nt, hsa
auuaugguaaauauaaaacuccagagguuguucuacuccauacaguucacacugauugugacac

SEQ ID NO: 302711 - RNA, 64 nt, hsa
ugguugcagcuggagggggcggaaaaaggccaaaacuccauauauguuagucuuccuuuaucuu

SEQ ID NO: 302712 - RNA, 64 nt, hsa
ucccuaacacagccacccucccuucauuacccccacuccauacccuucucccaacuuuuugaug

SEQ ID NO: 302713 - RNA, 64 nt, hsa
agcucauacccagcccuaccaaucaugaacuggaacuccauaaggaggggccaaauugggaggc

SEQ ID NO: 302714 - RNA, 64 nt, hsa
uuuuccgguguuguacuaaaccucgugcuugugaacuccauacagaaaacggugccaucccuga

SEQ ID NO: 302715 - RNA, 64 nt, hsa
cacugcggccagcacauuuccacuuuuagauccuacuccauaccacagguuucauuuaagaaga

SEQ ID NO: 302716 - RNA, 64 nt, hsa
gcacucugcugcuccucccccacccccaccuuccacuccauacaaucugggccugguggagucu

SEQ ID NO: 302717 - RNA, 64 nt, hsa
guccuucuugggggaaauagcagagccccacuuaacuccauaaacugcuucccauuccgcagcc

SEQ ID NO: 302718 - RNA, 64 nt, hsa
agugcgcgggccuguccucccaggggccugggcgacuccauaugcaaucaguagcgagcagccg

SEQ ID NO: 302719 - RNA, 64 nt, hsa
cugcaggaacuggccuuguucuccuuagcccgucacuccauacaguauuaggugaggauggaug

SEQ ID NO: 302720 - RNA, 64 nt, hsa
ucauaaagggcacuaaaaguaacauuuggguuucacuccauaucuagaagaauuuagcucacaa

SEQ ID NO: 302721 - RNA, 64 nt, hsa
aguuuaagauuuuaaguauuguuuccugagcauaacuccauaaguaagaaauuucuaguucaca

SEQ ID NO: 302722 - RNA, 64 nt, hsa
gaacuguagcagugcagguggcuuaagugaaguaacuccauauguaauuacaugauuaugauac

SEQ ID NO: 302723 - RNA, 64 nt, hsa
uggucuguaacaugauauuugguaaauaacaaggacuccauacguuuugcaaagaguaaauucu

SEQ ID NO: 302724 - RNA, 64 nt, hsa
auuauaucuccucucugggacucuucaaccugguacuccauaccucuugugcccucucacuuua

SEQ ID NO: 302725 - RNA, 64 nt, hsa
uucuauguuaucugaagagucaaaugguuuugugacuccauaguuuuuaaaguaauaaggguca

SEQ ID NO: 302726 - RNA, 64 nt, hsa
gaggcccaagucaugggguuucaccgccuuccucacuccauauagaacaccuuucccaauagga

SEQ ID NO: 302727 - RNA, 64 nt, hsa
cuagaaauuaccuuuauauucuaguauuuucagcacuccauaaauucuauuaccuaaauauugc

SEQ ID NO: 302728 - RNA, 64 nt, hsa
aaauguacauacacucaggaagguaguacaagauacuccauacaacacaaccaugugcuauuua

SEQ ID NO: 302729 - RNA, 64 nt, hsa
uuaguuacugguguauggccuguggguuaccugaacuccauaaucugggacuuuuuaaaaauaa

SEQ ID NO: 302730 - RNA, 64 nt, hsa
uggguccugaagaauuaagauacaaauuaauuuuacuccauaaacagacuguuaauuauaggag

SEQ ID NO: 302731 - RNA, 64 nt, hsa
agaaaacaaaucuuucuucauuuaugaauuucuuacuccauacaagcaguuuauggaugucugg

SEQ ID NO: 302732 - RNA, 64 nt, hsa
uagaguucagaugaauucuuaaaauuaaaaaaaaacuccauaguacuaauuuuguuucuuuaua

SEQ ID NO: 302733 - RNA, 64 nt, hsa
cggugagaauuccaacacuguucauguaacaguaacuccauagauggaagagcauuggcaggaa

SEQ ID NO: 302734 - RNA, 64 nt, hsa
guauuugccaaauaauuuacuguauagccuaaaaacuccauauauauugagaaaagcauauguu

SEQ ID NO: 302735 - RNA, 64 nt, hsa
uaacaguguauuuguguaaaguuugucauuucauacuccauacacuacaguugcugucacugau

SEQ ID NO: 302736 - RNA, 64 nt, hsa
ugggacgguauuuauuaucagacuggcaagccuaacuccauagguuuacaggaaguagggauau

SEQ ID NO: 302737 - RNA, 64 nt, hsa
auuguaaauaaaggaugauggccacaacaugaaaacuccauauuuauuuagaugcuauuauuac

SEQ ID NO: 302738 - RNA, 64 nt, hsa
ccuccuaagaaagucaugugccucuguccuaugaacuccauauaaggcuggguccuccuuuggc

SEQ ID NO: 302739 - RNA, 64 nt, hsa
ucuuucauuagcuaggaucuacuagaugcauuauacuccauaccugcuuuucccauggccgccc

SEQ ID NO: 302740 - RNA, 64 nt, hsa
cacaaugcaggauccucuuugcugacucaggaauacuccauauuuuagacuacugccucuacca

SEQ ID NO: 302741 - RNA, 64 nt, hsa
gccagagagagguguugacucugagagaccuugcacuccauacugaaaggagguggggucacag

SEQ ID NO: 302742 - RNA, 64 nt, hsa
uuauuaauuuuuaggguaugggcacugugcaaagacuccauagcugugccuaggagucuaggaa

SEQ ID NO: 302743 - RNA, 64 nt, hsa
cacugaaaaggcuggguuggggacagggaguaucacuccauaagugauccuaaaagguagccuc

SEQ ID NO: 302744 - RNA, 64 nt, hsa
uuaggggcaaguaauaauggaaugcuacuaagauacuccauauucuuccccgaaucacacagac

SEQ ID NO: 302745 - RNA, 64 nt, hsa
uaaacuguaucagguacauuccagccuguuggcaacuccauaaaaacauuucagauuuuaaucc

SEQ ID NO: 302746 - RNA, 61 nt, hsa
uccugaagcaauacuguugaccagaaaggacacuccauauugugaaaccggccuaauuuuu

SEQ ID NO: 302747 - RNA, 64 nt, hsa
caugcccucucucgggagcccuagcccugcuccaacuccauacuccacuccaagugccccacca

SEQ ID NO: 302748 - RNA, 64 nt, hsa
ccaagccugccauggguccucucuugcuagacacacuccauagauccccccacugagcugugga

SEQ ID NO: 302749 - RNA, 64 nt, hsa
cuucgcaaaggucacuuuuuaauggcuaucuaacacuccauauguggugggcaagucugguugg

SEQ ID NO: 302750 - RNA, 64 nt, hsa
cuggugaugggagucagcaguuucagauucuuacacuccauagcuccccuuaccaugaggugga

SEQ ID NO: 302751 - RNA, 64 nt, hsa
auuugugggcagggguggaggaugcauguaugauacuccauaaauucaacauucuuuacuauag

SEQ ID NO: 302752 - RNA, 64 nt, hsa
gggcuagaccagauuugggggccaggagggaagaacuccauaugggauggagaagggaaucuac

SEQ ID NO: 302753 - RNA, 56 nt, hsa
uugccaaccaugccuacugaguauccacuccauaccacagcccuuggcccagccau

SEQ ID NO: 302754 - RNA, 64 nt, hsa
aaacaaggacuagagcucaggccugcugguucccacuccauacuuucccacagcacuacgaugu

SEQ ID NO: 302755 - RNA, 64 nt, hsa
gccggccacaagacccaugucuccaucuggucauacuccauagcuaccaaguuaaccugcucua

SEQ ID NO: 302756 - RNA, 64 nt, hsa
uucuggccagggaggggaucaggcccccuuguccacuccauacccuuccucccucugucccucu

SEQ ID NO: 302757 - RNA, 64 nt, hsa
ugaugucauagacaggauuguuuaaauuuaguuaacuccauacucuucagacugugauauugug

SEQ ID NO: 302758 - RNA, 64 nt, hsa
guaggugggcuccccuugcccuucccucccuaucacuccauacuggggugggcuggaggaggcc

SEQ ID NO: 302759 - RNA, 64 nt, hsa
aauacauuugaugguuuuuuggaaaaccuuuuucacuccauacucagauaugcuucauugucaa

SEQ ID NO: 302760 - RNA, 64 nt, hsa
uuuaauaauuaaauaccuauucuuaguguuugacacuccauauuucuuuuuuuuggaaaugaaa

SEQ ID NO: 302761 - RNA, 64 nt, hsa
cuuuuuuuuuuuuuuuaagaaaguuguuuguuggacuccauaagugaauuucaagcagugagga

SEQ ID NO: 302762 - RNA, 64 nt, hsa
auguuaacuacuaauaaaugguuuauucuuucuaacuccauauaagcuuuuccagcaaagauug

SEQ ID NO: 302763 - RNA, 64 nt, hsa
uagacgccccucccaagcguuccuggccuucugaacuccauacagccucuacagccgucccgcg

SEQ ID NO: 302764 - RNA, 64 nt, hsa
caucuuaccaucuggucauucauacugaagagaaacuccauaaguaucaucucugugggaaaac

SEQ ID NO: 302765 - RNA, 64 nt, hsa
uuuuuggaaauaucucuuuauuuaaaaaauuguuacuccauacggcuaaacucggauugugaug

SEQ ID NO: 302766 - RNA, 64 nt, hsa
ugcaauuuaaaugguauggucuggaugaugccccacuccauauuuguaagcccuaaguccuagu

SEQ ID NO: 302767 - RNA, 64 nt, hsa
aagugaagagaaaauauuaaaacuagaauauucaacuccauauggaaaaucauauccauggauc

SEQ ID NO: 302768 - RNA, 64 nt, hsa
cugccaacauaguuuuauccugucucaguaggauacuccauaacacaauagcaguacaccacua

SEQ ID NO: 302769 - RNA, 64 nt, hsa
ggccagaggccuugcuggguggagccucugugugacuccauacuccucccaccacaacacucau

SEQ ID NO: 302770 - RNA, 64 nt, hsa
auucugcccuucccugaccccauuguaauaaccaacuccauauccaaagggagguggugcucuc

SEQ ID NO: 302771 - RNA, 64 nt, hsa
augacuggguugcaccucaggauacuguaauuugacuccauaauugcuuuugcuccugaaaccu

SEQ ID NO: 302772 - RNA, 64 nt, hsa
gccccccccuugaaucugcagggagcaacucuccacuccauauuuauuuaaacaauuuuuuccc

SEQ ID NO: 302773 - RNA, 64 nt, hsa
caguggacugcuugcuggucgcuuacaucacuuuacuccauaagcgcuucagugggguuauccu

SEQ ID NO: 302774 - RNA, 64 nt, hsa
auauccagaagaaucugauaucaucauagugaagacuccauacagacacaugaaugaauuauau

SEQ ID NO: 302775 - RNA, 64 nt, hsa
ccuggaccauugcaaguccauccuucaaaugaccacuccauaauauaacauuucauccaguaaa

SEQ ID NO: 302776 - RNA, 64 nt, hsa
cugguuacauuccauuauugcuuauuaguauuucacuccauaacccuuuuuucugcuaaaacua

SEQ ID NO: 302777 - RNA, 64 nt, hsa
agucagcuugaggauuuagcauuguuaaucuuggacuccauaacuuaugaguccuagcacugau

SEQ ID NO: 302778 - RNA, 64 nt, hsa
gcauucauccgugacacaugaguaccuacugaggacuccauaaacagaacgggauacagagaua

SEQ ID NO: 302779 - RNA, 64 nt, hsa
ccgaauugcuuuuauuuucuuauacuuucaguauacuccauagaccaaagagcaaaaucuaucu

SEQ ID NO: 302780 - RNA, 64 nt, hsa
ccccugggcugccccuucucauggcuucgugcugacuccauaaacauucucuguugaggauguc

SEQ ID NO: 302781 - RNA, 64 nt, hsa
acuuuccucagugcuccaugauacuuuuuuugagacuccauaucauugcuuauuuuaccuuuuu

SEQ ID NO: 302782 - RNA, 64 nt, hsa
augcuguaaauauuucauaaauuaacaaagugucacuccauaaaaagaaagcuaauacuaauag

SEQ ID NO: 302783 - RNA, 64 nt, hsa
auagauggcaaguaagcauaugaaaagcuguuaaacuccauaagucaucagggaaugcaaauug

SEQ ID NO: 302784 - RNA, 64 nt, hsa
aauuuaucuguguuacccuguuuuucuaccuggaacuccauagaaugauguuugcaaaccaaca

SEQ ID NO: 302785 - RNA, 64 nt, hsa
cucaaaaagcaacuucugcccugcaacgccccccacuccauagucugguauucugagcacuagc

SEQ ID NO: 302786 - RNA, 64 nt, hsa
uauuuuucuguccagaagagcuuuaccaggcugugcaaaguaaaauucuucucaggcaacauuu

SEQ ID NO: 302787 - RNA, 64 nt, hsa
ugugcaauauuguuguguaguuaaaugcauauuagcaaaguauagaggucacuguguaaaccga

SEQ ID NO: 302788 - RNA, 64 nt, hsa
guacaaaucaauagaaaccauuuuaccuacauaggcaaaguaaaugugugacuuagagacugcc

SEQ ID NO: 302789 - RNA, 64 nt, hsa
ccacauuccuuuaagcaucuuugaugaauacucugcaaaguagccuuuaaaaaaauguaaauuu

SEQ ID NO: 302790 - RNA, 64 nt, hsa
auacaauuuccuguuacaaagcucucccucucaugcaaaguagggaacaccuuuugagcaucuu

SEQ ID NO: 302791 - RNA, 64 nt, hsa
uuguuuuaagguggaaaauuuucuuacaguugaugcaaaguaucaacuacuuuacccuaccuuc

SEQ ID NO: 302792 - RNA, 64 nt, hsa
ucuucacauauggcccuuucugaaucaaagugcggcaaaguaaauauugucuaagcuuuaaucc

SEQ ID NO: 302793 - RNA, 64 nt, hsa
cucuugaaaaugaauugucuacaaaauuucaaaugcaaaguauuacagccaaauauuaucuuaa

SEQ ID NO: 302794 - RNA, 64 nt, hsa
ugcuuugauaucaucaacugcagagaaugcuguugaugggaaugcuggaagcagaaacuuuguc

SEQ ID NO: 302795 - RNA, 64 nt, hsa
gcaugagacucaacaucaggauccacagcuuaaagaugggaauucagguaugaaagaaaacagg

SEQ ID NO: 302796 - RNA, 64 nt, hsa
aaauguaugauccaacuagaaaugaauggaagaugaugggaaauaugacuucaccaaggagcaa

SEQ ID NO: 302797 - RNA, 64 nt, hsa
aaccuuguacuacucagcugaucacaagcugcuugaugggaaccuacuagauggacaggcugag

SEQ ID NO: 302798 - RNA, 64 nt, hsa
gugaggauggccucugcuaagcucaaggcgugaggaugggaaggagggagguauucguaaggau

SEQ ID NO: 302799 - RNA, 64 nt, hsa
gcgugaggaugggaaggagggagguauucguaaggaugggaaggagggagguauucgugcagca

SEQ ID NO: 302800 - RNA, 64 nt, hsa
agaugcaggcugaaaagaaaaggaagugggcuaagaugggaaaaauauaaaaagauuuaaaauc

SEQ ID NO: 302801 - RNA, 64 nt, hsa
guuggcaacacauuuauuaagugauccaacaugggaugggaaggaaugggcaaagagauuaaaa

SEQ ID NO: 302802 - RNA, 64 nt, hsa
uaaacugagugcugggagugaguugguaauaugagaugggaaggaauguugacuugcuaacauu

SEQ ID NO: 302803 - RNA, 64 nt, hsa
auguucaccacagggauacaagccuguuauguuugaugggaaagaccacuacaaucuaauggug

SEQ ID NO: 302804 - RNA, 64 nt, hsa
auuuuuuaagauagaaagauuaaaaagaaagaaagaugggaagaaaaugaaugucagucaagga

SEQ ID NO: 302805 - RNA, 64 nt, hsa
gcaagaaaagcagucggacucuaccuuaaggagggaugggaaggaaagaguugaguugguuucu

SEQ ID NO: 302806 - RNA, 64 nt, hsa
guguagacaacuguaguugugcucaguuuguagugaugggaaguguauuuuacucugaucaaau

SEQ ID NO: 302807 - RNA, 64 nt, hsa
acaucuuuggaggaugggagagaacaggagggaagaugggaaacaaaauagagaauucuuaaga

SEQ ID NO: 302808 - RNA, 64 nt, hsa
ugggucaugaccuuuucuucauccaaaacaaggugaugggaagacaaaaacaauagcuacuaca

SEQ ID NO: 302809 - RNA, 64 nt, hsa
ccuuguccucaaaauacuuccagaagaacaaccagaugggaaggaccuugguugggacucuuuc

SEQ ID NO: 302810 - RNA, 64 nt, hsa
auauaguggaaaucugccaauacuaauugguggagaugggaacuguaaaagaucaaguaugcua

SEQ ID NO: 302811 - RNA, 64 nt, hsa
cagccagcccuugccagcugacgucacagucuaagaugggaaacugugguacagauagacauga

SEQ ID NO: 302812 - RNA, 64 nt, hsa
cagccauuugcccagggcugcucccgagggggaugaugggaaauucagcaguguagacugacuu

SEQ ID NO: 302813 - RNA, 64 nt, hsa
ucagcuguuuuuaaaugaaugugugugaggaacagaugggaaaguugggagaucugucuacaga

SEQ ID NO: 302814 - RNA, 64 nt, hsa
uugaauuuuguuuuuauuuucaagagggcaaguggaugggaauuugucagcguucuaccaggca

SEQ ID NO: 302815 - RNA, 64 nt, hsa
uuuugguucagacaccuguucacagaaaaagcaugaugggaaaauauuuccugacuugaguguu

SEQ ID NO: 302816 - RNA, 64 nt, hsa; identical to SEQ ID NO: 243860

SEQ ID NO: 302817 - RNA, 64 nt, hsa; identical to SEQ ID NO: 243861

SEQ ID NO: 302818 - RNA, 64 nt, hsa; identical to SEQ ID NO: 243862

SEQ ID NO: 302819 - RNA, 64 nt, hsa; identical to SEQ ID NO: 243863

SEQ ID NO: 302820 - RNA, 64 nt, hsa; identical to SEQ ID NO: 243864

SEQ ID NO: 302821 - RNA, 64 nt, hsa; identical to SEQ ID NO: 243865

SEQ ID NO: 302822 - RNA, 64 nt, hsa; identical to SEQ ID NO: 243866

SEQ ID NO: 302823 - RNA, 64 nt, hsa; identical to SEQ ID NO: 243867

SEQ ID NO: 302824 - RNA, 64 nt, hsa; identical to SEQ ID NO: 243868

SEQ ID NO: 302825 - RNA, 64 nt, hsa; identical to SEQ ID NO: 243869

SEQ ID NO: 302826 - RNA, 64 nt, hsa; identical to SEQ ID NO: 243870

SEQ ID NO: 302827 - RNA, 64 nt, hsa; identical to SEQ ID NO: 243871

SEQ ID NO: 302828 - RNA, 64 nt, hsa; identical to SEQ ID NO: 243872

SEQ ID NO: 302829 - RNA, 64 nt, hsa; identical to SEQ ID NO: 243873

SEQ ID NO: 302830 - RNA, 64 nt, hsa; identical to SEQ ID NO: 243874

SEQ ID NO: 302831 - RNA, 64 nt, hsa; identical to SEQ ID NO: 243875

SEQ ID NO: 302832 - RNA, 64 nt, hsa; identical to SEQ ID NO: 243876

SEQ ID NO: 302833 - RNA, 64 nt, hsa; identical to SEQ ID NO: 243877

SEQ ID NO: 302834 - RNA, 64 nt, hsa; identical to SEQ ID NO: 243878

SEQ ID NO: 302835 - RNA, 64 nt, hsa; identical to SEQ ID NO: 243879

SEQ ID NO: 302836 - RNA, 64 nt, hsa; identical to SEQ ID NO: 243880

SEQ ID NO: 302837 - RNA, 64 nt, hsa; identical to SEQ ID NO: 243881

SEQ ID NO: 302838 - RNA, 64 nt, hsa; identical to SEQ ID NO: 243882

SEQ ID NO: 302839 - RNA, 64 nt, hsa; identical to SEQ ID NO: 243883

SEQ ID NO: 302840 - RNA, 64 nt, hsa; identical to SEQ ID NO: 243884

SEQ ID NO: 302841 - RNA, 64 nt, hsa; identical to SEQ ID NO: 243885

SEQ ID NO: 302842 - RNA, 64 nt, hsa; identical to SEQ ID NO: 243886

SEQ ID NO: 302843 - RNA, 64 nt, hsa; identical to SEQ ID NO: 243887

SEQ ID NO: 302844 - RNA, 64 nt, hsa; identical to SEQ ID NO: 243888

SEQ ID NO: 302845 - RNA, 64 nt, hsa; identical to SEQ ID NO: 243889

SEQ ID NO: 302846 - RNA, 51 nt, hsa; identical to SEQ ID NO: 243890

SEQ ID NO: 302847 - RNA, 64 nt, hsa; identical to SEQ ID NO: 243891

SEQ ID NO: 302848 - RNA, 64 nt, hsa; identical to SEQ ID NO: 243892

SEQ ID NO: 302849 - RNA, 64 nt, hsa; identical to SEQ ID NO: 243893

SEQ ID NO: 302850 - RNA, 64 nt, hsa; identical to SEQ ID NO: 243894

SEQ ID NO: 302851 - RNA, 64 nt, hsa; identical to SEQ ID NO: 243895

SEQ ID NO: 302852 - RNA, 64 nt, hsa; identical to SEQ ID NO: 243896

SEQ ID NO: 302853 - RNA, 64 nt, hsa; identical to SEQ ID NO: 243897

SEQ ID NO: 302854 - RNA, 64 nt, hsa; identical to SEQ ID NO: 243898

SEQ ID NO: 302855 - RNA, 64 nt, hsa; identical to SEQ ID NO: 243899

SEQ ID NO: 302856 - RNA, 64 nt, hsa; identical to SEQ ID NO: 243900

SEQ ID NO: 302857 - RNA, 64 nt, hsa; identical to SEQ ID NO: 243901

SEQ ID NO: 302858 - RNA, 63 nt, hsa; identical to SEQ ID NO: 243902

SEQ ID NO: 302859 - RNA, 64 nt, hsa; identical to SEQ ID NO: 243903

SEQ ID NO: 302860 - RNA, 64 nt, hsa; identical to SEQ ID NO: 243904

SEQ ID NO: 302861 - RNA, 64 nt, hsa; identical to SEQ ID NO: 243905

SEQ ID NO: 302862 - RNA, 64 nt, hsa; identical to SEQ ID NO: 243906

SEQ ID NO: 302863 - RNA, 64 nt, hsa; identical to SEQ ID NO: 243907

SEQ ID NO: 302864 - RNA, 64 nt, hsa; identical to SEQ ID NO: 243908

SEQ ID NO: 302865 - RNA, 64 nt, hsa; identical to SEQ ID NO: 243909

SEQ ID NO: 302866 - RNA, 64 nt, hsa; identical to SEQ ID NO: 243910

SEQ ID NO: 302867 - RNA, 64 nt, hsa; identical to SEQ ID NO: 243911

SEQ ID NO: 302868 - RNA, 64 nt, hsa; identical to SEQ ID NO: 243912

SEQ ID NO: 302869 - RNA, 64 nt, hsa; identical to SEQ ID NO: 243913

SEQ ID NO: 302870 - RNA, 64 nt, hsa; identical to SEQ ID NO: 243914

SEQ ID NO: 302871 - RNA, 64 nt, hsa; identical to SEQ ID NO: 243915

SEQ ID NO: 302872 - RNA, 64 nt, hsa; identical to SEQ ID NO: 243916

SEQ ID NO: 302873 - RNA, 64 nt, hsa; identical to SEQ ID NO: 243917

SEQ ID NO: 302874 - RNA, 64 nt, hsa; identical to SEQ ID NO: 243918

SEQ ID NO: 302875 - RNA, 64 nt, hsa; identical to SEQ ID NO: 243919

SEQ ID NO: 302876 - RNA, 64 nt, hsa; identical to SEQ ID NO: 243920

SEQ ID NO: 302877 - RNA, 64 nt, hsa; identical to SEQ ID NO: 243921

SEQ ID NO: 302878 - RNA, 64 nt, hsa; identical to SEQ ID NO: 243922

SEQ ID NO: 302879 - RNA, 64 nt, hsa; identical to SEQ ID NO: 243923

SEQ ID NO: 302880 - RNA, 64 nt, hsa; identical to SEQ ID NO: 243924

SEQ ID NO: 302881 - RNA, 64 nt, hsa; identical to SEQ ID NO: 243925

SEQ ID NO: 302882 - RNA, 64 nt, hsa; identical to SEQ ID NO: 243926

SEQ ID NO: 302883 - RNA, 64 nt, hsa; identical to SEQ ID NO: 243927

SEQ ID NO: 302884 - RNA, 64 nt, hsa; identical to SEQ ID NO: 243928

SEQ ID NO: 302885 - RNA, 64 nt, hsa; identical to SEQ ID NO: 243929

SEQ ID NO: 302886 - RNA, 64 nt, hsa; identical to SEQ ID NO: 243930

SEQ ID NO: 302887 - RNA, 64 nt, hsa; identical to SEQ ID NO: 243931

SEQ ID NO: 302888 - RNA, 64 nt, hsa; identical to SEQ ID NO: 243932

SEQ ID NO: 302889 - RNA, 64 nt, hsa; identical to SEQ ID NO: 243933

SEQ ID NO: 302890 - RNA, 64 nt, hsa; identical to SEQ ID NO: 243934

SEQ ID NO: 302891 - RNA, 64 nt, hsa; identical to SEQ ID NO: 243935

SEQ ID NO: 302892 - RNA, 64 nt, hsa; identical to SEQ ID NO: 243936

SEQ ID NO: 302893 - RNA, 64 nt, hsa; identical to SEQ ID NO: 243937

SEQ ID NO: 302894 - RNA, 64 nt, hsa; identical to SEQ ID NO: 243938

SEQ ID NO: 302895 - RNA, 64 nt, hsa; identical to SEQ ID NO: 243939

SEQ ID NO: 302896 - RNA, 64 nt, hsa; identical to SEQ ID NO: 243940

SEQ ID NO: 302897 - RNA, 64 nt, hsa; identical to SEQ ID NO: 243941

SEQ ID NO: 302898 - RNA, 64 nt, hsa; identical to SEQ ID NO: 243942

SEQ ID NO: 302899 - RNA, 64 nt, hsa; identical to SEQ ID NO: 243943

SEQ ID NO: 302900 - RNA, 64 nt, hsa; identical to SEQ ID NO: 243944

SEQ ID NO: 302901 - RNA, 64 nt, hsa; identical to SEQ ID NO: 243945

SEQ ID NO: 302902 - RNA, 64 nt, hsa; identical to SEQ ID NO: 243946

SEQ ID NO: 302903 - RNA, 64 nt, hsa; identical to SEQ ID NO: 243947

SEQ ID NO: 302904 - RNA, 64 nt, hsa; identical to SEQ ID NO: 243948

SEQ ID NO: 302905 - RNA, 64 nt, hsa; identical to SEQ ID NO: 302794

SEQ ID NO: 302906 - RNA, 64 nt, hsa; identical to SEQ ID NO: 302795

SEQ ID NO: 302907 - RNA, 64 nt, hsa; identical to SEQ ID NO: 302796

SEQ ID NO: 302908 - RNA, 64 nt, hsa; identical to SEQ ID NO: 302797

SEQ ID NO: 302909 - RNA, 64 nt, hsa; identical to SEQ ID NO: 302798

SEQ ID NO: 302910 - RNA, 64 nt, hsa; identical to SEQ ID NO: 302799

SEQ ID NO: 302911 - RNA, 64 nt, hsa; identical to SEQ ID NO: 302800

SEQ ID NO: 302912 - RNA, 64 nt, hsa; identical to SEQ ID NO: 302801

SEQ ID NO: 302913 - RNA, 64 nt, hsa; identical to SEQ ID NO: 302802

SEQ ID NO: 302914 - RNA, 64 nt, hsa; identical to SEQ ID NO: 302803

SEQ ID NO: 302915 - RNA, 64 nt, hsa; identical to SEQ ID NO: 302804

SEQ ID NO: 302916 - RNA, 64 nt, hsa; identical to SEQ ID NO: 302805

SEQ ID NO: 302917 - RNA, 64 nt, hsa; identical to SEQ ID NO: 302806

SEQ ID NO: 302918 - RNA, 64 nt, hsa; identical to SEQ ID NO: 302807

SEQ ID NO: 302919 - RNA, 64 nt, hsa; identical to SEQ ID NO: 302808

SEQ ID NO: 302920 - RNA, 64 nt, hsa; identical to SEQ ID NO: 302809

SEQ ID NO: 302921 - RNA, 64 nt, hsa; identical to SEQ ID NO: 302810

SEQ ID NO: 302922 - RNA, 64 nt, hsa; identical to SEQ ID NO: 302811

SEQ ID NO: 302923 - RNA, 64 nt, hsa; identical to SEQ ID NO: 302812

SEQ ID NO: 302924 - RNA, 64 nt, hsa; identical to SEQ ID NO: 302813

SEQ ID NO: 302925 - RNA, 64 nt, hsa; identical to SEQ ID NO: 302814

SEQ ID NO: 302926 - RNA, 64 nt, hsa; identical to SEQ ID NO: 302815

SEQ ID NO: 302927 - RNA, 64 nt, hsa; identical to SEQ ID NO: 243860

SEQ ID NO: 302928 - RNA, 64 nt, hsa; identical to SEQ ID NO: 243861

SEQ ID NO: 302929 - RNA, 64 nt, hsa; identical to SEQ ID NO: 243862

SEQ ID NO: 302930 - RNA, 64 nt, hsa; identical to SEQ ID NO: 243863

SEQ ID NO: 302931 - RNA, 64 nt, hsa; identical to SEQ ID NO: 243864

SEQ ID NO: 302932 - RNA, 64 nt, hsa; identical to SEQ ID NO: 243865

SEQ ID NO: 302933 - RNA, 64 nt, hsa; identical to SEQ ID NO: 243866

SEQ ID NO: 302934 - RNA, 64 nt, hsa; identical to SEQ ID NO: 243867

SEQ ID NO: 302935 - RNA, 64 nt, hsa; identical to SEQ ID NO: 243868

SEQ ID NO: 302936 - RNA, 64 nt, hsa; identical to SEQ ID NO: 243869

SEQ ID NO: 302937 - RNA, 64 nt, hsa; identical to SEQ ID NO: 243870

SEQ ID NO: 302938 - RNA, 64 nt, hsa; identical to SEQ ID NO: 243871

SEQ ID NO: 302939 - RNA, 64 nt, hsa; identical to SEQ ID NO: 243872

SEQ ID NO: 302940 - RNA, 64 nt, hsa; identical to SEQ ID NO: 243873

SEQ ID NO: 302941 - RNA, 64 nt, hsa; identical to SEQ ID NO: 243874

SEQ ID NO: 302942 - RNA, 64 nt, hsa; identical to SEQ ID NO: 243875

SEQ ID NO: 302943 - RNA, 64 nt, hsa; identical to SEQ ID NO: 243876

SEQ ID NO: 302944 - RNA, 64 nt, hsa; identical to SEQ ID NO: 243877

SEQ ID NO: 302945 - RNA, 64 nt, hsa; identical to SEQ ID NO: 243878

SEQ ID NO: 302946 - RNA, 64 nt, hsa; identical to SEQ ID NO: 243879

SEQ ID NO: 302947 - RNA, 64 nt, hsa; identical to SEQ ID NO: 243880

SEQ ID NO: 302948 - RNA, 64 nt, hsa; identical to SEQ ID NO: 243881

SEQ ID NO: 302949 - RNA, 64 nt, hsa; identical to SEQ ID NO: 243882

SEQ ID NO: 302950 - RNA, 64 nt, hsa; identical to SEQ ID NO: 243883

SEQ ID NO: 302951 - RNA, 64 nt, hsa; identical to SEQ ID NO: 243884

SEQ ID NO: 302952 - RNA, 64 nt, hsa; identical to SEQ ID NO: 243885

SEQ ID NO: 302953 - RNA, 64 nt, hsa; identical to SEQ ID NO: 243886

SEQ ID NO: 302954 - RNA, 64 nt, hsa; identical to SEQ ID NO: 243887

SEQ ID NO: 302955 - RNA, 64 nt, hsa; identical to SEQ ID NO: 243888

SEQ ID NO: 302956 - RNA, 64 nt, hsa; identical to SEQ ID NO: 243889

SEQ ID NO: 302957 - RNA, 51 nt, hsa; identical to SEQ ID NO: 243890

SEQ ID NO: 302958 - RNA, 64 nt, hsa; identical to SEQ ID NO: 243891

SEQ ID NO: 302959 - RNA, 64 nt, hsa; identical to SEQ ID NO: 243892

SEQ ID NO: 302960 - RNA, 64 nt, hsa; identical to SEQ ID NO: 243893

SEQ ID NO: 302961 - RNA, 64 nt, hsa; identical to SEQ ID NO: 243894

SEQ ID NO: 302962 - RNA, 64 nt, hsa; identical to SEQ ID NO: 243895

SEQ ID NO: 302963 - RNA, 64 nt, hsa; identical to SEQ ID NO: 243896

SEQ ID NO: 302964 - RNA, 64 nt, hsa; identical to SEQ ID NO: 243897

SEQ ID NO: 302965 - RNA, 64 nt, hsa; identical to SEQ ID NO: 243898

SEQ ID NO: 302966 - RNA, 64 nt, hsa; identical to SEQ ID NO: 243899

SEQ ID NO: 302967 - RNA, 64 nt, hsa; identical to SEQ ID NO: 243900

SEQ ID NO: 302968 - RNA, 64 nt, hsa; identical to SEQ ID NO: 243901

SEQ ID NO: 302969 - RNA, 63 nt, hsa; identical to SEQ ID NO: 243902

SEQ ID NO: 302970 - RNA, 64 nt, hsa; identical to SEQ ID NO: 243903

SEQ ID NO: 302971 - RNA, 64 nt, hsa; identical to SEQ ID NO: 243904

SEQ ID NO: 302972 - RNA, 64 nt, hsa; identical to SEQ ID NO: 243905

SEQ ID NO: 302973 - RNA, 64 nt, hsa; identical to SEQ ID NO: 243906

SEQ ID NO: 302974 - RNA, 64 nt, hsa; identical to SEQ ID NO: 243907

SEQ ID NO: 302975 - RNA, 64 nt, hsa; identical to SEQ ID NO: 243908

SEQ ID NO: 302976 - RNA, 64 nt, hsa; identical to SEQ ID NO: 243909

SEQ ID NO: 302977 - RNA, 64 nt, hsa; identical to SEQ ID NO: 243910

SEQ ID NO: 302978 - RNA, 64 nt, hsa; identical to SEQ ID NO: 243911

SEQ ID NO: 302979 - RNA, 64 nt, hsa; identical to SEQ ID NO: 243912

SEQ ID NO: 302980 - RNA, 64 nt, hsa; identical to SEQ ID NO: 243913

SEQ ID NO: 302981 - RNA, 64 nt, hsa; identical to SEQ ID NO: 243914

SEQ ID NO: 302982 - RNA, 64 nt, hsa; identical to SEQ ID NO: 243915

SEQ ID NO: 302983 - RNA, 64 nt, hsa; identical to SEQ ID NO: 243916

SEQ ID NO: 302984 - RNA, 64 nt, hsa; identical to SEQ ID NO: 243917

SEQ ID NO: 302985 - RNA, 64 nt, hsa; identical to SEQ ID NO: 243918

SEQ ID NO: 302986 - RNA, 64 nt, hsa; identical to SEQ ID NO: 243919

SEQ ID NO: 302987 - RNA, 64 nt, hsa; identical to SEQ ID NO: 243920

SEQ ID NO: 302988 - RNA, 64 nt, hsa; identical to SEQ ID NO: 243921

SEQ ID NO: 302989 - RNA, 64 nt, hsa; identical to SEQ ID NO: 243922

SEQ ID NO: 302990 - RNA, 64 nt, hsa; identical to SEQ ID NO: 243923

SEQ ID NO: 302991 - RNA, 64 nt, hsa; identical to SEQ ID NO: 243924

SEQ ID NO: 302992 - RNA, 64 nt, hsa; identical to SEQ ID NO: 243925

SEQ ID NO: 302993 - RNA, 64 nt, hsa; identical to SEQ ID NO: 243926

SEQ ID NO: 302994 - RNA, 64 nt, hsa; identical to SEQ ID NO: 243927

SEQ ID NO: 302995 - RNA, 64 nt, hsa; identical to SEQ ID NO: 243928

SEQ ID NO: 302996 - RNA, 64 nt, hsa; identical to SEQ ID NO: 243929

SEQ ID NO: 302997 - RNA, 64 nt, hsa; identical to SEQ ID NO: 243930

SEQ ID NO: 302998 - RNA, 64 nt, hsa; identical to SEQ ID NO: 243931

SEQ ID NO: 302999 - RNA, 64 nt, hsa; identical to SEQ ID NO: 243932

SEQ ID NO: 303000 - RNA, 64 nt, hsa; identical to SEQ ID NO: 243933

SEQ ID NO: 303001 - RNA, 64 nt, hsa; identical to SEQ ID NO: 243934

SEQ ID NO: 303002 - RNA, 64 nt, hsa; identical to SEQ ID NO: 243935

SEQ ID NO: 303003 - RNA, 64 nt, hsa; identical to SEQ ID NO: 243936

SEQ ID NO: 303004 - RNA, 64 nt, hsa; identical to SEQ ID NO: 243937

SEQ ID NO: 303005 - RNA, 64 nt, hsa; identical to SEQ ID NO: 243938

SEQ ID NO: 303006 - RNA, 64 nt, hsa; identical to SEQ ID NO: 243939

SEQ ID NO: 303007 - RNA, 64 nt, hsa; identical to SEQ ID NO: 243940

SEQ ID NO: 303008 - RNA, 64 nt, hsa; identical to SEQ ID NO: 243941

SEQ ID NO: 303009 - RNA, 64 nt, hsa; identical to SEQ ID NO: 243942

SEQ ID NO: 303010 - RNA, 64 nt, hsa; identical to SEQ ID NO: 243943

SEQ ID NO: 303011 - RNA, 64 nt, hsa; identical to SEQ ID NO: 243944

SEQ ID NO: 303012 - RNA, 64 nt, hsa; identical to SEQ ID NO: 243945

SEQ ID NO: 303013 - RNA, 64 nt, hsa; identical to SEQ ID NO: 243946

SEQ ID NO: 303014 - RNA, 64 nt, hsa; identical to SEQ ID NO: 243947

SEQ ID NO: 303015 - RNA, 64 nt, hsa; identical to SEQ ID NO: 243948

SEQ ID NO: 303016 - RNA, 64 nt, hsa
accuaauguuuaugagccagacaaauggaggaauaugacggaagaacauagaacucugggcugc

SEQ ID NO: 303017 - RNA, 64 nt, hsa
gcuggcccggguaucgggaaggaggagcgagggaaugacggagguagggugcagggucagggcu

SEQ ID NO: 303018 - RNA, 64 nt, hsa
uaguaguagguaaaaguuagagugauccuacuauaugacggaaacuuuggcuggaugcaagagc

SEQ ID NO: 303019 - RNA, 64 nt, hsa
ccagcaucuguuccugaacuguguuuuucccaucaugacggaagaagagagugagccgcaauug

SEQ ID NO: 303020 - RNA, 64 nt, hsa
cucccuggaggagacuuauuucaaugaguccaccaugacggaugaggcaccuccuuucccugcu

SEQ ID NO: 303021 - RNA, 64 nt, hsa
ucacaaaagauggaauuugcccuuccuagaaaauaugacggagaaaagucugacucagagaaag

SEQ ID NO: 303022 - RNA, 64 nt, hsa
ucacuaucacuuuaccucaaauugaacagauuccaugacggaacuucauucuucacaaacuagc

SEQ ID NO: 303023 - RNA, 64 nt, hsa
uugggcucuuggaauccuggggaacauagaacucaugacggaagaguugagaccuaacgagaaa

SEQ ID NO: 303024 - RNA, 64 nt, hsa
ucagauaauucauguggagauuuuuggagaaaccaugacggauaguuuaggaugacuacauguc

SEQ ID NO: 303025 - RNA, 64 nt, hsa
aagaggggucuuuuauccuugucguaggaaaaccaugacggaaaggaaaaacugauguuuaaaa

SEQ ID NO: 303026 - RNA, 64 nt, hsa
auguccucccuaggcacagugacagcuguaaaguaugacggaacaagguagcagaugguacaga

SEQ ID NO: 303027 - RNA, 64 nt, hsa
uguauuuugcaaaacuacacugaaguuucugauaaugacggauaucaacaauuaaacgcuuacu

SEQ ID NO: 303028 - RNA, 64 nt, hsa
uuauaggcagaaccuuagagaagaagaguggaagaugacggagaugcauuuugaagcaccccug

SEQ ID NO: 303029 - RNA, 64 nt, hsa
gauggccugaaauuccaccuuucauccccuauggaugacggagagcuuacagaugacccuauug

SEQ ID NO: 303030 - RNA, 64 nt, hsa
aagcaauucacugcuauaauuuaguugauguaaaaugacggaaacugacucaauaugucagguu

SEQ ID NO: 303031 - RNA, 64 nt, hsa
aaaacaccaggaaagaggaacccugggucauaaaaugacggaccuguuaggaaaaugcuguugu

SEQ ID NO: 303032 - RNA, 64 nt, hsa
gcaaacauuuggucacaugcaaguuaguggucauaugacggacugcauucaggacaaggguaaa

SEQ ID NO: 303033 - RNA, 64 nt, hsa
aacuuaacagaugaguucuugaaucugggaugagaugacggauguaaauauuucuaaauuuuaa

SEQ ID NO: 303034 - RNA, 64 nt, hsa
uccuaggcggucccagcuggaauuacccaaccccaugacggacccuuucauugcagcgaucugc

SEQ ID NO: 303035 - RNA, 59 nt, hsa
aacuaagauguggaauauagcaauuaccuaugacggauuagaggaagaugaugaggucu

SEQ ID NO: 303036 - RNA, 64 nt, hsa
ggacuucauguuucccucaaagacucucccguggaugacggaugaggacucugggcugcuggaa

SEQ ID NO: 303037 - RNA, 64 nt, hsa
gcugcuuggcagcccagccuggaggagaaggcuaaugacggaggggccccucgcuggggccccu

SEQ ID NO: 303038 - RNA, 64 nt, hsa
caaauccaucuccaaacaugauacucuugggccaaugacggaucaucaaaauguagauucauug

SEQ ID NO: 303039 - RNA, 64 nt, hsa
guuuuauuugaauggggaaaauacccuuuaaauuaugacggacauccacuagagauggguuuga

SEQ ID NO: 303040 - RNA, 59 nt, hsa
ugaaacuugauauaaaaugaaggagggagaugacggacuagaagacuguaaauaagaua

SEQ ID NO: 303041 - RNA, 64 nt, hsa
aauucuuuaugaauuuuacacuuggcaaauguuaaugacggaagccauagucugcuccuaauac

SEQ ID NO: 303042 - RNA, 64 nt, hsa
aaacuggacaauguccaaacccacucaugacugcaugacggagccgagccaugugucuuuacac

SEQ ID NO: 303043 - RNA, 64 nt, hsa
ucuacugauggcaguguuuuagcugcugggacacaugacggaaguguguauuuuugggccacuc

SEQ ID NO: 303044 - RNA, 64 nt, hsa
gugguuucuuaugcuuuggaagccccuagaaauaaugacggaagaaugccauguugcugaucgu

SEQ ID NO: 303045 - RNA, 64 nt, hsa
uuggaaaugaagaccuaaccagcuauuggugggaaugacggaacuggggauugcgaugauugau

SEQ ID NO: 303046 - RNA, 64 nt, hsa
uggggaaacccuuccuagucucacuugauuccucaugacggaaaucacacuaaagagagaaauc

SEQ ID NO: 303047 - RNA, 64 nt, hsa
uucuuguaaaacauaacacuggaggagaugccuuaugacggagccaucugccuaaauugacaua

SEQ ID NO: 303048 - RNA, 64 nt, hsa
uuucaacaguuuuugcuaauuuuuaggcugaaagaugacggaugccuagaguuuaccuuauguu

SEQ ID NO: 303049 - RNA, 64 nt, hsa
cagucuguuccggggcccccucagccaggugggaaugacggacacguacuauccaaguguaugg

SEQ ID NO: 303050 - RNA, 64 nt, hsa
uucggggagaggagcaggugggacccucaagaaaaugacggagaacaucccagacagaugggac

SEQ ID NO: 303051 - RNA, 64 nt, hsa
gcucacagccgaggagccguggcuccauggccagaugacggaaacagggucugaccaagugcca

SEQ ID NO: 303052 - RNA, 64 nt, hsa
aguaugagaugguguaaggagaagucuuucaagaaugacggaauaagagaccuguuuuaaaaag

SEQ ID NO: 303053 - RNA, 64 nt, hsa
ucugcugagcaggaauaucaugagcuguucaauaaugacggacgcauugguugagaugaaguuu

SEQ ID NO: 303054 - RNA, 64 nt, hsa
auuuuuuaugucaaaauguuacaaccgcuguaaaaugacggagagagagagaaagaaucccaga

SEQ ID NO: 303055 - RNA, 64 nt, hsa
caaccaagaacaaagccccgggacuguuuucuuuuuaauaaagccacaggcaggcaucguagcu

SEQ ID NO: 303056 - RNA, 64 nt, hsa
gaaugagucaccuugugauuuuuaaauuuuuauuuuaauaaagcuaaucaauuucuacaaccuu

SEQ ID NO: 303057 - RNA, 64 nt, hsa
agucuuaauuuaccuugcauuguaauauucaguuuuaauaaaucuucaaaauauuuuguauuua

SEQ ID NO: 303058 - RNA, 64 nt, hsa
ucaaaauauuuuguauuuaggaauagaucugacuuuaauaaaaacauggcucagaaucuacagg

SEQ ID NO: 303059 - RNA, 64 nt, hsa
uacuauaguauucuuaauacagugcucacugcauuuaauaaauauuuaauaaaugaugaaugau

SEQ ID NO: 303060 - RNA, 64 nt, hsa
ucuuaauacagugcucacugcauuuaauaaauauuuaauaaaugaugaaugauagaaguuucca

SEQ ID NO: 303061 - RNA, 64 nt, hsa
ugaauaauaaauuuugacacugaaaaacauuuuauuaauaaagaauauugacaugaguauacca

SEQ ID NO: 303062 - RNA, 64 nt, hsa
auugguaaauaucaccugcucaacauguaauuauuuaauaaaacuuuggaacauuaaaaaaaua

SEQ ID NO: 303063 - RNA, 64 nt, hsa
augguaguuccucuaccuuacaguuaaucguuucuuaauaaagaagcagaauuuagaaaccaca

SEQ ID NO: 303064 - RNA, 64 nt, hsa
aaacuauuauaugauucauaaugguucucaggaauuaauaaaugauuacuguguuuagcucugu

SEQ ID NO: 303065 - RNA, 64 nt, hsa
uuuguugcauuauuuugaauauugucuuuucauuuuaauaaaguuauaauacuuauuuaugaua

SEQ ID NO: 303066 - RNA, 64 nt, hsa
guguugugguuuugcuuuuuuuuuuuagacuguauuaauaaacauacaacacaagcuggccuug

SEQ ID NO: 303067 - RNA, 64 nt, hsa
cugccauaaaagcuaugacacgagaaucagaauauuaauaaaacuuuauguacugcuguagcaa

SEQ ID NO: 303068 - RNA, 64 nt, hsa
ugcuguugguggcagugacuucuuuugaguuagguuaauaaaucaagccauagagccccuccug

SEQ ID NO: 303069 - RNA, 64 nt, hsa
cccaaucuuaccagaugcuacuggacuugaaugguuaauaaaacugcacagugcuguugguggc

SEQ ID NO: 303070 - RNA, 64 nt, hsa
gccucuuacuuuauuuaacauuguagaaauguaauuaauaaacaaugcucacuacacaguuuag

SEQ ID NO: 303071 - RNA, 64 nt, hsa
cacucaguaaaagagcaguacauguaagcagccauuaauaaacuguugcacauggauacuuaua

SEQ ID NO: 303072 - RNA, 64 nt, hsa
cauuuaauguuauuucuguaaacuuugagcuuuguuaauaaacuauuaugcagcaucuacacuu

SEQ ID NO: 303073 - RNA, 64 nt, hsa
uuuuauaguaucagaacuuggguugauuucaauguuaauaaacuaggcaaaacaaauaacuguu

SEQ ID NO: 303074 - RNA, 64 nt, hsa
aguuucaauaaaaacugggccauuaacaaauaaauuaauaaacuaauaagcauucccuucuagg

SEQ ID NO: 303075 - RNA, 64 nt, hsa
accagcuucaacauaugucuacauugcccccaaguuaauaaagugccaacccuuuacucucuca

SEQ ID NO: 303076 - RNA, 64 nt, hsa
uuaacucaaaagaaauagggugauuuuuaaaggauuaauaaaauucugaaauguuaaguagaag

SEQ ID NO: 303077 - RNA, 64 nt, hsa
gggagaucaccccucuaauuauuucugaacuugguuaauaaaaguuuauaagauuuuuaugaag

SEQ ID NO: 303078 - RNA, 64 nt, hsa
uaauaaacacuuuuuguuaaauuguauucuuccuuuaauaaaauauuuuaagcaauuguggaaa

SEQ ID NO: 303079 - RNA, 64 nt, hsa
ugugccuuaaacauauuacuauauauuuuccccuuuaauaaacacuuuuuguuaaauuguauuc

SEQ ID NO: 303080 - RNA, 64 nt, hsa
aaguucguuaguauaaauuacuuuucuaggauuauuaauaaaagccacauagguggcaaguugu

SEQ ID NO: 303081 - RNA, 64 nt, hsa
uaacacuuacauuuccauaaagaaaacucaaguauuaauaaaagagacuuuacuggcuuaagag

SEQ ID NO: 303082 - RNA, 64 nt, hsa
aaauaagauuaguauuaucuguuuauaaugccuguuaauaaaagaauuuacaguuugguaaaau

SEQ ID NO: 303083 - RNA, 64 nt, hsa
aacuugcuaaauauugagaaacuaaacuacuaaguuaauaaauuauauauagcaguguagcugu

SEQ ID NO: 303084 - RNA, 64 nt, hsa
auauucuugguuaaccaugguuaaauaugcuauuuuaauaaauuauugaaacucaccagucaug

SEQ ID NO: 303085 - RNA, 64 nt, hsa
aaaaaaugccgauuuuauuuaugaaaguggguacuuaauaaaugagucguuauacuaugcauaa

SEQ ID NO: 303086 - RNA, 64 nt, hsa
uauagcauacaaaagugauucaguuuuuugguuuuuaauaaaucagaagaccauguagaaaacu

SEQ ID NO: 303087 - RNA, 64 nt, hsa
auuguuuacagccugugaaagugauuuauuuguguuaauaaaacucuuuugaggaagucuaugc

SEQ ID NO: 303088 - RNA, 64 nt, hsa
cagaguaaucuuucaggaacuaaaauagcaauuguuaauaaaauuuaguuucucauuauagucu

SEQ ID NO: 303089 - RNA, 64 nt, hsa
uuuguauugauaauguauuaaaaguuguuugugcuuaauaaaagacuucuuuaaacaucuuauu

SEQ ID NO: 303090 - RNA, 64 nt, hsa
ugccccuaucuuuguuuugucaaauguagaucaguuaauaaacaugaguagcuugaauuuucau

SEQ ID NO: 303091 - RNA, 64 nt, hsa
gcccaaauaccacucaauuauuuuguauuuaugauuaauaaaaguucauuuuuuaaauuuguau

SEQ ID NO: 303092 - RNA, 64 nt, hsa
ccgcuaauauaaguaaaguuuguaaaauucauacuuaauaaacaauuuaggacagucaugucug

SEQ ID NO: 303093 - RNA, 64 nt, hsa
caguguauaaaacauacugugugguauaacaggcuuaauaaauucuuuaaaaggagagaacuga

SEQ ID NO: 303094 - RNA, 64 nt, hsa
uucagcaacuguuaauacucagaucauauaccucuuaauaaauagcaucuuaugcuaauuagcc

SEQ ID NO: 303095 - RNA, 64 nt, hsa
uuuuauauggccuuguaugaggggaguuugaauguuaauaaacauguuuuccacuuuaagaucc

SEQ ID NO: 303096 - RNA, 64 nt, hsa
aauuuuuuacuugugccacuuaauaucaggcauuuuaauaaaauauuguuacaaaaaauguaca

SEQ ID NO: 303097 - RNA, 64 nt, hsa
aaauguacaguacugacaccaccacaaaucaugguuaauaaaagagaguaguuuuaacuuuauu

SEQ ID NO: 303098 - RNA, 64 nt, hsa
aauacaaaguauauucucuuuauuggaaaauaaauuaauaaauauauucuguauuuuugcucuc

SEQ ID NO: 303099 - RNA, 64 nt, hsa
uaaaguauugaaccaacucuaaaauguuaacuccuuaauaaacagauucucaguaaacaaauuu

SEQ ID NO: 303100 - RNA, 64 nt, hsa
uaauugacagaaaaauacagguucuauuaauaaauuaauaaacuguuggucuucaaaauagaaa

SEQ ID NO: 303101 - RNA, 64 nt, hsa
aagcacaauaauugacagaaaaauacagguucuauuaauaaauuaauaaacuguuggucuucaa

SEQ ID NO: 303102 - RNA, 64 nt, hsa
cuuuguaaauauuacccuguaauauuauauauacuuaauaaaacauuuuaagcuauuuuguugg

SEQ ID NO: 303103 - RNA, 64 nt, hsa
aguuaaguuuuuauucaaagcagcuguaauuuaguuaauaaaauaauuaugaucuauguuguuu

SEQ ID NO: 303104 - RNA, 64 nt, hsa
uugguuuuguuuuucugccacauucacuaguuuuuuaauaaauauuuuccaaaaauggauauug

SEQ ID NO: 303105 - RNA, 64 nt, hsa
accuucaaaauuauuugggcauagugcucuauguuuaauaaagguuuuuauagauguuuuauuc

SEQ ID NO: 303106 - RNA, 64 nt, hsa
gacucaguaaguuggcaagguccugacuuuagucuuaauaaaacauugaauuguaguaaagguu

SEQ ID NO: 303107 - RNA, 64 nt, hsa
aggagagcuuugcagauaacaaaauagccuauccuuaauaaauccuccacucucuggaaggaga

SEQ ID NO: 303108 - RNA, 64 nt, hsa
gaauguggcaaagcauuuaauugguccucaaugcuuaauaaauauaauucaugcuggagagaaa

SEQ ID NO: 303109 - RNA, 64 nt, hsa
cuccucacauuuuacuaacuagcaauguucauacuuaauaaaaacauuauaaauguaauuucug

SEQ ID NO: 303110 - RNA, 64 nt, hsa
aggaugccuacgucugaaauugcucuuacgaacuuuaauaaaauaguuagcuaauagaaaaaca

SEQ ID NO: 303111 - RNA, 64 nt, hsa
gagaauugccauauuaauuuuuauaauggaaaacuuaauaaauugcuacuguuuuauaucauaa

SEQ ID NO: 303112 - RNA, 64 nt, hsa
guuacuuaugauauauuuuguuuccucuugugguuuaauaaagugaagugugugugugugugug

SEQ ID NO: 303113 - RNA, 64 nt, hsa
caugggacuguuugcaauaccauauggaaaucuuuuaauaaauauauguaaauaaaauaaaaaa

SEQ ID NO: 303114 - RNA, 64 nt, hsa
auugagccacuuccuugaagaaucaaaauuccuguuaauaaaagaaaaacaaauguaauugaaa

SEQ ID NO: 303115 - RNA, 64 nt, hsa
agcauucucuagucaauaucuuuagugaucuucuuuaauaaacuugaaagcaaagauuuugguu

SEQ ID NO: 303116 - RNA, 64 nt, hsa
ucuucccacacacuuaccuuacuaagucuuugcuuuaauaaaugagcaacccuggguauagucu

SEQ ID NO: 303117 - RNA, 64 nt, hsa
caccccauacuaccucacagauguguugugaggauuaauaaaauuaugucuaugguauuuucag

SEQ ID NO: 303118 - RNA, 64 nt, hsa
uaaaaugcauaguaaaccacuaacguuagcuguuuuaauaaaaguuuucaguuauaaguuuagu

SEQ ID NO: 303119 - RNA, 64 nt, hsa
uaauaaaaguuuucaguuauaaguuuaguaaauauuaauaaauggauacacauucaaaauacuu

SEQ ID NO: 303120 - RNA, 64 nt, hsa
uauauguauguacguauuucagguccuugaaauuuuaauaaauauuacaguuaaauccugauau

SEQ ID NO: 303121 - RNA, 64 nt, hsa
uuuauuucuacccuuaaugcaaugaaauguuucauuaauaaaaaaccacuuuauauaaaauugc

SEQ ID NO: 303122 - RNA, 64 nt, hsa
ucugaaauuguucuuuuaugugucuagcaaguauuuaauaaacccuuguauaguaauuuuguug

SEQ ID NO: 303123 - RNA, 64 nt, hsa
uaaagacaaacauaacuauuuagcagagaauauuuuaauaaaugcaaaacaacagcuggacugc

SEQ ID NO: 303124 - RNA, 64 nt, hsa
gaauuggaguaauagaaaauggaagaugguguuguuaauaaaggcauuuaauagauaaaaacau

SEQ ID NO: 303125 - RNA, 64 nt, hsa
aaagguuuuugaaauccaggaauuaaaucaucccuuaauaaaauauucgaaauucauauuuuau

SEQ ID NO: 303126 - RNA, 64 nt, hsa
auaaauaaaaauuuauaagcauuuguauuauuuuuuaauaaacugcaggguuacacaaaaaucu

SEQ ID NO: 303127 - RNA, 64 nt, hsa
acccaaaugccaagguaauuuuaaauuuacauuuuuaauaaaagcaacauguugaaacaagaga

SEQ ID NO: 303128 - RNA, 64 nt, hsa
cauauuuucaggcaugguaacagaaauuuaccuuuuaauaaauuaaaaaaucuaaauuuuaacc

SEQ ID NO: 303129 - RNA, 64 nt, hsa
aauucuuuaaucuguccagucccaguuucucuuauuaauaaaacuuuggaaauugcuuuaaacc

SEQ ID NO: 303130 - RNA, 62 nt, hsa
ggaauuuuaaauuucuuucauauggaauuuguauuuaauaaaaaugugaaaaagagaauguc

SEQ ID NO: 303131 - RNA, 64 nt, hsa
gaugaccagcagugacaauuuuagacacacuguguuaauaaaugacagaaccugaagaagucau

SEQ ID NO: 303132 - RNA, 64 nt, hsa
gugccaucuguacauauuacuguugcauuuacuuuuaauaaagcuuguggccccuuuuacuuuu

SEQ ID NO: 303133 - RNA, 64 nt, hsa
cuaagccaguuuucauuuugguuuuguguuuugguuaauaaaacaauacucaaauacaaaaggu

SEQ ID NO: 303134 - RNA, 64 nt, hsa
gcaaaaaaucuauaauuugauucucauaaacauauuaauaaaguauaagugauguuuuauauga

SEQ ID NO: 303135 - RNA, 64 nt, hsa
cauuaaauguaaauuuuacauaaaaguugugcucuuaauaaacauguaauauauaauuuaucaa

SEQ ID NO: 303136 - RNA, 64 nt, hsa
ucuucauauacuucauuuuuuaauauaaauaauuuuaauaaauuuuauuuucuuauauucugcu

SEQ ID NO: 303137 - RNA, 64 nt, hsa
gacauuuuuggugaauguuuagccauuuuuaauauuaauaaauugauguuaaguguuugauuca

SEQ ID NO: 303138 - RNA, 64 nt, hsa
ugcuccaaaaaauauguuaauuauuuuauuuuguuuaauaaagaacauucucaaaacguaaaua

SEQ ID NO: 303139 - RNA, 64 nt, hsa
ucaagguuaaaauucugaguaaaauggucuuugauuaauaaacuuaguuuaaucugaauaugua

SEQ ID NO: 303140 - RNA, 64 nt, hsa
uguuuugaauguaaaguugaaaagucugguuuacuuaauaaauugaaagugauuuauaaaaucu

SEQ ID NO: 303141 - RNA, 64 nt, hsa
aucacauauguucuucaagaaacacaugaaauuauuaauaaaguaauuaaaaaauuuuuaaugu

SEQ ID NO: 303142 - RNA, 64 nt, hsa
cugccuacagaauauuaucacuugacagauagaguuaauaaauuaccaaucaggcacauuuuau

SEQ ID NO: 303143 - RNA, 64 nt, hsa
uguuguuacuguaagcuuaggaguuuuccuacuauuaauaaaugugcucuauuuuuacauuuau

SEQ ID NO: 303144 - RNA, 64 nt, hsa
aucaccuccaguuuguugguuuuguuuccaacuguuaauaaagcauugaaacaguacugccuua

SEQ ID NO: 303145 - RNA, 64 nt, hsa
cuuucuuuuuuaaucuacuuuugcuaagaugcauuuaauaaaaaaaaagagagagagagagagg

SEQ ID NO: 303146 - RNA, 64 nt, hsa
uguuacuucagcuacugauucaaagccaauacucuuaauaaaguguugcaauacucugacguuc

SEQ ID NO: 303147 - RNA, 64 nt, hsa
auuauucaugacagcuuuguacuguggaaugugcuuaauaaaaaacaaaaaaguuugacuuuug

SEQ ID NO: 303148 - RNA, 64 nt, hsa
cuugauuucgugaccuugauuucuucccccaaauuuaauaaagacagaggguucucaugauuca

SEQ ID NO: 303149 - RNA, 64 nt, hsa
uuaagugaauuaauauuuguaaaacgcuuagcucuuaauaaauguuucuguuguuauuauuaug

SEQ ID NO: 303150 - RNA, 64 nt, hsa
aaaauguuaucuuuuaauuuauguuaaaauagcauuaauaaaucaguuauagguuaauguagau

SEQ ID NO: 303151 - RNA, 64 nt, hsa
uucuuagccuccauaaucacaugagccaaucuccuuaauaaaugccugcucauagaucuguauc

SEQ ID NO: 303152 - RNA, 64 nt, hsa
auuugcuuuccucugagauucuaagagaaggccuuuaauaaauuuaauaaauauugaguuagca

SEQ ID NO: 303153 - RNA, 64 nt, hsa
ccucugagauucuaagagaaggccuuuaauaaauuuaauaaauauugaguuagcaccuucuuug

SEQ ID NO: 303154 - RNA, 64 nt, hsa
ugccaguuuucacuuuuugaagcauugcaucuuuuuaauaaaucuauccugaaagcuauauaau

SEQ ID NO: 303155 - RNA, 64 nt, hsa
aacauaaagggggaagaaacauaaagugguucucuuaauaaaacuagcagaaaauguugcuuua

SEQ ID NO: 303156 - RNA, 64 nt, hsa
cauucucuuuguuuucauuuuccaaauauaaucuuuaauaaacuugauuuaguuucuugggaaa

SEQ ID NO: 303157 - RNA, 64 nt, hsa
uuaaguguuugucauuuggacaaauugaaaacuuuuaauaaagccauuuucuucuuuguuaaaa

SEQ ID NO: 303158 - RNA, 64 nt, hsa
uacucacauacuauagaaagauauuaguaugcauuuaauaaaacauauucacuugaauauaugg

SEQ ID NO: 303159 - RNA, 64 nt, hsa
aauaaucauguucugguauuauaucuaucuauauuuaauaaauauauacauuuuaauuuauuau

SEQ ID NO: 303160 - RNA, 63 nt, hsa
ccucaucucuuaagcuaaaucuguuuggaucauauuaauaaacuaaaugaaauuacacuuuug

SEQ ID NO: 303161 - RNA, 64 nt, hsa
ucaugguucuauuguagauuuauuuuuauauuaguuaauaaaugacuuuaaauugucaccaauu

SEQ ID NO: 303162 - RNA, 64 nt, hsa
ggacuuacugaagaguuacugaagccugugggacuuaauaaauacaauaugcuacucccuguug

SEQ ID NO: 303163 - RNA, 64 nt, hsa
guaaauugucaacauguaauuuggaauuuucugauuaauaaaugugguuuuggacaucuuuucg

SEQ ID NO: 303164 - RNA, 64 nt, hsa
uuuuuagugugauuuauacugaaaugugagccacuuaauaaagguucauauguucauauuaaua

SEQ ID NO: 303165 - RNA, 64 nt, hsa
ugugagccacuuaauaaagguucauauguucauauuaauaaauauguuuucuguugagucugua

SEQ ID NO: 303166 - RNA, 64 nt, hsa
uacagcccuuaucuagauuauauguauacuuguauuaauaaaaauguuauuuguacaaacauug

SEQ ID NO: 303167 - RNA, 64 nt, hsa
aaugaaauccugaacuuuauucuguguaauuguguuaauaaauccuaauaaauuuaaauuuuua

SEQ ID NO: 303168 - RNA, 64 nt, hsa
gccuacugaugcuucuuaugaucagaacucuuuuuuaauaaaauaaauaacauaaaucguugaa

SEQ ID NO: 303169 - RNA, 64 nt, hsa
aguuucuagaacagugcuaugcacauauuagaucuuaauaaacauuugcugagugaaaguaaga

SEQ ID NO: 303170 - RNA, 64 nt, hsa
guguuucacuauaaggaacagcuaaggaauaauuuuaauaaaagugaaccagaacaaaucacuc

SEQ ID NO: 303171 - RNA, 64 nt, hsa
uaauaaauacuuuaauaagauaugggaaaauauuuuaauaaaacaaggaaaacauaaugaugua

SEQ ID NO: 303172 - RNA, 64 nt, hsa
agaguauauacuaagcucuacagggacagaaugcuuaauaaauacuuuaauaagauaugggaaa

SEQ ID NO: 303173 - RNA, 64 nt, hsa
aaacuaguugugagauaacauucugguagcucaguuaauaaaacaauuucagaauuaaagaaau

SEQ ID NO: 303174 - RNA, 64 nt, hsa
aaaaaagaacuguguuuuuaaacuguaggagaauuuaauaaaucagcaaggguauuuuagcuaa

SEQ ID NO: 303175 - RNA, 64 nt, hsa
augaagcacuucacuuuuuuuuauucaaagccauuuaauaaaacacaguuggucagcccagugc

SEQ ID NO: 303176 - RNA, 64 nt, hsa
uaucuucaccaguguucuaucuuguuccccuaaauuaauaaaauguuuuucuccaggauuuugg

SEQ ID NO: 303177 - RNA, 64 nt, hsa
ccuguugcaauaacuuugcugaaauauuaacacauuaauaaaacuuuucuuaaacaaguugucu

SEQ ID NO: 303178 - RNA, 64 nt, hsa
ucacagggguucuuaugaagguaaauuuaccagauuaauaaaaauuuaugaauauuaaaauuau

SEQ ID NO: 303179 - RNA, 64 nt, hsa
gcuucuuaaaugguggcuguaacauaauaaauguuuaauaaaugcuuauaugaauggauuuuua

SEQ ID NO: 303180 - RNA, 64 nt, hsa
gaacuuauuaaaagcuaucuaugauuuaauagauuuaauaaaauuccuucacgaccugguaccc

SEQ ID NO: 303181 - RNA, 64 nt, hsa
cauaaaaggaaaaagguagcucucucgagucucuuuaauaaagauacuaauucucaugacugaa

SEQ ID NO: 303182 - RNA, 64 nt, hsa
auauuagugccaaucaaauggaaaaaagguaguuuuaauaaacaagacacaacguuuuuauaca

SEQ ID NO: 303183 - RNA, 64 nt, hsa
gaauacaaaaacuuuguuuugugugaucuuuucauuaauaaaauuaucuuuguauaagaauuau

SEQ ID NO: 303184 - RNA, 64 nt, hsa
uacagaauuuuucuucauuaauuuuguguuuaaguuaauaaaauuuauuugugauguacuguaa

SEQ ID NO: 303185 - RNA, 64 nt, hsa
cacaaagaauauagaugauaguagauauauuuuauuaauaaaaugguucaugaaucggagacua

SEQ ID NO: 303186 - RNA, 64 nt, hsa
cauuuuggacagcacaugaagucugccaauguacuuaauaaaacaugacuuuguuuauuuaaag

SEQ ID NO: 303187 - RNA, 64 nt, hsa
guguuaauucccaugaaaguuaagcaagaugcuauuaauaaacugcucugcucuuucuuguuuu

SEQ ID NO: 303188 - RNA, 64 nt, hsa
caauuaaaacuaugugcuaucacaugugaaaagcuuaauaaauuccaucuaucaguaguauagg

SEQ ID NO: 303189 - RNA, 64 nt, hsa
agggguuggugauaacucuugaggauguaaugcauuaauaaaaaucaacucaucauuuucuacu

SEQ ID NO: 303190 - RNA, 64 nt, hsa
uuugagacaaacauuuuuauaauucuaauuuggguuaauaaagauuuuaaauauuucuugguuu

SEQ ID NO: 303191 - RNA, 64 nt, hsa
guaauaguaauaauaguugaaguuuggccaacucuuaauaaaguuauuuugguaacuaauguuu

SEQ ID NO: 303192 - RNA, 64 nt, hsa
uuucagauaaacuggaguguucagauggacuguuuuaauaaaaaucuuugagcaagugaguuau

SEQ ID NO: 303193 - RNA, 64 nt, hsa
cacauauguaauuuuaaauauucuaguagccacauuaauaaaguaaaaagaaacaggugagguu

SEQ ID NO: 303194 - RNA, 64 nt, hsa
gagauucuguugugauuauuugaauaguuuuauauuaauaaaagaagacaaaauuuuuuaaaug

SEQ ID NO: 303195 - RNA, 64 nt, hsa
uuuuuuggccucaaaaaaaucaaggguguaauuuuuaauaaauuguuaauccuauguuuuguaa

SEQ ID NO: 303196 - RNA, 64 nt, hsa
cuucaagaaacuaaauugaucucguagaauuaucuuaauaaaauaauggcuauaauuucucugc

SEQ ID NO: 303197 - RNA, 64 nt, hsa
aauaccuaauaaacugcccucaguaaauccaugguuaauaaaugugguuucuacauuaaccugc

SEQ ID NO: 303198 - RNA, 64 nt, hsa
uguguugaauuacuacauuugcuguacauauuauuuaauaaacuuuauucagaauugcguggca

SEQ ID NO: 303199 - RNA, 64 nt, hsa
gaaauucagguaugccucaccaauuugcccgucuuuaauaaaaucuuguguuaaaauuugcauc

SEQ ID NO: 303200 - RNA, 64 nt, hsa
cugaucuuauguguuacaaaauuggagaaaguauuuaauaaaaccuguuaauuuuuauacugac

SEQ ID NO: 303201 - RNA, 64 nt, hsa
uugcuuucagggaaaaugguauaacguuaauuuauuaauaaauugguaauauacaaaacaauua

SEQ ID NO: 303202 - RNA, 64 nt, hsa
gugcuuuccucccucuccccugcccaccucaaguuuaauaaauaagguuguacuuuucuuacua

SEQ ID NO: 303203 - RNA, 64 nt, hsa
cuugguuccuguaaaauuucaaauugaugugguauuaauaaaaaaaaaaaaaacacaaacaaug

SEQ ID NO: 303204 - RNA, 64 nt, hsa
auaagguuuugaguuagcuggaaaagugaucagauuaauaaauguauauugguaguugaauuua

SEQ ID NO: 303205 - RNA, 64 nt, hsa
accuugauagagaacuuuauaaacuucuuucucuuuaauaaagacuugucuuacaccgugcugc

SEQ ID NO: 303206 - RNA, 64 nt, hsa
augcagcagguguaaaaauuaauaaauauauuuuuuaauaaacauguuuguaugugugaagcua

SEQ ID NO: 303207 - RNA, 64 nt, hsa
uuaauagucuugugcuaugcagcagguguaaaaauuaauaaauauauuuuuuaauaaacauguu

SEQ ID NO: 303208 - RNA, 64 nt, hsa
aagacauuuuaugaaaucuucauugucaaaaccuuuaauaaaaguggaaauauuuugaaaugcc

SEQ ID NO: 303209 - RNA, 64 nt, hsa
acauugagaauuucaacuagcuucugaucaauuuuuaauaaaaaauuuucaaaucauguuagcu

SEQ ID NO: 303210 - RNA, 64 nt, hsa
guaaucucacuaauuuucaugauaaaugaaguuuuuaauaaaauauacuuguuauuaguaauuu

SEQ ID NO: 303211 - RNA, 64 nt, hsa
cauguagggauaucagcguuucucugugugcuuguuaauaaaacuauauaaaaauuaaaauuuu

SEQ ID NO: 303212 - RNA, 64 nt, hsa
caucagccaagcauuguuaguaguauaaauaugauuaauaaaaaugugcauggcuuuccugaag

SEQ ID NO: 303213 - RNA, 64 nt, hsa
aauuucucaaagucuauuguuugaucuaguuauuuuaauaaaggaacucuagaaguuucaagug

SEQ ID NO: 303214 - RNA, 64 nt, hsa
aacggaggaaaaaaaccccaaaccccaaacaaucuuaauaaacacgacugagcaagaaaguggc

SEQ ID NO: 303215 - RNA, 64 nt, hsa
uucaagcauuuaaauacaucuuuuguaagguuuuuuaauaaaggcagauugagucaaguuuauu

SEQ ID NO: 303216 - RNA, 64 nt, hsa
uuucauucacuuuuuuacauuuggauuuauguuuuuaauaaaagggguguuacacuauuugauu

SEQ ID NO: 303217 - RNA, 64 nt, hsa
uugaccuguguuuguaauuucacuuucaucuugcuuaauaaauaucugcuggauucuuucauuc

SEQ ID NO: 303218 - RNA, 64 nt, hsa
uccacaagagcugaggguuucauaacuuuauggcuuaauaaauguaugacacugaaaagauuug

SEQ ID NO: 303219 - RNA, 64 nt, hsa
auguagcuaaauaaaguacauauauuucagucacuuaauaaaagaauaaaggagaauuauucaa

SEQ ID NO: 303220 - RNA, 64 nt, hsa
gaccgaaaaguugaaugauuuauuguuacuuauauuaauaaacuuuucaagagaauuuugucuu

SEQ ID NO: 303221 - RNA, 64 nt, hsa
aagauuuguuaguaacaaucuugaagagcuaauuuuaauaaaaauaagaaaaauuaauacuauc

SEQ ID NO: 303222 - RNA, 64 nt, hsa
auucuagaaauuugaaguauguaaccugaaauccuuaauaaaauuuggauuuaauuuuauaaaa

SEQ ID NO: 303223 - RNA, 64 nt, hsa
auugucauuagaggaaggucuagauuuccugcucuuaauaaaauuacauugaauugauuuuuag

SEQ ID NO: 303224 - RNA, 64 nt, hsa
augccaggaggcuucauugacguuguagucuguguuaauaaacuuguguaucacucugcucuga

SEQ ID NO: 303225 - RNA, 64 nt, hsa
uuauuuucugugccaucuguuaaaugaugagcauuuaauaaaauugugauaaucaguuaucagu

SEQ ID NO: 303226 - RNA, 64 nt, hsa
gggcuugaacugagauuuaaaucuaauaaacaaguuaauaaauguguauguuuuguuguggguu

SEQ ID NO: 303227 - RNA, 64 nt, hsa
ugcuugagacuuaagaggucauguugcuuuagguuuaauaaauagccuuaacuauuuggagggg

SEQ ID NO: 303228 - RNA, 64 nt, hsa
uuaauaaauaggcccauguaaauuuuaauuacaauuaauaaaugaucaaaaaauuugcauuuau

SEQ ID NO: 303229 - RNA, 64 nt, hsa
guuuaaaacaaaguggaaacauuacacaauguccuuaauaaauaggcccauguaaauuuuaauu

SEQ ID NO: 303230 - RNA, 64 nt, hsa
auauaauagauaucuaucgcuauagaauaaugcauuaauaaaaugaggcuuuuuuagaggaaga

SEQ ID NO: 303231 - RNA, 64 nt, hsa
uuggcagauuugauuuuuaaaaaacguauuaucuuuaauaaaauguuauuaugucaaccaguga

SEQ ID NO: 303232 - RNA, 64 nt, hsa
gggcuuggggacccaaugcaaagaugaugacuauuuaauaaaauggaaaauuuaauaaauccuc

SEQ ID NO: 303233 - RNA, 64 nt, hsa
gcaaagaugaugacuauuuaauaaaauggaaaauuuaauaaauccucauuuuauuaacuaagau

SEQ ID NO: 303234 - RNA, 64 nt, hsa
acuuuguacugagagaacuugcuuuggggugcaauuaauaaacugauuuuauuugggagaaaca

SEQ ID NO: 303235 - RNA, 64 nt, hsa
auguagcucuuugaaucucagaaaaaaguagauuuuaauaaagugugaaaguugucaaucaaag

SEQ ID NO: 303236 - RNA, 64 nt, hsa
aaauugagaaauaucugaaauacagaauacgaauuuaauaaaggaagccuaccuuauguaaauu

SEQ ID NO: 303237 - RNA, 64 nt, hsa
gguaaauagauuuuaagccaauucuaguaagaaauuaauaaaacuaccuuauuuuguauuucac

SEQ ID NO: 303238 - RNA, 64 nt, hsa
ccugaaauaccaugauuguuuauggaaaguaucuuuaauaaagcuggauacaguuugaaagaaa

SEQ ID NO: 303239 - RNA, 64 nt, hsa
agacuuacauguagugaaauagaauuuguauuauuuaauaaaauuuuaggguuugguuuuuacu

SEQ ID NO: 303240 - RNA, 64 nt, hsa
uaugacaucugcaauguuuuauaaagcaacuaauuuaauaaaaucacuguugugaggacuuaaa

SEQ ID NO: 303241 - RNA, 64 nt, hsa
ugggaguacaguucucuacguucucuacuaaaucuuaauaaaugcuugacauaguuacagcuuu

SEQ ID NO: 303242 - RNA, 64 nt, hsa
uugcauuaagccaccugcuuuguaaguggauugauuaauaaauaacuuauauuucuauugucuu

SEQ ID NO: 303243 - RNA, 64 nt, hsa
aauguaggcaaagcuuuguuacuuugaaauuuauuuaauaaaaguauuugugacauaaaccuga

SEQ ID NO: 303244 - RNA, 64 nt, hsa
uaugcaauaccaccugcucccuuccaggagcauuuuaauaaaagauuuuuuuuaauaacagaau

SEQ ID NO: 303245 - RNA, 64 nt, hsa
ucaaagcccacuuuagaaccuaaagcauuuuggguuaauaaagcaaaauuuugcuuauguuauu

SEQ ID NO: 303246 - RNA, 64 nt, hsa
aaauguguaucuauguaacaucacuuaagugugcuuaauaaaucuucuguaaggauuuuagaug

SEQ ID NO: 303247 - RNA, 64 nt, hsa
caugacuuuuggagcacuauuccauugucaguuauuaauaaagaauuccauugcuuagcuaacc

SEQ ID NO: 303248 - RNA, 64 nt, hsa
uuagcuuuuaaucauuuuuaccaauuugaacaguuuaauaaacugguucugcucucuucugaau

SEQ ID NO: 303249 - RNA, 64 nt, hsa
aauccaugugcccaggauuauauuagcauuauuuuuaauaaaucuauaugcuuaacauauuaga

SEQ ID NO: 303250 - RNA, 64 nt, hsa
cuaugaaagaaucugugaauauauguaaauacguuuaauaaauuuuauuggucauguuaaauca

SEQ ID NO: 303251 - RNA, 64 nt, hsa
uguuuaaugacuaguugauauuugugcauguuauuuaauaaagaguuauauuuuuauagaaaaa

SEQ ID NO: 303252 - RNA, 64 nt, hsa
uauugaaguuuugguaaaaauucuuuuuucuuuuuuaauaaaaaauuagguuauuacuuuuuuu

SEQ ID NO: 303253 - RNA, 64 nt, hsa
uuucuuugguugucccuauuaacaaaaaaguauuuuaauaaaaaauugaaaugagugagucaua

SEQ ID NO: 303254 - RNA, 64 nt, hsa
augaagucaccguuacaguaacuugauguguauauuaauaaaaguaauucagucauuuuaguuu

SEQ ID NO: 303255 - RNA, 64 nt, hsa
acuuuucuacacugaacauuuuuuuuaacuugauuuaauaaaaauguuaauuuuggaagugcag

SEQ ID NO: 303256 - RNA, 64 nt, hsa
auucauaaaucuucuauauugagaauuggcuauguuaauaaauauuacaacaucauuaagguuu

SEQ ID NO: 303257 - RNA, 64 nt, hsa
auaaguuacuaguuuggaauguccaucaggaccuuuaauaaaugaguuaaaaauuugucuuaug

SEQ ID NO: 303258 - RNA, 64 nt, hsa
ggcacugccccccuuuccugcccccuccucaucuuuaauaaagaccuggcuucucaucuuuaau

SEQ ID NO: 303259 - RNA, 64 nt, hsa
uccucaucuuuaauaaagaccuggcuucucaucuuuaauaaagaccuguuuguaacagaaguuu

SEQ ID NO: 303260 - RNA, 64 nt, hsa
ugcucacauuuuacucaacacagagaguuccugcuuaauaaaagcauuauaagugcaauuacug

SEQ ID NO: 303261 - RNA, 64 nt, hsa
uauacgaguauaaaugaaauucauuucuaaauucuuaauaaauauuuucucaugccaggugugg

SEQ ID NO: 303262 - RNA, 64 nt, hsa
cuguaugcacacaaacuagaaaaccuagaaaaaauuaauaaauuccuugaaagauauaaccccc

SEQ ID NO: 303263 - RNA, 64 nt, hsa
gaccaugaucaucucuuuagaugcagaaagguuuuuaauaaaauucaacaucccuucauuuuaa

SEQ ID NO: 303264 - RNA, 64 nt, hsa
gucuuugaaaguguaacuggaauauuguguaauuuuaauaaauaauaacuauuguuguuuuuau

SEQ ID NO: 303265 - RNA, 64 nt, hsa
caauauaauacaauuauuauuugucaaucaaauauuaauaaaaucaaagaugagcaggucucuu

SEQ ID NO: 303266 - RNA, 64 nt, hsa
uagacaaucauaaaugaaugaucauggcuauguuuuaauaaaacuuuauggacacugagcuuga

SEQ ID NO: 303267 - RNA, 64 nt, hsa
uagacaaucauaaaugaaugaucauggcuauguuuuaauaaaacuuuacagacacugaacuuga

SEQ ID NO: 303268 - RNA, 64 nt, hsa
ggugggaguuguuauauuuaucuguaauauuucuuuaauaaaagagugaaagcaaauaugacag

SEQ ID NO: 303269 - RNA, 64 nt, hsa
ugcuauugaaaucacuggggaaugaauggcuuauuuaauaaauggaagguucauaggagaaaaa

SEQ ID NO: 303270 - RNA, 64 nt, hsa
aguauccaaaaugguuacugaugacaaauacuuuuuaauaaaugucaaaaucacaauacuuggg

SEQ ID NO: 303271 - RNA, 64 nt, hsa
aaauguauuuggaggagaaauccugcaaguaaucuuaauaaaaucauuucaaguaaauauuuga

SEQ ID NO: 303272 - RNA, 64 nt, hsa
cuaaggcuuauaaaauaugaguauggucaggaauuuaauaaaaguacagugaugagcaugccua

SEQ ID NO: 303273 - RNA, 64 nt, hsa
cauaaggcacagcacaucgcaagaugaacaguuguuaauaaaagcuguugcuggaaacuugcuu

SEQ ID NO: 303274 - RNA, 64 nt, hsa
gcucaagaaccuuggaguucauauuucacaaauauuaauaaauauaaguccaagagcugucagc

SEQ ID NO: 303275 - RNA, 64 nt, hsa
gucuccugcacagcaccugcagcauuguaacugcuuaauaaaugacaucucacugaacgaauga

SEQ ID NO: 303276 - RNA, 64 nt, hsa
gcuuccauuguucuguuaagucuugaagaggaauuuaauaaagcaaagaaacuuuuuaaaaacg

SEQ ID NO: 303277 - RNA, 64 nt, hsa
ugaauaacaaucugaagucuuuucauaaaaaaaauuaauaaacuuuaguuguacauuuagccag

SEQ ID NO: 303278 - RNA, 64 nt, hsa
aguugagcauauucucuaguauauagcuacaccuuuaauaaaaugaaggaaugucuucaaucau

SEQ ID NO: 303279 - RNA, 64 nt, hsa
gagaaaagguuugggauguauauugcuauguaauuuaauaaacugauuuuauggauauaaauau

SEQ ID NO: 303280 - RNA, 64 nt, hsa
ggcacugcuuuauccaggggcuucacccaugaaauuaauaaaacuuaucugagucacuugaaac

SEQ ID NO: 303281 - RNA, 64 nt, hsa
cucaguaguguguucugaauucuauucaguuuguuuaauaaauagggaaaacuggcaacaugcu

SEQ ID NO: 303282 - RNA, 64 nt, hsa
uaaauagggaaaacuggcaacaugcuaguuacuuuuaauaaaguaaucccugauucuauaccga

SEQ ID NO: 303283 - RNA, 64 nt, hsa
aauaacagaacugccaaucagggccuaguuucuauuaauaaauuggauaaauuuaauaaaauaa

SEQ ID NO: 303284 - RNA, 64 nt, hsa
cagggccuaguuucuauuaauaaauuggauaaauuuaauaaaauaagagugauacugaaagugc

SEQ ID NO: 303285 - RNA, 64 nt, hsa
uuuaguaguugaaacuuaaacuauuuaaugucauuuaauaaagugaccaaaauguguugugcuc

SEQ ID NO: 303286 - RNA, 64 nt, hsa
gccugcuuuuagcaaccauaaaauugucauaaaauuaauaaauuuaggaaagaauaaagauuua

SEQ ID NO: 303287 - RNA, 64 nt, hsa
auuauaaagaauuuggagauugagcugccuuauuucuaaugaacacuccucuucaucuuauuaa

SEQ ID NO: 303288 - RNA, 51 nt, hsa
acucccgacauaggcuuugagucuaaugaaacaaaaaauauucaucuguug

SEQ ID NO: 303289 - RNA, 64 nt, hsa
aacaaccuuuuacauugugacuguguuugcauugucuaaugacagauaaauccuuaacauuucu

SEQ ID NO: 303290 - RNA, 64 nt, hsa
gauaauaugagauuucuacuucggagaggccaagucuaaugaagagaaaaaaaggaaaagaagu

SEQ ID NO: 303291 - RNA, 64 nt, hsa
auuaacuuccauugggcuaaugaaugcucaaauuucuaaugagaaacuaacacuuuaaaauuua

SEQ ID NO: 303292 - RNA, 64 nt, hsa
uaacauuacuucagaaguuaacacaaugguuuuuucuaaugaaaaacuaccuauaauaggauaa

SEQ ID NO: 303293 - RNA, 64 nt, hsa
guccaaccagacuuugagccugcaucuucuugcaucuaaugaaaaacaaaaagcuaacaucuuu

SEQ ID NO: 303294 - RNA, 64 nt, hsa
gacgaauaugaaugucacauuugaauucuugaucucuaaugagcuagugucuuauggucuugau

SEQ ID NO: 303295 - RNA, 64 nt, hsa
aaaaaauccaaagacucuaaugacuuguaaagacucuaaugauuuguaucauguaaugaacuaa

SEQ ID NO: 303296 - RNA, 64 nt, hsa
acacaguaaaugggaguuuaaaaaauccaaagacucuaaugacuuguaaagacucuaaugauuu

SEQ ID NO: 303297 - RNA, 64 nt, hsa
aagaaucuaaugaaugugcaaccuaauuguagcaucuaaugaauguuccaccauugcuggaaaa

SEQ ID NO: 303298 - RNA, 64 nt, hsa
agaugugagccagcacaccgggccaagugaagaaucuaaugaaugugcaaccuaauuguagcau

SEQ ID NO: 303299 - RNA, 64 nt, hsa; identical to SEQ ID NO: 239630

SEQ ID NO: 303300 - RNA, 64 nt, hsa; identical to SEQ ID NO: 239631

SEQ ID NO: 303301 - RNA, 64 nt, hsa; identical to SEQ ID NO: 239632

SEQ ID NO: 303302 - RNA, 64 nt, hsa; identical to SEQ ID NO: 239633

SEQ ID NO: 303303 - RNA, 64 nt, hsa; identical to SEQ ID NO: 239634

SEQ ID NO: 303304 - RNA, 64 nt, hsa; identical to SEQ ID NO: 239635

SEQ ID NO: 303305 - RNA, 64 nt, hsa; identical to SEQ ID NO: 239636

SEQ ID NO: 303306 - RNA, 64 nt, hsa; identical to SEQ ID NO: 239637

SEQ ID NO: 303307 - RNA, 64 nt, hsa; identical to SEQ ID NO: 239638

SEQ ID NO: 303308 - RNA, 64 nt, hsa; identical to SEQ ID NO: 239639

SEQ ID NO: 303309 - RNA, 64 nt, hsa; identical to SEQ ID NO: 239640

SEQ ID NO: 303310 - RNA, 64 nt, hsa; identical to SEQ ID NO: 239641

SEQ ID NO: 303311 - RNA, 64 nt, hsa; identical to SEQ ID NO: 239642

SEQ ID NO: 303312 - RNA, 64 nt, hsa; identical to SEQ ID NO: 239643

SEQ ID NO: 303313 - RNA, 64 nt, hsa; identical to SEQ ID NO: 239644

SEQ ID NO: 303314 - RNA, 64 nt, hsa; identical to SEQ ID NO: 239645

SEQ ID NO: 303315 - RNA, 64 nt, hsa; identical to SEQ ID NO: 239646

SEQ ID NO: 303316 - RNA, 64 nt, hsa; identical to SEQ ID NO: 239647

SEQ ID NO: 303317 - RNA, 64 nt, hsa; identical to SEQ ID NO: 239648

SEQ ID NO: 303318 - RNA, 64 nt, hsa; identical to SEQ ID NO: 239649

SEQ ID NO: 303319 - RNA, 64 nt, hsa; identical to SEQ ID NO: 239650

SEQ ID NO: 303320 - RNA, 64 nt, hsa; identical to SEQ ID NO: 239651

SEQ ID NO: 303321 - RNA, 64 nt, hsa; identical to SEQ ID NO: 239652

SEQ ID NO: 303322 - RNA, 64 nt, hsa; identical to SEQ ID NO: 239653

SEQ ID NO: 303323 - RNA, 64 nt, hsa; identical to SEQ ID NO: 239654

SEQ ID NO: 303324 - RNA, 64 nt, hsa; identical to SEQ ID NO: 239655

SEQ ID NO: 303325 - RNA, 64 nt, hsa; identical to SEQ ID NO: 239656

SEQ ID NO: 303326 - RNA, 64 nt, hsa; identical to SEQ ID NO: 239657

SEQ ID NO: 303327 - RNA, 64 nt, hsa; identical to SEQ ID NO: 239658

SEQ ID NO: 303328 - RNA, 64 nt, hsa; identical to SEQ ID NO: 239659

SEQ ID NO: 303329 - RNA, 64 nt, hsa; identical to SEQ ID NO: 239660

SEQ ID NO: 303330 - RNA, 64 nt, hsa; identical to SEQ ID NO: 239661

SEQ ID NO: 303331 - RNA, 64 nt, hsa; identical to SEQ ID NO: 239662

SEQ ID NO: 303332 - RNA, 64 nt, hsa; identical to SEQ ID NO: 239663

SEQ ID NO: 303333 - RNA, 64 nt, hsa; identical to SEQ ID NO: 239664

SEQ ID NO: 303334 - RNA, 64 nt, hsa; identical to SEQ ID NO: 239665

SEQ ID NO: 303335 - RNA, 64 nt, hsa; identical to SEQ ID NO: 239666

SEQ ID NO: 303336 - RNA, 64 nt, hsa; identical to SEQ ID NO: 239667

SEQ ID NO: 303337 - RNA, 64 nt, hsa; identical to SEQ ID NO: 239668

SEQ ID NO: 303338 - RNA, 64 nt, hsa; identical to SEQ ID NO: 239669

SEQ ID NO: 303339 - RNA, 64 nt, hsa; identical to SEQ ID NO: 239670

SEQ ID NO: 303340 - RNA, 64 nt, hsa; identical to SEQ ID NO: 239671

SEQ ID NO: 303341 - RNA, 64 nt, hsa; identical to SEQ ID NO: 239672

SEQ ID NO: 303342 - RNA, 64 nt, hsa; identical to SEQ ID NO: 239673

SEQ ID NO: 303343 - RNA, 64 nt, hsa; identical to SEQ ID NO: 239674

SEQ ID NO: 303344 - RNA, 56 nt, hsa; identical to SEQ ID NO: 239675

SEQ ID NO: 303345 - RNA, 64 nt, hsa; identical to SEQ ID NO: 161898

SEQ ID NO: 303346 - RNA, 64 nt, hsa; identical to SEQ ID NO: 161899

SEQ ID NO: 303347 - RNA, 64 nt, hsa; identical to SEQ ID NO: 161900

SEQ ID NO: 303348 - RNA, 64 nt, hsa; identical to SEQ ID NO: 161901

SEQ ID NO: 303349 - RNA, 64 nt, hsa; identical to SEQ ID NO: 161902

SEQ ID NO: 303350 - RNA, 64 nt, hsa; identical to SEQ ID NO: 161903

SEQ ID NO: 303351 - RNA, 64 nt, hsa; identical to SEQ ID NO: 161904

SEQ ID NO: 303352 - RNA, 64 nt, hsa; identical to SEQ ID NO: 161905

SEQ ID NO: 303353 - RNA, 64 nt, hsa; identical to SEQ ID NO: 161906

SEQ ID NO: 303354 - RNA, 64 nt, hsa; identical to SEQ ID NO: 161907

SEQ ID NO: 303355 - RNA, 64 nt, hsa; identical to SEQ ID NO: 161908

SEQ ID NO: 303356 - RNA, 64 nt, hsa; identical to SEQ ID NO: 161909

SEQ ID NO: 303357 - RNA, 64 nt, hsa; identical to SEQ ID NO: 161910

SEQ ID NO: 303358 - RNA, 64 nt, hsa; identical to SEQ ID NO: 161911

SEQ ID NO: 303359 - RNA, 64 nt, hsa; identical to SEQ ID NO: 161912

SEQ ID NO: 303360 - RNA, 64 nt, hsa; identical to SEQ ID NO: 161913

SEQ ID NO: 303361 - RNA, 64 nt, hsa; identical to SEQ ID NO: 161914

SEQ ID NO: 303362 - RNA, 64 nt, hsa; identical to SEQ ID NO: 161915

SEQ ID NO: 303363 - RNA, 64 nt, hsa; identical to SEQ ID NO: 161916

SEQ ID NO: 303364 - RNA, 64 nt, hsa; identical to SEQ ID NO: 161917

SEQ ID NO: 303365 - RNA, 64 nt, hsa; identical to SEQ ID NO: 161918

SEQ ID NO: 303366 - RNA, 64 nt, hsa; identical to SEQ ID NO: 161919

SEQ ID NO: 303367 - RNA, 64 nt, hsa; identical to SEQ ID NO: 161920

SEQ ID NO: 303368 - RNA, 64 nt, hsa; identical to SEQ ID NO: 161921

SEQ ID NO: 303369 - RNA, 64 nt, hsa; identical to SEQ ID NO: 161922

SEQ ID NO: 303370 - RNA, 64 nt, hsa; identical to SEQ ID NO: 161923

SEQ ID NO: 303371 - RNA, 64 nt, hsa; identical to SEQ ID NO: 161919

SEQ ID NO: 303372 - RNA, 64 nt, hsa; identical to SEQ ID NO: 161920

SEQ ID NO: 303373 - RNA, 63 nt, hsa; identical to SEQ ID NO: 161926

SEQ ID NO: 303374 - RNA, 63 nt, hsa; identical to SEQ ID NO: 161927

SEQ ID NO: 303375 - RNA, 63 nt, hsa; identical to SEQ ID NO: 161928

SEQ ID NO: 303376 - RNA, 63 nt, hsa; identical to SEQ ID NO: 161929

SEQ ID NO: 303377 - RNA, 63 nt, hsa; identical to SEQ ID NO: 161930

SEQ ID NO: 303378 - RNA, 63 nt, hsa; identical to SEQ ID NO: 161931

SEQ ID NO: 303379 - RNA, 63 nt, hsa; identical to SEQ ID NO: 161932

SEQ ID NO: 303380 - RNA, 63 nt, hsa; identical to SEQ ID NO: 161933

SEQ ID NO: 303381 - RNA, 63 nt, hsa; identical to SEQ ID NO: 161934

SEQ ID NO: 303382 - RNA, 63 nt, hsa; identical to SEQ ID NO: 161935

SEQ ID NO: 303383 - RNA, 63 nt, hsa; identical to SEQ ID NO: 161936

SEQ ID NO: 303384 - RNA, 63 nt, hsa; identical to SEQ ID NO: 161937

SEQ ID NO: 303385 - RNA, 63 nt, hsa; identical to SEQ ID NO: 161938

SEQ ID NO: 303386 - RNA, 63 nt, hsa; identical to SEQ ID NO: 161939

SEQ ID NO: 303387 - RNA, 63 nt, hsa; identical to SEQ ID NO: 161940

SEQ ID NO: 303388 - RNA, 63 nt, hsa; identical to SEQ ID NO: 161941

SEQ ID NO: 303389 - RNA, 63 nt, hsa; identical to SEQ ID NO: 161942

SEQ ID NO: 303390 - RNA, 63 nt, hsa; identical to SEQ ID NO: 161943

SEQ ID NO: 303391 - RNA, 63 nt, hsa; identical to SEQ ID NO: 161944

SEQ ID NO: 303392 - RNA, 63 nt, hsa; identical to SEQ ID NO: 161945

SEQ ID NO: 303393 - RNA, 63 nt, hsa; identical to SEQ ID NO: 161946

SEQ ID NO: 303394 - RNA, 63 nt, hsa; identical to SEQ ID NO: 161947

SEQ ID NO: 303395 - RNA, 63 nt, hsa; identical to SEQ ID NO: 161948

SEQ ID NO: 303396 - RNA, 63 nt, hsa; identical to SEQ ID NO: 161949

SEQ ID NO: 303397 - RNA, 63 nt, hsa; identical to SEQ ID NO: 161950

SEQ ID NO: 303398 - RNA, 63 nt, hsa; identical to SEQ ID NO: 161951

SEQ ID NO: 303399 - RNA, 64 nt, hsa
caaagucacacauucagaacugucucuggcagucgaauaucacuagagaaaaguaaacagagaa

SEQ ID NO: 303400 - RNA, 64 nt, hsa
acacacaguagccauuaguuagacucuucuuagugaauaucaggaacaucccaucugugcuuaa

SEQ ID NO: 303401 - RNA, 63 nt, hsa
auggcuuuggaauaaaucauuuuauauuuuauuugaauaucagaaccauuuuuaagguuuucu

SEQ ID NO: 303402 - RNA, 64 nt, hsa
uuuuucagcuuuagaauuuguaaauauuuuuguagaauaucauaugacuguaauuccagagugu

SEQ ID NO: 303403 - RNA, 64 nt, hsa
auguccuagcuuagccauucagaagagaaaaauggaauaucagaguuacaguugucagugaaac

SEQ ID NO: 303404 - RNA, 64 nt, hsa
uccaacauuauugagauugucguguauagucaucgaauaucagccaguuccuguaauuuuguga

SEQ ID NO: 303405 - RNA, 64 nt, hsa
uugggauuaauaauuauuuuuaauuuuucuggcugaauaucaaauugauaguaacaacagaagc

SEQ ID NO: 303406 - RNA, 64 nt, hsa
caaaauuaacuuaugcucauauauuaggaugugagaauaucaucuguuuauggacacaugaaac

SEQ ID NO: 303407 - RNA, 64 nt, hsa
ucauuuuaucgagaugccaagaugaacacaaugugaauaucauuuccauuucuaagcaguugaa

SEQ ID NO: 303408 - RNA, 64 nt, hsa
agccucuuauucuaaaguccauagcaaugcuauggaauaucaaguauaaugauguaguaaaaag

SEQ ID NO: 303409 - RNA, 64 nt, hsa
agaauuccauauugcuauaguacuucuguaaagagaauaucaauauaaauaaggaaaauaaauc

SEQ ID NO: 303410 - RNA, 64 nt, hsa
uguaauccacuaaagacgugccaaugaauuauuggaauaucacacuuuaaaaaccgccuuguaa

SEQ ID NO: 303411 - RNA, 64 nt, hsa
ggaagguagaucuuaucuagccuuuggauuucaagaauaucauaguccuuuugauuuucaaagu

SEQ ID NO: 303412 - RNA, 64 nt, hsa
gaauuaaugaaaacguagaagaaaguacuaaaaggaauaucauaagggcuguagcucaaacuuc

SEQ ID NO: 303413 - RNA, 64 nt, hsa
gagaaagaucuuaauuccuuguuguuuugacuaggaauaucaauauuugguauaaaauaacuag

SEQ ID NO: 303414 - RNA, 64 nt, hsa
uauuucucuguaaugcauuguugaaagacaaccagaauaucaagaaaauguauauaggaauaug

SEQ ID NO: 303415 - RNA, 64 nt, hsa
aaaggaauccuuucagcugccaguuuugaauaaugaauaucauauuguaucaucaaugcugaua

SEQ ID NO: 303416 - RNA, 64 nt, hsa
acugaguuggucuuuagguuuaagauggauaaaugaauaucacuacuuguucugaaaacauguu

SEQ ID NO: 303417 - RNA, 64 nt, hsa
cuuuaaucuuccucuagcaggcaugcaguccaaggaauaucaaaauucugguuguauugggaac

SEQ ID NO: 303418 - RNA, 64 nt, hsa
cuuuaauuuuccucuagcaggcaugcaguccaaggaauaucaaaauucugauuguaugggaacc

SEQ ID NO: 303419 - RNA, 64 nt, hsa
aaggauggggaucuuucaccuuuagggaucucagcacaauuagaaucguaaagugaauucuauc

SEQ ID NO: 303420 - RNA, 64 nt, hsa
uuuggaaaugggugaccugaagugacacuuuuuccacaauuaacccaaguuguguuaauacuuc

SEQ ID NO: 303421 - RNA, 64 nt, hsa
uugacguaucaguacuucuaagaagggaucuaagcacaauuaagugaauugagucccuggucua

SEQ ID NO: 303422 - RNA, 64 nt, hsa
uuucugcuguuuguuguccugcuugguugaguaccacaauuaaagauuaugcuccccuuuucuu

SEQ ID NO: 303423 - RNA, 64 nt, hsa
auuuauaguuuucuugggaguaucacaggaaaaucacaauuacaccacuuuagacccuaugugu

SEQ ID NO: 303424 - RNA, 64 nt, hsa
uaaaacauuuuuaaugaacuaaguugaauaaaggcacaauuaaaaacugucaucaaagcccagu

SEQ ID NO: 303425 - RNA, 64 nt, hsa
cuucacucaguugugcugaggucaauagaguguagaguuucagaaaggauuccagcagguuuau

SEQ ID NO: 303426 - RNA, 64 nt, hsa
ucaaaugguaugcucgcagcauuagcaaaauuaggaguuucaucuuuuucauugaaucacaggu

SEQ ID NO: 303427 - RNA, 64 nt, hsa
auaugguuggauguccacugaugaaauuuuaaaggaguuucaguuuuaaaagugcgcaugauuc

SEQ ID NO: 303428 - RNA, 64 nt, hsa
cugggagcacaguuggcuacaggccucuuguggagaguuucacgggcaggggugauuccaacuu

SEQ ID NO: 303429 - RNA, 64 nt, hsa
uuuaccauauuaguggucauuauuuaugcuuugagaguuucaauauuguucgucaaguuaacuu

SEQ ID NO: 303430 - RNA, 64 nt, hsa
gauucagguucucaauaauaauauucaaguuuuagaguuucacuuuguacuauuuaaauuuaug

SEQ ID NO: 303431 - RNA, 64 nt, hsa
uuguaccuuuuuuuuuuuuuuuuuuuuuuugacggaguuucacucuuguuacccaggcuggagu

SEQ ID NO: 303432 - RNA, 64 nt, hsa
acgguagaaauuucuacaaaaugaauauuaucaagaguuucaugugaucacugcaguguuguca

SEQ ID NO: 303433 - RNA, 64 nt, hsa
ccugauccuucuacaggauuuuuaaaaaguaagagaguuucagagaagccgaucccauaauccc

SEQ ID NO: 303434 - RNA, 64 nt, hsa
agaaguagcuucucuguuuaaguuuaauaaaguugaguuucaccagucuucuauguccuaagug

SEQ ID NO: 303435 - RNA, 64 nt, hsa
uuacaccgugcugccauuaaaggcagcuguucuagaguuucagucaccuaaguacacccacaaa

SEQ ID NO: 303436 - RNA, 64 nt, hsa
gaucuacuuaugguugauggagcacauugauuuggaguuucagaucuuccaaagcacuauuugu

SEQ ID NO: 303437 - RNA, 64 nt, hsa
uuaaaaaauauuuccuagggcuguaguuauuugggaguuucauaaccuguuauggugcuuuugg

SEQ ID NO: 303438 - RNA, 64 nt, hsa
ugaagucauuacaaacuccuuguacauucacugugaguuucaaagggagucagucccuaauuua

SEQ ID NO: 303439 - RNA, 64 nt, hsa
acacccagcuaauuuuuuguauuugguagagauggaguuucaccaugguggucaggcuggucuu

SEQ ID NO: 303440 - RNA, 64 nt, hsa
ggacauagaucuuuuuuuuuuuuuuuuugagacagaguuucacucuuguuguccagucuggagu

SEQ ID NO: 303441 - RNA, 64 nt, hsa
auugccuucuaaauuaugauaaaacagaagugaagaguuucagagcaucagauugagugaaaag

SEQ ID NO: 303442 - RNA, 64 nt, hsa
ucuuuucuuuccuuuuuuuuuuuuuuuugagacggaguuucacucuuguugcccaggcuggagu

SEQ ID NO: 303443 - RNA, 64 nt, hsa
uuuuuuuuauuuaaaaaauuuuuuuuucgagauggaguuucacucuguugcccaggcuggagug

SEQ ID NO: 303444 - RNA, 64 nt, hsa
auuccaguuuuaaucauuguaaaaaaagcaccuggaguuucaaaacaugugaauacuaccaagu

SEQ ID NO: 303445 - RNA, 64 nt, hsa; identical to SEQ ID NO: 47605

SEQ ID NO: 303446 - RNA, 64 nt, hsa; identical to SEQ ID NO: 47606

SEQ ID NO: 303447 - RNA, 64 nt, hsa; identical to SEQ ID NO: 47607

SEQ ID NO: 303448 - RNA, 64 nt, hsa; identical to SEQ ID NO: 47608

SEQ ID NO: 303449 - RNA, 64 nt, hsa; identical to SEQ ID NO: 47609

SEQ ID NO: 303450 - RNA, 64 nt, hsa; identical to SEQ ID NO: 47610

SEQ ID NO: 303451 - RNA, 64 nt, hsa; identical to SEQ ID NO: 47611

SEQ ID NO: 303452 - RNA, 64 nt, hsa; identical to SEQ ID NO: 47612

SEQ ID NO: 303453 - RNA, 64 nt, hsa; identical to SEQ ID NO: 47613

SEQ ID NO: 303454 - RNA, 64 nt, hsa; identical to SEQ ID NO: 47614

SEQ ID NO: 303455 - RNA, 64 nt, hsa; identical to SEQ ID NO: 47615

SEQ ID NO: 303456 - RNA, 64 nt, hsa; identical to SEQ ID NO: 47616

SEQ ID NO: 303457 - RNA, 64 nt, hsa; identical to SEQ ID NO: 47617

SEQ ID NO: 303458 - RNA, 64 nt, hsa; identical to SEQ ID NO: 47618

SEQ ID NO: 303459 - RNA, 64 nt, hsa; identical to SEQ ID NO: 47619

SEQ ID NO: 303460 - RNA, 64 nt, hsa; identical to SEQ ID NO: 47620

SEQ ID NO: 303461 - RNA, 64 nt, hsa; identical to SEQ ID NO: 47621

SEQ ID NO: 303462 - RNA, 64 nt, hsa; identical to SEQ ID NO: 47622

SEQ ID NO: 303463 - RNA, 64 nt, hsa; identical to SEQ ID NO: 47623

SEQ ID NO: 303464 - RNA, 64 nt, hsa; identical to SEQ ID NO: 47624

SEQ ID NO: 303465 - RNA, 64 nt, hsa; identical to SEQ ID NO: 47625

SEQ ID NO: 303466 - RNA, 64 nt, hsa; identical to SEQ ID NO: 47626

SEQ ID NO: 303467 - RNA, 64 nt, hsa; identical to SEQ ID NO: 47627

SEQ ID NO: 303468 - RNA, 64 nt, hsa; identical to SEQ ID NO: 47628

SEQ ID NO: 303469 - RNA, 64 nt, hsa; identical to SEQ ID NO: 47629

SEQ ID NO: 303470 - RNA, 64 nt, hsa; identical to SEQ ID NO: 47630

SEQ ID NO: 303471 - RNA, 64 nt, hsa; identical to SEQ ID NO: 47631

SEQ ID NO: 303472 - RNA, 64 nt, hsa; identical to SEQ ID NO: 47632

SEQ ID NO: 303473 - RNA, 64 nt, hsa; identical to SEQ ID NO: 47633

SEQ ID NO: 303474 - RNA, 64 nt, hsa; identical to SEQ ID NO: 47634

SEQ ID NO: 303475 - RNA, 64 nt, hsa; identical to SEQ ID NO: 47635

SEQ ID NO: 303476 - RNA, 64 nt, hsa; identical to SEQ ID NO: 47636

SEQ ID NO: 303477 - RNA, 64 nt, hsa; identical to SEQ ID NO: 47637

SEQ ID NO: 303478 - RNA, 64 nt, hsa; identical to SEQ ID NO: 47638

SEQ ID NO: 303479 - RNA, 64 nt, hsa; identical to SEQ ID NO: 47639

SEQ ID NO: 303480 - RNA, 64 nt, hsa; identical to SEQ ID NO: 47640

SEQ ID NO: 303481 - RNA, 64 nt, hsa; identical to SEQ ID NO: 47641

SEQ ID NO: 303482 - RNA, 64 nt, hsa; identical to SEQ ID NO: 47642

SEQ ID NO: 303483 - RNA, 64 nt, hsa; identical to SEQ ID NO: 47643

SEQ ID NO: 303484 - RNA, 64 nt, hsa; identical to SEQ ID NO: 47644

SEQ ID NO: 303485 - RNA, 64 nt, hsa; identical to SEQ ID NO: 47645

SEQ ID NO: 303486 - RNA, 64 nt, hsa; identical to SEQ ID NO: 47646

SEQ ID NO: 303487 - RNA, 64 nt, hsa; identical to SEQ ID NO: 47647

SEQ ID NO: 303488 - RNA, 64 nt, hsa; identical to SEQ ID NO: 47648

SEQ ID NO: 303489 - RNA, 64 nt, hsa; identical to SEQ ID NO: 47649

SEQ ID NO: 303490 - RNA, 64 nt, hsa; identical to SEQ ID NO: 47650

SEQ ID NO: 303491 - RNA, 64 nt, hsa; identical to SEQ ID NO: 47651

SEQ ID NO: 303492 - RNA, 64 nt, hsa; identical to SEQ ID NO: 47652

SEQ ID NO: 303493 - RNA, 64 nt, hsa; identical to SEQ ID NO: 47653

SEQ ID NO: 303494 - RNA, 64 nt, hsa; identical to SEQ ID NO: 47654

SEQ ID NO: 303495 - RNA, 64 nt, hsa; identical to SEQ ID NO: 47655

SEQ ID NO: 303496 - RNA, 64 nt, hsa; identical to SEQ ID NO: 47656

SEQ ID NO: 303497 - RNA, 64 nt, hsa; identical to SEQ ID NO: 47657

SEQ ID NO: 303498 - RNA, 64 nt, hsa; identical to SEQ ID NO: 47658

SEQ ID NO: 303499 - RNA, 64 nt, hsa; identical to SEQ ID NO: 47659

SEQ ID NO: 303500 - RNA, 64 nt, hsa; identical to SEQ ID NO: 47660

SEQ ID NO: 303501 - RNA, 64 nt, hsa; identical to SEQ ID NO: 47659

SEQ ID NO: 303502 - RNA, 64 nt, hsa; identical to SEQ ID NO: 47662

SEQ ID NO: 303503 - RNA, 64 nt, hsa; identical to SEQ ID NO: 47663

SEQ ID NO: 303504 - RNA, 64 nt, hsa; identical to SEQ ID NO: 47664

SEQ ID NO: 303505 - RNA, 64 nt, hsa; identical to SEQ ID NO: 47665

SEQ ID NO: 303506 - RNA, 64 nt, hsa; identical to SEQ ID NO: 47666

SEQ ID NO: 303507 - RNA, 64 nt, hsa; identical to SEQ ID NO: 47667

SEQ ID NO: 303508 - RNA, 64 nt, hsa; identical to SEQ ID NO: 47668

SEQ ID NO: 303509 - RNA, 64 nt, hsa; identical to SEQ ID NO: 47669

SEQ ID NO: 303510 - RNA, 64 nt, hsa; identical to SEQ ID NO: 47670

SEQ ID NO: 303511 - RNA, 64 nt, hsa; identical to SEQ ID NO: 47671

SEQ ID NO: 303512 - RNA, 64 nt, hsa; identical to SEQ ID NO: 47672

SEQ ID NO: 303513 - RNA, 64 nt, hsa; identical to SEQ ID NO: 47673

SEQ ID NO: 303514 - RNA, 64 nt, hsa; identical to SEQ ID NO: 47674

SEQ ID NO: 303515 - RNA, 64 nt, hsa
acacauauggcgaaagucaaguaucugaggccacuugcaacauugugacaaagaagauggaaga

SEQ ID NO: 303516 - RNA, 64 nt, hsa
ucugaggccacuagugagauuucagaucucucuuuugcaacauuuuacccauuucccuucccca

SEQ ID NO: 303517 - RNA, 64 nt, hsa
uugaaaugacaaccuuugguuaagugugucaagguugcaacagaauuuucacaauuuuuuuguu

SEQ ID NO: 303518 - RNA, 64 nt, hsa
agaaauugauuuuuuuguauuaaucauuuucccauugcaacagagcuauauuuuuucuauuuua

SEQ ID NO: 303519 - RNA, 64 nt, hsa
aaaaacccaccauucucuucucccccuauuaaauuugcaacaauaaaggguggaggguaaucuc

SEQ ID NO: 303520 - RNA, 64 nt, hsa
auugauuucuguacagucagaacaguacuuggguuugcaacagcuuucugagaaaagcuaggug

SEQ ID NO: 303521 - RNA, 64 nt, hsa
caauacugggcagccuuuuuuuuuuuuuuuuuaauugcaacaaugcaaaagccaagaaaguaua

SEQ ID NO: 303522 - RNA, 64 nt, hsa
uuuuuuuuuuuguuccuguguauucucauugggguugcaacaauaauucaucaaguaaucaugg

SEQ ID NO: 303523 - RNA, 64 nt, hsa
gaaucagccauuuuaucgaggcacgugaucaguguugcaacauaaugaaaaagauggcuacugu

SEQ ID NO: 303524 - RNA, 64 nt, hsa
ugcauuuggccaaaugaaaugguagucaagccuauugcaacaaaguuaggaaguuuguuguuug

SEQ ID NO: 303525 - RNA, 64 nt, hsa
ugaaauguaagagaucugguuuugaauguaaaaguugcaacacacaaacggaagucuuaaaaac

SEQ ID NO: 303526 - RNA, 64 nt, hsa
gaucauuuuuccccccaccuuaggauggugaauguugcaacacaaugacagguuuaagucaguc

SEQ ID NO: 303527 - RNA, 64 nt, hsa
ccaaaagcugccacugugugguauucgaggauuauugcaacaaagccaguaguuaaaccaaacu

SEQ ID NO: 303528 - RNA, 64 nt, hsa
ccaucucuaguuuuuccacgucugucugaaguucuugcaacaaauucugcaugguccagcgcuc

SEQ ID NO: 303529 - RNA, 64 nt, hsa
caguauguauauauuguguuaaguuccucaagaaucuccuuaaaaacuuugaaguuaauacuuu

SEQ ID NO: 303530 - RNA, 64 nt, hsa
gaauauauuaucaauacaguuuuaugcaguaagcucuccuuaccauaaauguuucuugguugac

SEQ ID NO: 303531 - RNA, 64 nt, hsa
caugaugggcacagagcaucacaugagcuguuucucuccuuaaagaagaucccuggaaaggaug

SEQ ID NO: 303532 - RNA, 64 nt, hsa
uccuuaggccauaucaacuuuggccaucaauaucucuccuuaaacaauuauauuucaccuuuua

SEQ ID NO: 303533 - RNA, 64 nt, hsa
agaugucauuugucucccgcccuaaguccuccagucuccuuagagcuaguacuuacuaagcauu

SEQ ID NO: 303534 - RNA, 64 nt, hsa
gcagaagagacacuuuccuauuuugccuaauaggucuccuuauaugcaucuguaguuaacauuc

SEQ ID NO: 303535 - RNA, 64 nt, hsa
aagucuccugucuuaugguccagaaacuccuguuucuccuuaguuggcuggaaacugcucccau

SEQ ID NO: 303536 - RNA, 64 nt, hsa
ggccugugaaucaauccugggcaaucagacacccucuccuuaaaaacuggcccguggagacuga

SEQ ID NO: 303537 - RNA, 64 nt, hsa
auaaaugcaauuuuaguggaauugauugacagugucuccuuacuuugaaguuuucaccaaagca

SEQ ID NO: 303538 - RNA, 64 nt, hsa
guucauuuuuuuugucuuucccaaaucuugguagucuccuuauaguugaagauaaaauguugag

SEQ ID NO: 303539 - RNA, 64 nt, hsa
agacaaaucuucaugcagacuggacuucuccuccugguagcacuuugcucugucauccuuuuug

SEQ ID NO: 303540 - RNA, 64 nt, hsa
aguugaaauggacuguccauugacguuccuaaugugguagcagaaaaaaaaaaauggugucuua

SEQ ID NO: 303541 - RNA, 64 nt, hsa
aagcucuggcccugcccuguauuccucuuccccuugguagcaguucccugaccaagggcaaggu

SEQ ID NO: 303542 - RNA, 64 nt, hsa
uauaaauaaagcaaauaaaguugaguguuccacaugguagcauuugcuaacacuuccuaauucu

SEQ ID NO: 303543 - RNA, 64 nt, hsa; identical to SEQ ID NO: 97744

SEQ ID NO: 303544 - RNA, 64 nt, hsa; identical to SEQ ID NO: 97745

SEQ ID NO: 303545 - RNA, 64 nt, hsa; identical to SEQ ID NO: 97746

SEQ ID NO: 303546 - RNA, 64 nt, hsa; identical to SEQ ID NO: 97747

SEQ ID NO: 303547 - RNA, 64 nt, hsa; identical to SEQ ID NO: 97748

SEQ ID NO: 303548 - RNA, 64 nt, hsa; identical to SEQ ID NO: 97749

SEQ ID NO: 303549 - RNA, 64 nt, hsa; identical to SEQ ID NO: 97750

SEQ ID NO: 303550 - RNA, 64 nt, hsa; identical to SEQ ID NO: 97751

SEQ ID NO: 303551 - RNA, 64 nt, hsa; identical to SEQ ID NO: 97752

SEQ ID NO: 303552 - RNA, 64 nt, hsa; identical to SEQ ID NO: 97753

SEQ ID NO: 303553 - RNA, 64 nt, hsa; identical to SEQ ID NO: 97754

SEQ ID NO: 303554 - RNA, 64 nt, hsa; identical to SEQ ID NO: 97755

SEQ ID NO: 303555 - RNA, 64 nt, hsa; identical to SEQ ID NO: 97756

SEQ ID NO: 303556 - RNA, 64 nt, hsa; identical to SEQ ID NO: 97757

SEQ ID NO: 303557 - RNA, 64 nt, hsa; identical to SEQ ID NO: 97758

SEQ ID NO: 303558 - RNA, 64 nt, hsa; identical to SEQ ID NO: 97759

SEQ ID NO: 303559 - RNA, 64 nt, hsa; identical to SEQ ID NO: 97760

SEQ ID NO: 303560 - RNA, 64 nt, hsa; identical to SEQ ID NO: 97761

SEQ ID NO: 303561 - RNA, 64 nt, hsa; identical to SEQ ID NO: 97762

SEQ ID NO: 303562 - RNA, 64 nt, hsa; identical to SEQ ID NO: 97763

SEQ ID NO: 303563 - RNA, 64 nt, hsa; identical to SEQ ID NO: 97764

SEQ ID NO: 303564 - RNA, 64 nt, hsa; identical to SEQ ID NO: 97765

SEQ ID NO: 303565 - RNA, 64 nt, hsa; identical to SEQ ID NO: 97766

SEQ ID NO: 303566 - RNA, 64 nt, hsa; identical to SEQ ID NO: 97767

SEQ ID NO: 303567 - RNA, 64 nt, hsa; identical to SEQ ID NO: 97768

SEQ ID NO: 303568 - RNA, 64 nt, hsa; identical to SEQ ID NO: 97769

SEQ ID NO: 303569 - RNA, 64 nt, hsa; identical to SEQ ID NO: 97770

SEQ ID NO: 303570 - RNA, 64 nt, hsa; identical to SEQ ID NO: 97771

SEQ ID NO: 303571 - RNA, 64 nt, hsa; identical to SEQ ID NO: 97772

SEQ ID NO: 303572 - RNA, 64 nt, hsa; identical to SEQ ID NO: 97773

SEQ ID NO: 303573 - RNA, 64 nt, hsa; identical to SEQ ID NO: 97774

SEQ ID NO: 303574 - RNA, 64 nt, hsa; identical to SEQ ID NO: 97775

SEQ ID NO: 303575 - RNA, 64 nt, hsa; identical to SEQ ID NO: 97776

SEQ ID NO: 303576 - RNA, 64 nt, hsa; identical to SEQ ID NO: 97777

SEQ ID NO: 303577 - RNA, 64 nt, hsa; identical to SEQ ID NO: 97778

SEQ ID NO: 303578 - RNA, 64 nt, hsa; identical to SEQ ID NO: 97779

SEQ ID NO: 303579 - RNA, 64 nt, hsa; identical to SEQ ID NO: 97780

SEQ ID NO: 303580 - RNA, 64 nt, hsa; identical to SEQ ID NO: 97781

SEQ ID NO: 303581 - RNA, 64 nt, hsa; identical to SEQ ID NO: 97782

SEQ ID NO: 303582 - RNA, 64 nt, hsa; identical to SEQ ID NO: 97783

SEQ ID NO: 303583 - RNA, 64 nt, hsa; identical to SEQ ID NO: 97784

SEQ ID NO: 303584 - RNA, 64 nt, hsa; identical to SEQ ID NO: 97785

SEQ ID NO: 303585 - RNA, 64 nt, hsa; identical to SEQ ID NO: 103765

SEQ ID NO: 303586 - RNA, 64 nt, hsa; identical to SEQ ID NO: 103766

SEQ ID NO: 303587 - RNA, 53 nt, hsa; identical to SEQ ID NO: 103767

SEQ ID NO: 303588 - RNA, 64 nt, hsa; identical to SEQ ID NO: 103768

SEQ ID NO: 303589 - RNA, 64 nt, hsa; identical to SEQ ID NO: 103769

SEQ ID NO: 303590 - RNA, 64 nt, hsa; identical to SEQ ID NO: 103770

SEQ ID NO: 303591 - RNA, 53 nt, hsa; identical to SEQ ID NO: 103771

SEQ ID NO: 303592 - RNA, 64 nt, hsa; identical to SEQ ID NO: 103772

SEQ ID NO: 303593 - RNA, 64 nt, hsa; identical to SEQ ID NO: 103773

SEQ ID NO: 303594 - RNA, 64 nt, hsa; identical to SEQ ID NO: 103774

SEQ ID NO: 303595 - RNA, 64 nt, hsa; identical to SEQ ID NO: 103775

SEQ ID NO: 303596 - RNA, 64 nt, hsa; identical to SEQ ID NO: 103776

SEQ ID NO: 303597 - RNA, 63 nt, hsa
uggauuugcuuuaacccucacauuuuuuuuuuaauguuucacauguuacauuauuagcugaau

SEQ ID NO: 303598 - RNA, 63 nt, hsa
ggcagucuggcgcccaugaugggagggauugacauguuucaacaaaauaaugcacuuccuuac

SEQ ID NO: 303599 - RNA, 63 nt, hsa
uuuucuuaaauccaaguuggccguuuuauuaguauguuucaaauguguauuaccaaugugggu

SEQ ID NO: 303600 - RNA, 63 nt, hsa
aauaucuccaugcauaguuuuagacaaaaaaagauguuucaauaaaauuacugucuuguaaua

SEQ ID NO: 303601 - RNA, 63 nt, hsa
cucaaccaauuuggcaccccaugcagccucaaaauguuucaaaugccuaccgccucuagaucg

SEQ ID NO: 303602 - RNA, 63 nt, hsa
ggcuucuuuucucccuugauggucaagucucuuauguuucaauauuucuuaacuggggugucu

SEQ ID NO: 303603 - RNA, 63 nt, hsa
augucaugaaugauuuccaguuuuuaaagcuauauguuucacugcuucauaucucuguccacu

SEQ ID NO: 303604 - RNA, 63 nt, hsa
cgcacacaugauuuugauuaugcuacaugauauauguuucaaaaagaauuagcauagaaaucc

SEQ ID NO: 303605 - RNA, 63 nt, hsa
agguaggggauugcugggccauaugauaagcauauguuucaguucuaccaaucuuguuuccag

SEQ ID NO: 303606 - RNA, 63 nt, hsa
agaaaaacauuaaaaaguucauuccuuaacacaauguuucaaguuaaaccuuuugugucaccg

SEQ ID NO: 303607 - RNA, 63 nt, hsa
uuugauaaauauccucucaguguuuuaucuuccauguuucaacaacuauugaaauaugaaaug

SEQ ID NO: 303608 - RNA, 63 nt, hsa
gguuucucuguauaguacuggcaugguacggagauguuucacgaaguuuguucaucagacucc

SEQ ID NO: 303609 - RNA, 63 nt, hsa
gugcuugccugaaauaaagcuaauaaaaauauuauguuucacauuaucuucuguucauuuuga

SEQ ID NO: 303610 - RNA, 63 nt, hsa
aaaaugcaaaucgacuuuuuaacaacuguugagauguuucaugggacaguagaacucugacuc

SEQ ID NO: 303611 - RNA, 63 nt, hsa
cacgcuugguuaauuuuuguauuuuuaguagagauguuucaccauguuggccaggcuagucuu

SEQ ID NO: 303612 - RNA, 63 nt, hsa
ccggguguuguauguguggugacuugcggauuuauguuucaguguacuggaaacuuuccauuu

SEQ ID NO: 303613 - RNA, 63 nt, hsa
ugauuuuguaaauuucaguaauucauuuaaaugauguuucaguagauauauucuagcauauua

SEQ ID NO: 303614 - RNA, 63 nt, hsa
auccaaaauuaugauaacuguauuucuagggguauguuucaccuugauuuuggcccgguucuu

SEQ ID NO: 303615 - RNA, 63 nt, hsa
cuacuugguaacaaaguucucagauguuaggucauguuucauuugcucagucggggaucacuc

SEQ ID NO: 303616 - RNA, 63 nt, hsa
uagcaggugaacuguuccaagacugacacaaggauguuucaaacuugccucugucuguagaaa

SEQ ID NO: 303617 - RNA, 63 nt, hsa
cguauuauauagagaaacaaauguuuuuauuaaauguuucauugacccaaguaauuuaaaagu

SEQ ID NO: 303618 - RNA, 63 nt, hsa
guuuuucauacucuuaaguguaaauaauauaaaauguuucaagcgcuuaacucccccucauuc

SEQ ID NO: 303619 - RNA, 63 nt, hsa
uagagcuuuagaaauuuguaagcugagagaacaauguuucacuuaauaggagggugucuuagu

SEQ ID NO: 303620 - RNA, 63 nt, hsa
uacucuuucuuuuaagauaaguuguagacuucgauguuucaugcucauguacuucaaauaaug

SEQ ID NO: 303621 - RNA, 61 nt, hsa
gaaaucuguuaaaauaaaauuguacauuuggagauguuucaugaugauguguuuauuucua

SEQ ID NO: 303622 - RNA, 63 nt, hsa
aaacuugugacuuguguauuaucgucauugaggauguuucacucaugucugucauuuuauaag

SEQ ID NO: 303623 - RNA, 63 nt, hsa
augguaaguucccuuagcuauaugaauuuuggcauguuucagagagaucaguaaauaaaauau

SEQ ID NO: 303624 - RNA, 63 nt, hsa
augcggagacguaaagcauuaaugcaaguuaaaauguuucagugaacaaguuucagcgguuca

SEQ ID NO: 303625 - RNA, 63 nt, hsa
cuagaaaacuuuggauuuuugaaguaaauuuuaauguuucauauuaauuucuugaaaauguau

SEQ ID NO: 303626 - RNA, 63 nt, hsa
agacucagaaggggaagcauugggaaaccauguauguuucauuucugguuuaaccaggcuuuu

SEQ ID NO: 303627 - RNA, 63 nt, hsa
ucuauauggaauugcuuaccaaaggauagugcgauguuucaggaggcuggaggaagggggguu

SEQ ID NO: 303628 - RNA, 63 nt, hsa
agucaacuuaccuauuaaauauuccucuauuagauguuucaacacuauaauuuaauugggaaa

SEQ ID NO: 303629 - RNA, 63 nt, hsa
uucuaugacaaauucaagagcuagaaaaauaaaauguuucauuaugcacuuuuagaaaugcau

SEQ ID NO: 303630 - RNA, 63 nt, hsa
gugacaccaaaaagaaaagucuauaaccugaaaauguuucauguucucugcugugaaacucuu

SEQ ID NO: 303631 - RNA, 63 nt, hsa
uuugucguguuuguuuuaacuucuaaagaaaauauguuucagcauuauaagaaaggcagaaug

SEQ ID NO: 303632 - RNA, 63 nt, hsa
gaaacaugcucagucaugcacauguguugacccauguuucagaugcagucugaugccagguau

SEQ ID NO: 303633 - RNA, 63 nt, hsa
uguuuauucuuuugcuucuccccaauaaagcacauguuucauggucaagcccacauugcuuuu

SEQ ID NO: 303634 - RNA, 63 nt, hsa
aaggcaaaccuggcuuuugauuaccauguguggauguuucaguguccuuucuucucugucccu

SEQ ID NO: 303635 - RNA, 56 nt, hsa
cccucccucacagccuguagccaccaauguuucaagaggagcccccacccuguucc

SEQ ID NO: 303636 - RNA, 63 nt, hsa
cuagauacuauuacgcuaucuuguuugggaaugauguuucauagguuugugaugaucuuuacg

SEQ ID NO: 303637 - RNA, 63 nt, hsa
aauccuagaccuuuucaugacguguaaaaaaugauguuucauccucugauugccccaauaaaa

SEQ ID NO: 303638 - RNA, 63 nt, hsa
agcaucccuugucugaaaugcuugggauuagaaauguuucagauuucaauuuuuuuucagauu

SEQ ID NO: 303639 - RNA, 63 nt, hsa
accgugccuagccaaggaugagauuuuuaaaguauguuucaguucugugucaugguuggaaga

SEQ ID NO: 303640 - RNA, 63 nt, hsa
auccacaauuaaaccauguuucucacuuuucacauguuucauagcaacugcuuuauaugacug

SEQ ID NO: 303641 - RNA, 63 nt, hsa
cuaacccugauaguuaccuaaagugacacuuaaauguuucagagugaaugcaaaaaagagaga

SEQ ID NO: 303642 - RNA, 51 nt, hsa
gcacucggagagaagucuaggauguuucacaaacuacaaagcugaagaaaa

SEQ ID NO: 303643 - RNA, 63 nt, hsa
gacaaaaccugggaauuuggguuguguaugcgaauguuucagugccucagacaaauguguauu

SEQ ID NO: 303644 - RNA, 63 nt, hsa
ugugucucaggcucaaguuuuuauaguuauuaaauguuucaaaauagacaaguuuuguuuccu

SEQ ID NO: 303645 - RNA, 63 nt, hsa
ugaguuauuccacaaacacauuauaaaguucagauguuucaucaaugcaguucucacgaaagu

SEQ ID NO: 303646 - RNA, 63 nt, hsa
uaacaaacaaaagaaauguaguucagcuuuucaauguuucauguuugcugugcuuuucugaau

SEQ ID NO: 303647 - RNA, 63 nt, hsa
acuuucugcugugaacugaacugcagcuauagaauguuucaaaugcuuaaauauauaauacau

SEQ ID NO: 303648 - RNA, 61 nt, hsa
uugaauguagauacucagaagaaauaaaaaaugauguuucacucugugucuguuuuuaauu

SEQ ID NO: 303649 - RNA, 63 nt, hsa
uuauugaugugcugugauaugagggaaucugaaauguuucauaaaaauaaagcuuaaaaauug

SEQ ID NO: 303650 - RNA, 63 nt, hsa
aacauuguagauaucuauuuauauuuaaaguuuauguuucaugaacugcagcugcaggauucu

SEQ ID NO: 303651 - RNA, 63 nt, hsa
gccuuuuaaguaguuugaaugauaagacuuaaaauguuucauaauuauguuuuauguaacaga

SEQ ID NO: 303652 - RNA, 63 nt, hsa
uguacugauaguacuucccaguaugauauugugauguuucauacaaugcagugaacauaacca

SEQ ID NO: 303653 - RNA, 63 nt, hsa
ucuuaacuaauugcgguuucauaggauauauaaauguuucaagccauuauugcugaaugguuc

SEQ ID NO: 303654 - RNA, 63 nt, hsa
auguaagcauguauacacugugcuaaaagucacauguuucaguuuguguauaauauuaauaug

SEQ ID NO: 303655 - RNA, 63 nt, hsa
aacaggaaaaaauaauuauaagaugauaagcaaauguuucagcccaaugucaacccaguuaaa

SEQ ID NO: 303656 - RNA, 63 nt, hsa
gcugccauaguuuucuaacuugaacagccaugaauguuucaugucucccuuuuuuuuugucua

SEQ ID NO: 303657 - RNA, 63 nt, hsa
cauguuguccuuucuggcuucccugauggugucauguuucagcgcaugcgccccagccuuucc

SEQ ID NO: 303658 - RNA, 63 nt, hsa
ugaauccuugugguuuuuaguuuuguauaaauuauguuucaaaucuuuacauuuuggaaauaa

SEQ ID NO: 303659 - RNA, 63 nt, hsa
acuuuuuggggaaguaaaagaagauggaaauggauguuucauuuguaugaguuuggagcagug

SEQ ID NO: 303660 - RNA, 63 nt, hsa
cuauucuuucccuagaggcaaacauuucuuaaaauguuucauuuucauuaaaaaugaaagcca

SEQ ID NO: 303661 - RNA, 63 nt, hsa
accauaccaacuggaauuuaggcuuuaaaaauaauguuucaaggccagguguggugauucaug

SEQ ID NO: 303662 - RNA, 63 nt, hsa
uuuuguguauuuauacuuguauguaugauuugcauguuucaaugauaaagggauaaaacagua

SEQ ID NO: 303663 - RNA, 63 nt, hsa
ccauagauugcugucccccucgacggacuuauaauguuucagguggcuggcuugaacaugagu

SEQ ID NO: 303664 - RNA, 63 nt, hsa
cugcuaaguuguaccuuaauuagagggcaauauauguuucauaaagaagagucuuuauaauuu

SEQ ID NO: 303665 - RNA, 63 nt, hsa
aguugaccuagauuguauuaauagcuacuuaagauguuucaaagauaggaagcuauugcuugg

SEQ ID NO: 303666 - RNA, 63 nt, hsa
aagggagagaacaaaagcuauaccaaaagggccauguuucaagaaaauggauuuaaacauauu

SEQ ID NO: 303667 - RNA, 63 nt, hsa
caaucagaccagguaggagcuuuccuguuucauauguuucaggguugcacaguuggucucuuu

SEQ ID NO: 303668 - RNA, 63 nt, hsa
ggcaugaaaauuuucuuaagcuaaaauacagacauguuucaaagggcuaaaguuggagaugag

SEQ ID NO: 303669 - RNA, 63 nt, hsa
acuaaaggauauacauauacugccucuucuaugauguuucauuugaccuacaccaucagcauc

SEQ ID NO: 303670 - RNA, 63 nt, hsa
acuuuugaaaacaaaauaugaaaagaaucggcaauguuucaaacaaaaagucauaaaagucac

SEQ ID NO: 303671 - RNA, 63 nt, hsa
uggcuacaucuguaucuuuuccuccuguguuuaauguuucacuagggagaggaaauaaagcag

SEQ ID NO: 303672 - RNA, 63 nt, hsa
guuuuuuuuauuauaaaacuugcccuucauuacauguuucaaagugguguggugggccaaaau

SEQ ID NO: 303673 - RNA, 63 nt, hsa
ucugcuucaauguagucagaauuagcugcuucuauguuucauaguuggggucauagauguuuc

SEQ ID NO: 303674 - RNA, 63 nt, hsa
uuuacauuggauaaaggauuaggcaaaaauaaaauguuucaaggauuccugaccauaagugac

SEQ ID NO: 303675 - RNA, 63 nt, hsa
cacacagacugcucuccaaucccugagucucagauguuucauuuauuuccuacuuuuccacua

SEQ ID NO: 303676 - RNA, 63 nt, hsa
aaauuauaucuguuuuggagcaagagugucauaauguuucaggguagucaaaauaaacauaaa

SEQ ID NO: 303677 - RNA, 63 nt, hsa
cucaguaggaacuuuuugaaauagggcaaguuuauguuucaugcgagaaaacaugaaggaggg

SEQ ID NO: 303678 - RNA, 63 nt, hsa; identical to SEQ ID NO: 303661

SEQ ID NO: 303679 - RNA, 63 nt, hsa
agagacaaucucuggcaaguuuuuguagaaaaaauguuucagugccuagucugaaaaauaaca

SEQ ID NO: 303680 - RNA, 63 nt, hsa
auucugaaaaauacauuucuauuuauagaauaaauguuucauuuauauaaaagcaaaagaacu

SEQ ID NO: 303681 - RNA, 63 nt, hsa
ugcguccuggguagucugugcuuguaauccagcauguuucacagaguaagccuguugugacuu

SEQ ID NO: 303682 - RNA, 63 nt, hsa
guaacauuaauucuacuaaauauuuuauaugaaauguuucacuaugauuuucuauuuuucuuc

SEQ ID NO: 303683 - RNA, 57 nt, hsa
cguccacgagguuaaucuaaagggagcauguuucacaguggcuggacuaccgagagc

SEQ ID NO: 303684 - RNA, 63 nt, hsa
guguuauuuuuucuuaucaaacaauuagauguuauguuucauauuauuugauauuuauuuuca

SEQ ID NO: 303685 - RNA, 63 nt, hsa
uuuaauuuuguuucauuuuguuuucauaagacaauguuucagauauguaauggggcaaaccac

SEQ ID NO: 303686 - RNA, 63 nt, hsa
cucccacugggagucaucgcugagaagaugccaauguuucauccaccggcugcacaggcacaa

SEQ ID NO: 303687 - RNA, 63 nt, hsa
aauauauauuauauaaauauauuaaaaaggaaaauguuucagauguuuauuuguauaauuacu

SEQ ID NO: 303688 - RNA, 63 nt, hsa
uuauaaccaaaaacaaugugacggauacccaagauguuucauguuguagcuugggugaauuac

SEQ ID NO: 303689 - RNA, 63 nt, hsa
auuuuuaauaacaugcaugggucccucucacuaauguuucaacaauagggaaaaaugagaacu

SEQ ID NO: 303690 - RNA, 63 nt, hsa
gguguagaauuuacacugcugcaccugaggucgauguuucaaaguaagaucaagccaguguuu

SEQ ID NO: 303691 - RNA, 63 nt, hsa
aagugacauuucaaaagaaguucuauaacaauuauguuucaugcuuaaaguaaaaauucccag

SEQ ID NO: 303692 - RNA, 63 nt, hsa
uuaaucaugcaguguacaauucaaaaucaugcaauguuucacuuuagaauuggauuugaagaa

SEQ ID NO: 303693 - RNA, 63 nt, hsa
uucaaauggcaguagccuuggcucacauaagacauguuucaugugaucuguauccuggcauac

SEQ ID NO: 303694 - RNA, 63 nt, hsa
augcauguauaggccgaacuauuaucagcucugauguuucagagagaagaccucagaaaccga

SEQ ID NO: 303695 - RNA, 63 nt, hsa
cauguaaagaauauaugagccuuguauggagugauguuucauuuaccuggguuguguuaauga

SEQ ID NO: 303696 - RNA, 63 nt, hsa
acuguuggucuagccugugaagcaauuaaucgaauguuucagaaggagcagagugaauuagua

SEQ ID NO: 303697 - RNA, 63 nt, hsa
auggacuggcuuaagccguguggcauccgaggaauguuucaaaugugucuguguuucucuuua

SEQ ID NO: 303698 - RNA, 63 nt, hsa
aggacauuaauaaugguguacuuuaaaaaauauauguuucauuuaaucuucacaaaagaucug

SEQ ID NO: 303699 - RNA, 63 nt, hsa
gccuccgccgccacugcugcugccaccucuuauauguuucagacacucucugcccagacucau

SEQ ID NO: 303700 - RNA, 63 nt, hsa
aaaauaacuauaucauaacucauucauaacuugauguuucauuuucuguugaggaaccauaaa

SEQ ID NO: 303701 - RNA, 63 nt, hsa
uauuaaaugauuuagcagucuccacguguguuaauguuucaaacguguaucauaauguguaua

SEQ ID NO: 303702 - RNA, 63 nt, hsa
uuaugauauggacguuaucauuggucuggugagauguuucauauuugugacaguuaauuuaaa

SEQ ID NO: 303703 - RNA, 63 nt, hsa
ccaacugccaagccauacuuauuaaguucgaacauguuucacuuaaggagagacaccuagcuu

SEQ ID NO: 303704 - RNA, 63 nt, hsa
aagaagucuugggauuggauuuuaccauaugaaauguuucauauugaaaacacaagaugaccu

SEQ ID NO: 303705 - RNA, 63 nt, hsa
uagugaagaaacaaguucucggguggggaaucuauguuucacucagauuuauauguuuggagg

SEQ ID NO: 303706 - RNA, 63 nt, hsa
cuuggacguuucauuuugaaagaaagaaauuuuauguuucacauauaguuuuauacaaaguag

SEQ ID NO: 303707 - RNA, 63 nt, hsa
aauaaaucaugccacuauauuaauuuauauuacauguuucauauuuaaaucauguuuuccuaa

SEQ ID NO: 303708 - RNA, 63 nt, hsa
auucaucacauaguaucuuaaagggaacaaauaauguuucauccuauggaaaugugaaggaug

SEQ ID NO: 303709 - RNA, 63 nt, hsa
uuauaaguuguaugcauaaacauaagauuuguaauguuucauuuauaaacugccuucuucaac

SEQ ID NO: 303710 - RNA, 63 nt, hsa
ugaaucuaccauucauagccagauguguaucagauguuucacugacaguuuuuaacaauaaau

SEQ ID NO: 303711 - RNA, 63 nt, hsa
uauaauaccuuuuccuuguguguaauuauacuuauguuucaauaacagcugaaggguuuuauu

SEQ ID NO: 303712 - RNA, 63 nt, hsa
augugaugggucuaguccaguuuauuuaaguucauguuucacuguuugcacuuugcauugaac

SEQ ID NO: 303713 - RNA, 63 nt, hsa
gagaacuugggaauguuuaagaagaaaucaaacauguuucaggaaaaggaaaucuauggagua

SEQ ID NO: 303714 - RNA, 63 nt, hsa
guaacuaggggcuguguuucugcauuaaaauaaauguuucaggcuuugugguccugaucaagg

SEQ ID NO: 303715 - RNA, 63 nt, hsa
uaccagcugaauagcccagcuugcaguauaguuauguuucagucugcaguguguuuagcauuc

SEQ ID NO: 303716 - RNA, 63 nt, hsa
caggucacccuguggcaggccugggcccucaggauguuucaaaggcuccacagcuccaccgcu

SEQ ID NO: 303717 - RNA, 63 nt, hsa
uuagaaugcucuuuugcauguaaagcacaaaguauguuucaguuuaaaugcacuucuuccggu

SEQ ID NO: 303718 - RNA, 63 nt, hsa
aguuagauauugacuuuaucuuuaggcuuuuguauguuucagaugcaaacauauuaaaguuuc

SEQ ID NO: 303719 - RNA, 63 nt, hsa
accuuagaacaugagagaguggaaaaccucaggauguuucagccaaacaagaagagaagaaaa

SEQ ID NO: 303720 - RNA, 63 nt, hsa
uuauauuaaccucuuccuacuuuaaagugugaaauguuucaccucagcuguacaaacuccagc

SEQ ID NO: 303721 - RNA, 63 nt, hsa
uaugugauguuggaaagcucauugauuuuguauauguuucagcguguuaccuuucuggcuucc

SEQ ID NO: 303722 - RNA, 63 nt, hsa
acuauucaguuuucaggaugauacacuaugaagauguuucaaaaaaucugaccaaaacaaaca

SEQ ID NO: 303723 - RNA, 63 nt, hsa
uuccccucaguucaucuuuaccaaagacacucuauguuucauuaaucucaacuggcagcaaua

SEQ ID NO: 303724 - RNA, 63 nt, hsa
agaacuaucuugguugcaaaggguaggucucuaauguuucaucaauaaaugugauguuucuag

SEQ ID NO: 303725 - RNA, 63 nt, hsa
ugcaucaguugcuucuauagagcaucagcccucauguuucauugucuuaaugucggggagcag

SEQ ID NO: 303726 - RNA, 63 nt, hsa
aaaaaagcaaaugaggcaaugugucaaaauuuaauguuucauaauaaaaauagauacguugac

SEQ ID NO: 303727 - RNA, 63 nt, hsa
cacuguuucucucaacacuauuuaaucugaaaaauguuucaguacaaaccacuguuugaacua

SEQ ID NO: 303728 - RNA, 63 nt, hsa
aaauucagaauaucucuaaaacauggaaaauugauguuucaauaaaaagggagacauuuuauu

SEQ ID NO: 303729 - RNA, 63 nt, hsa
ccauucugccccuguacauguuuccuaccaagcauguuucacauuuuccuauuaguggaggag

SEQ ID NO: 303730 - RNA, 63 nt, hsa
aauugccuauaaauugacucuacuaaaauaacaauguuucagucugaaaauuugaauugaaaa

SEQ ID NO: 303731 - RNA, 63 nt, hsa
uaguguacauuguaaaacucagauauugucaugauguuucacuuggacauaagacuuauuaau

SEQ ID NO: 303732 - RNA, 63 nt, hsa
ccugaccuugaaucacaagagucuuaacagggaauguuucaggaaacaaauaggauaagacaa

SEQ ID NO: 303733 - RNA, 63 nt, hsa
uauuuuuauauuaaaguacuauacuaggagagaauguuucagaacucccugaugaauuucuaa

SEQ ID NO: 303734 - RNA, 63 nt, hsa
augaauaauuccugcuauucugaaauugccuacauguuucaauaccaguuauauggagugcuu

SEQ ID NO: 303735 - RNA, 63 nt, hsa
uguaguuuaauaaaguuccuguuuaugagagucauguuucaucucagcuucuuccauggaugu

SEQ ID NO: 303736 - RNA, 63 nt, hsa
agcugugcaaccugugaagccaagagugaacugauguuucauuuauauuuucauccaaaugac

SEQ ID NO: 303737 - RNA, 63 nt, hsa
gauccugugcuuaccuuuuccugcuguacucugauguuucagugaagcucauccacgaagucc

SEQ ID NO: 303738 - RNA, 63 nt, hsa
uccagaucagauggggacacacaaccccuggauauguuucauugucagauuuugugcuugauu

SEQ ID NO: 303739 - RNA, 63 nt, hsa
caucagccucacugagcuaauaaagggaaacgaauguuucaaaucuacuucugcuuuucuuau

SEQ ID NO: 303740 - RNA, 63 nt, hsa
agagacagcccagucucuucugguuuaaucauuauguuucaaauugaaacagucucuuuugag

SEQ ID NO: 303741 - RNA, 63 nt, hsa
ccucaugccuucaggaaagacuuaacaaaaacaauguuucaucuggggaacugagcuaggcgg

SEQ ID NO: 303742 - RNA, 63 nt, hsa
ggacuauguuugugaacauaauugucauaaguuauguuucagauuuuugaauuuauuuauaug

SEQ ID NO: 303743 - RNA, 63 nt, hsa
ugguuuucaacaagccugaaaguaauuucaagaauguuucaguuauagagguaaaauuugcac

SEQ ID NO: 303744 - RNA, 63 nt, hsa
aguuaccccacacaaaaguuacugagcuuccuuauguuucacacauuguauuugaacacaaaa

SEQ ID NO: 303745 - RNA, 63 nt, hsa
aacugagaaggcuguggauuuaauguggaaaugauguuucauaagaauucuguugauggaaau

SEQ ID NO: 303746 - RNA, 63 nt, hsa
augcuuggagcagucaguacauaccaguuucugauguuucaggcaggagugggguaaauaagu

SEQ ID NO: 303747 - RNA, 63 nt, hsa
ugacauguuuauuucuacccuuaaugcaaugaaauguuucauuaauaaaaaaccacuuuauau

SEQ ID NO: 303748 - RNA, 63 nt, hsa
ugcaguacagacauagcaagccuuguccugacuauguuucacauuugugaauuagguauggcc

SEQ ID NO: 303749 - RNA, 63 nt, hsa
aaaauggcauacagauaauggaaaauaagcuuuauguuucaagaagggcagacucacgaauuu

SEQ ID NO: 303750 - RNA, 63 nt, hsa
aaucagacuuacuggaaauaaauuaccuaucccauguuucagugggaaaugaacuacauauug

SEQ ID NO: 303751 - RNA, 63 nt, hsa
uuauuaauagauuguuucuuuucauauaguccaauguuucaucaucaggaacuuucgguuuua

SEQ ID NO: 303752 - RNA, 63 nt, hsa
guaaaugauuguacuuauuuauugaccugccucauguuucauuucauuuuaaacauccuaaau

SEQ ID NO: 303753 - RNA, 63 nt, hsa
gugacugucucauugugccaugagguaaauguaauguuucaggcauucugcuugcaaaaaaau

SEQ ID NO: 303754 - RNA, 63 nt, hsa
gagaaacuggucaaugaacaggaagacuuagagauguuucacaagccuuugauuuuuguuuca

SEQ ID NO: 303755 - RNA, 63 nt, hsa
ucagagaugcuggaaacaaaucauuugcuuuauauguuucauuagaauaccaaugaaacauac

SEQ ID NO: 303756 - RNA, 63 nt, hsa
gcauuuaggaaugaaguguuagagugucuuaaaauguuucaaaugguuuaacaaaauguaugu

SEQ ID NO: 303757 - RNA, 63 nt, hsa; identical to SEQ ID NO: 303756

SEQ ID NO: 303758 - RNA, 63 nt, hsa
uuucuuacaacagccuuucagacuauucuucauauguuucaagcuaaucuuguagcuaagcua

SEQ ID NO: 303759 - RNA, 63 nt, hsa
ucaugcauagagugugauguauguguaauaaauauguuucacacaaacaaggccugucagcua

SEQ ID NO: 303760 - RNA, 63 nt, hsa
agagauaaggauugcacauuggaaaaguaaaccauguuucauuccuuuuucccuauuuauauu

SEQ ID NO: 303761 - RNA, 63 nt, hsa
agaaaugcccuccaugugucccucuaauguugcauguuucaguggguuggaaguuuuguauau

SEQ ID NO: 303762 - RNA, 52 nt, hsa
accaacugcuuaaaacauaaggauguuucaguuccuccauuuaacagguagu

SEQ ID NO: 303763 - RNA, 63 nt, hsa
guggacuaguauaguauacggucaguuaugucaauguuucauggucaauaaaaaggaaguugc

SEQ ID NO: 303764 - RNA, 63 nt, hsa
uuaaauauagcaauacaaccaauaauuuguuuuauguuucacugcauauaaauauuuccauua

SEQ ID NO: 303765 - RNA, 63 nt, hsa
auacuguacuauccuuuauaagucauuaaaauaauguuucaucaaaugguuaaauggaccacu

SEQ ID NO: 303766 - RNA, 63 nt, hsa
gcuucuuaaggucccugcucggccgguguaaauauguuucacccugucccucuaauaaagcuc

SEQ ID NO: 303767 - RNA, 63 nt, hsa
cauggaaugauuucucugcuaacagccgccuguauguuucaauaaauuuguccaaagcucaac

SEQ ID NO: 303768 - RNA, 63 nt, hsa
cuacuuguaugcagaagagaauuaguugauuacauguuucaaccuuuuagggugauaaauaca

SEQ ID NO: 303769 - RNA, 63 nt, hsa
uuaacauucagguguagauuguuucagcuucucauguuucauuuuccugaagauuuauguuuu

SEQ ID NO: 303770 - RNA, 63 nt, hsa
uauuuucaaguaguauaccccugugguuuuacaauguuucaucauuuuuuugcauuaauaaca

SEQ ID NO: 303771 - RNA, 63 nt, hsa
gcguauaaaauggggcugugugcaugcaggcccauguuucagccucagcccacgccaggugaa

SEQ ID NO: 303772 - RNA, 63 nt, hsa
aaaggaaugucuugcauauuacugacauuugguauguuucauucauuggaauauuucuuauuu

SEQ ID NO: 303773 - RNA, 63 nt, hsa
uuaugugaagguguuucaaaggguaaauuauaaauguuucaugaagaaaaaauuuuaaaaauc

SEQ ID NO: 303774 - RNA, 63 nt, hsa
gaaccguaucaggcauucgccugccucucacaaauguuucagggaggccaguucugcagggug

SEQ ID NO: 303775 - RNA, 63 nt, hsa
auuucauagauaauauauuuaauaugacagauuauguuucaacucuguagauguuuaacguca

SEQ ID NO: 303776 - RNA, 63 nt, hsa
uucccugguaaagaggauucuaauauuucaagaauguuucacuggaauugaugggaaaugguu

SEQ ID NO: 303777 - RNA, 63 nt, hsa
aggcuuuuauaaugcuccgccuacuucagucccauguuucagaagcuuuugucuauuuuuuaa

SEQ ID NO: 303778 - RNA, 63 nt, hsa
aucuaaaauaaauauacacaaauaugaaauauaauguuucagauugcaagguaauauguaaua

SEQ ID NO: 303779 - RNA, 63 nt, hsa
auuucacaauccuguggaucugggcaaaugaaaauguuucaggaaguuucugcagcagaugcu

SEQ ID NO: 303780 - RNA, 63 nt, hsa
guuuuuaaaauaugagugguuauugaaaauaugauguuucacauaaaaccucauucucggacc

SEQ ID NO: 303781 - RNA, 63 nt, hsa
guuuauauaugaacuuuacucugaccugugaucauguuucaggaaggaaugaaagagaguucu

SEQ ID NO: 303782 - RNA, 63 nt, hsa
gcaggacagccuauaaaauugugguacuuuuugauguuucaguaaacuugacauugucagagu

SEQ ID NO: 303783 - RNA, 63 nt, hsa
gugccuuuguaccucagguguuuuaggugugagauguuucagugaaccaaaguucugauaccu

SEQ ID NO: 303784 - RNA, 63 nt, hsa
uugcgaguauacauguuuuuuaacaaguugaaaauguuucaucugaaccuuuccuaacuuuuu

SEQ ID NO: 303785 - RNA, 63 nt, hsa
gaggaauaccuaugaagagcuauuuacaauaaaauguuucauuugaaaagucugguuucuuac

SEQ ID NO: 303786 - RNA, 63 nt, hsa
cauaaaauuuugauuagugaaacuagagucuggauguuucauuguaggaauauuuaaguuauu

SEQ ID NO: 303787 - RNA, 63 nt, hsa
guuauuuaacguuugucugccaggauguauggaauguuucauacucuuaugaccugauccauc

SEQ ID NO: 303788 - RNA, 63 nt, hsa
cccguuuccuucccucaucagugaaaaaaucuaauguuucaaauguaaauuguucauagaaaa

SEQ ID NO: 303789 - RNA, 63 nt, hsa
auaacauuaauuuuuuuaaaaaauaaggucuuaauguuucauuuaauuuaaaauauacuguca

SEQ ID NO: 303790 - RNA, 63 nt, hsa
uuuacacuucagacagauuuucuguguuaugaaauguuucaguaaaauauuguuuacugacuu

SEQ ID NO: 303791 - RNA, 63 nt, hsa
uuucggaaguuugaucugagaaccaaccauagaauguuucaguucuaggaaauaaaaccaguu

SEQ ID NO: 303792 - RNA, 63 nt, hsa
gacucaaagagggagugcauuuaugagcucuucauguuucaggagagaguugaaccuaaacau

SEQ ID NO: 303793 - RNA, 63 nt, hsa
acacuacugagagaaugagaugaaaaacgauuaauguuucauuauuauuauugugaaaauauu

SEQ ID NO: 303794 - RNA, 63 nt, hsa
gccuaauugcuguuacuaauuagaggaguaaaaauguuucacgauaacucagcaauuguaaug

SEQ ID NO: 303795 - RNA, 63 nt, hsa
acugaaacuauggcuaauaauugggguacucuuauguuucaauccaauuuaaccucauuuccc

SEQ ID NO: 303796 - RNA, 63 nt, hsa
uguagcugagcacuuuaacaaguugagcauuccauguuucauucuuagaaccuucuuuaauag

SEQ ID NO: 303797 - RNA, 63 nt, hsa
uuaaccuagaaagggcucacucuaccucuaggcauguuucaucccaacaaucagacugugcca

SEQ ID NO: 303798 - RNA, 63 nt, hsa
aauauagaaaucuuauguaaaugaaauuuugucauguuucaaauaaagagaacugaaguagaa

SEQ ID NO: 303799 - RNA, 63 nt, hsa
agaaguuacuagcacugacacacugauuuugaaauguuucaaaaugaguagauaugauuagau

SEQ ID NO: 303800 - RNA, 63 nt, hsa
aauacaucuuuuauaaugggggaagaaugcccuauguuucaauucaaaacaaagacaguuuuc

SEQ ID NO: 303801 - RNA, 63 nt, hsa
uauugaaauggaaaugaaaacagccaguaacuuauguuucagaauguuuguaacacacuucau

SEQ ID NO: 303802 - RNA, 63 nt, hsa
uguuggaauugucaucuguacaauuaguccauaauguuucauguuuguccuaagugugcuguu

SEQ ID NO: 303803 - RNA, 63 nt, hsa
gcuaugcagugugaucuuuauuuauaguaaauuauguuucauguaaaugauauauuuuuggug

SEQ ID NO: 303804 - RNA, 63 nt, hsa
uugcuaccagauuauaucuggugguaauuguuaauguuucagcagggcuggucucaguccuuu

SEQ ID NO: 303805 - RNA, 63 nt, hsa
caucuuguucuucaauaucacggguuuuuguuaauguuucauaaguaauucuccccacuugau

SEQ ID NO: 303806 - RNA, 63 nt, hsa
ucauucuuguauugccuuuuaaauuuuguuaugauguuucauuaauaaacaguguuuuguuuu

SEQ ID NO: 303807 - RNA, 63 nt, hsa
cucaccuucccucuuuuuuaaagucacauuuccauguuucaacauuaguuugcauucaccuuu

SEQ ID NO: 303808 - RNA, 63 nt, hsa
gagcaggauaucuuuuuuuuuuuuuuugaggcgauguuucacucuuguguccaggcuggagug

SEQ ID NO: 303809 - RNA, 63 nt, hsa
uugguacccuaggacauaaaaaucacauauaucauguuucaguaaaugcagugaaaggaacua

SEQ ID NO: 303810 - RNA, 63 nt, hsa
augauuguuuucucucuuuguauauuuguacaaauguuucagcugugcuuuuaaaaaaucugg

SEQ ID NO: 303811 - RNA, 63 nt, hsa
cagggcccaaagcuuauuaguuuaaauuaggguauguuucaaguuuguauuaauuuguaauag

SEQ ID NO: 303812 - RNA, 63 nt, hsa
cuuuucuuguaucuggauucaaauuuauuuccaauguuucaagcgggaaacaugacucuuuau

SEQ ID NO: 303813 - RNA, 63 nt, hsa
uuuuuaucagagucaugaugaaucaguccuagaauguuucauuugcacaaguagggcugccuc

SEQ ID NO: 303814 - RNA, 63 nt, hsa
uuuuguccugcaucaucuugaacauuaauccacauguuucagagcucaccaggcaguaccaau

SEQ ID NO: 303815 - RNA, 63 nt, hsa
ucugcuuugcagggaaauaacuuguuuuuucucauguuucaucuucuuuuuauguaaauuugu

SEQ ID NO: 303816 - RNA, 63 nt, hsa
gucaauaaaaauagaaguuuguugacucguuuuauguuucaauggugugugucuuuuuacuau

SEQ ID NO: 303817 - RNA, 63 nt, hsa
cugggccuucaugcuuuucugcauuguguuaacauguuucaagugcauggccuucuacggcuu

SEQ ID NO: 303818 - RNA, 63 nt, hsa
agaaaaguugcaugauugacaucgcuuccacccauguuucagagcaucugauuugucagaccc

SEQ ID NO: 303819 - RNA, 63 nt, hsa
gaacuaugcaguuaaggcagauaaaauguacagauguuucauauauuacagguuacauauaua

SEQ ID NO: 303820 - RNA, 63 nt, hsa
ucuuucuauauacugaucucuauauagauaucaauguuucauugaaaauccacugguaaggaa

SEQ ID NO: 303821 - RNA, 63 nt, hsa
gcaacuuagcaaggcuucuuuucauuauuuuuuauguuucacuuauaaagucuuagguaacua

SEQ ID NO: 303822 - RNA, 63 nt, hsa
aaguggcuuuuggggccccagguugagcucuggauguuucaagccaaggcucggcuauucccg

SEQ ID NO: 303823 - RNA, 63 nt, hsa
aaucaguaaaucaguuucacaucauguauugugauguuucaaugugagacacaaaaacaaugg

SEQ ID NO: 303824 - RNA, 63 nt, hsa
uccugccguuuucuuccugccaagccugaaucaauguuucaucuccaacccucugccaguuug

SEQ ID NO: 303825 - RNA, 63 nt, hsa
ccauugggcccucgucugccucuccaggauuguauguuucaagccuuguccuguguuccuuug

SEQ ID NO: 303826 - RNA, 63 nt, hsa
caagugggauuagaagacuaucaaaauacauguauguuucaggauauuugaccugucauuaaa

SEQ ID NO: 303827 - RNA, 63 nt, hsa
uuugguauuacacuguauuuguaucucugaagcauguuucauguuuugugacuauauagagau

SEQ ID NO: 303828 - RNA, 63 nt, hsa
uguauuguaauggcauuaucaaaauauuugaugauguuucagauauauugcaaagucuguauu

SEQ ID NO: 303829 - RNA, 63 nt, hsa
accauaaguuaaaaucugaagguuaucuuuaucauguuucaucccugucugaagauuuccuag

SEQ ID NO: 303830 - RNA, 63 nt, hsa
aaauauuguuuuccuacaggccuauuuaacaagauguuucauuuuacuguauauuuuguaguu

SEQ ID NO: 303831 - RNA, 63 nt, hsa
aaauuuuuucucuaggaaauauuuauuuuaauaauguuucaaacauauauaacaaugcuguau

SEQ ID NO: 303832 - RNA, 63 nt, hsa
uagagccagccuugguuggaccuauugccaggaauguuucagcugcaguugaagagccugaca

SEQ ID NO: 303833 - RNA, 63 nt, hsa
aagaagugaguguccacgggugaagaagugaguauguuucaccuggacauuaaggugauguuu

SEQ ID NO: 303834 - RNA, 63 nt, hsa
aacacccagagacggcacaaggagguugaacucauguuucaguucgcgaacauugacuccuua

SEQ ID NO: 303835 - RNA, 55 nt, hsa
aggaacguccagauuucuaaaugaaauguuucacuauaacgcugcuuuagaauga

SEQ ID NO: 303836 - RNA, 63 nt, hsa
auggguuuuauccucaaauauguauuuuuguguauguuucaaauacaaguauuaggcugcuuu

SEQ ID NO: 303837 - RNA, 63 nt, hsa
aguuucuguaaggucuuacauugccugacuaaaauguuucauuuaccucuaaauuuccauauc

SEQ ID NO: 303838 - RNA, 63 nt, hsa
gagugagaaaacaaguauggugaggucacuuuaauguuucacagcgaucucagaucuaggccu

SEQ ID NO: 303839 - RNA, 63 nt, hsa
gacgaagggagagagaaagcaguuuccaaggauauguuucaugucccaccauuuucucaguuu

SEQ ID NO: 303840 - RNA, 63 nt, hsa
acucuuagauauuuauauaauucaaaagaaugcauguuucacauugugacagauaaagaugua

SEQ ID NO: 303841 - RNA, 63 nt, hsa
ugaccucugccacccacauccuucacaaacuccauguuucaguguuugaguccauguuuauuc

SEQ ID NO: 303842 - RNA, 63 nt, hsa
cauacauuguacgaagaguauuuuugacagaauauguuucaaacuuuggaacaagaugguucu

SEQ ID NO: 303843 - RNA, 63 nt, hsa
uaucaauauaaauaaggaaaauaaaucaaugaaauguuucaaugauauaugcaacuauucagu

SEQ ID NO: 303844 - RNA, 63 nt, hsa
aaaucugcuuuaccaaguaagguguaagguugcauguuucaguccucuaccauccugcacugu

SEQ ID NO: 303845 - RNA, 63 nt, hsa
uauugcauuuuucuauuaaaaaauuaacaguuaauguuucagucaauguauuaucuguagcau

SEQ ID NO: 303846 - RNA, 63 nt, hsa
cuguaugaauaaugaaacuuacuaucauaaaccauguuucauguggccuguuagggccuguca

SEQ ID NO: 303847 - RNA, 63 nt, hsa
ucccgucugauuguuccuccccagcccccuggcauguuucaccacaacccuguugcuacauca

SEQ ID NO: 303848 - RNA, 63 nt, hsa
auucuguggucaaguaaguuuagggagcuauucauguuucacuugcuuuguggagauucacac

SEQ ID NO: 303849 - RNA, 63 nt, hsa
gacaaaaaguaaaucauugaccaaagcuaugaaauguuucacaaaguuuuccucuuuugcaua

SEQ ID NO: 303850 - RNA, 63 nt, hsa
auggaauauuacuucuaucagaagaugaucaagauguuucaguccagugcacaucagcauugc

SEQ ID NO: 303851 - RNA, 63 nt, hsa
gagcaggaagucuagaaaugauaacuagacuguauguuucaugugugugauuuuucagaauuc

SEQ ID NO: 303852 - RNA, 63 nt, hsa
uuugucuuaauuucuaacauuaucuuugcuuuuauguuucauaaaaauuugucauuauuuaug

SEQ ID NO: 303853 - RNA, 63 nt, hsa
uuuucugcugguggauaaacauuaaaauuaaucauguuucaaaguuuuauuuucaguuccuuu

SEQ ID NO: 303854 - RNA, 63 nt, hsa
ugcuagcauguacuguaugggaggaugauccagauguuucaaagagaauuucucuuaguuuag

SEQ ID NO: 303855 - RNA, 63 nt, hsa
cuugaaauuauauugauuuaaaugaugugugagauguuucaccauuuucaggcacuguguaau

SEQ ID NO: 303856 - RNA, 63 nt, hsa
auuaggccaagugcaauugacuucccuuuuuuaauguuucaugaccacccauugauuguauua

SEQ ID NO: 303857 - RNA, 63 nt, hsa
ucuacauuuucuggaaaaucagcauuacuagagauguuucaaauguagauuuuaccagaccau

SEQ ID NO: 303858 - RNA, 63 nt, hsa
ccugugcugagcccugagggcagagaggauggcauguuucaggggagggggaagccuuccucu

SEQ ID NO: 303859 - RNA, 63 nt, hsa
aauagagaauucuuaagauuuuguuuaaaccaaauguuucauguagaaugcaaaauguuggca

SEQ ID NO: 303860 - RNA, 63 nt, hsa
ugccuuguuuggguaaaggcaguaacuaaguuuauguuucagaacugcaaaacaaacaggaua

SEQ ID NO: 303861 - RNA, 63 nt, hsa
uaaaaucuuuaaaacuagauucuugcuucugauauguuucaauacauuguugauggcauugug

SEQ ID NO: 303862 - RNA, 63 nt, hsa
gcaaauuguuucaguuuuuuuaaaugcccuuugauguuucaaaaaaaaaaaggaacuguaauu

SEQ ID NO: 303863 - RNA, 63 nt, hsa
uuuauuucaaaaacaaaguacauuuuugaaauaauguuucagaauaaaauaaucucacuuuua

SEQ ID NO: 303864 - RNA, 63 nt, hsa
caaugucauagaagacaaagaaagguuguggaaauguuucagauuaaaugauaguaaaaacac

SEQ ID NO: 303865 - RNA, 63 nt, hsa
uuccuuuuuaaccauuccaaucgguguguagugauguuucauuuugguuuuaauuuguauauc

SEQ ID NO: 303866 - RNA, 63 nt, hsa
uugcaguucuaugauagauugcauuuauuaaaaauguuucauuguaucacauagaaauauggc

SEQ ID NO: 303867 - RNA, 63 nt, hsa
auaaacauauauccucuuuuuauugcuuugucuauguuucauaugaaacauuucagaaauuau

SEQ ID NO: 303868 - RNA, 63 nt, hsa
gcgcccucucaauuuagucuucucucauuggccauguuucagauuuugaccuagaaaugcgag

SEQ ID NO: 303869 - RNA, 63 nt, hsa
gucacuuuuuugccuaucccccguuuuuuggucauguuucaauuaauugugaggaaggcgcag

SEQ ID NO: 303870 - RNA, 63 nt, hsa
aaaucaaaaaaucuuccuucuuauaacugagaaauguuucacccaaauuuccuuuguuauuau

SEQ ID NO: 303871 - RNA, 63 nt, hsa
aauaucuucacuucaguuuuauuugugaauuacauguuucaugaauccauuuggcacagagac

SEQ ID NO: 303872 - RNA, 63 nt, hsa
uuucucuuguagugauuuggguaggaagaggccauguuucaguucguuuucucuguagggucg

SEQ ID NO: 303873 - RNA, 63 nt, hsa
cuagcuagccagcuggagauaauuuaccagggaauguuucaaagcccuaaccuugaaguuugg

SEQ ID NO: 303874 - RNA, 63 nt, hsa
acaaaaugcugauucaguucaaaauuaaugcaaauguuucaaaacuggguuucugauauuugu

SEQ ID NO: 303875 - RNA, 63 nt, hsa
guuacuaagauuucuauaccuggaauaucauguauguuucauuuacuggauguuuacauuuua

SEQ ID NO: 303876 - RNA, 63 nt, hsa
gcaucaagcuacccucaagaguuucugggcuggauguuucagaacaacaucuacaccaguaaa

SEQ ID NO: 303877 - RNA, 63 nt, hsa
acucccuggccuugcccgucgugugcugaagacauguuucaagaaccgcauuucgggaagggc

SEQ ID NO: 303878 - RNA, 63 nt, hsa
gguauuugacauaauauguauuaaguuauacuaauguuucaaucaguaaagaaauaaaaguuu

SEQ ID NO: 303879 - RNA, 63 nt, hsa
ugugcauaaggagaggaaaguuccaggguguguauguuucaggggcuucacauggaggagcug

SEQ ID NO: 303880 - RNA, 63 nt, hsa
cuaugaagaaagauacgguuucagacugaaaacauguuucacagguguuugcuuccuuccaga

SEQ ID NO: 303881 - RNA, 63 nt, hsa
uugaaauguugcuuucacugaaaaagugucuugauguuucaguuauuuuuaaucgccauaaaa

SEQ ID NO: 303882 - RNA, 63 nt, hsa
uuugagagcauaauuaugguaaucaugagauuaauguuucaugauuucuaccuccaaagugug

SEQ ID NO: 303883 - RNA, 63 nt, hsa
gccucaacauuuucgcagcacuugaaucaauaaauguuucaccuuugugcauuugugaacaga

SEQ ID NO: 303884 - RNA, 63 nt, hsa
ggucauugaaaaagagaacagugacguaggcaaauguuucaagcacuuuagaaacaguacuuu

SEQ ID NO: 303885 - RNA, 63 nt, hsa
uuccuuauuuaguguuguaucauaaauacuuugauguuucaaacauucuaaauaaauaauuuu

SEQ ID NO: 303886 - RNA, 63 nt, hsa
uaauuuauagcuaugguuauaaacagguuuuagauguuucaaaugacuuguccacugaauguc

SEQ ID NO: 303887 - RNA, 63 nt, hsa
uaucaagguucuaccuauguuaauuuacaauucauguuucaagacauuugccaaauguauuac

SEQ ID NO: 303888 - RNA, 63 nt, hsa
ccuuuaauucuucauuaaaauggaaauaaguagauguuucaaaguaaucuacauuccuggcuu

SEQ ID NO: 303889 - RNA, 63 nt, hsa
agguucauuacaaucgagacugcaaugugaucuauguuucaucuuguuuuuauaauaaaaagc

SEQ ID NO: 303890 - RNA, 63 nt, hsa
agcaauucaacuugaugugagaagaaaaaacaaauguuucaacacaaaaucucuguuuuguga

SEQ ID NO: 303891 - RNA, 63 nt, hsa
aacuaaccugaaaaacaaauaaaugcuuuggaaauguuucaguugcuuuagaaacauuagugc

SEQ ID NO: 303892 - RNA, 63 nt, hsa
auaaaaguuuuauaguuuuaaauacauaaagaaauguuucaguuaggcauuaaccuugauaga

SEQ ID NO: 303893 - RNA, 63 nt, hsa
uuuuuuaacaaaauauuuuuuuaagggaaagaaauguuucaggagggauaaagcuuaccauua

SEQ ID NO: 303894 - RNA, 63 nt, hsa
agugauaaacaacagcaaauauacuugaauaaaauguuucagguauuuuuguuucauuuuguu

SEQ ID NO: 303895 - RNA, 63 nt, hsa
uuugaucuggcaaccauauuucuggaaguugagauguuucagcuugaagaaccaaaacagaag

SEQ ID NO: 303896 - RNA, 63 nt, hsa
ugaacauucgaccuccauuacggagaguuuccuauguuucacugugcaaauauaucugcuauu

SEQ ID NO: 303897 - RNA, 63 nt, hsa
ugccuccagaagaaguuuuuccuugauugugcuauguuucaguggaagaaauucuuugaagua

SEQ ID NO: 303898 - RNA, 63 nt, hsa
ugaaugucuuucuuugaaaacugcaauguauguauguuucaagguuauuuaacaguguacuau

SEQ ID NO: 303899 - RNA, 63 nt, hsa
augcgcaucaguaugaaauugucucaaucuuggauguuucauuuuaugaauggaggcacuuua

SEQ ID NO: 303900 - RNA, 63 nt, hsa
uugcugauuuguuuuuaaaaaaacaagaaaugcauguuucaaauaaaauucucuauuguaaau

SEQ ID NO: 303901 - RNA, 63 nt, hsa
gcugggacucuugggcucugugccugagggaaaauguuucacaacuaguggcugcccaauugc

SEQ ID NO: 303902 - RNA, 63 nt, hsa
uuuuucuagcuauuuugcauuuuuucuuuuaccauguuucaguuucugcauguagauuuaaau

SEQ ID NO: 303903 - RNA, 63 nt, hsa
uuuaacgaaucaugauucagauuguaccauuacauguuucagugcagcaugguuacuaacgcu

SEQ ID NO: 303904 - RNA, 63 nt, hsa
agcaauguagaguuacgcuuuuauaaguauuucauguuucagaaaugaugcauacagcaauuu

SEQ ID NO: 303905 - RNA, 63 nt, hsa
acugguagauauagaagccuuuauuaagaauugauguuucauucaauuucagaucacugguac

SEQ ID NO: 303906 - RNA, 63 nt, hsa
gucauuccacuugugaaagaaaacacaaugugcauguuucaaugauacugugcggaaacacac

SEQ ID NO: 303907 - RNA, 63 nt, hsa
uucaguucauagcguagacugcuaaauacuguaauguuucaaaacauccaacuguuuguuaua

SEQ ID NO: 303908 - RNA, 63 nt, hsa
uauucucauugugagaauuuuaauacuaauggaauguuucaaagguuuuauucaaaccacaaa

SEQ ID NO: 303909 - RNA, 63 nt, hsa
gccauuugggaggcaaugacuuucugcuggcccauguuucaguugccaguaagcuucucacau

SEQ ID NO: 303910 - RNA, 63 nt, hsa
cuccaugauugauucagucaugaaccucaucccauguuucaucuguggacaauugcuuacuuu

SEQ ID NO: 303911 - RNA, 63 nt, hsa
gguacaucaguucuuuuugauaugaaaacauucauguuucagacauugaauugagagcuuuua

SEQ ID NO: 303912 - RNA, 63 nt, hsa
cccaucccucacagccucuugcugcuaaaauagauguuucauuuuucugacucaugcaaucau

SEQ ID NO: 303913 - RNA, 63 nt, hsa
aguuguuguagucuccacuucagucagaaacugauguuucagcuaggcacagugguacaugcc

SEQ ID NO: 303914 - RNA, 63 nt, hsa
aaaaggacuuguuuguagaauaaggaauuuucuauguuucaaaguguucuaaaaccuggcuaa

SEQ ID NO: 303915 - RNA, 63 nt, hsa
ucuauuuaaccucuguaaugaaacuaaauaaaaauguuucaccuuuacaccuggcuguuuguu

SEQ ID NO: 303916 - RNA, 63 nt, hsa
uaaccuuaaagauguuaauguugauggaaauucauguuucauauuaaaacaacacuuugucuu

SEQ ID NO: 303917 - RNA, 63 nt, hsa
uaguggagugaucauacaguucccccaaaugugauguuucaguguauuuauuuaaaacauaaa

SEQ ID NO: 303918 - RNA, 63 nt, hsa
uauagaagcucuucaagcauuaaaauagaguugauguuucauuccauuuguuuuauccaucaa

SEQ ID NO: 303919 - RNA, 63 nt, hsa
ccauaaaaacuucaaggcuuauccauacuuuugauguuucaauaugcauugaacuggauguua

SEQ ID NO: 303920 - RNA, 63 nt, hsa
cucuucacucuucaaaugccugacuagggagccauguuucacaaggucuuuaaagugacuaau

SEQ ID NO: 303921 - RNA, 63 nt, hsa
auggguauaacauccuugccuucccauuuauccauguuucacuuuaucacugauaugaagagg

SEQ ID NO: 303922 - RNA, 63 nt, hsa
cuaaaucuucgggacuucuuuaaugcuacguuaauguuucacugcucgucuagaaacuccuaa

SEQ ID NO: 303923 - RNA, 63 nt, hsa
auauagugacaguaccaagaguaccaggacucaauguuucauaugaagcccuuggugaugagg

SEQ ID NO: 303924 - RNA, 63 nt, hsa
gauauuucuuucccuaaccaucauacacuuggcauguuucauucccaucuccuuuccccucac

SEQ ID NO: 303925 - RNA, 63 nt, hsa
aaacuuuuuuaauauaugaaagcugugauaaaaauguuucagauguuuagucaauugugaaau

SEQ ID NO: 303926 - RNA, 63 nt, hsa
acuuuguaaucauauacaaugucaacuuuuuagauguuucaccacucuuuugcaaauaaagca

SEQ ID NO: 303927 - RNA, 63 nt, hsa
cagaccccccacccccaaggcugcagccacaccauguuucaggcuuggggcuggggcaggcuu

SEQ ID NO: 303928 - RNA, 63 nt, hsa
uagagaacaggugguuuuuaaggguuaucuuagauguuucacaccggaagguuuuuaaacacu

SEQ ID NO: 303929 - RNA, 63 nt, hsa
uuucccucuuccuuuaagaaaacuuacuaaaaaauguuucauugcgaagcagaggaaaagaaa

SEQ ID NO: 303930 - RNA, 63 nt, hsa
cuggaguaaaaaucugauuugaccccucugcucauguuucaucauauuuguagcucugcauca

SEQ ID NO: 303931 - RNA, 63 nt, hsa
caagucuacccugaucaccucagggcauaaagcauguuucauucucuggcccgacagugucuu

SEQ ID NO: 303932 - RNA, 63 nt, hsa
ucucauucugugaaagccuuuuaauuuauugaaauguuucaugacuacugcugcuagcucuuc

SEQ ID NO: 303933 - RNA, 63 nt, hsa
uucucugcgcgcaaggacccucgacucacccccauguuucagugucacagagacauucuuuga

SEQ ID NO: 303934 - RNA, 63 nt, hsa
aauggaucuuuacauguugcaguaacauugacuauguuucaaaacucagaugcauaaaacgua

SEQ ID NO: 303935 - RNA, 63 nt, hsa
gcagcuauccugacacagugcccuguuccuggaauguuucagauacagcugagcccaagggac

SEQ ID NO: 303936 - RNA, 63 nt, hsa
uaacaguucugaaugcuguccucaaaguauauaauguuucauguaccaagacccuuuucacag

SEQ ID NO: 303937 - RNA, 63 nt, hsa
uaacugaagaaaauaucuugcuaauuuuaccuaauguuucauccuuaaucucaggacaacuua

SEQ ID NO: 303938 - RNA, 63 nt, hsa
aaucugugagaacaaugguugaaauuucaaaguauguuucauuauucuuucuaaauuugauaa

SEQ ID NO: 303939 - RNA, 63 nt, hsa
gacaauuuaucuuccauaugcucuuuaaguaaaauguuucaaagacaguuuuaaagggagcca

SEQ ID NO: 303940 - RNA, 63 nt, hsa
cugaagaaucaaacuuccauccugaaaaucuauauguuucaaaaccacuugccauccuguuag

SEQ ID NO: 303941 - RNA, 63 nt, hsa
uaaaaaguaacaagaaagaacucguuugaaaccauguuucaucauccuguagcuacaucuggu

SEQ ID NO: 303942 - RNA, 63 nt, hsa
gcuggggcugaaggucagaaguaauccugagaaauguuucaggccuggggagggaggggagcc

SEQ ID NO: 303943 - RNA, 63 nt, hsa
uuaacaauuuuuuuuuguuuuuuaaauacuaauauguuucacacuauaguuuguguaacaaca

SEQ ID NO: 303944 - RNA, 63 nt, hsa
auuagugccuuucucuuucaucacuuguucuggauguuucaaucaguuuaguggaaggaaaaa

SEQ ID NO: 303945 - RNA, 63 nt, hsa
gggcaucagcaccuguccagcucuacuugugugauguuucaggaacucagccccuuuuucugc

SEQ ID NO: 303946 - RNA, 63 nt, hsa
ucucuugaaguccaauaacaagaccaaguaagaauguuucaacaaugcguuggcaagagaugu

SEQ ID NO: 303947 - RNA, 63 nt, hsa
caguaggcaucacauaugcuugguucaaacuguauguuucaguauugauugacucugcuauug

SEQ ID NO: 303948 - RNA, 63 nt, hsa
gcaaaacuuuuaaauauuugaauugacaguuacauguuucauaacuuuguaugucuauugguu

SEQ ID NO: 303949 - RNA, 63 nt, hsa
gcuuccagacguuguuccauauuuuugccccaaauguuucauggcuuauaccccauugguuua

SEQ ID NO: 303950 - RNA, 63 nt, hsa
ugaacaaacaaugaaaacucuuugcugcugcccauguuucaaauacuuagagcagugaagacu

SEQ ID NO: 303951 - RNA, 63 nt, hsa
gaaccucucagccuuccucuacgccuugaggggauguuucauccaaaguacaaccugaauuga

SEQ ID NO: 303952 - RNA, 63 nt, hsa
cauccuuauucacguugacaguaccuagcuguaauguuucacagagugugcugcuauuuuaua

SEQ ID NO: 303953 - RNA, 63 nt, hsa
uuuaaagauuugaaaccacauuuuuauuguuugauguuucauuuucagacuuuuuaaugucag

SEQ ID NO: 303954 - RNA, 63 nt, hsa
aaucaagcuuuuccacaguucuugaaaaguacuauguuucaaauuucaggaacaccagcguua

SEQ ID NO: 303955 - RNA, 63 nt, hsa
ugcugugggauugucaaccagcuuaucugcaggauguuucagaucugauaaauccugauggaa

SEQ ID NO: 303956 - RNA, 63 nt, hsa
ugugcagcuuucccccuuggagcaggagugaagauguuucauuaucuugggccugggaaacca

SEQ ID NO: 303957 - RNA, 63 nt, hsa
uaucuuauaucuaaaaaauauauaacuuacuauauguuucaguugcucucugaacaaaaauua

SEQ ID NO: 303958 - RNA, 63 nt, hsa
aaaguuaagggaaaagacuuugcuuuuaaaaaaauguuucaaaagaaagguauuuucacuaaa

SEQ ID NO: 303959 - RNA, 63 nt, hsa
cucauaaggucuaccaagaaaauaaauguuaugauguuucaguuggcuucuaggaaauaauua

SEQ ID NO: 303960 - RNA, 63 nt, hsa
auggguaagaaauaaauggaaauaugacaucggauguuucagcaacuguucuguaaauaaaau

SEQ ID NO: 303961 - RNA, 63 nt, hsa
cuagcaaucugagugauggaaucuuagucauucauguuucaccagaggacagcaagcaaaagg

SEQ ID NO: 303962 - RNA, 63 nt, hsa
cuuaugagaaguggaugguaggaggagucacuaauguuucaaucucuauuucuguaaucuugg

SEQ ID NO: 303963 - RNA, 63 nt, hsa
uagaacagcuaagguuuacauguaccaaauaacauguuucagcucauuccauccucacaacag

SEQ ID NO: 303964 - RNA, 63 nt, hsa
uuuaaaaaaaaaguauguguaauaugaaguaaaauguuucagacuuuuuuuuauacucaagug

SEQ ID NO: 303965 - RNA, 63 nt, hsa
auguguaaguuuuguacaaggaaugccccuaaaauguuucagcaggcugucaccuauuacacu

SEQ ID NO: 303966 - RNA, 63 nt, hsa
uauagauaaugaggaagaaaugguaagacguaaauguuucaacacuuuacuaaaagcuuauuu

SEQ ID NO: 303967 - RNA, 63 nt, hsa
acaugaauuuuuuugucuuauucuguuuuuaacauguuucaaauguuuuauacauuuuuggag

SEQ ID NO: 303968 - RNA, 63 nt, hsa
ugucaccucauuuugcauuacugucuuccguggauguuucaguuacaacuguaauguuauuua

SEQ ID NO: 303969 - RNA, 63 nt, hsa
ccucccaaaucaagucucuccaucacuugaucaauguuucagcccuagacugcccaaggagua

SEQ ID NO: 303970 - RNA, 63 nt, hsa
uuuuccucccuuucccugagagcucacaguacaauguuucagaagccccauuugcacagguuu

SEQ ID NO: 303971 - RNA, 63 nt, hsa
aacugcauuuguuuugacuucuuuaauguuugaauguuucacucuguuguaaagucagcauaa

SEQ ID NO: 303972 - RNA, 63 nt, hsa
cauguccagaagaguaagagggaaaauggacauauguuucauauccaaggguauucaaacugu

SEQ ID NO: 303973 - RNA, 63 nt, hsa
ccuuucuuuuugcccuuuauucaauuaguccuaauguuucaguucucuaauuaccaauuaguu

SEQ ID NO: 303974 - RNA, 63 nt, hsa
aagcauacauuuccugacuggucuagagaacugauguuucaauuuaccccucugcuaaauaaa

SEQ ID NO: 303975 - RNA, 63 nt, hsa
augugucuuguauuaaauauuuuuauuaaaagaauguuucauuaaugcauugauaagaaaacu

SEQ ID NO: 303976 - RNA, 63 nt, hsa
ugaagcugcucugauacuagauauccuuaaaugauguuucaauuuuauauguuuucuaagaua

SEQ ID NO: 303977 - RNA, 63 nt, hsa
accugaggaagggaaggaagggaauaaucuuuuauguuucauuuaccuuaugaaaaguguuaa

SEQ ID NO: 303978 - RNA, 63 nt, hsa
uaggaucauauugcauucaucacuuuaaacaucauguuucagguuuuggucaauacuugacaa

SEQ ID NO: 303979 - RNA, 63 nt, hsa
acaguacacgucacaguauugaugugauucaaaauguuucagugaaaacuuuggagacaguuu

SEQ ID NO: 303980 - RNA, 63 nt, hsa
uuuuaaaagaaaaaauucuaccauuuuaaauucauguuucaacuccuacaaccaaaugagaaa

SEQ ID NO: 303981 - RNA, 63 nt, hsa
ggaugugcuauuguaugauuacgaauagucuguauguuucaagcccuucuguaaaauaugaag

SEQ ID NO: 303982 - RNA, 63 nt, hsa
ccucaauucccucaccugaaauaggaaaugagaauguuucauuguagccccaagcggucaugu

SEQ ID NO: 303983 - RNA, 63 nt, hsa
cugugcucugugaggugugaaauuaaaaacauuauguuucaccaauauuuaaacaucaguacu

SEQ ID NO: 303984 - RNA, 63 nt, hsa
uucagucagguacacuguuacuugaaaggaagaauguuucacuuacccaagagcuauggcugc

SEQ ID NO: 303985 - RNA, 63 nt, hsa
ucucucauuauugagauucauccauauuguugaauguuucacuaguuaauguuuauuguucaa

SEQ ID NO: 303986 - RNA, 63 nt, hsa
uaaagucuuucuaagaccaauuauuaucuuagcauguuucaguaucuucucuaucauaggccc

SEQ ID NO: 303987 - RNA, 63 nt, hsa
gggaaaacuucagcuuuccaaaagcuaguaaacauguuucaaagaaaaauaaggucaggagaa

SEQ ID NO: 303988 - RNA, 63 nt, hsa
augcuugguuauuuccaguacuugucagucaacauguuucaagacgcuguguuagacacuagg

SEQ ID NO: 303989 - RNA, 63 nt, hsa
cugucaugucauuuacccacuggaucaaaggguauguuucacuucuugacaauauaaaugcug

SEQ ID NO: 303990 - RNA, 63 nt, hsa
cuuuacaauuuguugcaauuucaucugcuuucuauguuucauuguuaauugccauccuucagc

SEQ ID NO: 303991 - RNA, 63 nt, hsa
cauuuaaaaguacuuuauauuuuacauaauagcauguuucauuuugauuaaaagcuaccaaag

SEQ ID NO: 303992 - RNA, 63 nt, hsa
uaugaaaacaucuccgaauuagcauuucuggauauguuucauccaggguaucauugauuuaug

SEQ ID NO: 303993 - RNA, 63 nt, hsa
guaugagaagaaaucauugggugacuaugacuaauguuucagaauuacuuuuuaauuguuuua

SEQ ID NO: 303994 - RNA, 63 nt, hsa
aggaaaacucaacuguuucucuuuguuaucuaaauguuucagaauucaaucgugaaggaacag

SEQ ID NO: 303995 - RNA, 63 nt, hsa
gguccaguauuuauuugauuauuuaguauguuuauguuucaugacacuaauuuagucuuuuga

SEQ ID NO: 303996 - RNA, 63 nt, hsa
aaaaugaauguauuuuuuucuccaaagaacagcauguuucacucaauggugaaaagguggaaa

SEQ ID NO: 303997 - RNA, 63 nt, hsa
cccuggucacccgacuuuggaauuugcaccaucauguuucagugaagaugcuguaaauagguu

SEQ ID NO: 303998 - RNA, 63 nt, hsa
cagguguccugcccuuccgcccacgagugcgccauguuucagcggagcggcgugugggagaag

SEQ ID NO: 303999 - RNA, 63 nt, hsa
guagugccucaucacaacccaugauggcuguucauguuucaccccuuuucuuccuucagcaga

SEQ ID NO: 304000 - RNA, 63 nt, hsa
cuggauuuggacaaaaagcaaaucuagacaugcauguuucaggguucaguaguauacuucaug

SEQ ID NO: 304001 - RNA, 63 nt, hsa
acaugcauguuucaggguucaguaguauacuucauguuucauacagauaauucacauucaaaa

SEQ ID NO: 304002 - RNA, 63 nt, hsa
cauuuguaaacaguccuggucaguaguuaaauaauguuucaauuaaagugcuguaaaauaaac

SEQ ID NO: 304003 - RNA, 63 nt, hsa
gccacugauauuuuuacuggauaaaauucaaaaauguuucaauucacaaaggcuaauuguuga

SEQ ID NO: 304004 - RNA, 63 nt, hsa
ucugugaagccuuuacucucuaggugccuuauaauguuucagggcucaacuuuuuaaaaucca

SEQ ID NO: 304005 - RNA, 63 nt, hsa
cgugugagaauuuaggagacacugugcacugacauguuucacaacaggcauuccagaauuaug

SEQ ID NO: 304006 - RNA, 63 nt, hsa
aaugggacccaaaucuaaacacaaaauucauuuauguuucauauacaccuuauauacaauaac

SEQ ID NO: 304007 - RNA, 63 nt, hsa
uuaauauuuccuuuuccucauaccaacuugacuauguuucacccgcuucaugacuaaaucaca

SEQ ID NO: 304008 - RNA, 63 nt, hsa
gugaaagugccaacaaauuauugauagcugauaauguuucauuaucugcaacugcuugauaag

SEQ ID NO: 304009 - RNA, 63 nt, hsa
auguguauauguaaauaauauguguuuuaccagauguuucauagaaagaauuuuuucuugauc

SEQ ID NO: 304010 - RNA, 63 nt, hsa
auuuauuaaauucuaguuaugugcccuauaaugauguuucagucagugacagaccucauauau

SEQ ID NO: 304011 - RNA, 63 nt, hsa
cugcagcagggggugacugacacaccaaacaagauguuucacuggguacucugccauagaaau

SEQ ID NO: 304012 - RNA, 63 nt, hsa
guggggacagauucgcagcacagagucgcuggcauguuucacuccugcuucucucagccagcu

SEQ ID NO: 304013 - RNA, 63 nt, hsa
caugaauggagaugcccgcacaguaauguagaaauguuucauacagcuauuaaaauguaacug

SEQ ID NO: 304014 - RNA, 63 nt, hsa
uucauaauguugaauuugccuuuuaggaaaacaauguuucaugaaacacuuguaagauacuua

SEQ ID NO: 304015 - RNA, 63 nt, hsa
ugauuguuaagcaauagauuugcucuauugaaaauguuucauuuuuuucacuguacaagcaac

SEQ ID NO: 304016 - RNA, 63 nt, hsa
gcugcauuccagccagggugacagagugagaccauguuucaaacaagaaacauuucagagggu

SEQ ID NO: 304017 - RNA, 63 nt, hsa
ucgucaccauuauacuaaugaacaauagauuucauguuucaaaauuucagauuuuacauguua

SEQ ID NO: 304018 - RNA, 63 nt, hsa
gguuguuaauuagcacauauuccuuuuagaaaaauguuucagaaaccucagucuugauaucug

SEQ ID NO: 304019 - RNA, 54 nt, hsa
agcugccaagugaaaguugacaccauguuucagaacucuugcccucccucucau

SEQ ID NO: 304020 - RNA, 63 nt, hsa
gauaucuauuugaaaguucucagaguuguacauauguuucacaguacaggaucuguacauaaa

SEQ ID NO: 304021 - RNA, 63 nt, hsa
auuucauaugacauucaugccuggcuucgcaaaauguuucaaguacuguaacugugucaugau

SEQ ID NO: 304022 - RNA, 63 nt, hsa
gagacuccgucucaaaaaaaaaaaaaaaaagaaauguuucauuuugguuuuucaccaaccuuc

SEQ ID NO: 304023 - RNA, 63 nt, hsa
guuagagggucucuuacuccccgcccagcugugauguuucaucugcuuugguuguuuuggugg

SEQ ID NO: 304024 - RNA, 63 nt, hsa
uacauguccucgacggaugccaaaguggaacagauguuucagauacuguuggacccagaagag

SEQ ID NO: 304025 - RNA, 63 nt, hsa
uugacugccuaagggacagcacgaaugacucacauguuucagacaggccuccacggcuaugga

SEQ ID NO: 304026 - RNA, 63 nt, hsa
cuugguggauuaaccaaggccuuggauuccagaauguuucaugguaagcacuguggagaaccu

SEQ ID NO: 304027 - RNA, 63 nt, hsa
gaagugcugugauuguccuguauucaauuuuguauguuucaccucuacugugauucagacaga

SEQ ID NO: 304028 - RNA, 63 nt, hsa
cauguuuuaccaccacccaggucaagacauagaauguuucaacauuuccaucaccccagaaac

SEQ ID NO: 304029 - RNA, 63 nt, hsa
aaugccuguguuaaagaggcagcuugacuguucauguuucauuuugcaaccauugguuuugag

SEQ ID NO: 304030 - RNA, 63 nt, hsa
gucuucauaccaaauuaaaggugguuuuaauauauguuucauggaaguuguuuauaaaauuca

SEQ ID NO: 304031 - RNA, 63 nt, hsa
cauucagcgcugcuguggcuaacaccacuguguauguuucaucauugcucugaaggucaaaag

SEQ ID NO: 304032 - RNA, 63 nt, hsa
uaaccaagcacucauuauauaugcauccuccaaauguuucaugcuuauuuauaggaaaguuau

SEQ ID NO: 304033 - RNA, 63 nt, hsa
auaagaccucuuguagcuacaauguuuuagagcauguuucaucuucauuuuuaauauccugaa

SEQ ID NO: 304034 - RNA, 63 nt, hsa
gggguuuacaacaacuaggauguguugggugagauguuucagaucuggagaaaugagcaggug

SEQ ID NO: 304035 - RNA, 63 nt, hsa
cccccagcaaggugccuggggagacuugagcagauguuucauuuuggccuggccaguggcuga

SEQ ID NO: 304036 - RNA, 63 nt, hsa
uauugucaagguuaacauaaaugcucuucuaaaauguuucacuuacuccuaaacuagcuaucc

SEQ ID NO: 304037 - RNA, 63 nt, hsa
gcugccucaccgcccagacauugauuuguucagauguuucaaugccucaugauacaauaaaac

SEQ ID NO: 304038 - RNA, 63 nt, hsa
ucacaccagauccuaccccuuucccugagccacauguuucacacaaguguagaaaaugccagg

SEQ ID NO: 304039 - RNA, 63 nt, hsa
ucagccaccagacugucccggcaccuacagagaauguuucacaguucuggcauuuaaauccuu

SEQ ID NO: 304040 - RNA, 63 nt, hsa
uauuuguuaaaugggguauuuuucuguauuuguauguuucacuauaauaagggaauuaaggau

SEQ ID NO: 304041 - RNA, 63 nt, hsa
accgcuucauaagccaguacgucugagcugaguauguuucaauaaaccuuuugauauuucuca

SEQ ID NO: 304042 - RNA, 63 nt, hsa
acuaaguccucuccagguugguccugggauaucauguuucaaguggcugugccaaaggugagu

SEQ ID NO: 304043 - RNA, 63 nt, hsa
ugcuugauuuuuaucaguuuuguguagauuuuuauguuucauauuuuaaauuuaaaucccaca

SEQ ID NO: 304044 - RNA, 63 nt, hsa
uuuggccaaaaauuuuuuuaaaaaucauauuauauguuucaauugaucuguuagaauaaccaa

SEQ ID NO: 304045 - RNA, 63 nt, hsa
ucacugagacugcaucagaguuugcaauuuuguauguuucauugccaaagaaggcuuaguggu

SEQ ID NO: 304046 - RNA, 63 nt, hsa
uccucucacuuggccuugcagcuaaauggagaaauguuucaauuucuuugaauacuugcacau

SEQ ID NO: 304047 - RNA, 63 nt, hsa
uucauguaguuucuuaauauauacuugaaggaaauguuucaccuuauuuuuggucuuuguuua

SEQ ID NO: 304048 - RNA, 63 nt, hsa
cccacucacuucccuuugguuuuucauauuuaaauguuucaauuucuguauuuuuuuuucuuu

SEQ ID NO: 304049 - RNA, 63 nt, hsa
aggccucugggagugauuugguucuuugcccuaauguuucauuugacggucucuuuuugauca

SEQ ID NO: 304050 - RNA, 63 nt, hsa
aaguugcaauuuauacuguauggcuucuuuuucauguuucaucuagguuuuuagaagugaagu

SEQ ID NO: 304051 - RNA, 63 nt, hsa
cucugcaguugggaacggugaucuucuugaaugauguuucagugugcaaaaacuauagagccu

SEQ ID NO: 304052 - RNA, 63 nt, hsa
ucaugcaggccuuuaccggcauugauguggcucauguuucaggcagacuugggguccuuaagg

SEQ ID NO: 304053 - RNA, 63 nt, hsa
augucuagcuucugagucuagaugaaagacaguauguuucagagaacauuggauaucaguuuu

SEQ ID NO: 304054 - RNA, 63 nt, hsa
gcagugucaagccugaaaccaagcaauaccgucauguuucagccaagcccagagcccuaagau

SEQ ID NO: 304055 - RNA, 63 nt, hsa
aaggcuagagggcgacucugguggugcuuuuguauguuucaauuaggcucugaaaucuugggc

SEQ ID NO: 304056 - RNA, 63 nt, hsa
cccacccucugccacccaguccucccagcugccauguuucaaagacgaccuuuaccuccugcc

SEQ ID NO: 304057 - RNA, 63 nt, hsa
ggacgucuucauugaagauucacuuacaaaggaauguuucacuaaauaaaagaaaaccagaau

SEQ ID NO: 304058 - RNA, 63 nt, hsa
ucccugaaggggagcucuuggauaucauuggccauguuucaaucgaauggagccacugggccc

SEQ ID NO: 304059 - RNA, 63 nt, hsa
auuuuuuuaaugaaaagaaaaaacaagaaaguuauguuucauaauuucuuacaacaugagcca

SEQ ID NO: 304060 - RNA, 63 nt, hsa
aguccuuaggccaaccaauuuaacugcagugucauguuucacaggccuuccuacauuuagaaa

SEQ ID NO: 304061 - RNA, 63 nt, hsa
uccagacugauagguagucauuagccaugagaaauguuucaggauggcuagggaagacuugug

SEQ ID NO: 304062 - RNA, 63 nt, hsa
aggcaagcaaaggagaugaaaucuguucugggaauguuucagcagccaauaagugcccgagca

SEQ ID NO: 304063 - RNA, 63 nt, hsa
gacaaaguguugaaaauguauuuccugaaauaaauguuucaaaugcagaaacccagaaggcuc

SEQ ID NO: 304064 - RNA, 63 nt, hsa
ucuuaggaaaggagaucaacauuuucaaauuagauguuucaacugugcucuuguuuugucuug

SEQ ID NO: 304065 - RNA, 63 nt, hsa
cuugccugucauugcacucagaaucuuaagaucauguuucaaauauguugauucaaacuugcu

SEQ ID NO: 304066 - RNA, 63 nt, hsa
gagaagagacaguuuaauauuugugcugaaaauauguuucaguauuuuuuucaaugaauguua

SEQ ID NO: 304067 - RNA, 63 nt, hsa
uugguguaguuuuuuaauauauacuugaaggaaauguuucaccuuauuuuuggucuuuguuua

SEQ ID NO: 304068 - RNA, 63 nt, hsa
uaaaguauaguacauuuuacauauguaaaugguauguuucaauaauuuaagaacucugaaaca

SEQ ID NO: 304069 - RNA, 63 nt, hsa
gcuuuuggugccagcuacagaguugagcuggccauguuucacaguauaucaagcauuauagag

SEQ ID NO: 304070 - RNA, 63 nt, hsa
gaaucauggacagaacuuacacuacuuuuuaccauguuucaucuuggcauaacaugguucuuu

SEQ ID NO: 304071 - RNA, 63 nt, hsa
uucguguaguuuuuuaauauauacuugaaggaaauguuucaccuuauuuuuggucuuuguuua

SEQ ID NO: 304072 - RNA, 63 nt, hsa
uuuucuauagcagagcauuauauuuugcauuauauguuucaaccuagucuaagugggucuuuu

SEQ ID NO: 304073 - RNA, 63 nt, hsa
cucagauauuaaaguaguauucucaauuaccaaauguuucauuugaaacaauuuaucuuaaug

SEQ ID NO: 304074 - RNA, 63 nt, hsa
cugcuggacaucuuugccaggcugugccuucucauguuucauagacaguggucugugcuggca

SEQ ID NO: 304075 - RNA, 63 nt, hsa
uggcacugguguugcuggcucagcucuuggugcauguuucagauauguguguacacuucugac

SEQ ID NO: 304076 - RNA, 63 nt, hsa
cagagcuuuagaggaagacacauagguggguuuauguuucaccucauuuggaacaaaagagga

SEQ ID NO: 304077 - RNA, 63 nt, hsa
auacacuacagaauuuagucaacauuuuauauaauguuucaauaaauguuucuuucaauaaag

SEQ ID NO: 304078 - RNA, 63 nt, hsa
aguuaugacauuagcuuuaaagguguaaaaaagauguuucacuaauguaacggugaaagagaa

SEQ ID NO: 304079 - RNA, 63 nt, hsa
uuaacaaugucugaucucagcugaacaaauuagauguuucaguugcucuugggucaacuggcu

SEQ ID NO: 304080 - RNA, 63 nt, hsa
acaaauguuuauacaaauacauacauguacaccauguuucaaauacuaaauaaauagaguuua

SEQ ID NO: 304081 - RNA, 63 nt, hsa
uguaaacugcucugcauauaaaccaagggcagaauguuucacccugaucuuaugggaggaauc

SEQ ID NO: 304082 - RNA, 63 nt, hsa
aagggaagucuugagguuuuagaggugugaauuauguuucaucaaugugcagaauaaucacaa

SEQ ID NO: 304083 - RNA, 63 nt, hsa
aauuauuuuucaauuuuauuuuaguucuaaauuauguuucagaaacaaaagacaaugcuguac

SEQ ID NO: 304084 - RNA, 63 nt, hsa
aaugaaacuuaauagcucacaaaauuccaguccauguuucaugacuuauuuuagucaaugaau

SEQ ID NO: 304085 - RNA, 63 nt, hsa
uguccccuuuucuggcauaaaucaacuaugaauauguuucaagcaucacaagacaaccuuuuc

SEQ ID NO: 304086 - RNA, 63 nt, hsa
uguaaacaagagauuuggcaugacauguucuguauguuucagggaaaaaugucuuuaaugcuu

SEQ ID NO: 304087 - RNA, 63 nt, hsa
ggauaauugcuugauucucgccagagacugucaauguuucauucauugccauuaccaauaaau

SEQ ID NO: 304088 - RNA, 63 nt, hsa
aaaaucucuguacagauugcagucuucuuccugauguuucaaacugugguucccccaagcucu

SEQ ID NO: 304089 - RNA, 63 nt, hsa
cuuaauaaguccucaauucuuaacagauauaagauguuucauacuggagcgaaacuacaaucc

SEQ ID NO: 304090 - RNA, 63 nt, hsa
acaacagagaaacccuauaaagaaugauacaauauguuucaaucagaaccuucacauccaaua

SEQ ID NO: 304091 - RNA, 63 nt, hsa
cuuuugagaaaugccuguucagcuacuuugcccauguuucaaguaguuuuugguuucuugcug

SEQ ID NO: 304092 - RNA, 63 nt, hsa
cauggauuucuuaguguauuugggggaagggaaauguuucaagguaaagaaccuugacccuuu

SEQ ID NO: 304093 - RNA, 63 nt, hsa
ucauccccuccuuauuuuauuugggagagggaaauguuucagaaacaaaagggccucaucccc

SEQ ID NO: 304094 - RNA, 63 nt, hsa
ucgucccuuuguuauuuuaugugggagagggaaauguuucagaaacgaaagaucucauccccu

SEQ ID NO: 304095 - RNA, 63 nt, hsa
cacauuguccacuucagaugcuuguuuaaaaaaauguuucaccaugugucuuuacccaauaca

SEQ ID NO: 304096 - RNA, 63 nt, hsa
cugcuauauuugaaugcaguuguucauguagguauguuucacuaugguaauaugguggugugc

SEQ ID NO: 304097 - RNA, 63 nt, hsa
ucugugucccauccugcuguccuucuguccuggauguuucaugggcccggggccccccaggga

SEQ ID NO: 304098 - RNA, 63 nt, hsa
auuggagugauggauuuggugccauggucuauaauguuucaugcauccauacuucuguuuuug

SEQ ID NO: 304099 - RNA, 63 nt, hsa
guaauauauauauauauauauaaaaugaaauauauguuucauuuuagagaaauaacuauuacu

SEQ ID NO: 304100 - RNA, 63 nt, hsa
auauaucuugcucuauagaggauuuuuuuuuguauguuucaagcuucagccuuuaaccuauac

SEQ ID NO: 304101 - RNA, 63 nt, hsa
ggguucccagagcuccgaggaaacugauccuucauguuucaauagcuguuguuguuuuucucu

SEQ ID NO: 304102 - RNA, 63 nt, hsa
uuuuuuuauugagaauaaauuuucuaaaauuacauguuucacugaaaccagugaaauauuuca

SEQ ID NO: 304103 - RNA, 63 nt, hsa
aauuuucuauuugaaaaugugcugauucuuggaauguuucauucuccagauuuaugaacauuu

SEQ ID NO: 304104 - RNA, 63 nt, hsa
auguauaaaugccauguggagauagagccccagauguuucagccaucucagcccaggcaccag

SEQ ID NO: 304105 - RNA, 63 nt, hsa
uccugaaaaaugcucaaucucagcuaacauuccauguuucagaagcauucaggcacugccagg

SEQ ID NO: 304106 - RNA, 63 nt, hsa
uuuguaggcagucaguuaccuucaccuuaugaaauguuucacugaguuauuugagguuuuuug

SEQ ID NO: 304107 - RNA, 63 nt, hsa
uuuccuucaccauuuaucauuucauagucauuuauguuucaucgguccucauguguacuagug

SEQ ID NO: 304108 - RNA, 63 nt, hsa
uggcauucugcauguuuagugauugucuugggaauguuucacugcuacccgcauccagcgacu

SEQ ID NO: 304109 - RNA, 63 nt, hsa
auauuuucacuguuccuucuuucuuaaagucuuauguuucacucuuuaacucaaauguauucu

SEQ ID NO: 304110 - RNA, 63 nt, hsa
ucaucaaguuaucuuuauaaucacuguaguuagauguuucauguccauucaagugacuuuuau

SEQ ID NO: 304111 - RNA, 63 nt, hsa
gcuaggaucauuggauucaguucccaaaauagaauguuucagugagaccaugagaauuccagg

SEQ ID NO: 304112 - RNA, 63 nt, hsa
ccuuuaaaugucccauggauguaggacagugccauguuucaagaugccugugagcuaggucuu

SEQ ID NO: 304113 - RNA, 63 nt, hsa
guaaaaaggcagaccagggauguaauguuuuuaauguuucagaagccuaacuuuuuacacagu

SEQ ID NO: 304114 - RNA, 63 nt, hsa
caguacuugauuuaggaucuguggugcagggcaauguuucaaaguuuagucacagcuuaaaaa

SEQ ID NO: 304115 - RNA, 63 nt, hsa
acauuaacuucuaaagaaguuuuuucuaagaaaauguuucaaggcaauauuuuuuuugaggcu

SEQ ID NO: 304116 - RNA, 63 nt, hsa
acuaaacuuuuguguccauauuuuacugagaccauguuucauuaaaagcauaguuucauagua

SEQ ID NO: 304117 - RNA, 63 nt, hsa
caacacucgugaggccaggaagcuauuaaagggauguuucaagcuguuucuagcacauuccaa

SEQ ID NO: 304118 - RNA, 63 nt, hsa
uguagcuuucucucuuaccuucuggaagagggaauguuucauuuauuacuguuugauuuucuu

SEQ ID NO: 304119 - RNA, 63 nt, hsa
cucuuuuuccaaggcccggaguacuggggauugauguuucaaggccaaucaaugggaugcuuc

SEQ ID NO: 304120 - RNA, 63 nt, hsa
caaaggauuugagauguucucaauaaaaagaaaauguuucacuacucugguguugcugagacu

SEQ ID NO: 304121 - RNA, 63 nt, hsa
accaagacuaaguuuuaaauccagaagagagaaauguuucacgcaagcagucccccaacuccc

SEQ ID NO: 304122 - RNA, 63 nt, hsa
aaaugacuccuacaauugaggguugugugaaagauguuucauaccaaggaggcaaaucuauaa

SEQ ID NO: 304123 - RNA, 63 nt, hsa
agaugaauuuauuuuauuucuaaagguauucaaauguuucagcaccauauaauagaaauaccc

SEQ ID NO: 304124 - RNA, 63 nt, hsa
aaucggugucucaggccacugggcccuuaguggauguuucagacgcucggccgggaacgagug

SEQ ID NO: 304125 - RNA, 63 nt, hsa
augugauuuucucuaauguaacuuccucuuaggauguuucaccaaggaaauauugagagagaa

SEQ ID NO: 304126 - RNA, 63 nt, hsa
uacaguucucugcguucgucacuuaauuccugaauguuucagagaaacaggaaucagaaaaua

SEQ ID NO: 304127 - RNA, 63 nt, hsa
ccagcaagaagggcuuggguucugaggaagcagauguuucaugcugugaggccuugcaccagg

SEQ ID NO: 304128 - RNA, 63 nt, hsa
uuugcucugcaauucugcagguacuggaucaugauguuucaaaggaagaaccagucaccuuuc

SEQ ID NO: 304129 - RNA, 63 nt, hsa
uuuaguugaaugccacugaagagcugugauagcauguuucaaagcugaacucuacagagcgag

SEQ ID NO: 304130 - RNA, 63 nt, hsa
gacagagacguggcauuuggaaacgaaacuuagauguuucauggagcuuauuuugagaacuuu

SEQ ID NO: 304131 - RNA, 63 nt, hsa
ggacaaauugacugcaauguaauacuagcugguauguuucauaaaugucaagcuguggaccaa

SEQ ID NO: 304132 - RNA, 63 nt, hsa
caaauuccucuuugaugaauguacccuguggggauguuucauacugacagauuauuuuuauuu

SEQ ID NO: 304133 - RNA, 63 nt, hsa
uggacagucucaccuccugccauaggguccugaauguuucagaccacaaggggcuccacaccu

SEQ ID NO: 304134 - RNA, 63 nt, hsa
gccagaaaagugaaguccuagguguuuccaucuauguuucaaucuguccaucuaccaggccuc

SEQ ID NO: 304135 - RNA, 63 nt, hsa
caucagaucuucucaccuugauuuugagcuggaauguuucaaugagcaaaauaaauuagacaa

SEQ ID NO: 304136 - RNA, 63 nt, hsa
cauugcuguaaaucuuaaaaugaaugaauaaaaauguuucauuuuacaagaggaguguaugau

SEQ ID NO: 304137 - RNA, 63 nt, hsa
ugugacauagauuauacuacuacuaauuuuuggauguuucaaaaggucaagaaguaaaagaug

SEQ ID NO: 304138 - RNA, 63 nt, hsa
agagccagagacaguguugcaacugggccuggcauguuucagugugguguccagcagugucuc

SEQ ID NO: 304139 - RNA, 63 nt, hsa
uuuccauaguaaauugucuugcaguuuuugaaaauguuucaagucuaguuuuuacaagcacau

SEQ ID NO: 304140 - RNA, 63 nt, hsa
cuugaugagauugaaacauggcuuuuggcaugaauguuucauagguuauguuguguucauuua

SEQ ID NO: 304141 - RNA, 63 nt, hsa
ugugaucuuuccuguccugacccucucugaauuauguuucaauaguacucuugauugucugcc

SEQ ID NO: 304142 - RNA, 63 nt, hsa
uuuucauauuuaguucugguguggugucuggaaauguuucaacuguuuuaauauauugucuga

SEQ ID NO: 304143 - RNA, 63 nt, hsa
guuuugacccaccugccaguguuugcuugcucuauguuucaguagcagauuuucacacaugug

SEQ ID NO: 304144 - RNA, 63 nt, hsa
uuuaaaaagguacuuaaauuuucuggaauauccauguuucagagguaauauuuacuuucuauu

SEQ ID NO: 304145 - RNA, 63 nt, hsa
uccaauuagaaaaugggcaaaagacaugaauagauguuucacugaagaggaucuauagauggc

SEQ ID NO: 304146 - RNA, 63 nt, hsa
gaaauuugugaaaaauauauuguauuucuuuugauguuucaaaagguugccuaugaaaaacug

SEQ ID NO: 304147 - RNA, 63 nt, hsa
uuauagucuuccaguuuaaugaacuaccaucugauguuucauauuuaaguguauuuaaagaaa

SEQ ID NO: 304148 - RNA, 63 nt, hsa
aagaggcugaugucuuuguuuuuguuuuuuuuaauguuucagguucuaagugaagugaguugg

SEQ ID NO: 304149 - RNA, 63 nt, hsa
ucuguauuuuucuuguaguguuaguuaaaacauauguuucaaaaauauaagaaaaguucaaaa

SEQ ID NO: 304150 - RNA, 63 nt, hsa
auauuguauauguuuugucccaguuguauaguaauguuucaguccaucauccagcuuuggcug

SEQ ID NO: 304151 - RNA, 63 nt, hsa
uuuaguauuguauuccaaguugauaacucuuccauguuucacauuucuaaauuuaacagagau

SEQ ID NO: 304152 - RNA, 63 nt, hsa
uuugauugcagacacuguagaacauaacucauuauguuucagauaagguaacuccuagauauc

SEQ ID NO: 304153 - RNA, 63 nt, hsa
aagacuucauuuguguaucaucaauaaaguuguauguuucaacugacaaaaagucguucuaau

SEQ ID NO: 304154 - RNA, 63 nt, hsa
guucuuuaaaaucguuaauguauaacagggcuuauguuucaguuuguuuuccguucuguuuua

SEQ ID NO: 304155 - RNA, 63 nt, hsa
uguuuauuauccugaucaagcauggaacaaagcauguuucaggaucagaucaauacaaucuug

SEQ ID NO: 304156 - RNA, 63 nt, hsa
agaagcuguuuugcuaaauuauuuuuacuuggaauguuucaaacagauuucaggcugcaaacu

SEQ ID NO: 304157 - RNA, 63 nt, hsa
gaaaccaacuugucccaggccacaggaguguauauguuucauaaucuuuaucaagaaguuugu

SEQ ID NO: 304158 - RNA, 63 nt, hsa
uacuuccaccuaaucuguuuacagucuuuugguauguuucaguuacuuagauggucucauaag

SEQ ID NO: 304159 - RNA, 65 nt, hsa
aguggauuugcuuuaacccucacauuuuuuuuuuaauguuucacauguuacauuauuagcugaau

SEQ ID NO: 304160 - RNA, 65 nt, hsa
agggcagucuggcgcccaugaugggagggauugacauguuucaacaaaauaaugcacuuccuuac

SEQ ID NO: 304161 - RNA, 65 nt, hsa
auuuuucuuaaauccaaguuggccguuuuauuaguauguuucaaauguguauuaccaaugugggu

SEQ ID NO: 304162 - RNA, 65 nt, hsa
uuaauaucuccaugcauaguuuuagacaaaaaaagauguuucaauaaaauuacugucuuguaaua

SEQ ID NO: 304163 - RNA, 65 nt, hsa
aacucaaccaauuuggcaccccaugcagccucaaaauguuucaaaugccuaccgccucuagaucg

SEQ ID NO: 304164 - RNA, 65 nt, hsa
uuggcuucuuuucucccuugauggucaagucucuuauguuucaauauuucuuaacuggggugucu

SEQ ID NO: 304165 - RNA, 65 nt, hsa
aaaugucaugaaugauuuccaguuuuuaaagcuauauguuucacugcuucauaucucuguccacu

SEQ ID NO: 304166 - RNA, 65 nt, hsa
cacgcacacaugauuuugauuaugcuacaugauauauguuucaaaaagaauuagcauagaaaucc

SEQ ID NO: 304167 - RNA, 65 nt, hsa
cuagguaggggauugcugggccauaugauaagcauauguuucaguucuaccaaucuuguuuccag

SEQ ID NO: 304168 - RNA, 65 nt, hsa
acagaaaaacauuaaaaaguucauuccuuaacacaauguuucaaguuaaaccuuuugugucaccg

SEQ ID NO: 304169 - RNA, 65 nt, hsa
uguuugauaaauauccucucaguguuuuaucuuccauguuucaacaacuauugaaauaugaaaug

SEQ ID NO: 304170 - RNA, 65 nt, hsa
uggguuucucuguauaguacuggcaugguacggagauguuucacgaaguuuguucaucagacucc

SEQ ID NO: 304171 - RNA, 65 nt, hsa
augugcuugccugaaauaaagcuaauaaaaauauuauguuucacauuaucuucuguucauuuuga

SEQ ID NO: 304172 - RNA, 65 nt, hsa
aaaaaaugcaaaucgacuuuuuaacaacuguugagauguuucaugggacaguagaacucugacuc

SEQ ID NO: 304173 - RNA, 65 nt, hsa
accacgcuugguuaauuuuuguauuuuuaguagagauguuucaccauguuggccaggcuagucuu

SEQ ID NO: 304174 - RNA, 65 nt, hsa
ugccggguguuguauguguggugacuugcggauuuauguuucaguguacuggaaacuuuccauuu

SEQ ID NO: 304175 - RNA, 65 nt, hsa
ugugauuuuguaaauuucaguaauucauuuaaaugauguuucaguagauauauucuagcauauua

SEQ ID NO: 304176 - RNA, 65 nt, hsa
aaauccaaaauuaugauaacuguauuucuagggguauguuucaccuugauuuuggcccgguucuu

SEQ ID NO: 304177 - RNA, 65 nt, hsa
cccuacuugguaacaaaguucucagauguuaggucauguuucauuugcucagucggggaucacuc

SEQ ID NO: 304178 - RNA, 65 nt, hsa
uuuagcaggugaacuguuccaagacugacacaaggauguuucaaacuugccucugucuguagaaa

SEQ ID NO: 304179 - RNA, 65 nt, hsa
uacguauuauauagagaaacaaauguuuuuauuaaauguuucauugacccaaguaauuuaaaagu

SEQ ID NO: 304180 - RNA, 65 nt, hsa
cuguuuuucauacucuuaaguguaaauaauauaaaauguuucaagcgcuuaacucccccucauuc

SEQ ID NO: 304181 - RNA, 65 nt, hsa
uuuagagcuuuagaaauuuguaagcugagagaacaauguuucacuuaauaggagggugucuuagu

SEQ ID NO: 304182 - RNA, 65 nt, hsa
cuuacucuuucuuuuaagauaaguuguagacuucgauguuucaugcucauguacuucaaauaaug

SEQ ID NO: 304183 - RNA, 63 nt, hsa
uugaaaucuguuaaaauaaaauuguacauuuggagauguuucaugaugauguguuuauuucua

SEQ ID NO: 304184 - RNA, 65 nt, hsa
ggaaacuugugacuuguguauuaucgucauugaggauguuucacucaugucugucauuuuauaag

SEQ ID NO: 304185 - RNA, 65 nt, hsa
gcaugguaaguucccuuagcuauaugaauuuuggcauguuucagagagaucaguaaauaaaauau

SEQ ID NO: 304186 - RNA, 65 nt, hsa
aaaugcggagacguaaagcauuaaugcaaguuaaaauguuucagugaacaaguuucagcgguuca

SEQ ID NO: 304187 - RNA, 65 nt, hsa
aucuagaaaacuuuggauuuuugaaguaaauuuuaauguuucauauuaauuucuugaaaauguau

SEQ ID NO: 304188 - RNA, 65 nt, hsa
ggagacucagaaggggaagcauugggaaaccauguauguuucauuucugguuuaaccaggcuuuu

SEQ ID NO: 304189 - RNA, 65 nt, hsa
uaucuauauggaauugcuuaccaaaggauagugcgauguuucaggaggcuggaggaagggggguu

SEQ ID NO: 304190 - RNA, 65 nt, hsa
caagucaacuuaccuauuaaauauuccucuauuagauguuucaacacuauaauuuaauugggaaa

SEQ ID NO: 304191 - RNA, 65 nt, hsa
auuucuaugacaaauucaagagcuagaaaaauaaaauguuucauuaugcacuuuuagaaaugcau

SEQ ID NO: 304192 - RNA, 65 nt, hsa
cugugacaccaaaaagaaaagucuauaaccugaaaauguuucauguucucugcugugaaacucuu

SEQ ID NO: 304193 - RNA, 65 nt, hsa
acuuugucguguuuguuuuaacuucuaaagaaaauauguuucagcauuauaagaaaggcagaaug

SEQ ID NO: 304194 - RNA, 65 nt, hsa
aggaaacaugcucagucaugcacauguguugacccauguuucagaugcagucugaugccagguau

SEQ ID NO: 304195 - RNA, 65 nt, hsa
uguguuuauucuuuugcuucuccccaauaaagcacauguuucauggucaagcccacauugcuuuu

SEQ ID NO: 304196 - RNA, 65 nt, hsa
uaaaggcaaaccuggcuuuugauuaccauguguggauguuucaguguccuuucuucucugucccu

SEQ ID NO: 304197 - RNA, 56 nt, hsa; identical to SEQ ID NO: 303635

SEQ ID NO: 304198 - RNA, 65 nt, hsa
uccuagauacuauuacgcuaucuuguuugggaaugauguuucauagguuugugaugaucuuuacg

SEQ ID NO: 304199 - RNA, 65 nt, hsa
auaauccuagaccuuuucaugacguguaaaaaaugauguuucauccucugauugccccaauaaaa

SEQ ID NO: 304200 - RNA, 65 nt, hsa
ugagcaucccuugucugaaaugcuugggauuagaaauguuucagauuucaauuuuuuuucagauu

SEQ ID NO: 304201 - RNA, 65 nt, hsa
ccaccgugccuagccaaggaugagauuuuuaaaguauguuucaguucugugucaugguuggaaga

SEQ ID NO: 304202 - RNA, 65 nt, hsa
aaauccacaauuaaaccauguuucucacuuuucacauguuucauagcaacugcuuuauaugacug

SEQ ID NO: 304203 - RNA, 65 nt, hsa
accuaacccugauaguuaccuaaagugacacuuaaauguuucagagugaaugcaaaaaagagaga

SEQ ID NO: 304204 - RNA, 51 nt, hsa; identical to SEQ ID NO: 303642

SEQ ID NO: 304205 - RNA, 65 nt, hsa
cugacaaaaccugggaauuuggguuguguaugcgaauguuucagugccucagacaaauguguauu

SEQ ID NO: 304206 - RNA, 65 nt, hsa
aaugugucucaggcucaaguuuuuauaguuauuaaauguuucaaaauagacaaguuuuguuuccu

SEQ ID NO: 304207 - RNA, 65 nt, hsa
guugaguuauuccacaaacacauuauaaaguucagauguuucaucaaugcaguucucacgaaagu

SEQ ID NO: 304208 - RNA, 65 nt, hsa
ccuaacaaacaaaagaaauguaguucagcuuuucaauguuucauguuugcugugcuuuucugaau

SEQ ID NO: 304209 - RNA, 65 nt, hsa
uuacuuucugcugugaacugaacugcagcuauagaauguuucaaaugcuuaaauauauaauacau

SEQ ID NO: 304210 - RNA, 63 nt, hsa
aauugaauguagauacucagaagaaauaaaaaaugauguuucacucugugucuguuuuuaauu

SEQ ID NO: 304211 - RNA, 65 nt, hsa
gcuuauugaugugcugugauaugagggaaucugaaauguuucauaaaaauaaagcuuaaaaauug

SEQ ID NO: 304212 - RNA, 65 nt, hsa
aaaacauuguagauaucuauuuauauuuaaaguuuauguuucaugaacugcagcugcaggauucu

SEQ ID NO: 304213 - RNA, 65 nt, hsa
gagccuuuuaaguaguuugaaugauaagacuuaaaauguuucauaauuauguuuuauguaacaga

SEQ ID NO: 304214 - RNA, 65 nt, hsa
ccuguacugauaguacuucccaguaugauauugugauguuucauacaaugcagugaacauaacca

SEQ ID NO: 304215 - RNA, 65 nt, hsa
ccucuuaacuaauugcgguuucauaggauauauaaauguuucaagccauuauugcugaaugguuc

SEQ ID NO: 304216 - RNA, 65 nt, hsa
uuauguaagcauguauacacugugcuaaaagucacauguuucaguuuguguauaauauuaauaug

SEQ ID NO: 304217 - RNA, 65 nt, hsa
agaacaggaaaaaauaauuauaagaugauaagcaaauguuucagcccaaugucaacccaguuaaa

SEQ ID NO: 304218 - RNA, 65 nt, hsa
ccgcugccauaguuuucuaacuugaacagccaugaauguuucaugucucccuuuuuuuuugucua

SEQ ID NO: 304219 - RNA, 65 nt, hsa
uccauguuguccuuucuggcuucccugauggugucauguuucagcgcaugcgccccagccuuucc

SEQ ID NO: 304220 - RNA, 65 nt, hsa
aaugaauccuugugguuuuuaguuuuguauaaauuauguuucaaaucuuuacauuuuggaaauaa

SEQ ID NO: 304221 - RNA, 65 nt, hsa
uuacuuuuuggggaaguaaaagaagauggaaauggauguuucauuuguaugaguuuggagcagug

SEQ ID NO: 304222 - RNA, 65 nt, hsa
aucuauucuuucccuagaggcaaacauuucuuaaaauguuucauuuucauuaaaaaugaaagcca

SEQ ID NO: 304223 - RNA, 65 nt, hsa
guaccauaccaacuggaauuuaggcuuuaaaaauaauguuucaaggccagguguggugauucaug

SEQ ID NO: 304224 - RNA, 65 nt, hsa
ucuuuuguguauuuauacuuguauguaugauuugcauguuucaaugauaaagggauaaaacagua

SEQ ID NO: 304225 - RNA, 65 nt, hsa
gaccauagauugcugucccccucgacggacuuauaauguuucagguggcuggcuugaacaugagu

SEQ ID NO: 304226 - RNA, 65 nt, hsa
aucugcuaaguuguaccuuaauuagagggcaauauauguuucauaaagaagagucuuuauaauuu

SEQ ID NO: 304227 - RNA, 65 nt, hsa
cuaguugaccuagauuguauuaauagcuacuuaagauguuucaaagauaggaagcuauugcuugg

SEQ ID NO: 304228 - RNA, 65 nt, hsa
aaaagggagagaacaaaagcuauaccaaaagggccauguuucaagaaaauggauuuaaacauauu

SEQ ID NO: 304229 - RNA, 65 nt, hsa
uccaaucagaccagguaggagcuuuccuguuucauauguuucaggguugcacaguuggucucuuu

SEQ ID NO: 304230 - RNA, 65 nt, hsa
guggcaugaaaauuuucuuaagcuaaaauacagacauguuucaaagggcuaaaguuggagaugag

SEQ ID NO: 304231 - RNA, 65 nt, hsa
auacuaaaggauauacauauacugccucuucuaugauguuucauuugaccuacaccaucagcauc

SEQ ID NO: 304232 - RNA, 65 nt, hsa
ugacuuuugaaaacaaaauaugaaaagaaucggcaauguuucaaacaaaaagucauaaaagucac

SEQ ID NO: 304233 - RNA, 65 nt, hsa
gauggcuacaucuguaucuuuuccuccuguguuuaauguuucacuagggagaggaaauaaagcag

SEQ ID NO: 304234 - RNA, 65 nt, hsa
uuguuuuuuuuauuauaaaacuugcccuucauuacauguuucaaagugguguggugggccaaaau

SEQ ID NO: 304235 - RNA, 65 nt, hsa
gcucugcuucaauguagucagaauuagcugcuucuauguuucauaguuggggucauagauguuuc

SEQ ID NO: 304236 - RNA, 65 nt, hsa
uguuuacauuggauaaaggauuaggcaaaaauaaaauguuucaaggauuccugaccauaagugac

SEQ ID NO: 304237 - RNA, 65 nt, hsa
accacacagacugcucuccaaucccugagucucagauguuucauuuauuuccuacuuuuccacua

SEQ ID NO: 304238 - RNA, 65 nt, hsa
agaaauuauaucuguuuuggagcaagagugucauaauguuucaggguagucaaaauaaacauaaa

SEQ ID NO: 304239 - RNA, 65 nt, hsa
uacucaguaggaacuuuuugaaauagggcaaguuuauguuucaugcgagaaaacaugaaggaggg

SEQ ID NO: 304240 - RNA, 65 nt, hsa; identical to SEQ ID NO: 304223

SEQ ID NO: 304241 - RNA, 65 nt, hsa
gaagagacaaucucuggcaaguuuuuguagaaaaaauguuucagugccuagucugaaaaauaaca

SEQ ID NO: 304242 - RNA, 65 nt, hsa
aaauucugaaaaauacauuucuauuuauagaauaaauguuucauuuauauaaaagcaaaagaacu

SEQ ID NO: 304243 - RNA, 65 nt, hsa
ucugcguccuggguagucugugcuuguaauccagcauguuucacagaguaagccuguugugacuu

SEQ ID NO: 304244 - RNA, 65 nt, hsa
auguaacauuaauucuacuaaauauuuuauaugaaauguuucacuaugauuuucuauuuuucuuc

SEQ ID NO: 304245 - RNA, 57 nt, hsa; identical to SEQ ID NO: 303683

SEQ ID NO: 304246 - RNA, 65 nt, hsa
uuguguuauuuuuucuuaucaaacaauuagauguuauguuucauauuauuugauauuuauuuuca

SEQ ID NO: 304247 - RNA, 65 nt, hsa
uauuuaauuuuguuucauuuuguuuucauaagacaauguuucagauauguaauggggcaaaccac

SEQ ID NO: 304248 - RNA, 65 nt, hsa
gccucccacugggagucaucgcugagaagaugccaauguuucauccaccggcugcacaggcacaa

SEQ ID NO: 304249 - RNA, 65 nt, hsa
uaaauauauauuauauaaauauauuaaaaaggaaaauguuucagauguuuauuuguauaauuacu

SEQ ID NO: 304250 - RNA, 65 nt, hsa
aauuauaaccaaaaacaaugugacggauacccaagauguuucauguuguagcuugggugaauuac

SEQ ID NO: 304251 - RNA, 65 nt, hsa
uaauuuuuaauaacaugcaugggucccucucacuaauguuucaacaauagggaaaaaugagaacu

SEQ ID NO: 304252 - RNA, 65 nt, hsa
cugguguagaauuuacacugcugcaccugaggucgauguuucaaaguaagaucaagccaguguuu

SEQ ID NO: 304253 - RNA, 65 nt, hsa
ucaagugacauuucaaaagaaguucuauaacaauuauguuucaugcuuaaaguaaaaauucccag

SEQ ID NO: 304254 - RNA, 65 nt, hsa
uauuaaucaugcaguguacaauucaaaaucaugcaauguuucacuuuagaauuggauuugaagaa

SEQ ID NO: 304255 - RNA, 65 nt, hsa
cauucaaauggcaguagccuuggcucacauaagacauguuucaugugaucuguauccuggcauac

SEQ ID NO: 304256 - RNA, 65 nt, hsa
gcaugcauguauaggccgaacuauuaucagcucugauguuucagagagaagaccucagaaaccga

SEQ ID NO: 304257 - RNA, 65 nt, hsa
cacauguaaagaauauaugagccuuguauggagugauguuucauuuaccuggguuguguuaauga

SEQ ID NO: 304258 - RNA, 65 nt, hsa
auacuguuggucuagccugugaagcaauuaaucgaauguuucagaaggagcagagugaauuagua

SEQ ID NO: 304259 - RNA, 65 nt, hsa
cuauggacuggcuuaagccguguggcauccgaggaauguuucaaaugugucuguguuucucuuua

SEQ ID NO: 304260 - RNA, 65 nt, hsa
acaggacauuaauaaugguguacuuuaaaaaauauauguuucauuuaaucuucacaaaagaucug

SEQ ID NO: 304261 - RNA, 65 nt, hsa
cugccuccgccgccacugcugcugccaccucuuauauguuucagacacucucugcccagacucau

SEQ ID NO: 304262 - RNA, 65 nt, hsa
aaaaaauaacuauaucauaacucauucauaacuugauguuucauuuucuguugaggaaccauaaa

SEQ ID NO: 304263 - RNA, 65 nt, hsa
aauauuaaaugauuuagcagucuccacguguguuaauguuucaaacguguaucauaauguguaua

SEQ ID NO: 304264 - RNA, 65 nt, hsa
aauuaugauauggacguuaucauuggucuggugagauguuucauauuugugacaguuaauuuaaa

SEQ ID NO: 304265 - RNA, 65 nt, hsa
ugccaacugccaagccauacuuauuaaguucgaacauguuucacuuaaggagagacaccuagcuu

SEQ ID NO: 304266 - RNA, 65 nt, hsa
ccaagaagucuugggauuggauuuuaccauaugaaauguuucauauugaaaacacaagaugaccu

SEQ ID NO: 304267 - RNA, 65 nt, hsa
uuuagugaagaaacaaguucucggguggggaaucuauguuucacucagauuuauauguuuggagg

SEQ ID NO: 304268 - RNA, 65 nt, hsa
cacuuggacguuucauuuugaaagaaagaaauuuuauguuucacauauaguuuuauacaaaguag

SEQ ID NO: 304269 - RNA, 65 nt, hsa
ugaauaaaucaugccacuauauuaauuuauauuacauguuucauauuuaaaucauguuuuccuaa

SEQ ID NO: 304270 - RNA, 65 nt, hsa
uaauucaucacauaguaucuuaaagggaacaaauaauguuucauccuauggaaaugugaaggaug

SEQ ID NO: 304271 - RNA, 65 nt, hsa
uuuuauaaguuguaugcauaaacauaagauuuguaauguuucauuuauaaacugccuucuucaac

SEQ ID NO: 304272 - RNA, 65 nt, hsa
uuugaaucuaccauucauagccagauguguaucagauguuucacugacaguuuuuaacaauaaau

SEQ ID NO: 304273 - RNA, 65 nt, hsa
cuuauaauaccuuuuccuuguguguaauuauacuuauguuucaauaacagcugaaggguuuuauu

SEQ ID NO: 304274 - RNA, 65 nt, hsa
ggaugugaugggucuaguccaguuuauuuaaguucauguuucacuguuugcacuuugcauugaac

SEQ ID NO: 304275 - RNA, 65 nt, hsa
augagaacuugggaauguuuaagaagaaaucaaacauguuucaggaaaaggaaaucuauggagua

SEQ ID NO: 304276 - RNA, 65 nt, hsa
guguaacuaggggcuguguuucugcauuaaaauaaauguuucaggcuuugugguccugaucaagg

SEQ ID NO: 304277 - RNA, 65 nt, hsa
cguaccagcugaauagcccagcuugcaguauaguuauguuucagucugcaguguguuuagcauuc

SEQ ID NO: 304278 - RNA, 65 nt, hsa
cccaggucacccuguggcaggccugggcccucaggauguuucaaaggcuccacagcuccaccgcu

SEQ ID NO: 304279 - RNA, 65 nt, hsa
cuuuagaaugcucuuuugcauguaaagcacaaaguauguuucaguuuaaaugcacuucuuccggu

SEQ ID NO: 304280 - RNA, 65 nt, hsa
uuaguuagauauugacuuuaucuuuaggcuuuuguauguuucagaugcaaacauauuaaaguuuc

SEQ ID NO: 304281 - RNA, 65 nt, hsa
ugaccuuagaacaugagagaguggaaaaccucaggauguuucagccaaacaagaagagaagaaaa

SEQ ID NO: 304282 - RNA, 65 nt, hsa
uguuauauuaaccucuuccuacuuuaaagugugaaauguuucaccucagcuguacaaacuccagc

SEQ ID NO: 304283 - RNA, 65 nt, hsa
auuaugugauguuggaaagcucauugauuuuguauauguuucagcguguuaccuuucuggcuucc

SEQ ID NO: 304284 - RNA, 65 nt, hsa
ugacuauucaguuuucaggaugauacacuaugaagauguuucaaaaaaucugaccaaaacaaaca

SEQ ID NO: 304285 - RNA, 65 nt, hsa
uauuccccucaguucaucuuuaccaaagacacucuauguuucauuaaucucaacuggcagcaaua

SEQ ID NO: 304286 - RNA, 65 nt, hsa
uuagaacuaucuugguugcaaaggguaggucucuaauguuucaucaauaaaugugauguuucuag

SEQ ID NO: 304287 - RNA, 65 nt, hsa
ucugcaucaguugcuucuauagagcaucagcccucauguuucauugucuuaaugucggggagcag

SEQ ID NO: 304288 - RNA, 65 nt, hsa
uuaaaaaagcaaaugaggcaaugugucaaaauuuaauguuucauaauaaaaauagauacguugac

SEQ ID NO: 304289 - RNA, 65 nt, hsa
aucacuguuucucucaacacuauuuaaucugaaaaauguuucaguacaaaccacuguuugaacua

SEQ ID NO: 304290 - RNA, 65 nt, hsa
uuaaauucagaauaucucuaaaacauggaaaauugauguuucaauaaaaagggagacauuuuauu

SEQ ID NO: 304291 - RNA, 65 nt, hsa
ucccauucugccccuguacauguuuccuaccaagcauguuucacauuuuccuauuaguggaggag

SEQ ID NO: 304292 - RNA, 65 nt, hsa
caaauugccuauaaauugacucuacuaaaauaacaauguuucagucugaaaauuugaauugaaaa

SEQ ID NO: 304293 - RNA, 65 nt, hsa
uguaguguacauuguaaaacucagauauugucaugauguuucacuuggacauaagacuuauuaau

SEQ ID NO: 304294 - RNA, 65 nt, hsa
cuccugaccuugaaucacaagagucuuaacagggaauguuucaggaaacaaauaggauaagacaa

SEQ ID NO: 304295 - RNA, 65 nt, hsa
aauauuuuuauauuaaaguacuauacuaggagagaauguuucagaacucccugaugaauuucuaa

SEQ ID NO: 304296 - RNA, 65 nt, hsa
aaaugaauaauuccugcuauucugaaauugccuacauguuucaauaccaguuauauggagugcuu

SEQ ID NO: 304297 - RNA, 65 nt, hsa
cauguaguuuaauaaaguuccuguuuaugagagucauguuucaucucagcuucuuccauggaugu

SEQ ID NO: 304298 - RNA, 65 nt, hsa
uaagcugugcaaccugugaagccaagagugaacugauguuucauuuauauuuucauccaaaugac

SEQ ID NO: 304299 - RNA, 65 nt, hsa
uggauccugugcuuaccuuuuccugcuguacucugauguuucagugaagcucauccacgaagucc

SEQ ID NO: 304300 - RNA, 65 nt, hsa
ccuccagaucagauggggacacacaaccccuggauauguuucauugucagauuuugugcuugauu

SEQ ID NO: 304301 - RNA, 65 nt, hsa
cacaucagccucacugagcuaauaaagggaaacgaauguuucaaaucuacuucugcuuuucuuau

SEQ ID NO: 304302 - RNA, 65 nt, hsa
uuagagacagcccagucucuucugguuuaaucauuauguuucaaauugaaacagucucuuuugag

SEQ ID NO: 304303 - RNA, 65 nt, hsa
auccucaugccuucaggaaagacuuaacaaaaacaauguuucaucuggggaacugagcuaggcgg

SEQ ID NO: 304304 - RNA, 65 nt, hsa
uuggacuauguuugugaacauaauugucauaaguuauguuucagauuuuugaauuuauuuauaug

SEQ ID NO: 304305 - RNA, 65 nt, hsa
aaugguuuucaacaagccugaaaguaauuucaagaauguuucaguuauagagguaaaauuugcac

SEQ ID NO: 304306 - RNA, 65 nt, hsa
aaaguuaccccacacaaaaguuacugagcuuccuuauguuucacacauuguauuugaacacaaaa

SEQ ID NO: 304307 - RNA, 65 nt, hsa
uuaacugagaaggcuguggauuuaauguggaaaugauguuucauaagaauucuguugauggaaau

SEQ ID NO: 304308 - RNA, 65 nt, hsa
uuaugcuuggagcagucaguacauaccaguuucugauguuucaggcaggagugggguaaauaagu

SEQ ID NO: 304309 - RNA, 65 nt, hsa
cuugacauguuuauuucuacccuuaaugcaaugaaauguuucauuaauaaaaaaccacuuuauau

SEQ ID NO: 304310 - RNA, 65 nt, hsa
caugcaguacagacauagcaagccuuguccugacuauguuucacauuugugaauuagguauggcc

SEQ ID NO: 304311 - RNA, 65 nt, hsa
uuaaaauggcauacagauaauggaaaauaagcuuuauguuucaagaagggcagacucacgaauuu

SEQ ID NO: 304312 - RNA, 65 nt, hsa
acaaucagacuuacuggaaauaaauuaccuaucccauguuucagugggaaaugaacuacauauug

SEQ ID NO: 304313 - RNA, 65 nt, hsa
auuuauuaauagauuguuucuuuucauauaguccaauguuucaucaucaggaacuuucgguuuua

SEQ ID NO: 304314 - RNA, 65 nt, hsa
ugguaaaugauuguacuuauuuauugaccugccucauguuucauuucauuuuaaacauccuaaau

SEQ ID NO: 304315 - RNA, 65 nt, hsa
uggugacugucucauugugccaugagguaaauguaauguuucaggcauucugcuugcaaaaaaau

SEQ ID NO: 304316 - RNA, 65 nt, hsa
uugagaaacuggucaaugaacaggaagacuuagagauguuucacaagccuuugauuuuuguuuca

SEQ ID NO: 304317 - RNA, 65 nt, hsa
uuucagagaugcuggaaacaaaucauuugcuuuauauguuucauuagaauaccaaugaaacauac

SEQ ID NO: 304318 - RNA, 65 nt, hsa
aagcauuuaggaaugaaguguuagagugucuuaaaauguuucaaaugguuuaacaaaauguaugu

SEQ ID NO: 304319 - RNA, 65 nt, hsa; identical to SEQ ID NO: 304318

SEQ ID NO: 304320 - RNA, 65 nt, hsa
uuuuucuuacaacagccuuucagacuauucuucauauguuucaagcuaaucuuguagcuaagcua

SEQ ID NO: 304321 - RNA, 65 nt, hsa
gaucaugcauagagugugauguauguguaauaaauauguuucacacaaacaaggccugucagcua

SEQ ID NO: 304322 - RNA, 65 nt, hsa
uuagagauaaggauugcacauuggaaaaguaaaccauguuucauuccuuuuucccuauuuauauu

SEQ ID NO: 304323 - RNA, 65 nt, hsa
acagaaaugcccuccaugugucccucuaauguugcauguuucaguggguuggaaguuuuguauau

SEQ ID NO: 304324 - RNA, 52 nt, hsa; identical to SEQ ID NO: 303762

SEQ ID NO: 304325 - RNA, 65 nt, hsa
ugguggacuaguauaguauacggucaguuaugucaauguuucauggucaauaaaaaggaaguugc

SEQ ID NO: 304326 - RNA, 65 nt, hsa
guuuaaauauagcaauacaaccaauaauuuguuuuauguuucacugcauauaaauauuuccauua

SEQ ID NO: 304327 - RNA, 65 nt, hsa
guauacuguacuauccuuuauaagucauuaaaauaauguuucaucaaaugguuaaauggaccacu

SEQ ID NO: 304328 - RNA, 65 nt, hsa
cugcuucuuaaggucccugcucggccgguguaaauauguuucacccugucccucuaauaaagcuc

SEQ ID NO: 304329 - RNA, 65 nt, hsa
aucauggaaugauuucucugcuaacagccgccuguauguuucaauaaauuuguccaaagcucaac

SEQ ID NO: 304330 - RNA, 65 nt, hsa
uacuacuuguaugcagaagagaauuaguugauuacauguuucaaccuuuuagggugauaaauaca

SEQ ID NO: 304331 - RNA, 65 nt, hsa
uuuuaacauucagguguagauuguuucagcuucucauguuucauuuuccugaagauuuauguuuu

SEQ ID NO: 304332 - RNA, 65 nt, hsa
auuauuuucaaguaguauaccccugugguuuuacaauguuucaucauuuuuuugcauuaauaaca

SEQ ID NO: 304333 - RNA, 65 nt, hsa
aggcguauaaaauggggcugugugcaugcaggcccauguuucagccucagcccacgccaggugaa

SEQ ID NO: 304334 - RNA, 65 nt, hsa
ccaaaggaaugucuugcauauuacugacauuugguauguuucauucauuggaauauuucuuauuu

SEQ ID NO: 304335 - RNA, 65 nt, hsa
uuuuaugugaagguguuucaaaggguaaauuauaaauguuucaugaagaaaaaauuuuaaaaauc

SEQ ID NO: 304336 - RNA, 65 nt, hsa
uggaaccguaucaggcauucgccugccucucacaaauguuucagggaggccaguucugcagggug

SEQ ID NO: 304337 - RNA, 65 nt, hsa
ugauuucauagauaauauauuuaauaugacagauuauguuucaacucuguagauguuuaacguca

SEQ ID NO: 304338 - RNA, 65 nt, hsa
uuuucccugguaaagaggauucuaauauuucaagaauguuucacuggaauugaugggaaaugguu

SEQ ID NO: 304339 - RNA, 65 nt, hsa
uuaggcuuuuauaaugcuccgccuacuucagucccauguuucagaagcuuuugucuauuuuuuaa

SEQ ID NO: 304340 - RNA, 65 nt, hsa
uuaucuaaaauaaauauacacaaauaugaaauauaauguuucagauugcaagguaauauguaaua

SEQ ID NO: 304341 - RNA, 65 nt, hsa
auauuucacaauccuguggaucugggcaaaugaaaauguuucaggaaguuucugcagcagaugcu

SEQ ID NO: 304342 - RNA, 65 nt, hsa
auguuuuuaaaauaugagugguuauugaaaauaugauguuucacauaaaaccucauucucggacc

SEQ ID NO: 304343 - RNA, 65 nt, hsa
auguuuauauaugaacuuuacucugaccugugaucauguuucaggaaggaaugaaagagaguucu

SEQ ID NO: 304344 - RNA, 65 nt, hsa
cugcaggacagccuauaaaauugugguacuuuuugauguuucaguaaacuugacauugucagagu

SEQ ID NO: 304345 - RNA, 65 nt, hsa
aggugccuuuguaccucagguguuuuaggugugagauguuucagugaaccaaaguucugauaccu

SEQ ID NO: 304346 - RNA, 65 nt, hsa
cuuugcgaguauacauguuuuuuaacaaguugaaaauguuucaucugaaccuuuccuaacuuuuu

SEQ ID NO: 304347 - RNA, 65 nt, hsa
acgaggaauaccuaugaagagcuauuuacaauaaaauguuucauuugaaaagucugguuucuuac

SEQ ID NO: 304348 - RNA, 65 nt, hsa
uucauaaaauuuugauuagugaaacuagagucuggauguuucauuguaggaauauuuaaguuauu

SEQ ID NO: 304349 - RNA, 65 nt, hsa
cuguuauuuaacguuugucugccaggauguauggaauguuucauacucuuaugaccugauccauc

SEQ ID NO: 304350 - RNA, 65 nt, hsa
agcccguuuccuucccucaucagugaaaaaaucuaauguuucaaauguaaauuguucauagaaaa

SEQ ID NO: 304351 - RNA, 65 nt, hsa
ccauaacauuaauuuuuuuaaaaaauaaggucuuaauguuucauuuaauuuaaaauauacuguca

SEQ ID NO: 304352 - RNA, 65 nt, hsa
acuuuacacuucagacagauuuucuguguuaugaaauguuucaguaaaauauuguuuacugacuu

SEQ ID NO: 304353 - RNA, 65 nt, hsa
aguuucggaaguuugaucugagaaccaaccauagaauguuucaguucuaggaaauaaaaccaguu

SEQ ID NO: 304354 - RNA, 65 nt, hsa
gagacucaaagagggagugcauuuaugagcucuucauguuucaggagagaguugaaccuaaacau

SEQ ID NO: 304355 - RNA, 65 nt, hsa
gcacacuacugagagaaugagaugaaaaacgauuaauguuucauuauuauuauugugaaaauauu

SEQ ID NO: 304356 - RNA, 65 nt, hsa
gagccuaauugcuguuacuaauuagaggaguaaaaauguuucacgauaacucagcaauuguaaug

SEQ ID NO: 304357 - RNA, 65 nt, hsa
ugacugaaacuauggcuaauaauugggguacucuuauguuucaauccaauuuaaccucauuuccc

SEQ ID NO: 304358 - RNA, 65 nt, hsa
guuguagcugagcacuuuaacaaguugagcauuccauguuucauucuuagaaccuucuuuaauag

SEQ ID NO: 304359 - RNA, 65 nt, hsa
uguuaaccuagaaagggcucacucuaccucuaggcauguuucaucccaacaaucagacugugcca

SEQ ID NO: 304360 - RNA, 65 nt, hsa
auaauauagaaaucuuauguaaaugaaauuuugucauguuucaaauaaagagaacugaaguagaa

SEQ ID NO: 304361 - RNA, 65 nt, hsa
auagaaguuacuagcacugacacacugauuuugaaauguuucaaaaugaguagauaugauuagau

SEQ ID NO: 304362 - RNA, 65 nt, hsa
gaaauacaucuuuuauaaugggggaagaaugcccuauguuucaauucaaaacaaagacaguuuuc

SEQ ID NO: 304363 - RNA, 65 nt, hsa
guuauugaaauggaaaugaaaacagccaguaacuuauguuucagaauguuuguaacacacuucau

SEQ ID NO: 304364 - RNA, 65 nt, hsa
acuguuggaauugucaucuguacaauuaguccauaauguuucauguuuguccuaagugugcuguu

SEQ ID NO: 304365 - RNA, 65 nt, hsa
uugcuaugcagugugaucuuuauuuauaguaaauuauguuucauguaaaugauauauuuuuggug

SEQ ID NO: 304366 - RNA, 65 nt, hsa
uguugcuaccagauuauaucuggugguaauuguuaauguuucagcagggcuggucucaguccuuu

SEQ ID NO: 304367 - RNA, 65 nt, hsa
aacaucuuguucuucaauaucacggguuuuuguuaauguuucauaaguaauucuccccacuugau

SEQ ID NO: 304368 - RNA, 65 nt, hsa
ucucauucuuguauugccuuuuaaauuuuguuaugauguuucauuaauaaacaguguuuuguuuu

SEQ ID NO: 304369 - RNA, 65 nt, hsa
uccucaccuucccucuuuuuuaaagucacauuuccauguuucaacauuaguuugcauucaccuuu

SEQ ID NO: 304370 - RNA, 65 nt, hsa
uugagcaggauaucuuuuuuuuuuuuuuugaggcgauguuucacucuuguguccaggcuggagug

SEQ ID NO: 304371 - RNA, 65 nt, hsa
uauugguacccuaggacauaaaaaucacauauaucauguuucaguaaaugcagugaaaggaacua

SEQ ID NO: 304372 - RNA, 65 nt, hsa
gaaugauuguuuucucucuuuguauauuuguacaaauguuucagcugugcuuuuaaaaaaucugg

SEQ ID NO: 304373 - RNA, 65 nt, hsa
agcagggcccaaagcuuauuaguuuaaauuaggguauguuucaaguuuguauuaauuuguaauag

SEQ ID NO: 304374 - RNA, 65 nt, hsa
accuuuucuuguaucuggauucaaauuuauuuccaauguuucaagcgggaaacaugacucuuuau

SEQ ID NO: 304375 - RNA, 65 nt, hsa
uuuuuuuaucagagucaugaugaaucaguccuagaauguuucauuugcacaaguagggcugccuc

SEQ ID NO: 304376 - RNA, 65 nt, hsa
ucuuuuguccugcaucaucuugaacauuaauccacauguuucagagcucaccaggcaguaccaau

SEQ ID NO: 304377 - RNA, 65 nt, hsa
gaucugcuuugcagggaaauaacuuguuuuuucucauguuucaucuucuuuuuauguaaauuugu

SEQ ID NO: 304378 - RNA, 65 nt, hsa
cugucaauaaaaauagaaguuuguugacucguuuuauguuucaauggugugugucuuuuuacuau

SEQ ID NO: 304379 - RNA, 65 nt, hsa
cucugggccuucaugcuuuucugcauuguguuaacauguuucaagugcauggccuucuacggcuu

SEQ ID NO: 304380 - RNA, 65 nt, hsa
uuagaaaaguugcaugauugacaucgcuuccacccauguuucagagcaucugauuugucagaccc

SEQ ID NO: 304381 - RNA, 65 nt, hsa
uggaacuaugcaguuaaggcagauaaaauguacagauguuucauauauuacagguuacauauaua

SEQ ID NO: 304382 - RNA, 65 nt, hsa
ggucuuucuauauacugaucucuauauagauaucaauguuucauugaaaauccacugguaaggaa

SEQ ID NO: 304383 - RNA, 65 nt, hsa
aagcaacuuagcaaggcuucuuuucauuauuuuuuauguuucacuuauaaagucuuagguaacua

SEQ ID NO: 304384 - RNA, 65 nt, hsa
ucaaguggcuuuuggggccccagguugagcucuggauguuucaagccaaggcucggcuauucccg

SEQ ID NO: 304385 - RNA, 65 nt, hsa
uuaaucaguaaaucaguuucacaucauguauugugauguuucaaugugagacacaaaaacaaugg

SEQ ID NO: 304386 - RNA, 65 nt, hsa
gcuccugccguuuucuuccugccaagccugaaucaauguuucaucuccaacccucugccaguuug

SEQ ID NO: 304387 - RNA, 65 nt, hsa
ccccauugggcccucgucugccucuccaggauuguauguuucaagccuuguccuguguuccuuug

SEQ ID NO: 304388 - RNA, 65 nt, hsa
cucaagugggauuagaagacuaucaaaauacauguauguuucaggauauuugaccugucauuaaa

SEQ ID NO: 304389 - RNA, 65 nt, hsa
auuuugguauuacacuguauuuguaucucugaagcauguuucauguuuugugacuauauagagau

SEQ ID NO: 304390 - RNA, 65 nt, hsa
guuguauuguaauggcauuaucaaaauauuugaugauguuucagauauauugcaaagucuguauu

SEQ ID NO: 304391 - RNA, 65 nt, hsa
caaccauaaguuaaaaucugaagguuaucuuuaucauguuucaucccugucugaagauuuccuag

SEQ ID NO: 304392 - RNA, 65 nt, hsa
uaaaauauuguuuuccuacaggccuauuuaacaagauguuucauuuuacuguauauuuuguaguu

SEQ ID NO: 304393 - RNA, 65 nt, hsa
caaaauuuuuucucuaggaaauauuuauuuuaauaauguuucaaacauauauaacaaugcuguau

SEQ ID NO: 304394 - RNA, 65 nt, hsa
uguagagccagccuugguuggaccuauugccaggaauguuucagcugcaguugaagagccugaca

SEQ ID NO: 304395 - RNA, 65 nt, hsa
ugaagaagugaguguccacgggugaagaagugaguauguuucaccuggacauuaaggugauguuu

SEQ ID NO: 304396 - RNA, 65 nt, hsa
aaaacacccagagacggcacaaggagguugaacucauguuucaguucgcgaacauugacuccuua

SEQ ID NO: 304397 - RNA, 55 nt, hsa; identical to SEQ ID NO: 303835

SEQ ID NO: 304398 - RNA, 65 nt, hsa
agauggguuuuauccucaaauauguauuuuuguguauguuucaaauacaaguauuaggcugcuuu

SEQ ID NO: 304399 - RNA, 65 nt, hsa
ccaguuucuguaaggucuuacauugccugacuaaaauguuucauuuaccucuaaauuuccauauc

SEQ ID NO: 304400 - RNA, 65 nt, hsa
cugagugagaaaacaaguauggugaggucacuuuaauguuucacagcgaucucagaucuaggccu

SEQ ID NO: 304401 - RNA, 65 nt, hsa
aagacgaagggagagagaaagcaguuuccaaggauauguuucaugucccaccauuuucucaguuu

SEQ ID NO: 304402 - RNA, 65 nt, hsa
aaacucuuagauauuuauauaauucaaaagaaugcauguuucacauugugacagauaaagaugua

SEQ ID NO: 304403 - RNA, 65 nt, hsa
cgugaccucugccacccacauccuucacaaacuccauguuucaguguuugaguccauguuuauuc

SEQ ID NO: 304404 - RNA, 65 nt, hsa
uucauacauuguacgaagaguauuuuugacagaauauguuucaaacuuuggaacaagaugguucu

SEQ ID NO: 304405 - RNA, 65 nt, hsa
aauaucaauauaaauaaggaaaauaaaucaaugaaauguuucaaugauauaugcaacuauucagu

SEQ ID NO: 304406 - RNA, 65 nt, hsa
cuaaaucugcuuuaccaaguaagguguaagguugcauguuucaguccucuaccauccugcacugu

SEQ ID NO: 304407 - RNA, 65 nt, hsa
uguauugcauuuuucuauuaaaaaauuaacaguuaauguuucagucaauguauuaucuguagcau

SEQ ID NO: 304408 - RNA, 65 nt, hsa
uacuguaugaauaaugaaacuuacuaucauaaaccauguuucauguggccuguuagggccuguca

SEQ ID NO: 304409 - RNA, 65 nt, hsa
cuucccgucugauuguuccuccccagcccccuggcauguuucaccacaacccuguugcuacauca

SEQ ID NO: 304410 - RNA, 65 nt, hsa
gcauucuguggucaaguaaguuuagggagcuauucauguuucacuugcuuuguggagauucacac

SEQ ID NO: 304411 - RNA, 65 nt, hsa
uggacaaaaaguaaaucauugaccaaagcuaugaaauguuucacaaaguuuuccucuuuugcaua

SEQ ID NO: 304412 - RNA, 65 nt, hsa
guauggaauauuacuucuaucagaagaugaucaagauguuucaguccagugcacaucagcauugc

SEQ ID NO: 304413 - RNA, 65 nt, hsa
augagcaggaagucuagaaaugauaacuagacuguauguuucaugugugugauuuuucagaauuc

SEQ ID NO: 304414 - RNA, 65 nt, hsa
cauuugucuuaauuucuaacauuaucuuugcuuuuauguuucauaaaaauuugucauuauuuaug

SEQ ID NO: 304415 - RNA, 65 nt, hsa
uuuuuucugcugguggauaaacauuaaaauuaaucauguuucaaaguuuuauuuucaguuccuuu

SEQ ID NO: 304416 - RNA, 65 nt, hsa
aaugcuagcauguacuguaugggaggaugauccagauguuucaaagagaauuucucuuaguuuag

SEQ ID NO: 304417 - RNA, 65 nt, hsa
ugcuugaaauuauauugauuuaaaugaugugugagauguuucaccauuuucaggcacuguguaau

SEQ ID NO: 304418 - RNA, 65 nt, hsa
auauuaggccaagugcaauugacuucccuuuuuuaauguuucaugaccacccauugauuguauua

SEQ ID NO: 304419 - RNA, 65 nt, hsa
gaucuacauuuucuggaaaaucagcauuacuagagauguuucaaauguagauuuuaccagaccau

SEQ ID NO: 304420 - RNA, 65 nt, hsa
ucccugugcugagcccugagggcagagaggauggcauguuucaggggagggggaagccuuccucu

SEQ ID NO: 304421 - RNA, 65 nt, hsa
aaaauagagaauucuuaagauuuuguuuaaaccaaauguuucauguagaaugcaaaauguuggca

SEQ ID NO: 304422 - RNA, 65 nt, hsa
ucugccuuguuuggguaaaggcaguaacuaaguuuauguuucagaacugcaaaacaaacaggaua

SEQ ID NO: 304423 - RNA, 65 nt, hsa
gguaaaaucuuuaaaacuagauucuugcuucugauauguuucaauacauuguugauggcauugug

SEQ ID NO: 304424 - RNA, 65 nt, hsa
aagcaaauuguuucaguuuuuuuaaaugcccuuugauguuucaaaaaaaaaaaggaacuguaauu

SEQ ID NO: 304425 - RNA, 65 nt, hsa
guuuuauuucaaaaacaaaguacauuuuugaaauaauguuucagaauaaaauaaucucacuuuua

SEQ ID NO: 304426 - RNA, 65 nt, hsa
gucaaugucauagaagacaaagaaagguuguggaaauguuucagauuaaaugauaguaaaaacac

SEQ ID NO: 304427 - RNA, 65 nt, hsa
uuuuccuuuuuaaccauuccaaucgguguguagugauguuucauuuugguuuuaauuuguauauc

SEQ ID NO: 304428 - RNA, 65 nt, hsa
acuugcaguucuaugauagauugcauuuauuaaaaauguuucauuguaucacauagaaauauggc

SEQ ID NO: 304429 - RNA, 65 nt, hsa
ugauaaacauauauccucuuuuuauugcuuugucuauguuucauaugaaacauuucagaaauuau

SEQ ID NO: 304430 - RNA, 65 nt, hsa
uggcgcccucucaauuuagucuucucucauuggccauguuucagauuuugaccuagaaaugcgag

SEQ ID NO: 304431 - RNA, 65 nt, hsa
augucacuuuuuugccuaucccccguuuuuuggucauguuucaauuaauugugaggaaggcgcag

SEQ ID NO: 304432 - RNA, 65 nt, hsa
acaaaucaaaaaaucuuccuucuuauaacugagaaauguuucacccaaauuuccuuuguuauuau

SEQ ID NO: 304433 - RNA, 65 nt, hsa
caaauaucuucacuucaguuuuauuugugaauuacauguuucaugaauccauuuggcacagagac

SEQ ID NO: 304434 - RNA, 65 nt, hsa
auuuucucuuguagugauuuggguaggaagaggccauguuucaguucguuuucucuguagggucg

SEQ ID NO: 304435 - RNA, 65 nt, hsa
aacuagcuagccagcuggagauaauuuaccagggaauguuucaaagcccuaaccuugaaguuugg

SEQ ID NO: 304436 - RNA, 65 nt, hsa
ccacaaaaugcugauucaguucaaaauuaaugcaaauguuucaaaacuggguuucugauauuugu

SEQ ID NO: 304437 - RNA, 65 nt, hsa
gaguuacuaagauuucuauaccuggaauaucauguauguuucauuuacuggauguuuacauuuua

SEQ ID NO: 304438 - RNA, 65 nt, hsa
aggcaucaagcuacccucaagaguuucugggcuggauguuucagaacaacaucuacaccaguaaa

SEQ ID NO: 304439 - RNA, 65 nt, hsa
gcacucccuggccuugcccgucgugugcugaagacauguuucaagaaccgcauuucgggaagggc

SEQ ID NO: 304440 - RNA, 65 nt, hsa
cagguauuugacauaauauguauuaaguuauacuaauguuucaaucaguaaagaaauaaaaguuu

SEQ ID NO: 304441 - RNA, 65 nt, hsa
ucugugcauaaggagaggaaaguuccaggguguguauguuucaggggcuucacauggaggagcug

SEQ ID NO: 304442 - RNA, 65 nt, hsa
uccuaugaagaaagauacgguuucagacugaaaacauguuucacagguguuugcuuccuuccaga

SEQ ID NO: 304443 - RNA, 65 nt, hsa
aauugaaauguugcuuucacugaaaaagugucuugauguuucaguuauuuuuaaucgccauaaaa

SEQ ID NO: 304444 - RNA, 65 nt, hsa
uguuugagagcauaauuaugguaaucaugagauuaauguuucaugauuucuaccuccaaagugug

SEQ ID NO: 304445 - RNA, 65 nt, hsa
aagccucaacauuuucgcagcacuugaaucaauaaauguuucaccuuugugcauuugugaacaga

SEQ ID NO: 304446 - RNA, 65 nt, hsa
gaggucauugaaaaagagaacagugacguaggcaaauguuucaagcacuuuagaaacaguacuuu

SEQ ID NO: 304447 - RNA, 65 nt, hsa
ucuuccuuauuuaguguuguaucauaaauacuuugauguuucaaacauucuaaauaaauaauuuu

SEQ ID NO: 304448 - RNA, 65 nt, hsa
uuuaauuuauagcuaugguuauaaacagguuuuagauguuucaaaugacuuguccacugaauguc

SEQ ID NO: 304449 - RNA, 65 nt, hsa
auuaucaagguucuaccuauguuaauuuacaauucauguuucaagacauuugccaaauguauuac

SEQ ID NO: 304450 - RNA, 65 nt, hsa
auccuuuaauucuucauuaaaauggaaauaaguagauguuucaaaguaaucuacauuccuggcuu

SEQ ID NO: 304451 - RNA, 65 nt, hsa
ugagguucauuacaaucgagacugcaaugugaucuauguuucaucuuguuuuuauaauaaaaagc

SEQ ID NO: 304452 - RNA, 65 nt, hsa
uuagcaauucaacuugaugugagaagaaaaaacaaauguuucaacacaaaaucucuguuuuguga

SEQ ID NO: 304453 - RNA, 65 nt, hsa
aaaacuaaccugaaaaacaaauaaaugcuuuggaaauguuucaguugcuuuagaaacauuagugc

SEQ ID NO: 304454 - RNA, 65 nt, hsa
aaauaaaaguuuuauaguuuuaaauacauaaagaaauguuucaguuaggcauuaaccuugauaga

SEQ ID NO: 304455 - RNA, 65 nt, hsa
uguuuuuuaacaaaauauuuuuuuaagggaaagaaauguuucaggagggauaaagcuuaccauua

SEQ ID NO: 304456 - RNA, 65 nt, hsa
uaagugauaaacaacagcaaauauacuugaauaaaauguuucagguauuuuuguuucauuuuguu

SEQ ID NO: 304457 - RNA, 65 nt, hsa
uuuuugaucuggcaaccauauuucuggaaguugagauguuucagcuugaagaaccaaaacagaag

SEQ ID NO: 304458 - RNA, 65 nt, hsa
agugaacauucgaccuccauuacggagaguuuccuauguuucacugugcaaauauaucugcuauu

SEQ ID NO: 304459 - RNA, 65 nt, hsa
uuugccuccagaagaaguuuuuccuugauugugcuauguuucaguggaagaaauucuuugaagua

SEQ ID NO: 304460 - RNA, 65 nt, hsa
caugaaugucuuucuuugaaaacugcaauguauguauguuucaagguuauuuaacaguguacuau

SEQ ID NO: 304461 - RNA, 65 nt, hsa
agaugcgcaucaguaugaaauugucucaaucuuggauguuucauuuuaugaauggaggcacuuua

SEQ ID NO: 304462 - RNA, 65 nt, hsa
auuugcugauuuguuuuuaaaaaaacaagaaaugcauguuucaaauaaaauucucuauuguaaau

SEQ ID NO: 304463 - RNA, 65 nt, hsa
cagcugggacucuugggcucugugccugagggaaaauguuucacaacuaguggcugcccaauugc

SEQ ID NO: 304464 - RNA, 65 nt, hsa
uuuuuuucuagcuauuuugcauuuuuucuuuuaccauguuucaguuucugcauguagauuuaaau

SEQ ID NO: 304465 - RNA, 65 nt, hsa
uauuuaacgaaucaugauucagauuguaccauuacauguuucagugcagcaugguuacuaacgcu

SEQ ID NO: 304466 - RNA, 65 nt, hsa
aaagcaauguagaguuacgcuuuuauaaguauuucauguuucagaaaugaugcauacagcaauuu

SEQ ID NO: 304467 - RNA, 65 nt, hsa
acacugguagauauagaagccuuuauuaagaauugauguuucauucaauuucagaucacugguac

SEQ ID NO: 304468 - RNA, 65 nt, hsa
augucauuccacuugugaaagaaaacacaaugugcauguuucaaugauacugugcggaaacacac

SEQ ID NO: 304469 - RNA, 65 nt, hsa
uguucaguucauagcguagacugcuaaauacuguaauguuucaaaacauccaacuguuuguuaua

SEQ ID NO: 304470 - RNA, 65 nt, hsa
cauauucucauugugagaauuuuaauacuaauggaauguuucaaagguuuuauucaaaccacaaa

SEQ ID NO: 304471 - RNA, 65 nt, hsa
cagccauuugggaggcaaugacuuucugcuggcccauguuucaguugccaguaagcuucucacau

SEQ ID NO: 304472 - RNA, 65 nt, hsa
cacuccaugauugauucagucaugaaccucaucccauguuucaucuguggacaauugcuuacuuu

SEQ ID NO: 304473 - RNA, 65 nt, hsa
cagguacaucaguucuuuuugauaugaaaacauucauguuucagacauugaauugagagcuuuua

SEQ ID NO: 304474 - RNA, 65 nt, hsa
accccaucccucacagccucuugcugcuaaaauagauguuucauuuuucugacucaugcaaucau

SEQ ID NO: 304475 - RNA, 65 nt, hsa
aaaguuguuguagucuccacuucagucagaaacugauguuucagcuaggcacagugguacaugcc

SEQ ID NO: 304476 - RNA, 65 nt, hsa
cuaaaaggacuuguuuguagaauaaggaauuuucuauguuucaaaguguucuaaaaccuggcuaa

SEQ ID NO: 304477 - RNA, 65 nt, hsa
agucuauuuaaccucuguaaugaaacuaaauaaaaauguuucaccuuuacaccuggcuguuuguu

SEQ ID NO: 304478 - RNA, 65 nt, hsa
uuuaaccuuaaagauguuaauguugauggaaauucauguuucauauuaaaacaacacuuugucuu

SEQ ID NO: 304479 - RNA, 65 nt, hsa
uauaguggagugaucauacaguucccccaaaugugauguuucaguguauuuauuuaaaacauaaa

SEQ ID NO: 304480 - RNA, 65 nt, hsa
gguauagaagcucuucaagcauuaaaauagaguugauguuucauuccauuuguuuuauccaucaa

SEQ ID NO: 304481 - RNA, 65 nt, hsa
guccauaaaaacuucaaggcuuauccauacuuuugauguuucaauaugcauugaacuggauguua

SEQ ID NO: 304482 - RNA, 65 nt, hsa
aacucuucacucuucaaaugccugacuagggagccauguuucacaaggucuuuaaagugacuaau

SEQ ID NO: 304483 - RNA, 65 nt, hsa
guauggguauaacauccuugccuucccauuuauccauguuucacuuuaucacugauaugaagagg

SEQ ID NO: 304484 - RNA, 65 nt, hsa
aacuaaaucuucgggacuucuuuaaugcuacguuaauguuucacugcucgucuagaaacuccuaa

SEQ ID NO: 304485 - RNA, 65 nt, hsa
agauauagugacaguaccaagaguaccaggacucaauguuucauaugaagcccuuggugaugagg

SEQ ID NO: 304486 - RNA, 65 nt, hsa
aagauauuucuuucccuaaccaucauacacuuggcauguuucauucccaucuccuuuccccucac

SEQ ID NO: 304487 - RNA, 65 nt, hsa
ggaaacuuuuuuaauauaugaaagcugugauaaaaauguuucagauguuuagucaauugugaaau

SEQ ID NO: 304488 - RNA, 65 nt, hsa
uuacuuuguaaucauauacaaugucaacuuuuuagauguuucaccacucuuuugcaaauaaagca

SEQ ID NO: 304489 - RNA, 65 nt, hsa
gacagaccccccacccccaaggcugcagccacaccauguuucaggcuuggggcuggggcaggcuu

SEQ ID NO: 304490 - RNA, 65 nt, hsa
ccuagagaacaggugguuuuuaaggguuaucuuagauguuucacaccggaagguuuuuaaacacu

SEQ ID NO: 304491 - RNA, 65 nt, hsa
acuuucccucuuccuuuaagaaaacuuacuaaaaaauguuucauugcgaagcagaggaaaagaaa

SEQ ID NO: 304492 - RNA, 65 nt, hsa
gccuggaguaaaaaucugauuugaccccucugcucauguuucaucauauuuguagcucugcauca

SEQ ID NO: 304493 - RNA, 65 nt, hsa
cucaagucuacccugaucaccucagggcauaaagcauguuucauucucuggcccgacagugucuu

SEQ ID NO: 304494 - RNA, 65 nt, hsa
aaucucauucugugaaagccuuuuaauuuauugaaauguuucaugacuacugcugcuagcucuuc

SEQ ID NO: 304495 - RNA, 65 nt, hsa
gauucucugcgcgcaaggacccucgacucacccccauguuucagugucacagagacauucuuuga

SEQ ID NO: 304496 - RNA, 65 nt, hsa
aaaauggaucuuuacauguugcaguaacauugacuauguuucaaaacucagaugcauaaaacgua

SEQ ID NO: 304497 - RNA, 65 nt, hsa
cugcagcuauccugacacagugcccuguuccuggaauguuucagauacagcugagcccaagggac

SEQ ID NO: 304498 - RNA, 65 nt, hsa
cuuaacaguucugaaugcuguccucaaaguauauaauguuucauguaccaagacccuuuucacag

SEQ ID NO: 304499 - RNA, 65 nt, hsa
uauaacugaagaaaauaucuugcuaauuuuaccuaauguuucauccuuaaucucaggacaacuua

SEQ ID NO: 304500 - RNA, 65 nt, hsa
guaaucugugagaacaaugguugaaauuucaaaguauguuucauuauucuuucuaaauuugauaa

SEQ ID NO: 304501 - RNA, 65 nt, hsa
cugacaauuuaucuuccauaugcucuuuaaguaaaauguuucaaagacaguuuuaaagggagcca

SEQ ID NO: 304502 - RNA, 65 nt, hsa
aucugaagaaucaaacuuccauccugaaaaucuauauguuucaaaaccacuugccauccuguuag

SEQ ID NO: 304503 - RNA, 65 nt, hsa
uuuaaaaaguaacaagaaagaacucguuugaaaccauguuucaucauccuguagcuacaucuggu

SEQ ID NO: 304504 - RNA, 65 nt, hsa
cugcuggggcugaaggucagaaguaauccugagaaauguuucaggccuggggagggaggggagcc

SEQ ID NO: 304505 - RNA, 65 nt, hsa
cauuaacaauuuuuuuuuguuuuuuaaauacuaauauguuucacacuauaguuuguguaacaaca

SEQ ID NO: 304506 - RNA, 65 nt, hsa
uaauuagugccuuucucuuucaucacuuguucuggauguuucaaucaguuuaguggaaggaaaaa

SEQ ID NO: 304507 - RNA, 65 nt, hsa
cugggcaucagcaccuguccagcucuacuugugugauguuucaggaacucagccccuuuuucugc

SEQ ID NO: 304508 - RNA, 65 nt, hsa
cuucucuugaaguccaauaacaagaccaaguaagaauguuucaacaaugcguuggcaagagaugu

SEQ ID NO: 304509 - RNA, 65 nt, hsa
ugcaguaggcaucacauaugcuugguucaaacuguauguuucaguauugauugacucugcuauug

SEQ ID NO: 304510 - RNA, 65 nt, hsa
aagcaaaacuuuuaaauauuugaauugacaguuacauguuucauaacuuuguaugucuauugguu

SEQ ID NO: 304511 - RNA, 65 nt, hsa
uugcuuccagacguuguuccauauuuuugccccaaauguuucauggcuuauaccccauugguuua

SEQ ID NO: 304512 - RNA, 65 nt, hsa
ggugaacaaacaaugaaaacucuuugcugcugcccauguuucaaauacuuagagcagugaagacu

SEQ ID NO: 304513 - RNA, 65 nt, hsa
cagaaccucucagccuuccucuacgccuugaggggauguuucauccaaaguacaaccugaauuga

SEQ ID NO: 304514 - RNA, 65 nt, hsa
uccauccuuauucacguugacaguaccuagcuguaauguuucacagagugugcugcuauuuuaua

SEQ ID NO: 304515 - RNA, 65 nt, hsa
acuuuaaagauuugaaaccacauuuuuauuguuugauguuucauuuucagacuuuuuaaugucag

SEQ ID NO: 304516 - RNA, 65 nt, hsa
guaaucaagcuuuuccacaguucuugaaaaguacuauguuucaaauuucaggaacaccagcguua

SEQ ID NO: 304517 - RNA, 65 nt, hsa
acugcugugggauugucaaccagcuuaucugcaggauguuucagaucugauaaauccugauggaa

SEQ ID NO: 304518 - RNA, 65 nt, hsa
ucugugcagcuuucccccuuggagcaggagugaagauguuucauuaucuugggccugggaaacca

SEQ ID NO: 304519 - RNA, 65 nt, hsa
uuuaucuuauaucuaaaaaauauauaacuuacuauauguuucaguugcucucugaacaaaaauua

SEQ ID NO: 304520 - RNA, 65 nt, hsa
aaaaaguuaagggaaaagacuuugcuuuuaaaaaaauguuucaaaagaaagguauuuucacuaaa

SEQ ID NO: 304521 - RNA, 65 nt, hsa
aacucauaaggucuaccaagaaaauaaauguuaugauguuucaguuggcuucuaggaaauaauua

SEQ ID NO: 304522 - RNA, 65 nt, hsa
cuauggguaagaaauaaauggaaauaugacaucggauguuucagcaacuguucuguaaauaaaau

SEQ ID NO: 304523 - RNA, 65 nt, hsa
cacuagcaaucugagugauggaaucuuagucauucauguuucaccagaggacagcaagcaaaagg

SEQ ID NO: 304524 - RNA, 65 nt, hsa
accuuaugagaaguggaugguaggaggagucacuaauguuucaaucucuauuucuguaaucuugg

SEQ ID NO: 304525 - RNA, 65 nt, hsa
gcuagaacagcuaagguuuacauguaccaaauaacauguuucagcucauuccauccucacaacag

SEQ ID NO: 304526 - RNA, 65 nt, hsa
uuuuuaaaaaaaaaguauguguaauaugaaguaaaauguuucagacuuuuuuuuauacucaagug

SEQ ID NO: 304527 - RNA, 65 nt, hsa
uuauguguaaguuuuguacaaggaaugccccuaaaauguuucagcaggcugucaccuauuacacu

SEQ ID NO: 304528 - RNA, 65 nt, hsa
ucuauagauaaugaggaagaaaugguaagacguaaauguuucaacacuuuacuaaaagcuuauuu

SEQ ID NO: 304529 - RNA, 65 nt, hsa
aaacaugaauuuuuuugucuuauucuguuuuuaacauguuucaaauguuuuauacauuuuuggag

SEQ ID NO: 304530 - RNA, 65 nt, hsa
cuugucaccucauuuugcauuacugucuuccguggauguuucaguuacaacuguaauguuauuua

SEQ ID NO: 304531 - RNA, 65 nt, hsa
agccucccaaaucaagucucuccaucacuugaucaauguuucagcccuagacugcccaaggagua

SEQ ID NO: 304532 - RNA, 65 nt, hsa
cuuuuuccucccuuucccugagagcucacaguacaauguuucagaagccccauuugcacagguuu

SEQ ID NO: 304533 - RNA, 65 nt, hsa
cuaacugcauuuguuuugacuucuuuaauguuugaauguuucacucuguuguaaagucagcauaa

SEQ ID NO: 304534 - RNA, 65 nt, hsa
uucauguccagaagaguaagagggaaaauggacauauguuucauauccaaggguauucaaacugu

SEQ ID NO: 304535 - RNA, 65 nt, hsa
guccuuucuuuuugcccuuuauucaauuaguccuaauguuucaguucucuaauuaccaauuaguu

SEQ ID NO: 304536 - RNA, 65 nt, hsa
caaagcauacauuuccugacuggucuagagaacugauguuucaauuuaccccucugcuaaauaaa

SEQ ID NO: 304537 - RNA, 65 nt, hsa
aaaugugucuuguauuaaauauuuuuauuaaaagaauguuucauuaaugcauugauaagaaaacu

SEQ ID NO: 304538 - RNA, 65 nt, hsa
ugugaagcugcucugauacuagauauccuuaaaugauguuucaauuuuauauguuuucuaagaua

SEQ ID NO: 304539 - RNA, 65 nt, hsa
ucaccugaggaagggaaggaagggaauaaucuuuuauguuucauuuaccuuaugaaaaguguuaa

SEQ ID NO: 304540 - RNA, 65 nt, hsa
ccuaggaucauauugcauucaucacuuuaaacaucauguuucagguuuuggucaauacuugacaa

SEQ ID NO: 304541 - RNA, 65 nt, hsa
ucacaguacacgucacaguauugaugugauucaaaauguuucagugaaaacuuuggagacaguuu

SEQ ID NO: 304542 - RNA, 65 nt, hsa
cuuuuuaaaagaaaaaauucuaccauuuuaaauucauguuucaacuccuacaaccaaaugagaaa

SEQ ID NO: 304543 - RNA, 65 nt, hsa
uuggaugugcuauuguaugauuacgaauagucuguauguuucaagcccuucuguaaaauaugaag

SEQ ID NO: 304544 - RNA, 65 nt, hsa
gaccucaauucccucaccugaaauaggaaaugagaauguuucauuguagccccaagcggucaugu

SEQ ID NO: 304545 - RNA, 65 nt, hsa
aacugugcucugugaggugugaaauuaaaaacauuauguuucaccaauauuuaaacaucaguacu

SEQ ID NO: 304546 - RNA, 65 nt, hsa
acuucagucagguacacuguuacuugaaaggaagaauguuucacuuacccaagagcuauggcugc

SEQ ID NO: 304547 - RNA, 65 nt, hsa
ucucucucauuauugagauucauccauauuguugaauguuucacuaguuaauguuuauuguucaa

SEQ ID NO: 304548 - RNA, 65 nt, hsa
uguaaagucuuucuaagaccaauuauuaucuuagcauguuucaguaucuucucuaucauaggccc

SEQ ID NO: 304549 - RNA, 65 nt, hsa
aggggaaaacuucagcuuuccaaaagcuaguaaacauguuucaaagaaaaauaaggucaggagaa

SEQ ID NO: 304550 - RNA, 65 nt, hsa
gcaugcuugguuauuuccaguacuugucagucaacauguuucaagacgcuguguuagacacuagg

SEQ ID NO: 304551 - RNA, 65 nt, hsa
uacugucaugucauuuacccacuggaucaaaggguauguuucacuucuugacaauauaaaugcug

SEQ ID NO: 304552 - RNA, 65 nt, hsa
uucuuuacaauuuguugcaauuucaucugcuuucuauguuucauuguuaauugccauccuucagc

SEQ ID NO: 304553 - RNA, 65 nt, hsa
aacauuuaaaaguacuuuauauuuuacauaauagcauguuucauuuugauuaaaagcuaccaaag

SEQ ID NO: 304554 - RNA, 65 nt, hsa
uguaugaaaacaucuccgaauuagcauuucuggauauguuucauccaggguaucauugauuuaug

SEQ ID NO: 304555 - RNA, 65 nt, hsa
uaguaugagaagaaaucauugggugacuaugacuaauguuucagaauuacuuuuuaauuguuuua

SEQ ID NO: 304556 - RNA, 65 nt, hsa
ggaggaaaacucaacuguuucucuuuguuaucuaaauguuucagaauucaaucgugaaggaacag

SEQ ID NO: 304557 - RNA, 65 nt, hsa
aggguccaguauuuauuugauuauuuaguauguuuauguuucaugacacuaauuuagucuuuuga

SEQ ID NO: 304558 - RNA, 65 nt, hsa
aaaaaaugaauguauuuuuuucuccaaagaacagcauguuucacucaauggugaaaagguggaaa

SEQ ID NO: 304559 - RNA, 65 nt, hsa
gucccuggucacccgacuuuggaauuugcaccaucauguuucagugaagaugcuguaaauagguu

SEQ ID NO: 304560 - RNA, 65 nt, hsa
ugcagguguccugcccuuccgcccacgagugcgccauguuucagcggagcggcgugugggagaag

SEQ ID NO: 304561 - RNA, 65 nt, hsa
ugguagugccucaucacaacccaugauggcuguucauguuucaccccuuuucuuccuucagcaga

SEQ ID NO: 304562 - RNA, 65 nt, hsa
ggcuggauuuggacaaaaagcaaaucuagacaugcauguuucaggguucaguaguauacuucaug

SEQ ID NO: 304563 - RNA, 65 nt, hsa
agacaugcauguuucaggguucaguaguauacuucauguuucauacagauaauucacauucaaaa

SEQ ID NO: 304564 - RNA, 65 nt, hsa
ugcauuuguaaacaguccuggucaguaguuaaauaauguuucaauuaaagugcuguaaaauaaac

SEQ ID NO: 304565 - RNA, 65 nt, hsa
uugccacugauauuuuuacuggauaaaauucaaaaauguuucaauucacaaaggcuaauuguuga

SEQ ID NO: 304566 - RNA, 65 nt, hsa
ucucugugaagccuuuacucucuaggugccuuauaauguuucagggcucaacuuuuuaaaaucca

SEQ ID NO: 304567 - RNA, 65 nt, hsa
cacgugugagaauuuaggagacacugugcacugacauguuucacaacaggcauuccagaauuaug

SEQ ID NO: 304568 - RNA, 65 nt, hsa
ggaaugggacccaaaucuaaacacaaaauucauuuauguuucauauacaccuuauauacaauaac

SEQ ID NO: 304569 - RNA, 65 nt, hsa
uauuaauauuuccuuuuccucauaccaacuugacuauguuucacccgcuucaugacuaaaucaca

SEQ ID NO: 304570 - RNA, 65 nt, hsa
aagugaaagugccaacaaauuauugauagcugauaauguuucauuaucugcaacugcuugauaag

SEQ ID NO: 304571 - RNA, 65 nt, hsa
caauguguauauguaaauaauauguguuuuaccagauguuucauagaaagaauuuuuucuugauc

SEQ ID NO: 304572 - RNA, 65 nt, hsa
ugauuuauuaaauucuaguuaugugcccuauaaugauguuucagucagugacagaccucauauau

SEQ ID NO: 304573 - RNA, 65 nt, hsa
cucugcagcagggggugacugacacaccaaacaagauguuucacuggguacucugccauagaaau

SEQ ID NO: 304574 - RNA, 65 nt, hsa
aaguggggacagauucgcagcacagagucgcuggcauguuucacuccugcuucucucagccagcu

SEQ ID NO: 304575 - RNA, 65 nt, hsa
ggcaugaauggagaugcccgcacaguaauguagaaauguuucauacagcuauuaaaauguaacug

SEQ ID NO: 304576 - RNA, 65 nt, hsa
uuuucauaauguugaauuugccuuuuaggaaaacaauguuucaugaaacacuuguaagauacuua

SEQ ID NO: 304577 - RNA, 65 nt, hsa
gaugauuguuaagcaauagauuugcucuauugaaaauguuucauuuuuuucacuguacaagcaac

SEQ ID NO: 304578 - RNA, 65 nt, hsa
cugcugcauuccagccagggugacagagugagaccauguuucaaacaagaaacauuucagagggu

SEQ ID NO: 304579 - RNA, 65 nt, hsa
auucgucaccauuauacuaaugaacaauagauuucauguuucaaaauuucagauuuuacauguua

SEQ ID NO: 304580 - RNA, 65 nt, hsa
gagguuguuaauuagcacauauuccuuuuagaaaaauguuucagaaaccucagucuugauaucug

SEQ ID NO: 304581 - RNA, 54 nt, hsa; identical to SEQ ID NO: 304019

SEQ ID NO: 304582 - RNA, 65 nt, hsa
aagauaucuauuugaaaguucucagaguuguacauauguuucacaguacaggaucuguacauaaa

SEQ ID NO: 304583 - RNA, 65 nt, hsa
gaauuucauaugacauucaugccuggcuucgcaaaauguuucaaguacuguaacugugucaugau

SEQ ID NO: 304584 - RNA, 65 nt, hsa
gugagacuccgucucaaaaaaaaaaaaaaaaagaaauguuucauuuugguuuuucaccaaccuuc

SEQ ID NO: 304585 - RNA, 65 nt, hsa
auguuagagggucucuuacuccccgcccagcugugauguuucaucugcuuugguuguuuuggugg

SEQ ID NO: 304586 - RNA, 65 nt, hsa
gauacauguccucgacggaugccaaaguggaacagauguuucagauacuguuggacccagaagag

SEQ ID NO: 304587 - RNA, 65 nt, hsa
guuugacugccuaagggacagcacgaaugacucacauguuucagacaggccuccacggcuaugga

SEQ ID NO: 304588 - RNA, 65 nt, hsa
gccuugguggauuaaccaaggccuuggauuccagaauguuucaugguaagcacuguggagaaccu

SEQ ID NO: 304589 - RNA, 65 nt, hsa
uugaagugcugugauuguccuguauucaauuuuguauguuucaccucuacugugauucagacaga

SEQ ID NO: 304590 - RNA, 65 nt, hsa
uacauguuuuaccaccacccaggucaagacauagaauguuucaacauuuccaucaccccagaaac

SEQ ID NO: 304591 - RNA, 65 nt, hsa
uaaaugccuguguuaaagaggcagcuugacuguucauguuucauuuugcaaccauugguuuugag

SEQ ID NO: 304592 - RNA, 65 nt, hsa
gugucuucauaccaaauuaaaggugguuuuaauauauguuucauggaaguuguuuauaaaauuca

SEQ ID NO: 304593 - RNA, 65 nt, hsa
agcauucagcgcugcuguggcuaacaccacuguguauguuucaucauugcucugaaggucaaaag

SEQ ID NO: 304594 - RNA, 65 nt, hsa
aguaaccaagcacucauuauauaugcauccuccaaauguuucaugcuuauuuauaggaaaguuau

SEQ ID NO: 304595 - RNA, 65 nt, hsa
auauaagaccucuuguagcuacaauguuuuagagcauguuucaucuucauuuuuaauauccugaa

SEQ ID NO: 304596 - RNA, 65 nt, hsa
uugggguuuacaacaacuaggauguguugggugagauguuucagaucuggagaaaugagcaggug

SEQ ID NO: 304597 - RNA, 65 nt, hsa
cacccccagcaaggugccuggggagacuugagcagauguuucauuuuggccuggccaguggcuga

SEQ ID NO: 304598 - RNA, 65 nt, hsa
ccuauugucaagguuaacauaaaugcucuucuaaaauguuucacuuacuccuaaacuagcuaucc

SEQ ID NO: 304599 - RNA, 65 nt, hsa
cagcugccucaccgcccagacauugauuuguucagauguuucaaugccucaugauacaauaaaac

SEQ ID NO: 304600 - RNA, 65 nt, hsa
uuucacaccagauccuaccccuuucccugagccacauguuucacacaaguguagaaaaugccagg

SEQ ID NO: 304601 - RNA, 65 nt, hsa
ugucagccaccagacugucccggcaccuacagagaauguuucacaguucuggcauuuaaauccuu

SEQ ID NO: 304602 - RNA, 65 nt, hsa
aguauuuguuaaaugggguauuuuucuguauuuguauguuucacuauaauaagggaauuaaggau

SEQ ID NO: 304603 - RNA, 65 nt, hsa
ugaccgcuucauaagccaguacgucugagcugaguauguuucaauaaaccuuuugauauuucuca

SEQ ID NO: 304604 - RNA, 65 nt, hsa
guacuaaguccucuccagguugguccugggauaucauguuucaaguggcugugccaaaggugagu

SEQ ID NO: 304605 - RNA, 65 nt, hsa
ugugcuugauuuuuaucaguuuuguguagauuuuuauguuucauauuuuaaauuuaaaucccaca

SEQ ID NO: 304606 - RNA, 65 nt, hsa
uguuuggccaaaaauuuuuuuaaaaaucauauuauauguuucaauugaucuguuagaauaaccaa

SEQ ID NO: 304607 - RNA, 65 nt, hsa
aaucacugagacugcaucagaguuugcaauuuuguauguuucauugccaaagaaggcuuaguggu

SEQ ID NO: 304608 - RNA, 65 nt, hsa
uuuccucucacuuggccuugcagcuaaauggagaaauguuucaauuucuuugaauacuugcacau

SEQ ID NO: 304609 - RNA, 65 nt, hsa
uuuucauguaguuucuuaauauauacuugaaggaaauguuucaccuuauuuuuggucuuuguuua

SEQ ID NO: 304610 - RNA, 65 nt, hsa
uucccacucacuucccuuugguuuuucauauuuaaauguuucaauuucuguauuuuuuuuucuuu

SEQ ID NO: 304611 - RNA, 65 nt, hsa
auaggccucugggagugauuugguucuuugcccuaauguuucauuugacggucucuuuuugauca

SEQ ID NO: 304612 - RNA, 65 nt, hsa
ugaaguugcaauuuauacuguauggcuucuuuuucauguuucaucuagguuuuuagaagugaagu

SEQ ID NO: 304613 - RNA, 65 nt, hsa
ugcucugcaguugggaacggugaucuucuugaaugauguuucagugugcaaaaacuauagagccu

SEQ ID NO: 304614 - RNA, 65 nt, hsa
ggucaugcaggccuuuaccggcauugauguggcucauguuucaggcagacuugggguccuuaagg

SEQ ID NO: 304615 - RNA, 65 nt, hsa
uuaugucuagcuucugagucuagaugaaagacaguauguuucagagaacauuggauaucaguuuu

SEQ ID NO: 304616 - RNA, 65 nt, hsa
uggcagugucaagccugaaaccaagcaauaccgucauguuucagccaagcccagagcccuaagau

SEQ ID NO: 304617 - RNA, 65 nt, hsa
agaaggcuagagggcgacucugguggugcuuuuguauguuucaauuaggcucugaaaucuugggc

SEQ ID NO: 304618 - RNA, 65 nt, hsa
cccccacccucugccacccaguccucccagcugccauguuucaaagacgaccuuuaccuccugcc

SEQ ID NO: 304619 - RNA, 65 nt, hsa
cgggacgucuucauugaagauucacuuacaaaggaauguuucacuaaauaaaagaaaaccagaau

SEQ ID NO: 304620 - RNA, 65 nt, hsa
caucccugaaggggagcucuuggauaucauuggccauguuucaaucgaauggagccacugggccc

SEQ ID NO: 304621 - RNA, 65 nt, hsa
uuauuuuuuuaaugaaaagaaaaaacaagaaaguuauguuucauaauuucuuacaacaugagcca

SEQ ID NO: 304622 - RNA, 65 nt, hsa
uuaguccuuaggccaaccaauuuaacugcagugucauguuucacaggccuuccuacauuuagaaa

SEQ ID NO: 304623 - RNA, 65 nt, hsa
acuccagacugauagguagucauuagccaugagaaauguuucaggauggcuagggaagacuugug

SEQ ID NO: 304624 - RNA, 65 nt, hsa
aaaggcaagcaaaggagaugaaaucuguucugggaauguuucagcagccaauaagugcccgagca

SEQ ID NO: 304625 - RNA, 65 nt, hsa
augacaaaguguugaaaauguauuuccugaaauaaauguuucaaaugcagaaacccagaaggcuc

SEQ ID NO: 304626 - RNA, 65 nt, hsa
ugucuuaggaaaggagaucaacauuuucaaauuagauguuucaacugugcucuuguuuugucuug

SEQ ID NO: 304627 - RNA, 65 nt, hsa
aucuugccugucauugcacucagaaucuuaagaucauguuucaaauauguugauucaaacuugcu

SEQ ID NO: 304628 - RNA, 65 nt, hsa
uagagaagagacaguuuaauauuugugcugaaaauauguuucaguauuuuuuucaaugaauguua

SEQ ID NO: 304629 - RNA, 65 nt, hsa
uuuugguguaguuuuuuaauauauacuugaaggaaauguuucaccuuauuuuuggucuuuguuua

SEQ ID NO: 304630 - RNA, 65 nt, hsa
uuuaaaguauaguacauuuuacauauguaaaugguauguuucaauaauuuaagaacucugaaaca

SEQ ID NO: 304631 - RNA, 65 nt, hsa
cagcuuuuggugccagcuacagaguugagcuggccauguuucacaguauaucaagcauuauagag

SEQ ID NO: 304632 - RNA, 65 nt, hsa
aagaaucauggacagaacuuacacuacuuuuuaccauguuucaucuuggcauaacaugguucuuu

SEQ ID NO: 304633 - RNA, 65 nt, hsa
uuuucguguaguuuuuuaauauauacuugaaggaaauguuucaccuuauuuuuggucuuuguuua

SEQ ID NO: 304634 - RNA, 65 nt, hsa
guuuuucuauagcagagcauuauauuuugcauuauauguuucaaccuagucuaagugggucuuuu

SEQ ID NO: 304635 - RNA, 65 nt, hsa
agcucagauauuaaaguaguauucucaauuaccaaauguuucauuugaaacaauuuaucuuaaug

SEQ ID NO: 304636 - RNA, 65 nt, hsa
accugcuggacaucuuugccaggcugugccuucucauguuucauagacaguggucugugcuggca

SEQ ID NO: 304637 - RNA, 65 nt, hsa
gguggcacugguguugcuggcucagcucuuggugcauguuucagauauguguguacacuucugac

SEQ ID NO: 304638 - RNA, 65 nt, hsa
uccagagcuuuagaggaagacacauagguggguuuauguuucaccucauuuggaacaaaagagga

SEQ ID NO: 304639 - RNA, 65 nt, hsa
aaauacacuacagaauuuagucaacauuuuauauaauguuucaauaaauguuucuuucaauaaag

SEQ ID NO: 304640 - RNA, 65 nt, hsa
aaaguuaugacauuagcuuuaaagguguaaaaaagauguuucacuaauguaacggugaaagagaa

SEQ ID NO: 304641 - RNA, 65 nt, hsa
auuuaacaaugucugaucucagcugaacaaauuagauguuucaguugcucuugggucaacuggcu

SEQ ID NO: 304642 - RNA, 65 nt, hsa
uaacaaauguuuauacaaauacauacauguacaccauguuucaaauacuaaauaaauagaguuua

SEQ ID NO: 304643 - RNA, 65 nt, hsa
uuuguaaacugcucugcauauaaaccaagggcagaauguuucacccugaucuuaugggaggaauc

SEQ ID NO: 304644 - RNA, 65 nt, hsa
aaaagggaagucuugagguuuuagaggugugaauuauguuucaucaaugugcagaauaaucacaa

SEQ ID NO: 304645 - RNA, 65 nt, hsa
agaauuauuuuucaauuuuauuuuaguucuaaauuauguuucagaaacaaaagacaaugcuguac

SEQ ID NO: 304646 - RNA, 65 nt, hsa
aaaaugaaacuuaauagcucacaaaauuccaguccauguuucaugacuuauuuuagucaaugaau

SEQ ID NO: 304647 - RNA, 65 nt, hsa
aguguccccuuuucuggcauaaaucaacuaugaauauguuucaagcaucacaagacaaccuuuuc

SEQ ID NO: 304648 - RNA, 65 nt, hsa
uauguaaacaagagauuuggcaugacauguucuguauguuucagggaaaaaugucuuuaaugcuu

SEQ ID NO: 304649 - RNA, 65 nt, hsa
cuggauaauugcuugauucucgccagagacugucaauguuucauucauugccauuaccaauaaau

SEQ ID NO: 304650 - RNA, 65 nt, hsa
ugaaaaucucuguacagauugcagucuucuuccugauguuucaaacugugguucccccaagcucu

SEQ ID NO: 304651 - RNA, 65 nt, hsa
cccuuaauaaguccucaauucuuaacagauauaagauguuucauacuggagcgaaacuacaaucc

SEQ ID NO: 304652 - RNA, 65 nt, hsa
acacaacagagaaacccuauaaagaaugauacaauauguuucaaucagaaccuucacauccaaua

SEQ ID NO: 304653 - RNA, 65 nt, hsa
uucuuuugagaaaugccuguucagcuacuuugcccauguuucaaguaguuuuugguuucuugcug

SEQ ID NO: 304654 - RNA, 65 nt, hsa
gucauggauuucuuaguguauuugggggaagggaaauguuucaagguaaagaaccuugacccuuu

SEQ ID NO: 304655 - RNA, 65 nt, hsa
ugucauccccuccuuauuuuauuugggagagggaaauguuucagaaacaaaagggccucaucccc

SEQ ID NO: 304656 - RNA, 65 nt, hsa
ugucgucccuuuguuauuuuaugugggagagggaaauguuucagaaacgaaagaucucauccccu

SEQ ID NO: 304657 - RNA, 65 nt, hsa
gacacauuguccacuucagaugcuuguuuaaaaaaauguuucaccaugugucuuuacccaauaca

SEQ ID NO: 304658 - RNA, 65 nt, hsa
aacugcuauauuugaaugcaguuguucauguagguauguuucacuaugguaauaugguggugugc

SEQ ID NO: 304659 - RNA, 65 nt, hsa
ugucugugucccauccugcuguccuucuguccuggauguuucaugggcccggggccccccaggga

SEQ ID NO: 304660 - RNA, 65 nt, hsa
uuauuggagugauggauuuggugccauggucuauaauguuucaugcauccauacuucuguuuuug

SEQ ID NO: 304661 - RNA, 65 nt, hsa
cuguaauauauauauauauauauaaaaugaaauauauguuucauuuuagagaaauaacuauuacu

SEQ ID NO: 304662 - RNA, 65 nt, hsa
gaauauaucuugcucuauagaggauuuuuuuuuguauguuucaagcuucagccuuuaaccuauac

SEQ ID NO: 304663 - RNA, 65 nt, hsa
ccggguucccagagcuccgaggaaacugauccuucauguuucaauagcuguuguuguuuuucucu

SEQ ID NO: 304664 - RNA, 65 nt, hsa
aauuuuuuuauugagaauaaauuuucuaaaauuacauguuucacugaaaccagugaaauauuuca

SEQ ID NO: 304665 - RNA, 65 nt, hsa
auaauuuucuauuugaaaaugugcugauucuuggaauguuucauucuccagauuuaugaacauuu

SEQ ID NO: 304666 - RNA, 65 nt, hsa
ucauguauaaaugccauguggagauagagccccagauguuucagccaucucagcccaggcaccag

SEQ ID NO: 304667 - RNA, 65 nt, hsa
uguccugaaaaaugcucaaucucagcuaacauuccauguuucagaagcauucaggcacugccagg

SEQ ID NO: 304668 - RNA, 65 nt, hsa
uauuuguaggcagucaguuaccuucaccuuaugaaauguuucacugaguuauuugagguuuuuug

SEQ ID NO: 304669 - RNA, 65 nt, hsa
uuuuuccuucaccauuuaucauuucauagucauuuauguuucaucgguccucauguguacuagug

SEQ ID NO: 304670 - RNA, 65 nt, hsa
gcuggcauucugcauguuuagugauugucuugggaauguuucacugcuacccgcauccagcgacu

SEQ ID NO: 304671 - RNA, 65 nt, hsa
gaauauuuucacuguuccuucuuucuuaaagucuuauguuucacucuuuaacucaaauguauucu

SEQ ID NO: 304672 - RNA, 65 nt, hsa
auucaucaaguuaucuuuauaaucacuguaguuagauguuucauguccauucaagugacuuuuau

SEQ ID NO: 304673 - RNA, 65 nt, hsa
gugcuaggaucauuggauucaguucccaaaauagaauguuucagugagaccaugagaauuccagg

SEQ ID NO: 304674 - RNA, 65 nt, hsa
uuccuuuaaaugucccauggauguaggacagugccauguuucaagaugccugugagcuaggucuu

SEQ ID NO: 304675 - RNA, 65 nt, hsa
cuguaaaaaggcagaccagggauguaauguuuuuaauguuucagaagccuaacuuuuuacacagu

SEQ ID NO: 304676 - RNA, 65 nt, hsa
ugcaguacuugauuuaggaucuguggugcagggcaauguuucaaaguuuagucacagcuuaaaaa

SEQ ID NO: 304677 - RNA, 65 nt, hsa
uaacauuaacuucuaaagaaguuuuuucuaagaaaauguuucaaggcaauauuuuuuuugaggcu

SEQ ID NO: 304678 - RNA, 65 nt, hsa
ccacuaaacuuuuguguccauauuuuacugagaccauguuucauuaaaagcauaguuucauagua

SEQ ID NO: 304679 - RNA, 65 nt, hsa
uucaacacucgugaggccaggaagcuauuaaagggauguuucaagcuguuucuagcacauuccaa

SEQ ID NO: 304680 - RNA, 65 nt, hsa
aauguagcuuucucucuuaccuucuggaagagggaauguuucauuuauuacuguuugauuuucuu

SEQ ID NO: 304681 - RNA, 65 nt, hsa
agcucuuuuuccaaggcccggaguacuggggauugauguuucaaggccaaucaaugggaugcuuc

SEQ ID NO: 304682 - RNA, 65 nt, hsa
gacaaaggauuugagauguucucaauaaaaagaaaauguuucacuacucugguguugcugagacu

SEQ ID NO: 304683 - RNA, 65 nt, hsa
caaccaagacuaaguuuuaaauccagaagagagaaauguuucacgcaagcagucccccaacuccc

SEQ ID NO: 304684 - RNA, 65 nt, hsa
ugaaaugacuccuacaauugaggguugugugaaagauguuucauaccaaggaggcaaaucuauaa

SEQ ID NO: 304685 - RNA, 65 nt, hsa
auagaugaauuuauuuuauuucuaaagguauucaaauguuucagcaccauauaauagaaauaccc

SEQ ID NO: 304686 - RNA, 65 nt, hsa
ccaaucggugucucaggccacugggcccuuaguggauguuucagacgcucggccgggaacgagug

SEQ ID NO: 304687 - RNA, 65 nt, hsa
auaugugauuuucucuaauguaacuuccucuuaggauguuucaccaaggaaauauugagagagaa

SEQ ID NO: 304688 - RNA, 65 nt, hsa
cuuacaguucucugcguucgucacuuaauuccugaauguuucagagaaacaggaaucagaaaaua

SEQ ID NO: 304689 - RNA, 65 nt, hsa
gcccagcaagaagggcuuggguucugaggaagcagauguuucaugcugugaggccuugcaccagg

SEQ ID NO: 304690 - RNA, 65 nt, hsa
cuggcucaaaauggacaagaagguacuggaucaugauguuucaaaggaagaaccagucaccuuuc

SEQ ID NO: 304691 - RNA, 65 nt, hsa
cuuuuaguugaaugccacugaagagcugugauagcauguuucaaagcugaacucuacagagcgag

SEQ ID NO: 304692 - RNA, 65 nt, hsa
acgacagagacguggcauuuggaaacgaaacuuagauguuucauggagcuuauuuugagaacuuu

SEQ ID NO: 304693 - RNA, 65 nt, hsa
auggacaaauugacugcaauguaauacuagcugguauguuucauaaaugucaagcuguggaccaa

SEQ ID NO: 304694 - RNA, 65 nt, hsa
gacaaauuccucuuugaugaauguacccuguggggauguuucauacugacagauuauuuuuauuu

SEQ ID NO: 304695 - RNA, 65 nt, hsa
auuggacagucucaccuccugccauaggguccugaauguuucagaccacaaggggcuccacaccu

SEQ ID NO: 304696 - RNA, 65 nt, hsa
augccagaaaagugaaguccuagguguuuccaucuauguuucaaucuguccaucuaccaggccuc

SEQ ID NO: 304697 - RNA, 65 nt, hsa
uccaucagaucuucucaccuugauuuugagcuggaauguuucaaugagcaaaauaaauuagacaa

SEQ ID NO: 304698 - RNA, 65 nt, hsa
gccauugcuguaaaucuuaaaaugaaugaauaaaaauguuucauuuuacaagaggaguguaugau

SEQ ID NO: 304699 - RNA, 65 nt, hsa
auugugacauagauuauacuacuacuaauuuuuggauguuucaaaaggucaagaaguaaaagaug

SEQ ID NO: 304700 - RNA, 65 nt, hsa
agagagccagagacaguguugcaacugggccuggcauguuucagugugguguccagcagugucuc

SEQ ID NO: 304701 - RNA, 65 nt, hsa
uuuuuccauaguaaauugucuugcaguuuuugaaaauguuucaagucuaguuuuuacaagcacau

SEQ ID NO: 304702 - RNA, 65 nt, hsa
gacuugaugagauugaaacauggcuuuuggcaugaauguuucauagguuauguuguguucauuua

SEQ ID NO: 304703 - RNA, 65 nt, hsa
guugugaucuuuccuguccugacccucucugaauuauguuucaauaguacucuugauugucugcc

SEQ ID NO: 304704 - RNA, 65 nt, hsa
ucuuuucauauuuaguucugguguggugucuggaaauguuucaacuguuuuaauauauugucuga

SEQ ID NO: 304705 - RNA, 65 nt, hsa
gcguuuugacccaccugccaguguuugcuugcucuauguuucaguagcagauuuucacacaugug

SEQ ID NO: 304706 - RNA, 65 nt, hsa
aauuuaaaaagguacuuaaauuuucuggaauauccauguuucagagguaauauuuacuuucuauu

SEQ ID NO: 304707 - RNA, 65 nt, hsa
aguccaauuagaaaaugggcaaaagacaugaauagauguuucacugaagaggaucuauagauggc

SEQ ID NO: 304708 - RNA, 65 nt, hsa
gagaaauuugugaaaaauauauuguauuucuuuugauguuucaaaagguugccuaugaaaaacug

SEQ ID NO: 304709 - RNA, 65 nt, hsa
gcuuauagucuuccaguuuaaugaacuaccaucugauguuucauauuuaaguguauuuaaagaaa

SEQ ID NO: 304710 - RNA, 65 nt, hsa
caaagaggcugaugucuuuguuuuuguuuuuuuuaauguuucagguucuaagugaagugaguugg

SEQ ID NO: 304711 - RNA, 65 nt, hsa
guucuguauuuuucuuguaguguuaguuaaaacauauguuucaaaaauauaagaaaaguucaaaa

SEQ ID NO: 304712 - RNA, 65 nt, hsa
ugauauuguauauguuuugucccaguuguauaguaauguuucaguccaucauccagcuuuggcug

SEQ ID NO: 304713 - RNA, 65 nt, hsa
guuuuaguauuguauuccaaguugauaacucuuccauguuucacauuucuaaauuuaacagagau

SEQ ID NO: 304714 - RNA, 65 nt, hsa
aguuugauugcagacacuguagaacauaacucauuauguuucagauaagguaacuccuagauauc

SEQ ID NO: 304715 - RNA, 65 nt, hsa
caaagacuucauuuguguaucaucaauaaaguuguauguuucaacugacaaaaagucguucuaau

SEQ ID NO: 304716 - RNA, 65 nt, hsa
auguucuuuaaaaucguuaauguauaacagggcuuauguuucaguuuguuuuccguucuguuuua

SEQ ID NO: 304717 - RNA, 65 nt, hsa
guuguuuauuauccugaucaagcauggaacaaagcauguuucaggaucagaucaauacaaucuug

SEQ ID NO: 304718 - RNA, 65 nt, hsa
uaagaagcuguuuugcuaaauuauuuuuacuuggaauguuucaaacagauuucaggcugcaaacu

SEQ ID NO: 304719 - RNA, 65 nt, hsa
cugaaaccaacuugucccaggccacaggaguguauauguuucauaaucuuuaucaagaaguuugu

SEQ ID NO: 304720 - RNA, 65 nt, hsa
ccuacuuccaccuaaucuguuuacagucuuuugguauguuucaguuacuuagauggucucauaag

SEQ ID NO: 304721 - RNA, 66 nt, hsa
caguggauuugcuuuaacccucacauuuuuuuuuuaauguuucacauguuacauuauuagcugaau

SEQ ID NO: 304722 - RNA, 66 nt, hsa
cagggcagucuggcgcccaugaugggagggauugacauguuucaacaaaauaaugcacuuccuuac

SEQ ID NO: 304723 - RNA, 66 nt, hsa
cauuuuucuuaaauccaaguuggccguuuuauuaguauguuucaaauguguauuaccaaugugggu

SEQ ID NO: 304724 - RNA, 66 nt, hsa
auuaauaucuccaugcauaguuuuagacaaaaaaagauguuucaauaaaauuacugucuuguaaua

SEQ ID NO: 304725 - RNA, 66 nt, hsa
gaacucaaccaauuuggcaccccaugcagccucaaaauguuucaaaugccuaccgccucuagaucg

SEQ ID NO: 304726 - RNA, 66 nt, hsa
cuuggcuucuuuucucccuugauggucaagucucuuauguuucaauauuucuuaacuggggugucu

SEQ ID NO: 304727 - RNA, 66 nt, hsa
caaaugucaugaaugauuuccaguuuuuaaagcuauauguuucacugcuucauaucucuguccacu

SEQ ID NO: 304728 - RNA, 66 nt, hsa
gcacgcacacaugauuuugauuaugcuacaugauauauguuucaaaaagaauuagcauagaaaucc

SEQ ID NO: 304729 - RNA, 66 nt, hsa
ccuagguaggggauugcugggccauaugauaagcauauguuucaguucuaccaaucuuguuuccag

SEQ ID NO: 304730 - RNA, 66 nt, hsa
aacagaaaaacauuaaaaaguucauuccuuaacacaauguuucaaguuaaaccuuuugugucaccg

SEQ ID NO: 304731 - RNA, 66 nt, hsa
guguuugauaaauauccucucaguguuuuaucuuccauguuucaacaacuauugaaauaugaaaug

SEQ ID NO: 304732 - RNA, 66 nt, hsa
cuggguuucucuguauaguacuggcaugguacggagauguuucacgaaguuuguucaucagacucc

SEQ ID NO: 304733 - RNA, 66 nt, hsa
aaugugcuugccugaaauaaagcuaauaaaaauauuauguuucacauuaucuucuguucauuuuga

SEQ ID NO: 304734 - RNA, 66 nt, hsa
aaaaaaaugcaaaucgacuuuuuaacaacuguugagauguuucaugggacaguagaacucugacuc

SEQ ID NO: 304735 - RNA, 66 nt, hsa
caccacgcuugguuaauuuuuguauuuuuaguagagauguuucaccauguuggccaggcuagucuu

SEQ ID NO: 304736 - RNA, 66 nt, hsa
cugccggguguuguauguguggugacuugcggauuuauguuucaguguacuggaaacuuuccauuu

SEQ ID NO: 304737 - RNA, 66 nt, hsa
cugugauuuuguaaauuucaguaauucauuuaaaugauguuucaguagauauauucuagcauauua

SEQ ID NO: 304738 - RNA, 66 nt, hsa
aaaauccaaaauuaugauaacuguauuucuagggguauguuucaccuugauuuuggcccgguucuu

SEQ ID NO: 304739 - RNA, 66 nt, hsa
acccuacuugguaacaaaguucucagauguuaggucauguuucauuugcucagucggggaucacuc

SEQ ID NO: 304740 - RNA, 66 nt, hsa
uuuuagcaggugaacuguuccaagacugacacaaggauguuucaaacuugccucugucuguagaaa

SEQ ID NO: 304741 - RNA, 66 nt, hsa
auacguauuauauagagaaacaaauguuuuuauuaaauguuucauugacccaaguaauuuaaaagu

SEQ ID NO: 304742 - RNA, 66 nt, hsa
acuguuuuucauacucuuaaguguaaauaauauaaaauguuucaagcgcuuaacucccccucauuc

SEQ ID NO: 304743 - RNA, 66 nt, hsa
uuuuagagcuuuagaaauuuguaagcugagagaacaauguuucacuuaauaggagggugucuuagu

SEQ ID NO: 304744 - RNA, 66 nt, hsa
acuuacucuuucuuuuaagauaaguuguagacuucgauguuucaugcucauguacuucaaauaaug

SEQ ID NO: 304745 - RNA, 64 nt, hsa
cuugaaaucuguuaaaauaaaauuguacauuuggagauguuucaugaugauguguuuauuucua

SEQ ID NO: 304746 - RNA, 66 nt, hsa
aggaaacuugugacuuguguauuaucgucauugaggauguuucacucaugucugucauuuuauaag

SEQ ID NO: 304747 - RNA, 66 nt, hsa
agcaugguaaguucccuuagcuauaugaauuuuggcauguuucagagagaucaguaaauaaaauau

SEQ ID NO: 304748 - RNA, 66 nt, hsa
uaaaugcggagacguaaagcauuaaugcaaguuaaaauguuucagugaacaaguuucagcgguuca

SEQ ID NO: 304749 - RNA, 66 nt, hsa
gaucuagaaaacuuuggauuuuugaaguaaauuuuaauguuucauauuaauuucuugaaaauguau

SEQ ID NO: 304750 - RNA, 66 nt, hsa
uggagacucagaaggggaagcauugggaaaccauguauguuucauuucugguuuaaccaggcuuuu

SEQ ID NO: 304751 - RNA, 66 nt, hsa
cuaucuauauggaauugcuuaccaaaggauagugcgauguuucaggaggcuggaggaagggggguu

SEQ ID NO: 304752 - RNA, 66 nt, hsa
gcaagucaacuuaccuauuaaauauuccucuauuagauguuucaacacuauaauuuaauugggaaa

SEQ ID NO: 304753 - RNA, 66 nt, hsa
uauuucuaugacaaauucaagagcuagaaaaauaaaauguuucauuaugcacuuuuagaaaugcau

SEQ ID NO: 304754 - RNA, 66 nt, hsa
ucugugacaccaaaaagaaaagucuauaaccugaaaauguuucauguucucugcugugaaacucuu

SEQ ID NO: 304755 - RNA, 66 nt, hsa
cacuuugucguguuuguuuuaacuucuaaagaaaauauguuucagcauuauaagaaaggcagaaug

SEQ ID NO: 304756 - RNA, 66 nt, hsa
gaggaaacaugcucagucaugcacauguguugacccauguuucagaugcagucugaugccagguau

SEQ ID NO: 304757 - RNA, 66 nt, hsa
guguguuuauucuuuugcuucuccccaauaaagcacauguuucauggucaagcccacauugcuuuu

SEQ ID NO: 304758 - RNA, 66 nt, hsa
auaaaggcaaaccuggcuuuugauuaccauguguggauguuucaguguccuuucuucucugucccu

SEQ ID NO: 304759 - RNA, 56 nt, hsa; identical to SEQ ID NO: 303635

SEQ ID NO: 304760 - RNA, 66 nt, hsa
cuccuagauacuauuacgcuaucuuguuugggaaugauguuucauagguuugugaugaucuuuacg

SEQ ID NO: 304761 - RNA, 66 nt, hsa
uauaauccuagaccuuuucaugacguguaaaaaaugauguuucauccucugauugccccaauaaaa

SEQ ID NO: 304762 - RNA, 66 nt, hsa
uugagcaucccuugucugaaaugcuugggauuagaaauguuucagauuucaauuuuuuuucagauu

SEQ ID NO: 304763 - RNA, 66 nt, hsa
gccaccgugccuagccaaggaugagauuuuuaaaguauguuucaguucugugucaugguuggaaga

SEQ ID NO: 304764 - RNA, 66 nt, hsa
aaaauccacaauuaaaccauguuucucacuuuucacauguuucauagcaacugcuuuauaugacug

SEQ ID NO: 304765 - RNA, 66 nt, hsa
caccuaacccugauaguuaccuaaagugacacuuaaauguuucagagugaaugcaaaaaagagaga

SEQ ID NO: 304766 - RNA, 51 nt, hsa; identical to SEQ ID NO: 303642

SEQ ID NO: 304767 - RNA, 66 nt, hsa
gcugacaaaaccugggaauuuggguuguguaugcgaauguuucagugccucagacaaauguguauu

SEQ ID NO: 304768 - RNA, 66 nt, hsa
uaaugugucucaggcucaaguuuuuauaguuauuaaauguuucaaaauagacaaguuuuguuuccu

SEQ ID NO: 304769 - RNA, 66 nt, hsa
aguugaguuauuccacaaacacauuauaaaguucagauguuucaucaaugcaguucucacgaaagu

SEQ ID NO: 304770 - RNA, 66 nt, hsa
uccuaacaaacaaaagaaauguaguucagcuuuucaauguuucauguuugcugugcuuuucugaau

SEQ ID NO: 304771 - RNA, 66 nt, hsa
uuuacuuucugcugugaacugaacugcagcuauagaauguuucaaaugcuuaaauauauaauacau

SEQ ID NO: 304772 - RNA, 64 nt, hsa
caauugaauguagauacucagaagaaauaaaaaaugauguuucacucugugucuguuuuuaauu

SEQ ID NO: 304773 - RNA, 66 nt, hsa
ugcuuauugaugugcugugauaugagggaaucugaaauguuucauaaaaauaaagcuuaaaaauug

SEQ ID NO: 304774 - RNA, 66 nt, hsa
aaaaacauuguagauaucuauuuauauuuaaaguuuauguuucaugaacugcagcugcaggauucu

SEQ ID NO: 304775 - RNA, 66 nt, hsa
ugagccuuuuaaguaguuugaaugauaagacuuaaaauguuucauaauuauguuuuauguaacaga

SEQ ID NO: 304776 - RNA, 66 nt, hsa
cccuguacugauaguacuucccaguaugauauugugauguuucauacaaugcagugaacauaacca

SEQ ID NO: 304777 - RNA, 66 nt, hsa
gccucuuaacuaauugcgguuucauaggauauauaaauguuucaagccauuauugcugaaugguuc

SEQ ID NO: 304778 - RNA, 66 nt, hsa
uuuauguaagcauguauacacugugcuaaaagucacauguuucaguuuguguauaauauuaauaug

SEQ ID NO: 304779 - RNA, 66 nt, hsa
aagaacaggaaaaaauaauuauaagaugauaagcaaauguuucagcccaaugucaacccaguuaaa

SEQ ID NO: 304780 - RNA, 66 nt, hsa
gccgcugccauaguuuucuaacuugaacagccaugaauguuucaugucucccuuuuuuuuugucua

SEQ ID NO: 304781 - RNA, 66 nt, hsa
guccauguuguccuuucuggcuucccugauggugucauguuucagcgcaugcgccccagccuuucc

SEQ ID NO: 304782 - RNA, 66 nt, hsa
gaaugaauccuugugguuuuuaguuuuguauaaauuauguuucaaaucuuuacauuuuggaaauaa

SEQ ID NO: 304783 - RNA, 66 nt, hsa
cuuacuuuuuggggaaguaaaagaagauggaaauggauguuucauuuguaugaguuuggagcagug

SEQ ID NO: 304784 - RNA, 66 nt, hsa
caucuauucuuucccuagaggcaaacauuucuuaaaauguuucauuuucauuaaaaaugaaagcca

SEQ ID NO: 304785 - RNA, 66 nt, hsa
gguaccauaccaacuggaauuuaggcuuuaaaaauaauguuucaaggccagguguggugauucaug

SEQ ID NO: 304786 - RNA, 66 nt, hsa
uucuuuuguguauuuauacuuguauguaugauuugcauguuucaaugauaaagggauaaaacagua

SEQ ID NO: 304787 - RNA, 66 nt, hsa
ggaccauagauugcugucccccucgacggacuuauaauguuucagguggcuggcuugaacaugagu

SEQ ID NO: 304788 - RNA, 66 nt, hsa
uaucugcuaaguuguaccuuaauuagagggcaauauauguuucauaaagaagagucuuuauaauuu

SEQ ID NO: 304789 - RNA, 66 nt, hsa
acuaguugaccuagauuguauuaauagcuacuuaagauguuucaaagauaggaagcuauugcuugg

SEQ ID NO: 304790 - RNA, 66 nt, hsa
caaaagggagagaacaaaagcuauaccaaaagggccauguuucaagaaaauggauuuaaacauauu

SEQ ID NO: 304791 - RNA, 66 nt, hsa
uuccaaucagaccagguaggagcuuuccuguuucauauguuucaggguugcacaguuggucucuuu

SEQ ID NO: 304792 - RNA, 66 nt, hsa
aguggcaugaaaauuuucuuaagcuaaaauacagacauguuucaaagggcuaaaguuggagaugag

SEQ ID NO: 304793 - RNA, 66 nt, hsa
uauacuaaaggauauacauauacugccucuucuaugauguuucauuugaccuacaccaucagcauc

SEQ ID NO: 304794 - RNA, 66 nt, hsa
uugacuuuugaaaacaaaauaugaaaagaaucggcaauguuucaaacaaaaagucauaaaagucac

SEQ ID NO: 304795 - RNA, 66 nt, hsa
ugauggcuacaucuguaucuuuuccuccuguguuuaauguuucacuagggagaggaaauaaagcag

SEQ ID NO: 304796 - RNA, 66 nt, hsa
guuguuuuuuuuauuauaaaacuugcccuucauuacauguuucaaagugguguggugggccaaaau

SEQ ID NO: 304797 - RNA, 66 nt, hsa
ugcucugcuucaauguagucagaauuagcugcuucuauguuucauaguuggggucauagauguuuc

SEQ ID NO: 304798 - RNA, 66 nt, hsa
auguuuacauuggauaaaggauuaggcaaaaauaaaauguuucaaggauuccugaccauaagugac

SEQ ID NO: 304799 - RNA, 66 nt, hsa
uaccacacagacugcucuccaaucccugagucucagauguuucauuuauuuccuacuuuuccacua

SEQ ID NO: 304800 - RNA, 66 nt, hsa
cagaaauuauaucuguuuuggagcaagagugucauaauguuucaggguagucaaaauaaacauaaa

SEQ ID NO: 304801 - RNA, 66 nt, hsa
auacucaguaggaacuuuuugaaauagggcaaguuuauguuucaugcgagaaaacaugaaggaggg

SEQ ID NO: 304802 - RNA, 66 nt, hsa; identical to SEQ ID NO: 304785

SEQ ID NO: 304803 - RNA, 66 nt, hsa
cgaagagacaaucucuggcaaguuuuuguagaaaaaauguuucagugccuagucugaaaaauaaca

SEQ ID NO: 304804 - RNA, 66 nt, hsa
aaaauucugaaaaauacauuucuauuuauagaauaaauguuucauuuauauaaaagcaaaagaacu

SEQ ID NO: 304805 - RNA, 66 nt, hsa
cucugcguccuggguagucugugcuuguaauccagcauguuucacagaguaagccuguugugacuu

SEQ ID NO: 304806 - RNA, 66 nt, hsa
aauguaacauuaauucuacuaaauauuuuauaugaaauguuucacuaugauuuucuauuuuucuuc

SEQ ID NO: 304807 - RNA, 57 nt, hsa; identical to SEQ ID NO: 303683

SEQ ID NO: 304808 - RNA, 66 nt, hsa
uuuguguuauuuuuucuuaucaaacaauuagauguuauguuucauauuauuugauauuuauuuuca

SEQ ID NO: 304809 - RNA, 66 nt, hsa
uuauuuaauuuuguuucauuuuguuuucauaagacaauguuucagauauguaauggggcaaaccac

SEQ ID NO: 304810 - RNA, 66 nt, hsa
ggccucccacugggagucaucgcugagaagaugccaauguuucauccaccggcugcacaggcacaa

SEQ ID NO: 304811 - RNA, 66 nt, hsa
auaaauauauauuauauaaauauauuaaaaaggaaaauguuucagauguuuauuuguauaauuacu

SEQ ID NO: 304812 - RNA, 66 nt, hsa
caauuauaaccaaaaacaaugugacggauacccaagauguuucauguuguagcuugggugaauuac

SEQ ID NO: 304813 - RNA, 66 nt, hsa
uuaauuuuuaauaacaugcaugggucccucucacuaauguuucaacaauagggaaaaaugagaacu

SEQ ID NO: 304814 - RNA, 66 nt, hsa
ccugguguagaauuuacacugcugcaccugaggucgauguuucaaaguaagaucaagccaguguuu

SEQ ID NO: 304815 - RNA, 66 nt, hsa
gucaagugacauuucaaaagaaguucuauaacaauuauguuucaugcuuaaaguaaaaauucccag

SEQ ID NO: 304816 - RNA, 66 nt, hsa
cuauuaaucaugcaguguacaauucaaaaucaugcaauguuucacuuuagaauuggauuugaagaa

SEQ ID NO: 304817 - RNA, 66 nt, hsa
ucauucaaauggcaguagccuuggcucacauaagacauguuucaugugaucuguauccuggcauac

SEQ ID NO: 304818 - RNA, 66 nt, hsa
agcaugcauguauaggccgaacuauuaucagcucugauguuucagagagaagaccucagaaaccga

SEQ ID NO: 304819 - RNA, 66 nt, hsa
acacauguaaagaauauaugagccuuguauggagugauguuucauuuaccuggguuguguuaauga

SEQ ID NO: 304820 - RNA, 66 nt, hsa
gauacuguuggucuagccugugaagcaauuaaucgaauguuucagaaggagcagagugaauuagua

SEQ ID NO: 304821 - RNA, 66 nt, hsa
ccuauggacuggcuuaagccguguggcauccgaggaauguuucaaaugugucuguguuucucuuua

SEQ ID NO: 304822 - RNA, 66 nt, hsa
cacaggacauuaauaaugguguacuuuaaaaaauauauguuucauuuaaucuucacaaaagaucug

SEQ ID NO: 304823 - RNA, 66 nt, hsa
gcugccuccgccgccacugcugcugccaccucuuauauguuucagacacucucugcccagacucau

SEQ ID NO: 304824 - RNA, 66 nt, hsa
uaaaaaauaacuauaucauaacucauucauaacuugauguuucauuuucuguugaggaaccauaaa

SEQ ID NO: 304825 - RNA, 66 nt, hsa
aaauauuaaaugauuuagcagucuccacguguguuaauguuucaaacguguaucauaauguguaua

SEQ ID NO: 304826 - RNA, 66 nt, hsa
aaauuaugauauggacguuaucauuggucuggugagauguuucauauuugugacaguuaauuuaaa

SEQ ID NO: 304827 - RNA, 66 nt, hsa
uugccaacugccaagccauacuuauuaaguucgaacauguuucacuuaaggagagacaccuagcuu

SEQ ID NO: 304828 - RNA, 66 nt, hsa
uccaagaagucuugggauuggauuuuaccauaugaaauguuucauauugaaaacacaagaugaccu

SEQ ID NO: 304829 - RNA, 66 nt, hsa
uuuuagugaagaaacaaguucucggguggggaaucuauguuucacucagauuuauauguuuggagg

SEQ ID NO: 304830 - RNA, 66 nt, hsa
ucacuuggacguuucauuuugaaagaaagaaauuuuauguuucacauauaguuuuauacaaaguag

SEQ ID NO: 304831 - RNA, 66 nt, hsa
cugaauaaaucaugccacuauauuaauuuauauuacauguuucauauuuaaaucauguuuuccuaa

SEQ ID NO: 304832 - RNA, 66 nt, hsa
guaauucaucacauaguaucuuaaagggaacaaauaauguuucauccuauggaaaugugaaggaug

SEQ ID NO: 304833 - RNA, 66 nt, hsa
auuuuauaaguuguaugcauaaacauaagauuuguaauguuucauuuauaaacugccuucuucaac

SEQ ID NO: 304834 - RNA, 66 nt, hsa
guuugaaucuaccauucauagccagauguguaucagauguuucacugacaguuuuuaacaauaaau

SEQ ID NO: 304835 - RNA, 66 nt, hsa
gcuuauaauaccuuuuccuuguguguaauuauacuuauguuucaauaacagcugaaggguuuuauu

SEQ ID NO: 304836 - RNA, 66 nt, hsa
uggaugugaugggucuaguccaguuuauuuaaguucauguuucacuguuugcacuuugcauugaac

SEQ ID NO: 304837 - RNA, 66 nt, hsa
aaugagaacuugggaauguuuaagaagaaaucaaacauguuucaggaaaaggaaaucuauggagua

SEQ ID NO: 304838 - RNA, 66 nt, hsa
aguguaacuaggggcuguguuucugcauuaaaauaaauguuucaggcuuugugguccugaucaagg

SEQ ID NO: 304839 - RNA, 66 nt, hsa
ucguaccagcugaauagcccagcuugcaguauaguuauguuucagucugcaguguguuuagcauuc

SEQ ID NO: 304840 - RNA, 66 nt, hsa
gcccaggucacccuguggcaggccugggcccucaggauguuucaaaggcuccacagcuccaccgcu

SEQ ID NO: 304841 - RNA, 66 nt, hsa
ucuuuagaaugcucuuuugcauguaaagcacaaaguauguuucaguuuaaaugcacuucuuccggu

SEQ ID NO: 304842 - RNA, 66 nt, hsa
uuuaguuagauauugacuuuaucuuuaggcuuuuguauguuucagaugcaaacauauuaaaguuuc

SEQ ID NO: 304843 - RNA, 66 nt, hsa
cugaccuuagaacaugagagaguggaaaaccucaggauguuucagccaaacaagaagagaagaaaa

SEQ ID NO: 304844 - RNA, 66 nt, hsa
auguuauauuaaccucuuccuacuuuaaagugugaaauguuucaccucagcuguacaaacuccagc

SEQ ID NO: 304845 - RNA, 66 nt, hsa
gauuaugugauguuggaaagcucauugauuuuguauauguuucagcguguuaccuuucuggcuucc

SEQ ID NO: 304846 - RNA, 66 nt, hsa
gugacuauucaguuuucaggaugauacacuaugaagauguuucaaaaaaucugaccaaaacaaaca

SEQ ID NO: 304847 - RNA, 66 nt, hsa
guauuccccucaguucaucuuuaccaaagacacucuauguuucauuaaucucaacuggcagcaaua

SEQ ID NO: 304848 - RNA, 66 nt, hsa
cuuagaacuaucuugguugcaaaggguaggucucuaauguuucaucaauaaaugugauguuucuag

SEQ ID NO: 304849 - RNA, 66 nt, hsa
cucugcaucaguugcuucuauagagcaucagcccucauguuucauugucuuaaugucggggagcag

SEQ ID NO: 304850 - RNA, 66 nt, hsa
uuuaaaaaagcaaaugaggcaaugugucaaaauuuaauguuucauaauaaaaauagauacguugac

SEQ ID NO: 304851 - RNA, 66 nt, hsa
gaucacuguuucucucaacacuauuuaaucugaaaaauguuucaguacaaaccacuguuugaacua

SEQ ID NO: 304852 - RNA, 66 nt, hsa
guuaaauucagaauaucucuaaaacauggaaaauugauguuucaauaaaaagggagacauuuuauu

SEQ ID NO: 304853 - RNA, 66 nt, hsa
gucccauucugccccuguacauguuuccuaccaagcauguuucacauuuuccuauuaguggaggag

SEQ ID NO: 304854 - RNA, 66 nt, hsa
gcaaauugccuauaaauugacucuacuaaaauaacaauguuucagucugaaaauuugaauugaaaa

SEQ ID NO: 304855 - RNA, 66 nt, hsa
guguaguguacauuguaaaacucagauauugucaugauguuucacuuggacauaagacuuauuaau

SEQ ID NO: 304856 - RNA, 66 nt, hsa
ucuccugaccuugaaucacaagagucuuaacagggaauguuucaggaaacaaauaggauaagacaa

SEQ ID NO: 304857 - RNA, 66 nt, hsa
caauauuuuuauauuaaaguacuauacuaggagagaauguuucagaacucccugaugaauuucuaa

SEQ ID NO: 304858 - RNA, 66 nt, hsa
caaaugaauaauuccugcuauucugaaauugccuacauguuucaauaccaguuauauggagugcuu

SEQ ID NO: 304859 - RNA, 66 nt, hsa
acauguaguuuaauaaaguuccuguuuaugagagucauguuucaucucagcuucuuccauggaugu

SEQ ID NO: 304860 - RNA, 66 nt, hsa
cuaagcugugcaaccugugaagccaagagugaacugauguuucauuuauauuuucauccaaaugac

SEQ ID NO: 304861 - RNA, 66 nt, hsa
uuggauccugugcuuaccuuuuccugcuguacucugauguuucagugaagcucauccacgaagucc

SEQ ID NO: 304862 - RNA, 66 nt, hsa
accuccagaucagauggggacacacaaccccuggauauguuucauugucagauuuugugcuugauu

SEQ ID NO: 304863 - RNA, 66 nt, hsa
acacaucagccucacugagcuaauaaagggaaacgaauguuucaaaucuacuucugcuuuucuuau

SEQ ID NO: 304864 - RNA, 66 nt, hsa
guuagagacagcccagucucuucugguuuaaucauuauguuucaaauugaaacagucucuuuugag

SEQ ID NO: 304865 - RNA, 66 nt, hsa
uauccucaugccuucaggaaagacuuaacaaaaacaauguuucaucuggggaacugagcuaggcgg

SEQ ID NO: 304866 - RNA, 66 nt, hsa
guuggacuauguuugugaacauaauugucauaaguuauguuucagauuuuugaauuuauuuauaug

SEQ ID NO: 304867 - RNA, 66 nt, hsa
aaaugguuuucaacaagccugaaaguaauuucaagaauguuucaguuauagagguaaaauuugcac

SEQ ID NO: 304868 - RNA, 66 nt, hsa
aaaaguuaccccacacaaaaguuacugagcuuccuuauguuucacacauuguauuugaacacaaaa

SEQ ID NO: 304869 - RNA, 66 nt, hsa
auuaacugagaaggcuguggauuuaauguggaaaugauguuucauaagaauucuguugauggaaau

SEQ ID NO: 304870 - RNA, 66 nt, hsa
uuuaugcuuggagcagucaguacauaccaguuucugauguuucaggcaggagugggguaaauaagu

SEQ ID NO: 304871 - RNA, 66 nt, hsa
ucuugacauguuuauuucuacccuuaaugcaaugaaauguuucauuaauaaaaaaccacuuuauau

SEQ ID NO: 304872 - RNA, 66 nt, hsa
ucaugcaguacagacauagcaagccuuguccugacuauguuucacauuugugaauuagguauggcc

SEQ ID NO: 304873 - RNA, 66 nt, hsa
uuuaaaauggcauacagauaauggaaaauaagcuuuauguuucaagaagggcagacucacgaauuu

SEQ ID NO: 304874 - RNA, 66 nt, hsa
aacaaucagacuuacuggaaauaaauuaccuaucccauguuucagugggaaaugaacuacauauug

SEQ ID NO: 304875 - RNA, 66 nt, hsa
uauuuauuaauagauuguuucuuuucauauaguccaauguuucaucaucaggaacuuucgguuuua

SEQ ID NO: 304876 - RNA, 66 nt, hsa
augguaaaugauuguacuuauuuauugaccugccucauguuucauuucauuuuaaacauccuaaau

SEQ ID NO: 304877 - RNA, 66 nt, hsa
uuggugacugucucauugugccaugagguaaauguaauguuucaggcauucugcuugcaaaaaaau

SEQ ID NO: 304878 - RNA, 66 nt, hsa
auugagaaacuggucaaugaacaggaagacuuagagauguuucacaagccuuugauuuuuguuuca

SEQ ID NO: 304879 - RNA, 66 nt, hsa
cuuucagagaugcuggaaacaaaucauuugcuuuauauguuucauuagaauaccaaugaaacauac

SEQ ID NO: 304880 - RNA, 66 nt, hsa
uaagcauuuaggaaugaaguguuagagugucuuaaaauguuucaaaugguuuaacaaaauguaugu

SEQ ID NO: 304881 - RNA, 66 nt, hsa; identical to SEQ ID NO: 304880

SEQ ID NO: 304882 - RNA, 66 nt, hsa
auuuuucuuacaacagccuuucagacuauucuucauauguuucaagcuaaucuuguagcuaagcua

SEQ ID NO: 304883 - RNA, 66 nt, hsa
agaucaugcauagagugugauguauguguaauaaauauguuucacacaaacaaggccugucagcua

SEQ ID NO: 304884 - RNA, 66 nt, hsa
uuuagagauaaggauugcacauuggaaaaguaaaccauguuucauuccuuuuucccuauuuauauu

SEQ ID NO: 304885 - RNA, 66 nt, hsa
uacagaaaugcccuccaugugucccucuaauguugcauguuucaguggguuggaaguuuuguauau

SEQ ID NO: 304886 - RNA, 52 nt, hsa; identical to SEQ ID NO: 303762

SEQ ID NO: 304887 - RNA, 66 nt, hsa
uugguggacuaguauaguauacggucaguuaugucaauguuucauggucaauaaaaaggaaguugc

SEQ ID NO: 304888 - RNA, 66 nt, hsa
uguuuaaauauagcaauacaaccaauaauuuguuuuauguuucacugcauauaaauauuuccauua

SEQ ID NO: 304889 - RNA, 66 nt, hsa
aguauacuguacuauccuuuauaagucauuaaaauaauguuucaucaaaugguuaaauggaccacu

SEQ ID NO: 304890 - RNA, 66 nt, hsa
ccugcuucuuaaggucccugcucggccgguguaaauauguuucacccugucccucuaauaaagcuc

SEQ ID NO: 304891 - RNA, 66 nt, hsa
aaucauggaaugauuucucugcuaacagccgccuguauguuucaauaaauuuguccaaagcucaac

SEQ ID NO: 304892 - RNA, 66 nt, hsa
auacuacuuguaugcagaagagaauuaguugauuacauguuucaaccuuuuagggugauaaauaca

SEQ ID NO: 304893 - RNA, 66 nt, hsa
uuuuuaacauucagguguagauuguuucagcuucucauguuucauuuuccugaagauuuauguuuu

SEQ ID NO: 304894 - RNA, 66 nt, hsa
cauuauuuucaaguaguauaccccugugguuuuacaauguuucaucauuuuuuugcauuaauaaca

SEQ ID NO: 304895 - RNA, 66 nt, hsa
gaggcguauaaaauggggcugugugcaugcaggcccauguuucagccucagcccacgccaggugaa

SEQ ID NO: 304896 - RNA, 66 nt, hsa
cccaaaggaaugucuugcauauuacugacauuugguauguuucauucauuggaauauuucuuauuu

SEQ ID NO: 304897 - RNA, 66 nt, hsa
uuuuuaugugaagguguuucaaaggguaaauuauaaauguuucaugaagaaaaaauuuuaaaaauc

SEQ ID NO: 304898 - RNA, 66 nt, hsa
cuggaaccguaucaggcauucgccugccucucacaaauguuucagggaggccaguucugcagggug

SEQ ID NO: 304899 - RNA, 66 nt, hsa
gugauuucauagauaauauauuuaauaugacagauuauguuucaacucuguagauguuuaacguca

SEQ ID NO: 304900 - RNA, 66 nt, hsa
auuuucccugguaaagaggauucuaauauuucaagaauguuucacuggaauugaugggaaaugguu

SEQ ID NO: 304901 - RNA, 66 nt, hsa
cuuaggcuuuuauaaugcuccgccuacuucagucccauguuucagaagcuuuugucuauuuuuuaa

SEQ ID NO: 304902 - RNA, 66 nt, hsa
guuaucuaaaauaaauauacacaaauaugaaauauaauguuucagauugcaagguaauauguaaua

SEQ ID NO: 304903 - RNA, 66 nt, hsa
cauauuucacaauccuguggaucugggcaaaugaaaauguuucaggaaguuucugcagcagaugcu

SEQ ID NO: 304904 - RNA, 66 nt, hsa
aauguuuuuaaaauaugagugguuauugaaaauaugauguuucacauaaaaccucauucucggacc

SEQ ID NO: 304905 - RNA, 66 nt, hsa
uauguuuauauaugaacuuuacucugaccugugaucauguuucaggaaggaaugaaagagaguucu

SEQ ID NO: 304906 - RNA, 66 nt, hsa
ucugcaggacagccuauaaaauugugguacuuuuugauguuucaguaaacuugacauugucagagu

SEQ ID NO: 304907 - RNA, 66 nt, hsa
aaggugccuuuguaccucagguguuuuaggugugagauguuucagugaaccaaaguucugauaccu

SEQ ID NO: 304908 - RNA, 66 nt, hsa
ucuuugcgaguauacauguuuuuuaacaaguugaaaauguuucaucugaaccuuuccuaacuuuuu

SEQ ID NO: 304909 - RNA, 66 nt, hsa
cacgaggaauaccuaugaagagcuauuuacaauaaaauguuucauuugaaaagucugguuucuuac

SEQ ID NO: 304910 - RNA, 66 nt, hsa
cuucauaaaauuuugauuagugaaacuagagucuggauguuucauuguaggaauauuuaaguuauu

SEQ ID NO: 304911 - RNA, 66 nt, hsa
acuguuauuuaacguuugucugccaggauguauggaauguuucauacucuuaugaccugauccauc

SEQ ID NO: 304912 - RNA, 66 nt, hsa
aagcccguuuccuucccucaucagugaaaaaaucuaauguuucaaauguaaauuguucauagaaaa

SEQ ID NO: 304913 - RNA, 66 nt, hsa
uccauaacauuaauuuuuuuaaaaaauaaggucuuaauguuucauuuaauuuaaaauauacuguca

SEQ ID NO: 304914 - RNA, 66 nt, hsa
aacuuuacacuucagacagauuuucuguguuaugaaauguuucaguaaaauauuguuuacugacuu

SEQ ID NO: 304915 - RNA, 66 nt, hsa
caguuucggaaguuugaucugagaaccaaccauagaauguuucaguucuaggaaauaaaaccaguu

SEQ ID NO: 304916 - RNA, 66 nt, hsa
agagacucaaagagggagugcauuuaugagcucuucauguuucaggagagaguugaaccuaaacau

SEQ ID NO: 304917 - RNA, 66 nt, hsa
ugcacacuacugagagaaugagaugaaaaacgauuaauguuucauuauuauuauugugaaaauauu

SEQ ID NO: 304918 - RNA, 66 nt, hsa
ugagccuaauugcuguuacuaauuagaggaguaaaaauguuucacgauaacucagcaauuguaaug

SEQ ID NO: 304919 - RNA, 66 nt, hsa
cugacugaaacuauggcuaauaauugggguacucuuauguuucaauccaauuuaaccucauuuccc

SEQ ID NO: 304920 - RNA, 66 nt, hsa
uguuguagcugagcacuuuaacaaguugagcauuccauguuucauucuuagaaccuucuuuaauag

SEQ ID NO: 304921 - RNA, 66 nt, hsa
auguuaaccuagaaagggcucacucuaccucuaggcauguuucaucccaacaaucagacugugcca

SEQ ID NO: 304922 - RNA, 66 nt, hsa
uauaauauagaaaucuuauguaaaugaaauuuugucauguuucaaauaaagagaacugaaguagaa

SEQ ID NO: 304923 - RNA, 66 nt, hsa
uauagaaguuacuagcacugacacacugauuuugaaauguuucaaaaugaguagauaugauuagau

SEQ ID NO: 304924 - RNA, 66 nt, hsa
agaaauacaucuuuuauaaugggggaagaaugcccuauguuucaauucaaaacaaagacaguuuuc

SEQ ID NO: 304925 - RNA, 66 nt, hsa
aguuauugaaauggaaaugaaaacagccaguaacuuauguuucagaauguuuguaacacacuucau

SEQ ID NO: 304926 - RNA, 66 nt, hsa
cacuguuggaauugucaucuguacaauuaguccauaauguuucauguuuguccuaagugugcuguu

SEQ ID NO: 304927 - RNA, 66 nt, hsa
guugcuaugcagugugaucuuuauuuauaguaaauuauguuucauguaaaugauauauuuuuggug

SEQ ID NO: 304928 - RNA, 66 nt, hsa
cuguugcuaccagauuauaucuggugguaauuguuaauguuucagcagggcuggucucaguccuuu

SEQ ID NO: 304929 - RNA, 66 nt, hsa
gaacaucuuguucuucaauaucacggguuuuuguuaauguuucauaaguaauucuccccacuugau

SEQ ID NO: 304930 - RNA, 66 nt, hsa
cucucauucuuguauugccuuuuaaauuuuguuaugauguuucauuaauaaacaguguuuuguuuu

SEQ ID NO: 304931 - RNA, 66 nt, hsa
cuccucaccuucccucuuuuuuaaagucacauuuccauguuucaacauuaguuugcauucaccuuu

SEQ ID NO: 304932 - RNA, 66 nt, hsa
cuugagcaggauaucuuuuuuuuuuuuuuugaggcgauguuucacucuuguguccaggcuggagug

SEQ ID NO: 304933 - RNA, 66 nt, hsa
guauugguacccuaggacauaaaaaucacauauaucauguuucaguaaaugcagugaaaggaacua

SEQ ID NO: 304934 - RNA, 66 nt, hsa
ugaaugauuguuuucucucuuuguauauuuguacaaauguuucagcugugcuuuuaaaaaaucugg

SEQ ID NO: 304935 - RNA, 66 nt, hsa
aagcagggcccaaagcuuauuaguuuaaauuaggguauguuucaaguuuguauuaauuuguaauag

SEQ ID NO: 304936 - RNA, 66 nt, hsa
aaccuuuucuuguaucuggauucaaauuuauuuccaauguuucaagcgggaaacaugacucuuuau

SEQ ID NO: 304937 - RNA, 66 nt, hsa
uuuuuuuuaucagagucaugaugaaucaguccuagaauguuucauuugcacaaguagggcugccuc

SEQ ID NO: 304938 - RNA, 66 nt, hsa
gucuuuuguccugcaucaucuugaacauuaauccacauguuucagagcucaccaggcaguaccaau

SEQ ID NO: 304939 - RNA, 66 nt, hsa
ugaucugcuuugcagggaaauaacuuguuuuuucucauguuucaucuucuuuuuauguaaauuugu

SEQ ID NO: 304940 - RNA, 66 nt, hsa
ccugucaauaaaaauagaaguuuguugacucguuuuauguuucaauggugugugucuuuuuacuau

SEQ ID NO: 304941 - RNA, 66 nt, hsa
ccucugggccuucaugcuuuucugcauuguguuaacauguuucaagugcauggccuucuacggcuu

SEQ ID NO: 304942 - RNA, 66 nt, hsa
uuuagaaaaguugcaugauugacaucgcuuccacccauguuucagagcaucugauuugucagaccc

SEQ ID NO: 304943 - RNA, 66 nt, hsa
uuggaacuaugcaguuaaggcagauaaaauguacagauguuucauauauuacagguuacauauaua

SEQ ID NO: 304944 - RNA, 66 nt, hsa
aggucuuucuauauacugaucucuauauagauaucaauguuucauugaaaauccacugguaaggaa

SEQ ID NO: 304945 - RNA, 66 nt, hsa
aaagcaacuuagcaaggcuucuuuucauuauuuuuuauguuucacuuauaaagucuuagguaacua

SEQ ID NO: 304946 - RNA, 66 nt, hsa
uucaaguggcuuuuggggccccagguugagcucuggauguuucaagccaaggcucggcuauucccg

SEQ ID NO: 304947 - RNA, 66 nt, hsa
uuuaaucaguaaaucaguuucacaucauguauugugauguuucaaugugagacacaaaaacaaugg

SEQ ID NO: 304948 - RNA, 66 nt, hsa
ugcuccugccguuuucuuccugccaagccugaaucaauguuucaucuccaacccucugccaguuug

SEQ ID NO: 304949 - RNA, 66 nt, hsa
gccccauugggcccucgucugccucuccaggauuguauguuucaagccuuguccuguguuccuuug

SEQ ID NO: 304950 - RNA, 66 nt, hsa
acucaagugggauuagaagacuaucaaaauacauguauguuucaggauauuugaccugucauuaaa

SEQ ID NO: 304951 - RNA, 66 nt, hsa
gauuuugguauuacacuguauuuguaucucugaagcauguuucauguuuugugacuauauagagau

SEQ ID NO: 304952 - RNA, 66 nt, hsa
gguuguauuguaauggcauuaucaaaauauuugaugauguuucagauauauugcaaagucuguauu

SEQ ID NO: 304953 - RNA, 66 nt, hsa
ucaaccauaaguuaaaaucugaagguuaucuuuaucauguuucaucccugucugaagauuuccuag

SEQ ID NO: 304954 - RNA, 66 nt, hsa
uuaaaauauuguuuuccuacaggccuauuuaacaagauguuucauuuuacuguauauuuuguaguu

SEQ ID NO: 304955 - RNA, 66 nt, hsa
gcaaaauuuuuucucuaggaaauauuuauuuuaauaauguuucaaacauauauaacaaugcuguau

SEQ ID NO: 304956 - RNA, 66 nt, hsa
cuguagagccagccuugguuggaccuauugccaggaauguuucagcugcaguugaagagccugaca

SEQ ID NO: 304957 - RNA, 66 nt, hsa
gugaagaagugaguguccacgggugaagaagugaguauguuucaccuggacauuaaggugauguuu

SEQ ID NO: 304958 - RNA, 66 nt, hsa
caaaacacccagagacggcacaaggagguugaacucauguuucaguucgcgaacauugacuccuua

SEQ ID NO: 304959 - RNA, 55 nt, hsa; identical to SEQ ID NO: 303835

SEQ ID NO: 304960 - RNA, 66 nt, hsa
aagauggguuuuauccucaaauauguauuuuuguguauguuucaaauacaaguauuaggcugcuuu

SEQ ID NO: 304961 - RNA, 66 nt, hsa
uccaguuucuguaaggucuuacauugccugacuaaaauguuucauuuaccucuaaauuuccauauc

SEQ ID NO: 304962 - RNA, 66 nt, hsa
ucugagugagaaaacaaguauggugaggucacuuuaauguuucacagcgaucucagaucuaggccu

SEQ ID NO: 304963 - RNA, 66 nt, hsa
aaagacgaagggagagagaaagcaguuuccaaggauauguuucaugucccaccauuuucucaguuu

SEQ ID NO: 304964 - RNA, 66 nt, hsa
uaaacucuuagauauuuauauaauucaaaagaaugcauguuucacauugugacagauaaagaugua

SEQ ID NO: 304965 - RNA, 66 nt, hsa
ucgugaccucugccacccacauccuucacaaacuccauguuucaguguuugaguccauguuuauuc

SEQ ID NO: 304966 - RNA, 66 nt, hsa
guucauacauuguacgaagaguauuuuugacagaauauguuucaaacuuuggaacaagaugguucu

SEQ ID NO: 304967 - RNA, 66 nt, hsa
gaauaucaauauaaauaaggaaaauaaaucaaugaaauguuucaaugauauaugcaacuauucagu

SEQ ID NO: 304968 - RNA, 66 nt, hsa
acuaaaucugcuuuaccaaguaagguguaagguugcauguuucaguccucuaccauccugcacugu

SEQ ID NO: 304969 - RNA, 66 nt, hsa
uuguauugcauuuuucuauuaaaaaauuaacaguuaauguuucagucaauguauuaucuguagcau

SEQ ID NO: 304970 - RNA, 66 nt, hsa
auacuguaugaauaaugaaacuuacuaucauaaaccauguuucauguggccuguuagggccuguca

SEQ ID NO: 304971 - RNA, 66 nt, hsa
ccuucccgucugauuguuccuccccagcccccuggcauguuucaccacaacccuguugcuacauca

SEQ ID NO: 304972 - RNA, 66 nt, hsa
agcauucuguggucaaguaaguuuagggagcuauucauguuucacuugcuuuguggagauucacac

SEQ ID NO: 304973 - RNA, 66 nt, hsa
auggacaaaaaguaaaucauugaccaaagcuaugaaauguuucacaaaguuuuccucuuuugcaua

SEQ ID NO: 304974 - RNA, 66 nt, hsa
uguauggaauauuacuucuaucagaagaugaucaagauguuucaguccagugcacaucagcauugc

SEQ ID NO: 304975 - RNA, 66 nt, hsa
aaugagcaggaagucuagaaaugauaacuagacuguauguuucaugugugugauuuuucagaauuc

SEQ ID NO: 304976 - RNA, 66 nt, hsa
acauuugucuuaauuucuaacauuaucuuugcuuuuauguuucauaaaaauuugucauuauuuaug

SEQ ID NO: 304977 - RNA, 66 nt, hsa
auuuuuucugcugguggauaaacauuaaaauuaaucauguuucaaaguuuuauuuucaguuccuuu

SEQ ID NO: 304978 - RNA, 66 nt, hsa
aaaugcuagcauguacuguaugggaggaugauccagauguuucaaagagaauuucucuuaguuuag

SEQ ID NO: 304979 - RNA, 66 nt, hsa
cugcuugaaauuauauugauuuaaaugaugugugagauguuucaccauuuucaggcacuguguaau

SEQ ID NO: 304980 - RNA, 66 nt, hsa
uauauuaggccaagugcaauugacuucccuuuuuuaauguuucaugaccacccauugauuguauua

SEQ ID NO: 304981 - RNA, 66 nt, hsa
agaucuacauuuucuggaaaaucagcauuacuagagauguuucaaauguagauuuuaccagaccau

SEQ ID NO: 304982 - RNA, 66 nt, hsa
aucccugugcugagcccugagggcagagaggauggcauguuucaggggagggggaagccuuccucu

SEQ ID NO: 304983 - RNA, 66 nt, hsa
caaaauagagaauucuuaagauuuuguuuaaaccaaauguuucauguagaaugcaaaauguuggca

SEQ ID NO: 304984 - RNA, 66 nt, hsa
cucugccuuguuuggguaaaggcaguaacuaaguuuauguuucagaacugcaaaacaaacaggaua

SEQ ID NO: 304985 - RNA, 66 nt, hsa
ugguaaaaucuuuaaaacuagauucuugcuucugauauguuucaauacauuguugauggcauugug

SEQ ID NO: 304986 - RNA, 66 nt, hsa
aaagcaaauuguuucaguuuuuuuaaaugcccuuugauguuucaaaaaaaaaaaggaacuguaauu

SEQ ID NO: 304987 - RNA, 66 nt, hsa
uguuuuauuucaaaaacaaaguacauuuuugaaauaauguuucagaauaaaauaaucucacuuuua

SEQ ID NO: 304988 - RNA, 66 nt, hsa
ugucaaugucauagaagacaaagaaagguuguggaaauguuucagauuaaaugauaguaaaaacac

SEQ ID NO: 304989 - RNA, 66 nt, hsa
uuuuuccuuuuuaaccauuccaaucgguguguagugauguuucauuuugguuuuaauuuguauauc

SEQ ID NO: 304990 - RNA, 66 nt, hsa
aacuugcaguucuaugauagauugcauuuauuaaaaauguuucauuguaucacauagaaauauggc

SEQ ID NO: 304991 - RNA, 66 nt, hsa
augauaaacauauauccucuuuuuauugcuuugucuauguuucauaugaaacauuucagaaauuau

SEQ ID NO: 304992 - RNA, 66 nt, hsa
auggcgcccucucaauuuagucuucucucauuggccauguuucagauuuugaccuagaaaugcgag

SEQ ID NO: 304993 - RNA, 66 nt, hsa
aaugucacuuuuuugccuaucccccguuuuuuggucauguuucaauuaauugugaggaaggcgcag

SEQ ID NO: 304994 - RNA, 66 nt, hsa
uacaaaucaaaaaaucuuccuucuuauaacugagaaauguuucacccaaauuuccuuuguuauuau

SEQ ID NO: 304995 - RNA, 66 nt, hsa
acaaauaucuucacuucaguuuuauuugugaauuacauguuucaugaauccauuuggcacagagac

SEQ ID NO: 304996 - RNA, 66 nt, hsa
gauuuucucuuguagugauuuggguaggaagaggccauguuucaguucguuuucucuguagggucg

SEQ ID NO: 304997 - RNA, 66 nt, hsa
uaacuagcuagccagcuggagauaauuuaccagggaauguuucaaagcccuaaccuugaaguuugg

SEQ ID NO: 304998 - RNA, 66 nt, hsa
cccacaaaaugcugauucaguucaaaauuaaugcaaauguuucaaaacuggguuucugauauuugu

SEQ ID NO: 304999 - RNA, 66 nt, hsa
ugaguuacuaagauuucuauaccuggaauaucauguauguuucauuuacuggauguuuacauuuua

SEQ ID NO: 305000 - RNA, 66 nt, hsa
caggcaucaagcuacccucaagaguuucugggcuggauguuucagaacaacaucuacaccaguaaa

SEQ ID NO: 305001 - RNA, 66 nt, hsa
ugcacucccuggccuugcccgucgugugcugaagacauguuucaagaaccgcauuucgggaagggc

SEQ ID NO: 305002 - RNA, 66 nt, hsa
acagguauuugacauaauauguauuaaguuauacuaauguuucaaucaguaaagaaauaaaaguuu

SEQ ID NO: 305003 - RNA, 66 nt, hsa
aucugugcauaaggagaggaaaguuccaggguguguauguuucaggggcuucacauggaggagcug

SEQ ID NO: 305004 - RNA, 66 nt, hsa
guccuaugaagaaagauacgguuucagacugaaaacauguuucacagguguuugcuuccuuccaga

SEQ ID NO: 305005 - RNA, 66 nt, hsa
uaauugaaauguugcuuucacugaaaaagugucuugauguuucaguuauuuuuaaucgccauaaaa

SEQ ID NO: 305006 - RNA, 66 nt, hsa
cuguuugagagcauaauuaugguaaucaugagauuaauguuucaugauuucuaccuccaaagugug

SEQ ID NO: 305007 - RNA, 66 nt, hsa
aaagccucaacauuuucgcagcacuugaaucaauaaauguuucaccuuugugcauuugugaacaga

SEQ ID NO: 305008 - RNA, 66 nt, hsa
ggaggucauugaaaaagagaacagugacguaggcaaauguuucaagcacuuuagaaacaguacuuu

SEQ ID NO: 305009 - RNA, 66 nt, hsa
cucuuccuuauuuaguguuguaucauaaauacuuugauguuucaaacauucuaaauaaauaauuuu

SEQ ID NO: 305010 - RNA, 66 nt, hsa
cuuuaauuuauagcuaugguuauaaacagguuuuagauguuucaaaugacuuguccacugaauguc

SEQ ID NO: 305011 - RNA, 66 nt, hsa
uauuaucaagguucuaccuauguuaauuuacaauucauguuucaagacauuugccaaauguauuac

SEQ ID NO: 305012 - RNA, 66 nt, hsa
uauccuuuaauucuucauuaaaauggaaauaaguagauguuucaaaguaaucuacauuccuggcuu

SEQ ID NO: 305013 - RNA, 66 nt, hsa
cugagguucauuacaaucgagacugcaaugugaucuauguuucaucuuguuuuuauaauaaaaagc

SEQ ID NO: 305014 - RNA, 66 nt, hsa
uuuagcaauucaacuugaugugagaagaaaaaacaaauguuucaacacaaaaucucuguuuuguga

SEQ ID NO: 305015 - RNA, 66 nt, hsa
uaaaacuaaccugaaaaacaaauaaaugcuuuggaaauguuucaguugcuuuagaaacauuagugc

SEQ ID NO: 305016 - RNA, 66 nt, hsa
aaaauaaaaguuuuauaguuuuaaauacauaaagaaauguuucaguuaggcauuaaccuugauaga

SEQ ID NO: 305017 - RNA, 66 nt, hsa
guguuuuuuaacaaaauauuuuuuuaagggaaagaaauguuucaggagggauaaagcuuaccauua

SEQ ID NO: 305018 - RNA, 66 nt, hsa
guaagugauaaacaacagcaaauauacuugaauaaaauguuucagguauuuuuguuucauuuuguu

SEQ ID NO: 305019 - RNA, 66 nt, hsa
auuuuugaucuggcaaccauauuucuggaaguugagauguuucagcuugaagaaccaaaacagaag

SEQ ID NO: 305020 - RNA, 66 nt, hsa
uagugaacauucgaccuccauuacggagaguuuccuauguuucacugugcaaauauaucugcuauu

SEQ ID NO: 305021 - RNA, 66 nt, hsa
cuuugccuccagaagaaguuuuuccuugauugugcuauguuucaguggaagaaauucuuugaagua

SEQ ID NO: 305022 - RNA, 66 nt, hsa
acaugaaugucuuucuuugaaaacugcaauguauguauguuucaagguuauuuaacaguguacuau

SEQ ID NO: 305023 - RNA, 66 nt, hsa
uagaugcgcaucaguaugaaauugucucaaucuuggauguuucauuuuaugaauggaggcacuuua

SEQ ID NO: 305024 - RNA, 66 nt, hsa
cauuugcugauuuguuuuuaaaaaaacaagaaaugcauguuucaaauaaaauucucuauuguaaau

SEQ ID NO: 305025 - RNA, 66 nt, hsa
ccagcugggacucuugggcucugugccugagggaaaauguuucacaacuaguggcugcccaauugc

SEQ ID NO: 305026 - RNA, 66 nt, hsa
cuuuuuuucuagcuauuuugcauuuuuucuuuuaccauguuucaguuucugcauguagauuuaaau

SEQ ID NO: 305027 - RNA, 66 nt, hsa
auauuuaacgaaucaugauucagauuguaccauuacauguuucagugcagcaugguuacuaacgcu

SEQ ID NO: 305028 - RNA, 66 nt, hsa
aaaagcaauguagaguuacgcuuuuauaaguauuucauguuucagaaaugaugcauacagcaauuu

SEQ ID NO: 305029 - RNA, 66 nt, hsa
gacacugguagauauagaagccuuuauuaagaauugauguuucauucaauuucagaucacugguac

SEQ ID NO: 305030 - RNA, 66 nt, hsa
caugucauuccacuugugaaagaaaacacaaugugcauguuucaaugauacugugcggaaacacac

SEQ ID NO: 305031 - RNA, 66 nt, hsa
uuguucaguucauagcguagacugcuaaauacuguaauguuucaaaacauccaacuguuuguuaua

SEQ ID NO: 305032 - RNA, 66 nt, hsa
ccauauucucauugugagaauuuuaauacuaauggaauguuucaaagguuuuauucaaaccacaaa

SEQ ID NO: 305033 - RNA, 66 nt, hsa
ccagccauuugggaggcaaugacuuucugcuggcccauguuucaguugccaguaagcuucucacau

SEQ ID NO: 305034 - RNA, 66 nt, hsa
acacuccaugauugauucagucaugaaccucaucccauguuucaucuguggacaauugcuuacuuu

SEQ ID NO: 305035 - RNA, 66 nt, hsa
gcagguacaucaguucuuuuugauaugaaaacauucauguuucagacauugaauugagagcuuuua

SEQ ID NO: 305036 - RNA, 66 nt, hsa
uaccccaucccucacagccucuugcugcuaaaauagauguuucauuuuucugacucaugcaaucau

SEQ ID NO: 305037 - RNA, 66 nt, hsa
uaaaguuguuguagucuccacuucagucagaaacugauguuucagcuaggcacagugguacaugcc

SEQ ID NO: 305038 - RNA, 66 nt, hsa
ucuaaaaggacuuguuuguagaauaaggaauuuucuauguuucaaaguguucuaaaaccuggcuaa

SEQ ID NO: 305039 - RNA, 66 nt, hsa
aagucuauuuaaccucuguaaugaaacuaaauaaaaauguuucaccuuuacaccuggcuguuuguu

SEQ ID NO: 305040 - RNA, 66 nt, hsa
auuuaaccuuaaagauguuaauguugauggaaauucauguuucauauuaaaacaacacuuugucuu

SEQ ID NO: 305041 - RNA, 66 nt, hsa
uuauaguggagugaucauacaguucccccaaaugugauguuucaguguauuuauuuaaaacauaaa

SEQ ID NO: 305042 - RNA, 66 nt, hsa
agguauagaagcucuucaagcauuaaaauagaguugauguuucauuccauuuguuuuauccaucaa

SEQ ID NO: 305043 - RNA, 66 nt, hsa
gguccauaaaaacuucaaggcuuauccauacuuuugauguuucaauaugcauugaacuggauguua

SEQ ID NO: 305044 - RNA, 66 nt, hsa
gaacucuucacucuucaaaugccugacuagggagccauguuucacaaggucuuuaaagugacuaau

SEQ ID NO: 305045 - RNA, 66 nt, hsa
aguauggguauaacauccuugccuucccauuuauccauguuucacuuuaucacugauaugaagagg

SEQ ID NO: 305046 - RNA, 66 nt, hsa
aaacuaaaucuucgggacuucuuuaaugcuacguuaauguuucacugcucgucuagaaacuccuaa

SEQ ID NO: 305047 - RNA, 66 nt, hsa
uagauauagugacaguaccaagaguaccaggacucaauguuucauaugaagcccuuggugaugagg

SEQ ID NO: 305048 - RNA, 66 nt, hsa
uaagauauuucuuucccuaaccaucauacacuuggcauguuucauucccaucuccuuuccccucac

SEQ ID NO: 305049 - RNA, 66 nt, hsa
aggaaacuuuuuuaauauaugaaagcugugauaaaaauguuucagauguuuagucaauugugaaau

SEQ ID NO: 305050 - RNA, 66 nt, hsa
uuuacuuuguaaucauauacaaugucaacuuuuuagauguuucaccacucuuuugcaaauaaagca

SEQ ID NO: 305051 - RNA, 66 nt, hsa
ggacagaccccccacccccaaggcugcagccacaccauguuucaggcuuggggcuggggcaggcuu

SEQ ID NO: 305052 - RNA, 66 nt, hsa
accuagagaacaggugguuuuuaaggguuaucuuagauguuucacaccggaagguuuuuaaacacu

SEQ ID NO: 305053 - RNA, 66 nt, hsa
cacuuucccucuuccuuuaagaaaacuuacuaaaaaauguuucauugcgaagcagaggaaaagaaa

SEQ ID NO: 305054 - RNA, 66 nt, hsa
ugccuggaguaaaaaucugauuugaccccucugcucauguuucaucauauuuguagcucugcauca

SEQ ID NO: 305055 - RNA, 66 nt, hsa
gcucaagucuacccugaucaccucagggcauaaagcauguuucauucucuggcccgacagugucuu

SEQ ID NO: 305056 - RNA, 66 nt, hsa
gaaucucauucugugaaagccuuuuaauuuauugaaauguuucaugacuacugcugcuagcucuuc

SEQ ID NO: 305057 - RNA, 66 nt, hsa
cgauucucugcgcgcaaggacccucgacucacccccauguuucagugucacagagacauucuuuga

SEQ ID NO: 305058 - RNA, 66 nt, hsa
uaaaauggaucuuuacauguugcaguaacauugacuauguuucaaaacucagaugcauaaaacgua

SEQ ID NO: 305059 - RNA, 66 nt, hsa
gcugcagcuauccugacacagugcccuguuccuggaauguuucagauacagcugagcccaagggac

SEQ ID NO: 305060 - RNA, 66 nt, hsa
ucuuaacaguucugaaugcuguccucaaaguauauaauguuucauguaccaagacccuuuucacag

SEQ ID NO: 305061 - RNA, 66 nt, hsa
cuauaacugaagaaaauaucuugcuaauuuuaccuaauguuucauccuuaaucucaggacaacuua

SEQ ID NO: 305062 - RNA, 66 nt, hsa
uguaaucugugagaacaaugguugaaauuucaaaguauguuucauuauucuuucuaaauuugauaa

SEQ ID NO: 305063 - RNA, 66 nt, hsa
ucugacaauuuaucuuccauaugcucuuuaaguaaaauguuucaaagacaguuuuaaagggagcca

SEQ ID NO: 305064 - RNA, 66 nt, hsa
aaucugaagaaucaaacuuccauccugaaaaucuauauguuucaaaaccacuugccauccuguuag

SEQ ID NO: 305065 - RNA, 66 nt, hsa
uuuuaaaaaguaacaagaaagaacucguuugaaaccauguuucaucauccuguagcuacaucuggu

SEQ ID NO: 305066 - RNA, 66 nt, hsa
ccugcuggggcugaaggucagaaguaauccugagaaauguuucaggccuggggagggaggggagcc

SEQ ID NO: 305067 - RNA, 66 nt, hsa
ccauuaacaauuuuuuuuuguuuuuuaaauacuaauauguuucacacuauaguuuguguaacaaca

SEQ ID NO: 305068 - RNA, 66 nt, hsa
cuaauuagugccuuucucuuucaucacuuguucuggauguuucaaucaguuuaguggaaggaaaaa

SEQ ID NO: 305069 - RNA, 66 nt, hsa
gcugggcaucagcaccuguccagcucuacuugugugauguuucaggaacucagccccuuuuucugc

SEQ ID NO: 305070 - RNA, 66 nt, hsa
ccuucucuugaaguccaauaacaagaccaaguaagaauguuucaacaaugcguuggcaagagaugu

SEQ ID NO: 305071 - RNA, 66 nt, hsa
gugcaguaggcaucacauaugcuugguucaaacuguauguuucaguauugauugacucugcuauug

SEQ ID NO: 305072 - RNA, 66 nt, hsa
caagcaaaacuuuuaaauauuugaauugacaguuacauguuucauaacuuuguaugucuauugguu

SEQ ID NO: 305073 - RNA, 66 nt, hsa
uuugcuuccagacguuguuccauauuuuugccccaaauguuucauggcuuauaccccauugguuua

SEQ ID NO: 305074 - RNA, 66 nt, hsa
gggugaacaaacaaugaaaacucuuugcugcugcccauguuucaaauacuuagagcagugaagacu

SEQ ID NO: 305075 - RNA, 66 nt, hsa
gcagaaccucucagccuuccucuacgccuugaggggauguuucauccaaaguacaaccugaauuga

SEQ ID NO: 305076 - RNA, 66 nt, hsa
auccauccuuauucacguugacaguaccuagcuguaauguuucacagagugugcugcuauuuuaua

SEQ ID NO: 305077 - RNA, 66 nt, hsa
cacuuuaaagauuugaaaccacauuuuuauuguuugauguuucauuuucagacuuuuuaaugucag

SEQ ID NO: 305078 - RNA, 66 nt, hsa
uguaaucaagcuuuuccacaguucuugaaaaguacuauguuucaaauuucaggaacaccagcguua

SEQ ID NO: 305079 - RNA, 66 nt, hsa
aacugcugugggauugucaaccagcuuaucugcaggauguuucagaucugauaaauccugauggaa

SEQ ID NO: 305080 - RNA, 66 nt, hsa
cucugugcagcuuucccccuuggagcaggagugaagauguuucauuaucuugggccugggaaacca

SEQ ID NO: 305081 - RNA, 66 nt, hsa
uuuuaucuuauaucuaaaaaauauauaacuuacuauauguuucaguugcucucugaacaaaaauua

SEQ ID NO: 305082 - RNA, 66 nt, hsa
aaaaaaguuaagggaaaagacuuugcuuuuaaaaaaauguuucaaaagaaagguauuuucacuaaa

SEQ ID NO: 305083 - RNA, 66 nt, hsa
aaacucauaaggucuaccaagaaaauaaauguuaugauguuucaguuggcuucuaggaaauaauua

SEQ ID NO: 305084 - RNA, 66 nt, hsa
ccuauggguaagaaauaaauggaaauaugacaucggauguuucagcaacuguucuguaaauaaaau

SEQ ID NO: 305085 - RNA, 66 nt, hsa
ccacuagcaaucugagugauggaaucuuagucauucauguuucaccagaggacagcaagcaaaagg

SEQ ID NO: 305086 - RNA, 66 nt, hsa
gaccuuaugagaaguggaugguaggaggagucacuaauguuucaaucucuauuucuguaaucuugg

SEQ ID NO: 305087 - RNA, 66 nt, hsa
ugcuagaacagcuaagguuuacauguaccaaauaacauguuucagcucauuccauccucacaacag

SEQ ID NO: 305088 - RNA, 66 nt, hsa
uuuuuuaaaaaaaaaguauguguaauaugaaguaaaauguuucagacuuuuuuuuauacucaagug

SEQ ID NO: 305089 - RNA, 66 nt, hsa
uuuauguguaaguuuuguacaaggaaugccccuaaaauguuucagcaggcugucaccuauuacacu

SEQ ID NO: 305090 - RNA, 66 nt, hsa
uucuauagauaaugaggaagaaaugguaagacguaaauguuucaacacuuuacuaaaagcuuauuu

SEQ ID NO: 305091 - RNA, 66 nt, hsa
aaaacaugaauuuuuuugucuuauucuguuuuuaacauguuucaaauguuuuauacauuuuuggag

SEQ ID NO: 305092 - RNA, 66 nt, hsa
ucuugucaccucauuuugcauuacugucuuccguggauguuucaguuacaacuguaauguuauuua

SEQ ID NO: 305093 - RNA, 66 nt, hsa
cagccucccaaaucaagucucuccaucacuugaucaauguuucagcccuagacugcccaaggagua

SEQ ID NO: 305094 - RNA, 66 nt, hsa
ucuuuuuccucccuuucccugagagcucacaguacaauguuucagaagccccauuugcacagguuu

SEQ ID NO: 305095 - RNA, 66 nt, hsa
ccuaacugcauuuguuuugacuucuuuaauguuugaauguuucacucuguuguaaagucagcauaa

SEQ ID NO: 305096 - RNA, 66 nt, hsa
cuucauguccagaagaguaagagggaaaauggacauauguuucauauccaaggguauucaaacugu

SEQ ID NO: 305097 - RNA, 66 nt, hsa
aguccuuucuuuuugcccuuuauucaauuaguccuaauguuucaguucucuaauuaccaauuaguu

SEQ ID NO: 305098 - RNA, 66 nt, hsa
acaaagcauacauuuccugacuggucuagagaacugauguuucaauuuaccccucugcuaaauaaa

SEQ ID NO: 305099 - RNA, 66 nt, hsa
aaaaugugucuuguauuaaauauuuuuauuaaaagaauguuucauuaaugcauugauaagaaaacu

SEQ ID NO: 305100 - RNA, 66 nt, hsa
uugugaagcugcucugauacuagauauccuuaaaugauguuucaauuuuauauguuuucuaagaua

SEQ ID NO: 305101 - RNA, 66 nt, hsa
cucaccugaggaagggaaggaagggaauaaucuuuuauguuucauuuaccuuaugaaaaguguuaa

SEQ ID NO: 305102 - RNA, 66 nt, hsa
accuaggaucauauugcauucaucacuuuaaacaucauguuucagguuuuggucaauacuugacaa

SEQ ID NO: 305103 - RNA, 66 nt, hsa
uucacaguacacgucacaguauugaugugauucaaaauguuucagugaaaacuuuggagacaguuu

SEQ ID NO: 305104 - RNA, 66 nt, hsa
acuuuuuaaaagaaaaaauucuaccauuuuaaauucauguuucaacuccuacaaccaaaugagaaa

SEQ ID NO: 305105 - RNA, 66 nt, hsa
uuuggaugugcuauuguaugauuacgaauagucuguauguuucaagcccuucuguaaaauaugaag

SEQ ID NO: 305106 - RNA, 66 nt, hsa
ugaccucaauucccucaccugaaauaggaaaugagaauguuucauuguagccccaagcggucaugu

SEQ ID NO: 305107 - RNA, 66 nt, hsa
caacugugcucugugaggugugaaauuaaaaacauuauguuucaccaauauuuaaacaucaguacu

SEQ ID NO: 305108 - RNA, 66 nt, hsa
cacuucagucagguacacuguuacuugaaaggaagaauguuucacuuacccaagagcuauggcugc

SEQ ID NO: 305109 - RNA, 66 nt, hsa
uucucucucauuauugagauucauccauauuguugaauguuucacuaguuaauguuuauuguucaa

SEQ ID NO: 305110 - RNA, 66 nt, hsa
cuguaaagucuuucuaagaccaauuauuaucuuagcauguuucaguaucuucucuaucauaggccc

SEQ ID NO: 305111 - RNA, 66 nt, hsa
aaggggaaaacuucagcuuuccaaaagcuaguaaacauguuucaaagaaaaauaaggucaggagaa

SEQ ID NO: 305112 - RNA, 66 nt, hsa
ggcaugcuugguuauuuccaguacuugucagucaacauguuucaagacgcuguguuagacacuagg

SEQ ID NO: 305113 - RNA, 66 nt, hsa
uuacugucaugucauuuacccacuggaucaaaggguauguuucacuucuugacaauauaaaugcug

SEQ ID NO: 305114 - RNA, 66 nt, hsa
uuucuuuacaauuuguugcaauuucaucugcuuucuauguuucauuguuaauugccauccuucagc

SEQ ID NO: 305115 - RNA, 66 nt, hsa
uaacauuuaaaaguacuuuauauuuuacauaauagcauguuucauuuugauuaaaagcuaccaaag

SEQ ID NO: 305116 - RNA, 66 nt, hsa
cuguaugaaaacaucuccgaauuagcauuucuggauauguuucauccaggguaucauugauuuaug

SEQ ID NO: 305117 - RNA, 66 nt, hsa
guaguaugagaagaaaucauugggugacuaugacuaauguuucagaauuacuuuuuaauuguuuua

SEQ ID NO: 305118 - RNA, 66 nt, hsa
gggaggaaaacucaacuguuucucuuuguuaucuaaauguuucagaauucaaucgugaaggaacag

SEQ ID NO: 305119 - RNA, 66 nt, hsa
aaggguccaguauuuauuugauuauuuaguauguuuauguuucaugacacuaauuuagucuuuuga

SEQ ID NO: 305120 - RNA, 66 nt, hsa
aaaaaaaugaauguauuuuuuucuccaaagaacagcauguuucacucaauggugaaaagguggaaa

SEQ ID NO: 305121 - RNA, 66 nt, hsa
cgucccuggucacccgacuuuggaauuugcaccaucauguuucagugaagaugcuguaaauagguu

SEQ ID NO: 305122 - RNA, 66 nt, hsa
cugcagguguccugcccuuccgcccacgagugcgccauguuucagcggagcggcgugugggagaag

SEQ ID NO: 305123 - RNA, 66 nt, hsa
cugguagugccucaucacaacccaugauggcuguucauguuucaccccuuuucuuccuucagcaga

SEQ ID NO: 305124 - RNA, 66 nt, hsa
aggcuggauuuggacaaaaagcaaaucuagacaugcauguuucaggguucaguaguauacuucaug

SEQ ID NO: 305125 - RNA, 66 nt, hsa
uagacaugcauguuucaggguucaguaguauacuucauguuucauacagauaauucacauucaaaa

SEQ ID NO: 305126 - RNA, 66 nt, hsa
uugcauuuguaaacaguccuggucaguaguuaaauaauguuucaauuaaagugcuguaaaauaaac

SEQ ID NO: 305127 - RNA, 66 nt, hsa
uuugccacugauauuuuuacuggauaaaauucaaaaauguuucaauucacaaaggcuaauuguuga

SEQ ID NO: 305128 - RNA, 66 nt, hsa
gucucugugaagccuuuacucucuaggugccuuauaauguuucagggcucaacuuuuuaaaaucca

SEQ ID NO: 305129 - RNA, 66 nt, hsa
gcacgugugagaauuuaggagacacugugcacugacauguuucacaacaggcauuccagaauuaug

SEQ ID NO: 305130 - RNA, 66 nt, hsa
gggaaugggacccaaaucuaaacacaaaauucauuuauguuucauauacaccuuauauacaauaac

SEQ ID NO: 305131 - RNA, 66 nt, hsa
auauuaauauuuccuuuuccucauaccaacuugacuauguuucacccgcuucaugacuaaaucaca

SEQ ID NO: 305132 - RNA, 66 nt, hsa
aaagugaaagugccaacaaauuauugauagcugauaauguuucauuaucugcaacugcuugauaag

SEQ ID NO: 305133 - RNA, 66 nt, hsa
acaauguguauauguaaauaauauguguuuuaccagauguuucauagaaagaauuuuuucuugauc

SEQ ID NO: 305134 - RNA, 66 nt, hsa
uugauuuauuaaauucuaguuaugugcccuauaaugauguuucagucagugacagaccucauauau

SEQ ID NO: 305135 - RNA, 66 nt, hsa
acucugcagcagggggugacugacacaccaaacaagauguuucacuggguacucugccauagaaau

SEQ ID NO: 305136 - RNA, 66 nt, hsa
gaaguggggacagauucgcagcacagagucgcuggcauguuucacuccugcuucucucagccagcu

SEQ ID NO: 305137 - RNA, 66 nt, hsa
gggcaugaauggagaugcccgcacaguaauguagaaauguuucauacagcuauuaaaauguaacug

SEQ ID NO: 305138 - RNA, 66 nt, hsa
auuuucauaauguugaauuugccuuuuaggaaaacaauguuucaugaaacacuuguaagauacuua

SEQ ID NO: 305139 - RNA, 66 nt, hsa
ggaugauuguuaagcaauagauuugcucuauugaaaauguuucauuuuuuucacuguacaagcaac

SEQ ID NO: 305140 - RNA, 66 nt, hsa
acugcugcauuccagccagggugacagagugagaccauguuucaaacaagaaacauuucagagggu

SEQ ID NO: 305141 - RNA, 66 nt, hsa
cauucgucaccauuauacuaaugaacaauagauuucauguuucaaaauuucagauuuuacauguua

SEQ ID NO: 305142 - RNA, 66 nt, hsa
agagguuguuaauuagcacauauuccuuuuagaaaaauguuucagaaaccucagucuugauaucug

SEQ ID NO: 305143 - RNA, 54 nt, hsa; identical to SEQ ID NO: 304019

SEQ ID NO: 305144 - RNA, 66 nt, hsa
aaagauaucuauuugaaaguucucagaguuguacauauguuucacaguacaggaucuguacauaaa

SEQ ID NO: 305145 - RNA, 66 nt, hsa
agaauuucauaugacauucaugccuggcuucgcaaaauguuucaaguacuguaacugugucaugau

SEQ ID NO: 305146 - RNA, 66 nt, hsa
agugagacuccgucucaaaaaaaaaaaaaaaaagaaauguuucauuuugguuuuucaccaaccuuc

SEQ ID NO: 305147 - RNA, 66 nt, hsa
aauguuagagggucucuuacuccccgcccagcugugauguuucaucugcuuugguuguuuuggugg

SEQ ID NO: 305148 - RNA, 66 nt, hsa
cgauacauguccucgacggaugccaaaguggaacagauguuucagauacuguuggacccagaagag

SEQ ID NO: 305149 - RNA, 66 nt, hsa
aguuugacugccuaagggacagcacgaaugacucacauguuucagacaggccuccacggcuaugga

SEQ ID NO: 305150 - RNA, 66 nt, hsa
ggccuugguggauuaaccaaggccuuggauuccagaauguuucaugguaagcacuguggagaaccu

SEQ ID NO: 305151 - RNA, 66 nt, hsa
guugaagugcugugauuguccuguauucaauuuuguauguuucaccucuacugugauucagacaga

SEQ ID NO: 305152 - RNA, 66 nt, hsa
guacauguuuuaccaccacccaggucaagacauagaauguuucaacauuuccaucaccccagaaac

SEQ ID NO: 305153 - RNA, 66 nt, hsa
guaaaugccuguguuaaagaggcagcuugacuguucauguuucauuuugcaaccauugguuuugag

SEQ ID NO: 305154 - RNA, 66 nt, hsa
agugucuucauaccaaauuaaaggugguuuuaauauauguuucauggaaguuguuuauaaaauuca

SEQ ID NO: 305155 - RNA, 66 nt, hsa
uagcauucagcgcugcuguggcuaacaccacuguguauguuucaucauugcucugaaggucaaaag

SEQ ID NO: 305156 - RNA, 66 nt, hsa
uaguaaccaagcacucauuauauaugcauccuccaaauguuucaugcuuauuuauaggaaaguuau

SEQ ID NO: 305157 - RNA, 66 nt, hsa
aauauaagaccucuuguagcuacaauguuuuagagcauguuucaucuucauuuuuaauauccugaa

SEQ ID NO: 305158 - RNA, 66 nt, hsa
uuugggguuuacaacaacuaggauguguugggugagauguuucagaucuggagaaaugagcaggug

SEQ ID NO: 305159 - RNA, 66 nt, hsa
ucacccccagcaaggugccuggggagacuugagcagauguuucauuuuggccuggccaguggcuga

SEQ ID NO: 305160 - RNA, 66 nt, hsa
uccuauugucaagguuaacauaaaugcucuucuaaaauguuucacuuacuccuaaacuagcuaucc

SEQ ID NO: 305161 - RNA, 66 nt, hsa
gcagcugccucaccgcccagacauugauuuguucagauguuucaaugccucaugauacaauaaaac

SEQ ID NO: 305162 - RNA, 66 nt, hsa
auuucacaccagauccuaccccuuucccugagccacauguuucacacaaguguagaaaaugccagg

SEQ ID NO: 305163 - RNA, 66 nt, hsa
uugucagccaccagacugucccggcaccuacagagaauguuucacaguucuggcauuuaaauccuu

SEQ ID NO: 305164 - RNA, 66 nt, hsa
uaguauuuguuaaaugggguauuuuucuguauuuguauguuucacuauaauaagggaauuaaggau

SEQ ID NO: 305165 - RNA, 66 nt, hsa
cugaccgcuucauaagccaguacgucugagcugaguauguuucaauaaaccuuuugauauuucuca

SEQ ID NO: 305166 - RNA, 66 nt, hsa
gguacuaaguccucuccagguugguccugggauaucauguuucaaguggcugugccaaaggugagu

SEQ ID NO: 305167 - RNA, 66 nt, hsa
cugugcuugauuuuuaucaguuuuguguagauuuuuauguuucauauuuuaaauuuaaaucccaca

SEQ ID NO: 305168 - RNA, 66 nt, hsa
guguuuggccaaaaauuuuuuuaaaaaucauauuauauguuucaauugaucuguuagaauaaccaa

SEQ ID NO: 305169 - RNA, 66 nt, hsa
caaucacugagacugcaucagaguuugcaauuuuguauguuucauugccaaagaaggcuuaguggu

SEQ ID NO: 305170 - RNA, 66 nt, hsa
uuuuccucucacuuggccuugcagcuaaauggagaaauguuucaauuucuuugaauacuugcacau

SEQ ID NO: 305171 - RNA, 66 nt, hsa
uuuuucauguaguuucuuaauauauacuugaaggaaauguuucaccuuauuuuuggucuuuguuua

SEQ ID NO: 305172 - RNA, 66 nt, hsa
cuucccacucacuucccuuugguuuuucauauuuaaauguuucaauuucuguauuuuuuuuucuuu

SEQ ID NO: 305173 - RNA, 66 nt, hsa
cauaggccucugggagugauuugguucuuugcccuaauguuucauuugacggucucuuuuugauca

SEQ ID NO: 305174 - RNA, 66 nt, hsa
cugaaguugcaauuuauacuguauggcuucuuuuucauguuucaucuagguuuuuagaagugaagu

SEQ ID NO: 305175 - RNA, 66 nt, hsa
uugcucugcaguugggaacggugaucuucuugaaugauguuucagugugcaaaaacuauagagccu

SEQ ID NO: 305176 - RNA, 66 nt, hsa
aggucaugcaggccuuuaccggcauugauguggcucauguuucaggcagacuugggguccuuaagg

SEQ ID NO: 305177 - RNA, 66 nt, hsa
uuuaugucuagcuucugagucuagaugaaagacaguauguuucagagaacauuggauaucaguuuu

SEQ ID NO: 305178 - RNA, 66 nt, hsa
cuggcagugucaagccugaaaccaagcaauaccgucauguuucagccaagcccagagcccuaagau

SEQ ID NO: 305179 - RNA, 66 nt, hsa
cagaaggcuagagggcgacucugguggugcuuuuguauguuucaauuaggcucugaaaucuugggc

SEQ ID NO: 305180 - RNA, 66 nt, hsa
gcccccacccucugccacccaguccucccagcugccauguuucaaagacgaccuuuaccuccugcc

SEQ ID NO: 305181 - RNA, 66 nt, hsa
ucgggacgucuucauugaagauucacuuacaaaggaauguuucacuaaauaaaagaaaaccagaau

SEQ ID NO: 305182 - RNA, 66 nt, hsa
acaucccugaaggggagcucuuggauaucauuggccauguuucaaucgaauggagccacugggccc

SEQ ID NO: 305183 - RNA, 66 nt, hsa
uuuauuuuuuuaaugaaaagaaaaaacaagaaaguuauguuucauaauuucuuacaacaugagcca

SEQ ID NO: 305184 - RNA, 66 nt, hsa
cuuaguccuuaggccaaccaauuuaacugcagugucauguuucacaggccuuccuacauuuagaaa

SEQ ID NO: 305185 - RNA, 66 nt, hsa
aacuccagacugauagguagucauuagccaugagaaauguuucaggauggcuagggaagacuugug

SEQ ID NO: 305186 - RNA, 66 nt, hsa
aaaaggcaagcaaaggagaugaaaucuguucugggaauguuucagcagccaauaagugcccgagca

SEQ ID NO: 305187 - RNA, 66 nt, hsa
aaugacaaaguguugaaaauguauuuccugaaauaaauguuucaaaugcagaaacccagaaggcuc

SEQ ID NO: 305188 - RNA, 66 nt, hsa
augucuuaggaaaggagaucaacauuuucaaauuagauguuucaacugugcucuuguuuugucuug

SEQ ID NO: 305189 - RNA, 66 nt, hsa
aaucuugccugucauugcacucagaaucuuaagaucauguuucaaauauguugauucaaacuugcu

SEQ ID NO: 305190 - RNA, 66 nt, hsa
guagagaagagacaguuuaauauuugugcugaaaauauguuucaguauuuuuuucaaugaauguua

SEQ ID NO: 305191 - RNA, 66 nt, hsa
uuuuugguguaguuuuuuaauauauacuugaaggaaauguuucaccuuauuuuuggucuuuguuua

SEQ ID NO: 305192 - RNA, 66 nt, hsa
cuuuaaaguauaguacauuuuacauauguaaaugguauguuucaauaauuuaagaacucugaaaca

SEQ ID NO: 305193 - RNA, 66 nt, hsa
ucagcuuuuggugccagcuacagaguugagcuggccauguuucacaguauaucaagcauuauagag

SEQ ID NO: 305194 - RNA, 66 nt, hsa
aaagaaucauggacagaacuuacacuacuuuuuaccauguuucaucuuggcauaacaugguucuuu

SEQ ID NO: 305195 - RNA, 66 nt, hsa
uuuuucguguaguuuuuuaauauauacuugaaggaaauguuucaccuuauuuuuggucuuuguuua

SEQ ID NO: 305196 - RNA, 66 nt, hsa
uguuuuucuauagcagagcauuauauuuugcauuauauguuucaaccuagucuaagugggucuuuu

SEQ ID NO: 305197 - RNA, 66 nt, hsa
uagcucagauauuaaaguaguauucucaauuaccaaauguuucauuugaaacaauuuaucuuaaug

SEQ ID NO: 305198 - RNA, 66 nt, hsa
caccugcuggacaucuuugccaggcugugccuucucauguuucauagacaguggucugugcuggca

SEQ ID NO: 305199 - RNA, 66 nt, hsa
ggguggcacugguguugcuggcucagcucuuggugcauguuucagauauguguguacacuucugac

SEQ ID NO: 305200 - RNA, 66 nt, hsa
auccagagcuuuagaggaagacacauagguggguuuauguuucaccucauuuggaacaaaagagga

SEQ ID NO: 305201 - RNA, 66 nt, hsa
caaauacacuacagaauuuagucaacauuuuauauaauguuucaauaaauguuucuuucaauaaag

SEQ ID NO: 305202 - RNA, 66 nt, hsa
gaaaguuaugacauuagcuuuaaagguguaaaaaagauguuucacuaauguaacggugaaagagaa

SEQ ID NO: 305203 - RNA, 66 nt, hsa
aauuuaacaaugucugaucucagcugaacaaauuagauguuucaguugcucuugggucaacuggcu

SEQ ID NO: 305204 - RNA, 66 nt, hsa
guaacaaauguuuauacaaauacauacauguacaccauguuucaaauacuaaauaaauagaguuua

SEQ ID NO: 305205 - RNA, 66 nt, hsa
uuuuguaaacugcucugcauauaaaccaagggcagaauguuucacccugaucuuaugggaggaauc

SEQ ID NO: 305206 - RNA, 66 nt, hsa
aaaaagggaagucuugagguuuuagaggugugaauuauguuucaucaaugugcagaauaaucacaa

SEQ ID NO: 305207 - RNA, 66 nt, hsa
gagaauuauuuuucaauuuuauuuuaguucuaaauuauguuucagaaacaaaagacaaugcuguac

SEQ ID NO: 305208 - RNA, 66 nt, hsa
caaaaugaaacuuaauagcucacaaaauuccaguccauguuucaugacuuauuuuagucaaugaau

SEQ ID NO: 305209 - RNA, 66 nt, hsa
caguguccccuuuucuggcauaaaucaacuaugaauauguuucaagcaucacaagacaaccuuuuc

SEQ ID NO: 305210 - RNA, 66 nt, hsa
uuauguaaacaagagauuuggcaugacauguucuguauguuucagggaaaaaugucuuuaaugcuu

SEQ ID NO: 305211 - RNA, 66 nt, hsa
ccuggauaauugcuugauucucgccagagacugucaauguuucauucauugccauuaccaauaaau

SEQ ID NO: 305212 - RNA, 66 nt, hsa
augaaaaucucuguacagauugcagucuucuuccugauguuucaaacugugguucccccaagcucu

SEQ ID NO: 305213 - RNA, 66 nt, hsa
gcccuuaauaaguccucaauucuuaacagauauaagauguuucauacuggagcgaaacuacaaucc

SEQ ID NO: 305214 - RNA, 66 nt, hsa
cacacaacagagaaacccuauaaagaaugauacaauauguuucaaucagaaccuucacauccaaua

SEQ ID NO: 305215 - RNA, 66 nt, hsa
cuucuuuugagaaaugccuguucagcuacuuugcccauguuucaaguaguuuuugguuucuugcug

SEQ ID NO: 305216 - RNA, 66 nt, hsa
ugucauggauuucuuaguguauuugggggaagggaaauguuucaagguaaagaaccuugacccuuu

SEQ ID NO: 305217 - RNA, 66 nt, hsa
uugucauccccuccuuauuuuauuugggagagggaaauguuucagaaacaaaagggccucaucccc

SEQ ID NO: 305218 - RNA, 66 nt, hsa
uugucgucccuuuguuauuuuaugugggagagggaaauguuucagaaacgaaagaucucauccccu

SEQ ID NO: 305219 - RNA, 66 nt, hsa
ggacacauuguccacuucagaugcuuguuuaaaaaaauguuucaccaugugucuuuacccaauaca

SEQ ID NO: 305220 - RNA, 66 nt, hsa
aaacugcuauauuugaaugcaguuguucauguagguauguuucacuaugguaauaugguggugugc

SEQ ID NO: 305221 - RNA, 66 nt, hsa
cugucugugucccauccugcuguccuucuguccuggauguuucaugggcccggggccccccaggga

SEQ ID NO: 305222 - RNA, 66 nt, hsa
uuuauuggagugauggauuuggugccauggucuauaauguuucaugcauccauacuucuguuuuug

SEQ ID NO: 305223 - RNA, 66 nt, hsa
ucuguaauauauauauauauauauaaaaugaaauauauguuucauuuuagagaaauaacuauuacu

SEQ ID NO: 305224 - RNA, 66 nt, hsa
ggaauauaucuugcucuauagaggauuuuuuuuuguauguuucaagcuucagccuuuaaccuauac

SEQ ID NO: 305225 - RNA, 66 nt, hsa
cccggguucccagagcuccgaggaaacugauccuucauguuucaauagcuguuguuguuuuucucu

SEQ ID NO: 305226 - RNA, 66 nt, hsa
aaauuuuuuuauugagaauaaauuuucuaaaauuacauguuucacugaaaccagugaaauauuuca

SEQ ID NO: 305227 - RNA, 66 nt, hsa
cauaauuuucuauuugaaaaugugcugauucuuggaauguuucauucuccagauuuaugaacauuu

SEQ ID NO: 305228 - RNA, 66 nt, hsa
cucauguauaaaugccauguggagauagagccccagauguuucagccaucucagcccaggcaccag

SEQ ID NO: 305229 - RNA, 66 nt, hsa
auguccugaaaaaugcucaaucucagcuaacauuccauguuucagaagcauucaggcacugccagg

SEQ ID NO: 305230 - RNA, 66 nt, hsa
auauuuguaggcagucaguuaccuucaccuuaugaaauguuucacugaguuauuugagguuuuuug

SEQ ID NO: 305231 - RNA, 66 nt, hsa
uuuuuuccuucaccauuuaucauuucauagucauuuauguuucaucgguccucauguguacuagug

SEQ ID NO: 305232 - RNA, 66 nt, hsa
ggcuggcauucugcauguuuagugauugucuugggaauguuucacugcuacccgcauccagcgacu

SEQ ID NO: 305233 - RNA, 66 nt, hsa
agaauauuuucacuguuccuucuuucuuaaagucuuauguuucacucuuuaacucaaauguauucu

SEQ ID NO: 305234 - RNA, 66 nt, hsa
cauucaucaaguuaucuuuauaaucacuguaguuagauguuucauguccauucaagugacuuuuau

SEQ ID NO: 305235 - RNA, 66 nt, hsa
agugcuaggaucauuggauucaguucccaaaauagaauguuucagugagaccaugagaauuccagg

SEQ ID NO: 305236 - RNA, 66 nt, hsa
cuuccuuuaaaugucccauggauguaggacagugccauguuucaagaugccugugagcuaggucuu

SEQ ID NO: 305237 - RNA, 66 nt, hsa
ucuguaaaaaggcagaccagggauguaauguuuuuaauguuucagaagccuaacuuuuuacacagu

SEQ ID NO: 305238 - RNA, 66 nt, hsa
uugcaguacuugauuuaggaucuguggugcagggcaauguuucaaaguuuagucacagcuuaaaaa

SEQ ID NO: 305239 - RNA, 66 nt, hsa
uuaacauuaacuucuaaagaaguuuuuucuaagaaaauguuucaaggcaauauuuuuuuugaggcu

SEQ ID NO: 305240 - RNA, 66 nt, hsa
accacuaaacuuuuguguccauauuuuacugagaccauguuucauuaaaagcauaguuucauagua

SEQ ID NO: 305241 - RNA, 66 nt, hsa
auucaacacucgugaggccaggaagcuauuaaagggauguuucaagcuguuucuagcacauuccaa

SEQ ID NO: 305242 - RNA, 66 nt, hsa
uaauguagcuuucucucuuaccuucuggaagagggaauguuucauuuauuacuguuugauuuucuu

SEQ ID NO: 305243 - RNA, 66 nt, hsa
cagcucuuuuuccaaggcccggaguacuggggauugauguuucaaggccaaucaaugggaugcuuc

SEQ ID NO: 305244 - RNA, 66 nt, hsa
agacaaaggauuugagauguucucaauaaaaagaaaauguuucacuacucugguguugcugagacu

SEQ ID NO: 305245 - RNA, 66 nt, hsa
gcaaccaagacuaaguuuuaaauccagaagagagaaauguuucacgcaagcagucccccaacuccc

SEQ ID NO: 305246 - RNA, 66 nt, hsa
cugaaaugacuccuacaauugaggguugugugaaagauguuucauaccaaggaggcaaaucuauaa

SEQ ID NO: 305247 - RNA, 66 nt, hsa
aauagaugaauuuauuuuauuucuaaagguauucaaauguuucagcaccauauaauagaaauaccc

SEQ ID NO: 305248 - RNA, 66 nt, hsa
accaaucggugucucaggccacugggcccuuaguggauguuucagacgcucggccgggaacgagug

SEQ ID NO: 305249 - RNA, 66 nt, hsa
aauaugugauuuucucuaauguaacuuccucuuaggauguuucaccaaggaaauauugagagagaa

SEQ ID NO: 305250 - RNA, 66 nt, hsa
gcuuacaguucucugcguucgucacuuaauuccugaauguuucagagaaacaggaaucagaaaaua

SEQ ID NO: 305251 - RNA, 66 nt, hsa
ggcccagcaagaagggcuuggguucugaggaagcagauguuucaugcugugaggccuugcaccagg

SEQ ID NO: 305252 - RNA, 66 nt, hsa
ccuggcucaaaauggacaagaagguacuggaucaugauguuucaaaggaagaaccagucaccuuuc

SEQ ID NO: 305253 - RNA, 66 nt, hsa
ccuuuuaguugaaugccacugaagagcugugauagcauguuucaaagcugaacucuacagagcgag

SEQ ID NO: 305254 - RNA, 66 nt, hsa
uacgacagagacguggcauuuggaaacgaaacuuagauguuucauggagcuuauuuugagaacuuu

SEQ ID NO: 305255 - RNA, 66 nt, hsa
aauggacaaauugacugcaauguaauacuagcugguauguuucauaaaugucaagcuguggaccaa

SEQ ID NO: 305256 - RNA, 66 nt, hsa
ugacaaauuccucuuugaugaauguacccuguggggauguuucauacugacagauuauuuuuauuu

SEQ ID NO: 305257 - RNA, 66 nt, hsa
uauuggacagucucaccuccugccauaggguccugaauguuucagaccacaaggggcuccacaccu

SEQ ID NO: 305258 - RNA, 66 nt, hsa
caugccagaaaagugaaguccuagguguuuccaucuauguuucaaucuguccaucuaccaggccuc

SEQ ID NO: 305259 - RNA, 66 nt, hsa
cuccaucagaucuucucaccuugauuuugagcuggaauguuucaaugagcaaaauaaauuagacaa

SEQ ID NO: 305260 - RNA, 66 nt, hsa
ugccauugcuguaaaucuuaaaaugaaugaauaaaaauguuucauuuuacaagaggaguguaugau

SEQ ID NO: 305261 - RNA, 66 nt, hsa
gauugugacauagauuauacuacuacuaauuuuuggauguuucaaaaggucaagaaguaaaagaug

SEQ ID NO: 305262 - RNA, 66 nt, hsa
gagagagccagagacaguguugcaacugggccuggcauguuucagugugguguccagcagugucuc

SEQ ID NO: 305263 - RNA, 66 nt, hsa
auuuuuccauaguaaauugucuugcaguuuuugaaaauguuucaagucuaguuuuuacaagcacau

SEQ ID NO: 305264 - RNA, 66 nt, hsa
agacuugaugagauugaaacauggcuuuuggcaugaauguuucauagguuauguuguguucauuua

SEQ ID NO: 305265 - RNA, 66 nt, hsa
gguugugaucuuuccuguccugacccucucugaauuauguuucaauaguacucuugauugucugcc

SEQ ID NO: 305266 - RNA, 66 nt, hsa
gucuuuucauauuuaguucugguguggugucuggaaauguuucaacuguuuuaauauauugucuga

SEQ ID NO: 305267 - RNA, 66 nt, hsa
agcguuuugacccaccugccaguguuugcuugcucuauguuucaguagcagauuuucacacaugug

SEQ ID NO: 305268 - RNA, 66 nt, hsa
aaauuuaaaaagguacuuaaauuuucuggaauauccauguuucagagguaauauuuacuuucuauu

SEQ ID NO: 305269 - RNA, 66 nt, hsa
caguccaauuagaaaaugggcaaaagacaugaauagauguuucacugaagaggaucuauagauggc

SEQ ID NO: 305270 - RNA, 66 nt, hsa
ugagaaauuugugaaaaauauauuguauuucuuuugauguuucaaaagguugccuaugaaaaacug

SEQ ID NO: 305271 - RNA, 66 nt, hsa
agcuuauagucuuccaguuuaaugaacuaccaucugauguuucauauuuaaguguauuuaaagaaa

SEQ ID NO: 305272 - RNA, 66 nt, hsa
ccaaagaggcugaugucuuuguuuuuguuuuuuuuaauguuucagguucuaagugaagugaguugg

SEQ ID NO: 305273 - RNA, 66 nt, hsa
uguucuguauuuuucuuguaguguuaguuaaaacauauguuucaaaaauauaagaaaaguucaaaa

SEQ ID NO: 305274 - RNA, 66 nt, hsa
gugauauuguauauguuuugucccaguuguauaguaauguuucaguccaucauccagcuuuggcug

SEQ ID NO: 305275 - RNA, 66 nt, hsa
aguuuuaguauuguauuccaaguugauaacucuuccauguuucacauuucuaaauuuaacagagau

SEQ ID NO: 305276 - RNA, 66 nt, hsa
aaguuugauugcagacacuguagaacauaacucauuauguuucagauaagguaacuccuagauauc

SEQ ID NO: 305277 - RNA, 66 nt, hsa
ccaaagacuucauuuguguaucaucaauaaaguuguauguuucaacugacaaaaagucguucuaau

SEQ ID NO: 305278 - RNA, 66 nt, hsa
gauguucuuuaaaaucguuaauguauaacagggcuuauguuucaguuuguuuuccguucuguuuua

SEQ ID NO: 305279 - RNA, 66 nt, hsa
aguuguuuauuauccugaucaagcauggaacaaagcauguuucaggaucagaucaauacaaucuug

SEQ ID NO: 305280 - RNA, 66 nt, hsa
uuaagaagcuguuuugcuaaauuauuuuuacuuggaauguuucaaacagauuucaggcugcaaacu

SEQ ID NO: 305281 - RNA, 66 nt, hsa
ucugaaaccaacuugucccaggccacaggaguguauauguuucauaaucuuuaucaagaaguuugu

SEQ ID NO: 305282 - RNA, 66 nt, hsa
cccuacuuccaccuaaucuguuuacagucuuuugguauguuucaguuacuuagauggucucauaag

SEQ ID NO: 305283 - RNA, 64 nt, hsa
accacaccaucuucuugcugugagaggucucaccccgggcuaccuccugucacuacucacugcc

SEQ ID NO: 305284 - RNA, 64 nt, hsa
uauuuuuacuacagacggaguuuccccauguuggccgggcuagucucgaacuccugaccucagg

SEQ ID NO: 305285 - RNA, 56 nt, hsa
gcaagcuccaggugcucugaccccagccgggcuacuaggacaggccagggcacuug

SEQ ID NO: 305286 - RNA, 64 nt, hsa
cgaccgggagguccaccugcguugugagcucucaccgggcuacuaccuggcuguccccagcacc

SEQ ID NO: 305287 - RNA, 64 nt, hsa
cuaugcacacagcacucgcucuuagcuccucuguccgggcuacuaggagugagaccagcuucug

SEQ ID NO: 305288 - RNA, 64 nt, hsa
ggcaggauugggccacagacagccucucauugguccgggcuaauucacuccugcugcuccccuu

SEQ ID NO: 305289 - RNA, 64 nt, hsa
gcuuagcugcaggcccaggcccucugcucugcucccgggcuaggagguggcccucugucugggc

SEQ ID NO: 305290 - RNA, 64 nt, hsa
uucuugaagcacuuuggcccaaaagaguuaucgcccgggcuagaauuuagcagacagcuguucc

SEQ ID NO: 305291 - RNA, 64 nt, hsa
ggccugauggaaucccugucaugcgcuggucccaccgggcuacggucagcucagucaagacaga

SEQ ID NO: 305292 - RNA, 64 nt, hsa
caaguagcugggauuacaggcgugcaccaccacgccgggcuaaauuuuuuuguauuuuuaguag

SEQ ID NO: 305293 - RNA, 64 nt, hsa
uaggauuuuuggaucuuucuacagcuacggggcuccgggcuacuuugcagggaugcgaugcgua

SEQ ID NO: 305294 - RNA, 64 nt, hsa
gugucugucagacugcccuggguggagggagacgccgggcuagagccuuugggaucguccugga

SEQ ID NO: 305295 - RNA, 64 nt, hsa
uguaauugcguuaaaucuuuugagaguguaaaugccgggcuaggcaauugcaguuaauacauac

SEQ ID NO: 305296 - RNA, 62 nt, hsa
gcagcagcccagcuguuuaggguugcuggaggccgggcuaccgucuugugccugaaaaccac

SEQ ID NO: 305297 - RNA, 64 nt, hsa
uuuaagauucccaaaccuaaugaucaucugaaucccgggcuaagaaugcagacuuuucagacug

SEQ ID NO: 305298 - RNA, 64 nt, hsa
cuuuaacuccagccgcggaaugacauuaguggaaccgggcuagggaacugcuggaaguucagga

SEQ ID NO: 305299 - RNA, 64 nt, hsa
ccccuucccacucagcuucugccagcgggucgcaccgggcuagcuggcugcccagagccucuga

SEQ ID NO: 305300 - RNA, 64 nt, hsa
cugcagacuuuugcaggauugucuagccugaguaccgggcuacuucuuaaaugccgucacuccu

SEQ ID NO: 305301 - RNA, 64 nt, hsa
ccugccgcccaggagcugggcccugccacccaggccgggcuagggacauggcagggccugggca

SEQ ID NO: 305302 - RNA, 64 nt, hsa
uccagggaucagcugugugugugugaccucccuaccgggcuaucggccucuugggagccagcgg

SEQ ID NO: 305303 - RNA, 64 nt, hsa
auugcagcggcucuggcuaauugggccucagugcccgggcuauuuugaacccaggaauccuugg

SEQ ID NO: 305304 - RNA, 64 nt, hsa
caaguagcugggauuacaggcacaugccuccauaccgggcuaauuuuuguauuuuuaguagaga

SEQ ID NO: 305305 - RNA, 56 nt, hsa
acgacuuuggcugggauugagcagacccgggcuauguaccuuacccacguggcuua

SEQ ID NO: 305306 - RNA, 64 nt, hsa
uguaauugcguuaaaucuuuugagaauguaaaugccgggcuaggcaauugcaguuaauacauac

SEQ ID NO: 305307 - RNA, 64 nt, hsa
cuuugaccagccuugugagggcaucgaugcugccccgggcuaccuggcugcucugggcagggug

SEQ ID NO: 305308 - RNA, 64 nt, hsa
auguuuauauuauaaaagaguguccuaacaguccccgggcuagagaggacuaaggaaaacagag

SEQ ID NO: 305309 - RNA, 64 nt, hsa
cuuuuuuuuuuaagauagagucucacucugcugcccgggcuagagugcaguggugggaucucgg

SEQ ID NO: 305310 - RNA, 64 nt, hsa
cagguauuugaaacuacagguguguaccaccacaccgggcuaauuuuuguauuuuuuguagaga

SEQ ID NO: 305311 - RNA, 64 nt, hsa
ccauuccagaccuaacccagaccaucuccccccgccgggcuacgaugacauguaccugugaagg

SEQ ID NO: 305312 - RNA, 64 nt, hsa
aggaacucccagggaugaagauuccuccugugacccgggcuaccuguagccaaaaugcaacugg

SEQ ID NO: 305313 - RNA, 64 nt, hsa
cauggugccccucacaagccgcagcggcuggugcccgggcuaccagggacaugccagagggcuc

SEQ ID NO: 305314 - RNA, 64 nt, hsa
cuaccacuccuaccucaccaucuucgggcagaucccgggcuacaucgacgguaggagccgggcg

SEQ ID NO: 305315 - RNA, 64 nt, hsa
cgaguagcugggacuacaggcacgugugaccaugccgggcuaauuuuuuauauuuuuaguagag

SEQ ID NO: 305316 - RNA, 64 nt, hsa
uugugcgaaaacaccaccuggggcgcguccugcgccgggcuagggcucucuuugcugauuaccu

SEQ ID NO: 305317 - RNA, 64 nt, hsa
guggggaaggugugagucagcgccccuggacgggccgggcuaaaaaaggcuguuagaaccuuug

SEQ ID NO: 305318 - RNA, 64 nt, hsa; identical to SEQ ID NO: 276332

SEQ ID NO: 305319 - RNA, 64 nt, hsa; identical to SEQ ID NO: 276333

SEQ ID NO: 305320 - RNA, 64 nt, hsa; identical to SEQ ID NO: 276334

SEQ ID NO: 305321 - RNA, 64 nt, hsa; identical to SEQ ID NO: 276335

SEQ ID NO: 305322 - RNA, 64 nt, hsa; identical to SEQ ID NO: 276336

SEQ ID NO: 305323 - RNA, 64 nt, hsa; identical to SEQ ID NO: 276337

SEQ ID NO: 305324 - RNA, 64 nt, hsa; identical to SEQ ID NO: 276338

SEQ ID NO: 305325 - RNA, 64 nt, hsa; identical to SEQ ID NO: 276339

SEQ ID NO: 305326 - RNA, 64 nt, hsa; identical to SEQ ID NO: 276340

SEQ ID NO: 305327 - RNA, 64 nt, hsa; identical to SEQ ID NO: 276341

SEQ ID NO: 305328 - RNA, 64 nt, hsa; identical to SEQ ID NO: 276342

SEQ ID NO: 305329 - RNA, 64 nt, hsa; identical to SEQ ID NO: 276343

SEQ ID NO: 305330 - RNA, 64 nt, hsa; identical to SEQ ID NO: 276344

SEQ ID NO: 305331 - RNA, 64 nt, hsa; identical to SEQ ID NO: 276345

SEQ ID NO: 305332 - RNA, 64 nt, hsa; identical to SEQ ID NO: 276346

SEQ ID NO: 305333 - RNA, 64 nt, hsa; identical to SEQ ID NO: 276347

SEQ ID NO: 305334 - RNA, 64 nt, hsa; identical to SEQ ID NO: 276348

SEQ ID NO: 305335 - RNA, 64 nt, hsa; identical to SEQ ID NO: 276349

SEQ ID NO: 305336 - RNA, 64 nt, hsa; identical to SEQ ID NO: 276350

SEQ ID NO: 305337 - RNA, 64 nt, hsa; identical to SEQ ID NO: 276351

SEQ ID NO: 305338 - RNA, 64 nt, hsa; identical to SEQ ID NO: 276352

SEQ ID NO: 305339 - RNA, 64 nt, hsa; identical to SEQ ID NO: 276353

SEQ ID NO: 305340 - RNA, 64 nt, hsa; identical to SEQ ID NO: 276354

SEQ ID NO: 305341 - RNA, 64 nt, hsa; identical to SEQ ID NO: 276355

SEQ ID NO: 305342 - RNA, 64 nt, hsa; identical to SEQ ID NO: 276356

SEQ ID NO: 305343 - RNA, 64 nt, hsa; identical to SEQ ID NO: 276357

SEQ ID NO: 305344 - RNA, 64 nt, hsa; identical to SEQ ID NO: 276358

SEQ ID NO: 305345 - RNA, 64 nt, hsa; identical to SEQ ID NO: 276359

SEQ ID NO: 305346 - RNA, 64 nt, hsa
aauacuuaaggcacuauggcacuuagcuuugaagugacacgacccugucuuccuuccgcccgcu

SEQ ID NO: 305347 - RNA, 64 nt, hsa
uuuuccucauggauuuugucaaauagaugaucuuugacacgauuagacacuccuccccacaaag

SEQ ID NO: 305348 - RNA, 64 nt, hsa
uggggaaaacaaauguguaacuuuuccaguuacuugacacgauucagugggggaaaaccagcau

SEQ ID NO: 305349 - RNA, 64 nt, hsa
ggcauguccucauccuuuccugccauaaaagcuaugacacgagaaucagaauauuaauaaaacu

SEQ ID NO: 305350 - RNA, 64 nt, hsa
caccccuuuuuucugacuuugccaaguaauuuguugacacgaaaauuuuggaggaaccaauuga

SEQ ID NO: 305351 - RNA, 64 nt, hsa
augagggaucgugcacgguagcgucagcccgaauugacacgacaacucugaauguguggcccuc

SEQ ID NO: 305352 - RNA, 64 nt, hsa
gugucccugugggaggcaggcagaaggugacaauugacacgauuuccugcacgcguccuccucu

SEQ ID NO: 305353 - RNA, 64 nt, hsa
uguggcaacaggcggccgagcugccgaauucaguugacacgaggcacagaaaacaaauaucaaa

SEQ ID NO: 305354 - RNA, 64 nt, hsa
ggagucucacucugucacccaggcuggaguacagugacacgaccucggcucacugcagccuccu

SEQ ID NO: 305355 - RNA, 64 nt, hsa
ggacauuccaucccuguacccuuagugguagccaugacacgauggccagaucauggacuccgga

SEQ ID NO: 305356 - RNA, 64 nt, hsa
gaugcuccaggcaacacgguucugagucaccuucugacacgagcucccucugcuugcuuuccag

SEQ ID NO: 305357 - RNA, 64 nt, hsa
auaacaaaauaucaauacuuaacggaaaauaaggugacacgaagaaaguacauauguuaacuau

SEQ ID NO: 305358 - RNA, 64 nt, hsa
agagucuugcuccaucgcccaggcugcagugcagugacacgaucuugucucacugcaaccucug

SEQ ID NO: 305359 - RNA, 64 nt, hsa
gacaccaggacacagggacagguucugucaugggugacacgaggacacagggacagguucuauc

SEQ ID NO: 305360 - RNA, 64 nt, hsa
gaauucacacuugccuugacuuucagucucguccugacacgauuccaaaggucugccauacucu

SEQ ID NO: 305361 - RNA, 64 nt, hsa
auggaucccaaagucagaugggaguacugcaaccugacacgaugcucagacacagaagggacug

SEQ ID NO: 305362 - RNA, 64 nt, hsa
ccccagcgcgccccgacacacaugcuuuucuccaugacacgaggccaguccccaggagcagccc

SEQ ID NO: 305363 - RNA, 64 nt, hsa
auauaauuaaauuuagcugcugcaaccauuguucugacacgacuucuguuucacaguucagacc

SEQ ID NO: 305364 - RNA, 64 nt, hsa
cgcuucuagaagccaggcacagguugccaagaggugacacgaaacaggaggaaacucagugacc

SEQ ID NO: 305365 - RNA, 64 nt, hsa
ccugaaauggcugccaucaacacaauguuaaaacugacacgaaggauagaguuucacagauuuc

SEQ ID NO: 305366 - RNA, 64 nt, hsa
gucuacuuuuuaguaaaauauuuuuggauagcguugacacgauagaucuuauuccauacuucuu

SEQ ID NO: 305367 - RNA, 64 nt, hsa
gccauuucaaagacucauguuucugcuaugaccaugacacgauuuaaaucuuuucaaauguuuu

SEQ ID NO: 305368 - RNA, 64 nt, hsa
uuuuuaaaaauauauucccagauuauccuuguaaugacacgaaucugcaauaaaagccaucagu

SEQ ID NO: 305369 - RNA, 64 nt, hsa
cccacucuccaguagggaggggccgggccaucccugacacgaagcucccugggccggugaaguc

SEQ ID NO: 305370 - RNA, 64 nt, hsa
cuugcauuuaauuagacgaaacggggaguaauuaugacacgaaguacuuauguuuauuucuuag

SEQ ID NO: 305371 - RNA, 64 nt, hsa
ucgagucucgcucugucaccaggcuggagugcagugacacgaucuuggcucacugcaaccuccg

SEQ ID NO: 305372 - RNA, 64 nt, hsa
ucagccuucagguuucccacagcauggccccugcugacacgagaacccaaaguuuucccaaauc

SEQ ID NO: 305373 - RNA, 64 nt, hsa
gagagguuuuacauccccugccagcaugguggggugacacgagaccuguaagcagguggugaga

SEQ ID NO: 305374 - RNA, 64 nt, hsa
auaaacuauaucuacacugucucgucaaguucucugacacgaucuuucugggcucuacauuucc

SEQ ID NO: 305375 - RNA, 54 nt, hsa
acuccaccccacccaucuagaguuugacacgaagccuuauuucuagaagcacau

SEQ ID NO: 305376 - RNA, 64 nt, hsa
aaaaauaauuuuuacuuauauuuuucagaggauuugacacgauaagccucaucugauggaagag

SEQ ID NO: 305377 - RNA, 64 nt, hsa
ggaaucuugcuuugucagccaggcuggagugcagugacacgaucucagcucacugcaaccucug

SEQ ID NO: 305378 - RNA, 64 nt, hsa
ucucuccuggcuugggucaccagccaggcaccugugacacgagugcugcucuccaggaucucca

SEQ ID NO: 305379 - RNA, 64 nt, hsa
gucuuucagaguuguuaguuuacuccauucuuugugacacgagucaaguggcucacaaccuccu

SEQ ID NO: 305380 - RNA, 64 nt, hsa
ggcaucucacucugucacccaggcuggaguguagugacacgaucucgacucacugcaauuucca

SEQ ID NO: 305381 - RNA, 64 nt, hsa
aaaaggaccugagcuagggucugcugggauuuccugacacgauuuuccaucuucauggacaaug

SEQ ID NO: 305382 - RNA, 64 nt, hsa
gcccccucccuguggagccuguuaccuccgcauuugacacgagucugcugugaaccccgcaacc

SEQ ID NO: 305383 - RNA, 64 nt, hsa
gaaacaagaacagcgacagcccuucucgagcagaugacacgagcuaguccacguugacagcuua

SEQ ID NO: 305384 - RNA, 64 nt, hsa
cugcucuggagccugcagaugagauccgggagacugacacgaagccagcagaggucagagggga

SEQ ID NO: 305385 - RNA, 64 nt, hsa
acuccuuucaucucagcagguagaggaggacugaugacacgagcugccauggcgggaggagggg

SEQ ID NO: 305386 - RNA, 64 nt, hsa
agggggaauugucaagugaggacuucaucacauaugacacgagagaaaaguaagagcugguucu

SEQ ID NO: 305387 - RNA, 64 nt, hsa
aacauguuuuacuaagccuagaguaauucguaaaggguauaagcauaggacagauuuugcccuc

SEQ ID NO: 305388 - RNA, 64 nt, hsa
uccuauauauuugucacacauugaaaacuggacuggguauaacuauguuauaggaaaguagaaa

SEQ ID NO: 305389 - RNA, 64 nt, hsa
ucguagaguucccucagaagagccaugguguuuaugaagagaagaguagugauugcucugccag

SEQ ID NO: 305390 - RNA, 64 nt, hsa
uccucucuugaugaauuucuuaaggcugaaggaaugaagagagugggacaugggguaaucuuua

SEQ ID NO: 305391 - RNA, 64 nt, hsa
aauaaauucauuguauguuagaauugcaauagaaugaagagaaacauuuagcuaguaacgugau

SEQ ID NO: 305392 - RNA, 64 nt, hsa
cuucucaggcaacauuugcuuuuaaaaauaaucaugaagagaaggcuguuaaagcaaaaauuuu

SEQ ID NO: 305393 - RNA, 64 nt, hsa
gacuaauggguagcaaucguauuauuugcuggccugaagagaaaaaaugguaaugugugccuuu

SEQ ID NO: 305394 - RNA, 64 nt, hsa
cauguguuuuguguauaugcucacaaaaugucugugaagagauuucuuucagcuuuugcucagc

SEQ ID NO: 305395 - RNA, 64 nt, hsa
uaaccaccucugaagaaguucaaaaaaaauuauaugaagagauaaaccaaguuuuuggaaaugg

SEQ ID NO: 305396 - RNA, 64 nt, hsa
uauauggugaccacaguacuucuuaguguauuggugaagagacugcaccuacuuucuguggagg

SEQ ID NO: 305397 - RNA, 64 nt, hsa
auugagaacaauuucauaauaaaacggcuauauuugaagagagaauacauuuuauauaaacagg

SEQ ID NO: 305398 - RNA, 64 nt, hsa
agucuuuaauuucaaaaacuucaaauuagccucaugaagagaauuuuucccugugaaaaguaag

SEQ ID NO: 305399 - RNA, 64 nt, hsa
acuuuaccuagcguuuuagaaauauuaauuuacuugaagagauguagaauguagcaaauuaugu

SEQ ID NO: 305400 - RNA, 64 nt, hsa
gaugacgccaagaaguaaggggggcagagauggaugaagagaaagcccacgaagaaaaaagccu

SEQ ID NO: 305401 - RNA, 64 nt, hsa
ucacaacaugaugcuuuaguauauguauacauugugaagagacuaccacaaucaagcuaaaccu

SEQ ID NO: 305402 - RNA, 64 nt, hsa
uaucuagaauaucauuuuuguuaaucuuaauucuugaagagaauuuuuaauggguauuuaauuu

SEQ ID NO: 305403 - RNA, 64 nt, hsa
agaccaaaacauguuuggaaagagaauaaauauaugaagagagacugguuguuuuauuuucaau

SEQ ID NO: 305404 - RNA, 64 nt, hsa
cccauauugcacuuugauuucaaacuaugcacugugaagagauuuuuuuccccagguaggaagg

SEQ ID NO: 305405 - RNA, 64 nt, hsa
uuuguaacaaaauauaaaugaagauauuuuaccaugaagagauugcacuuauccuugagaacag

SEQ ID NO: 305406 - RNA, 64 nt, hsa
gaacagucuaaauauaaaugaagauauuuuaccaugaagagauugcacuuauccuugagaacag

SEQ ID NO: 305407 - RNA, 64 nt, hsa
ucacuuacucuuucugagguccaggguccuuauaugaagagauucauauauaugaagagauucg

SEQ ID NO: 305408 - RNA, 64 nt, hsa
guccaggguccuuauaugaagagauucauauauaugaagagauucgucuagagcagugguuguc

SEQ ID NO: 305409 - RNA, 64 nt, hsa
uacaagauuccagcuuucgucugucaucagacauugaagagauuuggagaaauguaaagcagca

SEQ ID NO: 305410 - RNA, 64 nt, hsa
gcuggaauuacuccuguagguauaaaccucuguaugaagagaagauuucucccaggaaaucuuu

SEQ ID NO: 305411 - RNA, 64 nt, hsa
uuuuuacaguuccaaaugaguugauaaagauuguugaagagauccaaaaccagaauaagccacu

SEQ ID NO: 305412 - RNA, 64 nt, hsa
ccucuuuuauagggggauguuuuuccaggacaagugaagagaaaauauuaaaacuagaauauuc

SEQ ID NO: 305413 - RNA, 64 nt, hsa
cuucucuuggaaacaucauaaaugcaacuuuuuuugaagagauggauaagaaagaucaagugua

SEQ ID NO: 305414 - RNA, 64 nt, hsa
cuacaaccauugcacaucauuggagaauccacagugaagagaucuuacaaguguaauaaaugug

SEQ ID NO: 305415 - RNA, 64 nt, hsa
aaucaaaccuuaaaacacauaagaaaauucacauugaagagaaaccauacagagguaagguuug

SEQ ID NO: 305416 - RNA, 64 nt, hsa
aacaaaacuccaucuaaagaagaaaaagaaaaacugaagagagaguaguugucagagugaagag

SEQ ID NO: 305417 - RNA, 64 nt, hsa
aaagagugaugaaaaauugaucuuguuuugaaauugaagagagaggccaggcgcgguggcucac

SEQ ID NO: 305418 - RNA, 64 nt, hsa
aaaccucaauggcuuuuugcuuuugaaggugguaugaagagaacguccacuuuaaggcuuuaaa

SEQ ID NO: 305419 - RNA, 64 nt, hsa
acccacuuuugaccgucacacacauuucagcauuugaagagacacaggcuaccuggaaacugcc

SEQ ID NO: 305420 - RNA, 52 nt, hsa
cgcagcugcaggaguccugacccgcccagacuguccccagacucccccgaga

SEQ ID NO: 305421 - RNA, 64 nt, hsa
uagaggcacugggaggacaguggcugaguggaggcgcccagaccugggcaggcagcaggcucag

SEQ ID NO: 305422 - RNA, 64 nt, hsa
guccuugcagaugaaaaaagucuccagagcagacuucugacaggaaagguuuagaugcuggaga

SEQ ID NO: 305423 - RNA, 64 nt, hsa
auuauguauuucagaucccuccgugggggccuucuucugacagagaauucuuugagguccgcag

SEQ ID NO: 305424 - RNA, 64 nt, hsa
agugaugcuccaggcaacacgguucugagucaccuucugacacgagcucccucugcuugcuuuc

SEQ ID NO: 305425 - RNA, 64 nt, hsa
ccuggaaacggggccccagacgccacgucgggauuucugacaugcucagcagguagaccagagg

SEQ ID NO: 305426 - RNA, 64 nt, hsa
cucuuccuuacaggugugagcaccuuuccugaaauucugacaccaugugcaaacugauccaucc

SEQ ID NO: 305427 - RNA, 64 nt, hsa
agccagcaggaggugaucauaggggcauagccaguucugacaguguuuuaggugccuggauauu

SEQ ID NO: 305428 - RNA, 64 nt, hsa
aauuaagaggaaaauagaaguugcuuuuagggguuucugacauauauucuggauacuauccgag

SEQ ID NO: 305429 - RNA, 64 nt, hsa
augacaugaaaauaauugugaaauauggaauuauuucugacacaugaagcccacuaaacuaugc

SEQ ID NO: 305430 - RNA, 64 nt, hsa
gcguauuuguguauagcagaacucugaaauaauauucugacagcaguuaucucugaggaauugg

SEQ ID NO: 305431 - RNA, 64 nt, hsa
gaaauagacuugaaagucucuaaggcucuaucaguucugacauucuaggcuucauauacauuaa

SEQ ID NO: 305432 - RNA, 64 nt, hsa
gcuuuaagucauucaagagaaccucaggcuguuuuucugacagugaugauaugauauacagaua

SEQ ID NO: 305433 - RNA, 64 nt, hsa
aaaaagcagcaaacagagggucagucacaggauguucugacacaccauuguaacuuuuuguuag

SEQ ID NO: 305434 - RNA, 64 nt, hsa
aaucuuuagcauuuaaaacuuuuuuuguuuuguuuucugacauauucugacaaagagcagcaaa

SEQ ID NO: 305435 - RNA, 64 nt, hsa
auuuaaaacuuuuuuuguuuuguuuucugacauauucugacaaagagcagcaaaccacugcugu

SEQ ID NO: 305436 - RNA, 64 nt, hsa
cuuuaauuaccuuuuuuucuuuucuuuuugauuuuucugacacugugugcgaaggcuuggaguc

SEQ ID NO: 305437 - RNA, 64 nt, hsa
ugacacugugugcgaaggcuuggaguccaagguguucugacaaggguggcuuuucucugccauu

SEQ ID NO: 305438 - RNA, 64 nt, hsa
uuuuaacaggaguuaaaauaacuccuguuaaacuuucugacaauaucauaagaauucauauuaa

SEQ ID NO: 305439 - RNA, 64 nt, hsa
cuuuuuuuuuuucauuucuggauuuuccugggauuucugacaacacaaaaguagaaagugcuug

SEQ ID NO: 305440 - RNA, 64 nt, hsa; identical to SEQ ID NO: 196865

SEQ ID NO: 305441 - RNA, 64 nt, hsa; identical to SEQ ID NO: 196866

SEQ ID NO: 305442 - RNA, 64 nt, hsa; identical to SEQ ID NO: 196867

SEQ ID NO: 305443 - RNA, 64 nt, hsa; identical to SEQ ID NO: 196868

SEQ ID NO: 305444 - RNA, 64 nt, hsa; identical to SEQ ID NO: 196869

SEQ ID NO: 305445 - RNA, 64 nt, hsa; identical to SEQ ID NO: 196870

SEQ ID NO: 305446 - RNA, 64 nt, hsa; identical to SEQ ID NO: 196871

SEQ ID NO: 305447 - RNA, 64 nt, hsa; identical to SEQ ID NO: 196872

SEQ ID NO: 305448 - RNA, 64 nt, hsa; identical to SEQ ID NO: 196873

SEQ ID NO: 305449 - RNA, 64 nt, hsa; identical to SEQ ID NO: 196874

SEQ ID NO: 305450 - RNA, 64 nt, hsa; identical to SEQ ID NO: 196875

SEQ ID NO: 305451 - RNA, 64 nt, hsa; identical to SEQ ID NO: 196876

SEQ ID NO: 305452 - RNA, 64 nt, hsa; identical to SEQ ID NO: 196877

SEQ ID NO: 305453 - RNA, 64 nt, hsa; identical to SEQ ID NO: 196878

SEQ ID NO: 305454 - RNA, 64 nt, hsa; identical to SEQ ID NO: 196879

SEQ ID NO: 305455 - RNA, 64 nt, hsa; identical to SEQ ID NO: 196880

SEQ ID NO: 305456 - RNA, 64 nt, hsa; identical to SEQ ID NO: 196881

SEQ ID NO: 305457 - RNA, 64 nt, hsa; identical to SEQ ID NO: 196882

SEQ ID NO: 305458 - RNA, 64 nt, hsa; identical to SEQ ID NO: 196883

SEQ ID NO: 305459 - RNA, 64 nt, hsa; identical to SEQ ID NO: 196884

SEQ ID NO: 305460 - RNA, 64 nt, hsa; identical to SEQ ID NO: 196885

SEQ ID NO: 305461 - RNA, 64 nt, hsa; identical to SEQ ID NO: 196886

SEQ ID NO: 305462 - RNA, 64 nt, hsa; identical to SEQ ID NO: 196887

SEQ ID NO: 305463 - RNA, 64 nt, hsa; identical to SEQ ID NO: 196888

SEQ ID NO: 305464 - RNA, 64 nt, hsa; identical to SEQ ID NO: 196889

SEQ ID NO: 305465 - RNA, 64 nt, hsa; identical to SEQ ID NO: 196890

SEQ ID NO: 305466 - RNA, 64 nt, hsa; identical to SEQ ID NO: 196891

SEQ ID NO: 305467 - RNA, 64 nt, hsa; identical to SEQ ID NO: 196892

SEQ ID NO: 305468 - RNA, 64 nt, hsa; identical to SEQ ID NO: 196893

SEQ ID NO: 305469 - RNA, 64 nt, hsa; identical to SEQ ID NO: 196894

SEQ ID NO: 305470 - RNA, 64 nt, hsa; identical to SEQ ID NO: 196895

SEQ ID NO: 305471 - RNA, 64 nt, hsa; identical to SEQ ID NO: 196896

SEQ ID NO: 305472 - RNA, 64 nt, hsa; identical to SEQ ID NO: 196897

SEQ ID NO: 305473 - RNA, 64 nt, hsa; identical to SEQ ID NO: 196898

SEQ ID NO: 305474 - RNA, 64 nt, hsa; identical to SEQ ID NO: 196899

SEQ ID NO: 305475 - RNA, 64 nt, hsa; identical to SEQ ID NO: 196900

SEQ ID NO: 305476 - RNA, 64 nt, hsa; identical to SEQ ID NO: 196901

SEQ ID NO: 305477 - RNA, 64 nt, hsa; identical to SEQ ID NO: 196902

SEQ ID NO: 305478 - RNA, 64 nt, hsa; identical to SEQ ID NO: 196903

SEQ ID NO: 305479 - RNA, 64 nt, hsa; identical to SEQ ID NO: 196904

SEQ ID NO: 305480 - RNA, 64 nt, hsa; identical to SEQ ID NO: 196905

SEQ ID NO: 305481 - RNA, 64 nt, hsa; identical to SEQ ID NO: 196906

SEQ ID NO: 305482 - RNA, 64 nt, hsa; identical to SEQ ID NO: 196907

SEQ ID NO: 305483 - RNA, 64 nt, hsa; identical to SEQ ID NO: 196908

SEQ ID NO: 305484 - RNA, 64 nt, hsa; identical to SEQ ID NO: 196909

SEQ ID NO: 305485 - RNA, 64 nt, hsa; identical to SEQ ID NO: 196910

SEQ ID NO: 305486 - RNA, 64 nt, hsa; identical to SEQ ID NO: 196911

SEQ ID NO: 305487 - RNA, 64 nt, hsa; identical to SEQ ID NO: 196912

SEQ ID NO: 305488 - RNA, 64 nt, hsa; identical to SEQ ID NO: 196913

SEQ ID NO: 305489 - RNA, 64 nt, hsa; identical to SEQ ID NO: 196914

SEQ ID NO: 305490 - RNA, 64 nt, hsa; identical to SEQ ID NO: 196915

SEQ ID NO: 305491 - RNA, 64 nt, hsa; identical to SEQ ID NO: 196916

SEQ ID NO: 305492 - RNA, 64 nt, hsa; identical to SEQ ID NO: 196917

SEQ ID NO: 305493 - RNA, 64 nt, hsa; identical to SEQ ID NO: 196918

SEQ ID NO: 305494 - RNA, 64 nt, hsa; identical to SEQ ID NO: 196919

SEQ ID NO: 305495 - RNA, 64 nt, hsa; identical to SEQ ID NO: 196920

SEQ ID NO: 305496 - RNA, 64 nt, hsa; identical to SEQ ID NO: 196921

SEQ ID NO: 305497 - RNA, 64 nt, hsa; identical to SEQ ID NO: 196922

SEQ ID NO: 305498 - RNA, 64 nt, hsa; identical to SEQ ID NO: 196923

SEQ ID NO: 305499 - RNA, 64 nt, hsa; identical to SEQ ID NO: 196924

SEQ ID NO: 305500 - RNA, 64 nt, hsa; identical to SEQ ID NO: 196925

SEQ ID NO: 305501 - RNA, 64 nt, hsa; identical to SEQ ID NO: 196926

SEQ ID NO: 305502 - RNA, 64 nt, hsa; identical to SEQ ID NO: 196927

SEQ ID NO: 305503 - RNA, 64 nt, hsa; identical to SEQ ID NO: 196928

SEQ ID NO: 305504 - RNA, 64 nt, hsa; identical to SEQ ID NO: 196929

SEQ ID NO: 305505 - RNA, 64 nt, hsa; identical to SEQ ID NO: 196930

SEQ ID NO: 305506 - RNA, 64 nt, hsa; identical to SEQ ID NO: 196931

SEQ ID NO: 305507 - RNA, 64 nt, hsa; identical to SEQ ID NO: 196932

SEQ ID NO: 305508 - RNA, 64 nt, hsa; identical to SEQ ID NO: 196933

SEQ ID NO: 305509 - RNA, 64 nt, hsa; identical to SEQ ID NO: 196934

SEQ ID NO: 305510 - RNA, 64 nt, hsa; identical to SEQ ID NO: 196935

SEQ ID NO: 305511 - RNA, 64 nt, hsa; identical to SEQ ID NO: 196936

SEQ ID NO: 305512 - RNA, 64 nt, hsa; identical to SEQ ID NO: 196937

SEQ ID NO: 305513 - RNA, 64 nt, hsa; identical to SEQ ID NO: 196938

SEQ ID NO: 305514 - RNA, 64 nt, hsa; identical to SEQ ID NO: 196939

SEQ ID NO: 305515 - RNA, 64 nt, hsa; identical to SEQ ID NO: 196940

SEQ ID NO: 305516 - RNA, 64 nt, hsa; identical to SEQ ID NO: 196941

SEQ ID NO: 305517 - RNA, 64 nt, hsa; identical to SEQ ID NO: 196942

SEQ ID NO: 305518 - RNA, 64 nt, hsa; identical to SEQ ID NO: 196943

SEQ ID NO: 305519 - RNA, 64 nt, hsa; identical to SEQ ID NO: 196944

SEQ ID NO: 305520 - RNA, 64 nt, hsa; identical to SEQ ID NO: 196945

SEQ ID NO: 305521 - RNA, 64 nt, hsa; identical to SEQ ID NO: 196946

SEQ ID NO: 305522 - RNA, 64 nt, hsa; identical to SEQ ID NO: 196947

SEQ ID NO: 305523 - RNA, 64 nt, hsa; identical to SEQ ID NO: 196948

SEQ ID NO: 305524 - RNA, 64 nt, hsa; identical to SEQ ID NO: 196949

SEQ ID NO: 305525 - RNA, 64 nt, hsa; identical to SEQ ID NO: 196950

SEQ ID NO: 305526 - RNA, 64 nt, hsa; identical to SEQ ID NO: 196951

SEQ ID NO: 305527 - RNA, 64 nt, hsa; identical to SEQ ID NO: 196952

SEQ ID NO: 305528 - RNA, 64 nt, hsa; identical to SEQ ID NO: 196953

SEQ ID NO: 305529 - RNA, 64 nt, hsa; identical to SEQ ID NO: 196954

SEQ ID NO: 305530 - RNA, 64 nt, hsa; identical to SEQ ID NO: 196955

SEQ ID NO: 305531 - RNA, 64 nt, hsa; identical to SEQ ID NO: 196956

SEQ ID NO: 305532 - RNA, 64 nt, hsa; identical to SEQ ID NO: 196957

SEQ ID NO: 305533 - RNA, 64 nt, hsa; identical to SEQ ID NO: 196958

SEQ ID NO: 305534 - RNA, 64 nt, hsa; identical to SEQ ID NO: 196959

SEQ ID NO: 305535 - RNA, 64 nt, hsa; identical to SEQ ID NO: 196960

SEQ ID NO: 305536 - RNA, 64 nt, hsa; identical to SEQ ID NO: 196961

SEQ ID NO: 305537 - RNA, 64 nt, hsa; identical to SEQ ID NO: 196962

SEQ ID NO: 305538 - RNA, 64 nt, hsa; identical to SEQ ID NO: 196963

SEQ ID NO: 305539 - RNA, 64 nt, hsa; identical to SEQ ID NO: 196964

SEQ ID NO: 305540 - RNA, 64 nt, hsa; identical to SEQ ID NO: 196965

SEQ ID NO: 305541 - RNA, 64 nt, hsa; identical to SEQ ID NO: 196966

SEQ ID NO: 305542 - RNA, 64 nt, hsa; identical to SEQ ID NO: 196967

SEQ ID NO: 305543 - RNA, 64 nt, hsa; identical to SEQ ID NO: 196968

SEQ ID NO: 305544 - RNA, 64 nt, hsa; identical to SEQ ID NO: 196969

SEQ ID NO: 305545 - RNA, 64 nt, hsa; identical to SEQ ID NO: 196970

SEQ ID NO: 305546 - RNA, 64 nt, hsa; identical to SEQ ID NO: 196971

SEQ ID NO: 305547 - RNA, 64 nt, hsa; identical to SEQ ID NO: 196972

SEQ ID NO: 305548 - RNA, 64 nt, hsa; identical to SEQ ID NO: 196973

SEQ ID NO: 305549 - RNA, 64 nt, hsa; identical to SEQ ID NO: 196974

SEQ ID NO: 305550 - RNA, 64 nt, hsa; identical to SEQ ID NO: 196975

SEQ ID NO: 305551 - RNA, 64 nt, hsa; identical to SEQ ID NO: 196976

SEQ ID NO: 305552 - RNA, 64 nt, hsa; identical to SEQ ID NO: 196977

SEQ ID NO: 305553 - RNA, 64 nt, hsa; identical to SEQ ID NO: 196978

SEQ ID NO: 305554 - RNA, 64 nt, hsa; identical to SEQ ID NO: 196979

SEQ ID NO: 305555 - RNA, 64 nt, hsa; identical to SEQ ID NO: 196980

SEQ ID NO: 305556 - RNA, 64 nt, hsa; identical to SEQ ID NO: 196981

SEQ ID NO: 305557 - RNA, 64 nt, hsa; identical to SEQ ID NO: 196982

SEQ ID NO: 305558 - RNA, 64 nt, hsa; identical to SEQ ID NO: 196983

SEQ ID NO: 305559 - RNA, 64 nt, hsa; identical to SEQ ID NO: 196984

SEQ ID NO: 305560 - RNA, 64 nt, hsa; identical to SEQ ID NO: 196985

SEQ ID NO: 305561 - RNA, 64 nt, hsa; identical to SEQ ID NO: 196986

SEQ ID NO: 305562 - RNA, 64 nt, hsa; identical to SEQ ID NO: 196987

SEQ ID NO: 305563 - RNA, 64 nt, hsa; identical to SEQ ID NO: 196988

SEQ ID NO: 305564 - RNA, 64 nt, hsa; identical to SEQ ID NO: 196989

SEQ ID NO: 305565 - RNA, 64 nt, hsa; identical to SEQ ID NO: 196990

SEQ ID NO: 305566 - RNA, 64 nt, hsa; identical to SEQ ID NO: 196991

SEQ ID NO: 305567 - RNA, 64 nt, hsa; identical to SEQ ID NO: 196992

SEQ ID NO: 305568 - RNA, 64 nt, hsa; identical to SEQ ID NO: 196993

SEQ ID NO: 305569 - RNA, 64 nt, hsa; identical to SEQ ID NO: 196994

SEQ ID NO: 305570 - RNA, 64 nt, hsa; identical to SEQ ID NO: 196995

SEQ ID NO: 305571 - RNA, 64 nt, hsa; identical to SEQ ID NO: 196996

SEQ ID NO: 305572 - RNA, 64 nt, hsa; identical to SEQ ID NO: 196997

SEQ ID NO: 305573 - RNA, 64 nt, hsa; identical to SEQ ID NO: 196998

SEQ ID NO: 305574 - RNA, 64 nt, hsa; identical to SEQ ID NO: 196999

SEQ ID NO: 305575 - RNA, 64 nt, hsa; identical to SEQ ID NO: 197000

SEQ ID NO: 305576 - RNA, 64 nt, hsa; identical to SEQ ID NO: 197001

SEQ ID NO: 305577 - RNA, 64 nt, hsa; identical to SEQ ID NO: 197002

SEQ ID NO: 305578 - RNA, 64 nt, hsa; identical to SEQ ID NO: 197003

SEQ ID NO: 305579 - RNA, 64 nt, hsa; identical to SEQ ID NO: 197004

SEQ ID NO: 305580 - RNA, 64 nt, hsa; identical to SEQ ID NO: 197005

SEQ ID NO: 305581 - RNA, 64 nt, hsa; identical to SEQ ID NO: 197006

SEQ ID NO: 305582 - RNA, 64 nt, hsa; identical to SEQ ID NO: 197007

SEQ ID NO: 305583 - RNA, 64 nt, hsa; identical to SEQ ID NO: 197008

SEQ ID NO: 305584 - RNA, 64 nt, hsa; identical to SEQ ID NO: 197009

SEQ ID NO: 305585 - RNA, 64 nt, hsa; identical to SEQ ID NO: 197010

SEQ ID NO: 305586 - RNA, 64 nt, hsa; identical to SEQ ID NO: 197011

SEQ ID NO: 305587 - RNA, 64 nt, hsa; identical to SEQ ID NO: 197012

SEQ ID NO: 305588 - RNA, 64 nt, hsa; identical to SEQ ID NO: 197013

SEQ ID NO: 305589 - RNA, 64 nt, hsa; identical to SEQ ID NO: 197014

SEQ ID NO: 305590 - RNA, 64 nt, hsa; identical to SEQ ID NO: 197015

SEQ ID NO: 305591 - RNA, 64 nt, hsa; identical to SEQ ID NO: 197016

SEQ ID NO: 305592 - RNA, 64 nt, hsa; identical to SEQ ID NO: 197017

SEQ ID NO: 305593 - RNA, 64 nt, hsa; identical to SEQ ID NO: 197018

SEQ ID NO: 305594 - RNA, 64 nt, hsa; identical to SEQ ID NO: 197019

SEQ ID NO: 305595 - RNA, 64 nt, hsa; identical to SEQ ID NO: 197020

SEQ ID NO: 305596 - RNA, 64 nt, hsa; identical to SEQ ID NO: 197021

SEQ ID NO: 305597 - RNA, 64 nt, hsa; identical to SEQ ID NO: 197022

SEQ ID NO: 305598 - RNA, 64 nt, hsa; identical to SEQ ID NO: 197023

SEQ ID NO: 305599 - RNA, 64 nt, hsa; identical to SEQ ID NO: 197024

SEQ ID NO: 305600 - RNA, 64 nt, hsa; identical to SEQ ID NO: 197025

SEQ ID NO: 305601 - RNA, 64 nt, hsa; identical to SEQ ID NO: 197026

SEQ ID NO: 305602 - RNA, 64 nt, hsa; identical to SEQ ID NO: 197027

SEQ ID NO: 305603 - RNA, 64 nt, hsa; identical to SEQ ID NO: 197028

SEQ ID NO: 305604 - RNA, 64 nt, hsa; identical to SEQ ID NO: 197029

SEQ ID NO: 305605 - RNA, 64 nt, hsa; identical to SEQ ID NO: 197030

SEQ ID NO: 305606 - RNA, 64 nt, hsa; identical to SEQ ID NO: 197031

SEQ ID NO: 305607 - RNA, 64 nt, hsa; identical to SEQ ID NO: 107827

SEQ ID NO: 305608 - RNA, 64 nt, hsa; identical to SEQ ID NO: 107828

SEQ ID NO: 305609 - RNA, 64 nt, hsa; identical to SEQ ID NO: 107829

SEQ ID NO: 305610 - RNA, 64 nt, hsa; identical to SEQ ID NO: 107830

SEQ ID NO: 305611 - RNA, 64 nt, hsa; identical to SEQ ID NO: 107831

SEQ ID NO: 305612 - RNA, 64 nt, hsa; identical to SEQ ID NO: 107832

SEQ ID NO: 305613 - RNA, 64 nt, hsa; identical to SEQ ID NO: 107833

SEQ ID NO: 305614 - RNA, 64 nt, hsa; identical to SEQ ID NO: 107834

SEQ ID NO: 305615 - RNA, 64 nt, hsa; identical to SEQ ID NO: 107835

SEQ ID NO: 305616 - RNA, 64 nt, hsa; identical to SEQ ID NO: 107836

SEQ ID NO: 305617 - RNA, 64 nt, hsa; identical to SEQ ID NO: 107837

SEQ ID NO: 305618 - RNA, 64 nt, hsa; identical to SEQ ID NO: 107838

SEQ ID NO: 305619 - RNA, 64 nt, hsa; identical to SEQ ID NO: 107839

SEQ ID NO: 305620 - RNA, 64 nt, hsa; identical to SEQ ID NO: 107840

SEQ ID NO: 305621 - RNA, 64 nt, hsa
uccaauuuuccuaaguuucuuugaggguuccaugggagcaaauaucuaaauaauggccugguag

SEQ ID NO: 305622 - RNA, 64 nt, hsa
ccacugacagccuccaccuugagcacuauucuaaggagcaaauaccuuagcucccuugagcugg

SEQ ID NO: 305623 - RNA, 64 nt, hsa
gguuggcccuccucaaggucagccuucagauuugggagcaaacuucagagaaggcagaggaaga

SEQ ID NO: 305624 - RNA, 64 nt, hsa
cccaggauaaguagaaauaugaucacagagcaacggagcaaaggcuuucgggagugugaggcug

SEQ ID NO: 305625 - RNA, 64 nt, hsa
caaaggcuuucgggagugugaggcugcaucugcuggagcaaagggaaaccgugggcuuuuccgg

SEQ ID NO: 305626 - RNA, 64 nt, hsa
ucuucagaaggacccaugucaggucugaccauugggagcaaagccauguucacacugaccuaau

SEQ ID NO: 305627 - RNA, 64 nt, hsa
cagagccugagcugcugcugugguguggcccacuggagcaaacugcuggcaccuauucuggguu

SEQ ID NO: 305628 - RNA, 64 nt, hsa
uccugccaugagcuucccagagacagaagagacuggagcaaagucggaaacacagagaagcacg

SEQ ID NO: 305629 - RNA, 64 nt, hsa
acgcacuacagagcuacgacacagggaaaccuuaggagcaaauaaaccgugcuuucauguuuuu

SEQ ID NO: 305630 - RNA, 64 nt, hsa
uaaccaauccugccagaccuguuuggggcaguggggagcaaaccuagauaaggaccuguuuggg

SEQ ID NO: 305631 - RNA, 64 nt, hsa
gcaaaccuagauaaggaccuguuuggggcagcagggagcaaaaucuccuuuaacaaccaagcag

SEQ ID NO: 305632 - RNA, 64 nt, hsa
aagcuuuaaaaacaagauugcaucauaacccccaggagcaaagcaaccuggaggcugcauaucc

SEQ ID NO: 305633 - RNA, 64 nt, hsa
uuuuguugguuauguggaaaucacaaacuccagaggagcaaagggguuuuucaaugucuuuugc

SEQ ID NO: 305634 - RNA, 64 nt, hsa
uagaauucuugccgccaucccaggucuagccuuaggagcaaauguaguagauagucgaauaaua

SEQ ID NO: 305635 - RNA, 64 nt, hsa
uguuucugucugguagagaguuugcuucucaaauggagcaaacaaauuugauuauuuuuucauu

SEQ ID NO: 305636 - RNA, 64 nt, hsa
caggaaugauuucuccuuaauugcuuaaggccggggagcaaagugucuuaacuucugucuuuga

SEQ ID NO: 305637 - RNA, 64 nt, hsa
gagucugcgguucucgccugggcagucuugacgaggagcaaaccccgccuucagagggcagaca

SEQ ID NO: 305638 - RNA, 64 nt, hsa; identical to SEQ ID NO: 165842

SEQ ID NO: 305639 - RNA, 64 nt, hsa; identical to SEQ ID NO: 165843

SEQ ID NO: 305640 - RNA, 64 nt, hsa
auuaaccuaagacacagaaggcagacugggugaggagaccuagcaugcccuauuggcagugcuc

SEQ ID NO: 305641 - RNA, 64 nt, hsa
accaaaaagaaccaaauccauagggugaaauuuugagaccuagacucuguaaaaauaauccuag

SEQ ID NO: 305642 - RNA, 64 nt, hsa
aguucuggugccuuaacgcauggcuggaauuuauagaggcuacaaccacauuuguucacaggag

SEQ ID NO: 305643 - RNA, 64 nt, hsa
aagaguuuucagagauuucauauauaucuuuuacagaggcuauuuuaaucuuuagugcaugguu

SEQ ID NO: 305644 - RNA, 64 nt, hsa
cccccaccacugagaagcuagacuuucaugcgggagaggcuacuuuuaugugucgucuuccggg

SEQ ID NO: 305645 - RNA, 64 nt, hsa
aacaagguacccagaauuuuuagaagccuucagaagaggcuaaaauauccagcuuugggggacc

SEQ ID NO: 305646 - RNA, 64 nt, hsa; identical to SEQ ID NO: 209353

SEQ ID NO: 305647 - RNA, 64 nt, hsa; identical to SEQ ID NO: 209354

SEQ ID NO: 305648 - RNA, 64 nt, hsa; identical to SEQ ID NO: 209355

SEQ ID NO: 305649 - RNA, 64 nt, hsa; identical to SEQ ID NO: 209356

SEQ ID NO: 305650 - RNA, 64 nt, hsa; identical to SEQ ID NO: 209357

SEQ ID NO: 305651 - RNA, 64 nt, hsa; identical to SEQ ID NO: 209358

SEQ ID NO: 305652 - RNA, 64 nt, hsa; identical to SEQ ID NO: 209359

SEQ ID NO: 305653 - RNA, 64 nt, hsa; identical to SEQ ID NO: 209360

SEQ ID NO: 305654 - RNA, 64 nt, hsa; identical to SEQ ID NO: 209361

SEQ ID NO: 305655 - RNA, 64 nt, hsa; identical to SEQ ID NO: 209362

SEQ ID NO: 305656 - RNA, 64 nt, hsa; identical to SEQ ID NO: 209363

SEQ ID NO: 305657 - RNA, 64 nt, hsa; identical to SEQ ID NO: 209364

SEQ ID NO: 305658 - RNA, 64 nt, hsa
uaaacuauucuugucacuuggcaucaaccucuucaugauaaauaucuacuacugagacacuuca

SEQ ID NO: 305659 - RNA, 64 nt, hsa
cugaugaggcugccauauuuugagcaucaaucuuaugauaaacuauucuugucacuuggcauca

SEQ ID NO: 305660 - RNA, 64 nt, hsa
gaacaaagggccaaauagaguuuuuauauuuguuaugauaaaaggaaguagaugugaaaaagcc

SEQ ID NO: 305661 - RNA, 64 nt, hsa
uugucuuuaucucaaguauauaaaguuuugccccaugauaaaauaaguaacauauaaauuaaua

SEQ ID NO: 305662 - RNA, 64 nt, hsa
uguugugacaguaauaaugguuauaauaauaaaaaugauaaaauugccaucauucuauuuuuau

SEQ ID NO: 305663 - RNA, 64 nt, hsa
ggguaauugcugaggugugcgguuuaucuuugagaugauaaagcuaaauuauagucuuuugcca

SEQ ID NO: 305664 - RNA, 64 nt, hsa
gaugcuaacuauuuuucaagcaagcuacagagaaaugauaaauguuuuuuguuuuauuauuuau

SEQ ID NO: 305665 - RNA, 64 nt, hsa
acacacaaaaaauaccuaaauuuuggaugagaaaaugauaaaauaugcuaaguucuaggcugga

SEQ ID NO: 305666 - RNA, 64 nt, hsa
auauguuugacuuguuaaccuacaaaacuuuaugaugauaaauuuguguuggucguaagccacu

SEQ ID NO: 305667 - RNA, 64 nt, hsa
gccacuuuacagagauaaauguaugugaauguuuaugauaaacgcuuaaauauuucuaaaauau

SEQ ID NO: 305668 - RNA, 64 nt, hsa
uuuucuacuuuuccauuaaaacauuggcaccucaaugauaaagaaauuuaagguauaaaauuaa

SEQ ID NO: 305669 - RNA, 64 nt, hsa
gucugauucugagauuucuaauuguguugugaaaaugauaaaugcagcaaaucuagcuuucagu

SEQ ID NO: 305670 - RNA, 64 nt, hsa
aaauauauaucuuuauaaaguaauauucaggaugaugauaaaaauuguuuauauuguuaugaua

SEQ ID NO: 305671 - RNA, 64 nt, hsa
auucaggaugaugauaaaaauuguuuauauuguuaugauaaaaaugacaguauaauguugccca

SEQ ID NO: 305672 - RNA, 64 nt, hsa
uauagcaggguuguagaauguaguccucagguauaugauaaaaaagaauuagacaucaagucau

SEQ ID NO: 305673 - RNA, 64 nt, hsa
agaaaaagcauuugacaaaauccaauauccauucaugauaaaaccucucaacacagaaggaaua

SEQ ID NO: 305674 - RNA, 64 nt, hsa
cuuuaaaaaaacauauuaaucauugacuacaucuaugauaaaagugcuuauuuugguuuacuaa

SEQ ID NO: 305675 - RNA, 64 nt, hsa
auuuugguuuacuaagauaaugcaguugguggaaaugauaaacguuuuaaguguuaacauccuu

SEQ ID NO: 305676 - RNA, 64 nt, hsa
uucagcuggguuuugaggaauauaagagcuuucaaugauaaagguuuguuguaguugucuuaug

SEQ ID NO: 305677 - RNA, 64 nt, hsa
uuugcuucuggcucacuuucaaucaguuaaauaaaugauaaauaauuuuggaagcugugaagau

SEQ ID NO: 305678 - RNA, 64 nt, hsa
uauuaacuauauaagagaguugugacaaaacagaaugauaaagcugcgaaccguggcacacgcu

SEQ ID NO: 305679 - RNA, 64 nt, hsa
uaaauacauugauugguaaauuaugagaaucaaaaugauaaaaagagccugcuuuuuucccuaa

SEQ ID NO: 305680 - RNA, 64 nt, hsa
gcugugaaauaguaaaauuauaaucguuuaugccaugauaaauacaagauugguaaauaaauac

SEQ ID NO: 305681 - RNA, 64 nt, hsa
cuuuaccaauuguuacuuucaaugugaggaaugaaugauaaauuaagagaaaaaaauaucagga

SEQ ID NO: 305682 - RNA, 64 nt, hsa
caacagugaggcauaucauguguuuuuauuaaaaaugauaaagauguguuucuucucaucuaaa

SEQ ID NO: 305683 - RNA, 64 nt, hsa
auaguauagaaugaacugucuagauggaugaauuaugauaaaggcuuaggacuucaaaagguga

SEQ ID NO: 305684 - RNA, 64 nt, hsa
ggagugaaguaauugacagggaaaauauagaccuaugauaaauaaccaggaagcauugcuuuug

SEQ ID NO: 305685 - RNA, 64 nt, hsa
uucaauuugaguaaaauuuaaaaccauauauuuuaugauaaagggccuuuaacuuaagauggcc

SEQ ID NO: 305686 - RNA, 64 nt, hsa
ugcguguacuguuucuaaaaaccacaaacuaagaaugauaaauuaucaauauaguuuaguauuu

SEQ ID NO: 305687 - RNA, 64 nt, hsa
gggccuuccuuuuuggaauguacgcuguuaugcuaugauaaaugauauaaugaguaaaaauuau

SEQ ID NO: 305688 - RNA, 64 nt, hsa
gaauauagaaauaauauucacuucuaaaaccauuaugauaaaauauuuguguauggauuagaau

SEQ ID NO: 305689 - RNA, 64 nt, hsa
ggagcucuguccuucaaaccuuuuagcccuauagaugauaaauaucacuggguuauaagaaaaa

SEQ ID NO: 305690 - RNA, 64 nt, hsa
gaaagagcaaaucauuaauguuguucuuguuucuaugauaaaagcacuuucagauuguucugca

SEQ ID NO: 305691 - RNA, 64 nt, hsa
cuguugcacauguuuaauuggcaaaaagcaauucaugauaaauaaaauuacugcuuuccaucua

SEQ ID NO: 305692 - RNA, 64 nt, hsa
uaaauuaguauucugauauuuguagauuauuuuaaugauaaaaaugacacuaagcuauuaauac

SEQ ID NO: 305693 - RNA, 64 nt, hsa
ugcuuucuuucccuccccuccaaugauaaagaaaaugauaaauuuucuguugugcauucaauuc

SEQ ID NO: 305694 - RNA, 64 nt, hsa
cccaccucugcuugcuuucuuucccuccccuccaaugauaaagaaaaugauaaauuuucuguug

SEQ ID NO: 305695 - RNA, 64 nt, hsa
acccaaacuuuuagaguaaaaagccaaauuuaaauuauaagaaagaagggaaaaaagagaaaaa

SEQ ID NO: 305696 - RNA, 64 nt, hsa
uuguuuuaacuucuaaagaaaauauguuucagcauuauaagaaaggcagaaugcagaacaccua

SEQ ID NO: 305697 - RNA, 64 nt, hsa
ugagagaaaacacaaaucuaaaguauguuugauuuuauaagaagcucuuguaaccaaccaucca

SEQ ID NO: 305698 - RNA, 64 nt, hsa
ugauucauugaauuuaaaauagagcaguaggaaauuauaagacucugcaauaauaucucauaau

SEQ ID NO: 305699 - RNA, 64 nt, hsa
cucagcccacccccaggguuucugaguucauagguuauaagagguaaguugaacaauuccccag

SEQ ID NO: 305700 - RNA, 64 nt, hsa
uaaaacuguuuuugcuacuuuugaagugucuuauuuauaagaucagaggucugacaccuuuuuu

SEQ ID NO: 305701 - RNA, 64 nt, hsa
ucagcuuaaaauugguaauugaauggaagcaaaauuauaagaagaggaaauuaaagucuuccau

SEQ ID NO: 305702 - RNA, 64 nt, hsa
cuugucauauaaaccugauguugagcugaguuccuuauaagaauuaaucuuaauuuuguauuuu

SEQ ID NO: 305703 - RNA, 64 nt, hsa
uaauguaauuauaacagggauuuauaagagggaauuauaagagggauuaugaaagggaauuacu

SEQ ID NO: 305704 - RNA, 64 nt, hsa
aaaguuguucuuauaauguaauuauaacagggauuuauaagagggaauuauaagagggauuaug

SEQ ID NO: 305705 - RNA, 64 nt, hsa
gcagggaggcaauguuucugaagacauuuucuguuuauaagagaguagaaagaaacacgaguuu

SEQ ID NO: 305706 - RNA, 64 nt, hsa
auuuguaggugcuuuuauguauaacuuuaaugauuuauaagaugcuaaaugaauuguuuuugua

SEQ ID NO: 305707 - RNA, 64 nt, hsa
gaaaaugcaucacaugaugaaaaauuauaguagcuuauaagagggcauauacagugaagaguaa

SEQ ID NO: 305708 - RNA, 64 nt, hsa
uuuuuucugguuuuuguuuuacuuucaaccuagguuauaagacuguuauucuauagcuccaacu

SEQ ID NO: 305709 - RNA, 64 nt, hsa
cugacuguaauggccucaagauagagagauacccuuauaagaguaaagaauuaagaugauaguc

SEQ ID NO: 305710 - RNA, 64 nt, hsa
cugcaacacuggaaaugaguucuggguaagugaguuauaagaguacaugcucuaguaacucugg

SEQ ID NO: 305711 - RNA, 64 nt, hsa
uuucccauaccuuuuuuuuucuuacuauaaaauauuauaagauccauugauguccaaauaauac

SEQ ID NO: 305712 - RNA, 64 nt, hsa
uuaaaagaacaguauuuuacaaaagguguagcuuuuauaagagugcagaaaagggaaggaugug

SEQ ID NO: 305713 - RNA, 64 nt, hsa
uguguuucuuuaugguuuuaaaacucuugagcuguuauaagagauaguucuuuuaaugugacua

SEQ ID NO: 305714 - RNA, 64 nt, hsa
aguggaaaccaggagguuaucaugguaguugaccuuauaagaaaaaugauucuucuucagaaau

SEQ ID NO: 305715 - RNA, 64 nt, hsa
auaggacagguacaauuuuggauaaauagcacauuuauaagaaccgcaaugaaaacugacuuga

SEQ ID NO: 305716 - RNA, 64 nt, hsa
acauuucacccaggcaggccauuuucuuuugugauuauaagaaagaguaguuguugauuaaauu

SEQ ID NO: 305717 - RNA, 64 nt, hsa
accauuagaauagucauaccuggaaugugucaaauuauaagagacagacacuugguuaguggcu

SEQ ID NO: 305718 - RNA, 64 nt, hsa
guuuguuacuauguauguuuuuuuccaaugcuucuuauaagacuaaaugauuagaaguaccuaa

SEQ ID NO: 305719 - RNA, 64 nt, hsa
caguacuuuauauuuauaaauguauuuauuauuauuauaagacugcauuuuauuuauaucauuu

SEQ ID NO: 305720 - RNA, 64 nt, hsa
cguuaguuacaaaggaaaccaaugccacuuuuguuuauaagaccagaagguagacuuucuaagc

SEQ ID NO: 305721 - RNA, 64 nt, hsa
aggacuccuaucgguauacaaauuccauuucuuuuuauaagaaaaacacauaaaccauuaucau

SEQ ID NO: 305722 - RNA, 64 nt, hsa
ugguaaagcaaauuucacaggaaaauagacaaaauuauaagagauuccuggagacaacacaagg

SEQ ID NO: 305723 - RNA, 64 nt, hsa
auaaauguaaaaugcacagaaaugcaugcaauacuuauaagacuuaaaaauuguguuuacagau

SEQ ID NO: 305724 - RNA, 64 nt, hsa
uauuuuuaaaaggacuuuaacgaagucaaacaacuuauaagacuagugauucacuggggcauua

SEQ ID NO: 305725 - RNA, 64 nt, hsa
gcuuugucuuggccaauuacuucagcaaguacugagaacucauuuucuacccugccucgucuua

SEQ ID NO: 305726 - RNA, 64 nt, hsa
gaacgauaaacagugaagucuccuucccuccuuuagaacucauuuucucuucccaaaaaguguu

SEQ ID NO: 305727 - RNA, 64 nt, hsa
auggguuuuaugagauggaucacauauuuuauuaagaacucaaacuucuggcucccucuucuuu

SEQ ID NO: 305728 - RNA, 64 nt, hsa
ggagagauagccuguggcccuguccugccaugcaagaacucaucacuguggcugucuggaaagc

SEQ ID NO: 305729 - RNA, 64 nt, hsa
ugcuauuugaagcagauguucaccaaugucagcaagaacucaaccugaauuuaaagguggcauu

SEQ ID NO: 305730 - RNA, 64 nt, hsa
acucuuacagugauuauuuagauauuaaagacugagaacucacggcuuaaccccagucuugaug

SEQ ID NO: 305731 - RNA, 64 nt, hsa
caucuaguucaacaucagagcauucauaccaaagagaacucaugaauguaaugaagaugggaag

SEQ ID NO: 305732 - RNA, 64 nt, hsa
gcgugugucacugugcugggccuauuuuauuuauagaacucauuuaagcuguuuuuauuuuaau

SEQ ID NO: 305733 - RNA, 64 nt, hsa
ccaagggccacgggaacuuggagagggagcuuggagaacucacugugggcuaggguggucagag

SEQ ID NO: 305734 - RNA, 64 nt, hsa
ccgaugcaguaucagcagcucuuuuccagaucaaagaacucaaagaaaacugucugggagauuc

SEQ ID NO: 305735 - RNA, 64 nt, hsa
cuuucaucagaagucagcucuaauuguucaccacagaacucauauaagacagaaacccuauggg

SEQ ID NO: 305736 - RNA, 64 nt, hsa
gagagcuagaaaaccuggaguguggcauuagaauagaacucauaucuuuuaaauauauaggaac

SEQ ID NO: 305737 - RNA, 64 nt, hsa
gucuccuaggauccaggccucugggcuucugccaagaacucaggguggcccuaugacuuggagg

SEQ ID NO: 305738 - RNA, 64 nt, hsa
ccuggagugagggggcugaagucagaccaaaggaagaacucagaaaugucuuguuuauuugugu

SEQ ID NO: 305739 - RNA, 64 nt, hsa
uuguggacccauuagcaagugacauugucacaucagaacucaugaaacugauguaaggcaauua

SEQ ID NO: 305740 - RNA, 64 nt, hsa
gaauuuugaauuguuauucuauuuuuuauuuuccagaacucauuuuuuaccuucagggguggga

SEQ ID NO: 305741 - RNA, 64 nt, hsa
uuaauauuuaaaaacccaaauuaucaaaccauuaagaacucauuacugguucucagccuccucc

SEQ ID NO: 305742 - RNA, 64 nt, hsa
gaucuugucuccuaguccugaggagcggaggcugagaacucagugcugguuuguaaauggugag

SEQ ID NO: 305743 - RNA, 64 nt, hsa
caaacugucucucagaccacagugcaaucaaacuagaacucaggauuaagaaacucacucaaaa

SEQ ID NO: 305744 - RNA, 64 nt, hsa
aacuagcagaaggcaagaaauaacuaaaaucagcagaacucaaggaaauagagacacaaaaaaa

SEQ ID NO: 305745 - RNA, 64 nt, hsa
agauaauuaggcaccgaccuugggcugcuguuagagaacucaggcagcagcgccagugacacgg

SEQ ID NO: 305746 - RNA, 64 nt, hsa
gaaguggcugaaaaacuaaggcaguggcaaagguagaacucaggcagggguggagaaaaggcgu

SEQ ID NO: 305747 - RNA, 64 nt, hsa
agcgcugggggugauuuuaggcagcaagaauuggagaacucacacugcgaaaagaaaaccuugg

SEQ ID NO: 305748 - RNA, 64 nt, hsa
cuucacucauucccguuuccuucaaggacaugaaagaacucauaccgcaaagaagcuaugugaa

SEQ ID NO: 305749 - RNA, 64 nt, hsa
cuuugauuguuccaguacacugcaaagucaugaaagaacucacacuggagagaagaaacucuau

SEQ ID NO: 305750 - RNA, 64 nt, hsa
auuuuucuggcccaguuuauuucguaugcaugaaagaacucacucuggagagaaacuauaugaa

SEQ ID NO: 305751 - RNA, 64 nt, hsa
acaguucuucuaugauuccaagcaucuggugcacagaacucaagaccucaaaauugaguuacug

SEQ ID NO: 305752 - RNA, 64 nt, hsa
aaugauugccauuaucaucauuacauacuguuagagaacucaaauggugggaauauuuuaugau

SEQ ID NO: 305753 - RNA, 64 nt, hsa
aaggcuggaguuauuauucaacucaaucucccagagaacucagaggcuacaguuucuacaggca

SEQ ID NO: 305754 - RNA, 64 nt, hsa
gagucucagguccagguggagucuguagguugccagaacucaaaagucugaaaaacaucccaaa

SEQ ID NO: 305755 - RNA, 64 nt, hsa
auaucuuuguuuuaaccaguacuucuaagagcauagaacucaaaugcuggggguagguggcuaa

SEQ ID NO: 305756 - RNA, 64 nt, hsa
cgaacauaauggacgugaaguggggcagaaacccagaacucagcauucaaggaugcccaggaga

SEQ ID NO: 305757 - RNA, 57 nt, hsa
cacaacuccuaugacuggcuccuacuuacauucaaguuaaaaaggcugauaugaaca

SEQ ID NO: 305758 - RNA, 57 nt, hsa
ucuaccugggagacuaguuagcaguccacauucaagaggagacuuggaguuuauugu

SEQ ID NO: 305759 - RNA, 57 nt, hsa
aggucugucacucuuguuacauuguguacauucaaaaggaagagagaaaauauauau

SEQ ID NO: 305760 - RNA, 57 nt, hsa
acaugcaaaaggcucuccuaauacuccacauucaaacugaagaggaaaauugaaauc

SEQ ID NO: 305761 - RNA, 57 nt, hsa
cacuauacuuugcuucaaaccuucagaacauucaaaccguuuauguuucucaucuaa

SEQ ID NO: 305762 - RNA, 57 nt, hsa
caucuugcuuagucauguuguuauaaaacauucaaauucugauauacauugcuugaa

SEQ ID NO: 305763 - RNA, 57 nt, hsa
auaggucauacaugaaugucuagugagacauucaaaauucguauagggugcagagua

SEQ ID NO: 305764 - RNA, 57 nt, hsa
uauuuuuuaaaauuuacuuaguaaugcacauucaaaacacacaucaagucuucagga

SEQ ID NO: 305765 - RNA, 57 nt, hsa
guuuguguucuuuuacuguguccucucacauucaaguauuagcaacuugcaguauau

SEQ ID NO: 305766 - RNA, 57 nt, hsa
auucuguuaaaaugcagaggugcuauaacauucaaagugucagauuccuugggagua

SEQ ID NO: 305767 - RNA, 57 nt, hsa
uaaauaaauaaccaaaaauguauguaaacauucaaaugauuaucugaacaaaugaga

SEQ ID NO: 305768 - RNA, 57 nt, hsa
uaugauguuuauuugaaugacuguugaacauucaaauuuguauuauuuggagaugaa

SEQ ID NO: 305769 - RNA, 57 nt, hsa
uuaaugaaauagguuccagugaugaaaacauucaagcagaacuagguagaaacagag

SEQ ID NO: 305770 - RNA, 57 nt, hsa
aaaucugcuagaggaaaacuuugaggaacauucaaugucaccugaaagagaaauggg

SEQ ID NO: 305771 - RNA, 57 nt, hsa
gaacuugaugcucaguauuugcagaauacauucaagguuucaaagcgccagucauuu

SEQ ID NO: 305772 - RNA, 57 nt, hsa
caguuaacaaaagaaaacauuuaauaaacauucaauaaugauuacaguuuucauuuu

SEQ ID NO: 305773 - RNA, 57 nt, hsa
aagacccuuaaaaugaagaaccuccuaacauucaauuuuagguccuacuacauuguu

SEQ ID NO: 305774 - RNA, 64 nt, hsa
agccaguugcuaaaaaauuggggguuuggugaagaaaucugauuguuguguguauucaaugugu

SEQ ID NO: 305775 - RNA, 64 nt, hsa
cuggauuuaggugguaauaggggcugugggccauaaaucugaagccuugagaaccuugggucug

SEQ ID NO: 305776 - RNA, 64 nt, hsa
cucuaauucaaaaaucugaaauccagaagcuucaaaaucugaaucuuuuugagcacugacuuga

SEQ ID NO: 305777 - RNA, 64 nt, hsa
gaaugauacuacaaguugagcaucucuaauucaaaaaucugaaauccagaagcuucaaaaucug

SEQ ID NO: 305778 - RNA, 64 nt, hsa
ccuuugcauaucugaacuuggcagguaccguucuaaaucugaaacagggugauagcucaaaguu

SEQ ID NO: 305779 - RNA, 64 nt, hsa
cgauuugaguuggugggcaaaacucuaaaaaucuaaaucugaugcuuauguaaggguugagcga

SEQ ID NO: 305780 - RNA, 64 nt, hsa
uuauuucugguuuugaaguaaucgaacaaauugaaaaucugaagaccgaugcugcaagcagacc

SEQ ID NO: 305781 - RNA, 64 nt, hsa
gucaucucaucacucaucaaagagagacuggucuaaaucugauaaggauguccagagcucuuua

SEQ ID NO: 305782 - RNA, 64 nt, hsa
uagccaguccaggaguccaaguagaucucgaaguaaaucugaaaccaaaucaagacacagaaca

SEQ ID NO: 305783 - RNA, 64 nt, hsa
aauauuugcauuauacuuaccaguugggcaucccaaaucugaaaucugaaauguuccaugagca

SEQ ID NO: 305784 - RNA, 64 nt, hsa
gcauuauacuuaccaguugggcaucccaaaucugaaaucugaaauguuccaugagcauuuccuu

SEQ ID NO: 305785 - RNA, 64 nt, hsa
cauggauuaauggggcuuacccuuguugcacucgaaaucugagguguaucuagcccugccacua

SEQ ID NO: 305786 - RNA, 64 nt, hsa
uuaguucuagauauguacuucaugguuaaauucuaaaucugaaaaugcuagugggagauaucaa

SEQ ID NO: 305787 - RNA, 64 nt, hsa
caugucaacuaauagcuuuuauaugguauguaacaaaucugaauuauguuaugcugugaauuau

SEQ ID NO: 305788 - RNA, 64 nt, hsa
caucuggcuuuuuaggcaccuucacuaaaggcaaaaaucugauuuguaguuuuuauuagcaugu

SEQ ID NO: 305789 - RNA, 64 nt, hsa
cacaacaaaagaaacaucagaaguuuauaaaaauaaaucugacuauaugcauccucauuuauuc

SEQ ID NO: 305790 - RNA, 64 nt, hsa
aaagaccauugcaggcaauggaauugugccagagaaaucugauuucuaguacaaaaggaauacu

SEQ ID NO: 305791 - RNA, 64 nt, hsa
cucaaaauuuucaguaggcaaauagguaauguggaaaucugaagaagaaaugaauauccaguau

SEQ ID NO: 305792 - RNA, 64 nt, hsa
cuuuauagcuacaaagucagggcguucauaggcaaaaucugacaagacugaaacaauugggaga

SEQ ID NO: 305793 - RNA, 64 nt, hsa
uuuccacuauggucgguuucaggaauuucaaaagaaaucugacgucaaugcaauuauccauuau

SEQ ID NO: 305794 - RNA, 63 nt, hsa
auaauucacuguaaugauguaauucuugaauaauaaaucugacaaaauauuaguuguguucaa

SEQ ID NO: 305795 - RNA, 64 nt, hsa
auaccuuccuauuucucaauagucuuuaaacccuaaaucugagucaguaauucucuuacauccu

SEQ ID NO: 305796 - RNA, 64 nt, hsa
auaccuuccuauuucucaauagucuuuaagcccuaaaucugagucaguaauucucuaaaaaucc

SEQ ID NO: 305797 - RNA, 64 nt, hsa
aaugggguaucuggaaaaggaaaaugaucuggauaaaucugagaccuggggggaaguuuguuuu

SEQ ID NO: 305798 - RNA, 64 nt, hsa
aauaauuuaucaaaauaagagggaaagugcaaucaaaucugaauuauuuuacuauuuguuucua

SEQ ID NO: 305799 - RNA, 64 nt, hsa
uugacaaagaaaagaaaaucaauguuaaaccauuaaaucugagcacuguuagacuugauuaauc

SEQ ID NO: 305800 - RNA, 64 nt, hsa
ugacuaaaguuauaaauacaauauuuauaucuauaaaucugaaguuuaacaugauuaauuuaaa

SEQ ID NO: 305801 - RNA, 64 nt, hsa
auuaucaaaggaaaaaguauuugcugaggugaaaaaaucugauguuugaggaaguuuuuauuuu

SEQ ID NO: 305802 - RNA, 64 nt, hsa
agagacagggaggaaguuuuuauuuuuauaaacaaaaucugauguucagaggccccguuucuua

SEQ ID NO: 305803 - RNA, 64 nt, hsa
uuuuuuauaaagucuaagcaagauguuuuguauaaaaucugaauuuugcaauguauuuagcuac

SEQ ID NO: 305804 - RNA, 64 nt, hsa
acagggaaagcauuuaggagaauagcagagagccaaaucugaccuaaaaguugaaaagccaaag

SEQ ID NO: 305805 - RNA, 64 nt, hsa
ggaaaggggggaaaagaguaacuuuacaguggagaaaucugacagacaccagcucagccaggug

SEQ ID NO: 305806 - RNA, 64 nt, hsa
uucucaaaacuaucaaggccauaaaaaacaaggaaaaucugagacauggucacagccaagagga

SEQ ID NO: 305807 - RNA, 64 nt, hsa
aaaagaaaaaaaggucauuugguagaaacuagggaaaucugaauacaguguggacuucaguuaa

SEQ ID NO: 305808 - RNA, 64 nt, hsa
ucccuuccuuaaaguacucuaaaccuuuaaaaaaaaaucugauuuaugcagcagagaugggaca

SEQ ID NO: 305809 - RNA, 64 nt, hsa
gcaaguaaguaucauaguauuaagaaauuugccuaaaucugaguugugccuuucuuuacucaca

SEQ ID NO: 305810 - RNA, 64 nt, hsa
uuauagagaaaggguuuugucaaauguuuucugaaaaucugaguaauucaaagcaugccucugc

SEQ ID NO: 305811 - RNA, 64 nt, hsa
aaaugugccuaauccuguguuacauucuguucuuaaaucugaaugccuucucauuuaauucuga

SEQ ID NO: 305812 - RNA, 64 nt, hsa
ccauaaaaguaauuauacuggugagaaauccuagaaaucugaagagugagauaaagccuuuaaa

SEQ ID NO: 305813 - RNA, 64 nt, hsa
uucagauauacuaaaucagagugcuaaguauagaaaaucugaaacuaaaguugguagaaaaguu

SEQ ID NO: 305814 - RNA, 64 nt, hsa
cuucucugugacugugaagccugcuguucccugaaaaucugauaauggagcaguggagguuuuu

SEQ ID NO: 305815 - RNA, 64 nt, hsa
uuuagccaacucccauuccaacuaggcuuuggcuaaaucugacaauuuuauauauagcuuaaaa

SEQ ID NO: 305816 - RNA, 64 nt, hsa
aauucucaguaugggguuucccucuggaaaaagaaaaucugaagacauuacaguugccuauugc

SEQ ID NO: 305817 - RNA, 64 nt, hsa
cauuaaagaaagcacuaaggaugaugggagcuccaaaucugauaucagauaauuuagauugugg

SEQ ID NO: 305818 - RNA, 64 nt, hsa; identical to SEQ ID NO: 50550

SEQ ID NO: 305819 - RNA, 64 nt, hsa; identical to SEQ ID NO: 50551

SEQ ID NO: 305820 - RNA, 64 nt, hsa; identical to SEQ ID NO: 50552

SEQ ID NO: 305821 - RNA, 64 nt, hsa; identical to SEQ ID NO: 50553

SEQ ID NO: 305822 - RNA, 64 nt, hsa; identical to SEQ ID NO: 50554

SEQ ID NO: 305823 - RNA, 64 nt, hsa; identical to SEQ ID NO: 50555

SEQ ID NO: 305824 - RNA, 64 nt, hsa; identical to SEQ ID NO: 194965

SEQ ID NO: 305825 - RNA, 64 nt, hsa; identical to SEQ ID NO: 194966

SEQ ID NO: 305826 - RNA, 64 nt, hsa; identical to SEQ ID NO: 194967

SEQ ID NO: 305827 - RNA, 64 nt, hsa; identical to SEQ ID NO: 194968

SEQ ID NO: 305828 - RNA, 64 nt, hsa; identical to SEQ ID NO: 194969

SEQ ID NO: 305829 - RNA, 64 nt, hsa; identical to SEQ ID NO: 194970

SEQ ID NO: 305830 - RNA, 64 nt, hsa; identical to SEQ ID NO: 194971

SEQ ID NO: 305831 - RNA, 64 nt, hsa; identical to SEQ ID NO: 194972

SEQ ID NO: 305832 - RNA, 64 nt, hsa; identical to SEQ ID NO: 194973

SEQ ID NO: 305833 - RNA, 64 nt, hsa; identical to SEQ ID NO: 194974

SEQ ID NO: 305834 - RNA, 64 nt, hsa; identical to SEQ ID NO: 194975

SEQ ID NO: 305835 - RNA, 64 nt, hsa; identical to SEQ ID NO: 194976

SEQ ID NO: 305836 - RNA, 64 nt, hsa; identical to SEQ ID NO: 194977

SEQ ID NO: 305837 - RNA, 64 nt, hsa; identical to SEQ ID NO: 194978

SEQ ID NO: 305838 - RNA, 64 nt, hsa; identical to SEQ ID NO: 194979

SEQ ID NO: 305839 - RNA, 64 nt, hsa; identical to SEQ ID NO: 194980

SEQ ID NO: 305840 - RNA, 64 nt, hsa; identical to SEQ ID NO: 194981

SEQ ID NO: 305841 - RNA, 64 nt, hsa; identical to SEQ ID NO: 194982

SEQ ID NO: 305842 - RNA, 64 nt, hsa
acuacacauuggcaaauagcgugggauagauuuguuucuuaaugggugugaccaauccuguuuu

SEQ ID NO: 305843 - RNA, 64 nt, hsa
aucuuuuuuccuaguuuuucuaauacuaauguuauuucuuaaaauucagugagauauaggauaa

SEQ ID NO: 305844 - RNA, 64 nt, hsa
uuuuuacaguacauaugucuugacugagcuguccuuucuuaauacaaaagcguguauaauuuuc

SEQ ID NO: 305845 - RNA, 64 nt, hsa
agcuguccuuucuuaauacaaaagcguguauaauuuucuuaacuuguacaguugguaaacuuuu

SEQ ID NO: 305846 - RNA, 64 nt, hsa
agagcuaaguaaguaaaguuuuauaacuguuagguuucuuaaugaucauauuuugcaguuuuag

SEQ ID NO: 305847 - RNA, 64 nt, hsa
aacauccuuauacuuucuauuuuaaguauaucuguuucuuaaguaaacaacuuagauauuuucc

SEQ ID NO: 305848 - RNA, 64 nt, hsa
gcaagaaccuaacuaacgugaugauaugaagaguuuucuuaagaccugucgucaaacuuaaaag

SEQ ID NO: 305849 - RNA, 64 nt, hsa
ucaggugcaguaugauauuuccuaaucuuuccuauuucuuaacaaaagauuuuaaaguacuucu

SEQ ID NO: 305850 - RNA, 64 nt, hsa
cagcuccucuuuaaacuccuccucucuugaugaauuucuuaaggcugaaggaaugaagagagug

SEQ ID NO: 305851 - RNA, 64 nt, hsa
acagacaguccauaucugugaggccagcaaauauuuucuuaaacucauggggagacagcagauu

SEQ ID NO: 305852 - RNA, 64 nt, hsa
acaggcucaguguaacuguauauccauucuaggcuuucuuaauaaaucuugaggcuaugggaua

SEQ ID NO: 305853 - RNA, 64 nt, hsa
uauugaaacguugaaaucuaaagcaaauuugcaauuucuuaagauuucuaaaauuuaccagaac

SEQ ID NO: 305854 - RNA, 64 nt, hsa
agucaguuugagucucacaagaagguaaguagaguuucuuaauagucacaacuuaauuugaacc

SEQ ID NO: 305855 - RNA, 64 nt, hsa
guuugcuuuaauauggcuuguaauucuugacauuuuucuuaaaauuaaaacgaauuuuuauuuu

SEQ ID NO: 305856 - RNA, 64 nt, hsa
caauaguguauaaauaucauguaaaugugauggauuucuuaaucauauuuauuucauauuaauc

SEQ ID NO: 305857 - RNA, 64 nt, hsa
uuuagucagagggcuagaggugcagauuucauauuuucuuaaugaaaauauuuuccuaauacac

SEQ ID NO: 305858 - RNA, 64 nt, hsa
agaaaccaaggguauguguuuuaaaauuacacuuuuucuuaaccugucuagcugucggaaaagg

SEQ ID NO: 305859 - RNA, 64 nt, hsa
agacgauuaggugccuaacuggcaaaugccuuaguuucuuaaaacguauuuucugauguggcuu

SEQ ID NO: 305860 - RNA, 64 nt, hsa
aguucuuccuauuccauucucgaccaaccugcccuuucuuaauaugacuaguggucuugaugcu

SEQ ID NO: 305861 - RNA, 64 nt, hsa
cuuggaaaaaucuugcuuggcuauuucugcaucauuucuuaaggcugccuuccucucucaguac

SEQ ID NO: 305862 - RNA, 64 nt, hsa
uggcugcuuuugaauggggaggaaagaagacauuuuucuuaauauccuuuuugucccaucucua

SEQ ID NO: 305863 - RNA, 64 nt, hsa
aaaauauauguuacaguuuaucugguacuucauuuuucuuaacuaaaauuacuuuuuacuuuaa

SEQ ID NO: 305864 - RNA, 64 nt, hsa
auacuuaaacugggauuaaaaccucauagucauuuuucuuaauugcccuuaauauuuugacaua

SEQ ID NO: 305865 - RNA, 64 nt, hsa
acaagaacauuuguuuguuugucuucugauguuuuuucuuaaaauaguaauuucuccuacuuuu

SEQ ID NO: 305866 - RNA, 64 nt, hsa
ggaacuaagacauuucuaauuuauugcuuauuacuuucuuaauuuuacaggauaauuauaagca

SEQ ID NO: 305867 - RNA, 64 nt, hsa
agcuaacagggagagguuacacaauauuuuacaguuucuuaaacauaauuuaaugcaucaccuu

SEQ ID NO: 305868 - RNA, 64 nt, hsa
auucgaguauuuuaauguuauaccugccauuuuuuuucuuaaagcauauucuuugcaucuaacu

SEQ ID NO: 305869 - RNA, 64 nt, hsa
agguauagcuauugcacuuaugccaucuccaaaauuucuuaaguauucuuucacuauccauuag

SEQ ID NO: 305870 - RNA, 64 nt, hsa
uucuuaaguauucuuucacuauccauuaggaguuuuucuuaaacuugucugauaauaagaauca

SEQ ID NO: 305871 - RNA, 64 nt, hsa
auauuccggugauaacuuuaaaaauuagauacauuuucuuaacauuuuuuucuuuuuuaauguu

SEQ ID NO: 305872 - RNA, 64 nt, hsa
accucuguaagcaauagauuuugcuuggguuuucuuucuuaaaaaaauaauacuaugcaggcaa

SEQ ID NO: 305873 - RNA, 64 nt, hsa
cauauuacagcugaaaauuuugagaagguaaaaguuucuuaauuaaaauaugaacauauuuagc

SEQ ID NO: 305874 - RNA, 64 nt, hsa
uguuaaugccaaaguugccugaacauugggcgguuuucuuaauuugaaguauaaaaauuauaaa

SEQ ID NO: 305875 - RNA, 64 nt, hsa
uuuagaacauaugaacugaaugaaauggacauuuuuucuuaauuuauguauaaauccauaugau

SEQ ID NO: 305876 - RNA, 64 nt, hsa
caugcaacugaaaaugucucaccuuucaucuuuuuuucuuaauucauaaaguuaucuuguagaa

SEQ ID NO: 305877 - RNA, 64 nt, hsa
uuauuuuuuauuuucaggaaaguuauacuaguauuuucuuaaguguggaaucaaaugagcacau

SEQ ID NO: 305878 - RNA, 64 nt, hsa
uucuaauuuugcagaucuuuacauuuuuauugcuuuucuuaaaauaagggauagcuuugcaacc

SEQ ID NO: 305879 - RNA, 64 nt, hsa
agguuugguaaugugauauuuuaagcuuauucuuuuucuuaaaagagagaggugacgaaggaag

SEQ ID NO: 305880 - RNA, 64 nt, hsa
uaaaaugcaauaaacaucucaguauuugaaggguuuucuuaaaguaugucaaaugacuacaauc

SEQ ID NO: 305881 - RNA, 64 nt, hsa
gugccccagcugcccugaggucaaucaaggaaaauuucuuaaugaaauaagcuccaaagagcca

SEQ ID NO: 305882 - RNA, 64 nt, hsa
uuuugcucccucuuuugaggguaaagcuacugucuuucuuaagaguguauuuaugccaaguuug

SEQ ID NO: 305883 - RNA, 64 nt, hsa
gcaugucuuuugggaggcagauauccacuuaacuuuucuuaaaaauacuuucaguugccuuugc

SEQ ID NO: 305884 - RNA, 64 nt, hsa
caaacuauuuauauugaaagcuauaugcacuuuauuucuuaacugaauugcaucaacaauguuc

SEQ ID NO: 305885 - RNA, 64 nt, hsa
aguaggaggcagugugagcuuuuuauuuuuuauuuuucuuaagguggucuuaguaauauaacau

SEQ ID NO: 305886 - RNA, 64 nt, hsa
caaaauugagagaaauuaggaacacugcuauuuuuuucuuaaaaauguuuuuaagaauauguuc

SEQ ID NO: 305887 - RNA, 64 nt, hsa
ugccauuuuguaaacuaaggauuuuggacugagauuucuuaaaucuuucuucaaaucucccaca

SEQ ID NO: 305888 - RNA, 64 nt, hsa
uaaggaaaggauccuacaauauuuuauucuaggguuucuuaaauauaugauuuauauuacuguc

SEQ ID NO: 305889 - RNA, 64 nt, hsa
uaucaugggcucugcagaacauaucaaaauaggauuucuuaaauuuuucaacccccagaccaua

SEQ ID NO: 305890 - RNA, 64 nt, hsa
uuaagcagguauuagauuuaggaaaaccuuuccauuucuuaaaguauuaucaagugucaagauc

SEQ ID NO: 305891 - RNA, 64 nt, hsa
auuugaaaaacuuuuuauaaaaaauuguuugauauuucuuaaugucugcucugagccuuaaaac

SEQ ID NO: 305892 - RNA, 64 nt, hsa
uauuccuuuuaaaccauaaauauuuuaaauaauauuucuuaagagugauaaauaacauuuuuuc

SEQ ID NO: 305893 - RNA, 64 nt, hsa
aguuuuucauaguguaggauuuugaagaaguguuuuucuuaaagcagauacgaugacauaaggc

SEQ ID NO: 305894 - RNA, 64 nt, hsa
aacuagaaacagcuccaguguuuuuaagagaauguuucuuaaaaccaauaggaaacuuaagcga

SEQ ID NO: 305895 - RNA, 64 nt, hsa
ccagagaaacugagguaacugucauuagaaaagguuucuuaaaauacucacaaagcuguuauug

SEQ ID NO: 305896 - RNA, 64 nt, hsa
uguaaauuuaaaaaggggaaauacuuuaauuuuuuuucuuaauaguguaaaaauucccugagcu

SEQ ID NO: 305897 - RNA, 64 nt, hsa
ugucuugucccaguucuucaaacacucuuaaauuuuucuuaaguaauguaaaaauggaacugcc

SEQ ID NO: 305898 - RNA, 64 nt, hsa
uuucccuggugccucucacuucguuggugaccaguuucuuaaacugaaagcuuuaauguuacau

SEQ ID NO: 305899 - RNA, 64 nt, hsa
uuuguuugguauaaauuaauuuguuaauuaaauauuucuuaaguauaaaccuuaugaacuacag

SEQ ID NO: 305900 - RNA, 64 nt, hsa
aauauuuuguuaacuuuuguuuuuuuuuguuuguuuucuuaaaaguaccucugcauugagcaua

SEQ ID NO: 305901 - RNA, 64 nt, hsa
uaaacauguuuaaaguguacuuauaaacuauuuuuuucuuaaagcaaacuaugauuuauuuugg

SEQ ID NO: 305902 - RNA, 64 nt, hsa
acagcuagacuugcauuucagguauuaaaauugcuuucuuaacugucaagaaucacaaaauaac

SEQ ID NO: 305903 - RNA, 64 nt, hsa
uauuacccuuguaggaauaguuuaaggaaauucauuucuuaaaaauauaguguccucaaauaau

SEQ ID NO: 305904 - RNA, 64 nt, hsa
gaccacaaauaguuaucuuuuaauuacagaagaguuucuuaacuuacuuuuguaaguuuuuauu

SEQ ID NO: 305905 - RNA, 64 nt, hsa
aauguacauguuccuuuguaauugacacuauauauuucuuaauaaaauaauucucaaauuuguu

SEQ ID NO: 305906 - RNA, 64 nt, hsa
gauaggcagcuucaggaugcauugcaaucauccuuuucuuaaauuaugucacuagucuuuuauu

SEQ ID NO: 305907 - RNA, 64 nt, hsa
uucuucaggauuauugaguagguugugaauuuucuuucuuaaaaauuguaaaacauaaugguac

SEQ ID NO: 305908 - RNA, 64 nt, hsa
cagucccccucucauaccaaaggaugacuguauauuucuuaaaugaagagacuuucauucuuua

SEQ ID NO: 305909 - RNA, 64 nt, hsa
aacuuaaugucuguguuuauuuauggaauucgguuuucuuaauaaauguuugagcuaauauaaa

SEQ ID NO: 305910 - RNA, 64 nt, hsa
uaacgcuuuuauuuuuauuuuaucuuauuuucauuuucuuaagcacaacugugugagaguguag

SEQ ID NO: 305911 - RNA, 64 nt, hsa
aaacucauguaagauguugcuagauguuuuuguuuuucuuaaguuugagaaguaagacauaaag

SEQ ID NO: 305912 - RNA, 64 nt, hsa
uaggguuuaaguaacuacaaguaaaauaaauuuauuucuuaaaaauaaguguuaaaggaauaac

SEQ ID NO: 305913 - RNA, 64 nt, hsa
guuugaauucuaaaauucaaaacaggcauuucauuuucuuaaggcacacuuccuacacacagcu

SEQ ID NO: 305914 - RNA, 64 nt, hsa
uuuuuaagccaaaaaucuguacuaacacauguaauuucuuaaugugccuaaguuaauuucugua

SEQ ID NO: 305915 - RNA, 64 nt, hsa
uaaaugaccagaggaaagauggauaagaugauaauuucuuaaauagacauuuuccuuuuuucuu

SEQ ID NO: 305916 - RNA, 64 nt, hsa
gguuggugcuugaagauaaaugugcuguuucuaguuucuuaaauagcccacaccccuggaugca

SEQ ID NO: 305917 - RNA, 64 nt, hsa
gcaaaugauuuuauaaacaauggacaauauauacuuucuuaagaucuaagguacuuucuuaaga

SEQ ID NO: 305918 - RNA, 64 nt, hsa
uggacaauauauacuuucuuaagaucuaagguacuuucuuaagaucuaagaauuugcugaaagc

SEQ ID NO: 305919 - RNA, 64 nt, hsa
uucuguaauauugagaguuauuuuauagaaaugauuucuuaauuagcuguugugagauauuucu

SEQ ID NO: 305920 - RNA, 64 nt, hsa
uuuucacugaucaaaauguuguucugcuuuuucauuucuuaaggaauacauguuugggauuuuu

SEQ ID NO: 305921 - RNA, 64 nt, hsa
auuacaguacuauuugcuuuaaauucggcauguuuuucuuaaguagcaaguacauguaucggaa

SEQ ID NO: 305922 - RNA, 64 nt, hsa
cauugguagauuucuaaagacaacucauaaauaauuucuuaacccauauaaggauaaaauaaua

SEQ ID NO: 305923 - RNA, 64 nt, hsa
agguauuuugauuuaaaguauacuuaaauuaggauuucuuaaagaaaacauagggagaaaacuu

SEQ ID NO: 305924 - RNA, 64 nt, hsa
uauucugaaaggagauuugacacuuaauucccauuuucuuaaaauaacaguuuuguugacuuaa

SEQ ID NO: 305925 - RNA, 64 nt, hsa
gugaaauuuuaacuacuuuaacuaguuuuauaaauuucuuaauauguuacaauaacuuagggac

SEQ ID NO: 305926 - RNA, 64 nt, hsa
uuuugggaugagaacauuuuaguuguuuaguuuguuucuuaagcagugcuauuuuuuguaaaca

SEQ ID NO: 305927 - RNA, 64 nt, hsa
gcaaaugugaaaauaguuucaauauaucuuaugauuucuuaauguaaaauguuuuguugaagua

SEQ ID NO: 305928 - RNA, 64 nt, hsa
ggcuuuccuagcaucccaaagcagucaacagugauuucuuaagcaauuugaucuguaccuuuac

SEQ ID NO: 305929 - RNA, 64 nt, hsa
cuauuaaaaaaaaaacacccuuccuaacccuucuuuucuuaaaauuccacauucauccacaauc

SEQ ID NO: 305930 - RNA, 64 nt, hsa
uagcuguaaaccaaguuggaagcuauucggauaauuucuuaaauauugaugaacuuuggaguac

SEQ ID NO: 305931 - RNA, 64 nt, hsa
agucaguauauuuagagcaauacuagcauacguuuuucuuaauuguuaucagcauugaccaagu

SEQ ID NO: 305932 - RNA, 64 nt, hsa
uauaauuugccaaagguaauuaauuuauucuuuuuuucuuaaagaagaaaaagacauugguugu

SEQ ID NO: 305933 - RNA, 64 nt, hsa
gguuuuugucaaauagcaugugaagaguuacauuuuucuuaaaagauugguggucccaauguca

SEQ ID NO: 305934 - RNA, 64 nt, hsa
cuauuuucauacccuacuuuuucuguaccuaaauuuucuuaaaaaaaaaucuaguauagcacua

SEQ ID NO: 305935 - RNA, 64 nt, hsa
uauauauauuuuaaaaugccugaggaaauacauuuuucuuaauaaacugaagagucucaguaug

SEQ ID NO: 305936 - RNA, 64 nt, hsa
gguuuuguuucuuuuucacagugccgggucuucguuucuuaaaguuggauggcagguagaguuc

SEQ ID NO: 305937 - RNA, 64 nt, hsa
uguuccaucuuugcacuguugcuuaccugcugauuuucuuaacuguucuugugcaaucgacaau

SEQ ID NO: 305938 - RNA, 64 nt, hsa
uuuuggauaaauuuccuguuguguggguggcauuuuucuuaacgagauuugcuucugucuuagc

SEQ ID NO: 305939 - RNA, 64 nt, hsa
cacgcugcacucccagccagacauggucuuuccguuucuuaaguagcaaguguagguuucagcu

SEQ ID NO: 305940 - RNA, 64 nt, hsa
ccgugcccacacauuuccuugcaacuugaucaaauuucuuaaagcaaacaacaaaaauguacau

SEQ ID NO: 305941 - RNA, 64 nt, hsa
agaaauaaaacauacuaccuugaugugacauuuuuuucuuaaccuuguugagcugguuuuguuc

SEQ ID NO: 305942 - RNA, 64 nt, hsa
aggguugacacagcagggcuaguccugcauauuuuuucuuaaauauuucccaauuguguuuuuc

SEQ ID NO: 305943 - RNA, 64 nt, hsa
aucaagugcagcugaacuggaacauaaaagauuuuuucuuaacuuuuuuuuuuuaacacacuaa

SEQ ID NO: 305944 - RNA, 64 nt, hsa
guagcugaagccgaaguaugaacaguccauuuuguuucuuaaaauuugaagucgugucugucau

SEQ ID NO: 305945 - RNA, 64 nt, hsa
cuugucuuaggauauucuguagauugauugcagauuucuuaaaucugaaaugaucuuuacacug

SEQ ID NO: 305946 - RNA, 64 nt, hsa
aaaaugcccccacccugauguaauugacauuacauuucuuaacauuuuaaaaucuagaauuucu

SEQ ID NO: 305947 - RNA, 64 nt, hsa
uggcuaaaggauuugacuuucucucaacugcaguuuucuuaaucuuugaaaugcaaauaauguu

SEQ ID NO: 305948 - RNA, 64 nt, hsa
uaggcucaaaaucgccccuacaaagcaguaguuguuucuuaauugcuaaguaaucuguuugcac

SEQ ID NO: 305949 - RNA, 64 nt, hsa
cuaucccugagcuugcucaacaagagaaacaagguuucuuaaguguuuugguuaaaguuuucau

SEQ ID NO: 305950 - RNA, 64 nt, hsa
guuuucccuugcuuuagggguuuuauaggucauuuuucuuaauagaagcugugaucgacuuaga

SEQ ID NO: 305951 - RNA, 64 nt, hsa
guguguaugccucaaaugcagaaacaguugggcuuuucuuaacagguuaacaguuugugcuggu

SEQ ID NO: 305952 - RNA, 64 nt, hsa
uucuuuuugccaaggguugcaugugaauuauaccuuucuuaauauuugauuaaauaaugcaguc

SEQ ID NO: 305953 - RNA, 64 nt, hsa
ugaucuagauauuuuccucuuuuucugaagcuacuuucuuaaaaaauaaauaaaauguuuauag

SEQ ID NO: 305954 - RNA, 64 nt, hsa
ugccagaagcagcauccuccacuuguucagggcuuuucuuaauacugaacguagcauaagggcu

SEQ ID NO: 305955 - RNA, 64 nt, hsa
ccucaguguuucuuaaccaaaguuguacucagcauuucuuaaccaaaguugaauuuugaaaaga

SEQ ID NO: 305956 - RNA, 64 nt, hsa
cggcaucugugacucuuuauccaugaccucaguguuucuuaaccaaaguuguacucagcauuuc

SEQ ID NO: 305957 - RNA, 64 nt, hsa
agcuuacuuaguugcugauuuccagauuucgauguuucuuaagucuaggugaauuuauauauau

SEQ ID NO: 305958 - RNA, 64 nt, hsa
cugucagcuuaaacacaaauguuacugcuuaucuuuucuuaaaaaaaaaaaaaacaaaguguag

SEQ ID NO: 305959 - RNA, 64 nt, hsa
cauguauuugaauauaguuaaaucguauuauuuuuuucuuaacagaaauauuuuuaaaaaugaa

SEQ ID NO: 305960 - RNA, 64 nt, hsa
uuugguuugcagagaacacagccugauacuuaauuuucuuaaaacuauuuuuaaugauccacua

SEQ ID NO: 305961 - RNA, 64 nt, hsa
ugguccugcugacaaaucaagagcauugcuuuuguuucuuaagaaaacaaacucuuuuuuaaaa

SEQ ID NO: 305962 - RNA, 64 nt, hsa
aaguguguaauuauguaaauacaauuuguacuuuuuucuuaaggcauacuaguacaagugguaa

SEQ ID NO: 305963 - RNA, 64 nt, hsa
uguuauggguucuuacccaaagagucaaaaacuauuucuuaagaaagagcagaguuauucauga

SEQ ID NO: 305964 - RNA, 64 nt, hsa
aaauugauugcuguccuuuugucuuauuuuuguuuuucuuaagucagcugguucauaacauagg

SEQ ID NO: 305965 - RNA, 64 nt, hsa
guacuuacuuuuuaaaccaucaacauuacuuuucuuucuuaaggcaaggcaugcauaagaguca

SEQ ID NO: 305966 - RNA, 64 nt, hsa
cuuggggaacuccacguguuaguuggcaucccaguuucuuaaacaaauaguaucaccugcuucc

SEQ ID NO: 305967 - RNA, 64 nt, hsa
caucucaaaaguuugggauuuuccuccucuuaacuuucuuaauauuuggacaugcaguugucgc

SEQ ID NO: 305968 - RNA, 64 nt, hsa
gauacugaagacugccaaauacauaggaauuuucuuucuuaaaaaacaguaaugaagacuauau

SEQ ID NO: 305969 - RNA, 64 nt, hsa
ccaggaguuuauuuagcaagauaaauagugguaauuucuuaaucauuccccuuuccuuugcuuu

SEQ ID NO: 305970 - RNA, 64 nt, hsa
uuaaaauauaaaguacuugggauuuugcauuauuuuucuuaauaucuauuuacuaaguauguaa

SEQ ID NO: 305971 - RNA, 64 nt, hsa
cgguaaauuuuuuaaaccuguaauucuuguaaaguuucuuaacuguuuuuuugaggagaaagaa

SEQ ID NO: 305972 - RNA, 64 nt, hsa
caguaggaauagggguuggaggauuaagaggguuuuucuuaaauauuagcuuuuaauguguaca

SEQ ID NO: 305973 - RNA, 64 nt, hsa
uuacucagagcuuuggaucaaguuaacugagcuuuuucuuaauuucauuccuuuuuuuggacac

SEQ ID NO: 305974 - RNA, 64 nt, hsa
agcaguacgugguagccacaauugcacaauauauuuucuuaaaaaauaccagcaguuacucaug

SEQ ID NO: 305975 - RNA, 64 nt, hsa
uuguuucuugacaguacauuuuuagaucuggccuuuucuuaacaaaaucugugcaaaagaugca

SEQ ID NO: 305976 - RNA, 64 nt, hsa
ucuuccucucccuucuccucugcugcagcaugauuuucuuaaucuucagacacucacuauuuuc

SEQ ID NO: 305977 - RNA, 64 nt, hsa
uugguuuagcgucuuuuuuuucuuucucuuuuuuuuucuuaaaaugccaacuaaaauaauuaga

SEQ ID NO: 305978 - RNA, 64 nt, hsa
uauuugauaaugagacugaucauuccgcuuuuucuuucuuaaaaauauuagucagaguuaagca

SEQ ID NO: 305979 - RNA, 64 nt, hsa
uauagaaaacaguuauuacauauguguuaagucauuucuuaagaauuuucuaaaaugccaacua

SEQ ID NO: 305980 - RNA, 64 nt, hsa
aaaaacugaaaucuaccaaaagagcauggagauuuuucuuaaauaauaauauugugcucuccac

SEQ ID NO: 305981 - RNA, 64 nt, hsa
ucuaauaaguuuguguuagaaaaguuucgacuuauuucuuaaagcuuuuuuuuuuuucccauca

SEQ ID NO: 305982 - RNA, 64 nt, hsa
uagcaucagaagguucacccagcaccuugcagauuuucuuaaggaauuuugucucacuuuuaaa

SEQ ID NO: 305983 - RNA, 64 nt, hsa
ugacaucuuuucuucaagccugccaucaaggacauuucuuaagacccaacuggcaugaguuggg

SEQ ID NO: 305984 - RNA, 64 nt, hsa
gggguaauuuccuauuauuuucaucuuggacaacuuucuuaacuuauauucuuuauagaggauu

SEQ ID NO: 305985 - RNA, 64 nt, hsa
uuuuacugaauagugguauaucugaugguauauguuucuuaaagguccaaauguaauaaaaaaa

SEQ ID NO: 305986 - RNA, 64 nt, hsa
uagcaucaugagccuaauggcucagucagucaccuuucuuaaguguugugaagauggcucuuuu

SEQ ID NO: 305987 - RNA, 64 nt, hsa
auguuuguguguguguuggcaacaugccuaauguuuucuuaaugaugacaacaaauauuuuaaa

SEQ ID NO: 305988 - RNA, 64 nt, hsa
uaucuguuucccacccccuacauuaggaggauaauuucuuaaaccacauuguuuuaauugauuu

SEQ ID NO: 305989 - RNA, 64 nt, hsa
guucauuuggaaaauauagacauauuucuuuugcuuucuuaaaacagcuuaaaaugaugaacuu

SEQ ID NO: 305990 - RNA, 64 nt, hsa
guaaauuaauugucagcauuccaugucucaagauuuucuuaauuuaguucgcuguuuaaauuaa

SEQ ID NO: 305991 - RNA, 64 nt, hsa
uccugugacauuugaaguuucuuuuaaagggguuuuucuuaaucaaaguuuuacauuugguagc

SEQ ID NO: 305992 - RNA, 64 nt, hsa
uggauaacuaggaaauauuuuuguuguuguuuuguuucuuaaagaguacagaggccauugaagc

SEQ ID NO: 305993 - RNA, 64 nt, hsa
aauuaagauguagauagaaauuaauuuaaggucuuuucuuaaaaaaaaaauccaccucauuuuc

SEQ ID NO: 305994 - RNA, 64 nt, hsa
ugaaaguuugacaguauuaauauuuuuuuuauauuuucuuaaaucauuaaaccauuuuaauaua

SEQ ID NO: 305995 - RNA, 64 nt, hsa
uuuucuuaaaaaaggcucaacccaaaagaaaccauuucuuaaaaaauuuuacauagaucaguug

SEQ ID NO: 305996 - RNA, 64 nt, hsa
cuuaucaaggccuguuugcaaaggggagaucccuuuucuuaaaaaaggcucaacccaaaagaaa

SEQ ID NO: 305997 - RNA, 64 nt, hsa
auagagucuaccuagagcaggggucgccaaauguuuucuuaaagagccugauaguguauauguu

SEQ ID NO: 305998 - RNA, 64 nt, hsa
ugaaaggacuagaauguucacaccacgaucuggauuucuuaauuuuuuguuuuuguuuuuguug

SEQ ID NO: 305999 - RNA, 64 nt, hsa
uugcugaauuuaaagagaaguucugcaucuuuuauuucuuaauuaucuucagauuucucuguau

SEQ ID NO: 306000 - RNA, 64 nt, hsa
gcccagccaaauguuuauuuuauuuaaauuuauuuuucuuaauuauuugggguacauaauauga

SEQ ID NO: 306001 - RNA, 64 nt, hsa
aauuggagccaauccucucaaacccugccacugcuuucuuaacuacgugcgucaauauuguaaa

SEQ ID NO: 306002 - RNA, 64 nt, hsa
ugccuauggaguagccguucuuuuauuccuuuacuuucuuaacaaauuugcuuucacuuaaaaa

SEQ ID NO: 306003 - RNA, 64 nt, hsa
agccauuuguuaccaaacugggaaaacagaggcuuuucuuaacuauuucacauacuguaacaaa

SEQ ID NO: 306004 - RNA, 64 nt, hsa
aaaaaaagaaagaaaggaaaacaaaaagcacuuuuuucuuaaugguagcaguauaauguauuuu

SEQ ID NO: 306005 - RNA, 64 nt, hsa
uccagcccaccgcccaaccuuuuacaaauggcauuuucuuaauugaaaauccgggaagcaggug

SEQ ID NO: 306006 - RNA, 64 nt, hsa
accuuuuuuuuuuuggaccauagcuagccagucauuucuuaaaccucccuuccuaaaaucuggg

SEQ ID NO: 306007 - RNA, 64 nt, hsa
gccaggaaaauagaugucuugcuguuuucaguauuuucuuaagaaauugcuuuuaaaacaaaua

SEQ ID NO: 306008 - RNA, 64 nt, hsa
auuaauaagacuguuuccacaccauaggcaauaauuucuuaauuuaaaaaaucuaaguauauuc

SEQ ID NO: 306009 - RNA, 64 nt, hsa
auaaauugcaguuauugauucuugccaucuuuguuuucuuaaagaaaucuaugcauuuuaagga

SEQ ID NO: 306010 - RNA, 64 nt, hsa
auuccacaauauuuuaguaguuaacuuccuauucuuucuuaaauuugauggagaagggaaaaua

SEQ ID NO: 306011 - RNA, 64 nt, hsa
uuugcucucauguguaauguuuucuauuuaaaucuuucuuaaauauaccagcuguucucuuucc

SEQ ID NO: 306012 - RNA, 64 nt, hsa
accuaaaaaugaaaguuugugaguguuuauugguuuucuuaagagaaauggacuauuuugcucu

SEQ ID NO: 306013 - RNA, 64 nt, hsa
auuacacaaguuuaaaaauauuauuaacuuguauuuucuuaauauacaaucuaucuuuuccaca

SEQ ID NO: 306014 - RNA, 64 nt, hsa
uauauauguaaauagcuuuucaucaauucuuaaauuucuuaaccuaggcuucagggagcauaug

SEQ ID NO: 306015 - RNA, 64 nt, hsa
uuccauguuagcacuuuacugcugaauucucaauuuucuuaacauugagacaauaaaugugugu

SEQ ID NO: 306016 - RNA, 64 nt, hsa
ugguaagcuggauuugaagguagugguuucaguguuucuuaaguugguagcugaggguaucagg

SEQ ID NO: 306017 - RNA, 64 nt, hsa
cauugggugaucauucaccaguacauucucaguuuuucuuaauauauagcauuuaugguaauca

SEQ ID NO: 306018 - RNA, 64 nt, hsa
uaugugaaggaccuucacucuaagauguuauauuuuucuuaaaaaguaacuccuaguaggggua

SEQ ID NO: 306019 - RNA, 64 nt, hsa
aagcuuuugagaauauaaacacaccuguuuuguuuuucuuaaguucaacauacuuuuguagaau

SEQ ID NO: 306020 - RNA, 64 nt, hsa
caguaggcuucaauuacaaacaguuaaguacuuguuucuuaauaguuucauuaauguugagucc

SEQ ID NO: 306021 - RNA, 64 nt, hsa
agguuagagcacuagaaugcaaaagaggauuuauuuucuuaaguuuagguagauaagucagcuc

SEQ ID NO: 306022 - RNA, 64 nt, hsa
auggcaaaaggcuuuuaaaaguugguguuuucuuuuucuuaaaaaaauaauaaaacuacagaca

SEQ ID NO: 306023 - RNA, 64 nt, hsa; identical to SEQ ID NO: 111894

SEQ ID NO: 306024 - RNA, 64 nt, hsa; identical to SEQ ID NO: 111895

SEQ ID NO: 306025 - RNA, 64 nt, hsa; identical to SEQ ID NO: 111896

SEQ ID NO: 306026 - RNA, 64 nt, hsa; identical to SEQ ID NO: 111897

SEQ ID NO: 306027 - RNA, 64 nt, hsa; identical to SEQ ID NO: 111898

SEQ ID NO: 306028 - RNA, 64 nt, hsa; identical to SEQ ID NO: 111899

SEQ ID NO: 306029 - RNA, 64 nt, hsa; identical to SEQ ID NO: 111900

SEQ ID NO: 306030 - RNA, 64 nt, hsa; identical to SEQ ID NO: 111901

SEQ ID NO: 306031 - RNA, 64 nt, hsa; identical to SEQ ID NO: 111902

SEQ ID NO: 306032 - RNA, 64 nt, hsa; identical to SEQ ID NO: 111903

SEQ ID NO: 306033 - RNA, 64 nt, hsa; identical to SEQ ID NO: 111904

SEQ ID NO: 306034 - RNA, 64 nt, hsa; identical to SEQ ID NO: 111905

SEQ ID NO: 306035 - RNA, 64 nt, hsa; identical to SEQ ID NO: 111906

SEQ ID NO: 306036 - RNA, 64 nt, hsa; identical to SEQ ID NO: 111907

SEQ ID NO: 306037 - RNA, 64 nt, hsa; identical to SEQ ID NO: 111908

SEQ ID NO: 306038 - RNA, 64 nt, hsa; identical to SEQ ID NO: 111909

SEQ ID NO: 306039 - RNA, 64 nt, hsa; identical to SEQ ID NO: 111910

SEQ ID NO: 306040 - RNA, 64 nt, hsa; identical to SEQ ID NO: 111911

SEQ ID NO: 306041 - RNA, 64 nt, hsa; identical to SEQ ID NO: 111912

SEQ ID NO: 306042 - RNA, 64 nt, hsa; identical to SEQ ID NO: 111913

SEQ ID NO: 306043 - RNA, 64 nt, hsa; identical to SEQ ID NO: 111914

SEQ ID NO: 306044 - RNA, 64 nt, hsa; identical to SEQ ID NO: 111915

SEQ ID NO: 306045 - RNA, 64 nt, hsa; identical to SEQ ID NO: 111916

SEQ ID NO: 306046 - RNA, 64 nt, hsa; identical to SEQ ID NO: 111917

SEQ ID NO: 306047 - RNA, 64 nt, hsa; identical to SEQ ID NO: 111918

SEQ ID NO: 306048 - RNA, 64 nt, hsa; identical to SEQ ID NO: 111919

SEQ ID NO: 306049 - RNA, 64 nt, hsa; identical to SEQ ID NO: 111920

SEQ ID NO: 306050 - RNA, 64 nt, hsa; identical to SEQ ID NO: 111921

SEQ ID NO: 306051 - RNA, 64 nt, hsa; identical to SEQ ID NO: 111922

SEQ ID NO: 306052 - RNA, 64 nt, hsa; identical to SEQ ID NO: 111923

SEQ ID NO: 306053 - RNA, 64 nt, hsa; identical to SEQ ID NO: 111924

SEQ ID NO: 306054 - RNA, 64 nt, hsa; identical to SEQ ID NO: 111925

SEQ ID NO: 306055 - RNA, 64 nt, hsa; identical to SEQ ID NO: 111926

SEQ ID NO: 306056 - RNA, 64 nt, hsa; identical to SEQ ID NO: 111927

SEQ ID NO: 306057 - RNA, 64 nt, hsa
agucaacugaguuaaggcaggaaaagaaauaagcccaaccaacuugccaaagguaucuuugucc

SEQ ID NO: 306058 - RNA, 64 nt, hsa
cuuggggaaacuugcagugggucaguggucugugccaaccaaacgauagccccauccaagccag

SEQ ID NO: 306059 - RNA, 64 nt, hsa
cacauguacagcuuucuacuucuuuguaagaacaccaaccaaccaagguuuaagugauuaauag

SEQ ID NO: 306060 - RNA, 64 nt, hsa
uguacagcuuucuacuucuuuguaagaacaccaaccaaccaagguuuaagugauuaauaggcuu

SEQ ID NO: 306061 - RNA, 64 nt, hsa
aaaaaggaaagaaaacuaacaaccaaccaaccaaccaaccaaccacaaaccacccuaaaaugac

SEQ ID NO: 306062 - RNA, 64 nt, hsa
aauuaaaaaggaaagaaaacuaacaaccaaccaaccaaccaaccaaccacaaaccacccuaaaa

SEQ ID NO: 306063 - RNA, 64 nt, hsa
uauaaauuaaaaaggaaagaaaacuaacaaccaaccaaccaaccaaccaaccacaaaccacccu

SEQ ID NO: 306064 - RNA, 64 nt, hsa
uauauauaaauuaaaaaggaaagaaaacuaacaaccaaccaaccaaccaaccaaccacaaacca

SEQ ID NO: 306065 - RNA, 64 nt, hsa
uuugagcaaguuggaaguuuaauuagcuuuccaaccaaccaaauuucugcauucgagucuuaac

SEQ ID NO: 306066 - RNA, 64 nt, hsa
ucuauuugagcaaguuggaaguuuaauuagcuuuccaaccaaccaaauuucugcauucgagucu

SEQ ID NO: 306067 - RNA, 64 nt, hsa
auaaauaucuauaugacgcucuuaaaaaaacaucccaaccaaaaccaaccaaacaaaaacaucc

SEQ ID NO: 306068 - RNA, 64 nt, hsa
auaugacgcucuuaaaaaaacaucccaaccaaaaccaaccaaacaaaaacauccucacaacucc

SEQ ID NO: 306069 - RNA, 64 nt, hsa
agaaagucugguggcagcgcagagcccaaucauuccaaccaaagcaggguuggggaaucccgaa

SEQ ID NO: 306070 - RNA, 64 nt, hsa
cguaaaagcauugacgcagccccuacacuccaucccaaccaagaaacugcauuuccuggggcca

SEQ ID NO: 306071 - RNA, 64 nt, hsa
auauguauguauucacugaccaaaaauucacugaccaaccaaccaaacuccacacuucaucuga

SEQ ID NO: 306072 - RNA, 64 nt, hsa
guauguauucacugaccaaaaauucacugaccaaccaaccaaacuccacacuucaucugauccc

SEQ ID NO: 306073 - RNA, 64 nt, hsa
auacuccccuccuucaacucuccccagaaauagcccaaccaagcgaguggauguccccaccacu

SEQ ID NO: 306074 - RNA, 64 nt, hsa
caacuaaaauauuacagauuaauaauaaauuaaaccaaccaaugauaaacacuacucaguccac

SEQ ID NO: 306075 - RNA, 64 nt, hsa
gagaagaauucuugcccuccccucucuucuccucccaaccaaaacccuccgauccagccccagg

SEQ ID NO: 306076 - RNA, 64 nt, hsa
gggccugggaccauuggcugggaccccucauuaaccaaccaagcacuuguaccucccuggcaua

SEQ ID NO: 306077 - RNA, 64 nt, hsa; identical to SEQ ID NO: 190131

SEQ ID NO: 306078 - RNA, 64 nt, hsa; identical to SEQ ID NO: 190132

SEQ ID NO: 306079 - RNA, 64 nt, hsa; identical to SEQ ID NO: 190133

SEQ ID NO: 306080 - RNA, 64 nt, hsa; identical to SEQ ID NO: 190134

SEQ ID NO: 306081 - RNA, 64 nt, hsa; identical to SEQ ID NO: 190135

SEQ ID NO: 306082 - RNA, 64 nt, hsa; identical to SEQ ID NO: 190136

SEQ ID NO: 306083 - RNA, 64 nt, hsa; identical to SEQ ID NO: 190137

SEQ ID NO: 306084 - RNA, 64 nt, hsa; identical to SEQ ID NO: 190138

SEQ ID NO: 306085 - RNA, 64 nt, hsa; identical to SEQ ID NO: 190139

SEQ ID NO: 306086 - RNA, 64 nt, hsa; identical to SEQ ID NO: 190140

SEQ ID NO: 306087 - RNA, 64 nt, hsa; identical to SEQ ID NO: 190141

SEQ ID NO: 306088 - RNA, 64 nt, hsa; identical to SEQ ID NO: 190142

SEQ ID NO: 306089 - RNA, 64 nt, hsa; identical to SEQ ID NO: 190143

SEQ ID NO: 306090 - RNA, 64 nt, hsa; identical to SEQ ID NO: 190144

SEQ ID NO: 306091 - RNA, 64 nt, hsa; identical to SEQ ID NO: 190145

SEQ ID NO: 306092 - RNA, 64 nt, hsa; identical to SEQ ID NO: 190146

SEQ ID NO: 306093 - RNA, 64 nt, hsa; identical to SEQ ID NO: 190147

SEQ ID NO: 306094 - RNA, 64 nt, hsa; identical to SEQ ID NO: 190148

SEQ ID NO: 306095 - RNA, 64 nt, hsa; identical to SEQ ID NO: 190149

SEQ ID NO: 306096 - RNA, 64 nt, hsa; identical to SEQ ID NO: 190150

SEQ ID NO: 306097 - RNA, 64 nt, hsa; identical to SEQ ID NO: 190151

SEQ ID NO: 306098 - RNA, 64 nt, hsa; identical to SEQ ID NO: 190152

SEQ ID NO: 306099 - RNA, 64 nt, hsa; identical to SEQ ID NO: 190153

SEQ ID NO: 306100 - RNA, 64 nt, hsa; identical to SEQ ID NO: 190154

SEQ ID NO: 306101 - RNA, 64 nt, hsa; identical to SEQ ID NO: 190155

SEQ ID NO: 306102 - RNA, 64 nt, hsa; identical to SEQ ID NO: 190156

SEQ ID NO: 306103 - RNA, 64 nt, hsa; identical to SEQ ID NO: 190157

SEQ ID NO: 306104 - RNA, 64 nt, hsa; identical to SEQ ID NO: 190158

SEQ ID NO: 306105 - RNA, 64 nt, hsa; identical to SEQ ID NO: 190159

SEQ ID NO: 306106 - RNA, 64 nt, hsa; identical to SEQ ID NO: 190160

SEQ ID NO: 306107 - RNA, 64 nt, hsa; identical to SEQ ID NO: 190161

SEQ ID NO: 306108 - RNA, 64 nt, hsa; identical to SEQ ID NO: 190162

SEQ ID NO: 306109 - RNA, 64 nt, hsa; identical to SEQ ID NO: 190163

SEQ ID NO: 306110 - RNA, 64 nt, hsa; identical to SEQ ID NO: 190164

SEQ ID NO: 306111 - RNA, 64 nt, hsa; identical to SEQ ID NO: 190165

SEQ ID NO: 306112 - RNA, 64 nt, hsa; identical to SEQ ID NO: 190166

SEQ ID NO: 306113 - RNA, 64 nt, hsa; identical to SEQ ID NO: 190167

SEQ ID NO: 306114 - RNA, 64 nt, hsa; identical to SEQ ID NO: 190168

SEQ ID NO: 306115 - RNA, 64 nt, hsa; identical to SEQ ID NO: 190169

SEQ ID NO: 306116 - RNA, 64 nt, hsa; identical to SEQ ID NO: 190170

SEQ ID NO: 306117 - RNA, 64 nt, hsa; identical to SEQ ID NO: 190171

SEQ ID NO: 306118 - RNA, 64 nt, hsa; identical to SEQ ID NO: 190172

SEQ ID NO: 306119 - RNA, 64 nt, hsa; identical to SEQ ID NO: 190173

SEQ ID NO: 306120 - RNA, 64 nt, hsa; identical to SEQ ID NO: 190174

SEQ ID NO: 306121 - RNA, 64 nt, hsa; identical to SEQ ID NO: 190175

SEQ ID NO: 306122 - RNA, 64 nt, hsa; identical to SEQ ID NO: 190176

SEQ ID NO: 306123 - RNA, 64 nt, hsa; identical to SEQ ID NO: 190177

SEQ ID NO: 306124 - RNA, 64 nt, hsa; identical to SEQ ID NO: 190178

SEQ ID NO: 306125 - RNA, 64 nt, hsa; identical to SEQ ID NO: 190179

SEQ ID NO: 306126 - RNA, 64 nt, hsa; identical to SEQ ID NO: 190180

SEQ ID NO: 306127 - RNA, 64 nt, hsa; identical to SEQ ID NO: 190181

SEQ ID NO: 306128 - RNA, 64 nt, hsa; identical to SEQ ID NO: 190182

SEQ ID NO: 306129 - RNA, 64 nt, hsa; identical to SEQ ID NO: 190183

SEQ ID NO: 306130 - RNA, 64 nt, hsa; identical to SEQ ID NO: 190184

SEQ ID NO: 306131 - RNA, 64 nt, hsa; identical to SEQ ID NO: 190185

SEQ ID NO: 306132 - RNA, 64 nt, hsa; identical to SEQ ID NO: 190186

SEQ ID NO: 306133 - RNA, 64 nt, hsa; identical to SEQ ID NO: 190187

SEQ ID NO: 306134 - RNA, 64 nt, hsa; identical to SEQ ID NO: 190188

SEQ ID NO: 306135 - RNA, 64 nt, hsa; identical to SEQ ID NO: 190189

SEQ ID NO: 306136 - RNA, 64 nt, hsa; identical to SEQ ID NO: 190190

SEQ ID NO: 306137 - RNA, 64 nt, hsa; identical to SEQ ID NO: 190191

SEQ ID NO: 306138 - RNA, 64 nt, hsa; identical to SEQ ID NO: 190192

SEQ ID NO: 306139 - RNA, 64 nt, hsa; identical to SEQ ID NO: 190193

SEQ ID NO: 306140 - RNA, 64 nt, hsa; identical to SEQ ID NO: 190194

SEQ ID NO: 306141 - RNA, 64 nt, hsa; identical to SEQ ID NO: 190195

SEQ ID NO: 306142 - RNA, 64 nt, hsa; identical to SEQ ID NO: 190196

SEQ ID NO: 306143 - RNA, 64 nt, hsa; identical to SEQ ID NO: 190197

SEQ ID NO: 306144 - RNA, 64 nt, hsa; identical to SEQ ID NO: 190198

SEQ ID NO: 306145 - RNA, 64 nt, hsa; identical to SEQ ID NO: 190199

SEQ ID NO: 306146 - RNA, 64 nt, hsa; identical to SEQ ID NO: 190200

SEQ ID NO: 306147 - RNA, 64 nt, hsa; identical to SEQ ID NO: 190201

SEQ ID NO: 306148 - RNA, 64 nt, hsa; identical to SEQ ID NO: 190202

SEQ ID NO: 306149 - RNA, 64 nt, hsa; identical to SEQ ID NO: 190203

SEQ ID NO: 306150 - RNA, 64 nt, hsa; identical to SEQ ID NO: 190204

SEQ ID NO: 306151 - RNA, 64 nt, hsa; identical to SEQ ID NO: 190205

SEQ ID NO: 306152 - RNA, 64 nt, hsa; identical to SEQ ID NO: 190206

SEQ ID NO: 306153 - RNA, 64 nt, hsa; identical to SEQ ID NO: 190207

SEQ ID NO: 306154 - RNA, 64 nt, hsa; identical to SEQ ID NO: 190208

SEQ ID NO: 306155 - RNA, 64 nt, hsa; identical to SEQ ID NO: 190209

SEQ ID NO: 306156 - RNA, 64 nt, hsa; identical to SEQ ID NO: 190210

SEQ ID NO: 306157 - RNA, 64 nt, hsa; identical to SEQ ID NO: 190211

SEQ ID NO: 306158 - RNA, 64 nt, hsa; identical to SEQ ID NO: 190212

SEQ ID NO: 306159 - RNA, 64 nt, hsa; identical to SEQ ID NO: 190213

SEQ ID NO: 306160 - RNA, 64 nt, hsa; identical to SEQ ID NO: 190214

SEQ ID NO: 306161 - RNA, 64 nt, hsa; identical to SEQ ID NO: 190215

SEQ ID NO: 306162 - RNA, 64 nt, hsa; identical to SEQ ID NO: 190216

SEQ ID NO: 306163 - RNA, 64 nt, hsa; identical to SEQ ID NO: 190217

SEQ ID NO: 306164 - RNA, 64 nt, hsa; identical to SEQ ID NO: 190218

SEQ ID NO: 306165 - RNA, 64 nt, hsa; identical to SEQ ID NO: 190219

SEQ ID NO: 306166 - RNA, 64 nt, hsa; identical to SEQ ID NO: 190220

SEQ ID NO: 306167 - RNA, 64 nt, hsa; identical to SEQ ID NO: 190221

SEQ ID NO: 306168 - RNA, 64 nt, hsa; identical to SEQ ID NO: 190222

SEQ ID NO: 306169 - RNA, 64 nt, hsa; identical to SEQ ID NO: 190223

SEQ ID NO: 306170 - RNA, 64 nt, hsa; identical to SEQ ID NO: 190224

SEQ ID NO: 306171 - RNA, 64 nt, hsa; identical to SEQ ID NO: 190225

SEQ ID NO: 306172 - RNA, 64 nt, hsa; identical to SEQ ID NO: 190226

SEQ ID NO: 306173 - RNA, 64 nt, hsa; identical to SEQ ID NO: 190227

SEQ ID NO: 306174 - RNA, 64 nt, hsa; identical to SEQ ID NO: 190228

SEQ ID NO: 306175 - RNA, 64 nt, hsa; identical to SEQ ID NO: 190229

SEQ ID NO: 306176 - RNA, 64 nt, hsa; identical to SEQ ID NO: 190230

SEQ ID NO: 306177 - RNA, 64 nt, hsa; identical to SEQ ID NO: 190231

SEQ ID NO: 306178 - RNA, 64 nt, hsa; identical to SEQ ID NO: 190232

SEQ ID NO: 306179 - RNA, 64 nt, hsa; identical to SEQ ID NO: 190233

SEQ ID NO: 306180 - RNA, 54 nt, hsa; identical to SEQ ID NO: 190234

SEQ ID NO: 306181 - RNA, 64 nt, hsa; identical to SEQ ID NO: 190235

SEQ ID NO: 306182 - RNA, 64 nt, hsa; identical to SEQ ID NO: 190236

SEQ ID NO: 306183 - RNA, 64 nt, hsa; identical to SEQ ID NO: 190237

SEQ ID NO: 306184 - RNA, 64 nt, hsa; identical to SEQ ID NO: 190238

SEQ ID NO: 306185 - RNA, 64 nt, hsa; identical to SEQ ID NO: 190239

SEQ ID NO: 306186 - RNA, 64 nt, hsa; identical to SEQ ID NO: 190240

SEQ ID NO: 306187 - RNA, 64 nt, hsa; identical to SEQ ID NO: 190241

SEQ ID NO: 306188 - RNA, 64 nt, hsa; identical to SEQ ID NO: 190242

SEQ ID NO: 306189 - RNA, 64 nt, hsa; identical to SEQ ID NO: 190243

SEQ ID NO: 306190 - RNA, 64 nt, hsa; identical to SEQ ID NO: 190244

SEQ ID NO: 306191 - RNA, 64 nt, hsa; identical to SEQ ID NO: 190245

SEQ ID NO: 306192 - RNA, 64 nt, hsa; identical to SEQ ID NO: 190246

SEQ ID NO: 306193 - RNA, 64 nt, hsa; identical to SEQ ID NO: 190247

SEQ ID NO: 306194 - RNA, 64 nt, hsa; identical to SEQ ID NO: 190248

SEQ ID NO: 306195 - RNA, 64 nt, hsa; identical to SEQ ID NO: 190249

SEQ ID NO: 306196 - RNA, 64 nt, hsa; identical to SEQ ID NO: 190250

SEQ ID NO: 306197 - RNA, 64 nt, hsa; identical to SEQ ID NO: 190251

SEQ ID NO: 306198 - RNA, 64 nt, hsa; identical to SEQ ID NO: 190252

SEQ ID NO: 306199 - RNA, 64 nt, hsa; identical to SEQ ID NO: 190253

SEQ ID NO: 306200 - RNA, 64 nt, hsa; identical to SEQ ID NO: 190254

SEQ ID NO: 306201 - RNA, 64 nt, hsa; identical to SEQ ID NO: 190255

SEQ ID NO: 306202 - RNA, 64 nt, hsa; identical to SEQ ID NO: 190256

SEQ ID NO: 306203 - RNA, 64 nt, hsa; identical to SEQ ID NO: 190257

SEQ ID NO: 306204 - RNA, 64 nt, hsa; identical to SEQ ID NO: 190258

SEQ ID NO: 306205 - RNA, 64 nt, hsa; identical to SEQ ID NO: 190259

SEQ ID NO: 306206 - RNA, 64 nt, hsa; identical to SEQ ID NO: 190260

SEQ ID NO: 306207 - RNA, 64 nt, hsa; identical to SEQ ID NO: 190261

SEQ ID NO: 306208 - RNA, 64 nt, hsa; identical to SEQ ID NO: 190262

SEQ ID NO: 306209 - RNA, 64 nt, hsa; identical to SEQ ID NO: 190263

SEQ ID NO: 306210 - RNA, 64 nt, hsa; identical to SEQ ID NO: 190264

SEQ ID NO: 306211 - RNA, 64 nt, hsa; identical to SEQ ID NO: 190265

SEQ ID NO: 306212 - RNA, 64 nt, hsa; identical to SEQ ID NO: 190266

SEQ ID NO: 306213 - RNA, 64 nt, hsa; identical to SEQ ID NO: 190267

SEQ ID NO: 306214 - RNA, 64 nt, hsa; identical to SEQ ID NO: 190268

SEQ ID NO: 306215 - RNA, 64 nt, hsa; identical to SEQ ID NO: 190269

SEQ ID NO: 306216 - RNA, 64 nt, hsa; identical to SEQ ID NO: 190270

SEQ ID NO: 306217 - RNA, 61 nt, hsa; identical to SEQ ID NO: 190271

SEQ ID NO: 306218 - RNA, 64 nt, hsa; identical to SEQ ID NO: 190272

SEQ ID NO: 306219 - RNA, 64 nt, hsa; identical to SEQ ID NO: 190273

SEQ ID NO: 306220 - RNA, 63 nt, hsa; identical to SEQ ID NO: 190274

SEQ ID NO: 306221 - RNA, 64 nt, hsa; identical to SEQ ID NO: 190275

SEQ ID NO: 306222 - RNA, 64 nt, hsa; identical to SEQ ID NO: 190276

SEQ ID NO: 306223 - RNA, 64 nt, hsa; identical to SEQ ID NO: 190277

SEQ ID NO: 306224 - RNA, 64 nt, hsa; identical to SEQ ID NO: 190278

SEQ ID NO: 306225 - RNA, 64 nt, hsa; identical to SEQ ID NO: 190279

SEQ ID NO: 306226 - RNA, 64 nt, hsa; identical to SEQ ID NO: 190280

SEQ ID NO: 306227 - RNA, 64 nt, hsa; identical to SEQ ID NO: 190281

SEQ ID NO: 306228 - RNA, 64 nt, hsa; identical to SEQ ID NO: 190282

SEQ ID NO: 306229 - RNA, 64 nt, hsa; identical to SEQ ID NO: 190283

SEQ ID NO: 306230 - RNA, 64 nt, hsa; identical to SEQ ID NO: 190284

SEQ ID NO: 306231 - RNA, 64 nt, hsa; identical to SEQ ID NO: 190285

SEQ ID NO: 306232 - RNA, 64 nt, hsa; identical to SEQ ID NO: 190286

SEQ ID NO: 306233 - RNA, 64 nt, hsa; identical to SEQ ID NO: 190287

SEQ ID NO: 306234 - RNA, 64 nt, hsa; identical to SEQ ID NO: 190288

SEQ ID NO: 306235 - RNA, 64 nt, hsa; identical to SEQ ID NO: 190289

SEQ ID NO: 306236 - RNA, 64 nt, hsa; identical to SEQ ID NO: 190290

SEQ ID NO: 306237 - RNA, 64 nt, hsa; identical to SEQ ID NO: 190291

SEQ ID NO: 306238 - RNA, 64 nt, hsa; identical to SEQ ID NO: 190292

SEQ ID NO: 306239 - RNA, 64 nt, hsa; identical to SEQ ID NO: 190293

SEQ ID NO: 306240 - RNA, 64 nt, hsa; identical to SEQ ID NO: 190294

SEQ ID NO: 306241 - RNA, 64 nt, hsa; identical to SEQ ID NO: 190295

SEQ ID NO: 306242 - RNA, 64 nt, hsa; identical to SEQ ID NO: 190296

SEQ ID NO: 306243 - RNA, 64 nt, hsa; identical to SEQ ID NO: 190297

SEQ ID NO: 306244 - RNA, 64 nt, hsa; identical to SEQ ID NO: 190298

SEQ ID NO: 306245 - RNA, 64 nt, hsa; identical to SEQ ID NO: 190299

SEQ ID NO: 306246 - RNA, 64 nt, hsa; identical to SEQ ID NO: 190300

SEQ ID NO: 306247 - RNA, 64 nt, hsa; identical to SEQ ID NO: 190301

SEQ ID NO: 306248 - RNA, 64 nt, hsa; identical to SEQ ID NO: 190302

SEQ ID NO: 306249 - RNA, 64 nt, hsa; identical to SEQ ID NO: 190303

SEQ ID NO: 306250 - RNA, 64 nt, hsa; identical to SEQ ID NO: 190304

SEQ ID NO: 306251 - RNA, 64 nt, hsa; identical to SEQ ID NO: 190305

SEQ ID NO: 306252 - RNA, 64 nt, hsa; identical to SEQ ID NO: 190306

SEQ ID NO: 306253 - RNA, 64 nt, hsa; identical to SEQ ID NO: 190307

SEQ ID NO: 306254 - RNA, 64 nt, hsa; identical to SEQ ID NO: 190308

SEQ ID NO: 306255 - RNA, 64 nt, hsa; identical to SEQ ID NO: 190309

SEQ ID NO: 306256 - RNA, 64 nt, hsa; identical to SEQ ID NO: 190310

SEQ ID NO: 306257 - RNA, 64 nt, hsa; identical to SEQ ID NO: 190311

SEQ ID NO: 306258 - RNA, 64 nt, hsa; identical to SEQ ID NO: 190312

SEQ ID NO: 306259 - RNA, 64 nt, hsa; identical to SEQ ID NO: 190313

SEQ ID NO: 306260 - RNA, 64 nt, hsa; identical to SEQ ID NO: 190314

SEQ ID NO: 306261 - RNA, 64 nt, hsa; identical to SEQ ID NO: 190315

SEQ ID NO: 306262 - RNA, 64 nt, hsa; identical to SEQ ID NO: 190316

SEQ ID NO: 306263 - RNA, 64 nt, hsa; identical to SEQ ID NO: 190317

SEQ ID NO: 306264 - RNA, 64 nt, hsa; identical to SEQ ID NO: 190318

SEQ ID NO: 306265 - RNA, 64 nt, hsa; identical to SEQ ID NO: 190319

SEQ ID NO: 306266 - RNA, 64 nt, hsa; identical to SEQ ID NO: 190320

SEQ ID NO: 306267 - RNA, 64 nt, hsa; identical to SEQ ID NO: 190321

SEQ ID NO: 306268 - RNA, 64 nt, hsa; identical to SEQ ID NO: 190322

SEQ ID NO: 306269 - RNA, 64 nt, hsa; identical to SEQ ID NO: 190323

SEQ ID NO: 306270 - RNA, 64 nt, hsa; identical to SEQ ID NO: 190324

SEQ ID NO: 306271 - RNA, 64 nt, hsa; identical to SEQ ID NO: 190325

SEQ ID NO: 306272 - RNA, 64 nt, hsa; identical to SEQ ID NO: 190326

SEQ ID NO: 306273 - RNA, 64 nt, hsa; identical to SEQ ID NO: 190327

SEQ ID NO: 306274 - RNA, 64 nt, hsa; identical to SEQ ID NO: 190328

SEQ ID NO: 306275 - RNA, 64 nt, hsa; identical to SEQ ID NO: 190329

SEQ ID NO: 306276 - RNA, 64 nt, hsa; identical to SEQ ID NO: 190330

SEQ ID NO: 306277 - RNA, 64 nt, hsa; identical to SEQ ID NO: 190331

SEQ ID NO: 306278 - RNA, 64 nt, hsa; identical to SEQ ID NO: 190332

SEQ ID NO: 306279 - RNA, 64 nt, hsa; identical to SEQ ID NO: 190333

SEQ ID NO: 306280 - RNA, 64 nt, hsa; identical to SEQ ID NO: 190334

SEQ ID NO: 306281 - RNA, 64 nt, hsa; identical to SEQ ID NO: 190335

SEQ ID NO: 306282 - RNA, 64 nt, hsa; identical to SEQ ID NO: 190336

SEQ ID NO: 306283 - RNA, 64 nt, hsa; identical to SEQ ID NO: 190337

SEQ ID NO: 306284 - RNA, 64 nt, hsa; identical to SEQ ID NO: 190338

SEQ ID NO: 306285 - RNA, 64 nt, hsa; identical to SEQ ID NO: 190339

SEQ ID NO: 306286 - RNA, 61 nt, hsa; identical to SEQ ID NO: 190340

SEQ ID NO: 306287 - RNA, 64 nt, hsa; identical to SEQ ID NO: 190341

SEQ ID NO: 306288 - RNA, 64 nt, hsa; identical to SEQ ID NO: 190342

SEQ ID NO: 306289 - RNA, 64 nt, hsa; identical to SEQ ID NO: 190343

SEQ ID NO: 306290 - RNA, 64 nt, hsa; identical to SEQ ID NO: 190344

SEQ ID NO: 306291 - RNA, 64 nt, hsa; identical to SEQ ID NO: 190345

SEQ ID NO: 306292 - RNA, 64 nt, hsa; identical to SEQ ID NO: 190346

SEQ ID NO: 306293 - RNA, 64 nt, hsa; identical to SEQ ID NO: 190347

SEQ ID NO: 306294 - RNA, 64 nt, hsa; identical to SEQ ID NO: 190348

SEQ ID NO: 306295 - RNA, 64 nt, hsa; identical to SEQ ID NO: 190349

SEQ ID NO: 306296 - RNA, 64 nt, hsa; identical to SEQ ID NO: 190350

SEQ ID NO: 306297 - RNA, 64 nt, hsa; identical to SEQ ID NO: 190351

SEQ ID NO: 306298 - RNA, 64 nt, hsa; identical to SEQ ID NO: 190352

SEQ ID NO: 306299 - RNA, 64 nt, hsa; identical to SEQ ID NO: 190353

SEQ ID NO: 306300 - RNA, 64 nt, hsa; identical to SEQ ID NO: 190354

SEQ ID NO: 306301 - RNA, 64 nt, hsa; identical to SEQ ID NO: 190355

SEQ ID NO: 306302 - RNA, 64 nt, hsa; identical to SEQ ID NO: 190356

SEQ ID NO: 306303 - RNA, 64 nt, hsa; identical to SEQ ID NO: 190357

SEQ ID NO: 306304 - RNA, 64 nt, hsa; identical to SEQ ID NO: 190358

SEQ ID NO: 306305 - RNA, 64 nt, hsa; identical to SEQ ID NO: 190359

SEQ ID NO: 306306 - RNA, 64 nt, hsa; identical to SEQ ID NO: 190360

SEQ ID NO: 306307 - RNA, 64 nt, hsa; identical to SEQ ID NO: 190361

SEQ ID NO: 306308 - RNA, 64 nt, hsa; identical to SEQ ID NO: 190362

SEQ ID NO: 306309 - RNA, 64 nt, hsa; identical to SEQ ID NO: 190363

SEQ ID NO: 306310 - RNA, 64 nt, hsa; identical to SEQ ID NO: 190364

SEQ ID NO: 306311 - RNA, 64 nt, hsa; identical to SEQ ID NO: 190365

SEQ ID NO: 306312 - RNA, 64 nt, hsa; identical to SEQ ID NO: 190366

SEQ ID NO: 306313 - RNA, 63 nt, hsa; identical to SEQ ID NO: 190367

SEQ ID NO: 306314 - RNA, 64 nt, hsa; identical to SEQ ID NO: 190368

SEQ ID NO: 306315 - RNA, 64 nt, hsa; identical to SEQ ID NO: 190369

SEQ ID NO: 306316 - RNA, 64 nt, hsa; identical to SEQ ID NO: 190370

SEQ ID NO: 306317 - RNA, 64 nt, hsa; identical to SEQ ID NO: 190371

SEQ ID NO: 306318 - RNA, 64 nt, hsa; identical to SEQ ID NO: 190372

SEQ ID NO: 306319 - RNA, 64 nt, hsa; identical to SEQ ID NO: 190373

SEQ ID NO: 306320 - RNA, 64 nt, hsa; identical to SEQ ID NO: 190374

SEQ ID NO: 306321 - RNA, 64 nt, hsa; identical to SEQ ID NO: 190375

SEQ ID NO: 306322 - RNA, 64 nt, hsa; identical to SEQ ID NO: 190376

SEQ ID NO: 306323 - RNA, 58 nt, hsa; identical to SEQ ID NO: 190377

SEQ ID NO: 306324 - RNA, 64 nt, hsa; identical to SEQ ID NO: 190378

SEQ ID NO: 306325 - RNA, 64 nt, hsa; identical to SEQ ID NO: 190379

SEQ ID NO: 306326 - RNA, 64 nt, hsa; identical to SEQ ID NO: 190380

SEQ ID NO: 306327 - RNA, 64 nt, hsa; identical to SEQ ID NO: 190381

SEQ ID NO: 306328 - RNA, 64 nt, hsa; identical to SEQ ID NO: 190382

SEQ ID NO: 306329 - RNA, 64 nt, hsa; identical to SEQ ID NO: 190383

SEQ ID NO: 306330 - RNA, 64 nt, hsa; identical to SEQ ID NO: 190384

SEQ ID NO: 306331 - RNA, 64 nt, hsa; identical to SEQ ID NO: 190385

SEQ ID NO: 306332 - RNA, 64 nt, hsa; identical to SEQ ID NO: 190386

SEQ ID NO: 306333 - RNA, 64 nt, hsa; identical to SEQ ID NO: 190387

SEQ ID NO: 306334 - RNA, 64 nt, hsa; identical to SEQ ID NO: 190388

SEQ ID NO: 306335 - RNA, 64 nt, hsa; identical to SEQ ID NO: 190389

SEQ ID NO: 306336 - RNA, 64 nt, hsa; identical to SEQ ID NO: 190390

SEQ ID NO: 306337 - RNA, 64 nt, hsa; identical to SEQ ID NO: 190391

SEQ ID NO: 306338 - RNA, 64 nt, hsa; identical to SEQ ID NO: 190392

SEQ ID NO: 306339 - RNA, 64 nt, hsa; identical to SEQ ID NO: 190393

SEQ ID NO: 306340 - RNA, 64 nt, hsa; identical to SEQ ID NO: 190394

SEQ ID NO: 306341 - RNA, 64 nt, hsa; identical to SEQ ID NO: 190395

SEQ ID NO: 306342 - RNA, 64 nt, hsa; identical to SEQ ID NO: 190396

SEQ ID NO: 306343 - RNA, 64 nt, hsa; identical to SEQ ID NO: 190397

SEQ ID NO: 306344 - RNA, 64 nt, hsa; identical to SEQ ID NO: 190398

SEQ ID NO: 306345 - RNA, 64 nt, hsa; identical to SEQ ID NO: 190399

SEQ ID NO: 306346 - RNA, 62 nt, hsa; identical to SEQ ID NO: 253135

SEQ ID NO: 306347 - RNA, 62 nt, hsa; identical to SEQ ID NO: 253136

SEQ ID NO: 306348 - RNA, 62 nt, hsa; identical to SEQ ID NO: 253137

SEQ ID NO: 306349 - RNA, 62 nt, hsa; identical to SEQ ID NO: 253138

SEQ ID NO: 306350 - RNA, 62 nt, hsa; identical to SEQ ID NO: 253139

SEQ ID NO: 306351 - RNA, 62 nt, hsa; identical to SEQ ID NO: 253140

SEQ ID NO: 306352 - RNA, 62 nt, hsa; identical to SEQ ID NO: 253141

SEQ ID NO: 306353 - RNA, 62 nt, hsa; identical to SEQ ID NO: 253142

SEQ ID NO: 306354 - RNA, 62 nt, hsa; identical to SEQ ID NO: 253143

SEQ ID NO: 306355 - RNA, 62 nt, hsa; identical to SEQ ID NO: 253144

SEQ ID NO: 306356 - RNA, 62 nt, hsa; identical to SEQ ID NO: 253145

SEQ ID NO: 306357 - RNA, 58 nt, hsa; identical to SEQ ID NO: 102991

SEQ ID NO: 306358 - RNA, 62 nt, hsa; identical to SEQ ID NO: 253147

SEQ ID NO: 306359 - RNA, 62 nt, hsa; identical to SEQ ID NO: 253148

SEQ ID NO: 306360 - RNA, 62 nt, hsa; identical to SEQ ID NO: 253149

SEQ ID NO: 306361 - RNA, 62 nt, hsa; identical to SEQ ID NO: 253150

SEQ ID NO: 306362 - RNA, 62 nt, hsa; identical to SEQ ID NO: 253151

SEQ ID NO: 306363 - RNA, 62 nt, hsa; identical to SEQ ID NO: 253152

SEQ ID NO: 306364 - RNA, 62 nt, hsa; identical to SEQ ID NO: 253153

SEQ ID NO: 306365 - RNA, 62 nt, hsa; identical to SEQ ID NO: 253154

SEQ ID NO: 306366 - RNA, 62 nt, hsa; identical to SEQ ID NO: 253155

SEQ ID NO: 306367 - RNA, 62 nt, hsa; identical to SEQ ID NO: 253156

SEQ ID NO: 306368 - RNA, 62 nt, hsa; identical to SEQ ID NO: 253157

SEQ ID NO: 306369 - RNA, 62 nt, hsa; identical to SEQ ID NO: 253158

SEQ ID NO: 306370 - RNA, 62 nt, hsa; identical to SEQ ID NO: 253159

SEQ ID NO: 306371 - RNA, 62 nt, hsa; identical to SEQ ID NO: 253160

SEQ ID NO: 306372 - RNA, 62 nt, hsa; identical to SEQ ID NO: 253161

SEQ ID NO: 306373 - RNA, 62 nt, hsa; identical to SEQ ID NO: 253162

SEQ ID NO: 306374 - RNA, 62 nt, hsa; identical to SEQ ID NO: 253163

SEQ ID NO: 306375 - RNA, 62 nt, hsa; identical to SEQ ID NO: 253164

SEQ ID NO: 306376 - RNA, 62 nt, hsa; identical to SEQ ID NO: 253165

SEQ ID NO: 306377 - RNA, 62 nt, hsa; identical to SEQ ID NO: 253166

SEQ ID NO: 306378 - RNA, 62 nt, hsa; identical to SEQ ID NO: 253167

SEQ ID NO: 306379 - RNA, 62 nt, hsa; identical to SEQ ID NO: 253168

SEQ ID NO: 306380 - RNA, 53 nt, hsa; identical to SEQ ID NO: 103014

SEQ ID NO: 306381 - RNA, 62 nt, hsa; identical to SEQ ID NO: 253170

SEQ ID NO: 306382 - RNA, 62 nt, hsa; identical to SEQ ID NO: 253171

SEQ ID NO: 306383 - RNA, 62 nt, hsa; identical to SEQ ID NO: 253172

SEQ ID NO: 306384 - RNA, 62 nt, hsa; identical to SEQ ID NO: 253173

SEQ ID NO: 306385 - RNA, 62 nt, hsa; identical to SEQ ID NO: 253174

SEQ ID NO: 306386 - RNA, 62 nt, hsa; identical to SEQ ID NO: 253175

SEQ ID NO: 306387 - RNA, 62 nt, hsa; identical to SEQ ID NO: 253176

SEQ ID NO: 306388 - RNA, 62 nt, hsa; identical to SEQ ID NO: 253177

SEQ ID NO: 306389 - RNA, 62 nt, hsa; identical to SEQ ID NO: 253178

SEQ ID NO: 306390 - RNA, 62 nt, hsa; identical to SEQ ID NO: 253179

SEQ ID NO: 306391 - RNA, 62 nt, hsa; identical to SEQ ID NO: 253180

SEQ ID NO: 306392 - RNA, 62 nt, hsa; identical to SEQ ID NO: 253181

SEQ ID NO: 306393 - RNA, 62 nt, hsa; identical to SEQ ID NO: 253182

SEQ ID NO: 306394 - RNA, 62 nt, hsa; identical to SEQ ID NO: 253183

SEQ ID NO: 306395 - RNA, 62 nt, hsa; identical to SEQ ID NO: 253184

SEQ ID NO: 306396 - RNA, 62 nt, hsa; identical to SEQ ID NO: 253185

SEQ ID NO: 306397 - RNA, 62 nt, hsa; identical to SEQ ID NO: 253186

SEQ ID NO: 306398 - RNA, 62 nt, hsa; identical to SEQ ID NO: 253187

SEQ ID NO: 306399 - RNA, 62 nt, hsa; identical to SEQ ID NO: 253188

SEQ ID NO: 306400 - RNA, 62 nt, hsa; identical to SEQ ID NO: 253189

SEQ ID NO: 306401 - RNA, 62 nt, hsa; identical to SEQ ID NO: 253190

SEQ ID NO: 306402 - RNA, 62 nt, hsa; identical to SEQ ID NO: 253191

SEQ ID NO: 306403 - RNA, 62 nt, hsa; identical to SEQ ID NO: 253192

SEQ ID NO: 306404 - RNA, 62 nt, hsa; identical to SEQ ID NO: 253193

SEQ ID NO: 306405 - RNA, 62 nt, hsa; identical to SEQ ID NO: 253194

SEQ ID NO: 306406 - RNA, 62 nt, hsa; identical to SEQ ID NO: 253195

SEQ ID NO: 306407 - RNA, 62 nt, hsa; identical to SEQ ID NO: 253196

SEQ ID NO: 306408 - RNA, 62 nt, hsa; identical to SEQ ID NO: 253197

SEQ ID NO: 306409 - RNA, 62 nt, hsa; identical to SEQ ID NO: 253198

SEQ ID NO: 306410 - RNA, 62 nt, hsa; identical to SEQ ID NO: 253199

SEQ ID NO: 306411 - RNA, 62 nt, hsa; identical to SEQ ID NO: 253200

SEQ ID NO: 306412 - RNA, 62 nt, hsa; identical to SEQ ID NO: 253201

SEQ ID NO: 306413 - RNA, 62 nt, hsa; identical to SEQ ID NO: 253202

SEQ ID NO: 306414 - RNA, 62 nt, hsa; identical to SEQ ID NO: 253203

SEQ ID NO: 306415 - RNA, 62 nt, hsa; identical to SEQ ID NO: 253204

SEQ ID NO: 306416 - RNA, 62 nt, hsa; identical to SEQ ID NO: 253205

SEQ ID NO: 306417 - RNA, 62 nt, hsa; identical to SEQ ID NO: 253206

SEQ ID NO: 306418 - RNA, 62 nt, hsa; identical to SEQ ID NO: 253207

SEQ ID NO: 306419 - RNA, 62 nt, hsa; identical to SEQ ID NO: 253208

SEQ ID NO: 306420 - RNA, 62 nt, hsa; identical to SEQ ID NO: 253209

SEQ ID NO: 306421 - RNA, 62 nt, hsa; identical to SEQ ID NO: 253210

SEQ ID NO: 306422 - RNA, 62 nt, hsa; identical to SEQ ID NO: 253211

SEQ ID NO: 306423 - RNA, 62 nt, hsa; identical to SEQ ID NO: 253212

SEQ ID NO: 306424 - RNA, 62 nt, hsa; identical to SEQ ID NO: 253213

SEQ ID NO: 306425 - RNA, 62 nt, hsa; identical to SEQ ID NO: 253214

SEQ ID NO: 306426 - RNA, 62 nt, hsa; identical to SEQ ID NO: 253215

SEQ ID NO: 306427 - RNA, 62 nt, hsa; identical to SEQ ID NO: 253216

SEQ ID NO: 306428 - RNA, 62 nt, hsa; identical to SEQ ID NO: 253217

SEQ ID NO: 306429 - RNA, 62 nt, hsa; identical to SEQ ID NO: 253218

SEQ ID NO: 306430 - RNA, 62 nt, hsa; identical to SEQ ID NO: 253219

SEQ ID NO: 306431 - RNA, 62 nt, hsa; identical to SEQ ID NO: 253220

SEQ ID NO: 306432 - RNA, 62 nt, hsa; identical to SEQ ID NO: 253221

SEQ ID NO: 306433 - RNA, 62 nt, hsa; identical to SEQ ID NO: 253222

SEQ ID NO: 306434 - RNA, 62 nt, hsa; identical to SEQ ID NO: 253223

SEQ ID NO: 306435 - RNA, 62 nt, hsa; identical to SEQ ID NO: 253224

SEQ ID NO: 306436 - RNA, 62 nt, hsa; identical to SEQ ID NO: 253225

SEQ ID NO: 306437 - RNA, 62 nt, hsa; identical to SEQ ID NO: 253226

SEQ ID NO: 306438 - RNA, 62 nt, hsa; identical to SEQ ID NO: 253227

SEQ ID NO: 306439 - RNA, 62 nt, hsa; identical to SEQ ID NO: 253228

SEQ ID NO: 306440 - RNA, 62 nt, hsa; identical to SEQ ID NO: 253229

SEQ ID NO: 306441 - RNA, 62 nt, hsa; identical to SEQ ID NO: 253230

SEQ ID NO: 306442 - RNA, 62 nt, hsa; identical to SEQ ID NO: 253231

SEQ ID NO: 306443 - RNA, 62 nt, hsa; identical to SEQ ID NO: 253232

SEQ ID NO: 306444 - RNA, 62 nt, hsa; identical to SEQ ID NO: 253233

SEQ ID NO: 306445 - RNA, 62 nt, hsa; identical to SEQ ID NO: 253234

SEQ ID NO: 306446 - RNA, 62 nt, hsa; identical to SEQ ID NO: 253235

SEQ ID NO: 306447 - RNA, 62 nt, hsa; identical to SEQ ID NO: 253236

SEQ ID NO: 306448 - RNA, 62 nt, hsa; identical to SEQ ID NO: 253237

SEQ ID NO: 306449 - RNA, 62 nt, hsa; identical to SEQ ID NO: 253238

SEQ ID NO: 306450 - RNA, 62 nt, hsa; identical to SEQ ID NO: 253239

SEQ ID NO: 306451 - RNA, 62 nt, hsa; identical to SEQ ID NO: 253240

SEQ ID NO: 306452 - RNA, 62 nt, hsa; identical to SEQ ID NO: 253241

SEQ ID NO: 306453 - RNA, 62 nt, hsa; identical to SEQ ID NO: 253242

SEQ ID NO: 306454 - RNA, 62 nt, hsa; identical to SEQ ID NO: 253243

SEQ ID NO: 306455 - RNA, 62 nt, hsa; identical to SEQ ID NO: 253244

SEQ ID NO: 306456 - RNA, 62 nt, hsa; identical to SEQ ID NO: 253245

SEQ ID NO: 306457 - RNA, 62 nt, hsa; identical to SEQ ID NO: 253246

SEQ ID NO: 306458 - RNA, 62 nt, hsa; identical to SEQ ID NO: 253247

SEQ ID NO: 306459 - RNA, 62 nt, hsa; identical to SEQ ID NO: 253248

SEQ ID NO: 306460 - RNA, 62 nt, hsa; identical to SEQ ID NO: 253249

SEQ ID NO: 306461 - RNA, 62 nt, hsa; identical to SEQ ID NO: 253250

SEQ ID NO: 306462 - RNA, 62 nt, hsa; identical to SEQ ID NO: 253251

SEQ ID NO: 306463 - RNA, 62 nt, hsa; identical to SEQ ID NO: 253252

SEQ ID NO: 306464 - RNA, 60 nt, hsa; identical to SEQ ID NO: 103098

SEQ ID NO: 306465 - RNA, 62 nt, hsa; identical to SEQ ID NO: 253254

SEQ ID NO: 306466 - RNA, 62 nt, hsa; identical to SEQ ID NO: 253255

SEQ ID NO: 306467 - RNA, 62 nt, hsa; identical to SEQ ID NO: 253256

SEQ ID NO: 306468 - RNA, 62 nt, hsa; identical to SEQ ID NO: 253257

SEQ ID NO: 306469 - RNA, 62 nt, hsa; identical to SEQ ID NO: 253258

SEQ ID NO: 306470 - RNA, 62 nt, hsa; identical to SEQ ID NO: 253259

SEQ ID NO: 306471 - RNA, 62 nt, hsa; identical to SEQ ID NO: 253260

SEQ ID NO: 306472 - RNA, 62 nt, hsa; identical to SEQ ID NO: 253261

SEQ ID NO: 306473 - RNA, 62 nt, hsa; identical to SEQ ID NO: 253262

SEQ ID NO: 306474 - RNA, 62 nt, hsa; identical to SEQ ID NO: 253263

SEQ ID NO: 306475 - RNA, 62 nt, hsa; identical to SEQ ID NO: 253264

SEQ ID NO: 306476 - RNA, 62 nt, hsa; identical to SEQ ID NO: 253265

SEQ ID NO: 306477 - RNA, 62 nt, hsa; identical to SEQ ID NO: 253266

SEQ ID NO: 306478 - RNA, 62 nt, hsa; identical to SEQ ID NO: 253267

SEQ ID NO: 306479 - RNA, 62 nt, hsa; identical to SEQ ID NO: 253268

SEQ ID NO: 306480 - RNA, 62 nt, hsa; identical to SEQ ID NO: 253269

SEQ ID NO: 306481 - RNA, 62 nt, hsa; identical to SEQ ID NO: 253270

SEQ ID NO: 306482 - RNA, 62 nt, hsa; identical to SEQ ID NO: 253271

SEQ ID NO: 306483 - RNA, 62 nt, hsa; identical to SEQ ID NO: 253272

SEQ ID NO: 306484 - RNA, 62 nt, hsa; identical to SEQ ID NO: 253273

SEQ ID NO: 306485 - RNA, 62 nt, hsa; identical to SEQ ID NO: 253274

SEQ ID NO: 306486 - RNA, 62 nt, hsa; identical to SEQ ID NO: 253275

SEQ ID NO: 306487 - RNA, 62 nt, hsa; identical to SEQ ID NO: 253276

SEQ ID NO: 306488 - RNA, 62 nt, hsa; identical to SEQ ID NO: 253277

SEQ ID NO: 306489 - RNA, 62 nt, hsa; identical to SEQ ID NO: 253278

SEQ ID NO: 306490 - RNA, 62 nt, hsa; identical to SEQ ID NO: 253279

SEQ ID NO: 306491 - RNA, 62 nt, hsa; identical to SEQ ID NO: 253280

SEQ ID NO: 306492 - RNA, 62 nt, hsa; identical to SEQ ID NO: 253281

SEQ ID NO: 306493 - RNA, 62 nt, hsa; identical to SEQ ID NO: 253282

SEQ ID NO: 306494 - RNA, 62 nt, hsa; identical to SEQ ID NO: 253283

SEQ ID NO: 306495 - RNA, 62 nt, hsa; identical to SEQ ID NO: 253284

SEQ ID NO: 306496 - RNA, 62 nt, hsa; identical to SEQ ID NO: 253285

SEQ ID NO: 306497 - RNA, 62 nt, hsa; identical to SEQ ID NO: 253286

SEQ ID NO: 306498 - RNA, 62 nt, hsa; identical to SEQ ID NO: 253287

SEQ ID NO: 306499 - RNA, 62 nt, hsa; identical to SEQ ID NO: 253288

SEQ ID NO: 306500 - RNA, 62 nt, hsa; identical to SEQ ID NO: 253289

SEQ ID NO: 306501 - RNA, 62 nt, hsa; identical to SEQ ID NO: 253290

SEQ ID NO: 306502 - RNA, 62 nt, hsa; identical to SEQ ID NO: 253291

SEQ ID NO: 306503 - RNA, 62 nt, hsa; identical to SEQ ID NO: 253292

SEQ ID NO: 306504 - RNA, 62 nt, hsa; identical to SEQ ID NO: 253293

SEQ ID NO: 306505 - RNA, 62 nt, hsa; identical to SEQ ID NO: 253294

SEQ ID NO: 306506 - RNA, 62 nt, hsa; identical to SEQ ID NO: 253295

SEQ ID NO: 306507 - RNA, 62 nt, hsa; identical to SEQ ID NO: 253296

SEQ ID NO: 306508 - RNA, 62 nt, hsa; identical to SEQ ID NO: 253297

SEQ ID NO: 306509 - RNA, 62 nt, hsa; identical to SEQ ID NO: 253298

SEQ ID NO: 306510 - RNA, 62 nt, hsa; identical to SEQ ID NO: 253299

SEQ ID NO: 306511 - RNA, 62 nt, hsa; identical to SEQ ID NO: 253300

SEQ ID NO: 306512 - RNA, 62 nt, hsa; identical to SEQ ID NO: 253301

SEQ ID NO: 306513 - RNA, 62 nt, hsa; identical to SEQ ID NO: 253302

SEQ ID NO: 306514 - RNA, 62 nt, hsa; identical to SEQ ID NO: 253303

SEQ ID NO: 306515 - RNA, 62 nt, hsa; identical to SEQ ID NO: 253304

SEQ ID NO: 306516 - RNA, 62 nt, hsa; identical to SEQ ID NO: 253305

SEQ ID NO: 306517 - RNA, 62 nt, hsa; identical to SEQ ID NO: 253306

SEQ ID NO: 306518 - RNA, 62 nt, hsa; identical to SEQ ID NO: 253307

SEQ ID NO: 306519 - RNA, 62 nt, hsa; identical to SEQ ID NO: 253308

SEQ ID NO: 306520 - RNA, 62 nt, hsa; identical to SEQ ID NO: 253309

SEQ ID NO: 306521 - RNA, 62 nt, hsa; identical to SEQ ID NO: 253310

SEQ ID NO: 306522 - RNA, 62 nt, hsa; identical to SEQ ID NO: 253311

SEQ ID NO: 306523 - RNA, 62 nt, hsa; identical to SEQ ID NO: 253312

SEQ ID NO: 306524 - RNA, 62 nt, hsa; identical to SEQ ID NO: 253313

SEQ ID NO: 306525 - RNA, 62 nt, hsa; identical to SEQ ID NO: 253314

SEQ ID NO: 306526 - RNA, 62 nt, hsa; identical to SEQ ID NO: 253315

SEQ ID NO: 306527 - RNA, 62 nt, hsa; identical to SEQ ID NO: 253316

SEQ ID NO: 306528 - RNA, 62 nt, hsa; identical to SEQ ID NO: 253317

SEQ ID NO: 306529 - RNA, 62 nt, hsa; identical to SEQ ID NO: 253318

SEQ ID NO: 306530 - RNA, 62 nt, hsa; identical to SEQ ID NO: 253319

SEQ ID NO: 306531 - RNA, 62 nt, hsa; identical to SEQ ID NO: 253320

SEQ ID NO: 306532 - RNA, 62 nt, hsa; identical to SEQ ID NO: 253321

SEQ ID NO: 306533 - RNA, 62 nt, hsa; identical to SEQ ID NO: 253322

SEQ ID NO: 306534 - RNA, 62 nt, hsa; identical to SEQ ID NO: 253323

SEQ ID NO: 306535 - RNA, 62 nt, hsa; identical to SEQ ID NO: 253324

SEQ ID NO: 306536 - RNA, 62 nt, hsa; identical to SEQ ID NO: 253325

SEQ ID NO: 306537 - RNA, 62 nt, hsa; identical to SEQ ID NO: 253326

SEQ ID NO: 306538 - RNA, 62 nt, hsa; identical to SEQ ID NO: 253327

SEQ ID NO: 306539 - RNA, 62 nt, hsa; identical to SEQ ID NO: 253328

SEQ ID NO: 306540 - RNA, 62 nt, hsa; identical to SEQ ID NO: 253329

SEQ ID NO: 306541 - RNA, 62 nt, hsa; identical to SEQ ID NO: 253330

SEQ ID NO: 306542 - RNA, 62 nt, hsa; identical to SEQ ID NO: 253331

SEQ ID NO: 306543 - RNA, 62 nt, hsa; identical to SEQ ID NO: 253332

SEQ ID NO: 306544 - RNA, 62 nt, hsa; identical to SEQ ID NO: 253333

SEQ ID NO: 306545 - RNA, 62 nt, hsa; identical to SEQ ID NO: 253334

SEQ ID NO: 306546 - RNA, 62 nt, hsa; identical to SEQ ID NO: 253335

SEQ ID NO: 306547 - RNA, 62 nt, hsa; identical to SEQ ID NO: 253336

SEQ ID NO: 306548 - RNA, 62 nt, hsa; identical to SEQ ID NO: 253337

SEQ ID NO: 306549 - RNA, 62 nt, hsa; identical to SEQ ID NO: 253338

SEQ ID NO: 306550 - RNA, 62 nt, hsa; identical to SEQ ID NO: 253339

SEQ ID NO: 306551 - RNA, 62 nt, hsa; identical to SEQ ID NO: 253340

SEQ ID NO: 306552 - RNA, 62 nt, hsa; identical to SEQ ID NO: 253341

SEQ ID NO: 306553 - RNA, 62 nt, hsa; identical to SEQ ID NO: 253342

SEQ ID NO: 306554 - RNA, 62 nt, hsa; identical to SEQ ID NO: 253343

SEQ ID NO: 306555 - RNA, 62 nt, hsa; identical to SEQ ID NO: 253344

SEQ ID NO: 306556 - RNA, 62 nt, hsa; identical to SEQ ID NO: 253345

SEQ ID NO: 306557 - RNA, 62 nt, hsa; identical to SEQ ID NO: 253346

SEQ ID NO: 306558 - RNA, 62 nt, hsa; identical to SEQ ID NO: 253347

SEQ ID NO: 306559 - RNA, 62 nt, hsa; identical to SEQ ID NO: 253348

SEQ ID NO: 306560 - RNA, 62 nt, hsa; identical to SEQ ID NO: 253349

SEQ ID NO: 306561 - RNA, 62 nt, hsa; identical to SEQ ID NO: 253350

SEQ ID NO: 306562 - RNA, 51 nt, hsa; identical to SEQ ID NO: 103196

SEQ ID NO: 306563 - RNA, 62 nt, hsa; identical to SEQ ID NO: 253352

SEQ ID NO: 306564 - RNA, 62 nt, hsa; identical to SEQ ID NO: 253353

SEQ ID NO: 306565 - RNA, 62 nt, hsa; identical to SEQ ID NO: 253354

SEQ ID NO: 306566 - RNA, 62 nt, hsa; identical to SEQ ID NO: 253355

SEQ ID NO: 306567 - RNA, 62 nt, hsa; identical to SEQ ID NO: 253356

SEQ ID NO: 306568 - RNA, 62 nt, hsa; identical to SEQ ID NO: 253357

SEQ ID NO: 306569 - RNA, 62 nt, hsa; identical to SEQ ID NO: 253358

SEQ ID NO: 306570 - RNA, 62 nt, hsa; identical to SEQ ID NO: 253359

SEQ ID NO: 306571 - RNA, 62 nt, hsa; identical to SEQ ID NO: 253360

SEQ ID NO: 306572 - RNA, 62 nt, hsa; identical to SEQ ID NO: 253361

SEQ ID NO: 306573 - RNA, 62 nt, hsa; identical to SEQ ID NO: 253362

SEQ ID NO: 306574 - RNA, 62 nt, hsa; identical to SEQ ID NO: 253363

SEQ ID NO: 306575 - RNA, 62 nt, hsa; identical to SEQ ID NO: 253364

SEQ ID NO: 306576 - RNA, 62 nt, hsa; identical to SEQ ID NO: 253365

SEQ ID NO: 306577 - RNA, 62 nt, hsa; identical to SEQ ID NO: 253366

SEQ ID NO: 306578 - RNA, 62 nt, hsa; identical to SEQ ID NO: 253367

SEQ ID NO: 306579 - RNA, 62 nt, hsa; identical to SEQ ID NO: 253368

SEQ ID NO: 306580 - RNA, 62 nt, hsa; identical to SEQ ID NO: 253369

SEQ ID NO: 306581 - RNA, 62 nt, hsa; identical to SEQ ID NO: 253370

SEQ ID NO: 306582 - RNA, 62 nt, hsa; identical to SEQ ID NO: 253371

SEQ ID NO: 306583 - RNA, 62 nt, hsa; identical to SEQ ID NO: 253372

SEQ ID NO: 306584 - RNA, 62 nt, hsa; identical to SEQ ID NO: 253373

SEQ ID NO: 306585 - RNA, 62 nt, hsa; identical to SEQ ID NO: 253374

SEQ ID NO: 306586 - RNA, 62 nt, hsa; identical to SEQ ID NO: 253375

SEQ ID NO: 306587 - RNA, 62 nt, hsa; identical to SEQ ID NO: 253376

SEQ ID NO: 306588 - RNA, 62 nt, hsa; identical to SEQ ID NO: 253377

SEQ ID NO: 306589 - RNA, 62 nt, hsa; identical to SEQ ID NO: 253378

SEQ ID NO: 306590 - RNA, 62 nt, hsa; identical to SEQ ID NO: 253379

SEQ ID NO: 306591 - RNA, 62 nt, hsa; identical to SEQ ID NO: 253380

SEQ ID NO: 306592 - RNA, 62 nt, hsa; identical to SEQ ID NO: 253381

SEQ ID NO: 306593 - RNA, 62 nt, hsa; identical to SEQ ID NO: 253382

SEQ ID NO: 306594 - RNA, 62 nt, hsa; identical to SEQ ID NO: 253383

SEQ ID NO: 306595 - RNA, 62 nt, hsa; identical to SEQ ID NO: 253384

SEQ ID NO: 306596 - RNA, 62 nt, hsa; identical to SEQ ID NO: 253385

SEQ ID NO: 306597 - RNA, 62 nt, hsa; identical to SEQ ID NO: 253386

SEQ ID NO: 306598 - RNA, 62 nt, hsa; identical to SEQ ID NO: 253387

SEQ ID NO: 306599 - RNA, 62 nt, hsa; identical to SEQ ID NO: 253388

SEQ ID NO: 306600 - RNA, 62 nt, hsa; identical to SEQ ID NO: 253389

SEQ ID NO: 306601 - RNA, 62 nt, hsa; identical to SEQ ID NO: 253390

SEQ ID NO: 306602 - RNA, 62 nt, hsa; identical to SEQ ID NO: 253391

SEQ ID NO: 306603 - RNA, 62 nt, hsa; identical to SEQ ID NO: 253392

SEQ ID NO: 306604 - RNA, 62 nt, hsa; identical to SEQ ID NO: 253393

SEQ ID NO: 306605 - RNA, 62 nt, hsa; identical to SEQ ID NO: 253394

SEQ ID NO: 306606 - RNA, 62 nt, hsa; identical to SEQ ID NO: 253395

SEQ ID NO: 306607 - RNA, 62 nt, hsa; identical to SEQ ID NO: 253396

SEQ ID NO: 306608 - RNA, 62 nt, hsa; identical to SEQ ID NO: 253397

SEQ ID NO: 306609 - RNA, 62 nt, hsa; identical to SEQ ID NO: 253398

SEQ ID NO: 306610 - RNA, 62 nt, hsa; identical to SEQ ID NO: 253399

SEQ ID NO: 306611 - RNA, 62 nt, hsa; identical to SEQ ID NO: 253400

SEQ ID NO: 306612 - RNA, 62 nt, hsa; identical to SEQ ID NO: 253401

SEQ ID NO: 306613 - RNA, 62 nt, hsa; identical to SEQ ID NO: 253402

SEQ ID NO: 306614 - RNA, 62 nt, hsa; identical to SEQ ID NO: 253403

SEQ ID NO: 306615 - RNA, 62 nt, hsa; identical to SEQ ID NO: 253404

SEQ ID NO: 306616 - RNA, 62 nt, hsa; identical to SEQ ID NO: 253405

SEQ ID NO: 306617 - RNA, 62 nt, hsa; identical to SEQ ID NO: 253406

SEQ ID NO: 306618 - RNA, 62 nt, hsa; identical to SEQ ID NO: 253407

SEQ ID NO: 306619 - RNA, 62 nt, hsa; identical to SEQ ID NO: 253408

SEQ ID NO: 306620 - RNA, 62 nt, hsa; identical to SEQ ID NO: 253409

SEQ ID NO: 306621 - RNA, 62 nt, hsa; identical to SEQ ID NO: 253410

SEQ ID NO: 306622 - RNA, 62 nt, hsa; identical to SEQ ID NO: 253411

SEQ ID NO: 306623 - RNA, 62 nt, hsa; identical to SEQ ID NO: 253412

SEQ ID NO: 306624 - RNA, 62 nt, hsa; identical to SEQ ID NO: 253413

SEQ ID NO: 306625 - RNA, 62 nt, hsa; identical to SEQ ID NO: 253414

SEQ ID NO: 306626 - RNA, 62 nt, hsa; identical to SEQ ID NO: 253415

SEQ ID NO: 306627 - RNA, 62 nt, hsa; identical to SEQ ID NO: 253416

SEQ ID NO: 306628 - RNA, 62 nt, hsa; identical to SEQ ID NO: 253417

SEQ ID NO: 306629 - RNA, 62 nt, hsa; identical to SEQ ID NO: 253418

SEQ ID NO: 306630 - RNA, 62 nt, hsa; identical to SEQ ID NO: 253419

SEQ ID NO: 306631 - RNA, 62 nt, hsa; identical to SEQ ID NO: 253420

SEQ ID NO: 306632 - RNA, 62 nt, hsa; identical to SEQ ID NO: 253421

SEQ ID NO: 306633 - RNA, 62 nt, hsa; identical to SEQ ID NO: 253422

SEQ ID NO: 306634 - RNA, 62 nt, hsa; identical to SEQ ID NO: 253423

SEQ ID NO: 306635 - RNA, 62 nt, hsa; identical to SEQ ID NO: 253424

SEQ ID NO: 306636 - RNA, 62 nt, hsa; identical to SEQ ID NO: 253425

SEQ ID NO: 306637 - RNA, 62 nt, hsa; identical to SEQ ID NO: 253426

SEQ ID NO: 306638 - RNA, 62 nt, hsa; identical to SEQ ID NO: 253427

SEQ ID NO: 306639 - RNA, 62 nt, hsa; identical to SEQ ID NO: 253428

SEQ ID NO: 306640 - RNA, 62 nt, hsa; identical to SEQ ID NO: 253429

SEQ ID NO: 306641 - RNA, 62 nt, hsa; identical to SEQ ID NO: 253430

SEQ ID NO: 306642 - RNA, 62 nt, hsa; identical to SEQ ID NO: 253431

SEQ ID NO: 306643 - RNA, 62 nt, hsa; identical to SEQ ID NO: 253432

SEQ ID NO: 306644 - RNA, 62 nt, hsa; identical to SEQ ID NO: 253433

SEQ ID NO: 306645 - RNA, 62 nt, hsa; identical to SEQ ID NO: 253434

SEQ ID NO: 306646 - RNA, 62 nt, hsa; identical to SEQ ID NO: 253435

SEQ ID NO: 306647 - RNA, 62 nt, hsa; identical to SEQ ID NO: 253436

SEQ ID NO: 306648 - RNA, 62 nt, hsa; identical to SEQ ID NO: 253437

SEQ ID NO: 306649 - RNA, 62 nt, hsa; identical to SEQ ID NO: 253438

SEQ ID NO: 306650 - RNA, 62 nt, hsa; identical to SEQ ID NO: 253439

SEQ ID NO: 306651 - RNA, 62 nt, hsa; identical to SEQ ID NO: 253440

SEQ ID NO: 306652 - RNA, 62 nt, hsa; identical to SEQ ID NO: 253441

SEQ ID NO: 306653 - RNA, 62 nt, hsa; identical to SEQ ID NO: 253442

SEQ ID NO: 306654 - RNA, 62 nt, hsa; identical to SEQ ID NO: 253443

SEQ ID NO: 306655 - RNA, 66 nt, hsa; identical to SEQ ID NO: 253444

SEQ ID NO: 306656 - RNA, 66 nt, hsa; identical to SEQ ID NO: 253445

SEQ ID NO: 306657 - RNA, 66 nt, hsa; identical to SEQ ID NO: 253446

SEQ ID NO: 306658 - RNA, 66 nt, hsa; identical to SEQ ID NO: 253447

SEQ ID NO: 306659 - RNA, 66 nt, hsa; identical to SEQ ID NO: 253448

SEQ ID NO: 306660 - RNA, 66 nt, hsa; identical to SEQ ID NO: 253449

SEQ ID NO: 306661 - RNA, 66 nt, hsa; identical to SEQ ID NO: 253450

SEQ ID NO: 306662 - RNA, 66 nt, hsa; identical to SEQ ID NO: 253451

SEQ ID NO: 306663 - RNA, 66 nt, hsa; identical to SEQ ID NO: 253452

SEQ ID NO: 306664 - RNA, 66 nt, hsa; identical to SEQ ID NO: 253453

SEQ ID NO: 306665 - RNA, 66 nt, hsa; identical to SEQ ID NO: 253454

SEQ ID NO: 306666 - RNA, 58 nt, hsa; identical to SEQ ID NO: 102991

SEQ ID NO: 306667 - RNA, 66 nt, hsa; identical to SEQ ID NO: 253456

SEQ ID NO: 306668 - RNA, 66 nt, hsa; identical to SEQ ID NO: 253457

SEQ ID NO: 306669 - RNA, 66 nt, hsa; identical to SEQ ID NO: 253458

SEQ ID NO: 306670 - RNA, 66 nt, hsa; identical to SEQ ID NO: 253459

SEQ ID NO: 306671 - RNA, 66 nt, hsa; identical to SEQ ID NO: 253460

SEQ ID NO: 306672 - RNA, 66 nt, hsa; identical to SEQ ID NO: 253461

SEQ ID NO: 306673 - RNA, 66 nt, hsa; identical to SEQ ID NO: 253462

SEQ ID NO: 306674 - RNA, 66 nt, hsa; identical to SEQ ID NO: 253463

SEQ ID NO: 306675 - RNA, 66 nt, hsa; identical to SEQ ID NO: 253464

SEQ ID NO: 306676 - RNA, 66 nt, hsa; identical to SEQ ID NO: 253465

SEQ ID NO: 306677 - RNA, 66 nt, hsa; identical to SEQ ID NO: 253466

SEQ ID NO: 306678 - RNA, 66 nt, hsa; identical to SEQ ID NO: 253467

SEQ ID NO: 306679 - RNA, 66 nt, hsa; identical to SEQ ID NO: 253468

SEQ ID NO: 306680 - RNA, 66 nt, hsa; identical to SEQ ID NO: 253469

SEQ ID NO: 306681 - RNA, 66 nt, hsa; identical to SEQ ID NO: 253470

SEQ ID NO: 306682 - RNA, 66 nt, hsa; identical to SEQ ID NO: 253471

SEQ ID NO: 306683 - RNA, 66 nt, hsa; identical to SEQ ID NO: 253472

SEQ ID NO: 306684 - RNA, 66 nt, hsa; identical to SEQ ID NO: 253473

SEQ ID NO: 306685 - RNA, 66 nt, hsa; identical to SEQ ID NO: 253474

SEQ ID NO: 306686 - RNA, 66 nt, hsa; identical to SEQ ID NO: 253475

SEQ ID NO: 306687 - RNA, 66 nt, hsa; identical to SEQ ID NO: 253476

SEQ ID NO: 306688 - RNA, 66 nt, hsa; identical to SEQ ID NO: 253477

SEQ ID NO: 306689 - RNA, 53 nt, hsa; identical to SEQ ID NO: 103014

SEQ ID NO: 306690 - RNA, 66 nt, hsa; identical to SEQ ID NO: 253479

SEQ ID NO: 306691 - RNA, 66 nt, hsa; identical to SEQ ID NO: 253480

SEQ ID NO: 306692 - RNA, 66 nt, hsa; identical to SEQ ID NO: 253481

SEQ ID NO: 306693 - RNA, 66 nt, hsa; identical to SEQ ID NO: 253482

SEQ ID NO: 306694 - RNA, 66 nt, hsa; identical to SEQ ID NO: 253483

SEQ ID NO: 306695 - RNA, 66 nt, hsa; identical to SEQ ID NO: 253484

SEQ ID NO: 306696 - RNA, 66 nt, hsa; identical to SEQ ID NO: 253485

SEQ ID NO: 306697 - RNA, 66 nt, hsa; identical to SEQ ID NO: 253486

SEQ ID NO: 306698 - RNA, 66 nt, hsa; identical to SEQ ID NO: 253487

SEQ ID NO: 306699 - RNA, 66 nt, hsa; identical to SEQ ID NO: 253488

SEQ ID NO: 306700 - RNA, 66 nt, hsa; identical to SEQ ID NO: 253489

SEQ ID NO: 306701 - RNA, 66 nt, hsa; identical to SEQ ID NO: 253490

SEQ ID NO: 306702 - RNA, 66 nt, hsa; identical to SEQ ID NO: 253491

SEQ ID NO: 306703 - RNA, 66 nt, hsa; identical to SEQ ID NO: 253492

SEQ ID NO: 306704 - RNA, 66 nt, hsa; identical to SEQ ID NO: 253493

SEQ ID NO: 306705 - RNA, 66 nt, hsa; identical to SEQ ID NO: 253494

SEQ ID NO: 306706 - RNA, 66 nt, hsa; identical to SEQ ID NO: 253495

SEQ ID NO: 306707 - RNA, 66 nt, hsa; identical to SEQ ID NO: 253496

SEQ ID NO: 306708 - RNA, 66 nt, hsa; identical to SEQ ID NO: 253497

SEQ ID NO: 306709 - RNA, 66 nt, hsa; identical to SEQ ID NO: 253498

SEQ ID NO: 306710 - RNA, 66 nt, hsa; identical to SEQ ID NO: 253499

SEQ ID NO: 306711 - RNA, 66 nt, hsa; identical to SEQ ID NO: 253500

SEQ ID NO: 306712 - RNA, 66 nt, hsa; identical to SEQ ID NO: 253501

SEQ ID NO: 306713 - RNA, 66 nt, hsa; identical to SEQ ID NO: 253502

SEQ ID NO: 306714 - RNA, 66 nt, hsa; identical to SEQ ID NO: 253503

SEQ ID NO: 306715 - RNA, 66 nt, hsa; identical to SEQ ID NO: 253504

SEQ ID NO: 306716 - RNA, 66 nt, hsa; identical to SEQ ID NO: 253505

SEQ ID NO: 306717 - RNA, 66 nt, hsa; identical to SEQ ID NO: 253506

SEQ ID NO: 306718 - RNA, 66 nt, hsa; identical to SEQ ID NO: 253507

SEQ ID NO: 306719 - RNA, 66 nt, hsa; identical to SEQ ID NO: 253508

SEQ ID NO: 306720 - RNA, 66 nt, hsa; identical to SEQ ID NO: 253509

SEQ ID NO: 306721 - RNA, 66 nt, hsa; identical to SEQ ID NO: 253510

SEQ ID NO: 306722 - RNA, 66 nt, hsa; identical to SEQ ID NO: 253511

SEQ ID NO: 306723 - RNA, 66 nt, hsa; identical to SEQ ID NO: 253512

SEQ ID NO: 306724 - RNA, 66 nt, hsa; identical to SEQ ID NO: 253513

SEQ ID NO: 306725 - RNA, 66 nt, hsa; identical to SEQ ID NO: 253514

SEQ ID NO: 306726 - RNA, 66 nt, hsa; identical to SEQ ID NO: 253515

SEQ ID NO: 306727 - RNA, 66 nt, hsa; identical to SEQ ID NO: 253516

SEQ ID NO: 306728 - RNA, 66 nt, hsa; identical to SEQ ID NO: 253517

SEQ ID NO: 306729 - RNA, 66 nt, hsa; identical to SEQ ID NO: 253518

SEQ ID NO: 306730 - RNA, 66 nt, hsa; identical to SEQ ID NO: 253519

SEQ ID NO: 306731 - RNA, 66 nt, hsa; identical to SEQ ID NO: 253520

SEQ ID NO: 306732 - RNA, 66 nt, hsa; identical to SEQ ID NO: 253521

SEQ ID NO: 306733 - RNA, 66 nt, hsa; identical to SEQ ID NO: 253522

SEQ ID NO: 306734 - RNA, 66 nt, hsa; identical to SEQ ID NO: 253523

SEQ ID NO: 306735 - RNA, 66 nt, hsa; identical to SEQ ID NO: 253524

SEQ ID NO: 306736 - RNA, 66 nt, hsa; identical to SEQ ID NO: 253525

SEQ ID NO: 306737 - RNA, 66 nt, hsa; identical to SEQ ID NO: 253526

SEQ ID NO: 306738 - RNA, 66 nt, hsa; identical to SEQ ID NO: 253527

SEQ ID NO: 306739 - RNA, 66 nt, hsa; identical to SEQ ID NO: 253528

SEQ ID NO: 306740 - RNA, 66 nt, hsa; identical to SEQ ID NO: 253529

SEQ ID NO: 306741 - RNA, 66 nt, hsa; identical to SEQ ID NO: 253530

SEQ ID NO: 306742 - RNA, 66 nt, hsa; identical to SEQ ID NO: 253531

SEQ ID NO: 306743 - RNA, 66 nt, hsa; identical to SEQ ID NO: 253532

SEQ ID NO: 306744 - RNA, 66 nt, hsa; identical to SEQ ID NO: 253533

SEQ ID NO: 306745 - RNA, 66 nt, hsa; identical to SEQ ID NO: 253534

SEQ ID NO: 306746 - RNA, 66 nt, hsa; identical to SEQ ID NO: 253535

SEQ ID NO: 306747 - RNA, 66 nt, hsa; identical to SEQ ID NO: 253536

SEQ ID NO: 306748 - RNA, 66 nt, hsa; identical to SEQ ID NO: 253537

SEQ ID NO: 306749 - RNA, 66 nt, hsa; identical to SEQ ID NO: 253538

SEQ ID NO: 306750 - RNA, 66 nt, hsa; identical to SEQ ID NO: 253539

SEQ ID NO: 306751 - RNA, 66 nt, hsa; identical to SEQ ID NO: 253540

SEQ ID NO: 306752 - RNA, 66 nt, hsa; identical to SEQ ID NO: 253541

SEQ ID NO: 306753 - RNA, 66 nt, hsa; identical to SEQ ID NO: 253542

SEQ ID NO: 306754 - RNA, 66 nt, hsa; identical to SEQ ID NO: 253543

SEQ ID NO: 306755 - RNA, 66 nt, hsa; identical to SEQ ID NO: 253544

SEQ ID NO: 306756 - RNA, 66 nt, hsa; identical to SEQ ID NO: 253545

SEQ ID NO: 306757 - RNA, 66 nt, hsa; identical to SEQ ID NO: 253546

SEQ ID NO: 306758 - RNA, 66 nt, hsa; identical to SEQ ID NO: 253547

SEQ ID NO: 306759 - RNA, 66 nt, hsa; identical to SEQ ID NO: 253548

SEQ ID NO: 306760 - RNA, 66 nt, hsa; identical to SEQ ID NO: 253549

SEQ ID NO: 306761 - RNA, 66 nt, hsa; identical to SEQ ID NO: 253550

SEQ ID NO: 306762 - RNA, 66 nt, hsa; identical to SEQ ID NO: 253551

SEQ ID NO: 306763 - RNA, 66 nt, hsa; identical to SEQ ID NO: 253552

SEQ ID NO: 306764 - RNA, 66 nt, hsa; identical to SEQ ID NO: 253553

SEQ ID NO: 306765 - RNA, 66 nt, hsa; identical to SEQ ID NO: 253554

SEQ ID NO: 306766 - RNA, 66 nt, hsa; identical to SEQ ID NO: 253555

SEQ ID NO: 306767 - RNA, 66 nt, hsa; identical to SEQ ID NO: 253556

SEQ ID NO: 306768 - RNA, 66 nt, hsa; identical to SEQ ID NO: 253557

SEQ ID NO: 306769 - RNA, 66 nt, hsa; identical to SEQ ID NO: 253558

SEQ ID NO: 306770 - RNA, 66 nt, hsa; identical to SEQ ID NO: 253559

SEQ ID NO: 306771 - RNA, 66 nt, hsa; identical to SEQ ID NO: 253560

SEQ ID NO: 306772 - RNA, 66 nt, hsa; identical to SEQ ID NO: 253561

SEQ ID NO: 306773 - RNA, 60 nt, hsa; identical to SEQ ID NO: 103098

SEQ ID NO: 306774 - RNA, 66 nt, hsa; identical to SEQ ID NO: 253563

SEQ ID NO: 306775 - RNA, 66 nt, hsa; identical to SEQ ID NO: 253564

SEQ ID NO: 306776 - RNA, 66 nt, hsa; identical to SEQ ID NO: 253565

SEQ ID NO: 306777 - RNA, 66 nt, hsa; identical to SEQ ID NO: 253566

SEQ ID NO: 306778 - RNA, 66 nt, hsa; identical to SEQ ID NO: 253567

SEQ ID NO: 306779 - RNA, 66 nt, hsa; identical to SEQ ID NO: 253568

SEQ ID NO: 306780 - RNA, 66 nt, hsa; identical to SEQ ID NO: 253569

SEQ ID NO: 306781 - RNA, 66 nt, hsa; identical to SEQ ID NO: 253570

SEQ ID NO: 306782 - RNA, 66 nt, hsa; identical to SEQ ID NO: 253571

SEQ ID NO: 306783 - RNA, 66 nt, hsa; identical to SEQ ID NO: 253572

SEQ ID NO: 306784 - RNA, 66 nt, hsa; identical to SEQ ID NO: 253573

SEQ ID NO: 306785 - RNA, 66 nt, hsa; identical to SEQ ID NO: 253574

SEQ ID NO: 306786 - RNA, 66 nt, hsa; identical to SEQ ID NO: 253575

SEQ ID NO: 306787 - RNA, 66 nt, hsa; identical to SEQ ID NO: 253576

SEQ ID NO: 306788 - RNA, 66 nt, hsa; identical to SEQ ID NO: 253577

SEQ ID NO: 306789 - RNA, 66 nt, hsa; identical to SEQ ID NO: 253578

SEQ ID NO: 306790 - RNA, 66 nt, hsa; identical to SEQ ID NO: 253579

SEQ ID NO: 306791 - RNA, 66 nt, hsa; identical to SEQ ID NO: 253580

SEQ ID NO: 306792 - RNA, 66 nt, hsa; identical to SEQ ID NO: 253581

SEQ ID NO: 306793 - RNA, 66 nt, hsa; identical to SEQ ID NO: 253582

SEQ ID NO: 306794 - RNA, 66 nt, hsa; identical to SEQ ID NO: 253583

SEQ ID NO: 306795 - RNA, 66 nt, hsa; identical to SEQ ID NO: 253584

SEQ ID NO: 306796 - RNA, 66 nt, hsa; identical to SEQ ID NO: 253585

SEQ ID NO: 306797 - RNA, 66 nt, hsa; identical to SEQ ID NO: 253586

SEQ ID NO: 306798 - RNA, 66 nt, hsa; identical to SEQ ID NO: 253587

SEQ ID NO: 306799 - RNA, 66 nt, hsa; identical to SEQ ID NO: 253588

SEQ ID NO: 306800 - RNA, 66 nt, hsa; identical to SEQ ID NO: 253589

SEQ ID NO: 306801 - RNA, 66 nt, hsa; identical to SEQ ID NO: 253590

SEQ ID NO: 306802 - RNA, 66 nt, hsa; identical to SEQ ID NO: 253591

SEQ ID NO: 306803 - RNA, 66 nt, hsa; identical to SEQ ID NO: 253592

SEQ ID NO: 306804 - RNA, 66 nt, hsa; identical to SEQ ID NO: 253593

SEQ ID NO: 306805 - RNA, 66 nt, hsa; identical to SEQ ID NO: 253594

SEQ ID NO: 306806 - RNA, 66 nt, hsa; identical to SEQ ID NO: 253595

SEQ ID NO: 306807 - RNA, 66 nt, hsa; identical to SEQ ID NO: 253596

SEQ ID NO: 306808 - RNA, 66 nt, hsa; identical to SEQ ID NO: 253597

SEQ ID NO: 306809 - RNA, 66 nt, hsa; identical to SEQ ID NO: 253598

SEQ ID NO: 306810 - RNA, 66 nt, hsa; identical to SEQ ID NO: 253599

SEQ ID NO: 306811 - RNA, 66 nt, hsa; identical to SEQ ID NO: 253600

SEQ ID NO: 306812 - RNA, 66 nt, hsa; identical to SEQ ID NO: 253601

SEQ ID NO: 306813 - RNA, 66 nt, hsa; identical to SEQ ID NO: 253602

SEQ ID NO: 306814 - RNA, 66 nt, hsa; identical to SEQ ID NO: 253603

SEQ ID NO: 306815 - RNA, 66 nt, hsa; identical to SEQ ID NO: 253604

SEQ ID NO: 306816 - RNA, 66 nt, hsa; identical to SEQ ID NO: 253605

SEQ ID NO: 306817 - RNA, 66 nt, hsa; identical to SEQ ID NO: 253606

SEQ ID NO: 306818 - RNA, 66 nt, hsa; identical to SEQ ID NO: 253607

SEQ ID NO: 306819 - RNA, 66 nt, hsa; identical to SEQ ID NO: 253608

SEQ ID NO: 306820 - RNA, 66 nt, hsa; identical to SEQ ID NO: 253609

SEQ ID NO: 306821 - RNA, 66 nt, hsa; identical to SEQ ID NO: 253610

SEQ ID NO: 306822 - RNA, 66 nt, hsa; identical to SEQ ID NO: 253611

SEQ ID NO: 306823 - RNA, 66 nt, hsa; identical to SEQ ID NO: 253612

SEQ ID NO: 306824 - RNA, 66 nt, hsa; identical to SEQ ID NO: 253613

SEQ ID NO: 306825 - RNA, 66 nt, hsa; identical to SEQ ID NO: 253614

SEQ ID NO: 306826 - RNA, 66 nt, hsa; identical to SEQ ID NO: 253615

SEQ ID NO: 306827 - RNA, 66 nt, hsa; identical to SEQ ID NO: 253616

SEQ ID NO: 306828 - RNA, 66 nt, hsa; identical to SEQ ID NO: 253617

SEQ ID NO: 306829 - RNA, 66 nt, hsa; identical to SEQ ID NO: 253618

SEQ ID NO: 306830 - RNA, 66 nt, hsa; identical to SEQ ID NO: 253619

SEQ ID NO: 306831 - RNA, 66 nt, hsa; identical to SEQ ID NO: 253620

SEQ ID NO: 306832 - RNA, 66 nt, hsa; identical to SEQ ID NO: 253621

SEQ ID NO: 306833 - RNA, 66 nt, hsa; identical to SEQ ID NO: 253622

SEQ ID NO: 306834 - RNA, 66 nt, hsa; identical to SEQ ID NO: 253623

SEQ ID NO: 306835 - RNA, 66 nt, hsa; identical to SEQ ID NO: 253624

SEQ ID NO: 306836 - RNA, 66 nt, hsa; identical to SEQ ID NO: 253625

SEQ ID NO: 306837 - RNA, 66 nt, hsa; identical to SEQ ID NO: 253626

SEQ ID NO: 306838 - RNA, 66 nt, hsa; identical to SEQ ID NO: 253627

SEQ ID NO: 306839 - RNA, 66 nt, hsa; identical to SEQ ID NO: 253628

SEQ ID NO: 306840 - RNA, 66 nt, hsa; identical to SEQ ID NO: 253629

SEQ ID NO: 306841 - RNA, 66 nt, hsa; identical to SEQ ID NO: 253630

SEQ ID NO: 306842 - RNA, 66 nt, hsa; identical to SEQ ID NO: 253631

SEQ ID NO: 306843 - RNA, 66 nt, hsa; identical to SEQ ID NO: 253632

SEQ ID NO: 306844 - RNA, 66 nt, hsa; identical to SEQ ID NO: 253633

SEQ ID NO: 306845 - RNA, 66 nt, hsa; identical to SEQ ID NO: 253634

SEQ ID NO: 306846 - RNA, 66 nt, hsa; identical to SEQ ID NO: 253635

SEQ ID NO: 306847 - RNA, 66 nt, hsa; identical to SEQ ID NO: 253636

SEQ ID NO: 306848 - RNA, 66 nt, hsa; identical to SEQ ID NO: 253637

SEQ ID NO: 306849 - RNA, 66 nt, hsa; identical to SEQ ID NO: 253638

SEQ ID NO: 306850 - RNA, 66 nt, hsa; identical to SEQ ID NO: 253639

SEQ ID NO: 306851 - RNA, 66 nt, hsa; identical to SEQ ID NO: 253640

SEQ ID NO: 306852 - RNA, 66 nt, hsa; identical to SEQ ID NO: 253641

SEQ ID NO: 306853 - RNA, 66 nt, hsa; identical to SEQ ID NO: 253642

SEQ ID NO: 306854 - RNA, 66 nt, hsa; identical to SEQ ID NO: 253643

SEQ ID NO: 306855 - RNA, 66 nt, hsa; identical to SEQ ID NO: 253644

SEQ ID NO: 306856 - RNA, 66 nt, hsa; identical to SEQ ID NO: 253645

SEQ ID NO: 306857 - RNA, 66 nt, hsa; identical to SEQ ID NO: 253646

SEQ ID NO: 306858 - RNA, 66 nt, hsa; identical to SEQ ID NO: 253647

SEQ ID NO: 306859 - RNA, 66 nt, hsa; identical to SEQ ID NO: 253648

SEQ ID NO: 306860 - RNA, 66 nt, hsa; identical to SEQ ID NO: 253649

SEQ ID NO: 306861 - RNA, 66 nt, hsa; identical to SEQ ID NO: 253650

SEQ ID NO: 306862 - RNA, 66 nt, hsa; identical to SEQ ID NO: 253651

SEQ ID NO: 306863 - RNA, 66 nt, hsa; identical to SEQ ID NO: 253652

SEQ ID NO: 306864 - RNA, 66 nt, hsa; identical to SEQ ID NO: 253653

SEQ ID NO: 306865 - RNA, 66 nt, hsa; identical to SEQ ID NO: 253654

SEQ ID NO: 306866 - RNA, 66 nt, hsa; identical to SEQ ID NO: 253655

SEQ ID NO: 306867 - RNA, 66 nt, hsa; identical to SEQ ID NO: 253656

SEQ ID NO: 306868 - RNA, 66 nt, hsa; identical to SEQ ID NO: 253657

SEQ ID NO: 306869 - RNA, 66 nt, hsa; identical to SEQ ID NO: 253658

SEQ ID NO: 306870 - RNA, 63 nt, hsa; identical to SEQ ID NO: 103195

SEQ ID NO: 306871 - RNA, 51 nt, hsa; identical to SEQ ID NO: 103196

SEQ ID NO: 306872 - RNA, 66 nt, hsa; identical to SEQ ID NO: 253661

SEQ ID NO: 306873 - RNA, 66 nt, hsa; identical to SEQ ID NO: 253662

SEQ ID NO: 306874 - RNA, 66 nt, hsa; identical to SEQ ID NO: 253663

SEQ ID NO: 306875 - RNA, 66 nt, hsa; identical to SEQ ID NO: 253664

SEQ ID NO: 306876 - RNA, 66 nt, hsa; identical to SEQ ID NO: 253665

SEQ ID NO: 306877 - RNA, 66 nt, hsa; identical to SEQ ID NO: 253666

SEQ ID NO: 306878 - RNA, 66 nt, hsa; identical to SEQ ID NO: 253667

SEQ ID NO: 306879 - RNA, 66 nt, hsa; identical to SEQ ID NO: 253668

SEQ ID NO: 306880 - RNA, 66 nt, hsa; identical to SEQ ID NO: 253669

SEQ ID NO: 306881 - RNA, 66 nt, hsa; identical to SEQ ID NO: 253670

SEQ ID NO: 306882 - RNA, 66 nt, hsa; identical to SEQ ID NO: 253671

SEQ ID NO: 306883 - RNA, 66 nt, hsa; identical to SEQ ID NO: 253672

SEQ ID NO: 306884 - RNA, 66 nt, hsa; identical to SEQ ID NO: 253673

SEQ ID NO: 306885 - RNA, 66 nt, hsa; identical to SEQ ID NO: 253674

SEQ ID NO: 306886 - RNA, 66 nt, hsa; identical to SEQ ID NO: 253675

SEQ ID NO: 306887 - RNA, 66 nt, hsa; identical to SEQ ID NO: 253676

SEQ ID NO: 306888 - RNA, 66 nt, hsa; identical to SEQ ID NO: 253677

SEQ ID NO: 306889 - RNA, 66 nt, hsa; identical to SEQ ID NO: 253678

SEQ ID NO: 306890 - RNA, 66 nt, hsa; identical to SEQ ID NO: 253679

SEQ ID NO: 306891 - RNA, 66 nt, hsa; identical to SEQ ID NO: 253680

SEQ ID NO: 306892 - RNA, 66 nt, hsa; identical to SEQ ID NO: 253681

SEQ ID NO: 306893 - RNA, 66 nt, hsa; identical to SEQ ID NO: 253682

SEQ ID NO: 306894 - RNA, 66 nt, hsa; identical to SEQ ID NO: 253683

SEQ ID NO: 306895 - RNA, 66 nt, hsa; identical to SEQ ID NO: 253684

SEQ ID NO: 306896 - RNA, 66 nt, hsa; identical to SEQ ID NO: 253685

SEQ ID NO: 306897 - RNA, 66 nt, hsa; identical to SEQ ID NO: 253686

SEQ ID NO: 306898 - RNA, 66 nt, hsa; identical to SEQ ID NO: 253687

SEQ ID NO: 306899 - RNA, 66 nt, hsa; identical to SEQ ID NO: 253688

SEQ ID NO: 306900 - RNA, 66 nt, hsa; identical to SEQ ID NO: 253689

SEQ ID NO: 306901 - RNA, 66 nt, hsa; identical to SEQ ID NO: 253690

SEQ ID NO: 306902 - RNA, 66 nt, hsa; identical to SEQ ID NO: 253691

SEQ ID NO: 306903 - RNA, 66 nt, hsa; identical to SEQ ID NO: 253692

SEQ ID NO: 306904 - RNA, 66 nt, hsa; identical to SEQ ID NO: 253693

SEQ ID NO: 306905 - RNA, 66 nt, hsa; identical to SEQ ID NO: 253694

SEQ ID NO: 306906 - RNA, 66 nt, hsa; identical to SEQ ID NO: 253695

SEQ ID NO: 306907 - RNA, 66 nt, hsa; identical to SEQ ID NO: 253696

SEQ ID NO: 306908 - RNA, 66 nt, hsa; identical to SEQ ID NO: 253697

SEQ ID NO: 306909 - RNA, 66 nt, hsa; identical to SEQ ID NO: 253698

SEQ ID NO: 306910 - RNA, 66 nt, hsa; identical to SEQ ID NO: 253699

SEQ ID NO: 306911 - RNA, 66 nt, hsa; identical to SEQ ID NO: 253700

SEQ ID NO: 306912 - RNA, 66 nt, hsa; identical to SEQ ID NO: 253701

SEQ ID NO: 306913 - RNA, 66 nt, hsa; identical to SEQ ID NO: 253702

SEQ ID NO: 306914 - RNA, 66 nt, hsa; identical to SEQ ID NO: 253703

SEQ ID NO: 306915 - RNA, 66 nt, hsa; identical to SEQ ID NO: 253704

SEQ ID NO: 306916 - RNA, 66 nt, hsa; identical to SEQ ID NO: 253705

SEQ ID NO: 306917 - RNA, 66 nt, hsa; identical to SEQ ID NO: 253706

SEQ ID NO: 306918 - RNA, 66 nt, hsa; identical to SEQ ID NO: 253707

SEQ ID NO: 306919 - RNA, 66 nt, hsa; identical to SEQ ID NO: 253708

SEQ ID NO: 306920 - RNA, 66 nt, hsa; identical to SEQ ID NO: 253709

SEQ ID NO: 306921 - RNA, 66 nt, hsa; identical to SEQ ID NO: 253710

SEQ ID NO: 306922 - RNA, 66 nt, hsa; identical to SEQ ID NO: 253711

SEQ ID NO: 306923 - RNA, 66 nt, hsa; identical to SEQ ID NO: 253712

SEQ ID NO: 306924 - RNA, 66 nt, hsa; identical to SEQ ID NO: 253713

SEQ ID NO: 306925 - RNA, 66 nt, hsa; identical to SEQ ID NO: 253714

SEQ ID NO: 306926 - RNA, 66 nt, hsa; identical to SEQ ID NO: 253715

SEQ ID NO: 306927 - RNA, 66 nt, hsa; identical to SEQ ID NO: 253716

SEQ ID NO: 306928 - RNA, 66 nt, hsa; identical to SEQ ID NO: 253717

SEQ ID NO: 306929 - RNA, 66 nt, hsa; identical to SEQ ID NO: 253718

SEQ ID NO: 306930 - RNA, 66 nt, hsa; identical to SEQ ID NO: 253719

SEQ ID NO: 306931 - RNA, 66 nt, hsa; identical to SEQ ID NO: 253720

SEQ ID NO: 306932 - RNA, 66 nt, hsa; identical to SEQ ID NO: 253721

SEQ ID NO: 306933 - RNA, 66 nt, hsa; identical to SEQ ID NO: 253722

SEQ ID NO: 306934 - RNA, 66 nt, hsa; identical to SEQ ID NO: 253723

SEQ ID NO: 306935 - RNA, 66 nt, hsa; identical to SEQ ID NO: 253724

SEQ ID NO: 306936 - RNA, 66 nt, hsa; identical to SEQ ID NO: 253725

SEQ ID NO: 306937 - RNA, 66 nt, hsa; identical to SEQ ID NO: 253726

SEQ ID NO: 306938 - RNA, 66 nt, hsa; identical to SEQ ID NO: 253727

SEQ ID NO: 306939 - RNA, 66 nt, hsa; identical to SEQ ID NO: 253728

SEQ ID NO: 306940 - RNA, 66 nt, hsa; identical to SEQ ID NO: 253729

SEQ ID NO: 306941 - RNA, 66 nt, hsa; identical to SEQ ID NO: 253730

SEQ ID NO: 306942 - RNA, 66 nt, hsa; identical to SEQ ID NO: 253731

SEQ ID NO: 306943 - RNA, 66 nt, hsa; identical to SEQ ID NO: 253732

SEQ ID NO: 306944 - RNA, 66 nt, hsa; identical to SEQ ID NO: 253733

SEQ ID NO: 306945 - RNA, 66 nt, hsa; identical to SEQ ID NO: 253734

SEQ ID NO: 306946 - RNA, 66 nt, hsa; identical to SEQ ID NO: 253735

SEQ ID NO: 306947 - RNA, 66 nt, hsa; identical to SEQ ID NO: 253736

SEQ ID NO: 306948 - RNA, 66 nt, hsa; identical to SEQ ID NO: 253737

SEQ ID NO: 306949 - RNA, 66 nt, hsa; identical to SEQ ID NO: 253738

SEQ ID NO: 306950 - RNA, 66 nt, hsa; identical to SEQ ID NO: 253739

SEQ ID NO: 306951 - RNA, 66 nt, hsa; identical to SEQ ID NO: 253740

SEQ ID NO: 306952 - RNA, 66 nt, hsa; identical to SEQ ID NO: 253741

SEQ ID NO: 306953 - RNA, 66 nt, hsa; identical to SEQ ID NO: 253742

SEQ ID NO: 306954 - RNA, 66 nt, hsa; identical to SEQ ID NO: 253743

SEQ ID NO: 306955 - RNA, 66 nt, hsa; identical to SEQ ID NO: 253744

SEQ ID NO: 306956 - RNA, 66 nt, hsa; identical to SEQ ID NO: 253745

SEQ ID NO: 306957 - RNA, 66 nt, hsa; identical to SEQ ID NO: 253746

SEQ ID NO: 306958 - RNA, 66 nt, hsa; identical to SEQ ID NO: 253747

SEQ ID NO: 306959 - RNA, 66 nt, hsa; identical to SEQ ID NO: 253748

SEQ ID NO: 306960 - RNA, 66 nt, hsa; identical to SEQ ID NO: 253749

SEQ ID NO: 306961 - RNA, 66 nt, hsa; identical to SEQ ID NO: 253750

SEQ ID NO: 306962 - RNA, 66 nt, hsa; identical to SEQ ID NO: 253751

SEQ ID NO: 306963 - RNA, 66 nt, hsa; identical to SEQ ID NO: 253752

SEQ ID NO: 306964 - RNA, 65 nt, hsa
gcuaauauuaaguuauugcagauaccacauucauuaugcugcaguacuguacauauuuuucuuag

SEQ ID NO: 306965 - RNA, 65 nt, hsa
cugagcaguaugccucuucuuuuagaauuaaaugaaugcugcacagguccagauguguguugaug

SEQ ID NO: 306966 - RNA, 65 nt, hsa
auccaugaacuuagauuuuauugguuucacucaaaaugcugcagucauuugaccugaacuugugg

SEQ ID NO: 306967 - RNA, 65 nt, hsa
uacucuccaggcuuugucauuucaaggcugcugaaaugcugcauuucaggggccaccauggagca

SEQ ID NO: 306968 - RNA, 65 nt, hsa
uagcuccacuggagagaaguggaauccuauauagaaugcugcacuaauugacaacacagccuaua

SEQ ID NO: 306969 - RNA, 65 nt, hsa
uaagaaaugcauaugucacuagaauggauaaaauaaugcugcaaacuuaauguucuuaugcaaaa

SEQ ID NO: 306970 - RNA, 65 nt, hsa
aaaaaaaacuacuguauguaacggaauugcagaauaugcugcacauguauuuuauuuaguuaucc

SEQ ID NO: 306971 - RNA, 65 nt, hsa
acauuccguuuuggucuuuuucaaaaaggucccaaaugcugcacucuacacaugaaggcccucuc

SEQ ID NO: 306972 - RNA, 65 nt, hsa
uuaaagggauggaugcaaccuagcuuaacaguauaaugcugcaaauuuuccuccauuaucagcca

SEQ ID NO: 306973 - RNA, 65 nt, hsa
ccuuaugugcagcacucaaucccacuggaagccuaaugcugcagucagaagcaaugccuggcugg

SEQ ID NO: 306974 - RNA, 65 nt, hsa
cccagcacaugauucugaacuugaugcuucguggaaugcugcauuuauauguaagugacauuuga

SEQ ID NO: 306975 - RNA, 65 nt, hsa
aacaaaauaaaccuuagacauaucacaccuaaaauaugcugcagauuuuauaauugauugguuac

SEQ ID NO: 306976 - RNA, 65 nt, hsa
cauucuguccauguguucucuggucuucucucacaaugcugcaucccugucccauuuuuaggguc

SEQ ID NO: 306977 - RNA, 65 nt, hsa
ccugucccauuuuuagggucccugucuaucacuggaugcugcagcuucuguucauuacuguuagu

SEQ ID NO: 306978 - RNA, 65 nt, hsa
aguaagacuuucugaaaacacuugaugauguggaaaugcugcaggauuaaauaacuugaagagcc

SEQ ID NO: 306979 - RNA, 65 nt, hsa
gacguauacauaggcaucauuucacaaggucaguaaugcugcaggaaaagcaaaauugcaaucua

SEQ ID NO: 306980 - RNA, 65 nt, hsa
uauuaauaauagggaauaaguuugcaacuaaucucaugcugcaaacuuguguuaauucuguuuaa

SEQ ID NO: 306981 - RNA, 65 nt, hsa
ugcacaaauuaagagagcugauuagacauaggcaaaugcugcaaacuuccaauauguucauaucg

SEQ ID NO: 306982 - RNA, 65 nt, hsa
augccgggccagcuccuuaacccaaugacccagugaugcugcaaggcuggaacgggguccaggag

SEQ ID NO: 306983 - RNA, 65 nt, hsa
cuuacuguuuuacaguuaacucugcuguuugcugcaugcugcaugagacccaggguccugguaag

SEQ ID NO: 306984 - RNA, 64 nt, hsa; identical to SEQ ID NO: 248368

SEQ ID NO: 306985 - RNA, 64 nt, hsa; identical to SEQ ID NO: 248369

SEQ ID NO: 306986 - RNA, 64 nt, hsa; identical to SEQ ID NO: 248370

SEQ ID NO: 306987 - RNA, 64 nt, hsa; identical to SEQ ID NO: 248371

SEQ ID NO: 306988 - RNA, 64 nt, hsa; identical to SEQ ID NO: 248372

SEQ ID NO: 306989 - RNA, 64 nt, hsa; identical to SEQ ID NO: 248373

SEQ ID NO: 306990 - RNA, 64 nt, hsa; identical to SEQ ID NO: 248374

SEQ ID NO: 306991 - RNA, 64 nt, hsa; identical to SEQ ID NO: 248375

SEQ ID NO: 306992 - RNA, 64 nt, hsa; identical to SEQ ID NO: 248376

SEQ ID NO: 306993 - RNA, 64 nt, hsa; identical to SEQ ID NO: 248377

SEQ ID NO: 306994 - RNA, 64 nt, hsa
caugaagcaggcaaggaccgaacaccuccaccccaacguagaccugcaggugcugccccaugac

SEQ ID NO: 306995 - RNA, 64 nt, hsa
caaugacaaggcuacuaagaaauucaucauuugaaacguagaggccgcagcagucagcgauguu

SEQ ID NO: 306996 - RNA, 64 nt, hsa
gguuuggguuugauacuuuagaugggaaagugaggggcuugagaaagugggugggaggagggaa

SEQ ID NO: 306997 - RNA, 64 nt, hsa
cuuugccucacucucuccaguugguuuucagcuggggcuugaaaugcauuuuuagcccuuugac

SEQ ID NO: 306998 - RNA, 64 nt, hsa
gacggaguuucaaaaacugaugagccucgauccagggcuugaaagaagccaggguguaaucuug

SEQ ID NO: 306999 - RNA, 64 nt, hsa
cagaaacccacacucuagacugaaaccccaaagugggcuugauggguggguuuguguuucaagg

SEQ ID NO: 307000 - RNA, 64 nt, hsa
cccuagggaaaggcugcucuugcucucccucccagggcuugaggcucccuauacuuuucugucu

SEQ ID NO: 307001 - RNA, 64 nt, hsa
uguccugcccccaugagagcccuuucuuuucaaggggcuugagucccucgcugaacuuuggggu

SEQ ID NO: 307002 - RNA, 64 nt, hsa
caggacagcuuuaagcccaugugcaagaaaaugagggcuugagucgccugaaccaagagcagga

SEQ ID NO: 307003 - RNA, 64 nt, hsa
caggacagcuuuaagcccaaguggaagaaaaugagggcuugagucgccugaacgaagagcagga

SEQ ID NO: 307004 - RNA, 64 nt, hsa
caucccccugauuuuauaugaagaaauagaagaggggcuugaaguccuccucgcgagugccuuc

SEQ ID NO: 307005 - RNA, 64 nt, hsa
caacuucguaccagcuagaagggagaagagaugggggcuugaacacggggcuuccuuacagccc

SEQ ID NO: 307006 - RNA, 64 nt, hsa
aggaagucucuggcugucuucauguggggaagccgggcuugaguugcccauaggccccugcccu

SEQ ID NO: 307007 - RNA, 64 nt, hsa
cggacgcuggggcccgggcucugcacagagagcugggcuugaguggaguuuauuguagauuucu

SEQ ID NO: 307008 - RNA, 64 nt, hsa; identical to SEQ ID NO: 184094

SEQ ID NO: 307009 - RNA, 64 nt, hsa; identical to SEQ ID NO: 184095

SEQ ID NO: 307010 - RNA, 64 nt, hsa; identical to SEQ ID NO: 184096

SEQ ID NO: 307011 - RNA, 64 nt, hsa; identical to SEQ ID NO: 184097

SEQ ID NO: 307012 - RNA, 64 nt, hsa; identical to SEQ ID NO: 184098

SEQ ID NO: 307013 - RNA, 64 nt, hsa; identical to SEQ ID NO: 184099

SEQ ID NO: 307014 - RNA, 64 nt, hsa; identical to SEQ ID NO: 184100

SEQ ID NO: 307015 - RNA, 64 nt, hsa; identical to SEQ ID NO: 184101

SEQ ID NO: 307016 - RNA, 64 nt, hsa; identical to SEQ ID NO: 184102

SEQ ID NO: 307017 - RNA, 64 nt, hsa; identical to SEQ ID NO: 184103

SEQ ID NO: 307018 - RNA, 64 nt, hsa; identical to SEQ ID NO: 184104

SEQ ID NO: 307019 - RNA, 64 nt, hsa; identical to SEQ ID NO: 184105

SEQ ID NO: 307020 - RNA, 64 nt, hsa; identical to SEQ ID NO: 184106

SEQ ID NO: 307021 - RNA, 64 nt, hsa; identical to SEQ ID NO: 184107

SEQ ID NO: 307022 - RNA, 64 nt, hsa; identical to SEQ ID NO: 184108

SEQ ID NO: 307023 - RNA, 64 nt, hsa; identical to SEQ ID NO: 184109

SEQ ID NO: 307024 - RNA, 64 nt, hsa; identical to SEQ ID NO: 184110

SEQ ID NO: 307025 - RNA, 64 nt, hsa; identical to SEQ ID NO: 184111

SEQ ID NO: 307026 - RNA, 64 nt, hsa; identical to SEQ ID NO: 184112

SEQ ID NO: 307027 - RNA, 64 nt, hsa; identical to SEQ ID NO: 184113

SEQ ID NO: 307028 - RNA, 64 nt, hsa; identical to SEQ ID NO: 184114

SEQ ID NO: 307029 - RNA, 64 nt, hsa; identical to SEQ ID NO: 184115

SEQ ID NO: 307030 - RNA, 64 nt, hsa; identical to SEQ ID NO: 184116

SEQ ID NO: 307031 - RNA, 64 nt, hsa; identical to SEQ ID NO: 184117

SEQ ID NO: 307032 - RNA, 64 nt, hsa; identical to SEQ ID NO: 184118

SEQ ID NO: 307033 - RNA, 64 nt, hsa; identical to SEQ ID NO: 184119

SEQ ID NO: 307034 - RNA, 64 nt, hsa; identical to SEQ ID NO: 184120

SEQ ID NO: 307035 - RNA, 64 nt, hsa; identical to SEQ ID NO: 184121

SEQ ID NO: 307036 - RNA, 64 nt, hsa; identical to SEQ ID NO: 245412

SEQ ID NO: 307037 - RNA, 64 nt, hsa; identical to SEQ ID NO: 245413

SEQ ID NO: 307038 - RNA, 64 nt, hsa; identical to SEQ ID NO: 245414

SEQ ID NO: 307039 - RNA, 64 nt, hsa; identical to SEQ ID NO: 245415

SEQ ID NO: 307040 - RNA, 64 nt, hsa; identical to SEQ ID NO: 245416

SEQ ID NO: 307041 - RNA, 64 nt, hsa; identical to SEQ ID NO: 245417

SEQ ID NO: 307042 - RNA, 64 nt, hsa; identical to SEQ ID NO: 245418

SEQ ID NO: 307043 - RNA, 64 nt, hsa; identical to SEQ ID NO: 245419

SEQ ID NO: 307044 - RNA, 64 nt, hsa; identical to SEQ ID NO: 245420

SEQ ID NO: 307045 - RNA, 64 nt, hsa; identical to SEQ ID NO: 245421

SEQ ID NO: 307046 - RNA, 64 nt, hsa; identical to SEQ ID NO: 245422

SEQ ID NO: 307047 - RNA, 64 nt, hsa; identical to SEQ ID NO: 245423

SEQ ID NO: 307048 - RNA, 64 nt, hsa; identical to SEQ ID NO: 245424

SEQ ID NO: 307049 - RNA, 50 nt, hsa; identical to SEQ ID NO: 245425

SEQ ID NO: 307050 - RNA, 64 nt, hsa; identical to SEQ ID NO: 245426

SEQ ID NO: 307051 - RNA, 64 nt, hsa; identical to SEQ ID NO: 245427

SEQ ID NO: 307052 - RNA, 64 nt, hsa; identical to SEQ ID NO: 245428

SEQ ID NO: 307053 - RNA, 64 nt, hsa; identical to SEQ ID NO: 245429

SEQ ID NO: 307054 - RNA, 64 nt, hsa; identical to SEQ ID NO: 245430

SEQ ID NO: 307055 - RNA, 64 nt, hsa; identical to SEQ ID NO: 245431

SEQ ID NO: 307056 - RNA, 64 nt, hsa; identical to SEQ ID NO: 245432

SEQ ID NO: 307057 - RNA, 64 nt, hsa; identical to SEQ ID NO: 245433

SEQ ID NO: 307058 - RNA, 64 nt, hsa; identical to SEQ ID NO: 245434

SEQ ID NO: 307059 - RNA, 64 nt, hsa; identical to SEQ ID NO: 245435

SEQ ID NO: 307060 - RNA, 64 nt, hsa; identical to SEQ ID NO: 245436

SEQ ID NO: 307061 - RNA, 64 nt, hsa; identical to SEQ ID NO: 245437

SEQ ID NO: 307062 - RNA, 64 nt, hsa; identical to SEQ ID NO: 245438

SEQ ID NO: 307063 - RNA, 64 nt, hsa; identical to SEQ ID NO: 245439

SEQ ID NO: 307064 - RNA, 64 nt, hsa; identical to SEQ ID NO: 245440

SEQ ID NO: 307065 - RNA, 53 nt, hsa; identical to SEQ ID NO: 245441

SEQ ID NO: 307066 - RNA, 64 nt, hsa; identical to SEQ ID NO: 245442

SEQ ID NO: 307067 - RNA, 64 nt, hsa; identical to SEQ ID NO: 245443

SEQ ID NO: 307068 - RNA, 64 nt, hsa; identical to SEQ ID NO: 245444

SEQ ID NO: 307069 - RNA, 64 nt, hsa; identical to SEQ ID NO: 245445

SEQ ID NO: 307070 - RNA, 64 nt, hsa; identical to SEQ ID NO: 245446

SEQ ID NO: 307071 - RNA, 64 nt, hsa; identical to SEQ ID NO: 245447

SEQ ID NO: 307072 - RNA, 64 nt, hsa; identical to SEQ ID NO: 245448

SEQ ID NO: 307073 - RNA, 64 nt, hsa; identical to SEQ ID NO: 245449

SEQ ID NO: 307074 - RNA, 64 nt, hsa; identical to SEQ ID NO: 245450

SEQ ID NO: 307075 - RNA, 64 nt, hsa; identical to SEQ ID NO: 245451

SEQ ID NO: 307076 - RNA, 64 nt, hsa; identical to SEQ ID NO: 245452

SEQ ID NO: 307077 - RNA, 64 nt, hsa; identical to SEQ ID NO: 245453

SEQ ID NO: 307078 - RNA, 64 nt, hsa; identical to SEQ ID NO: 245454

SEQ ID NO: 307079 - RNA, 64 nt, hsa; identical to SEQ ID NO: 245455

SEQ ID NO: 307080 - RNA, 64 nt, hsa; identical to SEQ ID NO: 245456

SEQ ID NO: 307081 - RNA, 64 nt, hsa; identical to SEQ ID NO: 245457

SEQ ID NO: 307082 - RNA, 64 nt, hsa; identical to SEQ ID NO: 245458

SEQ ID NO: 307083 - RNA, 64 nt, hsa; identical to SEQ ID NO: 245459

SEQ ID NO: 307084 - RNA, 64 nt, hsa; identical to SEQ ID NO: 245460

SEQ ID NO: 307085 - RNA, 64 nt, hsa; identical to SEQ ID NO: 245461

SEQ ID NO: 307086 - RNA, 64 nt, hsa; identical to SEQ ID NO: 245462

SEQ ID NO: 307087 - RNA, 64 nt, hsa; identical to SEQ ID NO: 245463

SEQ ID NO: 307088 - RNA, 64 nt, hsa; identical to SEQ ID NO: 245464

SEQ ID NO: 307089 - RNA, 64 nt, hsa; identical to SEQ ID NO: 245465

SEQ ID NO: 307090 - RNA, 64 nt, hsa; identical to SEQ ID NO: 245466

SEQ ID NO: 307091 - RNA, 64 nt, hsa; identical to SEQ ID NO: 245467

SEQ ID NO: 307092 - RNA, 64 nt, hsa; identical to SEQ ID NO: 245468

SEQ ID NO: 307093 - RNA, 64 nt, hsa; identical to SEQ ID NO: 245469

SEQ ID NO: 307094 - RNA, 64 nt, hsa; identical to SEQ ID NO: 245470

SEQ ID NO: 307095 - RNA, 64 nt, hsa; identical to SEQ ID NO: 245471

SEQ ID NO: 307096 - RNA, 64 nt, hsa; identical to SEQ ID NO: 245472

SEQ ID NO: 307097 - RNA, 64 nt, hsa; identical to SEQ ID NO: 245473

SEQ ID NO: 307098 - RNA, 64 nt, hsa; identical to SEQ ID NO: 245474

SEQ ID NO: 307099 - RNA, 64 nt, hsa; identical to SEQ ID NO: 245475

SEQ ID NO: 307100 - RNA, 64 nt, hsa; identical to SEQ ID NO: 245476

SEQ ID NO: 307101 - RNA, 64 nt, hsa; identical to SEQ ID NO: 245477

SEQ ID NO: 307102 - RNA, 64 nt, hsa; identical to SEQ ID NO: 245478

SEQ ID NO: 307103 - RNA, 64 nt, hsa; identical to SEQ ID NO: 245479

SEQ ID NO: 307104 - RNA, 64 nt, hsa; identical to SEQ ID NO: 245480

SEQ ID NO: 307105 - RNA, 64 nt, hsa; identical to SEQ ID NO: 245481

SEQ ID NO: 307106 - RNA, 64 nt, hsa; identical to SEQ ID NO: 245482

SEQ ID NO: 307107 - RNA, 64 nt, hsa; identical to SEQ ID NO: 245483

SEQ ID NO: 307108 - RNA, 64 nt, hsa; identical to SEQ ID NO: 245484

SEQ ID NO: 307109 - RNA, 64 nt, hsa; identical to SEQ ID NO: 245485

SEQ ID NO: 307110 - RNA, 64 nt, hsa; identical to SEQ ID NO: 245486

SEQ ID NO: 307111 - RNA, 64 nt, hsa; identical to SEQ ID NO: 245487

SEQ ID NO: 307112 - RNA, 64 nt, hsa; identical to SEQ ID NO: 245488

SEQ ID NO: 307113 - RNA, 64 nt, hsa; identical to SEQ ID NO: 245489

SEQ ID NO: 307114 - RNA, 64 nt, hsa; identical to SEQ ID NO: 245490

SEQ ID NO: 307115 - RNA, 64 nt, hsa; identical to SEQ ID NO: 245491

SEQ ID NO: 307116 - RNA, 64 nt, hsa; identical to SEQ ID NO: 245492

SEQ ID NO: 307117 - RNA, 64 nt, hsa; identical to SEQ ID NO: 245493

SEQ ID NO: 307118 - RNA, 64 nt, hsa; identical to SEQ ID NO: 245494

SEQ ID NO: 307119 - RNA, 64 nt, hsa; identical to SEQ ID NO: 245495

SEQ ID NO: 307120 - RNA, 64 nt, hsa; identical to SEQ ID NO: 245496

SEQ ID NO: 307121 - RNA, 64 nt, hsa; identical to SEQ ID NO: 245497

SEQ ID NO: 307122 - RNA, 64 nt, hsa; identical to SEQ ID NO: 245498

SEQ ID NO: 307123 - RNA, 64 nt, hsa; identical to SEQ ID NO: 245499

SEQ ID NO: 307124 - RNA, 64 nt, hsa; identical to SEQ ID NO: 245500

SEQ ID NO: 307125 - RNA, 64 nt, hsa; identical to SEQ ID NO: 245501

SEQ ID NO: 307126 - RNA, 64 nt, hsa; identical to SEQ ID NO: 245502

SEQ ID NO: 307127 - RNA, 64 nt, hsa; identical to SEQ ID NO: 245503

SEQ ID NO: 307128 - RNA, 64 nt, hsa; identical to SEQ ID NO: 245504

SEQ ID NO: 307129 - RNA, 64 nt, hsa; identical to SEQ ID NO: 245505

SEQ ID NO: 307130 - RNA, 64 nt, hsa; identical to SEQ ID NO: 245506

SEQ ID NO: 307131 - RNA, 64 nt, hsa; identical to SEQ ID NO: 245507

SEQ ID NO: 307132 - RNA, 64 nt, hsa; identical to SEQ ID NO: 245508

SEQ ID NO: 307133 - RNA, 64 nt, hsa; identical to SEQ ID NO: 245509

SEQ ID NO: 307134 - RNA, 64 nt, hsa; identical to SEQ ID NO: 245510

SEQ ID NO: 307135 - RNA, 64 nt, hsa; identical to SEQ ID NO: 245511

SEQ ID NO: 307136 - RNA, 64 nt, hsa; identical to SEQ ID NO: 245512

SEQ ID NO: 307137 - RNA, 64 nt, hsa; identical to SEQ ID NO: 245513

SEQ ID NO: 307138 - RNA, 64 nt, hsa; identical to SEQ ID NO: 245514

SEQ ID NO: 307139 - RNA, 64 nt, hsa; identical to SEQ ID NO: 245515

SEQ ID NO: 307140 - RNA, 64 nt, hsa; identical to SEQ ID NO: 245516

SEQ ID NO: 307141 - RNA, 64 nt, hsa; identical to SEQ ID NO: 245517

SEQ ID NO: 307142 - RNA, 64 nt, hsa; identical to SEQ ID NO: 245518

SEQ ID NO: 307143 - RNA, 64 nt, hsa; identical to SEQ ID NO: 245519

SEQ ID NO: 307144 - RNA, 64 nt, hsa; identical to SEQ ID NO: 245520

SEQ ID NO: 307145 - RNA, 64 nt, hsa; identical to SEQ ID NO: 245521

SEQ ID NO: 307146 - RNA, 64 nt, hsa; identical to SEQ ID NO: 245522

SEQ ID NO: 307147 - RNA, 64 nt, hsa; identical to SEQ ID NO: 245523

SEQ ID NO: 307148 - RNA, 64 nt, hsa; identical to SEQ ID NO: 245524

SEQ ID NO: 307149 - RNA, 64 nt, hsa; identical to SEQ ID NO: 245525

SEQ ID NO: 307150 - RNA, 64 nt, hsa; identical to SEQ ID NO: 245526

SEQ ID NO: 307151 - RNA, 64 nt, hsa; identical to SEQ ID NO: 245527

SEQ ID NO: 307152 - RNA, 64 nt, hsa; identical to SEQ ID NO: 245528

SEQ ID NO: 307153 - RNA, 64 nt, hsa; identical to SEQ ID NO: 245529

SEQ ID NO: 307154 - RNA, 64 nt, hsa; identical to SEQ ID NO: 245530

SEQ ID NO: 307155 - RNA, 64 nt, hsa; identical to SEQ ID NO: 245531

SEQ ID NO: 307156 - RNA, 64 nt, hsa; identical to SEQ ID NO: 245532

SEQ ID NO: 307157 - RNA, 64 nt, hsa; identical to SEQ ID NO: 245533

SEQ ID NO: 307158 - RNA, 64 nt, hsa; identical to SEQ ID NO: 245534

SEQ ID NO: 307159 - RNA, 64 nt, hsa; identical to SEQ ID NO: 245535

SEQ ID NO: 307160 - RNA, 64 nt, hsa; identical to SEQ ID NO: 245536

SEQ ID NO: 307161 - RNA, 64 nt, hsa; identical to SEQ ID NO: 245537

SEQ ID NO: 307162 - RNA, 64 nt, hsa; identical to SEQ ID NO: 245538

SEQ ID NO: 307163 - RNA, 64 nt, hsa; identical to SEQ ID NO: 245539

SEQ ID NO: 307164 - RNA, 64 nt, hsa; identical to SEQ ID NO: 245540

SEQ ID NO: 307165 - RNA, 64 nt, hsa; identical to SEQ ID NO: 245541

SEQ ID NO: 307166 - RNA, 64 nt, hsa; identical to SEQ ID NO: 245542

SEQ ID NO: 307167 - RNA, 64 nt, hsa; identical to SEQ ID NO: 245543

SEQ ID NO: 307168 - RNA, 64 nt, hsa; identical to SEQ ID NO: 245544

SEQ ID NO: 307169 - RNA, 64 nt, hsa; identical to SEQ ID NO: 245545

SEQ ID NO: 307170 - RNA, 64 nt, hsa; identical to SEQ ID NO: 245546

SEQ ID NO: 307171 - RNA, 64 nt, hsa; identical to SEQ ID NO: 245547

SEQ ID NO: 307172 - RNA, 64 nt, hsa; identical to SEQ ID NO: 245548

SEQ ID NO: 307173 - RNA, 64 nt, hsa; identical to SEQ ID NO: 245549

SEQ ID NO: 307174 - RNA, 64 nt, hsa; identical to SEQ ID NO: 245550

SEQ ID NO: 307175 - RNA, 64 nt, hsa; identical to SEQ ID NO: 245551

SEQ ID NO: 307176 - RNA, 64 nt, hsa; identical to SEQ ID NO: 245552

SEQ ID NO: 307177 - RNA, 64 nt, hsa; identical to SEQ ID NO: 245553

SEQ ID NO: 307178 - RNA, 64 nt, hsa; identical to SEQ ID NO: 245554

SEQ ID NO: 307179 - RNA, 64 nt, hsa; identical to SEQ ID NO: 245555

SEQ ID NO: 307180 - RNA, 64 nt, hsa; identical to SEQ ID NO: 245556

SEQ ID NO: 307181 - RNA, 64 nt, hsa; identical to SEQ ID NO: 245557

SEQ ID NO: 307182 - RNA, 64 nt, hsa; identical to SEQ ID NO: 245558

SEQ ID NO: 307183 - RNA, 64 nt, hsa; identical to SEQ ID NO: 245559

SEQ ID NO: 307184 - RNA, 64 nt, hsa; identical to SEQ ID NO: 245560

SEQ ID NO: 307185 - RNA, 64 nt, hsa; identical to SEQ ID NO: 245561

SEQ ID NO: 307186 - RNA, 64 nt, hsa; identical to SEQ ID NO: 245562

SEQ ID NO: 307187 - RNA, 64 nt, hsa; identical to SEQ ID NO: 245563

SEQ ID NO: 307188 - RNA, 64 nt, hsa; identical to SEQ ID NO: 245564

SEQ ID NO: 307189 - RNA, 64 nt, hsa; identical to SEQ ID NO: 245565

SEQ ID NO: 307190 - RNA, 64 nt, hsa; identical to SEQ ID NO: 245566

SEQ ID NO: 307191 - RNA, 64 nt, hsa; identical to SEQ ID NO: 245567

SEQ ID NO: 307192 - RNA, 64 nt, hsa; identical to SEQ ID NO: 245568

SEQ ID NO: 307193 - RNA, 64 nt, hsa; identical to SEQ ID NO: 245569

SEQ ID NO: 307194 - RNA, 64 nt, hsa; identical to SEQ ID NO: 245570

SEQ ID NO: 307195 - RNA, 64 nt, hsa; identical to SEQ ID NO: 245571

SEQ ID NO: 307196 - RNA, 64 nt, hsa; identical to SEQ ID NO: 245572

SEQ ID NO: 307197 - RNA, 64 nt, hsa; identical to SEQ ID NO: 245573

SEQ ID NO: 307198 - RNA, 64 nt, hsa; identical to SEQ ID NO: 245574

SEQ ID NO: 307199 - RNA, 64 nt, hsa; identical to SEQ ID NO: 245575

SEQ ID NO: 307200 - RNA, 64 nt, hsa; identical to SEQ ID NO: 245576

SEQ ID NO: 307201 - RNA, 64 nt, hsa; identical to SEQ ID NO: 245577

SEQ ID NO: 307202 - RNA, 64 nt, hsa; identical to SEQ ID NO: 245578

SEQ ID NO: 307203 - RNA, 50 nt, hsa; identical to SEQ ID NO: 245579

SEQ ID NO: 307204 - RNA, 64 nt, hsa; identical to SEQ ID NO: 245580

SEQ ID NO: 307205 - RNA, 64 nt, hsa; identical to SEQ ID NO: 245581

SEQ ID NO: 307206 - RNA, 64 nt, hsa; identical to SEQ ID NO: 245582

SEQ ID NO: 307207 - RNA, 64 nt, hsa; identical to SEQ ID NO: 245583

SEQ ID NO: 307208 - RNA, 64 nt, hsa; identical to SEQ ID NO: 245584

SEQ ID NO: 307209 - RNA, 64 nt, hsa; identical to SEQ ID NO: 245585

SEQ ID NO: 307210 - RNA, 64 nt, hsa; identical to SEQ ID NO: 245586

SEQ ID NO: 307211 - RNA, 64 nt, hsa; identical to SEQ ID NO: 245587

SEQ ID NO: 307212 - RNA, 64 nt, hsa; identical to SEQ ID NO: 245588

SEQ ID NO: 307213 - RNA, 64 nt, hsa; identical to SEQ ID NO: 245589

SEQ ID NO: 307214 - RNA, 64 nt, hsa; identical to SEQ ID NO: 245590

SEQ ID NO: 307215 - RNA, 64 nt, hsa; identical to SEQ ID NO: 245591

SEQ ID NO: 307216 - RNA, 64 nt, hsa; identical to SEQ ID NO: 245592

SEQ ID NO: 307217 - RNA, 64 nt, hsa; identical to SEQ ID NO: 245593

SEQ ID NO: 307218 - RNA, 64 nt, hsa; identical to SEQ ID NO: 245594

SEQ ID NO: 307219 - RNA, 64 nt, hsa; identical to SEQ ID NO: 245595

SEQ ID NO: 307220 - RNA, 64 nt, hsa; identical to SEQ ID NO: 245596

SEQ ID NO: 307221 - RNA, 64 nt, hsa; identical to SEQ ID NO: 245597

SEQ ID NO: 307222 - RNA, 64 nt, hsa; identical to SEQ ID NO: 245598

SEQ ID NO: 307223 - RNA, 64 nt, hsa; identical to SEQ ID NO: 245599

SEQ ID NO: 307224 - RNA, 64 nt, hsa; identical to SEQ ID NO: 245600

SEQ ID NO: 307225 - RNA, 64 nt, hsa; identical to SEQ ID NO: 245601

SEQ ID NO: 307226 - RNA, 64 nt, hsa; identical to SEQ ID NO: 245602

SEQ ID NO: 307227 - RNA, 64 nt, hsa; identical to SEQ ID NO: 245603

SEQ ID NO: 307228 - RNA, 64 nt, hsa; identical to SEQ ID NO: 245604

SEQ ID NO: 307229 - RNA, 64 nt, hsa; identical to SEQ ID NO: 245605

SEQ ID NO: 307230 - RNA, 64 nt, hsa; identical to SEQ ID NO: 245606

SEQ ID NO: 307231 - RNA, 64 nt, hsa; identical to SEQ ID NO: 245607

SEQ ID NO: 307232 - RNA, 64 nt, hsa; identical to SEQ ID NO: 245608

SEQ ID NO: 307233 - RNA, 64 nt, hsa; identical to SEQ ID NO: 245609

SEQ ID NO: 307234 - RNA, 64 nt, hsa; identical to SEQ ID NO: 245610

SEQ ID NO: 307235 - RNA, 64 nt, hsa; identical to SEQ ID NO: 245611

SEQ ID NO: 307236 - RNA, 64 nt, hsa; identical to SEQ ID NO: 245612

SEQ ID NO: 307237 - RNA, 64 nt, hsa; identical to SEQ ID NO: 245613

SEQ ID NO: 307238 - RNA, 64 nt, hsa; identical to SEQ ID NO: 245614

SEQ ID NO: 307239 - RNA, 64 nt, hsa; identical to SEQ ID NO: 245615

SEQ ID NO: 307240 - RNA, 64 nt, hsa; identical to SEQ ID NO: 245616

SEQ ID NO: 307241 - RNA, 64 nt, hsa; identical to SEQ ID NO: 245617

SEQ ID NO: 307242 - RNA, 64 nt, hsa; identical to SEQ ID NO: 245618

SEQ ID NO: 307243 - RNA, 64 nt, hsa; identical to SEQ ID NO: 245619

SEQ ID NO: 307244 - RNA, 64 nt, hsa; identical to SEQ ID NO: 245620

SEQ ID NO: 307245 - RNA, 64 nt, hsa; identical to SEQ ID NO: 245621

SEQ ID NO: 307246 - RNA, 64 nt, hsa; identical to SEQ ID NO: 245622

SEQ ID NO: 307247 - RNA, 64 nt, hsa; identical to SEQ ID NO: 245623

SEQ ID NO: 307248 - RNA, 64 nt, hsa; identical to SEQ ID NO: 245624

SEQ ID NO: 307249 - RNA, 64 nt, hsa; identical to SEQ ID NO: 245625

SEQ ID NO: 307250 - RNA, 64 nt, hsa; identical to SEQ ID NO: 245626

SEQ ID NO: 307251 - RNA, 64 nt, hsa; identical to SEQ ID NO: 245627

SEQ ID NO: 307252 - RNA, 64 nt, hsa; identical to SEQ ID NO: 245628

SEQ ID NO: 307253 - RNA, 64 nt, hsa; identical to SEQ ID NO: 245629

SEQ ID NO: 307254 - RNA, 64 nt, hsa; identical to SEQ ID NO: 245630

SEQ ID NO: 307255 - RNA, 64 nt, hsa; identical to SEQ ID NO: 245631

SEQ ID NO: 307256 - RNA, 64 nt, hsa; identical to SEQ ID NO: 245632

SEQ ID NO: 307257 - RNA, 64 nt, hsa; identical to SEQ ID NO: 245633

SEQ ID NO: 307258 - RNA, 64 nt, hsa; identical to SEQ ID NO: 245634

SEQ ID NO: 307259 - RNA, 64 nt, hsa; identical to SEQ ID NO: 245635

SEQ ID NO: 307260 - RNA, 64 nt, hsa; identical to SEQ ID NO: 245636

SEQ ID NO: 307261 - RNA, 64 nt, hsa; identical to SEQ ID NO: 245637

SEQ ID NO: 307262 - RNA, 64 nt, hsa
agaagcaucuuccuuaggucugcccugcuugcaaauccacuagcaccgaccccaccaccugguu

SEQ ID NO: 307263 - RNA, 52 nt, hsa
uacguggagaacgugcuuaagaauccacuaugaugggaaacauuucauucuc

SEQ ID NO: 307264 - RNA, 64 nt, hsa
cuguggcuuuccacgugagguuuuguuuagagggauccacuacucaagaaaaaguuagcaaacc

SEQ ID NO: 307265 - RNA, 64 nt, hsa
agcaugugacagucccuggacaaccuccugcuccauccacuacaagaaggaaggauguccccag

SEQ ID NO: 307266 - RNA, 64 nt, hsa
auguaagauauuauuucugaaacaauuuagcuauauccacuaugauuauaaacugugucucgac

SEQ ID NO: 307267 - RNA, 64 nt, hsa
cauugacuaaccacauccacaaagcacaccauuaauccacuaugaucaaguuggggggaaucug

SEQ ID NO: 307268 - RNA, 64 nt, hsa
guuuucaauaaugugaaugcuauguucugggaaaauccacuaugacaucuaaguuuuguguaca

SEQ ID NO: 307269 - RNA, 64 nt, hsa
aacacugugaucugaccugugacaagucuguacuauccacuauguaaauggcucacaagucaau

SEQ ID NO: 307270 - RNA, 64 nt, hsa
ugcugcugagcauucuccuguuccaucaguugccauccacuaccccguuuucucuucuugcugc

SEQ ID NO: 307271 - RNA, 64 nt, hsa
acauuuccuuuuucugugggaaucacaagaguuuauccacuaaaaaaagauauguaaaaaagau

SEQ ID NO: 307272 - RNA, 64 nt, hsa
aaggaggugcuuaggauuguggguuucugauugcauccacuagcuucucuuuuucucgccauaa

SEQ ID NO: 307273 - RNA, 64 nt, hsa
gccacggccugggagggugguuccuguucucagcauccacuaauauucaguccuguauauuuua

SEQ ID NO: 307274 - RNA, 64 nt, hsa
gaaauauaacuagaaaagaaugacuugccaccauauccacuaggugucacuaccucuaaccuuu

SEQ ID NO: 307275 - RNA, 64 nt, hsa
aauugcauuuuuaccuuucaugugccugaaggcuauccacuacauucugaaggccuuguuaaaa

SEQ ID NO: 307276 - RNA, 64 nt, hsa
uuugucuuuauuacuauauguaaauuagacauuaauccacuaaacuggucuucuucaagagagc

SEQ ID NO: 307277 - RNA, 64 nt, hsa
uuccaacguuugccaucuggaugacaaacggaagauccacuaaaacguccacgggauuaacaga

SEQ ID NO: 307278 - RNA, 64 nt, hsa
ggucuccccuucugcuguucuccuguucuucauaauccacuacugcagcagucccugaaccacu

SEQ ID NO: 307279 - RNA, 64 nt, hsa
uucuguuuuuugauggaggugaaaucucuuuguaauccacuagguuuucaucguaaaaccaucu

SEQ ID NO: 307280 - RNA, 64 nt, hsa
uccucccuggugugaacucuuucuuugguauuccauccacuauccuggcaacucaaggcugcuu

SEQ ID NO: 307281 - RNA, 64 nt, hsa
uucagagagaguacgguauauuuaugguaauuuuauccacuagcaaaucuugauuuaguuugau

SEQ ID NO: 307282 - RNA, 64 nt, hsa
cuguguaacaagagagacauggaaaaggaaaaaaauccacuauaucaugggcucugcagaacau

SEQ ID NO: 307283 - RNA, 64 nt, hsa
uggaacuaagaaagcccuuaggaagaauuuuuauauccacuaaaaucaaacaauucagggagug

SEQ ID NO: 307284 - RNA, 64 nt, hsa
cccuaagauugaauuccuauauuuacuugguaagauccacuaaucuguuauagggaguuguuuu

SEQ ID NO: 307285 - RNA, 64 nt, hsa
uacaauguucaucccaugauguagugccucuuucauccacuagugcaaaucauagcuggggguu

SEQ ID NO: 307286 - RNA, 64 nt, hsa
gaaguauugcuaaaaucuuauaauaugaaaagagauccacuaauguagcuuaagguuauuagau

SEQ ID NO: 307287 - RNA, 64 nt, hsa
accuguucuugccuaauaaguuucuuuuaauccaauccacuaacacuuuaguuauauucacugg

SEQ ID NO: 307288 - RNA, 64 nt, hsa
ugccucccccaccaaagaauauaauguaaauuaaauccacuaaaauguaauggcaugaaaaucu

SEQ ID NO: 307289 - RNA, 64 nt, hsa
guuuucugaaaccaggaugaugcucauucaggaaauccacuauguugaauguccacuggucauu

SEQ ID NO: 307290 - RNA, 64 nt, hsa
aauaggcuuuuaaaagcauugagucauugucagaauccacuaugggaagcucuguguguaccug

SEQ ID NO: 307291 - RNA, 64 nt, hsa
cugaaauaugugaaguggcuauuucuuuauauuuauccacuacuccgugaaggcuucucuguuc

SEQ ID NO: 307292 - RNA, 64 nt, hsa
ugaguuuauauugauuuuuuuuuuccauuuaaaaauccacuaaugguguaaaagagaccaguag

SEQ ID NO: 307293 - RNA, 64 nt, hsa
cuuuagaaucuggcacacaacaaaagugccuggcauccacuacugcugccuuucauuuauaaua

SEQ ID NO: 307294 - RNA, 64 nt, hsa
ccugggauugacucugaguggaauaccuuggcacauccacuaggaucuacugucugcacuguuu

SEQ ID NO: 307295 - RNA, 64 nt, hsa
aauucuugaguuuguuuucuaaaggagaccagaaauccacuauuacaaauguauuugaaaacau

SEQ ID NO: 307296 - RNA, 64 nt, hsa
uuaauaauaaauaacgugucagcauuuaguaagcauccacuaaguguacaauacuucuacaaua

SEQ ID NO: 307297 - RNA, 64 nt, hsa
ccuuuuggcuuacuucgaguauugaauugacuggauccacuaaaccaacacuaagaugggaaaa

SEQ ID NO: 307298 - RNA, 64 nt, hsa
gucuucuaauguaaauuuuaauguuaacuuucaaauccacuaguauuuuuuuugcuuuuaugac

SEQ ID NO: 307299 - RNA, 64 nt, hsa
ugauuggccaugcuggucaugucuauuuugcuucauccacuagaaccaacuuugagucagucuc

SEQ ID NO: 307300 - RNA, 64 nt, hsa
cccccaaugcugguuguaaugccacuucugucucauccacuaaagaaagcuuguuggaaugcag

SEQ ID NO: 307301 - RNA, 64 nt, hsa
uucagaauuuucagauacuaaggaggaagaaaggauccacuacuucuuguucuuaugaaugacu

SEQ ID NO: 307302 - RNA, 64 nt, hsa
gggcuuaccucacugagagugcuccccagcaggcauccacuaccccagggccccccacauguca

SEQ ID NO: 307303 - RNA, 64 nt, hsa
augcauagcacuuaauaaaauggauuuuuaaaaaauccacuaguaauaucagaauguccaggga

SEQ ID NO: 307304 - RNA, 64 nt, hsa
uuucauccuauaguuaguaagaugcauaaaaucaauccacuacugaaauaguuuccagucagac

SEQ ID NO: 307305 - RNA, 64 nt, hsa
uuuaaaagccaccuggguugacaccuuccuacuuauccacuagaugucaucagaggugcuguuc

SEQ ID NO: 307306 - RNA, 64 nt, hsa
aagacuaaaauauuuggggacuuaaaguacuguaauccacuaaagacgugccaaugaauuauug

SEQ ID NO: 307307 - RNA, 64 nt, hsa
aaagggaccaggaaguuugaaauagugacauaucauccacuagucccaagggcuaaggaauagu

SEQ ID NO: 307308 - RNA, 64 nt, hsa
aggugauguuaagucacaaggugcugcuuuucagauccacuaugcaagaggggaggguggggcc

SEQ ID NO: 307309 - RNA, 64 nt, hsa
gauguaagugaguaauaaaagcuguuucaaguuuauccacuauccacucuucaagugaaaagaa

SEQ ID NO: 307310 - RNA, 64 nt, hsa
aggggcagcagucucaggggguguaaacucuggaauccacuaugguuuaccuugaguggccugc

SEQ ID NO: 307311 - RNA, 64 nt, hsa
agguagcaauaccaguuucaaacuuggugacuugauccacuaugccuuaaugguuuccuccauu

SEQ ID NO: 307312 - RNA, 64 nt, hsa
aaaauauaaacuuauuugcauauauuggaggagcauccacuaucaguauuucugugcuuuauaa

SEQ ID NO: 307313 - RNA, 64 nt, hsa
cauccccauugcccacaaauggaauccucacuguauccacuaggagauuagaaauuaagguuuc

SEQ ID NO: 307314 - RNA, 64 nt, hsa
uguaauaaauguacuuccuggaagugucuuucggauccacuauaugccucagcacauggaaccu

SEQ ID NO: 307315 - RNA, 64 nt, hsa
agauagcucaggcaaaacuauuaccuggguauuuauccacuaaugagucacaagaaaaggagug

SEQ ID NO: 307316 - RNA, 64 nt, hsa
guuacuguauggcacucaaaaacuauguuaaaugauccacuaacuuuuuuuuucuuggcccaug

SEQ ID NO: 307317 - RNA, 64 nt, hsa
uaaaaaauaucaaagcaagauaagcagaugugugauccacuaccgccaaagcaaauacuccuua

SEQ ID NO: 307318 - RNA, 64 nt, hsa
auucuuuucaaagauucagagauuggcuuuugucauccacuauuguauguuuuguuucauugac

SEQ ID NO: 307319 - RNA, 64 nt, hsa
gauguauaaaugaacuugggguauaagcaauaauauccacuaguguuguuaucagcuacuguaa

SEQ ID NO: 307320 - RNA, 64 nt, hsa
auacuuuuucaguucccuucuuccuucccucucaauccacuagcuuucauguugggcaaggaaa

SEQ ID NO: 307321 - RNA, 64 nt, hsa
uuucuucaaacagagaaagagaggcuguucauugauccacuauucccucuauuuuccucuaagg

SEQ ID NO: 307322 - RNA, 64 nt, hsa
agggggcaggaaggugggacgaaugacgaugcccauccacuaccugaagcacuaggacacucuu

SEQ ID NO: 307323 - RNA, 64 nt, hsa
ugaacacuggauugcaugguugaaugugucuuuaauccacuacaaaaugugcuuguuauugaua

SEQ ID NO: 307324 - RNA, 64 nt, hsa
uggcuccaaccaaccccuccccugccuccaccauauccacuaccaggcacccuuuagaacaggg

SEQ ID NO: 307325 - RNA, 64 nt, hsa
ccccccuuuuacccuccauuuguguuuauugcauauccacuauaacaacauuaaaggaccuuua

SEQ ID NO: 307326 - RNA, 64 nt, hsa
cugauacuuaauuuucuuaaaacuauuuuuaaugauccacuaaacaaagcaggggauccugaag

SEQ ID NO: 307327 - RNA, 64 nt, hsa
gaauggggaaaauacccuuuaaauuaugacggacauccacuagagauggguuugaggauuuucc

SEQ ID NO: 307328 - RNA, 64 nt, hsa
aaaaauaaagacacacacagagcauuuuagugacauccacuacuuauugccgcuaugaguuaga

SEQ ID NO: 307329 - RNA, 64 nt, hsa
gauucauguucaauuauuuggaaauaaugcaagcauccacuaagggccuuuaagcuuucuuuga

SEQ ID NO: 307330 - RNA, 64 nt, hsa
aauuuguggcauuuuuagucuaaugcauguuuucauccacuauccaguacugauuauuaaaaug

SEQ ID NO: 307331 - RNA, 64 nt, hsa
cugucuacuuaaagucaagguaccuguauuuuuaauccacuaauuuuuuuuuaguugggaaaua

SEQ ID NO: 307332 - RNA, 64 nt, hsa
uauguacagcuuaaggaagauguuaacaccuguaauccacuaaggaacugaauggcaauuugcu

SEQ ID NO: 307333 - RNA, 64 nt, hsa
uauuauaaaguuaaauuugcaaaauaauucuaacauccacuauuguucaguauagguaaucucc

SEQ ID NO: 307334 - RNA, 64 nt, hsa
uauuuuagacgguauaacuauuucaauuugauuaauccacuauuauauaaacaauagugggagu

SEQ ID NO: 307335 - RNA, 64 nt, hsa
ucacccaauuuuuuauuuuuauugcuauuaaaauauccacuagaugccaccuagagcuccaguu

SEQ ID NO: 307336 - RNA, 64 nt, hsa
agccuuuugggcaaagccccugggaacgaggccuauccacuauggacuaugguaacuugguagg

SEQ ID NO: 307337 - RNA, 64 nt, hsa
cagaucacucugacuucuuaugcuucuccuguggauccacuaucaaaguacuaaaugcugugua

SEQ ID NO: 307338 - RNA, 64 nt, hsa
gaguagguggucaucuuguacauuucagcaaagcauccacuaggaaaccucauaggacaguguu

SEQ ID NO: 307339 - RNA, 64 nt, hsa
aucugagauccugcuggaaaccacagcaaccuguauccacuauuaggagguaaaaaucaauaaa

SEQ ID NO: 307340 - RNA, 64 nt, hsa
aucugagauccugcuggaaaccacggcaaccuguauccacuauuaggagguaaaaaucaauaaa

SEQ ID NO: 307341 - RNA, 64 nt, hsa
uaaacaccaccaccguggacaacucuugaauuaaauccacuagagcgagcuuuaaaacuaaucu

SEQ ID NO: 307342 - RNA, 64 nt, hsa
cuucagggagcaagacaugaacugacuaauugguauccacuacuuguacagcuuacauaaauga

SEQ ID NO: 307343 - RNA, 64 nt, hsa
aucacuucagcguaaagcaguguguuuauuaaccauccacuaagcuaaaacuagagcaguuuga

SEQ ID NO: 307344 - RNA, 64 nt, hsa
uccagucauggcaccaaauaugaaauaauuuguaauccacuagcuaagaaauuauuccaauccu

SEQ ID NO: 307345 - RNA, 64 nt, hsa
cucccuucuccagccucaggggaggaucuggaggauccacuacugucuuuaagaugcagagugg

SEQ ID NO: 307346 - RNA, 64 nt, hsa
acaucuguauauaguguacggcaaaagaguauuaauccacuaucucuagugcuugacuuuaaau

SEQ ID NO: 307347 - RNA, 64 nt, hsa
ggaaaucucaauauagagauuugaggaaaguuauauccacuagguggcagucauugaucauaau

SEQ ID NO: 307348 - RNA, 64 nt, hsa
auuuauacuauuuacagauuguugacaaauauuuauccacuaaguaaaauguuagacugaaaug

SEQ ID NO: 307349 - RNA, 64 nt, hsa
aucauuuauucgucauguauggauuguuuccuauauccacuaucauaaaauuaucauuugaaau

SEQ ID NO: 307350 - RNA, 64 nt, hsa
ugaaaaaggcccaaguacagucuuaaugcgauaaauccacuagcuaagacgucgagugccaaga

SEQ ID NO: 307351 - RNA, 64 nt, hsa
ugugcccugggucugugcaaacguugggaccagaauccacuauaaguuucauucuucggagaca

SEQ ID NO: 307352 - RNA, 64 nt, hsa
uucagcugagccgaguguguauacugcucuggccauccacuagcccagggaggacccagaccuc

SEQ ID NO: 307353 - RNA, 64 nt, hsa
ccacugccugaucucacuucugucagaugcucccauccacuauuaaugcacuaggugggaggag

SEQ ID NO: 307354 - RNA, 64 nt, hsa
cggguggucgcggagguccugcuacccaguaaaaauccacuauuuccauugagcgaaccugccu

SEQ ID NO: 307355 - RNA, 64 nt, hsa
aauaagcacagagaagcagaacucuaauugcuuaauccacuaaacauuacuucugggaauuggc

SEQ ID NO: 307356 - RNA, 64 nt, hsa
ugaagcaaauuuggaacuuuucugucucagugugauccacuaacccacaggaucauuuggaacc

SEQ ID NO: 307357 - RNA, 64 nt, hsa
gggagcuacagagccaaggucaaugugagucaacauccacuagaaauauccauguuguguagac

SEQ ID NO: 307358 - RNA, 64 nt, hsa
auuguuuccucuauuuuauuuuauuuauuuuugaauccacuaucucuuuccauucaaaauauuu

SEQ ID NO: 307359 - RNA, 64 nt, hsa
caaaguguugucuuauuccuaauuccuguauguuauccacuacagguuuuaugagacuuccuau

SEQ ID NO: 307360 - RNA, 64 nt, hsa
ucugucugagcccugcccucacuccacuccccucauccacuaggugcccagucuugagugggcc

SEQ ID NO: 307361 - RNA, 64 nt, hsa; identical to SEQ ID NO: 165047

SEQ ID NO: 307362 - RNA, 64 nt, hsa; identical to SEQ ID NO: 165048

SEQ ID NO: 307363 - RNA, 64 nt, hsa; identical to SEQ ID NO: 165049

SEQ ID NO: 307364 - RNA, 64 nt, hsa; identical to SEQ ID NO: 165050

SEQ ID NO: 307365 - RNA, 64 nt, hsa; identical to SEQ ID NO: 165051

SEQ ID NO: 307366 - RNA, 64 nt, hsa; identical to SEQ ID NO: 165052

SEQ ID NO: 307367 - RNA, 64 nt, hsa; identical to SEQ ID NO: 165053

SEQ ID NO: 307368 - RNA, 64 nt, hsa; identical to SEQ ID NO: 165054

SEQ ID NO: 307369 - RNA, 64 nt, hsa; identical to SEQ ID NO: 165055

SEQ ID NO: 307370 - RNA, 64 nt, hsa; identical to SEQ ID NO: 165056

SEQ ID NO: 307371 - RNA, 64 nt, hsa; identical to SEQ ID NO: 165057

SEQ ID NO: 307372 - RNA, 64 nt, hsa; identical to SEQ ID NO: 165058

SEQ ID NO: 307373 - RNA, 64 nt, hsa; identical to SEQ ID NO: 165059

SEQ ID NO: 307374 - RNA, 64 nt, hsa; identical to SEQ ID NO: 165060

SEQ ID NO: 307375 - RNA, 64 nt, hsa; identical to SEQ ID NO: 165061

SEQ ID NO: 307376 - RNA, 64 nt, hsa; identical to SEQ ID NO: 165062

SEQ ID NO: 307377 - RNA, 64 nt, hsa
uacuuuacucccuauagagaaaccauugccaucauuguagcaagugcuggaaugucccuuuuuu

SEQ ID NO: 307378 - RNA, 64 nt, hsa
ggcaccaaauggcuggguacaaucaagugauauuuuguagcaccucacuaucugaaaggccaug

SEQ ID NO: 307379 - RNA, 64 nt, hsa
accuuugaaacaaugguuuguagcagagaugacauuguagcaacccagaauuaugcuuuuggaa

SEQ ID NO: 307380 - RNA, 64 nt, hsa
accaucuuguuucuuucaccuuugaaacaaugguuuguagcagagaugacauuguagcaaccca

SEQ ID NO: 307381 - RNA, 64 nt, hsa
ugaaaaucuuguguaaauccugccauuuaaaaaguuguagcagauuguuuccucuuccaaagua

SEQ ID NO: 307382 - RNA, 64 nt, hsa
auaacccaggccugucugacuacuuugccuucuuuuguagcauauaggugauguuugcucuugu

SEQ ID NO: 307383 - RNA, 64 nt, hsa
auuucaggcuuucuccccugacacuuuuacaguuaucuuggacuucguauauucuggcaaacug

SEQ ID NO: 307384 - RNA, 64 nt, hsa
gcccagagcaaggaacagguauaauaaguggaaaaucuuggaauaaguauaauuaucauccagc

SEQ ID NO: 307385 - RNA, 64 nt, hsa
aaacuuacauaccauaaagacagaauuccuaaacaucuuggagccgucugucucucccauauga

SEQ ID NO: 307386 - RNA, 64 nt, hsa
aauuuuuuugacagccacaaacaagaauacagguaucuuggauuucagacacauucuguuucuu

SEQ ID NO: 307387 - RNA, 64 nt, hsa
ccgccccacuaugggccuaccauuaauaguguauaucuuggagguuaaaagagccuuuuggaca

SEQ ID NO: 307388 - RNA, 64 nt, hsa
aaagaauauauagugucagacggaaguuauaaucaucuuggaggaaccauaagaaaaagugucc

SEQ ID NO: 307389 - RNA, 64 nt, hsa
cuuagaggguucugaacccguucccuacacagaaaucuuggaaaccaaaugcugcugaguaagg

SEQ ID NO: 307390 - RNA, 64 nt, hsa
ccugaggcuuccugcuugagaaccugcccccuggaucuuggacacuuacagauugagcuguaug

SEQ ID NO: 307391 - RNA, 64 nt, hsa
aaaaagaauuccaccaggcuguuuggagauccucaucuuggagcuuuuucaaaagcggggcuuc

SEQ ID NO: 307392 - RNA, 64 nt, hsa
aauggggaaagcgggaacccuggaguucuugggaaucuuggagccuaaagagaaaccgaggugc

SEQ ID NO: 307393 - RNA, 64 nt, hsa
acuacccccuaaugaagggccuggagguugggguaucuuggagcuccucagagcccuucuuccc

SEQ ID NO: 307394 - RNA, 64 nt, hsa
acguuugaauacugacugcucacccacagacacaaucuuggacauuaaccccugaggcuccacc

SEQ ID NO: 307395 - RNA, 64 nt, hsa
agcccaauaggcucagcucaugaugacagaacacaucuuggaaagacugacucuguuauguaac

SEQ ID NO: 307396 - RNA, 64 nt, hsa
auagaugaauacucaggcuaaccuaguggaugugaucuuggaacuuccaugauuauccacuuaa

SEQ ID NO: 307397 - RNA, 64 nt, hsa; identical to SEQ ID NO: 92469

SEQ ID NO: 307398 - RNA, 64 nt, hsa; identical to SEQ ID NO: 92470

SEQ ID NO: 307399 - RNA, 64 nt, hsa; identical to SEQ ID NO: 92471

SEQ ID NO: 307400 - RNA, 64 nt, hsa; identical to SEQ ID NO: 92472

SEQ ID NO: 307401 - RNA, 64 nt, hsa; identical to SEQ ID NO: 92473

SEQ ID NO: 307402 - RNA, 64 nt, hsa; identical to SEQ ID NO: 92474

SEQ ID NO: 307403 - RNA, 63 nt, hsa; identical to SEQ ID NO: 92475

SEQ ID NO: 307404 - RNA, 64 nt, hsa; identical to SEQ ID NO: 92476

SEQ ID NO: 307405 - RNA, 64 nt, hsa; identical to SEQ ID NO: 92477

SEQ ID NO: 307406 - RNA, 64 nt, hsa; identical to SEQ ID NO: 92478

SEQ ID NO: 307407 - RNA, 64 nt, hsa; identical to SEQ ID NO: 92479

SEQ ID NO: 307408 - RNA, 64 nt, hsa; identical to SEQ ID NO: 92480

SEQ ID NO: 307409 - RNA, 64 nt, hsa; identical to SEQ ID NO: 92481

SEQ ID NO: 307410 - RNA, 64 nt, hsa; identical to SEQ ID NO: 92482

SEQ ID NO: 307411 - RNA, 64 nt, hsa; identical to SEQ ID NO: 92483

SEQ ID NO: 307412 - RNA, 64 nt, hsa; identical to SEQ ID NO: 92484

SEQ ID NO: 307413 - RNA, 64 nt, hsa; identical to SEQ ID NO: 92485

SEQ ID NO: 307414 - RNA, 64 nt, hsa; identical to SEQ ID NO: 92486

SEQ ID NO: 307415 - RNA, 64 nt, hsa; identical to SEQ ID NO: 92487

SEQ ID NO: 307416 - RNA, 64 nt, hsa; identical to SEQ ID NO: 92488

SEQ ID NO: 307417 - RNA, 64 nt, hsa; identical to SEQ ID NO: 92489

SEQ ID NO: 307418 - RNA, 64 nt, hsa; identical to SEQ ID NO: 92490

SEQ ID NO: 307419 - RNA, 64 nt, hsa; identical to SEQ ID NO: 92491

SEQ ID NO: 307420 - RNA, 64 nt, hsa; identical to SEQ ID NO: 92492

SEQ ID NO: 307421 - RNA, 64 nt, hsa; identical to SEQ ID NO: 92493

SEQ ID NO: 307422 - RNA, 64 nt, hsa; identical to SEQ ID NO: 92494

SEQ ID NO: 307423 - RNA, 64 nt, hsa; identical to SEQ ID NO: 92495

SEQ ID NO: 307424 - RNA, 64 nt, hsa; identical to SEQ ID NO: 92496

SEQ ID NO: 307425 - RNA, 64 nt, hsa; identical to SEQ ID NO: 92497

SEQ ID NO: 307426 - RNA, 64 nt, hsa; identical to SEQ ID NO: 92498

SEQ ID NO: 307427 - RNA, 64 nt, hsa; identical to SEQ ID NO: 92499

SEQ ID NO: 307428 - RNA, 64 nt, hsa; identical to SEQ ID NO: 92500

SEQ ID NO: 307429 - RNA, 64 nt, hsa; identical to SEQ ID NO: 92501

SEQ ID NO: 307430 - RNA, 64 nt, hsa; identical to SEQ ID NO: 92502

SEQ ID NO: 307431 - RNA, 64 nt, hsa; identical to SEQ ID NO: 92503

SEQ ID NO: 307432 - RNA, 64 nt, hsa; identical to SEQ ID NO: 92504

SEQ ID NO: 307433 - RNA, 64 nt, hsa; identical to SEQ ID NO: 92505

SEQ ID NO: 307434 - RNA, 64 nt, hsa; identical to SEQ ID NO: 92506

SEQ ID NO: 307435 - RNA, 64 nt, hsa; identical to SEQ ID NO: 92507

SEQ ID NO: 307436 - RNA, 64 nt, hsa; identical to SEQ ID NO: 92508

SEQ ID NO: 307437 - RNA, 64 nt, hsa; identical to SEQ ID NO: 92509

SEQ ID NO: 307438 - RNA, 64 nt, hsa; identical to SEQ ID NO: 92510

SEQ ID NO: 307439 - RNA, 64 nt, hsa; identical to SEQ ID NO: 92511

SEQ ID NO: 307440 - RNA, 64 nt, hsa; identical to SEQ ID NO: 92512

SEQ ID NO: 307441 - RNA, 64 nt, hsa; identical to SEQ ID NO: 92513

SEQ ID NO: 307442 - RNA, 64 nt, hsa; identical to SEQ ID NO: 92514

SEQ ID NO: 307443 - RNA, 64 nt, hsa; identical to SEQ ID NO: 92515

SEQ ID NO: 307444 - RNA, 64 nt, hsa; identical to SEQ ID NO: 92516

SEQ ID NO: 307445 - RNA, 64 nt, hsa; identical to SEQ ID NO: 92517

SEQ ID NO: 307446 - RNA, 64 nt, hsa; identical to SEQ ID NO: 92518

SEQ ID NO: 307447 - RNA, 64 nt, hsa
aacggagaccaucaagccacacccccuucuuaaaacuggggacaugagccugagcagaaagggu

SEQ ID NO: 307448 - RNA, 64 nt, hsa
caguccacagagucgguagaccagggguuacgugacuggggaaaaucucacaucuccuugucug

SEQ ID NO: 307449 - RNA, 64 nt, hsa
ccugcauguucaggccccucgggggauuggggggacuggggaggcgcagccuagacccaauugc

SEQ ID NO: 307450 - RNA, 64 nt, hsa
acaaccaaccccucuccugggaggccccugccccacuggggauaggagccugugucccuggugc

SEQ ID NO: 307451 - RNA, 64 nt, hsa
ccauggcagaagucaacgccucgguggcauacagacuggggacccuggacaugcgggccuuucu

SEQ ID NO: 307452 - RNA, 64 nt, hsa
ugggaagggcugcgaggccugcccuccaaaccugacuggggaugggcggcacugugcgggugag

SEQ ID NO: 307453 - RNA, 64 nt, hsa
cuuuuucuucugucagaggaccauucuuaguggcacuggggaaaucuuggcacccagaagaauu

SEQ ID NO: 307454 - RNA, 64 nt, hsa
cuagcagauuuauauuauaugcagauaauaauuaacuggggauaaaagaauggcaaggggugac

SEQ ID NO: 307455 - RNA, 64 nt, hsa
ucccccaaggugcaggagggcaggauccagcagcacuggggaugccgaggcaaugcuguacuug

SEQ ID NO: 307456 - RNA, 64 nt, hsa
uugcugccaaaggagauaacuguuggaaguucacacuggggaaacucauuuuccccugcagcuc

SEQ ID NO: 307457 - RNA, 64 nt, hsa
ucagauggugcgaacagcagagcaggcaagggaaacuggggagauggggauggaggaggaaggc

SEQ ID NO: 307458 - RNA, 64 nt, hsa
ccagccucucccuacucccaucccauuuccaccaacuggggaacugugacuaucuaucuccccc

SEQ ID NO: 307459 - RNA, 64 nt, hsa
aaagggcaggguggcucaggcuuuaggcccagguacuggggaggccugaggagcccuccuggag

SEQ ID NO: 307460 - RNA, 64 nt, hsa
gcagugucauaggaguggagggggauaaguggggacuggggacaugugaaaugaugggcauucc

SEQ ID NO: 307461 - RNA, 64 nt, hsa
cagccugggcuagagcuccugggcugugccguccacuggggacuggggaugggacaccugagga

SEQ ID NO: 307462 - RNA, 64 nt, hsa
ggcuagagcuccugggcugugccguccacuggggacuggggaugggacaccugaggacauucug

SEQ ID NO: 307463 - RNA, 64 nt, hsa
uaguaauaccugaguacccaugggaauaauagacacuggggagguaggguggggagcgggagca

SEQ ID NO: 307464 - RNA, 64 nt, hsa
uggggagcgggagcaagagcugaaaaacuuaccuacuggggacugugcucacuaccugggugac

SEQ ID NO: 307465 - RNA, 64 nt, hsa
ccagauguuuugaguuauuucccuuaaguguuucacuggggagagaacagggagugcuccucca

SEQ ID NO: 307466 - RNA, 64 nt, hsa
uuucucucucgcuacaaguauucuuucacucagcacuggggaaguugggaacagcuggucacca

SEQ ID NO: 307467 - RNA, 64 nt, hsa
gccgggcacuggggauauacacaaagccauaagcacuggggacugccagguuggcacuguaggg

SEQ ID NO: 307468 - RNA, 64 nt, hsa
gagcaucuauuaugugccaggcacugugccgggcacuggggauauacacaaagccauaagcacu

SEQ ID NO: 307469 - RNA, 64 nt, hsa
agccuucuccucuucaguccaucguccacacagcacuggggaaggggagccacuugaaacaaaa

SEQ ID NO: 307470 - RNA, 64 nt, hsa
ucgggcgugguggugcaugccuguaaucccagcuacuggggaggcugaggcaggagaaucgcuu

SEQ ID NO: 307471 - RNA, 64 nt, hsa
gucuuuccugugcucugaagaugccagcuacaucacuggggaaacaguggugguggguggagga

SEQ ID NO: 307472 - RNA, 64 nt, hsa
ccuuggcaaagaccaagauauuuuuuccugggccacuggggaaucugaggggugaugggagaga

SEQ ID NO: 307473 - RNA, 64 nt, hsa
acccaaaucacaauaaaauugucauuuaggauaaacuggggagaauagacugaacauaugguua

SEQ ID NO: 307474 - RNA, 64 nt, hsa
cacuuugcuuauuuuuaaaaaauuuauuggcaaaacuggggauuuuguuuguaacuuugguuau

SEQ ID NO: 307475 - RNA, 64 nt, hsa
caaaaauuagccaggcgugguggugggcaccuguacuggggaggugcccacccagcuacugggg

SEQ ID NO: 307476 - RNA, 64 nt, hsa
ugggcaccuguacuggggaggugcccacccagcuacuggggaggcugagucaggagaaucgcuu

SEQ ID NO: 307477 - RNA, 64 nt, hsa
ccaaaaugaauaagcuggacuuucuccccauggcacuggggaaccauggaaguucagggaacuu

SEQ ID NO: 307478 - RNA, 64 nt, hsa
uauguagccucuggguguggagcugggaucuucaacuggggacaguacaguaaagaacaucaca

SEQ ID NO: 307479 - RNA, 64 nt, hsa
guaaagacaggcauaggaaaucacaaggguauugacuggggaagugauaaguguccaugaaauc

SEQ ID NO: 307480 - RNA, 64 nt, hsa
uuccucaugccuaaguaugcaugaaagaauucacacuggggagaaauacuaugaauguaaggau

SEQ ID NO: 307481 - RNA, 64 nt, hsa
agaagcuucugcuguuuugccggaauuggcggugacuggggagggcuggguggguggggggccu

SEQ ID NO: 307482 - RNA, 64 nt, hsa
gcagguuucugucugcgucgucgucggagggauuacuggggagugcgcugcauccggaagucgc

SEQ ID NO: 307483 - RNA, 64 nt, hsa
uuuucaccccauuauggccaaauaguauagggccacuggggagggggaagggaaucauuuugug

SEQ ID NO: 307484 - RNA, 64 nt, hsa
uucgagacuggccccgucugaaccuucucugggcacuggggacuaagguugcaggccuuagccu

SEQ ID NO: 307485 - RNA, 64 nt, hsa
guaguuaauuuuagguuauguuuuauauuaggcuacuggggacauaaacggucauaacuaauga

SEQ ID NO: 307486 - RNA, 64 nt, hsa
gugugugagugugaguguguguguacgcacacacacuggggauagauaagcuaccugguaaagg

SEQ ID NO: 307487 - RNA, 64 nt, hsa
acaucccacaucagguauauuagagcuuauccgaacuggggaaagacggauugagauuaacugc

SEQ ID NO: 307488 - RNA, 64 nt, hsa
uuuugaggauguugugugaggguguuugacugugacuggggaagcucagacuacuuuguaugug

SEQ ID NO: 307489 - RNA, 64 nt, hsa; identical to SEQ ID NO: 141798

SEQ ID NO: 307490 - RNA, 64 nt, hsa; identical to SEQ ID NO: 141799

SEQ ID NO: 307491 - RNA, 64 nt, hsa; identical to SEQ ID NO: 141800

SEQ ID NO: 307492 - RNA, 64 nt, hsa; identical to SEQ ID NO: 141801

SEQ ID NO: 307493 - RNA, 64 nt, hsa; identical to SEQ ID NO: 141802

SEQ ID NO: 307494 - RNA, 64 nt, hsa; identical to SEQ ID NO: 141803

SEQ ID NO: 307495 - RNA, 64 nt, hsa; identical to SEQ ID NO: 141804

SEQ ID NO: 307496 - RNA, 64 nt, hsa; identical to SEQ ID NO: 141805

SEQ ID NO: 307497 - RNA, 64 nt, hsa
uaaacuugauggucauuguuaugauuaagauaaugccgggcaggccgggcacaguggcucacgc

SEQ ID NO: 307498 - RNA, 64 nt, hsa
uggucauuguuaugauuaagauaaugccgggcaggccgggcacaguggcucacgccuguaaucc

SEQ ID NO: 307499 - RNA, 64 nt, hsa
ucaggagcacaggcaaggggugcuuguggcaguggccgggcaccugagccccagcucguuguua

SEQ ID NO: 307500 - RNA, 64 nt, hsa
uauuauagcaaguucuuuauuaaagauuuuugaggccgggcacagugacucacgccuguaaccc

SEQ ID NO: 307501 - RNA, 64 nt, hsa
gugaaacacugucuguacuaaaaauacagaauuagccgggcauggugcaugccuguaaucccag

SEQ ID NO: 307502 - RNA, 64 nt, hsa
ugaaaccccgucucuacuaaaaauacaaaaauuagccgggcaugguggcaggcgccuauaaucc

SEQ ID NO: 307503 - RNA, 64 nt, hsa
accucaucucuacuaaaauucaaaaacaaaauuagccgggcaugauggugcaugccuguagucu

SEQ ID NO: 307504 - RNA, 64 nt, hsa
uaguguaauggaucaaauuaagauucucugcccagccgggcacaguggcgcaugccuguaaucc

SEQ ID NO: 307505 - RNA, 64 nt, hsa
uucuaacucauauguucccaauuaccaagggguggccgggcacaguggcucacgccuguaaucc

SEQ ID NO: 307506 - RNA, 64 nt, hsa
caccgcaagagccauggcugucccuguuggcccagccgggcacucacagggcagaagggugggu

SEQ ID NO: 307507 - RNA, 64 nt, hsa
agcagacacaguguucauaacaaagaaagguugugccgggcacgguggcucacaccuguaaucc

SEQ ID NO: 307508 - RNA, 64 nt, hsa
gcucugcuccuuagggcaugguagucaccgcgaagccgggcaccgucccacagcaucuccuaga

SEQ ID NO: 307509 - RNA, 64 nt, hsa
uacucuggaguucacuuucccagagcuggggcaggccgggcagucugcgggcaagcuccggggu

SEQ ID NO: 307510 - RNA, 64 nt, hsa
uguauuuaaaaaaauaaaaauagaagaagaaaaggccgggcaugguggcucaugccuguaaucc

SEQ ID NO: 307511 - RNA, 64 nt, hsa
agcauuucaugugguccucauaaaaaucuugagggccgggcaugguggcucacgccuguaaucu

SEQ ID NO: 307512 - RNA, 64 nt, hsa
ugaaacccugucucuccuaaaaauacaaaaauuagccgggcaugguggaaugugccuguaaucc

SEQ ID NO: 307513 - RNA, 64 nt, hsa
gcucauaugcgucccaagcagccgcagcgcagccgccgggcaggccugcgugccgggagaggac

SEQ ID NO: 307514 - RNA, 64 nt, hsa
gcaggcucagacucugggucccucggagcugccagccgggcacccccaaccucauggucaugga

SEQ ID NO: 307515 - RNA, 64 nt, hsa
cuagugccgaggacacguuaaacgaacaggaugggccgggcacgguggcucacgccuguaaucc

SEQ ID NO: 307516 - RNA, 64 nt, hsa
ugaaaccccaucuccacuaaaaauagaaaaauuagccgggcauggugacacaugccuguagucc

SEQ ID NO: 307517 - RNA, 64 nt, hsa
gggaggcuuccccaucuuuaguuuuccacucugccccggggagcacccuucuacuccuagccac

SEQ ID NO: 307518 - RNA, 64 nt, hsa
ggcaggccucccucagggccaggggcgauggcaccccggggacaggcagaccuccuuccugccg

SEQ ID NO: 307519 - RNA, 64 nt, hsa
gccgagggcugaggccaggcaaucacgggcuaugcccggggagcugucgggaguggcgggaauc

SEQ ID NO: 307520 - RNA, 64 nt, hsa
ggagcugucgggaguggcgggaaucggggccaugcccggggagcugucgggaguggcgggaauc

SEQ ID NO: 307521 - RNA, 64 nt, hsa
ggagcugucgggaguggcgggaaucggggccaugcccggggagcugucgggaguggcgggaaau

SEQ ID NO: 307522 - RNA, 64 nt, hsa
ugcuucucccggggacgcuuuugagugggcccugcccggggagcugcagagcagcagcaccuuu

SEQ ID NO: 307523 - RNA, 64 nt, hsa
cucuguccucccauccccucaacacccugcuucucccggggacgcuuuugagugggcccugccc

SEQ ID NO: 307524 - RNA, 64 nt, hsa; identical to SEQ ID NO: 81134

SEQ ID NO: 307525 - RNA, 64 nt, hsa; identical to SEQ ID NO: 81135

SEQ ID NO: 307526 - RNA, 64 nt, hsa; identical to SEQ ID NO: 81136

SEQ ID NO: 307527 - RNA, 64 nt, hsa; identical to SEQ ID NO: 81137

SEQ ID NO: 307528 - RNA, 64 nt, hsa; identical to SEQ ID NO: 81138

SEQ ID NO: 307529 - RNA, 64 nt, hsa; identical to SEQ ID NO: 81139

SEQ ID NO: 307530 - RNA, 64 nt, hsa; identical to SEQ ID NO: 81140

SEQ ID NO: 307531 - RNA, 64 nt, hsa; identical to SEQ ID NO: 81141

SEQ ID NO: 307532 - RNA, 64 nt, hsa; identical to SEQ ID NO: 81142

SEQ ID NO: 307533 - RNA, 64 nt, hsa; identical to SEQ ID NO: 81143

SEQ ID NO: 307534 - RNA, 64 nt, hsa; identical to SEQ ID NO: 81144

SEQ ID NO: 307535 - RNA, 64 nt, hsa; identical to SEQ ID NO: 81145

SEQ ID NO: 307536 - RNA, 64 nt, hsa; identical to SEQ ID NO: 81146

SEQ ID NO: 307537 - RNA, 64 nt, hsa; identical to SEQ ID NO: 81147

SEQ ID NO: 307538 - RNA, 64 nt, hsa; identical to SEQ ID NO: 81148

SEQ ID NO: 307539 - RNA, 64 nt, hsa; identical to SEQ ID NO: 81149

SEQ ID NO: 307540 - RNA, 64 nt, hsa; identical to SEQ ID NO: 81150

SEQ ID NO: 307541 - RNA, 64 nt, hsa; identical to SEQ ID NO: 81151

SEQ ID NO: 307542 - RNA, 64 nt, hsa; identical to SEQ ID NO: 81152

SEQ ID NO: 307543 - RNA, 64 nt, hsa; identical to SEQ ID NO: 81153

SEQ ID NO: 307544 - RNA, 64 nt, hsa; identical to SEQ ID NO: 81154

SEQ ID NO: 307545 - RNA, 64 nt, hsa; identical to SEQ ID NO: 81155

SEQ ID NO: 307546 - RNA, 64 nt, hsa; identical to SEQ ID NO: 81156

SEQ ID NO: 307547 - RNA, 64 nt, hsa; identical to SEQ ID NO: 81157

SEQ ID NO: 307548 - RNA, 64 nt, hsa; identical to SEQ ID NO: 81158

SEQ ID NO: 307549 - RNA, 64 nt, hsa; identical to SEQ ID NO: 81159

SEQ ID NO: 307550 - RNA, 64 nt, hsa; identical to SEQ ID NO: 81160

SEQ ID NO: 307551 - RNA, 64 nt, hsa; identical to SEQ ID NO: 81161

SEQ ID NO: 307552 - RNA, 64 nt, hsa; identical to SEQ ID NO: 81162

SEQ ID NO: 307553 - RNA, 64 nt, hsa; identical to SEQ ID NO: 81163

SEQ ID NO: 307554 - RNA, 64 nt, hsa; identical to SEQ ID NO: 81164

SEQ ID NO: 307555 - RNA, 64 nt, hsa; identical to SEQ ID NO: 81165

SEQ ID NO: 307556 - RNA, 64 nt, hsa; identical to SEQ ID NO: 81166

SEQ ID NO: 307557 - RNA, 64 nt, hsa; identical to SEQ ID NO: 81167

SEQ ID NO: 307558 - RNA, 64 nt, hsa; identical to SEQ ID NO: 81168

SEQ ID NO: 307559 - RNA, 64 nt, hsa; identical to SEQ ID NO: 81169

SEQ ID NO: 307560 - RNA, 64 nt, hsa; identical to SEQ ID NO: 81170

SEQ ID NO: 307561 - RNA, 64 nt, hsa; identical to SEQ ID NO: 81171

SEQ ID NO: 307562 - RNA, 64 nt, hsa; identical to SEQ ID NO: 81172

SEQ ID NO: 307563 - RNA, 64 nt, hsa; identical to SEQ ID NO: 81173

SEQ ID NO: 307564 - RNA, 64 nt, hsa
ccuggagccuggcccucugaggcuuacggucuuggcaaggcagcaucgccuuggcucuugggaa

SEQ ID NO: 307565 - RNA, 64 nt, hsa
cucugggggcgguggggugcguggggguggcaaugcaaggcacugaggccacagaugugaguaa

SEQ ID NO: 307566 - RNA, 64 nt, hsa
cacccaggccacaaggccaugguuaauucuuaaggcaaggcaaauccauggaugagaagugcaa

SEQ ID NO: 307567 - RNA, 64 nt, hsa
gaggcgcuacgcagacaguccugcugcucuagcagcaaggcaguaacaccacaaaagcaaaacc

SEQ ID NO: 307568 - RNA, 64 nt, hsa
uaauguuaauagaggaaaugcagcaacgucaaaagcaaggcagguugguuaauuagaucugggg

SEQ ID NO: 307569 - RNA, 64 nt, hsa
ggucucuccaagugcaucuagccuggccuggagggcaaggcagaugcauucuccuggcugcugg

SEQ ID NO: 307570 - RNA, 64 nt, hsa
ccggcagggaaucggaacccucagacccacagccgcaaggcacuggauucuggcagcacccuga

SEQ ID NO: 307571 - RNA, 64 nt, hsa
uauuuacuuuucuuggcccuggccagggcugggcgcaaggcacgcagugaugggcaaaccaauu

SEQ ID NO: 307572 - RNA, 64 nt, hsa
acuugaaucugggaucucgccuuauucucaaguagcaaggcaucucgacaagcauggucuaggu

SEQ ID NO: 307573 - RNA, 64 nt, hsa
cuagucuggaaucuuugugaagcauaggguuauugcaaggcaaaugggaacuaacacaucuugc

SEQ ID NO: 307574 - RNA, 64 nt, hsa
guuuaccaggagcuuaauaauuaauggcuacauagcaaggcaucgucuuggaaccggagaauuu

SEQ ID NO: 307575 - RNA, 64 nt, hsa
uugagggagcuaggcuguuuugcuagagauaauugcaaggcacguggcacuaaaagucauuuuu

SEQ ID NO: 307576 - RNA, 64 nt, hsa
cguccaggaagcguuagggcugaugggugacucagcaaggcagugucagagcugggacugggcg

SEQ ID NO: 307577 - RNA, 64 nt, hsa
acaaauggaaaagcagauuggggccagggagucagcaaggcaccccagcucugugaugugacuu

SEQ ID NO: 307578 - RNA, 64 nt, hsa; identical to SEQ ID NO: 119656

SEQ ID NO: 307579 - RNA, 64 nt, hsa; identical to SEQ ID NO: 119657

SEQ ID NO: 307580 - RNA, 64 nt, hsa; identical to SEQ ID NO: 119658

SEQ ID NO: 307581 - RNA, 64 nt, hsa; identical to SEQ ID NO: 119659

SEQ ID NO: 307582 - RNA, 64 nt, hsa; identical to SEQ ID NO: 119660

SEQ ID NO: 307583 - RNA, 64 nt, hsa; identical to SEQ ID NO: 119661

SEQ ID NO: 307584 - RNA, 64 nt, hsa; identical to SEQ ID NO: 119662

SEQ ID NO: 307585 - RNA, 64 nt, hsa; identical to SEQ ID NO: 119663

SEQ ID NO: 307586 - RNA, 64 nt, hsa; identical to SEQ ID NO: 119664

SEQ ID NO: 307587 - RNA, 64 nt, hsa; identical to SEQ ID NO: 119665

SEQ ID NO: 307588 - RNA, 64 nt, hsa; identical to SEQ ID NO: 119666

SEQ ID NO: 307589 - RNA, 64 nt, hsa; identical to SEQ ID NO: 119667

SEQ ID NO: 307590 - RNA, 64 nt, hsa; identical to SEQ ID NO: 119668

SEQ ID NO: 307591 - RNA, 64 nt, hsa; identical to SEQ ID NO: 119669

SEQ ID NO: 307592 - RNA, 64 nt, hsa; identical to SEQ ID NO: 119670

SEQ ID NO: 307593 - RNA, 64 nt, hsa; identical to SEQ ID NO: 119671

SEQ ID NO: 307594 - RNA, 64 nt, hsa; identical to SEQ ID NO: 119672

SEQ ID NO: 307595 - RNA, 64 nt, hsa; identical to SEQ ID NO: 119673

SEQ ID NO: 307596 - RNA, 64 nt, hsa; identical to SEQ ID NO: 119674

SEQ ID NO: 307597 - RNA, 64 nt, hsa; identical to SEQ ID NO: 119675

SEQ ID NO: 307598 - RNA, 64 nt, hsa; identical to SEQ ID NO: 119676

SEQ ID NO: 307599 - RNA, 64 nt, hsa; identical to SEQ ID NO: 119677

SEQ ID NO: 307600 - RNA, 64 nt, hsa; identical to SEQ ID NO: 119678

SEQ ID NO: 307601 - RNA, 64 nt, hsa; identical to SEQ ID NO: 119679

SEQ ID NO: 307602 - RNA, 64 nt, hsa
gguccaaacauguaagacuucuacccuaaucaguauccuucagcuuuuuacauuaacccagugu

SEQ ID NO: 307603 - RNA, 64 nt, hsa
ucagggaaugcuaaauuagaguaauaaguuuuauauccuucauucugggagaggaaaucaacau

SEQ ID NO: 307604 - RNA, 64 nt, hsa
gagucauucuaacuauaaaagugcaaugacuaagauccuucacuucucugaaaguaaggcccua

SEQ ID NO: 307605 - RNA, 64 nt, hsa
auccuucuuuaacaggcugcugagucacucagaaauccuucaaacaugauuaauuaugaagaug

SEQ ID NO: 307606 - RNA, 64 nt, hsa
aagagaauagauuguaucaaacaacggcagggaaauccuucagcaauucuaauccacuuugggu

SEQ ID NO: 307607 - RNA, 64 nt, hsa
uauuacucugaguaacuggccagccauucaucggauccuucauuggguacuccugaaaucagac

SEQ ID NO: 307608 - RNA, 64 nt, hsa
guuuguaaauggauauagacagugguaauaacuaauccuucaaaaauaaguuaaaauguuuuug

SEQ ID NO: 307609 - RNA, 64 nt, hsa
uaagaugaguugggaaauucucuugacugaauuaauccuucaaaacaaucagauaauucacaca

SEQ ID NO: 307610 - RNA, 64 nt, hsa
guucuguuuuuuagcacagccauuuagauauaacauccuucacuuaaaaauuaaaaacaucagu

SEQ ID NO: 307611 - RNA, 64 nt, hsa
uuauguacguugcauauucaaacugugauguuuuauccuucaaaacaaucugcauuaagaagau

SEQ ID NO: 307612 - RNA, 64 nt, hsa; identical to SEQ ID NO: 90288

SEQ ID NO: 307613 - RNA, 64 nt, hsa; identical to SEQ ID NO: 90289

SEQ ID NO: 307614 - RNA, 64 nt, hsa; identical to SEQ ID NO: 90290

SEQ ID NO: 307615 - RNA, 64 nt, hsa; identical to SEQ ID NO: 90291

SEQ ID NO: 307616 - RNA, 64 nt, hsa; identical to SEQ ID NO: 90292

SEQ ID NO: 307617 - RNA, 64 nt, hsa; identical to SEQ ID NO: 90293

SEQ ID NO: 307618 - RNA, 62 nt, hsa; identical to SEQ ID NO: 90294

SEQ ID NO: 307619 - RNA, 64 nt, hsa; identical to SEQ ID NO: 90295

SEQ ID NO: 307620 - RNA, 53 nt, hsa; identical to SEQ ID NO: 90296

SEQ ID NO: 307621 - RNA, 64 nt, hsa; identical to SEQ ID NO: 90297

SEQ ID NO: 307622 - RNA, 64 nt, hsa; identical to SEQ ID NO: 90298

SEQ ID NO: 307623 - RNA, 64 nt, hsa; identical to SEQ ID NO: 90299

SEQ ID NO: 307624 - RNA, 64 nt, hsa; identical to SEQ ID NO: 90300

SEQ ID NO: 307625 - RNA, 64 nt, hsa; identical to SEQ ID NO: 90301

SEQ ID NO: 307626 - RNA, 64 nt, hsa; identical to SEQ ID NO: 90302

SEQ ID NO: 307627 - RNA, 64 nt, hsa; identical to SEQ ID NO: 90303

SEQ ID NO: 307628 - RNA, 64 nt, hsa; identical to SEQ ID NO: 90304

SEQ ID NO: 307629 - RNA, 64 nt, hsa; identical to SEQ ID NO: 90305

SEQ ID NO: 307630 - RNA, 64 nt, hsa; identical to SEQ ID NO: 90306

SEQ ID NO: 307631 - RNA, 64 nt, hsa; identical to SEQ ID NO: 90307

SEQ ID NO: 307632 - RNA, 64 nt, hsa; identical to SEQ ID NO: 90308

SEQ ID NO: 307633 - RNA, 64 nt, hsa; identical to SEQ ID NO: 90309

SEQ ID NO: 307634 - RNA, 64 nt, hsa; identical to SEQ ID NO: 90310

SEQ ID NO: 307635 - RNA, 64 nt, hsa; identical to SEQ ID NO: 90311

SEQ ID NO: 307636 - RNA, 64 nt, hsa; identical to SEQ ID NO: 90312

SEQ ID NO: 307637 - RNA, 64 nt, hsa; identical to SEQ ID NO: 90313

SEQ ID NO: 307638 - RNA, 64 nt, hsa; identical to SEQ ID NO: 90314

SEQ ID NO: 307639 - RNA, 64 nt, hsa; identical to SEQ ID NO: 90315

SEQ ID NO: 307640 - RNA, 64 nt, hsa; identical to SEQ ID NO: 90316

SEQ ID NO: 307641 - RNA, 64 nt, hsa; identical to SEQ ID NO: 90317

SEQ ID NO: 307642 - RNA, 64 nt, hsa; identical to SEQ ID NO: 90318

SEQ ID NO: 307643 - RNA, 64 nt, hsa; identical to SEQ ID NO: 90319

SEQ ID NO: 307644 - RNA, 64 nt, hsa; identical to SEQ ID NO: 90320

SEQ ID NO: 307645 - RNA, 64 nt, hsa; identical to SEQ ID NO: 90321

SEQ ID NO: 307646 - RNA, 64 nt, hsa; identical to SEQ ID NO: 90322

SEQ ID NO: 307647 - RNA, 64 nt, hsa; identical to SEQ ID NO: 90323

SEQ ID NO: 307648 - RNA, 64 nt, hsa; identical to SEQ ID NO: 90324

SEQ ID NO: 307649 - RNA, 64 nt, hsa; identical to SEQ ID NO: 90325

SEQ ID NO: 307650 - RNA, 64 nt, hsa; identical to SEQ ID NO: 90326

SEQ ID NO: 307651 - RNA, 64 nt, hsa; identical to SEQ ID NO: 90327

SEQ ID NO: 307652 - RNA, 64 nt, hsa; identical to SEQ ID NO: 90328

SEQ ID NO: 307653 - RNA, 64 nt, hsa; identical to SEQ ID NO: 90329

SEQ ID NO: 307654 - RNA, 64 nt, hsa; identical to SEQ ID NO: 90330

SEQ ID NO: 307655 - RNA, 64 nt, hsa; identical to SEQ ID NO: 90331

SEQ ID NO: 307656 - RNA, 64 nt, hsa; identical to SEQ ID NO: 90332

SEQ ID NO: 307657 - RNA, 64 nt, hsa; identical to SEQ ID NO: 90333

SEQ ID NO: 307658 - RNA, 64 nt, hsa; identical to SEQ ID NO: 90334

SEQ ID NO: 307659 - RNA, 64 nt, hsa; identical to SEQ ID NO: 90335

SEQ ID NO: 307660 - RNA, 64 nt, hsa; identical to SEQ ID NO: 90336

SEQ ID NO: 307661 - RNA, 64 nt, hsa; identical to SEQ ID NO: 90337

SEQ ID NO: 307662 - RNA, 64 nt, hsa; identical to SEQ ID NO: 90338

SEQ ID NO: 307663 - RNA, 64 nt, hsa; identical to SEQ ID NO: 90339

SEQ ID NO: 307664 - RNA, 64 nt, hsa; identical to SEQ ID NO: 90340

SEQ ID NO: 307665 - RNA, 64 nt, hsa; identical to SEQ ID NO: 90341

SEQ ID NO: 307666 - RNA, 64 nt, hsa; identical to SEQ ID NO: 90342

SEQ ID NO: 307667 - RNA, 64 nt, hsa; identical to SEQ ID NO: 90343

SEQ ID NO: 307668 - RNA, 64 nt, hsa; identical to SEQ ID NO: 90344

SEQ ID NO: 307669 - RNA, 64 nt, hsa; identical to SEQ ID NO: 90345

SEQ ID NO: 307670 - RNA, 64 nt, hsa; identical to SEQ ID NO: 90346

SEQ ID NO: 307671 - RNA, 64 nt, hsa; identical to SEQ ID NO: 90347

SEQ ID NO: 307672 - RNA, 64 nt, hsa; identical to SEQ ID NO: 90348

SEQ ID NO: 307673 - RNA, 64 nt, hsa; identical to SEQ ID NO: 90349

SEQ ID NO: 307674 - RNA, 64 nt, hsa; identical to SEQ ID NO: 90350

SEQ ID NO: 307675 - RNA, 64 nt, hsa; identical to SEQ ID NO: 90351

SEQ ID NO: 307676 - RNA, 64 nt, hsa; identical to SEQ ID NO: 90352

SEQ ID NO: 307677 - RNA, 64 nt, hsa; identical to SEQ ID NO: 90353

SEQ ID NO: 307678 - RNA, 64 nt, hsa; identical to SEQ ID NO: 90354

SEQ ID NO: 307679 - RNA, 64 nt, hsa; identical to SEQ ID NO: 90355

SEQ ID NO: 307680 - RNA, 64 nt, hsa; identical to SEQ ID NO: 90356

SEQ ID NO: 307681 - RNA, 64 nt, hsa; identical to SEQ ID NO: 90357

SEQ ID NO: 307682 - RNA, 64 nt, hsa; identical to SEQ ID NO: 90358

SEQ ID NO: 307683 - RNA, 64 nt, hsa; identical to SEQ ID NO: 90359

SEQ ID NO: 307684 - RNA, 64 nt, hsa; identical to SEQ ID NO: 90360

SEQ ID NO: 307685 - RNA, 64 nt, hsa; identical to SEQ ID NO: 90361

SEQ ID NO: 307686 - RNA, 64 nt, hsa; identical to SEQ ID NO: 90362

SEQ ID NO: 307687 - RNA, 64 nt, hsa; identical to SEQ ID NO: 90363

SEQ ID NO: 307688 - RNA, 64 nt, hsa; identical to SEQ ID NO: 90364

SEQ ID NO: 307689 - RNA, 64 nt, hsa; identical to SEQ ID NO: 90365

SEQ ID NO: 307690 - RNA, 64 nt, hsa; identical to SEQ ID NO: 90366

SEQ ID NO: 307691 - RNA, 64 nt, hsa; identical to SEQ ID NO: 90367

SEQ ID NO: 307692 - RNA, 64 nt, hsa; identical to SEQ ID NO: 90368

SEQ ID NO: 307693 - RNA, 64 nt, hsa; identical to SEQ ID NO: 90369

SEQ ID NO: 307694 - RNA, 64 nt, hsa; identical to SEQ ID NO: 90370

SEQ ID NO: 307695 - RNA, 64 nt, hsa; identical to SEQ ID NO: 90371

SEQ ID NO: 307696 - RNA, 64 nt, hsa; identical to SEQ ID NO: 90372

SEQ ID NO: 307697 - RNA, 64 nt, hsa; identical to SEQ ID NO: 90373

SEQ ID NO: 307698 - RNA, 64 nt, hsa; identical to SEQ ID NO: 90374

SEQ ID NO: 307699 - RNA, 64 nt, hsa; identical to SEQ ID NO: 90375

SEQ ID NO: 307700 - RNA, 64 nt, hsa; identical to SEQ ID NO: 90376

SEQ ID NO: 307701 - RNA, 64 nt, hsa; identical to SEQ ID NO: 90377

SEQ ID NO: 307702 - RNA, 64 nt, hsa; identical to SEQ ID NO: 90378

SEQ ID NO: 307703 - RNA, 64 nt, hsa; identical to SEQ ID NO: 90379

SEQ ID NO: 307704 - RNA, 64 nt, hsa; identical to SEQ ID NO: 90380

SEQ ID NO: 307705 - RNA, 64 nt, hsa; identical to SEQ ID NO: 90381

SEQ ID NO: 307706 - RNA, 64 nt, hsa; identical to SEQ ID NO: 90382

SEQ ID NO: 307707 - RNA, 64 nt, hsa; identical to SEQ ID NO: 90383

SEQ ID NO: 307708 - RNA, 64 nt, hsa; identical to SEQ ID NO: 90384

SEQ ID NO: 307709 - RNA, 64 nt, hsa; identical to SEQ ID NO: 90385

SEQ ID NO: 307710 - RNA, 64 nt, hsa; identical to SEQ ID NO: 90386

SEQ ID NO: 307711 - RNA, 64 nt, hsa; identical to SEQ ID NO: 90387

SEQ ID NO: 307712 - RNA, 64 nt, hsa; identical to SEQ ID NO: 90388

SEQ ID NO: 307713 - RNA, 64 nt, hsa; identical to SEQ ID NO: 90389

SEQ ID NO: 307714 - RNA, 64 nt, hsa; identical to SEQ ID NO: 90390

SEQ ID NO: 307715 - RNA, 64 nt, hsa; identical to SEQ ID NO: 90391

SEQ ID NO: 307716 - RNA, 64 nt, hsa; identical to SEQ ID NO: 90392

SEQ ID NO: 307717 - RNA, 64 nt, hsa; identical to SEQ ID NO: 90393

SEQ ID NO: 307718 - RNA, 64 nt, hsa; identical to SEQ ID NO: 90394

SEQ ID NO: 307719 - RNA, 64 nt, hsa; identical to SEQ ID NO: 90395

SEQ ID NO: 307720 - RNA, 64 nt, hsa; identical to SEQ ID NO: 90396

SEQ ID NO: 307721 - RNA, 64 nt, hsa; identical to SEQ ID NO: 90397

SEQ ID NO: 307722 - RNA, 64 nt, hsa; identical to SEQ ID NO: 90398

SEQ ID NO: 307723 - RNA, 64 nt, hsa; identical to SEQ ID NO: 90399

SEQ ID NO: 307724 - RNA, 64 nt, hsa; identical to SEQ ID NO: 90400

SEQ ID NO: 307725 - RNA, 64 nt, hsa; identical to SEQ ID NO: 90401

SEQ ID NO: 307726 - RNA, 64 nt, hsa; identical to SEQ ID NO: 90402

SEQ ID NO: 307727 - RNA, 64 nt, hsa; identical to SEQ ID NO: 90403

SEQ ID NO: 307728 - RNA, 64 nt, hsa; identical to SEQ ID NO: 90404

SEQ ID NO: 307729 - RNA, 64 nt, hsa; identical to SEQ ID NO: 90405

SEQ ID NO: 307730 - RNA, 64 nt, hsa; identical to SEQ ID NO: 90406

SEQ ID NO: 307731 - RNA, 64 nt, hsa; identical to SEQ ID NO: 90407

SEQ ID NO: 307732 - RNA, 64 nt, hsa; identical to SEQ ID NO: 90408

SEQ ID NO: 307733 - RNA, 64 nt, hsa; identical to SEQ ID NO: 90409

SEQ ID NO: 307734 - RNA, 64 nt, hsa
ggaauacucucuggggcggauggcagaaggccugagccaccacgaccccaucaugaaggugcug

SEQ ID NO: 307735 - RNA, 64 nt, hsa
ggcugccgcacgggaacucauggguguguuacucagccaccacccaccgcuggagccccagcug

SEQ ID NO: 307736 - RNA, 64 nt, hsa
cuacucucuggccuaacggagcccacccaggcacagccaccacuuugcaagugggaggagggga

SEQ ID NO: 307737 - RNA, 64 nt, hsa
aaggggagacaaaaccacugcagaccuaccacgaagccaccaccaccuucaguaacaaggguac

SEQ ID NO: 307738 - RNA, 64 nt, hsa
cgauaugggggucugccaagcugugaggaccaguagccaccaagccacccacaagcccccuccc

SEQ ID NO: 307739 - RNA, 64 nt, hsa
cugcccccacacccacuccacaccaguaauaaaaagccaccacacacugacuggcauuucuguc

SEQ ID NO: 307740 - RNA, 64 nt, hsa
uccuguuuggaaauggggagcuggccuaggugggagccaccacuccugccugcccccacaccca

SEQ ID NO: 307741 - RNA, 64 nt, hsa
cuuggccucccaaagugcugggauuacaggcgugagccaccaugccccgccccagauggauuuu

SEQ ID NO: 307742 - RNA, 59 nt, hsa
gaagucauggcaccuugugagcccagcagagccaccacccagcaucccaggcugguggc

SEQ ID NO: 307743 - RNA, 64 nt, hsa
ccucagccuccaacuagcugggauuacaggcacaagccaccaugccuggcuaaaauucuuuugu

SEQ ID NO: 307744 - RNA, 64 nt, hsa
cucggccucccaaaguucugggauuaaaugcgugagccaccaugcccggccgcuauugcucuuu

SEQ ID NO: 307745 - RNA, 64 nt, hsa
cgugcagcaucagcaucccuagaaagccaugugcagccaccaguccauugggcaggcagauguu

SEQ ID NO: 307746 - RNA, 64 nt, hsa
ggagcaucuccucaacucugaguguuaagcguugagccaccaagcugguggcucugugugcucu

SEQ ID NO: 307747 - RNA, 64 nt, hsa
cucuguguagguaaccagauggcucuuuuucccaagccaccaucuuccagcugaccagacuaaa

SEQ ID NO: 307748 - RNA, 64 nt, hsa
accccuaauucccucaacagcagaaccuaccugcagccaccaggggaccagcucuguguaggua

SEQ ID NO: 307749 - RNA, 64 nt, hsa
cuuggccucccaaagugcugggauuacaggugugagccaccaugccuggcccuaauuuuugugu

SEQ ID NO: 307750 - RNA, 64 nt, hsa
gcugaaguccaaucccacaaucauggcucacugcagccaccaccuccugagcucaagugauccu

SEQ ID NO: 307751 - RNA, 64 nt, hsa
uggcagagaugaggagguuuggcacagaaaacauagccaccauuuuguccaagccugggcaugg

SEQ ID NO: 307752 - RNA, 64 nt, hsa
auuagguugacaacuugucaugauuuugacgguaagccaccaugauuguguucucugccucugg

SEQ ID NO: 307753 - RNA, 64 nt, hsa
cucagccucccaaagugcugggauuauagucgugagccaccacgccuggccagaguuuuuuauu

SEQ ID NO: 307754 - RNA, 64 nt, hsa
cucggccucccaaagugcuggcauuacaggcaugagccaccaugccuggcccaaaguucuagaa

SEQ ID NO: 307755 - RNA, 64 nt, hsa
cuuggccucccaaagugcugggauuacagggacgagccaccacaccccaccuauugucuauauu

SEQ ID NO: 307756 - RNA, 64 nt, hsa
cucggccucccaaagugcuaggauuacaggcgugagccaccacucccggcugucaucaucaaau

SEQ ID NO: 307757 - RNA, 64 nt, hsa
cucggccucccaaagugcugagauuacaagugugagccaccacgcccagccucuccccuuuaaa

SEQ ID NO: 307758 - RNA, 64 nt, hsa
aauuucauaccuagcguggagcuaugcaagaagcagccaccagagggccccaaguggcagcaac

SEQ ID NO: 307759 - RNA, 64 nt, hsa
aaagcuguuuucccuacaaggugcuugguggugaagccaccaagcugucuuugguacucuuaaa

SEQ ID NO: 307760 - RNA, 64 nt, hsa
uaugaccucaucacccucagacuuuaagacaagaagccaccaucaaaacaaaggaugggauacg

SEQ ID NO: 307761 - RNA, 64 nt, hsa
cucagccucccaaagugcugggauuacaggcgugagccaccacaccaggcccgagaaaugcuuu

SEQ ID NO: 307762 - RNA, 64 nt, hsa
agcagagugagggcacucacugccauccuguggaagccaccaucaucucuggcccaagcuucug

SEQ ID NO: 307763 - RNA, 64 nt, hsa
cucggccucccaaagugcugggauuacaggcgugagccaccacgccuggccaauuauguaauuu

SEQ ID NO: 307764 - RNA, 64 nt, hsa
cuuggccucccaaaguucuaggauuacaggugugagccaccacguccggccaauuuuucucauu

SEQ ID NO: 307765 - RNA, 64 nt, hsa
cuuggcuccccaaagugcugggauuacaggcgugagccaccaggcccugccugguuuucaaauu

SEQ ID NO: 307766 - RNA, 64 nt, hsa
uuucuguuugaaccccaugugggaugaaucucaaagccaccagcguucuugccuaguguccaga

SEQ ID NO: 307767 - RNA, 64 nt, hsa
gccaugggggagggaagaguguguccuggcaggaagccaccauuggagaaggugaggccaguaa

SEQ ID NO: 307768 - RNA, 64 nt, hsa
ccuggccucccagagugcugggauuacaggugugagccaccaugcucugccaauuauuuuaaau

SEQ ID NO: 307769 - RNA, 64 nt, hsa
uuauuuuauuauuucuucuuuuucucuuuuuuagagccaccaauacuggauuuguuuguuuuuc

SEQ ID NO: 307770 - RNA, 64 nt, hsa
ugcuccucaaggguuggggguccuucucccucgcagccaccacaugucucagggcuaccuucuc

SEQ ID NO: 307771 - RNA, 64 nt, hsa
acugccaugagcuuucuacccagggacugugcucagccaccaguucagcagcuaagagaucggc

SEQ ID NO: 307772 - RNA, 64 nt, hsa
gggcuuagugccacaugcaccccacucauuccaaagccaccaaacugccaggggcugccgucca

SEQ ID NO: 307773 - RNA, 64 nt, hsa
ugugucagccucucaccggcuccccgagcguggcagccaccagguccacagaacuacugcagcc

SEQ ID NO: 307774 - RNA, 64 nt, hsa
ugcucccuugaugggguccagagagccucccugcagccaccagacuuggccuccagcuguucuu

SEQ ID NO: 307775 - RNA, 64 nt, hsa
uauguuuauucuaguuaaggaaauguugagggcaagccaccaaauuaccuaggcugagguuaga

SEQ ID NO: 307776 - RNA, 64 nt, hsa
cucagccucccaaaguacugggauuauaggcaugagccaccacgcccagccuguuauuuuuuua

SEQ ID NO: 307777 - RNA, 64 nt, hsa
cucggucucccaaagugcugggauuacaggcgugagccaccaugcccggcccaaauauuuuuua

SEQ ID NO: 307778 - RNA, 64 nt, hsa
gcaguuuaaaauguugggaugccugaggaccaggagccaccacccacugggguguugugagaga

SEQ ID NO: 307779 - RNA, 64 nt, hsa
cucagccucccaaagugcugagauuacaggcaugagccaccacgcccagccauugaguauucuu

SEQ ID NO: 307780 - RNA, 64 nt, hsa
agaggugcaggggagucaccgcccagaccuccccagccaccaaccgaccccaccucuguuccua

SEQ ID NO: 307781 - RNA, 64 nt, hsa
ggaggcccugcccggggcuggggccuaguccagcagccaccaaagucuggcagacuuucugcau

SEQ ID NO: 307782 - RNA, 64 nt, hsa
cgaacucuugggcuucaagcaauccuccugugucagccaccagaguagcugagacuacaggggu

SEQ ID NO: 307783 - RNA, 64 nt, hsa
cuugcccucccaaaguguugggauuauaggcaugagccaccacgacuggccagaggacaaaauu

SEQ ID NO: 307784 - RNA, 64 nt, hsa
cucagccucccaaagugcugggauuacaggcaugagccaccacacccagcgagacgggguuuca

SEQ ID NO: 307785 - RNA, 64 nt, hsa
cuuggccucccaaagugcugggauuacagacaugagccaccacgcuuggccgggauaguauauu

SEQ ID NO: 307786 - RNA, 64 nt, hsa
cucggccucccaaagugcuaggauuacaggcgugagccaccaugcccagcugggagcguucuuu

SEQ ID NO: 307787 - RNA, 64 nt, hsa
cuuggccucccaaagugcugggauuacacgcgugagccaccaugcccggccaauacuacacucu

SEQ ID NO: 307788 - RNA, 64 nt, hsa
cucagcaucccaaguagcugggauaacaggugccagccaccaugcccagcuaauuuguguauuu

SEQ ID NO: 307789 - RNA, 64 nt, hsa
cucagccucccaaagugcugggauuacaggcuugagccaccacgcccagccuguagcauauuuu

SEQ ID NO: 307790 - RNA, 64 nt, hsa
ucgucacccgcaucuccaacgaccucgagcucugagccaccacggucccagggcccuuacucuu

SEQ ID NO: 307791 - RNA, 64 nt, hsa
auaucgggccccccauucauccacucacacucccagccaccauguuacacuggacucuaagcca

SEQ ID NO: 307792 - RNA, 64 nt, hsa
cucugccucccaaagugcugggauuacagacgugagccaccacagcuggcugaagauuauacuu

SEQ ID NO: 307793 - RNA, 64 nt, hsa
uucagccucccaaguagcugggacuacaauugugagccaccaugccaggcucauuguuauauuu

SEQ ID NO: 307794 - RNA, 64 nt, hsa
auuggccucccaaggugcugggauuacagccaugagccaccaugaccaacguguuucuuaauuu

SEQ ID NO: 307795 - RNA, 64 nt, hsa
cuccaccugccaaagugcugagauuacaggcgugagccaccacaccuggccuguuuuuuguuuc

SEQ ID NO: 307796 - RNA, 64 nt, hsa
cucggccucccaaagugcugggauuacaggugugagccaccacaccugacccauaggucuucaa

SEQ ID NO: 307797 - RNA, 62 nt, hsa
ugcugaagacucggcugugacccggggcccaaagccaccaccguccuuccaaagccagaucu

SEQ ID NO: 307798 - RNA, 64 nt, hsa
cucagccucccaaagugcugggauuacaggggugagccaccacgcccagccccagcuuaguuuu

SEQ ID NO: 307799 - RNA, 64 nt, hsa
cucagccuccugaguagcugggacuacaggcaugagccaccaugccuggccaacucacauuuuu

SEQ ID NO: 307800 - RNA, 64 nt, hsa
cccaagccccuccccacgucgcccccuccugcacagccaccagcagccagcccccuccgauaca

SEQ ID NO: 307801 - RNA, 64 nt, hsa
aggucucugccccacgcguucccgucgcugacaaagccaccagcugccuccuuuaagcuuggug

SEQ ID NO: 307802 - RNA, 64 nt, hsa
aaaguggccugaaugaggccaggcccugagaaggagccaccagcuggaggaaaggggcuccaag

SEQ ID NO: 307803 - RNA, 64 nt, hsa
aggccacugagggaauccuccacguggcugucccagccaccaaaacccaugcacagugcugcag

SEQ ID NO: 307804 - RNA, 64 nt, hsa
ggggucagcuggucucaaaacuggccacugccucagccaccaagcuuuuuccuaccacuaccuu

SEQ ID NO: 307805 - RNA, 64 nt, hsa
gucuccccuggccucgccuucugcaaaccaccgcagccaccacagcgucaggguggagaucugg

SEQ ID NO: 307806 - RNA, 64 nt, hsa
cgcagucucccgaagugcugggauuacugacaugagccaccacacucagcccuuuaaaccuuuc

SEQ ID NO: 307807 - RNA, 64 nt, hsa
ccuuggcucccaaagugcuggaauuacaggcauuagccaccaugccuggccuauucuggucucu

SEQ ID NO: 307808 - RNA, 64 nt, hsa
ugucauuauaaaaguuuccuuuuuuauucucucaagccaccagcugccagccaccagcagccag

SEQ ID NO: 307809 - RNA, 64 nt, hsa
uuuccuuuuuuauucucucaagccaccagcugccagccaccagcagccagcugccagccuagcu

SEQ ID NO: 307810 - RNA, 60 nt, hsa
ggaucccugagcucugagccaagggugaggauggggaaacucuaagcucccaccuaauaa

SEQ ID NO: 307811 - RNA, 60 nt, hsa
ccaaccaucggguggagcuccugcugggcuauggggaagggagguugugcggaucuugac

SEQ ID NO: 307812 - RNA, 60 nt, hsa
ugcauaccugccagcucguaugccucuggcauggggaaauuaagggaacagugucuguuu

SEQ ID NO: 307813 - RNA, 60 nt, hsa
auuggcgcaauauuuaugggagugggagggauggggaaaauaaacuuaacucuacaaaag

SEQ ID NO: 307814 - RNA, 60 nt, hsa
gaaauccuacuucagaaguguaauaaauggauggggaaaucguuugauggggaaaagucu

SEQ ID NO: 307815 - RNA, 60 nt, hsa
aguguaauaaauggauggggaaaucguuugauggggaaaagucucuuguaaguaaaagua

SEQ ID NO: 307816 - RNA, 60 nt, hsa
aaaugaauagaaaauuuuaaaacccgagaaauggggaaaaaaaaaucagugcacaagaau

SEQ ID NO: 307817 - RNA, 60 nt, hsa
gaagaucuuuugcauuuucuucugucaggaauggggaaggggagugggggcacaaucuga

SEQ ID NO: 307818 - RNA, 60 nt, hsa
ggccagcauggggugggcuucacuaaggaaauggggaagguuuuagugaugggucuugcu

SEQ ID NO: 307819 - RNA, 60 nt, hsa
gagcucucccugccucucucucugggggcgauggggaaggucaggaguccagcccauucc

SEQ ID NO: 307820 - RNA, 60 nt, hsa
uuuuucucugaccuuuccauccuugaaaaaauggggaaaaaagaagaaaaaagacaaaau

SEQ ID NO: 307821 - RNA, 60 nt, hsa
cugguuuggggcacaaggaagccuuaggguauggggaaaggcuguuauuaccuagaguuu

SEQ ID NO: 307822 - RNA, 60 nt, hsa
aacuguguuguauauaauguaaagauuaaaauggggaaauaaugagcaucugugaauaau

SEQ ID NO: 307823 - RNA, 60 nt, hsa
gacauguacauugucaugugacuggaucacauggggaagcgcuuuauacagacaucaguu

SEQ ID NO: 307824 - RNA, 60 nt, hsa
uggcucaaaaauggaaacugaaagcaagucauggggaaugaauacuuugggcaguaucuu

SEQ ID NO: 307825 - RNA, 60 nt, hsa
gugcuuuuaaaaagagaugcuugcaaagcaauggggaacguguucucggggcagguuucc

SEQ ID NO: 307826 - RNA, 60 nt, hsa
aaaaaaaucagguuuuaaacaggaaaaccuauggggaaugauauuuuuugaaagacuuuu

SEQ ID NO: 307827 - RNA, 60 nt, hsa
auuacauagcaauuucuccuucccaccaucauggggaagcuggcucugcuuuugcccuuu

SEQ ID NO: 307828 - RNA, 60 nt, hsa
cccuguggguuggagccgagucaggccacuauggggaagcaguugccccacaaaaugugg

SEQ ID NO: 307829 - RNA, 60 nt, hsa
gcuuaggcccugucucucuuuuuuaauauuauggggaaaccacuaacuauccaaccagcu

SEQ ID NO: 307830 - RNA, 60 nt, hsa
agccaagguggcugggaucuggccccacagauggggaaagauggggaaggguguggagug

SEQ ID NO: 307831 - RNA, 60 nt, hsa
gcugggaucuggccccacagauggggaaagauggggaaggguguggaguggggaggagcc

SEQ ID NO: 307832 - RNA, 60 nt, hsa
caagaaggaauugaaauaaggagggacaugauggggaaggaguacaaaacaaucucucaa

SEQ ID NO: 307833 - RNA, 60 nt, hsa
ucauugcagacaccaccauauugcuaucuaauggggaaauguagcuaugggccauaacca

SEQ ID NO: 307834 - RNA, 60 nt, hsa
acucuccugggccccaaggagucccacggaauggggaaagcgggaacccuggaguucuug

SEQ ID NO: 307835 - RNA, 60 nt, hsa
gaugcuucugagggaugcugaccucccacuauggggaaaaggguugcuuggaggaccugg

SEQ ID NO: 307836 - RNA, 60 nt, hsa
gguguuggaugccuuuuuccuagaccaggaauggggaauauauaacaccugugccaccgc

SEQ ID NO: 307837 - RNA, 60 nt, hsa
ugauuuuccuuagccaguuuguaauggcuuauggggaacauugugagcuuccuaccugac

SEQ ID NO: 307838 - RNA, 60 nt, hsa
cuguauuuaaaagcaugaacuguguauaaaauggggaaauggaggcaggagacuuugagg

SEQ ID NO: 307839 - RNA, 60 nt, hsa
gaguugccaacuauucucaggccaagggccauggggaagauggagcaaaccuagccccca

SEQ ID NO: 307840 - RNA, 60 nt, hsa
gccagugcugucugggauguauucaagugaauggggaagggagucucucuuccaaguccu

SEQ ID NO: 307841 - RNA, 60 nt, hsa
uaaggaagugaaaacuuagcagucagugacauggggaaauaguuauagaaaaugucacug

SEQ ID NO: 307842 - RNA, 60 nt, hsa
uaucauaaaauuuucauauaugccuagauaauggggaaaaaaagucuugugauugacuuu

SEQ ID NO: 307843 - RNA, 60 nt, hsa
acugcauggauuaaaguagucccuccauacauggggaaguguuuggagcaaagagaugaa

SEQ ID NO: 307844 - RNA, 64 nt, hsa; identical to SEQ ID NO: 244135

SEQ ID NO: 307845 - RNA, 64 nt, hsa; identical to SEQ ID NO: 244136

SEQ ID NO: 307846 - RNA, 64 nt, hsa; identical to SEQ ID NO: 244137

SEQ ID NO: 307847 - RNA, 64 nt, hsa; identical to SEQ ID NO: 244138

SEQ ID NO: 307848 - RNA, 64 nt, hsa; identical to SEQ ID NO: 244139

SEQ ID NO: 307849 - RNA, 64 nt, hsa; identical to SEQ ID NO: 244140

SEQ ID NO: 307850 - RNA, 64 nt, hsa; identical to SEQ ID NO: 244141

SEQ ID NO: 307851 - RNA, 64 nt, hsa; identical to SEQ ID NO: 244142

SEQ ID NO: 307852 - RNA, 64 nt, hsa
aucucuuuacuauguccuagcucuguccugcuaccuaaaggauauaaagaaauacuauugcucu

SEQ ID NO: 307853 - RNA, 64 nt, hsa
uaccaggacaauagggucauuccauaugauaaaacuaaaggacuaaauuuguuuuauaaugaug

SEQ ID NO: 307854 - RNA, 64 nt, hsa
aggcuggccccagagaugaucuugcccuuccuaacuaaaggacagaagugcaauuuagcuuaaa

SEQ ID NO: 307855 - RNA, 64 nt, hsa
ucauuggauauuucugauccuuauugcauuguaccuaaaggagaguaacuaaugguaaccuuuu

SEQ ID NO: 307856 - RNA, 64 nt, hsa
uuaauuauaauacugucaaauugccacgaucucacuaaaggauuucuauuugcugucaguuaaa

SEQ ID NO: 307857 - RNA, 64 nt, hsa
uuuacucauugcacuugaguuuauugccccauaacuaaaggaucaggaugaugguagaacggag

SEQ ID NO: 307858 - RNA, 64 nt, hsa
gagauagucacuuuaaacagcucaaaguagcuagcuaaaggaguagccuuaaauaccuaaaaga

SEQ ID NO: 307859 - RNA, 64 nt, hsa
cauuaaagucagucgugcgugaagcaucucucuucuaaaggauguguauuuccauaaaugcuuu

SEQ ID NO: 307860 - RNA, 64 nt, hsa
ggcauaauuuucuuuccucuggcugaucccagcccuaaaggaaggguagacccgugucuuucca

SEQ ID NO: 307861 - RNA, 64 nt, hsa
ccuaaaggaaggguagacccgugucuuuccagcccuaaaggaaggguagacccgugucuuucca

SEQ ID NO: 307862 - RNA, 64 nt, hsa
ccuaaaggaaggguagacccgugucuuuccagcccuaaaggaagggcagacccgugucuuucca

SEQ ID NO: 307863 - RNA, 64 nt, hsa
augccucugagcuucuaaacugaagcugcuguaacuaaaggaaucugaaaagaacaacccugaa

SEQ ID NO: 307864 - RNA, 64 nt, hsa
gcugucgguguggacgcugugcugguucuguuuucuaaaggagcagaaggacaggucucugaga

SEQ ID NO: 307865 - RNA, 64 nt, hsa; identical to SEQ ID NO: 172254

SEQ ID NO: 307866 - RNA, 64 nt, hsa; identical to SEQ ID NO: 172255

SEQ ID NO: 307867 - RNA, 64 nt, hsa; identical to SEQ ID NO: 172256

SEQ ID NO: 307868 - RNA, 64 nt, hsa; identical to SEQ ID NO: 172257

SEQ ID NO: 307869 - RNA, 64 nt, hsa; identical to SEQ ID NO: 172258

SEQ ID NO: 307870 - RNA, 64 nt, hsa; identical to SEQ ID NO: 172259

SEQ ID NO: 307871 - RNA, 64 nt, hsa; identical to SEQ ID NO: 172260

SEQ ID NO: 307872 - RNA, 64 nt, hsa; identical to SEQ ID NO: 172261

SEQ ID NO: 307873 - RNA, 64 nt, hsa; identical to SEQ ID NO: 172262

SEQ ID NO: 307874 - RNA, 64 nt, hsa; identical to SEQ ID NO: 172263

SEQ ID NO: 307875 - RNA, 64 nt, hsa; identical to SEQ ID NO: 172264

SEQ ID NO: 307876 - RNA, 64 nt, hsa; identical to SEQ ID NO: 172265

SEQ ID NO: 307877 - RNA, 64 nt, hsa; identical to SEQ ID NO: 172266

SEQ ID NO: 307878 - RNA, 64 nt, hsa; identical to SEQ ID NO: 45833

SEQ ID NO: 307879 - RNA, 64 nt, hsa; identical to SEQ ID NO: 45834

SEQ ID NO: 307880 - RNA, 64 nt, hsa; identical to SEQ ID NO: 45835

SEQ ID NO: 307881 - RNA, 64 nt, hsa; identical to SEQ ID NO: 45836

SEQ ID NO: 307882 - RNA, 64 nt, hsa; identical to SEQ ID NO: 45837

SEQ ID NO: 307883 - RNA, 64 nt, hsa; identical to SEQ ID NO: 45838

SEQ ID NO: 307884 - RNA, 64 nt, hsa; identical to SEQ ID NO: 45839

SEQ ID NO: 307885 - RNA, 64 nt, hsa; identical to SEQ ID NO: 45840

SEQ ID NO: 307886 - RNA, 64 nt, hsa
uccccacugcccccugcagccccugagauauuuugcucacuaucccuccccacuugcuucccug

SEQ ID NO: 307887 - RNA, 64 nt, hsa
ucagugaauuaccacugccugugggccaaaucuagcucacuaucuguuuuuguaaauaaaauuu

SEQ ID NO: 307888 - RNA, 64 nt, hsa
uuuaucuugaagagauaagcacagaagagaaggugcucacuaacagagguacauuacugcaaug

SEQ ID NO: 307889 - RNA, 64 nt, hsa
gaaauauauuccaucaagucaaagaguaauaacugcucacuaguugcuuuuuagcaucucuggu

SEQ ID NO: 307890 - RNA, 64 nt, hsa
auuuaacauuguagaaauguaauuaauaaacaaugcucacuacacaguuuagaauagacguucu

SEQ ID NO: 307891 - RNA, 64 nt, hsa
caugaguuagaccagugguugagauuaguagauggcucacuagacauguuuuuguuuugcagac

SEQ ID NO: 307892 - RNA, 64 nt, hsa
ccgcauccagaagggagaauuggucccuggaguggcucacuaagcucuuaaucagcaaacgcag

SEQ ID NO: 307893 - RNA, 52 nt, hsa
ggcggaacccaggcguuuaacggcucacuaggcagccccagaucuggggaac

SEQ ID NO: 307894 - RNA, 64 nt, hsa
ucucagcuguuagaaucugccuucccugaagugcgcucacuaacacuggaagcccucuuggaaa

SEQ ID NO: 307895 - RNA, 64 nt, hsa
ucucuguuggaauuugccuacuuaccuauaaacagcucacuacacuuaaaggaaaugauucuau

SEQ ID NO: 307896 - RNA, 64 nt, hsa
auucugaaacuuaagucuuacauauuuuuugugggcucacuaaguguucugcuguguuucagga

SEQ ID NO: 307897 - RNA, 64 nt, hsa
gucauccaggcuggagugcagugguggaaucauagcucacuauagccucaaacuucugggcuua

SEQ ID NO: 307898 - RNA, 64 nt, hsa
agcauuaccacucaggcauuugacugaagaugcagcucacuacccuauucucucuuuacgcuua

SEQ ID NO: 307899 - RNA, 64 nt, hsa
guugcccaggcugcagugcaguggugugaucuuggcucacuacaaccucugccucccggguuca

SEQ ID NO: 307900 - RNA, 64 nt, hsa
uaugcaggcacucaugcuuaccgggacuggggcagcucacuaggauucuauccuuuccaaucgg

SEQ ID NO: 307901 - RNA, 64 nt, hsa
gaaggcccuuuuuacauacucuuuucucaugagagcucacuauuuuaacaauaaacaauaaacg

SEQ ID NO: 307902 - RNA, 64 nt, hsa
uuaaguccagacuuggcacauggcuagggauacugcucacuagcuguggagguccucaggagug

SEQ ID NO: 307903 - RNA, 64 nt, hsa
uagaauuucuuaaaaggguguuacugaguuauaagcucacuaggcuguaaaaacaaaacaaugu

SEQ ID NO: 307904 - RNA, 64 nt, hsa
ucagucaaagcucugcuuucaauuucucugauuugcucacuaaugccuuguguguguuuuacua

SEQ ID NO: 307905 - RNA, 64 nt, hsa
gucauaaucuguguaauacuacaauuuaugggaugcucacuaugcccuguuucucuucuaaaca

SEQ ID NO: 307906 - RNA, 64 nt, hsa
guugcccuccccaguggcuggcaggggccugcuugcucacuagagagauggauucucaccuguc

SEQ ID NO: 307907 - RNA, 64 nt, hsa
aucaauaagaaaaaggaucgaaagggaccaagcagcucacuacgauaucaaguuacacuaagac

SEQ ID NO: 307908 - RNA, 64 nt, hsa
uuguuuuucuuuuaaaguaaaugcaaguaccaaagcucacuacugcgguuugccugugccugga

SEQ ID NO: 307909 - RNA, 64 nt, hsa
augccucacuucaagcacuaauuuggcucuuucugcucacuaaaaaucauauauuuuacagauu

SEQ ID NO: 307910 - RNA, 64 nt, hsa
aaaaacauauccaaaauaaugaggaaauguguuggcucacuacguagaguccagagggacaguc

SEQ ID NO: 307911 - RNA, 64 nt, hsa
gucacccaggcuggagugcaguggcacgaucucggcucacuacaaccuccgccucccagguuca

SEQ ID NO: 307912 - RNA, 64 nt, hsa
uacucuguuucccaggcuggagugcacaaacauggcucacuacagccucgcucucccgggcucc

SEQ ID NO: 307913 - RNA, 64 nt, hsa
ccuagaagacucaccuuggguuuccacagcuauggcucacuaccaggugcuugaugaaucuggc

SEQ ID NO: 307914 - RNA, 64 nt, hsa
ucaaauuuggguauagacaauaaagaacugaagugcucacuacucagugauuuggaaauuuuga

SEQ ID NO: 307915 - RNA, 64 nt, hsa
gucacccaggcuggagugcagaagcaugaucacagcucacuacaguuucaacgucccccgcuca

SEQ ID NO: 307916 - RNA, 64 nt, hsa
cagauauuuaugaaguggugaaauuucaaguguggcucacuagguacuucaggccuucuuggac

SEQ ID NO: 307917 - RNA, 64 nt, hsa
ccagccaggaccuuacugaucucagcauaauaaugcucacuaauaaugaagucugcauagugac

SEQ ID NO: 307918 - RNA, 64 nt, hsa
uaagguuagaagccugaaccguuacaaaagaagagcucacuauggucaaaaagugauggcuuuc

SEQ ID NO: 307919 - RNA, 64 nt, hsa
uugguggcaucaucacgccauuccuggucuaccggcucacuaacaucuggcuugagcucccgcu

SEQ ID NO: 307920 - RNA, 64 nt, hsa
guuauguauaaaagcauaugugcuacucaucuuugcucacuaugcagucuuuuuuaagagagca

SEQ ID NO: 307921 - RNA, 64 nt, hsa
uuuugccuagugcuuuuucucuaccugcccuugggcucacuaauaucaccaguauuauuaccaa

SEQ ID NO: 307922 - RNA, 64 nt, hsa
gcacaaggcagacuguuugaguggauugguugcugcucacuaaaguuguuccccugaucucuaa

SEQ ID NO: 307923 - RNA, 64 nt, hsa
cacccccacaggacauggccgugcggcagcaccugcucacuaaccugguagagguagacgggcg

SEQ ID NO: 307924 - RNA, 64 nt, hsa
cuugcaacuuagcucacaccugaccaaucagagagcucacuaaaaugcuaauuaggcaaagaca

SEQ ID NO: 307925 - RNA, 64 nt, hsa
gcaagagcugaaaaacuuaccuacuggggacugugcucacuaccugggugacaggaucauacgu

SEQ ID NO: 307926 - RNA, 64 nt, hsa
cuuucucagacauuuuguagaauucauuucggcagcucacuaggauuuugcugaacauuaaaaa

SEQ ID NO: 307927 - RNA, 64 nt, hsa
gucucccaggcuggagugcaauggugcaaucuuggcucacuauagccuugaccucucaggcuca

SEQ ID NO: 307928 - RNA, 64 nt, hsa
auugacauugcuuuacugucaaaauaauuuuauggcucacuaugaaucuauuauacuguauuaa

SEQ ID NO: 307929 - RNA, 64 nt, hsa
uuaagauuacuucccuuugaaaacuuuuuucauagcucacuagggagaaggaugcacaaauaag

SEQ ID NO: 307930 - RNA, 64 nt, hsa
guagugaaugagugaaggacuguaaucauaauaugcucacuacuugcucuuguuuuuguuuuaa

SEQ ID NO: 307931 - RNA, 64 nt, hsa
uuuaacuucauuuuguaucuugcuuaaguagcaggcucacuaaaauuagagaaaguccaauaac

SEQ ID NO: 307932 - RNA, 64 nt, hsa
aagcuuugguauuguacaaggucaguaguaagaugcucacuagucucagggcuuguguaauauu

SEQ ID NO: 307933 - RNA, 64 nt, hsa
cagcuguggcugccacccagccagguuucuccgugcucacuaauuuauuuccaggaaggugugu

SEQ ID NO: 307934 - RNA, 64 nt, hsa
auuguucagacuggagugcaguggcaugaucucggcucacuacaaccuccaccuccuggguucc

SEQ ID NO: 307935 - RNA, 64 nt, hsa
guugcucaggcuggagugcaguggcgugaucucagcucacuacagccuccaccucguggguuca

SEQ ID NO: 307936 - RNA, 64 nt, hsa
ggacggaccccugguacccagaagaggaguucuugcucacuaacccggauccgccucgugcccc

SEQ ID NO: 307937 - RNA, 64 nt, hsa
ugaccuuucacccugccaucccaucccaaccccagcucacuagccuucauauaugccuuauacu

SEQ ID NO: 307938 - RNA, 64 nt, hsa
gguagguggacaccacuuucauaagugaacuugagcucacuacucaauugugcagcuuaauaug

SEQ ID NO: 307939 - RNA, 64 nt, hsa
gggacccgagcccccgcgaugcccugggggccgugcucacuaccaaauguuaauaaagcccgcg

SEQ ID NO: 307940 - RNA, 64 nt, hsa
cgacuacugcuccuguggcaggaggcuuuggguggcucacuacugaacacauguguaugauacu

SEQ ID NO: 307941 - RNA, 64 nt, hsa
ggcccauaguagaaucuguguagaggaaacgagagcucacuauuugugaggcagccuguuccac

SEQ ID NO: 307942 - RNA, 64 nt, hsa
caugugcccauuucuaugugugugucuacgugcagcucacuaccaacagccucaugugcacuug

SEQ ID NO: 307943 - RNA, 64 nt, hsa
gaauuuaaaggagauaagaggcguaaaguaggaugcucacuacaaccauaggugggguuucagc

SEQ ID NO: 307944 - RNA, 64 nt, hsa
ucugcugccccggaguccccucccugggugggaugcucacuacagcucugauguauauagcaca

SEQ ID NO: 307945 - RNA, 64 nt, hsa
ugaagcuaggucuuaaugcguaggcaaccucccagcucacuaugaacgcugacagaagaguguu

SEQ ID NO: 307946 - RNA, 64 nt, hsa
uuccaaagucaagccuauuuuaaagaaagacugagcucacuaguucaguauauuuuauucucac

SEQ ID NO: 307947 - RNA, 64 nt, hsa
uccuugcaauacuggaacauaauucuuuuguguagcucacuauuagccagcuaaguucaucuuu

SEQ ID NO: 307948 - RNA, 64 nt, hsa
gacgcuuauaaaaccuucagaucucaugagaccggcucacuaucacaggaacagcauggaggaa

SEQ ID NO: 307949 - RNA, 64 nt, hsa
guugcccaggcuugagcgcaguggcaccaucucggcucacuacaaccuccgccucccagauuca

SEQ ID NO: 307950 - RNA, 64 nt, hsa
gucacccaggcuggagugcaguggugagauuuuggcucacuauaaccucuuccuccaggguuca

SEQ ID NO: 307951 - RNA, 64 nt, hsa
uguugccaggcuggagugcaguggcgcgaucucagcucacuacaaccuccgccucccauguuca

SEQ ID NO: 307952 - RNA, 64 nt, hsa
uaaaaugggggacuuggaccagguagauugcugagcucacuaccagguucaaaguucaaugaca

SEQ ID NO: 307953 - RNA, 64 nt, hsa
aauuacuuuucuuguauuuaaacaaacaaugguagcucacuaaaaugaccucagcacaugacga

SEQ ID NO: 307954 - RNA, 64 nt, hsa
cagcuaauggaggcuggaauucagcuuguguucugcucacuaagcugugugcgugcccuggugu

SEQ ID NO: 307955 - RNA, 64 nt, hsa
agggccucuaggcccugggccugccuccccaagggcucacuaagccagaggccaaagugccccc

SEQ ID NO: 307956 - RNA, 64 nt, hsa
gucgcccaggcuggagugcaguggcgugaucucggcucacuacaaccucgaccuccuggguuca

SEQ ID NO: 307957 - RNA, 64 nt, hsa
augguguuucacaagaaugagccauucagucuuugcucacuauauauuuaauauuuuauuauug

SEQ ID NO: 307958 - RNA, 64 nt, hsa
cuacccauugcuugaaaaucucucuugacagggagcucacuaccucacaaggcaggucauuuca

SEQ ID NO: 307959 - RNA, 64 nt, hsa
gcuagaauuggauauguccaggaacaugggaagggcucacuauuggaaucccaugaguuuccau

SEQ ID NO: 307960 - RNA, 64 nt, hsa
ggugcccaggcuggagugcaguggcgugaucucggcucacuacaaccuccaccucccagccacc

SEQ ID NO: 307961 - RNA, 64 nt, hsa
guugcccaggcuggagugcaauggcgcguucucugcucacuacagcacccgcuucccagguuga

SEQ ID NO: 307962 - RNA, 64 nt, hsa
ucuucucuuuauuuuagaagaaaguggaugaucagcucacuaccacaucaaaggugccaacucu

SEQ ID NO: 307963 - RNA, 64 nt, hsa
ccuggccaaugccuauggguggccccucuggagugcucacuaacaagggugagugcucucgcua

SEQ ID NO: 307964 - RNA, 64 nt, hsa
gucgcccaggcugaggugcaguagugcaaucuccgcucacuacaaccuccacucccuggggcuc

SEQ ID NO: 307965 - RNA, 64 nt, hsa
gucacccgagcuagagugcaguggugcagucuuggcucacuacagccucgaacuccuggucuca

SEQ ID NO: 307966 - RNA, 64 nt, hsa
uguugauauuacaacagggacagauguguuaguugcucacuagaguuuaugucuuauauuaaau

SEQ ID NO: 307967 - RNA, 64 nt, hsa
caucaaaucucugucucugcuugguuaaaaauuggcucacuauugcuuuguaguaaccccugcc

SEQ ID NO: 307968 - RNA, 64 nt, hsa
uucgcccaggcuggagugcauuggcaugaucucagcucacuacaaccucugccuucugguuuca

SEQ ID NO: 307969 - RNA, 64 nt, hsa
cccgcccuccucccugugagacacugggccaaaggcucacuaccccugugcguuguccagcaca

SEQ ID NO: 307970 - RNA, 64 nt, hsa
cgacaaagcuacuugaaggacacaagagagaaaagcucacuaagaagcuugaaucuacuuuuuu

SEQ ID NO: 307971 - RNA, 64 nt, hsa
aucuacaggccuuugauuaccuccugggaugggugcucacuaucuaccccagaccaaugccacc

SEQ ID NO: 307972 - RNA, 64 nt, hsa
guugcccaggcuggagugcaguggcgugaucuuggcucacuacaaccuccaccuuccaggcuua

SEQ ID NO: 307973 - RNA, 64 nt, hsa
cagcgggcagagugggaguuggcucacucagcacgcucacuaacccagcaugccacuuccagca

SEQ ID NO: 307974 - RNA, 64 nt, hsa
cacagggaaccaugagcucaguggucuuggaacagcucacuaagucaguccuuccuuagccugg

SEQ ID NO: 307975 - RNA, 64 nt, hsa
ugcugucauguuuuguggaaugagggaccguugagcucacuaccaccuggaguuugaguugaag

SEQ ID NO: 307976 - RNA, 64 nt, hsa
ggccagaacaaaaacacaugccuagugggggaaggcucacuaagagggcaccaaguggggcaaa

SEQ ID NO: 307977 - RNA, 64 nt, hsa
cgccccaugggcccucagcgucuccccaugcugggcucacuacaugggccagcccuugcucuac

SEQ ID NO: 307978 - RNA, 64 nt, hsa
gacccuccuccagaaggcagccgcugaguucggggcucacuacugacugugcccucaggcuggg

SEQ ID NO: 307979 - RNA, 64 nt, hsa
gcggagacacugagccuaccucugacagcgcggggcucacuaguuaccgcccaaccuggauccg

SEQ ID NO: 307980 - RNA, 64 nt, hsa
uuagcccccacccacuucccugggcaaaugaauggcucacuauggugccaauggaaccuccuuu

SEQ ID NO: 307981 - RNA, 64 nt, hsa
auaugaaaagagacgaaaagcaccaacaaaugaagcucacuaaaugugcugaaaguugaaacca

SEQ ID NO: 307982 - RNA, 64 nt, hsa
ugccugggggaggaggggagaaagcaccaugagugcucacuaaaacaacuuuuuccauuuuuaa

SEQ ID NO: 307983 - RNA, 64 nt, hsa
gcuccuacccaccgcccuugccgaaccaggagcugcucacuaccuccucagggauggccguugg

SEQ ID NO: 307984 - RNA, 64 nt, hsa
ugaagaaauaaagaggcagaagauggauucaauagcucacuaaaauuuuauauauuuguaugau

SEQ ID NO: 307985 - RNA, 64 nt, hsa
aguugaagguggauuauaguaaauguacaacugugcucacuaggcuucaaguaaaaaguuuucc

SEQ ID NO: 307986 - RNA, 64 nt, hsa
cagggggauugacucugcaguuugggagccacaaaaagcguagcggugugauuucuagcucagc

SEQ ID NO: 307987 - RNA, 64 nt, hsa
gaaaccaaccacaggcacccaagcacuaccagacaaagcguauuaaacagaacacuuuugaacc

SEQ ID NO: 307988 - RNA, 64 nt, hsa
guagauacuaaucaagaaagcugugauucuccucaaagcguauuuuugugaaaucuuuuaagag

SEQ ID NO: 307989 - RNA, 64 nt, hsa
ugcacagcaacugccuggauguguuugauuuuuuaaagcguagacauauauuuaugaaugugca

SEQ ID NO: 307990 - RNA, 64 nt, hsa
auguauguuaagugacuaauuuaauuucaauuaaaaagcguaaagugaaaaugaauaagugaaa

SEQ ID NO: 307991 - RNA, 64 nt, hsa
cuuucggggggaaaaagcuacuugacuuggagggaaagcguauguauuagccggcagccuguug

SEQ ID NO: 307992 - RNA, 64 nt, hsa
uuauacacugauuuuuguaaaggacaaaguuuuaaaagcguauuuaacuugauguuuucuauca

SEQ ID NO: 307993 - RNA, 64 nt, hsa
aggcagugugauguguucugaaaguguccagggcaaagcguagggagaggguggauuugugcag

SEQ ID NO: 307994 - RNA, 64 nt, hsa
cuuacugcaugauaacaaagcagcaaggcaagcaaaagcguaagaugaagagagaggaaaugaa

SEQ ID NO: 307995 - RNA, 64 nt, hsa
uuguuuuugaacgauaauuuagaaguucucauagaaagcguauaacauaggucuucagaaacua

SEQ ID NO: 307996 - RNA, 64 nt, hsa
agccacugcgcccagccaacaauccgcucugaggaaagcguaagcaggaagaccucuuaauggc

SEQ ID NO: 307997 - RNA, 64 nt, hsa
augaaguuugauaauucacuuuucugucauuguuaaagcguacauacuguaaauuaaagggagg

SEQ ID NO: 307998 - RNA, 64 nt, hsa
gacuauuauaggccagcuuuccauuuagucaauaaaagcguacauuuuuaguuacuuaccuuga

SEQ ID NO: 307999 - RNA, 64 nt, hsa
guugcagauaaccagagacccaacaaccaaaggcaaagcguaagccuugauuggauuuugguuu

SEQ ID NO: 308000 - RNA, 64 nt, hsa
gguaucaaccaaauggagugacuuaguguacaugaaagcguaaagaggauguguggcauuuuca

SEQ ID NO: 308001 - RNA, 64 nt, hsa
uacuguuuuuuguuauucuaagucaguguuuuucaaagcguagugguccccauauuagcugcau

SEQ ID NO: 308002 - RNA, 64 nt, hsa
uaaaugauaaaggaauuauuguaugaaauauuacaaagcguagacuaugcauuguuauucauua

SEQ ID NO: 308003 - RNA, 64 nt, hsa
gaaaaaaaacauagagaucacaccgcaaagaagcaaagcguaauaauuacuauaguaggauaag

SEQ ID NO: 308004 - RNA, 64 nt, hsa
uguguaauguauucucucuuguagccuauucuucaaagcguaucuucacuuuccauguuaacau

SEQ ID NO: 308005 - RNA, 64 nt, hsa
auggcuccucccucccauguccucagacccagcaaaagcguagaggcagaauuagaggccucuc

SEQ ID NO: 308006 - RNA, 64 nt, hsa
guugcaauuauguuucuuauuuccuuaaaagcaaaaagcguaguuucugauuuauguuauagaa

SEQ ID NO: 308007 - RNA, 64 nt, hsa
gcaggcuuuucugaauaccaaaucugcuuuuuguaaagcguaaaaacaucacaaaguaggucau

SEQ ID NO: 308008 - RNA, 64 nt, hsa
caaaagugguucucucucauuaaaccaaccaguaaaagcguauccuauuuuuuugcacaaggug

SEQ ID NO: 308009 - RNA, 64 nt, hsa
auaaguucuggucuuuccagucacaucuggaaauaaagcguauuauuuucuugggaaaacauac

SEQ ID NO: 308010 - RNA, 64 nt, hsa
gguguugccgugcuucaggaaguguggcgaccagaaagcguagacccggggcccagggucugcc

SEQ ID NO: 308011 - RNA, 64 nt, hsa
cagcaauacuuguaugcauguucauugcaacuuaaaagcguaaaaaccccaaauguccauccac

SEQ ID NO: 308012 - RNA, 64 nt, hsa
aacuuuuuaugaaucuucgaguugacaguuccuaaaagcguaacucagauauuaaugggcugug

SEQ ID NO: 308013 - RNA, 64 nt, hsa
guugcgaagaccuaaccucaaaugcaucugcuagaaagcguacaucacacauucgcaaugcauc

SEQ ID NO: 308014 - RNA, 64 nt, hsa
agcccagagccauguggauuugacuuacgggaguaaagcguaacuuuuuacugcaucuaaugag

SEQ ID NO: 308015 - RNA, 64 nt, hsa
gaagacauuaugagcuguguccaacguuuuaaccaaagcguaucguaccaacgaucugugaaaa

SEQ ID NO: 308016 - RNA, 64 nt, hsa
cagguggcagaaauuuuaaaaauacugucggaaaaaagcguaccccaggccucaucucccaaau

SEQ ID NO: 308017 - RNA, 64 nt, hsa
cgaagaguuagucaccaagagagccauauguaugaaagcguaucugugaaagguaggaaacuua

SEQ ID NO: 308018 - RNA, 64 nt, hsa
uuuucuccaguucuguuacccaauuuagauuaguaaagcguacacaacuggaaagacugcugua

SEQ ID NO: 308019 - RNA, 64 nt, hsa
cugaaaaaaugccaagacaugauuauuuuuuuaaaaagcguacuuuaaauguuuguguuaauaa

SEQ ID NO: 308020 - RNA, 64 nt, hsa
ccugcauuucucccaggacuuggggguggggugaaaagcguacaaaagauacuuaaaagggcuc

SEQ ID NO: 308021 - RNA, 64 nt, hsa
agauaauacaagagcguccccucacaaauaaauuaaagcguaaaaggagaccuacaucaggccu

SEQ ID NO: 308022 - RNA, 64 nt, hsa
ucgcaaagccuuccagaaguuuucugugcuuaugaaagcguauguguggccuuucucuucccuu

SEQ ID NO: 308023 - RNA, 64 nt, hsa
uccagauuuuauauuccuaaucccaguaaggaagaaagcguagugugggagaggagagagcuga

SEQ ID NO: 308024 - RNA, 64 nt, hsa
agcaagaauaguugcaagaaguaaauucuggcacaaagcguaaaaauauaacagaagaaauaau

SEQ ID NO: 308025 - RNA, 64 nt, hsa
ccucaccuuuucuuucugguuugaacuugcucggaaagcguaagacaagaugaagagcaggcgc

SEQ ID NO: 308026 - RNA, 64 nt, hsa
auuuuuuucuguguagauuuaaauaauuucuuuaaaagcguaagcuuuggcugggcaugguggc

SEQ ID NO: 308027 - RNA, 64 nt, hsa
uuuucucgaagacaaacuuuccucuaugucuggaaaagcguaggcauccggaggcuuuggaggg

SEQ ID NO: 308028 - RNA, 64 nt, hsa
ccugguuaaucacuaugcauauuugaaauaaaagaaagcguaagccucugcaauuuuaacuucu

SEQ ID NO: 308029 - RNA, 64 nt, hsa
gugagcacuguuagcagaugccuaugggagaggaaaagcguaucugaaaaugguccaggacagg

SEQ ID NO: 308030 - RNA, 64 nt, hsa
cgaauuauuuuuuuaaagugauuugccauuuuugaaagcguauuuaaugauagaauacuaucga

SEQ ID NO: 308031 - RNA, 64 nt, hsa; identical to SEQ ID NO: 174977

SEQ ID NO: 308032 - RNA, 64 nt, hsa; identical to SEQ ID NO: 174978

SEQ ID NO: 308033 - RNA, 64 nt, hsa; identical to SEQ ID NO: 174979

SEQ ID NO: 308034 - RNA, 64 nt, hsa; identical to SEQ ID NO: 174980

SEQ ID NO: 308035 - RNA, 64 nt, hsa; identical to SEQ ID NO: 174981

SEQ ID NO: 308036 - RNA, 64 nt, hsa; identical to SEQ ID NO: 174982

SEQ ID NO: 308037 - RNA, 64 nt, hsa; identical to SEQ ID NO: 174983

SEQ ID NO: 308038 - RNA, 64 nt, hsa; identical to SEQ ID NO: 174984

SEQ ID NO: 308039 - RNA, 64 nt, hsa; identical to SEQ ID NO: 174985

SEQ ID NO: 308040 - RNA, 55 nt, hsa; identical to SEQ ID NO: 174986

SEQ ID NO: 308041 - RNA, 64 nt, hsa; identical to SEQ ID NO: 174987

SEQ ID NO: 308042 - RNA, 64 nt, hsa; identical to SEQ ID NO: 174988

SEQ ID NO: 308043 - RNA, 64 nt, hsa
agcaagauaagcagggccagucucagggcccggagacgaacacggggacaauugucaaaggagc

SEQ ID NO: 308044 - RNA, 64 nt, hsa
caugcuuccuuuucaaagaauagacuucaaaagggacgaacaaacauuaggucaccuuuugugu

SEQ ID NO: 308045 - RNA, 64 nt, hsa
uuuuacaacgugacaggaagaggagggagagggugacgaacaccaggcauuuccaggggcuaua

SEQ ID NO: 308046 - RNA, 64 nt, hsa
auuuccugacacugagaaugaagaguaucacagugacgaacaaaaugauacucagaagcaauuu

SEQ ID NO: 308047 - RNA, 64 nt, hsa
ugcagaugcucuuaaaagcauugauaaccuuugugacgaacauaaagagauccuuaaauuauga

SEQ ID NO: 308048 - RNA, 64 nt, hsa
uccagguguggccucuggaaccugacuccguuaggacgaacaucugccccuucagggaggguga

SEQ ID NO: 308049 - RNA, 64 nt, hsa
gagugguggcagcucaaaaugauauguuugaguagacgaacagcugacauggaguucccgugca

SEQ ID NO: 308050 - RNA, 64 nt, hsa
gcaccucacgcacagcucucagaagcugcaggcggacgaacaucugaccaaagagguguggucg

SEQ ID NO: 308051 - RNA, 64 nt, hsa
uaggggaaaguuucaugaugguaucuauagucaagacgaacauguagcauggugccuauguaga

SEQ ID NO: 308052 - RNA, 64 nt, hsa
cccccucccugguggucuuaggucuauaaucagugacgaacagagggugcccuuggccaaugua

SEQ ID NO: 308053 - RNA, 64 nt, hsa
cuucuaaaaucuaaaauccauuucaagaaauaaagacgaacacauuugcaggaagguaacuguu

SEQ ID NO: 308054 - RNA, 64 nt, hsa
cucuucugccugauagagggaagaggaagaggaggacgaacagagauccugaaauucugacuug

SEQ ID NO: 308055 - RNA, 54 nt, hsa
uugggaucauugcccugugaggaggacgaacauccaaccuucccaaacgccucc

SEQ ID NO: 308056 - RNA, 64 nt, hsa
gcgugggcaaagcugaaggugaugaggaagaagagacgaacauuaaagaugucuauuuacuaug

SEQ ID NO: 308057 - RNA, 64 nt, hsa
gggacuccugagaugggagaggcagggaucagaggacgaacaggugggacuuugcgagcucugu

SEQ ID NO: 308058 - RNA, 64 nt, hsa
uaaucagacaagcuugaauauuguuuuugcaccagacgaacagugaggaaauucggagcuauac

SEQ ID NO: 308059 - RNA, 64 nt, hsa
uucucacagacccuucagcaauggcuacuagaaggacgaacaauugcccuccuuuggaaguacg

SEQ ID NO: 308060 - RNA, 64 nt, hsa
uuacaaacucagaaauacgaacagaaauacagcagacgaacauauuuauugguacugaaaagag

SEQ ID NO: 308061 - RNA, 57 nt, hsa
aucuuuacagauucauuuaagccaucagacgaacacaagagaggcucaaacaagaaa

SEQ ID NO: 308062 - RNA, 64 nt, hsa
aaauuacgaaagaaaagaaaucucuaugcaaaaugacgaacaugguccuguggacuccucuggc

SEQ ID NO: 308063 - RNA, 64 nt, hsa
gugccucucuggccgcccacuggaugagcggugagacgaacaaaagggaaaggaaaaaaugggg

SEQ ID NO: 308064 - RNA, 64 nt, hsa
gagcuggccaucccaaauucaaucaguccauagagacgaacagaaugagaccuuccggcccaag

SEQ ID NO: 308065 - RNA, 64 nt, hsa
caaacaguuuuuccaauuauaaauaaaugcuaaagacgaacaccacuuucuugaucuuauuucc

SEQ ID NO: 308066 - RNA, 64 nt, hsa
caagccuccucaccccuagucuucaucuccuguggacgaacaucugggguggaaguuuuguagc

SEQ ID NO: 308067 - RNA, 64 nt, hsa
uucuuuaaaaagaaagaggguugaaaauccucuggacgaacagaagucacuuuggcuguucagu

SEQ ID NO: 308068 - RNA, 64 nt, hsa
cuccguaaacagcccagcuguaacgccagaccgagacgaacacucugccuaacuaucaaaggau

SEQ ID NO: 308069 - RNA, 64 nt, hsa
gucacgcuggcgcugaauacuuuuuguauaaaccgacgaacagcugaugaccgcaugaaugcuc

SEQ ID NO: 308070 - RNA, 64 nt, hsa
uguuugcugcccagccauaacccacucagugacagacgaacacagcuaaggccucgcugccagc

SEQ ID NO: 308071 - RNA, 64 nt, hsa
uuugucacacaggauggcaugugauccucaagacgacgaacaaugaacuaaagccaaaugcagc

SEQ ID NO: 308072 - RNA, 64 nt, hsa
ugauuccgaccagggcacccccuucagagcuagggacgaacagcagugugcucccaccucaggg

SEQ ID NO: 308073 - RNA, 64 nt, hsa
ggacaucagaucacucuguauucaaagcuuacuagacgaacaaucuuucauuucuggauauauu

SEQ ID NO: 308074 - RNA, 64 nt, hsa
aaggccacguaugugccuugaauguagccaaaaugacgaacaacacccagaaaucugugauuua

SEQ ID NO: 308075 - RNA, 64 nt, hsa
aggcacugagagcuggagaguuggugauaagcgagacgaacacauuuccugcccucauacacac

SEQ ID NO: 308076 - RNA, 64 nt, hsa
ggccccugaccucaagaucaaggaaaggaggauggacgaacaggggccaaacuggugggaggca

SEQ ID NO: 308077 - RNA, 64 nt, hsa
gcacugccguggcagacagcuggacuugagcagagggaacgaccugacuuacuugcacugugau

SEQ ID NO: 308078 - RNA, 64 nt, hsa
cuuuucaggauuugagacuguucucaaagggauugggaacgaaggccccaucucgggcagaccc

SEQ ID NO: 308079 - RNA, 64 nt, hsa
uucagcagcagcauggaggagggugcugaaccucgggaacgagcuauccuagcuucugaaucca

SEQ ID NO: 308080 - RNA, 64 nt, hsa
cuuccacugggcugacagacuuugcugaccacaggggaacgauguucuuuucuuucuucaugau

SEQ ID NO: 308081 - RNA, 64 nt, hsa
ccgugccacauuccuccaguucccacacguagaagggaacgaaacugacgucuaccucaugggg

SEQ ID NO: 308082 - RNA, 64 nt, hsa
cuagcuuuuuccuggaaagcccgcuagaagguuugggaacgaggggaaaguucucagaacuguu

SEQ ID NO: 308083 - RNA, 64 nt, hsa
ugcauaucugauguucagguagaccugggcgccugggaacgaggccaucagcugccaugcacau

SEQ ID NO: 308084 - RNA, 64 nt, hsa
gcaugcaggcugcugggcaccacccccucauccagggaacgagugugucucaaggggcauuugu

SEQ ID NO: 308085 - RNA, 64 nt, hsa
gggggaggaggaccugugugucaggcucugccaugggaacgaguguaaaccguggcugucuccu

SEQ ID NO: 308086 - RNA, 64 nt, hsa
ccagaacagaaggaggguggaggaagugaucagagggaacgagcuguagguuugcagaaaugug

SEQ ID NO: 308087 - RNA, 64 nt, hsa
ucucuaacauaauaaugaguggcagcuggcgccagggaacgauggccucccaauagauaggaaa

SEQ ID NO: 308088 - RNA, 64 nt, hsa
uuacgucuguagucaucuuauuugagaugggggugggaacgaauuaaaauaugauagagaacua

SEQ ID NO: 308089 - RNA, 64 nt, hsa
accucaccaaggaucggacucugccccuggaccugggaacgacuggacugucacgggguucccu

SEQ ID NO: 308090 - RNA, 64 nt, hsa
uaaaaguuaaggggcaagcagcauugcauucugggggaacgauccuggccacagccgccaaaca

SEQ ID NO: 308091 - RNA, 64 nt, hsa
uucucagcugggcucugaccuggggucuggggcagggaacgaacaugguggcuuugggcugaga

SEQ ID NO: 308092 - RNA, 64 nt, hsa
uguccccaacccccucagcaacaaagcucagcuggggaacgagaguaauuugaagaaugcuuga

SEQ ID NO: 308093 - RNA, 64 nt, hsa
ggccagacaaagacucggcaaaggggcgagaggagggaacgagcgggcgccgggccacucgggg

SEQ ID NO: 308094 - RNA, 64 nt, hsa
guuuggugcaucuugaccugggaagacgccucaugggaacgaacuuggacagguguuggguuga

SEQ ID NO: 308095 - RNA, 64 nt, hsa
agaggaaaagaaugaauggauucuaggaauguuagggaacgauuuacuuuacccgauggcugua

SEQ ID NO: 308096 - RNA, 64 nt, hsa
gcgcggggcgcggacuccgggcacggcuucccaggggaacgaggagaucuguguuuacuuaaga

SEQ ID NO: 308097 - RNA, 64 nt, hsa
caggaggccgugggugccauucgggggaaagugggggaacgacacacacuucaccugcaagggc

SEQ ID NO: 308098 - RNA, 64 nt, hsa
ucguggcuucggagagcagaggggucaggcccaggggaacgagcuggccuugccaacccucugc

SEQ ID NO: 308099 - RNA, 64 nt, hsa
cauaacucaauggccuaaaacuggccugacuugggggaacgaugugucuguauuucauguggcu

SEQ ID NO: 308100 - RNA, 64 nt, hsa
cucuaguggcagagcagcucacacucccuccgcugggaacgauggcuucugccuaguaccuauc

SEQ ID NO: 308101 - RNA, 64 nt, hsa
uagauuaagcccuauaaugcuauuuauauuccaggggaacgaaaaucugaauuuguuuuaugau

SEQ ID NO: 308102 - RNA, 64 nt, hsa
caagaaaaugugcagccuuuugggcaaagccccugggaacgaggccuauccacuauggacuaug

SEQ ID NO: 308103 - RNA, 64 nt, hsa
caucuccaucuugaaggaacucaaagacucaagugggaacgacugggcacugccaccaccagaa

SEQ ID NO: 308104 - RNA, 64 nt, hsa
gaaacuuauuuuuuucugauuguaacguugcugugggaacgagaggggaagaguguacuggggg

SEQ ID NO: 308105 - RNA, 64 nt, hsa
uaagaguacagcuaagugcggggguggcgguggagggaacgaaaauugaaccugucugccugug

SEQ ID NO: 308106 - RNA, 64 nt, hsa
gggugccugagucaggcggagcugacccaggggugggaacgauggcagcugcccaggacccaug

SEQ ID NO: 308107 - RNA, 64 nt, hsa
cuggagccaagagaagcccugggaaggagggguggggaacgacaugcaugugagggauggcaca

SEQ ID NO: 308108 - RNA, 64 nt, hsa
cuuguuugaacuuuuuaaaaauucgaaaacuuuggggaacgaaugcaacagggaguaaggacuc

SEQ ID NO: 308109 - RNA, 64 nt, hsa
acuucagguaccagcuuaaagagcacuagggauggggaacgaaugccaaaucagacuccaccua

SEQ ID NO: 308110 - RNA, 64 nt, hsa
uuguuuucuaguguggucuguagcccaauaacuggggaacgaguuacagacaaacaucaccgua

SEQ ID NO: 308111 - RNA, 64 nt, hsa
gggauuuuugcauuggcaaagucaaugcggguuggggaacgaaacuuccaauggacaccagaac

SEQ ID NO: 308112 - RNA, 61 nt, hsa
cuaucuccagugucagcuaauggaacaucaggggaacgaugacuccuggauucuccuuccu

SEQ ID NO: 308113 - RNA, 64 nt, hsa
acgugaguuagagggagaagauggagggaaucuagggaacgaggcagccuauuggagaugcgga

SEQ ID NO: 308114 - RNA, 64 nt, hsa
guuugcauucacggcaguaguuagcccagguguggggaacgagagugcacugcaugauagcguu

SEQ ID NO: 308115 - RNA, 64 nt, hsa
cugguggagcagaacacacugaugguggaagagcgggaacgagagauucgccagauuguacagu

SEQ ID NO: 308116 - RNA, 64 nt, hsa
gggagcuucugaagagcugaacauguggagggaggggaacgagaacuuguccaugugccaagag

SEQ ID NO: 308117 - RNA, 64 nt, hsa
cugggcccuuaguggauguuucagacgcucggccgggaacgaaucccaccaccaggaggaaugc

SEQ ID NO: 308118 - RNA, 64 nt, hsa
cugccacgccacugugucaugaaggaaagugaaagggaacgaggaaguaggaaugcccacgcuc

SEQ ID NO: 308119 - RNA, 64 nt, hsa; identical to SEQ ID NO: 157920

SEQ ID NO: 308120 - RNA, 64 nt, hsa; identical to SEQ ID NO: 157921

SEQ ID NO: 308121 - RNA, 64 nt, hsa; identical to SEQ ID NO: 157922

SEQ ID NO: 308122 - RNA, 64 nt, hsa; identical to SEQ ID NO: 157923

SEQ ID NO: 308123 - RNA, 64 nt, hsa; identical to SEQ ID NO: 157924

SEQ ID NO: 308124 - RNA, 64 nt, hsa; identical to SEQ ID NO: 157925

SEQ ID NO: 308125 - RNA, 64 nt, hsa; identical to SEQ ID NO: 157926

SEQ ID NO: 308126 - RNA, 64 nt, hsa; identical to SEQ ID NO: 157927

SEQ ID NO: 308127 - RNA, 64 nt, hsa; identical to SEQ ID NO: 157928

SEQ ID NO: 308128 - RNA, 64 nt, hsa; identical to SEQ ID NO: 157929

SEQ ID NO: 308129 - RNA, 64 nt, hsa; identical to SEQ ID NO: 157930

SEQ ID NO: 308130 - RNA, 64 nt, hsa; identical to SEQ ID NO: 157931

SEQ ID NO: 308131 - RNA, 64 nt, hsa; identical to SEQ ID NO: 157932

SEQ ID NO: 308132 - RNA, 64 nt, hsa; identical to SEQ ID NO: 157933

SEQ ID NO: 308133 - RNA, 64 nt, hsa; identical to SEQ ID NO: 157934

SEQ ID NO: 308134 - RNA, 64 nt, hsa; identical to SEQ ID NO: 157935

SEQ ID NO: 308135 - RNA, 64 nt, hsa; identical to SEQ ID NO: 157936

SEQ ID NO: 308136 - RNA, 64 nt, hsa; identical to SEQ ID NO: 157937

SEQ ID NO: 308137 - RNA, 64 nt, hsa; identical to SEQ ID NO: 157938

SEQ ID NO: 308138 - RNA, 64 nt, hsa; identical to SEQ ID NO: 157939

SEQ ID NO: 308139 - RNA, 64 nt, hsa; identical to SEQ ID NO: 157940

SEQ ID NO: 308140 - RNA, 64 nt, hsa; identical to SEQ ID NO: 157941

SEQ ID NO: 308141 - RNA, 64 nt, hsa; identical to SEQ ID NO: 157942

SEQ ID NO: 308142 - RNA, 64 nt, hsa; identical to SEQ ID NO: 157943

SEQ ID NO: 308143 - RNA, 64 nt, hsa; identical to SEQ ID NO: 157944

SEQ ID NO: 308144 - RNA, 64 nt, hsa; identical to SEQ ID NO: 157945

SEQ ID NO: 308145 - RNA, 64 nt, hsa; identical to SEQ ID NO: 157946

SEQ ID NO: 308146 - RNA, 64 nt, hsa; identical to SEQ ID NO: 157947

SEQ ID NO: 308147 - RNA, 64 nt, hsa; identical to SEQ ID NO: 157948

SEQ ID NO: 308148 - RNA, 64 nt, hsa; identical to SEQ ID NO: 157949

SEQ ID NO: 308149 - RNA, 62 nt, hsa; identical to SEQ ID NO: 115690

SEQ ID NO: 308150 - RNA, 64 nt, hsa; identical to SEQ ID NO: 157951

SEQ ID NO: 308151 - RNA, 64 nt, hsa; identical to SEQ ID NO: 157952

SEQ ID NO: 308152 - RNA, 64 nt, hsa; identical to SEQ ID NO: 157953

SEQ ID NO: 308153 - RNA, 64 nt, hsa; identical to SEQ ID NO: 157954

SEQ ID NO: 308154 - RNA, 64 nt, hsa; identical to SEQ ID NO: 157955

SEQ ID NO: 308155 - RNA, 64 nt, hsa; identical to SEQ ID NO: 157956

SEQ ID NO: 308156 - RNA, 64 nt, hsa; identical to SEQ ID NO: 157955

SEQ ID NO: 308157 - RNA, 64 nt, hsa; identical to SEQ ID NO: 157958

SEQ ID NO: 308158 - RNA, 64 nt, hsa; identical to SEQ ID NO: 157959

SEQ ID NO: 308159 - RNA, 64 nt, hsa; identical to SEQ ID NO: 157960

SEQ ID NO: 308160 - RNA, 64 nt, hsa; identical to SEQ ID NO: 157961

SEQ ID NO: 308161 - RNA, 64 nt, hsa; identical to SEQ ID NO: 157962

SEQ ID NO: 308162 - RNA, 64 nt, hsa; identical to SEQ ID NO: 157963

SEQ ID NO: 308163 - RNA, 64 nt, hsa; identical to SEQ ID NO: 157964

SEQ ID NO: 308164 - RNA, 64 nt, hsa; identical to SEQ ID NO: 157965

SEQ ID NO: 308165 - RNA, 64 nt, hsa; identical to SEQ ID NO: 157966

SEQ ID NO: 308166 - RNA, 64 nt, hsa; identical to SEQ ID NO: 157967

SEQ ID NO: 308167 - RNA, 64 nt, hsa; identical to SEQ ID NO: 157968

SEQ ID NO: 308168 - RNA, 64 nt, hsa; identical to SEQ ID NO: 157969

SEQ ID NO: 308169 - RNA, 64 nt, hsa; identical to SEQ ID NO: 157970

SEQ ID NO: 308170 - RNA, 64 nt, hsa; identical to SEQ ID NO: 157971

SEQ ID NO: 308171 - RNA, 64 nt, hsa; identical to SEQ ID NO: 157972

SEQ ID NO: 308172 - RNA, 64 nt, hsa; identical to SEQ ID NO: 157973

SEQ ID NO: 308173 - RNA, 64 nt, hsa
auuuuuacugagauuuggcgagaccgaauggaagcguccgcacaguaacugcagcugcuaggcc

SEQ ID NO: 308174 - RNA, 64 nt, hsa
ccuucucgguccccgagggcccuggcccccgcugcguccgcaucacucugcaucagcacugccg

SEQ ID NO: 308175 - RNA, 64 nt, hsa
uccgggguucggaucgcuccgccgugaguauuugcguccgcacgcggccgcucuccgccccccg

SEQ ID NO: 308176 - RNA, 64 nt, hsa
ugagagguggaugaaacaccaaagucuguuuccccguccgcaguggguguugccucuuugugug

SEQ ID NO: 308177 - RNA, 64 nt, hsa
guuugugguguaggcaccacccacccagcaguaccguccgcaccgccaggcucagccccugccc

SEQ ID NO: 308178 - RNA, 64 nt, hsa
aggcagaggugccgagugacugccaugcuucgcccguccgcaugggcgcuucuguccagcugca

SEQ ID NO: 308179 - RNA, 64 nt, hsa
ccgcgggacaccuguuuccuucccgcagugucugcguccgcacagcauacccagcucggaccuc

SEQ ID NO: 308180 - RNA, 64 nt, hsa
guuccucgacugagggccgguggccaugcagaggcguccgcaggugccguguucugccagcacc

SEQ ID NO: 308181 - RNA, 64 nt, hsa
ggcuguucaagauccagaaccucaaugccagcaccguccgcacggugaugguggccgacugcag

SEQ ID NO: 308182 - RNA, 64 nt, hsa
aggcuccauaggagggcugguggcugggaggucgcguccgcacacuucuggaagugagccuuug

SEQ ID NO: 308183 - RNA, 64 nt, hsa
uccugucggggugacgggcccauggggcggagcucguccgcauggugcugaauggcugaggacc

SEQ ID NO: 308184 - RNA, 64 nt, hsa
ggggacagcuggccaccgugucccaggaccguaccguccgcaucugggaccuggccacccugca

SEQ ID NO: 308185 - RNA, 64 nt, hsa
agaccugcaagcucccugagcggugggcgggccucguccgcaggucucaucccacacucuugag

SEQ ID NO: 308186 - RNA, 51 nt, hsa
gggagggggagugggacugagcguccgcagaggugaccgaaaagccguaug

SEQ ID NO: 308187 - RNA, 64 nt, hsa
uuucuaucuccagcaucccccugcugccuucuuccguccgcagugcgccuucuagugcuccauc

SEQ ID NO: 308188 - RNA, 64 nt, hsa
uucccagccuggauggagcuccagggcuggggaacguccgcaagucaaugcucagagaugcccg

SEQ ID NO: 308189 - RNA, 64 nt, hsa
ugcuggagaccaacaagccguaccuggugaacugcguccgcaucccugcccuccaggugggccu

SEQ ID NO: 308190 - RNA, 64 nt, hsa
gccaaacuggagaaccccaccccaaggcaugccacguccgcagccccggccuggcugcggugcu

SEQ ID NO: 308191 - RNA, 64 nt, hsa
gugucuuuguaauggccaaauuucuccuuccacucguccgcacgguacgucuucaugggaguca

SEQ ID NO: 308192 - RNA, 64 nt, hsa
guauccccagcccuuggcaacacuggagugcacacgccgccacgguugcccagaaaaagugccc

SEQ ID NO: 308193 - RNA, 64 nt, hsa
aggaaggugcagcuuuuccauaucagcucaaccacgccgccaguccauucuuaaggaacugccg

SEQ ID NO: 308194 - RNA, 64 nt, hsa
aaggcauugccaagccccccgagugaggacgcaccgccgccaccagcccgcaacucuccagccg

SEQ ID NO: 308195 - RNA, 64 nt, hsa
cagcccaggcagcaccagcgcggccacgugcacgcgccgccacuacgagagguacggcggggcg

SEQ ID NO: 308196 - RNA, 64 nt, hsa
cucagccugccgagugccugcgauuacaggcgcgcgccgccacaccugacugguuuucguauuu

SEQ ID NO: 308197 - RNA, 54 nt, hsa; identical to SEQ ID NO: 214225

SEQ ID NO: 308198 - RNA, 64 nt, hsa
acugcccaggccuuuguuaggaaaacccaugggccgccgccacacucagugccauggggaagcg

SEQ ID NO: 308199 - RNA, 59 nt, hsa; identical to SEQ ID NO: 214227

SEQ ID NO: 308200 - RNA, 64 nt, hsa
ccugguccucucgcaggaaugcugcugcugccuccgccgccacugcugcugccaccucuuauau

SEQ ID NO: 308201 - RNA, 64 nt, hsa
ggcaggcucaccugggacucaacguuccuucccccgccgccacugugccccccgucccuccacc

SEQ ID NO: 308202 - RNA, 64 nt, hsa
gcgcgacgccggccccggucgcagccgacgacgccgccgccagccugaccucacacccucuggg

SEQ ID NO: 308203 - RNA, 64 nt, hsa
cccgcgggcgggggcugcagggccgugccgccgccgccgccaggcacuccggagcuguccgcuu

SEQ ID NO: 308204 - RNA, 64 nt, hsa
ggcuucauucgagagcugcugccaaaacgccuggcgccgccaccgucgggggcuggcuucgagg

SEQ ID NO: 308205 - RNA, 64 nt, hsa
cgcugccccggguggugagcgggcaggaaccuggcgccgccaccgagacugagccuccugcaga

SEQ ID NO: 308206 - RNA, 59 nt, hsa; identical to SEQ ID NO: 214234

SEQ ID NO: 308207 - RNA, 64 nt, hsa
cucagccucccaaguagcugugacuaaaggugcacgccgccaugcccagcuaauuuuuuguauu

SEQ ID NO: 308208 - RNA, 64 nt, hsa
gugcuggacgugucccggagacccaccgggagggcgccgccaugccuuguacccccaccgugca

SEQ ID NO: 308209 - RNA, 64 nt, hsa
gcauuaaucccaggaaccacuagcaguaguggggcgccgccaaucuaacaugagcacaggugcu

SEQ ID NO: 308210 - RNA, 64 nt, hsa
agcccagugacagaaagaacagccucugucaccccgccgccacugccuugguuacucagagcac

SEQ ID NO: 308211 - RNA, 64 nt, hsa
gcaggaguagggaggaaaaggaguucuggagaggcgccgccauccuguuuucuggaaaggcugc

SEQ ID NO: 308212 - RNA, 64 nt, hsa
cucagccugcugaguagcugguauacaggcacaucgccgccacacccagcucauuuuuguauua

SEQ ID NO: 308213 - RNA, 64 nt, hsa
agggaacucuccccauuggcaaaccggacccggccgccgccaggacuguguuuccaaagguucc

SEQ ID NO: 308214 - RNA, 64 nt, hsa
gaccccgugccucucgugguccuuugagggaucccgccgccaccacccuuguauuuuaucacgu

SEQ ID NO: 308215 - RNA, 64 nt, hsa
ugcaagugcuggagucuccugaggacacgcgcgucgccgccaccgcgggugugggaaagcgcgg

SEQ ID NO: 308216 - RNA, 64 nt, hsa
gcaggcucaggcggccccacucacccacagcauccgccgccaccccuucgggugugagcgcuca

SEQ ID NO: 308217 - RNA, 64 nt, hsa
uuuuuacaaaggggaaugguucuccagugcagcccgccgccacuggagugcccuguauggaagu

SEQ ID NO: 308218 - RNA, 64 nt, hsa
ggccgcuccagaagggugcccagucaggccgcaccgccgccagccuccuccggcccuggaggga

SEQ ID NO: 308219 - RNA, 64 nt, hsa
gcuuucacugcggucccgcuuagcgacccgccgccgccgccaagcgaggcugaggacuccgauc

SEQ ID NO: 308220 - RNA, 64 nt, hsa
gagccgcggguugacgacgguguccucgcagugucgccgccaccccagcguaguccaagucaga

SEQ ID NO: 308221 - RNA, 64 nt, hsa
cccacacccggugcccacaucccgccgccgccgccgccgccaugcccaagagaaagacugaagg

SEQ ID NO: 308222 - RNA, 64 nt, hsa
cuggcccaguccugggccucggcccuucccgcaccgccgccagcgcccgcagacacccuggcau

SEQ ID NO: 308223 - RNA, 64 nt, hsa
ugguggugcugggggaggcaccccacagacucagcgccgccagagauaggguuuuuggagggcu

SEQ ID NO: 308224 - RNA, 64 nt, hsa
ugaaguauguagggugggcagaagccacagucgccgccgccaggggcuugcuccuggcucuguc

SEQ ID NO: 308225 - RNA, 64 nt, hsa
agcauaccugcugguguguaaguguggacuaacccgccgccaccacccucuguuccagcaggcu

SEQ ID NO: 308226 - RNA, 64 nt, hsa
ggcucucacucagcucccacgggacucagaagugcgccgccaugcugccuaggguacugucccc

SEQ ID NO: 308227 - RNA, 64 nt, hsa
ugcacgccgcccuccgccacgccacagccacagccgccgccaucacucgcucgcccucccgcuu

SEQ ID NO: 308228 - RNA, 64 nt, hsa
aaggcugcuggcuucagggaggguuagccugcaccgccgccacccugccccuaaguuauuaccu

SEQ ID NO: 308229 - RNA, 64 nt, hsa
cucagccugccgagugccugcaauugcaggcgagcgccgccacgccugacugccucggccuccc

SEQ ID NO: 308230 - RNA, 64 nt, hsa
cguucugucugccaccugaagggaauuugaggaccgccgccagggcaccccguacauacacaca

SEQ ID NO: 308231 - RNA, 64 nt, hsa
accagcccacccagccaguggucgagcacugccccgccgccaaagucugcagaaugugagauga

SEQ ID NO: 308232 - RNA, 64 nt, hsa
ugccuccuccgggaagccuucccugcccagcccacgccgccaccgggaggaagccugacugucc

SEQ ID NO: 308233 - RNA, 55 nt, hsa; identical to SEQ ID NO: 214261

SEQ ID NO: 308234 - RNA, 60 nt, hsa; identical to SEQ ID NO: 214262

SEQ ID NO: 308235 - RNA, 64 nt, hsa
agacccggcucugagcgccccgcagcccggccgccgccgccaagcaucuguccccuccuccccc

SEQ ID NO: 308236 - RNA, 64 nt, hsa
ggcacccacccagcugggguguuuuugggggagucgccgccaagcccaggcugcuggagccagg

SEQ ID NO: 308237 - RNA, 57 nt, hsa; identical to SEQ ID NO: 214265

SEQ ID NO: 308238 - RNA, 64 nt, hsa
ccugaagugccagcaccaccagcaccagauccuccgccgccacaccgcacugaggacacgccgg

SEQ ID NO: 308239 - RNA, 64 nt, hsa
cucagccuccugaguagcugggauuacaggugugcgccgccacacccagcuaauuuuguauuuu

SEQ ID NO: 308240 - RNA, 64 nt, hsa
cagcagguccgcauccaggagaugcugcuucaggcgccgccacugggccccgggacccccacgg

SEQ ID NO: 308241 - RNA, 64 nt, hsa
gcgcggcacccggagccacagcuggcggggucuccgccgccagcccugcagcgggccggccaga

SEQ ID NO: 308242 - RNA, 64 nt, hsa
aagaaucuggcucucaggguggcuucugcguccccgccgccaggccccagacuauggucacagg

SEQ ID NO: 308243 - RNA, 64 nt, hsa
cucaacaucugguaccagcacuccgcggcggggccgccgccagcucccccagacccccuccacc

SEQ ID NO: 308244 - RNA, 64 nt, hsa
cccuccacccccuccaacucugcuccucuagggccgccgccaccuccccugggaccccgccccc

SEQ ID NO: 308245 - RNA, 64 nt, hsa
ggccuugguccccagaagauggcggcuagggccucgccgccaggacagagaagggacggggugg

SEQ ID NO: 308246 - RNA, 64 nt, hsa
ccagcuuugguaucuggagauuuccagggccccucgccgccacguccugacucucgggugaucu

SEQ ID NO: 308247 - RNA, 64 nt, hsa
gggagcccugucccuguugcuguggccccucucacgccgccaucucucugccccgccccgcccc

SEQ ID NO: 308248 - RNA, 64 nt, hsa
uuuucugcucagugugauccugagauggcuuccccgccgccacccagagugugguccuuggccg

SEQ ID NO: 308249 - RNA, 64 nt, hsa
gcugcccacagagggccgagggucacccgucggccgccgccaccccaggcgaggccggaggaag

SEQ ID NO: 308250 - RNA, 64 nt, hsa
ccguugcagcccagagccacuggucccuacagggcgccgccacaccagcaggaaggaggauggc

SEQ ID NO: 308251 - RNA, 64 nt, hsa
ccaauccggagaaggggcucuguccacagucccccgccgccagguggcccacaugggaccagca

SEQ ID NO: 308252 - RNA, 64 nt, hsa
ggcugcccagggcuggaggggacgcuguuccucccgccgccacugcccaaccuuuccugauaau

SEQ ID NO: 308253 - RNA, 64 nt, hsa
gggccagcacggaccacccaaggccucugcuucccgccgccacccuccucgcugccauucucug

SEQ ID NO: 308254 - RNA, 64 nt, hsa
cgccaucccugcaggccagggcacacggugcgcccgccgccagcuccucggaggccagacccag

SEQ ID NO: 308255 - RNA, 64 nt, hsa
agccagguguguguacauacggggucucucuccacgccgccaagccagccgggcggccgacccg

SEQ ID NO: 308256 - RNA, 59 nt, hsa; identical to SEQ ID NO: 214234

SEQ ID NO: 308257 - RNA, 64 nt, hsa
ccucaccagaggaugccaccuccgcccccacccccgccgccagaggaguacaagagccagaggc

SEQ ID NO: 308258 - RNA, 64 nt, hsa
ucgacccucgggccucgggggggagggcccugcacgccgccacccccuccccgcagcccucacc

SEQ ID NO: 308259 - RNA, 64 nt, hsa; identical to SEQ ID NO: 126154

SEQ ID NO: 308260 - RNA, 64 nt, hsa; identical to SEQ ID NO: 126155

SEQ ID NO: 308261 - RNA, 64 nt, hsa; identical to SEQ ID NO: 126156

SEQ ID NO: 308262 - RNA, 64 nt, hsa; identical to SEQ ID NO: 126157

SEQ ID NO: 308263 - RNA, 64 nt, hsa; identical to SEQ ID NO: 126158

SEQ ID NO: 308264 - RNA, 64 nt, hsa; identical to SEQ ID NO: 126159

SEQ ID NO: 308265 - RNA, 64 nt, hsa; identical to SEQ ID NO: 61376

SEQ ID NO: 308266 - RNA, 64 nt, hsa; identical to SEQ ID NO: 61377

SEQ ID NO: 308267 - RNA, 64 nt, hsa; identical to SEQ ID NO: 61378

SEQ ID NO: 308268 - RNA, 64 nt, hsa; identical to SEQ ID NO: 61379

SEQ ID NO: 308269 - RNA, 64 nt, hsa; identical to SEQ ID NO: 61380

SEQ ID NO: 308270 - RNA, 64 nt, hsa; identical to SEQ ID NO: 61381

SEQ ID NO: 308271 - RNA, 64 nt, hsa; identical to SEQ ID NO: 61382

SEQ ID NO: 308272 - RNA, 64 nt, hsa; identical to SEQ ID NO: 61383

SEQ ID NO: 308273 - RNA, 64 nt, hsa; identical to SEQ ID NO: 61384

SEQ ID NO: 308274 - RNA, 64 nt, hsa; identical to SEQ ID NO: 61384

SEQ ID NO: 308275 - RNA, 64 nt, hsa; identical to SEQ ID NO: 61386

SEQ ID NO: 308276 - RNA, 64 nt, hsa; identical to SEQ ID NO: 61387

SEQ ID NO: 308277 - RNA, 64 nt, hsa; identical to SEQ ID NO: 61388

SEQ ID NO: 308278 - RNA, 64 nt, hsa; identical to SEQ ID NO: 61389

SEQ ID NO: 308279 - RNA, 64 nt, hsa
cauuaguuuggggggcccucuucuuaaaguggggaucuugaaccauccuuucuuuuguauuccc

SEQ ID NO: 308280 - RNA, 64 nt, hsa
auguuuacugcuaaaaaccaaagcuuuguguaaaaucuugaauuuauggggcgggaggguagga

SEQ ID NO: 308281 - RNA, 64 nt, hsa
ugguguuccgauuuucacauccuuccauguauuuaucuugaagagauaagcacagaagagaagg

SEQ ID NO: 308282 - RNA, 64 nt, hsa
uuggcaaccauauugucaccuguaccugucacacaucuugaaaaauaaaacgauaauagaacua

SEQ ID NO: 308283 - RNA, 64 nt, hsa
augaaaacuauuuuaaagcugacuuuguugccuuaucuugaaaagaaucuagauaggugcuuuu

SEQ ID NO: 308284 - RNA, 64 nt, hsa
accuuaaaucugccuuuguuucuaaagguagaucaucuugaauauuugcuuaaaauugcuagug

SEQ ID NO: 308285 - RNA, 64 nt, hsa
aaguggccuuaaauaugaguagugaauugagaacaucuugaauucuuaaaagacuucuuaguga

SEQ ID NO: 308286 - RNA, 64 nt, hsa
uugcauguauguguauuuacaaauuuuucuaaguaucuugaauucucagacugcaaaaggccua

SEQ ID NO: 308287 - RNA, 64 nt, hsa
acccaaauaaaaugauuaaaguucugauggaaaaaucuugaauggaguauaaguuuuccguugu

SEQ ID NO: 308288 - RNA, 64 nt, hsa
aagccucugugauguuacauauggaaaugguugaaucuugaaaaaucuaaaauuguugcaaaac

SEQ ID NO: 308289 - RNA, 64 nt, hsa
guguuuauugucaaaguggugagaggcauccaguaucuugaagacuuuucuuucagccaagaau

SEQ ID NO: 308290 - RNA, 64 nt, hsa
cuuucagccaagaauucuuaaauauguggaguucaucuugaauuguaaggaaugauuaauuaaa

SEQ ID NO: 308291 - RNA, 64 nt, hsa
gagaccccucccagcuuuguuugagauccugaaaaucuugaagaagguauuccucaccuuucuu

SEQ ID NO: 308292 - RNA, 64 nt, hsa
ggaaaacagccuguugcaugguaagagugauaccaucuugaagugaaaccaccacaauggccau

SEQ ID NO: 308293 - RNA, 64 nt, hsa
uaaugcuuuuacaggaaaacuaaagaaacugucaaucuugaagguggaucagaauagacucaca

SEQ ID NO: 308294 - RNA, 64 nt, hsa
auaacaaaaauauguauuucuuuuuuguuauuuuaucuugaaaacgguacauauuuuaguauuu

SEQ ID NO: 308295 - RNA, 64 nt, hsa
ucugacguguaaaggaccauaagguacaucauuuaucuugaacauuccgacguguaacucacag

SEQ ID NO: 308296 - RNA, 64 nt, hsa
gucuuccuuucaaggaccauaagguacaucaguuaucuugaacauucugacguguaaaggacca

SEQ ID NO: 308297 - RNA, 64 nt, hsa
aaggcuuuuauuaagaaaacagcagaaagauuaaaucuugaauuaagucuggggggaaauggcc

SEQ ID NO: 308298 - RNA, 64 nt, hsa
ugugggugugccuaucauaacaauuguuuucuguaucuugaaaaaguauucuccacauuuuaaa

SEQ ID NO: 308299 - RNA, 64 nt, hsa
ucuuacaccaacccccacuuggcuguuggcugucaucuugaacucuauuugaaugugacuuaaa

SEQ ID NO: 308300 - RNA, 64 nt, hsa
aucacaggaguuuagaaagacucugccucccagcaucuugaauaucuccagccuguucacuguu

SEQ ID NO: 308301 - RNA, 64 nt, hsa
uugcacacuuuaaaguguaaaaucauuuuuuaaaaucuugaauccacaaauaaaguucuauucu

SEQ ID NO: 308302 - RNA, 64 nt, hsa
gaacuacuaaaauguggccacugagucuucccagaucuugaagaaaaucauauaaaaagcauuu

SEQ ID NO: 308303 - RNA, 64 nt, hsa
guacaagucacauuucauuuugauugaauacaugaucuugaacagcuccuguacuugcucuuug

SEQ ID NO: 308304 - RNA, 64 nt, hsa
augaggccacauucagcugcuauuuaaacuuaauaucuugaaccuaaagaaugcugacuuuucc

SEQ ID NO: 308305 - RNA, 64 nt, hsa
uucuuuugacagcuuaucagucuguaggagaaugaucuugaaauguuaacccugacuaaaauuu

SEQ ID NO: 308306 - RNA, 64 nt, hsa
ccugcagcucugcucucgggauggugcuuccuuuaucuugaaggguggcacauguuugcagcug

SEQ ID NO: 308307 - RNA, 64 nt, hsa
cccuaccuuccaacccaggucaagacauugccaaaucuugaacucagaacccaaguguuccaug

SEQ ID NO: 308308 - RNA, 64 nt, hsa
ccccaaacuggggccuggagcaaggcacucucaaaucuugaacccuggaccaaagcuuuuccag

SEQ ID NO: 308309 - RNA, 64 nt, hsa
agauguuuguggauguagcacugaguggugauacccagaccagcagucaccccaggaagugggg

SEQ ID NO: 308310 - RNA, 64 nt, hsa
guuguucauuuggggcuccaguuuuugugcauuuccagaccagggucccugucugggagcucag

SEQ ID NO: 308311 - RNA, 64 nt, hsa
ccggccgcgggucucccggcccaaccccaccgacccagaccaagaccgcgccgagccgccggga

SEQ ID NO: 308312 - RNA, 64 nt, hsa
auggaaaucugaaaggagugugcucaugccauuuccagaccaagaaaauacauuuauuauuugc

SEQ ID NO: 308313 - RNA, 64 nt, hsa
aguggauguggaggagugaccagaccagaccagaccagaccagagggaucggaggcucaggccc

SEQ ID NO: 308314 - RNA, 64 nt, hsa
guggaaguggauguggaggagugaccagaccagaccagaccagaccagagggaucggaggcuca

SEQ ID NO: 308315 - RNA, 64 nt, hsa
aagggguggaaguggauguggaggagugaccagaccagaccagaccagaccagagggaucggag

SEQ ID NO: 308316 - RNA, 64 nt, hsa
caaugaagggguggaaguggauguggaggagugaccagaccagaccagaccagaccagagggau

SEQ ID NO: 308317 - RNA, 64 nt, hsa
cugugucucugaauuccugucuuccaaauugaagccagaccaugcugaugaccucaaguagcac

SEQ ID NO: 308318 - RNA, 64 nt, hsa
auaucaaaauaggauuucuuaaauuuuucaacccccagaccauacugacucaacauggagucuc

SEQ ID NO: 308319 - RNA, 64 nt, hsa
agaugggugcugguccuguugaucccagucucugccagaccaaggcgaguuuccccacuaauaa

SEQ ID NO: 308320 - RNA, 64 nt, hsa
acggugugccccuacgcagguacagccgccgcuuccagaccauugacaucgagccugacaucga

SEQ ID NO: 308321 - RNA, 64 nt, hsa
cucccugauagaugcugagagcauccagaaacuuccagaccagcccucucaccacacccagaag

SEQ ID NO: 308322 - RNA, 64 nt, hsa
ccagaagaggccuuucccaucuggagagaagcuuccagaccagcccuucacacaccacagccag

SEQ ID NO: 308323 - RNA, 64 nt, hsa
ccaggaggggccuuucccaccuggagagaaacuuccagaccagccccucauaccacagccaaga

SEQ ID NO: 308324 - RNA, 64 nt, hsa
ccaagaggggccuuucucaccuggagagaaauuuccagaccauccccucucaccacagccagga

SEQ ID NO: 308325 - RNA, 64 nt, hsa
ccaggagaggccuuucccaccgguagagaaacuuccagaccagccccucacaccacagccaaga

SEQ ID NO: 308326 - RNA, 64 nt, hsa
ccaagagaagccuuuccagccuggagagaaacuuccagaccagcccucucacuacagccaggag

SEQ ID NO: 308327 - RNA, 64 nt, hsa
ccaggagaggccuuucccaccuggacagaaacuuccagaccagccccucucaccacagccagga

SEQ ID NO: 308328 - RNA, 64 nt, hsa
ccaggagaggccuuuaccaccuggagagaagcuuccagaccagccccucacaccacagccagga

SEQ ID NO: 308329 - RNA, 64 nt, hsa
ccaggagaggccuuucccaccuggagagaaacuuccagaccagccccucauaccacagccaaga

SEQ ID NO: 308330 - RNA, 64 nt, hsa
ccaagaggggccuuucucaccuggagagaaacuuccagaccagccccucacaccaccgccagga

SEQ ID NO: 308331 - RNA, 64 nt, hsa
ccaggagaggccuuucccaccgggagagaaacuuccagaccagccccucacaccacagccagga

SEQ ID NO: 308332 - RNA, 64 nt, hsa
ccaggagaggccuuucccaccgggagagaaacuuccagaccagcccucucacuacagccagaag

SEQ ID NO: 308333 - RNA, 64 nt, hsa
ccagaagaggccuuucccaccgggagaggaacuuccagaccagccccucacaccacagccagga

SEQ ID NO: 308334 - RNA, 64 nt, hsa
ccaggagaggccguuccugccuggagagaagcuuccagaccagcccuucacaccacagccagga

SEQ ID NO: 308335 - RNA, 64 nt, hsa
ccaggagaggccuuucccaccuggagagaaacuuccagaccagccccucucaccacagccagga

SEQ ID NO: 308336 - RNA, 64 nt, hsa
cugcccucucaccucugacacccagccccaggagccagaccacuccugccuccaccucugacuc

SEQ ID NO: 308337 - RNA, 64 nt, hsa
gugaugaugguguccuuuagggcucuuggagcagccagaccauguuuccaagagaaaccuggug

SEQ ID NO: 308338 - RNA, 64 nt, hsa
ugcugggauuacaggcgugagccacugcgccuggccagaccauuuuagaauugggaaauuuuag

SEQ ID NO: 308339 - RNA, 64 nt, hsa
auuaaggauuuacugaauaagguguugaccaaauccagaccauuuuauuuuauuuuuuuauuua

SEQ ID NO: 308340 - RNA, 64 nt, hsa
aacagccagcuuuggcgcuguuggggagacuccuccagaccaggaaccccagaaggagacagag

SEQ ID NO: 308341 - RNA, 64 nt, hsa
gcuccguuguucccuugcccugguggugggggggccagaccaccuccggaauccugccaccugu

SEQ ID NO: 308342 - RNA, 64 nt, hsa
aagaucacauuucugggaagaugagaacuuguuuccagaccagcauccaguggccaucaggucu

SEQ ID NO: 308343 - RNA, 64 nt, hsa
cuuuaggacagcuuagaugccgagugggcgaaugccagaccaaugauacccagagcuaccugcc

SEQ ID NO: 308344 - RNA, 64 nt, hsa
gggcaccguguaugcccuggcggucaucucgacgccagaccagaccaaagucuucagugcaucc

SEQ ID NO: 308345 - RNA, 64 nt, hsa
ccguguaugcccuggcggucaucucgacgccagaccagaccaaagucuucagugcauccuacga

SEQ ID NO: 308346 - RNA, 64 nt, hsa
gagcugugcucccuugagugcacuugagcacuccccagaccagaucacuuuuuggacacaccca

SEQ ID NO: 308347 - RNA, 64 nt, hsa
ccacugggcuccccccgggguugaaacggguuucccagaccagggguucagaggagacuauuua

SEQ ID NO: 308348 - RNA, 64 nt, hsa
ggccagcucagggcuuccugcgggugacugucgcccagaccaggugccauucaugacuaaucag

SEQ ID NO: 308349 - RNA, 64 nt, hsa
agucaaaggacugggcaccugccucugacagacaccagaccagguccagggccuccuccacagc

SEQ ID NO: 308350 - RNA, 64 nt, hsa
aaacugagcaguuucuguguauauauagaagguagaaaugaaaagugagaaaauauuugaaagg

SEQ ID NO: 308351 - RNA, 64 nt, hsa
aaaacagagauaugugcaugaaaucaagaaaaaagaaaugaacaaaagcaaagcauuaguggcu

SEQ ID NO: 308352 - RNA, 64 nt, hsa
cuguguuauccuaguuugaacaggauauguucaggaaaugaaaggugaauuaugccccuuauug

SEQ ID NO: 308353 - RNA, 64 nt, hsa
ucuuauuugacauuucguagguguaagagaaauggaaaugaaugguuucaacaaagaucauuua

SEQ ID NO: 308354 - RNA, 64 nt, hsa
auuucucauuuaacuuuacuguuaagacaucacugaaaugaacuucaguaagcuuucaauuuug

SEQ ID NO: 308355 - RNA, 64 nt, hsa
uuucugauuucuuggagcaggaauuuuagagauugaaaugaaugaucauuuagucagauuuauc

SEQ ID NO: 308356 - RNA, 64 nt, hsa
gaaaagaaaaaucaugucaucuucuauuuguacagaaaugaaaauaaaauaugaaaauaaugaa

SEQ ID NO: 308357 - RNA, 64 nt, hsa
acagaaaugaaaauaaaauaugaaaauaaugaaagaaaugaaaagauagcuuuuaauuguggua

SEQ ID NO: 308358 - RNA, 57 nt, hsa
uuaccauggaaacugagugaaugguuugaaaugaagacuuugucguguacuuaggaa

SEQ ID NO: 308359 - RNA, 64 nt, hsa
caccaccuaaauguaauguugauuccucaagaaugaaaugaaggcacuacauugaaauauguuu

SEQ ID NO: 308360 - RNA, 64 nt, hsa
aaagacaauaaagaccuccaaggguacuucuuuggaaaugaaauguagcacaaucuuagccuac

SEQ ID NO: 308361 - RNA, 64 nt, hsa
gcccacaggacaagaaguggguaagggcaggaaggaaaugaacggaguuagcucccaggcuccu

SEQ ID NO: 308362 - RNA, 64 nt, hsa
aaaaauaaaguuaagucugagacucuaaggaggugaaaugaaucccaaaugcauuuuuuaacua

SEQ ID NO: 308363 - RNA, 64 nt, hsa
gcccuauuuaaaaaagagcaguacauccugggaggaaaugaaacuaaagaacaguuagaguaac

SEQ ID NO: 308364 - RNA, 64 nt, hsa
aauaaauaaggauggugauagagagguugaagaagaaaugaagaagcaugaaaguaauaaugug

SEQ ID NO: 308365 - RNA, 64 nt, hsa
uauuuuccagcuagaaaauuuuauggcuaucgaagaaaugaagaagcacggaaguacucauguc

SEQ ID NO: 308366 - RNA, 64 nt, hsa
gaccuaagguguugguauuuuccaggugucgggggaaaugaacuggugaagggguuuuguaaag

SEQ ID NO: 308367 - RNA, 64 nt, hsa
cauguaauguguacagucuuugcaguuccaccaagaaaugaacuugguaccugcagaguggcug

SEQ ID NO: 308368 - RNA, 64 nt, hsa
aucuuuaugcuaauagauuuggaauuuuugaaaugaaaugaaaccuuguuuaaacauuaaaauu

SEQ ID NO: 308369 - RNA, 64 nt, hsa
guuacaucuuuaugcuaauagauuuggaauuuuugaaaugaaaugaaaccuuguuuaaacauua

SEQ ID NO: 308370 - RNA, 64 nt, hsa
acuaaguauaccaaaauaauugacucuauuaucugaaaugaagaauaaacugaugcuaucucaa

SEQ ID NO: 308371 - RNA, 64 nt, hsa
cauuuauguuccuauauauuacaacaucggcgaggaaaugaaagcgauucuccuugaguucuga

SEQ ID NO: 308372 - RNA, 64 nt, hsa
aacuuaaaucacaguuuguuauuaaguaauaucugaaaugaauuagaaagaaaccauaagccuu

SEQ ID NO: 308373 - RNA, 64 nt, hsa
ccuuaggcuuaugaauucaaaaaaaaaaauagaagaaaugaacaaaaacuuaaaucacaguuug

SEQ ID NO: 308374 - RNA, 64 nt, hsa
gaaaccuuggaagcccucuuaugagcgaauucaggaaaugaaagcuaaaacaacccauuugcua

SEQ ID NO: 308375 - RNA, 64 nt, hsa
ugcuguggaaguuaagguguugaccacugugccugaaaugaaaccacaaggcuugagaauagaa

SEQ ID NO: 308376 - RNA, 64 nt, hsa
guccacgcaauggaacauuauuagacucuaaaaagaaaugaaguacucacacaugccacaacau

SEQ ID NO: 308377 - RNA, 64 nt, hsa
cccaggaaugccacuccuagguauuuacccaagagaaaugaaaacguacauacacacaaaaacu

SEQ ID NO: 308378 - RNA, 64 nt, hsa
aaagagagaugccguguuuugaaaguaagaugaugaaaugaauuuuuaauucaagaaacauuca

SEQ ID NO: 308379 - RNA, 64 nt, hsa
cagcuccacuggguccccuuugguuguaggacaggaaaugaaacauuaggagcucugcuuggaa

SEQ ID NO: 308380 - RNA, 64 nt, hsa
uagaaccuaggguuucuaauugacuugauuucuggaaaugaaaacccgcgcuuuuauuauggga

SEQ ID NO: 308381 - RNA, 64 nt, hsa
aauagauugaguucuguaagggcaaaaacggauugaaaugaacauagcguuuugcacuaaugau

SEQ ID NO: 308382 - RNA, 64 nt, hsa
aaaguuuguauaaacagguugcuauaagcuuggugaaaugaaaauggaacauuucaaucaaaca

SEQ ID NO: 308383 - RNA, 64 nt, hsa
uacaauagguucuaaaaauaaaauugcuaaacaagaaaugaaaacauggagcauuguuaauuua

SEQ ID NO: 308384 - RNA, 64 nt, hsa
ucaaaguguauucaaguagguuuucugaaauauagaaaugaaauuuaucuucuguuuuggucuc

SEQ ID NO: 308385 - RNA, 64 nt, hsa
cuggaaauaaauuaccuaucccauguuucagugggaaaugaacuacauauugagaugcugacag

SEQ ID NO: 308386 - RNA, 64 nt, hsa
aaaaaaaaauggcuuaucugaaaucaguacuguggaaaugaacuauauuagcuauuaugaauaa

SEQ ID NO: 308387 - RNA, 64 nt, hsa
uaauaaaguaggcauuuguuuauuuuguaaaaaagaaaugaaaaucugcuggccagcuaugucc

SEQ ID NO: 308388 - RNA, 64 nt, hsa
cagcauggcauuuauuugugugaguguuuauauagaaaugaacauagaccuggccaguaaaagg

SEQ ID NO: 308389 - RNA, 64 nt, hsa
aaaaaauugcacugaaaugcugacaaaaaauaaugaaaugaaguggcuuccaaaauaugcacug

SEQ ID NO: 308390 - RNA, 64 nt, hsa
guagaugugauagugccgugaauguauucuacuggaaaugaauguaauaauacauuaaauuuuu

SEQ ID NO: 308391 - RNA, 64 nt, hsa
auuaaacugaugaugaagaaaguuccugauuugagaaaugaaucaaaguaauuuuaaugaauuu

SEQ ID NO: 308392 - RNA, 64 nt, hsa
aaguuucaugucuguacagauuauuuaaaucauggaaaugaaaaaaauguucucugcuugcuac

SEQ ID NO: 308393 - RNA, 64 nt, hsa
uguucucugcuugcuaccaaaggacaaacucuuggaaaugaacacuuucugcuuuccuuccucc

SEQ ID NO: 308394 - RNA, 64 nt, hsa
uguuuaauaagagcaaauauaggggaaaaucuuugaaaugaaagcuacaaauacaugugagaag

SEQ ID NO: 308395 - RNA, 64 nt, hsa
cuggggcuggcuaggccuccacuuguccaucugugaaaugaaaggaucagccuggacagcccuc

SEQ ID NO: 308396 - RNA, 64 nt, hsa
uucugugaauguaccuuuuuuauuaacagggaaagaaaugaauuaauuugauaugcucuaaaua

SEQ ID NO: 308397 - RNA, 64 nt, hsa
uaguccgauggauccuggauugauacaagguugagaaaugaaugcuccuggccuuaaacaucac

SEQ ID NO: 308398 - RNA, 64 nt, hsa
uuaguuuacaguuuagcauaaacaaauaguaguagaaaugaaugcauuuauucauuccuuccuu

SEQ ID NO: 308399 - RNA, 64 nt, hsa
ucaaaaauaguaucugaagauacugaaucaucaugaaaugaacucuacuucuggccaaagcaca

SEQ ID NO: 308400 - RNA, 64 nt, hsa
aauggcuugaaacuuguguaucauaugugauuuugaaaugaacaccuugaauagcacuaauuuu

SEQ ID NO: 308401 - RNA, 64 nt, hsa
aauuuugugacuguuaccaugugaaaguccuguugaaaugaacaauugucugccccacaaucaa

SEQ ID NO: 308402 - RNA, 64 nt, hsa
auucaacuuauuguaaauuuugagauuuuauuuagaaaugaauugucuaauuaauuuauguaga

SEQ ID NO: 308403 - RNA, 64 nt, hsa
cuucuguuuugccuuuucacgcccuuuauagugugaaaugaaaaauuagucacuuccucacaug

SEQ ID NO: 308404 - RNA, 64 nt, hsa
uuggucugcagucuggaagcuugucugcucuauagaaaugaaaaugcagcaugaaguugacauu

SEQ ID NO: 308405 - RNA, 64 nt, hsa
agaaaugaaaaugcagcaugaaguugacauuguggaaaugaaaguaauuggguauuagaaaucu

SEQ ID NO: 308406 - RNA, 64 nt, hsa
gcaugauauuuacuguuuuguugucuggguuugagaaaugaaauauuguuuccaauuauuuaua

SEQ ID NO: 308407 - RNA, 64 nt, hsa
auuacucugauuuuugauacaguuuucagaaaaagaaaugaacauaaucaaguaaggauguaug

SEQ ID NO: 308408 - RNA, 64 nt, hsa
guauuuuuauaaccccauugagaagacuaaguaagaaaugaaauguccuaucaauuuuauuuug

SEQ ID NO: 308409 - RNA, 64 nt, hsa
ggcguacuuuguuuauccauuggccaaccugaaggaaaugaaacucaccuaucuuucuaucaca

SEQ ID NO: 308410 - RNA, 64 nt, hsa
cugccagacugagggugcuuuuuggggggugggagaaaugaacugacagauaaacaguaacuca

SEQ ID NO: 308411 - RNA, 64 nt, hsa
caaugcuguugacaguggaauucaccuuacaauagaaaugaacaagucugcuaccucuucaucc

SEQ ID NO: 308412 - RNA, 64 nt, hsa
gcuccccuaauucagugugccagcuuacaauguggaaaugaaagcuaauuuauacacagcaggc

SEQ ID NO: 308413 - RNA, 64 nt, hsa
ccuuucgaucguguauuuauguagguuuaucagugaaaugaaaggcuuguuuccgucuagucua

SEQ ID NO: 308414 - RNA, 64 nt, hsa
ucuuccucaucaucccuuugagaauaaaagucuagaaaugaaacacaauccugacaaguuugga

SEQ ID NO: 308415 - RNA, 64 nt, hsa
cucucacgguuuuuugcagaagcaagugcucagggaaaugaagacaggagaacugcugccguca

SEQ ID NO: 308416 - RNA, 64 nt, hsa
ugcagacaauucucccugagguuagcccaauggagaaaugaagcagaggaaggaaacauagaaa

SEQ ID NO: 308417 - RNA, 64 nt, hsa
uaauuucuaggcagguggagagagugguaaaaaagaaaugaaauugacaagcuaggaaagagga

SEQ ID NO: 308418 - RNA, 64 nt, hsa
uugcuuauguugcuuuuucacaugcuuaaugauggaaaugaaauguuaaaucaacaaaauaaga

SEQ ID NO: 308419 - RNA, 64 nt, hsa
guuuuuagaaaauaauucucaucuuuuuucuaaagaaaugaauuuguggcuggucugaagguag

SEQ ID NO: 308420 - RNA, 64 nt, hsa
uauauacguuuuguauaucauuaaaucuuuaaaagaaaugaaauaaauuuauuguuuacagaug

SEQ ID NO: 308421 - RNA, 64 nt, hsa
uuauuggcagcuguuuuauugccauucaacuagggaaaugaagaaaucacgcagccuuuugguu

SEQ ID NO: 308422 - RNA, 64 nt, hsa
agugacuccagaagaaaugagccuccaccaccaagaaaugaacuuagagaaucagacaggcgag

SEQ ID NO: 308423 - RNA, 64 nt, hsa
aaccuuucagguaaaaggugaucccucuaagaaagaaaugaagaaagaaaaugaugaaaagagu

SEQ ID NO: 308424 - RNA, 64 nt, hsa
cuugucaaagagagaaggucggguacuucaagaagaaaugaaagaagggacagacauguucauc

SEQ ID NO: 308425 - RNA, 64 nt, hsa
gagggacaggaggaaaaugaaaccuguucugguggaaaugaaaaccaagagcuacaagauggcu

SEQ ID NO: 308426 - RNA, 64 nt, hsa
auauuucguucucuccccauggggcacugacagagaaaugaaauaguuuuaucuggaaaauucc

SEQ ID NO: 308427 - RNA, 64 nt, hsa
gccaugaagaagugcuuccguggccgacagucuggaaaugaauccaucauacauuagugccaua

SEQ ID NO: 308428 - RNA, 64 nt, hsa
gguugaauugauuuuuaaacacauauaacaguaggaaaugaauaaaugggcuucugcauuuggc

SEQ ID NO: 308429 - RNA, 64 nt, hsa
gccaugccuuuuaagcauguguaaaauuuuuaaagaaaugaacauacacauaguuauuuuagua

SEQ ID NO: 308430 - RNA, 64 nt, hsa
ccucuuuguaaucacagggcagggaucagaguuugaaaugaaauguugucaggguguuggaaaa

SEQ ID NO: 308431 - RNA, 64 nt, hsa
agaugagccuacuugugagcgaugugacuuuaaggaaaugaagacuggggaagaauaauuagug

SEQ ID NO: 308432 - RNA, 64 nt, hsa
guucccguuaacaaauuacggccucugcuugcuggaaaugaaauauaguuuaagaccaaacauu

SEQ ID NO: 308433 - RNA, 64 nt, hsa
cuccugaauaaaacaacauccaacccaggucauugaaaugaaauuggccagucaaaaaaaaaaa

SEQ ID NO: 308434 - RNA, 64 nt, hsa
uccaagacacauaauugucagauucaccaaaguugaaaugaaggaaaaaauguuaagggcagcc

SEQ ID NO: 308435 - RNA, 64 nt, hsa
caaccugcuccugaaugacuacuggguacauaacgaaaugaaggcaggaauaaagauguucuuu

SEQ ID NO: 308436 - RNA, 64 nt, hsa
guuuaaaaucaaaaccaaaauuauagacuauguagaaaugaaugacagugagaugccugcacau

SEQ ID NO: 308437 - RNA, 64 nt, hsa
aauaaaagaucguaugauaugagauacauacuaugaaaugaagauagacacauuuggauuaaaa

SEQ ID NO: 308438 - RNA, 64 nt, hsa
gaaauuuaaaauguuuacggcgcuuaauugccuggaaaugaaaugaaaucaaauuuaucaguuu

SEQ ID NO: 308439 - RNA, 64 nt, hsa
uuaaaauguuuacggcgcuuaauugccuggaaaugaaaugaaaucaaauuuaucaguuuuuuuc

SEQ ID NO: 308440 - RNA, 64 nt, hsa
aauuuuuuuuaaguucacuuuuuuuguucuaggggaaaugaaugugcaaaaaaagaaaaagaac

SEQ ID NO: 308441 - RNA, 64 nt, hsa
ugugcagauaaacagaaaugcucugauuagaaaggaaaugaaugguuccacucaaauguccugc

SEQ ID NO: 308442 - RNA, 64 nt, hsa
gcccuaugaaaaaauacccaauauauauuuuuuggaaaugaaacauuaaaagaacuuaaaaagu

SEQ ID NO: 308443 - RNA, 64 nt, hsa
uuugaugugcuacaagccucaugaaagaacaaaagaaaugaagccuuuugauaugcauucgcua

SEQ ID NO: 308444 - RNA, 64 nt, hsa
ugagccaccuugcccagcccacaucauacaguuugaaaugaaacuuugccacaaccagccuuug

SEQ ID NO: 308445 - RNA, 64 nt, hsa
auguugcuuuaucuuugaaauuuugcaugaaaaggaaaugaauggauucgaaugaaauuguccu

SEQ ID NO: 308446 - RNA, 64 nt, hsa
uguuugguuuuaugugcagcaccuugacuucuaagaaaugaaucaugucccuuugccccuuaua

SEQ ID NO: 308447 - RNA, 64 nt, hsa
auaaauacagucuuaaaccuuuaugucugagucugaaaugaaccuguucacuuagacuagauuu

SEQ ID NO: 308448 - RNA, 64 nt, hsa
cccagcaguugugcuccuggacauucauuccagagaaaugaaaaccuauauuguacuuguacuc

SEQ ID NO: 308449 - RNA, 64 nt, hsa
auuuauauaacauucuugaggugacaaaauuauugaaaugaagaacagauuaaugguugccagg

SEQ ID NO: 308450 - RNA, 64 nt, hsa
agcacacacuggcucaagcagcagagguaagaggaagaggcagcagcaucccaagaaggaaaga

SEQ ID NO: 308451 - RNA, 64 nt, hsa
cagggcauaugcugacccaugcagccgaagaaagaagaggcagcaacaggaggaggaggacuug

SEQ ID NO: 308452 - RNA, 64 nt, hsa
cuaagaucaaagucaacaacacucgguccccuugaagaggcaacucucugaacccgucucugac

SEQ ID NO: 308453 - RNA, 64 nt, hsa
cccaggaaacagacgcgugaaaacugagccccagaagaggcacacuugacggcacaggaaguca

SEQ ID NO: 308454 - RNA, 64 nt, hsa
uugugcccuggagugggguuucuccuuguugaagaagaggcauccuucucugaugugcacaaac

SEQ ID NO: 308455 - RNA, 64 nt, hsa
uuacagcaguagugggcucuggaaugcccaagggaagaggcaagguggggccugcagccuggac

SEQ ID NO: 308456 - RNA, 64 nt, hsa
ucgguaggaauuggagccgguguaauuccucccuaagaggcaaccuguugaauuuacucucuca

SEQ ID NO: 308457 - RNA, 64 nt, hsa
ugggaaauugauuaaaggggcugucucccaaugaaagaggcauucccagaauuugcugcauuua

SEQ ID NO: 308458 - RNA, 64 nt, hsa
ucuuuuugaucucacacaccagggcauucccccuaagaggcagugagauguagccuggcccugg

SEQ ID NO: 308459 - RNA, 64 nt, hsa
ggagggaauuugaagaaaggaacugaggcccagaaagaggcagugauuugccaaagugacacag

SEQ ID NO: 308460 - RNA, 64 nt, hsa
gcucagccacacaggaagaaagucuugguuacuuaagaggcagagaagccccuaggcaaagacu

SEQ ID NO: 308461 - RNA, 64 nt, hsa
cuccuuccuuuaggcugugcucuugccugucacaaagaggcaacguagccacugccucccuaug

SEQ ID NO: 308462 - RNA, 64 nt, hsa
ccggcacuggucagggagucugggaagaguggagaagaggcagggucaggccucagcaucucac

SEQ ID NO: 308463 - RNA, 64 nt, hsa
cuggaugcuuauaucaauuuaggaaaugucuugaaagaggcacgcauuuuugacaggugagaga

SEQ ID NO: 308464 - RNA, 64 nt, hsa
cuagccaauaucaaacgagaacagggaaacauugaagaggcaguucgcuuguaucguaaagcau

SEQ ID NO: 308465 - RNA, 64 nt, hsa
augagguuuugccaagcaagaacucuugauuacuaagaggcaguuagagacaaaccaauuuaau

SEQ ID NO: 308466 - RNA, 64 nt, hsa
uuaauauuugaauuauuacuuagcacauggauauaagaggcacuuuauuagaauuugacaacgu

SEQ ID NO: 308467 - RNA, 64 nt, hsa
ucucugugagggaccuccccggccuucggcggagguggaguaagcuccgucaaggcagguggcu

SEQ ID NO: 308468 - RNA, 64 nt, hsa
gugucaggaaggcaggggugccgggucccacccaguggaguaacaaacuguggguggcguuugg

SEQ ID NO: 308469 - RNA, 64 nt, hsa
guaccuguuggcaggagaaggccagauggaguauguggaguaauagggaaagaagaguuacaga

SEQ ID NO: 308470 - RNA, 64 nt, hsa
cucugaaaucaaaaugcuacgccauuauaagccaguggaguaauuacaauguauuggaugaaaa

SEQ ID NO: 308471 - RNA, 64 nt, hsa
aucccagcuacucgagaggccaaggcaggagaauugcuagaaccugggggugugaagguuucag

SEQ ID NO: 308472 - RNA, 64 nt, hsa
ccaggcaaaggaacaaaacuggugcagacccagcugcuagaaggagcagagagcauuugaggag

SEQ ID NO: 308473 - RNA, 64 nt, hsa
cccccuguaaauuauuuugcuuuugaccagguugugcuagaaaguagggcugcuucugugaguu

SEQ ID NO: 308474 - RNA, 64 nt, hsa
gaaauaaaaacaaaaaacaagaagcaaguuguacugcuagaaacuucucuaagauaagaggcca

SEQ ID NO: 308475 - RNA, 64 nt, hsa
ugaaccagcagagcuguguuauauuuucuaucuuugcuagaacuucgucauugaaggacaauuu

SEQ ID NO: 308476 - RNA, 64 nt, hsa
gcuggucuacuaggcagccuuugugccacuucagugcuagaaaguuaaagaaaaaaaaacuuuu

SEQ ID NO: 308477 - RNA, 64 nt, hsa
caagagccugauuuuuugaggccaguaauucguuugcuagaauugauuuuuuuucucucucucu

SEQ ID NO: 308478 - RNA, 64 nt, hsa
uuuccagaagccuccccugccuggcugacugccuugcuagaaacauaauuuuuuuuuucucacu

SEQ ID NO: 308479 - RNA, 64 nt, hsa
gcagacagggucggagguguuagcgagccuuuggugcuagaagccugcggggucaugugcuaag

SEQ ID NO: 308480 - RNA, 64 nt, hsa
aggcggagggacugaagccauugcguuccuucccugcuagaaacacaggaagaaguugaggacu

SEQ ID NO: 308481 - RNA, 64 nt, hsa
aaauaguggauugggcagacuggccuggaggaaaugcuagaacagagggaaaggaggcuggaga

SEQ ID NO: 308482 - RNA, 64 nt, hsa
gaggccuggauuggauucgguaaaaagaggggguugcuagaaggaaaaacaggugugaccugau

SEQ ID NO: 308483 - RNA, 64 nt, hsa; identical to SEQ ID NO: 172363

SEQ ID NO: 308484 - RNA, 64 nt, hsa; identical to SEQ ID NO: 172364

SEQ ID NO: 308485 - RNA, 64 nt, hsa; identical to SEQ ID NO: 172365

SEQ ID NO: 308486 - RNA, 64 nt, hsa; identical to SEQ ID NO: 172366

SEQ ID NO: 308487 - RNA, 64 nt, hsa; identical to SEQ ID NO: 172367

SEQ ID NO: 308488 - RNA, 64 nt, hsa; identical to SEQ ID NO: 172368

SEQ ID NO: 308489 - RNA, 64 nt, hsa; identical to SEQ ID NO: 243440

SEQ ID NO: 308490 - RNA, 64 nt, hsa; identical to SEQ ID NO: 243441

SEQ ID NO: 308491 - RNA, 64 nt, hsa; identical to SEQ ID NO: 243442

SEQ ID NO: 308492 - RNA, 64 nt, hsa; identical to SEQ ID NO: 243443

SEQ ID NO: 308493 - RNA, 64 nt, hsa; identical to SEQ ID NO: 243444

SEQ ID NO: 308494 - RNA, 64 nt, hsa; identical to SEQ ID NO: 243445

SEQ ID NO: 308495 - RNA, 64 nt, hsa; identical to SEQ ID NO: 243446

SEQ ID NO: 308496 - RNA, 64 nt, hsa; identical to SEQ ID NO: 243447

SEQ ID NO: 308497 - RNA, 64 nt, hsa; identical to SEQ ID NO: 243448

SEQ ID NO: 308498 - RNA, 64 nt, hsa; identical to SEQ ID NO: 243449

SEQ ID NO: 308499 - RNA, 64 nt, hsa; identical to SEQ ID NO: 243450

SEQ ID NO: 308500 - RNA, 64 nt, hsa; identical to SEQ ID NO: 243451

SEQ ID NO: 308501 - RNA, 64 nt, hsa; identical to SEQ ID NO: 243452

SEQ ID NO: 308502 - RNA, 64 nt, hsa; identical to SEQ ID NO: 243453

SEQ ID NO: 308503 - RNA, 64 nt, hsa; identical to SEQ ID NO: 243454

SEQ ID NO: 308504 - RNA, 64 nt, hsa; identical to SEQ ID NO: 243455

SEQ ID NO: 308505 - RNA, 64 nt, hsa; identical to SEQ ID NO: 243456

SEQ ID NO: 308506 - RNA, 64 nt, hsa; identical to SEQ ID NO: 243457

SEQ ID NO: 308507 - RNA, 64 nt, hsa
aaagagaaguaagagagauagcuagauagcuagauagcuagauagucuugugucuuguuugacc

SEQ ID NO: 308508 - RNA, 64 nt, hsa
ggggcgccaaagagaaguaagagagauagcuagauagcuagauagcuagauagucuugugucuu

SEQ ID NO: 308509 - RNA, 64 nt, hsa
gacacaugggggcgccaaagagaaguaagagagauagcuagauagcuagauagcuagauagucu

SEQ ID NO: 308510 - RNA, 64 nt, hsa
aguuaacuccaggauagguagguuucuauuguuauagcuagauguaaaucuuuaguuccaagaa

SEQ ID NO: 308511 - RNA, 64 nt, hsa
aaaugcugcuugcacauguugguucuugaaaccuuagcuagaagaauuucaggucauaccaaca

SEQ ID NO: 308512 - RNA, 64 nt, hsa
uucuggaauaaggcaaggaguggguuguuuuucauagcuagauaagaucuuuuccaaaguuuuu

SEQ ID NO: 308513 - RNA, 64 nt, hsa
auccauuucuucaaagcaaaacaugaaaugguuuuagcuagagucagaccagaaugaaaaugcc

SEQ ID NO: 308514 - RNA, 64 nt, hsa; identical to SEQ ID NO: 45477

SEQ ID NO: 308515 - RNA, 64 nt, hsa; identical to SEQ ID NO: 45478

SEQ ID NO: 308516 - RNA, 64 nt, hsa; identical to SEQ ID NO: 45479

SEQ ID NO: 308517 - RNA, 64 nt, hsa; identical to SEQ ID NO: 45480

SEQ ID NO: 308518 - RNA, 64 nt, hsa; identical to SEQ ID NO: 45481

SEQ ID NO: 308519 - RNA, 64 nt, hsa; identical to SEQ ID NO: 45482

SEQ ID NO: 308520 - RNA, 64 nt, hsa; identical to SEQ ID NO: 45483

SEQ ID NO: 308521 - RNA, 64 nt, hsa; identical to SEQ ID NO: 45484

SEQ ID NO: 308522 - RNA, 64 nt, hsa; identical to SEQ ID NO: 45485

SEQ ID NO: 308523 - RNA, 64 nt, hsa; identical to SEQ ID NO: 45486

SEQ ID NO: 308524 - RNA, 64 nt, hsa; identical to SEQ ID NO: 45487

SEQ ID NO: 308525 - RNA, 56 nt, hsa; identical to SEQ ID NO: 45488

SEQ ID NO: 308526 - RNA, 64 nt, hsa; identical to SEQ ID NO: 45489

SEQ ID NO: 308527 - RNA, 64 nt, hsa; identical to SEQ ID NO: 45490

SEQ ID NO: 308528 - RNA, 64 nt, hsa; identical to SEQ ID NO: 45491

SEQ ID NO: 308529 - RNA, 64 nt, hsa; identical to SEQ ID NO: 45492

SEQ ID NO: 308530 - RNA, 64 nt, hsa; identical to SEQ ID NO: 45493

SEQ ID NO: 308531 - RNA, 64 nt, hsa; identical to SEQ ID NO: 45494

SEQ ID NO: 308532 - RNA, 64 nt, hsa; identical to SEQ ID NO: 45495

SEQ ID NO: 308533 - RNA, 64 nt, hsa; identical to SEQ ID NO: 45496

SEQ ID NO: 308534 - RNA, 64 nt, hsa; identical to SEQ ID NO: 45497

SEQ ID NO: 308535 - RNA, 64 nt, hsa; identical to SEQ ID NO: 45498

SEQ ID NO: 308536 - RNA, 64 nt, hsa; identical to SEQ ID NO: 45499

SEQ ID NO: 308537 - RNA, 64 nt, hsa; identical to SEQ ID NO: 45500

SEQ ID NO: 308538 - RNA, 64 nt, hsa; identical to SEQ ID NO: 45501

SEQ ID NO: 308539 - RNA, 64 nt, hsa; identical to SEQ ID NO: 45502

SEQ ID NO: 308540 - RNA, 64 nt, hsa; identical to SEQ ID NO: 45503

SEQ ID NO: 308541 - RNA, 64 nt, hsa; identical to SEQ ID NO: 45504

SEQ ID NO: 308542 - RNA, 64 nt, hsa; identical to SEQ ID NO: 45505

SEQ ID NO: 308543 - RNA, 64 nt, hsa; identical to SEQ ID NO: 45506

SEQ ID NO: 308544 - RNA, 64 nt, hsa; identical to SEQ ID NO: 45507

SEQ ID NO: 308545 - RNA, 64 nt, hsa; identical to SEQ ID NO: 45508

SEQ ID NO: 308546 - RNA, 64 nt, hsa; identical to SEQ ID NO: 45509

SEQ ID NO: 308547 - RNA, 64 nt, hsa; identical to SEQ ID NO: 45510

SEQ ID NO: 308548 - RNA, 64 nt, hsa; identical to SEQ ID NO: 45511

SEQ ID NO: 308549 - RNA, 64 nt, hsa; identical to SEQ ID NO: 45512

SEQ ID NO: 308550 - RNA, 64 nt, hsa; identical to SEQ ID NO: 45513

SEQ ID NO: 308551 - RNA, 64 nt, hsa; identical to SEQ ID NO: 45514

SEQ ID NO: 308552 - RNA, 64 nt, hsa; identical to SEQ ID NO: 45515

SEQ ID NO: 308553 - RNA, 64 nt, hsa; identical to SEQ ID NO: 45516

SEQ ID NO: 308554 - RNA, 64 nt, hsa; identical to SEQ ID NO: 45517

SEQ ID NO: 308555 - RNA, 64 nt, hsa; identical to SEQ ID NO: 45518

SEQ ID NO: 308556 - RNA, 64 nt, hsa; identical to SEQ ID NO: 45519

SEQ ID NO: 308557 - RNA, 64 nt, hsa; identical to SEQ ID NO: 45520

SEQ ID NO: 308558 - RNA, 64 nt, hsa; identical to SEQ ID NO: 45521

SEQ ID NO: 308559 - RNA, 64 nt, hsa; identical to SEQ ID NO: 45522

SEQ ID NO: 308560 - RNA, 64 nt, hsa; identical to SEQ ID NO: 45523

SEQ ID NO: 308561 - RNA, 64 nt, hsa; identical to SEQ ID NO: 45524

SEQ ID NO: 308562 - RNA, 64 nt, hsa; identical to SEQ ID NO: 45525

SEQ ID NO: 308563 - RNA, 64 nt, hsa; identical to SEQ ID NO: 45526

SEQ ID NO: 308564 - RNA, 64 nt, hsa; identical to SEQ ID NO: 45527

SEQ ID NO: 308565 - RNA, 64 nt, hsa; identical to SEQ ID NO: 45528

SEQ ID NO: 308566 - RNA, 64 nt, hsa; identical to SEQ ID NO: 45529

SEQ ID NO: 308567 - RNA, 64 nt, hsa; identical to SEQ ID NO: 45530

SEQ ID NO: 308568 - RNA, 64 nt, hsa; identical to SEQ ID NO: 45531

SEQ ID NO: 308569 - RNA, 64 nt, hsa; identical to SEQ ID NO: 45532

SEQ ID NO: 308570 - RNA, 64 nt, hsa; identical to SEQ ID NO: 45533

SEQ ID NO: 308571 - RNA, 64 nt, hsa; identical to SEQ ID NO: 45534

SEQ ID NO: 308572 - RNA, 64 nt, hsa; identical to SEQ ID NO: 45535

SEQ ID NO: 308573 - RNA, 64 nt, hsa; identical to SEQ ID NO: 45536

SEQ ID NO: 308574 - RNA, 64 nt, hsa; identical to SEQ ID NO: 45537

SEQ ID NO: 308575 - RNA, 64 nt, hsa; identical to SEQ ID NO: 45538

SEQ ID NO: 308576 - RNA, 64 nt, hsa; identical to SEQ ID NO: 45539

SEQ ID NO: 308577 - RNA, 64 nt, hsa; identical to SEQ ID NO: 45540

SEQ ID NO: 308578 - RNA, 64 nt, hsa; identical to SEQ ID NO: 45541

SEQ ID NO: 308579 - RNA, 64 nt, hsa; identical to SEQ ID NO: 45542

SEQ ID NO: 308580 - RNA, 64 nt, hsa; identical to SEQ ID NO: 45543

SEQ ID NO: 308581 - RNA, 64 nt, hsa; identical to SEQ ID NO: 45544

SEQ ID NO: 308582 - RNA, 64 nt, hsa; identical to SEQ ID NO: 45545

SEQ ID NO: 308583 - RNA, 64 nt, hsa; identical to SEQ ID NO: 45546

SEQ ID NO: 308584 - RNA, 64 nt, hsa; identical to SEQ ID NO: 45547

SEQ ID NO: 308585 - RNA, 64 nt, hsa; identical to SEQ ID NO: 45548

SEQ ID NO: 308586 - RNA, 64 nt, hsa; identical to SEQ ID NO: 45549

SEQ ID NO: 308587 - RNA, 64 nt, hsa; identical to SEQ ID NO: 45550

SEQ ID NO: 308588 - RNA, 64 nt, hsa; identical to SEQ ID NO: 45551

SEQ ID NO: 308589 - RNA, 64 nt, hsa; identical to SEQ ID NO: 45552

SEQ ID NO: 308590 - RNA, 64 nt, hsa; identical to SEQ ID NO: 45553

SEQ ID NO: 308591 - RNA, 64 nt, hsa; identical to SEQ ID NO: 45554

SEQ ID NO: 308592 - RNA, 64 nt, hsa; identical to SEQ ID NO: 45555

SEQ ID NO: 308593 - RNA, 64 nt, hsa; identical to SEQ ID NO: 45556

SEQ ID NO: 308594 - RNA, 64 nt, hsa; identical to SEQ ID NO: 45557

SEQ ID NO: 308595 - RNA, 64 nt, hsa; identical to SEQ ID NO: 45558

SEQ ID NO: 308596 - RNA, 64 nt, hsa; identical to SEQ ID NO: 45559

SEQ ID NO: 308597 - RNA, 64 nt, hsa; identical to SEQ ID NO: 45560

SEQ ID NO: 308598 - RNA, 64 nt, hsa; identical to SEQ ID NO: 45561

SEQ ID NO: 308599 - RNA, 64 nt, hsa; identical to SEQ ID NO: 45562

SEQ ID NO: 308600 - RNA, 64 nt, hsa; identical to SEQ ID NO: 45563

SEQ ID NO: 308601 - RNA, 64 nt, hsa; identical to SEQ ID NO: 45564

SEQ ID NO: 308602 - RNA, 64 nt, hsa; identical to SEQ ID NO: 45565

SEQ ID NO: 308603 - RNA, 64 nt, hsa; identical to SEQ ID NO: 45566

SEQ ID NO: 308604 - RNA, 64 nt, hsa; identical to SEQ ID NO: 45567

SEQ ID NO: 308605 - RNA, 64 nt, hsa; identical to SEQ ID NO: 45568

SEQ ID NO: 308606 - RNA, 64 nt, hsa; identical to SEQ ID NO: 45569

SEQ ID NO: 308607 - RNA, 64 nt, hsa; identical to SEQ ID NO: 45570

SEQ ID NO: 308608 - RNA, 64 nt, hsa; identical to SEQ ID NO: 45571

SEQ ID NO: 308609 - RNA, 64 nt, hsa; identical to SEQ ID NO: 45572

SEQ ID NO: 308610 - RNA, 64 nt, hsa; identical to SEQ ID NO: 45573

SEQ ID NO: 308611 - RNA, 64 nt, hsa; identical to SEQ ID NO: 45574

SEQ ID NO: 308612 - RNA, 64 nt, hsa; identical to SEQ ID NO: 45575

SEQ ID NO: 308613 - RNA, 64 nt, hsa; identical to SEQ ID NO: 45576

SEQ ID NO: 308614 - RNA, 64 nt, hsa; identical to SEQ ID NO: 45577

SEQ ID NO: 308615 - RNA, 64 nt, hsa; identical to SEQ ID NO: 45578

SEQ ID NO: 308616 - RNA, 64 nt, hsa; identical to SEQ ID NO: 45579

SEQ ID NO: 308617 - RNA, 64 nt, hsa; identical to SEQ ID NO: 45580

SEQ ID NO: 308618 - RNA, 64 nt, hsa; identical to SEQ ID NO: 45581

SEQ ID NO: 308619 - RNA, 64 nt, hsa; identical to SEQ ID NO: 45582

SEQ ID NO: 308620 - RNA, 64 nt, hsa; identical to SEQ ID NO: 45583

SEQ ID NO: 308621 - RNA, 64 nt, hsa; identical to SEQ ID NO: 45584

SEQ ID NO: 308622 - RNA, 64 nt, hsa; identical to SEQ ID NO: 45585

SEQ ID NO: 308623 - RNA, 64 nt, hsa; identical to SEQ ID NO: 45586

SEQ ID NO: 308624 - RNA, 64 nt, hsa; identical to SEQ ID NO: 45587

SEQ ID NO: 308625 - RNA, 64 nt, hsa; identical to SEQ ID NO: 45588

SEQ ID NO: 308626 - RNA, 64 nt, hsa; identical to SEQ ID NO: 45589

SEQ ID NO: 308627 - RNA, 64 nt, hsa; identical to SEQ ID NO: 45590

SEQ ID NO: 308628 - RNA, 64 nt, hsa; identical to SEQ ID NO: 45591

SEQ ID NO: 308629 - RNA, 64 nt, hsa; identical to SEQ ID NO: 45592

SEQ ID NO: 308630 - RNA, 64 nt, hsa; identical to SEQ ID NO: 45593

SEQ ID NO: 308631 - RNA, 64 nt, hsa; identical to SEQ ID NO: 45594

SEQ ID NO: 308632 - RNA, 64 nt, hsa; identical to SEQ ID NO: 45595

SEQ ID NO: 308633 - RNA, 64 nt, hsa; identical to SEQ ID NO: 45596

SEQ ID NO: 308634 - RNA, 64 nt, hsa; identical to SEQ ID NO: 45597

SEQ ID NO: 308635 - RNA, 64 nt, hsa; identical to SEQ ID NO: 45598

SEQ ID NO: 308636 - RNA, 64 nt, hsa; identical to SEQ ID NO: 45599

SEQ ID NO: 308637 - RNA, 64 nt, hsa; identical to SEQ ID NO: 45600

SEQ ID NO: 308638 - RNA, 64 nt, hsa; identical to SEQ ID NO: 45601

SEQ ID NO: 308639 - RNA, 64 nt, hsa; identical to SEQ ID NO: 45602

SEQ ID NO: 308640 - RNA, 64 nt, hsa; identical to SEQ ID NO: 45603

SEQ ID NO: 308641 - RNA, 64 nt, hsa; identical to SEQ ID NO: 45604

SEQ ID NO: 308642 - RNA, 64 nt, hsa; identical to SEQ ID NO: 45605

SEQ ID NO: 308643 - RNA, 64 nt, hsa; identical to SEQ ID NO: 45606

SEQ ID NO: 308644 - RNA, 64 nt, hsa; identical to SEQ ID NO: 45607

SEQ ID NO: 308645 - RNA, 64 nt, hsa; identical to SEQ ID NO: 45608

SEQ ID NO: 308646 - RNA, 64 nt, hsa; identical to SEQ ID NO: 45609

SEQ ID NO: 308647 - RNA, 64 nt, hsa; identical to SEQ ID NO: 45610

SEQ ID NO: 308648 - RNA, 64 nt, hsa; identical to SEQ ID NO: 45611

SEQ ID NO: 308649 - RNA, 64 nt, hsa; identical to SEQ ID NO: 45612

SEQ ID NO: 308650 - RNA, 64 nt, hsa; identical to SEQ ID NO: 45613

SEQ ID NO: 308651 - RNA, 64 nt, hsa; identical to SEQ ID NO: 45614

SEQ ID NO: 308652 - RNA, 64 nt, hsa; identical to SEQ ID NO: 45615

SEQ ID NO: 308653 - RNA, 64 nt, hsa; identical to SEQ ID NO: 45616

SEQ ID NO: 308654 - RNA, 64 nt, hsa; identical to SEQ ID NO: 45617

SEQ ID NO: 308655 - RNA, 64 nt, hsa; identical to SEQ ID NO: 45618

SEQ ID NO: 308656 - RNA, 64 nt, hsa; identical to SEQ ID NO: 45619

SEQ ID NO: 308657 - RNA, 64 nt, hsa; identical to SEQ ID NO: 45620

SEQ ID NO: 308658 - RNA, 64 nt, hsa; identical to SEQ ID NO: 45621

SEQ ID NO: 308659 - RNA, 64 nt, hsa; identical to SEQ ID NO: 45622

SEQ ID NO: 308660 - RNA, 64 nt, hsa; identical to SEQ ID NO: 45623

SEQ ID NO: 308661 - RNA, 64 nt, hsa; identical to SEQ ID NO: 45624

SEQ ID NO: 308662 - RNA, 64 nt, hsa; identical to SEQ ID NO: 45625

SEQ ID NO: 308663 - RNA, 64 nt, hsa; identical to SEQ ID NO: 45626

SEQ ID NO: 308664 - RNA, 64 nt, hsa; identical to SEQ ID NO: 45627

SEQ ID NO: 308665 - RNA, 64 nt, hsa; identical to SEQ ID NO: 45628

SEQ ID NO: 308666 - RNA, 64 nt, hsa; identical to SEQ ID NO: 45629

SEQ ID NO: 308667 - RNA, 64 nt, hsa; identical to SEQ ID NO: 45630

SEQ ID NO: 308668 - RNA, 64 nt, hsa; identical to SEQ ID NO: 45631

SEQ ID NO: 308669 - RNA, 64 nt, hsa; identical to SEQ ID NO: 45632

SEQ ID NO: 308670 - RNA, 64 nt, hsa; identical to SEQ ID NO: 45633

SEQ ID NO: 308671 - RNA, 64 nt, hsa; identical to SEQ ID NO: 45634

SEQ ID NO: 308672 - RNA, 64 nt, hsa; identical to SEQ ID NO: 45635

SEQ ID NO: 308673 - RNA, 64 nt, hsa; identical to SEQ ID NO: 45636

SEQ ID NO: 308674 - RNA, 64 nt, hsa; identical to SEQ ID NO: 45637

SEQ ID NO: 308675 - RNA, 64 nt, hsa; identical to SEQ ID NO: 45638

SEQ ID NO: 308676 - RNA, 64 nt, hsa; identical to SEQ ID NO: 45639

SEQ ID NO: 308677 - RNA, 64 nt, hsa; identical to SEQ ID NO: 45640

SEQ ID NO: 308678 - RNA, 64 nt, hsa; identical to SEQ ID NO: 45641

SEQ ID NO: 308679 - RNA, 64 nt, hsa; identical to SEQ ID NO: 45642

SEQ ID NO: 308680 - RNA, 64 nt, hsa; identical to SEQ ID NO: 45643

SEQ ID NO: 308681 - RNA, 64 nt, hsa; identical to SEQ ID NO: 45644

SEQ ID NO: 308682 - RNA, 64 nt, hsa; identical to SEQ ID NO: 45645

SEQ ID NO: 308683 - RNA, 64 nt, hsa; identical to SEQ ID NO: 45646

SEQ ID NO: 308684 - RNA, 64 nt, hsa; identical to SEQ ID NO: 45647

SEQ ID NO: 308685 - RNA, 64 nt, hsa; identical to SEQ ID NO: 45648

SEQ ID NO: 308686 - RNA, 64 nt, hsa; identical to SEQ ID NO: 45649

SEQ ID NO: 308687 - RNA, 64 nt, hsa; identical to SEQ ID NO: 45650

SEQ ID NO: 308688 - RNA, 64 nt, hsa; identical to SEQ ID NO: 45651

SEQ ID NO: 308689 - RNA, 64 nt, hsa; identical to SEQ ID NO: 45652

SEQ ID NO: 308690 - RNA, 64 nt, hsa; identical to SEQ ID NO: 45653

SEQ ID NO: 308691 - RNA, 64 nt, hsa; identical to SEQ ID NO: 45654

SEQ ID NO: 308692 - RNA, 64 nt, hsa; identical to SEQ ID NO: 45655

SEQ ID NO: 308693 - RNA, 64 nt, hsa; identical to SEQ ID NO: 96939

SEQ ID NO: 308694 - RNA, 64 nt, hsa; identical to SEQ ID NO: 96940

SEQ ID NO: 308695 - RNA, 64 nt, hsa; identical to SEQ ID NO: 96941

SEQ ID NO: 308696 - RNA, 64 nt, hsa; identical to SEQ ID NO: 96942

SEQ ID NO: 308697 - RNA, 64 nt, hsa; identical to SEQ ID NO: 96943

SEQ ID NO: 308698 - RNA, 64 nt, hsa; identical to SEQ ID NO: 96944

SEQ ID NO: 308699 - RNA, 64 nt, hsa; identical to SEQ ID NO: 96945

SEQ ID NO: 308700 - RNA, 64 nt, hsa; identical to SEQ ID NO: 96946

SEQ ID NO: 308701 - RNA, 64 nt, hsa; identical to SEQ ID NO: 96947

SEQ ID NO: 308702 - RNA, 64 nt, hsa; identical to SEQ ID NO: 96948

SEQ ID NO: 308703 - RNA, 64 nt, hsa; identical to SEQ ID NO: 96949

SEQ ID NO: 308704 - RNA, 64 nt, hsa; identical to SEQ ID NO: 96950

SEQ ID NO: 308705 - RNA, 64 nt, hsa; identical to SEQ ID NO: 96951

SEQ ID NO: 308706 - RNA, 64 nt, hsa; identical to SEQ ID NO: 96952

SEQ ID NO: 308707 - RNA, 64 nt, hsa; identical to SEQ ID NO: 96953

SEQ ID NO: 308708 - RNA, 64 nt, hsa; identical to SEQ ID NO: 96954

SEQ ID NO: 308709 - RNA, 64 nt, hsa; identical to SEQ ID NO: 96955

SEQ ID NO: 308710 - RNA, 64 nt, hsa; identical to SEQ ID NO: 96956

SEQ ID NO: 308711 - RNA, 64 nt, hsa; identical to SEQ ID NO: 96957

SEQ ID NO: 308712 - RNA, 62 nt, hsa; identical to SEQ ID NO: 96958

SEQ ID NO: 308713 - RNA, 64 nt, hsa; identical to SEQ ID NO: 96959

SEQ ID NO: 308714 - RNA, 64 nt, hsa; identical to SEQ ID NO: 96960

SEQ ID NO: 308715 - RNA, 64 nt, hsa; identical to SEQ ID NO: 96961

SEQ ID NO: 308716 - RNA, 64 nt, hsa; identical to SEQ ID NO: 96962

SEQ ID NO: 308717 - RNA, 64 nt, hsa; identical to SEQ ID NO: 96963

SEQ ID NO: 308718 - RNA, 64 nt, hsa; identical to SEQ ID NO: 96964

SEQ ID NO: 308719 - RNA, 64 nt, hsa; identical to SEQ ID NO: 96965

SEQ ID NO: 308720 - RNA, 64 nt, hsa; identical to SEQ ID NO: 96966

SEQ ID NO: 308721 - RNA, 64 nt, hsa; identical to SEQ ID NO: 96967

SEQ ID NO: 308722 - RNA, 64 nt, hsa; identical to SEQ ID NO: 96968

SEQ ID NO: 308723 - RNA, 64 nt, hsa; identical to SEQ ID NO: 96969

SEQ ID NO: 308724 - RNA, 64 nt, hsa; identical to SEQ ID NO: 96970

SEQ ID NO: 308725 - RNA, 64 nt, hsa; identical to SEQ ID NO: 96971

SEQ ID NO: 308726 - RNA, 64 nt, hsa; identical to SEQ ID NO: 96972

SEQ ID NO: 308727 - RNA, 64 nt, hsa; identical to SEQ ID NO: 96973

SEQ ID NO: 308728 - RNA, 64 nt, hsa; identical to SEQ ID NO: 96974

SEQ ID NO: 308729 - RNA, 64 nt, hsa; identical to SEQ ID NO: 96975

SEQ ID NO: 308730 - RNA, 64 nt, hsa; identical to SEQ ID NO: 96976

SEQ ID NO: 308731 - RNA, 64 nt, hsa; identical to SEQ ID NO: 96977

SEQ ID NO: 308732 - RNA, 64 nt, hsa; identical to SEQ ID NO: 96978

SEQ ID NO: 308733 - RNA, 64 nt, hsa; identical to SEQ ID NO: 96979

SEQ ID NO: 308734 - RNA, 64 nt, hsa; identical to SEQ ID NO: 96980

SEQ ID NO: 308735 - RNA, 64 nt, hsa; identical to SEQ ID NO: 96981

SEQ ID NO: 308736 - RNA, 64 nt, hsa; identical to SEQ ID NO: 96982

SEQ ID NO: 308737 - RNA, 64 nt, hsa; identical to SEQ ID NO: 96983

SEQ ID NO: 308738 - RNA, 64 nt, hsa; identical to SEQ ID NO: 96984

SEQ ID NO: 308739 - RNA, 64 nt, hsa; identical to SEQ ID NO: 96985

SEQ ID NO: 308740 - RNA, 64 nt, hsa; identical to SEQ ID NO: 96986

SEQ ID NO: 308741 - RNA, 64 nt, hsa; identical to SEQ ID NO: 96987

SEQ ID NO: 308742 - RNA, 64 nt, hsa; identical to SEQ ID NO: 96988

SEQ ID NO: 308743 - RNA, 64 nt, hsa; identical to SEQ ID NO: 96989

SEQ ID NO: 308744 - RNA, 64 nt, hsa; identical to SEQ ID NO: 96990

SEQ ID NO: 308745 - RNA, 64 nt, hsa; identical to SEQ ID NO: 96991

SEQ ID NO: 308746 - RNA, 64 nt, hsa; identical to SEQ ID NO: 96992

SEQ ID NO: 308747 - RNA, 64 nt, hsa; identical to SEQ ID NO: 96993

SEQ ID NO: 308748 - RNA, 64 nt, hsa; identical to SEQ ID NO: 96994

SEQ ID NO: 308749 - RNA, 64 nt, hsa; identical to SEQ ID NO: 96995

SEQ ID NO: 308750 - RNA, 64 nt, hsa; identical to SEQ ID NO: 96996

SEQ ID NO: 308751 - RNA, 64 nt, hsa; identical to SEQ ID NO: 96997

SEQ ID NO: 308752 - RNA, 64 nt, hsa; identical to SEQ ID NO: 96998

SEQ ID NO: 308753 - RNA, 64 nt, hsa; identical to SEQ ID NO: 96999

SEQ ID NO: 308754 - RNA, 64 nt, hsa; identical to SEQ ID NO: 97000

SEQ ID NO: 308755 - RNA, 64 nt, hsa; identical to SEQ ID NO: 97001

SEQ ID NO: 308756 - RNA, 64 nt, hsa; identical to SEQ ID NO: 97002

SEQ ID NO: 308757 - RNA, 64 nt, hsa; identical to SEQ ID NO: 97003

SEQ ID NO: 308758 - RNA, 64 nt, hsa; identical to SEQ ID NO: 97004

SEQ ID NO: 308759 - RNA, 64 nt, hsa; identical to SEQ ID NO: 97005

SEQ ID NO: 308760 - RNA, 64 nt, hsa; identical to SEQ ID NO: 97006

SEQ ID NO: 308761 - RNA, 64 nt, hsa; identical to SEQ ID NO: 97007

SEQ ID NO: 308762 - RNA, 64 nt, hsa; identical to SEQ ID NO: 97008

SEQ ID NO: 308763 - RNA, 64 nt, hsa; identical to SEQ ID NO: 97009

SEQ ID NO: 308764 - RNA, 64 nt, hsa; identical to SEQ ID NO: 97010

SEQ ID NO: 308765 - RNA, 64 nt, hsa; identical to SEQ ID NO: 97011

SEQ ID NO: 308766 - RNA, 64 nt, hsa; identical to SEQ ID NO: 97012

SEQ ID NO: 308767 - RNA, 64 nt, hsa; identical to SEQ ID NO: 97013

SEQ ID NO: 308768 - RNA, 64 nt, hsa; identical to SEQ ID NO: 97014

SEQ ID NO: 308769 - RNA, 64 nt, hsa; identical to SEQ ID NO: 97015

SEQ ID NO: 308770 - RNA, 64 nt, hsa; identical to SEQ ID NO: 97016

SEQ ID NO: 308771 - RNA, 64 nt, hsa; identical to SEQ ID NO: 97017

SEQ ID NO: 308772 - RNA, 64 nt, hsa; identical to SEQ ID NO: 106495

SEQ ID NO: 308773 - RNA, 64 nt, hsa; identical to SEQ ID NO: 106496

SEQ ID NO: 308774 - RNA, 64 nt, hsa; identical to SEQ ID NO: 106497

SEQ ID NO: 308775 - RNA, 64 nt, hsa; identical to SEQ ID NO: 106498

SEQ ID NO: 308776 - RNA, 64 nt, hsa; identical to SEQ ID NO: 106499

SEQ ID NO: 308777 - RNA, 64 nt, hsa; identical to SEQ ID NO: 106500

SEQ ID NO: 308778 - RNA, 64 nt, hsa; identical to SEQ ID NO: 106501

SEQ ID NO: 308779 - RNA, 64 nt, hsa; identical to SEQ ID NO: 106502

SEQ ID NO: 308780 - RNA, 64 nt, hsa; identical to SEQ ID NO: 106503

SEQ ID NO: 308781 - RNA, 64 nt, hsa; identical to SEQ ID NO: 106504

SEQ ID NO: 308782 - RNA, 64 nt, hsa; identical to SEQ ID NO: 106505

SEQ ID NO: 308783 - RNA, 64 nt, hsa; identical to SEQ ID NO: 106506

SEQ ID NO: 308784 - RNA, 61 nt, hsa
uaggagagauaucauuaucgcuguuuuauaaauaagggaaacuuuagcuugaggguuuaag

SEQ ID NO: 308785 - RNA, 61 nt, hsa
cugauguuuucagcauauuuucaaaauauugauaagggaaguuauuacuuuuauauaguau

SEQ ID NO: 308786 - RNA, 61 nt, hsa
aaaauacuuaaauguuauguauauggugguaauaagggaaaaaucaaguauuauaaacaag

SEQ ID NO: 308787 - RNA, 61 nt, hsa
acuagauuugggagaagggcagaguuacuugauaagggacugauguuugugcaguaacuug

SEQ ID NO: 308788 - RNA, 64 nt, hsa; identical to SEQ ID NO: 167885

SEQ ID NO: 308789 - RNA, 64 nt, hsa; identical to SEQ ID NO: 167886

SEQ ID NO: 308790 - RNA, 64 nt, hsa; identical to SEQ ID NO: 167887

SEQ ID NO: 308791 - RNA, 64 nt, hsa; identical to SEQ ID NO: 167888

SEQ ID NO: 308792 - RNA, 64 nt, hsa; identical to SEQ ID NO: 167889

SEQ ID NO: 308793 - RNA, 64 nt, hsa; identical to SEQ ID NO: 167890

SEQ ID NO: 308794 - RNA, 64 nt, hsa; identical to SEQ ID NO: 167891

SEQ ID NO: 308795 - RNA, 64 nt, hsa; identical to SEQ ID NO: 167892

SEQ ID NO: 308796 - RNA, 64 nt, hsa; identical to SEQ ID NO: 167893

SEQ ID NO: 308797 - RNA, 64 nt, hsa; identical to SEQ ID NO: 167894

SEQ ID NO: 308798 - RNA, 64 nt, hsa; identical to SEQ ID NO: 167895

SEQ ID NO: 308799 - RNA, 64 nt, hsa; identical to SEQ ID NO: 167896

SEQ ID NO: 308800 - RNA, 64 nt, hsa; identical to SEQ ID NO: 167897

SEQ ID NO: 308801 - RNA, 64 nt, hsa; identical to SEQ ID NO: 167898

SEQ ID NO: 308802 - RNA, 64 nt, hsa; identical to SEQ ID NO: 167899

SEQ ID NO: 308803 - RNA, 64 nt, hsa; identical to SEQ ID NO: 167900

SEQ ID NO: 308804 - RNA, 64 nt, hsa; identical to SEQ ID NO: 167901

SEQ ID NO: 308805 - RNA, 64 nt, hsa; identical to SEQ ID NO: 167902

SEQ ID NO: 308806 - RNA, 64 nt, hsa; identical to SEQ ID NO: 167903

SEQ ID NO: 308807 - RNA, 64 nt, hsa; identical to SEQ ID NO: 167904

SEQ ID NO: 308808 - RNA, 64 nt, hsa; identical to SEQ ID NO: 167905

SEQ ID NO: 308809 - RNA, 64 nt, hsa; identical to SEQ ID NO: 167906

SEQ ID NO: 308810 - RNA, 64 nt, hsa; identical to SEQ ID NO: 167907

SEQ ID NO: 308811 - RNA, 64 nt, hsa; identical to SEQ ID NO: 167908

SEQ ID NO: 308812 - RNA, 64 nt, hsa; identical to SEQ ID NO: 167909

SEQ ID NO: 308813 - RNA, 64 nt, hsa; identical to SEQ ID NO: 167910

SEQ ID NO: 308814 - RNA, 64 nt, hsa; identical to SEQ ID NO: 167911

SEQ ID NO: 308815 - RNA, 64 nt, hsa; identical to SEQ ID NO: 167912

SEQ ID NO: 308816 - RNA, 64 nt, hsa; identical to SEQ ID NO: 167913

SEQ ID NO: 308817 - RNA, 64 nt, hsa
aagcuccuuggauguggagacagaugucuuuacuagagcugaaaggcccccuugacacauccag

SEQ ID NO: 308818 - RNA, 64 nt, hsa
gccccacuuucuggaugacagacuugaggcucugagagcugaaaacacuuguccaaggucucac

SEQ ID NO: 308819 - RNA, 64 nt, hsa
caugaggaucuuccacaauuucagaaugcacgccagagcugaagggggaaacuugguaacuugc

SEQ ID NO: 308820 - RNA, 64 nt, hsa
cguuucccauugcuguagcauuucuuauccccugagagcugaugauuauugaggacagaaggcu

SEQ ID NO: 308821 - RNA, 64 nt, hsa
gaggacauccgccucccugaaaguggugcuagacagagcugaggucauuguaucuguguaucca

SEQ ID NO: 308822 - RNA, 64 nt, hsa
ugacuaaccccgggucagccugccauuuagggaaagagcugagguucuuacccuuguugcaugc

SEQ ID NO: 308823 - RNA, 64 nt, hsa
uguuuucuuacauuggguagaguccagccuagugagagcugagugaaggggcuggccaugccug

SEQ ID NO: 308824 - RNA, 64 nt, hsa
ggaugugcuucauccucuaacaguguacacucccagagcugauauucuggauuuugacugugca

SEQ ID NO: 308825 - RNA, 64 nt, hsa
gcauugugguccgagguagcugcucuccccacugagagcugagccgaaauauaagaauaauaua

SEQ ID NO: 308826 - RNA, 64 nt, hsa
acuagccacauucccaaggucccaaggagaaggaagagcugaaauucaucuccuagugacagug

SEQ ID NO: 308827 - RNA, 64 nt, hsa
gaacuuccuccagcuaugcagggauucucauuaaagagcugaucugcaucuguuuauccauuuu

SEQ ID NO: 308828 - RNA, 64 nt, hsa
gaaaccgacugaagggacugaccagcuagcuaggagagcugagacgccaguccucaaauggcgu

SEQ ID NO: 308829 - RNA, 64 nt, hsa
acucaucauggauugcucagaguuccuuuagggcagagcugagggccugggauccaggaaccag

SEQ ID NO: 308830 - RNA, 64 nt, hsa
ugcauggcaucaccuccaccauacuccaucaguuagagcugacacaaaccugccuggguuuaag

SEQ ID NO: 308831 - RNA, 64 nt, hsa
acuugaggcuuagcuuugcucugccaacuucuucagagcugacacaggaugaaggcaaugccau

SEQ ID NO: 308832 - RNA, 64 nt, hsa
uuugugaauuauuucuggguuuguguuuugccuaagagcugaucuuauuucugauuugugugug

SEQ ID NO: 308833 - RNA, 64 nt, hsa
gauggcucaggggcgcacuaccuauuuugucaccagagcugacucaggcuuccuggacccucaa

SEQ ID NO: 308834 - RNA, 64 nt, hsa
agccaccuucucacucuguggaaguacuuuagugagagcugacuggcaagauaaaaacccugaa

SEQ ID NO: 308835 - RNA, 64 nt, hsa
aaggugaaaucuuucuuaacaggguucaaagaugagagcugaaaaaucguggccuuaacaacug

SEQ ID NO: 308836 - RNA, 64 nt, hsa
gagguuaugaucccugggcgcuucggcagaauggagagcugaggugucccuccccugcuaguca

SEQ ID NO: 308837 - RNA, 64 nt, hsa
ucaccagcuuccccaagagagugucagaaucuuaagagcugagaggccgggcacgguggcucac

SEQ ID NO: 308838 - RNA, 64 nt, hsa
gagaaaaggagagagcgcgugcagagacuugguggugcauaauggauauuuuuuaacuuggcga

SEQ ID NO: 308839 - RNA, 64 nt, hsa
aguagccacgacuuuaucaggcagccccaaacuggugcauaaugcaugguacaagaaauauuua

SEQ ID NO: 308840 - RNA, 64 nt, hsa
uagacaucuucagaaugacuaauuucuccgaguggugcauaaucuuauuuuguuugggaguaac

SEQ ID NO: 308841 - RNA, 64 nt, hsa
ucaauccaaaggcacuuugcagugcaguccacaugugcauaaggaccauggggagcuuguauuu

SEQ ID NO: 308842 - RNA, 64 nt, hsa
gucaguuauugcccuuuuauauugugaauguaaugugcauaagcuauauccguagauguuauug

SEQ ID NO: 308843 - RNA, 64 nt, hsa
gaauaucaucugucauuauauucuaauuaaaauugugcauaaugcuuuggaaaaaugggucuuu

SEQ ID NO: 308844 - RNA, 64 nt, hsa
uuggcacaaaugugcagaauagauacaucaguuggugcauaaucgaaaaaaauaggaauuuuga

SEQ ID NO: 308845 - RNA, 64 nt, hsa
uauauuagguuuuacugccuauugagacaaccaggugcauaauugauugcccuuuggccauaaa

SEQ ID NO: 308846 - RNA, 64 nt, hsa
cgaguagcuuguguggaugcaguccugugagggugugcauaaccguucccagguguacgcacgc

SEQ ID NO: 308847 - RNA, 64 nt, hsa
uucuaaagcuaaaccucucaaggaaaaggacucagugcauaagaugacuuuggugaaaccccgu

SEQ ID NO: 308848 - RNA, 64 nt, hsa
aaucuccacccaaugaaugaugaugguauaguaugugcauaauggaaaguuaccuuacugaaaa

SEQ ID NO: 308849 - RNA, 64 nt, hsa
cccuuaaaaauauguguauacuacuuuggcucuugugcauaaaaacaagaacacugaaaauugg

SEQ ID NO: 308850 - RNA, 64 nt, hsa
agucaugugucuuaauuuuauuuucucuauuugagugcauaauuauccuaauaaucccaaagac

SEQ ID NO: 308851 - RNA, 64 nt, hsa
aacucacauucuaugacaucaugaggucuccucagugcauaaggaagaacucuacagcagccca

SEQ ID NO: 308852 - RNA, 64 nt, hsa
uugucaugugaacuuggaaacuaagguuacucgugugcauaaaaauucuaaaugaaagggugug

SEQ ID NO: 308853 - RNA, 64 nt, hsa
auguuaggagcugcaaggccccaaaguagaagaugugcauaaugucugcucuuguguagcucag

SEQ ID NO: 308854 - RNA, 64 nt, hsa
agggguuaaagucguuucuuuuaguuuaauagaugugcauaagguagcuuuagcaauuaaauuc

SEQ ID NO: 308855 - RNA, 64 nt, hsa
acaauggucacaaggucuuuacuuaugcacauuugugcauaaauuuccacccaauuuccaagac

SEQ ID NO: 308856 - RNA, 64 nt, hsa
guaagugagugugcugcuguaagaaaucucccaugugcauaacaaauucugaauauuuuuugag

SEQ ID NO: 308857 - RNA, 64 nt, hsa
uuauauuucuuauagucuuaauuuuguuauccaugugcauaauuuaccucaugauuucuuuugg

SEQ ID NO: 308858 - RNA, 64 nt, hsa
aauuuggaucacuuucaauugaagucaggguauugugcauaauagaaaguauuggacugagaua

SEQ ID NO: 308859 - RNA, 64 nt, hsa
uauuuuuguacuuuaucaugaaugcuuuuagugugugcauaauagcuacagugcauaguuguag

SEQ ID NO: 308860 - RNA, 64 nt, hsa
uagcaccugcaauuguugggauguggauggaugugugcauaagagagagagagaauaugugugu

SEQ ID NO: 308861 - RNA, 64 nt, hsa
caacuaaaacuauuuuugcuauaaguucuauaaggugcauaaaacccuuaaauucaucuaguag

SEQ ID NO: 308862 - RNA, 64 nt, hsa
cuuagguaaucccaaaaacuaacaaauaacaaaggugcauaauuuauuuaucuacuuuuuaggu

SEQ ID NO: 308863 - RNA, 53 nt, hsa
cucaccuucuugaacauuagagagugcauaauggugauacuuguuuauaauuc

SEQ ID NO: 308864 - RNA, 64 nt, hsa
aaacacaugccaguugggaaggucugaaaacucagugcauaauaggaacacuugagacuaauga

SEQ ID NO: 308865 - RNA, 64 nt, hsa
acccuugucaagccuaccagagcagcugauacgugugcauaacagugaggcauuguguccugga

SEQ ID NO: 308866 - RNA, 64 nt, hsa
cagaagucugcagcggugccucacaaacuugauugugcauaaaaaucacuggggaucuuguuaa

SEQ ID NO: 308867 - RNA, 64 nt, hsa
ccaggguuucugguuugggagaucagaugaacaagugcauaagccugggaugcugguggaggac

SEQ ID NO: 308868 - RNA, 64 nt, hsa
auaacauuaaccucauuguuuauggccaugcuuugugcauaaucaaaguuuaugauuaaaugua

SEQ ID NO: 308869 - RNA, 64 nt, hsa
uuuuccaacuuucuguacuaauagauacauuucugugcauaagauuauaaagcauauacucaca

SEQ ID NO: 308870 - RNA, 64 nt, hsa
acaggguugaaagcuguuggagaggggaaaaguugugcauaaagaacugaaaaggguucuggag

SEQ ID NO: 308871 - RNA, 64 nt, hsa
cuuuugacauuugacuuugcauaaaaguuuaucugugcauaauuuuauauguaguugaauucau

SEQ ID NO: 308872 - RNA, 64 nt, hsa
aaugccacuuuucuguuccugaagaggcucuuuugugcauaauauucuaaaaugaagacauuuc

SEQ ID NO: 308873 - RNA, 64 nt, hsa
uaacaccaaaaccucugucagaacacaaaggaaugugcauaauggagagaagacauauuuuuuu

SEQ ID NO: 308874 - RNA, 64 nt, hsa
uuuauaucuaaaagcuguauuuacuuuaaaagaagugcauaauuaccaaaauuguauguacuau

SEQ ID NO: 308875 - RNA, 64 nt, hsa
agauucccccuuuuccuguguuuaggauuuaguagugcauaaagcauuaauauccauaaacaua

SEQ ID NO: 308876 - RNA, 64 nt, hsa
ugcuauguaaaugugacauauuaauuauaaaauggugcauaaucaaauuuuacugcuugaggac

SEQ ID NO: 308877 - RNA, 64 nt, hsa
ugugauuucaggagauugugcagugccagcaucagugcauaaaggguccuguauguccuuuggc

SEQ ID NO: 308878 - RNA, 64 nt, hsa
uuagagauauuuuuauauagaccccaagcauucugugcauaaaaguuaacauuaggcuguggug

SEQ ID NO: 308879 - RNA, 64 nt, hsa
aguugauuauucuuuuuaucuauuuggagauucagugcauaacuaaguauuuuccuuaauacua

SEQ ID NO: 308880 - RNA, 64 nt, hsa
aguacauuggaaagcugguauugauguagaaccagugcauaacuuuuuaugggguuuuguuauu

SEQ ID NO: 308881 - RNA, 64 nt, hsa
uuaagugguauuauauuuuacauuuucaaguauagugcauaaagaauguuuuaaauguaacugu

SEQ ID NO: 308882 - RNA, 64 nt, hsa
gguaaaaggucaugcuguuacagguguaguuugugugcauaaauaauacuuccgaauuaaauua

SEQ ID NO: 308883 - RNA, 64 nt, hsa
aagagacaucauguuggaaagauguucuagaaaugugcauaaauuucagugccucuuguaagca

SEQ ID NO: 308884 - RNA, 64 nt, hsa
accguuaugcauuacucugugucuacuauuaugugugcauaauuuauaccguaaauguuuacuc

SEQ ID NO: 308885 - RNA, 64 nt, hsa
ccugggcauggagcaccuguccaacaaccgcuuugugcauaaggacuuggcugcgcguaacugc

SEQ ID NO: 308886 - RNA, 64 nt, hsa
gcugugauaaguaaguguuuacauacacugucuagugcauaaaaaccuuaguguuugcuaucau

SEQ ID NO: 308887 - RNA, 64 nt, hsa
aagugauaggggucacaauggggaaauugaaguggugcauaacauugccaaaauagugugccac

SEQ ID NO: 308888 - RNA, 64 nt, hsa
aaugcccacacagugaccaacagaacuggucugcgugcauaaccagcugccacccucaggccug

SEQ ID NO: 308889 - RNA, 64 nt, hsa
gguauguucuaaucuauauuaagcaauaaugccagugcauaaucauuccauuuguuccuuuagc

SEQ ID NO: 308890 - RNA, 64 nt, hsa
ccauguugcuucacucuauccaaagugucacuuggugcauaagcacagaaaucugaaaaauggc

SEQ ID NO: 308891 - RNA, 64 nt, hsa
cacacagccaugaggagccucaguuuugaaagaggugcauaauaaaacuacuaaccagaggagu

SEQ ID NO: 308892 - RNA, 64 nt, hsa
ugagggagguguaguuuuuuuacucuugaaaugggugcauaauauaacuaggcaguggcggugc

SEQ ID NO: 308893 - RNA, 64 nt, hsa
guauuuauguguauauggaguugaagggaauacugugcauaagccauuaugauaaauuaagcau

SEQ ID NO: 308894 - RNA, 64 nt, hsa
aacucuuuguuuuccucuccaucuacuuuucccugugcauaauauccauccaaaggacaacagu

SEQ ID NO: 308895 - RNA, 64 nt, hsa
uuugaaagcauuaaaauaaaugauccuagagcaugugcauaaugagaggacuguauucucucug

SEQ ID NO: 308896 - RNA, 64 nt, hsa
uacuuuuuugcuuguuucuuuaaaguuuucugacgugcauaaugcauaauucauugaaaagcau

SEQ ID NO: 308897 - RNA, 64 nt, hsa
aaagggugauccagacaugagacgcaacuaguuggugcauaagaaggccccacuuggcuauuuc

SEQ ID NO: 308898 - RNA, 64 nt, hsa
uugcuaauguuaguguuuauaaagucuuaaaugugugcauaaaaaacuaaaugugaauauaaaa

SEQ ID NO: 308899 - RNA, 64 nt, hsa
acacucacaagacaucagcuauauacucugcuuggugcauaagaaagagaaaagagaugccuuu

SEQ ID NO: 308900 - RNA, 64 nt, hsa
gcagggcaccccugcugggguugggggcuggucugugcauaauccuggacugugaugggaacag

SEQ ID NO: 308901 - RNA, 64 nt, hsa
uucugcaguugcagagccagccccgcgugagaacgugcauaaugagugcacaccaucaugucaa

SEQ ID NO: 308902 - RNA, 64 nt, hsa
gaacuaaaaaaaugggaagcccuccccaaaaaaagugcauaaaauguuauuuuugcauggcaug

SEQ ID NO: 308903 - RNA, 64 nt, hsa
acuccuaacaacccaaagaccuauuuaacaauuggugcauaaaugaaaguaguacuguauacuu

SEQ ID NO: 308904 - RNA, 64 nt, hsa
aagaacuguacugucuguuaugauuuccuucaaugugcauaaugauaaaauaaauaauuuuaau

SEQ ID NO: 308905 - RNA, 64 nt, hsa
aaaaacauuuagaggauuaugcuuguuuugaguggugcauaagggaaaaaacugacuuuuuuuc

SEQ ID NO: 308906 - RNA, 64 nt, hsa
uguuuaaauuuuagaaaaccuguauaaauuacuggugcauaacuuaaagauuauucugccuuug

SEQ ID NO: 308907 - RNA, 64 nt, hsa
gcaaucagccuggucucucccaugaagaugucgugugcauaagcacaaucaucacugauuagaa

SEQ ID NO: 308908 - RNA, 64 nt, hsa
aauucuguuaucaaggcccacauucuuaaauacugugcauaaauuauuaugguguuuugccuau

SEQ ID NO: 308909 - RNA, 64 nt, hsa
ugcccuucugauucccgccucugguccuuuacaugugcauaaccacaugcacacacacucacgc

SEQ ID NO: 308910 - RNA, 64 nt, hsa
auuaaaaaguugaauauguuccugcauuucagcagugcauaaucgagcaggaggcuggaaucug

SEQ ID NO: 308911 - RNA, 64 nt, hsa
agcccagagacaggggaaggcagccuguccaucugugcauaaggagaggaaaguuccagggugu

SEQ ID NO: 308912 - RNA, 64 nt, hsa
aguagcaaugucuuccucuuaugaccagaguucugugcauaacaggaucccauaccaaagcccu

SEQ ID NO: 308913 - RNA, 64 nt, hsa
gagcuuuugacucuguuggguuuuauuugaaugugugcauaacaguaaugagaucuggaaacac

SEQ ID NO: 308914 - RNA, 64 nt, hsa
cauuguuaacauuaaggaaagcuggcagaagggugugcauaaauucuauacucuuuuugaaacu

SEQ ID NO: 308915 - RNA, 64 nt, hsa
gggugagcauaccugucucagcuguuuggccaaugugcauaaccuacucggauccccaccugac

SEQ ID NO: 308916 - RNA, 64 nt, hsa
ccuggugcccagaacagggcauggcauauuguuggugcauaauaaauauuguggaaauaauuuc

SEQ ID NO: 308917 - RNA, 64 nt, hsa
acaaaauguggugcagaaacuaucuugcaccugugugcauaaacuguuagucgugacugacuug

SEQ ID NO: 308918 - RNA, 64 nt, hsa
caucucauuauuuucaggccaaggugggaguauagugcauaauaauuguacaguagcaauuuuu

SEQ ID NO: 308919 - RNA, 64 nt, hsa
gcaaaaggaagcaucaauaguggacccagaggcagugcauaaaaccuuaggauagauuccuaag

SEQ ID NO: 308920 - RNA, 64 nt, hsa
auaaaaggaccuugggacauaagaaccaaugauugugcauaaguucuaaauuagagacacauau

SEQ ID NO: 308921 - RNA, 64 nt, hsa
uuuuuaaaaauauauauaucuaaaugaaugcaaugugcauaaauauuuuuuaaacauaacagug

SEQ ID NO: 308922 - RNA, 64 nt, hsa
gccauucucacacuauaacaagaaaagaaaugaagugcauaagucuccugggaaaagaaccuua

SEQ ID NO: 308923 - RNA, 64 nt, hsa
agcugugucaaaaggaagcuuguuuguaauacgugugcauaaaaauuaaauagaggugaacaca

SEQ ID NO: 308924 - RNA, 64 nt, hsa
aagccacccuguggggauggagaauggguaguuagugcauaauggauacaaaguuucugauugg

SEQ ID NO: 308925 - RNA, 64 nt, hsa
cuucacaggagccuuguuuucaauuugcuaacaggugcauaaucccugugcuccuuaagccuca

SEQ ID NO: 308926 - RNA, 64 nt, hsa
uuuugaauguuuuguauuauacuuguuuuugugugugcauaaauucauucuguaggaucuuaag

SEQ ID NO: 308927 - RNA, 64 nt, hsa
gccuucuuuuucagcuuguggcaaugccagugaugugcauaaacaguuuuuuuuuuuccauaag

SEQ ID NO: 308928 - RNA, 64 nt, hsa
auuugggaacauuugacuuccuugggacucuuaagugcauaaugauggcaugaaguaaaagggg

SEQ ID NO: 308929 - RNA, 64 nt, hsa
gcugcugcacacuucucggucuaggugggagagagugcauaaagguucuggggcugggccugag

SEQ ID NO: 308930 - RNA, 64 nt, hsa
ugggauccaguguauaaauccaauaucaugucuugugcauaauucuuccaaaggaucuuauuuu

SEQ ID NO: 308931 - RNA, 64 nt, hsa
uuuauuuuacagaauuuaccuucucuguauauaugugcauaaagugugguguaaauauacuaaa

SEQ ID NO: 308932 - RNA, 64 nt, hsa
gcuaguguuuuauccuauguauuuuaacucauuagugcauaaaggcaagccccauauaaugaag

SEQ ID NO: 308933 - RNA, 64 nt, hsa
ggugggagaagaggggcugguagaccgaagccuugugcauaaggauuuuuucccaggaaaagau

SEQ ID NO: 308934 - RNA, 64 nt, hsa
ccacauauguauaacuaugugaaaaauuauauuugugcauaauaaaaugugauaacuuuuuaca

SEQ ID NO: 308935 - RNA, 64 nt, hsa
uaguaaagaugagaaagaugguugaagaaaauuagugcauaauuucucagugaauaaaguugua

SEQ ID NO: 308936 - RNA, 64 nt, hsa
gauaaugaaguugcaaguuuugauagcccgugaagugcauaaguaucuaauuuuaccugaauug

SEQ ID NO: 308937 - RNA, 64 nt, hsa
auguaugaggaugaucacugaaauauuuaugacagugcauaauuugcaaaauaaaaaauguaca

SEQ ID NO: 308938 - RNA, 64 nt, hsa
ggggccccugguucgucccugagccuuuuucacagugcauaagcaguuuuuuuuguuuuuguuu

SEQ ID NO: 308939 - RNA, 64 nt, hsa
gcauuugaauugugauagauuucuuuggcuaccugugcauaauguaguuuguaguaucaaugug

SEQ ID NO: 308940 - RNA, 64 nt, hsa
aaguuaaacugagcagcauuuggguugauaccaagugcauaagauucaaacuuugagugacauu

SEQ ID NO: 308941 - RNA, 64 nt, hsa
ggaaaauguauagcuuuuugauuagggcaauggagugcauaaauuagaaacuucuaagugcacu

SEQ ID NO: 308942 - RNA, 64 nt, hsa
augggaaagaaaauggacauucugaaugugucaggugcauaauauccuaauuuaugcuugucag

SEQ ID NO: 308943 - RNA, 64 nt, hsa
ucucccggcacuucuaccuuccagaguuacuucagugcauaaaguuugaauuauuuuguucuug

SEQ ID NO: 308944 - RNA, 64 nt, hsa
caccuaguaugcucaguaaauguuuguggaauaagugcauaaaauguucuuaaccuuugauucu

SEQ ID NO: 308945 - RNA, 64 nt, hsa
uuacuuuugugaauuccuuagccuuucuuccuuggugcauaaaguuaaaaugcacaucagcaga

SEQ ID NO: 308946 - RNA, 64 nt, hsa
uucuagguuagucaagauuucucuuaagauuuaagugcauaaagaauaguaauuuagaaguauc

SEQ ID NO: 308947 - RNA, 64 nt, hsa
uauauaaugucauuuuuacggaaacccuuucggcgugcauaaggaaucacuguguacaaacugg

SEQ ID NO: 308948 - RNA, 64 nt, hsa
acuuggaaaauccaaauaaggaaguuuuagguuggugcauaacuuuguuucucaaauuuucguu

SEQ ID NO: 308949 - RNA, 64 nt, hsa
gaaacacgagaagcagcaaagacagagcacacaagugcauaaggcuguugucuucggcuugggu

SEQ ID NO: 308950 - RNA, 64 nt, hsa
aucuuucuuggauccuuuuggucauuauuucagugugcauaaguucuuaaugucaaccaucuuu

SEQ ID NO: 308951 - RNA, 64 nt, hsa
cucuugcacucaaagcuuguuaagauaguuaagcgugcauaaguuaacuuccaauuuacauacu

SEQ ID NO: 308952 - RNA, 64 nt, hsa
uaauuucuguuacuggcuuugcuagaauucauaugugcauaaauaacacuaauauuuaucaucu

SEQ ID NO: 308953 - RNA, 64 nt, hsa
uuuuuaaaauauucugugugaugacauggguagugugcauaaaguaccucugugucugaaguau

SEQ ID NO: 308954 - RNA, 64 nt, hsa
uaaauuuccaguucaacuuguaaauguuuuuauugugcauaaauacauacuaauguugaucuaa

SEQ ID NO: 308955 - RNA, 64 nt, hsa
ugucaacuguuucauugcuuuuuaaauuuuucacgugcauaacccccuuuagaaguaaauuuuu

SEQ ID NO: 308956 - RNA, 64 nt, hsa
uggaaagagccugauuuucuaaaauaugcaucaagugcauaaauuacaaaucagagcugagugg

SEQ ID NO: 308957 - RNA, 64 nt, hsa
aagacgaggaaguaaggaagggaaugcaagacuagugcauaaaaaugcaauaggugucauaugu

SEQ ID NO: 308958 - RNA, 64 nt, hsa
caaguuuuaaaaaaaugacaggguuuaauggagcgugcauaaaaauguacuguuuucaccuuuu

SEQ ID NO: 308959 - RNA, 64 nt, hsa
aaggcugauagcugguaucacauaguuggagucagugcauaauuccaaguggcuuuuuuuuuuu

SEQ ID NO: 308960 - RNA, 64 nt, hsa
guugacaaugcacugacuuuagaaagauguuaaugugcauaaauagaguguaaauaaaauagug

SEQ ID NO: 308961 - RNA, 64 nt, hsa
cacgaauccguaaaaaccccaugacuuucucuucgugcauaaacagauguauuuuugauuucag

SEQ ID NO: 308962 - RNA, 64 nt, hsa
gaauauaguuuuaaaaacccuuugaacaaagugugugcauaaccagucaugagauaaaacaaca

SEQ ID NO: 308963 - RNA, 64 nt, hsa
ccauuuuuuaauuuuaacagugcucuuccaucuugugcauaagccugagauuuggaaagaauaa

SEQ ID NO: 308964 - RNA, 64 nt, hsa
caaucagugaauguacaacccagccgaggggacggugcauaacucuccaucagaagcccugggg

SEQ ID NO: 308965 - RNA, 64 nt, hsa
acuguuuuguauaacuguacaguguuuaauagaggugcauaaucagcuguuguuacugguaaaa

SEQ ID NO: 308966 - RNA, 64 nt, hsa
ggaggaaacaaucuagaagauaaaagaaaaagaugugcauaacuuguuuucaguuucccuguuu

SEQ ID NO: 308967 - RNA, 64 nt, hsa
gaguacuggauggaaaacucuacaauaacauuuugugcauaauuguagaaauacagauuuuguu

SEQ ID NO: 308968 - RNA, 64 nt, hsa
uucugaauuauucuggauaucgucauuuugcagugugcauaauuuugccaaccguugcuuucgu

SEQ ID NO: 308969 - RNA, 64 nt, hsa
cuuugguuucuggggcaaauagagcaccagcuuugugcauaauuuggauguccaaauuugaacu

SEQ ID NO: 308970 - RNA, 64 nt, hsa
ugcuuccgcaccgguagcaguuguggaugucagugugcauaagcaaguaucagaccucagaaug

SEQ ID NO: 308971 - RNA, 64 nt, hsa
aacagauuuuguaauaauguaacuuuguuaauaggugcauaaacacuaaugcagucaauuugaa

SEQ ID NO: 308972 - RNA, 64 nt, hsa
aaauaaaauccacucaagagucacaaggcccgcugugcauaaucgguuucacuuuuaccuuuuu

SEQ ID NO: 308973 - RNA, 64 nt, hsa
cuguguauaacauguacuaaauauuacaguuauugugcauaacagauuguuccucuuauauuug

SEQ ID NO: 308974 - RNA, 64 nt, hsa
aggagucugagaauauuggcccuuucuaaccuaugugcauaauuaaaaccagcuucauuuguug

SEQ ID NO: 308975 - RNA, 64 nt, hsa
uaaaucacuucugucuuugcuggaaaguguauuugugcauaaauaaagucuguguauuuguuuc

SEQ ID NO: 308976 - RNA, 64 nt, hsa
ucaaugguguuggcuuccccuccccaccccacgcgugcauaaaaacugguucuacaaauuuuua

SEQ ID NO: 308977 - RNA, 64 nt, hsa
ugaugaucccaugguaggucuucucaccucgauggugcauaacaggauguguuugaaccuagua

SEQ ID NO: 308978 - RNA, 64 nt, hsa
uucuaccguacuuuaguaguuugaaguuuuucaagugcauaacuauuuuugaccagcagauggc

SEQ ID NO: 308979 - RNA, 64 nt, hsa
guugauagugcagagaaacccuccacauuuuucagugcauaauugaguuuucuauaaaugccuu

SEQ ID NO: 308980 - RNA, 64 nt, hsa
aguaaguuucauucuaaaaucagagguaaauagagugcauaaauaauuuuguuuuaaucuuuuu

SEQ ID NO: 308981 - RNA, 64 nt, hsa
cucuauuacagcauguugccauacaucuauuuaagugcauaaggucuuuggccuucaagaucca

SEQ ID NO: 308982 - RNA, 64 nt, hsa
uccauacuaaagccccauuauuuagauugagcuugugcauaagaaugccaagcauuuuagugaa

SEQ ID NO: 308983 - RNA, 64 nt, hsa
cauguuaggaaggucaaaaaaaaggaaaaaagaaaaauaauaaaaaauaauaaaaauccuuagg

SEQ ID NO: 308984 - RNA, 64 nt, hsa
aggucaaaaaaaaggaaaaaagaaaaauaauaaaaaauaauaaaaauccuuaggauaacuugag

SEQ ID NO: 308985 - RNA, 64 nt, hsa
gccaccaagucuagacuugaugguguucaagaauaaauaauacugauugccucccuaguccuug

SEQ ID NO: 308986 - RNA, 64 nt, hsa
cuuaugugcaguaacuauaaugguaaagaauguuaaauaauaaaauuuaacauuuuccaaaugc

SEQ ID NO: 308987 - RNA, 64 nt, hsa
guagucucacacuguuuuucauacucuuaaguguaaauaauauaaaauguuucaagcgcuuaac

SEQ ID NO: 308988 - RNA, 64 nt, hsa
uuguggcaaaauauucuucuuugauaguguaaacaaauaauaaagcaaucuagguccuuuaggu

SEQ ID NO: 308989 - RNA, 64 nt, hsa
uguuuaacuuucuaagccuccauuucucaucaguaaauaauaguugcuuccuaggacuuuaaug

SEQ ID NO: 308990 - RNA, 64 nt, hsa
aacaguuaucuugaaagcuauuggguauagcauaaaauaauaucacucuuuuaauaguauacaa

SEQ ID NO: 308991 - RNA, 64 nt, hsa
uugguuuuacaauuuaaaaaguauauucuauaauaaauaauaaaacaaauuguuuuaaauguuu

SEQ ID NO: 308992 - RNA, 64 nt, hsa
cuuuaaaaaauguaaggauuucauuuauauugaaaaauaauauuaaucauuuugcuguuaacac

SEQ ID NO: 308993 - RNA, 64 nt, hsa
guggaguagccauucuuuauucuuuuacuuuuuaaaauaauaacaaucacaaaggaaagauuug

SEQ ID NO: 308994 - RNA, 64 nt, hsa
gccaauagaguugggacaauugcuuacucauuaaaaauaauagagccccacuugacacuauuca

SEQ ID NO: 308995 - RNA, 64 nt, hsa
uuaaaugguguggaaaugcaaauaauaccaaguaaaauaauacagauauuauuaaaguuucugg

SEQ ID NO: 308996 - RNA, 64 nt, hsa
ugcaagcuaaaauuuuuaaaugguguggaaaugcaaauaauaccaaguaaaauaauacagauau

SEQ ID NO: 308997 - RNA, 64 nt, hsa
gaaaacugaggcaguuaaccaaaguagcucauauaaauaauaaaaccaaucugaguuuagccuc

SEQ ID NO: 308998 - RNA, 64 nt, hsa
acuaauguaagauuagcuauuauuuguaggacugaaauaauaauccagauaauugguuuuugcc

SEQ ID NO: 308999 - RNA, 64 nt, hsa
uuauaagauuuaauuguaauugucucaaagcaucaaauaauacaucuuuaucauuaaacaugaa

SEQ ID NO: 309000 - RNA, 64 nt, hsa
cuaaaacuagauaacuuaaauaauuuaagccaauaaauaauauuauauuguauuuaacccauua

SEQ ID NO: 309001 - RNA, 64 nt, hsa
aucuaauaaaauggcuauuccucuuuuuacuuggaaauaauaaauuaacauuauauuuuaaaca

SEQ ID NO: 309002 - RNA, 64 nt, hsa
aguugcugaaaaguauuaacaugguauuaagcuuaaauaauacguaaugggacuagauggccca

SEQ ID NO: 309003 - RNA, 64 nt, hsa
uguuacuuuucuggucuuuucauggcauaugagcaaauaauaaacuauuuacacuacuauucug

SEQ ID NO: 309004 - RNA, 64 nt, hsa
accguaauauuauaucuugcccuacuuauuuacaaaauaauauguuucuguuaugguccuuagu

SEQ ID NO: 309005 - RNA, 64 nt, hsa
uccuuugucuuuggcugauuucugcuuuguagauaaauaauaauagcccugagauguuucuaac

SEQ ID NO: 309006 - RNA, 64 nt, hsa
aacugaccugaauuggaaaggaugugauuaauauaaauaauagcagauauaaauugugguuaug

SEQ ID NO: 309007 - RNA, 64 nt, hsa
ucucccgagaaaaauaucucauuaaaaagcccauaaauaauaggggagaagaaagccuuaggua

SEQ ID NO: 309008 - RNA, 64 nt, hsa
accuacuugaaaggaucauugugcggauuaaaagaaauaauauauguaaagcacuuuaacacag

SEQ ID NO: 309009 - RNA, 64 nt, hsa
gauuucaguaaccuucuggaaagcuaucaguuucaaauaauauuuucucuguaguaugagauga

SEQ ID NO: 309010 - RNA, 64 nt, hsa
uagauuuuauguaguauuaagugaaaaaauacgaaaauaauaaacauugaagaaaaaaauaacu

SEQ ID NO: 309011 - RNA, 64 nt, hsa
uuaauaaaauaauuuuuauggcaauacaacugugaaauaauaaggccgauuuucauauaaaugu

SEQ ID NO: 309012 - RNA, 64 nt, hsa
ccaggaaagaagcagcuuagagaaaauguggaggaaauaauaugacacuuagagaaaaaggaag

SEQ ID NO: 309013 - RNA, 64 nt, hsa
cuacugcuggcaauugggaaccgcaagguauacuaaauaauauaucaacaacuaauggccaucu

SEQ ID NO: 309014 - RNA, 64 nt, hsa
cucaaauuugcuauaguuugucauuuuugcuuacaaauaauauaacuuuucaaccuucuaguua

SEQ ID NO: 309015 - RNA, 64 nt, hsa
aaauuuaaaaucacaugcaaaaaaaaaaucagcaaaauaauaaaaugaacgaaaaaaaaugaca

SEQ ID NO: 309016 - RNA, 64 nt, hsa
uuuuuaccaaaguguagcuaauauuucaagcugaaaauaauaguucuacugcccgugucuccag

SEQ ID NO: 309017 - RNA, 64 nt, hsa
acauguacagacuuuuuucuuguuauuauucucuaaauaauacaguaugacaacuauuuccaca

SEQ ID NO: 309018 - RNA, 64 nt, hsa
ucuguaauaaaaaacuaaauuaaaccuugcauuaaaauaauaucacaguaucaguggacuaaac

SEQ ID NO: 309019 - RNA, 64 nt, hsa
cuaugucucauaaaaauuagaauguacuauuuuaaaauaauauguguaaauugaaauuuuuuuc

SEQ ID NO: 309020 - RNA, 64 nt, hsa
caagaucugccccaguaauuuaccaaagguagcaaaauaauagugaagauggaauaugucugcu

SEQ ID NO: 309021 - RNA, 64 nt, hsa
guugauuuuuuugcucuccauuuugacuugcaagaaauaauaccucaagauaaucugauuuauu

SEQ ID NO: 309022 - RNA, 64 nt, hsa
aguacaucucccuuuugccuaaugaacuuuugaaaaauaauaaaauaauagaauaaauuagacu

SEQ ID NO: 309023 - RNA, 64 nt, hsa
ucccuuuugccuaaugaacuuuugaaaaauaauaaaauaauagaauaaauuagacuuugaaugg

SEQ ID NO: 309024 - RNA, 64 nt, hsa
uguugcauuucaguaaaagcagaauaaccuuucaaaauaauaacaggcugggugcaauggcuca

SEQ ID NO: 309025 - RNA, 64 nt, hsa
ccuggccugggcaacagagcaagacccugucucaaaauaauaauaauauauaauuuuacaccaa

SEQ ID NO: 309026 - RNA, 64 nt, hsa
acuuuuauuucgucucaguuuuuggucacaggccaaauaauacagcgcucucucugcuucucuc

SEQ ID NO: 309027 - RNA, 64 nt, hsa
aaauuagucaauaaugaccccaauuuuuucauuaaaauaauaguggugaauuauauguuauugu

SEQ ID NO: 309028 - RNA, 64 nt, hsa
ggauucaaccaaccaaggacggaaaaugcuuaaaaaauaauacaacaacaacaaaaaauacauu

SEQ ID NO: 309029 - RNA, 64 nt, hsa
cccuaaaauaguuagaucuuuguaaaugcauauuaaauaauaaaguaugacccacauuacuuuu

SEQ ID NO: 309030 - RNA, 64 nt, hsa
cccacauuacuuuuuaugggugaaaauaagacaaaaauaauaguuuuagugaggauggugcuga

SEQ ID NO: 309031 - RNA, 64 nt, hsa
auuuuuagauucaauauuuauauggaguuuugaaaaauaauaguggcccugaaggaauaaauuc

SEQ ID NO: 309032 - RNA, 64 nt, hsa
auaccccccaauuguuuuucaauccccuuuucucaaauaauaaauuaguuaaaucaguuucuga

SEQ ID NO: 309033 - RNA, 64 nt, hsa
ccuuugacuauaagaaauuaaaaaaaaaacaccaaaauaauauuuuucuuacuugauauaccaa

SEQ ID NO: 309034 - RNA, 64 nt, hsa
uuuacaaaccauauuaaaaggcuaauuuaaauauaaauaauauaaagugcucugaauaaagcag

SEQ ID NO: 309035 - RNA, 64 nt, hsa
ccagaagcacuggacuaaagagugcuaaugcaggaaauaauacacauaauuuuuagguaaggau

SEQ ID NO: 309036 - RNA, 64 nt, hsa
uggaaauuaaaacaccaucucagcuuuaacuuuuaaauaauaaugauaacuaucuuuauugagc

SEQ ID NO: 309037 - RNA, 64 nt, hsa
aguuuuuguuuuacugagaugcuuuuguaaaggaaaauaauacugugacaguuuaguaauucua

SEQ ID NO: 309038 - RNA, 64 nt, hsa
uucccugucuaacuguagacaaaucuuuaaaaaaaaauaauaauaaucuggugccucaguuucc

SEQ ID NO: 309039 - RNA, 64 nt, hsa
gugcuuuacaacuacauaguacuuuuuaacaacaaaauaauaauuuuaagaaugaaaaauuuaa

SEQ ID NO: 309040 - RNA, 64 nt, hsa
uauucaagacaaaaagaacaguaugaggcaagagaaauaauauguauuuaaaauuuuugguuac

SEQ ID NO: 309041 - RNA, 64 nt, hsa
caaccaacagugaauguggagcugagagacaguaaaauaauaacugacaugccaccgaaguaca

SEQ ID NO: 309042 - RNA, 64 nt, hsa
caagguaguaauuuaaacagggaaaguuuaauauaaauaauaauuaagcuaugauaggagaaua

SEQ ID NO: 309043 - RNA, 64 nt, hsa
auaaauucuauaggaacauaugaaaauacaacuuaaauaauaaacaguggaauauaaggaaagc

SEQ ID NO: 309044 - RNA, 64 nt, hsa
ugugauguuuguccugaacacuuuuguuguaaaaaaauaauaauaauguuuaauauugagaaag

SEQ ID NO: 309045 - RNA, 64 nt, hsa
auuucccaaagaaauguaagugaauggagaccucaaauaauaacuguauucauaaaacucgugu

SEQ ID NO: 309046 - RNA, 64 nt, hsa
auuuuaaagauucaaggaagccauaagucauacuaaauaauauuauauacaguuuuguuauugu

SEQ ID NO: 309047 - RNA, 64 nt, hsa
agagauguauggcauuuuaauuuggcaaucucuuaaauaauauugcccugcaaguacccaguaa

SEQ ID NO: 309048 - RNA, 64 nt, hsa
uugaaggucauaaucagugauuuuuguuauaugaaaauaauaguguuucacaguauuucuauuu

SEQ ID NO: 309049 - RNA, 64 nt, hsa
gugcccuuaaaauugugcuggggcugcagcaaauaaauaauauugggacucauauucagucuuu

SEQ ID NO: 309050 - RNA, 64 nt, hsa
aaguguuugauuaaaauagagaaaauaauuuuuaaaauaauagauaaaaauuuuaaaaacagcc

SEQ ID NO: 309051 - RNA, 64 nt, hsa
agccuggccaccuuagugagaucccuucucuuaaaaauaauaacuuauugccagauuuggggca

SEQ ID NO: 309052 - RNA, 64 nt, hsa
ucuauauucacccaaauaaucaagggugaagguaaaauaauacauuuuuagacaagcaaagacu

SEQ ID NO: 309053 - RNA, 64 nt, hsa
cuuugguacaaauaaaaacuguauaucuauauacaaauaauauauagauauauauguccaccag

SEQ ID NO: 309054 - RNA, 64 nt, hsa
gcaaaaauguccauaugcacuauuuaaauguuuuaaauaauauauuccuucuuuauaaugcuaa

SEQ ID NO: 309055 - RNA, 64 nt, hsa
cuucauaauuucacccugugacuauccugaaaagaaauaauaaucauuuuaugauugaugggcc

SEQ ID NO: 309056 - RNA, 64 nt, hsa
cagaauuacuaagcauguggcauaaauuuggagaaaauaauaugacuagaaaaauuaguguuau

SEQ ID NO: 309057 - RNA, 64 nt, hsa
gagcaguuaacuuuacucuugguucugagucuccaaauaauaauagccgacguuuauugagcac

SEQ ID NO: 309058 - RNA, 64 nt, hsa
auggacauagugcagacauuaauaagacauagaaaaauaauaauuauacaugcuguuguacccu

SEQ ID NO: 309059 - RNA, 64 nt, hsa
ccaaaguaaaucugauauauguaaugaaguuauuaaauaauacuuuuaaaaaucagacauuuau

SEQ ID NO: 309060 - RNA, 64 nt, hsa
cucuauccuggguaacagcgagacucugucuuaaaaauaauaacaauaauaauaauaauaaaga

SEQ ID NO: 309061 - RNA, 64 nt, hsa
agccaaagacugcuugcuaguaggaaaaaauuucaaauaauaaccaaagcugaaaaauggucug

SEQ ID NO: 309062 - RNA, 64 nt, hsa
gcucucaauaaauaugcauuaugauuuacauacgaaauaauagcauuuaacaaauguagguaga

SEQ ID NO: 309063 - RNA, 64 nt, hsa
caggucauuacuguaaguuuuccauuuuuguuacaaauaauaaguaagaugauacuuuaaaauc

SEQ ID NO: 309064 - RNA, 64 nt, hsa
uauauacuaagaauaaauaaaauauacccaugugaaauaauaauuggauuauggauaacaagag

SEQ ID NO: 309065 - RNA, 64 nt, hsa
aauguuaguauucaucucuuugaaucauuugcucaaauaauaacauuccaccuuuuccugcugu

SEQ ID NO: 309066 - RNA, 64 nt, hsa
uuuauagcugaguuuucccuucuguaucaaaacaaaauaauacaaaaaaugcuuuuagaguuua

SEQ ID NO: 309067 - RNA, 64 nt, hsa
aagcaagcacaaguaugcugguaguagccucuuuaaauaauauguauagacaacaacaacgaca

SEQ ID NO: 309068 - RNA, 64 nt, hsa
uuuaucacagaguagaucacuggaauggaauuccaaauaauaaacuuuggaagguguaacucuc

SEQ ID NO: 309069 - RNA, 64 nt, hsa
uacauuaugacaggaaguaaaaguuuacauggugaaauaauacuggggaaaucggagcaacaau

SEQ ID NO: 309070 - RNA, 64 nt, hsa
uacuauuuuuauuuuaaaauaaaauuuaccuuuaaaauaauaauaguacuauugcuaguacuag

SEQ ID NO: 309071 - RNA, 64 nt, hsa
uuaaucaauauuuaagagauuaagaauauugcccaaauaauauuuuagauuacaggauuaauau

SEQ ID NO: 309072 - RNA, 64 nt, hsa
agguagcuucuuuuuucucaaauguaauucagcaaaauaauacaguacugccaccagauuuuuu

SEQ ID NO: 309073 - RNA, 64 nt, hsa
aauguuuugcaaauacaugccaauaacacagaucaaauaauaucuccucaugagaaauuuauga

SEQ ID NO: 309074 - RNA, 64 nt, hsa
agaaacuuaaauuuuaguucuuacugcuuaauucaaauaauaauuaguaagcuagcaaauagua

SEQ ID NO: 309075 - RNA, 64 nt, hsa
aagaacacagcccugcuucugacauaauccaguaaaauaauaauuuuuaagaaauaaauuuauu

SEQ ID NO: 309076 - RNA, 64 nt, hsa
acuauuuccaaacucauauuacaaaaacaaaauaaaauaauaaaaaaagaaagcaugauauuua

SEQ ID NO: 309077 - RNA, 64 nt, hsa
uuaaaagaauguaaaauauaucaucaaguucuuaaaauaauauacaugcauuuaauauuuccuu

SEQ ID NO: 309078 - RNA, 64 nt, hsa
ccuauaccugaauauaacaaccuuuaaaaaagcaaaauaauaagaaggaaaaauuccaggaggg

SEQ ID NO: 309079 - RNA, 64 nt, hsa
uugcccuaucgugauuucaguugaauucaugugaaaauaauagccauccuuggccuggcgcggu

SEQ ID NO: 309080 - RNA, 64 nt, hsa
cagccugggugacagagcgacccucugucucaaaaaauaauaauaauaauaaauaaaacaacaa

SEQ ID NO: 309081 - RNA, 64 nt, hsa
gaaaccuuuacuauuuccaauguauguuuguuaaaaauaauaauaauaaaaccaaaagccuuug

SEQ ID NO: 309082 - RNA, 64 nt, hsa
aauagcugacccuaaauucauuuuucaugcuuaaaaauaauagaacaaauaauaauacuauuuu

SEQ ID NO: 309083 - RNA, 64 nt, hsa
uaaauucauuuuucaugcuuaaaaauaauagaacaaauaauaauacuauuuuugggcaaaaucc

SEQ ID NO: 309084 - RNA, 64 nt, hsa
auaucucugaaauaaugaaauauauugaugggugaaauaauauuucugguauuuucuucauuau

SEQ ID NO: 309085 - RNA, 64 nt, hsa
auauggaagucaaagugaggaacagagauagcuuaaauaauacacuaagauugauuuuaugcuc

SEQ ID NO: 309086 - RNA, 64 nt, hsa
ccugggauguaacuaucuuacauguuuacauaagaaauaauaaacuggaggugggaauggagaa

SEQ ID NO: 309087 - RNA, 64 nt, hsa
uuauuuuaacaaagauuaaaauauacugcagggcaaauaauauucucuaaaacacaggaacugc

SEQ ID NO: 309088 - RNA, 64 nt, hsa
uaaaauggaaggccacagaaaaggggaaaagaggaaauaauacaguaaucguuaauccagcaaa

SEQ ID NO: 309089 - RNA, 64 nt, hsa
aaucuauaaugccauaaaugauaaugcaaaaccuaaauaauaugguggccggaggggcugccuu

SEQ ID NO: 309090 - RNA, 64 nt, hsa
ucuucaucucacccauuucaagucugagguaaaaaaauaauaaugauaacaaaacggggugggu

SEQ ID NO: 309091 - RNA, 64 nt, hsa
uuuaaaagcacuuucuauuuuuaaaaguaacuugaaauaauauaguauaagaauccuauugucu

SEQ ID NO: 309092 - RNA, 64 nt, hsa
ggcucucuaaagaaaaacucauuguaacuuauuaaaauaauaucuggugcaaaguaucuguuuu

SEQ ID NO: 309093 - RNA, 64 nt, hsa
gaacuuugccaaugauagugaccacagcaaaagcaaauaauaauaauauuaauaauaauaaaga

SEQ ID NO: 309094 - RNA, 64 nt, hsa
auaauaauaauauuaauaauaauaaagagaaauaaaauaauaaaauaaaaaacaauagcacagc

SEQ ID NO: 309095 - RNA, 64 nt, hsa
ugcuuuuuaaaaauuggaauaauguauuaaggucaaauaauaucccauaaaauauauauuucug

SEQ ID NO: 309096 - RNA, 64 nt, hsa
aggucuaaaacacacuagaguagcuggugacuauaaauaauauuuuaaaaugcugugucuacac

SEQ ID NO: 309097 - RNA, 64 nt, hsa
auuauggucaaauauaauuuggucaccaaaaaugaaauaauaguuuaaaacaaguagcuguuac

SEQ ID NO: 309098 - RNA, 64 nt, hsa
uuuuuuuaccccaacuacugaauccaggaguaccaaauaauauauaguaaaacuaagauuuaag

SEQ ID NO: 309099 - RNA, 64 nt, hsa
gaguaaacuuauugcauauuuucauaaucagucaaaauaauaaaacuaaaaacaaaaaguaaaa

SEQ ID NO: 309100 - RNA, 64 nt, hsa
ggaaugaagaauuaggcuugguuucagguuacauaaauaauagagcagaugguugccuuugggu

SEQ ID NO: 309101 - RNA, 64 nt, hsa
gaagagauaacuuccaaaagagugcuguuuuuaaaaauaauaauuaggaaauguuuauuuagca

SEQ ID NO: 309102 - RNA, 64 nt, hsa
auguacaguuguauauacaguaugacaagauguaaaauaauauguuuuucaugcaguuuaaaau

SEQ ID NO: 309103 - RNA, 64 nt, hsa
cauaaauaacagucugaacuuauuuguuuauuuaaaauaauaauaaaauaauuaaaaauuuauu

SEQ ID NO: 309104 - RNA, 64 nt, hsa
uucuaaagaugagcuuccaaaacccacaacuccuaaauaauacagaaaguuuuguguuugacug

SEQ ID NO: 309105 - RNA, 64 nt, hsa
cguauaauuugaggaguggaugguggaugaaaagaaauaauaaauuguaaucagcaguaaagga

SEQ ID NO: 309106 - RNA, 64 nt, hsa
gaggcaugaaaguuaaauguauauauuaugguagaaauaauauugaaggauauuguacuucacu

SEQ ID NO: 309107 - RNA, 64 nt, hsa
guauuguugcuccuaccuucaaauaugacaccugaaauaauaagucuguuguccagaauuuaug

SEQ ID NO: 309108 - RNA, 64 nt, hsa
aucuucugaauguucaagagcauccuauagugccaaauaauaaagcaccauuuuuuucuucaua

SEQ ID NO: 309109 - RNA, 64 nt, hsa
aacaccagucuagagcaucuuauugucaacagcaaaauaauauuuugcccacccuguuugugac

SEQ ID NO: 309110 - RNA, 64 nt, hsa
gauacuuaggucaaauuucuguucucucuuccccaaauaauauuaaaguauuauuugaacuuuu

SEQ ID NO: 309111 - RNA, 64 nt, hsa
auauaaggaaagugauccaaaauuugaaauauuaaaauaauaucuaauaaaaagucacaaaguu

SEQ ID NO: 309112 - RNA, 64 nt, hsa
acuacauaucuaguaaaaccucguuuaauacuauaaauaauauucuauucauuuugaaaaacac

SEQ ID NO: 309113 - RNA, 64 nt, hsa
agucuccuaguauucaacaucauucugaacccugaaauaauauuuuucucuguuaaacaauuuu

SEQ ID NO: 309114 - RNA, 64 nt, hsa
uuuuaguuuaaaaagaccuucuucagauuggaccaaauaauacuuauaagaucagcagaauguu

SEQ ID NO: 309115 - RNA, 64 nt, hsa
uaagcaguuuuuauaaugaauuaaauuauuccauaaauaauauuuaaagagcacaagaaaaauu

SEQ ID NO: 309116 - RNA, 64 nt, hsa
uuuuggcuguauaaauaaaacugugagaagaaaaaaauaauaugaaacaaugagguauuuaaag

SEQ ID NO: 309117 - RNA, 64 nt, hsa
aauugcuuuaaaucugaagaacuuaaguuucacuaaauaauauauaugacauuuaucacacaaa

SEQ ID NO: 309118 - RNA, 64 nt, hsa
acauagaaaauuaaagauagcugcagaccauuagaaauaauacaauuguuuuuguuuacuuuua

SEQ ID NO: 309119 - RNA, 64 nt, hsa
gaacaaaaaauguuuuaaauuucucuuauauaggaaauaauaggaacgucaaagcucuguauac

SEQ ID NO: 309120 - RNA, 64 nt, hsa
aaaugaaaauguaucaccuguuccuuaacuguguaaauaauaauuaaauuucuuugaaacugga

SEQ ID NO: 309121 - RNA, 64 nt, hsa
ggacuagugaaaaaucuaguauuuguauccuggcaaauaauacuaauuuauaauccacaguaaa

SEQ ID NO: 309122 - RNA, 64 nt, hsa
uccagccugggcaacaagagcaaaacucagucucaaauaauaauaauaacaacaacuuaaugug

SEQ ID NO: 309123 - RNA, 64 nt, hsa
aaaagaaacaguugcuuguaaaauauacuuuuguaaauaauauuuaauuuuuuaaauaauauau

SEQ ID NO: 309124 - RNA, 64 nt, hsa
aaaauauacuuuuguaaauaauauuuaauuuuuuaaauaauauauuuggugcuguuuucucaga

SEQ ID NO: 309125 - RNA, 53 nt, hsa
uuuuucuuuucuuacaguaaaugaaauaauacgaaaugaccucuccagcacga

SEQ ID NO: 309126 - RNA, 64 nt, hsa
auguguguacauaucuaggcaucuauuuauguauaaauaauaacagagccgacguguccucgcc

SEQ ID NO: 309127 - RNA, 64 nt, hsa
uuuuaaucaguuugcuuucuccagagaaauuuuaaaauaauagaagaaauagaaauuuugaaug

SEQ ID NO: 309128 - RNA, 64 nt, hsa
uuaggucuuugucagacauucuggagguuuccaaaaauaauauuguaaaguucaauuucaacau

SEQ ID NO: 309129 - RNA, 64 nt, hsa
uacuuuuauuauucccuugcucauauaacuuuaaaaauaauacuuuuagcucuaauagcucaag

SEQ ID NO: 309130 - RNA, 64 nt, hsa
uuauuugaguagauuaauaaugaaaauacuuuggaaauaauauacauuuugacauucuaccaag

SEQ ID NO: 309131 - RNA, 64 nt, hsa
agacauuacacuaaaucagagugcugaguauagaaaauaauacaaacagauuugucuaaacauu

SEQ ID NO: 309132 - RNA, 64 nt, hsa
agucauauguuauuuuauuaauuguacuucuaugaaauaauaugcagucuauuuuuaaauuaua

SEQ ID NO: 309133 - RNA, 64 nt, hsa
aagaaauuccuaaaagucgauuuauuuuuguacaaaauaauaaaaaaaaaaacccaccacaaac

SEQ ID NO: 309134 - RNA, 64 nt, hsa
aacaaaauuuauauauagauauauauauauauauaaauaauauacuuuuccucagaggagcagg

SEQ ID NO: 309135 - RNA, 64 nt, hsa
gguuggaucacauacauuuaaggaucauauuauuaaauaauauaugcacagacauggagagaau

SEQ ID NO: 309136 - RNA, 64 nt, hsa
auuacuuaaaaauuaauugacucuucauauggaaaaauaauaucucccaucauaauauaaaaua

SEQ ID NO: 309137 - RNA, 64 nt, hsa
gauauauagugaaaagugugggaaaagaauauagaaauaauauucacuucuaaaaccauuauga

SEQ ID NO: 309138 - RNA, 64 nt, hsa
uguuaaacuugauucuuaugacauauuccuaugaaaauaauaaauacuggcacuuuuccuugca

SEQ ID NO: 309139 - RNA, 64 nt, hsa
uccucuacgguuauuuccugcuuucuaauuaaaaaaauaauaaccauggcaagagagaaagaaa

SEQ ID NO: 309140 - RNA, 64 nt, hsa
gugacaugaaaauuacaacagauauuccagaccaaaauaauacaacaaucccagcaucugauug

SEQ ID NO: 309141 - RNA, 64 nt, hsa
uaagcuuguuuuaauggucaaaaaauuaggacagaaauaauauggacauuuauuaguaucuucc

SEQ ID NO: 309142 - RNA, 64 nt, hsa
aucaaaagcauaauugaaaguucugaaaaaagaaaaauaauaauauguagaaaaauguaacuua

SEQ ID NO: 309143 - RNA, 64 nt, hsa
gguuuuaagaauaucugaguaaaauaacaauaugaaauaauaaacagaagcucuaacgucaggu

SEQ ID NO: 309144 - RNA, 64 nt, hsa
cuagagaguugacaaguugcuuguaguuuuaaaaaaauaauaaaguauacccuucugguauauc

SEQ ID NO: 309145 - RNA, 64 nt, hsa
ucuuuuuaauuaaaaauauuucaaauaugcagaaaaauaauaauauaaaugcccuuguacccuu

SEQ ID NO: 309146 - RNA, 64 nt, hsa
ugcuccaauguauguacauaagugucuguggcuuaaauaauauguuguuauuugauacauuuuu

SEQ ID NO: 309147 - RNA, 64 nt, hsa
uuaauaggccuaaaauagugagcauauauaaucaaaauaauacuucauacaacauauacuucca

SEQ ID NO: 309148 - RNA, 64 nt, hsa
accuaccucacaagguuaucagaaagaucaaauuaaauaauagaugugaaaaugcuuugaaaau

SEQ ID NO: 309149 - RNA, 64 nt, hsa
uaacuacuacauugaauugcauguuaaggugcagaaauaauacauuaaaagauuuucacuuuaa

SEQ ID NO: 309150 - RNA, 64 nt, hsa
ugaugauauuauuaaacaccauuauucacauuucaaauaauaacaauacuuuuuguuuuucaaa

SEQ ID NO: 309151 - RNA, 64 nt, hsa
augagaacaggugugaguuuuccaaaauacuuaaaaauaauagugucaaaaauucaggggcagu

SEQ ID NO: 309152 - RNA, 64 nt, hsa
guaacaaaaguguacuauguuaugcacacauuacaaauaauauaaggggaaguuuuauuagcuu

SEQ ID NO: 309153 - RNA, 64 nt, hsa
acccccagccuggguagagccaccagguacgacgaccagguaccagaaaccaccaggcacacgg

SEQ ID NO: 309154 - RNA, 64 nt, hsa
gccccuccccucgacccccagccuggguagagccaccagguacgacgaccagguaccagaaacc

SEQ ID NO: 309155 - RNA, 64 nt, hsa
aacaugacccuuaguaacaaacacaauuuauauaaugacccagcaaaacacaucacaucuuacu

SEQ ID NO: 309156 - RNA, 64 nt, hsa
aacaugcuaguugagacuuuucaaauggauuuuuaugacccacuacuggguuuggauccacagu

SEQ ID NO: 309157 - RNA, 64 nt, hsa
aauguccuucuccuccaaccucaaccacuauggcaugacccauguagcuagugucagcgaugua

SEQ ID NO: 309158 - RNA, 64 nt, hsa
auuggcaauaaaaccuguguguuugagaaggaaaaugacccaucggugaugcgcucaccuucug

SEQ ID NO: 309159 - RNA, 64 nt, hsa
aggaaggauuguuucuggugacugcagccgcugccgucgcgacacagggcuugguggugguagc

SEQ ID NO: 309160 - RNA, 64 nt, hsa
caaggacugaagccucaagcugcccgggguggcacgucgcgaaagcuuguuuccccacggucug

SEQ ID NO: 309161 - RNA, 64 nt, hsa
cuccaacacugcaacauggggacauuugccaacucgaacaaaggcugagaagcagccacaccgu

SEQ ID NO: 309162 - RNA, 64 nt, hsa
uucuuacuuacuaaaauauauauagaaauauauacgaacaaaacacacgcgcgcacacacacac

SEQ ID NO: 309163 - RNA, 64 nt, hsa
auuuuacaaaaaaaaaaaaaagcccagaaacuuucgaacaaaaccaaacacccggacgacccuc

SEQ ID NO: 309164 - RNA, 64 nt, hsa
ugcuuccuuuucaaagaauagacuucaaaagggacgaacaaacauuaggucaccuuuuguguuu

SEQ ID NO: 309165 - RNA, 64 nt, hsa
cucauguauuugaagacuguuucaugcuuugcuccgaacaaauaguaaauaacugaguauguuc

SEQ ID NO: 309166 - RNA, 64 nt, hsa
uuccugacacugagaaugaagaguaucacagugacgaacaaaaugauacucagaagcaauuuug

SEQ ID NO: 309167 - RNA, 64 nt, hsa
gcauaauuuuuaugaugaccugaaauuuuacauccgaacaaaauuuuacauccgaaaagcaacc

SEQ ID NO: 309168 - RNA, 64 nt, hsa
gauggauggauggaugagcgagaacccgcgcccgcgaacaaagagcgaaccaaagcgaugcuuc

SEQ ID NO: 309169 - RNA, 64 nt, hsa
guaggaguggaagagaggugugaagaaaccucuccgaacaaaugaaccagcaguaaguuucuaa

SEQ ID NO: 309170 - RNA, 64 nt, hsa
ucuuuggacugguuauuucugguuuugaaguaaucgaacaaauugaaaaucugaagaccgaugc

SEQ ID NO: 309171 - RNA, 64 nt, hsa
aagucagaauauaauaugaaguuccccaaggaaacgaacaaaaugaacucuagaauaucuagca

SEQ ID NO: 309172 - RNA, 64 nt, hsa
acgaaugguacguuuaaaaucagaaacaaaacaucgaacaaaacccuauuuaagagacugauca

SEQ ID NO: 309173 - RNA, 64 nt, hsa
auccuccugaccucaaaguguauuugccuuuaagcgaacaaaugcugggguccuuggggaccag

SEQ ID NO: 309174 - RNA, 64 nt, hsa
caauauguuagauuagguguaagacuuuaagaagcgaacaaaaaguaauguauaucuguaauau

SEQ ID NO: 309175 - RNA, 64 nt, hsa
ucuuuuuucagaauuucugacuauacuuuugguacgaacaaaauucaucaccacaggguccugu

SEQ ID NO: 309176 - RNA, 64 nt, hsa
aauugaugaaaaacuaaauucgaggaauuaaaaucgaacaaaacauagccuuucuuuuccgaug

SEQ ID NO: 309177 - RNA, 64 nt, hsa
gaccccaggaagucauccugcaaugggagagacacgaacaaaccaaggaaaucuaaguuucgag

SEQ ID NO: 309178 - RNA, 64 nt, hsa
cuuuauguauauauuuuaacaauccgcuuggacacgaacaaagccacacuucuaacugcuucug

SEQ ID NO: 309179 - RNA, 64 nt, hsa
auaucaaauacaaacgauguuguguuccuucucucgaacaaaacagcaaagggaaugccagcua

SEQ ID NO: 309180 - RNA, 64 nt, hsa
uuucuccuucaguggacugucugugucccccugccgaacaaagcugggaguaaaggcaaaaccu

SEQ ID NO: 309181 - RNA, 64 nt, hsa
aggucagccaacccccauccaacccuuagacucacgaacaaauccaccugagaucagcagagcc

SEQ ID NO: 309182 - RNA, 64 nt, hsa
aacaguauugcguugucagacuaggaaagcuaaacgaacaaaaugguuuuaguuuugcugaaga

SEQ ID NO: 309183 - RNA, 64 nt, hsa
ucaaggucauugaucuuacgcauuuacuguuuaccgaacaaaugucugacuguguacucgggug

SEQ ID NO: 309184 - RNA, 64 nt, hsa
gccucucuggccgcccacuggaugagcggugagacgaacaaaagggaaaggaaaaaaugggggu

SEQ ID NO: 309185 - RNA, 64 nt, hsa
aguuugccagccaggccccaccuacagcgucugucgaacaaacagaggucuggugguuuucccu

SEQ ID NO: 309186 - RNA, 64 nt, hsa
uaacuuuucuaagauagcaauuuuugaagagacacgaacaaaaaucugaauuaguucaugagcc

SEQ ID NO: 309187 - RNA, 62 nt, hsa
cacuucauuuuaucaaguaauuaccugugucacgaacaaaggcaacaagcaugcagccagca

SEQ ID NO: 309188 - RNA, 64 nt, hsa
uuucuuuuuucucauuucuuuugaaauggcaucucgaacaaaguccaccaaucccuuuacaaaa

SEQ ID NO: 309189 - RNA, 64 nt, hsa
uauucgacggaggacagaguaugugagccuuugccgaacaaacaaacguaaguuauuguuauuu

SEQ ID NO: 309190 - RNA, 64 nt, hsa
uaaaagaaaaacguuuggauuauuuucccucuuucgaacaaagacauugguuugcccaaggacu

SEQ ID NO: 309191 - RNA, 64 nt, hsa
cacuuuaacgguaguuccggugucaacauggacacgaacaaaaccuuacccagguguuuauacu

SEQ ID NO: 309192 - RNA, 64 nt, hsa
ugaacgaauuauuucuucaagcacuuauggacaacgaacaaauucuucaaccuuucuuugucuu

SEQ ID NO: 309193 - RNA, 64 nt, hsa
aaauuuuugcagcaagcagucaacauuccacaaacgaacaaacauuauaccucuucugauaguu

SEQ ID NO: 309194 - RNA, 64 nt, hsa
uccccggccccucccccgcagaggucaaugccaacgaacaaacguccccucccucccucccucu

SEQ ID NO: 309195 - RNA, 64 nt, hsa
guuuuaagaaguggcuauauagcucuggauaaaacgaacaaaagaauuagaauuccugcgggga

SEQ ID NO: 309196 - RNA, 64 nt, hsa
gguuugggacacgagaccucaucauauugaugagcgaacaaacaagaacauuuccucccucccc

SEQ ID NO: 309197 - RNA, 64 nt, hsa
ugcagccucuuaugcaccacaguuaaaucuagaacgaacaaaauuucagagcucaagacauggg

SEQ ID NO: 309198 - RNA, 64 nt, hsa
ggaagcagcgccuccuucaggguuggcugggagcucggcccauccaccucuugggguaccugcc

SEQ ID NO: 309199 - RNA, 64 nt, hsa
ucuuccugucucuguccuggucccugcccccgucucggcccagccucuguauucuccacccuug

SEQ ID NO: 309200 - RNA, 64 nt, hsa
acgguuuucugugccaccaucggucacccauugaucggcccacucugaacccccuggcucucca

SEQ ID NO: 309201 - RNA, 64 nt, hsa
uccccuaagucucugcucaaaaaaaaaacaauucucggcccaaagaaaacaaucagaagaauuc

SEQ ID NO: 309202 - RNA, 64 nt, hsa
ugguagcuuagcaaagagaccagcugacugucucucggcccagcccaccacgccgaguagcuug

SEQ ID NO: 309203 - RNA, 64 nt, hsa
agaagcagcauuugauauacaugcucaaccuucaucggcccacguguauuguccgggcucagaa

SEQ ID NO: 309204 - RNA, 64 nt, hsa
ugucccuuuuugcaggggacugggccauggguccucggcccaucuguccauccuccucuccaug

SEQ ID NO: 309205 - RNA, 54 nt, hsa
ugggcucccagcucuccuaaucccucggcccaugccuccugccucuccccuccc

SEQ ID NO: 309206 - RNA, 64 nt, hsa
gcaggcuccggaacccucgcuguggcucccccgcucggcccaggccuugaagccgcggcgaacc

SEQ ID NO: 309207 - RNA, 64 nt, hsa
agugauauuucagcuuggacauuuuacccuucagucggcccaagaaaucaaaauaaaggaaaca

SEQ ID NO: 309208 - RNA, 64 nt, hsa
gcccaagggcuuagcuuuagggcuccuccugaguucggcccacaguagaagcaagauuuuaacu

SEQ ID NO: 309209 - RNA, 64 nt, hsa
ugaccagugaucaaggcuaauuggaaaagaguuaucggcccauagcuaauaaguagugacagac

SEQ ID NO: 309210 - RNA, 64 nt, hsa
agaacacugguggcugagaugcuauaaaaacagcucggcccaacagacacuuccccuggguugc

SEQ ID NO: 309211 - RNA, 64 nt, hsa
ucccgaaggccgacaccacuccugccagcccggcucggcccagcacccccucuccuggagggcg

SEQ ID NO: 309212 - RNA, 64 nt, hsa
ugcugccugaaaccccagaccgagaaguugaugcucggcccacgccguuagcucgugugcgugu

SEQ ID NO: 309213 - RNA, 64 nt, hsa
aaauagugaauugauaaucuacuuguuaauauauucggcccauauuuuguguguuuggacaagu

SEQ ID NO: 309214 - RNA, 64 nt, hsa
cagggcuugguggugguagcauuugggucugagaucggcccagcucugacugaaggggcuuggc

SEQ ID NO: 309215 - RNA, 64 nt, hsa
acaaacucugccuucggucauuucacucaacagcucggcccagcucugaaacuugggaagguga

SEQ ID NO: 309216 - RNA, 64 nt, hsa
gugagcccgcccaccgcggaacguucggucagucucggcccacaccccaaaggcucuuuucaga

SEQ ID NO: 309217 - RNA, 64 nt, hsa
ugccgggccgggagggaagagggaggcugcacgcucggcccacgggagggcaggcuccggggcc

SEQ ID NO: 309218 - RNA, 64 nt, hsa
aagcucaaggacaaaauccagcuaacccagucccucggcccaggccuccuuucgugcuuugugc

SEQ ID NO: 309219 - RNA, 64 nt, hsa
cuuuccuucccaccacagagguggacgagugcucucggcccaaccgcgggggcugugagcagcg

SEQ ID NO: 309220 - RNA, 64 nt, hsa
gcccugcagcccccagcccuccccacccagguuuucggcccagugaagaggccacuggccaggc

SEQ ID NO: 309221 - RNA, 64 nt, hsa
caucaaaggagggauuauguggcugcuaaagccaucggcccacagcccuguucacaucuuggug

SEQ ID NO: 309222 - RNA, 64 nt, hsa
ucguugugucccccacaacuguccucuugcuagcucggcccagcuuugucccuggagcccgaug

SEQ ID NO: 309223 - RNA, 64 nt, hsa
uggaagacuucuuccuagccuggaagcccugaccucggcccaucugcagaaucucccaguuccu

SEQ ID NO: 309224 - RNA, 64 nt, hsa
acagaggcaccugcugcacacacaagcaucucacucggcccacggagggggccaggcuuccuuu

SEQ ID NO: 309225 - RNA, 64 nt, hsa
ggguccccucuccagcaagccuccaccagcaagcucggcccagagcuucccuuccggcuggcuc

SEQ ID NO: 309226 - RNA, 64 nt, hsa
gccugccuggacugcgcggcgccgugagggggauucggcccagcucgucccggccuccaccaag

SEQ ID NO: 309227 - RNA, 64 nt, hsa
uugagacuccuguugggacacaguuggucugcagucggcccaggacggucuacucagcacaacu

SEQ ID NO: 309228 - RNA, 64 nt, hsa
acggccacauccugcuaaaacugggauggaggaaucggcccagccccaagagcaacugugauuu

SEQ ID NO: 309229 - RNA, 64 nt, hsa
gcagcccccucaaguucuccccuuuugagggguuucggcccagccccagccugccggagcccac

SEQ ID NO: 309230 - RNA, 64 nt, hsa
cagaaaaggcuucuuacacagcagccuuacuucaucggcccacagacaccaccgcaguuucuuc

SEQ ID NO: 309231 - RNA, 64 nt, hsa
cccagcgccgccgcugacgccgccgacgccgcccucggcccagaccucggugaucacugaggga

SEQ ID NO: 309232 - RNA, 64 nt, hsa
uccucccucuggccccuucucccauggggacaucucggcccagcaccccuaucccauuuccaga

SEQ ID NO: 309233 - RNA, 64 nt, hsa
cucgccccacuucucccagccuggugcuguccucucggcccaccaucggccagguccagcgcuu

SEQ ID NO: 309234 - RNA, 64 nt, hsa
uccugagcagcucuugguuuuggcgucuuuugggucggcccaugugguuugagcacccagccag

SEQ ID NO: 309235 - RNA, 64 nt, hsa
uucacaugcucaauugauauuuuuugcugcuuccucggcccagggagaaagcaugucaggacag

SEQ ID NO: 309236 - RNA, 64 nt, hsa
acucagcguugccaggugugcugccaucugcuguucggcccaaccucagagugaaggcagggug

SEQ ID NO: 309237 - RNA, 64 nt, hsa
uccuguguguugugugcaggaucuguuugcccacucggcccaggaggucagcagucuguucuug

SEQ ID NO: 309238 - RNA, 64 nt, hsa
gggucucccucuccugccuacucacgauaaauaaucggcccacagcucccaccccacccccuuc

SEQ ID NO: 309239 - RNA, 64 nt, hsa
ucuacuauggagaucaacaguuacugugacugagucggcccauucuguuuagaaauauauuuua

SEQ ID NO: 309240 - RNA, 64 nt, hsa
cuggaagagucuuccgcacccucuccaggugcacucggcccaguccugccgccguguccaggcg

SEQ ID NO: 309241 - RNA, 64 nt, hsa
uccucggaggggccguggugagucuccaguauguucggcccagcgcucuucgcacccuucugga

SEQ ID NO: 309242 - RNA, 64 nt, hsa
aaagugcugggauuacgggcgugagccaccgugcucggcccaaggcaggagaaucucuugaagc

SEQ ID NO: 309243 - RNA, 64 nt, hsa
aagcucagcaccaccggccaugaccagagguugcucggcccagggucugggagcugggcuaaca

SEQ ID NO: 309244 - RNA, 64 nt, hsa
cgugaccauggcccacugcagcccugaccccccuucggcccaugcuauuccuccugucccaacc

SEQ ID NO: 309245 - RNA, 64 nt, hsa
cauggggcaguuuccuuugguggaccccaggacuucggcccacuccggggccuccccucccugc

SEQ ID NO: 309246 - RNA, 64 nt, hsa
aaggucaccauguaccacacaccaaagaagggggucggcccaggggugggcgacacaggcagcu

SEQ ID NO: 309247 - RNA, 64 nt, hsa
cccuucugcauuuccucccggagucacugguuucucggcccaaaccaugcuccccagcaguggc

SEQ ID NO: 309248 - RNA, 64 nt, hsa
caagaacaacccugacggcugcccucccucuuauucggcccaaggacuugaagcccggcaucuu

SEQ ID NO: 309249 - RNA, 64 nt, hsa
ucugucacccaggcuggaguacaauggcgugaucucggcccacugcaaccucugccuccugggu

SEQ ID NO: 309250 - RNA, 64 nt, hsa
auuuacccggcaugcacucuucagauaagccaugucggcccaaaucugaguaacuuuauauaaa

SEQ ID NO: 309251 - RNA, 64 nt, hsa
cgucagccacgggugggccuugugucgccuuguaucggcccagguagguuguuggccucuuacu

SEQ ID NO: 309252 - RNA, 64 nt, hsa
uacuuaauguggaaagacacgcccaugucccccuucggcccacucugggggccuggaaaugcug

SEQ ID NO: 309253 - RNA, 64 nt, hsa
ggaccccuagugucccuggucuaucucuccagccucggcccacacgcaagggagucgggggacg

SEQ ID NO: 309254 - RNA, 64 nt, hsa
uccccaaaccaacugcagagaagaaagacgagccucggcccaggacgcgauuucuaacgaaaug

SEQ ID NO: 309255 - RNA, 64 nt, hsa
cucgcccgcuccugacuuccucuacuugcgcugcucggcccagccuggggggcccgcccagccc

SEQ ID NO: 309256 - RNA, 55 nt, hsa
cagaaccggcugcagacugacacccucggcccacgacugucuucccaaguuuuac

SEQ ID NO: 309257 - RNA, 64 nt, hsa
cggcagcaccucugagccggagggcaccagggacucggcccagggccgucaaggaaagggcagu

SEQ ID NO: 309258 - RNA, 64 nt, hsa
agagaagagacuagcaaaaagcugcagagaggauucggcccaaacucagaacuguuccccugag

SEQ ID NO: 309259 - RNA, 64 nt, hsa
ccggguccagugggcacugggcggggugguguguucggcccagaggccccuggccugagcaggu

SEQ ID NO: 309260 - RNA, 64 nt, hsa
cucucagccuccugcccucagcugcgcgaagcgcucggcccagcucacugaagcugcccugccu

SEQ ID NO: 309261 - RNA, 64 nt, hsa
ugucuugguuggaaauaccaucagccuuccuugcucggcccaggucuguuucaggcaucugagu

SEQ ID NO: 309262 - RNA, 64 nt, hsa
uaugaaaacuaaguucucuaucuuaggaguaaugucggcccacaagggugcccaccucuuguuu

SEQ ID NO: 309263 - RNA, 64 nt, hsa
acugcugcccucucggguaacucacccuaaggccucggcccaccucuggcuaugguaaccacac

SEQ ID NO: 309264 - RNA, 64 nt, hsa
uuuccagaagcccacuauugccuuuguagugcuuucggcccaguucuggccucagccucaaagu

SEQ ID NO: 309265 - RNA, 64 nt, hsa
cugagggccccugugucccgaacccggagcggaggcgcccaacccggcagacgggugcaggccc

SEQ ID NO: 309266 - RNA, 64 nt, hsa
cacggucgcuuauggcaguuccacacaguaguuggcgcccaauggggggucccugagacuugca

SEQ ID NO: 309267 - RNA, 64 nt, hsa
uacacauucauaucaaccagcacaacacgggauggcgcccaaacuccggcguucacaagaggag

SEQ ID NO: 309268 - RNA, 64 nt, hsa
ccugggguuccugcuggucuucgcccucagucuggcgcccaaccaccugcugcuggcgcccuag

SEQ ID NO: 309269 - RNA, 64 nt, hsa
cucccagcauuucuggcacguuagauuugggauggcgcccaauaacuugcauuucuaacaaguu

SEQ ID NO: 309270 - RNA, 64 nt, hsa
agcacuuuaggaaaucaccuuucuaagcccuggggcgcccaagucccaugggacagggaaacgu

SEQ ID NO: 309271 - RNA, 64 nt, hsa
acuaugaucuucuaugaaauggugguaccaaggggcgcccaacagcuuuuauccccauucuuag

SEQ ID NO: 309272 - RNA, 64 nt, hsa
cgaggggcagcagcgcccccacggggcucgcugggcgcccaacuacgacccgcucugcucacuc

SEQ ID NO: 309273 - RNA, 64 nt, hsa
caccucccuccccaccucaguguuuugucuguccgcgcccaagaaagauaagcaaguauuuccu

SEQ ID NO: 309274 - RNA, 64 nt, hsa
ggagaagacucggaauucccugagucccaccauagcgcccaagcucagcuuagaaguucgaaaa

SEQ ID NO: 309275 - RNA, 64 nt, hsa
uggcagucccuccagguggggcuggagccugcuggcgcccaauacaaaacccauacauccaggu

SEQ ID NO: 309276 - RNA, 64 nt, hsa
cuugggaccgagaacugagaaucacaagggaguugcgcccaacaugcagaacaugaauccucug

SEQ ID NO: 309277 - RNA, 64 nt, hsa
ugcugugcuccacacccugcaggcgccucgggaagcgcccaaaggauuccccuucacguuggug

SEQ ID NO: 309278 - RNA, 64 nt, hsa
uggcaggagagcagaugugauucugagcgacauggcgcccaaugccacaggguuccgggaccuc

SEQ ID NO: 309279 - RNA, 64 nt, hsa
aguguaacuuuuagaccugcgugacaucuacaaagcgcccaauaaagaaagaggaagccacggu

SEQ ID NO: 309280 - RNA, 64 nt, hsa
gugucucuguggcucaggaaacccacggcuccccgcgcccaagagcguccugcggucucgcugg

SEQ ID NO: 309281 - RNA, 64 nt, hsa
acccgcccgagggauggugccccuagggucccucgcgcccaaaagauugaacuuaaaugccccc

SEQ ID NO: 309282 - RNA, 64 nt, hsa
gccagugcgccugcuccugaccacugcaaucccagcgcccaaggaaggccacuucucaacuggc

SEQ ID NO: 309283 - RNA, 64 nt, hsa
ucccaaagugcugggauuacagacuugagccacugcgcccaaccuggaguguuuuuacauauug

SEQ ID NO: 309284 - RNA, 64 nt, hsa
uuaaugaauggaugcccagccaagcucagaguaggcgcccaaagcauuguggauuauuuuccug

SEQ ID NO: 309285 - RNA, 64 nt, hsa
ugccccgggaggucuccccggcccgcaucccgaggcgcccaagcuggagccgccuggagggcuc

SEQ ID NO: 309286 - RNA, 64 nt, hsa
ccacacuguaaccacugggucugggcuccauccugcgcccaaagacauccacccagaccucauu

SEQ ID NO: 309287 - RNA, 64 nt, hsa
uggcugcugggagagcccaugggaaccuugcuuagcgcccaagguagaugagagacagggcagg

SEQ ID NO: 309288 - RNA, 64 nt, hsa
agcuagaggagcuggccuugcccaguggccuguggcgcccaaagcuggcaggucaggcaagcag

SEQ ID NO: 309289 - RNA, 64 nt, hsa
guaucaguacaugccuagaccugggcuccggccagcgcccaacagcguggaugucgaugacuuc

SEQ ID NO: 309290 - RNA, 64 nt, hsa
gugugggguccgcucucuccacucccagggcuccgcgcccaagugagggggccccugccggagc

SEQ ID NO: 309291 - RNA, 64 nt, hsa
acaggguccaacauagagccggguguccccaacagcgcccaaaggacgcacugagcaacgcuau

SEQ ID NO: 309292 - RNA, 64 nt, hsa
ggcagagcccccaucccuugggggcuguggggaugcgcccaagcccccgagggagaggccuggg

SEQ ID NO: 309293 - RNA, 64 nt, hsa
agcccugagacacaggccucaguuaggacgcucggcgcccaaaucucaucaguuuuauugccug

SEQ ID NO: 309294 - RNA, 64 nt, hsa
cacuggcucgaggcugcgaggcugaccgacaggggcgcccaauagaguuugugggaauggagua

SEQ ID NO: 309295 - RNA, 64 nt, hsa
gggcacaugugauguggugcgugugaaucugugggcgcccaaggccagcagccauaucuggcaa

SEQ ID NO: 309296 - RNA, 64 nt, hsa
cccucaugaacacagggauuggggagggaccagagcgcccaauacacacagcuccauuaugcaa

SEQ ID NO: 309297 - RNA, 63 nt, hsa; identical to SEQ ID NO: 118067

SEQ ID NO: 309298 - RNA, 64 nt, hsa; identical to SEQ ID NO: 118068

SEQ ID NO: 309299 - RNA, 64 nt, hsa; identical to SEQ ID NO: 118069

SEQ ID NO: 309300 - RNA, 64 nt, hsa; identical to SEQ ID NO: 118070

SEQ ID NO: 309301 - RNA, 64 nt, hsa; identical to SEQ ID NO: 118071

SEQ ID NO: 309302 - RNA, 64 nt, hsa; identical to SEQ ID NO: 118072

SEQ ID NO: 309303 - RNA, 64 nt, hsa; identical to SEQ ID NO: 118073

SEQ ID NO: 309304 - RNA, 64 nt, hsa; identical to SEQ ID NO: 118074

SEQ ID NO: 309305 - RNA, 64 nt, hsa; identical to SEQ ID NO: 118075

SEQ ID NO: 309306 - RNA, 64 nt, hsa; identical to SEQ ID NO: 118076

SEQ ID NO: 309307 - RNA, 64 nt, hsa; identical to SEQ ID NO: 118077

SEQ ID NO: 309308 - RNA, 64 nt, hsa; identical to SEQ ID NO: 118078

SEQ ID NO: 309309 - RNA, 64 nt, hsa; identical to SEQ ID NO: 118079

SEQ ID NO: 309310 - RNA, 64 nt, hsa; identical to SEQ ID NO: 118080

SEQ ID NO: 309311 - RNA, 64 nt, hsa; identical to SEQ ID NO: 118081

SEQ ID NO: 309312 - RNA, 64 nt, hsa; identical to SEQ ID NO: 118082

SEQ ID NO: 309313 - RNA, 64 nt, hsa; identical to SEQ ID NO: 118083

SEQ ID NO: 309314 - RNA, 64 nt, hsa; identical to SEQ ID NO: 118084

SEQ ID NO: 309315 - RNA, 64 nt, hsa; identical to SEQ ID NO: 118085

SEQ ID NO: 309316 - RNA, 64 nt, hsa; identical to SEQ ID NO: 118086

SEQ ID NO: 309317 - RNA, 64 nt, hsa; identical to SEQ ID NO: 118087

SEQ ID NO: 309318 - RNA, 64 nt, hsa; identical to SEQ ID NO: 118088

SEQ ID NO: 309319 - RNA, 64 nt, hsa; identical to SEQ ID NO: 118089

SEQ ID NO: 309320 - RNA, 64 nt, hsa; identical to SEQ ID NO: 118090

SEQ ID NO: 309321 - RNA, 64 nt, hsa; identical to SEQ ID NO: 118091

SEQ ID NO: 309322 - RNA, 64 nt, hsa; identical to SEQ ID NO: 118092

SEQ ID NO: 309323 - RNA, 64 nt, hsa; identical to SEQ ID NO: 118093

SEQ ID NO: 309324 - RNA, 64 nt, hsa; identical to SEQ ID NO: 118094

SEQ ID NO: 309325 - RNA, 64 nt, hsa; identical to SEQ ID NO: 118095

SEQ ID NO: 309326 - RNA, 64 nt, hsa; identical to SEQ ID NO: 118096

SEQ ID NO: 309327 - RNA, 64 nt, hsa; identical to SEQ ID NO: 118097

SEQ ID NO: 309328 - RNA, 64 nt, hsa; identical to SEQ ID NO: 118098

SEQ ID NO: 309329 - RNA, 64 nt, hsa; identical to SEQ ID NO: 118099

SEQ ID NO: 309330 - RNA, 64 nt, hsa; identical to SEQ ID NO: 118100

SEQ ID NO: 309331 - RNA, 64 nt, hsa; identical to SEQ ID NO: 118101

SEQ ID NO: 309332 - RNA, 64 nt, hsa; identical to SEQ ID NO: 118102

SEQ ID NO: 309333 - RNA, 64 nt, hsa; identical to SEQ ID NO: 118103

SEQ ID NO: 309334 - RNA, 64 nt, hsa; identical to SEQ ID NO: 118104

SEQ ID NO: 309335 - RNA, 64 nt, hsa; identical to SEQ ID NO: 118105

SEQ ID NO: 309336 - RNA, 64 nt, hsa; identical to SEQ ID NO: 118106

SEQ ID NO: 309337 - RNA, 64 nt, hsa; identical to SEQ ID NO: 118107

SEQ ID NO: 309338 - RNA, 64 nt, hsa; identical to SEQ ID NO: 118108

SEQ ID NO: 309339 - RNA, 64 nt, hsa; identical to SEQ ID NO: 118109

SEQ ID NO: 309340 - RNA, 64 nt, hsa; identical to SEQ ID NO: 118110

SEQ ID NO: 309341 - RNA, 64 nt, hsa; identical to SEQ ID NO: 118111

SEQ ID NO: 309342 - RNA, 64 nt, hsa; identical to SEQ ID NO: 118112

SEQ ID NO: 309343 - RNA, 64 nt, hsa; identical to SEQ ID NO: 118113

SEQ ID NO: 309344 - RNA, 64 nt, hsa; identical to SEQ ID NO: 118114

SEQ ID NO: 309345 - RNA, 64 nt, hsa; identical to SEQ ID NO: 118115

SEQ ID NO: 309346 - RNA, 64 nt, hsa; identical to SEQ ID NO: 118116

SEQ ID NO: 309347 - RNA, 64 nt, hsa; identical to SEQ ID NO: 118117

SEQ ID NO: 309348 - RNA, 64 nt, hsa; identical to SEQ ID NO: 118118

SEQ ID NO: 309349 - RNA, 64 nt, hsa; identical to SEQ ID NO: 118119

SEQ ID NO: 309350 - RNA, 64 nt, hsa; identical to SEQ ID NO: 118120

SEQ ID NO: 309351 - RNA, 64 nt, hsa; identical to SEQ ID NO: 118121

SEQ ID NO: 309352 - RNA, 64 nt, hsa
acauauuuauuuuugucuauucuguaggcuuccauguccagaauccugcuuaagguuuuagggu

SEQ ID NO: 309353 - RNA, 64 nt, hsa
aggcacugagcugggcacccacggaaggacaugcuguccagacugugaugacugccagcacagg

SEQ ID NO: 309354 - RNA, 64 nt, hsa
aggcagacgggcugaaguggggucccaaauuccauguccagagguguggggagccugccucccu

SEQ ID NO: 309355 - RNA, 64 nt, hsa
uucaaguugaaaggcagucccuuuaguugggggcuguccagagcugcagcagggcuuugcacgg

SEQ ID NO: 309356 - RNA, 64 nt, hsa
cccuggcccuggccuugcuugcccaugguguguguguccagaggugugugugaggcugccagaa

SEQ ID NO: 309357 - RNA, 64 nt, hsa
aggccuuaauuauggacuguugggaaaaggguuuuguccagaaggacaagccggacaaaugagc

SEQ ID NO: 309358 - RNA, 64 nt, hsa
gagaaggggggccuugggccgcugcagucacaucuguccagagaaauuccuuuugggacuggag

SEQ ID NO: 309359 - RNA, 64 nt, hsa
ccugagcgaacuugccugaugcagggcugugcuguguccagauguugcuggggccucacuuuuu

SEQ ID NO: 309360 - RNA, 64 nt, hsa
ggaagugggaacaguuuuguccuguaugcugauguguccagaauuucauuuaaugauagacgga

SEQ ID NO: 309361 - RNA, 64 nt, hsa
cggaaccugggaugagaaacgacagguggaagguuguccagagacaccuacagcguggaugcug

SEQ ID NO: 309362 - RNA, 64 nt, hsa
uggacacgccaccggcagccguaagggaaaaggguguccagaacuagcgaccgggagagcuuuu

SEQ ID NO: 309363 - RNA, 64 nt, hsa
guaaaccugccgggcaggaccgugccacaccagcuguccagagucggaggaccccagcuccuca

SEQ ID NO: 309364 - RNA, 64 nt, hsa
caccuacgccgagggaguggagcuccugggugcguguccagaugggaaaggcagggucguaucu

SEQ ID NO: 309365 - RNA, 64 nt, hsa
ccucagccaucucagggugaggagcugccagucauguccagauggaaugacucccauccucucc

SEQ ID NO: 309366 - RNA, 64 nt, hsa
uggcucaguuccaucaucuggaggucagacacacuguccagaggcagaacugaagcccucucgg

SEQ ID NO: 309367 - RNA, 64 nt, hsa
ugcccacagacagacuugaccuuugugccagaacuguccagagcugugaguuuuguuacugaau

SEQ ID NO: 309368 - RNA, 64 nt, hsa
ugcguuuuuggugggcuuacuuggugcagugugcuguccagagagaccugcugacccagucugg

SEQ ID NO: 309369 - RNA, 64 nt, hsa
gaccaccccagaucccacauccccugacgaagcuuguccagauggcaggaaggagaacggaugc

SEQ ID NO: 309370 - RNA, 64 nt, hsa
gcuuugcaauuccaggagcggcauugcccccgaauguccagauuaucccuguuuuugugaccaa

SEQ ID NO: 309371 - RNA, 64 nt, hsa
caacuauuuccucuuuauuuucccucauugaaagaugcaaaacagcucucuauuguguacagaa

SEQ ID NO: 309372 - RNA, 64 nt, hsa
aacagcucucuauuguguacagaaaggguaaauaaugcaaaauaccugguaguaaaauaaaugc

SEQ ID NO: 309373 - RNA, 64 nt, hsa
gguuauuauuacauggugguggugguuuuauuauaugcaaaaucucugucuauuaugagauacu

SEQ ID NO: 309374 - RNA, 64 nt, hsa
aagcacaguaauguguguuuuguucagcauuauuaugcaaaaauucacuaguugagaugguuug

SEQ ID NO: 309375 - RNA, 64 nt, hsa
uuuuuagaaggauuuuauucucaacagaugcaaaaugcaaaauaaaauauuggcaaacaauaca

SEQ ID NO: 309376 - RNA, 64 nt, hsa
aaagacauuuuuagaaggauuuuauucucaacagaugcaaaaugcaaaauaaaauauuggcaaa

SEQ ID NO: 309377 - RNA, 64 nt, hsa
aacagguuuguauguagcaccuuucaugcaaggcaugcaaaaagccuauuuuaaaaucacugug

SEQ ID NO: 309378 - RNA, 64 nt, hsa
ugauacuuuuuuuuucuuaaagccaauuauuuugaugcaaaagaaauucaguuuauaagauaaa

SEQ ID NO: 309379 - RNA, 64 nt, hsa
gaaccaucagcaucacccgggaacuuuuuuagaaaugcaaaaucucuacugcuuuggauccugg

SEQ ID NO: 309380 - RNA, 64 nt, hsa
ggauccugggucaaaaaaaagaaaaaaaaaagaaaugcaaaacuuuaggcccugccccagauuu

SEQ ID NO: 309381 - RNA, 50 nt, hsa; identical to SEQ ID NO: 56892

SEQ ID NO: 309382 - RNA, 64 nt, hsa
aguucccuaauauauucuuauauguagagcaauaaugcaaaagcuguucuauaugcaaacauga

SEQ ID NO: 309383 - RNA, 64 nt, hsa
cuuuuuguaauguaguaucaaaguuuuuuagguaaugcaaaauuuuacaaaucauuuguggaau

SEQ ID NO: 309384 - RNA, 64 nt, hsa
gaauuuuucaucaagaagguagcuugagccugaaaugcaaaacccauggaggaauucugaagcc

SEQ ID NO: 309385 - RNA, 64 nt, hsa
acacuguuaucagaaauaggagaguggaugauagaugcaaaauaauaccuguccacaacaaacu

SEQ ID NO: 309386 - RNA, 64 nt, hsa
aaaaauauacuuguauaugucacagagaaaaaaaaugcaaaauuuauaauagaguuacauuaac

SEQ ID NO: 309387 - RNA, 64 nt, hsa
gaugcaacuuaaacuuuucuuugcaucaagguauaugcaaaacauuggugccgugcaucaccaa

SEQ ID NO: 309388 - RNA, 64 nt, hsa
uagugccuuggauuuuacauauuuuucuuuuuaaaugcaaaaccuuuucaacaaaauaguguuu

SEQ ID NO: 309389 - RNA, 64 nt, hsa
uucaggagcaaagauuuucaaacaagcauacacgaugcaaaauaccaaucuggcuucuagucuc

SEQ ID NO: 309390 - RNA, 64 nt, hsa
guauguauugagugccuauucauugucacuguagaugcaaaacgaaugagcuguaaccccuuca

SEQ ID NO: 309391 - RNA, 64 nt, hsa
uggugguaauguaaaaucauuucauuuaucauucaugcaaaaaaaaguauguauugagugccua

SEQ ID NO: 309392 - RNA, 64 nt, hsa
gccacaaccacauacaacacaaagagaaaaagaaaugcaaaaaucucugcgugcagggacaaag

SEQ ID NO: 309393 - RNA, 64 nt, hsa
gcaggagugagaggucucucuuccugauuuagauaugcaaaagcugguauguucaguaggaacu

SEQ ID NO: 309394 - RNA, 64 nt, hsa
ccuaaggcaugugugaaacauacucauagauguuaugcaaaaaaaagucuauggccagguaugc

SEQ ID NO: 309395 - RNA, 64 nt, hsa
guucuuguaagcuuuaacuauaucucucuuuaaaaugcaaaauaaugucuuaagauucaaaguc

SEQ ID NO: 309396 - RNA, 64 nt, hsa
cuauaauucuaaauguuuaaaugcuuuucuaaaaaugcaaaacuaugauguuuaguugcuuuau

SEQ ID NO: 309397 - RNA, 64 nt, hsa
aaagaauguagaaaagauacucagucuuaauccuaugcaaaaaaaaaaaucaaguaauuguuuu

SEQ ID NO: 309398 - RNA, 64 nt, hsa
aacaaucuaaucaaaacugggaguucucaagugaaugcaaaaggagcaggccauaacuuuauuu

SEQ ID NO: 309399 - RNA, 64 nt, hsa
guccuaaauucauagaguggauauuaggauuaggaugcaaaaauaaaugcuuaaccaacacuac

SEQ ID NO: 309400 - RNA, 64 nt, hsa
guuuccccuuucacccaagugaugucacaguucgaugcaaaaucaaugauccagaaugaucgug

SEQ ID NO: 309401 - RNA, 64 nt, hsa
aauaacucaaaguguuucuuaagggugaguuggcaugcaaaaaauuacauugauuacagugugu

SEQ ID NO: 309402 - RNA, 64 nt, hsa
auacucauuuuuaaauaauucaaaaucaguagcaaugcaaaaauauucugauuacuuuagccuu

SEQ ID NO: 309403 - RNA, 64 nt, hsa
acugucuccaacacauuguuucugagcuccacaaaugcaaaagauguauuuuccuguggcccau

SEQ ID NO: 309404 - RNA, 64 nt, hsa
gauucuuguauauuagcaauuauaauguuuguauaugcaaaacugcuagcuugauuuuaaaaaa

SEQ ID NO: 309405 - RNA, 64 nt, hsa
gcugcuuccacacauuaauggcaugauuuuuuuuaugcaaaaagaaaagaaaagaaaaccaccc

SEQ ID NO: 309406 - RNA, 64 nt, hsa
cauaacuuuccucagauuuucaaaaguauuuuuaaugcaaaaaauguagaaagaguuuaaaacc

SEQ ID NO: 309407 - RNA, 64 nt, hsa
aauuauauuuccaaaaaugaaccuuuaaaaugguaugcaaaauuuugucuauauauauuugugu

SEQ ID NO: 309408 - RNA, 64 nt, hsa
agcgauguaagugucgauguuuuuuuaaaaaaaaaugcaaaaaaauucuuauggcggaguuuuu

SEQ ID NO: 309409 - RNA, 64 nt, hsa
guguguguguguguguguguguguguuugcagacaugcaaaacugcagcugaaauaauaccuua

SEQ ID NO: 309410 - RNA, 64 nt, hsa
aauuaguccgguaggaugucaggugagacuguguaugcaaaaugaauggcacaggugaugccag

SEQ ID NO: 309411 - RNA, 64 nt, hsa
gcacacaucuguacucgucaaucaacaaaaccugaugcaaaaaacagaaaaggggugauguagg

SEQ ID NO: 309412 - RNA, 64 nt, hsa
cugcacuaaagcuggcacucccccagccguucucaugcaaaauaccugugucagaauacuccuu

SEQ ID NO: 309413 - RNA, 64 nt, hsa
uugcacuacaagaagaauguaguugugcaaaucuaugcaaaacugaugguggccugcuauuucc

SEQ ID NO: 309414 - RNA, 64 nt, hsa
cauccagcugugugauauucugcugugcaaauccaugcaaaacugacugugguagugaaaaguc

SEQ ID NO: 309415 - RNA, 64 nt, hsa
gaagaguaaacaggaaaccuacuuuuuaugugcuaugcaaaauagacaucuuuaacauaguccu

SEQ ID NO: 309416 - RNA, 64 nt, hsa
aacaucauuccaaaaagaacaauaaugagagcaaaugcaaaaauaaccaaguccuccgaaggca

SEQ ID NO: 309417 - RNA, 64 nt, hsa
uuucaugguguuuucagggaacacagaaaugcggaugcaaaacaacuuuugacagaggcccauc

SEQ ID NO: 309418 - RNA, 64 nt, hsa
gacaguuugcagaacacugauuugaaagcuuccuaugcaaaaugagaagggguucaaauauauu

SEQ ID NO: 309419 - RNA, 64 nt, hsa
uacaaaacugguuaccuguaucaaagacccauuuaugcaaaaauguuaaaaaaaaaaaaaaaca

SEQ ID NO: 309420 - RNA, 64 nt, hsa
ucaauaaguugauuuacugaugauaugucauaugaugcaaaaaagguuuugugucauuaacuga

SEQ ID NO: 309421 - RNA, 64 nt, hsa
gaggcuuuuaagaaucauguguucaauguagacaaugcaaaauuuguaguuaaauuugaccuca

SEQ ID NO: 309422 - RNA, 54 nt, hsa; identical to SEQ ID NO: 56933

SEQ ID NO: 309423 - RNA, 64 nt, hsa
gccgaagaggaauaugguauaauuuuaaauuuuaaugcaaaauuuuaauuugucuuuauuuuuu

SEQ ID NO: 309424 - RNA, 64 nt, hsa
uaugacuuguggaaagcuucaaggaguuccacugaugcaaaagggucuuuuccuagcuuccugg

SEQ ID NO: 309425 - RNA, 64 nt, hsa
uauaaauauauauauauaugucaaaagguaggaaaugcaaaaaagaaaaaaaaaaaaggugaca

SEQ ID NO: 309426 - RNA, 64 nt, hsa
gcaagagccucuggacuaaauggacauauuucuuaugcaaaaaggaaaacacacacaaccaaua

SEQ ID NO: 309427 - RNA, 64 nt, hsa
guuuuuuuuugaagugaauucuuuugaaaaaaaaaugcaaaacuagaaaacuuuauucauuuua

SEQ ID NO: 309428 - RNA, 64 nt, hsa
aauuaacaucugcauaauuucacuuaaaauuauuaugcaaaaaugaauguuuuuucaaaaaaug

SEQ ID NO: 309429 - RNA, 64 nt, hsa
uccuuauuucuuauucagugcugaauacuaccucaugcaaaauauugguguggcugcaaauuuc

SEQ ID NO: 309430 - RNA, 64 nt, hsa
cacagagagaaggccuagagguuagagcacuagaaugcaaaagaggauuuauuuucuuaaguuu

SEQ ID NO: 309431 - RNA, 64 nt, hsa
cucugaucagguacuacaucaaccaaaagaggaaauacuuuaaaaauuccuuuuagcaaccuga

SEQ ID NO: 309432 - RNA, 64 nt, hsa
cuuuuaagaaauuaaauacuugccugagauagaaauacuuuauuuuuguaacuuuaaggucuaa

SEQ ID NO: 309433 - RNA, 64 nt, hsa
uuugcagggaaucauggagcugagaauuucacagauacuuuauaagccauaguacaugagcuua

SEQ ID NO: 309434 - RNA, 64 nt, hsa
uuuuaucagugguucauuguuaaagaaggugucuauacuuuagauuuucaguuuuuugcaggga

SEQ ID NO: 309435 - RNA, 64 nt, hsa
guuucacaauuugacuagauggacuuuuugguaaauacuuuaguggcauuucacugucaaauau

SEQ ID NO: 309436 - RNA, 64 nt, hsa
acuggcuuuaaaacuguaacacaucacauaaaagauacuuuaccagguauguauugcauuauau

SEQ ID NO: 309437 - RNA, 64 nt, hsa
agauuggaagagggauaagaaaugaaagauccugauacuuuagguuuuucccuuuccucuauuu

SEQ ID NO: 309438 - RNA, 64 nt, hsa
uuucagaagcauaauaaaguucacaauaaggauaauacuuuauauaauguauaaaguauauaua

SEQ ID NO: 309439 - RNA, 64 nt, hsa
uauagauagguuuagccuuuaaguguauguuuuuauacuuuaaaauaagaaauauaaccuuuua

SEQ ID NO: 309440 - RNA, 64 nt, hsa
auaagaguauuuagaggacacugauuaguugucaauacuuuagcaagcccacuaaagauaacua

SEQ ID NO: 309441 - RNA, 64 nt, hsa
uauuauguuccuguguguugaauuuaaaaaaaaaauacuuuacuuggauauucauguaauauau

SEQ ID NO: 309442 - RNA, 64 nt, hsa
uugcaaugacaagagguuucauggucuuaaaaagauacuuuaugugguugaagaugaaaucauu

SEQ ID NO: 309443 - RNA, 64 nt, hsa
ugccuuaaguuauaguuauguauagauacccauuauacuuuaaauuuuucagcagaaauuaugc

SEQ ID NO: 309444 - RNA, 64 nt, hsa
aucucucuugggcuuccucccgaaaugugagacuauacuuuaaagauguaugguuagaguccaa

SEQ ID NO: 309445 - RNA, 64 nt, hsa
ugaugaaauauuugaacugucacauauauuaagaauacuuuaugauuuagaccaauauucuaga

SEQ ID NO: 309446 - RNA, 64 nt, hsa
ggggcagaguuaaccauuucuccauggugucuuuauacuuuacugguuugugaauuuuauacaa

SEQ ID NO: 309447 - RNA, 64 nt, hsa
gauucauuauuacaaaaauaaaauacacauugaaauacuuuaauaauguugcgauggauugcca

SEQ ID NO: 309448 - RNA, 64 nt, hsa
uggaagcacuggguugaacuugcuaaaguaaaucauacuuuagaaucucuucagggaaugugac

SEQ ID NO: 309449 - RNA, 64 nt, hsa
aagcaaaauuguuccuuuuuuuugaaaauuuuauauacuuuauaaugauagaaguccaaccguu

SEQ ID NO: 309450 - RNA, 64 nt, hsa
ggcaacuuuugaacuccugucucugugagaauguauacuuuaugcucucugaaauguaugacac

SEQ ID NO: 309451 - RNA, 64 nt, hsa
cugaaauuauaauuuuuuguuucuaugaguuugaauacuuuagauaccuuguugccaugguuug

SEQ ID NO: 309452 - RNA, 64 nt, hsa
aauuuuuuaauuuuauauuauuauuauuauuauuauacuuuaagguuuaggguacaugugcaca

SEQ ID NO: 309453 - RNA, 64 nt, hsa
ucgaucuuuaugcuguuauuacaggagaagugacauacuuuauauauguuuauauuagcaaggu

SEQ ID NO: 309454 - RNA, 64 nt, hsa
uguuuauauuagcaaggucuguuuuuaauaccauauacuuuauauuucuauacauuuauauuuc

SEQ ID NO: 309455 - RNA, 64 nt, hsa
uuaacuugaacauggcguguuuaaauuuucauacauacuuuacuugaauuauugcuguugucac

SEQ ID NO: 309456 - RNA, 64 nt, hsa
acuggaaagauuuauuaaagaauuauauuuguguauacuuuauaaauuagucccucauuagauu

SEQ ID NO: 309457 - RNA, 64 nt, hsa
agguggugguuaaaauucuuggaaaauuuucagaauacuuuaaaaauaaaguuccaaguuacac

SEQ ID NO: 309458 - RNA, 64 nt, hsa
auucugagacuuuauuugcguaagugauacuacuauacuuuauuuuugacccaugccuuuuuaa

SEQ ID NO: 309459 - RNA, 64 nt, hsa
uucuagacagaguugcuuaaugaaaggguuuguaauacuuuacaaaccauuaccuguaccuggc

SEQ ID NO: 309460 - RNA, 64 nt, hsa
uuauugugacuucacuguauauaaacauauuuuuauacuuuauugaaaggggacaccuguacau

SEQ ID NO: 309461 - RNA, 64 nt, hsa
gcuccauuauuuuuuaaaaagaaauuauauaaaaauacuuuauugcuaaaaauacuaauaauga

SEQ ID NO: 309462 - RNA, 64 nt, hsa
uguaaaaugguguuaugucuaggaaacaaggcacauacuuuaauuuuaaaacacuugaugcugg

SEQ ID NO: 309463 - RNA, 64 nt, hsa
aauuucuccauugaugaaucucuaguauguguguauacuuuauuuacccauacguauauuuuau

SEQ ID NO: 309464 - RNA, 64 nt, hsa
auuuuguauguuuuuuuaaaugugucuuugaugcauacuuuagaagcacacuggcucgcgguuu

SEQ ID NO: 309465 - RNA, 64 nt, hsa
uacuucuguauacauuuacauauuuuuacaauucauacuuuaauuucuaggcuauaacucagac

SEQ ID NO: 309466 - RNA, 64 nt, hsa
gaauaggagacaguaguagccauaaaaaguacuuauacuuuagaaaacaguccuuauucagaaa

SEQ ID NO: 309467 - RNA, 64 nt, hsa
uuuugacuauccaauuuagauguguaauuucuauauacuuuaugcuguuuauauuucagucauu

SEQ ID NO: 309468 - RNA, 64 nt, hsa
uuuaaagucagaauaguacagauugcugaguauuauacuuuaggcuagauuaauuaaaauugaa

SEQ ID NO: 309469 - RNA, 64 nt, hsa; identical to SEQ ID NO: 70765

SEQ ID NO: 309470 - RNA, 64 nt, hsa; identical to SEQ ID NO: 70766

SEQ ID NO: 309471 - RNA, 64 nt, hsa; identical to SEQ ID NO: 70767

SEQ ID NO: 309472 - RNA, 64 nt, hsa; identical to SEQ ID NO: 70768

SEQ ID NO: 309473 - RNA, 64 nt, hsa; identical to SEQ ID NO: 70769

SEQ ID NO: 309474 - RNA, 64 nt, hsa; identical to SEQ ID NO: 70770

SEQ ID NO: 309475 - RNA, 64 nt, hsa; identical to SEQ ID NO: 70771

SEQ ID NO: 309476 - RNA, 64 nt, hsa; identical to SEQ ID NO: 70772

SEQ ID NO: 309477 - RNA, 64 nt, hsa; identical to SEQ ID NO: 70773

SEQ ID NO: 309478 - RNA, 64 nt, hsa; identical to SEQ ID NO: 70774

SEQ ID NO: 309479 - RNA, 64 nt, hsa; identical to SEQ ID NO: 70775

SEQ ID NO: 309480 - RNA, 64 nt, hsa; identical to SEQ ID NO: 70776

SEQ ID NO: 309481 - RNA, 64 nt, hsa; identical to SEQ ID NO: 70777

SEQ ID NO: 309482 - RNA, 64 nt, hsa; identical to SEQ ID NO: 70778

SEQ ID NO: 309483 - RNA, 64 nt, hsa; identical to SEQ ID NO: 70779

SEQ ID NO: 309484 - RNA, 64 nt, hsa; identical to SEQ ID NO: 70780

SEQ ID NO: 309485 - RNA, 64 nt, hsa; identical to SEQ ID NO: 70781

SEQ ID NO: 309486 - RNA, 64 nt, hsa; identical to SEQ ID NO: 70782

SEQ ID NO: 309487 - RNA, 64 nt, hsa; identical to SEQ ID NO: 70783

SEQ ID NO: 309488 - RNA, 64 nt, hsa; identical to SEQ ID NO: 70784

SEQ ID NO: 309489 - RNA, 64 nt, hsa; identical to SEQ ID NO: 70785

SEQ ID NO: 309490 - RNA, 64 nt, hsa; identical to SEQ ID NO: 70786

SEQ ID NO: 309491 - RNA, 64 nt, hsa; identical to SEQ ID NO: 70787

SEQ ID NO: 309492 - RNA, 64 nt, hsa; identical to SEQ ID NO: 70788

SEQ ID NO: 309493 - RNA, 64 nt, hsa; identical to SEQ ID NO: 70789

SEQ ID NO: 309494 - RNA, 64 nt, hsa; identical to SEQ ID NO: 70790

SEQ ID NO: 309495 - RNA, 64 nt, hsa; identical to SEQ ID NO: 70791

SEQ ID NO: 309496 - RNA, 64 nt, hsa; identical to SEQ ID NO: 70792

SEQ ID NO: 309497 - RNA, 64 nt, hsa; identical to SEQ ID NO: 70793

SEQ ID NO: 309498 - RNA, 64 nt, hsa; identical to SEQ ID NO: 70794

SEQ ID NO: 309499 - RNA, 64 nt, hsa; identical to SEQ ID NO: 70795

SEQ ID NO: 309500 - RNA, 64 nt, hsa; identical to SEQ ID NO: 70796

SEQ ID NO: 309501 - RNA, 64 nt, hsa; identical to SEQ ID NO: 70797

SEQ ID NO: 309502 - RNA, 64 nt, hsa; identical to SEQ ID NO: 70798

SEQ ID NO: 309503 - RNA, 64 nt, hsa; identical to SEQ ID NO: 70799

SEQ ID NO: 309504 - RNA, 64 nt, hsa; identical to SEQ ID NO: 70800

SEQ ID NO: 309505 - RNA, 64 nt, hsa; identical to SEQ ID NO: 70801

SEQ ID NO: 309506 - RNA, 64 nt, hsa; identical to SEQ ID NO: 70802

SEQ ID NO: 309507 - RNA, 64 nt, hsa; identical to SEQ ID NO: 70803

SEQ ID NO: 309508 - RNA, 64 nt, hsa; identical to SEQ ID NO: 70804

SEQ ID NO: 309509 - RNA, 64 nt, hsa; identical to SEQ ID NO: 70805

SEQ ID NO: 309510 - RNA, 64 nt, hsa; identical to SEQ ID NO: 70806

SEQ ID NO: 309511 - RNA, 64 nt, hsa; identical to SEQ ID NO: 70807

SEQ ID NO: 309512 - RNA, 64 nt, hsa; identical to SEQ ID NO: 70808

SEQ ID NO: 309513 - RNA, 64 nt, hsa; identical to SEQ ID NO: 70809

SEQ ID NO: 309514 - RNA, 64 nt, hsa; identical to SEQ ID NO: 70810

SEQ ID NO: 309515 - RNA, 64 nt, hsa; identical to SEQ ID NO: 70811

SEQ ID NO: 309516 - RNA, 64 nt, hsa; identical to SEQ ID NO: 70812

SEQ ID NO: 309517 - RNA, 64 nt, hsa; identical to SEQ ID NO: 70813

SEQ ID NO: 309518 - RNA, 64 nt, hsa; identical to SEQ ID NO: 70814

SEQ ID NO: 309519 - RNA, 64 nt, hsa; identical to SEQ ID NO: 70814

SEQ ID NO: 309520 - RNA, 64 nt, hsa; identical to SEQ ID NO: 70816

SEQ ID NO: 309521 - RNA, 64 nt, hsa; identical to SEQ ID NO: 70817

SEQ ID NO: 309522 - RNA, 64 nt, hsa; identical to SEQ ID NO: 70818

SEQ ID NO: 309523 - RNA, 64 nt, hsa; identical to SEQ ID NO: 70819

SEQ ID NO: 309524 - RNA, 64 nt, hsa; identical to SEQ ID NO: 70820

SEQ ID NO: 309525 - RNA, 64 nt, hsa; identical to SEQ ID NO: 70821

SEQ ID NO: 309526 - RNA, 64 nt, hsa; identical to SEQ ID NO: 70822

SEQ ID NO: 309527 - RNA, 64 nt, hsa; identical to SEQ ID NO: 70823

SEQ ID NO: 309528 - RNA, 64 nt, hsa; identical to SEQ ID NO: 70824

SEQ ID NO: 309529 - RNA, 64 nt, hsa; identical to SEQ ID NO: 70825

SEQ ID NO: 309530 - RNA, 64 nt, hsa; identical to SEQ ID NO: 70826

SEQ ID NO: 309531 - RNA, 64 nt, hsa; identical to SEQ ID NO: 70827

SEQ ID NO: 309532 - RNA, 64 nt, hsa; identical to SEQ ID NO: 70828

SEQ ID NO: 309533 - RNA, 64 nt, hsa; identical to SEQ ID NO: 70829

SEQ ID NO: 309534 - RNA, 64 nt, hsa
agccauaaauguaugauauuagugcccaugaugcagcagcuaauuucaaaccuaccacugcaug

SEQ ID NO: 309535 - RNA, 64 nt, hsa
acuuugguaacaauccaaagacccugagggucugagcagcuagaaguccuagacaaagaacuug

SEQ ID NO: 309536 - RNA, 64 nt, hsa
acuaaaacuauuacucaucagucauucacugaucagcagcuaaaguccaugagaccaaaugguu

SEQ ID NO: 309537 - RNA, 64 nt, hsa
guugcuucgaucuucagccacaugcuguccuugaagcagcuauuugaagauguguuuucugagg

SEQ ID NO: 309538 - RNA, 64 nt, hsa
guuccaagauuucaaaguggugaaaugaaaauggagcagcuaguauguuuuauuauuuuauggg

SEQ ID NO: 309539 - RNA, 64 nt, hsa
cuguugcuacacuauuauaggcauguuugauacuagcagcuaacacuggucacuccaaagcacu

SEQ ID NO: 309540 - RNA, 64 nt, hsa
ccggagcccccagcagggcccuccgagguggagcagcagcuacaagcagaggcugaacaccugc

SEQ ID NO: 309541 - RNA, 64 nt, hsa
ccggagcccccagcagggcccuccgagguggaacagcagcuacaagcagaggcugaacaccugc

SEQ ID NO: 309542 - RNA, 64 nt, hsa; identical to SEQ ID NO: 249425

SEQ ID NO: 309543 - RNA, 64 nt, hsa; identical to SEQ ID NO: 249426

SEQ ID NO: 309544 - RNA, 64 nt, hsa; identical to SEQ ID NO: 249427

SEQ ID NO: 309545 - RNA, 64 nt, hsa; identical to SEQ ID NO: 249428

SEQ ID NO: 309546 - RNA, 64 nt, hsa; identical to SEQ ID NO: 249429

SEQ ID NO: 309547 - RNA, 64 nt, hsa; identical to SEQ ID NO: 249430

SEQ ID NO: 309548 - RNA, 64 nt, hsa; identical to SEQ ID NO: 249431

SEQ ID NO: 309549 - RNA, 64 nt, hsa; identical to SEQ ID NO: 249432

SEQ ID NO: 309550 - RNA, 64 nt, hsa; identical to SEQ ID NO: 249433

SEQ ID NO: 309551 - RNA, 64 nt, hsa; identical to SEQ ID NO: 249434

SEQ ID NO: 309552 - RNA, 64 nt, hsa; identical to SEQ ID NO: 249435

SEQ ID NO: 309553 - RNA, 64 nt, hsa; identical to SEQ ID NO: 249436

SEQ ID NO: 309554 - RNA, 64 nt, hsa; identical to SEQ ID NO: 249437

SEQ ID NO: 309555 - RNA, 64 nt, hsa; identical to SEQ ID NO: 249438

SEQ ID NO: 309556 - RNA, 64 nt, hsa; identical to SEQ ID NO: 249439

SEQ ID NO: 309557 - RNA, 64 nt, hsa; identical to SEQ ID NO: 249440

SEQ ID NO: 309558 - RNA, 64 nt, hsa; identical to SEQ ID NO: 249441

SEQ ID NO: 309559 - RNA, 64 nt, hsa; identical to SEQ ID NO: 249442

SEQ ID NO: 309560 - RNA, 64 nt, hsa; identical to SEQ ID NO: 249443

SEQ ID NO: 309561 - RNA, 64 nt, hsa; identical to SEQ ID NO: 249444

SEQ ID NO: 309562 - RNA, 64 nt, hsa; identical to SEQ ID NO: 249445

SEQ ID NO: 309563 - RNA, 64 nt, hsa; identical to SEQ ID NO: 249446

SEQ ID NO: 309564 - RNA, 64 nt, hsa; identical to SEQ ID NO: 249447

SEQ ID NO: 309565 - RNA, 64 nt, hsa; identical to SEQ ID NO: 249448

SEQ ID NO: 309566 - RNA, 64 nt, hsa; identical to SEQ ID NO: 249449

SEQ ID NO: 309567 - RNA, 64 nt, hsa; identical to SEQ ID NO: 249450

SEQ ID NO: 309568 - RNA, 64 nt, hsa; identical to SEQ ID NO: 249451

SEQ ID NO: 309569 - RNA, 64 nt, hsa; identical to SEQ ID NO: 249452

SEQ ID NO: 309570 - RNA, 64 nt, hsa; identical to SEQ ID NO: 249453

SEQ ID NO: 309571 - RNA, 64 nt, hsa; identical to SEQ ID NO: 249454

SEQ ID NO: 309572 - RNA, 64 nt, hsa; identical to SEQ ID NO: 249455

SEQ ID NO: 309573 - RNA, 64 nt, hsa; identical to SEQ ID NO: 249456

SEQ ID NO: 309574 - RNA, 64 nt, hsa; identical to SEQ ID NO: 249457

SEQ ID NO: 309575 - RNA, 64 nt, hsa; identical to SEQ ID NO: 249458

SEQ ID NO: 309576 - RNA, 64 nt, hsa; identical to SEQ ID NO: 249459

SEQ ID NO: 309577 - RNA, 64 nt, hsa; identical to SEQ ID NO: 249460

SEQ ID NO: 309578 - RNA, 64 nt, hsa; identical to SEQ ID NO: 249461

SEQ ID NO: 309579 - RNA, 64 nt, hsa; identical to SEQ ID NO: 249462

SEQ ID NO: 309580 - RNA, 64 nt, hsa; identical to SEQ ID NO: 249463

SEQ ID NO: 309581 - RNA, 64 nt, hsa; identical to SEQ ID NO: 249464

SEQ ID NO: 309582 - RNA, 64 nt, hsa; identical to SEQ ID NO: 249465

SEQ ID NO: 309583 - RNA, 64 nt, hsa; identical to SEQ ID NO: 249466

SEQ ID NO: 309584 - RNA, 64 nt, hsa; identical to SEQ ID NO: 249467

SEQ ID NO: 309585 - RNA, 64 nt, hsa; identical to SEQ ID NO: 249468

SEQ ID NO: 309586 - RNA, 64 nt, hsa; identical to SEQ ID NO: 249469

SEQ ID NO: 309587 - RNA, 64 nt, hsa; identical to SEQ ID NO: 249470

SEQ ID NO: 309588 - RNA, 64 nt, hsa; identical to SEQ ID NO: 249471

SEQ ID NO: 309589 - RNA, 64 nt, hsa; identical to SEQ ID NO: 249472

SEQ ID NO: 309590 - RNA, 64 nt, hsa; identical to SEQ ID NO: 249473

SEQ ID NO: 309591 - RNA, 64 nt, hsa; identical to SEQ ID NO: 249474

SEQ ID NO: 309592 - RNA, 64 nt, hsa; identical to SEQ ID NO: 249475

SEQ ID NO: 309593 - RNA, 64 nt, hsa; identical to SEQ ID NO: 249476

SEQ ID NO: 309594 - RNA, 64 nt, hsa; identical to SEQ ID NO: 249477

SEQ ID NO: 309595 - RNA, 64 nt, hsa; identical to SEQ ID NO: 249478

SEQ ID NO: 309596 - RNA, 64 nt, hsa; identical to SEQ ID NO: 249479

SEQ ID NO: 309597 - RNA, 64 nt, hsa; identical to SEQ ID NO: 249480

SEQ ID NO: 309598 - RNA, 64 nt, hsa; identical to SEQ ID NO: 249481

SEQ ID NO: 309599 - RNA, 64 nt, hsa; identical to SEQ ID NO: 249482

SEQ ID NO: 309600 - RNA, 64 nt, hsa; identical to SEQ ID NO: 249483

SEQ ID NO: 309601 - RNA, 64 nt, hsa; identical to SEQ ID NO: 249484

SEQ ID NO: 309602 - RNA, 63 nt, hsa
acuacacaaaauuuuauuuaaagagaacacuuagcagccuaugauaguuuucaauaaaauguu

SEQ ID NO: 309603 - RNA, 63 nt, hsa
uugggucgcguaguugcugaaaccuaaguaccugcagccuacaggauaaggaaguucacagcc

SEQ ID NO: 309604 - RNA, 63 nt, hsa
gggguuggccaguuggagccugggucagccucagcagccuauccccauguccucuaugccccu

SEQ ID NO: 309605 - RNA, 63 nt, hsa
ggccccucgggggauuggggggacuggggaggcgcagccuagacccaauugcuugcccccaug

SEQ ID NO: 309606 - RNA, 63 nt, hsa
aaggcuuucccaggaugcacguccucagagggagcagccuaucucccccaagcuggaggcggc

SEQ ID NO: 309607 - RNA, 63 nt, hsa
auuuuuaagugugugaggagaugcucaguagcagcagccuauggcaagagcuuauaaaugauu

SEQ ID NO: 309608 - RNA, 64 nt, hsa; identical to SEQ ID NO: 229370

SEQ ID NO: 309609 - RNA, 64 nt, hsa; identical to SEQ ID NO: 229371

SEQ ID NO: 309610 - RNA, 64 nt, hsa; identical to SEQ ID NO: 229372

SEQ ID NO: 309611 - RNA, 64 nt, hsa; identical to SEQ ID NO: 229373

SEQ ID NO: 309612 - RNA, 64 nt, hsa; identical to SEQ ID NO: 229373

SEQ ID NO: 309613 - RNA, 64 nt, hsa; identical to SEQ ID NO: 229372

SEQ ID NO: 309614 - RNA, 64 nt, hsa; identical to SEQ ID NO: 44480

SEQ ID NO: 309615 - RNA, 64 nt, hsa; identical to SEQ ID NO: 44481

SEQ ID NO: 309616 - RNA, 64 nt, hsa; identical to SEQ ID NO: 44482

SEQ ID NO: 309617 - RNA, 64 nt, hsa; identical to SEQ ID NO: 44483

SEQ ID NO: 309618 - RNA, 64 nt, hsa; identical to SEQ ID NO: 44484

SEQ ID NO: 309619 - RNA, 64 nt, hsa; identical to SEQ ID NO: 44485

SEQ ID NO: 309620 - RNA, 64 nt, hsa; identical to SEQ ID NO: 44486

SEQ ID NO: 309621 - RNA, 64 nt, hsa; identical to SEQ ID NO: 44487

SEQ ID NO: 309622 - RNA, 64 nt, hsa; identical to SEQ ID NO: 44488

SEQ ID NO: 309623 - RNA, 64 nt, hsa; identical to SEQ ID NO: 44489

SEQ ID NO: 309624 - RNA, 64 nt, hsa; identical to SEQ ID NO: 44490

SEQ ID NO: 309625 - RNA, 64 nt, hsa; identical to SEQ ID NO: 44491

SEQ ID NO: 309626 - RNA, 64 nt, hsa; identical to SEQ ID NO: 44492

SEQ ID NO: 309627 - RNA, 64 nt, hsa; identical to SEQ ID NO: 44493

SEQ ID NO: 309628 - RNA, 64 nt, hsa; identical to SEQ ID NO: 44494

SEQ ID NO: 309629 - RNA, 64 nt, hsa; identical to SEQ ID NO: 44495

SEQ ID NO: 309630 - RNA, 64 nt, hsa; identical to SEQ ID NO: 44496

SEQ ID NO: 309631 - RNA, 64 nt, hsa; identical to SEQ ID NO: 44497

SEQ ID NO: 309632 - RNA, 64 nt, hsa; identical to SEQ ID NO: 44498

SEQ ID NO: 309633 - RNA, 64 nt, hsa; identical to SEQ ID NO: 44499

SEQ ID NO: 309634 - RNA, 64 nt, hsa
ccacacccuuccuccuuccccugcccacagaggcagagggcacaggaaagaagccgggccaagc

SEQ ID NO: 309635 - RNA, 64 nt, hsa
agagaagaggccccggcauggggaucuggguucuagagggcaugugaugacuguaaauguucac

SEQ ID NO: 309636 - RNA, 64 nt, hsa
aaagauugugugucaccccuguuuauucuugaacagagggcaaagagggcacugggcacuucuc

SEQ ID NO: 309637 - RNA, 64 nt, hsa
gugucaccccuguuuauucuugaacagagggcaaagagggcacugggcacuucucacaaacuuu

SEQ ID NO: 309638 - RNA, 64 nt, hsa
aaccaacaggggcugaggagagagggcacaggagagagggcagagaagaggaggggugucuagg

SEQ ID NO: 309639 - RNA, 64 nt, hsa
gcaucucagccuggaaccaacaggggcugaggagagagggcacaggagagagggcagagaagag

SEQ ID NO: 309640 - RNA, 64 nt, hsa
cacccccaugcucuguggccuucuuacacuucucagagggcagaguggcagccgggcacccuac

SEQ ID NO: 309641 - RNA, 64 nt, hsa
ggcagaguggcagccgggcacccuacagaaacucagagggcagaguggcagccaggcccacaug

SEQ ID NO: 309642 - RNA, 64 nt, hsa
uggaggauggggaagguuugcagagagaggaagaagagggcaggguggggaggagcucugggcc

SEQ ID NO: 309643 - RNA, 64 nt, hsa
gacaugggcccgggcccgguguggggguagacgcagagggcagaggguagcccuugguacugug

SEQ ID NO: 309644 - RNA, 64 nt, hsa
aaugaagggacaaagucaacuggacugcugagugagagggcaggggcaguugaagggaacauga

SEQ ID NO: 309645 - RNA, 64 nt, hsa
gagaaacaagcagaauuccaggaguccuugaagcagagggcacuggaagacaauauagcagauu

SEQ ID NO: 309646 - RNA, 64 nt, hsa
ugcaccacaauugugauguccuaguccuaccacuagagggcaugguacagccuggcaaaaguua

SEQ ID NO: 309647 - RNA, 64 nt, hsa
aaggaagaccagaugggcuuagcauugggaagacagagggcaaggaggugauagauggauauag

SEQ ID NO: 309648 - RNA, 64 nt, hsa
aggaagcccacaggcggauguuccccacuugccuagagggcaucccucugggguagcgacagac

SEQ ID NO: 309649 - RNA, 64 nt, hsa
aggugccugugggugaacugaggggaguagagggagagggcagguggaacuggggcagaaucua

SEQ ID NO: 309650 - RNA, 64 nt, hsa
ugagaggacagaggcggugggacagccuggccacagagggcaaggacugugccggagucccugg

SEQ ID NO: 309651 - RNA, 64 nt, hsa
ugaggacgggccacccuggcaccggaaggccagcagagggcacuguccgccagggcugggcagg

SEQ ID NO: 309652 - RNA, 64 nt, hsa
ggcauuauguacagugcuuuuuauuacuguggggagagggcagugcuaaauaaauuaaucacua

SEQ ID NO: 309653 - RNA, 64 nt, hsa
gcggugggaagugaugcagagagcccacccgugcagagggcagaagaggacgaaaugccuuugg

SEQ ID NO: 309654 - RNA, 64 nt, hsa
uugaaucuuauguaagaggcuugagaugugcuggagagggcaggaagaggaaaguaucaggccu

SEQ ID NO: 309655 - RNA, 64 nt, hsa
ccccuguguaaacaacucaagguggaaguauuucagagggcauagggucaugaauccuuaccca

SEQ ID NO: 309656 - RNA, 64 nt, hsa
ggccugugccagcaccaggcagagggcaagacggagagggcagagcaagaacugcacugcaucu

SEQ ID NO: 309657 - RNA, 64 nt, hsa
cucccgccuggaagggccugugccagcaccaggcagagggcaagacggagagggcagagcaaga

SEQ ID NO: 309658 - RNA, 64 nt, hsa
cuacgguguaugguucugugccaauguauugauaagagggcacacacuguguacaguaaauggc

SEQ ID NO: 309659 - RNA, 64 nt, hsa
ugauaagaccaccaccucagaguauggagcucagagagggcaggcaugaaguuuccuuggcugg

SEQ ID NO: 309660 - RNA, 64 nt, hsa
ucuuuggaugcugucuucgaggacagcaaugcagagagggcauaggaucugaggacaaggaaau

SEQ ID NO: 309661 - RNA, 64 nt, hsa
gugugaacaugggggaacaaugagcagagauggcagagggcagagcacauggcccccagaggcu

SEQ ID NO: 309662 - RNA, 64 nt, hsa
ccugguuuuuuagggagaugguauccccuggaguagagggcaagaggagagagcgccuccaguc

SEQ ID NO: 309663 - RNA, 64 nt, hsa
accuuggguaagucgcgccugacccaggcugcuaagagggcaaggagaaggaaguacccugggg

SEQ ID NO: 309664 - RNA, 64 nt, hsa
ucugcacauaggcaguagccuccuccugggcuccagagggcacucagaaguugugcuaaaccaa

SEQ ID NO: 309665 - RNA, 64 nt, hsa
cgugcagaaccagcacuaagguggacagcagacaagagggcaagccucuaguguaccaagugcu

SEQ ID NO: 309666 - RNA, 64 nt, hsa
acccccucccccugggggcaaaucaggacacaacagagggcagaggccccauuagcuuuaaaau

SEQ ID NO: 309667 - RNA, 64 nt, hsa
gucaccuccugacaugcgcucugggaaagguggcagagggcaggacaccaugagcucaggaucu

SEQ ID NO: 309668 - RNA, 64 nt, hsa
ucucccaugcugggcauccuaggccacuuugcuuagagggcauuaaaggugccaugaaagguag

SEQ ID NO: 309669 - RNA, 64 nt, hsa
cugaagaacauucccagugccccuggcuaggggcagagggcacugccaggcuguguucaguuag

SEQ ID NO: 309670 - RNA, 63 nt, hsa
aguguuagagcggagcccaaaggaaggaugggagcccuggagugggcaagaccaggccaccug

SEQ ID NO: 309671 - RNA, 63 nt, hsa
ccaggugccuccucucagucaggcuucagagcagcccuggagacaggagggccauguuaaaag

SEQ ID NO: 309672 - RNA, 63 nt, hsa
ccuauagaaacaccaguaccugaaagcacuguagcccuggaccugccuccuucccucggggcc

SEQ ID NO: 309673 - RNA, 63 nt, hsa
ugccuuugcuuaagccaucuuugugguagaggggcccuggaauugcagcuguacugaggauga

SEQ ID NO: 309674 - RNA, 63 nt, hsa
gggccucaagccugcagccacuggcuugauugggcccuggacguugagcccagauguuggagc

SEQ ID NO: 309675 - RNA, 63 nt, hsa
gacagugaccugaucuccuccucaugaccuucugcccuggacaagcccccugaacuggauuug

SEQ ID NO: 309676 - RNA, 63 nt, hsa
ugacugggaugagggugaggggugacggguguggcccuggauguggugguuuucccuuggcca

SEQ ID NO: 309677 - RNA, 63 nt, hsa
cacacaggaggccuguaugacuuccugcucacagcccuggaguccuguuacgagcacauccag

SEQ ID NO: 309678 - RNA, 63 nt, hsa
cugcugcgaguugccuuagagcgcaagggccaggcccuggaggaggaugaagacacagagaca

SEQ ID NO: 309679 - RNA, 63 nt, hsa
ggugcacucucaccccacuguaggcugagcuuggcccuggacucggaacacaccugcaguccc

SEQ ID NO: 309680 - RNA, 63 nt, hsa
ccaucgugguccauggagccuuucaaaaugggugcccuggaggggccugacaguggguuccuu

SEQ ID NO: 309681 - RNA, 63 nt, hsa
agauaggccauugcuuucaccgauuccaacccagcccuggacugaggauggaugguuccauga

SEQ ID NO: 309682 - RNA, 63 nt, hsa
ccuucauuucuuaucuacuuggcaugaaagggugcccuggauaggaggguguguacagggcaa

SEQ ID NO: 309683 - RNA, 63 nt, hsa
agcagagaacaaggacagaggccaggcacugaggcccuggagacagcuguuccacuugcacac

SEQ ID NO: 309684 - RNA, 63 nt, hsa
gugugugcuaaggcuccguccugacugcccugugcccuggaaaagcagcaauagcauccgccc

SEQ ID NO: 309685 - RNA, 63 nt, hsa
acuuaggugacaggaacuuccgcaccuccugaggcccuggaugauucuaauuguuagaaauuc

SEQ ID NO: 309686 - RNA, 63 nt, hsa
ugccucaccuccagcugucagagggugagcagggcccuggaggcaggcacccccuccuccucc

SEQ ID NO: 309687 - RNA, 63 nt, hsa
cugggaggugguguuggaggccccaugaagagcgcccuggacugcugagggugggccaacagc

SEQ ID NO: 309688 - RNA, 63 nt, hsa
aaguugagcgugcgcacugcaugggaaauagcggcccuggaggauguuagacuugcucccucu

SEQ ID NO: 309689 - RNA, 63 nt, hsa
cccugccugcagccagggcugggguugccagaggcccuggagggaaggacagucccugcuggg

SEQ ID NO: 309690 - RNA, 63 nt, hsa
acccaagaugcaagaaggaggcuaugcucaggggcccuggagcagccaccccaugcuggccuu

SEQ ID NO: 309691 - RNA, 63 nt, hsa
ccuaaagggccauagcccagugagcagccuggagcccuggagaccccaccagccucaccagcg

SEQ ID NO: 309692 - RNA, 63 nt, hsa
uaugaagcccuuggugaugaggacauagcaucugcccuggaaaucguuauuccaacauaauau

SEQ ID NO: 309693 - RNA, 63 nt, hsa
ucguuauuccaacauaauauuauuuucuagaaugcccuggaaggacagaauauuuaaaaauau

SEQ ID NO: 309694 - RNA, 63 nt, hsa
gguauguagggcccagggugggugucccugggagcccuggaaaugugcauaugugcauguguc

SEQ ID NO: 309695 - RNA, 63 nt, hsa
cucaccuaagcugcacuucaaguucgacacgacgcccuggauccugugcaagggggacuggag

SEQ ID NO: 309696 - RNA, 63 nt, hsa
ucuucacuagccucucugaagguguccuggccagcccuggagaagcacuggugucugcagcac

SEQ ID NO: 309697 - RNA, 63 nt, hsa
aggcccaggcuggggccagggccagaggggaaggcccuggauucucacucaugugagaucuug

SEQ ID NO: 309698 - RNA, 63 nt, hsa
ggcauuucuccucuccucuugcugcucagcacagcccuggauugcagccccgaggcugagacc

SEQ ID NO: 309699 - RNA, 63 nt, hsa
cugcaggaggaggccgccggcggggagcaggaugcccuggaccuguaccagcacagccugggg

SEQ ID NO: 309700 - RNA, 63 nt, hsa
gagauggcccgggacaagccacgccuccuagcugcccuggaaguggcuucagcugccauggcc

SEQ ID NO: 309701 - RNA, 63 nt, hsa
gcacauugguuuaagcccagagauccugcuugagcccuggacucaucuugggaagggccaugg

SEQ ID NO: 309702 - RNA, 63 nt, hsa
ugcaccuggggaucccccuaaacugugaauucugcccuggacagggcuuugcccuuggaggau

SEQ ID NO: 309703 - RNA, 63 nt, hsa
cucuaggaauagccugugagccagcccuggacugcccuggacuuguucucagagguaucagga

SEQ ID NO: 309704 - RNA, 63 nt, hsa
uacucccuggcucuaggaauagccugugagccagcccuggacugcccuggacuuguucucaga

SEQ ID NO: 309705 - RNA, 63 nt, hsa
gcccccgcccacccuccugaccgcagcucccaggcccuggagaccuccaggcuuuccugcccu

SEQ ID NO: 309706 - RNA, 63 nt, hsa
gcccgcagagcacagagcaggagaagggcuugggcccuggaggagaaagccauucuggacacc

SEQ ID NO: 309707 - RNA, 63 nt, hsa
gccaggggugggagcaucggagggagucccagagcccuggaccuugggccuagaccgcgugau

SEQ ID NO: 309708 - RNA, 63 nt, hsa
gggggggcccuuggcugcgggagaaggcccagagcccuggaggagccaccaccccgccggccc

SEQ ID NO: 309709 - RNA, 63 nt, hsa
cccacagcacccccugccggcgggcuccguggggcccuggagcugaugacgggggaggcccgu

SEQ ID NO: 309710 - RNA, 63 nt, hsa
uggaggccgguggagaagccccaccuggcuuaugcccuggagaggguuuagcgggcugggugg

SEQ ID NO: 309711 - RNA, 63 nt, hsa
ugagcgaggggcagauucuagucgggagcccaugcccuggaaauccaucuuucuucaucuuuc

SEQ ID NO: 309712 - RNA, 63 nt, hsa
cgaguuuuguaggggucacugucacaugcuugugcccuggaagccccaaggcucuuccuccag

SEQ ID NO: 309713 - RNA, 63 nt, hsa
gagacagaagccuggacucugccccacgcuguggcccuggagggucccgguuugucaguucuu

SEQ ID NO: 309714 - RNA, 63 nt, hsa
agucucagaaacuccccuggggguuucaccugggcccuggaggaauucagcucagcuucuucc

SEQ ID NO: 309715 - RNA, 63 nt, hsa
uucuaguagcuguugucugguggggacgcaguggcccuggacacggcuccccucugcaggucu

SEQ ID NO: 309716 - RNA, 63 nt, hsa
aguguguucccuguaacugccccauagugggcagcccuggaggaacaaggggcuggcuguccu

SEQ ID NO: 309717 - RNA, 63 nt, hsa
gggaauggcaagggcaagguagagugccuaggagcccuggacucaggcuggcagaggggcugg

SEQ ID NO: 309718 - RNA, 63 nt, hsa
gagcccuggacucaggcuggcagaggggcuggugcccuggagaaaauaaagagaaggcuggag

SEQ ID NO: 309719 - RNA, 63 nt, hsa
gcccugcagguauauugcaggggccugggggcggcccuggacuggcgggcgguuccccagugg

SEQ ID NO: 309720 - RNA, 63 nt, hsa
gcccuggacuggcgggcgguuccccaguggggugcccuggaggcugccgggcagaguggagca

SEQ ID NO: 309721 - RNA, 63 nt, hsa
aagcgguacaagaguucugugccuguguguccagcccuggagccagccagugcauuuauuuua

SEQ ID NO: 309722 - RNA, 63 nt, hsa
cgcgccuguagucccagcuacuugggaggcugagcccuggaggucgaggcuacagugagcuau

SEQ ID NO: 309723 - RNA, 63 nt, hsa
uauggguguccgguuggguccuguguuuggucugcccuggaggugcugggcccuccugggaug

SEQ ID NO: 309724 - RNA, 63 nt, hsa
ucuuacaguaacugaguguggcgggaagggugggcccuggaggggcccaugugggcugaagga

SEQ ID NO: 309725 - RNA, 63 nt, hsa
uggagaggacccucaggccucugagggcaccaggcccuggagaagaggugcaauucagggugu

SEQ ID NO: 309726 - RNA, 63 nt, hsa
gggagggguugucaagcccacccgggaaacugagcccuggagaggggaagcagccagcccagg

SEQ ID NO: 309727 - RNA, 64 nt, hsa
ugcuucucuuucccccacccuacucccuccaauucccccuuaaacuuccaaagcuucgucuugu

SEQ ID NO: 309728 - RNA, 64 nt, hsa
guuugauuuuuuuaaaguaguuccuauuuucuaucccccuuaaagaaaauugcaugaaacuagg

SEQ ID NO: 309729 - RNA, 64 nt, hsa
gguucuuacacauaugcacacacgcauacacacaugcacgcacacacacauacacacaugcacg

SEQ ID NO: 309730 - RNA, 64 nt, hsa
cauacacacaugcacgcacacacacauacacacaugcacgcacgcacgcaugcacaccaauuua

SEQ ID NO: 309731 - RNA, 64 nt, hsa
uauaaaaaacgaguuacgugugugugugcacgcaugcacgcacaugugcuggcuuaaagguugu

SEQ ID NO: 309732 - RNA, 64 nt, hsa
uuguguauuauaaaaaacgaguuacgugugugugugcacgcaugcacgcacaugugcuggcuua

SEQ ID NO: 309733 - RNA, 64 nt, hsa
cgcaugugauugugugugcacgcaugugugugugugcacgcacugggcugggccaagcgacuga

SEQ ID NO: 309734 - RNA, 64 nt, hsa
gccagacauugggacgcacgcaugugauugugugugcacgcaugugugugugugcacgcacugg

SEQ ID NO: 309735 - RNA, 64 nt, hsa
cacacacagaugcacacacagauauacacauggaugcacgcacaugccaaugcacgcacacauc

SEQ ID NO: 309736 - RNA, 64 nt, hsa
cacagauauacacauggaugcacgcacaugccaaugcacgcacacaucagugcacacggaugca

SEQ ID NO: 309737 - RNA, 64 nt, hsa
ucgagcgccugcugcggcucagugacuacaacgugcagaccagccagggugccauccugcaggc

SEQ ID NO: 309738 - RNA, 64 nt, hsa
ugaccccaccuagagcuuuuaaccaaacaacauugcagaccaccagaguccuuggacucccccu

SEQ ID NO: 309739 - RNA, 64 nt, hsa
cuuugggacauggugccucaugcucucugggauugcagaccauccaggucugucuucgccccug

SEQ ID NO: 309740 - RNA, 64 nt, hsa
gcugaggcaggcagaucaccugaggcuaggaguugcagaccagccuggccaacauggcaaaacc

SEQ ID NO: 309741 - RNA, 64 nt, hsa
ccggccagccccgccccugccgaucuacuggaccgcagaccaccuucugcccccgugggccagg

SEQ ID NO: 309742 - RNA, 64 nt, hsa
gccccagcaccccucuccuuuggccuccggcagugcagaccagaggggaccuuuuaaggaaaga

SEQ ID NO: 309743 - RNA, 64 nt, hsa
uccuugucaaaaugagauuccagguccugagagcugcuuugaggcaguuccaggaguacuuacu

SEQ ID NO: 309744 - RNA, 64 nt, hsa
aaugauggcaccuacuuuugggaaucuguagcugugcuuugagaauugccaucggucauguguu

SEQ ID NO: 309745 - RNA, 64 nt, hsa
uuugggcuuugucuggauuugcuuuucucaguugugcuuugaagugaauaagcuuuguuacaaa

SEQ ID NO: 309746 - RNA, 64 nt, hsa
ugaaccagucuuaccugagacuggaaggcugauuugcuuugaggcugauauguguguuucagag

SEQ ID NO: 309747 - RNA, 64 nt, hsa
cugcaggucgucagcuuguucuggaaacucuuuaugcuuugacaucgaguacaaaaauaaucaa

SEQ ID NO: 309748 - RNA, 64 nt, hsa
guacaaaaauaaucaaagaagcaauggcaaagggugcuuugaucuauuuacuggauauguucug

SEQ ID NO: 309749 - RNA, 64 nt, hsa
guuugugugaagaaaugaacuguggaguacaaaaugcuuugagucuuuccgauugcucauuaau

SEQ ID NO: 309750 - RNA, 56 nt, hsa; identical to SEQ ID NO: 83586

SEQ ID NO: 309751 - RNA, 64 nt, hsa
uuuauguccauuucucaauuuuuucauugaucuaugcuuugaguuugcuuucucaacauuauug

SEQ ID NO: 309752 - RNA, 64 nt, hsa
aauccaucagaaucucagacuacagcacuaaauaugcuuugaugcuacaucaaacggaauggaa

SEQ ID NO: 309753 - RNA, 64 nt, hsa
aaugucaugaaagugguaaaagugggaaccagugugcuuugaaaccaaauuagaaacacauucc

SEQ ID NO: 309754 - RNA, 64 nt, hsa
ucucuacaauacccggcggggcgagaaggaggagugcuuugagcggguccauggcgaguguauc

SEQ ID NO: 309755 - RNA, 64 nt, hsa
guuuaacaaaugacuguaucuaggcauuucauuaugcuuugaacuuuaguuugccugcaguuuc

SEQ ID NO: 309756 - RNA, 64 nt, hsa
gggcccaaagaauuggaauccuccuuaauuuaauugcuuugaagcauagcuacaauuuguuuuu

SEQ ID NO: 309757 - RNA, 64 nt, hsa
ccugcuuggcagugggacaucaggggaccgguccugcuuugagauggcagggucccuguucuga

SEQ ID NO: 309758 - RNA, 64 nt, hsa
uuugccucugaaauucauggccccugacguuaugugcuuugagguuuugugccugcuuuuugcu

SEQ ID NO: 309759 - RNA, 64 nt, hsa
uaaguucccacacugcuggaccuguggcaaagagugcuuugaauaagucagcuagggauucuug

SEQ ID NO: 309760 - RNA, 64 nt, hsa
guuuuggaaggagaggucuuuaauagcuuugaaaugcuuugagaucauuggucaaauugcauuu

SEQ ID NO: 309761 - RNA, 64 nt, hsa
caaaugaaaaaaauguuaacauuugguagacaugugcuuugacauagcgugagcagcacauuac

SEQ ID NO: 309762 - RNA, 64 nt, hsa
ucuaaaaguuaugguuagaugcuauucuguggguugcuuugauaauucuuacuaacacagauua

SEQ ID NO: 309763 - RNA, 64 nt, hsa
acaagaucuaugccuuaguguuguuuuuguugucugcuuugauguaaaagcaagaguauuugga

SEQ ID NO: 309764 - RNA, 64 nt, hsa
augcuagcugcuuggacauuaacuguguuauuucugcuuugagaugaaaauauauauuuaucuu

SEQ ID NO: 309765 - RNA, 64 nt, hsa
aaauaugaguaauuucucuaagauauaacccaggugcuuugagaagcugcauuaagguguucag

SEQ ID NO: 309766 - RNA, 64 nt, hsa
uuauaucuaacuuuccuucccuccauugaguacgugcuuugagaaaacauuucuuaaaacagug

SEQ ID NO: 309767 - RNA, 64 nt, hsa
aaacuugaaaaguuuauugcuuguagaguuguacugcuuugauuuuugaaguugggguaguagu

SEQ ID NO: 309768 - RNA, 64 nt, hsa
ccucauagacuuauauuuuauaaucagaauauguugcuuugaaaaagccucuaauggacugacc

SEQ ID NO: 309769 - RNA, 64 nt, hsa
aaauguuaaugguuaauguucccaaaccagagaaugcuuugaaaauguaucauucaguguaaau

SEQ ID NO: 309770 - RNA, 64 nt, hsa
uuggaauuacaggugugagccaccaugccuggccugcuuugacauauuuuauaguguguuaauu

SEQ ID NO: 309771 - RNA, 64 nt, hsa
uuagaugggaauugcagaagcugcaucaaaaguaugcuuugagguauauauagugaaacagagc

SEQ ID NO: 309772 - RNA, 64 nt, hsa
ggcuaagggggacagccuuccccuugucagggcuugcuuugacccugcuucguuccaccccggg

SEQ ID NO: 309773 - RNA, 64 nt, hsa
gcgggccaccccacccuguucauuuccauaaacgugcuuugagaggcgggguccgcauguacgu

SEQ ID NO: 309774 - RNA, 64 nt, hsa
ugagagcaaaaugcauguaaucaacauggcuacuugcuuugaggcucaccagaauuauuuuuaa

SEQ ID NO: 309775 - RNA, 64 nt, hsa
gucacuuuucacauccuugacuuuuuagaugugcugcuuugauauauaggacauugauuugauu

SEQ ID NO: 309776 - RNA, 64 nt, hsa; identical to SEQ ID NO: 274997

SEQ ID NO: 309777 - RNA, 64 nt, hsa; identical to SEQ ID NO: 274998

SEQ ID NO: 309778 - RNA, 64 nt, hsa; identical to SEQ ID NO: 274999

SEQ ID NO: 309779 - RNA, 64 nt, hsa; identical to SEQ ID NO: 275000

SEQ ID NO: 309780 - RNA, 64 nt, hsa
gaaagaaaaacuggcuaugcauuaccuaaaaccaguccaaaaugaaacagaccaacacacacac

SEQ ID NO: 309781 - RNA, 64 nt, hsa
uucuaccacguguaggauaaucauucauugguguguccaaaaauggggucugcuccugcuaccu

SEQ ID NO: 309782 - RNA, 64 nt, hsa
aaaaaugaagcugaaacuuaaaguggcgguguuuguccaaaauaacggggcuccugcucugcca

SEQ ID NO: 309783 - RNA, 64 nt, hsa
gugccaauaggaaaaagcuaccuagacuaggcauguccaaaauggcggcuccaaguucccuucu

SEQ ID NO: 309784 - RNA, 64 nt, hsa
caaaccaauaaaaauaccaucugaggguguuacuguccaaaaguaaagaauaagaugcaucacu

SEQ ID NO: 309785 - RNA, 64 nt, hsa
uugacuggccauccaauuaccauuuuuucuuucaguccaaaauaguuagacccuugcauacaga

SEQ ID NO: 309786 - RNA, 64 nt, hsa
uauuucaaaaauagguauuagagcacuaucagugguccaaaauuaguuuuagcuacuuauuuug

SEQ ID NO: 309787 - RNA, 64 nt, hsa
uugaguucuaguuaaaucuuaaccauguucuuaaguccaaaauaggaagaaguggaguaguuug

SEQ ID NO: 309788 - RNA, 64 nt, hsa
gugccuguagucccagcuacuugggaggcugaggcaggagaaucacuugaccccagguggugga

SEQ ID NO: 309789 - RNA, 64 nt, hsa
auaacuauaaucccagcuacuugggaggcugaggcaggagaaucgcuugaacccgggaggcaca

SEQ ID NO: 309790 - RNA, 64 nt, hsa
gcuccuguagucccagcuacuugggaggcugaggcaggagaaucgcuugaaccugggaggcaga

SEQ ID NO: 309791 - RNA, 64 nt, hsa
acgccuguagucccaguuacuugggaggcugaggcaggagaauugcuugaaccugggaggugga

SEQ ID NO: 309792 - RNA, 64 nt, hsa
cugccuguaaucccagcuacuugggaggcugaggcaggagaaucgcuugaacccgggaggcgga

SEQ ID NO: 309793 - RNA, 64 nt, hsa
uuuugcggauugagagacuugguccaucuugucucaggagaagaaaccuuucuccaauguagca

SEQ ID NO: 309794 - RNA, 64 nt, hsa
augccuguaaucccagcugcuugggaggcugaggcaggagaaucacuugaacacaggaggcaga

SEQ ID NO: 309795 - RNA, 64 nt, hsa
gagccuguagucccagcuacucgggaggcugaggcaggagaauugcuugaaccggggaggcaga

SEQ ID NO: 309796 - RNA, 64 nt, hsa
gcgccuguaaucccagcuacuugggaggcugaggcaggagaauggcaugaaccugggaggcaga

SEQ ID NO: 309797 - RNA, 64 nt, hsa
gcaccuguagucccagcuacucagggggcugaggcaggagaauggcgugaauccgggaggcgga

SEQ ID NO: 309798 - RNA, 64 nt, hsa
acgccuguagucccagcuacuugggaggcugaggcaggagaauugcuugagcccaagaggugga

SEQ ID NO: 309799 - RNA, 64 nt, hsa
guaccuauaaucccagcuacuugggaggcugaggcaggagaaucgcuugaaccugggaggugga

SEQ ID NO: 309800 - RNA, 64 nt, hsa
aagggauggauaggcacauagagagggaaggucucaggagaagggauagaaaggaacuauguuc

SEQ ID NO: 309801 - RNA, 64 nt, hsa
gugccuauagucccagcuacucaggaggcugaggcaggagaauugcuugaaccugggaggcaga

SEQ ID NO: 309802 - RNA, 64 nt, hsa
acgccuguagucccagcuacucaggaggcugaggcaggagaauugcuugaacccaggaggaaga

SEQ ID NO: 309803 - RNA, 64 nt, hsa
gcgccuguaaucccagcuacucaggaggcugaggcaggagaaucgcuugaacccgggaggcgga

SEQ ID NO: 309804 - RNA, 64 nt, hsa
cagaaaugagugagaggccuuccugcagagcagucaggagaaaugguggagccuggggcccugg

SEQ ID NO: 309805 - RNA, 64 nt, hsa
gcaccaguaaucccagcuacuugggaggcugaggcaggagaaucacuugaacccgggaggcaga

SEQ ID NO: 309806 - RNA, 64 nt, hsa
augccuguaauccaagauacucaggaggcugaggcaggagaaucgcuugaaccugggaggcgga

SEQ ID NO: 309807 - RNA, 64 nt, hsa
uacuaacauucacuguuagagaguguaggcgcugcaggagaaagagaaagugcccacgaaaauu

SEQ ID NO: 309808 - RNA, 64 nt, hsa
aguaacuuagaccaaaaggaaaaaugaagugccccaggagaagauacuucagaagggcuguucu

SEQ ID NO: 309809 - RNA, 64 nt, hsa
uuugaaggucaguucuaugacagugaauuuugcacaggagaagcagcuaccugauuucuuacuu

SEQ ID NO: 309810 - RNA, 64 nt, hsa
gcgccuguagucccagcuacucaggaggcuaaggcaggagaaucucuugaacccgagaggugga

SEQ ID NO: 309811 - RNA, 64 nt, hsa
cucagaaggccgaggcaggagaauuacuugaacgcaggagaaucacugcagcccaggaggcaga

SEQ ID NO: 309812 - RNA, 64 nt, hsa
augccuguaaucccaacuacucagaaggccgaggcaggagaauuacuugaacgcaggagaauca

SEQ ID NO: 309813 - RNA, 64 nt, hsa
uccuaugccccuggacaggacaguuggcuggggacaggagaagugcucaaucuucaugagacaa

SEQ ID NO: 309814 - RNA, 64 nt, hsa
ggcagagggagaugguggcaaaaagguuuagaugcaggagaacaguaagauggaugguuccggc

SEQ ID NO: 309815 - RNA, 64 nt, hsa
gcacccguaaucccagcuacucaggaggcugaggcaggagaauugcuugaacccaggaagcaga

SEQ ID NO: 309816 - RNA, 64 nt, hsa
uugccuguaauccuagcuacucaggaggcugaggcaggagaaucgcuugaaccugggaggugga

SEQ ID NO: 309817 - RNA, 64 nt, hsa
gcaccuguaaucccaguuacuugggaagcugaggcaggagaaucccuugaaccugggaggcaga

SEQ ID NO: 309818 - RNA, 64 nt, hsa
guaccuguagucccagcuacccaggaagcuaaggcaggagaaucgcuugaauccaggaggcgga

SEQ ID NO: 309819 - RNA, 64 nt, hsa
gcgccuguagucccagcuacuugggaggcugaggcaggagaauggcgugaacccgggaggcgga

SEQ ID NO: 309820 - RNA, 64 nt, hsa
uagcucagauguggagauucauagaaugaggguccaggagaagaaaguuaggggaaaucucauu

SEQ ID NO: 309821 - RNA, 64 nt, hsa
augccuauaaucccggcuacucgggaggcugaggcaggagaaucaccugaacccgggaggcaaa

SEQ ID NO: 309822 - RNA, 64 nt, hsa
augccuguagucccaacuacuagggaggcugaggcaggagaaucacuugaacccaggaggugga

SEQ ID NO: 309823 - RNA, 64 nt, hsa
augccuguaaucccagcuacuagggaggcugaggcaggagaauugcuugaaccugggagacgga

SEQ ID NO: 309824 - RNA, 64 nt, hsa
gugccuguagucuuagcuacuugagaggcugaggcaggagaaucgcuugaaccugggaggcaga

SEQ ID NO: 309825 - RNA, 64 nt, hsa
gcaccuguagucccagcuauuugggaggcugaugcaggagaauagcuuaagcccaggaauuuga

SEQ ID NO: 309826 - RNA, 64 nt, hsa
acaccuauagucgcagcuacuugggaggcuggggcaggagaauugccugagccugggaagugga

SEQ ID NO: 309827 - RNA, 64 nt, hsa
gggagcugaucccacgggcaggcucucccugcuccaggagaagacuaggaggaagaaugaggug

SEQ ID NO: 309828 - RNA, 64 nt, hsa
gugccugcaaucccagcuacucaggaagcugaggcaggagaaucgcuugaaccugggaggugga

SEQ ID NO: 309829 - RNA, 64 nt, hsa
ccaagcuugagagcucagcaccaugcaccaagagcaggagaaaagacguaaaccuaccccagca

SEQ ID NO: 309830 - RNA, 64 nt, hsa
gcaccuguaaucccagcuacucgggaggcugaggcaggagaaucgcuugaaccuagaaggcgga

SEQ ID NO: 309831 - RNA, 64 nt, hsa
aacagauuuuaaaugucugauauaaaacaugccacaggagaauucggggauuugaguuucucug

SEQ ID NO: 309832 - RNA, 64 nt, hsa
cauucuugucacaaaagugccacuaaaacagccucaggagaauaaaugacuugcuuuucuaaau

SEQ ID NO: 309833 - RNA, 64 nt, hsa
augccuguaauugcagcacuuuuagaggcugaggcaggagaauugguugaacccaggaggcgga

SEQ ID NO: 309834 - RNA, 64 nt, hsa
augccuguaaucccagcuacucgggaggcugaggcaggagaauugcuugaacucgggaggugga

SEQ ID NO: 309835 - RNA, 64 nt, hsa
gcgccuauaaucccagcuacuggggaggcugaggcaggagaaucacuugaacccgggggacaga

SEQ ID NO: 309836 - RNA, 64 nt, hsa
gugcccguaaucccagcuacucaggaggcugagacaggagaaucaccugaaccccagaggcaga

SEQ ID NO: 309837 - RNA, 64 nt, hsa
gcgccuguagucccagcuacuugggaggcugaggcaggagaauggcgugaacccgggaagcgga

SEQ ID NO: 309838 - RNA, 64 nt, hsa
caccuaaauaaaaauugaaagcaaguggauuacacaggagaaccauuaugaacauuuauuuaga

SEQ ID NO: 309839 - RNA, 64 nt, hsa
ggcgccuguaauccagcuacucgggaggcugaggcaggagaaucacuugaacccaggaggugga

SEQ ID NO: 309840 - RNA, 64 nt, hsa
gcgccuguagucccagcuacuugggaggcugaggcaggagaauggcgggaaccugggaggcgga

SEQ ID NO: 309841 - RNA, 64 nt, hsa
aaacagaacuccacugcaagagggggggccgggccaggagaaucuccgcuuguccaagacaggg

SEQ ID NO: 309842 - RNA, 64 nt, hsa
ucacugaauaucaacucugaaagagcaaaccuaacaggagaaaggacaaccaggaugaggaugu

SEQ ID NO: 309843 - RNA, 64 nt, hsa
uuuauuaccaagacauuaaaguagcauggcugcccaggagaaaagaagacauucuaauuccagu

SEQ ID NO: 309844 - RNA, 64 nt, hsa
gcaccuguagucccagcuacucaggaggcugaggcaggagaauggugugaaccugggaggugga

SEQ ID NO: 309845 - RNA, 64 nt, hsa
auaccuguagucccagcuacuugggaggcugaggcaggagaaucacuugaacucgggaggcgaa

SEQ ID NO: 309846 - RNA, 64 nt, hsa
gugccuguagucucagcuacucaggaggcugaggcaggagaaucgccugaacccgggcggcgga

SEQ ID NO: 309847 - RNA, 64 nt, hsa
aacgaugguuugaaaaggaaaccuaugauacaugcaggagaagcaaaacccaagugauugguga

SEQ ID NO: 309848 - RNA, 64 nt, hsa
gcaccuguaaucccaguuaccugggaggcugaggcaggagaaucucuugagcccaggaggcgga

SEQ ID NO: 309849 - RNA, 64 nt, hsa
gcgccuguaaucccagcuacucagaaggcugaggcaggagaaucacuugaaccuaggaggcgga

SEQ ID NO: 309850 - RNA, 64 nt, hsa
augccuguaaucccagcuacucgggaggcugaggcaggagaaucgcuugaacccaggaggcgga

SEQ ID NO: 309851 - RNA, 64 nt, hsa
gcgcuuguagucucagcuacuccggaggcugaggcaggagaauugcuugaaccuggaaggcaga

SEQ ID NO: 309852 - RNA, 64 nt, hsa
gugucuguaaucccagcuauucgggaggcugaggcaggagaaucgcuugaacccaggaggugga

SEQ ID NO: 309853 - RNA, 64 nt, hsa
cucacccccugcccccgcaccaaccacccauauucaggagaagaggacagacacggcaccucug

SEQ ID NO: 309854 - RNA, 64 nt, hsa
augccuguaaucccagcuacucaggaggcuaaggcaggagaaucgcuugaacccgggaggugga

SEQ ID NO: 309855 - RNA, 64 nt, hsa
aggagcugaggaggagaagccaaagaggaggaggcaggagaagcaggcagccugccccuucuac

SEQ ID NO: 309856 - RNA, 64 nt, hsa
caugcccuuccccaacaucaggucugcagagcugcaggagaagauggccuacuuggaucaaacc

SEQ ID NO: 309857 - RNA, 64 nt, hsa
gcccucacauccccuggccuggacccaggagacccaggagaaagcacccucccuuaggaaugag

SEQ ID NO: 309858 - RNA, 64 nt, hsa
uugagccccgaaggagaucaggcagccccaccugcaggagaacgucagcccuccaggggaucag

SEQ ID NO: 309859 - RNA, 64 nt, hsa
gcaccuguagucccagcuacucaggaggcugaggcaggagaauggcgugaacccggaaggcgga

SEQ ID NO: 309860 - RNA, 64 nt, hsa
augcauguagucccagcuacuccugaggcucagucaggagaaucgcuugaacuugggaggcgga

SEQ ID NO: 309861 - RNA, 64 nt, hsa
gggccuguaauuccagcuacucaggaggcugaagcaggagaaucguuuaaacacaggaggugga

SEQ ID NO: 309862 - RNA, 64 nt, hsa
gcgugguggcgggugccuguacaggaggcugaggcaggagaauggcgugaacccgcgaggcgga

SEQ ID NO: 309863 - RNA, 64 nt, hsa
gcaccuguaaucccagcuacuugggaggcugaggcaggagaaaucgccugaacccagaaggcag

SEQ ID NO: 309864 - RNA, 64 nt, hsa
augccuguaaucccagcuacuggggaggcugaggcaggagaaucgcuugaaccugggaggcaga

SEQ ID NO: 309865 - RNA, 64 nt, hsa
gcaccuguaaucgcagccuuucaggaggcugagacaggagaaucgcuugaacccuagaggcgga

SEQ ID NO: 309866 - RNA, 64 nt, hsa
acgccuguaaucccaucuucuugggaggcugaggcaggagaaucgcuagaaacugggaggugga

SEQ ID NO: 309867 - RNA, 64 nt, hsa
acgccuguaguuccagcuacucaggaggcugaggcaggagaaucgcuugaacccgggaggugga

SEQ ID NO: 309868 - RNA, 64 nt, hsa
caagugccuuuaaucccaccucaggaggcugaggcaggagaaucgcuugaaccugggaggcaga

SEQ ID NO: 309869 - RNA, 64 nt, hsa
augccuguaaucccagcuacuugggaggcugaggcaggagaaucgcuugaaccugggaggcgga

SEQ ID NO: 309870 - RNA, 64 nt, hsa
uccuccuccccagaacucagaacccaagucugaucaggagaaaaacaucacacaaauuccaauu

SEQ ID NO: 309871 - RNA, 64 nt, hsa
ugcaccugcagucccagcaacaugggaggcugaacaggagaaucgcuugaacccgcgacaggga

SEQ ID NO: 309872 - RNA, 64 nt, hsa
gcaccuauaaucccaccuacuugguaggcugaggcaggagaaucgcuugaacccaggaggcgga

SEQ ID NO: 309873 - RNA, 64 nt, hsa
gaucaguuugucuuuuuguauccaucaaguauuacaggagaaggauugggaacagaauggaaaa

SEQ ID NO: 309874 - RNA, 64 nt, hsa
gugccuguagucucagcuacucaggaggcugagacaggagaaucacuugaacccuggagguaga

SEQ ID NO: 309875 - RNA, 64 nt, hsa
gcgccuguaaucccagcugcucaggaggcugaggcaggagaaucgcuugaacccgggaggcaga

SEQ ID NO: 309876 - RNA, 64 nt, hsa
uaggaaggcaccaaagaaccuccucugcacuaaacaggagaauggaaagaaaagucuccauuga

SEQ ID NO: 309877 - RNA, 64 nt, hsa
auccuuaaccaacuagguaccgugaguuuacauacaggagaaugauggaaggaagggaggaagg

SEQ ID NO: 309878 - RNA, 64 nt, hsa
ggugccuguaauccagcuacuugggagacugaggcaggagaauugcuugaacccaggaggcaga

SEQ ID NO: 309879 - RNA, 64 nt, hsa
uccccuguagucccagcuacucgggaggcugaggcaggagaaucguuugaaccugggaggugga

SEQ ID NO: 309880 - RNA, 64 nt, hsa
guaccuguaguccuagcuacuugggaggcugaggcaggagaauggcgugaaccugggaggugga

SEQ ID NO: 309881 - RNA, 64 nt, hsa
uuagggccaaaauuuuaggaggagauguaggaugcaggagaaaauuaaaguguuuucuuuauau

SEQ ID NO: 309882 - RNA, 64 nt, hsa
acgccuguauucacagcuacucgggagguugaggcaggagaauggggugaacccgggaggaaga

SEQ ID NO: 309883 - RNA, 64 nt, hsa
gcaccuguaaucccagcuacuugggaggcugaggcaggagaaucucuugaacccaggaggcgga

SEQ ID NO: 309884 - RNA, 64 nt, hsa
gcaugguggcacacaccuguaaucguagcugaggcaggagaaucgccugaacccaggaggcgga

SEQ ID NO: 309885 - RNA, 64 nt, hsa
gcgccugaaaucccagcuacucaagaggcugaggcaggagaaucgcuugaaccugggaggcaaa

SEQ ID NO: 309886 - RNA, 64 nt, hsa
caagggcccuccccagcuacucgggaggcugaggcaggagaaucgcuugaacucaggaggugga

SEQ ID NO: 309887 - RNA, 64 nt, hsa
gcgccuguagucccagcuacuugggaggcugaggcaggagaauggccugaacccgggaggcgga

SEQ ID NO: 309888 - RNA, 64 nt, hsa
uaaugaaaacucagaggaaauaggaaaaucugcucaggagaaagaagcuaaaucugcauagauu

SEQ ID NO: 309889 - RNA, 64 nt, hsa
aaaaaaaaaagaaaaaaagaaauguaccuguuggcaggagaaggccagauggaguauguggagu

SEQ ID NO: 309890 - RNA, 64 nt, hsa
gcaccuguagucccagcuacacgggaggcugaggcaggagaauggcaugaaccugggaggcaga

SEQ ID NO: 309891 - RNA, 64 nt, hsa
uugguggaagauugcugaccgugccguuucugggcaggagaagacaucaugguguccagcaacu

SEQ ID NO: 309892 - RNA, 64 nt, hsa
gucgugagguccuucugaauguaaaacuggagcccaggagaagcugucccaggagggcuguuaa

SEQ ID NO: 309893 - RNA, 64 nt, hsa
ucccaagcccgagcagagggucaugcgggccccacaggagaagcggccagggcccgcggggggc

SEQ ID NO: 309894 - RNA, 64 nt, hsa
gugccuauaaucccagcuacucgggaggcugaggcaggagaaucgcuugaacccgggaggugga

SEQ ID NO: 309895 - RNA, 64 nt, hsa
gugccuguaauccuagcuacuugggaggcugaggcaggagaauugcuugaacuugggaggugga

SEQ ID NO: 309896 - RNA, 64 nt, hsa
gcgcuuguaaucccagcuacucgggaggcugaggcaggagaauugcuugaacccaugaggugga

SEQ ID NO: 309897 - RNA, 64 nt, hsa
gugccuguagucccagcuacucgggaggcugaggcaggagaauggcgugaaccugggaggcgga

SEQ ID NO: 309898 - RNA, 64 nt, hsa
gcaucuguagucucagcaacuuaggagccugaggcaggagaaugguuugaacacagggauggug

SEQ ID NO: 309899 - RNA, 64 nt, hsa
agaaccgccuggaagaggaaggccaggguuuggccaggagaacuaagaaggucucaacuccagg

SEQ ID NO: 309900 - RNA, 64 nt, hsa
gccuuagccucgucucgucccagaggcauuggaucaggagaaugggaauuuuuuuccucccacc

SEQ ID NO: 309901 - RNA, 64 nt, hsa
cauuugcuguauagagcugccacccaacucuaagcaggagaaacuguacagaaagggcuuugcu

SEQ ID NO: 309902 - RNA, 64 nt, hsa
augccuguauucccagcugcuugggaggcugaggcaggagaauggcuugaaccugggaggugga

SEQ ID NO: 309903 - RNA, 64 nt, hsa
ugugaaagcuggaaggaaaaaagcuauucucuaacaggagaacauaaagauucauuucucuccc

SEQ ID NO: 309904 - RNA, 64 nt, hsa
cacuucucgaguagaggucugccuagugagugagcaggagaacaucaucuuaauagccuuuggc

SEQ ID NO: 309905 - RNA, 64 nt, hsa
aaacgacgguacccaggagaagggauuuugggcccaggagaaacacuuacauucuggugccuug

SEQ ID NO: 309906 - RNA, 64 nt, hsa
uauggcugagccuggagccagaaacgacgguacccaggagaagggauuuugggcccaggagaaa

SEQ ID NO: 309907 - RNA, 64 nt, hsa
gcgccuguagucccagcuacucugaagacugaggcaggagaauggcgugaacccaggaggcgga

SEQ ID NO: 309908 - RNA, 64 nt, hsa
acgccuguagucucagcuacucaggaggcugaggcaggagaaucgcuugaacccgggaggcaga

SEQ ID NO: 309909 - RNA, 64 nt, hsa
gcgccuguaguuccagcuaacugggcggcugaggcaggagaauggcgugaaccugggaggugga

SEQ ID NO: 309910 - RNA, 64 nt, hsa
auggagaaagcccaagaguuagaacaguuggauacaggagaagaaacagcggcuccacuacaga

SEQ ID NO: 309911 - RNA, 64 nt, hsa
agaaacccccacccugccgcccgcauuauaaacacaggagaauaaucaauagaauaaaagugac

SEQ ID NO: 309912 - RNA, 64 nt, hsa
cagacaggggcuggguggggaggcucuuuaggcucaggagaagcauuuuaaagaaacccccacc

SEQ ID NO: 309913 - RNA, 64 nt, hsa
gcaccuguagucccagauacucgggaggcuaaggcaggagaaucgcuugacgggaagcggaggu

SEQ ID NO: 309914 - RNA, 64 nt, hsa
gggccuguaauccuagcuacuuggggugcugaggcaggagaaucaacugaacccgggaggcgga

SEQ ID NO: 309915 - RNA, 64 nt, hsa; identical to SEQ ID NO: 209315

SEQ ID NO: 309916 - RNA, 64 nt, hsa; identical to SEQ ID NO: 209316

SEQ ID NO: 309917 - RNA, 64 nt, hsa; identical to SEQ ID NO: 209317

SEQ ID NO: 309918 - RNA, 64 nt, hsa; identical to SEQ ID NO: 209318

SEQ ID NO: 309919 - RNA, 64 nt, hsa; identical to SEQ ID NO: 209319

SEQ ID NO: 309920 - RNA, 64 nt, hsa; identical to SEQ ID NO: 209320

SEQ ID NO: 309921 - RNA, 64 nt, hsa; identical to SEQ ID NO: 209321

SEQ ID NO: 309922 - RNA, 64 nt, hsa; identical to SEQ ID NO: 209322

SEQ ID NO: 309923 - RNA, 64 nt, hsa; identical to SEQ ID NO: 209323

SEQ ID NO: 309924 - RNA, 64 nt, hsa; identical to SEQ ID NO: 209324

SEQ ID NO: 309925 - RNA, 64 nt, hsa; identical to SEQ ID NO: 209325

SEQ ID NO: 309926 - RNA, 64 nt, hsa; identical to SEQ ID NO: 209326

SEQ ID NO: 309927 - RNA, 64 nt, hsa; identical to SEQ ID NO: 209327

SEQ ID NO: 309928 - RNA, 64 nt, hsa; identical to SEQ ID NO: 209328

SEQ ID NO: 309929 - RNA, 64 nt, hsa; identical to SEQ ID NO: 209329

SEQ ID NO: 309930 - RNA, 64 nt, hsa; identical to SEQ ID NO: 209330

SEQ ID NO: 309931 - RNA, 64 nt, hsa; identical to SEQ ID NO: 209331

SEQ ID NO: 309932 - RNA, 64 nt, hsa; identical to SEQ ID NO: 209332

SEQ ID NO: 309933 - RNA, 64 nt, hsa; identical to SEQ ID NO: 209333

SEQ ID NO: 309934 - RNA, 64 nt, hsa; identical to SEQ ID NO: 209334

SEQ ID NO: 309935 - RNA, 64 nt, hsa; identical to SEQ ID NO: 209335

SEQ ID NO: 309936 - RNA, 64 nt, hsa; identical to SEQ ID NO: 209336

SEQ ID NO: 309937 - RNA, 64 nt, hsa; identical to SEQ ID NO: 209337

SEQ ID NO: 309938 - RNA, 64 nt, hsa; identical to SEQ ID NO: 209338

SEQ ID NO: 309939 - RNA, 64 nt, hsa; identical to SEQ ID NO: 209339

SEQ ID NO: 309940 - RNA, 64 nt, hsa; identical to SEQ ID NO: 209340

SEQ ID NO: 309941 - RNA, 64 nt, hsa; identical to SEQ ID NO: 209341

SEQ ID NO: 309942 - RNA, 64 nt, hsa; identical to SEQ ID NO: 209342

SEQ ID NO: 309943 - RNA, 64 nt, hsa; identical to SEQ ID NO: 209343

SEQ ID NO: 309944 - RNA, 64 nt, hsa; identical to SEQ ID NO: 209344

SEQ ID NO: 309945 - RNA, 64 nt, hsa; identical to SEQ ID NO: 209345

SEQ ID NO: 309946 - RNA, 64 nt, hsa; identical to SEQ ID NO: 209346

SEQ ID NO: 309947 - RNA, 64 nt, hsa; identical to SEQ ID NO: 209347

SEQ ID NO: 309948 - RNA, 64 nt, hsa; identical to SEQ ID NO: 209348

SEQ ID NO: 309949 - RNA, 64 nt, hsa; identical to SEQ ID NO: 209349

SEQ ID NO: 309950 - RNA, 64 nt, hsa; identical to SEQ ID NO: 209350

SEQ ID NO: 309951 - RNA, 64 nt, hsa; identical to SEQ ID NO: 209351

SEQ ID NO: 309952 - RNA, 64 nt, hsa; identical to SEQ ID NO: 209352

SEQ ID NO: 309953 - RNA, 64 nt, hsa; identical to SEQ ID NO: 309788

SEQ ID NO: 309954 - RNA, 64 nt, hsa; identical to SEQ ID NO: 309789

SEQ ID NO: 309955 - RNA, 64 nt, hsa; identical to SEQ ID NO: 309790

SEQ ID NO: 309956 - RNA, 64 nt, hsa; identical to SEQ ID NO: 309791

SEQ ID NO: 309957 - RNA, 64 nt, hsa; identical to SEQ ID NO: 309792

SEQ ID NO: 309958 - RNA, 64 nt, hsa; identical to SEQ ID NO: 309793

SEQ ID NO: 309959 - RNA, 64 nt, hsa; identical to SEQ ID NO: 309794

SEQ ID NO: 309960 - RNA, 64 nt, hsa; identical to SEQ ID NO: 309795

SEQ ID NO: 309961 - RNA, 64 nt, hsa; identical to SEQ ID NO: 309796

SEQ ID NO: 309962 - RNA, 64 nt, hsa; identical to SEQ ID NO: 309797

SEQ ID NO: 309963 - RNA, 64 nt, hsa; identical to SEQ ID NO: 309798

SEQ ID NO: 309964 - RNA, 64 nt, hsa; identical to SEQ ID NO: 309799

SEQ ID NO: 309965 - RNA, 64 nt, hsa; identical to SEQ ID NO: 309800

SEQ ID NO: 309966 - RNA, 64 nt, hsa; identical to SEQ ID NO: 309801

SEQ ID NO: 309967 - RNA, 64 nt, hsa; identical to SEQ ID NO: 309802

SEQ ID NO: 309968 - RNA, 64 nt, hsa; identical to SEQ ID NO: 309803

SEQ ID NO: 309969 - RNA, 64 nt, hsa; identical to SEQ ID NO: 309804

SEQ ID NO: 309970 - RNA, 64 nt, hsa; identical to SEQ ID NO: 309805

SEQ ID NO: 309971 - RNA, 64 nt, hsa; identical to SEQ ID NO: 309806

SEQ ID NO: 309972 - RNA, 64 nt, hsa; identical to SEQ ID NO: 309807

SEQ ID NO: 309973 - RNA, 64 nt, hsa; identical to SEQ ID NO: 309808

SEQ ID NO: 309974 - RNA, 64 nt, hsa; identical to SEQ ID NO: 309809

SEQ ID NO: 309975 - RNA, 64 nt, hsa; identical to SEQ ID NO: 309810

SEQ ID NO: 309976 - RNA, 64 nt, hsa; identical to SEQ ID NO: 309811

SEQ ID NO: 309977 - RNA, 64 nt, hsa; identical to SEQ ID NO: 309812

SEQ ID NO: 309978 - RNA, 64 nt, hsa; identical to SEQ ID NO: 309813

SEQ ID NO: 309979 - RNA, 64 nt, hsa; identical to SEQ ID NO: 309814

SEQ ID NO: 309980 - RNA, 64 nt, hsa; identical to SEQ ID NO: 309815

SEQ ID NO: 309981 - RNA, 64 nt, hsa; identical to SEQ ID NO: 309816

SEQ ID NO: 309982 - RNA, 64 nt, hsa; identical to SEQ ID NO: 309817

SEQ ID NO: 309983 - RNA, 64 nt, hsa; identical to SEQ ID NO: 309818

SEQ ID NO: 309984 - RNA, 64 nt, hsa; identical to SEQ ID NO: 309819

SEQ ID NO: 309985 - RNA, 64 nt, hsa; identical to SEQ ID NO: 309820

SEQ ID NO: 309986 - RNA, 64 nt, hsa; identical to SEQ ID NO: 309821

SEQ ID NO: 309987 - RNA, 64 nt, hsa; identical to SEQ ID NO: 309822

SEQ ID NO: 309988 - RNA, 64 nt, hsa; identical to SEQ ID NO: 309823

SEQ ID NO: 309989 - RNA, 64 nt, hsa; identical to SEQ ID NO: 309824

SEQ ID NO: 309990 - RNA, 64 nt, hsa; identical to SEQ ID NO: 309825

SEQ ID NO: 309991 - RNA, 64 nt, hsa; identical to SEQ ID NO: 309826

SEQ ID NO: 309992 - RNA, 64 nt, hsa; identical to SEQ ID NO: 309827

SEQ ID NO: 309993 - RNA, 64 nt, hsa; identical to SEQ ID NO: 309828

SEQ ID NO: 309994 - RNA, 64 nt, hsa; identical to SEQ ID NO: 309829

SEQ ID NO: 309995 - RNA, 64 nt, hsa; identical to SEQ ID NO: 309830

SEQ ID NO: 309996 - RNA, 64 nt, hsa; identical to SEQ ID NO: 309831

SEQ ID NO: 309997 - RNA, 64 nt, hsa; identical to SEQ ID NO: 309832

SEQ ID NO: 309998 - RNA, 64 nt, hsa; identical to SEQ ID NO: 309833

SEQ ID NO: 309999 - RNA, 64 nt, hsa; identical to SEQ ID NO: 309834

SEQ ID NO: 310000 - RNA, 64 nt, hsa; identical to SEQ ID NO: 309835

SEQ ID NO: 310001 - RNA, 64 nt, hsa; identical to SEQ ID NO: 309836

SEQ ID NO: 310002 - RNA, 64 nt, hsa; identical to SEQ ID NO: 309837

SEQ ID NO: 310003 - RNA, 64 nt, hsa; identical to SEQ ID NO: 309838

SEQ ID NO: 310004 - RNA, 64 nt, hsa; identical to SEQ ID NO: 309839

SEQ ID NO: 310005 - RNA, 64 nt, hsa; identical to SEQ ID NO: 309840

SEQ ID NO: 310006 - RNA, 64 nt, hsa; identical to SEQ ID NO: 309841

SEQ ID NO: 310007 - RNA, 64 nt, hsa; identical to SEQ ID NO: 309842

SEQ ID NO: 310008 - RNA, 64 nt, hsa; identical to SEQ ID NO: 309843

SEQ ID NO: 310009 - RNA, 64 nt, hsa; identical to SEQ ID NO: 309844

SEQ ID NO: 310010 - RNA, 64 nt, hsa; identical to SEQ ID NO: 309845

SEQ ID NO: 310011 - RNA, 64 nt, hsa; identical to SEQ ID NO: 309846

SEQ ID NO: 310012 - RNA, 64 nt, hsa; identical to SEQ ID NO: 309847

SEQ ID NO: 310013 - RNA, 64 nt, hsa; identical to SEQ ID NO: 309848

SEQ ID NO: 310014 - RNA, 64 nt, hsa; identical to SEQ ID NO: 309849

SEQ ID NO: 310015 - RNA, 64 nt, hsa; identical to SEQ ID NO: 309850

SEQ ID NO: 310016 - RNA, 64 nt, hsa; identical to SEQ ID NO: 309851

SEQ ID NO: 310017 - RNA, 64 nt, hsa; identical to SEQ ID NO: 309852

SEQ ID NO: 310018 - RNA, 64 nt, hsa; identical to SEQ ID NO: 309853

SEQ ID NO: 310019 - RNA, 64 nt, hsa; identical to SEQ ID NO: 309854

SEQ ID NO: 310020 - RNA, 64 nt, hsa; identical to SEQ ID NO: 309855

SEQ ID NO: 310021 - RNA, 64 nt, hsa; identical to SEQ ID NO: 309856

SEQ ID NO: 310022 - RNA, 64 nt, hsa; identical to SEQ ID NO: 309857

SEQ ID NO: 310023 - RNA, 64 nt, hsa; identical to SEQ ID NO: 309858

SEQ ID NO: 310024 - RNA, 64 nt, hsa; identical to SEQ ID NO: 309859

SEQ ID NO: 310025 - RNA, 64 nt, hsa; identical to SEQ ID NO: 309860

SEQ ID NO: 310026 - RNA, 64 nt, hsa; identical to SEQ ID NO: 309861

SEQ ID NO: 310027 - RNA, 64 nt, hsa; identical to SEQ ID NO: 309862

SEQ ID NO: 310028 - RNA, 64 nt, hsa; identical to SEQ ID NO: 309863

SEQ ID NO: 310029 - RNA, 64 nt, hsa; identical to SEQ ID NO: 309864

SEQ ID NO: 310030 - RNA, 64 nt, hsa; identical to SEQ ID NO: 309865

SEQ ID NO: 310031 - RNA, 64 nt, hsa; identical to SEQ ID NO: 309866

SEQ ID NO: 310032 - RNA, 64 nt, hsa; identical to SEQ ID NO: 309867

SEQ ID NO: 310033 - RNA, 64 nt, hsa; identical to SEQ ID NO: 309868

SEQ ID NO: 310034 - RNA, 64 nt, hsa; identical to SEQ ID NO: 309869

SEQ ID NO: 310035 - RNA, 64 nt, hsa; identical to SEQ ID NO: 309870

SEQ ID NO: 310036 - RNA, 64 nt, hsa; identical to SEQ ID NO: 309871

SEQ ID NO: 310037 - RNA, 64 nt, hsa; identical to SEQ ID NO: 309872

SEQ ID NO: 310038 - RNA, 64 nt, hsa; identical to SEQ ID NO: 309873

SEQ ID NO: 310039 - RNA, 64 nt, hsa; identical to SEQ ID NO: 309874

SEQ ID NO: 310040 - RNA, 64 nt, hsa; identical to SEQ ID NO: 309875

SEQ ID NO: 310041 - RNA, 64 nt, hsa; identical to SEQ ID NO: 309876

SEQ ID NO: 310042 - RNA, 64 nt, hsa; identical to SEQ ID NO: 309877

SEQ ID NO: 310043 - RNA, 64 nt, hsa; identical to SEQ ID NO: 309878

SEQ ID NO: 310044 - RNA, 64 nt, hsa; identical to SEQ ID NO: 309879

SEQ ID NO: 310045 - RNA, 64 nt, hsa; identical to SEQ ID NO: 309880

SEQ ID NO: 310046 - RNA, 64 nt, hsa; identical to SEQ ID NO: 309881

SEQ ID NO: 310047 - RNA, 64 nt, hsa; identical to SEQ ID NO: 309882

SEQ ID NO: 310048 - RNA, 64 nt, hsa; identical to SEQ ID NO: 309883

SEQ ID NO: 310049 - RNA, 64 nt, hsa; identical to SEQ ID NO: 309884

SEQ ID NO: 310050 - RNA, 64 nt, hsa; identical to SEQ ID NO: 309885

SEQ ID NO: 310051 - RNA, 64 nt, hsa; identical to SEQ ID NO: 309886

SEQ ID NO: 310052 - RNA, 64 nt, hsa; identical to SEQ ID NO: 309887

SEQ ID NO: 310053 - RNA, 64 nt, hsa; identical to SEQ ID NO: 309888

SEQ ID NO: 310054 - RNA, 64 nt, hsa; identical to SEQ ID NO: 309889

SEQ ID NO: 310055 - RNA, 64 nt, hsa; identical to SEQ ID NO: 309890

SEQ ID NO: 310056 - RNA, 64 nt, hsa; identical to SEQ ID NO: 309891

SEQ ID NO: 310057 - RNA, 64 nt, hsa; identical to SEQ ID NO: 309892

SEQ ID NO: 310058 - RNA, 64 nt, hsa; identical to SEQ ID NO: 309893

SEQ ID NO: 310059 - RNA, 64 nt, hsa; identical to SEQ ID NO: 309894

SEQ ID NO: 310060 - RNA, 64 nt, hsa; identical to SEQ ID NO: 309895

SEQ ID NO: 310061 - RNA, 64 nt, hsa; identical to SEQ ID NO: 309896

SEQ ID NO: 310062 - RNA, 64 nt, hsa; identical to SEQ ID NO: 309897

SEQ ID NO: 310063 - RNA, 64 nt, hsa; identical to SEQ ID NO: 309898

SEQ ID NO: 310064 - RNA, 64 nt, hsa; identical to SEQ ID NO: 309899

SEQ ID NO: 310065 - RNA, 64 nt, hsa; identical to SEQ ID NO: 309900

SEQ ID NO: 310066 - RNA, 64 nt, hsa; identical to SEQ ID NO: 309901

SEQ ID NO: 310067 - RNA, 64 nt, hsa; identical to SEQ ID NO: 309902

SEQ ID NO: 310068 - RNA, 64 nt, hsa; identical to SEQ ID NO: 309903

SEQ ID NO: 310069 - RNA, 64 nt, hsa; identical to SEQ ID NO: 309904

SEQ ID NO: 310070 - RNA, 64 nt, hsa; identical to SEQ ID NO: 309905

SEQ ID NO: 310071 - RNA, 64 nt, hsa; identical to SEQ ID NO: 309906

SEQ ID NO: 310072 - RNA, 64 nt, hsa; identical to SEQ ID NO: 309907

SEQ ID NO: 310073 - RNA, 64 nt, hsa; identical to SEQ ID NO: 309908

SEQ ID NO: 310074 - RNA, 64 nt, hsa; identical to SEQ ID NO: 309909

SEQ ID NO: 310075 - RNA, 64 nt, hsa; identical to SEQ ID NO: 309910

SEQ ID NO: 310076 - RNA, 64 nt, hsa; identical to SEQ ID NO: 309911

SEQ ID NO: 310077 - RNA, 64 nt, hsa; identical to SEQ ID NO: 309912

SEQ ID NO: 310078 - RNA, 64 nt, hsa; identical to SEQ ID NO: 309913

SEQ ID NO: 310079 - RNA, 64 nt, hsa; identical to SEQ ID NO: 309914

SEQ ID NO: 310080 - RNA, 64 nt, hsa; identical to SEQ ID NO: 209315

SEQ ID NO: 310081 - RNA, 64 nt, hsa; identical to SEQ ID NO: 209316

SEQ ID NO: 310082 - RNA, 64 nt, hsa; identical to SEQ ID NO: 209317

SEQ ID NO: 310083 - RNA, 64 nt, hsa; identical to SEQ ID NO: 209318

SEQ ID NO: 310084 - RNA, 64 nt, hsa; identical to SEQ ID NO: 209319

SEQ ID NO: 310085 - RNA, 64 nt, hsa; identical to SEQ ID NO: 209320

SEQ ID NO: 310086 - RNA, 64 nt, hsa; identical to SEQ ID NO: 209321

SEQ ID NO: 310087 - RNA, 64 nt, hsa; identical to SEQ ID NO: 209322

SEQ ID NO: 310088 - RNA, 64 nt, hsa; identical to SEQ ID NO: 209323

SEQ ID NO: 310089 - RNA, 64 nt, hsa; identical to SEQ ID NO: 209324

SEQ ID NO: 310090 - RNA, 64 nt, hsa; identical to SEQ ID NO: 209325

SEQ ID NO: 310091 - RNA, 64 nt, hsa; identical to SEQ ID NO: 209326

SEQ ID NO: 310092 - RNA, 64 nt, hsa; identical to SEQ ID NO: 209327

SEQ ID NO: 310093 - RNA, 64 nt, hsa; identical to SEQ ID NO: 209328

SEQ ID NO: 310094 - RNA, 64 nt, hsa; identical to SEQ ID NO: 209329

SEQ ID NO: 310095 - RNA, 64 nt, hsa; identical to SEQ ID NO: 209330

SEQ ID NO: 310096 - RNA, 64 nt, hsa; identical to SEQ ID NO: 209331

SEQ ID NO: 310097 - RNA, 64 nt, hsa; identical to SEQ ID NO: 209332

SEQ ID NO: 310098 - RNA, 64 nt, hsa; identical to SEQ ID NO: 209333

SEQ ID NO: 310099 - RNA, 64 nt, hsa; identical to SEQ ID NO: 209334

SEQ ID NO: 310100 - RNA, 64 nt, hsa; identical to SEQ ID NO: 209335

SEQ ID NO: 310101 - RNA, 64 nt, hsa; identical to SEQ ID NO: 209336

SEQ ID NO: 310102 - RNA, 64 nt, hsa; identical to SEQ ID NO: 209337

SEQ ID NO: 310103 - RNA, 64 nt, hsa; identical to SEQ ID NO: 209338

SEQ ID NO: 310104 - RNA, 64 nt, hsa; identical to SEQ ID NO: 209339

SEQ ID NO: 310105 - RNA, 64 nt, hsa; identical to SEQ ID NO: 209340

SEQ ID NO: 310106 - RNA, 64 nt, hsa; identical to SEQ ID NO: 209341

SEQ ID NO: 310107 - RNA, 64 nt, hsa; identical to SEQ ID NO: 209342

SEQ ID NO: 310108 - RNA, 64 nt, hsa; identical to SEQ ID NO: 209343

SEQ ID NO: 310109 - RNA, 64 nt, hsa; identical to SEQ ID NO: 209344

SEQ ID NO: 310110 - RNA, 64 nt, hsa; identical to SEQ ID NO: 209345

SEQ ID NO: 310111 - RNA, 64 nt, hsa; identical to SEQ ID NO: 209346

SEQ ID NO: 310112 - RNA, 64 nt, hsa; identical to SEQ ID NO: 209347

SEQ ID NO: 310113 - RNA, 64 nt, hsa; identical to SEQ ID NO: 209348

SEQ ID NO: 310114 - RNA, 64 nt, hsa; identical to SEQ ID NO: 209349

SEQ ID NO: 310115 - RNA, 64 nt, hsa; identical to SEQ ID NO: 209350

SEQ ID NO: 310116 - RNA, 64 nt, hsa; identical to SEQ ID NO: 209351

SEQ ID NO: 310117 - RNA, 64 nt, hsa; identical to SEQ ID NO: 209352

SEQ ID NO: 310118 - RNA, 59 nt, hsa
ucugcccuucacaaacaccucucucuccccugcacuagcugucccaagcuuacauacag

SEQ ID NO: 310119 - RNA, 59 nt, hsa
ggcccgcggcucagccucggccgucugcccugcacuaccaaggccgaccacuagagguc

SEQ ID NO: 310120 - RNA, 59 nt, hsa
cuugggucccacuuucuccaggaugccaacugcacuagcugugugcgaaugacguaucu

SEQ ID NO: 310121 - RNA, 59 nt, hsa
ccuuaccccacccauccaugccagcacuucugcacuacggccauucuccucuugggcgc

SEQ ID NO: 310122 - RNA, 59 nt, hsa
gcuaugacaugagcacacccaacgcaccccugcacuacuaugagaccguucgcauggca

SEQ ID NO: 310123 - RNA, 59 nt, hsa
aauggaagacacaaaacugagagaucauucugcacuaaguuucgggaacuuauccccga

SEQ ID NO: 310124 - RNA, 59 nt, hsa
gaacaucccccucccaacacuacccuucccugcacuaaagccagccugaccuuccuucc

SEQ ID NO: 310125 - RNA, 59 nt, hsa
ugaacauccccucccaucauuacccuucccugcacuaaagccagccugaccuuccuucc

SEQ ID NO: 310126 - RNA, 59 nt, hsa; identical to SEQ ID NO: 310125

SEQ ID NO: 310127 - RNA, 59 nt, hsa
aaagucccccuccuaacgucuuccuuucccugcacuaacgccaaccugacugcuuuucc

SEQ ID NO: 310128 - RNA, 59 nt, hsa
cugaaucugcuuauucuucagcuucaccucugcacuaaccccuuacccuuaugguacgu

SEQ ID NO: 310129 - RNA, 59 nt, hsa
cucugucuuguggccaguuuggccuuucacugcacuauucugauggugccugacugaau

SEQ ID NO: 310130 - RNA, 59 nt, hsa
accaaaacagcauguguaagaggcaguaucugcacuaauucucaacaugcuaaacauua

SEQ ID NO: 310131 - RNA, 59 nt, hsa
uguguugucucuagagcagggauuaaccucugcacuacugacauguggggccaggucac

SEQ ID NO: 310132 - RNA, 59 nt, hsa
caggggguagagagauuucagcuuggguucugcacuaacagccuccaagcccccuggca

SEQ ID NO: 310133 - RNA, 59 nt, hsa
uucuccuuguccuagucagaugaaggaggcugcacuacaaacccaaauucugcaaaaaa

SEQ ID NO: 310134 - RNA, 59 nt, hsa
cuucuggaauauagagaaauaguuucacccugcacuacccuguucuguaguuauucuga

SEQ ID NO: 310135 - RNA, 59 nt, hsa
ucugccugugccuuuaucccugacagcugcugcacuagccuuccugcuucccuaaggac

SEQ ID NO: 310136 - RNA, 59 nt, hsa
auuuagcuauacuucaaguacucuauucucugcacuaacuuacuguccuucugggaacu

SEQ ID NO: 310137 - RNA, 59 nt, hsa
auauauauguauaucauguauauauuacucugcacuauaucccuucuuuuuggagaacu

SEQ ID NO: 310138 - RNA, 59 nt, hsa
cagcuugaacaugcauuuucuaaagcaaacugcacuaguguauauaucagggacauuaa

SEQ ID NO: 310139 - RNA, 59 nt, hsa
aggaauaauuuuuuauuuaaaguugauuucugcacuaucuuuuucucaguuaccugcau

SEQ ID NO: 310140 - RNA, 59 nt, hsa
ugcucaguuuucucuauucuuauuauucacugcacuauauucuaagcacuuacaugugg

SEQ ID NO: 310141 - RNA, 59 nt, hsa
uucacuuacaccugacugacccuccugaacugcacuacaagacacuuuguagaagagga

SEQ ID NO: 310142 - RNA, 59 nt, hsa
auuguuaauuuuauaaaauuugguuuggccugcacuacgaugagggauggagguagcug

SEQ ID NO: 310143 - RNA, 59 nt, hsa
gucugguguagcuccucugcugcucccaucugcacuaauugacccaaaacguggguauu

SEQ ID NO: 310144 - RNA, 54 nt, hsa
cccagcagcuggcacacugagcaccugcacuaaauuacucaaaaugugcuguaa

SEQ ID NO: 310145 - RNA, 59 nt, hsa
gaaaauauggccauacugcuuuuuuaccccugcacuauuucagugcaccacagaauagg

SEQ ID NO: 310146 - RNA, 59 nt, hsa
aguguagcugaggaggcaccuacacucaccugcacuaacagaguggccguccuaaccuc

SEQ ID NO: 310147 - RNA, 59 nt, hsa
uggauucuguugaacuauggggucccacacugcacuauuaauuccacccacuguaaggg

SEQ ID NO: 310148 - RNA, 59 nt, hsa
uccagauuugauuguuuuacucccaaugacugcacuauauguaugcauaagaccacuuu

SEQ ID NO: 310149 - RNA, 59 nt, hsa
auugucugacccuagaggcagaugcugcacugcacuacuccaaugucuuccauggagcc

SEQ ID NO: 310150 - RNA, 59 nt, hsa
caaaauugccugaauuguacuguauguagcugcacuacaacagauucuuaccgucucca

SEQ ID NO: 310151 - RNA, 59 nt, hsa
aaaacuggaaccaacucugcccuaccucccugcacuaaccagcuuugaggauggcacug

SEQ ID NO: 310152 - RNA, 59 nt, hsa
uuuuugucccuggcggguaaauuaggaaucugcacuauuuuggaggacaaguagcacaa

SEQ ID NO: 310153 - RNA, 59 nt, hsa
gggcagaggaugcacgguggcuagagccgcugcacuauccuuuucagagcacuucaucc

SEQ ID NO: 310154 - RNA, 59 nt, hsa
auuacucuuuggccugggaacccuguggucugcacuacaugugaauggccuuccacuuc

SEQ ID NO: 310155 - RNA, 59 nt, hsa
cauuuguaugguauuuuuaugaaaaagaacugcacuacaguacaauuuacaacaaugcu

SEQ ID NO: 310156 - RNA, 59 nt, hsa
gcagacuagucuuauuuuuuuaauuccugcugcacuaaagcuauuacaaauauaacaug

SEQ ID NO: 310157 - RNA, 59 nt, hsa
ucaagaggaauaccacuuauguuacacuccugcacuaaaggcacguacugcagugugaa

SEQ ID NO: 310158 - RNA, 59 nt, hsa
auguugcccaguaaaaguauacaaauucccugcacuagcagaagagaauucuguaucag

SEQ ID NO: 310159 - RNA, 59 nt, hsa
ccuaguaguuccugaaacugugagcaccacugcacuaagccagugcggagcuguuaggg

SEQ ID NO: 310160 - RNA, 59 nt, hsa
cuggagucauacccagccuaaguguugcccugcacuauggcuggaggacacauuuggua

SEQ ID NO: 310161 - RNA, 59 nt, hsa
uggagagaaguggaauccuauauagaaugcugcacuaauugacaacacagccuauaggc

SEQ ID NO: 310162 - RNA, 59 nt, hsa
uuucuguuuacugucaaaauauuucucaucugcacuauguuuccauuugugguccugaa

SEQ ID NO: 310163 - RNA, 59 nt, hsa
agacuuugauuucuccaaguguguaucaucugcacuaggaacuuuguuuuuaagcaaua

SEQ ID NO: 310164 - RNA, 59 nt, hsa
ccuggcuuuccuuggauacccacugucaccugcacuaugaagugcugcuggcugggcuu

SEQ ID NO: 310165 - RNA, 59 nt, hsa
gucuuggaaggacuacuacucaauggccccugcacuacucuacuuccucuuaccuaugu

SEQ ID NO: 310166 - RNA, 59 nt, hsa
ggagguuccagagagccaagaucgcaccacugcacuacagccugggcgacagaacgaga

SEQ ID NO: 310167 - RNA, 59 nt, hsa
uuauuuuugaagaagaauagccuuuuucucugcacuauuuagauccgaaugaaccuuau

SEQ ID NO: 310168 - RNA, 59 nt, hsa
aaaauaaaugaaauuauuuaaggguuaugcugcacuaguauuccuuagaggaaacaguu

SEQ ID NO: 310169 - RNA, 59 nt, hsa
acagaaaaguuggaaaaggauaauacagacugcacuaaauguuuuccucuguuuuacaa

SEQ ID NO: 310170 - RNA, 59 nt, hsa
gaggcccagaugugggcaggcagcccgggcugcacuaugcggucaggauuccuugcugc

SEQ ID NO: 310171 - RNA, 59 nt, hsa
gaaauauguaaagaaaaacaggaagauaccugcacuaaucauucagacuucauugagcu

SEQ ID NO: 310172 - RNA, 59 nt, hsa
uucuaauccucauuuccuguaggauguuccugcacuauaacaagauuauguuuucuucc

SEQ ID NO: 310173 - RNA, 59 nt, hsa
gacaguggagccaguuugguuuucucccucugcacuaggccaagaacuugcugccuugc

SEQ ID NO: 310174 - RNA, 59 nt, hsa
gagaggccucccccaugccucccugcccucugcacuaagcacuuuccaggcaggccugg

SEQ ID NO: 310175 - RNA, 59 nt, hsa
aagggcaaucuaaauuguggcuugaaggacugcacuaaaacccacuaaaaagaugcgaa

SEQ ID NO: 310176 - RNA, 59 nt, hsa
aaugcucagucugaucaacaagugggcaccugcacuaccacuuuuuagaggaaauucac

SEQ ID NO: 310177 - RNA, 59 nt, hsa
cccuuucucuuaaaaaccauggcauuagacugcacuaaauuaacaagcauguuaguugc

SEQ ID NO: 310178 - RNA, 59 nt, hsa
uggauuaauuccuucuguucauuuuccaacugcacuaauugugcauauuacucugccua

SEQ ID NO: 310179 - RNA, 59 nt, hsa
cucagaauuucaggccugcugggagcuuucugcacuaggccacacuaguucaugguauc

SEQ ID NO: 310180 - RNA, 59 nt, hsa
caaaggaaucugcucuuugagguuucuuucugcacuagagauuuuucuguuuuugaaaa

SEQ ID NO: 310181 - RNA, 59 nt, hsa
ggagaacaccauuccugauuucccacaaacugcacuacaucaguauaacugcauuucua

SEQ ID NO: 310182 - RNA, 59 nt, hsa
uucuacuucugaaguuauuaaagcuaaaacugcacuaagccuuuugagacauccuuuau

SEQ ID NO: 310183 - RNA, 59 nt, hsa
auggaugcuuuccacaaaaugucaccucgcugcacuaaaggaugaugaauccuaaucau

SEQ ID NO: 310184 - RNA, 59 nt, hsa
uccagccucugggaaucagcccccccucucugcacuauccgauccucaucaacagaggg

SEQ ID NO: 310185 - RNA, 59 nt, hsa
cauucauguaacaaaacccagcacauuaucugcacuauaagcucaaagaaugucacauc

SEQ ID NO: 310186 - RNA, 58 nt, hsa
auaaauaaaacugugcuugcucuaaagcucugcacuacaaaagcaaauuuuccagucu

SEQ ID NO: 310187 - RNA, 59 nt, hsa
ccagaccugaaaggguaaaggguuuauaacugcacuaauaaagagaggcucuuuuuuuu

SEQ ID NO: 310188 - RNA, 59 nt, hsa
aaagcauaacaccaaucccagggcuggcucugcacuaagagaaaauugcacuaaaugaa

SEQ ID NO: 310189 - RNA, 59 nt, hsa
guauaacaagcauagacaaaugagugucccugcacuaagaagaaucacuuuaaaaagca

SEQ ID NO: 310190 - RNA, 59 nt, hsa
uuuuguuggacuuggcauguuuccaugaacugcacuauuauaaacuauuaaaaugauag

SEQ ID NO: 310191 - RNA, 59 nt, hsa
aacauuuuucauauucgaagugguugucucugcacuauuuacugaaaaguucauccuuu

SEQ ID NO: 310192 - RNA, 59 nt, hsa
uggaccuagcuugaggcaauuuuaauccccugcacuaggcagguaauaauaaagguuga

SEQ ID NO: 310193 - RNA, 59 nt, hsa
aaacacaggccaucagggaaaacgaaaugcugcacuauuaaauuagagguuuuugaaaa

SEQ ID NO: 310194 - RNA, 59 nt, hsa
agccggcugagugcaccgcccggcugcuucugcacuagcggguggggugguaugguggu

SEQ ID NO: 310195 - RNA, 59 nt, hsa
gccaugcagcccucccugaggauugacuucugcacuaauccagugaaggaggcuguguc

SEQ ID NO: 310196 - RNA, 59 nt, hsa
guacauagugcuaacaugaagaccuuuuucugcacuauaugcaaacaggguaacuaacu

SEQ ID NO: 310197 - RNA, 59 nt, hsa
uggguuuaacugaccagagcgagagaacucugcacuaugaacccaaacccagcucaaaa

SEQ ID NO: 310198 - RNA, 59 nt, hsa
aguuauuuuuaccauccgggcgcugauagcugcacuauuaauaaauugcauguguuccu

SEQ ID NO: 310199 - RNA, 59 nt, hsa
gaaacuuuaguacuuagaauuuuggccuucugcacuacucuuuugcucuuacgaacaua

SEQ ID NO: 310200 - RNA, 59 nt, hsa
ccacaccaaaacgcugaagagaguaacaacugcacuaggauuucuguaaggaguaauuu

SEQ ID NO: 310201 - RNA, 59 nt, hsa
gauguggagccuucauauguuaaauauuccugcacuagugauggucacuuagaauguuu

SEQ ID NO: 310202 - RNA, 59 nt, hsa
uuauguuccucugugugcuaaacugaagucugcacuagaaguacagagagaauggccag

SEQ ID NO: 310203 - RNA, 59 nt, hsa
uauguauucuucaaaacauuuggcacaugcugcacuaaccuagucuaucuuuucuaucu

SEQ ID NO: 310204 - RNA, 59 nt, hsa
ggaaguuuguccuguuaaccaaaugguuacugcacuaccaggguuacugguuuauuuuc

SEQ ID NO: 310205 - RNA, 59 nt, hsa
auuaguaaggugaacuguucaggaauucucugcacuagcugugcagaagagcagauaac

SEQ ID NO: 310206 - RNA, 59 nt, hsa
uugguuacuugcagccugaaguaccguaacugcacuaaagggacguagugugaacaucc

SEQ ID NO: 310207 - RNA, 59 nt, hsa
ccaccugagaugcugaccagcagugaaggcugcacuaguuuucuacacuacaggaauua

SEQ ID NO: 310208 - RNA, 59 nt, hsa
agaugccccagccugcagagggcgcgccucugcacuaacucaggccagguagcccuggc

SEQ ID NO: 310209 - RNA, 59 nt, hsa
augauugcuaugaucuuugagaaauuuuucugcacuauuugcacugaaauguuuauuua

SEQ ID NO: 310210 - RNA, 59 nt, hsa
acuucagccaacaggggugucugcuucugcugcacuacacaggccaggaguggcauucc

SEQ ID NO: 310211 - RNA, 59 nt, hsa
ggauaaaacuuggccuagaaaaguuuggucugcacuauaaaacauuuuacuuauuuucc

SEQ ID NO: 310212 - RNA, 59 nt, hsa
cucuucucuguuuccugccaagaccucaucugcacuaaugccuucucccugaccuugac

SEQ ID NO: 310213 - RNA, 59 nt, hsa
caaaagggaggcucucuguaggcacagagcugcacuaucacgagccuuuguuuuucucc

SEQ ID NO: 310214 - RNA, 59 nt, hsa
aaagggugaaggaaauccuugucuaaggacugcacuauaguugaguuugauuuuuauug

SEQ ID NO: 310215 - RNA, 59 nt, hsa
gcgauagggaacgcgcccuugccccgaggcugcacuaccacaggaaauaacauauguaa

SEQ ID NO: 310216 - RNA, 59 nt, hsa
auuuauuacuaugucuuauuuaucagacccugcacuaagauuaaaaguugugcaugggc

SEQ ID NO: 310217 - RNA, 59 nt, hsa
uugguaauuuuuauuuuuuauuuuugggacugcacuauccuguucacgaagacauguga

SEQ ID NO: 310218 - RNA, 59 nt, hsa
aaaucacccaaauuucaguucuuuaccuacugcacuaacaauggcaagggggguauucu

SEQ ID NO: 310219 - RNA, 59 nt, hsa
aauauuguuuuucuagaggacauucauaucugcacuauuaucugaugacauguugguaa

SEQ ID NO: 310220 - RNA, 59 nt, hsa
auguggaggcuugaugcugcgguugggggcugcacuaccugcguccguggaagccucug

SEQ ID NO: 310221 - RNA, 59 nt, hsa
guuuccgaugagguguacggaugagugaccugcacuaagaagugaguugccacagugaa

SEQ ID NO: 310222 - RNA, 59 nt, hsa
gggguauggaauauggaaucuauuucugucugcacuagagaggucgggaggaaguuaau

SEQ ID NO: 310223 - RNA, 59 nt, hsa
acucauugcuaaaaauguguagcacagaacugcacuaggauuaauuuguuuacaagaag

SEQ ID NO: 310224 - RNA, 59 nt, hsa
gaaaauuagaaauugcauguuaguucaugcugcacuaccauauuguucuuuuggggcuc

SEQ ID NO: 310225 - RNA, 59 nt, hsa
aguaauauuucugguuuuuagcccuuucucugcacuaccaacaagagauaaaauuguua

SEQ ID NO: 310226 - RNA, 59 nt, hsa
ugagauuuguguuugguuugguuuuugcacugcacuaaggcaggaggguuggagggcug

SEQ ID NO: 310227 - RNA, 59 nt, hsa
aguuguuguuuuucucccuaaucuaucagcugcacuacuugagaaaauuuaaaguguuu

SEQ ID NO: 310228 - RNA, 59 nt, hsa
uuauuauguuuuuuaaaaugugagaacuucugcacuacaaaauucccuucacagagaag

SEQ ID NO: 310229 - RNA, 59 nt, hsa
uccaaauaaauaguacuggucauuucucucugcacuauuucugcgcgcugucuucugag

SEQ ID NO: 310230 - RNA, 59 nt, hsa
caacacaaaaucucuguuuugugagaauacugcacuauggaauaauugacaaauugaaa

SEQ ID NO: 310231 - RNA, 59 nt, hsa
agugaaaaagaaauuauauucagauaggacugcacuacauuauuugucacacauggauc

SEQ ID NO: 310232 - RNA, 59 nt, hsa
guggccaaagcauggccuuaccagcuugucugcacuauuuucuuuuggguggugacugu

SEQ ID NO: 310233 - RNA, 59 nt, hsa
auuuuaauuguccucacuuuuuuuugaaacugcacuaaauuuuucuuaacauuccaaga

SEQ ID NO: 310234 - RNA, 59 nt, hsa
auugcuaugaaugauacccugaauuuggccugcacuaauuugauguuuacagguggaca

SEQ ID NO: 310235 - RNA, 59 nt, hsa
gauauguuuuucugauauaauuacuuuagcugcacuaacaguacaaugcuuguuaaugg

SEQ ID NO: 310236 - RNA, 59 nt, hsa
cugcggaccgcuuccuuccacagcgagaacugcacuaccuucuguuguacuuuaauuau

SEQ ID NO: 310237 - RNA, 59 nt, hsa
aauaucuuuaaaggagagaugucaacuuucugcacuauucccagccucugcuccucccu

SEQ ID NO: 310238 - RNA, 59 nt, hsa
ucauccugcuuaauccuuccagcaugucucugcacuaauaaacagcuaaauucacauaa

SEQ ID NO: 310239 - RNA, 59 nt, hsa
gagauguuuuccaggaaggggcucagaagcugcacuaggccccgaguccccaugugucu

SEQ ID NO: 310240 - RNA, 59 nt, hsa
agugggacuaguucuucacaguguggcagcugcacuaaucuguuugugagggaauaucc

SEQ ID NO: 310241 - RNA, 59 nt, hsa
ugcuuuauccccuucucuuccuucaccaucugcacuacauuucuggcugaucccaauca

SEQ ID NO: 310242 - RNA, 59 nt, hsa
auucugauacacacuaaaguugagaaucacugcacuagaucacuuuguguuuucugauu

SEQ ID NO: 310243 - RNA, 59 nt, hsa
uagagaggccacuuucccagaauccacagcugcacuaagcuaaggagaagccagaugcc

SEQ ID NO: 310244 - RNA, 59 nt, hsa
ugcucccccugagccagcaccugcgggagcugcacuacagcccuggccuccacccccac

SEQ ID NO: 310245 - RNA, 59 nt, hsa
aucugaaaugaucuuaauuacuagaagaucugcacuauuaacuuugugaagaguuucuc

SEQ ID NO: 310246 - RNA, 59 nt, hsa
agccuaucaggacugcacucucuucucggcugcacuaaagcuggcacucccccagccgu

SEQ ID NO: 310247 - RNA, 59 nt, hsa
acaauugugguuuauugaaugugauuuuucugcacuaauauaaauuagacuaaguguuu

SEQ ID NO: 310248 - RNA, 59 nt, hsa
uuacucuagaauucuaauacagauacuuucugcacuaguaucacuuuuauuauugcagu

SEQ ID NO: 310249 - RNA, 59 nt, hsa
ugcccguaucaucaugauugguacccugacugcacuacagugguuuaucuaugacuccg

SEQ ID NO: 310250 - RNA, 59 nt, hsa
ggguggguggcagaggggagcagagccaucugcacuauugcauaaucugagccagaguu

SEQ ID NO: 310251 - RNA, 59 nt, hsa
uuggagcaaaggcacaguucacccuuagccugcacuaagggccguggaagcuugaccag

SEQ ID NO: 310252 - RNA, 59 nt, hsa
caucucuggucuggggcugagggcaaggacugcacuaguccagggaguaggggacccuu

SEQ ID NO: 310253 - RNA, 59 nt, hsa
guguuguaugugcuguuccaugguguugacugcacuaauaauaaaccuuuuacucaacu

SEQ ID NO: 310254 - RNA, 59 nt, hsa
caccuucacagcuuccucgcugcugucaccugcacuauccaauuaguauuuucauuuac

SEQ ID NO: 310255 - RNA, 59 nt, hsa
auggugucacuuagauugacuuuaguugacugcacuauauaauauagaacuaugaauau

SEQ ID NO: 310256 - RNA, 59 nt, hsa
guauauugaacccuagcuagugccccaagcugcacuauugggaauggauuguggcugaa

SEQ ID NO: 310257 - RNA, 59 nt, hsa
ggcucuugugccugcuguagacauuaggccugcacuagggccaugugcugucaagauuc

SEQ ID NO: 310258 - RNA, 59 nt, hsa
gcaacaggaaggggccuggggccguuuggcugcacuaacuuugguagcucagugugcau

SEQ ID NO: 310259 - RNA, 59 nt, hsa
gggcccugcaaccuucccagccacuccugcugcacuaaggacuuaggauccuuuuauca

SEQ ID NO: 310260 - RNA, 59 nt, hsa
cuucucuccucagccuaggguggaggucacugcacuaccacccaccucuggaagacugg

SEQ ID NO: 310261 - RNA, 59 nt, hsa
aagcuuuuucuuuuccuuuuuaaugaugccugcacuaucaagaguauucuaguguucuc

SEQ ID NO: 310262 - RNA, 59 nt, hsa
acaauugauugaccacaugaaaguguggccugcacuauauucucaauuuuaauauuaag

SEQ ID NO: 310263 - RNA, 59 nt, hsa
aaaggaaaaauaaggaaauucaauacaaacugcacuaugauuugcuuuaacuauuaugg

SEQ ID NO: 310264 - RNA, 59 nt, hsa
agaaauguaccaacucaaugccuuuucagcugcacuauuuaauuaugguaccugcugcc

SEQ ID NO: 310265 - RNA, 59 nt, hsa
ugacgauagucccauuugggugguuucagcugcacuaucuguaugaaauggugucacca

SEQ ID NO: 310266 - RNA, 59 nt, hsa
uaaugcaaauuaauaaaaugacacuuuuacugcacuauagaaauauucauguauguuaa

SEQ ID NO: 310267 - RNA, 59 nt, hsa
gugcaccguuccccuccucggcuugaguccugcacuaccaaaauggccuggccauuuga

SEQ ID NO: 310268 - RNA, 59 nt, hsa
guuguuaggaaggcaccaaagaaccuccucugcacuaaacaggagaauggaaagaaaag

SEQ ID NO: 310269 - RNA, 59 nt, hsa
gcaaggcucuggacuucuuuguaccugcccugcacuaugaaguggaugcccagcggaag

SEQ ID NO: 310270 - RNA, 59 nt, hsa
cuuugcacuugcugaaucugucuuuguuucugcacuaauuaaugcacauugaguuuugu

SEQ ID NO: 310271 - RNA, 59 nt, hsa
agagguugcagugagccgagaucacgccacugcacuauagccuaggugacagagugaga

SEQ ID NO: 310272 - RNA, 59 nt, hsa
cggaggggcgcgcuggggcuucgaccuggcugcacuaacccaggcuccuccucgccccg

SEQ ID NO: 310273 - RNA, 59 nt, hsa
guccucacaucuuucacacuuccaccagccugcacuacucccucaaagcacacgucaug

SEQ ID NO: 310274 - RNA, 59 nt, hsa
acguuuacacagggugggcugcccccacccugcacuaccuauuuuugugagucuccgug

SEQ ID NO: 310275 - RNA, 59 nt, hsa
aacacuggacacccucgccagggccacuucugcacuagggcucugugcuggaacccagg

SEQ ID NO: 310276 - RNA, 59 nt, hsa
cauucgcagugcccagugauggcauuacucugcacuauagccauuugccccaacuuaag

SEQ ID NO: 310277 - RNA, 59 nt, hsa
ugguccaguaccuggcugagcugcugaagcugcacuacaugcaggaaucuccagggacc

SEQ ID NO: 310278 - RNA, 59 nt, hsa
ccauccuuuccucucuccccguucaugcccugcacuacauagcacagccgggaugcuug

SEQ ID NO: 310279 - RNA, 59 nt, hsa
gucuuaaaauugccaccugcacuuuguuucugcacuauuauguagugcauuuuaacuua

SEQ ID NO: 310280 - RNA, 59 nt, hsa
guucguggggaacugcguggugcucuuugcugcacuauuugccgucaucgggaggagca

SEQ ID NO: 310281 - RNA, 59 nt, hsa
cugagccaagggagggaagggccacccugcugcacuaggacuugguaagaugacucuga

SEQ ID NO: 310282 - RNA, 59 nt, hsa
ugucccacaccugccauauugaaccguuucugcacuaaucuucuccacgggcacggagu

SEQ ID NO: 310283 - RNA, 59 nt, hsa
cgcggaacauugcacuaaacgucgucgagcugcacuaggccuggccugagccucugaaa

SEQ ID NO: 310284 - RNA, 59 nt, hsa
gcugacaggcaacauuuuuggggugcuuucugcacuaguuuuccuuguaaaugauuuga

SEQ ID NO: 310285 - RNA, 59 nt, hsa
auaaacaauuaauuuugcccagcaagcuucugcacuaguaacugacagugcuacauuaa

SEQ ID NO: 310286 - RNA, 59 nt, hsa
agcucauaaagaauugggacucaccccuacugcacuaccaaauucauuugacuuuggag

SEQ ID NO: 310287 - RNA, 59 nt, hsa
aaauuauggaucaugccgaagugucacaacugcacuaaagacaaauagcacuagaggcu

SEQ ID NO: 310288 - RNA, 59 nt, hsa
ggguguggucaaggggcacucagagacaccugcacuagaaauugcauugacauugugag

SEQ ID NO: 310289 - RNA, 59 nt, hsa
caagggacaguuccauggcccuucccggacugcacuaggcugggagcucuguugugugg

SEQ ID NO: 310290 - RNA, 59 nt, hsa
guucuggguaaggggacgaggagcgaacacugcacuaagauuugguuugccaaaucaga

SEQ ID NO: 310291 - RNA, 59 nt, hsa
cuaacuuggacugcacuaacuuguggagucugcacuaacuuggagaaguuagugucaga

SEQ ID NO: 310292 - RNA, 59 nt, hsa
cuaacuaacuugcacugcacuaacuuggacugcacuaacuuguggagucugcacuaacu

SEQ ID NO: 310293 - RNA, 59 nt, hsa
cuaauuuagacugcacuaacuaacuugcacugcacuaacuuggacugcacuaacuugug

SEQ ID NO: 310294 - RNA, 59 nt, hsa
uuaacuuguggagucugcacuaauuuagacugcacuaacuaacuugcacugcacuaacu

SEQ ID NO: 310295 - RNA, 59 nt, hsa
cuuggacugagccccuuaacuuguggagucugcacuaauuuagacugcacuaacuaacu

SEQ ID NO: 310296 - RNA, 59 nt, hsa
ucacccuccacuggaaucaccuaccuugccugcacuaacuggugauaauaaagaccuua

SEQ ID NO: 310297 - RNA, 59 nt, hsa
ccuguccuuuagggaagcuggagccaucucugcacuaacugcccucccaaauaucuugg

SEQ ID NO: 310298 - RNA, 59 nt, hsa
guacuuuaaguuccagaaugaacauguagcugcacuaugccagaaauuaaugagggaag

SEQ ID NO: 310299 - RNA, 59 nt, hsa
ccacucccaggaccaagauuggccugaggcugcacuaaaauucacuuagggucgagcau

SEQ ID NO: 310300 - RNA, 59 nt, hsa
cucuuaaggaaaccacuguacaaaugacacugcacuaggauuauugggaaggaaucauu

SEQ ID NO: 310301 - RNA, 59 nt, hsa
gagagccgggccccggacggacguugguucugcacuaaaacccaucuuccccggaugug

SEQ ID NO: 310302 - RNA, 59 nt, hsa
uaaaauaagcaguuuagauuccgacgacacugcacuaauuggcaugucagccuccagcu

SEQ ID NO: 310303 - RNA, 59 nt, hsa
gccaaggaaaguaaaaugugauuuuguaacugcacuaaacauuugucaugcuguaguug

SEQ ID NO: 310304 - RNA, 59 nt, hsa
agaagcugcagugagcucugauggaaccacugcacuauagccuggaccacagagcaggc

SEQ ID NO: 310305 - RNA, 59 nt, hsa
gcuccugccccuucugcccugccuugccccugcacuaugcucuuggcuccuguggaagg

SEQ ID NO: 310306 - RNA, 59 nt, hsa
ccugucucgggcuccccaccgacuggcagcugcacuauccccaacuccccacuucugcc

SEQ ID NO: 310307 - RNA, 59 nt, hsa
uggccacaggcccagugugcugcuuggcacugcacuaguuuaggaccugcagcauguag

SEQ ID NO: 310308 - RNA, 59 nt, hsa
guuuguuuugcgcucuccugucacaaaugcugcacuauugguucuuaaguuuuuuaucu

SEQ ID NO: 310309 - RNA, 59 nt, hsa
auuuuuuuuaagaauacaaaaacagaaaucugcacuaauuuaccugguuucguaggaaa

SEQ ID NO: 310310 - RNA, 59 nt, hsa
cuuucagaugucuucugccuguuauaacucugcacuacuccucugcagugccuugggga

SEQ ID NO: 310311 - RNA, 59 nt, hsa
gaucuccaaacugaugucccugugaacaccugcacuaugagaagguuucccaacaagag

SEQ ID NO: 310312 - RNA, 59 nt, hsa
gguccaucccgucuucaggaucaucuacacugcacuaggggagccccaggaaggcagca

SEQ ID NO: 310313 - RNA, 59 nt, hsa
gcgccuccaccccuaccccgcacauccaacugcacuaaacugccucugcucucuugucu

SEQ ID NO: 310314 - RNA, 59 nt, hsa
ucccucuccuugcuggcuccaucuuucgucugcacuaccaauucaaugcccuucaucca

SEQ ID NO: 310315 - RNA, 64 nt, hsa
gggaaacaaacugccccguuaacuccagaucauugcacuggaauguaaucaagaaaguuaguca

SEQ ID NO: 310316 - RNA, 64 nt, hsa
cugaguaccuacuagguaccaaguacucuuuuaggcacuggaaauacagugauggacaaaacag

SEQ ID NO: 310317 - RNA, 64 nt, hsa
ucgagccuacaagccccgagagaaugaugaauuggcacuggagaaagccgacguggugauggug

SEQ ID NO: 310318 - RNA, 64 nt, hsa
uuugugcuuggugggggggauuucgagggacuuugcacuggacucugggaaccuuucaucauua

SEQ ID NO: 310319 - RNA, 64 nt, hsa
uaaaacaacauauuguguugggccaccuguacugaacgcugaaucguuuuuccucuuaaguuga

SEQ ID NO: 310320 - RNA, 64 nt, hsa
cccugugugugaaaucuuaacgucucuacuugggaacgcugaucccauucauuuagaguugaug

SEQ ID NO: 310321 - RNA, 64 nt, hsa; identical to SEQ ID NO: 250794

SEQ ID NO: 310322 - RNA, 64 nt, hsa; identical to SEQ ID NO: 250795

SEQ ID NO: 310323 - RNA, 64 nt, hsa; identical to SEQ ID NO: 250796

SEQ ID NO: 310324 - RNA, 64 nt, hsa; identical to SEQ ID NO: 250797

SEQ ID NO: 310325 - RNA, 64 nt, hsa; identical to SEQ ID NO: 250798

SEQ ID NO: 310326 - RNA, 64 nt, hsa; identical to SEQ ID NO: 250799

SEQ ID NO: 310327 - RNA, 64 nt, hsa; identical to SEQ ID NO: 250800

SEQ ID NO: 310328 - RNA, 64 nt, hsa; identical to SEQ ID NO: 250801

SEQ ID NO: 310329 - RNA, 64 nt, hsa; identical to SEQ ID NO: 250802

SEQ ID NO: 310330 - RNA, 64 nt, hsa; identical to SEQ ID NO: 250803

SEQ ID NO: 310331 - RNA, 64 nt, hsa; identical to SEQ ID NO: 250804

SEQ ID NO: 310332 - RNA, 64 nt, hsa; identical to SEQ ID NO: 250805

SEQ ID NO: 310333 - RNA, 64 nt, hsa; identical to SEQ ID NO: 250806

SEQ ID NO: 310334 - RNA, 64 nt, hsa; identical to SEQ ID NO: 250807

SEQ ID NO: 310335 - RNA, 64 nt, hsa; identical to SEQ ID NO: 250808

SEQ ID NO: 310336 - RNA, 64 nt, hsa; identical to SEQ ID NO: 250809

SEQ ID NO: 310337 - RNA, 64 nt, hsa; identical to SEQ ID NO: 250810

SEQ ID NO: 310338 - RNA, 64 nt, hsa; identical to SEQ ID NO: 250811

SEQ ID NO: 310339 - RNA, 64 nt, hsa; identical to SEQ ID NO: 250812

SEQ ID NO: 310340 - RNA, 64 nt, hsa; identical to SEQ ID NO: 250813

SEQ ID NO: 310341 - RNA, 64 nt, hsa; identical to SEQ ID NO: 250814

SEQ ID NO: 310342 - RNA, 64 nt, hsa; identical to SEQ ID NO: 250815

SEQ ID NO: 310343 - RNA, 64 nt, hsa; identical to SEQ ID NO: 250816

SEQ ID NO: 310344 - RNA, 64 nt, hsa; identical to SEQ ID NO: 250817

SEQ ID NO: 310345 - RNA, 64 nt, hsa; identical to SEQ ID NO: 250818

SEQ ID NO: 310346 - RNA, 64 nt, hsa; identical to SEQ ID NO: 250819

SEQ ID NO: 310347 - RNA, 64 nt, hsa; identical to SEQ ID NO: 250820

SEQ ID NO: 310348 - RNA, 64 nt, hsa; identical to SEQ ID NO: 250821

SEQ ID NO: 310349 - RNA, 64 nt, hsa; identical to SEQ ID NO: 250822

SEQ ID NO: 310350 - RNA, 64 nt, hsa; identical to SEQ ID NO: 250823

SEQ ID NO: 310351 - RNA, 64 nt, hsa; identical to SEQ ID NO: 250824

SEQ ID NO: 310352 - RNA, 64 nt, hsa; identical to SEQ ID NO: 250825

SEQ ID NO: 310353 - RNA, 64 nt, hsa; identical to SEQ ID NO: 250826

SEQ ID NO: 310354 - RNA, 64 nt, hsa; identical to SEQ ID NO: 250827

SEQ ID NO: 310355 - RNA, 64 nt, hsa; identical to SEQ ID NO: 250828

SEQ ID NO: 310356 - RNA, 64 nt, hsa; identical to SEQ ID NO: 250829

SEQ ID NO: 310357 - RNA, 64 nt, hsa; identical to SEQ ID NO: 250830

SEQ ID NO: 310358 - RNA, 64 nt, hsa; identical to SEQ ID NO: 250831

SEQ ID NO: 310359 - RNA, 64 nt, hsa; identical to SEQ ID NO: 250832

SEQ ID NO: 310360 - RNA, 64 nt, hsa; identical to SEQ ID NO: 250833

SEQ ID NO: 310361 - RNA, 64 nt, hsa; identical to SEQ ID NO: 250834

SEQ ID NO: 310362 - RNA, 64 nt, hsa; identical to SEQ ID NO: 250835

SEQ ID NO: 310363 - RNA, 64 nt, hsa; identical to SEQ ID NO: 250836

SEQ ID NO: 310364 - RNA, 64 nt, hsa; identical to SEQ ID NO: 250837

SEQ ID NO: 310365 - RNA, 64 nt, hsa; identical to SEQ ID NO: 250838

SEQ ID NO: 310366 - RNA, 64 nt, hsa; identical to SEQ ID NO: 250839

SEQ ID NO: 310367 - RNA, 58 nt, hsa; identical to SEQ ID NO: 250840

SEQ ID NO: 310368 - RNA, 64 nt, hsa; identical to SEQ ID NO: 250841

SEQ ID NO: 310369 - RNA, 64 nt, hsa; identical to SEQ ID NO: 250842

SEQ ID NO: 310370 - RNA, 64 nt, hsa; identical to SEQ ID NO: 250843

SEQ ID NO: 310371 - RNA, 64 nt, hsa; identical to SEQ ID NO: 250844

SEQ ID NO: 310372 - RNA, 64 nt, hsa; identical to SEQ ID NO: 250845

SEQ ID NO: 310373 - RNA, 64 nt, hsa; identical to SEQ ID NO: 250846

SEQ ID NO: 310374 - RNA, 64 nt, hsa; identical to SEQ ID NO: 250847

SEQ ID NO: 310375 - RNA, 64 nt, hsa; identical to SEQ ID NO: 250848

SEQ ID NO: 310376 - RNA, 64 nt, hsa; identical to SEQ ID NO: 250849

SEQ ID NO: 310377 - RNA, 64 nt, hsa; identical to SEQ ID NO: 250850

SEQ ID NO: 310378 - RNA, 64 nt, hsa; identical to SEQ ID NO: 250851

SEQ ID NO: 310379 - RNA, 64 nt, hsa; identical to SEQ ID NO: 250852

SEQ ID NO: 310380 - RNA, 64 nt, hsa; identical to SEQ ID NO: 250853

SEQ ID NO: 310381 - RNA, 64 nt, hsa; identical to SEQ ID NO: 250854

SEQ ID NO: 310382 - RNA, 64 nt, hsa; identical to SEQ ID NO: 250855

SEQ ID NO: 310383 - RNA, 64 nt, hsa; identical to SEQ ID NO: 250856

SEQ ID NO: 310384 - RNA, 64 nt, hsa; identical to SEQ ID NO: 250857

SEQ ID NO: 310385 - RNA, 64 nt, hsa; identical to SEQ ID NO: 250858

SEQ ID NO: 310386 - RNA, 64 nt, hsa; identical to SEQ ID NO: 250859

SEQ ID NO: 310387 - RNA, 64 nt, hsa; identical to SEQ ID NO: 250860

SEQ ID NO: 310388 - RNA, 63 nt, hsa; identical to SEQ ID NO: 250861

SEQ ID NO: 310389 - RNA, 64 nt, hsa; identical to SEQ ID NO: 250862

SEQ ID NO: 310390 - RNA, 64 nt, hsa; identical to SEQ ID NO: 250863

SEQ ID NO: 310391 - RNA, 64 nt, hsa; identical to SEQ ID NO: 250864

SEQ ID NO: 310392 - RNA, 64 nt, hsa; identical to SEQ ID NO: 250865

SEQ ID NO: 310393 - RNA, 64 nt, hsa; identical to SEQ ID NO: 250866

SEQ ID NO: 310394 - RNA, 64 nt, hsa; identical to SEQ ID NO: 250867

SEQ ID NO: 310395 - RNA, 64 nt, hsa; identical to SEQ ID NO: 250868

SEQ ID NO: 310396 - RNA, 64 nt, hsa; identical to SEQ ID NO: 250869

SEQ ID NO: 310397 - RNA, 64 nt, hsa; identical to SEQ ID NO: 250870

SEQ ID NO: 310398 - RNA, 64 nt, hsa; identical to SEQ ID NO: 250871

SEQ ID NO: 310399 - RNA, 64 nt, hsa; identical to SEQ ID NO: 250872

SEQ ID NO: 310400 - RNA, 64 nt, hsa; identical to SEQ ID NO: 250873

SEQ ID NO: 310401 - RNA, 64 nt, hsa; identical to SEQ ID NO: 250874

SEQ ID NO: 310402 - RNA, 64 nt, hsa; identical to SEQ ID NO: 250875

SEQ ID NO: 310403 - RNA, 64 nt, hsa; identical to SEQ ID NO: 250876

SEQ ID NO: 310404 - RNA, 64 nt, hsa; identical to SEQ ID NO: 250877

SEQ ID NO: 310405 - RNA, 64 nt, hsa; identical to SEQ ID NO: 250878

SEQ ID NO: 310406 - RNA, 64 nt, hsa; identical to SEQ ID NO: 250879

SEQ ID NO: 310407 - RNA, 64 nt, hsa; identical to SEQ ID NO: 250880

SEQ ID NO: 310408 - RNA, 64 nt, hsa; identical to SEQ ID NO: 250881

SEQ ID NO: 310409 - RNA, 64 nt, hsa; identical to SEQ ID NO: 250882

SEQ ID NO: 310410 - RNA, 64 nt, hsa; identical to SEQ ID NO: 250883

SEQ ID NO: 310411 - RNA, 64 nt, hsa; identical to SEQ ID NO: 250884

SEQ ID NO: 310412 - RNA, 64 nt, hsa; identical to SEQ ID NO: 250885

SEQ ID NO: 310413 - RNA, 64 nt, hsa; identical to SEQ ID NO: 250886

SEQ ID NO: 310414 - RNA, 64 nt, hsa; identical to SEQ ID NO: 250887

SEQ ID NO: 310415 - RNA, 64 nt, hsa; identical to SEQ ID NO: 250888

SEQ ID NO: 310416 - RNA, 64 nt, hsa; identical to SEQ ID NO: 250889

SEQ ID NO: 310417 - RNA, 64 nt, hsa; identical to SEQ ID NO: 250890

SEQ ID NO: 310418 - RNA, 64 nt, hsa; identical to SEQ ID NO: 139090

SEQ ID NO: 310419 - RNA, 64 nt, hsa; identical to SEQ ID NO: 139091

SEQ ID NO: 310420 - RNA, 64 nt, hsa; identical to SEQ ID NO: 139092

SEQ ID NO: 310421 - RNA, 64 nt, hsa; identical to SEQ ID NO: 139093

SEQ ID NO: 310422 - RNA, 64 nt, hsa; identical to SEQ ID NO: 139094

SEQ ID NO: 310423 - RNA, 64 nt, hsa; identical to SEQ ID NO: 139095

SEQ ID NO: 310424 - RNA, 64 nt, hsa; identical to SEQ ID NO: 139096

SEQ ID NO: 310425 - RNA, 64 nt, hsa; identical to SEQ ID NO: 139097

SEQ ID NO: 310426 - RNA, 64 nt, hsa; identical to SEQ ID NO: 139098

SEQ ID NO: 310427 - RNA, 64 nt, hsa; identical to SEQ ID NO: 139099

SEQ ID NO: 310428 - RNA, 64 nt, hsa; identical to SEQ ID NO: 139100

SEQ ID NO: 310429 - RNA, 64 nt, hsa; identical to SEQ ID NO: 139101

SEQ ID NO: 310430 - RNA, 64 nt, hsa; identical to SEQ ID NO: 139102

SEQ ID NO: 310431 - RNA, 64 nt, hsa; identical to SEQ ID NO: 139103

SEQ ID NO: 310432 - RNA, 64 nt, hsa; identical to SEQ ID NO: 139104

SEQ ID NO: 310433 - RNA, 64 nt, hsa; identical to SEQ ID NO: 139105

SEQ ID NO: 310434 - RNA, 64 nt, hsa; identical to SEQ ID NO: 139106

SEQ ID NO: 310435 - RNA, 64 nt, hsa; identical to SEQ ID NO: 139107

SEQ ID NO: 310436 - RNA, 64 nt, hsa; identical to SEQ ID NO: 139108

SEQ ID NO: 310437 - RNA, 64 nt, hsa; identical to SEQ ID NO: 139109

SEQ ID NO: 310438 - RNA, 64 nt, hsa; identical to SEQ ID NO: 139110

SEQ ID NO: 310439 - RNA, 64 nt, hsa; identical to SEQ ID NO: 139111

SEQ ID NO: 310440 - RNA, 64 nt, hsa; identical to SEQ ID NO: 139112

SEQ ID NO: 310441 - RNA, 64 nt, hsa; identical to SEQ ID NO: 139113

SEQ ID NO: 310442 - RNA, 64 nt, hsa; identical to SEQ ID NO: 139114

SEQ ID NO: 310443 - RNA, 64 nt, hsa; identical to SEQ ID NO: 139115

SEQ ID NO: 310444 - RNA, 52 nt, hsa; identical to SEQ ID NO: 112167

SEQ ID NO: 310445 - RNA, 64 nt, hsa; identical to SEQ ID NO: 139117

SEQ ID NO: 310446 - RNA, 64 nt, hsa; identical to SEQ ID NO: 139118

SEQ ID NO: 310447 - RNA, 64 nt, hsa; identical to SEQ ID NO: 139119

SEQ ID NO: 310448 - RNA, 64 nt, hsa; identical to SEQ ID NO: 139120

SEQ ID NO: 310449 - RNA, 64 nt, hsa; identical to SEQ ID NO: 139121

SEQ ID NO: 310450 - RNA, 64 nt, hsa; identical to SEQ ID NO: 139122

SEQ ID NO: 310451 - RNA, 64 nt, hsa; identical to SEQ ID NO: 139123

SEQ ID NO: 310452 - RNA, 64 nt, hsa; identical to SEQ ID NO: 139124

SEQ ID NO: 310453 - RNA, 64 nt, hsa; identical to SEQ ID NO: 139125

SEQ ID NO: 310454 - RNA, 64 nt, hsa; identical to SEQ ID NO: 139126

SEQ ID NO: 310455 - RNA, 64 nt, hsa; identical to SEQ ID NO: 139127

SEQ ID NO: 310456 - RNA, 64 nt, hsa; identical to SEQ ID NO: 139128

SEQ ID NO: 310457 - RNA, 64 nt, hsa; identical to SEQ ID NO: 139129

SEQ ID NO: 310458 - RNA, 64 nt, hsa; identical to SEQ ID NO: 139130

SEQ ID NO: 310459 - RNA, 64 nt, hsa; identical to SEQ ID NO: 139131

SEQ ID NO: 310460 - RNA, 64 nt, hsa
gcgcuagaaucuuuuauuuuacuuuauuuuuuuugagguggaguuucgcucuuguugcccgggc

SEQ ID NO: 310461 - RNA, 64 nt, hsa
gcucacgccuguaaucccaguauuuugggaggccgagguggaaagaucgcuugagcccaggagu

SEQ ID NO: 310462 - RNA, 64 nt, hsa
cacuccugucaucccaggacacuugaggcccaaggagguggaguggagagugggcucggguaca

SEQ ID NO: 310463 - RNA, 64 nt, hsa
cugugcccugggaugccuacccugcccaccuccggagguggaaccgggcugccccugggggccu

SEQ ID NO: 310464 - RNA, 64 nt, hsa
ggaggccgccagguguuugcucucuccuuguggggagguggauccucugccagcaggugucugu

SEQ ID NO: 310465 - RNA, 64 nt, hsa
gggaggcugaggcaggagaaucgcuugaacucgggagguggagguugcagucagccaagaucgu

SEQ ID NO: 310466 - RNA, 64 nt, hsa
ggucugcagagggagaaaagaacccacaagggaagagguggaggucaggcacgguggcucacgc

SEQ ID NO: 310467 - RNA, 64 nt, hsa
gggaggcugaggcaggagaauugcuugagcccaagagguggagguuacagugagcagagaucac

SEQ ID NO: 310468 - RNA, 64 nt, hsa
gggaggcugaggcaggagaaucgcuugaaccugggagguggagguugcagugagcugagaucgu

SEQ ID NO: 310469 - RNA, 64 nt, hsa
gggaggcugaggcaggagaauugcuugaaccugggagguggagguugcagugagcuaaaauugu

SEQ ID NO: 310470 - RNA, 64 nt, hsa
gcugaauguauguugcguaucccaaggcacugaagagguggaaaaauaaucgugucaaucugga

SEQ ID NO: 310471 - RNA, 64 nt, hsa
gcgguggcucacaccuguaaucccagcacuuugggagguggaggcggguggaucacaaggucaa

SEQ ID NO: 310472 - RNA, 64 nt, hsa
gggaggcugaggcaggagaaucacuugaacccaggagguggagguugcagugagccgagaucac

SEQ ID NO: 310473 - RNA, 64 nt, hsa
gggaggcugaggcgggagaaucgcuugaacccaggagguggagguugcaguuagcugagauccu

SEQ ID NO: 310474 - RNA, 64 nt, hsa
gcucaugccuauaaucccaggacuuugggaagcugagguggacggaucauuugaggucaggagu

SEQ ID NO: 310475 - RNA, 64 nt, hsa
guugacaguaauaggaauaacaggagacagggaagagguggaaauuuguuucuuuuuuuaaguu

SEQ ID NO: 310476 - RNA, 64 nt, hsa
gggaggcugaggcaggagaaucgcuugaaccugggagguggagguugcagugagcugugauugu

SEQ ID NO: 310477 - RNA, 64 nt, hsa
cugcuugcugccucuccuuucuuccucuugccucgagguggaagcuguauagagcccgggucca

SEQ ID NO: 310478 - RNA, 64 nt, hsa
ggacucuguugcuggucuucucaguucauuuccugagguggauuuacugagagaaggugaaaua

SEQ ID NO: 310479 - RNA, 64 nt, hsa
ggcaggcugaggcaugagaaucgcuugaacccaggagguggagguuacagugagcugagagugc

SEQ ID NO: 310480 - RNA, 64 nt, hsa
ccgggagagcuucgcuucagggaaacauuacugggagguggagguggaaaacgugauugagugg

SEQ ID NO: 310481 - RNA, 64 nt, hsa
gagcuucgcuucagggaaacauuacugggagguggagguggaaaacgugauugaguggacugug

SEQ ID NO: 310482 - RNA, 64 nt, hsa
agaaaagcugaauguuugggugugacguuugacugagguggauuggggcugccuguggacauua

SEQ ID NO: 310483 - RNA, 64 nt, hsa
aaaaauuauugugaugauucauuuagcauaaagagagguggacggaaggguuuuccuauguauc

SEQ ID NO: 310484 - RNA, 64 nt, hsa
uguaauuuauuuuaacauuuuuacaauaaaacaugagguggacaggccagcuuggugugugcug

SEQ ID NO: 310485 - RNA, 64 nt, hsa
aaggccaugaugucaagggccauguccccaagcagagguggagaaggggacacugaggugagca

SEQ ID NO: 310486 - RNA, 64 nt, hsa
gaagcuucuggugaccuuccaagagccugagagugagguggaauuauuuuaaaagauaaauauu

SEQ ID NO: 310487 - RNA, 64 nt, hsa
aaugugaacagcggcuggacuuggagguagcuuugagguggaagagggcugcaaauccuugugg

SEQ ID NO: 310488 - RNA, 64 nt, hsa
gcaggaguauaacuuccugaagauggagccucaggagguggagucccugggggagaccuaugac

SEQ ID NO: 310489 - RNA, 64 nt, hsa
uaacaaagcgggcuuugccgucaacuuuuucaaagagguggacgagugcucucggcccaaccgc

SEQ ID NO: 310490 - RNA, 64 nt, hsa
gggaggcugaggcaggagaaucacuugaacucgggagguggagguugcagugagccaagaucgc

SEQ ID NO: 310491 - RNA, 64 nt, hsa
gcacaucccuauagucccagcuacuugggaggcugagguggaaggauugcuugagcgagggagg

SEQ ID NO: 310492 - RNA, 64 nt, hsa
ggcugaaaugacacaccuacucccaggaacagcagagguggaggcaagcagugacuccugagag

SEQ ID NO: 310493 - RNA, 64 nt, hsa
aaagcuguuuccuccuggugcccugagcgggcaggagguggaccacccuggcugaaaugacaca

SEQ ID NO: 310494 - RNA, 64 nt, hsa
gacccugguaugcccacgugggacagaggacacagagguggaagauugaucuugccaagaguga

SEQ ID NO: 310495 - RNA, 64 nt, hsa
uucuacaguccccaacgugaacaguauuaagcaagagguggacucgagcaauccaggagcccag

SEQ ID NO: 310496 - RNA, 64 nt, hsa
caaaguuucugauuggggugaugagaaaguucuggagguggauggggaggaugguugcacaaca

SEQ ID NO: 310497 - RNA, 64 nt, hsa
auucaaauuuuucuucuuaaaaaucagcuauuuagagguggauaaauuggaaguuugugcauug

SEQ ID NO: 310498 - RNA, 64 nt, hsa
guaaggcugagguggaagguucacuugagccugggagguggagguuguagugagccaagaucgu

SEQ ID NO: 310499 - RNA, 64 nt, hsa
gcccaugccuguaguaccugcuauugguaaggcugagguggaagguucacuugagccugggagg

SEQ ID NO: 310500 - RNA, 64 nt, hsa
acucaggaggcugaggcagaagaauugaacccaggagguggagguugcagugagcugagaucgu

SEQ ID NO: 310501 - RNA, 64 nt, hsa
aggugugcgggaccgguacagaaaggcguucuucgagguggaucacagaggcuucuucagauca

SEQ ID NO: 310502 - RNA, 64 nt, hsa
cacaguuccucgcccugggucuaagggguugguugagguggaagcccuccuuccacggauccau

SEQ ID NO: 310503 - RNA, 64 nt, hsa
uuucauugugagguggaugggggagugaaauugugagguggaugggggagugaaaucuccaugg

SEQ ID NO: 310504 - RNA, 64 nt, hsa
ccugguauaagaugugcuagauuaauuucauugugagguggaugggggagugaaauugugaggu

SEQ ID NO: 310505 - RNA, 64 nt, hsa
uuuaauuuuauuugagauuuuuuuuugcuuuuaagagguggauugaagaauauuugaauugacu

SEQ ID NO: 310506 - RNA, 64 nt, hsa
agaaauguuccauuggggggugggggugccaggugagguggagcauuccuuguauucuggcagc

SEQ ID NO: 310507 - RNA, 64 nt, hsa
gggaggcugaggcaggagaaucgcuagaaacugggagguggagguuacaguagccgagaucgcg

SEQ ID NO: 310508 - RNA, 64 nt, hsa
aggaggcugaggcaggagaaucgcuugaacccgggagguggagguugcagugagcugagaucgc

SEQ ID NO: 310509 - RNA, 64 nt, hsa
gggagguuuaggcaggagaaucgcuugaacccuggagguggagguggagguugcagugagccga

SEQ ID NO: 310510 - RNA, 64 nt, hsa
uuuaggcaggagaaucgcuugaacccuggagguggagguggagguugcagugagccgagaucgc

SEQ ID NO: 310511 - RNA, 64 nt, hsa
ggggagggcaggcuuggggaaaauggccaugcaggagguggagaaaauuggaacucuacucaac

SEQ ID NO: 310512 - RNA, 64 nt, hsa
cccaccuguuuucugaaacacacgagcaaacccagagguggauguuaugaacagcugugucugc

SEQ ID NO: 310513 - RNA, 64 nt, hsa
accccuacucccggagcccccagcagggcccuccgagguggagcagcagcuacaagcagaggcu

SEQ ID NO: 310514 - RNA, 64 nt, hsa
gaaccccuacccggagcccccagcagggcccuccgagguggaacagcagcuacaagcagaggcu

SEQ ID NO: 310515 - RNA, 64 nt, hsa
gagaaccugaagaucugaggcaagcuggacaggagagguggauauuuguugauggaagaauuca

SEQ ID NO: 310516 - RNA, 64 nt, hsa
aggcugcaugaagaccugcccccugauugacuuggagguggacaauggaccugcgcagaugggg

SEQ ID NO: 310517 - RNA, 64 nt, hsa
gcuggacuucggcgagguggaaguggagcccagugagguggaagacuucgaggcucgugggagc

SEQ ID NO: 310518 - RNA, 64 nt, hsa
caguccucgccuggaggagacgcuggacuucggcgagguggaaguggagcccagugagguggaa

SEQ ID NO: 310519 - RNA, 64 nt, hsa
uccaaguggcuuagucugggggaucaggaggugggagguggaugguucuuauucuguggagaag

SEQ ID NO: 310520 - RNA, 64 nt, hsa
gaggaagcuggaacuuacugacuguaagagguuagagguggaccgagaaggacuuuucccaguc

SEQ ID NO: 310521 - RNA, 64 nt, hsa
uggagaacugcccuuauggagcuugcaguccagugagguggacagaccuguccccagacaguga

SEQ ID NO: 310522 - RNA, 64 nt, hsa
gugcaugccugugauccuggcuacuucagaggcugagguggaaggaucacuugaggccaggagu

SEQ ID NO: 310523 - RNA, 64 nt, hsa
ccaacagcaccagcacggcuaugacagugaugaggagguggacagcgagcugggcaccugggag

SEQ ID NO: 310524 - RNA, 64 nt, hsa
aaaguuggccagguucauagcggacgggggucccgagguggaaaccauugcccuccagaacaac

SEQ ID NO: 310525 - RNA, 64 nt, hsa
ggcugaguccaccgcugugcagcuuaagauccccgagguggagcuggucacgcugggcgcccag

SEQ ID NO: 310526 - RNA, 64 nt, hsa
agggaagcugguaacacuucccugucugcagccagagguggauggugaggcucauguggguguc

SEQ ID NO: 310527 - RNA, 64 nt, hsa
gcccgaggcagcccuuccagagguucgacucccagagguggagcuccccaaggugucagagaug

SEQ ID NO: 310528 - RNA, 64 nt, hsa
gacuguggggguggaccuggccuugccgggugcagagguggaggcccggggagaggcaccugag

SEQ ID NO: 310529 - RNA, 64 nt, hsa
gggaggcugaggcaggagaauugcuugaacuugggagguggaggccaagauuguaccacuguau

SEQ ID NO: 310530 - RNA, 64 nt, hsa
gggaggcugaggcaggagaauugcuugaacccaugagguggagguugcggugagccaagauggc

SEQ ID NO: 310531 - RNA, 64 nt, hsa
caaaaggauagagaaagagacccagaaaaaggaagagguggaaacccagagagacagagaccca

SEQ ID NO: 310532 - RNA, 64 nt, hsa
guguucauccagaggcgacuggguaaauuaggaagagguggaugcuccuccuguuuaccccaca

SEQ ID NO: 310533 - RNA, 64 nt, hsa
gggaggcugaggcggaagauucgcuugagcccaggagguggagguugcagugagccaagacuac

SEQ ID NO: 310534 - RNA, 64 nt, hsa
uggaggcugaggccagagaaucgcuugaaccugggagguggagguugcaguaagcugagaucgc

SEQ ID NO: 310535 - RNA, 64 nt, hsa
cugagagugauuuaacacugguuuugagacagacuuuauucagcuaucccucuauauaauaggu

SEQ ID NO: 310536 - RNA, 64 nt, hsa
gagccaugaaguauaaauacugaaagaugucacuuuuauucaggaaauagggggagauucaagu

SEQ ID NO: 310537 - RNA, 64 nt, hsa
auccuugugugauauuuuuuucuucgcuuguuuauuuauucauuuauuuaauuguauuuauuca

SEQ ID NO: 310538 - RNA, 64 nt, hsa
uucgcuuguuuauuuauucauuuauuuaauuguauuuauucauuuacuaacuuuauguguuacc

SEQ ID NO: 310539 - RNA, 64 nt, hsa
gcaaaaagauagaaucaaucauaaagugcacaccuuuauucagaacuuuaguauuaaaucaguu

SEQ ID NO: 310540 - RNA, 64 nt, hsa
ucaauuucauuuuuuauguauuguuuuacuccuuuuuauucauacguaaaauuuuggauuaauu

SEQ ID NO: 310541 - RNA, 64 nt, hsa
gcaaaaagauagaaucaaucauaaaaugcacaccuuuauucagaacuuuaguauuaaaucaguu

SEQ ID NO: 310542 - RNA, 64 nt, hsa
cuuaauuucauuuuuaaguauuguuuuacuccuuuuuauucauacguaaaauuuuggauuaauu

SEQ ID NO: 310543 - RNA, 64 nt, hsa
uuaauaucauacuaagugaaggacaggaaaggguuuuauucauaaauuaaaugucuacaugugc

SEQ ID NO: 310544 - RNA, 64 nt, hsa
ggagacaacuuuuauagaaauacaaagccauuacuuuauucaauuucagacccucagaagcaau

SEQ ID NO: 310545 - RNA, 64 nt, hsa
agaucuaccuaaaucaccccagagcuuuaugucuuuuauucauucuaauucuuauuaaccggaa

SEQ ID NO: 310546 - RNA, 64 nt, hsa
uuaccauuauuuauaccauagcuaagguuaaaaauuuauucacuuuaaguucguauuuuuuaau

SEQ ID NO: 310547 - RNA, 64 nt, hsa
ucgcaaaauggaucucuaaacugaaugcacuuguuuuauucaucugcaaagagccauguauuca

SEQ ID NO: 310548 - RNA, 64 nt, hsa
uaagaaauggacuugaggucccaggagauuucauuuuauucacccuggucagauacaauaaagg

SEQ ID NO: 310549 - RNA, 64 nt, hsa
ggacaaaugcauuacuguuuucaaacugcucacauuuauucaguauuucuccaaguugcuaucu

SEQ ID NO: 310550 - RNA, 64 nt, hsa
gccugaccaaauucuaaaaccuaauccauauaaguuuauucauuuaggaauguucguuuaaauu

SEQ ID NO: 310551 - RNA, 64 nt, hsa
cuacuauguaacuuuuucagggaauaguuuaagcuuuauucauucaugcaauacuaaagagaaa

SEQ ID NO: 310552 - RNA, 64 nt, hsa
uuuuuuccuuacagugagacauuuaagcacacauuuuauucacauagauacuauguccuugaca

SEQ ID NO: 310553 - RNA, 64 nt, hsa
uguucacgagaaacauaggcuuuucaaaaaaauuuuuauucaaggcaaagcaaggaacaucuug

SEQ ID NO: 310554 - RNA, 64 nt, hsa
agguauuuaaauaauaaaauuucaagggauaguuuuuauucaauguauauaagacagguagugc

SEQ ID NO: 310555 - RNA, 64 nt, hsa
uguagaguggugaaccuucuagaggaauauaugauuuauucacaguuccucaaggccuggggau

SEQ ID NO: 310556 - RNA, 64 nt, hsa
ugaucuuacaaguuagauguuacuauaccuaccauuuauucagcuggauugcugaacacaguuc

SEQ ID NO: 310557 - RNA, 64 nt, hsa
gauuuccacguuuuguguuuuauuggcccuuuucuuuauucagccccuuaaucuauuuucaguc

SEQ ID NO: 310558 - RNA, 64 nt, hsa
cuacuggaaaguaacagagucaaaauuggaagguuuuauucauucuugaauuuuuccuuucuaa

SEQ ID NO: 310559 - RNA, 64 nt, hsa
auuaaaagagguaaacaucaguuuccucaaacauuuuauucauguugaaugccuuuuugcaaug

SEQ ID NO: 310560 - RNA, 64 nt, hsa
uuuauuuguuuguuuguuuuauucauuggucuaauuuauucaaagggggcaagaaguagcagug

SEQ ID NO: 310561 - RNA, 64 nt, hsa
gcuucccuauuuauuuauuuauuuguuuguuuguuuuauucauuggucuaauuuauucaaaggg

SEQ ID NO: 310562 - RNA, 64 nt, hsa
ccucaauauaaccuuuuauucauagauguuuuuuuuuauucaacuuuuguaguauuuacguaug

SEQ ID NO: 310563 - RNA, 64 nt, hsa
uuuucuaccaacuaugguugccucaauauaaccuuuuauucauagauguuuuuuuuuauucaac

SEQ ID NO: 310564 - RNA, 64 nt, hsa
guucuagugcauuuccaugguccccaauucauaguuuauucauaaugcuaugucacuauuuuug

SEQ ID NO: 310565 - RNA, 64 nt, hsa
cuaagccagaagcuguaaacucaucucuuuucccuuuauucaagcugucaauuuuugucuccua

SEQ ID NO: 310566 - RNA, 64 nt, hsa
ucuguagauucugcuuagagcaaauuaugguacuuuuauucagacuuguuuccuuucuaguuaa

SEQ ID NO: 310567 - RNA, 64 nt, hsa
aauuuauucauugcagauacuuuuuagguggcauuuuauucauuuccugugcuuuaaauaaaca

SEQ ID NO: 310568 - RNA, 64 nt, hsa
uguguguggaucugcagugcuucacuggaaauaauuuauucauugcagauacuuuuuagguggc

SEQ ID NO: 310569 - RNA, 64 nt, hsa
uuuaggguacuuuuauugauggauauguuuuccuuuuauucacauaaccccuugaaacccuguc

SEQ ID NO: 310570 - RNA, 64 nt, hsa
ccuaugagacccuuacgugauuguuaguuaaguuuuuauucaaagcagcuguaauuuaguuaau

SEQ ID NO: 310571 - RNA, 64 nt, hsa
uuccaccugccaauucuacauguauuguugugguuuuauucauuguaugaaaauuccugugauu

SEQ ID NO: 310572 - RNA, 64 nt, hsa
ggcaagagacagaaugauauccaguaagcacauguuuauucaugggugucagcuuugcuuuucc

SEQ ID NO: 310573 - RNA, 64 nt, hsa
uuggcuauuucucuuuucugggauuuccugggcuuuuauucacuaaaugggcuccugcccaguu

SEQ ID NO: 310574 - RNA, 64 nt, hsa
auauaacucuuuuaaagaugaaauucagaauaauuuuauucaggaccuaguaucugcaguccau

SEQ ID NO: 310575 - RNA, 64 nt, hsa
uggagggcuuuaaaauuugugcucuuuuucauauuuuauucauauucaauuuaugguuuguaac

SEQ ID NO: 310576 - RNA, 64 nt, hsa
aaccgcacagauuucaugaacuuaggauguguuuuuuauucaugaaaaacuuagaauagugaac

SEQ ID NO: 310577 - RNA, 64 nt, hsa
ccaaggcagaggucgcauugcuguaucacaguauuuuauucagguuucugcaaaaaaauaaaaa

SEQ ID NO: 310578 - RNA, 64 nt, hsa
ugaauagaauuuugcaaauuuaacguuuucaagauuuauucaaggaaacaaaaugccuauguuc

SEQ ID NO: 310579 - RNA, 64 nt, hsa
cuucaucuuucuaagaauuaucuuggcuuuggacuuuauucauaaauguuuuauuucuguuagu

SEQ ID NO: 310580 - RNA, 64 nt, hsa
aguuuuuuuuuaaacaaaaucguucuuguuggauuuuauucagcagcaucuaucauguagauaa

SEQ ID NO: 310581 - RNA, 64 nt, hsa
ccaugucccuguagucgguagggggcagucuugcuuuauucauccuccaucucaaaaugaacuu

SEQ ID NO: 310582 - RNA, 64 nt, hsa
uaauccauauuugcuguucaaguuaaucuagaaauuuauucaauucuguaugaacaccuggaag

SEQ ID NO: 310583 - RNA, 64 nt, hsa
uuugcaaagugaacauguacauggucugcucucauuuauucauucuucucucaaaagucaaaug

SEQ ID NO: 310584 - RNA, 64 nt, hsa
gguauguugaaguagugucuaaaaguaucuagucuuuauucacaguacauuauauugugugaug

SEQ ID NO: 310585 - RNA, 64 nt, hsa
uaaauccaaaccuuuuuauucauccaaccaucuauuuauucacuucuuuuuaaaguaucuacug

SEQ ID NO: 310586 - RNA, 64 nt, hsa
ccucuuuuuuuccccuucauuaaauccaaaccuuuuuauucauccaaccaucuauuuauucacu

SEQ ID NO: 310587 - RNA, 64 nt, hsa
gaauaccaucagcauucugcuuuaaagcucauguuuuauucaaagcacaaggacgguuauaacu

SEQ ID NO: 310588 - RNA, 64 nt, hsa
cuuuugauguacuuucugauuccaggauuggauauuuauucaaggacuauuuuaaaaauagaaa

SEQ ID NO: 310589 - RNA, 64 nt, hsa
uauacugucuuagacuuauuguacacacuuaguuuuuauucacuuguuuucacucugaauuuua

SEQ ID NO: 310590 - RNA, 64 nt, hsa
aaugcauugccucaaaggugaugucaucuuaauuuuuauucacuuuaaauaacuacauuuuugu

SEQ ID NO: 310591 - RNA, 64 nt, hsa
uuauuauaggaaaauaaaucaaacccaaagaaaguuuauucaaugcuaauuugaaagaaaauug

SEQ ID NO: 310592 - RNA, 64 nt, hsa
aacaaauacauaaauauuuuaagaaaaauuuaaguuuauucagauaagucaccaugcuucaaaa

SEQ ID NO: 310593 - RNA, 64 nt, hsa
aagaggaggaauuuuauucaaagcauucaaacauuuuauucaaguguuucaaaauucaaagcau

SEQ ID NO: 310594 - RNA, 64 nt, hsa
acuaaaauaagguuuacucugaaagaggaggaauuuuauucaaagcauucaaacauuuuauuca

SEQ ID NO: 310595 - RNA, 64 nt, hsa
aaguucucaaaucaugccuuccgcuuagucucauuuuauucauucagucgucaugaguugagug

SEQ ID NO: 310596 - RNA, 64 nt, hsa
uaacauacugcauuucaaguacauguguguguguuuuauucagguuguguaaugcucccguaga

SEQ ID NO: 310597 - RNA, 64 nt, hsa
auaaguuuugaaguuucuuagcaauuaaaguuuuuuuauucagugugaacugucaguaucuauu

SEQ ID NO: 310598 - RNA, 64 nt, hsa
agugaaguuuuuuagaaccuuuagaaggguggucuuuauucagguuuuacuguaaugguaagga

SEQ ID NO: 310599 - RNA, 64 nt, hsa
ugguuguuaacggcauuccugaaagccacauguguuuauucauugggcuuguucuuaucagcaa

SEQ ID NO: 310600 - RNA, 64 nt, hsa
uagguaaaauuauuguaccuaauuaugucuaaaguuuauucagggguaauuucccugaugucug

SEQ ID NO: 310601 - RNA, 64 nt, hsa
gaguaacgucaguggcuuaggguuaaacggccauuuuauucaaaugcuugcuauacaaucugaa

SEQ ID NO: 310602 - RNA, 64 nt, hsa
uaucuaguaucaccaaacaguaucgcuguucucuuuuauucauuugaaaugaauauaauuauau

SEQ ID NO: 310603 - RNA, 64 nt, hsa
uuuauuagacuaguguugacuuuggggggggacauuuauucacaaaugagaaguaggcacaaag

SEQ ID NO: 310604 - RNA, 64 nt, hsa
gggagagccagauuuucucugugcucuugaguuuuuuauucauucaagaaaccuugggccaccg

SEQ ID NO: 310605 - RNA, 64 nt, hsa
auuuuaaagugacuuuuauuuugcacaaauaauuuuuauucagaauaauaaaucacucuuuauc

SEQ ID NO: 310606 - RNA, 64 nt, hsa
acagauucucugcacaaaaccacccauucauucauuuauucauucacagcacuagcaagugcug

SEQ ID NO: 310607 - RNA, 64 nt, hsa
aggaagucacagggaagcagauuucagucugacauuuauucagugcaaguuuuuuggugcugua

SEQ ID NO: 310608 - RNA, 64 nt, hsa
ucguuaugcaugauuuauccaaaguuuccauaguuuuauucaaaauaauaaauguuaauaaggu

SEQ ID NO: 310609 - RNA, 64 nt, hsa
cucaggugccuuugaguucuaggaggcuguggguuuuauucaacuacgguugggagaaugagac

SEQ ID NO: 310610 - RNA, 64 nt, hsa
agcaucuaaagcagcaggucuagaagaacaacgguuuauucauacuugcauucuuuuggcaguu

SEQ ID NO: 310611 - RNA, 64 nt, hsa
uaagaggaaagacaagugucguauuucgauccuguuuauucaaaugugugauuuugcugaaaug

SEQ ID NO: 310612 - RNA, 64 nt, hsa
acugucuaaaaaauguacauuuguaauuagugccuuuauucauauuuugaaauaaguucuuagu

SEQ ID NO: 310613 - RNA, 64 nt, hsa
uuauuaugaauuugguaauaguauagguuuauuauuuauucaucuaauuuuauaguacagguuu

SEQ ID NO: 310614 - RNA, 64 nt, hsa
aauuuugauaaauuuuuuuuguaaacuaaguauguuuauucaagacauugaaacuacuuugcac

SEQ ID NO: 310615 - RNA, 64 nt, hsa
uuccccuugaggaaagaauggcucaacguggauuuuuauucauuguggugcacguuucaaauuu

SEQ ID NO: 310616 - RNA, 64 nt, hsa
aguuuguaaaggucuggaaucacaguuggcauccuuuauucaggucucuucucuccagcguaca

SEQ ID NO: 310617 - RNA, 64 nt, hsa
cagagcauuguuuucucccccccacguaggagauuuuauucaacuaaggcacaggcauauuaaa

SEQ ID NO: 310618 - RNA, 64 nt, hsa
uuucuauugugaguuuguuuaguucauuaauugguuuauucauucauucaacaaucauauacug

SEQ ID NO: 310619 - RNA, 64 nt, hsa
auauuuguagaaguauuagaaaaauauucuauuuuuuauucagugcugcguaauuacccauggu

SEQ ID NO: 310620 - RNA, 64 nt, hsa
uauucauuaaagaacuuguaauaucaaauuacuauuuauucauaacaauugauuugaugcuaau

SEQ ID NO: 310621 - RNA, 64 nt, hsa
caggcgugagccaccaugcccggcccaaauauuuuuuauucaggaugguauaaccuaacugaua

SEQ ID NO: 310622 - RNA, 64 nt, hsa
ugcacuguccagcugguuguacccucuccaggcauuuauucaacaaaugugggugaagugccug

SEQ ID NO: 310623 - RNA, 63 nt, hsa
gccuguccaauuucugcuguacauuauuaaaaguuuuauucacagagcugcucuggugccauc

SEQ ID NO: 310624 - RNA, 64 nt, hsa
uaugauauaauccauucacacauucauuuauucauuuauucauuuauucauucauaaaaugagu

SEQ ID NO: 310625 - RNA, 64 nt, hsa
auuacacuuaugauauaauccauucacacauucauuuauucauuuauucauuuauucauucaua

SEQ ID NO: 310626 - RNA, 64 nt, hsa
uacgaugcagcccaccauuaacucauucauguaguuuauucaagugauuuauguauuuaaacua

SEQ ID NO: 310627 - RNA, 64 nt, hsa
ccaauagauauauauccuacaauugauauauugcuuuauucacacuuuuauuguggcugaauuu

SEQ ID NO: 310628 - RNA, 64 nt, hsa
gagguaccaaauagugcaauuggguaaaacaggguuuauucaguugcaucugucuccaguguug

SEQ ID NO: 310629 - RNA, 64 nt, hsa
acucuuuuacuuuuaagaaauugcuuuuuugaacuuuauucagaagcaguuaucaauaaauucc

SEQ ID NO: 310630 - RNA, 64 nt, hsa
aauucaugaccugaagcugaauacuuccagcauauuuauucaggguguaggugggaauaaagua

SEQ ID NO: 310631 - RNA, 64 nt, hsa
gaaaaagagaaaaaaaucacaaaaacaaacuuuuuuuauucaaaaguaacaaaguucuuguaag

SEQ ID NO: 310632 - RNA, 64 nt, hsa
gacaguuuaacaaagauaaaauucugaacugcguuuuauucauuuguguacuaugugauuuuuu

SEQ ID NO: 310633 - RNA, 64 nt, hsa
aagauuuguugcucucagacuguguaaaacaaaauuuauucauguuuucugcauauuaaaaaau

SEQ ID NO: 310634 - RNA, 64 nt, hsa
ugagguauagucugugaauuauguguuuuguauuuuuauucauuguguaauuuaguggugguga

SEQ ID NO: 310635 - RNA, 64 nt, hsa
ugaucuaaauuauuguuuuaauuuuuaaaccuaauuuauucacucagugaacauucuuaccuaa

SEQ ID NO: 310636 - RNA, 64 nt, hsa
agaauuuauuuucgaaggggaauaguuucaauguuuuauucacuugggcuuuuuuucuuccccc

SEQ ID NO: 310637 - RNA, 64 nt, hsa
caaauacguauugucuaaaugcauuuaaaucuguuuuauucaaagaaaagcuaaagcaaaaaca

SEQ ID NO: 310638 - RNA, 64 nt, hsa
ucauuccaggugaaaagcaggauguaccgagcacuuuauucagugcauagcuuuaagccagugu

SEQ ID NO: 310639 - RNA, 64 nt, hsa
gacaggaaggaguguuacacacugcuuacccugauuuauucagugguuuuguuuucauucugga

SEQ ID NO: 310640 - RNA, 64 nt, hsa
ccugccccaaccaaaccgcauucguguggauuuuuuuauucaacuuaauuggcuauuccaaaga

SEQ ID NO: 310641 - RNA, 64 nt, hsa
uuauauacauuuuccuuaaaacacuugcaaacauuuuauucaguugucuuuagcuacaauugcu

SEQ ID NO: 310642 - RNA, 64 nt, hsa
cuuuuuguagaacccauguuguauacaguuuuccuuuauucaguacaaucuuuucauuuuuuaa

SEQ ID NO: 310643 - RNA, 64 nt, hsa
ugccuucuguauaaguuuauguuuauuccuacauuuuauucauuuuuaauguauggguaauugg

SEQ ID NO: 310644 - RNA, 64 nt, hsa
gacuucgcugagucaguaaguauaaucacucuaguuuauucaaggauguguggcaacuuucaac

SEQ ID NO: 310645 - RNA, 64 nt, hsa
cccagaacccuuccugagaccucgccggccuuguuuuauucaaagacagagaagaccaaagcau

SEQ ID NO: 310646 - RNA, 64 nt, hsa
caaagcauugccugccagagcuuuguuuuauauauuuauucaucugggaggcagaacaggcuuc

SEQ ID NO: 310647 - RNA, 64 nt, hsa
auccuuuuuuucuuuccugauuauccuaacaccauuuauucaauaaccuuguccauuuucauau

SEQ ID NO: 310648 - RNA, 64 nt, hsa
uuuuuuuauugacuauuugaugguaaguuacauuuuuauucacauaaagcuuggauaucagguc

SEQ ID NO: 310649 - RNA, 64 nt, hsa
ggaccuauuaucagaaggugacaaguacuggcucuuuauucauuaagcuuuuuuuuuuugaacc

SEQ ID NO: 310650 - RNA, 64 nt, hsa
uggugaugggguaaucuauaacacaucauaagguuuuauucauauauauacaggguauuaagaa

SEQ ID NO: 310651 - RNA, 64 nt, hsa
guuuuguucauuacuuuguucacuccuucuuccauuuauucauucaauaaacauuuauugggaa

SEQ ID NO: 310652 - RNA, 64 nt, hsa
cucucccaaguauaugucugguuccccgacucacuuuauucaagucccugcucaggugucaccu

SEQ ID NO: 310653 - RNA, 64 nt, hsa
cuucugcucaucaaauugcugugauagugaauuauuuauucaugggagauaauuuauuuuaaag

SEQ ID NO: 310654 - RNA, 64 nt, hsa
cuguuucuuuuuuguuuucucuaugggcucuuuuuuuauucauuaccuaaauguagguauuccc

SEQ ID NO: 310655 - RNA, 64 nt, hsa
agaauuauugcuucuaguccacuuuucuuuacauuuuauucaauacgcuguccugaauccuauu

SEQ ID NO: 310656 - RNA, 64 nt, hsa
uucagucauaaaagcuuuacuauuuauuuacauauuuauucauguucaugguacucuucuaaga

SEQ ID NO: 310657 - RNA, 64 nt, hsa; identical to SEQ ID NO: 270569

SEQ ID NO: 310658 - RNA, 64 nt, hsa; identical to SEQ ID NO: 270570

SEQ ID NO: 310659 - RNA, 64 nt, hsa; identical to SEQ ID NO: 270571

SEQ ID NO: 310660 - RNA, 64 nt, hsa; identical to SEQ ID NO: 270572

SEQ ID NO: 310661 - RNA, 64 nt, hsa; identical to SEQ ID NO: 270573

SEQ ID NO: 310662 - RNA, 64 nt, hsa; identical to SEQ ID NO: 270574

SEQ ID NO: 310663 - RNA, 64 nt, hsa; identical to SEQ ID NO: 270575

SEQ ID NO: 310664 - RNA, 64 nt, hsa; identical to SEQ ID NO: 270576

SEQ ID NO: 310665 - RNA, 64 nt, hsa; identical to SEQ ID NO: 270577

SEQ ID NO: 310666 - RNA, 64 nt, hsa; identical to SEQ ID NO: 270578

SEQ ID NO: 310667 - RNA, 64 nt, hsa; identical to SEQ ID NO: 270579

SEQ ID NO: 310668 - RNA, 55 nt, hsa; identical to SEQ ID NO: 270580

SEQ ID NO: 310669 - RNA, 64 nt, hsa; identical to SEQ ID NO: 270581

SEQ ID NO: 310670 - RNA, 64 nt, hsa; identical to SEQ ID NO: 270582

SEQ ID NO: 310671 - RNA, 64 nt, hsa; identical to SEQ ID NO: 270583

SEQ ID NO: 310672 - RNA, 64 nt, hsa; identical to SEQ ID NO: 270584

SEQ ID NO: 310673 - RNA, 64 nt, hsa; identical to SEQ ID NO: 270585

SEQ ID NO: 310674 - RNA, 64 nt, hsa; identical to SEQ ID NO: 270586

SEQ ID NO: 310675 - RNA, 64 nt, hsa; identical to SEQ ID NO: 270587

SEQ ID NO: 310676 - RNA, 64 nt, hsa; identical to SEQ ID NO: 270588

SEQ ID NO: 310677 - RNA, 64 nt, hsa; identical to SEQ ID NO: 270589

SEQ ID NO: 310678 - RNA, 64 nt, hsa; identical to SEQ ID NO: 270590

SEQ ID NO: 310679 - RNA, 64 nt, hsa; identical to SEQ ID NO: 270591

SEQ ID NO: 310680 - RNA, 64 nt, hsa; identical to SEQ ID NO: 270592

SEQ ID NO: 310681 - RNA, 64 nt, hsa; identical to SEQ ID NO: 270593

SEQ ID NO: 310682 - RNA, 64 nt, hsa; identical to SEQ ID NO: 270594

SEQ ID NO: 310683 - RNA, 64 nt, hsa
aguggggaugggguaaaagugguuaacguacuguuggaucaacaaauaaagguuacaguuuugu

SEQ ID NO: 310684 - RNA, 64 nt, hsa
aaauugacuagagacccaagaaaaccuggaacuuuggaucaauuucuuuuucauagggguggaa

SEQ ID NO: 310685 - RNA, 64 nt, hsa; identical to SEQ ID NO: 44100

SEQ ID NO: 310686 - RNA, 64 nt, hsa; identical to SEQ ID NO: 44101

SEQ ID NO: 310687 - RNA, 64 nt, hsa; identical to SEQ ID NO: 44102

SEQ ID NO: 310688 - RNA, 64 nt, hsa; identical to SEQ ID NO: 44103

SEQ ID NO: 310689 - RNA, 64 nt, hsa; identical to SEQ ID NO: 44104

SEQ ID NO: 310690 - RNA, 64 nt, hsa; identical to SEQ ID NO: 44105

SEQ ID NO: 310691 - RNA, 64 nt, hsa; identical to SEQ ID NO: 44106

SEQ ID NO: 310692 - RNA, 64 nt, hsa; identical to SEQ ID NO: 44107

SEQ ID NO: 310693 - RNA, 64 nt, hsa; identical to SEQ ID NO: 44108

SEQ ID NO: 310694 - RNA, 64 nt, hsa; identical to SEQ ID NO: 44109

SEQ ID NO: 310695 - RNA, 64 nt, hsa; identical to SEQ ID NO: 44110

SEQ ID NO: 310696 - RNA, 64 nt, hsa; identical to SEQ ID NO: 44111

SEQ ID NO: 310697 - RNA, 64 nt, hsa; identical to SEQ ID NO: 44112

SEQ ID NO: 310698 - RNA, 64 nt, hsa; identical to SEQ ID NO: 44113

SEQ ID NO: 310699 - RNA, 64 nt, hsa; identical to SEQ ID NO: 44114

SEQ ID NO: 310700 - RNA, 64 nt, hsa; identical to SEQ ID NO: 44115

SEQ ID NO: 310701 - RNA, 64 nt, hsa; identical to SEQ ID NO: 44116

SEQ ID NO: 310702 - RNA, 64 nt, hsa; identical to SEQ ID NO: 44117

SEQ ID NO: 310703 - RNA, 64 nt, hsa; identical to SEQ ID NO: 44118

SEQ ID NO: 310704 - RNA, 64 nt, hsa; identical to SEQ ID NO: 44119

SEQ ID NO: 310705 - RNA, 64 nt, hsa; identical to SEQ ID NO: 44120

SEQ ID NO: 310706 - RNA, 64 nt, hsa; identical to SEQ ID NO: 44121

SEQ ID NO: 310707 - RNA, 64 nt, hsa; identical to SEQ ID NO: 44122

SEQ ID NO: 310708 - RNA, 64 nt, hsa; identical to SEQ ID NO: 44123

SEQ ID NO: 310709 - RNA, 64 nt, hsa; identical to SEQ ID NO: 44124

SEQ ID NO: 310710 - RNA, 64 nt, hsa; identical to SEQ ID NO: 44125

SEQ ID NO: 310711 - RNA, 64 nt, hsa; identical to SEQ ID NO: 44126

SEQ ID NO: 310712 - RNA, 64 nt, hsa; identical to SEQ ID NO: 44127

SEQ ID NO: 310713 - RNA, 64 nt, hsa; identical to SEQ ID NO: 44128

SEQ ID NO: 310714 - RNA, 64 nt, hsa; identical to SEQ ID NO: 44129

SEQ ID NO: 310715 - RNA, 64 nt, hsa; identical to SEQ ID NO: 44130

SEQ ID NO: 310716 - RNA, 64 nt, hsa; identical to SEQ ID NO: 44131

SEQ ID NO: 310717 - RNA, 64 nt, hsa; identical to SEQ ID NO: 44132

SEQ ID NO: 310718 - RNA, 64 nt, hsa; identical to SEQ ID NO: 44133

SEQ ID NO: 310719 - RNA, 64 nt, hsa; identical to SEQ ID NO: 44134

SEQ ID NO: 310720 - RNA, 64 nt, hsa; identical to SEQ ID NO: 44135

SEQ ID NO: 310721 - RNA, 64 nt, hsa; identical to SEQ ID NO: 44136

SEQ ID NO: 310722 - RNA, 64 nt, hsa; identical to SEQ ID NO: 44137

SEQ ID NO: 310723 - RNA, 64 nt, hsa; identical to SEQ ID NO: 44138

SEQ ID NO: 310724 - RNA, 64 nt, hsa; identical to SEQ ID NO: 44139

SEQ ID NO: 310725 - RNA, 64 nt, hsa; identical to SEQ ID NO: 44140

SEQ ID NO: 310726 - RNA, 64 nt, hsa; identical to SEQ ID NO: 44141

SEQ ID NO: 310727 - RNA, 64 nt, hsa; identical to SEQ ID NO: 44142

SEQ ID NO: 310728 - RNA, 64 nt, hsa; identical to SEQ ID NO: 44143

SEQ ID NO: 310729 - RNA, 64 nt, hsa; identical to SEQ ID NO: 44144

SEQ ID NO: 310730 - RNA, 64 nt, hsa; identical to SEQ ID NO: 44145

SEQ ID NO: 310731 - RNA, 64 nt, hsa; identical to SEQ ID NO: 44146

SEQ ID NO: 310732 - RNA, 64 nt, hsa; identical to SEQ ID NO: 44147

SEQ ID NO: 310733 - RNA, 64 nt, hsa; identical to SEQ ID NO: 44148

SEQ ID NO: 310734 - RNA, 64 nt, hsa; identical to SEQ ID NO: 44149

SEQ ID NO: 310735 - RNA, 64 nt, hsa; identical to SEQ ID NO: 44150

SEQ ID NO: 310736 - RNA, 64 nt, hsa; identical to SEQ ID NO: 44151

SEQ ID NO: 310737 - RNA, 64 nt, hsa; identical to SEQ ID NO: 44152

SEQ ID NO: 310738 - RNA, 64 nt, hsa; identical to SEQ ID NO: 44153

SEQ ID NO: 310739 - RNA, 64 nt, hsa; identical to SEQ ID NO: 44154

SEQ ID NO: 310740 - RNA, 64 nt, hsa; identical to SEQ ID NO: 44155

SEQ ID NO: 310741 - RNA, 64 nt, hsa; identical to SEQ ID NO: 44156

SEQ ID NO: 310742 - RNA, 64 nt, hsa; identical to SEQ ID NO: 44157

SEQ ID NO: 310743 - RNA, 64 nt, hsa; identical to SEQ ID NO: 44158

SEQ ID NO: 310744 - RNA, 64 nt, hsa; identical to SEQ ID NO: 44159

SEQ ID NO: 310745 - RNA, 64 nt, hsa; identical to SEQ ID NO: 44160

SEQ ID NO: 310746 - RNA, 64 nt, hsa; identical to SEQ ID NO: 44161

SEQ ID NO: 310747 - RNA, 64 nt, hsa; identical to SEQ ID NO: 44162

SEQ ID NO: 310748 - RNA, 64 nt, hsa; identical to SEQ ID NO: 44163

SEQ ID NO: 310749 - RNA, 64 nt, hsa; identical to SEQ ID NO: 44164

SEQ ID NO: 310750 - RNA, 64 nt, hsa; identical to SEQ ID NO: 44165

SEQ ID NO: 310751 - RNA, 64 nt, hsa; identical to SEQ ID NO: 44166

SEQ ID NO: 310752 - RNA, 64 nt, hsa; identical to SEQ ID NO: 44167

SEQ ID NO: 310753 - RNA, 64 nt, hsa; identical to SEQ ID NO: 44168

SEQ ID NO: 310754 - RNA, 64 nt, hsa; identical to SEQ ID NO: 44169

SEQ ID NO: 310755 - RNA, 64 nt, hsa; identical to SEQ ID NO: 44170

SEQ ID NO: 310756 - RNA, 64 nt, hsa; identical to SEQ ID NO: 44171

SEQ ID NO: 310757 - RNA, 64 nt, hsa; identical to SEQ ID NO: 44172

SEQ ID NO: 310758 - RNA, 64 nt, hsa; identical to SEQ ID NO: 44173

SEQ ID NO: 310759 - RNA, 64 nt, hsa; identical to SEQ ID NO: 44174

SEQ ID NO: 310760 - RNA, 64 nt, hsa; identical to SEQ ID NO: 44175

SEQ ID NO: 310761 - RNA, 64 nt, hsa; identical to SEQ ID NO: 44176

SEQ ID NO: 310762 - RNA, 64 nt, hsa; identical to SEQ ID NO: 44177

SEQ ID NO: 310763 - RNA, 64 nt, hsa; identical to SEQ ID NO: 44178

SEQ ID NO: 310764 - RNA, 64 nt, hsa; identical to SEQ ID NO: 44179

SEQ ID NO: 310765 - RNA, 64 nt, hsa; identical to SEQ ID NO: 44180

SEQ ID NO: 310766 - RNA, 64 nt, hsa; identical to SEQ ID NO: 44181

SEQ ID NO: 310767 - RNA, 64 nt, hsa; identical to SEQ ID NO: 44182

SEQ ID NO: 310768 - RNA, 64 nt, hsa; identical to SEQ ID NO: 44183

SEQ ID NO: 310769 - RNA, 64 nt, hsa; identical to SEQ ID NO: 44184

SEQ ID NO: 310770 - RNA, 64 nt, hsa; identical to SEQ ID NO: 44185

SEQ ID NO: 310771 - RNA, 64 nt, hsa; identical to SEQ ID NO: 44186

SEQ ID NO: 310772 - RNA, 64 nt, hsa; identical to SEQ ID NO: 44187

SEQ ID NO: 310773 - RNA, 64 nt, hsa; identical to SEQ ID NO: 44188

SEQ ID NO: 310774 - RNA, 64 nt, hsa; identical to SEQ ID NO: 44189

SEQ ID NO: 310775 - RNA, 64 nt, hsa; identical to SEQ ID NO: 44190

SEQ ID NO: 310776 - RNA, 64 nt, hsa; identical to SEQ ID NO: 44191

SEQ ID NO: 310777 - RNA, 64 nt, hsa; identical to SEQ ID NO: 44192

SEQ ID NO: 310778 - RNA, 64 nt, hsa; identical to SEQ ID NO: 44193

SEQ ID NO: 310779 - RNA, 64 nt, hsa; identical to SEQ ID NO: 44194

SEQ ID NO: 310780 - RNA, 64 nt, hsa; identical to SEQ ID NO: 44195

SEQ ID NO: 310781 - RNA, 64 nt, hsa; identical to SEQ ID NO: 44196

SEQ ID NO: 310782 - RNA, 64 nt, hsa; identical to SEQ ID NO: 44197

SEQ ID NO: 310783 - RNA, 64 nt, hsa; identical to SEQ ID NO: 44198

SEQ ID NO: 310784 - RNA, 64 nt, hsa; identical to SEQ ID NO: 44199

SEQ ID NO: 310785 - RNA, 64 nt, hsa; identical to SEQ ID NO: 44200

SEQ ID NO: 310786 - RNA, 64 nt, hsa; identical to SEQ ID NO: 44201

SEQ ID NO: 310787 - RNA, 64 nt, hsa; identical to SEQ ID NO: 44202

SEQ ID NO: 310788 - RNA, 64 nt, hsa; identical to SEQ ID NO: 44203

SEQ ID NO: 310789 - RNA, 64 nt, hsa; identical to SEQ ID NO: 44204

SEQ ID NO: 310790 - RNA, 64 nt, hsa; identical to SEQ ID NO: 44205

SEQ ID NO: 310791 - RNA, 64 nt, hsa; identical to SEQ ID NO: 44206

SEQ ID NO: 310792 - RNA, 64 nt, hsa; identical to SEQ ID NO: 44207

SEQ ID NO: 310793 - RNA, 64 nt, hsa; identical to SEQ ID NO: 44208

SEQ ID NO: 310794 - RNA, 64 nt, hsa; identical to SEQ ID NO: 44209

SEQ ID NO: 310795 - RNA, 64 nt, hsa; identical to SEQ ID NO: 44210

SEQ ID NO: 310796 - RNA, 64 nt, hsa; identical to SEQ ID NO: 44211

SEQ ID NO: 310797 - RNA, 64 nt, hsa; identical to SEQ ID NO: 44212

SEQ ID NO: 310798 - RNA, 64 nt, hsa; identical to SEQ ID NO: 44213

SEQ ID NO: 310799 - RNA, 64 nt, hsa; identical to SEQ ID NO: 44214

SEQ ID NO: 310800 - RNA, 64 nt, hsa; identical to SEQ ID NO: 44215

SEQ ID NO: 310801 - RNA, 64 nt, hsa; identical to SEQ ID NO: 44216

SEQ ID NO: 310802 - RNA, 64 nt, hsa; identical to SEQ ID NO: 44217

SEQ ID NO: 310803 - RNA, 64 nt, hsa; identical to SEQ ID NO: 44218

SEQ ID NO: 310804 - RNA, 64 nt, hsa; identical to SEQ ID NO: 44219

SEQ ID NO: 310805 - RNA, 64 nt, hsa; identical to SEQ ID NO: 44220

SEQ ID NO: 310806 - RNA, 64 nt, hsa; identical to SEQ ID NO: 44221

SEQ ID NO: 310807 - RNA, 64 nt, hsa; identical to SEQ ID NO: 44222

SEQ ID NO: 310808 - RNA, 64 nt, hsa; identical to SEQ ID NO: 44223

SEQ ID NO: 310809 - RNA, 64 nt, hsa; identical to SEQ ID NO: 44224

SEQ ID NO: 310810 - RNA, 64 nt, hsa; identical to SEQ ID NO: 44225

SEQ ID NO: 310811 - RNA, 64 nt, hsa; identical to SEQ ID NO: 44226

SEQ ID NO: 310812 - RNA, 64 nt, hsa; identical to SEQ ID NO: 44227

SEQ ID NO: 310813 - RNA, 64 nt, hsa; identical to SEQ ID NO: 44228

SEQ ID NO: 310814 - RNA, 64 nt, hsa; identical to SEQ ID NO: 44229

SEQ ID NO: 310815 - RNA, 64 nt, hsa; identical to SEQ ID NO: 44230

SEQ ID NO: 310816 - RNA, 64 nt, hsa; identical to SEQ ID NO: 44231

SEQ ID NO: 310817 - RNA, 64 nt, hsa; identical to SEQ ID NO: 44232

SEQ ID NO: 310818 - RNA, 64 nt, hsa; identical to SEQ ID NO: 44233

SEQ ID NO: 310819 - RNA, 64 nt, hsa; identical to SEQ ID NO: 44234

SEQ ID NO: 310820 - RNA, 64 nt, hsa; identical to SEQ ID NO: 44235

SEQ ID NO: 310821 - RNA, 64 nt, hsa; identical to SEQ ID NO: 44236

SEQ ID NO: 310822 - RNA, 64 nt, hsa; identical to SEQ ID NO: 44237

SEQ ID NO: 310823 - RNA, 64 nt, hsa; identical to SEQ ID NO: 44238

SEQ ID NO: 310824 - RNA, 64 nt, hsa; identical to SEQ ID NO: 44239

SEQ ID NO: 310825 - RNA, 64 nt, hsa; identical to SEQ ID NO: 44240

SEQ ID NO: 310826 - RNA, 64 nt, hsa; identical to SEQ ID NO: 44241

SEQ ID NO: 310827 - RNA, 64 nt, hsa; identical to SEQ ID NO: 44242

SEQ ID NO: 310828 - RNA, 64 nt, hsa; identical to SEQ ID NO: 44243

SEQ ID NO: 310829 - RNA, 64 nt, hsa; identical to SEQ ID NO: 44244

SEQ ID NO: 310830 - RNA, 64 nt, hsa; identical to SEQ ID NO: 44245

SEQ ID NO: 310831 - RNA, 64 nt, hsa; identical to SEQ ID NO: 44246

SEQ ID NO: 310832 - RNA, 64 nt, hsa; identical to SEQ ID NO: 44247

SEQ ID NO: 310833 - RNA, 64 nt, hsa; identical to SEQ ID NO: 44248

SEQ ID NO: 310834 - RNA, 64 nt, hsa; identical to SEQ ID NO: 44249

SEQ ID NO: 310835 - RNA, 64 nt, hsa; identical to SEQ ID NO: 44250

SEQ ID NO: 310836 - RNA, 64 nt, hsa; identical to SEQ ID NO: 44251

SEQ ID NO: 310837 - RNA, 64 nt, hsa; identical to SEQ ID NO: 44252

SEQ ID NO: 310838 - RNA, 64 nt, hsa; identical to SEQ ID NO: 44253

SEQ ID NO: 310839 - RNA, 64 nt, hsa
gcccuggaucucccaauggccuuccaauccuuaaacugccaaucgccccacccguuccuaccug

SEQ ID NO: 310840 - RNA, 64 nt, hsa
uuguaauccagucccuucuuggaaccuaaauugaacugccaaguacugcgcaugcaagagaccc

SEQ ID NO: 310841 - RNA, 64 nt, hsa
guucaagguaauaugccaggcgcuguaugucuccacugccaaguagaagugacucaaaacccuc

SEQ ID NO: 310842 - RNA, 64 nt, hsa
ccuuuacuaagcacaaguacuugccacugccaucacugccaaguaacuagaugucucuguuucc

SEQ ID NO: 310843 - RNA, 64 nt, hsa
ucacaacccaggugacgaugcccucucagccaacacugccaaccugacccugucaucccgauug

SEQ ID NO: 310844 - RNA, 64 nt, hsa
gaggaaucuuuucucugccuggucucagaaugggacugccaacuggcucauuggugggagacac

SEQ ID NO: 310845 - RNA, 64 nt, hsa
gagauuccuaugucucccuagugccccuaaugagacugccaagugggggcuguagaaaagccuu

SEQ ID NO: 310846 - RNA, 64 nt, hsa
aacuauuuuccccuccuauuuacuuccuuugcugacugccaacuuagugccaagaggaggugug

SEQ ID NO: 310847 - RNA, 64 nt, hsa
auuguucuuggcauauuauuguacuaucccuguaacugccaagagcucaggagccaggcuagug

SEQ ID NO: 310848 - RNA, 64 nt, hsa
acgagggcucuggagcugugaguggugccaaaagacugccaagaaucaaggcuuuugugauaug

SEQ ID NO: 310849 - RNA, 64 nt, hsa
ccuccagaauugacuuagcccuaguaauaaaagcacugccaaaacaucucagagacuucuuuua

SEQ ID NO: 310850 - RNA, 64 nt, hsa
uuucugguaaagaucaugguuaaguauaaucauuacugccaaacuggaauuuucaaguuauuau

SEQ ID NO: 310851 - RNA, 64 nt, hsa
ucucugacccagcagaaaugugucuguaagugaaacugccaaugucugcaccauugugaaucca

SEQ ID NO: 310852 - RNA, 64 nt, hsa
ucuucuuuucuauuuuccagccugggaaagaauuacugccaaaggaugccaguggagagauuau

SEQ ID NO: 310853 - RNA, 64 nt, hsa
cucaucagcucaguaccuaacugccaaucaacacacugccaaugcgggugggcuaagccgccag

SEQ ID NO: 310854 - RNA, 64 nt, hsa
ucuggaaaugcuaaacucaucagcucaguaccuaacugccaaucaacacacugccaaugcgggu

SEQ ID NO: 310855 - RNA, 64 nt, hsa
gggugcagugaaaugauucaugugcuuccggacaacugccaaaucuauguaauuuucuuuaauu

SEQ ID NO: 310856 - RNA, 64 nt, hsa
cucuggagagguagggccagaggaaugcugcugcacugccaacucaggcacaugcuuagcugua

SEQ ID NO: 310857 - RNA, 64 nt, hsa
uucucacagcaacaugugacaacaugcaagaaguacugccaauacugccaaccagagcagcuca

SEQ ID NO: 310858 - RNA, 64 nt, hsa
caacaugugacaacaugcaagaaguacugccaauacugccaaccagagcagcucacucgagauc

SEQ ID NO: 310859 - RNA, 64 nt, hsa
gggauccagggacacuuuuuuuuaaagcucauaaacugccaagagcuccauauauuggguguga

SEQ ID NO: 310860 - RNA, 64 nt, hsa
gacaggcuaaaaugugaacguggggugagggaucacugccaaaaugguacagcuucuggagcag

SEQ ID NO: 310861 - RNA, 64 nt, hsa
ucagcaagaagggacuguuucuaggugggcugggcgcgagcagggacugucccgagcgguauag

SEQ ID NO: 310862 - RNA, 64 nt, hsa
cccccgcacgcugggcaccaacagagccacggagcgcgagcacaugcccgcccggggagcacaa

SEQ ID NO: 310863 - RNA, 64 nt, hsa
gcacccugacacuggcauuuagcagcaguggaaccgcgagcaagucccuuccuuuuagagcgug

SEQ ID NO: 310864 - RNA, 64 nt, hsa
ucuggcugcccguguuaaugaaggacagcgcuuccgcgagcacccugggaacugggucuugggu

SEQ ID NO: 310865 - RNA, 64 nt, hsa
gccccagcuuuccgccugcacccgcgaggacgcgcgcgagcacacgcggcgccccgccaggccu

SEQ ID NO: 310866 - RNA, 64 nt, hsa
uuagagauuaaaccaauuauaacuuauuagcagucgcgagcacauguucauauagucaauguaa

SEQ ID NO: 310867 - RNA, 64 nt, hsa
cacuggggucucuccaccccagagucucaggcaccgcgagcauucccauguacccuggggcacc

SEQ ID NO: 310868 - RNA, 64 nt, hsa
agccucagcccaccgccaguacucucccagcaaccgcgagcaauuucuugggaccaaagucaau

SEQ ID NO: 310869 - RNA, 64 nt, hsa
gaggccaaguugcccacccugcggagcuaggaggcgcgagcagagaacguguguguuaggagaa

SEQ ID NO: 310870 - RNA, 64 nt, hsa
gcgccgggaccgggaucgugaccgugaccgugaccgcgagcacaaacggggggagcggggcagu

SEQ ID NO: 310871 - RNA, 64 nt, hsa
ucagccucaacugcugagcgcccccacucccggccgcgagcaggcagggcuucggggacgcggg

SEQ ID NO: 310872 - RNA, 64 nt, hsa
cagcggacgugagcuuccacugcggcugcagagacgcgagcaaccucuucucaucggcucuuau

SEQ ID NO: 310873 - RNA, 64 nt, hsa; identical to SEQ ID NO: 220358

SEQ ID NO: 310874 - RNA, 64 nt, hsa; identical to SEQ ID NO: 220359

SEQ ID NO: 310875 - RNA, 64 nt, hsa; identical to SEQ ID NO: 220360

SEQ ID NO: 310876 - RNA, 64 nt, hsa; identical to SEQ ID NO: 220361

SEQ ID NO: 310877 - RNA, 64 nt, hsa
uuugauuuacugguacauuuuuaaaauaauaaaucugccauaaaaugcauuauaucuggagacu

SEQ ID NO: 310878 - RNA, 64 nt, hsa
uaccucucuggugcuguuacaguacauucuguaccugccauacaggcucauuuucaugcaaauu

SEQ ID NO: 310879 - RNA, 64 nt, hsa
auuuauuguuucauuuuuuuucccacaauccaagcugccauauuuugagggcagggggaguuuu

SEQ ID NO: 310880 - RNA, 64 nt, hsa
cgaacauaggguuaacccuuucaggccuucaugucugccauaacaugcauguuucuuccuguac

SEQ ID NO: 310881 - RNA, 64 nt, hsa
ggaccauguuugagacucagaagaaugggccuuucugccauaauucuucacuagucaagaaugc

SEQ ID NO: 310882 - RNA, 64 nt, hsa
cucaacaauggaucccgcuacaaucugaugaacucugccauaauagagauguuugaauuuauua

SEQ ID NO: 310883 - RNA, 64 nt, hsa
uccguucugccaccugccuugaaagggucuccagcugccauauguagcauuggaguccucugca

SEQ ID NO: 310884 - RNA, 64 nt, hsa
gaagccacccagcuuaggauacucuggcagccuacugccauacaguauugggauacuauaguga

SEQ ID NO: 310885 - RNA, 64 nt, hsa; identical to SEQ ID NO: 250698

SEQ ID NO: 310886 - RNA, 64 nt, hsa; identical to SEQ ID NO: 250699

SEQ ID NO: 310887 - RNA, 64 nt, hsa; identical to SEQ ID NO: 250700

SEQ ID NO: 310888 - RNA, 64 nt, hsa; identical to SEQ ID NO: 250701

SEQ ID NO: 310889 - RNA, 64 nt, hsa; identical to SEQ ID NO: 250702

SEQ ID NO: 310890 - RNA, 64 nt, hsa; identical to SEQ ID NO: 250703

SEQ ID NO: 310891 - RNA, 64 nt, hsa; identical to SEQ ID NO: 250704

SEQ ID NO: 310892 - RNA, 64 nt, hsa; identical to SEQ ID NO: 250705

SEQ ID NO: 310893 - RNA, 64 nt, hsa; identical to SEQ ID NO: 250706

SEQ ID NO: 310894 - RNA, 64 nt, hsa; identical to SEQ ID NO: 250707

SEQ ID NO: 310895 - RNA, 64 nt, hsa; identical to SEQ ID NO: 250708

SEQ ID NO: 310896 - RNA, 64 nt, hsa; identical to SEQ ID NO: 250709

SEQ ID NO: 310897 - RNA, 64 nt, hsa; identical to SEQ ID NO: 250710

SEQ ID NO: 310898 - RNA, 64 nt, hsa; identical to SEQ ID NO: 250711

SEQ ID NO: 310899 - RNA, 64 nt, hsa; identical to SEQ ID NO: 250712

SEQ ID NO: 310900 - RNA, 64 nt, hsa; identical to SEQ ID NO: 250713

SEQ ID NO: 310901 - RNA, 61 nt, hsa; identical to SEQ ID NO: 250714

SEQ ID NO: 310902 - RNA, 64 nt, hsa; identical to SEQ ID NO: 250715

SEQ ID NO: 310903 - RNA, 64 nt, hsa; identical to SEQ ID NO: 250716

SEQ ID NO: 310904 - RNA, 64 nt, hsa; identical to SEQ ID NO: 250717

SEQ ID NO: 310905 - RNA, 64 nt, hsa; identical to SEQ ID NO: 250718

SEQ ID NO: 310906 - RNA, 64 nt, hsa; identical to SEQ ID NO: 250719

SEQ ID NO: 310907 - RNA, 64 nt, hsa; identical to SEQ ID NO: 250720

SEQ ID NO: 310908 - RNA, 64 nt, hsa; identical to SEQ ID NO: 250721

SEQ ID NO: 310909 - RNA, 64 nt, hsa; identical to SEQ ID NO: 250722

SEQ ID NO: 310910 - RNA, 64 nt, hsa; identical to SEQ ID NO: 250723

SEQ ID NO: 310911 - RNA, 64 nt, hsa; identical to SEQ ID NO: 250724

SEQ ID NO: 310912 - RNA, 64 nt, hsa; identical to SEQ ID NO: 250725

SEQ ID NO: 310913 - RNA, 64 nt, hsa; identical to SEQ ID NO: 250726

SEQ ID NO: 310914 - RNA, 64 nt, hsa; identical to SEQ ID NO: 250727

SEQ ID NO: 310915 - RNA, 64 nt, hsa; identical to SEQ ID NO: 250728

SEQ ID NO: 310916 - RNA, 64 nt, hsa; identical to SEQ ID NO: 250729

SEQ ID NO: 310917 - RNA, 64 nt, hsa; identical to SEQ ID NO: 250730

SEQ ID NO: 310918 - RNA, 64 nt, hsa; identical to SEQ ID NO: 250731

SEQ ID NO: 310919 - RNA, 64 nt, hsa; identical to SEQ ID NO: 250732

SEQ ID NO: 310920 - RNA, 64 nt, hsa; identical to SEQ ID NO: 250733

SEQ ID NO: 310921 - RNA, 64 nt, hsa; identical to SEQ ID NO: 250734

SEQ ID NO: 310922 - RNA, 64 nt, hsa; identical to SEQ ID NO: 250735

SEQ ID NO: 310923 - RNA, 64 nt, hsa; identical to SEQ ID NO: 250736

SEQ ID NO: 310924 - RNA, 64 nt, hsa; identical to SEQ ID NO: 250737

SEQ ID NO: 310925 - RNA, 64 nt, hsa; identical to SEQ ID NO: 250738

SEQ ID NO: 310926 - RNA, 64 nt, hsa; identical to SEQ ID NO: 250739

SEQ ID NO: 310927 - RNA, 64 nt, hsa; identical to SEQ ID NO: 250740

SEQ ID NO: 310928 - RNA, 64 nt, hsa; identical to SEQ ID NO: 250741

SEQ ID NO: 310929 - RNA, 64 nt, hsa; identical to SEQ ID NO: 250742

SEQ ID NO: 310930 - RNA, 64 nt, hsa; identical to SEQ ID NO: 250743

SEQ ID NO: 310931 - RNA, 64 nt, hsa; identical to SEQ ID NO: 250744

SEQ ID NO: 310932 - RNA, 64 nt, hsa; identical to SEQ ID NO: 250745

SEQ ID NO: 310933 - RNA, 64 nt, hsa; identical to SEQ ID NO: 250746

SEQ ID NO: 310934 - RNA, 64 nt, hsa; identical to SEQ ID NO: 250747

SEQ ID NO: 310935 - RNA, 64 nt, hsa; identical to SEQ ID NO: 250748

SEQ ID NO: 310936 - RNA, 64 nt, hsa; identical to SEQ ID NO: 250749

SEQ ID NO: 310937 - RNA, 64 nt, hsa; identical to SEQ ID NO: 250750

SEQ ID NO: 310938 - RNA, 64 nt, hsa; identical to SEQ ID NO: 250751

SEQ ID NO: 310939 - RNA, 64 nt, hsa; identical to SEQ ID NO: 250752

SEQ ID NO: 310940 - RNA, 64 nt, hsa; identical to SEQ ID NO: 250753

SEQ ID NO: 310941 - RNA, 64 nt, hsa; identical to SEQ ID NO: 146964

SEQ ID NO: 310942 - RNA, 64 nt, hsa; identical to SEQ ID NO: 146965

SEQ ID NO: 310943 - RNA, 64 nt, hsa; identical to SEQ ID NO: 146966

SEQ ID NO: 310944 - RNA, 64 nt, hsa; identical to SEQ ID NO: 146967

SEQ ID NO: 310945 - RNA, 64 nt, hsa; identical to SEQ ID NO: 146968

SEQ ID NO: 310946 - RNA, 64 nt, hsa; identical to SEQ ID NO: 146969

SEQ ID NO: 310947 - RNA, 64 nt, hsa; identical to SEQ ID NO: 146970

SEQ ID NO: 310948 - RNA, 64 nt, hsa; identical to SEQ ID NO: 146971

SEQ ID NO: 310949 - RNA, 64 nt, hsa; identical to SEQ ID NO: 146972

SEQ ID NO: 310950 - RNA, 64 nt, hsa; identical to SEQ ID NO: 146973

SEQ ID NO: 310951 - RNA, 64 nt, hsa; identical to SEQ ID NO: 146974

SEQ ID NO: 310952 - RNA, 64 nt, hsa; identical to SEQ ID NO: 146975

SEQ ID NO: 310953 - RNA, 64 nt, hsa; identical to SEQ ID NO: 146976

SEQ ID NO: 310954 - RNA, 64 nt, hsa; identical to SEQ ID NO: 146977

SEQ ID NO: 310955 - RNA, 64 nt, hsa; identical to SEQ ID NO: 146978

SEQ ID NO: 310956 - RNA, 64 nt, hsa; identical to SEQ ID NO: 146979

SEQ ID NO: 310957 - RNA, 64 nt, hsa; identical to SEQ ID NO: 146980

SEQ ID NO: 310958 - RNA, 64 nt, hsa; identical to SEQ ID NO: 146981

SEQ ID NO: 310959 - RNA, 64 nt, hsa; identical to SEQ ID NO: 284671

SEQ ID NO: 310960 - RNA, 64 nt, hsa; identical to SEQ ID NO: 284672

SEQ ID NO: 310961 - RNA, 64 nt, hsa; identical to SEQ ID NO: 284673

SEQ ID NO: 310962 - RNA, 64 nt, hsa; identical to SEQ ID NO: 284674

SEQ ID NO: 310963 - RNA, 64 nt, hsa; identical to SEQ ID NO: 284675

SEQ ID NO: 310964 - RNA, 64 nt, hsa; identical to SEQ ID NO: 284676

SEQ ID NO: 310965 - RNA, 64 nt, hsa; identical to SEQ ID NO: 284677

SEQ ID NO: 310966 - RNA, 64 nt, hsa; identical to SEQ ID NO: 284678

SEQ ID NO: 310967 - RNA, 64 nt, hsa; identical to SEQ ID NO: 284679

SEQ ID NO: 310968 - RNA, 64 nt, hsa; identical to SEQ ID NO: 284680

SEQ ID NO: 310969 - RNA, 64 nt, hsa; identical to SEQ ID NO: 284681

SEQ ID NO: 310970 - RNA, 64 nt, hsa; identical to SEQ ID NO: 284682

SEQ ID NO: 310971 - RNA, 64 nt, hsa
ggaccagaaugcaaccccagcuccacuccagccuggcguccagggccacagccauggccugggg

SEQ ID NO: 310972 - RNA, 64 nt, hsa
cagaacagucucuccgugggaggagacauuauggggcguccaccaccaccccucccuggccauc

SEQ ID NO: 310973 - RNA, 64 nt, hsa
guauccucauaggaaacagugaucaccccggacgggcguccaggacccugagggccauggccaa

SEQ ID NO: 310974 - RNA, 64 nt, hsa
gacugauguuaagaguggccagaggaaagugagaggcguccauuuccagcagacacaauggagg

SEQ ID NO: 310975 - RNA, 64 nt, hsa
gcggcugcaucgccuucuccccuccauccagccuggcguccagguugcccuguucaggggacag

SEQ ID NO: 310976 - RNA, 64 nt, hsa
ugggggugugcaucuucgggaaaggugguggcggggcguccacuagguuuccuguccccugcug

SEQ ID NO: 310977 - RNA, 64 nt, hsa
ucuugccuuagccucccgagcagcugggauuauaggcguccaccaccacgcccagcuaauuuuu

SEQ ID NO: 310978 - RNA, 64 nt, hsa
cuggguuuucuccgcacugaucugagagcugggcggcguccacaccuaagaacagcagcuccac

SEQ ID NO: 310979 - RNA, 64 nt, hsa
ggcagacacagggaggaaggacccagugcccucaggcguccaucugaugcaugggaccaacaua

SEQ ID NO: 310980 - RNA, 64 nt, hsa
caaucaucugugaagugguggugucaggugagaaggcguccacaaaagaggggagaaaaggcga

SEQ ID NO: 310981 - RNA, 64 nt, hsa
agcaagaagagacugauugaggauacugaagacuggcguccaaggacuggaacaacucagucuc

SEQ ID NO: 310982 - RNA, 64 nt, hsa
ccaagcauaggauuuggaagacaggaacggcacaggcguccaggaaagcagcugcacucagaca

SEQ ID NO: 310983 - RNA, 53 nt, hsa
uccuccugaagugcuuaugaaggggcguccauucuccuccauacauccccauc

SEQ ID NO: 310984 - RNA, 64 nt, hsa
cggcguggguccuagccuggccagugaugcugcuggcguccagaccccagacucacuccaagca

SEQ ID NO: 310985 - RNA, 64 nt, hsa
ccuuuggugagaagccaauucccacuugacagaaggcguccauccauucaucucauuggccaag

SEQ ID NO: 310986 - RNA, 64 nt, hsa
cagaaugucacagaugaagaauauuaaaauuaggggcguccacuccaaaacauaucaccagagu

SEQ ID NO: 310987 - RNA, 64 nt, hsa
cagacucagccucuauuguccagagcacuggcuuggcguccagcaaugaaggcuggagaaugca

SEQ ID NO: 310988 - RNA, 64 nt, hsa
ugcugagcuguaccccacauucauuaggaaucuuggcguccacaucuguuccucaaugugugac

SEQ ID NO: 310989 - RNA, 64 nt, hsa
cuccccacgggcuggaugacgggguuggcacuguggcguccaggaggagaugccugguucugcc

SEQ ID NO: 310990 - RNA, 64 nt, hsa
caaaagggauccccuucauugggaaaauggaaauggcguccaguacuucugcacagaauuuggu

SEQ ID NO: 310991 - RNA, 64 nt, hsa
gaggaggcagacgcccugcguggcccauggucggggcguccacgccgaggccggcaacaaacga

SEQ ID NO: 310992 - RNA, 64 nt, hsa
uagagcagacaggccuggcccugguucccaggguggcguccacucggcuguggcaggaggagcu

SEQ ID NO: 310993 - RNA, 64 nt, hsa
auuuccuuagaucguggucagcuccgaggaauguggcguccaggcucuuugagagccaugggcu

SEQ ID NO: 310994 - RNA, 64 nt, hsa
cccauccccugcaccucccuacucucccugccgaggcguccauagcauuucccuaauaaauagu

SEQ ID NO: 310995 - RNA, 63 nt, hsa
aggcccagacucguaaaugaccccggugcagcuggcguccaaagggugacccagacucguaaa

SEQ ID NO: 310996 - RNA, 64 nt, hsa
cucugcaccagccucucccuccacacccgaagcaggcguccaucuguguccuccuggcagcccc

SEQ ID NO: 310997 - RNA, 64 nt, hsa
gaaguugaacgagcauaguccaaaaagcuccuggggcguccaggccgcgcccuuuccccgacgc

SEQ ID NO: 310998 - RNA, 64 nt, hsa
uuuaauuuuugugguccuuccguuuauuauaauaggcguccaccaaugauuauccauauguguu

SEQ ID NO: 310999 - RNA, 64 nt, hsa
ggcuuacucuuucucuugcuggagguggaggaagggcguccaugccaaggccccauaccugggc

SEQ ID NO: 311000 - RNA, 64 nt, hsa
cccucagggaccaagaaguccaagaggggccgugggcguccagggcgcuaggaagccggguggg

SEQ ID NO: 311001 - RNA, 64 nt, hsa
agguagcagcugccuccuucucuguggcugaucuggcguccacaccccagguguugcugacacu

SEQ ID NO: 311002 - RNA, 64 nt, hsa
gagggucccgguguauccuggcccugggggucugggcguccagcucagcccuggccuggcuggg

SEQ ID NO: 311003 - RNA, 64 nt, hsa
ucacagagcugcuuccccacgagcagcaggcaacggcguccaaggagacuaggaugaguucuug

SEQ ID NO: 311004 - RNA, 64 nt, hsa
accugcgucuggggcuccagucgcugcucuugcuggcguccaucgccgccucggacggccgugc

SEQ ID NO: 311005 - RNA, 64 nt, hsa
cagauacacaaggacccuucagguguuacuagaaggcguccauguuuauuguuuuuuaaagaau

SEQ ID NO: 311006 - RNA, 64 nt, hsa
uuccuguccggccugagcgccucccuccuggagcggcguccagccagcccgcugggcccugcug

SEQ ID NO: 311007 - RNA, 64 nt, hsa
ucccccaagggggcuuugggacagggagggcccgggcguccagugcaaacuacaguacgugagu

SEQ ID NO: 311008 - RNA, 64 nt, hsa
agaaccuaaacuauuccugcagaacugccugguuggcguccacaagcaauaccucucguuccag

SEQ ID NO: 311009 - RNA, 64 nt, hsa
uagacugugauuuugauagcgucauucagaagaaggcguccaaggagcugaagguggugaaauu

SEQ ID NO: 311010 - RNA, 64 nt, hsa
uucuuuucggagaaauugaaauaagcucuuugcaggcguccaauccuagaaaccaauggucucc

SEQ ID NO: 311011 - RNA, 64 nt, hsa
cuucugagugacaggugccaccugcgugugucuuggcguccacaucacaccugugacggaagca

SEQ ID NO: 311012 - RNA, 64 nt, hsa
ccgagcuccugcaucccuugaguguugaucaggaggcguccacagcauuguucucgccucugaa

SEQ ID NO: 311013 - RNA, 64 nt, hsa
cucagugcucccuccagaucccguccggcagcuuggcguccacccugcacagcaucacugaauc

SEQ ID NO: 311014 - RNA, 64 nt, hsa
cccaagugggccugauuuagcaggugguccugcgggcguccaggucagcaccuuccuguagggc

SEQ ID NO: 311015 - RNA, 64 nt, hsa
cagauuugcccuccuccugcucugcccaggagguggcguccagcaguccaggcagggcaugggg

SEQ ID NO: 311016 - RNA, 64 nt, hsa
cagcaaaaggcuuuuguggagaaccuuuuauguucccaaccacuuuuugaauggugugccauuu

SEQ ID NO: 311017 - RNA, 64 nt, hsa
uuaggccaagaagcaagagaguauuccuaguauucccaaccaugaaaaguaucauucuuugcac

SEQ ID NO: 311018 - RNA, 64 nt, hsa
uccuccauccccagaacaaaccgaaaucaggauacccaaccauacacacauacaaguccacaca

SEQ ID NO: 311019 - RNA, 64 nt, hsa
aaaauaacaaauuaaccgcaaacuaucaacaacccccaaccaccaucuaccacuacggccaccc

SEQ ID NO: 311020 - RNA, 64 nt, hsa
agccgagauccaccugauccgugacaugauggaccccaaccacacaggaggccuguaugacuuc

SEQ ID NO: 311021 - RNA, 64 nt, hsa
aggcccagcugcagcccucagcuagaguccaagacccaaccaggcgcugggcugacucugaccg

SEQ ID NO: 311022 - RNA, 64 nt, hsa
aggacuuuauagaucagccagugaccaaccuuuucccaaccauacaaaaauuccuuuucccgaa

SEQ ID NO: 311023 - RNA, 64 nt, hsa
auuuuagcaauacccaugucuacacagauguucacccaaccacaucccacucacaacagcugcc

SEQ ID NO: 311024 - RNA, 64 nt, hsa
cccuccaucuguggauuuuucagcauuggaaucccccaaccagagauguuaaagugagccuguc

SEQ ID NO: 311025 - RNA, 64 nt, hsa
cuaaucacuguucccaaacauugacaaauccuaacccaaccaugguccagcaguuaccaguuua

SEQ ID NO: 311026 - RNA, 64 nt, hsa
ggccccucugcugugccccuaugcccugugugggcccaaccaguggacaauggagucuggggga

SEQ ID NO: 311027 - RNA, 64 nt, hsa
ucuccauccugcuuggaccaggguccugggucuucccaaccauaccccgagaucaggccccacc

SEQ ID NO: 311028 - RNA, 64 nt, hsa
gaucccacacaaaucagugaauggaucccaacaccccaaccacaggagcacggauucccuguac

SEQ ID NO: 311029 - RNA, 64 nt, hsa
cagcauccagauccuggauccuagacuccuaugccccaaccacugggucaugcgauccccaccc

SEQ ID NO: 311030 - RNA, 64 nt, hsa
caguacccagauccuggauccuagacuccuaugccccaaccauugggucaugggaucccagcau

SEQ ID NO: 311031 - RNA, 64 nt, hsa
guuccuucugccaggcaggcccuuccucccuuggcccaaccagcaaagcgccccucagucuuca

SEQ ID NO: 311032 - RNA, 64 nt, hsa
ucuuggccggccccacugcccccccauucuaugccccaaccaccaaggcuuucccaucuugggg

SEQ ID NO: 311033 - RNA, 64 nt, hsa
uaguucaucccuucucuuccaggcagccgcggugcccaaccacacuugucggcuccagucccca

SEQ ID NO: 311034 - RNA, 64 nt, hsa
uacagcucccccagcuccccccaccucccccacucccaaccacguugggacagggaggugugag

SEQ ID NO: 311035 - RNA, 64 nt, hsa; identical to SEQ ID NO: 132800

SEQ ID NO: 311036 - RNA, 64 nt, hsa; identical to SEQ ID NO: 132801

SEQ ID NO: 311037 - RNA, 64 nt, hsa; identical to SEQ ID NO: 132802

SEQ ID NO: 311038 - RNA, 64 nt, hsa; identical to SEQ ID NO: 132803

SEQ ID NO: 311039 - RNA, 64 nt, hsa; identical to SEQ ID NO: 132804

SEQ ID NO: 311040 - RNA, 64 nt, hsa; identical to SEQ ID NO: 132805

SEQ ID NO: 311041 - RNA, 64 nt, hsa; identical to SEQ ID NO: 132806

SEQ ID NO: 311042 - RNA, 64 nt, hsa; identical to SEQ ID NO: 132807

SEQ ID NO: 311043 - RNA, 64 nt, hsa; identical to SEQ ID NO: 132808

SEQ ID NO: 311044 - RNA, 64 nt, hsa; identical to SEQ ID NO: 132809

SEQ ID NO: 311045 - RNA, 64 nt, hsa; identical to SEQ ID NO: 132810

SEQ ID NO: 311046 - RNA, 64 nt, hsa; identical to SEQ ID NO: 132811

SEQ ID NO: 311047 - RNA, 64 nt, hsa; identical to SEQ ID NO: 132812

SEQ ID NO: 311048 - RNA, 64 nt, hsa; identical to SEQ ID NO: 132813

SEQ ID NO: 311049 - RNA, 64 nt, hsa; identical to SEQ ID NO: 132814

SEQ ID NO: 311050 - RNA, 64 nt, hsa; identical to SEQ ID NO: 132815

SEQ ID NO: 311051 - RNA, 64 nt, hsa; identical to SEQ ID NO: 132816

SEQ ID NO: 311052 - RNA, 64 nt, hsa; identical to SEQ ID NO: 132817

SEQ ID NO: 311053 - RNA, 64 nt, hsa; identical to SEQ ID NO: 132818

SEQ ID NO: 311054 - RNA, 64 nt, hsa; identical to SEQ ID NO: 132819

SEQ ID NO: 311055 - RNA, 64 nt, hsa; identical to SEQ ID NO: 132820

SEQ ID NO: 311056 - RNA, 64 nt, hsa; identical to SEQ ID NO: 132821

SEQ ID NO: 311057 - RNA, 64 nt, hsa; identical to SEQ ID NO: 132822

SEQ ID NO: 311058 - RNA, 64 nt, hsa; identical to SEQ ID NO: 132823

SEQ ID NO: 311059 - RNA, 64 nt, hsa; identical to SEQ ID NO: 132824

SEQ ID NO: 311060 - RNA, 64 nt, hsa; identical to SEQ ID NO: 132825

SEQ ID NO: 311061 - RNA, 64 nt, hsa; identical to SEQ ID NO: 132826

SEQ ID NO: 311062 - RNA, 64 nt, hsa; identical to SEQ ID NO: 132827

SEQ ID NO: 311063 - RNA, 64 nt, hsa; identical to SEQ ID NO: 132828

SEQ ID NO: 311064 - RNA, 64 nt, hsa; identical to SEQ ID NO: 132829

SEQ ID NO: 311065 - RNA, 64 nt, hsa; identical to SEQ ID NO: 132830

SEQ ID NO: 311066 - RNA, 64 nt, hsa; identical to SEQ ID NO: 132831

SEQ ID NO: 311067 - RNA, 64 nt, hsa; identical to SEQ ID NO: 132832

SEQ ID NO: 311068 - RNA, 64 nt, hsa; identical to SEQ ID NO: 132833

SEQ ID NO: 311069 - RNA, 64 nt, hsa; identical to SEQ ID NO: 132834

SEQ ID NO: 311070 - RNA, 64 nt, hsa; identical to SEQ ID NO: 132835

SEQ ID NO: 311071 - RNA, 64 nt, hsa; identical to SEQ ID NO: 132836

SEQ ID NO: 311072 - RNA, 64 nt, hsa; identical to SEQ ID NO: 132837

SEQ ID NO: 311073 - RNA, 64 nt, hsa; identical to SEQ ID NO: 132838

SEQ ID NO: 311074 - RNA, 64 nt, hsa; identical to SEQ ID NO: 132839

SEQ ID NO: 311075 - RNA, 64 nt, hsa; identical to SEQ ID NO: 132840

SEQ ID NO: 311076 - RNA, 64 nt, hsa; identical to SEQ ID NO: 132841

SEQ ID NO: 311077 - RNA, 64 nt, hsa; identical to SEQ ID NO: 132842

SEQ ID NO: 311078 - RNA, 64 nt, hsa; identical to SEQ ID NO: 132843

SEQ ID NO: 311079 - RNA, 64 nt, hsa; identical to SEQ ID NO: 132844

SEQ ID NO: 311080 - RNA, 58 nt, hsa; identical to SEQ ID NO: 132845

SEQ ID NO: 311081 - RNA, 64 nt, hsa; identical to SEQ ID NO: 132846

SEQ ID NO: 311082 - RNA, 64 nt, hsa; identical to SEQ ID NO: 132847

SEQ ID NO: 311083 - RNA, 64 nt, hsa; identical to SEQ ID NO: 132848

SEQ ID NO: 311084 - RNA, 64 nt, hsa; identical to SEQ ID NO: 132849

SEQ ID NO: 311085 - RNA, 64 nt, hsa; identical to SEQ ID NO: 132850

SEQ ID NO: 311086 - RNA, 64 nt, hsa; identical to SEQ ID NO: 132851

SEQ ID NO: 311087 - RNA, 64 nt, hsa; identical to SEQ ID NO: 132852

SEQ ID NO: 311088 - RNA, 64 nt, hsa; identical to SEQ ID NO: 132853

SEQ ID NO: 311089 - RNA, 64 nt, hsa; identical to SEQ ID NO: 132854

SEQ ID NO: 311090 - RNA, 64 nt, hsa; identical to SEQ ID NO: 132855

SEQ ID NO: 311091 - RNA, 64 nt, hsa; identical to SEQ ID NO: 132856

SEQ ID NO: 311092 - RNA, 64 nt, hsa; identical to SEQ ID NO: 132857

SEQ ID NO: 311093 - RNA, 64 nt, hsa; identical to SEQ ID NO: 132858

SEQ ID NO: 311094 - RNA, 64 nt, hsa; identical to SEQ ID NO: 132859

SEQ ID NO: 311095 - RNA, 64 nt, hsa; identical to SEQ ID NO: 132860

SEQ ID NO: 311096 - RNA, 64 nt, hsa; identical to SEQ ID NO: 132861

SEQ ID NO: 311097 - RNA, 64 nt, hsa; identical to SEQ ID NO: 132862

SEQ ID NO: 311098 - RNA, 64 nt, hsa; identical to SEQ ID NO: 132863

SEQ ID NO: 311099 - RNA, 64 nt, hsa; identical to SEQ ID NO: 132864

SEQ ID NO: 311100 - RNA, 64 nt, hsa; identical to SEQ ID NO: 132865

SEQ ID NO: 311101 - RNA, 64 nt, hsa; identical to SEQ ID NO: 132866

SEQ ID NO: 311102 - RNA, 64 nt, hsa; identical to SEQ ID NO: 132867

SEQ ID NO: 311103 - RNA, 64 nt, hsa; identical to SEQ ID NO: 132868

SEQ ID NO: 311104 - RNA, 64 nt, hsa; identical to SEQ ID NO: 132869

SEQ ID NO: 311105 - RNA, 64 nt, hsa; identical to SEQ ID NO: 132870

SEQ ID NO: 311106 - RNA, 64 nt, hsa; identical to SEQ ID NO: 132871

SEQ ID NO: 311107 - RNA, 64 nt, hsa; identical to SEQ ID NO: 132872

SEQ ID NO: 311108 - RNA, 64 nt, hsa; identical to SEQ ID NO: 132873

SEQ ID NO: 311109 - RNA, 64 nt, hsa; identical to SEQ ID NO: 132874

SEQ ID NO: 311110 - RNA, 64 nt, hsa; identical to SEQ ID NO: 132875

SEQ ID NO: 311111 - RNA, 64 nt, hsa; identical to SEQ ID NO: 132876

SEQ ID NO: 311112 - RNA, 64 nt, hsa; identical to SEQ ID NO: 132877

SEQ ID NO: 311113 - RNA, 64 nt, hsa; identical to SEQ ID NO: 132878

SEQ ID NO: 311114 - RNA, 64 nt, hsa; identical to SEQ ID NO: 132879

SEQ ID NO: 311115 - RNA, 64 nt, hsa; identical to SEQ ID NO: 132880

SEQ ID NO: 311116 - RNA, 64 nt, hsa; identical to SEQ ID NO: 132881

SEQ ID NO: 311117 - RNA, 64 nt, hsa; identical to SEQ ID NO: 132882

SEQ ID NO: 311118 - RNA, 64 nt, hsa; identical to SEQ ID NO: 132883

SEQ ID NO: 311119 - RNA, 64 nt, hsa; identical to SEQ ID NO: 132884

SEQ ID NO: 311120 - RNA, 64 nt, hsa; identical to SEQ ID NO: 132885

SEQ ID NO: 311121 - RNA, 64 nt, hsa; identical to SEQ ID NO: 132886

SEQ ID NO: 311122 - RNA, 64 nt, hsa; identical to SEQ ID NO: 132887

SEQ ID NO: 311123 - RNA, 64 nt, hsa; identical to SEQ ID NO: 132888

SEQ ID NO: 311124 - RNA, 64 nt, hsa; identical to SEQ ID NO: 132889

SEQ ID NO: 311125 - RNA, 52 nt, hsa; identical to SEQ ID NO: 119717

SEQ ID NO: 311126 - RNA, 64 nt, hsa; identical to SEQ ID NO: 119718

SEQ ID NO: 311127 - RNA, 64 nt, hsa; identical to SEQ ID NO: 119719

SEQ ID NO: 311128 - RNA, 64 nt, hsa; identical to SEQ ID NO: 119720

SEQ ID NO: 311129 - RNA, 64 nt, hsa; identical to SEQ ID NO: 119721

SEQ ID NO: 311130 - RNA, 64 nt, hsa; identical to SEQ ID NO: 119722

SEQ ID NO: 311131 - RNA, 64 nt, hsa; identical to SEQ ID NO: 119723

SEQ ID NO: 311132 - RNA, 64 nt, hsa; identical to SEQ ID NO: 119724

SEQ ID NO: 311133 - RNA, 64 nt, hsa; identical to SEQ ID NO: 113812

SEQ ID NO: 311134 - RNA, 64 nt, hsa; identical to SEQ ID NO: 113813

SEQ ID NO: 311135 - RNA, 64 nt, hsa; identical to SEQ ID NO: 113814

SEQ ID NO: 311136 - RNA, 64 nt, hsa; identical to SEQ ID NO: 113815

SEQ ID NO: 311137 - RNA, 64 nt, hsa; identical to SEQ ID NO: 113816

SEQ ID NO: 311138 - RNA, 64 nt, hsa; identical to SEQ ID NO: 113817

SEQ ID NO: 311139 - RNA, 64 nt, hsa; identical to SEQ ID NO: 113818

SEQ ID NO: 311140 - RNA, 64 nt, hsa; identical to SEQ ID NO: 113819

SEQ ID NO: 311141 - RNA, 64 nt, hsa; identical to SEQ ID NO: 113820

SEQ ID NO: 311142 - RNA, 64 nt, hsa; identical to SEQ ID NO: 113821

SEQ ID NO: 311143 - RNA, 64 nt, hsa; identical to SEQ ID NO: 245760

SEQ ID NO: 311144 - RNA, 64 nt, hsa; identical to SEQ ID NO: 245761

SEQ ID NO: 311145 - RNA, 64 nt, hsa; identical to SEQ ID NO: 245762

SEQ ID NO: 311146 - RNA, 64 nt, hsa; identical to SEQ ID NO: 245763

SEQ ID NO: 311147 - RNA, 64 nt, hsa; identical to SEQ ID NO: 245764

SEQ ID NO: 311148 - RNA, 64 nt, hsa; identical to SEQ ID NO: 245765

SEQ ID NO: 311149 - RNA, 64 nt, hsa; identical to SEQ ID NO: 245766

SEQ ID NO: 311150 - RNA, 64 nt, hsa; identical to SEQ ID NO: 245767

SEQ ID NO: 311151 - RNA, 64 nt, hsa; identical to SEQ ID NO: 245768

SEQ ID NO: 311152 - RNA, 64 nt, hsa; identical to SEQ ID NO: 245769

SEQ ID NO: 311153 - RNA, 64 nt, hsa; identical to SEQ ID NO: 245770

SEQ ID NO: 311154 - RNA, 64 nt, hsa; identical to SEQ ID NO: 245771

SEQ ID NO: 311155 - RNA, 64 nt, hsa; identical to SEQ ID NO: 245772

SEQ ID NO: 311156 - RNA, 64 nt, hsa; identical to SEQ ID NO: 245773

SEQ ID NO: 311157 - RNA, 64 nt, hsa; identical to SEQ ID NO: 245774

SEQ ID NO: 311158 - RNA, 64 nt, hsa; identical to SEQ ID NO: 245775

SEQ ID NO: 311159 - RNA, 64 nt, hsa; identical to SEQ ID NO: 245776

SEQ ID NO: 311160 - RNA, 64 nt, hsa; identical to SEQ ID NO: 245777

SEQ ID NO: 311161 - RNA, 64 nt, hsa; identical to SEQ ID NO: 245778

SEQ ID NO: 311162 - RNA, 64 nt, hsa; identical to SEQ ID NO: 245779

SEQ ID NO: 311163 - RNA, 64 nt, hsa; identical to SEQ ID NO: 245780

SEQ ID NO: 311164 - RNA, 64 nt, hsa; identical to SEQ ID NO: 245781

SEQ ID NO: 311165 - RNA, 64 nt, hsa; identical to SEQ ID NO: 245782

SEQ ID NO: 311166 - RNA, 64 nt, hsa; identical to SEQ ID NO: 245783

SEQ ID NO: 311167 - RNA, 64 nt, hsa; identical to SEQ ID NO: 245784

SEQ ID NO: 311168 - RNA, 64 nt, hsa; identical to SEQ ID NO: 245785

SEQ ID NO: 311169 - RNA, 64 nt, hsa; identical to SEQ ID NO: 245786

SEQ ID NO: 311170 - RNA, 64 nt, hsa; identical to SEQ ID NO: 245787

SEQ ID NO: 311171 - RNA, 64 nt, hsa; identical to SEQ ID NO: 245788

SEQ ID NO: 311172 - RNA, 64 nt, hsa; identical to SEQ ID NO: 245789

SEQ ID NO: 311173 - RNA, 64 nt, hsa; identical to SEQ ID NO: 245790

SEQ ID NO: 311174 - RNA, 64 nt, hsa; identical to SEQ ID NO: 245791

SEQ ID NO: 311175 - RNA, 64 nt, hsa; identical to SEQ ID NO: 245792

SEQ ID NO: 311176 - RNA, 64 nt, hsa; identical to SEQ ID NO: 245793

SEQ ID NO: 311177 - RNA, 64 nt, hsa; identical to SEQ ID NO: 245794

SEQ ID NO: 311178 - RNA, 64 nt, hsa; identical to SEQ ID NO: 245795

SEQ ID NO: 311179 - RNA, 64 nt, hsa; identical to SEQ ID NO: 245796

SEQ ID NO: 311180 - RNA, 64 nt, hsa; identical to SEQ ID NO: 245797

SEQ ID NO: 311181 - RNA, 64 nt, hsa; identical to SEQ ID NO: 245798

SEQ ID NO: 311182 - RNA, 64 nt, hsa; identical to SEQ ID NO: 245799

SEQ ID NO: 311183 - RNA, 64 nt, hsa; identical to SEQ ID NO: 245800

SEQ ID NO: 311184 - RNA, 64 nt, hsa; identical to SEQ ID NO: 245801

SEQ ID NO: 311185 - RNA, 64 nt, hsa; identical to SEQ ID NO: 245802

SEQ ID NO: 311186 - RNA, 64 nt, hsa; identical to SEQ ID NO: 245803

SEQ ID NO: 311187 - RNA, 64 nt, hsa; identical to SEQ ID NO: 245804

SEQ ID NO: 311188 - RNA, 64 nt, hsa; identical to SEQ ID NO: 83018

SEQ ID NO: 311189 - RNA, 64 nt, hsa; identical to SEQ ID NO: 83019

SEQ ID NO: 311190 - RNA, 64 nt, hsa; identical to SEQ ID NO: 83020

SEQ ID NO: 311191 - RNA, 64 nt, hsa; identical to SEQ ID NO: 83021

SEQ ID NO: 311192 - RNA, 64 nt, hsa; identical to SEQ ID NO: 83022

SEQ ID NO: 311193 - RNA, 64 nt, hsa; identical to SEQ ID NO: 83023

SEQ ID NO: 311194 - RNA, 64 nt, hsa; identical to SEQ ID NO: 83024

SEQ ID NO: 311195 - RNA, 64 nt, hsa; identical to SEQ ID NO: 83025

SEQ ID NO: 311196 - RNA, 64 nt, hsa; identical to SEQ ID NO: 83026

SEQ ID NO: 311197 - RNA, 64 nt, hsa; identical to SEQ ID NO: 83027

SEQ ID NO: 311198 - RNA, 64 nt, hsa; identical to SEQ ID NO: 83028

SEQ ID NO: 311199 - RNA, 64 nt, hsa; identical to SEQ ID NO: 83029

SEQ ID NO: 311200 - RNA, 64 nt, hsa; identical to SEQ ID NO: 83030

SEQ ID NO: 311201 - RNA, 64 nt, hsa; identical to SEQ ID NO: 83031

SEQ ID NO: 311202 - RNA, 64 nt, hsa; identical to SEQ ID NO: 83032

SEQ ID NO: 311203 - RNA, 64 nt, hsa; identical to SEQ ID NO: 83033

SEQ ID NO: 311204 - RNA, 64 nt, hsa; identical to SEQ ID NO: 83034

SEQ ID NO: 311205 - RNA, 64 nt, hsa; identical to SEQ ID NO: 83035

SEQ ID NO: 311206 - RNA, 64 nt, hsa
aguaaccugggcuaaaauaggucuuaugugguucaacucccacccccgccuuccccauauuuuc

SEQ ID NO: 311207 - RNA, 64 nt, hsa
aaauuucacugauuuuaaucaugcuggagaccuuaacucccauccugauacauccugaaguaac

SEQ ID NO: 311208 - RNA, 64 nt, hsa
cuugauuguauauaagauaauucauacuggagaaaacucccagaaguggaguuuuccuuauugc

SEQ ID NO: 311209 - RNA, 64 nt, hsa
acaggguuucuccauguuggucagucuggucucaaacucccaaccucaggugauaugcccgccu

SEQ ID NO: 311210 - RNA, 64 nt, hsa
ggcaaccaaagaaaugaguuuuggggaggaacacaacucccaucccagucaguuuccuucccau

SEQ ID NO: 311211 - RNA, 64 nt, hsa
uguagugguaugaucauagcucaccacaaccuugaacucccaggcucaagcgauccucccgccu

SEQ ID NO: 311212 - RNA, 64 nt, hsa
ccagagguacagcugccgaaagugucagagaugaaacucccagaggugucagagguggcugugc

SEQ ID NO: 311213 - RNA, 64 nt, hsa
ccagagguacagcugcugaaagugucggagaugaaacucccaaaggugccagagauggcugugc

SEQ ID NO: 311214 - RNA, 64 nt, hsa
ccagagguagagcugcccaaagugucagagaugaaacucccaaaggugccagagauggcugugc

SEQ ID NO: 311215 - RNA, 64 nt, hsa
ccagagguggagcuccccaaggugucagagaugaaacucccaaaggugccagagauggcugugc

SEQ ID NO: 311216 - RNA, 64 nt, hsa
uuuccuuaugcuguaaaagcaaguccugcaaccaaacucccaucagcccaaucccugaucccug

SEQ ID NO: 311217 - RNA, 64 nt, hsa
guagugcagcagggcaguagcgguaccaaugcagaacucccaagacccgagcugggaccaguac

SEQ ID NO: 311218 - RNA, 64 nt, hsa
cuuuaggagagauaucauuaucgcuguuuuauaaauaagggaaacuuuagcuugaggguuuaag

SEQ ID NO: 311219 - RNA, 64 nt, hsa
gaacugauguuuucagcauauuuucaaaauauugauaagggaaguuauuacuuuuauauaguau

SEQ ID NO: 311220 - RNA, 64 nt, hsa
aagaaaauacuuaaauguuauguauauggugguaauaagggaaaaaucaaguauuauaaacaag

SEQ ID NO: 311221 - RNA, 64 nt, hsa
aauacuagauuugggagaagggcagaguuacuugauaagggacugauguuugugcaguaacuug

SEQ ID NO: 311222 - RNA, 64 nt, hsa; identical to SEQ ID NO: 302048

SEQ ID NO: 311223 - RNA, 64 nt, hsa; identical to SEQ ID NO: 302049

SEQ ID NO: 311224 - RNA, 64 nt, hsa; identical to SEQ ID NO: 302050

SEQ ID NO: 311225 - RNA, 64 nt, hsa; identical to SEQ ID NO: 302051

SEQ ID NO: 311226 - RNA, 64 nt, hsa; identical to SEQ ID NO: 302052

SEQ ID NO: 311227 - RNA, 64 nt, hsa; identical to SEQ ID NO: 302053

SEQ ID NO: 311228 - RNA, 64 nt, hsa
ucauauucccaguggagaggggaacaaguggggcugggcauauaccuauuccggcuucuagugg

SEQ ID NO: 311229 - RNA, 64 nt, hsa
gacccacgugggagccuggaucccuggacuguccugggcauagguuucaggggccuccuuuguu

SEQ ID NO: 311230 - RNA, 64 nt, hsa
aucugggcauacagugucuggacgcugccacaucugggcauacagugucuggacacugccacau

SEQ ID NO: 311231 - RNA, 64 nt, hsa
ggcagccacacagcuggacggaugcugccacaucugggcauacagugucuggacgcugccacau

SEQ ID NO: 311232 - RNA, 64 nt, hsa
cauccucuuguuccagucucagcuggcugcuccgugggcauacuucauaccuuucaucacagag

SEQ ID NO: 311233 - RNA, 64 nt, hsa
aaaccagcuuccuccucagcuccagcucuuuuaaugggcauaucaaaacugaugacuuuuuccu

SEQ ID NO: 311234 - RNA, 64 nt, hsa
agaaguaucugacuguagacacaacuaggcuccgugggcauaucuggguggcaauuucagaggg

SEQ ID NO: 311235 - RNA, 64 nt, hsa
ccaguaugaaauaagaauaagcagcccacacaacugggcauagugguucaugccuguaauccca

SEQ ID NO: 311236 - RNA, 64 nt, hsa; identical to SEQ ID NO: 131192

SEQ ID NO: 311237 - RNA, 64 nt, hsa; identical to SEQ ID NO: 131193

SEQ ID NO: 311238 - RNA, 64 nt, hsa; identical to SEQ ID NO: 131194

SEQ ID NO: 311239 - RNA, 64 nt, hsa; identical to SEQ ID NO: 131195

SEQ ID NO: 311240 - RNA, 64 nt, hsa; identical to SEQ ID NO: 131196

SEQ ID NO: 311241 - RNA, 64 nt, hsa; identical to SEQ ID NO: 131197

SEQ ID NO: 311242 - RNA, 64 nt, hsa; identical to SEQ ID NO: 131198

SEQ ID NO: 311243 - RNA, 64 nt, hsa; identical to SEQ ID NO: 131199

SEQ ID NO: 311244 - RNA, 64 nt, hsa; identical to SEQ ID NO: 131200

SEQ ID NO: 311245 - RNA, 64 nt, hsa; identical to SEQ ID NO: 131201

SEQ ID NO: 311246 - RNA, 64 nt, hsa; identical to SEQ ID NO: 131202

SEQ ID NO: 311247 - RNA, 64 nt, hsa; identical to SEQ ID NO: 131203

SEQ ID NO: 311248 - RNA, 64 nt, hsa; identical to SEQ ID NO: 131204

SEQ ID NO: 311249 - RNA, 64 nt, hsa; identical to SEQ ID NO: 131205

SEQ ID NO: 311250 - RNA, 64 nt, hsa; identical to SEQ ID NO: 131206

SEQ ID NO: 311251 - RNA, 64 nt, hsa; identical to SEQ ID NO: 131207

SEQ ID NO: 311252 - RNA, 64 nt, hsa
uuaaaagucacuugucauucaaaaaugaguuaaguaacaugauaaucuuuuaaauuuaccuagc

SEQ ID NO: 311253 - RNA, 64 nt, hsa
uaugcacuaaacguuuugugccuuggucuaauauuaacaugauguauguguaaacugacaaaaa

SEQ ID NO: 311254 - RNA, 64 nt, hsa
ccuuguaugauguaaguggcccaccccaauuuuguaacaugaugcaagugucuggcacuaaggg

SEQ ID NO: 311255 - RNA, 64 nt, hsa
uugugaauuuuuucauguuaaagagcuaaagucauaacaugauuacagucaacucuccauuauc

SEQ ID NO: 311256 - RNA, 64 nt, hsa
augauaguuuccuaaccuuuucauaaccuuuucauaacaugauaguuuccauaacagagacagc

SEQ ID NO: 311257 - RNA, 64 nt, hsa
aguuguuuuuaaaagauucaauauuagcuuuucauaacaugauaguuuccuaaccuuuucauaa

SEQ ID NO: 311258 - RNA, 64 nt, hsa
uacaacaaauaccauagacagguugguuuauaaauaacaugaauuuauuucucacaguucugga

SEQ ID NO: 311259 - RNA, 64 nt, hsa
accucccaauaccaucacauuagggguuaggauuuaacaugaauuuuggggacauauaaacauu

SEQ ID NO: 311260 - RNA, 64 nt, hsa
uugcuuuacacaucaucaacucuaaauccuauaguaacaugagaauucacuucuucuuguaaaa

SEQ ID NO: 311261 - RNA, 64 nt, hsa
aggaauauugugacaauucauugcuaauaaaacauaacaugagucucuuuguacuguuuuuaau

SEQ ID NO: 311262 - RNA, 64 nt, hsa
cugaagagaaaguucauucacagagacugccucuuaacaugaagaucauuggacaagccacacg

SEQ ID NO: 311263 - RNA, 64 nt, hsa
auaccucuggugugggacggucuuuucuaaacuuuaacaugagacuuaaaagauauaauaaggg

SEQ ID NO: 311264 - RNA, 64 nt, hsa
uuaaaacuaaugcuaauaagggauuuagaguugaauggcaaaauguuuauuacuuggcaauacc

SEQ ID NO: 311265 - RNA, 64 nt, hsa
cuugagagcugacuguugcuuaagaaguuuucuuauggcaaaaauaauguaaauaaguuacuau

SEQ ID NO: 311266 - RNA, 64 nt, hsa
ggaugucuugaaacccgugcauuuaauuuuagaaauggcaaauuuguaagcgugucauuuaagu

SEQ ID NO: 311267 - RNA, 64 nt, hsa
gcacuuugcgcauuguguaaguuggguaacaaaaauggcaaaagaaaugcagauuucccaguua

SEQ ID NO: 311268 - RNA, 64 nt, hsa
cagugguuaaagagguaaucacagucugagcaacauggcaaaacccugugucuacaaaaaauaa

SEQ ID NO: 311269 - RNA, 64 nt, hsa
aaucaaaagcugguucuuugaaaagaucuacaaaauggcaaacauuuagcuagauugaccaccc

SEQ ID NO: 311270 - RNA, 64 nt, hsa
gucuuucagaauaggauucugugauaauauuuaaauggcaaaaacaaaacauaauuuugugcaa

SEQ ID NO: 311271 - RNA, 64 nt, hsa
uccuauaauuuuagacauucuuuaucuuuuuaguauggcaaacugccaucauuuacuuuuaaac

SEQ ID NO: 311272 - RNA, 64 nt, hsa
aauucuaaaccccuuuuccauagacacaagaaagauggcaaauuuaugcuauuccuggaaaaau

SEQ ID NO: 311273 - RNA, 64 nt, hsa
uguauaacacauucugcuaaggcccagggauacaauggcaaacaagauagauguaguuccuucc

SEQ ID NO: 311274 - RNA, 64 nt, hsa
uugaggccaggaguucaagaccagccuggccaacauggcaaaaucccaucucuacuaaaaauac

SEQ ID NO: 311275 - RNA, 64 nt, hsa
aacuaaucgugguuuuugccauuuuuaauuuuuaauggcaaaagccacuauuacuuuugcacca

SEQ ID NO: 311276 - RNA, 64 nt, hsa
aggaugugguuuacaguaagguggaugguaccuuauggcaaaaaucucucagaaauuuaugugu

SEQ ID NO: 311277 - RNA, 64 nt, hsa
agacuuagacucccacauaguaauaauaauaauaauggcaaacuuaacaccccacugucaacau

SEQ ID NO: 311278 - RNA, 64 nt, hsa
gaaagagcuguguuuugguucaaagacaagggaaauggcaaacaaaagacuguaggagagccaa

SEQ ID NO: 311279 - RNA, 64 nt, hsa
gaucuuucucaaaggaagcuuaggacccgugggaauggcaaaacaguaaggauggggaccuucu

SEQ ID NO: 311280 - RNA, 64 nt, hsa
ucagacuugaaucuguagacauuucuuuauugauauggcaaauugcuugcagauauuuuuaaau

SEQ ID NO: 311281 - RNA, 64 nt, hsa
cccuagaggguagaaaguuuucccaauucuacacauggcaaaauggagacccagagucacuugc

SEQ ID NO: 311282 - RNA, 64 nt, hsa
cacaaacucaacacuaccaucagggguuuucuuuauggcaaagccaaaauagcuccuacaauuu

SEQ ID NO: 311283 - RNA, 64 nt, hsa
caguaaaacuauguauaauaguauauagccaugcauggcaaauauuuuaauauuucuguuuuca

SEQ ID NO: 311284 - RNA, 64 nt, hsa
guucacaggcuuucacagcaaggguaccuauuucauggcaaaauaggcaguuuuaaaagaauaa

SEQ ID NO: 311285 - RNA, 64 nt, hsa
uugagcccaggaguuugagaccagccugggcaacauggcaaaaccccaucucuacaaaaaauac

SEQ ID NO: 311286 - RNA, 64 nt, hsa
cugugucuguugugccuugcccggcgccucacggauggcaaagcucuccucacccaugggacug

SEQ ID NO: 311287 - RNA, 64 nt, hsa
ucuaaaaccagugggaaaacugucugauuucuggauggcaaaggcuuucuaaacucaaaaguga

SEQ ID NO: 311288 - RNA, 64 nt, hsa
acaugcuuuuguaucuugucauaguuauccacaaauggcaaaacuggacuugauucuacuggua

SEQ ID NO: 311289 - RNA, 64 nt, hsa
agugugagcgguuugcuguuagccagggcuauuuauggcaaacacaugcuuuuguaucuuguca

SEQ ID NO: 311290 - RNA, 55 nt, hsa; identical to SEQ ID NO: 244290

SEQ ID NO: 311291 - RNA, 64 nt, hsa
cauacuggugagaaauucuaaaaaugugaagacuauggcaaagucuuuaaaugguugucacacu

SEQ ID NO: 311292 - RNA, 64 nt, hsa
uauacuguacaaaaaccccacaagugugaaaaacauggcaaagccuuuaagaagcccucaauuc

SEQ ID NO: 311293 - RNA, 64 nt, hsa
cauacuggagaaaacgccuacaugugugaacaauauggcaaaacuuaaugcucacacuuuauug

SEQ ID NO: 311294 - RNA, 64 nt, hsa
uugagcccaggaguuugaaaccagccuggguaacauggcaaaauccugucuuuacaaaaaauac

SEQ ID NO: 311295 - RNA, 64 nt, hsa
cugaagucagaaguuugagaccagccuggcaaacauggcaaaacugucucuauuaaaaauacag

SEQ ID NO: 311296 - RNA, 64 nt, hsa
gcuggccuuccccagccugcaaggagccuguagcauggcaaaucugccugcuguaugcuauuuu

SEQ ID NO: 311297 - RNA, 64 nt, hsa
aaaggaaacucaggcaaagggauccauaugugcaauggcaaagaaaugugaaaaggcauuggga

SEQ ID NO: 311298 - RNA, 64 nt, hsa
uggaacgcaaagggccgaggagcaucugguuuucauggcaaagcucuacuccagagcuccuuua

SEQ ID NO: 311299 - RNA, 64 nt, hsa
ucugcuaauuaagugcaauaaauuuuucuagaaaauggcaaagaugacuuccagguggauauug

SEQ ID NO: 311300 - RNA, 64 nt, hsa
ugccaccuucgugguuguaaaagacaaacaaaacauggcaaauuucauuaacacaaaauuucau

SEQ ID NO: 311301 - RNA, 64 nt, hsa
uuucucauauccaucgugauaggaaggccuaagaauggcaaaucgcuuugagauauaauauuga

SEQ ID NO: 311302 - RNA, 64 nt, hsa; identical to SEQ ID NO: 165419

SEQ ID NO: 311303 - RNA, 64 nt, hsa; identical to SEQ ID NO: 165420

SEQ ID NO: 311304 - RNA, 64 nt, hsa; identical to SEQ ID NO: 165421

SEQ ID NO: 311305 - RNA, 64 nt, hsa; identical to SEQ ID NO: 165422

SEQ ID NO: 311306 - RNA, 64 nt, hsa; identical to SEQ ID NO: 165423

SEQ ID NO: 311307 - RNA, 64 nt, hsa; identical to SEQ ID NO: 165424

SEQ ID NO: 311308 - RNA, 64 nt, hsa; identical to SEQ ID NO: 165425

SEQ ID NO: 311309 - RNA, 64 nt, hsa; identical to SEQ ID NO: 165426

SEQ ID NO: 311310 - RNA, 64 nt, hsa; identical to SEQ ID NO: 165427

SEQ ID NO: 311311 - RNA, 64 nt, hsa; identical to SEQ ID NO: 165428

SEQ ID NO: 311312 - RNA, 64 nt, hsa; identical to SEQ ID NO: 165429

SEQ ID NO: 311313 - RNA, 64 nt, hsa; identical to SEQ ID NO: 165430

SEQ ID NO: 311314 - RNA, 64 nt, hsa; identical to SEQ ID NO: 165431

SEQ ID NO: 311315 - RNA, 64 nt, hsa; identical to SEQ ID NO: 165432

SEQ ID NO: 311316 - RNA, 64 nt, hsa; identical to SEQ ID NO: 165433

SEQ ID NO: 311317 - RNA, 64 nt, hsa; identical to SEQ ID NO: 165434

SEQ ID NO: 311318 - RNA, 64 nt, hsa; identical to SEQ ID NO: 165435

SEQ ID NO: 311319 - RNA, 64 nt, hsa; identical to SEQ ID NO: 165436

SEQ ID NO: 311320 - RNA, 64 nt, hsa; identical to SEQ ID NO: 165437

SEQ ID NO: 311321 - RNA, 64 nt, hsa; identical to SEQ ID NO: 165438

SEQ ID NO: 311322 - RNA, 64 nt, hsa; identical to SEQ ID NO: 165439

SEQ ID NO: 311323 - RNA, 64 nt, hsa; identical to SEQ ID NO: 165440

SEQ ID NO: 311324 - RNA, 64 nt, hsa; identical to SEQ ID NO: 165441

SEQ ID NO: 311325 - RNA, 64 nt, hsa; identical to SEQ ID NO: 165442

SEQ ID NO: 311326 - RNA, 64 nt, hsa; identical to SEQ ID NO: 165443

SEQ ID NO: 311327 - RNA, 64 nt, hsa; identical to SEQ ID NO: 165444

SEQ ID NO: 311328 - RNA, 64 nt, hsa; identical to SEQ ID NO: 165445

SEQ ID NO: 311329 - RNA, 64 nt, hsa; identical to SEQ ID NO: 165446

SEQ ID NO: 311330 - RNA, 64 nt, hsa; identical to SEQ ID NO: 165447

SEQ ID NO: 311331 - RNA, 64 nt, hsa; identical to SEQ ID NO: 165448

SEQ ID NO: 311332 - RNA, 64 nt, hsa; identical to SEQ ID NO: 165449

SEQ ID NO: 311333 - RNA, 64 nt, hsa; identical to SEQ ID NO: 165450

SEQ ID NO: 311334 - RNA, 64 nt, hsa; identical to SEQ ID NO: 165451

SEQ ID NO: 311335 - RNA, 64 nt, hsa; identical to SEQ ID NO: 165452

SEQ ID NO: 311336 - RNA, 64 nt, hsa; identical to SEQ ID NO: 165453

SEQ ID NO: 311337 - RNA, 64 nt, hsa; identical to SEQ ID NO: 165454

SEQ ID NO: 311338 - RNA, 64 nt, hsa; identical to SEQ ID NO: 165455

SEQ ID NO: 311339 - RNA, 64 nt, hsa; identical to SEQ ID NO: 165456

SEQ ID NO: 311340 - RNA, 64 nt, hsa; identical to SEQ ID NO: 165457

SEQ ID NO: 311341 - RNA, 64 nt, hsa; identical to SEQ ID NO: 165458

SEQ ID NO: 311342 - RNA, 64 nt, hsa; identical to SEQ ID NO: 165459

SEQ ID NO: 311343 - RNA, 64 nt, hsa; identical to SEQ ID NO: 165460

SEQ ID NO: 311344 - RNA, 64 nt, hsa; identical to SEQ ID NO: 165461

SEQ ID NO: 311345 - RNA, 64 nt, hsa; identical to SEQ ID NO: 165462

SEQ ID NO: 311346 - RNA, 64 nt, hsa; identical to SEQ ID NO: 165463

SEQ ID NO: 311347 - RNA, 64 nt, hsa; identical to SEQ ID NO: 165464

SEQ ID NO: 311348 - RNA, 63 nt, hsa; identical to SEQ ID NO: 165465

SEQ ID NO: 311349 - RNA, 64 nt, hsa; identical to SEQ ID NO: 165466

SEQ ID NO: 311350 - RNA, 64 nt, hsa; identical to SEQ ID NO: 165467

SEQ ID NO: 311351 - RNA, 64 nt, hsa; identical to SEQ ID NO: 165468

SEQ ID NO: 311352 - RNA, 64 nt, hsa; identical to SEQ ID NO: 165469

SEQ ID NO: 311353 - RNA, 64 nt, hsa; identical to SEQ ID NO: 165470

SEQ ID NO: 311354 - RNA, 64 nt, hsa; identical to SEQ ID NO: 165471

SEQ ID NO: 311355 - RNA, 64 nt, hsa; identical to SEQ ID NO: 165472

SEQ ID NO: 311356 - RNA, 64 nt, hsa; identical to SEQ ID NO: 165473

SEQ ID NO: 311357 - RNA, 64 nt, hsa; identical to SEQ ID NO: 165474

SEQ ID NO: 311358 - RNA, 64 nt, hsa; identical to SEQ ID NO: 165475

SEQ ID NO: 311359 - RNA, 64 nt, hsa; identical to SEQ ID NO: 165476

SEQ ID NO: 311360 - RNA, 64 nt, hsa; identical to SEQ ID NO: 165477

SEQ ID NO: 311361 - RNA, 64 nt, hsa; identical to SEQ ID NO: 165478

SEQ ID NO: 311362 - RNA, 64 nt, hsa; identical to SEQ ID NO: 165479

SEQ ID NO: 311363 - RNA, 64 nt, hsa; identical to SEQ ID NO: 165480

SEQ ID NO: 311364 - RNA, 64 nt, hsa; identical to SEQ ID NO: 165481

SEQ ID NO: 311365 - RNA, 64 nt, hsa; identical to SEQ ID NO: 165482

SEQ ID NO: 311366 - RNA, 64 nt, hsa; identical to SEQ ID NO: 165483

SEQ ID NO: 311367 - RNA, 64 nt, hsa; identical to SEQ ID NO: 165484

SEQ ID NO: 311368 - RNA, 64 nt, hsa; identical to SEQ ID NO: 165485

SEQ ID NO: 311369 - RNA, 61 nt, hsa
agcuuccauagaaauacacuuuguaucuggaccucaaaauuaugggaacauuuacuuaaac

SEQ ID NO: 311370 - RNA, 61 nt, hsa
uaugauaaaggacaaaauaagcuguuugccaccucaaaacuuuaugaacuucaccaccacu

SEQ ID NO: 311371 - RNA, 61 nt, hsa
agagagacugaagucacaaccccugacugcuccucaaaagcuaacgguugcaccuccaagu

SEQ ID NO: 311372 - RNA, 61 nt, hsa
gccuauaaaucuuggaggaaucauuucuccuccucaaaaacugauucagaaacugacuugg

SEQ ID NO: 311373 - RNA, 61 nt, hsa
aguuggggcaggcuggcuggcccgucauguuccucaaaagcacccuugacgucaagucucc

SEQ ID NO: 311374 - RNA, 61 nt, hsa
aacaugcgaccgugaccaggaacacccgacuccucaaaagcaaaugagaucccgccucuuc

SEQ ID NO: 311375 - RNA, 61 nt, hsa
aauacuugucuuucucuccucucccuccaucccucaaaagaucuuuaugcauuucccacua

SEQ ID NO: 311376 - RNA, 61 nt, hsa
ugaggggcauagugaaaaaggaacagccaugccucaaaaucaaaucauuugcauucccaca

SEQ ID NO: 311377 - RNA, 61 nt, hsa
acuuccaguaggcccacaguuguugguuguuccucaaaacagguuguggcuccuguugaau

SEQ ID NO: 311378 - RNA, 61 nt, hsa
ugccauggagcacuagaugguccuuuucacuccucaaaaugcaugcccauugucuucaggu

SEQ ID NO: 311379 - RNA, 61 nt, hsa
cuccagccugggcgacaagagugaaacuccaccucaaaaaaaaaaaaaaaagaguuaaucu

SEQ ID NO: 311380 - RNA, 61 nt, hsa
agugucgcuuuccagccuuuuguuucuggauccucaaaacucagaacguggccgggcgugg

SEQ ID NO: 311381 - RNA, 61 nt, hsa
uggcacaugccuguauuacugaaagcuaaauccucaaaaccuaguaaggggacuaaugauu

SEQ ID NO: 311382 - RNA, 61 nt, hsa
ugagcauguaauaauacaagaacuguuucccccucaaaaccugaaccugaauuauuuguaa

SEQ ID NO: 311383 - RNA, 61 nt, hsa
uguacaauuuggggccucaaauuugacucugccucaaaaaaaagaaauauauccuaugcag

SEQ ID NO: 311384 - RNA, 61 nt, hsa
gccucucacccacucccagacacacacaaguccucaaaaguuucagcuccgugugugagau

SEQ ID NO: 311385 - RNA, 61 nt, hsa
cugaguguuuagggaaauagcuucuuuaaaaccucaaaaccaugaccauccugucaaagac

SEQ ID NO: 311386 - RNA, 61 nt, hsa
auuccagccugggugacagagugagacucccccucaaaaaaaaaaaaaaaaaaaaaaaaaa

SEQ ID NO: 311387 - RNA, 61 nt, hsa
cauacacacacacacauacaguauauucuuuccucaaaaggguuaagaugucuaaaauagg

SEQ ID NO: 311388 - RNA, 61 nt, hsa
ucuagaugcaaauacauugaguuuaaaagugccucaaaauaauugagaucacauuucagga

SEQ ID NO: 311389 - RNA, 64 nt, hsa
cuuauuucuuuucucaaaaaaauuuuucuuuuuuuaacugcaauaaaguaggucguuaccccua

SEQ ID NO: 311390 - RNA, 64 nt, hsa
gaagggggugggcuaugaaagccggucucaaagauaacugcauccuucauuccaggaaagcccu

SEQ ID NO: 311391 - RNA, 64 nt, hsa
uaaugguacuuaugauuaaaaacgcauuuaauacuaacugcaguaguucuuucaagaaucuuua

SEQ ID NO: 311392 - RNA, 64 nt, hsa
uaacuugcaccaagcaagaaaauauaaauacaguuaacugcauuaagauaaucacguuaaaauu

SEQ ID NO: 311393 - RNA, 64 nt, hsa
agacuaugaacauagaauugcugcuuuuauauuuuaacugcagauugugaauuucacugccuua

SEQ ID NO: 311394 - RNA, 64 nt, hsa
acuuuuuuguccguguccucucauuuggguuuuguaacugcaauuuucaaaccaaaguuuaaaa

SEQ ID NO: 311395 - RNA, 64 nt, hsa
cacuuucugauuacucaugauaaacugacauggcuaacugcaagaauuaaaucuucuaucugag

SEQ ID NO: 311396 - RNA, 64 nt, hsa
aaguucucuauggcaaagucuuucaaauacgagauaacugcaaaauauuuuccuuuuauacuac

SEQ ID NO: 311397 - RNA, 64 nt, hsa
acuugaacagcgaaagcagagcauguuauuuauauaacugcauuuaagcaguaccaagacugaa

SEQ ID NO: 311398 - RNA, 64 nt, hsa
aaaucuuuguguuacuucacucaaagaacauaaguaacugcaauuaacauauaugaaauuuauu

SEQ ID NO: 311399 - RNA, 64 nt, hsa
guaucuacuuaccauagauaccuuucauaacugguaacugcaaagccuuuugugcuggacccag

SEQ ID NO: 311400 - RNA, 64 nt, hsa
uuaguuugucauauaaccagguuuauccuuagucuaacugcaagggauggaaccugccccaggu

SEQ ID NO: 311401 - RNA, 64 nt, hsa
uuucugugucugaaaguuuacagguuguggugcaucagcccaaacucacuggcguuguguuuuu

SEQ ID NO: 311402 - RNA, 64 nt, hsa
agacccaagguaguccuggcacugcccuguggacucagcccagcuggggaggacauggcgcccg

SEQ ID NO: 311403 - RNA, 64 nt, hsa
cagcccuccuaauaccucauauuccccaucuuccucagcccagaaagcaauggggcuuuaguga

SEQ ID NO: 311404 - RNA, 64 nt, hsa
cauggaggcaguggcgccuuauggauaggucaucucagcccaaagggccuccuuggcuggcaug

SEQ ID NO: 311405 - RNA, 64 nt, hsa
ggcgggcagcagcuccccaucuucucuggcagacucagcccacugccuugccagucuugccagg

SEQ ID NO: 311406 - RNA, 64 nt, hsa
cugcacauuguugucacccacccuccugcccuucucagcccagaugccaugccccugggcgggc

SEQ ID NO: 311407 - RNA, 64 nt, hsa
agaacugucucauucauuuacauuucuguuacagucagcccaggagguuacagugagcucucca

SEQ ID NO: 311408 - RNA, 64 nt, hsa
aauccaucacccuucgcugacucucuuuucggacucagcccaccugcacccaggugaaauaaac

SEQ ID NO: 311409 - RNA, 64 nt, hsa
gcgguggaaaaacuugaggguuugggguucaaagucagcccaucccaccuggcaaaauccuccu

SEQ ID NO: 311410 - RNA, 64 nt, hsa
auuccucaugcugacccuccucacgauggcugugucagcccagccccuucccuucuccaggccc

SEQ ID NO: 311411 - RNA, 64 nt, hsa
gacaguacuuauuaauugagucccuaaggaauauucagcccacuacauagauagcuuuuuuuuu

SEQ ID NO: 311412 - RNA, 64 nt, hsa
guaaaaauaauacaugaaucccauucacagguucucagcccaagcaacaagguaauugcgugcc

SEQ ID NO: 311413 - RNA, 64 nt, hsa
aaggccacugcuacaucucccagacucugggcugucagcccaugugcaccugccccccagccuu

SEQ ID NO: 311414 - RNA, 64 nt, hsa
cuuccugcuucagggccgcaccgcccagacuggcucagcccaggccaccaacuucaucgccuuu

SEQ ID NO: 311415 - RNA, 64 nt, hsa
acuaggcuggacccuucccacuacauaauagggcucagcccaggcagccagcuuugggcugagc

SEQ ID NO: 311416 - RNA, 64 nt, hsa
ggagcuagggcagggaccaaaugaacagaaagucucagcccaggauggggcuucuucaacaggg

SEQ ID NO: 311417 - RNA, 64 nt, hsa
ccggggaggcagggguccugcagguccuggugggucagcccagcaccugcucccagugggagcu

SEQ ID NO: 311418 - RNA, 64 nt, hsa
ccaauagcucuacugcccuccccuuccccuuuacucagcccagcuggccaccuagaagucuccc

SEQ ID NO: 311419 - RNA, 64 nt, hsa
cagcacuuugggaggccaaggcagggggauuacuucagcccaggaguuccagacugccuggcua

SEQ ID NO: 311420 - RNA, 64 nt, hsa
aguaucuauuuuacaaaaugcagagccaggucccucagcccagacucagucagacauguucacu

SEQ ID NO: 311421 - RNA, 64 nt, hsa
caggaugugaacuuccccaucgcaaaugcaguucucagcccacugcaguggauacaaggaaggg

SEQ ID NO: 311422 - RNA, 64 nt, hsa
gccaggcugucuacccuauggccacagcaggaggucagcccagggccaggagacacauggcugg

SEQ ID NO: 311423 - RNA, 64 nt, hsa
gugcugugcuucucagaggcaggauccaagcagaucagcccagccuagcccagcucaggcaggc

SEQ ID NO: 311424 - RNA, 64 nt, hsa
caaaaaguccagaagccuugacagcuggcaucaaucagcccaagacccccaggggauucauggg

SEQ ID NO: 311425 - RNA, 64 nt, hsa
caggucagagcccacccggcagguuucagaguggucagcccaguuuaagggugggagucuggag

SEQ ID NO: 311426 - RNA, 64 nt, hsa
uagacaucugccaguaagccugcugagagaagccucagcccacucauaccuagagacgcugcug

SEQ ID NO: 311427 - RNA, 64 nt, hsa
uuacgcccccucccuguuucuuaucaccagcccaucagcccacugacucccauaugguagaaaa

SEQ ID NO: 311428 - RNA, 64 nt, hsa
ggaaugcucauggccccuguggucugcuuguccuucagcccaugcccagcagauaccucucuga

SEQ ID NO: 311429 - RNA, 64 nt, hsa
agaaugaaucaacugcuauccuuccccucaccccucagcccaggagggaaagggcauuuucuuu

SEQ ID NO: 311430 - RNA, 64 nt, hsa
agaacauuuuagccauugauguucacacguggcaucagcccaugcaagauagguuucuguauuu

SEQ ID NO: 311431 - RNA, 64 nt, hsa
uggggcccugagauggccccagcuccucuuguccucagcccaccccucauugugacuuaugagg

SEQ ID NO: 311432 - RNA, 64 nt, hsa
aguaccagccccccagcccacccacuuggcccacucagcccauucaccaggcgcuggucucacc

SEQ ID NO: 311433 - RNA, 64 nt, hsa; identical to SEQ ID NO: 155574

SEQ ID NO: 311434 - RNA, 64 nt, hsa; identical to SEQ ID NO: 155575

SEQ ID NO: 311435 - RNA, 64 nt, hsa; identical to SEQ ID NO: 155576

SEQ ID NO: 311436 - RNA, 64 nt, hsa; identical to SEQ ID NO: 155577

SEQ ID NO: 311437 - RNA, 64 nt, hsa; identical to SEQ ID NO: 155578

SEQ ID NO: 311438 - RNA, 64 nt, hsa; identical to SEQ ID NO: 155579

SEQ ID NO: 311439 - RNA, 64 nt, hsa; identical to SEQ ID NO: 155580

SEQ ID NO: 311440 - RNA, 64 nt, hsa; identical to SEQ ID NO: 155581

SEQ ID NO: 311441 - RNA, 64 nt, hsa; identical to SEQ ID NO: 155582

SEQ ID NO: 311442 - RNA, 64 nt, hsa; identical to SEQ ID NO: 155583

SEQ ID NO: 311443 - RNA, 64 nt, hsa; identical to SEQ ID NO: 155584

SEQ ID NO: 311444 - RNA, 64 nt, hsa; identical to SEQ ID NO: 155585

SEQ ID NO: 311445 - RNA, 64 nt, hsa; identical to SEQ ID NO: 155586

SEQ ID NO: 311446 - RNA, 64 nt, hsa; identical to SEQ ID NO: 155587

SEQ ID NO: 311447 - RNA, 64 nt, hsa; identical to SEQ ID NO: 155588

SEQ ID NO: 311448 - RNA, 64 nt, hsa; identical to SEQ ID NO: 155589

SEQ ID NO: 311449 - RNA, 64 nt, hsa; identical to SEQ ID NO: 155590

SEQ ID NO: 311450 - RNA, 64 nt, hsa; identical to SEQ ID NO: 155591

SEQ ID NO: 311451 - RNA, 64 nt, hsa; identical to SEQ ID NO: 155592

SEQ ID NO: 311452 - RNA, 64 nt, hsa; identical to SEQ ID NO: 155593

SEQ ID NO: 311453 - RNA, 64 nt, hsa; identical to SEQ ID NO: 155594

SEQ ID NO: 311454 - RNA, 64 nt, hsa; identical to SEQ ID NO: 155595

SEQ ID NO: 311455 - RNA, 64 nt, hsa; identical to SEQ ID NO: 305621

SEQ ID NO: 311456 - RNA, 64 nt, hsa; identical to SEQ ID NO: 305622

SEQ ID NO: 311457 - RNA, 64 nt, hsa; identical to SEQ ID NO: 305623

SEQ ID NO: 311458 - RNA, 64 nt, hsa; identical to SEQ ID NO: 305624

SEQ ID NO: 311459 - RNA, 64 nt, hsa; identical to SEQ ID NO: 305625

SEQ ID NO: 311460 - RNA, 64 nt, hsa; identical to SEQ ID NO: 305626

SEQ ID NO: 311461 - RNA, 64 nt, hsa; identical to SEQ ID NO: 305627

SEQ ID NO: 311462 - RNA, 64 nt, hsa; identical to SEQ ID NO: 305628

SEQ ID NO: 311463 - RNA, 64 nt, hsa; identical to SEQ ID NO: 305629

SEQ ID NO: 311464 - RNA, 64 nt, hsa; identical to SEQ ID NO: 305630

SEQ ID NO: 311465 - RNA, 64 nt, hsa; identical to SEQ ID NO: 305631

SEQ ID NO: 311466 - RNA, 64 nt, hsa; identical to SEQ ID NO: 305632

SEQ ID NO: 311467 - RNA, 64 nt, hsa; identical to SEQ ID NO: 305633

SEQ ID NO: 311468 - RNA, 64 nt, hsa; identical to SEQ ID NO: 305634

SEQ ID NO: 311469 - RNA, 64 nt, hsa; identical to SEQ ID NO: 305635

SEQ ID NO: 311470 - RNA, 64 nt, hsa; identical to SEQ ID NO: 305636

SEQ ID NO: 311471 - RNA, 64 nt, hsa; identical to SEQ ID NO: 305637

SEQ ID NO: 311472 - RNA, 64 nt, hsa; identical to SEQ ID NO: 285749

SEQ ID NO: 311473 - RNA, 64 nt, hsa; identical to SEQ ID NO: 285750

SEQ ID NO: 311474 - RNA, 64 nt, hsa; identical to SEQ ID NO: 285751

SEQ ID NO: 311475 - RNA, 64 nt, hsa; identical to SEQ ID NO: 285752

SEQ ID NO: 311476 - RNA, 64 nt, hsa; identical to SEQ ID NO: 285753

SEQ ID NO: 311477 - RNA, 64 nt, hsa; identical to SEQ ID NO: 285754

SEQ ID NO: 311478 - RNA, 64 nt, hsa; identical to SEQ ID NO: 285755

SEQ ID NO: 311479 - RNA, 64 nt, hsa; identical to SEQ ID NO: 285756

SEQ ID NO: 311480 - RNA, 58 nt, hsa; identical to SEQ ID NO: 285757

SEQ ID NO: 311481 - RNA, 64 nt, hsa; identical to SEQ ID NO: 285758

SEQ ID NO: 311482 - RNA, 64 nt, hsa; identical to SEQ ID NO: 285759

SEQ ID NO: 311483 - RNA, 64 nt, hsa; identical to SEQ ID NO: 285760

SEQ ID NO: 311484 - RNA, 64 nt, hsa
uuuaauagccaugacuauaauuuaagccuaugagaagauagacuguuucguagggauauauuca

SEQ ID NO: 311485 - RNA, 64 nt, hsa
uucaucauauaucaucaucauuauuauggugguaaagauagaaucuuuuuucuuuuuugucauu

SEQ ID NO: 311486 - RNA, 64 nt, hsa
uaacuuuagauuugggauuuaaaaugccuauuguaagauagaauaauugugaggcuggauucac

SEQ ID NO: 311487 - RNA, 64 nt, hsa
uuauucuaauguaucccaaaccuaaucuuuuuaaaagauagaagauacuuuuaagacaacuugg

SEQ ID NO: 311488 - RNA, 64 nt, hsa
acuuggucuaucugcauuaggacccaugggccguggaggcuauggaggugguggcagugguggu

SEQ ID NO: 311489 - RNA, 64 nt, hsa
ggguaacuacggggaugaucgucgugguggcagaggaggcuaugaucgaggcggcuaccggggc

SEQ ID NO: 311490 - RNA, 64 nt, hsa
ugaguuccuccaguuaaauguggcuguagauguuggaggcuagggaggcuaguaaauaucaaaa

SEQ ID NO: 311491 - RNA, 64 nt, hsa
ccaguuaaauguggcuguagauguuggaggcuagggaggcuaguaaauaucaaaaggaaaaggg

SEQ ID NO: 311492 - RNA, 64 nt, hsa; identical to SEQ ID NO: 227821

SEQ ID NO: 311493 - RNA, 64 nt, hsa; identical to SEQ ID NO: 227822

SEQ ID NO: 311494 - RNA, 64 nt, hsa; identical to SEQ ID NO: 227823

SEQ ID NO: 311495 - RNA, 64 nt, hsa; identical to SEQ ID NO: 227824

SEQ ID NO: 311496 - RNA, 64 nt, hsa; identical to SEQ ID NO: 227825

SEQ ID NO: 311497 - RNA, 64 nt, hsa; identical to SEQ ID NO: 227826

SEQ ID NO: 311498 - RNA, 64 nt, hsa; identical to SEQ ID NO: 227827

SEQ ID NO: 311499 - RNA, 64 nt, hsa; identical to SEQ ID NO: 227828

SEQ ID NO: 311500 - RNA, 64 nt, hsa; identical to SEQ ID NO: 227829

SEQ ID NO: 311501 - RNA, 64 nt, hsa; identical to SEQ ID NO: 227830

SEQ ID NO: 311502 - RNA, 64 nt, hsa; identical to SEQ ID NO: 227831

SEQ ID NO: 311503 - RNA, 64 nt, hsa; identical to SEQ ID NO: 227832

SEQ ID NO: 311504 - RNA, 64 nt, hsa; identical to SEQ ID NO: 227833

SEQ ID NO: 311505 - RNA, 64 nt, hsa; identical to SEQ ID NO: 227834

SEQ ID NO: 311506 - RNA, 64 nt, hsa; identical to SEQ ID NO: 227835

SEQ ID NO: 311507 - RNA, 64 nt, hsa; identical to SEQ ID NO: 227836

SEQ ID NO: 311508 - RNA, 64 nt, hsa; identical to SEQ ID NO: 227837

SEQ ID NO: 311509 - RNA, 64 nt, hsa; identical to SEQ ID NO: 227838

SEQ ID NO: 311510 - RNA, 64 nt, hsa; identical to SEQ ID NO: 227839

SEQ ID NO: 311511 - RNA, 64 nt, hsa; identical to SEQ ID NO: 227840

SEQ ID NO: 311512 - RNA, 64 nt, hsa; identical to SEQ ID NO: 227841

SEQ ID NO: 311513 - RNA, 64 nt, hsa; identical to SEQ ID NO: 227842

SEQ ID NO: 311514 - RNA, 64 nt, hsa
aacuugacauucuggagagagacuaucuucuggaguugaguacaagcacagaaacaucuuuacg

SEQ ID NO: 311515 - RNA, 64 nt, hsa
cagcaaaggucuauagaaaaaggcuugcguguucguugaguaaucauuguuucauuuucauuuu

SEQ ID NO: 311516 - RNA, 64 nt, hsa
auaaaacacuauaggacauuuguuuucaaaagcaguugaguaacagcaacauaaaccacauuuu

SEQ ID NO: 311517 - RNA, 64 nt, hsa
gagguaaucuuucugcuguuuguuguccugcuugguugaguaccacaauuaaagauuaugcucc

SEQ ID NO: 311518 - RNA, 64 nt, hsa
ccaauagguuuuuauuccaacuccgagcacugugguugaguaacaucaccucaauuuuuuauua

SEQ ID NO: 311519 - RNA, 64 nt, hsa
gauucccaccccaaauaguaauaaaauuacuucuguugaguaaacuuuuuaugucaucguaaaa

SEQ ID NO: 311520 - RNA, 64 nt, hsa
gcagacaguggccuccccuuccccucccugccccaggacuuaaagagcaauaguuugccccuuu

SEQ ID NO: 311521 - RNA, 64 nt, hsa
acagaagcuauuaauacacgacagcauguggggaaggacuuauggugggccagguggaccucau

SEQ ID NO: 311522 - RNA, 64 nt, hsa
auuuauaauaaugauaggugauaggcccacaaggaggacuuacaauguggaacuuagucucuuu

SEQ ID NO: 311523 - RNA, 64 nt, hsa
gggacucccuauggcugaaggccuuaugagucaaaggacuuauagccaauugauuguucuaggc

SEQ ID NO: 311524 - RNA, 64 nt, hsa
uuaccuggugcucucaacaggacuuaacaucaacaggacuuaacacaggccucuuguuccuucc

SEQ ID NO: 311525 - RNA, 64 nt, hsa
aaggggugcagaguguuuaccuggugcucucaacaggacuuaacaucaacaggacuuaacacag

SEQ ID NO: 311526 - RNA, 64 nt, hsa
augaacuaaacauugccuugcuauauucaccaaaaggacuuaauucuuguuuuuuucccaguuu

SEQ ID NO: 311527 - RNA, 64 nt, hsa
augaacuaaacauugccuugcuauauucaccaaaaggacuuacuucuuguuuuuucccaguuuu

SEQ ID NO: 311528 - RNA, 64 nt, hsa
aaaaaacauuguguaucuauacauauggcucuugaggacuuagcuuucacuacacuacaggaua

SEQ ID NO: 311529 - RNA, 64 nt, hsa
uuuuuauuucauuuuuauuuuuguuaaugcaaacaggacuuaaaugaacuuugaucucuguuuu

SEQ ID NO: 311530 - RNA, 64 nt, hsa
caaaacuuuacugguuugagaagaauaaucaaaaaggacuuauaccaauaggacuuacuauugu

SEQ ID NO: 311531 - RNA, 64 nt, hsa
uugagaagaauaaucaaaaaggacuuauaccaauaggacuuacuauuguuuuuuaaggaucucc

SEQ ID NO: 311532 - RNA, 64 nt, hsa; identical to SEQ ID NO: 82704

SEQ ID NO: 311533 - RNA, 64 nt, hsa; identical to SEQ ID NO: 82705

SEQ ID NO: 311534 - RNA, 64 nt, hsa; identical to SEQ ID NO: 82706

SEQ ID NO: 311535 - RNA, 64 nt, hsa; identical to SEQ ID NO: 82707

SEQ ID NO: 311536 - RNA, 64 nt, hsa; identical to SEQ ID NO: 82708

SEQ ID NO: 311537 - RNA, 64 nt, hsa; identical to SEQ ID NO: 82709

SEQ ID NO: 311538 - RNA, 64 nt, hsa; identical to SEQ ID NO: 82710

SEQ ID NO: 311539 - RNA, 64 nt, hsa; identical to SEQ ID NO: 82711

SEQ ID NO: 311540 - RNA, 64 nt, hsa; identical to SEQ ID NO: 82712

SEQ ID NO: 311541 - RNA, 64 nt, hsa; identical to SEQ ID NO: 82713

SEQ ID NO: 311542 - RNA, 64 nt, hsa; identical to SEQ ID NO: 82714

SEQ ID NO: 311543 - RNA, 64 nt, hsa; identical to SEQ ID NO: 82715

SEQ ID NO: 311544 - RNA, 64 nt, hsa; identical to SEQ ID NO: 82716

SEQ ID NO: 311545 - RNA, 64 nt, hsa; identical to SEQ ID NO: 82717

SEQ ID NO: 311546 - RNA, 64 nt, hsa; identical to SEQ ID NO: 82718

SEQ ID NO: 311547 - RNA, 64 nt, hsa; identical to SEQ ID NO: 82719

SEQ ID NO: 311548 - RNA, 64 nt, hsa; identical to SEQ ID NO: 82720

SEQ ID NO: 311549 - RNA, 64 nt, hsa; identical to SEQ ID NO: 82721

SEQ ID NO: 311550 - RNA, 64 nt, hsa; identical to SEQ ID NO: 82722

SEQ ID NO: 311551 - RNA, 64 nt, hsa; identical to SEQ ID NO: 82723

SEQ ID NO: 311552 - RNA, 64 nt, hsa; identical to SEQ ID NO: 82724

SEQ ID NO: 311553 - RNA, 64 nt, hsa; identical to SEQ ID NO: 82725

SEQ ID NO: 311554 - RNA, 64 nt, hsa; identical to SEQ ID NO: 82726

SEQ ID NO: 311555 - RNA, 64 nt, hsa; identical to SEQ ID NO: 82727

SEQ ID NO: 311556 - RNA, 64 nt, hsa; identical to SEQ ID NO: 82728

SEQ ID NO: 311557 - RNA, 64 nt, hsa; identical to SEQ ID NO: 82729

SEQ ID NO: 311558 - RNA, 64 nt, hsa; identical to SEQ ID NO: 82730

SEQ ID NO: 311559 - RNA, 64 nt, hsa; identical to SEQ ID NO: 82731

SEQ ID NO: 311560 - RNA, 64 nt, hsa; identical to SEQ ID NO: 82732

SEQ ID NO: 311561 - RNA, 64 nt, hsa; identical to SEQ ID NO: 82733

SEQ ID NO: 311562 - RNA, 64 nt, hsa; identical to SEQ ID NO: 82734

SEQ ID NO: 311563 - RNA, 64 nt, hsa; identical to SEQ ID NO: 82735

SEQ ID NO: 311564 - RNA, 64 nt, hsa; identical to SEQ ID NO: 82736

SEQ ID NO: 311565 - RNA, 64 nt, hsa; identical to SEQ ID NO: 82737

SEQ ID NO: 311566 - RNA, 64 nt, hsa; identical to SEQ ID NO: 82738

SEQ ID NO: 311567 - RNA, 64 nt, hsa; identical to SEQ ID NO: 82739

SEQ ID NO: 311568 - RNA, 64 nt, hsa; identical to SEQ ID NO: 82740

SEQ ID NO: 311569 - RNA, 64 nt, hsa; identical to SEQ ID NO: 82741

SEQ ID NO: 311570 - RNA, 64 nt, hsa; identical to SEQ ID NO: 82742

SEQ ID NO: 311571 - RNA, 64 nt, hsa; identical to SEQ ID NO: 82743

SEQ ID NO: 311572 - RNA, 64 nt, hsa; identical to SEQ ID NO: 82744

SEQ ID NO: 311573 - RNA, 64 nt, hsa; identical to SEQ ID NO: 82745

SEQ ID NO: 311574 - RNA, 64 nt, hsa; identical to SEQ ID NO: 82746

SEQ ID NO: 311575 - RNA, 64 nt, hsa; identical to SEQ ID NO: 82747

SEQ ID NO: 311576 - RNA, 64 nt, hsa; identical to SEQ ID NO: 82748

SEQ ID NO: 311577 - RNA, 64 nt, hsa; identical to SEQ ID NO: 82749

SEQ ID NO: 311578 - RNA, 64 nt, hsa; identical to SEQ ID NO: 82750

SEQ ID NO: 311579 - RNA, 64 nt, hsa; identical to SEQ ID NO: 82751

SEQ ID NO: 311580 - RNA, 64 nt, hsa; identical to SEQ ID NO: 82752

SEQ ID NO: 311581 - RNA, 64 nt, hsa; identical to SEQ ID NO: 82753

SEQ ID NO: 311582 - RNA, 64 nt, hsa; identical to SEQ ID NO: 82754

SEQ ID NO: 311583 - RNA, 64 nt, hsa; identical to SEQ ID NO: 82755

SEQ ID NO: 311584 - RNA, 64 nt, hsa; identical to SEQ ID NO: 82756

SEQ ID NO: 311585 - RNA, 64 nt, hsa; identical to SEQ ID NO: 82757

SEQ ID NO: 311586 - RNA, 64 nt, hsa; identical to SEQ ID NO: 82758

SEQ ID NO: 311587 - RNA, 64 nt, hsa; identical to SEQ ID NO: 82759

SEQ ID NO: 311588 - RNA, 64 nt, hsa; identical to SEQ ID NO: 82760

SEQ ID NO: 311589 - RNA, 64 nt, hsa; identical to SEQ ID NO: 82761

SEQ ID NO: 311590 - RNA, 64 nt, hsa; identical to SEQ ID NO: 82762

SEQ ID NO: 311591 - RNA, 64 nt, hsa; identical to SEQ ID NO: 82763

SEQ ID NO: 311592 - RNA, 64 nt, hsa; identical to SEQ ID NO: 82764

SEQ ID NO: 311593 - RNA, 64 nt, hsa; identical to SEQ ID NO: 82765

SEQ ID NO: 311594 - RNA, 64 nt, hsa; identical to SEQ ID NO: 82766

SEQ ID NO: 311595 - RNA, 64 nt, hsa; identical to SEQ ID NO: 82767

SEQ ID NO: 311596 - RNA, 64 nt, hsa; identical to SEQ ID NO: 82768

SEQ ID NO: 311597 - RNA, 64 nt, hsa; identical to SEQ ID NO: 82769

SEQ ID NO: 311598 - RNA, 64 nt, hsa; identical to SEQ ID NO: 82770

SEQ ID NO: 311599 - RNA, 64 nt, hsa; identical to SEQ ID NO: 82771

SEQ ID NO: 311600 - RNA, 64 nt, hsa; identical to SEQ ID NO: 82772

SEQ ID NO: 311601 - RNA, 64 nt, hsa; identical to SEQ ID NO: 82773

SEQ ID NO: 311602 - RNA, 64 nt, hsa; identical to SEQ ID NO: 82774

SEQ ID NO: 311603 - RNA, 64 nt, hsa; identical to SEQ ID NO: 82775

SEQ ID NO: 311604 - RNA, 64 nt, hsa; identical to SEQ ID NO: 82776

SEQ ID NO: 311605 - RNA, 64 nt, hsa; identical to SEQ ID NO: 82777

SEQ ID NO: 311606 - RNA, 64 nt, hsa; identical to SEQ ID NO: 82778

SEQ ID NO: 311607 - RNA, 64 nt, hsa; identical to SEQ ID NO: 82779

SEQ ID NO: 311608 - RNA, 64 nt, hsa; identical to SEQ ID NO: 82780

SEQ ID NO: 311609 - RNA, 64 nt, hsa; identical to SEQ ID NO: 82781

SEQ ID NO: 311610 - RNA, 64 nt, hsa; identical to SEQ ID NO: 82782

SEQ ID NO: 311611 - RNA, 64 nt, hsa; identical to SEQ ID NO: 82783

SEQ ID NO: 311612 - RNA, 64 nt, hsa; identical to SEQ ID NO: 82784

SEQ ID NO: 311613 - RNA, 64 nt, hsa; identical to SEQ ID NO: 82785

SEQ ID NO: 311614 - RNA, 64 nt, hsa; identical to SEQ ID NO: 82786

SEQ ID NO: 311615 - RNA, 64 nt, hsa; identical to SEQ ID NO: 82787

SEQ ID NO: 311616 - RNA, 64 nt, hsa; identical to SEQ ID NO: 82788

SEQ ID NO: 311617 - RNA, 64 nt, hsa; identical to SEQ ID NO: 82789

SEQ ID NO: 311618 - RNA, 64 nt, hsa; identical to SEQ ID NO: 82790

SEQ ID NO: 311619 - RNA, 64 nt, hsa; identical to SEQ ID NO: 97587

SEQ ID NO: 311620 - RNA, 64 nt, hsa; identical to SEQ ID NO: 97588

SEQ ID NO: 311621 - RNA, 64 nt, hsa; identical to SEQ ID NO: 97589

SEQ ID NO: 311622 - RNA, 64 nt, hsa; identical to SEQ ID NO: 97590

SEQ ID NO: 311623 - RNA, 64 nt, hsa; identical to SEQ ID NO: 97591

SEQ ID NO: 311624 - RNA, 64 nt, hsa; identical to SEQ ID NO: 97592

SEQ ID NO: 311625 - RNA, 64 nt, hsa; identical to SEQ ID NO: 97593

SEQ ID NO: 311626 - RNA, 61 nt, hsa; identical to SEQ ID NO: 97594

SEQ ID NO: 311627 - RNA, 64 nt, hsa; identical to SEQ ID NO: 97595

SEQ ID NO: 311628 - RNA, 64 nt, hsa; identical to SEQ ID NO: 97596

SEQ ID NO: 311629 - RNA, 64 nt, hsa; identical to SEQ ID NO: 97597

SEQ ID NO: 311630 - RNA, 64 nt, hsa; identical to SEQ ID NO: 97598

SEQ ID NO: 311631 - RNA, 64 nt, hsa; identical to SEQ ID NO: 97599

SEQ ID NO: 311632 - RNA, 64 nt, hsa; identical to SEQ ID NO: 97600

SEQ ID NO: 311633 - RNA, 64 nt, hsa; identical to SEQ ID NO: 97601

SEQ ID NO: 311634 - RNA, 64 nt, hsa; identical to SEQ ID NO: 97602

SEQ ID NO: 311635 - RNA, 64 nt, hsa; identical to SEQ ID NO: 97603

SEQ ID NO: 311636 - RNA, 64 nt, hsa; identical to SEQ ID NO: 97604

SEQ ID NO: 311637 - RNA, 64 nt, hsa; identical to SEQ ID NO: 97605

SEQ ID NO: 311638 - RNA, 64 nt, hsa; identical to SEQ ID NO: 97606

SEQ ID NO: 311639 - RNA, 64 nt, hsa; identical to SEQ ID NO: 97607

SEQ ID NO: 311640 - RNA, 64 nt, hsa; identical to SEQ ID NO: 97608

SEQ ID NO: 311641 - RNA, 64 nt, hsa; identical to SEQ ID NO: 97609

SEQ ID NO: 311642 - RNA, 64 nt, hsa; identical to SEQ ID NO: 97610

SEQ ID NO: 311643 - RNA, 64 nt, hsa; identical to SEQ ID NO: 97611

SEQ ID NO: 311644 - RNA, 64 nt, hsa; identical to SEQ ID NO: 97612

SEQ ID NO: 311645 - RNA, 64 nt, hsa; identical to SEQ ID NO: 97613

SEQ ID NO: 311646 - RNA, 64 nt, hsa; identical to SEQ ID NO: 97614

SEQ ID NO: 311647 - RNA, 64 nt, hsa; identical to SEQ ID NO: 97615

SEQ ID NO: 311648 - RNA, 64 nt, hsa; identical to SEQ ID NO: 97616

SEQ ID NO: 311649 - RNA, 64 nt, hsa; identical to SEQ ID NO: 97617

SEQ ID NO: 311650 - RNA, 64 nt, hsa; identical to SEQ ID NO: 97618

SEQ ID NO: 311651 - RNA, 64 nt, hsa; identical to SEQ ID NO: 97619

SEQ ID NO: 311652 - RNA, 64 nt, hsa; identical to SEQ ID NO: 97620

SEQ ID NO: 311653 - RNA, 64 nt, hsa; identical to SEQ ID NO: 97621

SEQ ID NO: 311654 - RNA, 64 nt, hsa; identical to SEQ ID NO: 97622

SEQ ID NO: 311655 - RNA, 64 nt, hsa; identical to SEQ ID NO: 97623

SEQ ID NO: 311656 - RNA, 64 nt, hsa; identical to SEQ ID NO: 97624

SEQ ID NO: 311657 - RNA, 64 nt, hsa; identical to SEQ ID NO: 97625

SEQ ID NO: 311658 - RNA, 64 nt, hsa; identical to SEQ ID NO: 97626

SEQ ID NO: 311659 - RNA, 64 nt, hsa; identical to SEQ ID NO: 97627

SEQ ID NO: 311660 - RNA, 64 nt, hsa; identical to SEQ ID NO: 97628

SEQ ID NO: 311661 - RNA, 64 nt, hsa; identical to SEQ ID NO: 97629

SEQ ID NO: 311662 - RNA, 64 nt, hsa; identical to SEQ ID NO: 97630

SEQ ID NO: 311663 - RNA, 64 nt, hsa; identical to SEQ ID NO: 97631

SEQ ID NO: 311664 - RNA, 64 nt, hsa; identical to SEQ ID NO: 97632

SEQ ID NO: 311665 - RNA, 64 nt, hsa; identical to SEQ ID NO: 97633

SEQ ID NO: 311666 - RNA, 64 nt, hsa; identical to SEQ ID NO: 97634

SEQ ID NO: 311667 - RNA, 64 nt, hsa; identical to SEQ ID NO: 97635

SEQ ID NO: 311668 - RNA, 64 nt, hsa; identical to SEQ ID NO: 97636

SEQ ID NO: 311669 - RNA, 64 nt, hsa; identical to SEQ ID NO: 97637

SEQ ID NO: 311670 - RNA, 64 nt, hsa; identical to SEQ ID NO: 97638

SEQ ID NO: 311671 - RNA, 64 nt, hsa; identical to SEQ ID NO: 97639

SEQ ID NO: 311672 - RNA, 64 nt, hsa; identical to SEQ ID NO: 97640

SEQ ID NO: 311673 - RNA, 64 nt, hsa; identical to SEQ ID NO: 97641

SEQ ID NO: 311674 - RNA, 64 nt, hsa; identical to SEQ ID NO: 97642

SEQ ID NO: 311675 - RNA, 64 nt, hsa; identical to SEQ ID NO: 97643

SEQ ID NO: 311676 - RNA, 64 nt, hsa; identical to SEQ ID NO: 97644

SEQ ID NO: 311677 - RNA, 64 nt, hsa; identical to SEQ ID NO: 97645

SEQ ID NO: 311678 - RNA, 64 nt, hsa; identical to SEQ ID NO: 97646

SEQ ID NO: 311679 - RNA, 64 nt, hsa; identical to SEQ ID NO: 97647

SEQ ID NO: 311680 - RNA, 64 nt, hsa; identical to SEQ ID NO: 97648

SEQ ID NO: 311681 - RNA, 64 nt, hsa; identical to SEQ ID NO: 97649

SEQ ID NO: 311682 - RNA, 64 nt, hsa; identical to SEQ ID NO: 97650

SEQ ID NO: 311683 - RNA, 64 nt, hsa; identical to SEQ ID NO: 97651

SEQ ID NO: 311684 - RNA, 64 nt, hsa; identical to SEQ ID NO: 97652

SEQ ID NO: 311685 - RNA, 64 nt, hsa; identical to SEQ ID NO: 97653

SEQ ID NO: 311686 - RNA, 64 nt, hsa; identical to SEQ ID NO: 97654

SEQ ID NO: 311687 - RNA, 64 nt, hsa; identical to SEQ ID NO: 97655

SEQ ID NO: 311688 - RNA, 64 nt, hsa; identical to SEQ ID NO: 97656

SEQ ID NO: 311689 - RNA, 64 nt, hsa; identical to SEQ ID NO: 97657

SEQ ID NO: 311690 - RNA, 64 nt, hsa; identical to SEQ ID NO: 97658

SEQ ID NO: 311691 - RNA, 64 nt, hsa; identical to SEQ ID NO: 97659

SEQ ID NO: 311692 - RNA, 58 nt, hsa; identical to SEQ ID NO: 97660

SEQ ID NO: 311693 - RNA, 64 nt, hsa; identical to SEQ ID NO: 97661

SEQ ID NO: 311694 - RNA, 64 nt, hsa; identical to SEQ ID NO: 97662

SEQ ID NO: 311695 - RNA, 64 nt, hsa; identical to SEQ ID NO: 97663

SEQ ID NO: 311696 - RNA, 64 nt, hsa; identical to SEQ ID NO: 97664

SEQ ID NO: 311697 - RNA, 64 nt, hsa; identical to SEQ ID NO: 97665

SEQ ID NO: 311698 - RNA, 64 nt, hsa; identical to SEQ ID NO: 97666

SEQ ID NO: 311699 - RNA, 64 nt, hsa; identical to SEQ ID NO: 97667

SEQ ID NO: 311700 - RNA, 64 nt, hsa; identical to SEQ ID NO: 97668

SEQ ID NO: 311701 - RNA, 64 nt, hsa; identical to SEQ ID NO: 97669

SEQ ID NO: 311702 - RNA, 64 nt, hsa; identical to SEQ ID NO: 97670

SEQ ID NO: 311703 - RNA, 64 nt, hsa
agcaaccccaggauagcuaaguguuauguaauaugccuagaaggugaugugaaugcgauucaga

SEQ ID NO: 311704 - RNA, 64 nt, hsa
uuuguuuacuaugaaauuuuaaauacacauuuaugccuagaaggaacggacuuuuuuuuucuau

SEQ ID NO: 311705 - RNA, 64 nt, hsa
ccacaacagcucaaaucucagaauaggaucaaaggccuagaaagacuccuaaaguauaggauua

SEQ ID NO: 311706 - RNA, 64 nt, hsa
ggcuuaaauuuauuuuucaaagucaagaacauuagccuagaaguuuuugcuuugcuaguuaaag

SEQ ID NO: 311707 - RNA, 64 nt, hsa
cauguuauuuaaccugaguauaguauuuaacgaagccuagaagcacggcuguggguggugauuu

SEQ ID NO: 311708 - RNA, 64 nt, hsa
gaagguuucauaauugguucuacgacccuuuugagccuagaauuauuguucuuauauaagauca

SEQ ID NO: 311709 - RNA, 64 nt, hsa
cugcagacagaaaaugaaagaaaaaaauggacuugccuagaauaauauauugaaugccuuuuga

SEQ ID NO: 311710 - RNA, 64 nt, hsa
caaaggaggcacucguucucuuuucuugcuguaugccuagaaagugguugaaggauucuugaug

SEQ ID NO: 311711 - RNA, 64 nt, hsa
ggaaucagaaaaaccuguucccaucaccggccuagccuagaauccuagccuagaagcccucucu

SEQ ID NO: 311712 - RNA, 64 nt, hsa
ccuguucccaucaccggccuagccuagaauccuagccuagaagcccucucucccucugggcugg

SEQ ID NO: 311713 - RNA, 64 nt, hsa
ugauuguguggaaccaguauguagcaaauggaaagccuagaaauaucuuauuuucuaaguuuac

SEQ ID NO: 311714 - RNA, 64 nt, hsa
uugggucuuuacuucugggaauuuguauguaacagccuagaaaauuaaaaggagguggaugcau

SEQ ID NO: 311715 - RNA, 64 nt, hsa; identical to SEQ ID NO: 311713

SEQ ID NO: 311716 - RNA, 64 nt, hsa; identical to SEQ ID NO: 311714

SEQ ID NO: 311717 - RNA, 64 nt, hsa
uaaggccucacaggaugagucuccauucucuguaaaugcuuauuuuaucauagucuuuagccuc

SEQ ID NO: 311718 - RNA, 64 nt, hsa
aaacucaaaucuggcacguaggugcuucuuaguaaaugcuuaaugaaugccaccaacucugcaa

SEQ ID NO: 311719 - RNA, 64 nt, hsa
uagaacuaaaaaucuuaaaauacagccagugcuuaaugcuuauaucaauguggauuugucggcu

SEQ ID NO: 311720 - RNA, 64 nt, hsa
acaguuugauuuuuacuuuucuuucuaacauaucaaugcuuagcagaacuauucagauugucag

SEQ ID NO: 311721 - RNA, 64 nt, hsa
ccacaucuguggauucaaccaaccaaggacggaaaaugcuuaaaaaauaauacaacaacaacaa

SEQ ID NO: 311722 - RNA, 64 nt, hsa
aaaacaagucauuuuuguauuuuucaucuuuaagaaugcuuaaaaaagcuaaucccuaaaauag

SEQ ID NO: 311723 - RNA, 64 nt, hsa
agugcugggauuacagguacaaugauguauaauuaaugcuuagugaagcauaaaguuaccuaca

SEQ ID NO: 311724 - RNA, 64 nt, hsa
guacagaaaacauguauaaauauaagucuauacuaaugcuuacaacuuucuaagaggguucuug

SEQ ID NO: 311725 - RNA, 64 nt, hsa
auguauguauacuggcguacuuuauauucucuaaaaugcuuaaugccuuugaaauuuuguaauc

SEQ ID NO: 311726 - RNA, 64 nt, hsa
ugauuaaacaccucuuuuggguaugccuuuuaaaaaugcuuauagagaaaaaaaauuuuaaaaa

SEQ ID NO: 311727 - RNA, 64 nt, hsa
ccugucguuaaguguuguaacuucaaaaaaccaaaaugcuuauuuuaaugugauuuuucuaaaa

SEQ ID NO: 311728 - RNA, 64 nt, hsa
cugaggauuugggcauauuuuuuggaaggugccuaaugcuuaggauagucucuagggugaugca

SEQ ID NO: 311729 - RNA, 64 nt, hsa
uuaauuuaguuguguguguguguuaaaaggagcuaaugcuuauucuguuaauguaaacuuuuga

SEQ ID NO: 311730 - RNA, 64 nt, hsa
cuaugguaaacuaagcuaguuuaacacuugagcaaaugcuuaagaaggaauuaaaaaaaaaaag

SEQ ID NO: 311731 - RNA, 64 nt, hsa
uagaguagaguuauuuucugggagaguuacuacaaaugcuuauucucauugacuuauuucuuuc

SEQ ID NO: 311732 - RNA, 64 nt, hsa
ccuuagaagaaagauugugaaaagcuggggagaaaaugcuuaaggacaugcuaggggaaaaaaa

SEQ ID NO: 311733 - RNA, 64 nt, hsa
uaaaugguggcuguaacauaauaaauguuuaauaaaugcuuauaugaauggauuuuuagaauua

SEQ ID NO: 311734 - RNA, 64 nt, hsa
aaacauaauuugaaugggucuaugaaggaaaaauaaugcuuagacuuugguguagguucuuccu

SEQ ID NO: 311735 - RNA, 64 nt, hsa
cuugacauuggucuguuuugcugugaauauuggaaaugcuuaggaucuucagacccaauagcuc

SEQ ID NO: 311736 - RNA, 64 nt, hsa
uaccuuauuuuuauauaugacaaacuacuucuauaaugcuuauuaugguaaaauaaaauuggaa

SEQ ID NO: 311737 - RNA, 64 nt, hsa
guccuaggaucuagaauuagaucuuuguauuuuuaaugcuuaggggaagaauauaaguaucucc

SEQ ID NO: 311738 - RNA, 64 nt, hsa
auagaguggauauuaggauuaggaugcaaaaauaaaugcuuaaccaacacuacuacuguuagca

SEQ ID NO: 311739 - RNA, 64 nt, hsa
augauccuacuaauuauccugcuguucuuuaauuaaugcuuaaugaauaauauggcacuguaaa

SEQ ID NO: 311740 - RNA, 64 nt, hsa
cuuuuguuuuuccuuggaccuaaacagagaaaauaaugcuuauguaucugaagaaaaggucaga

SEQ ID NO: 311741 - RNA, 64 nt, hsa
ugucacccaucauuuugaagcauauagaacaacaaaugcuuacacaagacaauauccacacuuu

SEQ ID NO: 311742 - RNA, 64 nt, hsa
aaaaaauaugagcaccauugaauucugugcccuuaaugcuuaacuggucuucuuccucugguau

SEQ ID NO: 311743 - RNA, 64 nt, hsa
gaaagagaagucacaacaaaaggaagacuggagaaaugcuuacuucuagagggagaagacugug

SEQ ID NO: 311744 - RNA, 64 nt, hsa
uuuugaauucagaccuggaauguaaguaagugacaaugcuuauggaaagccaguuaguuagaau

SEQ ID NO: 311745 - RNA, 64 nt, hsa
ucuuugcugucaggugcauugugggcauaaggaaaucuguuacaagcugccauauuggccugcu

SEQ ID NO: 311746 - RNA, 64 nt, hsa
uuuuuguauuauugccaauuuguguuaccagacaaucuguuaauguaucuaauucgaaucagca

SEQ ID NO: 311747 - RNA, 64 nt, hsa
uuaugacauucagaaaucaugaaacacaguagauaucuguuauaaugugguguaucacauggau

SEQ ID NO: 311748 - RNA, 64 nt, hsa
uagauacuaagugaaacuuaguguaacaauuuugaucuguuaaauuggauuuuacauguacauu

SEQ ID NO: 311749 - RNA, 64 nt, hsa
gacaguuuuuuuuuuuuuuuuuuuuuggaacucaaucuguuaacagucugggacauccgguaua

SEQ ID NO: 311750 - RNA, 64 nt, hsa
gugcuaauucuuggaccuuuaauacagugugcuuaucuguuacggccuccuuuuaucucucuuc

SEQ ID NO: 311751 - RNA, 64 nt, hsa
uauuggauaugguaucuccuaaaguguaaaaaaaaucuguuacuauauagugauaaaccaucug

SEQ ID NO: 311752 - RNA, 64 nt, hsa
ucuacacuuaguuauugauaaacuucuuaaagagaucuguuauuuucagguagugccauaaucu

SEQ ID NO: 311753 - RNA, 64 nt, hsa
gcuccagugcuugccauaauuugucugagaaggaaucuguuaaauaaaagcuuuuauccucuaa

SEQ ID NO: 311754 - RNA, 64 nt, hsa
auuacugaauuaacaaugagaaagagagaaguguaucuguuacguggauauaugggccagccug

SEQ ID NO: 311755 - RNA, 64 nt, hsa
aaaucagaugccuauguaaggaaagugcuauucacccaguaaacccaaaaaaagcaaauggaua

SEQ ID NO: 311756 - RNA, 64 nt, hsa
ggugucccuaaagaccacuuccuaucugguuuuucccaguaaaugaggcaagcaauucuaagau

SEQ ID NO: 311757 - RNA, 64 nt, hsa
aaugggcugcaauuaggcagauaaagacaucagucccaguaaaugaauccauagacucaucuag

SEQ ID NO: 311758 - RNA, 64 nt, hsa
uagaggccucuugugacuggagguaacaacccugcccaguaacugugggagaaggggaucaaua

SEQ ID NO: 311759 - RNA, 64 nt, hsa
agucuccgguucagcuuccgacaccagaguggaacccaguaagcaccaucaggaaugaauuuca

SEQ ID NO: 311760 - RNA, 64 nt, hsa
gcaagagaggcccaaucucaacuguagacugugucccaguaagagagucacagcuucagguguu

SEQ ID NO: 311761 - RNA, 64 nt, hsa
cauuacacucacuccuguucccuuauucuucauucccaguaauucccuaccaaaugguggggac

SEQ ID NO: 311762 - RNA, 64 nt, hsa
cccaguuacaucaaacagugacuuccaguuauuccccaguaagucugagugguuccuucaagcu

SEQ ID NO: 311763 - RNA, 64 nt, hsa
gggguuuaggugugcagaagcuuuccuuucccuacccaguaaccaugugacuacuaacguggua

SEQ ID NO: 311764 - RNA, 64 nt, hsa
agaaaacagggaccuuauuauucauuacugcauccccaguaaugaaaguacuuagaaaauaauu

SEQ ID NO: 311765 - RNA, 64 nt, hsa
cugugcucuugaccugcuccgcccccuucccuggagggagcacccucuggacagacagaaccau

SEQ ID NO: 311766 - RNA, 64 nt, hsa
caggucagcguggccugauugucccaggaccugaagggagcaaggauggccucagggccuggug

SEQ ID NO: 311767 - RNA, 64 nt, hsa
cggacacaaaguccauccaggacccaggccgcagagggagcaggaagagaugcugauaguuuga

SEQ ID NO: 311768 - RNA, 64 nt, hsa
auaaaaaguuauauauaauuaucccuuuaauuaaagggagcaaaggggcguuccacauggacag

SEQ ID NO: 311769 - RNA, 64 nt, hsa
ggguuggcuuggggugaaaaguucugcccuccgcagggagcagcuccagcugccuggcagugcu

SEQ ID NO: 311770 - RNA, 64 nt, hsa
gucagggagagaaacccaaccccacugucaacauagggagcaucaccaacuccagacuggcucc

SEQ ID NO: 311771 - RNA, 64 nt, hsa
aauuucuaauggaaguuuguugugaauguaaaggagggagcauucuuugcuuuuuaauauacaa

SEQ ID NO: 311772 - RNA, 64 nt, hsa
agaugcccagggagacccaagaaagagucagguuagggagcagugaaagugaggagggaagaca

SEQ ID NO: 311773 - RNA, 64 nt, hsa
ugacuaggguccucaggcaguggcccagggaaucagggagcacuggaggccucugcaagauucu

SEQ ID NO: 311774 - RNA, 64 nt, hsa
aggggcagggccguagacucacggcugcaccugcagggagcagcacgccaaccccagcaguccu

SEQ ID NO: 311775 - RNA, 64 nt, hsa
cccgcguagccaggugggcccaagggugccuggcagggagcacuaccccuggaccccuccugcu

SEQ ID NO: 311776 - RNA, 64 nt, hsa
uggggaggugcaguggcacccccagagccaacagagggagcaggcagagggugggggaccuggc

SEQ ID NO: 311777 - RNA, 64 nt, hsa
gguaugaagcugcgcuccuccaucggguuuggggagggagcacucugggacugugagacaagga

SEQ ID NO: 311778 - RNA, 64 nt, hsa
gccaagcaaagagaagucucaguggagcaugaggagggagcaguccagaugccaacaaggaaau

SEQ ID NO: 311779 - RNA, 64 nt, hsa
uucccuccacuuccagguggugcugggcucaccgagggagcacuggugggugcucugaaaaccc

SEQ ID NO: 311780 - RNA, 64 nt, hsa
uuuaaagcagagacuauuuugguggauaggugggagggagcaaggggaguuugagggaaucaga

SEQ ID NO: 311781 - RNA, 64 nt, hsa
auaggaaggaaacuggaauucuuuguacuaauacagggagcacacuccuucaguucagcaagac

SEQ ID NO: 311782 - RNA, 64 nt, hsa
uaugacucucugcuaucccacuguauagauccacagggagcaaacacuuagaaaugauagagaa

SEQ ID NO: 311783 - RNA, 64 nt, hsa
cugucugacuacaacaugcaucaugcucauggggagggagcaggggaagguuguaugugucauu

SEQ ID NO: 311784 - RNA, 64 nt, hsa
aguuucuuugcuuacuuuuacugucuauauauauagggagcacuuuaaacuuaaugcagugggc

SEQ ID NO: 311785 - RNA, 64 nt, hsa
ccugagggcuugagggaggcuggggaaaaccagcagggagcacuuggcuccuggcagagggaga

SEQ ID NO: 311786 - RNA, 64 nt, hsa
uuccccugcaaggugcccaccugcccggagacagagggagcagcugaggccucucuccacuggc

SEQ ID NO: 311787 - RNA, 64 nt, hsa
accaaaaccugcggggcugcuuggaguggaaagcagggagcaguguucagaggcaaagcagccu

SEQ ID NO: 311788 - RNA, 64 nt, hsa
gcuucaccacccuggcuuauguggaacaccuaucagggagcagaaaaggggugcaguacacuaa

SEQ ID NO: 311789 - RNA, 64 nt, hsa
gcucaggcccccaucucugggguguuugggggucagggagcagggagcacuggccguggucuac

SEQ ID NO: 311790 - RNA, 64 nt, hsa
cccccaucucugggguguuugggggucagggagcagggagcacuggccguggucuacagcgugu

SEQ ID NO: 311791 - RNA, 64 nt, hsa
gcauccgugagcagugugucuccugcaugcagaaagggagcagagaaggccaggggcuuuugcu

SEQ ID NO: 311792 - RNA, 64 nt, hsa
guaucaaacagcucaggcuguuuuugggugcaagagggagcacgugacuguauuauacaugggu

SEQ ID NO: 311793 - RNA, 64 nt, hsa
guccaauuuucacacacgugagaaucccuggcaaagggagcagaacugaaccggcuuuaccaaa

SEQ ID NO: 311794 - RNA, 64 nt, hsa
ggagaaggaggggaaccagauguuagaucaggggagggagcaggagugucccucccgucagugc

SEQ ID NO: 311795 - RNA, 64 nt, hsa
ugcggauccgggaggaggagcgcuacccaccuccagggagcacccugcccaccaagaagcacug

SEQ ID NO: 311796 - RNA, 64 nt, hsa
ucacuggauugacuuugcugucaaaacuacugacagggagcagcccccgggccgcuggcuggug

SEQ ID NO: 311797 - RNA, 64 nt, hsa
cuucccaggucugacuuugucacccugccguuucagggagcagaaguccuucuggacaguguga

SEQ ID NO: 311798 - RNA, 64 nt, hsa
ugagaggguuucuuuuacuucaaaaucuuucuucagggagcaagacaugaacugacuaauuggu

SEQ ID NO: 311799 - RNA, 64 nt, hsa
gaggagggaggaggaauaaggggaaggaagagagagggagcaggcggagcgagagagggagaaa

SEQ ID NO: 311800 - RNA, 64 nt, hsa
gcgccuggccagagccgggguuccaggacagggaagggagcaggagccugcagucacuggcuug

SEQ ID NO: 311801 - RNA, 64 nt, hsa
uugccggcauguuuuggggguaaugaucgugggcagggagcagagguccgcugaggcagucugu

SEQ ID NO: 311802 - RNA, 64 nt, hsa
auaagagagggcuuauaaaucccucugccgacgcagggagcagagacuugccggcauguuuugg

SEQ ID NO: 311803 - RNA, 64 nt, hsa
gaacauugcucuucauuuuggccuguacuucucccucagggacguagaacaauggaaugucagu

SEQ ID NO: 311804 - RNA, 64 nt, hsa
cuuuuucuuuaaaauucaauuaagguacuucucccucagggacguagaacaauggaaugucagu

SEQ ID NO: 311805 - RNA, 64 nt, hsa
aaauauuagccacagaccaccuacaucacaauaacucagggagcuuauagaagugaagauuccu

SEQ ID NO: 311806 - RNA, 64 nt, hsa
gucuuaucagacgcccgucuuaaaguccagcaugcucagggacccuguguaggaucucguuugu

SEQ ID NO: 311807 - RNA, 64 nt, hsa
ucagggguuggucugagaggccugccauccaccccucagggagcuagguuuucucagaggcuca

SEQ ID NO: 311808 - RNA, 64 nt, hsa
aggccccugugcuccaggccgaggcugggcuacccucagggagauccagagacucaugcccaug

SEQ ID NO: 311809 - RNA, 64 nt, hsa
agaaguugucugugggugauguuacuguaguggucucagggaaaggauuguccaguuacuuuag

SEQ ID NO: 311810 - RNA, 64 nt, hsa
agggcaggaggagggggccgugccucccacccuucucagggacccccacgccuuuguuguuuga

SEQ ID NO: 311811 - RNA, 64 nt, hsa
cuaaugaguggucggaccguggggaagggccccacucagggaucucagaccuagugcucccuuc

SEQ ID NO: 311812 - RNA, 64 nt, hsa
gaggccgaugcauaaagucagccuguucaaagugcucagggacuuagcaaaaugagaagaugug

SEQ ID NO: 311813 - RNA, 64 nt, hsa
auacuguacuguguagugugucuccguaugucaucucagggagcuuaaaaugggcuugauuuaa

SEQ ID NO: 311814 - RNA, 64 nt, hsa
ucuuuccucggccgagucaggcuuccuggugagccucagggagugcauggucucagaugccauc

SEQ ID NO: 311815 - RNA, 64 nt, hsa
gcuccucuccagaguuuccggucaccuccguguucucagggagugcguggucuuggaugccauc

SEQ ID NO: 311816 - RNA, 64 nt, hsa
aaggguagggguauaagucuguuccaugcagucacucagggacccagucuccuuuugucuggug

SEQ ID NO: 311817 - RNA, 64 nt, hsa
ugagcaggucagcaggaacccuuuucugcagucacucagggacccagacuuacagaguggguag

SEQ ID NO: 311818 - RNA, 64 nt, hsa
gaaaagagagaucuacuuuggugguuucucaggucucagggaaggucuuuuauaaacucaaugg

SEQ ID NO: 311819 - RNA, 64 nt, hsa
cuuugggaagagcugcugagcucuuugccugccacucagggagugcaauuguucuuaaagagcc

SEQ ID NO: 311820 - RNA, 64 nt, hsa
gcuggccacccuggccucagcucccucaggacgccucagggaucucgcugcgcgguccuauacg

SEQ ID NO: 311821 - RNA, 64 nt, hsa
ccaauugauccucuacuuuccuucuuuagucccucucagggacgccuccauccccggcuccccu

SEQ ID NO: 311822 - RNA, 64 nt, hsa
gggcugggccugagauucugcauuucuaaggagucucagggaugccuaugcugcuggccuaaaa

SEQ ID NO: 311823 - RNA, 64 nt, hsa
cuaaaaucugaguuuugcccagugugacaucaaacucagggaagaggaagcuaaagugacgagu

SEQ ID NO: 311824 - RNA, 64 nt, hsa
aggaugacucagcacugccgcucaacagacaugacucagggauggcuuaguacugccccucagc

SEQ ID NO: 311825 - RNA, 64 nt, hsa
aggaugacucagcacugccgcucaacagggaugacucagggauggcuuaguacugccccucaac

SEQ ID NO: 311826 - RNA, 64 nt, hsa; identical to SEQ ID NO: 311824

SEQ ID NO: 311827 - RNA, 64 nt, hsa; identical to SEQ ID NO: 311824

SEQ ID NO: 311828 - RNA, 64 nt, hsa
agccccucagccauccagggcuacccacugcuuacucagggaccaggcagcccccauggcagua

SEQ ID NO: 311829 - RNA, 64 nt, hsa
ccucccccuacuucuccccaagggccaagaacugcucagggacauuaaaggucaaaaguccagc

SEQ ID NO: 311830 - RNA, 64 nt, hsa
cauaaggagcgugggauccgauggaaagguggagcucagggaaaauggggguccuugccucucg

SEQ ID NO: 311831 - RNA, 64 nt, hsa
acucagaggggagggaagggcucaucagcacccgcucagggagccugucccuuuauguucccaa

SEQ ID NO: 311832 - RNA, 64 nt, hsa
cacccccaggcuucaaaccaccuggaaugcacagcucagggaagcugguggaugccuagaggcu

SEQ ID NO: 311833 - RNA, 64 nt, hsa
gaaggacagggaacucuccauuauuggggcaggacucagggaggacacuuggggccaugugucu

SEQ ID NO: 311834 - RNA, 64 nt, hsa
gcccaucugucagcagcgucuucuagguccccagcucagggagccauccccagcuccaguuuuc

SEQ ID NO: 311835 - RNA, 64 nt, hsa
acaucuuucuucuuaguuuacagugaaauauuaucucagggauauuuuuuuuuuuuuuuugaga

SEQ ID NO: 311836 - RNA, 64 nt, hsa
gggauuacaggcgugagccaccgcgcccggccaucucagggauauuuaaacaaaggaagaggaa

SEQ ID NO: 311837 - RNA, 64 nt, hsa
auauuugguaaguuuuguacauauauuauguacacucagggaaccaauaccauaaucaugauaa

SEQ ID NO: 311838 - RNA, 64 nt, hsa
gcucuccaaagaguguguccaccacuccacugugcucagggaaggcagaccucuccucucucuu

SEQ ID NO: 311839 - RNA, 64 nt, hsa
cagacacccagaguuggagacagaacaacagagucucagggaaagagaaccacaauagaaaaag

SEQ ID NO: 311840 - RNA, 64 nt, hsa
gagagacagagacccaaagggagagaaacagagacucagggagagggagacaaugaccuggagg

SEQ ID NO: 311841 - RNA, 64 nt, hsa
auuacauccucccauggaggaugagagacugaggcucagggagggcaaggaauaggcccaagau

SEQ ID NO: 311842 - RNA, 64 nt, hsa
auggugguauggcugaacaaggagcggcagacaacucagggagaaacucaggagugcaguacca

SEQ ID NO: 311843 - RNA, 64 nt, hsa
gccaaucagaucaacucugucuugggcguuugaacucagggagggaggcccuugggagcaggug

SEQ ID NO: 311844 - RNA, 64 nt, hsa
acugcccccuccacuggaggggucuccucugcagcucagggacuggcacacuggccuccagaag

SEQ ID NO: 311845 - RNA, 64 nt, hsa
uccaaacauuguaagaauugcuugguagcauaagcucagggauaaggugggaauugaguucaaa

SEQ ID NO: 311846 - RNA, 64 nt, hsa
aauaauuuuuaaucugcagacccacgaaaagggucucagggacuccuccaggggucuucagacc

SEQ ID NO: 311847 - RNA, 64 nt, hsa
guuaucaaguguuucugcaugguaaugucauguaaaugcugauauugauuucacugguccaucu

SEQ ID NO: 311848 - RNA, 64 nt, hsa
gaauggaauuuccuaugcacuacuguagcuaggaaaugcugaaaacaacuguguuuuuuaauua

SEQ ID NO: 311849 - RNA, 64 nt, hsa
aaucuaggugaaaucacagaguacaaaacgugagaaugcugaauguguaaaguugcagagggau

SEQ ID NO: 311850 - RNA, 64 nt, hsa
agugaacagagcugggauuccaugcgacagcuugaaugcugaccuucagacaugagacauaggg

SEQ ID NO: 311851 - RNA, 64 nt, hsa
augcccugaccuccaauaaaaaccucuuuaaaacaaugcugauuuuugaauucaugauuaguuu

SEQ ID NO: 311852 - RNA, 64 nt, hsa
gaauuacccugucaugaagcguuuaaauuguuaaaaugcugauuuucuuauuaguuuguuaauu

SEQ ID NO: 311853 - RNA, 64 nt, hsa
ucauauguaauugaaauacuucagaucacaugaaaaugcugauuuaacauuuaaguaucacagc

SEQ ID NO: 311854 - RNA, 64 nt, hsa
ccagaucugugaaugauagagauuaugcuaaauuaaugcugauucuuugugugugugggaaauc

SEQ ID NO: 311855 - RNA, 64 nt, hsa
gcucuagauuuucugaagaaaauggauuguguaaaaugcugaucauuuguuuauuaaaaugugu

SEQ ID NO: 311856 - RNA, 64 nt, hsa
acuucaucugaaaguucagcuguuuucaaacugcaaugcugaaauguuaugcaaauaaugaagu

SEQ ID NO: 311857 - RNA, 64 nt, hsa
auggugcuaaaccugacaaauaagagaucauugaaaugcugaaaauuuuaacagucuucuuaaa

SEQ ID NO: 311858 - RNA, 64 nt, hsa
uugucuccaccagauaguauuuuucuguaaaugaaaugcugacuucgccucuuccugcuguaug

SEQ ID NO: 311859 - RNA, 64 nt, hsa
auaaauaaaagucagaaucuuugcuggucccuuuaaugcugauuugauaguaaaucaauuucag

SEQ ID NO: 311860 - RNA, 64 nt, hsa
gggcucaagccaucugccugccuccaccucccaaaaugcugagauuacaggugugagccaccau

SEQ ID NO: 311861 - RNA, 64 nt, hsa
uguuauucugaagugagaggaccaaguauaguaaaaugcugacaucuaaaacuaaauaaauaga

SEQ ID NO: 311862 - RNA, 64 nt, hsa
gagaaugaagacuacuuaguaauucccaucaggaaaugcugaccuuuuacauaaaaucaaggag

SEQ ID NO: 311863 - RNA, 64 nt, hsa
auuacuuauuaucuuggauuuaugguguuauuaaaaugcugaccauauuuccuucauccucuug

SEQ ID NO: 311864 - RNA, 64 nt, hsa
aaacaaugaaaacucaauucuauuuacaaguauaaaugcugaguaugucuguugaagacgagca

SEQ ID NO: 311865 - RNA, 64 nt, hsa
uaggguuuaugcuuaauuuuaauuggaggaaaugaaugcugauuguaacggaguuaauuuuauu

SEQ ID NO: 311866 - RNA, 64 nt, hsa
aaaacaacccagcgaaggcgccuucucugaaaacaaugcugagaaugagagcggcggagacaag

SEQ ID NO: 311867 - RNA, 64 nt, hsa
acuaaaguugaauaaaaugcaugaacaauagaaaaaugcugaacauuauuuuggaugcuagcug

SEQ ID NO: 311868 - RNA, 64 nt, hsa
cuauuacagagcuauguaaagggacuuaggagaaaaugcugaauguaagauggucccauuucaa

SEQ ID NO: 311869 - RNA, 64 nt, hsa
gcauguaccauuugcauggcuccagaaaugucuaaaugcugaaaaaacaccuagcuuuauucuu

SEQ ID NO: 311870 - RNA, 64 nt, hsa
guuggaugagaguaaaaaaauuauaugcugcauaaaugcugaugcaaaaggauuuuucaacaca

SEQ ID NO: 311871 - RNA, 64 nt, hsa
ucuuccuuugaccagauggaagucguuacaucagaaugcugaugacugcaaaaucuuggacaua

SEQ ID NO: 311872 - RNA, 64 nt, hsa
ggucugaugugccuaauuuaucuguggaaaauuuaaugcugaauuacauuugguugggaaaugu

SEQ ID NO: 311873 - RNA, 64 nt, hsa
uauaaaaguaucuauauaauaucuauaaacuguuaaugcugagguauagucugugaauuaugug

SEQ ID NO: 311874 - RNA, 64 nt, hsa
agaagagaaacuagaaacaguuaaagugucuaauaaugcugaagaccccaaagaucucauguua

SEQ ID NO: 311875 - RNA, 64 nt, hsa
gcggacucccagcacagaaaaaaagguagaucugaaugcugauccccugugugagagaaaagaa

SEQ ID NO: 311876 - RNA, 64 nt, hsa; identical to SEQ ID NO: 276332

SEQ ID NO: 311877 - RNA, 64 nt, hsa; identical to SEQ ID NO: 276333

SEQ ID NO: 311878 - RNA, 64 nt, hsa; identical to SEQ ID NO: 276334

SEQ ID NO: 311879 - RNA, 64 nt, hsa; identical to SEQ ID NO: 276335

SEQ ID NO: 311880 - RNA, 64 nt, hsa; identical to SEQ ID NO: 276336

SEQ ID NO: 311881 - RNA, 64 nt, hsa; identical to SEQ ID NO: 276337

SEQ ID NO: 311882 - RNA, 64 nt, hsa; identical to SEQ ID NO: 276338

SEQ ID NO: 311883 - RNA, 64 nt, hsa; identical to SEQ ID NO: 276339

SEQ ID NO: 311884 - RNA, 64 nt, hsa; identical to SEQ ID NO: 276340

SEQ ID NO: 311885 - RNA, 64 nt, hsa; identical to SEQ ID NO: 276341

SEQ ID NO: 311886 - RNA, 64 nt, hsa; identical to SEQ ID NO: 276342

SEQ ID NO: 311887 - RNA, 64 nt, hsa; identical to SEQ ID NO: 276343

SEQ ID NO: 311888 - RNA, 64 nt, hsa; identical to SEQ ID NO: 276344

SEQ ID NO: 311889 - RNA, 64 nt, hsa; identical to SEQ ID NO: 276345

SEQ ID NO: 311890 - RNA, 64 nt, hsa; identical to SEQ ID NO: 276346

SEQ ID NO: 311891 - RNA, 64 nt, hsa; identical to SEQ ID NO: 276347

SEQ ID NO: 311892 - RNA, 64 nt, hsa; identical to SEQ ID NO: 276348

SEQ ID NO: 311893 - RNA, 64 nt, hsa; identical to SEQ ID NO: 276349

SEQ ID NO: 311894 - RNA, 64 nt, hsa; identical to SEQ ID NO: 276350

SEQ ID NO: 311895 - RNA, 64 nt, hsa; identical to SEQ ID NO: 276351

SEQ ID NO: 311896 - RNA, 64 nt, hsa; identical to SEQ ID NO: 276352

SEQ ID NO: 311897 - RNA, 64 nt, hsa; identical to SEQ ID NO: 276353

SEQ ID NO: 311898 - RNA, 64 nt, hsa; identical to SEQ ID NO: 276354

SEQ ID NO: 311899 - RNA, 64 nt, hsa; identical to SEQ ID NO: 276355

SEQ ID NO: 311900 - RNA, 64 nt, hsa; identical to SEQ ID NO: 276356

SEQ ID NO: 311901 - RNA, 64 nt, hsa; identical to SEQ ID NO: 276357

SEQ ID NO: 311902 - RNA, 64 nt, hsa; identical to SEQ ID NO: 276358

SEQ ID NO: 311903 - RNA, 64 nt, hsa; identical to SEQ ID NO: 276359

SEQ ID NO: 311904 - RNA, 64 nt, hsa
cauuucuuuucuggccaaaagcaguaaauuugcuagcaguaaaagaugaaguuuuauacacaca

SEQ ID NO: 311905 - RNA, 64 nt, hsa
accccauguccucagcauuucuuuucuggccaaaagcaguaaauuugcuagcaguaaaagauga

SEQ ID NO: 311906 - RNA, 64 nt, hsa
gauuucuuuccuaaagucccuagugacaugauugagcaguaaagaacggccaaaucacacaguc

SEQ ID NO: 311907 - RNA, 64 nt, hsa
aucugucacugaaggagguggagcucccacagccagcaguaaucagggagcugagagccugguu

SEQ ID NO: 311908 - RNA, 64 nt, hsa
ucacaaguucuuuccaguuuccaagucuuuuccuagcaguaauuuaggggagacagaggaguuu

SEQ ID NO: 311909 - RNA, 64 nt, hsa
gcuuccuuacagucuggaacugacaauaugcaggagcaguaaacuggcagaaaaccaggaauca

SEQ ID NO: 311910 - RNA, 64 nt, hsa; identical to SEQ ID NO: 289244

SEQ ID NO: 311911 - RNA, 64 nt, hsa; identical to SEQ ID NO: 289245

SEQ ID NO: 311912 - RNA, 64 nt, hsa; identical to SEQ ID NO: 289246

SEQ ID NO: 311913 - RNA, 64 nt, hsa; identical to SEQ ID NO: 289247

SEQ ID NO: 311914 - RNA, 64 nt, hsa; identical to SEQ ID NO: 289248

SEQ ID NO: 311915 - RNA, 64 nt, hsa; identical to SEQ ID NO: 289249

SEQ ID NO: 311916 - RNA, 64 nt, hsa; identical to SEQ ID NO: 289250

SEQ ID NO: 311917 - RNA, 64 nt, hsa; identical to SEQ ID NO: 289251

SEQ ID NO: 311918 - RNA, 64 nt, hsa; identical to SEQ ID NO: 289252

SEQ ID NO: 311919 - RNA, 64 nt, hsa; identical to SEQ ID NO: 289253

SEQ ID NO: 311920 - RNA, 64 nt, hsa; identical to SEQ ID NO: 289254

SEQ ID NO: 311921 - RNA, 64 nt, hsa; identical to SEQ ID NO: 289255

SEQ ID NO: 311922 - RNA, 64 nt, hsa; identical to SEQ ID NO: 289256

SEQ ID NO: 311923 - RNA, 64 nt, hsa; identical to SEQ ID NO: 289257

SEQ ID NO: 311924 - RNA, 64 nt, hsa; identical to SEQ ID NO: 289258

SEQ ID NO: 311925 - RNA, 64 nt, hsa; identical to SEQ ID NO: 289259

SEQ ID NO: 311926 - RNA, 64 nt, hsa; identical to SEQ ID NO: 289260

SEQ ID NO: 311927 - RNA, 64 nt, hsa; identical to SEQ ID NO: 289261

SEQ ID NO: 311928 - RNA, 64 nt, hsa; identical to SEQ ID NO: 289262

SEQ ID NO: 311929 - RNA, 64 nt, hsa; identical to SEQ ID NO: 289263

SEQ ID NO: 311930 - RNA, 64 nt, hsa
uaucuggaucuguguauuugauuuuguacuuuaaaugugacaaauaaaccuuuugggagaaaac

SEQ ID NO: 311931 - RNA, 64 nt, hsa
aguguauaguguauauauaaccuuuccuauggaaaugugacauugaguacauuuuguguugcug

SEQ ID NO: 311932 - RNA, 64 nt, hsa
cuaacucuaagccuauuuuauuuuuuauaaaacuaugugacauuuugguugagcagaauguacg

SEQ ID NO: 311933 - RNA, 64 nt, hsa
auuuggugccugugagcucugauuguaggaaugcaugugacagucccaguccuaugguaaugac

SEQ ID NO: 311934 - RNA, 64 nt, hsa
gggagaguggccaguuggaagaaggauccuaaggaugugacacugguuuucaacaacaugcuua

SEQ ID NO: 311935 - RNA, 64 nt, hsa
auagcucauuuuauucuaggucuuucaaacuuucaugugacauauuucccuuucccauuguugc

SEQ ID NO: 311936 - RNA, 64 nt, hsa
ucauuuauuuuguaccucauucacaugaauaguaaugugacaaacuaaaguuaauacaugaagc

SEQ ID NO: 311937 - RNA, 64 nt, hsa
guauauucauucauuuaguugucauauuggcuuuaugugacauaacugucauuauaccaguguu

SEQ ID NO: 311938 - RNA, 64 nt, hsa
auuauuuauuaccuuuccauuuguucgccugaugaugugacaaugcauggucuuugugcaugcu

SEQ ID NO: 311939 - RNA, 64 nt, hsa
uauguacuucuggcaauucuaucuguauuuaaagaugugacaaucuugacaccaauuuuaagaa

SEQ ID NO: 311940 - RNA, 64 nt, hsa
guugauuucccucauuguguaaacauugacagguaugugacaaaugggaaaaaaaauccaaaua

SEQ ID NO: 311941 - RNA, 64 nt, hsa
ggcgagaggugagcuacuuugugagccaaagcuuaugugacaugguuggggaaacaguccaaac

SEQ ID NO: 311942 - RNA, 64 nt, hsa
ugugugcauacgccucuuguucaugucagcuuauaugugacacugcagcagaaaggcucugaag

SEQ ID NO: 311943 - RNA, 64 nt, hsa
gcgagcagcugcacugcucaugcaguuagcuagcaugugacaucaugugacaaaguucauguaa

SEQ ID NO: 311944 - RNA, 64 nt, hsa
gcacugcucaugcaguuagcuagcaugugacaucaugugacaaaguucauguaauuagauggaa

SEQ ID NO: 311945 - RNA, 64 nt, hsa
caacgaaagcuacucucuuaguuauguucuugugaugugacaaaaugucaagaagauaggagaa

SEQ ID NO: 311946 - RNA, 64 nt, hsa
uuucaugauuuuauaucucuuaaaauggugauggaugugacaccucauaaaagugagcuuugaa

SEQ ID NO: 311947 - RNA, 64 nt, hsa
uucauacugaaaagaaacucuacaaacuugaaagaugugacagugcuuuugacaacaccuaaaa

SEQ ID NO: 311948 - RNA, 64 nt, hsa
aucauacuggugagaaauccuagaaauguaaagaaugugacaaggccuuuaaaugguugucaca

SEQ ID NO: 311949 - RNA, 64 nt, hsa
uucauaccauagagaaauccuacaaauaugaagaaugugacaaagcuuuuaaccacuucucaac

SEQ ID NO: 311950 - RNA, 64 nt, hsa
uucauacaggagagaaacccuacaaaugugaagaaugugacaaagccuuuaaccaguccucaau

SEQ ID NO: 311951 - RNA, 64 nt, hsa
uucuuacugcagagaaacucuacaaaccaguaagaugugacagugcuucugacaacaucucaaa

SEQ ID NO: 311952 - RNA, 64 nt, hsa
aucauaugaaugagaaauccuagaaaugugaagaaugugacaaagccuuuaaauggcugucaca

SEQ ID NO: 311953 - RNA, 64 nt, hsa
aauucauacaugagagacucuacaaaccugaaagaugugacaaugcuuuuggcaacaccucaga

SEQ ID NO: 311954 - RNA, 64 nt, hsa
uucaugcuggagagaaacacuacaaacgugaagaaugugacaaaggcuucaaccgguccucaaa

SEQ ID NO: 311955 - RNA, 64 nt, hsa
gaauccauaaugagagaucuuacaaguguaauaaaugugacagauuuuucagauaucguucaua

SEQ ID NO: 311956 - RNA, 64 nt, hsa
uucauacugcagagaaacuuuacaaauaggaagaaugugacaaaguuuucgguugcaaaucaaa

SEQ ID NO: 311957 - RNA, 64 nt, hsa
uucauacugcauagaaaucuuacaaacgugaacaaugugacaaaguuuucauucacaaauccag

SEQ ID NO: 311958 - RNA, 64 nt, hsa
uucauaguggagagaaaccuuacaagcacaaugaaugugacaugguuuuuaaucaacaaucaca

SEQ ID NO: 311959 - RNA, 64 nt, hsa
uucauacuggagagaaaccuuacaaaugggaggaaugugacaaaaguuuucaguuguaaaucaa

SEQ ID NO: 311960 - RNA, 64 nt, hsa
cccuuuccucacugaaggcugugaguugcuuucaaugugacaacacuaugaugucauuuggaag

SEQ ID NO: 311961 - RNA, 64 nt, hsa
ugucucaugaaggaucacagaguucagggggaaaaugugacagcacacgcacaaacgccuucac

SEQ ID NO: 311962 - RNA, 64 nt, hsa
cacuacccuuccaugccccagaccucugucuugcaugugacaauugacaaucuggacuacccca

SEQ ID NO: 311963 - RNA, 64 nt, hsa
aaaagcaaaacaaaauggaaaguaggggagguggaugugacaacaacuuccaaauuggcucuuu

SEQ ID NO: 311964 - RNA, 64 nt, hsa; identical to SEQ ID NO: 255986

SEQ ID NO: 311965 - RNA, 64 nt, hsa; identical to SEQ ID NO: 255987

SEQ ID NO: 311966 - RNA, 64 nt, hsa; identical to SEQ ID NO: 255988

SEQ ID NO: 311967 - RNA, 64 nt, hsa; identical to SEQ ID NO: 255989

SEQ ID NO: 311968 - RNA, 64 nt, hsa; identical to SEQ ID NO: 255990

SEQ ID NO: 311969 - RNA, 64 nt, hsa; identical to SEQ ID NO: 255991

SEQ ID NO: 311970 - RNA, 64 nt, hsa; identical to SEQ ID NO: 255992

SEQ ID NO: 311971 - RNA, 64 nt, hsa; identical to SEQ ID NO: 255993

SEQ ID NO: 311972 - RNA, 64 nt, hsa; identical to SEQ ID NO: 255994

SEQ ID NO: 311973 - RNA, 64 nt, hsa; identical to SEQ ID NO: 255995

SEQ ID NO: 311974 - RNA, 64 nt, hsa; identical to SEQ ID NO: 266128

SEQ ID NO: 311975 - RNA, 64 nt, hsa; identical to SEQ ID NO: 266129

SEQ ID NO: 311976 - RNA, 64 nt, hsa; identical to SEQ ID NO: 266130

SEQ ID NO: 311977 - RNA, 64 nt, hsa; identical to SEQ ID NO: 266131

SEQ ID NO: 311978 - RNA, 64 nt, hsa; identical to SEQ ID NO: 266132

SEQ ID NO: 311979 - RNA, 64 nt, hsa; identical to SEQ ID NO: 266133

SEQ ID NO: 311980 - RNA, 64 nt, hsa; identical to SEQ ID NO: 266134

SEQ ID NO: 311981 - RNA, 64 nt, hsa
ucucccguaugagauuucagguccccauguuuucaccaagcaaucugcuaugucagccaaccca

SEQ ID NO: 311982 - RNA, 64 nt, hsa
aauaaaaggaagccauagaauugcucuggucaaaaccaagcacaccauagccuuaacugaauau

SEQ ID NO: 311983 - RNA, 64 nt, hsa
ucuugucauuuggagucaguggaaaauccagcacaccaagcaccagucuucuucugaggcaaaa

SEQ ID NO: 311984 - RNA, 64 nt, hsa
gccaugaaagguaaacacauugugaacugaacuuaccaagcagauucugugagaaagcacuggu

SEQ ID NO: 311985 - RNA, 64 nt, hsa
uacuuaauucaacuuaacuaucaucuuauucagcaccaagcaugucccaggcacuguacuaacc

SEQ ID NO: 311986 - RNA, 64 nt, hsa
cugauguacucuaaauacugagaaaaccuguucuaccaagcaacaacuccgcaggcaguuacca

SEQ ID NO: 311987 - RNA, 64 nt, hsa
acuuugugaaacuggauggaacaaacuuuaacuuaccaagcaccaagugugaaagugacuuuca

SEQ ID NO: 311988 - RNA, 64 nt, hsa
uuaauauagguuuucuuucuguauuauaaaaugcaccaagcaauuaugguggaccuauuacccu

SEQ ID NO: 311989 - RNA, 64 nt, hsa
guggacccaguucuauuguuggcuucagcgguggaccaagcacugguguuggcuucugcagugg

SEQ ID NO: 311990 - RNA, 64 nt, hsa
guggaccaagcacugguguuggcuucugcaguggaccaagcaccaguggcuucagcgguggacc

SEQ ID NO: 311991 - RNA, 64 nt, hsa
gaaauccuuuuaauuuuuaauccauagcuuacugcuugugcagucaccugccucuugagguugc

SEQ ID NO: 311992 - RNA, 64 nt, hsa
cacuguugcuuaccugcugauuuucuuaacuguucuugugcaaucgacaaugugcuaaccugcu

SEQ ID NO: 311993 - RNA, 64 nt, hsa
uuuaaaauuuccaccuuuuggucuuguuuuuaaucuugugcaugauaccccauguaaaauccac

SEQ ID NO: 311994 - RNA, 64 nt, hsa
uaaucuugugcaugauaccccauguaaaauccaccuugugcaagauuucuuggacagaugugug

SEQ ID NO: 311995 - RNA, 64 nt, hsa
cacauugaaauugguggcuucauucuagauguagcuugugcagauguagcaggaaaauaggaaa

SEQ ID NO: 311996 - RNA, 64 nt, hsa
gccaugaggucuucaauacuguuuuaccccaucccuugugcauauuuccagggagaaggaaagc

SEQ ID NO: 311997 - RNA, 64 nt, hsa; identical to SEQ ID NO: 53673

SEQ ID NO: 311998 - RNA, 64 nt, hsa; identical to SEQ ID NO: 53674

SEQ ID NO: 311999 - RNA, 64 nt, hsa; identical to SEQ ID NO: 53675

SEQ ID NO: 312000 - RNA, 64 nt, hsa; identical to SEQ ID NO: 53676

SEQ ID NO: 312001 - RNA, 64 nt, hsa; identical to SEQ ID NO: 53677

SEQ ID NO: 312002 - RNA, 64 nt, hsa; identical to SEQ ID NO: 53678

SEQ ID NO: 312003 - RNA, 64 nt, hsa; identical to SEQ ID NO: 53679

SEQ ID NO: 312004 - RNA, 64 nt, hsa; identical to SEQ ID NO: 53680

SEQ ID NO: 312005 - RNA, 64 nt, hsa; identical to SEQ ID NO: 53681

SEQ ID NO: 312006 - RNA, 64 nt, hsa; identical to SEQ ID NO: 53682

SEQ ID NO: 312007 - RNA, 64 nt, hsa; identical to SEQ ID NO: 53683

SEQ ID NO: 312008 - RNA, 64 nt, hsa; identical to SEQ ID NO: 53684

SEQ ID NO: 312009 - RNA, 64 nt, hsa
caagaaaaaccccaccauaacccaaggcaaacaauguauugacaggauuccaauaauuaagaau

SEQ ID NO: 312010 - RNA, 64 nt, hsa
uaccuuucacuugaaaaagaaguauaaaaacaacuguauugaguugaggcuguggagaaauaag

SEQ ID NO: 312011 - RNA, 64 nt, hsa
uaaaguguaagugcuuucuuuugucccuaacuuguguauugauggcaguccacucuguuuucua

SEQ ID NO: 312012 - RNA, 64 nt, hsa
uauucauaauguuauuuaagugucauugauguacuguauugacuugggguuugcuuauuuguua

SEQ ID NO: 312013 - RNA, 64 nt, hsa
aaaagauuuagaagugcaugugcuuuggaggauuuguauugagcuuuuacaguauucauuuuuc

SEQ ID NO: 312014 - RNA, 64 nt, hsa
aguuuagugaugucuuggugaacugugagugaacuguauugauuuuucuaaucuuuagagaccu

SEQ ID NO: 312015 - RNA, 64 nt, hsa
uaaacuggacuagaauagugcauuguauuuagucuguauugaucauggaugcccuccuuaauag

SEQ ID NO: 312016 - RNA, 64 nt, hsa
gauagggacugaauauggacccugcugaaagcaguguauugacgcauauuuaacucgcccucua

SEQ ID NO: 312017 - RNA, 64 nt, hsa
aaaauacauaauuaauauuugaccuaccucaaaauguauugaggaucugugaaaugcuaagugc

SEQ ID NO: 312018 - RNA, 64 nt, hsa
uuuguauguuacucuuauuuaauauaaucucuauuguauugauuucuucuguauuuaccuuuug

SEQ ID NO: 312019 - RNA, 64 nt, hsa
gauagaggauagggagaauauuuacuaacuaaauaccauucacuacucaugcgugagaugggug

SEQ ID NO: 312020 - RNA, 64 nt, hsa
cauuuguaaguguaaaaaaugucucaugucaaugaccauucaauuaguggucauaaaauagaau

SEQ ID NO: 312021 - RNA, 64 nt, hsa
uauugcaaggacagcaucaaagagauggugcuaaaccauucaugaugaacucacccccaugauc

SEQ ID NO: 312022 - RNA, 64 nt, hsa
cucccaccaggcuccaccucgaauacuggggauuaccauucagcaugagauuugggcaggaaca

SEQ ID NO: 312023 - RNA, 64 nt, hsa
uaaagugcccucacacugcugugcagccaucaccaccauucaucuccagaauuuguucucaguc

SEQ ID NO: 312024 - RNA, 64 nt, hsa
ccagaauuuguucucagucccaaacugaaacuauaccauucaaacaacagcgcuccccauuucc

SEQ ID NO: 312025 - RNA, 64 nt, hsa
ccuaagccuguucaaguaggcucucacuagaguuaccauucauauuugagaagaaaagaacauu

SEQ ID NO: 312026 - RNA, 64 nt, hsa
cugaucaucgauaagcauuuaagagugugcuaacaccauucacagaggucccuggaaaaaaaua

SEQ ID NO: 312027 - RNA, 64 nt, hsa
uucguuugccccucugacuguuggaaucccacgcaccauucaguaggauucaauucaaugugga

SEQ ID NO: 312028 - RNA, 64 nt, hsa
acgcaccauucaguaggauucaauucaauguggaaccauucaacauucaccucauuaaccuaaa

SEQ ID NO: 312029 - RNA, 64 nt, hsa
uuuaaacaaaauuuaguaucuuuuggucuuucacaccauucauauguuaaguggcagaauagcc

SEQ ID NO: 312030 - RNA, 64 nt, hsa
auuauauuuaguaggggaaaaauugggcucaagaaccauucaucaguacgugagacaagcaguu

SEQ ID NO: 312031 - RNA, 64 nt, hsa
uuguggaagacaguguggggauaaagacagagauaccauucaacccagcaaucucauuacuggg

SEQ ID NO: 312032 - RNA, 64 nt, hsa
aacaguaaaaauccuggaagacaacccaggcaguaccauucaggacauaggcacaggcaaagau

SEQ ID NO: 312033 - RNA, 64 nt, hsa
uacccaaaucaagaaagacaaaauaacaauagaaaccauucacacacuccguucaugcauggac

SEQ ID NO: 312034 - RNA, 64 nt, hsa
cuccacuggccgccagccucccuagcacaaggggaccauucagcaaugaguguuuacucauguu

SEQ ID NO: 312035 - RNA, 64 nt, hsa
ccagcauuugguauuacuacuauuuuuuaucuuaaccauucacauagauguguguaaugauacc

SEQ ID NO: 312036 - RNA, 64 nt, hsa
uauuccaugguauggauguaccacaguuugcuuaaccauucacccacuaaaggacauaagaguu

SEQ ID NO: 312037 - RNA, 64 nt, hsa
agcagaagcggaaggccgcuuccuuucucagcugaaccccuacucccggagcccccagcagggc

SEQ ID NO: 312038 - RNA, 64 nt, hsa
agcagaagcggaaggccgcuuccuuucucagcugaaccccuacccggagcccccagcagggccc

SEQ ID NO: 312039 - RNA, 64 nt, hsa
aaaauuaaggggagagaggaaaacaaaaccaaccaaccccuaaaaucauuuucuuauuguacau

SEQ ID NO: 312040 - RNA, 64 nt, hsa
ucaggagccaguuucuccagccccuccuccccacaaccccuaguggggaggggcagcuguccau

SEQ ID NO: 312041 - RNA, 64 nt, hsa
uaaaggauaaauucaaaaaauagccucaugagacuuggcauacacacucgugggauuccaguua

SEQ ID NO: 312042 - RNA, 64 nt, hsa
uaaaaaacaaaacaacaacaauaauuuaucaaaauuggcauauuuaaagccuaacauucuaaua

SEQ ID NO: 312043 - RNA, 64 nt, hsa
uuagaaaaaaauguaguguguuccauuuaaaauuuuggcauauggcauuuucuaacuuaggaag

SEQ ID NO: 312044 - RNA, 64 nt, hsa
ggggauguggaauuuuuauacaaguuauaaguguuuggcauaguacuuuugguacauuguggcu

SEQ ID NO: 312045 - RNA, 64 nt, hsa
ugguacucuuggcauaaagcgaggauucugauauuuggcauacuuguaaaaacaaauacauaag

SEQ ID NO: 312046 - RNA, 64 nt, hsa
uuaacuaaaccagucuuguuagaugaugguacucuuggcauaaagcgaggauucugauauuugg

SEQ ID NO: 312047 - RNA, 64 nt, hsa
cacuguaaaaauaguauguguacauaauguuuuauuggcauagucuauggagaagugcagaaac

SEQ ID NO: 312048 - RNA, 64 nt, hsa
uuguagucuacuagcacagugcuugcuggaggcuuuggcauaggcugcaaaccaauuugggcuc

SEQ ID NO: 312049 - RNA, 64 nt, hsa
uugauacguguuaguccuguuauuuggaggcuuuuuggcauaguuguucgaucaggagccuguu

SEQ ID NO: 312050 - RNA, 64 nt, hsa
aguaaagcuaucuggagagaacacauaaaugauuuuggcauaccauuagagaaaccauuuguaa

SEQ ID NO: 312051 - RNA, 64 nt, hsa
gaaaauuuuugucuuucauggaaugcaauuugacuuggcauaauugugaguuaauuugauaaag

SEQ ID NO: 312052 - RNA, 64 nt, hsa
auuacaguucacacugcagagcuagguuguccuauuggcauaaaacaaaccagcaacuuuucuc

SEQ ID NO: 312053 - RNA, 64 nt, hsa
cuucauaucuguugcauggaagaaaguuggguucuuggcauagaguugcaugauauguaagauu

SEQ ID NO: 312054 - RNA, 64 nt, hsa
ucuaucuacgcuugauucacauguacucuuuucuuuggcauagugcaacuuuaugauuucugaa

SEQ ID NO: 312055 - RNA, 64 nt, hsa
acacacacacacacacacacacauacacagacaaaaacacaaaaacucugaggggaucugguga

SEQ ID NO: 312056 - RNA, 64 nt, hsa
ggauuaaaacuaaccgugaccacuacuccaaacaaaacacaauaugccuaggggcacggaugaa

SEQ ID NO: 312057 - RNA, 64 nt, hsa
cuauuuucucuacggcuuaggcuaugugagggcaaaacacaaaucccuuugcuaaaaagaacca

SEQ ID NO: 312058 - RNA, 64 nt, hsa
agugaaauuaucuugagucuacacauuauuuuuaaaacacaaaaauuguucggcuggaacugac

SEQ ID NO: 312059 - RNA, 64 nt, hsa
uagccuugacaaauuuuaccuuaaaaccaaaaugaaacacaaaaauuaauccuuaauaaugaua

SEQ ID NO: 312060 - RNA, 64 nt, hsa
auguuucucuaagauuuccuuugguuguauuuagaaacacaaauaguuuuauaaucaggauugc

SEQ ID NO: 312061 - RNA, 64 nt, hsa
agaaagcaaaguaauaaaaucacaaauguuuggaaaacacaaaaguaacuuguuuaucucaguc

SEQ ID NO: 312062 - RNA, 64 nt, hsa
cccuggccagcuuaaccuggucugaggugagacuaaacacaaaaacaguagauaaaucucuccc

SEQ ID NO: 312063 - RNA, 64 nt, hsa
ggaacccauuacuaauaccuaacaggaaauagcuaaacacaacacaccuuaucuauuagucacc

SEQ ID NO: 312064 - RNA, 64 nt, hsa
uguuuccuuaaaaauugauuugacuccuguucuuaaacacaagugguuuuuccuaauuccagag

SEQ ID NO: 312065 - RNA, 64 nt, hsa
uagguguucaucuaagguuacaguuauguuaccgaaacacaaaacugccaaaaucuuacucugc

SEQ ID NO: 312066 - RNA, 64 nt, hsa
caucuuaugccugacuauuaaaccuauucuucauaaacacaagaacacuuuaauuuuucguuaa

SEQ ID NO: 312067 - RNA, 64 nt, hsa
uacuuuuuuuaagugauuuuuuuguccuucagccaaacacaauaugggcucaagucacuuuuau

SEQ ID NO: 312068 - RNA, 64 nt, hsa
auuaguauuuuccacgucacuguuuauuuuuuuaaaacacaaauucuaaagcuacaacaaauac

SEQ ID NO: 312069 - RNA, 64 nt, hsa
cauuauuuccacuugcaggccagcuuaaccucugaaacacaaaugaucuugagaccacuuuagu

SEQ ID NO: 312070 - RNA, 64 nt, hsa
uuucauuuuucucuuccugggauucauuuuuucaaaacacaaugcuggaaaaaaaagauuuguu

SEQ ID NO: 312071 - RNA, 62 nt, hsa
aauugcaucuucauuaggaaaaauaaaaagcauaaaacacaauuucugguuacuaugaauaa

SEQ ID NO: 312072 - RNA, 64 nt, hsa
acuuucuaaaacuaaaagagucuuuuuauuuuuaaaacacaaguagaaugauuuaaauaggauu

SEQ ID NO: 312073 - RNA, 64 nt, hsa
uuuuuuguuuuugcuucuggaacuuugaaacacaaaacacaaguuggcacuuacaauuuuaaag

SEQ ID NO: 312074 - RNA, 64 nt, hsa
ccgaacuuuuuuuguuuuugcuucuggaacuuugaaacacaaaacacaaguuggcacuuacaau

SEQ ID NO: 312075 - RNA, 64 nt, hsa
accaaaaaggaaaaaaaauccaccaaaccaugauaaacacaaaaugcagcuuccugaugcuuag

SEQ ID NO: 312076 - RNA, 64 nt, hsa
uuugaccuuaucuuaauggaaaacgguuaacuccaaacacaaaagacucuacuggaaaguguag

SEQ ID NO: 312077 - RNA, 64 nt, hsa
ucaauuaaugcuaaauaaagcuauuguuuuuccaaaacacaaaucuacacugggucucaauauc

SEQ ID NO: 312078 - RNA, 64 nt, hsa
aagaugaccacaaggggcccaaaacagaaaagagaaacacaagcucaccucuuggagcugcuuc

SEQ ID NO: 312079 - RNA, 64 nt, hsa
cgauuuccucugaacacaggguuccagaguacuuaaacacaacauuuuuuaaaucgugauuucg

SEQ ID NO: 312080 - RNA, 64 nt, hsa
ggagaugaaggaggacgacguuucuuuucucaugaaacacaagagccgaaaacgccgguaaguu

SEQ ID NO: 312081 - RNA, 64 nt, hsa
ccucuguucuuucaacuccuuugaggcucaaaaaaaacacaaagaucagaagccuucagauaga

SEQ ID NO: 312082 - RNA, 64 nt, hsa
acaguucaauaaugaggaaacaggugagcccugaaaacacaaaaggacaguucuguguugaaac

SEQ ID NO: 312083 - RNA, 64 nt, hsa
aaaaaucaaaaggcacugugaacuauuuugaagaaaacacaacauuuuaauacagauugaaagg

SEQ ID NO: 312084 - RNA, 64 nt, hsa
acagggaaaacagcuagcuugaaaacuugcugaaaaacacaacuuguguuuauggcauuuagua

SEQ ID NO: 312085 - RNA, 64 nt, hsa
cauauauuuuguguucauucuacugagaggaccuaaacacaaugacaccucaguaacaguaagc

SEQ ID NO: 312086 - RNA, 64 nt, hsa
uccagaaaacuuuaacauucuucaaagaaauagaaaacacaauccuaaaauuuauaugggaacc

SEQ ID NO: 312087 - RNA, 64 nt, hsa
cagcucuaucuuuguguuuacaucauggcaauggaaacacaauuuaaguauuaauacaggaugg

SEQ ID NO: 312088 - RNA, 64 nt, hsa
uagaaacuguggagcuuugugacacuugggaggcaaacacaagcugcuggaacucauccucaac

SEQ ID NO: 312089 - RNA, 64 nt, hsa
acacuuuugugugugugcgcagguuuauacacauaaacacaacaauacuuggacuuauuuauuu

SEQ ID NO: 312090 - RNA, 64 nt, hsa
ucuuuaacuccaccuccaauuucugucaaucuacaaacacaagugucgccucgcaguguuucgu

SEQ ID NO: 312091 - RNA, 64 nt, hsa
uuuaauuaugguuuucuugaaacguguaaauuaaaaacacaaucaguguucaggcuucaguuau

SEQ ID NO: 312092 - RNA, 64 nt, hsa
ugauacccuacacuuucaggggaccgagucugacaaacacaauacauuuaucugugaccuauau

SEQ ID NO: 312093 - RNA, 64 nt, hsa
ucauacauauaaaugguggugaaauaaagaaauaaaacacaauacuuuuacuugaaauguaaau

SEQ ID NO: 312094 - RNA, 64 nt, hsa
aauaaagccccuuugugaaacuguucuuuaaaugaaacacaagaaauuggccacugguaaaacu

SEQ ID NO: 312095 - RNA, 64 nt, hsa
uccacacuguguaugugaacagcuugggcccugcaaacacaaccaucuacacacaucuacaccc

SEQ ID NO: 312096 - RNA, 64 nt, hsa
aggugacuaaauuaaacuaaaauaaaauagaaugaaacacaaaauucaauuccucggcugaacu

SEQ ID NO: 312097 - RNA, 64 nt, hsa
uaggcuuugccuuuaaugaucucuuacgguuagaaaacacaauaaaaacaaacuguucggcuac

SEQ ID NO: 312098 - RNA, 64 nt, hsa
aaccucuugcuugugugcaaaaguuccuaaaaggaaacacaaguaaugccuauccauuacuagc

SEQ ID NO: 312099 - RNA, 64 nt, hsa
auuuugcaaauguaaagaauaugacaaggucuucaaacacaaguuuuucuaauaacucauuaga

SEQ ID NO: 312100 - RNA, 64 nt, hsa
aaaaaauuucacaccuugcaaaaggagaucuaaaaaacacaaucagaaaugacaaaggggacau

SEQ ID NO: 312101 - RNA, 64 nt, hsa
cacccccaagacugggaggggacuucuuuuucuaaaacacaaaacucagcccagccaggccccc

SEQ ID NO: 312102 - RNA, 64 nt, hsa
aacaaaaaagaaaaaaaucaaaaaagcgacaaaaaaacacaaacagaagaggaaaaaaaagcaa

SEQ ID NO: 312103 - RNA, 64 nt, hsa
uuuggacaucaaauuuggacaccaggucacggagaaacacaaacaccacccaggaacacgcaga

SEQ ID NO: 312104 - RNA, 64 nt, hsa
auuuuuacuggggauucuugaacuugaaaaaaaaaaacacaaaaaaagacaaaaaaaaaaaaag

SEQ ID NO: 312105 - RNA, 64 nt, hsa
ccagugccaugacugcccgcggauugaaaaacagaaacacaaaacuuugacuugacuugcgaag

SEQ ID NO: 312106 - RNA, 64 nt, hsa
gccccaggcucguuuuccuuuauagcgaagcaaaaaacacaagacccuccgcccgaguaaauuc

SEQ ID NO: 312107 - RNA, 64 nt, hsa
aacuuauccaaaaauuuuauguggaaaaguaaagaaacacaaauagcugaaacaaacuugacaa

SEQ ID NO: 312108 - RNA, 64 nt, hsa
aauuagaaaauguguugauagaaaaccuaagaauaaacacaacaaugaguuaggucuuuaucaa

SEQ ID NO: 312109 - RNA, 64 nt, hsa
ggguuauagcuucaggagggaaccagcuucugauaaacacaaucugcuaggaacuugggaaagg

SEQ ID NO: 312110 - RNA, 64 nt, hsa
cuccuauuucuccaaagccuugugugaacucaccaaacacaagaaaaucaaauauauaaccaau

SEQ ID NO: 312111 - RNA, 64 nt, hsa
uugauuuuacauuuccuauaucacuaaaauacuuaaacacaaaaauaaaauuccacuccuuuau

SEQ ID NO: 312112 - RNA, 64 nt, hsa
uagucuagguaaagaaaaaaaaaaaaaggucaugaaacacaaauguccucaacugucaucauuc

SEQ ID NO: 312113 - RNA, 54 nt, hsa
uguguguucuggaucugugaaaguaaacacaaaauauagaaaaaaagaaaagaa

SEQ ID NO: 312114 - RNA, 64 nt, hsa
ccugccuugaaugcaugggguugcagcucuguucaaacacaauucuaucagcuccaaaaugugu

SEQ ID NO: 312115 - RNA, 64 nt, hsa
ccaaaguagaaaaugguagaagguaguggguagaagucacuauauaaggaaggggaugggauuu

SEQ ID NO: 312116 - RNA, 64 nt, hsa
uaaaaguuuuggagagggaaauccaggcuauuaaagucacuaaauuucuaaguauguccauuuc

SEQ ID NO: 312117 - RNA, 64 nt, hsa
gagcacuuguccacgucuuuucucauaucaugguagucacuaacauauauaagguaugugcuau

SEQ ID NO: 312118 - RNA, 64 nt, hsa
guacuucagugcaccuacugcuuacuguugcuuuagucacuaauugcuuucugguuugaaagau

SEQ ID NO: 312119 - RNA, 64 nt, hsa
gagugguucuugaugcucaccugaagccccuagacgcugcuaggagggggggcccuccugggcc

SEQ ID NO: 312120 - RNA, 64 nt, hsa
ggcccuccugggcccccaauaccccuccgcuugccgcugcuagcgcaccccugcaguccagcgu

SEQ ID NO: 312121 - RNA, 64 nt, hsa
uagguaguacagguaagggggaaauuguaaagaauuagcagaauuaggcauauguacaaaacca

SEQ ID NO: 312122 - RNA, 64 nt, hsa
ucuaacauuugguaaaaggaaguauacuggucuguuagcagagacaaacuuuuuuuagaauuga

SEQ ID NO: 312123 - RNA, 64 nt, hsa
uucucaucuuaaaacccuuuauguucaaaauacauuagcagaggccaugaaagugaaaaaaaau

SEQ ID NO: 312124 - RNA, 64 nt, hsa
acagcuaccccaucaaagcugaacuugaaacguuuuagcagaauuuuaaauaugugaaaguuca

SEQ ID NO: 312125 - RNA, 64 nt, hsa
aggcagagucaggagagguggucuuugaaguaaguuagcagaaaucaaggggacccccgccucc

SEQ ID NO: 312126 - RNA, 64 nt, hsa
uuuugguuugaagccacagguguggcuucuggccuuagcagaugguaugcuugcggaccgcagc

SEQ ID NO: 312127 - RNA, 64 nt, hsa
ugggcgcauaaccugcgcugaccaguuuaggggcuuagcagaugccugccagcugaccucguug

SEQ ID NO: 312128 - RNA, 64 nt, hsa
accucguuggcaggaggguuggguggagauguuuuuagcagagcuuccauuaguguagaccugu

SEQ ID NO: 312129 - RNA, 64 nt, hsa
gggcuguuuuuccuuguugccccgcucuagacuuuuagcagaucugcagcccacaggcuuuuuu

SEQ ID NO: 312130 - RNA, 64 nt, hsa
cucugggcagaucuccaagcgccuggagugcuuuuuagcagagacaccucguuaagcuccggga

SEQ ID NO: 312131 - RNA, 64 nt, hsa
gucaccaaggcuccuccaacaugcgggaggaggcuuagcagacuugcgcugcaccagcgaaucu

SEQ ID NO: 312132 - RNA, 64 nt, hsa
acugcuggcuucagccccuugagcagcccauggcuuagcagacccccagauguaggucaguggc

SEQ ID NO: 312133 - RNA, 64 nt, hsa; identical to SEQ ID NO: 296379

SEQ ID NO: 312134 - RNA, 64 nt, hsa; identical to SEQ ID NO: 296380

SEQ ID NO: 312135 - RNA, 64 nt, hsa; identical to SEQ ID NO: 296381

SEQ ID NO: 312136 - RNA, 64 nt, hsa; identical to SEQ ID NO: 296382

SEQ ID NO: 312137 - RNA, 64 nt, hsa; identical to SEQ ID NO: 296383

SEQ ID NO: 312138 - RNA, 64 nt, hsa; identical to SEQ ID NO: 296384

SEQ ID NO: 312139 - RNA, 64 nt, hsa; identical to SEQ ID NO: 296385

SEQ ID NO: 312140 - RNA, 64 nt, hsa; identical to SEQ ID NO: 296386

SEQ ID NO: 312141 - RNA, 64 nt, hsa; identical to SEQ ID NO: 296387

SEQ ID NO: 312142 - RNA, 64 nt, hsa; identical to SEQ ID NO: 296388

SEQ ID NO: 312143 - RNA, 64 nt, hsa; identical to SEQ ID NO: 296389

SEQ ID NO: 312144 - RNA, 64 nt, hsa; identical to SEQ ID NO: 296390

SEQ ID NO: 312145 - RNA, 64 nt, hsa; identical to SEQ ID NO: 296391

SEQ ID NO: 312146 - RNA, 64 nt, hsa; identical to SEQ ID NO: 296392

SEQ ID NO: 312147 - RNA, 64 nt, hsa; identical to SEQ ID NO: 296393

SEQ ID NO: 312148 - RNA, 64 nt, hsa; identical to SEQ ID NO: 296394

SEQ ID NO: 312149 - RNA, 64 nt, hsa; identical to SEQ ID NO: 296395

SEQ ID NO: 312150 - RNA, 64 nt, hsa; identical to SEQ ID NO: 296396

SEQ ID NO: 312151 - RNA, 64 nt, hsa; identical to SEQ ID NO: 296397

SEQ ID NO: 312152 - RNA, 64 nt, hsa; identical to SEQ ID NO: 296398

SEQ ID NO: 312153 - RNA, 64 nt, hsa; identical to SEQ ID NO: 296399

SEQ ID NO: 312154 - RNA, 64 nt, hsa; identical to SEQ ID NO: 296400

SEQ ID NO: 312155 - RNA, 64 nt, hsa; identical to SEQ ID NO: 296401

SEQ ID NO: 312156 - RNA, 64 nt, hsa; identical to SEQ ID NO: 296402

SEQ ID NO: 312157 - RNA, 64 nt, hsa; identical to SEQ ID NO: 296403

SEQ ID NO: 312158 - RNA, 64 nt, hsa; identical to SEQ ID NO: 296404

SEQ ID NO: 312159 - RNA, 64 nt, hsa; identical to SEQ ID NO: 296405

SEQ ID NO: 312160 - RNA, 64 nt, hsa; identical to SEQ ID NO: 296406

SEQ ID NO: 312161 - RNA, 64 nt, hsa; identical to SEQ ID NO: 296407

SEQ ID NO: 312162 - RNA, 64 nt, hsa; identical to SEQ ID NO: 296408

SEQ ID NO: 312163 - RNA, 64 nt, hsa; identical to SEQ ID NO: 296409

SEQ ID NO: 312164 - RNA, 64 nt, hsa; identical to SEQ ID NO: 296410

SEQ ID NO: 312165 - RNA, 64 nt, hsa; identical to SEQ ID NO: 296402

SEQ ID NO: 312166 - RNA, 64 nt, hsa; identical to SEQ ID NO: 296403

SEQ ID NO: 312167 - RNA, 64 nt, hsa; identical to SEQ ID NO: 296404

SEQ ID NO: 312168 - RNA, 64 nt, hsa; identical to SEQ ID NO: 296414

SEQ ID NO: 312169 - RNA, 64 nt, hsa; identical to SEQ ID NO: 296415

SEQ ID NO: 312170 - RNA, 64 nt, hsa; identical to SEQ ID NO: 296416

SEQ ID NO: 312171 - RNA, 64 nt, hsa; identical to SEQ ID NO: 296417

SEQ ID NO: 312172 - RNA, 64 nt, hsa; identical to SEQ ID NO: 296418

SEQ ID NO: 312173 - RNA, 64 nt, hsa; identical to SEQ ID NO: 296419

SEQ ID NO: 312174 - RNA, 64 nt, hsa; identical to SEQ ID NO: 296420

SEQ ID NO: 312175 - RNA, 64 nt, hsa; identical to SEQ ID NO: 296421

SEQ ID NO: 312176 - RNA, 64 nt, hsa; identical to SEQ ID NO: 296422

SEQ ID NO: 312177 - RNA, 64 nt, hsa; identical to SEQ ID NO: 296423

SEQ ID NO: 312178 - RNA, 64 nt, hsa; identical to SEQ ID NO: 296424

SEQ ID NO: 312179 - RNA, 64 nt, hsa; identical to SEQ ID NO: 296425

SEQ ID NO: 312180 - RNA, 64 nt, hsa; identical to SEQ ID NO: 296426

SEQ ID NO: 312181 - RNA, 64 nt, hsa; identical to SEQ ID NO: 296427

SEQ ID NO: 312182 - RNA, 64 nt, hsa; identical to SEQ ID NO: 296428

SEQ ID NO: 312183 - RNA, 64 nt, hsa; identical to SEQ ID NO: 296429

SEQ ID NO: 312184 - RNA, 64 nt, hsa; identical to SEQ ID NO: 296430

SEQ ID NO: 312185 - RNA, 64 nt, hsa; identical to SEQ ID NO: 296431

SEQ ID NO: 312186 - RNA, 64 nt, hsa; identical to SEQ ID NO: 142221

SEQ ID NO: 312187 - RNA, 64 nt, hsa; identical to SEQ ID NO: 142222

SEQ ID NO: 312188 - RNA, 64 nt, hsa; identical to SEQ ID NO: 142223

SEQ ID NO: 312189 - RNA, 64 nt, hsa; identical to SEQ ID NO: 142224

SEQ ID NO: 312190 - RNA, 64 nt, hsa; identical to SEQ ID NO: 142225

SEQ ID NO: 312191 - RNA, 64 nt, hsa; identical to SEQ ID NO: 142226

SEQ ID NO: 312192 - RNA, 64 nt, hsa; identical to SEQ ID NO: 142227

SEQ ID NO: 312193 - RNA, 64 nt, hsa; identical to SEQ ID NO: 142228

SEQ ID NO: 312194 - RNA, 64 nt, hsa; identical to SEQ ID NO: 142229

SEQ ID NO: 312195 - RNA, 64 nt, hsa; identical to SEQ ID NO: 142230

SEQ ID NO: 312196 - RNA, 64 nt, hsa; identical to SEQ ID NO: 142231

SEQ ID NO: 312197 - RNA, 64 nt, hsa; identical to SEQ ID NO: 142232

SEQ ID NO: 312198 - RNA, 64 nt, hsa; identical to SEQ ID NO: 142233

SEQ ID NO: 312199 - RNA, 64 nt, hsa; identical to SEQ ID NO: 142234

SEQ ID NO: 312200 - RNA, 64 nt, hsa; identical to SEQ ID NO: 142235

SEQ ID NO: 312201 - RNA, 64 nt, hsa; identical to SEQ ID NO: 142236

SEQ ID NO: 312202 - RNA, 64 nt, hsa; identical to SEQ ID NO: 142237

SEQ ID NO: 312203 - RNA, 64 nt, hsa; identical to SEQ ID NO: 142238

SEQ ID NO: 312204 - RNA, 64 nt, hsa; identical to SEQ ID NO: 142239

SEQ ID NO: 312205 - RNA, 64 nt, hsa; identical to SEQ ID NO: 142240

SEQ ID NO: 312206 - RNA, 64 nt, hsa; identical to SEQ ID NO: 142241

SEQ ID NO: 312207 - RNA, 64 nt, hsa; identical to SEQ ID NO: 142242

SEQ ID NO: 312208 - RNA, 64 nt, hsa; identical to SEQ ID NO: 142243

SEQ ID NO: 312209 - RNA, 64 nt, hsa; identical to SEQ ID NO: 142244

SEQ ID NO: 312210 - RNA, 64 nt, hsa; identical to SEQ ID NO: 142245

SEQ ID NO: 312211 - RNA, 64 nt, hsa; identical to SEQ ID NO: 142246

SEQ ID NO: 312212 - RNA, 64 nt, hsa; identical to SEQ ID NO: 142247

SEQ ID NO: 312213 - RNA, 64 nt, hsa; identical to SEQ ID NO: 142248

SEQ ID NO: 312214 - RNA, 64 nt, hsa; identical to SEQ ID NO: 142249

SEQ ID NO: 312215 - RNA, 64 nt, hsa; identical to SEQ ID NO: 142250

SEQ ID NO: 312216 - RNA, 64 nt, hsa; identical to SEQ ID NO: 142251

SEQ ID NO: 312217 - RNA, 64 nt, hsa; identical to SEQ ID NO: 142252

SEQ ID NO: 312218 - RNA, 64 nt, hsa; identical to SEQ ID NO: 142253

SEQ ID NO: 312219 - RNA, 64 nt, hsa; identical to SEQ ID NO: 142254

SEQ ID NO: 312220 - RNA, 64 nt, hsa; identical to SEQ ID NO: 142255

SEQ ID NO: 312221 - RNA, 64 nt, hsa; identical to SEQ ID NO: 142256

SEQ ID NO: 312222 - RNA, 64 nt, hsa; identical to SEQ ID NO: 142257

SEQ ID NO: 312223 - RNA, 64 nt, hsa; identical to SEQ ID NO: 142258

SEQ ID NO: 312224 - RNA, 64 nt, hsa; identical to SEQ ID NO: 142259

SEQ ID NO: 312225 - RNA, 64 nt, hsa; identical to SEQ ID NO: 142260

SEQ ID NO: 312226 - RNA, 64 nt, hsa; identical to SEQ ID NO: 142261

SEQ ID NO: 312227 - RNA, 64 nt, hsa; identical to SEQ ID NO: 142262

SEQ ID NO: 312228 - RNA, 64 nt, hsa; identical to SEQ ID NO: 142263

SEQ ID NO: 312229 - RNA, 64 nt, hsa; identical to SEQ ID NO: 142264

SEQ ID NO: 312230 - RNA, 64 nt, hsa; identical to SEQ ID NO: 142265

SEQ ID NO: 312231 - RNA, 64 nt, hsa; identical to SEQ ID NO: 142266

SEQ ID NO: 312232 - RNA, 64 nt, hsa; identical to SEQ ID NO: 142267

SEQ ID NO: 312233 - RNA, 64 nt, hsa; identical to SEQ ID NO: 142268

SEQ ID NO: 312234 - RNA, 64 nt, hsa
gauuggggaaaggggagagagaagcaguagauacacuccuuauccuccccaaauuuuaagcucu

SEQ ID NO: 312235 - RNA, 64 nt, hsa
gggugccaccuguuuuuaaacucuuaaaccuggaacuccuuaaaugggguaggugggugagauu

SEQ ID NO: 312236 - RNA, 64 nt, hsa
aagggauggaugaaguucauguauuaggacuggcacuccuuacggugcuuauagaacuagucuc

SEQ ID NO: 312237 - RNA, 64 nt, hsa
ccaagcuuggggcaagcuugaugcaguaggagagacuccuuaugaggcuuagcccuugucuuac

SEQ ID NO: 312238 - RNA, 64 nt, hsa
cuuuauuauaauaaaccugaugcuuuuuuuuagaacuccuuacucugaugucuguauauguugc

SEQ ID NO: 312239 - RNA, 64 nt, hsa
uuuggaaacagaguaaugaagaaauaauauauaaacuccuuaugugaggaaaugcuacuaauau

SEQ ID NO: 312240 - RNA, 64 nt, hsa
auugagguuaagauauagcuagugucugaacgacacuccuuaaaguaaguuccaaauguaaaac

SEQ ID NO: 312241 - RNA, 64 nt, hsa
cgacacuccuuaaaguaaguuccaaauguaaaacacuccuuaaguuccaaauguuuuccgcuaa

SEQ ID NO: 312242 - RNA, 64 nt, hsa
ccucuaauaguaaugguucaguaagcacuccuuaacuccuuaguauuucauagaaaaaugacug

SEQ ID NO: 312243 - RNA, 64 nt, hsa
cuucccucccucuaauaguaaugguucaguaagcacuccuuaacuccuuaguauuucauagaaa

SEQ ID NO: 312244 - RNA, 64 nt, hsa
uggaauaugucacacuccuuaauagggaccugugacuccuuaauaaggaccugugacaugccca

SEQ ID NO: 312245 - RNA, 64 nt, hsa
caauucuaccaagacacucaauggaauaugucacacuccuuaauagggaccugugacuccuuaa

SEQ ID NO: 312246 - RNA, 64 nt, hsa
cggccuccugucugcaugcccccuguggccaccaggcuccgaggggccguggugacucuugauc

SEQ ID NO: 312247 - RNA, 64 nt, hsa
ggggcagcucaguacccucccugaggcucacgguggcuccgagcaugagguccgccuccugggc

SEQ ID NO: 312248 - RNA, 64 nt, hsa
cugacucuuuuucuuguuuugucugccauucuugaaagugcaucuugagagcccccauuuguug

SEQ ID NO: 312249 - RNA, 64 nt, hsa
uuuugugauccuuuaauauuauccaugcuuuuauaaagugcaguacacauuuugacauugccac

SEQ ID NO: 312250 - RNA, 64 nt, hsa
uacaaaaggauuguuuuaauccccauuauucuggaaagugcauccuagucucccagucuauaac

SEQ ID NO: 312251 - RNA, 64 nt, hsa
gcaagugcccuugagaacuuguagagggaguaaaaaagugcauggauaaaugacugcagcaaau

SEQ ID NO: 312252 - RNA, 64 nt, hsa
auuugguauucacaucucagagaacuacaacacaaaagugcagacuuauauuugagaauuaaug

SEQ ID NO: 312253 - RNA, 64 nt, hsa
uugauuccuaagguuuccagugugucaccaacaaaaagugcauugauagggaccuuugucucuu

SEQ ID NO: 312254 - RNA, 64 nt, hsa
uuaggaaaaguaaaauccaaaauguuagcaaaacaaagugcaauauuaaauguuugcuuuauag

SEQ ID NO: 312255 - RNA, 64 nt, hsa
auggaaguuuuccauucacuggggaaaggagggaaaagugcauuuauuuuuauacagaguuacu

SEQ ID NO: 312256 - RNA, 64 nt, hsa
caagacggaaaaggacuuucuucuguuuucuuccaaagugcaaccacaguggagagcccacggu

SEQ ID NO: 312257 - RNA, 64 nt, hsa
auuucucuucuuugaccgugcuaggaauuccaggaaagugcauuccugcccuggugaccuuuuc

SEQ ID NO: 312258 - RNA, 64 nt, hsa
acuuuuuccuuuuuucucacaugguuugaaacuuaaagugcacaucacugaaauaaugagauuu

SEQ ID NO: 312259 - RNA, 64 nt, hsa
aucaaaucaguaacuggucauggucaugcaucuaaaagugcauggaagaucauuuauuacuuuu

SEQ ID NO: 312260 - RNA, 64 nt, hsa
agaaccguuguuaauuuuaaaacuagcaaucuauaaagugcaccaggucaacuugaauaaaaac

SEQ ID NO: 312261 - RNA, 64 nt, hsa
aucaagagcaaaacugcacaaacuugcacauuggaaagugcaacaaguucccgugauugcagua

SEQ ID NO: 312262 - RNA, 64 nt, hsa
ugucuaccugcucguucccaauguaucuuaaugaaaagugcaaaagaaaaaccuaccaauuaac

SEQ ID NO: 312263 - RNA, 64 nt, hsa
auguuccuaaauuuuuguaaucuuacuguaaaaaaaagugcacugaacuucaaaacaaaacaaa

SEQ ID NO: 312264 - RNA, 64 nt, hsa
uuguuguuuguuuauuauaaacaaaaagcaugugaaagugcacuuaagauagaguuuuuauuaa

SEQ ID NO: 312265 - RNA, 64 nt, hsa
uguuguucucguuguuguuuuaaguuuacuggggaaagugcauuuggccaaaugaaaugguagu

SEQ ID NO: 312266 - RNA, 64 nt, hsa
cugaggugugacauggcccccaagcagagcggguaaagugcaauggguaagggagggaagggga

SEQ ID NO: 312267 - RNA, 64 nt, hsa
aaaccagcagggaguuagcacugaacugcuuuuaaaagugcacauuaaaaaggaaaguuugcca

SEQ ID NO: 312268 - RNA, 64 nt, hsa; identical to SEQ ID NO: 217813

SEQ ID NO: 312269 - RNA, 64 nt, hsa; identical to SEQ ID NO: 217814

SEQ ID NO: 312270 - RNA, 64 nt, hsa; identical to SEQ ID NO: 217815

SEQ ID NO: 312271 - RNA, 64 nt, hsa; identical to SEQ ID NO: 217816

SEQ ID NO: 312272 - RNA, 64 nt, hsa; identical to SEQ ID NO: 217817

SEQ ID NO: 312273 - RNA, 64 nt, hsa; identical to SEQ ID NO: 217818

SEQ ID NO: 312274 - RNA, 64 nt, hsa; identical to SEQ ID NO: 217819

SEQ ID NO: 312275 - RNA, 64 nt, hsa; identical to SEQ ID NO: 217820

SEQ ID NO: 312276 - RNA, 64 nt, hsa; identical to SEQ ID NO: 217821

SEQ ID NO: 312277 - RNA, 64 nt, hsa; identical to SEQ ID NO: 217822

SEQ ID NO: 312278 - RNA, 64 nt, hsa; identical to SEQ ID NO: 217823

SEQ ID NO: 312279 - RNA, 64 nt, hsa; identical to SEQ ID NO: 217824

SEQ ID NO: 312280 - RNA, 64 nt, hsa; identical to SEQ ID NO: 217825

SEQ ID NO: 312281 - RNA, 64 nt, hsa; identical to SEQ ID NO: 217826

SEQ ID NO: 312282 - RNA, 64 nt, hsa; identical to SEQ ID NO: 217827

SEQ ID NO: 312283 - RNA, 64 nt, hsa; identical to SEQ ID NO: 217828

SEQ ID NO: 312284 - RNA, 64 nt, hsa; identical to SEQ ID NO: 217829

SEQ ID NO: 312285 - RNA, 64 nt, hsa; identical to SEQ ID NO: 217830

SEQ ID NO: 312286 - RNA, 64 nt, hsa; identical to SEQ ID NO: 217831

SEQ ID NO: 312287 - RNA, 64 nt, hsa; identical to SEQ ID NO: 217832

SEQ ID NO: 312288 - RNA, 64 nt, hsa; identical to SEQ ID NO: 217833

SEQ ID NO: 312289 - RNA, 64 nt, hsa; identical to SEQ ID NO: 217834

SEQ ID NO: 312290 - RNA, 64 nt, hsa; identical to SEQ ID NO: 217835

SEQ ID NO: 312291 - RNA, 64 nt, hsa; identical to SEQ ID NO: 217836

SEQ ID NO: 312292 - RNA, 64 nt, hsa; identical to SEQ ID NO: 217837

SEQ ID NO: 312293 - RNA, 64 nt, hsa; identical to SEQ ID NO: 217838

SEQ ID NO: 312294 - RNA, 64 nt, hsa; identical to SEQ ID NO: 217839

SEQ ID NO: 312295 - RNA, 64 nt, hsa; identical to SEQ ID NO: 217840

SEQ ID NO: 312296 - RNA, 64 nt, hsa; identical to SEQ ID NO: 217841

SEQ ID NO: 312297 - RNA, 63 nt, hsa; identical to SEQ ID NO: 217842

SEQ ID NO: 312298 - RNA, 64 nt, hsa; identical to SEQ ID NO: 217843

SEQ ID NO: 312299 - RNA, 64 nt, hsa; identical to SEQ ID NO: 217844

SEQ ID NO: 312300 - RNA, 64 nt, hsa; identical to SEQ ID NO: 217845

SEQ ID NO: 312301 - RNA, 64 nt, hsa; identical to SEQ ID NO: 217846

SEQ ID NO: 312302 - RNA, 64 nt, hsa; identical to SEQ ID NO: 217847

SEQ ID NO: 312303 - RNA, 64 nt, hsa; identical to SEQ ID NO: 217848

SEQ ID NO: 312304 - RNA, 64 nt, hsa; identical to SEQ ID NO: 217849

SEQ ID NO: 312305 - RNA, 64 nt, hsa; identical to SEQ ID NO: 217850

SEQ ID NO: 312306 - RNA, 64 nt, hsa; identical to SEQ ID NO: 217851

SEQ ID NO: 312307 - RNA, 64 nt, hsa; identical to SEQ ID NO: 217852

SEQ ID NO: 312308 - RNA, 64 nt, hsa; identical to SEQ ID NO: 217853

SEQ ID NO: 312309 - RNA, 64 nt, hsa; identical to SEQ ID NO: 217854

SEQ ID NO: 312310 - RNA, 64 nt, hsa; identical to SEQ ID NO: 217855

SEQ ID NO: 312311 - RNA, 64 nt, hsa; identical to SEQ ID NO: 217856

SEQ ID NO: 312312 - RNA, 64 nt, hsa; identical to SEQ ID NO: 217857

SEQ ID NO: 312313 - RNA, 64 nt, hsa; identical to SEQ ID NO: 217858

SEQ ID NO: 312314 - RNA, 64 nt, hsa; identical to SEQ ID NO: 217859

SEQ ID NO: 312315 - RNA, 64 nt, hsa; identical to SEQ ID NO: 217860

SEQ ID NO: 312316 - RNA, 64 nt, hsa; identical to SEQ ID NO: 217861

SEQ ID NO: 312317 - RNA, 64 nt, hsa; identical to SEQ ID NO: 217862

SEQ ID NO: 312318 - RNA, 64 nt, hsa; identical to SEQ ID NO: 217863

SEQ ID NO: 312319 - RNA, 64 nt, hsa; identical to SEQ ID NO: 217864

SEQ ID NO: 312320 - RNA, 64 nt, hsa; identical to SEQ ID NO: 217865

SEQ ID NO: 312321 - RNA, 64 nt, hsa
gaaacuugcuguaguaacuuuuugaacgcuguaagcuguguacuguuauaagugugcuuccuau

SEQ ID NO: 312322 - RNA, 64 nt, hsa
uugcuggaaaugccugaccucucagucuggcucugcuguguaguccauagcccagccagaugag

SEQ ID NO: 312323 - RNA, 64 nt, hsa
gcucuucgaguuuguggggaagaugcuggggaaggcuguguaugagguaggaacguuaagaaac

SEQ ID NO: 312324 - RNA, 64 nt, hsa
uugggagucugucuuuccuuagccgucugagugagcuguguaugaacaagucccaggaguucca

SEQ ID NO: 312325 - RNA, 64 nt, hsa
cccuuaugauuacuaaauauuuuauuuuggaguggcuguguacucucccauugacuagauggac

SEQ ID NO: 312326 - RNA, 64 nt, hsa
gcgucugcagccacccagguagcauacgcucuuugcuguguagaagaaaugcccauacgacagc

SEQ ID NO: 312327 - RNA, 64 nt, hsa
acuuuucuuguugacaaagcaagaauauagguuugcuguguagguuuggugcucuauugauugg

SEQ ID NO: 312328 - RNA, 64 nt, hsa
ccgucucucugcccuuccuuugcaguaauccauggcuguguacugaauaguauuccccgcuaca

SEQ ID NO: 312329 - RNA, 64 nt, hsa
cgacaagccacaaggaccaauguagguauucuccccgccccaucuucaaggcucagcgacugag

SEQ ID NO: 312330 - RNA, 64 nt, hsa
agcaauuguucccucuggagggguccaggugcccccgccccacaaggccgcggagccucagcag

SEQ ID NO: 312331 - RNA, 64 nt, hsa
uaacuucaguguuuucuacaauacuccuccugccccgccccauuaaaacaguucuuuuguuaag

SEQ ID NO: 312332 - RNA, 64 nt, hsa
gugaccuggagcagucagagggcccucagucaccccgccccauuccucaccagagaaaagaauc

SEQ ID NO: 312333 - RNA, 64 nt, hsa
cgacuggcagccaggccugucgggccccccgacgccgccccauuucccuuccagcaaacucaac

SEQ ID NO: 312334 - RNA, 64 nt, hsa
gccgcaccugcccgccucggcguucgugacucagccgccccaucccgagucgcuaaggggcugc

SEQ ID NO: 312335 - RNA, 64 nt, hsa
cuccuccuugccgcuguguggggcaguccccuguccgccccaaaacccggccuuggucccuggc

SEQ ID NO: 312336 - RNA, 64 nt, hsa
agccccgccccgggcaggggggcggcgggugggcccgccccacgcacgcacgcacacucgggga

SEQ ID NO: 312337 - RNA, 64 nt, hsa
cccgcccccagcccugcaugcaggugcccucgcuccgccccaucaguuccugccccugccccuc

SEQ ID NO: 312338 - RNA, 64 nt, hsa
gcacgcacgcacgcacacggccccgcacacagccccgccccaccccgcaaccagcccugucgac

SEQ ID NO: 312339 - RNA, 61 nt, hsa
cgccgccugccgcccgcugagcaccgaggacccgccccaagcagagccgccccugggcccg

SEQ ID NO: 312340 - RNA, 64 nt, hsa
aaccucggccgugacauucggggccgggcgggacccgccccacagacuccaacuuccccuccaa

SEQ ID NO: 312341 - RNA, 64 nt, hsa
acugagagggggaagaagcggggaggaagaaaucccgccccaaacguccgcuuuccuuuucucu

SEQ ID NO: 312342 - RNA, 64 nt, hsa
gggagcccucgcccccgacucucggucggccuccccgccccaggcgucacucagugaucacggg

SEQ ID NO: 312343 - RNA, 64 nt, hsa
cccagagcugggcccccugggcagguuccccaccccgccccaccgcauccuucucggagcuggu

SEQ ID NO: 312344 - RNA, 64 nt, hsa
cccggaccgcgggccggaaggaggcgcccccgccccgccccagagcugggcccccugggcaggu

SEQ ID NO: 312345 - RNA, 64 nt, hsa
cauucauuuggggggugggagauuuuggcugaagccgccccagccuuaguccccagggccaagc

SEQ ID NO: 312346 - RNA, 64 nt, hsa
acugugaauccugugcucugcccgugaccgccccccgccccaucaaucccauugcauagguuua

SEQ ID NO: 312347 - RNA, 64 nt, hsa
uccuuaauguggacgaauuucucuuacguacaacugacagcaaaaggaagggcgaacuuucuag

SEQ ID NO: 312348 - RNA, 64 nt, hsa
gcugaggcucucccuuucucugugauuggacaguugacagcacccaaacucuggggugcaugug

SEQ ID NO: 312349 - RNA, 64 nt, hsa
gaaauaggugaggcaggguuuccuccuuagacacugacagcauucucuguaccccuucaaaucc

SEQ ID NO: 312350 - RNA, 64 nt, hsa
gggcauuuaguccuacccagccaucggcugcguaugacagcaggauggcacuucccauuucucu

SEQ ID NO: 312351 - RNA, 64 nt, hsa
aauuucaguguagcuucaagauuaauguuaauuaugacagcagaucuacaaagcuguaguucac

SEQ ID NO: 312352 - RNA, 64 nt, hsa
gggcguauuucgaaaaccagaguacagucuuaagugacagcacugaaccuauuccuguuguugc

SEQ ID NO: 312353 - RNA, 64 nt, hsa
gaacauggcccaggcccuuuccuucccccugugcugacagcauugcuguggggguggcccacug

SEQ ID NO: 312354 - RNA, 64 nt, hsa
ucaacaaagcaaacagagagccugugggaggggcugacagcagcagccggcuguuugggggaug

SEQ ID NO: 312355 - RNA, 64 nt, hsa
gugcucuuugaaugcagacuucuauuuccagaagugacagcacaagucugaguugcuguuuggu

SEQ ID NO: 312356 - RNA, 64 nt, hsa
uagggugguuucccucucaggcccagcagcccauugacagcauuagacuggcggcauggugcuu

SEQ ID NO: 312357 - RNA, 64 nt, hsa
aaaaugucaucuccccccaccucaucccucuuugugacagcagaccuggcuguguugccccucu

SEQ ID NO: 312358 - RNA, 64 nt, hsa
gcauccaggaaaaguggggaaugcugccaucuggugacagcauguagauuugggcagugaacag

SEQ ID NO: 312359 - RNA, 64 nt, hsa
ccuggggguggcagggguggggcagagagaauacugacagcagaggucuuggugggcugcacgu

SEQ ID NO: 312360 - RNA, 64 nt, hsa
gggguaucaucugcucgguggggccacccacaggugacagcauggacccucaggcuggcugccc

SEQ ID NO: 312361 - RNA, 64 nt, hsa
cuaagcaguucccucauugcucuuuggacuaggcugacagcaggaagagcagggcccaugaccg

SEQ ID NO: 312362 - RNA, 64 nt, hsa
caagguuauuugcaggcagggaugggcuuguaccugacagcacccaccccuguguggcccccag

SEQ ID NO: 312363 - RNA, 64 nt, hsa
cuucgugcuggcuuagacucucaguuguuuguguugacagcauuaggaauaaaccguuuguuuc

SEQ ID NO: 312364 - RNA, 64 nt, hsa
uaaucugcuuuuccaagcacuggaugcccuuggaugacagcauccucagcauuaaaacugguga

SEQ ID NO: 312365 - RNA, 64 nt, hsa
gacuugggagaaggauggggucuuaggaaggaggugacagcacuugcauggucacuugagccca

SEQ ID NO: 312366 - RNA, 64 nt, hsa
ccugcccaucaacuguaucugauuucacuaauuuugacagcacccccaguaggguaggauugug

SEQ ID NO: 312367 - RNA, 64 nt, hsa
agaaaugaagagaaccuucuuuuucucuugacuuugacagcacaugcuaaaaaucucuuccaag

SEQ ID NO: 312368 - RNA, 64 nt, hsa
gcuaugagcuccagugcuuuugccaaaauucucuugacagcacaccuccucucuuuccauguua

SEQ ID NO: 312369 - RNA, 62 nt, hsa
cugaaacagcuaaaaaaaugaauuugaauugcgccagauaggucaauaccaagcuucugauu

SEQ ID NO: 312370 - RNA, 62 nt, hsa
ugcuguuucuaauauaauuauuuucuaagauagccagauaguuagaaaaagauuuucauuga

SEQ ID NO: 312371 - RNA, 62 nt, hsa
uuguugauaaagagauguuaaauaauugugaagccagauaugcaauguguaucugaaaagca

SEQ ID NO: 312372 - RNA, 62 nt, hsa
cagauccuguauuaauuacucuuaguggagaugccagauaucccauacagaauuagcagaga

SEQ ID NO: 312373 - RNA, 64 nt, hsa; identical to SEQ ID NO: 50556

SEQ ID NO: 312374 - RNA, 64 nt, hsa; identical to SEQ ID NO: 50557

SEQ ID NO: 312375 - RNA, 64 nt, hsa; identical to SEQ ID NO: 50558

SEQ ID NO: 312376 - RNA, 64 nt, hsa; identical to SEQ ID NO: 50559

SEQ ID NO: 312377 - RNA, 64 nt, hsa; identical to SEQ ID NO: 50560

SEQ ID NO: 312378 - RNA, 64 nt, hsa; identical to SEQ ID NO: 50561

SEQ ID NO: 312379 - RNA, 64 nt, hsa; identical to SEQ ID NO: 50562

SEQ ID NO: 312380 - RNA, 64 nt, hsa; identical to SEQ ID NO: 50563

SEQ ID NO: 312381 - RNA, 64 nt, hsa; identical to SEQ ID NO: 50564

SEQ ID NO: 312382 - RNA, 64 nt, hsa; identical to SEQ ID NO: 50565

SEQ ID NO: 312383 - RNA, 64 nt, hsa; identical to SEQ ID NO: 50566

SEQ ID NO: 312384 - RNA, 64 nt, hsa; identical to SEQ ID NO: 50567

SEQ ID NO: 312385 - RNA, 64 nt, hsa; identical to SEQ ID NO: 50568

SEQ ID NO: 312386 - RNA, 64 nt, hsa; identical to SEQ ID NO: 50569

SEQ ID NO: 312387 - RNA, 64 nt, hsa; identical to SEQ ID NO: 50570

SEQ ID NO: 312388 - RNA, 64 nt, hsa; identical to SEQ ID NO: 50571

SEQ ID NO: 312389 - RNA, 64 nt, hsa; identical to SEQ ID NO: 50572

SEQ ID NO: 312390 - RNA, 64 nt, hsa; identical to SEQ ID NO: 50573

SEQ ID NO: 312391 - RNA, 64 nt, hsa; identical to SEQ ID NO: 50574

SEQ ID NO: 312392 - RNA, 64 nt, hsa; identical to SEQ ID NO: 50575

SEQ ID NO: 312393 - RNA, 64 nt, hsa; identical to SEQ ID NO: 50576

SEQ ID NO: 312394 - RNA, 64 nt, hsa; identical to SEQ ID NO: 50577

SEQ ID NO: 312395 - RNA, 64 nt, hsa; identical to SEQ ID NO: 50578

SEQ ID NO: 312396 - RNA, 64 nt, hsa; identical to SEQ ID NO: 50579

SEQ ID NO: 312397 - RNA, 64 nt, hsa; identical to SEQ ID NO: 50580

SEQ ID NO: 312398 - RNA, 64 nt, hsa; identical to SEQ ID NO: 50581

SEQ ID NO: 312399 - RNA, 64 nt, hsa; identical to SEQ ID NO: 50582

SEQ ID NO: 312400 - RNA, 64 nt, hsa; identical to SEQ ID NO: 50583

SEQ ID NO: 312401 - RNA, 64 nt, hsa; identical to SEQ ID NO: 50584

SEQ ID NO: 312402 - RNA, 64 nt, hsa; identical to SEQ ID NO: 50585

SEQ ID NO: 312403 - RNA, 64 nt, hsa; identical to SEQ ID NO: 50586

SEQ ID NO: 312404 - RNA, 64 nt, hsa; identical to SEQ ID NO: 50587

SEQ ID NO: 312405 - RNA, 64 nt, hsa; identical to SEQ ID NO: 50588

SEQ ID NO: 312406 - RNA, 64 nt, hsa; identical to SEQ ID NO: 50589

SEQ ID NO: 312407 - RNA, 64 nt, hsa; identical to SEQ ID NO: 50590

SEQ ID NO: 312408 - RNA, 64 nt, hsa; identical to SEQ ID NO: 50591

SEQ ID NO: 312409 - RNA, 64 nt, hsa; identical to SEQ ID NO: 50592

SEQ ID NO: 312410 - RNA, 64 nt, hsa; identical to SEQ ID NO: 50593

SEQ ID NO: 312411 - RNA, 64 nt, hsa; identical to SEQ ID NO: 50594

SEQ ID NO: 312412 - RNA, 64 nt, hsa; identical to SEQ ID NO: 50595

SEQ ID NO: 312413 - RNA, 64 nt, hsa; identical to SEQ ID NO: 50596

SEQ ID NO: 312414 - RNA, 64 nt, hsa; identical to SEQ ID NO: 50597

SEQ ID NO: 312415 - RNA, 64 nt, hsa; identical to SEQ ID NO: 50598

SEQ ID NO: 312416 - RNA, 64 nt, hsa; identical to SEQ ID NO: 50599

SEQ ID NO: 312417 - RNA, 64 nt, hsa; identical to SEQ ID NO: 50600

SEQ ID NO: 312418 - RNA, 64 nt, hsa; identical to SEQ ID NO: 50601

SEQ ID NO: 312419 - RNA, 64 nt, hsa; identical to SEQ ID NO: 50602

SEQ ID NO: 312420 - RNA, 64 nt, hsa; identical to SEQ ID NO: 50603

SEQ ID NO: 312421 - RNA, 64 nt, hsa; identical to SEQ ID NO: 50604

SEQ ID NO: 312422 - RNA, 64 nt, hsa; identical to SEQ ID NO: 50605

SEQ ID NO: 312423 - RNA, 64 nt, hsa; identical to SEQ ID NO: 50606

SEQ ID NO: 312424 - RNA, 64 nt, hsa; identical to SEQ ID NO: 50607

SEQ ID NO: 312425 - RNA, 64 nt, hsa; identical to SEQ ID NO: 50608

SEQ ID NO: 312426 - RNA, 64 nt, hsa; identical to SEQ ID NO: 50609

SEQ ID NO: 312427 - RNA, 64 nt, hsa; identical to SEQ ID NO: 50610

SEQ ID NO: 312428 - RNA, 64 nt, hsa; identical to SEQ ID NO: 50611

SEQ ID NO: 312429 - RNA, 64 nt, hsa; identical to SEQ ID NO: 50612

SEQ ID NO: 312430 - RNA, 64 nt, hsa; identical to SEQ ID NO: 50613

SEQ ID NO: 312431 - RNA, 64 nt, hsa; identical to SEQ ID NO: 50614

SEQ ID NO: 312432 - RNA, 64 nt, hsa; identical to SEQ ID NO: 50615

SEQ ID NO: 312433 - RNA, 64 nt, hsa; identical to SEQ ID NO: 50616

SEQ ID NO: 312434 - RNA, 64 nt, hsa; identical to SEQ ID NO: 50617

SEQ ID NO: 312435 - RNA, 64 nt, hsa; identical to SEQ ID NO: 50618

SEQ ID NO: 312436 - RNA, 64 nt, hsa; identical to SEQ ID NO: 50619

SEQ ID NO: 312437 - RNA, 64 nt, hsa; identical to SEQ ID NO: 50620

SEQ ID NO: 312438 - RNA, 64 nt, hsa; identical to SEQ ID NO: 50621

SEQ ID NO: 312439 - RNA, 64 nt, hsa; identical to SEQ ID NO: 50622

SEQ ID NO: 312440 - RNA, 64 nt, hsa; identical to SEQ ID NO: 50623

SEQ ID NO: 312441 - RNA, 64 nt, hsa; identical to SEQ ID NO: 50624

SEQ ID NO: 312442 - RNA, 64 nt, hsa; identical to SEQ ID NO: 50625

SEQ ID NO: 312443 - RNA, 64 nt, hsa; identical to SEQ ID NO: 50626

SEQ ID NO: 312444 - RNA, 64 nt, hsa; identical to SEQ ID NO: 50627

SEQ ID NO: 312445 - RNA, 64 nt, hsa; identical to SEQ ID NO: 50628

SEQ ID NO: 312446 - RNA, 64 nt, hsa; identical to SEQ ID NO: 50629

SEQ ID NO: 312447 - RNA, 64 nt, hsa; identical to SEQ ID NO: 50630

SEQ ID NO: 312448 - RNA, 64 nt, hsa; identical to SEQ ID NO: 50631

SEQ ID NO: 312449 - RNA, 64 nt, hsa; identical to SEQ ID NO: 50632

SEQ ID NO: 312450 - RNA, 64 nt, hsa; identical to SEQ ID NO: 50633

SEQ ID NO: 312451 - RNA, 64 nt, hsa; identical to SEQ ID NO: 50634

SEQ ID NO: 312452 - RNA, 64 nt, hsa; identical to SEQ ID NO: 50635

SEQ ID NO: 312453 - RNA, 64 nt, hsa; identical to SEQ ID NO: 50636

SEQ ID NO: 312454 - RNA, 64 nt, hsa; identical to SEQ ID NO: 50637

SEQ ID NO: 312455 - RNA, 64 nt, hsa; identical to SEQ ID NO: 50638

SEQ ID NO: 312456 - RNA, 64 nt, hsa; identical to SEQ ID NO: 50639

SEQ ID NO: 312457 - RNA, 64 nt, hsa; identical to SEQ ID NO: 50640

SEQ ID NO: 312458 - RNA, 64 nt, hsa; identical to SEQ ID NO: 50641

SEQ ID NO: 312459 - RNA, 64 nt, hsa; identical to SEQ ID NO: 50642

SEQ ID NO: 312460 - RNA, 64 nt, hsa; identical to SEQ ID NO: 50643

SEQ ID NO: 312461 - RNA, 64 nt, hsa; identical to SEQ ID NO: 50644

SEQ ID NO: 312462 - RNA, 64 nt, hsa; identical to SEQ ID NO: 53253

SEQ ID NO: 312463 - RNA, 64 nt, hsa; identical to SEQ ID NO: 53254

SEQ ID NO: 312464 - RNA, 64 nt, hsa
aagccauuuauuuauuccaucuagaaaggaaacccuguuucaguccccucucucuggcuguucu

SEQ ID NO: 312465 - RNA, 64 nt, hsa
uuaccuguaagacuuuuaaagauuuuccucccuccuguuucaggugggucacauucugaugaau

SEQ ID NO: 312466 - RNA, 64 nt, hsa
ugauugcaucugaagaaaggaucccugagagucucuguuucaucaggacauucugaaauuuacc

SEQ ID NO: 312467 - RNA, 64 nt, hsa
aaauguuugagccuguuccauuuucccguggaaccuguuucacucaaugccaggcagugcagca

SEQ ID NO: 312468 - RNA, 64 nt, hsa
uuuggaauuugagagaagguauaggugaucggaucuguuucauuuauaaaagguccaguuuuua

SEQ ID NO: 312469 - RNA, 64 nt, hsa
cuuuuuaguauuuuauaaaugguccaaaaaaugccuguuucagaaguuuuugaauucagugcau

SEQ ID NO: 312470 - RNA, 64 nt, hsa
aaucccauucaggcuacaagugacgacaaagauucuguuucaaauauagccacagaaauaaagg

SEQ ID NO: 312471 - RNA, 64 nt, hsa
aaucccauucaggcuacaagugacgagaaagauucuguuucaaauauagccacagaaauaaaga

SEQ ID NO: 312472 - RNA, 64 nt, hsa
aagucaguucugugaucugggucucuaaucugugcuguuucaaaguucucuguggcaaagcagc

SEQ ID NO: 312473 - RNA, 64 nt, hsa
cagaacugaacugagguucauggauuuuccaggacuguuucaaacaugcccauuacuaacggca

SEQ ID NO: 312474 - RNA, 64 nt, hsa
gaugggagauugaagauuucuguugaaacuuacacuguuucaucucagcuuuugaugguacuga

SEQ ID NO: 312475 - RNA, 64 nt, hsa
ugguccuaccaauggauucauggaguagccuggacuguuucauaguuuucuaaauguacaaauu

SEQ ID NO: 312476 - RNA, 64 nt, hsa
aaaacuugcauagaauucugauuaaauagugggucuguuucacaugugcaguuugaaguauuua

SEQ ID NO: 312477 - RNA, 64 nt, hsa
cauuguauauuuugcaaaaacaagauguuuguagcuguuucagagagaguacgguauauuuaug

SEQ ID NO: 312478 - RNA, 64 nt, hsa
cuuauaauuaaauguaaaauugaaaauucauuugcuguuucaaagugugauaucuuucacaaua

SEQ ID NO: 312479 - RNA, 64 nt, hsa
acaugaauaccucguguuccuccucccucuauuacuguuucaccagagcugucuuagcucaaau

SEQ ID NO: 312480 - RNA, 64 nt, hsa
ucauuuuauuuuagccaaacauuuugccuguuuucuguuucaaacaugauaguugauaugagac

SEQ ID NO: 312481 - RNA, 64 nt, hsa
guauuguaaacugaggcuaaauuuuuuuuuaaaccuguuucauguguuauaaaggccagcuugu

SEQ ID NO: 312482 - RNA, 64 nt, hsa
uuuccuacucauagccaaccaauaaauucaguaucuguuucaaauauuuuagaaguguaguuug

SEQ ID NO: 312483 - RNA, 64 nt, hsa
ccagguuacagaccugccuaucguuccaauaauccuguuucacuugaaugaagggaguaugucu

SEQ ID NO: 312484 - RNA, 64 nt, hsa
auaaacuccugaccuccuggugggguuggagcaucuguuucaaaugugggacuuacaagcacuu

SEQ ID NO: 312485 - RNA, 64 nt, hsa
aguauuauuugccuucauaauagaacccaagagucuguuucaauuuaugaauucaguauuugca

SEQ ID NO: 312486 - RNA, 64 nt, hsa
gaacaaaauuuaguauucaagcugagugagaauacuguuucaaugagcaugucccuaagauaaa

SEQ ID NO: 312487 - RNA, 64 nt, hsa
guaaauuauaagaagcuggcgaucuuuugauaugcuguuucacaggauccugacacuggagggc

SEQ ID NO: 312488 - RNA, 64 nt, hsa
ugcugcuauuccugcuggaggaaugaauagauggcuguuucaguuaagcuauuaguaauaaaag

SEQ ID NO: 312489 - RNA, 64 nt, hsa
uuuuauuaauaacacauaauuaguaaccacucuacuguuucaaguuaaucuaguaauagagcuu

SEQ ID NO: 312490 - RNA, 64 nt, hsa
cuccagagucugugcccuuuaccaccgugcccaacuguuucacaugcuguguuugguaguuuuu

SEQ ID NO: 312491 - RNA, 64 nt, hsa
uuuaagaaaacaaguauauaauuuacuuuguagacuguuucacauugcacucaucauauuuugu

SEQ ID NO: 312492 - RNA, 64 nt, hsa
gaggcccaaagcacuugcuuacauccucugauagcuguuucaaaugugcauuuuguggaauuuu

SEQ ID NO: 312493 - RNA, 64 nt, hsa
uaaagaaauaaguauccuacucaaaaaaggaagucuguuucagaacuuuagggccuuugaaaua

SEQ ID NO: 312494 - RNA, 64 nt, hsa
uuguccaagaucuuugcaccuuaauauuaauggacuguuucagguaaaagagaaugaauguaug

SEQ ID NO: 312495 - RNA, 64 nt, hsa
caagaggcaggugacauuguguccauauuucuuccuguuucagaacuucuguuucacaacaauu

SEQ ID NO: 312496 - RNA, 64 nt, hsa
cauuguguccauauuucuuccuguuucagaacuucuguuucacaacaauuucucucucgcuaca

SEQ ID NO: 312497 - RNA, 64 nt, hsa
aggagacucuuuuccuauacuucuaaaaugcaaacuguuucagauucugagcaccucauuguaa

SEQ ID NO: 312498 - RNA, 64 nt, hsa
ugauggugccagggaauccguggcuugguacacacuguuucauccaguggccacguggaagcuu

SEQ ID NO: 312499 - RNA, 64 nt, hsa
agaaugccuuuuaaaacauuguauauaaucuucacuguuucaccaucuagcuugcuaagucaaa

SEQ ID NO: 312500 - RNA, 64 nt, hsa
aauauuuaaaauuagauaugauucacacuauauucuguuucauaugcagauuuuauucucaccu

SEQ ID NO: 312501 - RNA, 64 nt, hsa
uuguuauaucugagaggcuuuaaaagccuauuaacuguuucagggcaaccgcgguacagacgug

SEQ ID NO: 312502 - RNA, 64 nt, hsa
aaaaaaaaaaaaaaaagaaaaaaaaaacaugcaccuguuucacugugaauagugaauguaaagg

SEQ ID NO: 312503 - RNA, 64 nt, hsa
uccaugcugcuagguggcgggggucgggggucuucuguuucacuaacaggaacaaagacagaaa

SEQ ID NO: 312504 - RNA, 64 nt, hsa
uucugggggugagaugaccauucugggucuaagacuguuucaaagaagagcucauagacugacu

SEQ ID NO: 312505 - RNA, 64 nt, hsa
auggccaccuccccauuuucugugccuuaucucacuguuucagcugaguccaaguuguuuacuc

SEQ ID NO: 312506 - RNA, 64 nt, hsa
ugggacucuaucagcuuuacacaugucccaccagcuguuucagauagauccuuacagcuggcag

SEQ ID NO: 312507 - RNA, 64 nt, hsa
uugcuuuuugaugguggauaagaugaaauuuuagcuguuucagcaucaauccaacuuaaaagca

SEQ ID NO: 312508 - RNA, 64 nt, hsa
cuucugagauguagcaggucacagaaguguucaccuguuucaucugaggauuucaguucugaag

SEQ ID NO: 312509 - RNA, 64 nt, hsa
uuagcaagccuaaguccccucauguucagugagccuguuucauuugcuauauagaaaaagaaac

SEQ ID NO: 312510 - RNA, 64 nt, hsa
aaugggugcuuuuaacuagcuucuacauggcaagcuguuucaguuugcaaaaucacugcccagc

SEQ ID NO: 312511 - RNA, 64 nt, hsa
gcucacuuaacucucgcaauaccauaaacgcacacuguuucaucuugacccuuucuugggaagg

SEQ ID NO: 312512 - RNA, 64 nt, hsa
agaaguaacucggggaaaagaugaaaaucccgcucuguuucagggucuuuuaguugaagcacuc

SEQ ID NO: 312513 - RNA, 63 nt, hsa
ugaaccguguggcaaagccuuuaaaugguccucaacccuuaaugaacguaagugaauucaugc

SEQ ID NO: 312514 - RNA, 63 nt, hsa
uaaagaauguggcaaagccuucaauagguucucaacccuuacugugcacaagauaauucauuc

SEQ ID NO: 312515 - RNA, 63 nt, hsa
gaagauauacaaaaacauacuucaaaaauguuaaacccuuaccaacagcuuuucccaggagac

SEQ ID NO: 312516 - RNA, 63 nt, hsa
guucgacgccccgaaccucaccugaccucaacuaacccuuaaaaaugcacaccucaugagucu

SEQ ID NO: 312517 - RNA, 63 nt, hsa
ugaagaauguggcaaaacuucuaaccauuucucaacccuuacuaaacauaagaugauucauac

SEQ ID NO: 312518 - RNA, 55 nt, hsa
guggcaaagccuuuaaccgaucuucaacccuuauuggacauaagagaauucauac

SEQ ID NO: 312519 - RNA, 63 nt, hsa
acugccuguaccaggcugccuggcaaaggccaaaacccuuacucacaugaggauggaggaaca

SEQ ID NO: 312520 - RNA, 63 nt, hsa
aagauaccuucuauauguaaugaucacagaacuaacccuuauaauauaguuuuacuuauuuug

SEQ ID NO: 312521 - RNA, 64 nt, hsa
ggccgcccuuggcuccugucccugcugcuccucuaggccucacucaacaaccaagcgccuggag

SEQ ID NO: 312522 - RNA, 64 nt, hsa
ucauugacacucuucccuccucccaccugccaccaggccucaccaaagcccacugccauggggc

SEQ ID NO: 312523 - RNA, 64 nt, hsa
acccugggugccauucccagcguuuaguuucuagaggccucaguuucuccaucagcuuauggga

SEQ ID NO: 312524 - RNA, 64 nt, hsa
acugaaaacauuucaaagcugaguuacuugucugaggccucaucccucggaagccgucugacuc

SEQ ID NO: 312525 - RNA, 64 nt, hsa
guuuaauuggacuuaaaguuccacauggcuggggaggccucagaaucauggugggaggcaaaag

SEQ ID NO: 312526 - RNA, 64 nt, hsa
guuuacuuggacuuacaguuccacauggcuggggaggccucagaaucauggcgggaggugaaag

SEQ ID NO: 312527 - RNA, 64 nt, hsa
agggauuuguccauucugcucuuggccucuccugaggccucauaaugggagaccaaaucaaaaa

SEQ ID NO: 312528 - RNA, 64 nt, hsa
caccugagcagaugcugaggcaguucauuaaaccaggccucagcuucagugccucaucuugcca

SEQ ID NO: 312529 - RNA, 64 nt, hsa
agauucaacaaggcccucugcccacccucucacuaggccucacccaacaccaguggaacuggag

SEQ ID NO: 312530 - RNA, 64 nt, hsa
gcgcaggucuccuuggggccugccguguccagggaggccucaugcgucugcuccuaggaccucc

SEQ ID NO: 312531 - RNA, 64 nt, hsa
cugugcuuagaaguccuuuaaucugggcugguacaggccucagccuugcccucaaugcacgaaa

SEQ ID NO: 312532 - RNA, 64 nt, hsa
ccaagcccccugaacaaacacagcuuccggcccgaggccucaccuggacaacggugcuucccca

SEQ ID NO: 312533 - RNA, 64 nt, hsa
ugccgccuguagccagugacagccgcaacccuacaggccucaguuccuugcagaggugaggggu

SEQ ID NO: 312534 - RNA, 64 nt, hsa
gccacuucccaccaggacccccaacaugaagucuaggccucaggggcucccgcccuucuuccuc

SEQ ID NO: 312535 - RNA, 64 nt, hsa
cccugccccaggccacagcaggacaggccgggacaggccucacccaaggccaaggcuggcauca

SEQ ID NO: 312536 - RNA, 64 nt, hsa
uuaugucauaugggcugacugguguagguuugguaggccucacugcucuccagaggcuaguguu

SEQ ID NO: 312537 - RNA, 64 nt, hsa
cacaagagauuuggccuccuuggaacauguaggaaggccucaaggauguaauucuagcccaggg

SEQ ID NO: 312538 - RNA, 64 nt, hsa
cuccuucaaucuccaugaaaccaucguaacauggaggccucagcugcucugaggagagaaauca

SEQ ID NO: 312539 - RNA, 64 nt, hsa
uccugcauuuuuagauuccuuuuaguucuaauugaggccucacuagaugcucuucaguucugug

SEQ ID NO: 312540 - RNA, 64 nt, hsa
cagagagcuggcuugagaguaguuauuaugaaaaaggccucaaggaguacguguucaguaugcu

SEQ ID NO: 312541 - RNA, 64 nt, hsa
gccugcagcauacaguaagaugggucccugugccaggccucaauacugccagggaauaaaacca

SEQ ID NO: 312542 - RNA, 64 nt, hsa
cugcucuucccagguggggacaguggcccaagcaaggccucacucgcagccacuucuucaagag

SEQ ID NO: 312543 - RNA, 64 nt, hsa
ugcucuugagaauaguuucucgugucccccucgcaggccucauucuuugaacaucgacucugaa

SEQ ID NO: 312544 - RNA, 64 nt, hsa
guuuaauuggacuuacaguuccacaugacuggggaggccucagaaucauggugggaggcaaaaa

SEQ ID NO: 312545 - RNA, 64 nt, hsa
guuuaauuggacuuacaguuccacauggccggggaggccucagaaucauggcgggaggugaaaa

SEQ ID NO: 312546 - RNA, 64 nt, hsa
guuucagguggaacaggaggaacugguccaggccaggccucauccuccuggacccagcaggggc

SEQ ID NO: 312547 - RNA, 64 nt, hsa
gugugggucagggaggggucuagaggcuauuccuaggccucaggccucccaaauaugccccucc

SEQ ID NO: 312548 - RNA, 64 nt, hsa
ugcuauucuauucugcugccccuaccuguuccugaggccucauuuagaaagaaaauccccucag

SEQ ID NO: 312549 - RNA, 64 nt, hsa
ucccugcugcaucugcaugaagccccugcuuuuuaggccucacucccaucagaacccugccugc

SEQ ID NO: 312550 - RNA, 64 nt, hsa
guuagacacuagggaugcaaagaugaaugagauaaggccucaggccucauggaaggugagacag

SEQ ID NO: 312551 - RNA, 64 nt, hsa
acuagggaugcaaagaugaaugagauaaggccucaggccucauggaaggugagacaguaaagac

SEQ ID NO: 312552 - RNA, 64 nt, hsa
gccccucucuucccagcacuucccugccucccccaggccucaggcccagcacccaguuccuccu

SEQ ID NO: 312553 - RNA, 64 nt, hsa
gcccucauugugguccgaggacagccuuuuccccaggccucagagcauugcucauccgugccaa

SEQ ID NO: 312554 - RNA, 64 nt, hsa
gcccccgcccgcacagcucccggcgggugcucugaggccucacuacucgagcccacccagcauc

SEQ ID NO: 312555 - RNA, 64 nt, hsa
gacuaggggaggggguccugggcccggugaccgcaggccucagcaucuccacucugcguaacag

SEQ ID NO: 312556 - RNA, 64 nt, hsa
ugaguuuuuaguacuguguugucaggcucuucccaggccucagguguugucuuuugugcugugu

SEQ ID NO: 312557 - RNA, 64 nt, hsa
cugaaguacucauguuuuaauagugccucuccaaaggccucaccuuggacagaggucaauccuu

SEQ ID NO: 312558 - RNA, 64 nt, hsa
auagguccuccccucaccccaacucuagguuuccaggccucacagccaagcugaagcuuggaga

SEQ ID NO: 312559 - RNA, 64 nt, hsa
caaaggcagcugcccucccugacccuauagccccaggccucaugggggguauguggggaaggga

SEQ ID NO: 312560 - RNA, 64 nt, hsa
cagagucacuagaaguuaccugaguaucucugggaggccucaugucuccugugggcuuuuuacc

SEQ ID NO: 312561 - RNA, 64 nt, hsa
caaauucaaggacaaccugucuuugagccagggcaggccucagacacccugccuguggccccgc

SEQ ID NO: 312562 - RNA, 64 nt, hsa
uucugugagacuggggccagccacacuacucucuaggccucaggggucaaggagcucagaggag

SEQ ID NO: 312563 - RNA, 64 nt, hsa
acccucccaaaggauacugccuucucaagaucauaggccucagacuccaacugguguuauccca

SEQ ID NO: 312564 - RNA, 64 nt, hsa
gcagggucaucagacagucaccuuuggccucaagaggccucagaacugcaaacuccugcgucgg

SEQ ID NO: 312565 - RNA, 64 nt, hsa
cagcaggacuuaugguucugggucucagagcuucaggccucacuguccuucugccacggaugcu

SEQ ID NO: 312566 - RNA, 64 nt, hsa
ucccaggacagggguaaguucugccugaccuaugaggccucaaugaccagaauguuccgggagg

SEQ ID NO: 312567 - RNA, 64 nt, hsa
aguuguacugcuuccaguuccugcccuuuggcaaaggccucaucaagaagugccggaccagccc

SEQ ID NO: 312568 - RNA, 64 nt, hsa
cgggcugagcgcgccuggugugggucugcagcggaggccucagcaaccugcucuuccgcugcuc

SEQ ID NO: 312569 - RNA, 64 nt, hsa; identical to SEQ ID NO: 73772

SEQ ID NO: 312570 - RNA, 64 nt, hsa; identical to SEQ ID NO: 73773

SEQ ID NO: 312571 - RNA, 64 nt, hsa; identical to SEQ ID NO: 73774

SEQ ID NO: 312572 - RNA, 64 nt, hsa; identical to SEQ ID NO: 73775

SEQ ID NO: 312573 - RNA, 64 nt, hsa; identical to SEQ ID NO: 73776

SEQ ID NO: 312574 - RNA, 64 nt, hsa; identical to SEQ ID NO: 73777

SEQ ID NO: 312575 - RNA, 64 nt, hsa; identical to SEQ ID NO: 73778

SEQ ID NO: 312576 - RNA, 64 nt, hsa; identical to SEQ ID NO: 73779

SEQ ID NO: 312577 - RNA, 64 nt, hsa; identical to SEQ ID NO: 73780

SEQ ID NO: 312578 - RNA, 64 nt, hsa; identical to SEQ ID NO: 73781

SEQ ID NO: 312579 - RNA, 64 nt, hsa; identical to SEQ ID NO: 73782

SEQ ID NO: 312580 - RNA, 64 nt, hsa; identical to SEQ ID NO: 73783

SEQ ID NO: 312581 - RNA, 64 nt, hsa; identical to SEQ ID NO: 73784

SEQ ID NO: 312582 - RNA, 64 nt, hsa; identical to SEQ ID NO: 73785

SEQ ID NO: 312583 - RNA, 64 nt, hsa; identical to SEQ ID NO: 73786

SEQ ID NO: 312584 - RNA, 64 nt, hsa; identical to SEQ ID NO: 73787

SEQ ID NO: 312585 - RNA, 64 nt, hsa; identical to SEQ ID NO: 73788

SEQ ID NO: 312586 - RNA, 64 nt, hsa; identical to SEQ ID NO: 73789

SEQ ID NO: 312587 - RNA, 64 nt, hsa; identical to SEQ ID NO: 73790

SEQ ID NO: 312588 - RNA, 64 nt, hsa; identical to SEQ ID NO: 73791

SEQ ID NO: 312589 - RNA, 64 nt, hsa; identical to SEQ ID NO: 73792

SEQ ID NO: 312590 - RNA, 64 nt, hsa; identical to SEQ ID NO: 73793

SEQ ID NO: 312591 - RNA, 64 nt, hsa; identical to SEQ ID NO: 73794

SEQ ID NO: 312592 - RNA, 64 nt, hsa; identical to SEQ ID NO: 73795

SEQ ID NO: 312593 - RNA, 64 nt, hsa; identical to SEQ ID NO: 73796

SEQ ID NO: 312594 - RNA, 64 nt, hsa; identical to SEQ ID NO: 73797

SEQ ID NO: 312595 - RNA, 64 nt, hsa; identical to SEQ ID NO: 73798

SEQ ID NO: 312596 - RNA, 64 nt, hsa; identical to SEQ ID NO: 73799

SEQ ID NO: 312597 - RNA, 64 nt, hsa; identical to SEQ ID NO: 73800

SEQ ID NO: 312598 - RNA, 64 nt, hsa; identical to SEQ ID NO: 73801

SEQ ID NO: 312599 - RNA, 64 nt, hsa; identical to SEQ ID NO: 73802

SEQ ID NO: 312600 - RNA, 64 nt, hsa; identical to SEQ ID NO: 73803

SEQ ID NO: 312601 - RNA, 64 nt, hsa; identical to SEQ ID NO: 73804

SEQ ID NO: 312602 - RNA, 64 nt, hsa; identical to SEQ ID NO: 73805

SEQ ID NO: 312603 - RNA, 64 nt, hsa; identical to SEQ ID NO: 73806

SEQ ID NO: 312604 - RNA, 64 nt, hsa; identical to SEQ ID NO: 73807

SEQ ID NO: 312605 - RNA, 64 nt, hsa; identical to SEQ ID NO: 73808

SEQ ID NO: 312606 - RNA, 64 nt, hsa; identical to SEQ ID NO: 73809

SEQ ID NO: 312607 - RNA, 64 nt, hsa; identical to SEQ ID NO: 73810

SEQ ID NO: 312608 - RNA, 64 nt, hsa; identical to SEQ ID NO: 73811

SEQ ID NO: 312609 - RNA, 64 nt, hsa; identical to SEQ ID NO: 73812

SEQ ID NO: 312610 - RNA, 64 nt, hsa; identical to SEQ ID NO: 73813

SEQ ID NO: 312611 - RNA, 64 nt, hsa; identical to SEQ ID NO: 73814

SEQ ID NO: 312612 - RNA, 64 nt, hsa; identical to SEQ ID NO: 73815

SEQ ID NO: 312613 - RNA, 64 nt, hsa; identical to SEQ ID NO: 73816

SEQ ID NO: 312614 - RNA, 64 nt, hsa; identical to SEQ ID NO: 73817

SEQ ID NO: 312615 - RNA, 64 nt, hsa; identical to SEQ ID NO: 73818

SEQ ID NO: 312616 - RNA, 64 nt, hsa; identical to SEQ ID NO: 73819

SEQ ID NO: 312617 - RNA, 64 nt, hsa; identical to SEQ ID NO: 73820

SEQ ID NO: 312618 - RNA, 64 nt, hsa; identical to SEQ ID NO: 73821

SEQ ID NO: 312619 - RNA, 64 nt, hsa; identical to SEQ ID NO: 73822

SEQ ID NO: 312620 - RNA, 64 nt, hsa; identical to SEQ ID NO: 73823

SEQ ID NO: 312621 - RNA, 64 nt, hsa; identical to SEQ ID NO: 73824

SEQ ID NO: 312622 - RNA, 64 nt, hsa; identical to SEQ ID NO: 73825

SEQ ID NO: 312623 - RNA, 64 nt, hsa; identical to SEQ ID NO: 73826

SEQ ID NO: 312624 - RNA, 64 nt, hsa; identical to SEQ ID NO: 73827

SEQ ID NO: 312625 - RNA, 64 nt, hsa; identical to SEQ ID NO: 73828

SEQ ID NO: 312626 - RNA, 64 nt, hsa; identical to SEQ ID NO: 73829

SEQ ID NO: 312627 - RNA, 64 nt, hsa; identical to SEQ ID NO: 73830

SEQ ID NO: 312628 - RNA, 64 nt, hsa; identical to SEQ ID NO: 105402

SEQ ID NO: 312629 - RNA, 64 nt, hsa; identical to SEQ ID NO: 105403

SEQ ID NO: 312630 - RNA, 64 nt, hsa
uguuauaagugcuuauuuauaaaaggaauguuucugaaugcaagugccuaaaaagaucuuuguu

SEQ ID NO: 312631 - RNA, 64 nt, hsa
aguucaguugacuuuccccaccaaaugguccauuugaaugcaucccuaauauaugauauagucu

SEQ ID NO: 312632 - RNA, 64 nt, hsa
auuucauacaacugaguuacucuguucacuccacugaaugcaacccauauaguuucuugcacaa

SEQ ID NO: 312633 - RNA, 64 nt, hsa
uuauuuuaccccaaguuuuuugggccacugacauugaaugcaacaacugauuucauacaacuga

SEQ ID NO: 312634 - RNA, 64 nt, hsa
gaccuuggaaaucuguaugugguggagaaguauuugaaugcauuuaggcuuaauuucuucgccu

SEQ ID NO: 312635 - RNA, 64 nt, hsa
gccugaggguccccacgguuccuuucugcuuuucugaaugcaucaaggguacgagaacuugcca

SEQ ID NO: 312636 - RNA, 64 nt, hsa
guuuaguuauagcaaaaauauggauaauuucuagugaaugcauaaauuagguugcguuucuuau

SEQ ID NO: 312637 - RNA, 64 nt, hsa
gauguuuugaaaaaagcuaggagaugacuuugaaugaaugcaagguuagugagauccuaagcuc

SEQ ID NO: 312638 - RNA, 64 nt, hsa
agaauccaaaaguauuuuccauugccgugcucuuugaaugcagacuucuauuuccagaagugac

SEQ ID NO: 312639 - RNA, 64 nt, hsa
caaaguaacccugacuagggcccaacuuuaauuuugaaugcauuuccagaguggccaugccuag

SEQ ID NO: 312640 - RNA, 64 nt, hsa
uggaaaugggacggagguccuuuggacagcugacugaaugcagaacgguuuuuggaucuggcau

SEQ ID NO: 312641 - RNA, 64 nt, hsa
uaacuugcauauuguuggcacagaacaggaggugugaaugcacguuucaaagcuuuccuguuuc

SEQ ID NO: 312642 - RNA, 64 nt, hsa
uugcaaugaagaugagcagauccacaggaaaacuugaaugcacaacugucuuauuuuaaucuua

SEQ ID NO: 312643 - RNA, 64 nt, hsa
ucuggccagggacgugcugcaauuggugcaguuuugaaugcaacauuguccccuacugggaaua

SEQ ID NO: 312644 - RNA, 64 nt, hsa
caucauuuuuuuaaaaaauguaauugaauaagugugaaugcagaagcaaauauugucugcccug

SEQ ID NO: 312645 - RNA, 64 nt, hsa
cccuuuuaauaaaauauaaggguagaguucauuuugaaugcaaguugccuuuauuauaaauuug

SEQ ID NO: 312646 - RNA, 64 nt, hsa
uguuuuguggauaauugaaauaaaaaguucucauugaaugcaccuauuaaucguuuuaguugcu

SEQ ID NO: 312647 - RNA, 64 nt, hsa
gccacaaauagaaaauaugaccagaucagggacuugaaugcacuuuugcucauggugaauauag

SEQ ID NO: 312648 - RNA, 64 nt, hsa
cacaucagaaaauucacacuggagagaaaccuuaugaaugcagugaaugugggaaagcuuuuau

SEQ ID NO: 312649 - RNA, 64 nt, hsa
auuauaaaaaccucaauucugaaaaucuauagacugaaugcaguuccaaacaaaaucaacuaag

SEQ ID NO: 312650 - RNA, 64 nt, hsa
gacaucagagaguucacucuggagagaggccuuaugaaugcagugaauguggcaaauucuuugu

SEQ ID NO: 312651 - RNA, 64 nt, hsa
gucaucagagaguucacacuggagaaagaccuuuugaaugcagcauuugugggaaauccuuuag

SEQ ID NO: 312652 - RNA, 64 nt, hsa
cuuugccagucuagccccagcagggcaccguguaugaaugcaguuuggugcuguuuuagaguau

SEQ ID NO: 312653 - RNA, 64 nt, hsa
cccccuagauccauguggcuuuaugugaggggacugaaugcagacacaccauagcccccuucua

SEQ ID NO: 312654 - RNA, 64 nt, hsa
gucugagcaaaccugggugugaauucggugguuuugaaugcauaaagugccuuguggacacggg

SEQ ID NO: 312655 - RNA, 64 nt, hsa
ucagugggagccaggaagccucaggcuucacgacugaaugcacccaauauccgaccuggcugcg

SEQ ID NO: 312656 - RNA, 64 nt, hsa; identical to SEQ ID NO: 288178

SEQ ID NO: 312657 - RNA, 64 nt, hsa; identical to SEQ ID NO: 288179

SEQ ID NO: 312658 - RNA, 64 nt, hsa; identical to SEQ ID NO: 288180

SEQ ID NO: 312659 - RNA, 64 nt, hsa; identical to SEQ ID NO: 288181

SEQ ID NO: 312660 - RNA, 64 nt, hsa; identical to SEQ ID NO: 288182

SEQ ID NO: 312661 - RNA, 64 nt, hsa; identical to SEQ ID NO: 288183

SEQ ID NO: 312662 - RNA, 64 nt, hsa; identical to SEQ ID NO: 288184

SEQ ID NO: 312663 - RNA, 64 nt, hsa; identical to SEQ ID NO: 288185

SEQ ID NO: 312664 - RNA, 64 nt, hsa; identical to SEQ ID NO: 288186

SEQ ID NO: 312665 - RNA, 64 nt, hsa; identical to SEQ ID NO: 288187

SEQ ID NO: 312666 - RNA, 64 nt, hsa; identical to SEQ ID NO: 288188

SEQ ID NO: 312667 - RNA, 64 nt, hsa; identical to SEQ ID NO: 288189

SEQ ID NO: 312668 - RNA, 64 nt, hsa; identical to SEQ ID NO: 288190

SEQ ID NO: 312669 - RNA, 64 nt, hsa; identical to SEQ ID NO: 288191

SEQ ID NO: 312670 - RNA, 64 nt, hsa; identical to SEQ ID NO: 288192

SEQ ID NO: 312671 - RNA, 64 nt, hsa; identical to SEQ ID NO: 288193

SEQ ID NO: 312672 - RNA, 64 nt, hsa; identical to SEQ ID NO: 288194

SEQ ID NO: 312673 - RNA, 64 nt, hsa; identical to SEQ ID NO: 288195

SEQ ID NO: 312674 - RNA, 64 nt, hsa
ucagaggcugaggugagaggaucaguugaggccaggaguuuaagaccagccugggcaacauagu

SEQ ID NO: 312675 - RNA, 64 nt, hsa
aaccggaguucggaaaccguccuguguacacaugggaguuuagugugauaaaggcaguauuuca

SEQ ID NO: 312676 - RNA, 64 nt, hsa
ccaagaggucacgagauugggcagugaggaauggggaguuuaguuuaaaagacaacacuagaua

SEQ ID NO: 312677 - RNA, 64 nt, hsa
agagcuugggaguaccacuggaaacguauggguaggaguuuagguggcuucuguuuuucaaaag

SEQ ID NO: 312678 - RNA, 64 nt, hsa
uuaaaaagcaaguugcgaugguuuuguauagccaggaguuuauugugauuaaacaucaaagaaa

SEQ ID NO: 312679 - RNA, 64 nt, hsa
ugggaggucgaggcaagcugaucgcuugagcccaggaguuuaagaccggccugaguagcauagc

SEQ ID NO: 312680 - RNA, 64 nt, hsa
ucuaauuucuguuacaguucugcaaagguaaccuggaguuuagaaguuaaaaaaaagcauggga

SEQ ID NO: 312681 - RNA, 64 nt, hsa
gggccacugcacaggccaccugcuuggguuccucggaguuuaauuugaaagucugggugucuua

SEQ ID NO: 312682 - RNA, 64 nt, hsa; identical to SEQ ID NO: 175198

SEQ ID NO: 312683 - RNA, 64 nt, hsa; identical to SEQ ID NO: 175199

SEQ ID NO: 312684 - RNA, 64 nt, hsa; identical to SEQ ID NO: 175200

SEQ ID NO: 312685 - RNA, 64 nt, hsa; identical to SEQ ID NO: 175201

SEQ ID NO: 312686 - RNA, 64 nt, hsa; identical to SEQ ID NO: 175202

SEQ ID NO: 312687 - RNA, 64 nt, hsa; identical to SEQ ID NO: 175203

SEQ ID NO: 312688 - RNA, 64 nt, hsa; identical to SEQ ID NO: 175204

SEQ ID NO: 312689 - RNA, 64 nt, hsa; identical to SEQ ID NO: 175205

SEQ ID NO: 312690 - RNA, 64 nt, hsa; identical to SEQ ID NO: 175206

SEQ ID NO: 312691 - RNA, 64 nt, hsa; identical to SEQ ID NO: 175207

SEQ ID NO: 312692 - RNA, 64 nt, hsa; identical to SEQ ID NO: 175208

SEQ ID NO: 312693 - RNA, 64 nt, hsa; identical to SEQ ID NO: 175209

SEQ ID NO: 312694 - RNA, 64 nt, hsa; identical to SEQ ID NO: 175210

SEQ ID NO: 312695 - RNA, 64 nt, hsa; identical to SEQ ID NO: 175211

SEQ ID NO: 312696 - RNA, 64 nt, hsa
ccccugcagggugggauuugagcugugaguugguaacuagcagggagaaauauuaacuuuuuua

SEQ ID NO: 312697 - RNA, 64 nt, hsa
uaaaaguuuuaugcagugaaucucaguuugaacaaacuagcaacaauuaagugacccccgucaa

SEQ ID NO: 312698 - RNA, 64 nt, hsa
ccccucccugcccuucagagcucaagacaaguaauacacccaggucuugacugcauuugucuug

SEQ ID NO: 312699 - RNA, 64 nt, hsa
guauguuaacuuaacuuuaauuuccuguguaguuuacacccagagcagauacucauaaaguaua

SEQ ID NO: 312700 - RNA, 64 nt, hsa
uaaugugaguccugggccuuucugccuccugauguacacccaucgccaucauagcaagagugcu

SEQ ID NO: 312701 - RNA, 64 nt, hsa
cucucugguccuuguugcucuaacaguccagauguacacccagccucagggggaaggcagcucu

SEQ ID NO: 312702 - RNA, 64 nt, hsa
auugugcaugagcucaaagggggaacaaaauagauacacccaucauggucaucuaucaucaaga

SEQ ID NO: 312703 - RNA, 64 nt, hsa
uuaccugggggugcugaugcauccucaguuaaccuacacccaccugaauauagaugagcguagc

SEQ ID NO: 312704 - RNA, 64 nt, hsa
cucaaccccccacauagcugggacuacaggugcuuacacccaagaccaguuaauuuuuuguauu

SEQ ID NO: 312705 - RNA, 64 nt, hsa
cuuaaagguacggguuucugcucuucucauaguguacacccaccugccucucuggcuccagaag

SEQ ID NO: 312706 - RNA, 64 nt, hsa
cuuuguuuguuuaccugugcucauccucugcccuuacacccaugacugaggaccaaugacguca

SEQ ID NO: 312707 - RNA, 64 nt, hsa
cucgagaaacagugccgccggugugaugagcacuuacacccacguucucaagggcagauucucu

SEQ ID NO: 312708 - RNA, 64 nt, hsa
ugagaggauauagccaauuaaguguguuauggaguacacccauuuugacacacuuguaauaaga

SEQ ID NO: 312709 - RNA, 64 nt, hsa
cugcccggcagcccccaucuucaagggcugcuucuacacccaccccaccgaggugcugaagccu

SEQ ID NO: 312710 - RNA, 64 nt, hsa
cugcucagacagauuuagggcccgccagcuaggcuacacccaucaugcgccgcccuccuccauc

SEQ ID NO: 312711 - RNA, 64 nt, hsa
cuuuaaagauaguaccugcagaauaguuuuugaauacacccacauuuuguacguuuccauguaa

SEQ ID NO: 312712 - RNA, 64 nt, hsa
aauaucuguugaaccuucaugaccuuaucaacuuuacacccauaucccagcaaaugccacucau

SEQ ID NO: 312713 - RNA, 64 nt, hsa
cauucuuuggaguuaaaaugcacauauagacacauacacccaaacacuuacaccaaacuacuga

SEQ ID NO: 312714 - RNA, 64 nt, hsa
guuuuuuuggcaguugucugcauuaaccuguucauacacccauuuugucccuuuauugaaaaaa

SEQ ID NO: 312715 - RNA, 64 nt, hsa
gcuaagccaucauauccccugugcccugcacguauacacccagauggccugaagcaacugaaga

SEQ ID NO: 312716 - RNA, 64 nt, hsa
gaagaguggguuucacaagugaaaaacauccagauacacccaaaguaucaggacgagaaugagg

SEQ ID NO: 312717 - RNA, 64 nt, hsa
agaauaagacuuauccauuuuuuaauguauuaaauacacccagccaguuaugcagcuacuuuuu

SEQ ID NO: 312718 - RNA, 64 nt, hsa
ccaguaaacgcaggauggaauuuuccugggacucuacacccaucuuaaggugguauaccuucca

SEQ ID NO: 312719 - RNA, 64 nt, hsa
aagagauuccugagccagugucaggaggaaggcuuacacccacaguggaaagacagcuucucau

SEQ ID NO: 312720 - RNA, 64 nt, hsa
uuuacaacucacuggugguuuuccgcauucuuuguacacccaugaaagaaaacuuuuaugcaag

SEQ ID NO: 312721 - RNA, 64 nt, hsa
cuguauuuuucaaguuuucuauaaggaauacacauacacccacaugcacacaccauaguuuuua

SEQ ID NO: 312722 - RNA, 64 nt, hsa
cuguaaauugauauaaauuaguuuucucucgaguuacacccaaguaaugaagacuuaagagaac

SEQ ID NO: 312723 - RNA, 64 nt, hsa
cucccaaguagcugggacuacaggcguucacuacuacacccagcuaauuuuuaaguuuuuuaua

SEQ ID NO: 312724 - RNA, 64 nt, hsa
aauuuaggcaacacucaauuuaccugcgaagcaauacacccagacacaccagucuuguaucucu

SEQ ID NO: 312725 - RNA, 64 nt, hsa
ugcccucuccucuggucccccgcgaaaagguaaauacacccaaagggagggaccuaguuaaguc

SEQ ID NO: 312726 - RNA, 64 nt, hsa
uacuuuuuagcaaauuuuuuuaaucaccucuugcuacacccauucuuuucaugugcagccgacu

SEQ ID NO: 312727 - RNA, 64 nt, hsa
ugcauacuucugacaacuugauaaaaagaaaagcuacacccaaacaauacaacaccaaaaugaa

SEQ ID NO: 312728 - RNA, 64 nt, hsa
cucuccuuaaaaugcauuucaaucagaagcaaaguacacccauuauuuaugcagacauguaaaa

SEQ ID NO: 312729 - RNA, 64 nt, hsa
ugucccucagacuuggauggaguuucugggaggguacacccaaaugaugcagauacuuguauac

SEQ ID NO: 312730 - RNA, 64 nt, hsa
aaaccuuugaguaauaaaucagcacucaaaaauguacacccauuuaguuugugguagcaaagug

SEQ ID NO: 312731 - RNA, 64 nt, hsa
caaagccucggcgcucaccuaagccgcagggagauacacccaacugggagguaagcaucuucca

SEQ ID NO: 312732 - RNA, 64 nt, hsa
gaaacucugucacuccucaugccugucuagcucauacacccauuucucuuugcuucacagguuu

SEQ ID NO: 312733 - RNA, 64 nt, hsa
aauucugauaauuugcuucuuccuauuaaaaccuuacacccauuauugauuuauuuuucuguuu

SEQ ID NO: 312734 - RNA, 64 nt, hsa
gcuccccacguugggcaacuccagccaagauuccuacacccaaaugugaccguguugcucacga

SEQ ID NO: 312735 - RNA, 64 nt, hsa
ugcaagcaacuuucuaaaguuguguacaugaacauacacccacauccagacuacagugauuuag

SEQ ID NO: 312736 - RNA, 64 nt, hsa
accuuuccaccauaagaaaugaauuuucuacuucuacacccauuugagagacaccaauaaaaga

SEQ ID NO: 312737 - RNA, 64 nt, hsa
guaaauauuuccaggcugucagcuucuuuguuaauacacccauggucagcuccuucuacuuauu

SEQ ID NO: 312738 - RNA, 64 nt, hsa
cuugauaucucgaacuuucaaaauauauuuucaguacacccaguugccaaaguuuugcugucuc

SEQ ID NO: 312739 - RNA, 64 nt, hsa
ccuugcaaagcgcuggauuacaggcaugagccacuacacccagccgauuuuuccuuuuugauua

SEQ ID NO: 312740 - RNA, 64 nt, hsa
gugacagggcugccaucgcucaccuguaccuauuuacacccagaacuuuccagcucccccucau

SEQ ID NO: 312741 - RNA, 64 nt, hsa
uggagaaaagaacccgacgucccacagccagauauacacccagcuccaugccagcccuucaugu

SEQ ID NO: 312742 - RNA, 64 nt, hsa
uuccauaccaaagacuuaucacaccaugugccuauacacccagcagcccaagguggagggugcg

SEQ ID NO: 312743 - RNA, 64 nt, hsa
augcaccagucaucauaaaagauggucaugauaguacacccauugcuccuacuuguuacuauua

SEQ ID NO: 312744 - RNA, 64 nt, hsa
cgagaugggaaggcacagggagaagggauaacccuacacccagaccccaggcuggacaugcuga

SEQ ID NO: 312745 - RNA, 64 nt, hsa
ggacaguuccccuucagucccaucccccuacacauacacccagccggggccaaauuuauacuua

SEQ ID NO: 312746 - RNA, 64 nt, hsa
gaggcacugaugcuuguaacucuggaaagaggccuacacccaagggcuaggaauuuuauuuuuc

SEQ ID NO: 312747 - RNA, 64 nt, hsa
cuaagcugguuggaguaggagcgauaccaaaggguacacccaucugugagucacaucuugaaaa

SEQ ID NO: 312748 - RNA, 64 nt, hsa
aauccuauauagucuuauucaccaauauauccaauacacccacagcaaugguaccuuuuuaaga

SEQ ID NO: 312749 - RNA, 64 nt, hsa
uucuccagucugucacccuccuuuccugcucccauacacccaaggcuuguuucuuccccuguaa

SEQ ID NO: 312750 - RNA, 64 nt, hsa
cgucucccucuuuuuguacccaucacuguuggucuacacccaguuuguugaagaacugcggguu

SEQ ID NO: 312751 - RNA, 64 nt, hsa
aaugaguuacgugaaaagagcaucucacuuuuaauacacccagauauuuucuucaagucuuugu

SEQ ID NO: 312752 - RNA, 64 nt, hsa
cuuccuucccaauuucuccuuuguagcaggaaauuacacccagcccucaucucaauuaaugcua

SEQ ID NO: 312753 - RNA, 64 nt, hsa
ccccacccccacagggucagcaacugcuuccgguuacacccaggacuaccccugcccgacccug

SEQ ID NO: 312754 - RNA, 64 nt, hsa
cuucgcuuaaagggaacaccaggcccggcuuuccuacacccagcucucuuuuucuaauguaaau

SEQ ID NO: 312755 - RNA, 64 nt, hsa
gcaaggcuggucuugaacuccugaccucaggugauacacccaucucggccucccaaagugcugg

SEQ ID NO: 312756 - RNA, 64 nt, hsa
acauuuuggaguguccuggcuaccagcucucaccuacacccacgcacccccccacacacuaugc

SEQ ID NO: 312757 - RNA, 64 nt, hsa
guagcccuaacacaugggaugaacguuuuacugcuacacccagauuuguguugaacgaaaacau

SEQ ID NO: 312758 - RNA, 64 nt, hsa
accuggacauuuguaagaauauauuuaauauauguacacccauuauguuuucagguaacaggag

SEQ ID NO: 312759 - RNA, 64 nt, hsa
ugggcauaaaauguucaccuuuuugccagaugaguacacccagaaugcuaauuuuucuguccau

SEQ ID NO: 312760 - RNA, 64 nt, hsa
uaaagaaaaaugccugucucuagcuguucuggacuacacccaagccugauccagccuuuccaag

SEQ ID NO: 312761 - RNA, 64 nt, hsa
cucuucuguacuuugauuguaauagguuggcucuuacacccauuccaaaugcaguuuauuuuua

SEQ ID NO: 312762 - RNA, 64 nt, hsa
uuuuccagcacuuuguaugauuuuggaugaguuguacacccaaggauucuguucugcaacucca

SEQ ID NO: 312763 - RNA, 64 nt, hsa
guggauggcacccgaggcauuauuugaccggaucuacacccaccagagugaugugugaguuugu

SEQ ID NO: 312764 - RNA, 64 nt, hsa
accugagugugccccugccugccagauggacagguacacccaagcacaucucccugcugcaccc

SEQ ID NO: 312765 - RNA, 64 nt, hsa
ugaaaagaagaaagucuaugcuuaggccagucaguacacccaauuuuaaaaaauaacauauucu

SEQ ID NO: 312766 - RNA, 64 nt, hsa
ggguuuccagaguuuggucaccaaaaauacaaaauacacccaaugaauuggacgcagcaaucug

SEQ ID NO: 312767 - RNA, 64 nt, hsa
agagcccuagagaaaugcuguuacuuuuuauuuuuacacccaucagauuuaaggaaaagacuuu

SEQ ID NO: 312768 - RNA, 64 nt, hsa
gggccaggcuggguguccucacaggagugagggcuacacccaauuccaaaagccugagaagaga

SEQ ID NO: 312769 - RNA, 64 nt, hsa
aggcuguucagaccgacguugccaucaaaacacauacacccagaaagaaacaacagaaaccaaa

SEQ ID NO: 312770 - RNA, 64 nt, hsa
aaggaggagaaugcugccuccuuucagucuggucuacacccacuuucugguagccucucugcuu

SEQ ID NO: 312771 - RNA, 64 nt, hsa
aaucccagaaagcuuaaugauaccccaaaaugauuacacccagggaggaaaaaaaggagcgcuu

SEQ ID NO: 312772 - RNA, 64 nt, hsa
cugguugcuuuugaacacuuacuuaguucuuagcuacacccacucuaaaauuaacuggacauua

SEQ ID NO: 312773 - RNA, 64 nt, hsa
acaaaggauaaucuuucuuuucauugacaacaccuacacccaccuguuuuccaguguucuucuc

SEQ ID NO: 312774 - RNA, 64 nt, hsa
ucccucaucccaccccaaauacuuaaaaugacacuacacccagacggcgcccagcuggcugcag

SEQ ID NO: 312775 - RNA, 64 nt, hsa
gugacuuugggugagccuuacagccccugaguccuacacccagaaggcggcugagggaacugag

SEQ ID NO: 312776 - RNA, 64 nt, hsa
uuggagagagcacccuggggccuccgugucgggguacacccagcacuuugcgaccugcggccca

SEQ ID NO: 312777 - RNA, 64 nt, hsa
agggcccaggcuuggggaacagagagagcagguguacacccaaccaaagugauugugcccuugg

SEQ ID NO: 312778 - RNA, 64 nt, hsa
ugcaaaacucuuucaucuugcaaaacugaaacucuacacccauuaaaaaauaacucgccauuuc

SEQ ID NO: 312779 - RNA, 64 nt, hsa
gauaaacaaauggaaaaagaagaugucccuaaccuacacccauagauuaccaagguuucagugu

SEQ ID NO: 312780 - RNA, 64 nt, hsa
ugaggccaccaggcucaagccacugcuguugcauuacacccaucccuuugcaaaaucccuaugg

SEQ ID NO: 312781 - RNA, 64 nt, hsa
cagauaaaacugcccaauacugagagguguuuucuacacccagcuagaggagcacacuccauuu

SEQ ID NO: 312782 - RNA, 64 nt, hsa
gccaggggcaguuggcaaaaguccaaguagagauuacacccagaacaccauuccuuccaggagc

SEQ ID NO: 312783 - RNA, 64 nt, hsa
uugggugcccaggauacuggugccuggccccacguacacccacauacuucucagauggcuccca

SEQ ID NO: 312784 - RNA, 64 nt, hsa
aguucacaaguagauguaauuuacuaaagaaugauacacccauaugcuauauacagcuuaacuc

SEQ ID NO: 312785 - RNA, 64 nt, hsa
aaaggcagcuguucuagaguuucagucaccuaaguacacccacaaaacaauaugaauauggaga

SEQ ID NO: 312786 - RNA, 64 nt, hsa
auaaugggcauuacugaauuuuuaaaaugccgauuacacccaaauauugugcacauuuaauaau

SEQ ID NO: 312787 - RNA, 64 nt, hsa
uugaguagugagaguuuuagaccuuugucuuuaguacacccaaggaucaacugcuccugaagca

SEQ ID NO: 312788 - RNA, 64 nt, hsa
cuaagcucugcuuaugccuaucuugagaugcaauuacacccaauuuccaaugugaacucuugcc

SEQ ID NO: 312789 - RNA, 64 nt, hsa
cauacacaccccugaacacacacacagacacacauacacccaugaugugagcaaacacacacac

SEQ ID NO: 312790 - RNA, 64 nt, hsa
aguccaaaauauuggaaguugaaaaugcauugaauacacccaaccuacugaacaucguagcuua

SEQ ID NO: 312791 - RNA, 64 nt, hsa
cucuagcuucaguugacuucuugacucucuccccuacacccacuaccuggcauccaggaccaaa

SEQ ID NO: 312792 - RNA, 64 nt, hsa
gagugacgguugaagaaucaagcucauaauaugauacacccagacagacccagaaaucuuuuga

SEQ ID NO: 312793 - RNA, 64 nt, hsa
gucgcugcaaccuacccucucucugccucagccuuacacccaagcaguaggucugugcucuccc

SEQ ID NO: 312794 - RNA, 64 nt, hsa
acaaaacacaaacccugaaggaaaaccuuuuccauacacccaggcuaugcauugaagaguuuuc

SEQ ID NO: 312795 - RNA, 64 nt, hsa
gcugcggcuacacauuccacaaagugcuggcacuuacacccacaacccggaaggcuguggaccg

SEQ ID NO: 312796 - RNA, 64 nt, hsa
ugaguaaaauugugcuaaccaguuaaaaguacuguacacccaugcucaauauauaguccuggaa

SEQ ID NO: 312797 - RNA, 64 nt, hsa
agcagagacacgcacaugcacguaagcauguuccuacacccacauggcgugcugucugucugca

SEQ ID NO: 312798 - RNA, 64 nt, hsa
aaaguuguacauacaugugauuacuucuguuuuuuacacccacauacaguacaaaagauuauua

SEQ ID NO: 312799 - RNA, 64 nt, hsa
uuguuccauggguguacacguagacagacacacauacacccaaauuauugcauuaagaauccug

SEQ ID NO: 312800 - RNA, 64 nt, hsa
gcaaagcauccaggcgguucugaaugugaagcacuacacccagcagagucccggugcccucugu

SEQ ID NO: 312801 - RNA, 64 nt, hsa
gcccuccucucaccgcccccacucccugccgugcuacacccagauccugugcaggcugccgggc

SEQ ID NO: 312802 - RNA, 64 nt, hsa
gugugggagcguguugaagauuuuaaguggucucuacacccaaauagugguauucuaaucccgu

SEQ ID NO: 312803 - RNA, 64 nt, hsa
aaaugauuuuccauacauuguacugaucaaguuauacacccagggguauauacacuuucuucau

SEQ ID NO: 312804 - RNA, 64 nt, hsa
uuuguacaugcuuuuaggacagaauggagacuuauacacccaaaguuuaucuguguuuguuugu

SEQ ID NO: 312805 - RNA, 64 nt, hsa
ucuguaauacaauuuuguccuaauuugccuaauuuacacccacauuuuuuccaagauucagcuc

SEQ ID NO: 312806 - RNA, 64 nt, hsa
ucaauucccucuccaggacuccgcaccacuccccuacacccagagcauucucuuccccucaucu

SEQ ID NO: 312807 - RNA, 64 nt, hsa
acagcagggacaagauacauaugaggacaagguauacacccaguucugaauaacuugaagaaca

SEQ ID NO: 312808 - RNA, 64 nt, hsa
gcagauguagcccuugcccaucuucacagacacauacacccaucuuggcacccugauuauucau

SEQ ID NO: 312809 - RNA, 64 nt, hsa
aaggaggagagaaaagcugguccucugcagucuuuacacccacagcucugcccuuuucccuuuc

SEQ ID NO: 312810 - RNA, 64 nt, hsa
ucucuuuuggugugggaggacaugggguaccaccuacacccaacaagucaaugagggacuucuu

SEQ ID NO: 312811 - RNA, 64 nt, hsa
ucaaaaaacaccacccaccaaauugcacaauagauacacccacaaaguugagauucagcguugu

SEQ ID NO: 312812 - RNA, 64 nt, hsa
auucuuucaauuccugcucuucaagccaauuuacuacacccaguugucuuuccagaaguucauc

SEQ ID NO: 312813 - RNA, 64 nt, hsa
uuaaucccauguugacaggaugcccaggucaccuuacacccagcaacccgccuuggcccacagg

SEQ ID NO: 312814 - RNA, 64 nt, hsa
aaccagagucacccgcuggcucuacugagauuguuacacccagaauccuuuuguguuuuuuugu

SEQ ID NO: 312815 - RNA, 64 nt, hsa
ccucaccccccagaugaggccagaccauggacacuacacccagcaauagagacgggacugcgga

SEQ ID NO: 312816 - RNA, 64 nt, hsa
cuugugaauaccugggacuucaggcacgcgccacuacacccagcuaauuuuuaaacuauaauuu

SEQ ID NO: 312817 - RNA, 64 nt, hsa
aauggaccaaaugugccacacgcucgcucuuuuuuacacccagugccucugacucuguccccau

SEQ ID NO: 312818 - RNA, 64 nt, hsa
gucaacaguaaaccacugaaaaaauauauguauauacacccaagaugggcaucuuuuguauuaa

SEQ ID NO: 312819 - RNA, 64 nt, hsa
ccgcugaccuccgcuccucguggcgcccuggcccuacacccagccuggcccagggccggcuuug

SEQ ID NO: 312820 - RNA, 64 nt, hsa
cugggcccuacagccuggagaaccuggagaauccuacacccacagaacccggcuuuguccccaa

SEQ ID NO: 312821 - RNA, 64 nt, hsa
aagcccucgugcacacacacaaauuauucagauguacacccacccacauaucuuacagccagag

SEQ ID NO: 312822 - RNA, 64 nt, hsa
gaaaaauaaucuuagaacagauggcugugaaaauuacacccaugcacagaacaagccacaggaa

SEQ ID NO: 312823 - RNA, 64 nt, hsa
cagaauaauagagcagauaauauauagaguuccauacacccacugcaccccauacccucauucc

SEQ ID NO: 312824 - RNA, 64 nt, hsa
gaauuugaauggguuugauuugcaaauuuggauuuacacccauuguuuuggaagcacaucagcu

SEQ ID NO: 312825 - RNA, 64 nt, hsa
aucuggugccaagaucuacauuucaacccugccuuacacccagagcguccagaucugccacaua

SEQ ID NO: 312826 - RNA, 64 nt, hsa
cauggcuugacuuccuucauuucccuaacugaaauacacccacucucuuggaauaaugacguac

SEQ ID NO: 312827 - RNA, 64 nt, hsa
acaacccguuugcugcagagccggacccaguggcuacacccacagcggucugugguagagaacu

SEQ ID NO: 312828 - RNA, 64 nt, hsa
gcucccagccccucuuggcacucugacacacaaguacacccaucuggggcccgcuuugccacga

SEQ ID NO: 312829 - RNA, 64 nt, hsa
uagccccucacuuccagcuugccuguuucuucucuacacccacccaaaagucacccagggacac

SEQ ID NO: 312830 - RNA, 64 nt, hsa
auucuauuuggcuaauuaagaaugauauacuauguacacccaauaagcuguacuagaaugaaua

SEQ ID NO: 312831 - RNA, 64 nt, hsa
ucuccugcggacuucauugcaggugcaaguugccuacacccaauaccagggauuucaagaguca

SEQ ID NO: 312832 - RNA, 64 nt, hsa
gccugcauucuagugcaaaacaucugaagagcuguacacccacaagggugacuauuuccccuga

SEQ ID NO: 312833 - RNA, 64 nt, hsa
aguauggauuucagaggugcucuuagauuccccauacacccaaggguaauaaacguguacaagu

SEQ ID NO: 312834 - RNA, 64 nt, hsa
aggauuucaggcugagugugguggcucacgccuauacacccagcacuuuggaaggcugaggaag

SEQ ID NO: 312835 - RNA, 64 nt, hsa
accacugcgaggccugcgggaaggacuuccucuuuacacccacagaggugcugcgccaccggaa

SEQ ID NO: 312836 - RNA, 64 nt, hsa
ggaaaggagagagauucuguuuccugaggcuuaauacacccaacauuauaacaaaggacuguag

SEQ ID NO: 312837 - RNA, 64 nt, hsa
auuuuuuucuuuuuucuccuauuugguguuaacauacacccaagcccacccggcccgucgugac

SEQ ID NO: 312838 - RNA, 64 nt, hsa
uuucaccccugcagucucgaccauaagagauggcuacacccaggggggccaguucagagaccca

SEQ ID NO: 312839 - RNA, 64 nt, hsa
gacugccucaccaccccugucccgcugccagaaauacacccacaauaaaaaccugaaaaccaac

SEQ ID NO: 312840 - RNA, 64 nt, hsa
aguggcauagccccuuuuccgguauggggucuccuacacccacgcgcaccaccucuccggucgc

SEQ ID NO: 312841 - RNA, 64 nt, hsa
ccaaguaaacucacuccuuuucccccacagggguuacacccaucugguugucccacccacucuu

SEQ ID NO: 312842 - RNA, 64 nt, hsa
aaaaaaaaaaaaaaaaaagaauaagaggugauauuacacccaugaaacaagaauaagaugcuau

SEQ ID NO: 312843 - RNA, 64 nt, hsa
uauuaaauugauguugcuggacugucauagaaauuacacccaaagagguauuuaucuuuacuuu

SEQ ID NO: 312844 - RNA, 64 nt, hsa
aaggagucugugugguguguaugugcaugcagccuacacccacacguguguaccgggggugaau

SEQ ID NO: 312845 - RNA, 64 nt, hsa
ccuaaccagccacagccaagggcccaagcagaaguacacccacaagcaaggccuuggauuucug

SEQ ID NO: 312846 - RNA, 64 nt, hsa
acucgguucuccaacagcccagagcucacucuuuuacacccagagguggagcagguggcuuagg

SEQ ID NO: 312847 - RNA, 64 nt, hsa
cagucaaagcuggacauuuuuauguugcauuauauacacccaugauauuucuaauaauauaugg

SEQ ID NO: 312848 - RNA, 64 nt, hsa
aagccaauggaacccuugauuuccuaccucaguguacacccaacuauugguuguaucaguuugu

SEQ ID NO: 312849 - RNA, 64 nt, hsa
ucauagacgcuucacagagccugcagggcagcuguacacccagcagaggacuccagccuucucg

SEQ ID NO: 312850 - RNA, 64 nt, hsa
ugcugcuuccaaguuugaguccauguggcuaaaauacacccauuucuucaggaacucuuccccu

SEQ ID NO: 312851 - RNA, 64 nt, hsa
gaucuacacaaacuacaaaaguuaauuuucuuguuacacccacugcacucugcaaccaguguug

SEQ ID NO: 312852 - RNA, 64 nt, hsa
cuucauggccacgcccgaguuucugaucaaugacuacacccacaacaucccgcucauugacgac

SEQ ID NO: 312853 - RNA, 64 nt, hsa
agacacuccccccuccauucccaccccucauaccuacacccaagguugucagcuuuggauugcu

SEQ ID NO: 312854 - RNA, 64 nt, hsa
cuuuccuucuucuauggacuucagacagccagugucuggggacucugccacucuacccccagcc

SEQ ID NO: 312855 - RNA, 64 nt, hsa
ggcugagccugggcgugguggguggggugauggcucuggggagcggcugccauccuacaagcca

SEQ ID NO: 312856 - RNA, 64 nt, hsa
agaggcggcucuggugccccuccucccagcaugcucuggggaggcggcucuggcucuugccuuc

SEQ ID NO: 312857 - RNA, 64 nt, hsa
agaggcggcucuggugcccauccucccagcacgcucuggggaggcggcucuggugcccauccuc

SEQ ID NO: 312858 - RNA, 64 nt, hsa
cuggagccuccauccgcagucacacguguacagaucuggggauuuggauguaggcuuuuucuaa

SEQ ID NO: 312859 - RNA, 64 nt, hsa
gauguggacuggagcaggggaguuuugucuggaaucuggggacaugggguuuggcuuuagcaac

SEQ ID NO: 312860 - RNA, 64 nt, hsa
auccuggccucuggcauauucaucaaguaugaguucuggggaugagucacuguaaugaugugag

SEQ ID NO: 312861 - RNA, 64 nt, hsa
ccagagcaauuuauacuuuacccucaggcuguccucuggggagaaggugccauggucuuaggug

SEQ ID NO: 312862 - RNA, 64 nt, hsa
auuuauaaauuauuaugacaccuuuggguugcaaucuggggauacuggcaaagcagaaaauugu

SEQ ID NO: 312863 - RNA, 64 nt, hsa
aauucucuguuugucuguuguggaaauaaaaccuucuggggaugaaucaaaacuaucugacaau

SEQ ID NO: 312864 - RNA, 64 nt, hsa
agcaggccaccaagagcacaaccccagggcgaggucuggggaggccucccagcccgccucuguu

SEQ ID NO: 312865 - RNA, 64 nt, hsa
uccuuccuggcccuugcauggaugcaguugugacucuggggacaaugcagccagaagcugaggg

SEQ ID NO: 312866 - RNA, 64 nt, hsa
aaaugaugacugagaacaggcuuggaaaagguuuucuggggaggaggaggcuggaggccaggac

SEQ ID NO: 312867 - RNA, 64 nt, hsa
ugcuccuaggaccucccuuggggaaagaggugcuucuggggaagugcugggcauucacucuauu

SEQ ID NO: 312868 - RNA, 64 nt, hsa
aggggccucuggccuggcugaguucacagcccagucuggggacagcuggguaugaggugcuuac

SEQ ID NO: 312869 - RNA, 64 nt, hsa
agaagguccugcagcccccuuccccuggguguguucuggggaccugugguuugcuggcggaaac

SEQ ID NO: 312870 - RNA, 64 nt, hsa
cagcuuccuugucggaggggaaaaggacaggugaucuggggaaaacgcagcuacaccuggagca

SEQ ID NO: 312871 - RNA, 64 nt, hsa
uaaccugaaacauguuacugggacucgacauuuuucuggggauugaaaucuuuaguccuuggag

SEQ ID NO: 312872 - RNA, 64 nt, hsa
gcagucagcacagagagcggcuuccccaucgccuucuggggaggggcuccguguagcaacccag

SEQ ID NO: 312873 - RNA, 64 nt, hsa
gcagucagcacagagagcggcuuccccauugccuucuggggagggacacagaggacagcuuccc

SEQ ID NO: 312874 - RNA, 64 nt, hsa
gcaguuagcacagaggauggcuuccccauugccuucuggggagggacacagaggacggcuuccc

SEQ ID NO: 312875 - RNA, 64 nt, hsa
agugcuucuccaacacugaagugcuugcagaucaucuggggaccugguuugaauggagauucug

SEQ ID NO: 312876 - RNA, 64 nt, hsa
agcaaggauaucagagcugggaaauucauguggaucuggggacugagugugggagugcagagaa

SEQ ID NO: 312877 - RNA, 64 nt, hsa
agcaccccugcccccgguggagggguuguugcuuucuggggaggaggacgguugacggcccugc

SEQ ID NO: 312878 - RNA, 64 nt, hsa
cugccgaugcuccguucacauaagccagugugguucuggggaccugaggagcccuguggcaccc

SEQ ID NO: 312879 - RNA, 64 nt, hsa
cauggugcugggagaggcagcccaggaagucucaucuggggagcaggcagccagcaucugggcc

SEQ ID NO: 312880 - RNA, 64 nt, hsa
gucaugaggagauucugccuuugccaggugacugucuggggagcgggucugcucccaaggggcc

SEQ ID NO: 312881 - RNA, 64 nt, hsa
cgggcugggguuuauuuaaacuguucugugugggucuggggagggagagcaccuuaauauuauu

SEQ ID NO: 312882 - RNA, 64 nt, hsa
aguucucacugucuccuggucugugcugcccugcucuggggaugcacggcggcaggguggggga

SEQ ID NO: 312883 - RNA, 64 nt, hsa
uuguacccguguccuugucuccccuccucccccaucuggggaugugucuguguuccacaccuug

SEQ ID NO: 312884 - RNA, 64 nt, hsa
ccacuggugggugccagggacagguuagggccacucuggggaaggcauuuugguuuuuuauucc

SEQ ID NO: 312885 - RNA, 64 nt, hsa
aaaggagugagcacuuuggguccuuagacucacgucuggggaggaagagcaaguagaaaagugg

SEQ ID NO: 312886 - RNA, 64 nt, hsa
ccuccugaccccucucucccucauguccugggauucuggggaagagaccuagaaacaagcuuuc

SEQ ID NO: 312887 - RNA, 64 nt, hsa
acaggaguggauccaggccugaaggucauacaauucuggggacucucuuuaagaaaaagaauuc

SEQ ID NO: 312888 - RNA, 64 nt, hsa
aguuguagcagagggaaaugagacaggaagaugcucuggggacacauuuuuuauguguuaucuu

SEQ ID NO: 312889 - RNA, 64 nt, hsa
ugaacccucccaacugugggagcuccuuaaacccucuggggagcauacugugugcucuccccau

SEQ ID NO: 312890 - RNA, 64 nt, hsa
gaucuaccugcccaggcccauucccagcuccuugucuggggagccuuggcucugagccucuagc

SEQ ID NO: 312891 - RNA, 64 nt, hsa
ccuguauucccuguuucucaggaacuuacaugggucuggggaggcuagguaggugauuguacgu

SEQ ID NO: 312892 - RNA, 64 nt, hsa
aagaaugcacucugcaggccuggcagaagaguccucuggggaggaccccaagggccggagaccc

SEQ ID NO: 312893 - RNA, 64 nt, hsa
ggacuggcaaaacauuccagaaugaagagagcugucuggggagagcccuucuucccuucuccac

SEQ ID NO: 312894 - RNA, 64 nt, hsa
augauuucguuaguuuuauuaucuguuuacuuccucuggggaaggcagacugauaaaauuauau

SEQ ID NO: 312895 - RNA, 64 nt, hsa
accuuucucagcuggcuguggggaccugucagagucuggggacucggcgugcagggcgggcucc

SEQ ID NO: 312896 - RNA, 64 nt, hsa
aggaaggcggccgcuggggcuccugggcauccucucuggggagcugcuggccgcuuagcguugu

SEQ ID NO: 312897 - RNA, 64 nt, hsa
gugaauucacaucuaggaccucagccauguggccucuggggaaucaguggaugaagacgucccu

SEQ ID NO: 312898 - RNA, 64 nt, hsa
gcuguuuguagguggcuacagugucaauggaggaucuggggaaaauacuuauggucggaagucg

SEQ ID NO: 312899 - RNA, 64 nt, hsa
ucguguuuccgguacuggguaaaaugauucuaccucuggggauaaggauucacauucgcucuag

SEQ ID NO: 312900 - RNA, 64 nt, hsa
agaaagagagggcagugagggugaggagaggggaucuggggacuugggugugacaccugcuuga

SEQ ID NO: 312901 - RNA, 64 nt, hsa
ccccaaauguccaucuuucucagacggggcucugucuggggagcacccacaggcugccuuuggg

SEQ ID NO: 312902 - RNA, 64 nt, hsa
gccaguccuguccuccuuucccuguucugcccacucuggggaauagggaggggaggagaggaga

SEQ ID NO: 312903 - RNA, 64 nt, hsa
uguccccagugguauguauguaugugcuaggcagucuggggacccccugugucucugaccaccc

SEQ ID NO: 312904 - RNA, 64 nt, hsa
aguauggcagauggcacagagaaagggaaggggcucuggggacuucuccuucuaugaaagccuc

SEQ ID NO: 312905 - RNA, 64 nt, hsa
guuggcuuugcccaccccucacuccccagggagcucuggggacagcuuccucacaccccugucc

SEQ ID NO: 312906 - RNA, 64 nt, hsa
gguggugggcaggugacacggaguggcuugagcuucuggggaugcagguccaccgagccccuga

SEQ ID NO: 312907 - RNA, 64 nt, hsa
aacugccuuccucccccugaccccgccccggccuucuggggaaggaacaaaguccccaaacaaa

SEQ ID NO: 312908 - RNA, 64 nt, hsa
aaaaauucuauuuuuguuguaauguccucgcggcucuggggacgcuaaaagaaccgggccugcc

SEQ ID NO: 312909 - RNA, 64 nt, hsa
ugaugcuccuccgggucugcgucgggcgugggucucuggggacccuccagagguggaggugggc

SEQ ID NO: 312910 - RNA, 64 nt, hsa
ugauuuuuuuucuugguuucuggauaaaccacccucuggggacaggauaauaaaacauguaaua

SEQ ID NO: 312911 - RNA, 64 nt, hsa
cugucccuuugaguuccugcuucuuguauauugcucuggggacucucgccggggaagauggggc

SEQ ID NO: 312912 - RNA, 64 nt, hsa
auuugggcaguucccaguccugugggcucggcuaucuggggagcagauuuugggucuggaucuc

SEQ ID NO: 312913 - RNA, 64 nt, hsa
uucccuccacaauaacagaaacacucccagggacucuggggagaggcugaggacaaauaccugc

SEQ ID NO: 312914 - RNA, 64 nt, hsa
gaugagcuagggcucugggggucugccugcacacucuggggagccaggggccccagcacccucc

SEQ ID NO: 312915 - RNA, 64 nt, hsa
ggggcccacccccuucgugcgcaugcuuaaugcuucuggggaggagggggcuggucccagcgga

SEQ ID NO: 312916 - RNA, 64 nt, hsa
agaaaacuaaaaaccaaggcaccuuaccagucugucuggggacaggaucccugcugcaccuucc

SEQ ID NO: 312917 - RNA, 64 nt, hsa
gaaggagaagcugguggccacagcagaguccugcucuggggacgccugcuucauuuacaagccu

SEQ ID NO: 312918 - RNA, 64 nt, hsa
ugucucgcaacagagccugggcugcuccuccugcucuggggagucuaggccguggggacuguuc

SEQ ID NO: 312919 - RNA, 64 nt, hsa
uccugcucuggggagucuaggccguggggacuguucuggggaggcucaugcugucuccaugacg

SEQ ID NO: 312920 - RNA, 64 nt, hsa
cacggaagccccaggcuuuagagcccucagcaggucuggggagcuagagcaaaggagggaccuc

SEQ ID NO: 312921 - RNA, 64 nt, hsa
aggaaggccagggagguccccggggaccuggcauucuggggagacccugcuucuaucuuggcug

SEQ ID NO: 312922 - RNA, 64 nt, hsa
caccugccaacaggccuugcggcaccuuuggaucucuggggacacagccuucgacagggacauc

SEQ ID NO: 312923 - RNA, 64 nt, hsa
uggggccuuucuugaucuccugcuccaccaaggcucuggggaaccugagagugccuagucccca

SEQ ID NO: 312924 - RNA, 64 nt, hsa; identical to SEQ ID NO: 110917

SEQ ID NO: 312925 - RNA, 64 nt, hsa; identical to SEQ ID NO: 110918

SEQ ID NO: 312926 - RNA, 64 nt, hsa; identical to SEQ ID NO: 110919

SEQ ID NO: 312927 - RNA, 64 nt, hsa; identical to SEQ ID NO: 110920

SEQ ID NO: 312928 - RNA, 64 nt, hsa; identical to SEQ ID NO: 110921

SEQ ID NO: 312929 - RNA, 64 nt, hsa; identical to SEQ ID NO: 110922

SEQ ID NO: 312930 - RNA, 64 nt, hsa; identical to SEQ ID NO: 110923

SEQ ID NO: 312931 - RNA, 64 nt, hsa; identical to SEQ ID NO: 110924

SEQ ID NO: 312932 - RNA, 64 nt, hsa; identical to SEQ ID NO: 110925

SEQ ID NO: 312933 - RNA, 64 nt, hsa; identical to SEQ ID NO: 110926

SEQ ID NO: 312934 - RNA, 64 nt, hsa; identical to SEQ ID NO: 110927

SEQ ID NO: 312935 - RNA, 64 nt, hsa; identical to SEQ ID NO: 110928

SEQ ID NO: 312936 - RNA, 61 nt, hsa; identical to SEQ ID NO: 110929

SEQ ID NO: 312937 - RNA, 64 nt, hsa; identical to SEQ ID NO: 110930

SEQ ID NO: 312938 - RNA, 64 nt, hsa; identical to SEQ ID NO: 110931

SEQ ID NO: 312939 - RNA, 64 nt, hsa; identical to SEQ ID NO: 110932

SEQ ID NO: 312940 - RNA, 64 nt, hsa; identical to SEQ ID NO: 110933

SEQ ID NO: 312941 - RNA, 64 nt, hsa; identical to SEQ ID NO: 110934

SEQ ID NO: 312942 - RNA, 64 nt, hsa; identical to SEQ ID NO: 110935

SEQ ID NO: 312943 - RNA, 64 nt, hsa; identical to SEQ ID NO: 110936

SEQ ID NO: 312944 - RNA, 64 nt, hsa; identical to SEQ ID NO: 110937

SEQ ID NO: 312945 - RNA, 64 nt, hsa; identical to SEQ ID NO: 110938

SEQ ID NO: 312946 - RNA, 64 nt, hsa; identical to SEQ ID NO: 110939

SEQ ID NO: 312947 - RNA, 64 nt, hsa; identical to SEQ ID NO: 110940

SEQ ID NO: 312948 - RNA, 64 nt, hsa; identical to SEQ ID NO: 110941

SEQ ID NO: 312949 - RNA, 64 nt, hsa; identical to SEQ ID NO: 110942

SEQ ID NO: 312950 - RNA, 64 nt, hsa; identical to SEQ ID NO: 110943

SEQ ID NO: 312951 - RNA, 64 nt, hsa; identical to SEQ ID NO: 110944

SEQ ID NO: 312952 - RNA, 64 nt, hsa; identical to SEQ ID NO: 110945

SEQ ID NO: 312953 - RNA, 64 nt, hsa; identical to SEQ ID NO: 110946

SEQ ID NO: 312954 - RNA, 64 nt, hsa; identical to SEQ ID NO: 110947

SEQ ID NO: 312955 - RNA, 64 nt, hsa; identical to SEQ ID NO: 110948

SEQ ID NO: 312956 - RNA, 64 nt, hsa; identical to SEQ ID NO: 110949

SEQ ID NO: 312957 - RNA, 64 nt, hsa; identical to SEQ ID NO: 110950

SEQ ID NO: 312958 - RNA, 64 nt, hsa; identical to SEQ ID NO: 110951

SEQ ID NO: 312959 - RNA, 64 nt, hsa; identical to SEQ ID NO: 110952

SEQ ID NO: 312960 - RNA, 64 nt, hsa; identical to SEQ ID NO: 110953

SEQ ID NO: 312961 - RNA, 64 nt, hsa; identical to SEQ ID NO: 110954

SEQ ID NO: 312962 - RNA, 64 nt, hsa; identical to SEQ ID NO: 110955

SEQ ID NO: 312963 - RNA, 64 nt, hsa; identical to SEQ ID NO: 110956

SEQ ID NO: 312964 - RNA, 64 nt, hsa; identical to SEQ ID NO: 110957

SEQ ID NO: 312965 - RNA, 64 nt, hsa; identical to SEQ ID NO: 110958

SEQ ID NO: 312966 - RNA, 64 nt, hsa; identical to SEQ ID NO: 72205

SEQ ID NO: 312967 - RNA, 64 nt, hsa; identical to SEQ ID NO: 72206

SEQ ID NO: 312968 - RNA, 64 nt, hsa; identical to SEQ ID NO: 72207

SEQ ID NO: 312969 - RNA, 64 nt, hsa; identical to SEQ ID NO: 72208

SEQ ID NO: 312970 - RNA, 64 nt, hsa; identical to SEQ ID NO: 72209

SEQ ID NO: 312971 - RNA, 64 nt, hsa; identical to SEQ ID NO: 72210

SEQ ID NO: 312972 - RNA, 64 nt, hsa; identical to SEQ ID NO: 72211

SEQ ID NO: 312973 - RNA, 64 nt, hsa; identical to SEQ ID NO: 72212

SEQ ID NO: 312974 - RNA, 64 nt, hsa; identical to SEQ ID NO: 72213

SEQ ID NO: 312975 - RNA, 64 nt, hsa; identical to SEQ ID NO: 72214

SEQ ID NO: 312976 - RNA, 64 nt, hsa; identical to SEQ ID NO: 72215

SEQ ID NO: 312977 - RNA, 64 nt, hsa; identical to SEQ ID NO: 72216

SEQ ID NO: 312978 - RNA, 64 nt, hsa; identical to SEQ ID NO: 72217

SEQ ID NO: 312979 - RNA, 64 nt, hsa; identical to SEQ ID NO: 72218

SEQ ID NO: 312980 - RNA, 64 nt, hsa; identical to SEQ ID NO: 72219

SEQ ID NO: 312981 - RNA, 64 nt, hsa; identical to SEQ ID NO: 72220

SEQ ID NO: 312982 - RNA, 64 nt, hsa; identical to SEQ ID NO: 72221

SEQ ID NO: 312983 - RNA, 64 nt, hsa; identical to SEQ ID NO: 72222

SEQ ID NO: 312984 - RNA, 64 nt, hsa; identical to SEQ ID NO: 72223

SEQ ID NO: 312985 - RNA, 64 nt, hsa; identical to SEQ ID NO: 72224

SEQ ID NO: 312986 - RNA, 64 nt, hsa; identical to SEQ ID NO: 72225

SEQ ID NO: 312987 - RNA, 64 nt, hsa; identical to SEQ ID NO: 72226

SEQ ID NO: 312988 - RNA, 64 nt, hsa; identical to SEQ ID NO: 72227

SEQ ID NO: 312989 - RNA, 64 nt, hsa; identical to SEQ ID NO: 72228

SEQ ID NO: 312990 - RNA, 64 nt, hsa; identical to SEQ ID NO: 72229

SEQ ID NO: 312991 - RNA, 64 nt, hsa; identical to SEQ ID NO: 72230

SEQ ID NO: 312992 - RNA, 64 nt, hsa; identical to SEQ ID NO: 72231

SEQ ID NO: 312993 - RNA, 64 nt, hsa; identical to SEQ ID NO: 72232

SEQ ID NO: 312994 - RNA, 64 nt, hsa; identical to SEQ ID NO: 72233

SEQ ID NO: 312995 - RNA, 64 nt, hsa; identical to SEQ ID NO: 72234

SEQ ID NO: 312996 - RNA, 64 nt, hsa; identical to SEQ ID NO: 72235

SEQ ID NO: 312997 - RNA, 64 nt, hsa; identical to SEQ ID NO: 72236

SEQ ID NO: 312998 - RNA, 64 nt, hsa; identical to SEQ ID NO: 72237

SEQ ID NO: 312999 - RNA, 64 nt, hsa; identical to SEQ ID NO: 72238

SEQ ID NO: 313000 - RNA, 64 nt, hsa; identical to SEQ ID NO: 72239

SEQ ID NO: 313001 - RNA, 64 nt, hsa; identical to SEQ ID NO: 72240

SEQ ID NO: 313002 - RNA, 64 nt, hsa; identical to SEQ ID NO: 72241

SEQ ID NO: 313003 - RNA, 64 nt, hsa; identical to SEQ ID NO: 72242

SEQ ID NO: 313004 - RNA, 64 nt, hsa; identical to SEQ ID NO: 72243

SEQ ID NO: 313005 - RNA, 64 nt, hsa; identical to SEQ ID NO: 72244

SEQ ID NO: 313006 - RNA, 64 nt, hsa; identical to SEQ ID NO: 72245

SEQ ID NO: 313007 - RNA, 64 nt, hsa; identical to SEQ ID NO: 72246

SEQ ID NO: 313008 - RNA, 64 nt, hsa; identical to SEQ ID NO: 72247

SEQ ID NO: 313009 - RNA, 64 nt, hsa; identical to SEQ ID NO: 72248

SEQ ID NO: 313010 - RNA, 64 nt, hsa; identical to SEQ ID NO: 72249

SEQ ID NO: 313011 - RNA, 64 nt, hsa; identical to SEQ ID NO: 72250

SEQ ID NO: 313012 - RNA, 64 nt, hsa; identical to SEQ ID NO: 72251

SEQ ID NO: 313013 - RNA, 64 nt, hsa; identical to SEQ ID NO: 72252

SEQ ID NO: 313014 - RNA, 64 nt, hsa; identical to SEQ ID NO: 72253

SEQ ID NO: 313015 - RNA, 64 nt, hsa; identical to SEQ ID NO: 72254

SEQ ID NO: 313016 - RNA, 64 nt, hsa; identical to SEQ ID NO: 72255

SEQ ID NO: 313017 - RNA, 64 nt, hsa; identical to SEQ ID NO: 72256

SEQ ID NO: 313018 - RNA, 64 nt, hsa; identical to SEQ ID NO: 72257

SEQ ID NO: 313019 - RNA, 64 nt, hsa; identical to SEQ ID NO: 72258

SEQ ID NO: 313020 - RNA, 64 nt, hsa; identical to SEQ ID NO: 72259

SEQ ID NO: 313021 - RNA, 64 nt, hsa; identical to SEQ ID NO: 72260

SEQ ID NO: 313022 - RNA, 64 nt, hsa; identical to SEQ ID NO: 72261

SEQ ID NO: 313023 - RNA, 64 nt, hsa; identical to SEQ ID NO: 72262

SEQ ID NO: 313024 - RNA, 64 nt, hsa; identical to SEQ ID NO: 72263

SEQ ID NO: 313025 - RNA, 64 nt, hsa; identical to SEQ ID NO: 72264

SEQ ID NO: 313026 - RNA, 64 nt, hsa; identical to SEQ ID NO: 72265

SEQ ID NO: 313027 - RNA, 64 nt, hsa; identical to SEQ ID NO: 72266

SEQ ID NO: 313028 - RNA, 64 nt, hsa; identical to SEQ ID NO: 72267

SEQ ID NO: 313029 - RNA, 64 nt, hsa; identical to SEQ ID NO: 72268

SEQ ID NO: 313030 - RNA, 64 nt, hsa; identical to SEQ ID NO: 72269

SEQ ID NO: 313031 - RNA, 64 nt, hsa; identical to SEQ ID NO: 72270

SEQ ID NO: 313032 - RNA, 64 nt, hsa; identical to SEQ ID NO: 72271

SEQ ID NO: 313033 - RNA, 64 nt, hsa; identical to SEQ ID NO: 72272

SEQ ID NO: 313034 - RNA, 64 nt, hsa; identical to SEQ ID NO: 72273

SEQ ID NO: 313035 - RNA, 64 nt, hsa; identical to SEQ ID NO: 95053

SEQ ID NO: 313036 - RNA, 64 nt, hsa; identical to SEQ ID NO: 95054

SEQ ID NO: 313037 - RNA, 64 nt, hsa; identical to SEQ ID NO: 95055

SEQ ID NO: 313038 - RNA, 64 nt, hsa; identical to SEQ ID NO: 95056

SEQ ID NO: 313039 - RNA, 64 nt, hsa; identical to SEQ ID NO: 95057

SEQ ID NO: 313040 - RNA, 64 nt, hsa; identical to SEQ ID NO: 95058

SEQ ID NO: 313041 - RNA, 64 nt, hsa; identical to SEQ ID NO: 95059

SEQ ID NO: 313042 - RNA, 64 nt, hsa; identical to SEQ ID NO: 95060

SEQ ID NO: 313043 - RNA, 64 nt, hsa; identical to SEQ ID NO: 95061

SEQ ID NO: 313044 - RNA, 64 nt, hsa; identical to SEQ ID NO: 95062

SEQ ID NO: 313045 - RNA, 64 nt, hsa; identical to SEQ ID NO: 95063

SEQ ID NO: 313046 - RNA, 64 nt, hsa; identical to SEQ ID NO: 95064

SEQ ID NO: 313047 - RNA, 64 nt, hsa; identical to SEQ ID NO: 95065

SEQ ID NO: 313048 - RNA, 64 nt, hsa; identical to SEQ ID NO: 95066

SEQ ID NO: 313049 - RNA, 64 nt, hsa; identical to SEQ ID NO: 95067

SEQ ID NO: 313050 - RNA, 64 nt, hsa; identical to SEQ ID NO: 95068

SEQ ID NO: 313051 - RNA, 64 nt, hsa; identical to SEQ ID NO: 95069

SEQ ID NO: 313052 - RNA, 64 nt, hsa; identical to SEQ ID NO: 95070

SEQ ID NO: 313053 - RNA, 64 nt, hsa; identical to SEQ ID NO: 95071

SEQ ID NO: 313054 - RNA, 64 nt, hsa; identical to SEQ ID NO: 95072

SEQ ID NO: 313055 - RNA, 64 nt, hsa; identical to SEQ ID NO: 95073

SEQ ID NO: 313056 - RNA, 64 nt, hsa; identical to SEQ ID NO: 95074

SEQ ID NO: 313057 - RNA, 64 nt, hsa; identical to SEQ ID NO: 95075

SEQ ID NO: 313058 - RNA, 64 nt, hsa; identical to SEQ ID NO: 95076

SEQ ID NO: 313059 - RNA, 64 nt, hsa; identical to SEQ ID NO: 95077

SEQ ID NO: 313060 - RNA, 64 nt, hsa; identical to SEQ ID NO: 95078

SEQ ID NO: 313061 - RNA, 64 nt, hsa; identical to SEQ ID NO: 95079

SEQ ID NO: 313062 - RNA, 64 nt, hsa; identical to SEQ ID NO: 64767

SEQ ID NO: 313063 - RNA, 64 nt, hsa; identical to SEQ ID NO: 64768

SEQ ID NO: 313064 - RNA, 64 nt, hsa; identical to SEQ ID NO: 64769

SEQ ID NO: 313065 - RNA, 64 nt, hsa; identical to SEQ ID NO: 64770

SEQ ID NO: 313066 - RNA, 64 nt, hsa; identical to SEQ ID NO: 64771

SEQ ID NO: 313067 - RNA, 64 nt, hsa; identical to SEQ ID NO: 64772

SEQ ID NO: 313068 - RNA, 64 nt, hsa; identical to SEQ ID NO: 64773

SEQ ID NO: 313069 - RNA, 64 nt, hsa; identical to SEQ ID NO: 64774

SEQ ID NO: 313070 - RNA, 64 nt, hsa; identical to SEQ ID NO: 64775

SEQ ID NO: 313071 - RNA, 64 nt, hsa; identical to SEQ ID NO: 64776

SEQ ID NO: 313072 - RNA, 64 nt, hsa; identical to SEQ ID NO: 64777

SEQ ID NO: 313073 - RNA, 64 nt, hsa; identical to SEQ ID NO: 64778

SEQ ID NO: 313074 - RNA, 64 nt, hsa; identical to SEQ ID NO: 64779

SEQ ID NO: 313075 - RNA, 64 nt, hsa; identical to SEQ ID NO: 64780

SEQ ID NO: 313076 - RNA, 64 nt, hsa; identical to SEQ ID NO: 64781

SEQ ID NO: 313077 - RNA, 64 nt, hsa; identical to SEQ ID NO: 64782

SEQ ID NO: 313078 - RNA, 64 nt, hsa; identical to SEQ ID NO: 64783

SEQ ID NO: 313079 - RNA, 64 nt, hsa; identical to SEQ ID NO: 64784

SEQ ID NO: 313080 - RNA, 64 nt, hsa; identical to SEQ ID NO: 64785

SEQ ID NO: 313081 - RNA, 64 nt, hsa; identical to SEQ ID NO: 64786

SEQ ID NO: 313082 - RNA, 64 nt, hsa; identical to SEQ ID NO: 64787

SEQ ID NO: 313083 - RNA, 64 nt, hsa; identical to SEQ ID NO: 64788

SEQ ID NO: 313084 - RNA, 64 nt, hsa; identical to SEQ ID NO: 64789

SEQ ID NO: 313085 - RNA, 64 nt, hsa; identical to SEQ ID NO: 64790

SEQ ID NO: 313086 - RNA, 64 nt, hsa; identical to SEQ ID NO: 64791

SEQ ID NO: 313087 - RNA, 64 nt, hsa; identical to SEQ ID NO: 64792

SEQ ID NO: 313088 - RNA, 64 nt, hsa; identical to SEQ ID NO: 64793

SEQ ID NO: 313089 - RNA, 64 nt, hsa; identical to SEQ ID NO: 64794

SEQ ID NO: 313090 - RNA, 64 nt, hsa; identical to SEQ ID NO: 64795

SEQ ID NO: 313091 - RNA, 64 nt, hsa; identical to SEQ ID NO: 64796

SEQ ID NO: 313092 - RNA, 64 nt, hsa; identical to SEQ ID NO: 64797

SEQ ID NO: 313093 - RNA, 64 nt, hsa; identical to SEQ ID NO: 64798

SEQ ID NO: 313094 - RNA, 64 nt, hsa; identical to SEQ ID NO: 64799

SEQ ID NO: 313095 - RNA, 64 nt, hsa; identical to SEQ ID NO: 64800

SEQ ID NO: 313096 - RNA, 64 nt, hsa; identical to SEQ ID NO: 64801

SEQ ID NO: 313097 - RNA, 64 nt, hsa; identical to SEQ ID NO: 64802

SEQ ID NO: 313098 - RNA, 64 nt, hsa; identical to SEQ ID NO: 64803

SEQ ID NO: 313099 - RNA, 64 nt, hsa
gguagcucuaucuggugaagugucuugucaguaagugaaacauuuuuuugugguggcuuaucca

SEQ ID NO: 313100 - RNA, 64 nt, hsa
gcauuccacaucagauuuaaagcaucaaaugccugugaaacagcaaagaugguugaagauugug

SEQ ID NO: 313101 - RNA, 64 nt, hsa
uauuaugccuuauuauggcugacguauuacuguggugaaacaaaauaucuuuaaaaguuaaaac

SEQ ID NO: 313102 - RNA, 64 nt, hsa
uaaauuacuuucaggcuauauguauaagguggaugugaaacaugaauuauguaauuagagucgg

SEQ ID NO: 313103 - RNA, 64 nt, hsa
uucgggcuucugacugcuccauagguuuugacuggugaaacaggggcccagaugacaaccucuc

SEQ ID NO: 313104 - RNA, 64 nt, hsa
agagggccucacgccaaacaaacggccuuuucgugugaaacaucuucagggcgggaaaggggcc

SEQ ID NO: 313105 - RNA, 64 nt, hsa
uccccacccccuuuauuuugguccucucguaguugugaaacacuugcagagcaaacaaagcaga

SEQ ID NO: 313106 - RNA, 64 nt, hsa
ccuagaccgcgaggaaguggaaucuuccuuaaaggugaaacauaaguugagaaguagugcuugg

SEQ ID NO: 313107 - RNA, 64 nt, hsa
caaacccagguucaugaauauggugucuauuauagugaaacauguacuuugagcuuauuguuuu

SEQ ID NO: 313108 - RNA, 64 nt, hsa
uuaacauagguuuuuaaagacuaggauauugaaugugaaacauccguuuucauuguucacuucu

SEQ ID NO: 313109 - RNA, 64 nt, hsa
ucgcuguuuccagaacggggaggaguaucucauugugaaacagacucuagagugguucuauuug

SEQ ID NO: 313110 - RNA, 64 nt, hsa
acugauauuucauuauaauuaguucaccuucccugugaaacaagagaauuguaaaauguugugg

SEQ ID NO: 313111 - RNA, 64 nt, hsa
uuguauauuaaaggucuugggguagauggugugugugaaacagugaagucucaacagcagaaaa

SEQ ID NO: 313112 - RNA, 64 nt, hsa
uuaaacagcucaggaagaaauagcuuaagaagaagugaaacauggaucuuggaagaaauuuuga

SEQ ID NO: 313113 - RNA, 64 nt, hsa
uggauacaagaguuaaaacuuccugucccauuuagugaaacaaaagguuaagaaauguggauaa

SEQ ID NO: 313114 - RNA, 64 nt, hsa
uccccaagugacaauacguauagauugcugggcagugaaacaguuaagaugucaccguagcuug

SEQ ID NO: 313115 - RNA, 64 nt, hsa
guuugcugccagcccagaaggaugaaggaaagaagcaccucacagcuccuuucuagguccuucu

SEQ ID NO: 313116 - RNA, 64 nt, hsa
uuccucauuggaagcaaagaccuagccaacaacagcaccucaaucugauacacucccgaugcca

SEQ ID NO: 313117 - RNA, 64 nt, hsa
caccagacucagcacuagcacuccaucagcacuagcaccucacuccaucagcacuagcaccuca

SEQ ID NO: 313118 - RNA, 64 nt, hsa
ccaucagcacuagcaccucacuccaucagcacuagcaccucacuccaucggccccggcacccug

SEQ ID NO: 313119 - RNA, 64 nt, hsa
gcugcgcggguuuccggcugccuguacugggcgugcaccucaaggaccuggugucccugcauga

SEQ ID NO: 313120 - RNA, 64 nt, hsa
uuuucgaccacuuggagacgggggagcuggcucagcaccucaccuaccuggaguuccgguccuu

SEQ ID NO: 313121 - RNA, 64 nt, hsa
ugcuuaggaaagagggccggagaauaagaagccagcaccucaucagucagcccugcaaugugag

SEQ ID NO: 313122 - RNA, 64 nt, hsa
uuucccuuuacucgcuggcagccauugucugugggcaccucauguuuuuccacacucuacuggg

SEQ ID NO: 313123 - RNA, 64 nt, hsa
aacccgugccccccgcccgggcgggguacugccugcaccucagaccucugccugggggcucccu

SEQ ID NO: 313124 - RNA, 64 nt, hsa
cagggcgcguuuccacuuaaggugugucugucacgcaccucauucuccccagacagucuuugag

SEQ ID NO: 313125 - RNA, 64 nt, hsa
ugcauguuaugagcgugugcuuauccguuaaggcuggaggcacaugugggugaugguggaugau

SEQ ID NO: 313126 - RNA, 64 nt, hsa
caggguucccggucaguccggcuggccgccuucauggaggcaucauggcagagcacaugagaug

SEQ ID NO: 313127 - RNA, 64 nt, hsa
uacccaauuucugggcucuggauccucacagucauggaggcaccgugggccuggcacuugcaaa

SEQ ID NO: 313128 - RNA, 64 nt, hsa
aacaaagcucacgcccuaugcaguucugagaagguggaggcaccaggcucaaaagaggaaauuu

SEQ ID NO: 313129 - RNA, 64 nt, hsa
augcagcccagugcagccuugcagaggacaaggcuggaggcauuugucaucacuacagauaugc

SEQ ID NO: 313130 - RNA, 64 nt, hsa
ugcagaagcaccugcuccggcauccagcgcugccuggaggcaggaaggagaggcagggcaggac

SEQ ID NO: 313131 - RNA, 64 nt, hsa
agccagguggccugugcuccccaugggugaccucuggaggcaguggaccaagaugcagcaagga

SEQ ID NO: 313132 - RNA, 64 nt, hsa
aaaaacugacacauggccagugcccggaggggucuggaggcauaagucuagaugcccagagagc

SEQ ID NO: 313133 - RNA, 64 nt, hsa
uaugggggagaaaagggaaaaugcugucaguagauggaggcaagguuacagguugacucaauag

SEQ ID NO: 313134 - RNA, 64 nt, hsa
ccacccaguccauucacccucaccucucccugcauggaggcaacagcauuucaagauguaccuu

SEQ ID NO: 313135 - RNA, 64 nt, hsa
ccugaugcaguuucugugccauugcuggugcugguggaggcagcggagcagaggcucaggcaca

SEQ ID NO: 313136 - RNA, 51 nt, hsa
ggucacacgagccagugugaguggaggcagaggagugaggcccacgggcag

SEQ ID NO: 313137 - RNA, 64 nt, hsa
gcgaccccccgacauagcaaaagguggcaacccauggaggcagaaagaaggacgccagccugac

SEQ ID NO: 313138 - RNA, 64 nt, hsa
uugagucuuuggaugccaacucagcccccugaccuggaggcagccggccaaggccucuagggaa

SEQ ID NO: 313139 - RNA, 64 nt, hsa
ccuuucaacagaauucacuuguggcuauuagagcuggaggcacccuuagccacuucauuccccu

SEQ ID NO: 313140 - RNA, 64 nt, hsa
ucauuuagccuguccugucaucaucauggccagcuggaggcaggggcuuccuggugcuggaggu

SEQ ID NO: 313141 - RNA, 64 nt, hsa
uuagagccagggggagcugggccuggucucacccuggaggcaccugguggccaugcuccucuuc

SEQ ID NO: 313142 - RNA, 64 nt, hsa
gggggagcccuggugaagggcuggaccugacccauggaggcaggaggaagaccuggcuuucuug

SEQ ID NO: 313143 - RNA, 64 nt, hsa
aauggaugcuuucuguugagaaaccaguaccuuguggaggcagguucuugggcugcuacuccag

SEQ ID NO: 313144 - RNA, 64 nt, hsa
uucaugugaaucccagggggcagagaggaggcucuggaggcacacaggaugcagccuucccccu

SEQ ID NO: 313145 - RNA, 64 nt, hsa
uagcuggcuaucucuggccuuacuaacaccccccuggaggcaugccccuuuucuccagcacaca

SEQ ID NO: 313146 - RNA, 64 nt, hsa
cgcugcccgcucagcccagcuguugggaacagcauggaggcagauguggggcugagcuggggaa

SEQ ID NO: 313147 - RNA, 64 nt, hsa
agccggcuaugaaagggagcgagccccucggcucuggaggcaaucaagcagacauagaagagcc

SEQ ID NO: 313148 - RNA, 64 nt, hsa
gcauuguucuugauuaguuuggcacuccauuacguggaggcagcacagugcagacagaccuaau

SEQ ID NO: 313149 - RNA, 64 nt, hsa
aagcagcagaacugacauugggacccagguccauuggaggcaucuuuuaguuaugcgcuugaga

SEQ ID NO: 313150 - RNA, 64 nt, hsa
cagccacaacccugccaccuuggggaauccagccuggaggcauccccuaagcagccagccaugg

SEQ ID NO: 313151 - RNA, 64 nt, hsa
gaggcauccccuaagcagccagccauggccuggguggaggcaccugaagacgucugucccaaac

SEQ ID NO: 313152 - RNA, 64 nt, hsa
uucuauuaguccccacccaaacuuuauugauucaccuccuaaaacaacagauguacgacuugca

SEQ ID NO: 313153 - RNA, 64 nt, hsa
uaagacuuaaugagacuuuaaaagcauuuuuuaaccuccuaaguaucaaguauagaaaaucuuc

SEQ ID NO: 313154 - RNA, 64 nt, hsa
ucaaucauguuuccucucagaugcguccgugaugccuccuaauguggaacugguuguccauugu

SEQ ID NO: 313155 - RNA, 64 nt, hsa
cuguauuuauuuucccuguguuugucucuaguguccuccuaaacagccuuuccugugagucuuu

SEQ ID NO: 313156 - RNA, 64 nt, hsa
agccagaaggugcaggggccaggggugggagcaucggagggagucccagagcccuggaccuugg

SEQ ID NO: 313157 - RNA, 64 nt, hsa
ugaagagacaggcaccccucccagccguggucaacggagggaguggcacuucugccuugagucc

SEQ ID NO: 313158 - RNA, 64 nt, hsa
agguggucuuggggcauggugcagagcaggugaccggagggaaucggugacggagcggggccaa

SEQ ID NO: 313159 - RNA, 64 nt, hsa
gaaucggugacggagcggggccaagggagggguccggagggagucagggauggagggcagaggg

SEQ ID NO: 313160 - RNA, 64 nt, hsa
uguaugaaauaaccacuccguuucuauucuuaaaccuuaccauuuuuguuuuguuuuguuuuuu

SEQ ID NO: 313161 - RNA, 64 nt, hsa
gaagauaaccucuccuccugggccaccuggggcaccuuaccaccggagccgaaucuggucccug

SEQ ID NO: 313162 - RNA, 64 nt, hsa
gcucgcuagcugaucucauuuccuuccaugguuuccuuaccauuuauaugcaaaugacugucag

SEQ ID NO: 313163 - RNA, 64 nt, hsa
uaaaauacguacauuaaaaaaaaaauuauuagguccuuaccaguuacuguccuauagcucauuc

SEQ ID NO: 313164 - RNA, 64 nt, hsa
uauucugcccaacuccauccucuguuacuagaucccuuaccagucacauuuguggacugguggc

SEQ ID NO: 313165 - RNA, 64 nt, hsa
uguugccuugccacguccugucacagcuggguauccuuaccauguuccacgcccuugcaguggg

SEQ ID NO: 313166 - RNA, 64 nt, hsa
aaagcgaauaggcaguuagcacagcacagcuaccccuuaccaagcagucuauggaaacaacccc

SEQ ID NO: 313167 - RNA, 64 nt, hsa
uguuucuccuucuccccgcuucccugggguuuuuccuuaccauaaguauucugguccgaggguu

SEQ ID NO: 313168 - RNA, 64 nt, hsa
augaaaguauaaccaagcauccuuuugggcaauuccuuaccaaaugcagaagcuuuucuguucg

SEQ ID NO: 313169 - RNA, 64 nt, hsa
cuccuguggcggucaccaccaccaccucucccgcccuuaccagcagaaagcaaugcaaacugag

SEQ ID NO: 313170 - RNA, 64 nt, hsa
ugaagcuaaagagauguguagcucacaggggcuaccuuaccaguauaaagagcugauaacagua

SEQ ID NO: 313171 - RNA, 64 nt, hsa
cucaguccaccaacaacaaacguguuugaauucaccuuaccaauauuaaucccagcguguguaa

SEQ ID NO: 313172 - RNA, 64 nt, hsa
ucugaggcuuuaugauaauagauucucuuguauaagauccuagauccuaagggucgaaagcucu

SEQ ID NO: 313173 - RNA, 64 nt, hsa
cuuuaugauaauagauucucuuguauaagauccuagauccuaagggucgaaagcucuagaaucu

SEQ ID NO: 313174 - RNA, 64 nt, hsa
auugggguuagggagguggggaagagauaaucuuucugauuaccuguuuugucuggauggcugg

SEQ ID NO: 313175 - RNA, 64 nt, hsa
aguaucuuggauuaacugaugccugcuagugcuuucugauuacucgcauucuguuucuugcuuu

SEQ ID NO: 313176 - RNA, 64 nt, hsa
ccuugguaaauuauauaaaccuaacuugagcagaucugauuauucuuggauaguauucaagugg

SEQ ID NO: 313177 - RNA, 64 nt, hsa
uugucaagacuuggcuaaccagugagcuuguagcucugauuaucuagcauuuuuagggucauuc

SEQ ID NO: 313178 - RNA, 64 nt, hsa
aaaaagugcuuauuaugugcaacauuaugauuaaucugauuauacaccauuuuugagcagaucu

SEQ ID NO: 313179 - RNA, 64 nt, hsa
cuagagaaucaaguuuauuuuauguauauauuuuucugauuauaagaguaauauauguucauug

SEQ ID NO: 313180 - RNA, 64 nt, hsa
uucugucuucccuuaggaagaacguuaucucucuucugauuaggaaggacuucccuuuugagua

SEQ ID NO: 313181 - RNA, 64 nt, hsa
caauugguucaguaugugaaaccaccauuuccccucugauuaguaaugcuauuuuuauagaaua

SEQ ID NO: 313182 - RNA, 64 nt, hsa
agugaaauagcagugauuucaugucccuguauguucugauuaagucuuauaugcagagaggaca

SEQ ID NO: 313183 - RNA, 64 nt, hsa
agccuuuggggguugauucacagcauuuaagcuuucugauuauaccucucaaacauucuucugu

SEQ ID NO: 313184 - RNA, 64 nt, hsa
ugccuuggguuucugugcagauaaacagaaaugcucugauuagaaaggaaaugaaugguuccac

SEQ ID NO: 313185 - RNA, 64 nt, hsa
cugaagauauuccaacucaaaaccagccucaugcucugauuagauaaucuuuuacauugaaccu

SEQ ID NO: 313186 - RNA, 64 nt, hsa
uaaggucagccucccuuuuuguaaguggcaaauaucugauuaaaucauuucucaguuuauuaau

SEQ ID NO: 313187 - RNA, 64 nt, hsa
auuuugacaguuuaggcuucauuaauagaacuauucugauuauuuggacugcauuaauugguca

SEQ ID NO: 313188 - RNA, 64 nt, hsa
gcuccuguuuagcuuuuauuucaguucuaaccucaguccagaaacauaugugagguuguuuccc

SEQ ID NO: 313189 - RNA, 64 nt, hsa
uuagcucuugcuuuaaguguuuguuuguuaucucaguccagaaccaauauuaucguaauuaauu

SEQ ID NO: 313190 - RNA, 64 nt, hsa
uuugcagcaauuacucacuaaagggcuucauuuuaguccagauuuuuagucuggcugcaccuaa

SEQ ID NO: 313191 - RNA, 64 nt, hsa
caggaugaggaugucaccaacugaauuaaacuuaaguccagaagccuccuguuggccuuggaau

SEQ ID NO: 313192 - RNA, 64 nt, hsa
acagaugcugcugugcugcagacagauacaugcuaguccagagagccgccccugagauggcugu

SEQ ID NO: 313193 - RNA, 64 nt, hsa
aguggaaaauaugaaaagaccacacaggcccagcaguccagaaacugggcaaaaauauucugca

SEQ ID NO: 313194 - RNA, 64 nt, hsa
accucauucuucccuuaucacugaaggaaggaagaguccagaagggccacagagaacucaaacg

SEQ ID NO: 313195 - RNA, 64 nt, hsa
agcucuagagugggagaaagaaugauggaagaagaguccagaacaggccagaaagugaauccag

SEQ ID NO: 313196 - RNA, 64 nt, hsa
cugaaucuuugcgggugaagggaguguugcucccaguccagaggccugauucuguuuggacugg

SEQ ID NO: 313197 - RNA, 64 nt, hsa
uuggaggcacccccaggggcagcccauuucucaaaguccagaaaauuagggucccagaaggggg

SEQ ID NO: 313198 - RNA, 64 nt, hsa
ggcugcucauuccuucuggaggacacacagucucaguccagaugccuuccugucuuucuggccc

SEQ ID NO: 313199 - RNA, 64 nt, hsa
aaaccacguggugucccugcgaauggggcgaucaaguccagagccggggcacuuucagaguuug

SEQ ID NO: 313200 - RNA, 64 nt, hsa
ccaggaguccagccccuccucccucagacccaggaguccagaccccccagccccuccucccuca

SEQ ID NO: 313201 - RNA, 64 nt, hsa
acagauccccagccccuccucccucagacccaggaguccagaccccccagccccuccucccuca

SEQ ID NO: 313202 - RNA, 64 nt, hsa
agguuuuguuuuuuuuuuaaaggaaaugcagccuagucuugagaacauaauuuuauauaaucaa

SEQ ID NO: 313203 - RNA, 64 nt, hsa
auaucuaauaagaguucaaagaguuaugaguugaagucuugaaugcaggaaacuaucugauagu

SEQ ID NO: 313204 - RNA, 64 nt, hsa
aaagugaggccaguguuauuucccgggaguguucagucuugacccuagucacugauuuuuucua

SEQ ID NO: 313205 - RNA, 64 nt, hsa
aaaagccaaacuccaagaccaaguaaguuagaggagucuugauuuuuuagacuucacugcggag

SEQ ID NO: 313206 - RNA, 64 nt, hsa
uacaagcaugcaccacggcacccagcagaauuccagucuugagaaacaggucaaggacagcuuc

SEQ ID NO: 313207 - RNA, 64 nt, hsa
agagacagaaucuugcuauguugugcggcaagcuagucuugaacucauggccucaagucauccu

SEQ ID NO: 313208 - RNA, 64 nt, hsa; identical to SEQ ID NO: 103765

SEQ ID NO: 313209 - RNA, 64 nt, hsa; identical to SEQ ID NO: 103766

SEQ ID NO: 313210 - RNA, 53 nt, hsa; identical to SEQ ID NO: 103767

SEQ ID NO: 313211 - RNA, 64 nt, hsa; identical to SEQ ID NO: 103768

SEQ ID NO: 313212 - RNA, 64 nt, hsa; identical to SEQ ID NO: 103769

SEQ ID NO: 313213 - RNA, 64 nt, hsa; identical to SEQ ID NO: 103770

SEQ ID NO: 313214 - RNA, 53 nt, hsa; identical to SEQ ID NO: 103771

SEQ ID NO: 313215 - RNA, 64 nt, hsa; identical to SEQ ID NO: 103772

SEQ ID NO: 313216 - RNA, 64 nt, hsa; identical to SEQ ID NO: 103773

SEQ ID NO: 313217 - RNA, 64 nt, hsa; identical to SEQ ID NO: 103774

SEQ ID NO: 313218 - RNA, 64 nt, hsa; identical to SEQ ID NO: 103775

SEQ ID NO: 313219 - RNA, 64 nt, hsa; identical to SEQ ID NO: 103776

SEQ ID NO: 313220 - RNA, 64 nt, hsa
cucugaaugaugacccuuccuuaauacugggugaugugugaauauuuguuuguuggcagacagg

SEQ ID NO: 313221 - RNA, 64 nt, hsa
gauuacaggcauaagccacugcgccuggccuugaugugugaauauuugagaggucauaagcagu

SEQ ID NO: 313222 - RNA, 64 nt, hsa
uucacuuuggaugcucugaaacauuuguugauuuugugugaauguuuauaucaaaauguuugcc

SEQ ID NO: 313223 - RNA, 64 nt, hsa
gaguaaaauaauuuaauuaauagcucauauuuuaugugugaaaacauguuagugaacauauaua

SEQ ID NO: 313224 - RNA, 64 nt, hsa
ucuuaaaaucuaucacuuuucaccuuacacuugaugugugaaaacuauaaaaacaaugugugaa

SEQ ID NO: 313225 - RNA, 64 nt, hsa
ccuuacacuugaugugugaaaacuauaaaaacaaugugugaaacccagggguucuaaaauacaa

SEQ ID NO: 313226 - RNA, 64 nt, hsa
uuuguauauuauguauaaauuagaaaaugaaaaaugugugaauaacauuguaugaaauaaaccu

SEQ ID NO: 313227 - RNA, 64 nt, hsa
aagauaauuuaaccaugugaaaagaauuuuuuugugugugaauuaucaaaacacaacucaacua

SEQ ID NO: 313228 - RNA, 64 nt, hsa
cgcauaauauucugugauacagccauuccguacaugugugaaguccugcauaacuuucgaacuu

SEQ ID NO: 313229 - RNA, 64 nt, hsa
gaaaaaucgauaguguuuucuucaaugcugcugcugugugaagccauacuuuuucaggauucuu

SEQ ID NO: 313230 - RNA, 64 nt, hsa
ugauuucacuccuaacugugacauuuuuaucaaaugugugaauaaauacauaaagauugguaca

SEQ ID NO: 313231 - RNA, 64 nt, hsa
cacucccuuggagcucucagaucuacagacaagcugugugaaugcauagauguaaucuugucuc

SEQ ID NO: 313232 - RNA, 64 nt, hsa
aaauaugaugcaauaaauuguuuugaaaaacaguugugugaauauuucaacuaaucuguguugg

SEQ ID NO: 313233 - RNA, 64 nt, hsa
uggaggagguaccagccauauaauaggggguguaugugugaauuuuguuuaaacucuacuguau

SEQ ID NO: 313234 - RNA, 64 nt, hsa
ccuacccugguggauuuuauuccuagauuuggguugugugaaucagauuugggcaucuguuuuu

SEQ ID NO: 313235 - RNA, 64 nt, hsa
uauucugaauaauugccauucagaaugcuauuuuugugugaaaucaaaauaucauugggccaug

SEQ ID NO: 313236 - RNA, 64 nt, hsa
uguuucaaaaauaaaagaacacauuagauguuacugugugaagaauaaugccuuguaugguguu

SEQ ID NO: 313237 - RNA, 64 nt, hsa
ugugaagaauaaugccuuguaugguguugauacgugugugaaguauucuuauuuuauuugucug

SEQ ID NO: 313238 - RNA, 64 nt, hsa
cugaguucugguuuugauucugccacgagccagcugugugaauuuggucaagggaccuaacucu

SEQ ID NO: 313239 - RNA, 64 nt, hsa
auguaagaagauagcacagauaucgggauauuauugugugaaaaugcugcuuuuacuuugaugu

SEQ ID NO: 313240 - RNA, 64 nt, hsa
agaucccuucaucugcacaagcccuggcuagauaugugugaauguguggcaucauuucacuuca

SEQ ID NO: 313241 - RNA, 64 nt, hsa
aaauugguaacucuauuguaaaacaugucaauggugugugaagaaaaaucaaccaaucuguagg

SEQ ID NO: 313242 - RNA, 64 nt, hsa
uguuuuuuuagagcuugauugugggagaaaagcuugugugaaauucccucuucaccuccccacc

SEQ ID NO: 313243 - RNA, 64 nt, hsa
agaacagacuaguuuugaguaaacucaguaugcaugugugaaugcugaaucacaggaauggugu

SEQ ID NO: 313244 - RNA, 64 nt, hsa
ccauuccaucucuugaaaaaauguagucuuugaaugugugaaaaucuagggacauucaaucuag

SEQ ID NO: 313245 - RNA, 64 nt, hsa
agcugcuuccccuccucucauaggccaagccuauugugugaaaccaucucauggucuuggugac

SEQ ID NO: 313246 - RNA, 64 nt, hsa
auacuguagccugauuucauauuguauuuuaaacugugugaaauuaaaaacaaagaauuucauu

SEQ ID NO: 313247 - RNA, 64 nt, hsa
acuggcaaaaggugugugugugaaugugugcaugugugugaauguugugugugugugugugugu

SEQ ID NO: 313248 - RNA, 64 nt, hsa
augugauuuuuguugggcacuggcaaaaggugugugugugaaugugugcaugugugugaauguu

SEQ ID NO: 313249 - RNA, 64 nt, hsa
caauuaaugcugauuuggguacaggggaauuaugugugugaaugucaucuacaauuaaaaaaaa

SEQ ID NO: 313250 - RNA, 64 nt, hsa
auuucucauuugauauaauuuuucucuguuucacugugugaaaaaaagaagauauuucccauaa

SEQ ID NO: 313251 - RNA, 64 nt, hsa
ucuguaauguccccuucuuucuaggcucuguugcugugugaauccauuagauuuacaguaucgu

SEQ ID NO: 313252 - RNA, 64 nt, hsa
aauugcauccucagaugauuauugacugugugugugugugaaaacagacauuccagugccaccc

SEQ ID NO: 313253 - RNA, 64 nt, hsa
gugcccugcucucccguucgccucuuucuguuucugugugaacuuucccgguaauaucacucgu

SEQ ID NO: 313254 - RNA, 64 nt, hsa
uucuuguauauuaaaggucuugggguagauggugugugugaaacagugaagucucaacagcaga

SEQ ID NO: 313255 - RNA, 64 nt, hsa
aagugagugcucgucacuggguucaucagagcagugugugaaauuccauguguuugcugaggug

SEQ ID NO: 313256 - RNA, 64 nt, hsa
aaccuucaaaacaagacauguaugugugcuugagugugugaacacgugugugugugugcacauc

SEQ ID NO: 313257 - RNA, 64 nt, hsa
uguguguguguucaagugcgugacuguaugugugugugugaaccacuguguacuggagccugca

SEQ ID NO: 313258 - RNA, 64 nt, hsa
cauuuucuaauugcaucuccaugggcugugagacugugugaagccguuuguguggucuccaugu

SEQ ID NO: 313259 - RNA, 64 nt, hsa
gcagaggggucucgccaaagcgcaugugugugcaugugugaacguguguguccuuugcaugguu

SEQ ID NO: 313260 - RNA, 64 nt, hsa
cuagguguugggggggaaaguacugugaauaaugugugugaaggacuuuauuccgacuaauacu

SEQ ID NO: 313261 - RNA, 64 nt, hsa
aucuuuguaucauaucuuuuaauugcagaaguaaugugugaauauauuuuccuuauaaaagaug

SEQ ID NO: 313262 - RNA, 64 nt, hsa
ggcaaaacuuccuuggccacgagacucuaggugaugugugaagcugggcagucuguggugugga

SEQ ID NO: 313263 - RNA, 64 nt, hsa
ugcagaaaguuccaucaggcuguuuccuaaaggaugugugaacgggagaugaugcacuguguuu

SEQ ID NO: 313264 - RNA, 64 nt, hsa
uuucuuuugguugauuaaaauugcauaugcuaagugugugaaugaaguaacugacauuguugug

SEQ ID NO: 313265 - RNA, 64 nt, hsa
ggguugguuuaugggcuuuuacuuuggagcacucugugugaagcuguuugguggaacccaugca

SEQ ID NO: 313266 - RNA, 65 nt, hsa
auguuaauauaaguaucuggugaaggaccaaaaccgugugauaagguugugugucgugugggagu

SEQ ID NO: 313267 - RNA, 65 nt, hsa
auuucugaagcguuuguguguguguugaucagguugugugauauuuuugcuugauagagaaucaa

SEQ ID NO: 313268 - RNA, 65 nt, hsa
auuauauaguaaagcugguagccuugaaaaugucagugugauaucuauuauguagauaaauauau

SEQ ID NO: 313269 - RNA, 65 nt, hsa
gagagauggacaaugaaauaucaguugguggauaugugugauagcugauuucaauauugaaguau

SEQ ID NO: 313270 - RNA, 65 nt, hsa
ucccccccgguggaggggcaaauggcugaauccuugugugauauuuuuuucuucgcuuguuuauu

SEQ ID NO: 313271 - RNA, 65 nt, hsa
cugaguucuggggugggaguuuugcucucugucaggugugauaaaauguugaacccuccccacca

SEQ ID NO: 313272 - RNA, 65 nt, hsa
agaggaaccuugugccggccaggcccaguuuccuugugugauacacuaauguauuugcuuuuuuu

SEQ ID NO: 313273 - RNA, 65 nt, hsa
aucugauuugacugggauguuuuaugagaauguaagugugauauuauacugucugccuugcugga

SEQ ID NO: 313274 - RNA, 65 nt, hsa
aaagcugcaugagcuagaauuuguucuagucuucugugugauacucauacuugcuguccagaggg

SEQ ID NO: 313275 - RNA, 65 nt, hsa
gccuccuacaugggcagcaguggacuaagugcugggugugauaaagaggaaugacuuaauuauga

SEQ ID NO: 313276 - RNA, 65 nt, hsa
aucucaaaauguuuaccaauguuuuaagaagcuuugugugauauucuuccaaauguaguuaccaa

SEQ ID NO: 313277 - RNA, 65 nt, hsa
cuugggauggagucaguuguucaggguccccgugugugugauaagcagugcuggcuggcugucuu

SEQ ID NO: 313278 - RNA, 65 nt, hsa
aauugaaaacacacuuccagucuagaugaugcuuugugugauacauuaaguucuuauuuuggauu

SEQ ID NO: 313279 - RNA, 65 nt, hsa
guucggaaaccguccuguguacacaugggaguuuagugugauaaaggcaguauuucagacuggug

SEQ ID NO: 313280 - RNA, 65 nt, hsa
ggugcagaauuucaugcaaaugaggagugccagcagugugauaauuuaaacauauuuaaacaaaa

SEQ ID NO: 313281 - RNA, 65 nt, hsa
gucuuuuucucaggccugagggggaaccauuuuuggugugauaaauacccuaaacugccuuuuuu

SEQ ID NO: 313282 - RNA, 65 nt, hsa
acucaaaugguuacccugcuucuuccuacaaugcugugugauaugggugaacccagccccugacc

SEQ ID NO: 313283 - RNA, 65 nt, hsa
cacacauaggaugguaaugccagucccaggggagggugugauaguaaggaaggccacuguuaggu

SEQ ID NO: 313284 - RNA, 65 nt, hsa
cuuaguggucacagucaucuaaccaaagugaucuagugugauagaucgaaauuaacauauuuuug

SEQ ID NO: 313285 - RNA, 65 nt, hsa
cccuggcugugcaaauaaauggggcugaggccccugugugauauugaaaggguuguugugucugg

SEQ ID NO: 313286 - RNA, 65 nt, hsa
uuuuuagagauuacagaauuuuuaaacagggagacgugugauauacucccucccuucccuacuau

SEQ ID NO: 313287 - RNA, 65 nt, hsa
agugauguguguauauuauucaaaaaaauguacuggugugauaucuuguaugaaugaucauuuaa

SEQ ID NO: 313288 - RNA, 65 nt, hsa
aacaugaaaucuuauaagguuucaguuugacagaagugugauauauguaacuugugccauggacc

SEQ ID NO: 313289 - RNA, 65 nt, hsa
uuauaauuuuuucaacuccuauuguguuucuuugugugugauauuuuaaucaaaagugguugagu

SEQ ID NO: 313290 - RNA, 65 nt, hsa
uuugauagugaaucaugacccuaagggagagauuugugugauaaaaguauuguauauaauagauc

SEQ ID NO: 313291 - RNA, 65 nt, hsa
auucuucaggucucuaagccccuggaagcagcauugugugauauucucagaggcaggggaaaaua

SEQ ID NO: 313292 - RNA, 65 nt, hsa
uuguugaaguuauuuguaauucagaaaccuugcuugugugauacauagucucuucauuuauuacu

SEQ ID NO: 313293 - RNA, 65 nt, hsa
cccauauaauugguaauggauaacuuaauaaauuugugugauauaaaaguaguguaucauguucu

SEQ ID NO: 313294 - RNA, 65 nt, hsa
gugucuacugauaaaauuaucccaaagguagguuggugugauaguuuccgaguaagaccuuaagg

SEQ ID NO: 313295 - RNA, 65 nt, hsa
cugugauuaacagugaagaccuuguaaaugcagaugugugauaaagcauuuagucagucccccaa

SEQ ID NO: 313296 - RNA, 65 nt, hsa
gcauuuaucuuuuaaaacuucacuaauauagcauugugugauaagcacuaagcagucaguccccu

SEQ ID NO: 313297 - RNA, 65 nt, hsa
gaccuguacuccacaugcaacccaacagcagugcagugugauaacugagcggucgcauggcagag

SEQ ID NO: 313298 - RNA, 65 nt, hsa
cuugagguuuuguucaugcccccuuugacugaucagugugauaaggacuuuaggaaaaaaagcau

SEQ ID NO: 313299 - RNA, 65 nt, hsa
acugguugcuagucaauguucuauauuuaaugaaugugugauaaaucauccuguaaucaguaugg

SEQ ID NO: 313300 - RNA, 65 nt, hsa
uuucucuguauuccgauacaaaguguuguaucaaagugugauauacaaaguguaccaacauaagu

SEQ ID NO: 313301 - RNA, 65 nt, hsa
acguuaguuauaaucaccuuguaucucuaaauauggugugauaugaaccaguccauucacauugg

SEQ ID NO: 313302 - RNA, 65 nt, hsa
aaauguaaaauugaaaauucauuugcuguuucaaagugugauaucuuucacaauagccuuuuuau

SEQ ID NO: 313303 - RNA, 65 nt, hsa
uuuggguuugaauuccagcucuacuauuuuugguugugugauagaguuauuuaaccucucugagc

SEQ ID NO: 313304 - RNA, 65 nt, hsa
ugcaaacaggaucuaagcuuaggaauaauauuuaggugugauauaguguuagauuuuuuugaugu

SEQ ID NO: 313305 - RNA, 65 nt, hsa
cucugcagagggggucauuccaggcccuccagugugugugauagucaccaugccaugcagggaua

SEQ ID NO: 313306 - RNA, 65 nt, hsa
auggcaguuucagcguucaaacagcaauagcucaagugugauaacuacugaggauaauaaaaucc

SEQ ID NO: 313307 - RNA, 65 nt, hsa
ugcuuguauguaaaacccaaauaaagguagaguaagugugauauaugggaguauuaaaauagcuu

SEQ ID NO: 313308 - RNA, 65 nt, hsa
cucccccaucccccgaccccaccacaguccccagagugugauauuccccuuccuguguccacgug

SEQ ID NO: 313309 - RNA, 65 nt, hsa
aaaaaaaaaaaaacucaagauaguaaaagcaccuagugugauagauuaucgguuaggucauuugu

SEQ ID NO: 313310 - RNA, 65 nt, hsa
uccucauuaaaaacaaauacuucuacuguuugggugugugauaggguucucaaugcagaucuccc

SEQ ID NO: 313311 - RNA, 65 nt, hsa
ccuaccugugugauucaguaggguuugagacuuacgugugauacugacagguaagcaacagugcu

SEQ ID NO: 313312 - RNA, 65 nt, hsa
agugacauuucuaucacaaucauuuuauggaagaugugugauaaucuguuuuuacugguauuaau

SEQ ID NO: 313313 - RNA, 59 nt, hsa
cuaacagcagugagauuuaaaaagagcuagugugauaauccuaacucuacuacgcauua

SEQ ID NO: 313314 - RNA, 65 nt, hsa
gcuaagguauaaggagaaaggagauugguaaggaagugugauacauauugaaucaggugucaagg

SEQ ID NO: 313315 - RNA, 65 nt, hsa
ggauuuuccucccacuuagacucaaacacauuuuagugugauauuucauuuauuauagguaguau

SEQ ID NO: 313316 - RNA, 65 nt, hsa
uuuuucuagacugucucuguggaauauauuugugugugugauauaugcaugugugugaugguaug

SEQ ID NO: 313317 - RNA, 65 nt, hsa
ucuuuuugcauugugaaaaaaacaaaauaaauuuugugugauaauuuugaugaugaaagguggaa

SEQ ID NO: 313318 - RNA, 65 nt, hsa
cgaacuaauaaaaaucuauaugacuuuuuauuauugugugauaaccaaguaaauguuuucuauuu

SEQ ID NO: 313319 - RNA, 65 nt, hsa
guguaauaucuuauguguauauagcauccugagcugugugauacaguagauuucuucuuagcaga

SEQ ID NO: 313320 - RNA, 65 nt, hsa
uaccaugaagaagaauaaaugaggguaaggggcuagugugauagggagaggggugggaugccauc

SEQ ID NO: 313321 - RNA, 65 nt, hsa
gugugaaggauuuccuaacagcuuuagaaaucuuagugugauacaucucucauacaguuuggggu

SEQ ID NO: 313322 - RNA, 65 nt, hsa
guguuuuuauguggcugcccaacguggagcgggcagugugauaggcugggugggcuaagcagccu

SEQ ID NO: 313323 - RNA, 65 nt, hsa
uuaaaaaaacaaaaauguacaugugauguuaguaggugugauaugcaaccugguauacagacauu

SEQ ID NO: 313324 - RNA, 65 nt, hsa
gaauguuucugcagaucuuguggcauuugucucuagugugauauauaaagguguaauuaagacag

SEQ ID NO: 313325 - RNA, 65 nt, hsa
aauagagcuuuuauauaaaguuuuaaaaauugaaugugugauauguguucuuugaagguuuuuua

SEQ ID NO: 313326 - RNA, 65 nt, hsa
ggucuucaaaguagccugacugugugcaugugugugugugauagguuauuuauaaagacuuugga

SEQ ID NO: 313327 - RNA, 65 nt, hsa
gagggauguuagcuuuguggcagaauucccugcaugugugauaacugaucuuguuuuauuuuuug

SEQ ID NO: 313328 - RNA, 65 nt, hsa
uaaauucuguuuaauuacaucuguaaauauuaugugugugauaguauucaauaaaguaaaaucaa

SEQ ID NO: 313329 - RNA, 65 nt, hsa
ggaguggagugucuccuggagagagugaggagagugugugauagcuagaaagagagagagacaga

SEQ ID NO: 313330 - RNA, 65 nt, hsa
uaacuguauaaagaaucuaugacuuuuugagggaagugugauauauuaacaaauauaaccaauuc

SEQ ID NO: 313331 - RNA, 65 nt, hsa
ccccuggaggaaauaauauuuucaaacugucguuggugugauacuuuggcucaaaggaucuuugc

SEQ ID NO: 313332 - RNA, 65 nt, hsa
aaccuugcgauuugcacauauugaguuuauaacuugugugauauuccugcaguuuuuauccaaua

SEQ ID NO: 313333 - RNA, 65 nt, hsa
guuauguuucuguuuguucccucccccucccccuugugugauaccacauguguauaguauuuaag

SEQ ID NO: 313334 - RNA, 65 nt, hsa
aauuccauuaauuaccaagcccucacccagcccaugugugauaggauuuauguaggaagaaacuu

SEQ ID NO: 313335 - RNA, 65 nt, hsa
auuaucuuuucuucuguaucucuguuacaagcguagugugauaauaccagauaauaaggaaaaca

SEQ ID NO: 313336 - RNA, 65 nt, hsa
aauguuuagcaguauccccuucccacuuauauauugugugauaugauuuugcuugccuauaggag

SEQ ID NO: 313337 - RNA, 65 nt, hsa
uugaaauaggaaugguuuucucaagaauagauuuggugugauaccuuguguuugcuuacauuggc

SEQ ID NO: 313338 - RNA, 65 nt, hsa
auccuucccucaucccaucacacaacuuuuuuugugugugauaaacugauuuugguuugcaauaa

SEQ ID NO: 313339 - RNA, 65 nt, hsa
cauuuuuuguucuuuucuugacuccuuucucaagugugugauaaggucugcugauaaaauauuua

SEQ ID NO: 313340 - RNA, 65 nt, hsa
cuguaaagucugaguaagaaacuucaugcuggccugugugauacaagagucagcaucauuaaagg

SEQ ID NO: 313341 - RNA, 65 nt, hsa
cuugagcaugcauuucucacaauaauuauuaagcugugugauaauuucugcuuucaggacacuca

SEQ ID NO: 313342 - RNA, 65 nt, hsa
acucauucagacugacuucuacaggacuucuacgugugugauaaaagccugugaaucgugagucc

SEQ ID NO: 313343 - RNA, 65 nt, hsa
aagugaaacugcuaaauauguauagagagguugacgugugauacgugggacaguucacauagaca

SEQ ID NO: 313344 - RNA, 65 nt, hsa
auccacgccaaguggaagccacuggaccacaggaggugugauagagccuuugaucuucaggaugc

SEQ ID NO: 313345 - RNA, 65 nt, hsa
cuuuaaccacugaagauugcuguaaauuauaaagggugugauagaauccacauggcugucaagaa

SEQ ID NO: 313346 - RNA, 65 nt, hsa
gucccugagaacacagacaaugaccacuacccugggugugauaucacaggaggccagagagaggc

SEQ ID NO: 313347 - RNA, 65 nt, hsa
gguuaauuaagaauguugguuauuuucacgggagcgugugauauuuaacauuaauauuuuauuug

SEQ ID NO: 313348 - RNA, 65 nt, hsa
aacuauaggaugauuggaauuauuaauuuuuaaaggugugauaagauacugcacuuggcugggca

SEQ ID NO: 313349 - RNA, 65 nt, hsa
uuuaaauacuuaaccacuaauuuugaaaauuaccagugugauacauaggaaucauuauucagaau

SEQ ID NO: 313350 - RNA, 65 nt, hsa
uuuuuucuucccaggcaauacaccucugaacaugugugugauaaauggguuugcuaaugugcugu

SEQ ID NO: 313351 - RNA, 65 nt, hsa
gcucccaagggcugacauggugugagugugugggugugugauaagcuucucaucccugcauagau

SEQ ID NO: 313352 - RNA, 65 nt, hsa
cagcuuacauuuuguuauuucuauuuuuauaaauugugugauaauuagagguaagaauaacaagu

SEQ ID NO: 313353 - RNA, 65 nt, hsa
auuaugauuccuguauuauuucagugagagcuacagugugauauuucagagucuauuaaauaaaa

SEQ ID NO: 313354 - RNA, 65 nt, hsa
cggcagcucacuaggauuuugcugaacauuaaaaagugugauagcgauauuagugccaaucaaau

SEQ ID NO: 313355 - RNA, 65 nt, hsa
uuaacgcacuuggaguaauuuuuaugaaauacugcgugugauaagcaaacgggagaaauuuauau

SEQ ID NO: 313356 - RNA, 65 nt, hsa
aaaaagagcaucccuaugggcuuggaccacuuacagugugauaaggccuacuauacauuaggaag

SEQ ID NO: 313357 - RNA, 65 nt, hsa
uauaauugcauacacaugccuccaugcauauaugugugugauaauacacaugcauuuaugugcgu

SEQ ID NO: 313358 - RNA, 65 nt, hsa
auuuuauuauuguguauaucuaauauauuaaguaugugugauacuaagguuugacugcuauaauu

SEQ ID NO: 313359 - RNA, 65 nt, hsa
aaccaaagaaaucaauggaacccuugcacaaaaaagugugauaaauauuuuuaaauaaaaacuua

SEQ ID NO: 313360 - RNA, 65 nt, hsa
uugauggauucuuccauccugccggaugagugugggugugauacagccuacauaaagacuguuau

SEQ ID NO: 313361 - RNA, 65 nt, hsa
aagauaguggcuacugauguucaagugggauugaagugugauaaauggauauauuuuguuguuug

SEQ ID NO: 313362 - RNA, 65 nt, hsa
auuuuucuaauuaguggaucuuuuuccacuggaaagugugauagcucauugcuaauuuuucauuc

SEQ ID NO: 313363 - RNA, 65 nt, hsa
aauauuugcucugggucaggaagaagcuguucacggugugauaauacucuuuagauugugcuuuc

SEQ ID NO: 313364 - RNA, 65 nt, hsa
aggggaacagauuuuucauuguaauaguggaaguugugugauaguuaggagauaucaacaugcau

SEQ ID NO: 313365 - RNA, 65 nt, hsa
guguguacguauguguguguucuacaagaacggaagugugauauguuuaaagaugaucagagaaa

SEQ ID NO: 313366 - RNA, 65 nt, hsa
uaacagaaauaagaagaaaacaggugaaaaagacagugugauaaggccauggugguggauugugg

SEQ ID NO: 313367 - RNA, 65 nt, hsa
caucucaguugguggguguuaagcuagaaugggcugugugauaggaaacaaaugccuuacagaug

SEQ ID NO: 313368 - RNA, 65 nt, hsa
agggucucuauugucacccaggcuggagugugguggugugauaauagcucaccuugaccuccuag

SEQ ID NO: 313369 - RNA, 65 nt, hsa
gcuuuuuuuuuuuuuuuuuuacaaaaugaugauuagugugauaaugugcugcaaaaaauauccaa

SEQ ID NO: 313370 - RNA, 65 nt, hsa
ugauuaacuuaugaaaaaauuauuuggggacaggagugugauaccuuccuugguuuuuuuuugca

SEQ ID NO: 313371 - RNA, 65 nt, hsa
gaagaaaagcuuuucaacagccuuucuauaucaucgugugauaauuguucaccaaugaaugaguc

SEQ ID NO: 313372 - RNA, 65 nt, hsa
ggaggacucaguuucuccacagccuucuccagccugugugauacaaguuugaucccaggaacuug

SEQ ID NO: 313373 - RNA, 65 nt, hsa
cuugguccucagcaacugucuggauccugacaggugugugauaauuacuuagugaauucaugggu

SEQ ID NO: 313374 - RNA, 65 nt, hsa
aucucgcuuuauccaccauaacguaaagaacugcggugugauaacagccuucacggggccacggu

SEQ ID NO: 313375 - RNA, 65 nt, hsa
auccauaaaaauuuaaagugagaggcaugguuagugugugauacaauaaaaaguaauuguuuggu

SEQ ID NO: 313376 - RNA, 65 nt, hsa
ucgcuccccuuuuuuuaaaaaggacuguuuugcuagugugauaaugaauagguaagauaugagau

SEQ ID NO: 313377 - RNA, 65 nt, hsa
aacucaaucacucagccccuccaaagauaguugaugugugauaaucucauaauguugagaacccu

SEQ ID NO: 313378 - RNA, 65 nt, hsa
cuaaaggguagaccuggaccugccaccuaugaguugugugauauagaaaaaaaucucuuagcucu

SEQ ID NO: 313379 - RNA, 65 nt, hsa
uguucuguaaauaaaaucuuugaucacaccacucagugugauaauugugucuacagcuaaaaugg

SEQ ID NO: 313380 - RNA, 65 nt, hsa
caucaagaugaaacaggacaggagagaacuguucagugugauacagagcugccauuuccaaagua

SEQ ID NO: 313381 - RNA, 65 nt, hsa
gucaacauaugugauuguuccauaauaaacuucuggugugauacuuucaucuuguaaaucugcuu

SEQ ID NO: 313382 - RNA, 65 nt, hsa
aaagaggccggucaccagaagccagcaggcguggggugugauacucucuauagccacuacagggc

SEQ ID NO: 313383 - RNA, 65 nt, hsa
acuguauccaucuauacuuggcagcaacaugagaagugugauacaugugaacccaacaaauucaa

SEQ ID NO: 313384 - RNA, 65 nt, hsa
auucauaaauucaagcacuaccacuggucaguuuugugugauagaauaaaaauauguuaccugca

SEQ ID NO: 313385 - RNA, 65 nt, hsa
agauccuugucaagcuuucuucuguggucugauuagugugauaccggggcaccuccucugguacu

SEQ ID NO: 313386 - RNA, 65 nt, hsa
augaguaugcagaggaguuuucaagaggcuaucuggugugauauuguaauaggcugaaugcaaaa

SEQ ID NO: 313387 - RNA, 65 nt, hsa
guucuaugguuaguuuugcagguuugcauccagcugugugauauucugcugugcaaauccaugca

SEQ ID NO: 313388 - RNA, 65 nt, hsa
gagauacacuagcaauuuuuuuaaaaacuggaacagugugauaggaagccugcuggaugauuucu

SEQ ID NO: 313389 - RNA, 65 nt, hsa
cauaucaugaacagcguaaguuccuacacacggacgugugauacacacaugcauguacagguaag

SEQ ID NO: 313390 - RNA, 65 nt, hsa
aaccagucuaucagggaggcugaagcaagggcgcagugugauauuuuaggaauacagaagauuua

SEQ ID NO: 313391 - RNA, 65 nt, hsa
cuucuggccguccuugucucugggccacuuggagugugugauaaaucagucaagcuguugaaguc

SEQ ID NO: 313392 - RNA, 65 nt, hsa
agaaaaaacuugaaagaacacuucuaagccuaagugugugauacaguuuguuacuuuuaaguaca

SEQ ID NO: 313393 - RNA, 65 nt, hsa
uggucauuugagaauuuuuuuuguacagcauucaugugugauauuuuccagauuuguuggaucua

SEQ ID NO: 313394 - RNA, 65 nt, hsa
ucaguacucacauggauuuuuaagauaaaucaccugugugauaauauuuugaaucugagacgaau

SEQ ID NO: 313395 - RNA, 65 nt, hsa
cagugugaauguaucauguuuuacuuuaaaugugugugugauacuucuucauuauguccugcgcu

SEQ ID NO: 313396 - RNA, 65 nt, hsa
uauaagaaguuaauuuuugaaaaugacauauuuuugugugauagaaagaauggagcaaguugugc

SEQ ID NO: 313397 - RNA, 65 nt, hsa
aacauaacaaaacccaguagucaccaaggcagguagugugauaaaugaacacaccacucugaggc

SEQ ID NO: 313398 - RNA, 65 nt, hsa
caguuuuacuuuuguauauaaaucuaagacugccugugugauaaaacacuuguuuaaaaaaaaaa

SEQ ID NO: 313399 - RNA, 65 nt, hsa
uguggacacgcuugguuugcucuauuuuuguuuaugugugauagugguucugucaucaucauuca

SEQ ID NO: 313400 - RNA, 65 nt, hsa
ugcaugucaccuugaugggggcugugaguggggcagugugauacccagugacuagacgcacucug

SEQ ID NO: 313401 - RNA, 65 nt, hsa
acucuagguugaugcauuuuguacuuagcuguacugugugauauuuuucauuauuuuaggacgcc

SEQ ID NO: 313402 - RNA, 65 nt, hsa
gcacauccacggugggugaguggccaagacaagcagugugauagaguccuugguggguuuaguca

SEQ ID NO: 313403 - RNA, 65 nt, hsa
guuuuuaaugaacauuugucuuucagaauaggauugugugauaauguuuaaauggcaaaaacaaa

SEQ ID NO: 313404 - RNA, 65 nt, hsa
uguuacuguauuuaguuugugauaaauuuuucacugugugauauuuaugcucuaaaucacuacac

SEQ ID NO: 313405 - RNA, 65 nt, hsa
acuuaggaacccuggcaucuuuucuauauuauccagugugauaaucuuuucacguuuuauagagc

SEQ ID NO: 313406 - RNA, 65 nt, hsa
uggccaagaauaccacuuuugaaguuaauccuuuugugugauacaggaugaacuugggauguuug

SEQ ID NO: 313407 - RNA, 65 nt, hsa
acucuccauauauuuauuuguuuggaaucacucuugugugauauaaaggcguguauauuaucuuu

SEQ ID NO: 313408 - RNA, 65 nt, hsa
agcagguuggagugacuggugggccuagaucacuggugugauaaaccccaauuuucaccccgggg

SEQ ID NO: 313409 - RNA, 65 nt, hsa
guaccuacguacuuauaucagcaccauguauguaggugugauaguacuuucaaacagcgccucca

SEQ ID NO: 313410 - RNA, 65 nt, hsa
ccugcggcaauagacuggaacgauuaaggaccauggugugauagaucccauuucaaaugauucca

SEQ ID NO: 313411 - RNA, 65 nt, hsa
gucaagugaaaggguagggggauaguccugaucaagugugauaaauuuuuauagacauauauaaa

SEQ ID NO: 313412 - RNA, 65 nt, hsa
gaagagagaaggaaauuuuaucaauuaaaaaugcugugugauaaaaucccagcccagauugcuca

SEQ ID NO: 313413 - RNA, 65 nt, hsa
ccauuuucaaaagacaguguugaauaaacauaccugugugauaaaacacagaauuuacauauaca

SEQ ID NO: 313414 - RNA, 65 nt, hsa
guuuuuuuuuuuuuuaguguguguuuucccuccaagugugauauuuccugcugaauuaaauuaua

SEQ ID NO: 313415 - RNA, 65 nt, hsa
caauacagucugauuuagaagucaucuuuucagccgugugauaauuaacaugguaagccuuagca

SEQ ID NO: 313416 - RNA, 65 nt, hsa
aauauuuaaauuggucagucagguagaagauacaugugugauauagaaaaauaaugccucuccug

SEQ ID NO: 313417 - RNA, 65 nt, hsa
ggaauuuaaagacucauccccagccuccaccuccugugugauacuugggggcuagcuuuuuucuu

SEQ ID NO: 313418 - RNA, 65 nt, hsa
cacuguaugauauaaaguuauagucauuuaaaaaugugugauauuaguacauuaguagguaaaug

SEQ ID NO: 313419 - RNA, 65 nt, hsa
cuuaucaucauugccuuuccacuacucuacuaucugugugauauuagacaaaauauuugcuucuu

SEQ ID NO: 313420 - RNA, 65 nt, hsa
ugacacguaaguguuguacauauuuaugggguacagugugauauuuaaauauauguauaugaugu

SEQ ID NO: 313421 - RNA, 65 nt, hsa
ugacacauaacuguuguacucauuuaugggguacagugugauaguuaaugcaaguauacaaugug

SEQ ID NO: 313422 - RNA, 65 nt, hsa
guccaugauggugaugaaucuauuaaucaugaugagugugauaggggugcucuucaagacuuaga

SEQ ID NO: 313423 - RNA, 65 nt, hsa
ggcuguagcuuuguaggauauuuggggauuccauagugugauauccccuucuucccuuugcucaa

SEQ ID NO: 313424 - RNA, 65 nt, hsa
gccagguaagaacaguaauuggcccagacagguaggugugauaaacagaguagaaaagauugugg

SEQ ID NO: 313425 - RNA, 65 nt, hsa
ugacaauauuagauaauauuaagaaacuuuguuaugugugauaauagcauugugguuauguaaaa

SEQ ID NO: 313426 - RNA, 65 nt, hsa
auuuucuagucugcauaggaagggaacaccuggacgugugauaaauagguuagcacuucaguuac

SEQ ID NO: 313427 - RNA, 65 nt, hsa
ugggccugacccuuccugucccagggcccaggucugugugauaucuguauauauugcauuuuguu

SEQ ID NO: 313428 - RNA, 65 nt, hsa
aacuuuaauugcauccuaucagauuguugaggugggugugauagucuucaggugcagugcguuca

SEQ ID NO: 313429 - RNA, 65 nt, hsa
gaauuuccucuuccugugcaaauuccucuagucaagugugauauaucaagaaaucugaggaggau

SEQ ID NO: 313430 - RNA, 65 nt, hsa
ucagaucccauuuccgucugcccccucgucaccaggugugauagccccagccaggucacaccugg

SEQ ID NO: 313431 - RNA, 65 nt, hsa
gagcgcacaccacuggcgugagacagcgcuugguggugugauacuuuuggugcuguguauaguau

SEQ ID NO: 313432 - RNA, 65 nt, hsa
gaaaacucuaaaguucugacuucaaucaacgguuagugugauacugccaaagaacuguauacugu

SEQ ID NO: 313433 - RNA, 65 nt, hsa
gaaaucucuucagaaauaagaagcuauuucauuaagugugauauaaaccuccucaaacauuuuac

SEQ ID NO: 313434 - RNA, 65 nt, hsa
uuuagacaaucgggagaagauagcaagaugcuagugugugauacgugugacaaaggguaucauac

SEQ ID NO: 313435 - RNA, 65 nt, hsa
caaauauuuauugaucaucucuucuccauaagauagugugauaaacacagucaugaauaaaguua

SEQ ID NO: 313436 - RNA, 65 nt, hsa
gcagauuuauaugcacugaugaggaaagacauacugugugauagggagaaaaagcagcuuauaaa

SEQ ID NO: 313437 - RNA, 65 nt, hsa
cauuaguuugcuguuaauuuaugcauuugaagccagugugauacagccaucuguaccuacuggag

SEQ ID NO: 313438 - RNA, 65 nt, hsa
cggcagguagcagggggagugcuggucacaccccugugugauaugugaugcccucggcaaagaau

SEQ ID NO: 313439 - RNA, 65 nt, hsa
cugaacuugggcuaaaaucaaaccuuggcacacaggugugauacaacuuaacaggaaucaucgau

SEQ ID NO: 313440 - RNA, 65 nt, hsa
ugcuuuaagaucucuaccacuccaaucgauguuuagugugauaggacaucaccauuucaaggccc

SEQ ID NO: 313441 - RNA, 65 nt, hsa
ugcaccuguagauaucaucuuuucucagauauuuugugugauacucugugguguucuguucaugu

SEQ ID NO: 313442 - RNA, 65 nt, hsa
guuuagaagaaaucuuacggaguuugccaugggaugugugauaucagcagucuucagcuccuuac

SEQ ID NO: 313443 - RNA, 65 nt, hsa
cuccccccucccccgaccccaccacaguccccagagugugauauuccccuuccuguguccaugug

SEQ ID NO: 313444 - RNA, 65 nt, hsa
ggaaaauugauuccucugacuuugcuauugauguagugugauagaaaauucaccccucugaacug

SEQ ID NO: 313445 - RNA, 65 nt, hsa
uuuauucuuuuuuucucuagaguagagguauaauugugugauauuucagaaauacagauaaauga

SEQ ID NO: 313446 - RNA, 65 nt, hsa
ucauugaguauuugugccuagggcuugggcuguuugugugauaccggccccccgccagacaauag

SEQ ID NO: 313447 - RNA, 65 nt, hsa
cuuccaaggccccauccauuaguuuccacugccucgugugauaugaggcccauucuucacucuuu

SEQ ID NO: 313448 - RNA, 65 nt, hsa
cuuccagggccccauccauuagcuuccacugccucgugugauaugaggcccauuccugccucuuu

SEQ ID NO: 313449 - RNA, 64 nt, hsa; identical to SEQ ID NO: 139090

SEQ ID NO: 313450 - RNA, 64 nt, hsa; identical to SEQ ID NO: 139091

SEQ ID NO: 313451 - RNA, 64 nt, hsa; identical to SEQ ID NO: 139092

SEQ ID NO: 313452 - RNA, 64 nt, hsa; identical to SEQ ID NO: 139093

SEQ ID NO: 313453 - RNA, 64 nt, hsa; identical to SEQ ID NO: 139094

SEQ ID NO: 313454 - RNA, 64 nt, hsa; identical to SEQ ID NO: 139095

SEQ ID NO: 313455 - RNA, 64 nt, hsa; identical to SEQ ID NO: 139096

SEQ ID NO: 313456 - RNA, 64 nt, hsa; identical to SEQ ID NO: 139097

SEQ ID NO: 313457 - RNA, 64 nt, hsa; identical to SEQ ID NO: 139098

SEQ ID NO: 313458 - RNA, 64 nt, hsa; identical to SEQ ID NO: 139099

SEQ ID NO: 313459 - RNA, 64 nt, hsa; identical to SEQ ID NO: 139100

SEQ ID NO: 313460 - RNA, 64 nt, hsa; identical to SEQ ID NO: 139101

SEQ ID NO: 313461 - RNA, 64 nt, hsa; identical to SEQ ID NO: 139102

SEQ ID NO: 313462 - RNA, 64 nt, hsa; identical to SEQ ID NO: 139103

SEQ ID NO: 313463 - RNA, 64 nt, hsa; identical to SEQ ID NO: 139104

SEQ ID NO: 313464 - RNA, 64 nt, hsa; identical to SEQ ID NO: 139105

SEQ ID NO: 313465 - RNA, 64 nt, hsa; identical to SEQ ID NO: 139106

SEQ ID NO: 313466 - RNA, 64 nt, hsa; identical to SEQ ID NO: 139107

SEQ ID NO: 313467 - RNA, 64 nt, hsa; identical to SEQ ID NO: 139108

SEQ ID NO: 313468 - RNA, 64 nt, hsa; identical to SEQ ID NO: 139109

SEQ ID NO: 313469 - RNA, 64 nt, hsa; identical to SEQ ID NO: 139110

SEQ ID NO: 313470 - RNA, 64 nt, hsa; identical to SEQ ID NO: 139111

SEQ ID NO: 313471 - RNA, 64 nt, hsa; identical to SEQ ID NO: 139112

SEQ ID NO: 313472 - RNA, 64 nt, hsa; identical to SEQ ID NO: 139113

SEQ ID NO: 313473 - RNA, 64 nt, hsa; identical to SEQ ID NO: 139114

SEQ ID NO: 313474 - RNA, 64 nt, hsa; identical to SEQ ID NO: 139115

SEQ ID NO: 313475 - RNA, 52 nt, hsa; identical to SEQ ID NO: 112167

SEQ ID NO: 313476 - RNA, 64 nt, hsa; identical to SEQ ID NO: 139117

SEQ ID NO: 313477 - RNA, 64 nt, hsa; identical to SEQ ID NO: 139118

SEQ ID NO: 313478 - RNA, 64 nt, hsa; identical to SEQ ID NO: 139119

SEQ ID NO: 313479 - RNA, 64 nt, hsa; identical to SEQ ID NO: 139120

SEQ ID NO: 313480 - RNA, 64 nt, hsa; identical to SEQ ID NO: 139121

SEQ ID NO: 313481 - RNA, 64 nt, hsa; identical to SEQ ID NO: 139122

SEQ ID NO: 313482 - RNA, 64 nt, hsa; identical to SEQ ID NO: 139123

SEQ ID NO: 313483 - RNA, 64 nt, hsa; identical to SEQ ID NO: 139124

SEQ ID NO: 313484 - RNA, 64 nt, hsa; identical to SEQ ID NO: 139125

SEQ ID NO: 313485 - RNA, 64 nt, hsa; identical to SEQ ID NO: 139126

SEQ ID NO: 313486 - RNA, 64 nt, hsa; identical to SEQ ID NO: 139127

SEQ ID NO: 313487 - RNA, 64 nt, hsa; identical to SEQ ID NO: 139128

SEQ ID NO: 313488 - RNA, 64 nt, hsa; identical to SEQ ID NO: 139129

SEQ ID NO: 313489 - RNA, 64 nt, hsa; identical to SEQ ID NO: 139130

SEQ ID NO: 313490 - RNA, 64 nt, hsa; identical to SEQ ID NO: 139131

SEQ ID NO: 313491 - RNA, 64 nt, hsa
ggaccagauuuggaaguuccagcgccaugaccugaucgaggaguaccacggccgccccgccgcg

SEQ ID NO: 313492 - RNA, 64 nt, hsa
acaguuccagcaaaagcagcggcccgagcagaagaucgaggacaucagcaauaaguaugggggc

SEQ ID NO: 313493 - RNA, 64 nt, hsa
gauccaacccucuuauuuucagaggggaaaauggggccuagaaguuacagagcaucuagcuggu

SEQ ID NO: 313494 - RNA, 64 nt, hsa
agucacuucugauucugacaaucaaucaaucaauggccuagagcacugacuguuaacacaaacg

SEQ ID NO: 313495 - RNA, 64 nt, hsa
uuaccugcugagccccgcaggccgcugaaccaaaggccuagauggggaggacuaggagagcgag

SEQ ID NO: 313496 - RNA, 64 nt, hsa
auuuucuggugagguggguuugggaggaaagagaggccuagaggaggaguugaaagcucugcug

SEQ ID NO: 313497 - RNA, 64 nt, hsa
cuccaucaauccaguccaagaggaggaggacgaaggccuagacucagcugaaggaucuucaaag

SEQ ID NO: 313498 - RNA, 64 nt, hsa
uucaaagcaggaugaagaccuagacuuaccugaaggccuagacucagcugaaggaucuucaaag

SEQ ID NO: 313499 - RNA, 64 nt, hsa
ccuuccugccccacugugggccauuuccagaaguggccuagaaaugccaacuucacuuaccuuu

SEQ ID NO: 313500 - RNA, 64 nt, hsa
cucuugccaaaugcuucauggaaaugaagaggaaggccuagagccuccuuccugccccacugug

SEQ ID NO: 313501 - RNA, 50 nt, hsa
gagguuucuuccaggggugaaggguggagccagguagaugcagcgguagc

SEQ ID NO: 313502 - RNA, 61 nt, hsa
cccaucggcuuccauaucuuccaggucccagaggguggaaggagccaggacgcacccccac

SEQ ID NO: 313503 - RNA, 61 nt, hsa
uguggggccuugcgguucagagcucuuggcgaggguggagggaggagugucauuucuaugu

SEQ ID NO: 313504 - RNA, 61 nt, hsa
uaaaaauaaauaucgcuuagaaugcaggagaaggguggagaggaggcaggggccgaggggg

SEQ ID NO: 313505 - RNA, 61 nt, hsa
gccagaccagcagagcagggagccacuugccaggguggaggaggagcauuguccaggcaug

SEQ ID NO: 313506 - RNA, 61 nt, hsa
agcugagacaggaguccggacagaggugggcaggguggauggcuucgggcagggaaggcgg

SEQ ID NO: 313507 - RNA, 61 nt, hsa
gacaaguguuuuggaaagagcacccucgagaaggguggaugacagggcagagcaggaagga

SEQ ID NO: 313508 - RNA, 61 nt, hsa
gauggcagcuggggcuaggggaagggcuuugaggguggaaggaugggauggguuccagagg

SEQ ID NO: 313509 - RNA, 61 nt, hsa
gggacguguuucugucauaaugcaggcaugaaggguggagugaagucaggucauaaguuuc

SEQ ID NO: 313510 - RNA, 61 nt, hsa
aagugggggcuucuacaggcuuuugggaaguaggguggauguggguagggcugggaggagg

SEQ ID NO: 313511 - RNA, 61 nt, hsa
ccaggccucuaaggcuucucucccuggagugaggguggaggugagggagagcuggcacaag

SEQ ID NO: 313512 - RNA, 61 nt, hsa
ucuucagcaccaccucuaagaucucugagagaggguggaucagccucuguguaaacaaaaa

SEQ ID NO: 313513 - RNA, 61 nt, hsa
gagacuguuggcuccaccuccaagcugagcuaggguggagggcagggugggcaggaaguga

SEQ ID NO: 313514 - RNA, 61 nt, hsa
uggcacaguguuauguggacugggccacgauaggguggagugagcuagugaagaaggcaga

SEQ ID NO: 313515 - RNA, 61 nt, hsa
ucacagccugcugggcugggucgcguagcccaggguggaggcagaacgaugcugcuguggu

SEQ ID NO: 313516 - RNA, 61 nt, hsa
uacaacuaggccagggauuagccacugugggaggguggacaggcaaugguucaguggccug

SEQ ID NO: 313517 - RNA, 61 nt, hsa
uugucaccaucaggccuuucuggcuccugauaggguggagcaaaaguggaaaggaaaggaa

SEQ ID NO: 313518 - RNA, 61 nt, hsa
ggggcccugccagaguuaaagcagugacuggaggguggacugggggguugcagcaucuuua

SEQ ID NO: 313519 - RNA, 61 nt, hsa
ugcaugucgggcuuaaggucaccagccgggcaggguggaaggagcuugccucuuugagaaa

SEQ ID NO: 313520 - RNA, 61 nt, hsa
ggcaauugucagucuuuuuagagaaggggccaggguggaacaaucccagugaguaaauuau

SEQ ID NO: 313521 - RNA, 61 nt, hsa
cagacccaagagcuuggcacauuuccggguuaggguggaaugggcuuugcagggaagaggg

SEQ ID NO: 313522 - RNA, 61 nt, hsa
caguucucagucagacgugcagcauggcugcaggguggaccagcugccuggcauucaggcc

SEQ ID NO: 313523 - RNA, 64 nt, hsa
uuaaaagaccuuaagcuggcauugugaaggaacaccaugguagacucuuuuuguaaauguauuu

SEQ ID NO: 313524 - RNA, 64 nt, hsa
uuagauuuaacagauagaguguggcuucauuuguccaugguagcccaucucuccuaagaccuuu

SEQ ID NO: 313525 - RNA, 63 nt, hsa
aaguucguauuugcugaugccaguuuaaaauucccagguuacgucugaggaucaguuggugua

SEQ ID NO: 313526 - RNA, 63 nt, hsa
aaccucgggaacgagcuauccuagcuucugaauccagguuaggauuauacuugaaugauggau

SEQ ID NO: 313527 - RNA, 63 nt, hsa
aguuucauuuguucuugcccacaagcuugaaauccagguuaagguauccagccuuuaucauau

SEQ ID NO: 313528 - RNA, 63 nt, hsa
agauguauagcuuucccaagaugaugguaaaacccagguuagucaucaguaaccuucucuauu

SEQ ID NO: 313529 - RNA, 63 nt, hsa
cagaaagagguaaagagucugaaucaaaaaggaccagguuauugcuguugcuguuuuguggug

SEQ ID NO: 313530 - RNA, 63 nt, hsa
gaggccccuggcuucaugagaacaaaggcaggcccagguuauaauuacagcuuucuccugccc

SEQ ID NO: 313531 - RNA, 63 nt, hsa
ugccagcccuugcuugaugcuuacuggaaaucuccagguuaauuucuaucucugaucccuccc

SEQ ID NO: 313532 - RNA, 63 nt, hsa
cuuuggugaccuacauugucaaaacuaccaauuccagguuaacuuuguuggagaauuuccccc

SEQ ID NO: 313533 - RNA, 63 nt, hsa
cuuuuucacucugcagugugauuggacugccagccagguuaauaaacugaaaaaugugauugg

SEQ ID NO: 313534 - RNA, 63 nt, hsa
uuaagugcugguaagaauauuucucuguuguugccagguuaccuucugcuuuuaaauugccau

SEQ ID NO: 313535 - RNA, 63 nt, hsa
acccuacguacuggcauauuugaaacucuuuuuccagguuagguccuuuucuuucucauugaa

SEQ ID NO: 313536 - RNA, 63 nt, hsa
acaccuucugccuuuguccugcucccuuuuaagccagguuacauucuaaaaauucuuaacuuu

SEQ ID NO: 313537 - RNA, 63 nt, hsa
ccuuagaucacaucacuccaccccugccaggccccagguuaggaauaguggugggaggaaggg

SEQ ID NO: 313538 - RNA, 63 nt, hsa
aagggaaacacagcucuaaccucaccucauucuccagguuacaaaggccaugugccccuuuga

SEQ ID NO: 313539 - RNA, 63 nt, hsa
ugacaacguaggguaacuacaguucauucuguuccagguuauauaaaacugcauuuccugaau

SEQ ID NO: 313540 - RNA, 63 nt, hsa
uuuucuauuuuucuaagauaaaguaaaugaauuccagguuaaauguucacuuuaagguaauaa

SEQ ID NO: 313541 - RNA, 63 nt, hsa
cagguugacuaguaucuguggguaccucccugcccagguuauucacucacaagccaccgggcc

SEQ ID NO: 313542 - RNA, 63 nt, hsa
cuuuaggugccuccugucuuauggcguugcaggccagguuaugccucaugcugacuugcagag

SEQ ID NO: 313543 - RNA, 63 nt, hsa
uuuucuguagaguguuguuugaauuuugagccuccagguuagaggcuccaagcagacaaagaa

SEQ ID NO: 313544 - RNA, 63 nt, hsa
aaauguaauuuuaauucaaugaagauaucauuaccagguuacucuugagauuuuucaacggug

SEQ ID NO: 313545 - RNA, 63 nt, hsa
gggcugguccuaagagggggcagaaaugaaugaccagguuaaaucccucuacaugugguuucu

SEQ ID NO: 313546 - RNA, 63 nt, hsa
uugcugacaaccauuaaagucagaaguuuuacuccagguuauugcaauaaaguauaauguuua

SEQ ID NO: 313547 - RNA, 63 nt, hsa
uuauacaaaugucuuaguuguacaaauaaagucccagguuaaagauaacaaacggcuccugug

SEQ ID NO: 313548 - RNA, 63 nt, hsa
gcugggucugggaguccucaguguccacuugucccagguuagggggcuugccuugcucucucc

SEQ ID NO: 313549 - RNA, 63 nt, hsa
cgcucacacuuggcuggguuucuaccuagguugccagguuaucaucggagccuucuugugucc

SEQ ID NO: 313550 - RNA, 63 nt, hsa
auuuacuucugguaagcauaaagcagagagaacccagguuagaaggaugggaagagaaaagga

SEQ ID NO: 313551 - RNA, 63 nt, hsa
gcagaugaugggauaacauggacugcucaguggccagguuaucaguggggggacuuaauucua

SEQ ID NO: 313552 - RNA, 63 nt, hsa
cccuagagagagugaggugcagggacccgagggccagguuagcacagcgcuggccccagcaug

SEQ ID NO: 313553 - RNA, 63 nt, hsa
uguugucauccucaugacauuccugaggauucaccagguuagaagugaggacguuuaucuuug

SEQ ID NO: 313554 - RNA, 63 nt, hsa
agagcaaaaagcuguguguuuuagaaaaaaaagccagguuacgcaacaggcauucugucaugu

SEQ ID NO: 313555 - RNA, 63 nt, hsa
guuuuaaauauaugcuauagggacguuccaugcccagguuaacaaagaacugugauauauaga

SEQ ID NO: 313556 - RNA, 63 nt, hsa
aaugccccgcaucaucccuuugcugguuacccaccagguuaucccaugcaggccuauguggau

SEQ ID NO: 313557 - RNA, 63 nt, hsa
aaacaugugacuauaccuuuccuaugaggaaagccagguuauacauagaguuccuuugucaua

SEQ ID NO: 313558 - RNA, 63 nt, hsa
aggaccauguuauagaucagcguuuagucaccuccagguuauaugcaucgagaaccugaauaa

SEQ ID NO: 313559 - RNA, 63 nt, hsa
cuaauaauaugaacuuauauuuccugggaguagccagguuaaauuuucuauacuuugguccau

SEQ ID NO: 313560 - RNA, 63 nt, hsa
auuccagaaccaaaucuuaaaugagaccaaaguccagguuagcacagguuuuuauuuuuccua

SEQ ID NO: 313561 - RNA, 63 nt, hsa
accugucggucuugaugucaagguccccaaagaccagguuaagugacgacaccugucuguucc

SEQ ID NO: 313562 - RNA, 63 nt, hsa
aaaaaaaaaauuauuuuuccagucuaccgugguccagguuaucagcucuuuaagagcucuauu

SEQ ID NO: 313563 - RNA, 63 nt, hsa
caacccuaagguccaccacuccauccugaugccccagguuauccacagccuccuucccgacca

SEQ ID NO: 313564 - RNA, 63 nt, hsa
agugccagcuuauuugugaugccccuucccagaccagguuaggauuccugggaaggccgcgga

SEQ ID NO: 313565 - RNA, 63 nt, hsa
auuggagcuucaggaccggcuugcacuguggcuccagguuauaccaccacugcccaaagcaaa

SEQ ID NO: 313566 - RNA, 63 nt, hsa
gccuugugagaaaagcuggagaagugagggcagccagguuauucucuggagguugguggauga

SEQ ID NO: 313567 - RNA, 63 nt, hsa
cagagaccaagaggguuggagacacuaguuuuaccagguuacaggaggguucaagacagaagg

SEQ ID NO: 313568 - RNA, 63 nt, hsa
uugauagacucugaagagucugcugcagaagaaccagguuaaaaaaacagguuagcuuuucuu

SEQ ID NO: 313569 - RNA, 63 nt, hsa
ugggaugcaaguauugcuaaauauguuagcccuccagguuaaaguugauucagcuuuaagaug

SEQ ID NO: 313570 - RNA, 63 nt, hsa
guagcuuuauuggucugaaccagcuccuuguucccagguuacagaccugccuaucguuccaau

SEQ ID NO: 313571 - RNA, 63 nt, hsa
gugcccugcaaauauuagcaaagaagcuucaugccagguuaggaaggcagcauuccaugacca

SEQ ID NO: 313572 - RNA, 63 nt, hsa
gaaacagcucucagauuuauaaauuggaaaucaccagguuacuugccaauauauagucauauu

SEQ ID NO: 313573 - RNA, 63 nt, hsa
guauucuccguuuuccuuucucguauaccugccccagguuaucccauuucuguuguuaccuuu

SEQ ID NO: 313574 - RNA, 63 nt, hsa
uuuuggguuucauuauaaacucuuagccucaguccagguuaaucugaaguuugaaagcucaga

SEQ ID NO: 313575 - RNA, 63 nt, hsa
cuacccauaacucccugcuaggcuaaguagaaaccagguuauuucucccugcuuauggcuccc

SEQ ID NO: 313576 - RNA, 63 nt, hsa
uucuuaucucuuucacuuuuuaaauaucuuucaccagguuauauuuugguauuauuuuuccaa

SEQ ID NO: 313577 - RNA, 63 nt, hsa
acacauaagauugaacaaagcauuuagauuauuccagguuauaucauuuuuuuaaagauuuuc

SEQ ID NO: 313578 - RNA, 63 nt, hsa
cuguguaguucguguuaucaaucugaucugcagccagguuauuuacuucugaagcauuggagu

SEQ ID NO: 313579 - RNA, 63 nt, hsa
ugccuaccccaugccugcugcagaaauauucauccagguuaaccuugauauacacagagaugg

SEQ ID NO: 313580 - RNA, 63 nt, hsa
gcuucacaugcaggaggccucucucaggugaguccagguuaaacuguugaguuguggcuucaa

SEQ ID NO: 313581 - RNA, 63 nt, hsa
auuugucugucauuuacccugucaggugucaugccagguuauguauacauuuauguggaggug

SEQ ID NO: 313582 - RNA, 63 nt, hsa
gauagaacaaugaugccaguugucaggcuccucccagguuauguuuucauaguguuucuuuca

SEQ ID NO: 313583 - RNA, 63 nt, hsa
aguuuaacaaguuccauaguaauuuauggaugcccagguuacauuuaaacuauacauauacau

SEQ ID NO: 313584 - RNA, 63 nt, hsa
ucugacagaaaaaaaaaaaaaaucacuguguaaccagguuaagugguaaaauaauccaggcgu

SEQ ID NO: 313585 - RNA, 63 nt, hsa
aaggagagaagcuacuauugauuagagccuaacccagguuaacugcaagaagaggcgggauac

SEQ ID NO: 313586 - RNA, 63 nt, hsa
ucauuaccccauuggguggcaccuuuuaaaaauccagguuauuaaaggauucacacuuuauua

SEQ ID NO: 313587 - RNA, 63 nt, hsa
cuguaucaauuacaguaguucuaccagaaucucccagguuauaauuuaugaggguagagaaau

SEQ ID NO: 313588 - RNA, 63 nt, hsa
gcaaugguguugcccugaguggaucuccaaggaccagguuauuuuaaaaagauuuguuuuguc

SEQ ID NO: 313589 - RNA, 63 nt, hsa
agacagcaggaagccauagaugcuggcuggguuccagguuauggggagaagaaauacagucaa

SEQ ID NO: 313590 - RNA, 63 nt, hsa
auguugcaacugggaauauaccacgacaugagaccagguuauagcacaaauuagcacccuaua

SEQ ID NO: 313591 - RNA, 63 nt, hsa
ccaggagcaugaacugauccaugaaugccuuuuccagguuaaaauuuggucacugaugccuau

SEQ ID NO: 313592 - RNA, 63 nt, hsa
ucacacaugguauauuauugacccaauaacucgccagguuacaugggucuugagagagaauuu

SEQ ID NO: 313593 - RNA, 63 nt, hsa
cucccaguuuaaaggaugggaagaccccaaucaccagguuauuggaucuguccagugagagau

SEQ ID NO: 313594 - RNA, 63 nt, hsa
uuauccggcaagagugaauucuaccaauggaagccagguuaaugauuacaauuaaucuuuuac

SEQ ID NO: 313595 - RNA, 63 nt, hsa
uuuauuauaccacuuauaucaacuuauuuuucaccagguuaaaauuuuaauuucuacaaaaua

SEQ ID NO: 313596 - RNA, 63 nt, hsa
ucccuggugaaacugaggagaaaaguuaaucaaccagguuacucccacaguuugcccgugugu

SEQ ID NO: 313597 - RNA, 63 nt, hsa
uuuucucauuuccaaagacccagagucucagagccagguuaaguggaagaaacuuugagaggu

SEQ ID NO: 313598 - RNA, 63 nt, hsa
ccgcuaauucauaccucccuccugauguuuuucccagguuacaauggccuuuauccuaguucc

SEQ ID NO: 313599 - RNA, 63 nt, hsa
uguauguugcuugcuauuaaaaagguuaagaggccagguuacccaccaguccuugcacuguuc

SEQ ID NO: 313600 - RNA, 63 nt, hsa
aagcaguacuuuaccuguuuuuucuuuagcaaaccagguuaugugguguaaagguuuguuaua

SEQ ID NO: 313601 - RNA, 63 nt, hsa
ccuacacuuccuucugugcccugccagugacccccagguuauucuaaagcagaguccuucccu

SEQ ID NO: 313602 - RNA, 63 nt, hsa
uccuguuuuuucagcacuuuaacagaugccauuccagguuaaacuggguugucuguacuaaau

SEQ ID NO: 313603 - RNA, 63 nt, hsa
aaaaggauaagugaacacccaugaaccuacuacccagguuaagaaaauaaaugucaccaggua

SEQ ID NO: 313604 - RNA, 63 nt, hsa
augaugauuuugcugugacaauucuaagaucaaccagguuacuuaaguccgcucugaugaaac

SEQ ID NO: 313605 - RNA, 63 nt, hsa
agggccuggacagauuaugauugcucaggcauaccagguuauagcuccaaguuccacaggucu

SEQ ID NO: 313606 - RNA, 63 nt, hsa
acauuuuaaaauccugauuuuggagacuuaaaaccagguuaauggcuaagaauggguaacaug

SEQ ID NO: 313607 - RNA, 63 nt, hsa
aguucucaaauauuggguugggcacggcuuauaccagguuaccucacuuuuaauuagugaugc

SEQ ID NO: 313608 - RNA, 63 nt, hsa
ggagggagaaaagagguggguaggguuacagauccagguuauaacuacucuggcccauaccuu

SEQ ID NO: 313609 - RNA, 63 nt, hsa
ggccuccugcgcccucaccugccacagagcaacccagguuaaauacagcccaugcacaaagcc

SEQ ID NO: 313610 - RNA, 63 nt, hsa
cacgcccuccauagaccuucagagaaggugaaaccagguuaucugggaaucuuuccagcccgc

SEQ ID NO: 313611 - RNA, 63 nt, hsa
uguuccguccccuuaccaccccugauacaacugccagguuaauuuccagaauucuugcaagac

SEQ ID NO: 313612 - RNA, 63 nt, hsa
cuguccacgugggguuguuuggagucuggggaaccagguuagugggcccccaagaagagcuuu

SEQ ID NO: 313613 - RNA, 63 nt, hsa
ccuuuacagcaaucaagauauuuuuguccauauccagguuagcugguaagaggauuuuuuugg

SEQ ID NO: 313614 - RNA, 63 nt, hsa
agagcuacagcgugugauggaaucagugaccggccagguuagccucuccccucuuggccuccu

SEQ ID NO: 313615 - RNA, 63 nt, hsa
gaacccaggcgcugccccagcaccuucuccuccccagguuacuugcuucuaggacucuuggcc

SEQ ID NO: 313616 - RNA, 63 nt, hsa
aggggcugcucaggccgccuagcugccccuuugccagguuaauaaagcacugacuuguuucuc

SEQ ID NO: 313617 - RNA, 63 nt, hsa
acaaaccagccuaaggcagacacucuccacuguccagguuauaaccugguaccagcagacuuu

SEQ ID NO: 313618 - RNA, 63 nt, hsa
auuuuuuguauuuuuaguagagacgggguuucaccagguuagccaggauggucucgaucuccu

SEQ ID NO: 313619 - RNA, 63 nt, hsa
agaguuuguaacaaaauauuuuauuauauaaaaccagguuagaaggaaugcaggauauuuuua

SEQ ID NO: 313620 - RNA, 63 nt, hsa
auggaagcugcuaagguucgaauucaaacccagccagguuaugccaacacuuugagggaugca

SEQ ID NO: 313621 - RNA, 63 nt, hsa
uuaagaauugguuuugggagggcgaggacugggccagguuagaggcagauggcacaggggcgu

SEQ ID NO: 313622 - RNA, 63 nt, hsa
cacaucaccaccuggaaucagggauugcucacuccagguuacugcaacccuaacucacucuag

SEQ ID NO: 313623 - RNA, 63 nt, hsa
uuauacaucucaaugcugagaguuaaaauauucccagguuaaaauuuuuuuaaaguaccaaua

SEQ ID NO: 313624 - RNA, 63 nt, hsa
aaaucugagaucugccaggccccucuucuaacaccagguuaggcaugcuugguuauuuccagu

SEQ ID NO: 313625 - RNA, 63 nt, hsa
gggggcaaucugagaauauuccucaaaagguguccagguuaaauagacauguuacuggcugca

SEQ ID NO: 313626 - RNA, 63 nt, hsa
gaugcauccagggguucauuuucaugagccuguccagguuaguuuacuccugaccacuaauag

SEQ ID NO: 313627 - RNA, 63 nt, hsa
accuuuagccaagaggagcugcagggaccauggccagguuaccaaaaugcccugcucugaagc

SEQ ID NO: 313628 - RNA, 63 nt, hsa
ccuuacugggcuaaucagcacuugaucggaaguccagguuaguaugugaagccaggaguacua

SEQ ID NO: 313629 - RNA, 63 nt, hsa
ugagaccagacauggagcaacacuuuuuuucuuccagguuauuaaaugggucaaccagagcaa

SEQ ID NO: 313630 - RNA, 63 nt, hsa
aauauauauguugcuguugcugaauacaggagaccagguuaggaauauaguuucauaauaaua

SEQ ID NO: 313631 - RNA, 63 nt, hsa
ucuccagggagagaggguggucgucugugcauuccagguuacugcacuugucugaugugacgu

SEQ ID NO: 313632 - RNA, 63 nt, hsa
ccaggucuucuuaaaacaaagucaucagcuuugccagguuacauacuuuauuuaaaaguauag

SEQ ID NO: 313633 - RNA, 63 nt, hsa
caaagcaagugauugggacagagguuaucugucccagguuaucugggcauagaugcaggugag

SEQ ID NO: 313634 - RNA, 63 nt, hsa
ggcuagaguugucuuuaaggguuaggguuaggaccagguuaggucaggguuggauuggguuua

SEQ ID NO: 313635 - RNA, 63 nt, hsa
uugaggugggaggaucgcuugagcccaugaggcccagguuacagugagccaagaucgugccac

SEQ ID NO: 313636 - RNA, 63 nt, hsa
cucagcuccuaucucuguauggccugguuuuucccagguuaugauuauagagcgaggauuauu

SEQ ID NO: 313637 - RNA, 63 nt, hsa
cuuggaaaugggccccacguuucgaauucaucuccagguuaagaagcugccagaccuugccag

SEQ ID NO: 313638 - RNA, 63 nt, hsa
cuuaccuguccgcccaccugucuggaacaagggccagguuaagaccacaugccucauguccaa

SEQ ID NO: 313639 - RNA, 63 nt, hsa
cuaagugacuuaaccuuagagcaagcacaacauccagguuaauuuuuuguaagauuucuccuu

SEQ ID NO: 313640 - RNA, 63 nt, hsa
guuuuuuaagaacagggaaaauuaaacaaaaccccagguuauuucuucccugcccagagccag

SEQ ID NO: 313641 - RNA, 63 nt, hsa
gagauugggaagcccacuguaacacuggagagcccagguuauaucagacaccacuaguagaua

SEQ ID NO: 313642 - RNA, 63 nt, hsa
uauuguuuuugagacaaggucccuuucugucacccagguuagaguagauuucaguggcacaau

SEQ ID NO: 313643 - RNA, 63 nt, hsa
uuuaugucugagcuuauuguguuugagcuaacaccagguuacucaguaaccaugaccugcucc

SEQ ID NO: 313644 - RNA, 63 nt, hsa
gacuagaagcuucuguuccugacaccaaaugugccagguuagcaaaugagcacaagauguggc

SEQ ID NO: 313645 - RNA, 63 nt, hsa
aggagccggugcucuggaagaccugaaagaagcccagguuacaaagacaugggggccuugugg

SEQ ID NO: 313646 - RNA, 63 nt, hsa
uucuagauguccggguucccugcacaccugucgccagguuaaacaaccaucgagcauguguca

SEQ ID NO: 313647 - RNA, 63 nt, hsa
gcccugagcugugagagaccagcacagcagcguccagguuaaaagccgcugaccaaaguccaa

SEQ ID NO: 313648 - RNA, 63 nt, hsa
aauauaagaaauaaaggagcucuuacgaaaaacccagguuagaccgcauaaaaaauaaaguga

SEQ ID NO: 313649 - RNA, 63 nt, hsa
gcuuacccuugauuuuuucuccccauuugacacccagguuaaaaagggguucccuuuuuggua

SEQ ID NO: 313650 - RNA, 63 nt, hsa
cagagacuagauguaucugagagggucuccagaccagguuacugcaaaaaugagguuuugcuu

SEQ ID NO: 313651 - RNA, 63 nt, hsa
acuccagggugaaggcagagugggauuugagacccagguuaggcacgacccaggcugagaagg

SEQ ID NO: 313652 - RNA, 63 nt, hsa
aaaaugaaaggaacuugacuguacaguuuguagccagguuaagcauuugguauuguuucauuu

SEQ ID NO: 313653 - RNA, 63 nt, hsa
caccaugucccuugcccccauguagcccauuucccagguuaugcucuuuucuuucucaggguc

SEQ ID NO: 313654 - RNA, 63 nt, hsa
uuacguauugaauauagaaaucauucuaacaacccagguuauuuucaaucagaccaggcauuc

SEQ ID NO: 313655 - RNA, 63 nt, hsa
guuuaccucuucuaugcaagccuugcuagacagccagguuagccuuugcccugucacccccga

SEQ ID NO: 313656 - RNA, 63 nt, hsa
auagccuaaaaaccuagccucuaacaccuuguuccagguuaccuuccaaaguuucuaucuugu

SEQ ID NO: 313657 - RNA, 63 nt, hsa
gcuggaccaacgcggguucuggggugcacagcgccagguuaacgcugaagccugccccgcuga

SEQ ID NO: 313658 - RNA, 63 nt, hsa
cuccucccuggagcuccagagacccaccccucuccagguuaucccagaaaugacccaacucuc

SEQ ID NO: 313659 - RNA, 63 nt, hsa
ggugcaaucuuggcucacugcaaccuccgccacccagguuaaaaauucuccugccucagccuc

SEQ ID NO: 313660 - RNA, 63 nt, hsa
cgcgagacuuucggucccccccgccccuuccccccagguuagcaauugggaauggcugggagg

SEQ ID NO: 313661 - RNA, 63 nt, hsa
gaugccuauccacccucuggcagaagacacucaccagguuaucugugaagagacucugggauc

SEQ ID NO: 313662 - RNA, 63 nt, hsa
ucggggcauagcccagggaugcccccaggcggcccagguuagaugcgucccuuuggcuuguca

SEQ ID NO: 313663 - RNA, 63 nt, hsa
aggcccaguggggaagaaugaacauggcuucauccagguuaacugaugcugccauuugcccag

SEQ ID NO: 313664 - RNA, 63 nt, hsa
aggccaagggguaggccugagcgccagagucgcccagguuagcccacaggauuccuuugugug

SEQ ID NO: 313665 - RNA, 63 nt, hsa
ucaugcacacgcugacacgcgguugcauggaguccagguuacucaggccggcacuucugagug

SEQ ID NO: 313666 - RNA, 63 nt, hsa
gauuaaugcauccagauuguuuuccuaguauuuccagguuagaaccuguggauuguuucaauu

SEQ ID NO: 313667 - RNA, 63 nt, hsa
ucuuuaccuagucccugcuguguagggcguaguccagguuagcuagguagaguuagugcucca

SEQ ID NO: 313668 - RNA, 63 nt, hsa
cacucugcuccuuacaucuaggcccagcugaacccagguuaggggcagaucagaagggcugcg

SEQ ID NO: 313669 - RNA, 63 nt, hsa
uguuuaauccauguauugguacuuuacugaaaaccagguuauauucuaaagaagaaagaaggc

SEQ ID NO: 313670 - RNA, 63 nt, hsa
ucauucaccagauauuuuguucuuaauugugaaccagguuagcaaaugaccuaucaaaaauua

SEQ ID NO: 313671 - RNA, 63 nt, hsa
ucauuggggugguugucaugugauggguccccuccagguuacuaaagggugcauguccccugc

SEQ ID NO: 313672 - RNA, 63 nt, hsa
ugguuggggugguugucaugugacggguccccuccagguuacuaaagggugcauguccccugc

SEQ ID NO: 313673 - RNA, 63 nt, hsa
aucugugagugacugagggagacaggaggaauaccagguuauucauggaauaaagucuuucca

SEQ ID NO: 313674 - RNA, 63 nt, hsa
gccaagcacugugcagaggguacacaguuccugccagguuaacacccucccuucaggccuccc

SEQ ID NO: 313675 - RNA, 63 nt, hsa
ggaaaauaauuuuuuccuccaagauucucagauccagguuaggaaaggauucagcacuacagc

SEQ ID NO: 313676 - RNA, 64 nt, hsa
aaaguucguauuugcugaugccaguuuaaaauucccagguuacgucugaggaucaguuggugua

SEQ ID NO: 313677 - RNA, 64 nt, hsa
gaaccucgggaacgagcuauccuagcuucugaauccagguuaggauuauacuugaaugauggau

SEQ ID NO: 313678 - RNA, 64 nt, hsa
uaguuucauuuguucuugcccacaagcuugaaauccagguuaagguauccagccuuuaucauau

SEQ ID NO: 313679 - RNA, 64 nt, hsa
aagauguauagcuuucccaagaugaugguaaaacccagguuagucaucaguaaccuucucuauu

SEQ ID NO: 313680 - RNA, 64 nt, hsa
acagaaagagguaaagagucugaaucaaaaaggaccagguuauugcuguugcuguuuuguggug

SEQ ID NO: 313681 - RNA, 64 nt, hsa
agaggccccuggcuucaugagaacaaaggcaggcccagguuauaauuacagcuuucuccugccc

SEQ ID NO: 313682 - RNA, 64 nt, hsa
uugccagcccuugcuugaugcuuacuggaaaucuccagguuaauuucuaucucugaucccuccc

SEQ ID NO: 313683 - RNA, 64 nt, hsa
ucuuuggugaccuacauugucaaaacuaccaauuccagguuaacuuuguuggagaauuuccccc

SEQ ID NO: 313684 - RNA, 64 nt, hsa
ccuuuuucacucugcagugugauuggacugccagccagguuaauaaacugaaaaaugugauugg

SEQ ID NO: 313685 - RNA, 64 nt, hsa
auuaagugcugguaagaauauuucucuguuguugccagguuaccuucugcuuuuaaauugccau

SEQ ID NO: 313686 - RNA, 64 nt, hsa
uacccuacguacuggcauauuugaaacucuuuuuccagguuagguccuuuucuuucucauugaa

SEQ ID NO: 313687 - RNA, 64 nt, hsa
cacaccuucugccuuuguccugcucccuuuuaagccagguuacauucuaaaaauucuuaacuuu

SEQ ID NO: 313688 - RNA, 64 nt, hsa
cccuuagaucacaucacuccaccccugccaggccccagguuaggaauaguggugggaggaaggg

SEQ ID NO: 313689 - RNA, 64 nt, hsa
uaagggaaacacagcucuaaccucaccucauucuccagguuacaaaggccaugugccccuuuga

SEQ ID NO: 313690 - RNA, 64 nt, hsa
augacaacguaggguaacuacaguucauucuguuccagguuauauaaaacugcauuuccugaau

SEQ ID NO: 313691 - RNA, 64 nt, hsa
auuuucuauuuuucuaagauaaaguaaaugaauuccagguuaaauguucacuuuaagguaauaa

SEQ ID NO: 313692 - RNA, 64 nt, hsa
acagguugacuaguaucuguggguaccucccugcccagguuauucacucacaagccaccgggcc

SEQ ID NO: 313693 - RNA, 64 nt, hsa
ucuuuaggugccuccugucuuauggcguugcaggccagguuaugccucaugcugacuugcagag

SEQ ID NO: 313694 - RNA, 64 nt, hsa
uuuuucuguagaguguuguuugaauuuugagccuccagguuagaggcuccaagcagacaaagaa

SEQ ID NO: 313695 - RNA, 64 nt, hsa
aaaauguaauuuuaauucaaugaagauaucauuaccagguuacucuugagauuuuucaacggug

SEQ ID NO: 313696 - RNA, 64 nt, hsa
agggcugguccuaagagggggcagaaaugaaugaccagguuaaaucccucuacaugugguuucu

SEQ ID NO: 313697 - RNA, 64 nt, hsa
uuugcugacaaccauuaaagucagaaguuuuacuccagguuauugcaauaaaguauaauguuua

SEQ ID NO: 313698 - RNA, 64 nt, hsa
uuuauacaaaugucuuaguuguacaaauaaagucccagguuaaagauaacaaacggcuccugug

SEQ ID NO: 313699 - RNA, 64 nt, hsa
ggcugggucugggaguccucaguguccacuugucccagguuagggggcuugccuugcucucucc

SEQ ID NO: 313700 - RNA, 64 nt, hsa
acgcucacacuuggcuggguuucuaccuagguugccagguuaucaucggagccuucuugugucc

SEQ ID NO: 313701 - RNA, 64 nt, hsa
cauuuacuucugguaagcauaaagcagagagaacccagguuagaaggaugggaagagaaaagga

SEQ ID NO: 313702 - RNA, 64 nt, hsa
agcagaugaugggauaacauggacugcucaguggccagguuaucaguggggggacuuaauucua

SEQ ID NO: 313703 - RNA, 64 nt, hsa
ccccuagagagagugaggugcagggacccgagggccagguuagcacagcgcuggccccagcaug

SEQ ID NO: 313704 - RNA, 64 nt, hsa
guguugucauccucaugacauuccugaggauucaccagguuagaagugaggacguuuaucuuug

SEQ ID NO: 313705 - RNA, 64 nt, hsa
aagagcaaaaagcuguguguuuuagaaaaaaaagccagguuacgcaacaggcauucugucaugu

SEQ ID NO: 313706 - RNA, 64 nt, hsa
gguuuuaaauauaugcuauagggacguuccaugcccagguuaacaaagaacugugauauauaga

SEQ ID NO: 313707 - RNA, 64 nt, hsa
uaaugccccgcaucaucccuuugcugguuacccaccagguuaucccaugcaggccuauguggau

SEQ ID NO: 313708 - RNA, 64 nt, hsa
gaaacaugugacuauaccuuuccuaugaggaaagccagguuauacauagaguuccuuugucaua

SEQ ID NO: 313709 - RNA, 64 nt, hsa
uaggaccauguuauagaucagcguuuagucaccuccagguuauaugcaucgagaaccugaauaa

SEQ ID NO: 313710 - RNA, 64 nt, hsa
acuaauaauaugaacuuauauuuccugggaguagccagguuaaauuuucuauacuuugguccau

SEQ ID NO: 313711 - RNA, 64 nt, hsa
cauuccagaaccaaaucuuaaaugagaccaaaguccagguuagcacagguuuuuauuuuuccua

SEQ ID NO: 313712 - RNA, 64 nt, hsa
gaccugucggucuugaugucaagguccccaaagaccagguuaagugacgacaccugucuguucc

SEQ ID NO: 313713 - RNA, 64 nt, hsa
caaaaaaaaaauuauuuuuccagucuaccgugguccagguuaucagcucuuuaagagcucuauu

SEQ ID NO: 313714 - RNA, 64 nt, hsa
ucaacccuaagguccaccacuccauccugaugccccagguuauccacagccuccuucccgacca

SEQ ID NO: 313715 - RNA, 64 nt, hsa
gagugccagcuuauuugugaugccccuucccagaccagguuaggauuccugggaaggccgcgga

SEQ ID NO: 313716 - RNA, 64 nt, hsa
aauuggagcuucaggaccggcuugcacuguggcuccagguuauaccaccacugcccaaagcaaa

SEQ ID NO: 313717 - RNA, 64 nt, hsa
ugccuugugagaaaagcuggagaagugagggcagccagguuauucucuggagguugguggauga

SEQ ID NO: 313718 - RNA, 64 nt, hsa
gcagagaccaagaggguuggagacacuaguuuuaccagguuacaggaggguucaagacagaagg

SEQ ID NO: 313719 - RNA, 64 nt, hsa
cuugauagacucugaagagucugcugcagaagaaccagguuaaaaaaacagguuagcuuuucuu

SEQ ID NO: 313720 - RNA, 64 nt, hsa
cugggaugcaaguauugcuaaauauguuagcccuccagguuaaaguugauucagcuuuaagaug

SEQ ID NO: 313721 - RNA, 64 nt, hsa
cguagcuuuauuggucugaaccagcuccuuguucccagguuacagaccugccuaucguuccaau

SEQ ID NO: 313722 - RNA, 64 nt, hsa
ugugcccugcaaauauuagcaaagaagcuucaugccagguuaggaaggcagcauuccaugacca

SEQ ID NO: 313723 - RNA, 64 nt, hsa
ggaaacagcucucagauuuauaaauuggaaaucaccagguuacuugccaauauauagucauauu

SEQ ID NO: 313724 - RNA, 64 nt, hsa
aguauucuccguuuuccuuucucguauaccugccccagguuaucccauuucuguuguuaccuuu

SEQ ID NO: 313725 - RNA, 64 nt, hsa
guuuuggguuucauuauaaacucuuagccucaguccagguuaaucugaaguuugaaagcucaga

SEQ ID NO: 313726 - RNA, 64 nt, hsa
ccuacccauaacucccugcuaggcuaaguagaaaccagguuauuucucccugcuuauggcuccc

SEQ ID NO: 313727 - RNA, 64 nt, hsa
uuucuuaucucuuucacuuuuuaaauaucuuucaccagguuauauuuugguauuauuuuuccaa

SEQ ID NO: 313728 - RNA, 64 nt, hsa
aacacauaagauugaacaaagcauuuagauuauuccagguuauaucauuuuuuuaaagauuuuc

SEQ ID NO: 313729 - RNA, 64 nt, hsa
ucuguguaguucguguuaucaaucugaucugcagccagguuauuuacuucugaagcauuggagu

SEQ ID NO: 313730 - RNA, 64 nt, hsa
cugccuaccccaugccugcugcagaaauauucauccagguuaaccuugauauacacagagaugg

SEQ ID NO: 313731 - RNA, 64 nt, hsa
ggcuucacaugcaggaggccucucucaggugaguccagguuaaacuguugaguuguggcuucaa

SEQ ID NO: 313732 - RNA, 64 nt, hsa
uauuugucugucauuuacccugucaggugucaugccagguuauguauacauuuauguggaggug

SEQ ID NO: 313733 - RNA, 64 nt, hsa
agauagaacaaugaugccaguugucaggcuccucccagguuauguuuucauaguguuucuuuca

SEQ ID NO: 313734 - RNA, 64 nt, hsa
uaguuuaacaaguuccauaguaauuuauggaugcccagguuacauuuaaacuauacauauacau

SEQ ID NO: 313735 - RNA, 64 nt, hsa
aucugacagaaaaaaaaaaaaaaucacuguguaaccagguuaagugguaaaauaauccaggcgu

SEQ ID NO: 313736 - RNA, 64 nt, hsa
uaaggagagaagcuacuauugauuagagccuaacccagguuaacugcaagaagaggcgggauac

SEQ ID NO: 313737 - RNA, 64 nt, hsa
uucauuaccccauuggguggcaccuuuuaaaaauccagguuauuaaaggauucacacuuuauua

SEQ ID NO: 313738 - RNA, 64 nt, hsa
ucuguaucaauuacaguaguucuaccagaaucucccagguuauaauuuaugaggguagagaaau

SEQ ID NO: 313739 - RNA, 64 nt, hsa
ugcaaugguguugcccugaguggaucuccaaggaccagguuauuuuaaaaagauuuguuuuguc

SEQ ID NO: 313740 - RNA, 64 nt, hsa
cagacagcaggaagccauagaugcuggcuggguuccagguuauggggagaagaaauacagucaa

SEQ ID NO: 313741 - RNA, 64 nt, hsa
aauguugcaacugggaauauaccacgacaugagaccagguuauagcacaaauuagcacccuaua

SEQ ID NO: 313742 - RNA, 64 nt, hsa
cccaggagcaugaacugauccaugaaugccuuuuccagguuaaaauuuggucacugaugccuau

SEQ ID NO: 313743 - RNA, 64 nt, hsa
uucacacaugguauauuauugacccaauaacucgccagguuacaugggucuugagagagaauuu

SEQ ID NO: 313744 - RNA, 64 nt, hsa
ccucccaguuuaaaggaugggaagaccccaaucaccagguuauuggaucuguccagugagagau

SEQ ID NO: 313745 - RNA, 64 nt, hsa
guuauccggcaagagugaauucuaccaauggaagccagguuaaugauuacaauuaaucuuuuac

SEQ ID NO: 313746 - RNA, 64 nt, hsa
guuuauuauaccacuuauaucaacuuauuuuucaccagguuaaaauuuuaauuucuacaaaaua

SEQ ID NO: 313747 - RNA, 64 nt, hsa
uucccuggugaaacugaggagaaaaguuaaucaaccagguuacucccacaguuugcccgugugu

SEQ ID NO: 313748 - RNA, 64 nt, hsa
auuuucucauuuccaaagacccagagucucagagccagguuaaguggaagaaacuuugagaggu

SEQ ID NO: 313749 - RNA, 64 nt, hsa
cccgcuaauucauaccucccuccugauguuuuucccagguuacaauggccuuuauccuaguucc

SEQ ID NO: 313750 - RNA, 64 nt, hsa
cuguauguugcuugcuauuaaaaagguuaagaggccagguuacccaccaguccuugcacuguuc

SEQ ID NO: 313751 - RNA, 64 nt, hsa
uaagcaguacuuuaccuguuuuuucuuuagcaaaccagguuaugugguguaaagguuuguuaua

SEQ ID NO: 313752 - RNA, 64 nt, hsa
accuacacuuccuucugugcccugccagugacccccagguuauucuaaagcagaguccuucccu

SEQ ID NO: 313753 - RNA, 64 nt, hsa
uuccuguuuuuucagcacuuuaacagaugccauuccagguuaaacuggguugucuguacuaaau

SEQ ID NO: 313754 - RNA, 64 nt, hsa
aaaaaggauaagugaacacccaugaaccuacuacccagguuaagaaaauaaaugucaccaggua

SEQ ID NO: 313755 - RNA, 64 nt, hsa
caugaugauuuugcugugacaauucuaagaucaaccagguuacuuaaguccgcucugaugaaac

SEQ ID NO: 313756 - RNA, 64 nt, hsa
aagggccuggacagauuaugauugcucaggcauaccagguuauagcuccaaguuccacaggucu

SEQ ID NO: 313757 - RNA, 64 nt, hsa
uacauuuuaaaauccugauuuuggagacuuaaaaccagguuaauggcuaagaauggguaacaug

SEQ ID NO: 313758 - RNA, 64 nt, hsa
aaguucucaaauauuggguugggcacggcuuauaccagguuaccucacuuuuaauuagugaugc

SEQ ID NO: 313759 - RNA, 64 nt, hsa
gggagggagaaaagagguggguaggguuacagauccagguuauaacuacucuggcccauaccuu

SEQ ID NO: 313760 - RNA, 64 nt, hsa
gggccuccugcgcccucaccugccacagagcaacccagguuaaauacagcccaugcacaaagcc

SEQ ID NO: 313761 - RNA, 64 nt, hsa
ccacgcccuccauagaccuucagagaaggugaaaccagguuaucugggaaucuuuccagcccgc

SEQ ID NO: 313762 - RNA, 64 nt, hsa
cuguuccguccccuuaccaccccugauacaacugccagguuaauuuccagaauucuugcaagac

SEQ ID NO: 313763 - RNA, 64 nt, hsa
gcuguccacgugggguuguuuggagucuggggaaccagguuagugggcccccaagaagagcuuu

SEQ ID NO: 313764 - RNA, 64 nt, hsa
accuuuacagcaaucaagauauuuuuguccauauccagguuagcugguaagaggauuuuuuugg

SEQ ID NO: 313765 - RNA, 64 nt, hsa
gagagcuacagcgugugauggaaucagugaccggccagguuagccucuccccucuuggccuccu

SEQ ID NO: 313766 - RNA, 64 nt, hsa
agaacccaggcgcugccccagcaccuucuccuccccagguuacuugcuucuaggacucuuggcc

SEQ ID NO: 313767 - RNA, 64 nt, hsa
caggggcugcucaggccgccuagcugccccuuugccagguuaauaaagcacugacuuguuucuc

SEQ ID NO: 313768 - RNA, 64 nt, hsa
cacaaaccagccuaaggcagacacucuccacuguccagguuauaaccugguaccagcagacuuu

SEQ ID NO: 313769 - RNA, 64 nt, hsa
aauuuuuuguauuuuuaguagagacgggguuucaccagguuagccaggauggucucgaucuccu

SEQ ID NO: 313770 - RNA, 64 nt, hsa
uagaguuuguaacaaaauauuuuauuauauaaaaccagguuagaaggaaugcaggauauuuuua

SEQ ID NO: 313771 - RNA, 64 nt, hsa
uauggaagcugcuaagguucgaauucaaacccagccagguuaugccaacacuuugagggaugca

SEQ ID NO: 313772 - RNA, 64 nt, hsa
uuuaagaauugguuuugggagggcgaggacugggccagguuagaggcagauggcacaggggcgu

SEQ ID NO: 313773 - RNA, 64 nt, hsa
ccacaucaccaccuggaaucagggauugcucacuccagguuacugcaacccuaacucacucuag

SEQ ID NO: 313774 - RNA, 64 nt, hsa
cuuauacaucucaaugcugagaguuaaaauauucccagguuaaaauuuuuuuaaaguaccaaua

SEQ ID NO: 313775 - RNA, 64 nt, hsa
aaaaucugagaucugccaggccccucuucuaacaccagguuaggcaugcuugguuauuuccagu

SEQ ID NO: 313776 - RNA, 64 nt, hsa
ugggggcaaucugagaauauuccucaaaagguguccagguuaaauagacauguuacuggcugca

SEQ ID NO: 313777 - RNA, 64 nt, hsa
ggaugcauccagggguucauuuucaugagccuguccagguuaguuuacuccugaccacuaauag

SEQ ID NO: 313778 - RNA, 64 nt, hsa
gaccuuuagccaagaggagcugcagggaccauggccagguuaccaaaaugcccugcucugaagc

SEQ ID NO: 313779 - RNA, 64 nt, hsa
cccuuacugggcuaaucagcacuugaucggaaguccagguuaguaugugaagccaggaguacua

SEQ ID NO: 313780 - RNA, 64 nt, hsa
uugagaccagacauggagcaacacuuuuuuucuuccagguuauuaaaugggucaaccagagcaa

SEQ ID NO: 313781 - RNA, 64 nt, hsa
aaauauauauguugcuguugcugaauacaggagaccagguuaggaauauaguuucauaauaaua

SEQ ID NO: 313782 - RNA, 64 nt, hsa; identical to SEQ ID NO: 144801

SEQ ID NO: 313783 - RNA, 64 nt, hsa; identical to SEQ ID NO: 144802

SEQ ID NO: 313784 - RNA, 64 nt, hsa
gcaaagcaagugauugggacagagguuaucugucccagguuaucugggcauagaugcaggugag

SEQ ID NO: 313785 - RNA, 64 nt, hsa
aggcuagaguugucuuuaaggguuaggguuaggaccagguuaggucaggguuggauuggguuua

SEQ ID NO: 313786 - RNA, 64 nt, hsa
guugaggugggaggaucgcuugagcccaugaggcccagguuacagugagccaagaucgugccac

SEQ ID NO: 313787 - RNA, 64 nt, hsa
ccucagcuccuaucucuguauggccugguuuuucccagguuaugauuauagagcgaggauuauu

SEQ ID NO: 313788 - RNA, 64 nt, hsa
ucuuggaaaugggccccacguuucgaauucaucuccagguuaagaagcugccagaccuugccag

SEQ ID NO: 313789 - RNA, 64 nt, hsa
gcuuaccuguccgcccaccugucuggaacaagggccagguuaagaccacaugccucauguccaa

SEQ ID NO: 313790 - RNA, 64 nt, hsa
ccuaagugacuuaaccuuagagcaagcacaacauccagguuaauuuuuuguaagauuucuccuu

SEQ ID NO: 313791 - RNA, 64 nt, hsa
uguuuuuuaagaacagggaaaauuaaacaaaaccccagguuauuucuucccugcccagagccag

SEQ ID NO: 313792 - RNA, 64 nt, hsa
ugagauugggaagcccacuguaacacuggagagcccagguuauaucagacaccacuaguagaua

SEQ ID NO: 313793 - RNA, 64 nt, hsa
uuauuguuuuugagacaaggucccuuucugucacccagguuagaguagauuucaguggcacaau

SEQ ID NO: 313794 - RNA, 64 nt, hsa
guuuaugucugagcuuauuguguuugagcuaacaccagguuacucaguaaccaugaccugcucc

SEQ ID NO: 313795 - RNA, 64 nt, hsa
ugacuagaagcuucuguuccugacaccaaaugugccagguuagcaaaugagcacaagauguggc

SEQ ID NO: 313796 - RNA, 64 nt, hsa
gaggagccggugcucuggaagaccugaaagaagcccagguuacaaagacaugggggccuugugg

SEQ ID NO: 313797 - RNA, 64 nt, hsa
auucuagauguccggguucccugcacaccugucgccagguuaaacaaccaucgagcauguguca

SEQ ID NO: 313798 - RNA, 64 nt, hsa
ggcccugagcugugagagaccagcacagcagcguccagguuaaaagccgcugaccaaaguccaa

SEQ ID NO: 313799 - RNA, 64 nt, hsa
aaauauaagaaauaaaggagcucuuacgaaaaacccagguuagaccgcauaaaaaauaaaguga

SEQ ID NO: 313800 - RNA, 64 nt, hsa
ugcuuacccuugauuuuuucuccccauuugacacccagguuaaaaagggguucccuuuuuggua

SEQ ID NO: 313801 - RNA, 64 nt, hsa
ucagagacuagauguaucugagagggucuccagaccagguuacugcaaaaaugagguuuugcuu

SEQ ID NO: 313802 - RNA, 64 nt, hsa
uacuccagggugaaggcagagugggauuugagacccagguuaggcacgacccaggcugagaagg

SEQ ID NO: 313803 - RNA, 64 nt, hsa
uaaaaugaaaggaacuugacuguacaguuuguagccagguuaagcauuugguauuguuucauuu

SEQ ID NO: 313804 - RNA, 64 nt, hsa
ucaccaugucccuugcccccauguagcccauuucccagguuaugcucuuuucuuucucaggguc

SEQ ID NO: 313805 - RNA, 64 nt, hsa
guuacguauugaauauagaaaucauucuaacaacccagguuauuuucaaucagaccaggcauuc

SEQ ID NO: 313806 - RNA, 64 nt, hsa
uguuuaccucuucuaugcaagccuugcuagacagccagguuagccuuugcccugucacccccga

SEQ ID NO: 313807 - RNA, 64 nt, hsa
aauagccuaaaaaccuagccucuaacaccuuguuccagguuaccuuccaaaguuucuaucuugu

SEQ ID NO: 313808 - RNA, 64 nt, hsa
ugcuggaccaacgcggguucuggggugcacagcgccagguuaacgcugaagccugccccgcuga

SEQ ID NO: 313809 - RNA, 64 nt, hsa
ccuccucccuggagcuccagagacccaccccucuccagguuaucccagaaaugacccaacucuc

SEQ ID NO: 313810 - RNA, 64 nt, hsa
uggugcaaucuuggcucacugcaaccuccgccacccagguuaaaaauucuccugccucagccuc

SEQ ID NO: 313811 - RNA, 64 nt, hsa
ucgcgagacuuucggucccccccgccccuuccccccagguuagcaauugggaauggcugggagg

SEQ ID NO: 313812 - RNA, 64 nt, hsa
ggaugccuauccacccucuggcagaagacacucaccagguuaucugugaagagacucugggauc

SEQ ID NO: 313813 - RNA, 64 nt, hsa
aucggggcauagcccagggaugcccccaggcggcccagguuagaugcgucccuuuggcuuguca

SEQ ID NO: 313814 - RNA, 64 nt, hsa
gaggcccaguggggaagaaugaacauggcuucauccagguuaacugaugcugccauuugcccag

SEQ ID NO: 313815 - RNA, 64 nt, hsa
gaggccaagggguaggccugagcgccagagucgcccagguuagcccacaggauuccuuugugug

SEQ ID NO: 313816 - RNA, 64 nt, hsa
cucaugcacacgcugacacgcgguugcauggaguccagguuacucaggccggcacuucugagug

SEQ ID NO: 313817 - RNA, 64 nt, hsa
ugauuaaugcauccagauuguuuuccuaguauuuccagguuagaaccuguggauuguuucaauu

SEQ ID NO: 313818 - RNA, 64 nt, hsa
cucuuuaccuagucccugcuguguagggcguaguccagguuagcuagguagaguuagugcucca

SEQ ID NO: 313819 - RNA, 64 nt, hsa
acacucugcuccuuacaucuaggcccagcugaacccagguuaggggcagaucagaagggcugcg

SEQ ID NO: 313820 - RNA, 64 nt, hsa
auguuuaauccauguauugguacuuuacugaaaaccagguuauauucuaaagaagaaagaaggc

SEQ ID NO: 313821 - RNA, 64 nt, hsa
uucauucaccagauauuuuguucuuaauugugaaccagguuagcaaaugaccuaucaaaaauua

SEQ ID NO: 313822 - RNA, 64 nt, hsa
gucauuggggugguugucaugugauggguccccuccagguuacuaaagggugcauguccccugc

SEQ ID NO: 313823 - RNA, 64 nt, hsa
gugguuggggugguugucaugugacggguccccuccagguuacuaaagggugcauguccccugc

SEQ ID NO: 313824 - RNA, 64 nt, hsa
caucugugagugacugagggagacaggaggaauaccagguuauucauggaauaaagucuuucca

SEQ ID NO: 313825 - RNA, 64 nt, hsa
ugccaagcacugugcagaggguacacaguuccugccagguuaacacccucccuucaggccuccc

SEQ ID NO: 313826 - RNA, 64 nt, hsa
gggaaaauaauuuuuuccuccaagauucucagauccagguuaggaaaggauucagcacuacagc

SEQ ID NO: 313827 - RNA, 64 nt, hsa
uggaagagaccauaaaggcuucaaaacuagaagugcgcaugaaggaugcuucaugcccuguucc

SEQ ID NO: 313828 - RNA, 64 nt, hsa
ugauaauaugguguuaugggaaaacacauuuugugcgcaugaugaagagagcaccgugaaucua

SEQ ID NO: 313829 - RNA, 64 nt, hsa
agauccggaacgucagccagcucccagccacauggcgcaugaaggagagcccagucucccucca

SEQ ID NO: 313830 - RNA, 64 nt, hsa
gcuuugugggcuccaggccuguacucaucggcaggcgcaugaguaucugugggaguccucuaga

SEQ ID NO: 313831 - RNA, 64 nt, hsa
uauuaaagcgagcaaagucugcauuuuaccuggugcgcaugaguggggucuuuaagaguuuugg

SEQ ID NO: 313832 - RNA, 64 nt, hsa
gaugaaauuuuaaaggaguuucaguuuuaaaagugcgcaugauucuacauaugagaauucuuua

SEQ ID NO: 313833 - RNA, 64 nt, hsa
cugggcacgccagucugcaccaugugucccugcggcgcaugagugacuggcguauuuagcccgu

SEQ ID NO: 313834 - RNA, 64 nt, hsa
gguguuuggugaugguuauugacgacaauguguagcgcaugauuguuuuuauaccaagaacauu

SEQ ID NO: 313835 - RNA, 64 nt, hsa
auuuaauucauguugccuugcauaauggucagaggcgcaugaauuugugaagguggaaauaaac

SEQ ID NO: 313836 - RNA, 64 nt, hsa
ucucuucuaacauuuaaggaauagagccuaauuagcgcaugaauacguguugaacugugaauga

SEQ ID NO: 313837 - RNA, 64 nt, hsa
uguuuguugcuuacaguuugacaacuuaaaugcugcgcaugaaaccucuaaguuggaaauugaa

SEQ ID NO: 313838 - RNA, 64 nt, hsa
ucugcuaggacuuaccccagccacugaguggcaggcgcaugagauuuguggcuguuccugaugc

SEQ ID NO: 313839 - RNA, 64 nt, hsa
ccagaaagaaacaacagaaaccaaaacucacaaggcgcaugauuacuuguuuuauauuucaugu

SEQ ID NO: 313840 - RNA, 64 nt, hsa
ucuugagcagguggagccauggugcucugugguggcgcaugauucacugagcaaacagcacuuu

SEQ ID NO: 313841 - RNA, 64 nt, hsa
cccuggucuuguuaccugugugugugcuggugcugcgcaugaggacugucugccuuugagggcu

SEQ ID NO: 313842 - RNA, 64 nt, hsa
auaacucagaggaacagacacucaaacucccaaagcgcaugauugcugggaaacaguagaaacc

SEQ ID NO: 313843 - RNA, 64 nt, hsa
guaagugcaguggggguaagcaguccugugaguggcgcaugaacgcuggagcuuauuccgccgc

SEQ ID NO: 313844 - RNA, 64 nt, hsa
ucuuccuccucuacuacaugguggugcagggcaagcgcaugaguaaagagacguggggcuauuu

SEQ ID NO: 313845 - RNA, 64 nt, hsa
auccccaggaccccauccuguucucggggacccugcgcaugaaccuggaccccuucggcagcua

SEQ ID NO: 313846 - RNA, 64 nt, hsa
cgacaagcuggacccccugcucccgggggggcgagcgcaugacccccccgcccucgcgcugccu

SEQ ID NO: 313847 - RNA, 64 nt, hsa
uuuagucugacuugacuauuguuuuuccuuucuggcgcaugaauccauacaucauuccuggaag

SEQ ID NO: 313848 - RNA, 64 nt, hsa
gggucagucaggguucgggggcugcagcagccaagcgcaugagagguguuuccuuggccuucca

SEQ ID NO: 313849 - RNA, 64 nt, hsa
gugugugcucacaaccacucucaccuguucgugagcgcaugaggcgaaguuaucuuauauuucc

SEQ ID NO: 313850 - RNA, 64 nt, hsa
gaagaugaaugaauguaacuccuggugugaagaugaauguaaacccuggcgacaguugagaccu

SEQ ID NO: 313851 - RNA, 64 nt, hsa
cacggcagagagcagcgccgaugugaagaugaaugaauguaacuccuggugugaagaugaaugu

SEQ ID NO: 313852 - RNA, 64 nt, hsa
auagcuuucaggaaagauaaagagaacaugcuuagaauguaagcuaaacagauuuuuucuguug

SEQ ID NO: 313853 - RNA, 64 nt, hsa
ggggcuaacuucgggaucccugcacuuuauguaagaauguaaaccuggagucucauuuaagaau

SEQ ID NO: 313854 - RNA, 64 nt, hsa
uacauagcacuugauacguguuaaaugaacauaugaauguaauuuauauauuccuagaauuuaa

SEQ ID NO: 313855 - RNA, 64 nt, hsa
agcagcucaauuuguacuacuucagccaaucugugaauguaaaaacuacacuguugccuugcua

SEQ ID NO: 313856 - RNA, 64 nt, hsa
aggaaucauuggugaacuuuccaagguuauuucugaauguaacaauuuccuuaaaaaugacuua

SEQ ID NO: 313857 - RNA, 64 nt, hsa
caaacugccccguuaacuccagaucauugcacuggaauguaaucaagaaaguuagucauguuuu

SEQ ID NO: 313858 - RNA, 64 nt, hsa
aacuuuauaaucgucauuguucaaccaagauuuugaauguaauaagaugaauauauuccuuaca

SEQ ID NO: 313859 - RNA, 64 nt, hsa
gcaaauaagaauguuugagcacacugcccacaaugaauguaacuauuuucuaaacacuuuacua

SEQ ID NO: 313860 - RNA, 64 nt, hsa
auaaugaccaaagugcauucugaguuuuuucaaggaauguaauacuggagcuuuaagaacauac

SEQ ID NO: 313861 - RNA, 64 nt, hsa
gaaaaauugacauugcugccuuuaagaauaccaugaauguaagaaauugaaagaaauuguaaaa

SEQ ID NO: 313862 - RNA, 64 nt, hsa
acacuuaaaucuaacagaggauuuucagaguagugaauguaaggaaagcuuaauggaucucucc

SEQ ID NO: 313863 - RNA, 64 nt, hsa
gcaucaaagaauucacacaggagagaaagcacaugaauguaaugaauguggaaaagcuuucagu

SEQ ID NO: 313864 - RNA, 64 nt, hsa
gcaucacaaaaugcauaggaaagagaaaucguaugaauguaaugaguaugagggcaguuucagu

SEQ ID NO: 313865 - RNA, 64 nt, hsa
caacaucagagcauucauaccaaagagaacucaugaauguaaugaagaugggaagauauuuauc

SEQ ID NO: 313866 - RNA, 64 nt, hsa
acauuugacuuuuauuuuuguauuuaauugacaugaauguaaaggggacagcucaggguuguuu

SEQ ID NO: 313867 - RNA, 64 nt, hsa
uuuuguauuuucccugccgaagugaauuguuggagaauguaaaccgccuccacguggcggcaga

SEQ ID NO: 313868 - RNA, 64 nt, hsa
ggcaguuuggugcaauuuauguuaaaugccauuugaauguaaucaccuguguuaccacgaauga

SEQ ID NO: 313869 - RNA, 64 nt, hsa
aagaaguggauuucucuuuuacuccugauuugcagaauguaagugauuucuccagcagugugca

SEQ ID NO: 313870 - RNA, 64 nt, hsa
ccaaagauaggaggaagaaagagaacucuccauagaauguaauuuauagaugcguguauaugua

SEQ ID NO: 313871 - RNA, 64 nt, hsa
cuccuaggauacagaaaccauggcaacgaaaguagaauguaaaacucgcagcagauaucagugg

SEQ ID NO: 313872 - RNA, 64 nt, hsa
aucuguugucauguuaguaaaugauuugaaaacugaauguaauacuugaguagauuuuuuuuuc

SEQ ID NO: 313873 - RNA, 64 nt, hsa
acauagaguaaacaucuuaguaauauauuaaagugaauguaaauggugguuaaaauuacauuac

SEQ ID NO: 313874 - RNA, 64 nt, hsa
aaccuuuagacucugaaaguaauauuuugacuaagaauguaaauauuuccaaacuaaauuacuc

SEQ ID NO: 313875 - RNA, 64 nt, hsa
augacugaaugaaugaaugaauggcucagcugaggaauguaacuuuggucaaguuauuaugaug

SEQ ID NO: 313876 - RNA, 64 nt, hsa
cacaaaacauuuaagugccagacuuaauauuaaagaauguaaagguccaaguaaaaugagguau

SEQ ID NO: 313877 - RNA, 64 nt, hsa
ugaaaaaagaugacaauuuaaaagucagccuaaagaauguaaagguaucuauauacaaaaggcu

SEQ ID NO: 313878 - RNA, 64 nt, hsa
ucagagauauuuagaauauuugacaaugguuugagaauguaaaacaaaaaggaacuaguuagag

SEQ ID NO: 313879 - RNA, 64 nt, hsa
gaucuuaacaauuccaauagaagagaagacauaugaauguaaggaaugugggaaaaucuuggcu

SEQ ID NO: 313880 - RNA, 64 nt, hsa
ucagcugugaucucacaagugugaaaaaucuuaugaauguaaaauguguggagauucuucuuug

SEQ ID NO: 313881 - RNA, 64 nt, hsa
ucauaaaaggacacacacuggagagaaacccugugaauguaagaaauguagaaaagcauuccau

SEQ ID NO: 313882 - RNA, 64 nt, hsa
acaugaaaggaugcacagaggagagaagcucugugaauguaagcauugugggaaagcauucaua

SEQ ID NO: 313883 - RNA, 64 nt, hsa
acaugcaagaacacacaauggagagaaacccuaugaauguaaagaaugcagaaaagcauucagc

SEQ ID NO: 313884 - RNA, 64 nt, hsa
gcauggaaggacucacacuggagaaaaacccuaugaauguaagcaguaugggaaagcguucaga

SEQ ID NO: 313885 - RNA, 64 nt, hsa
ucagaccugacaagauucuuugaauacagauaaugaauguaaacaauuaacuguuuauaauaac

SEQ ID NO: 313886 - RNA, 64 nt, hsa
uuaugaaaggacacacacuggagagaaacccuaugaauguaagaaauguggaaaagcguuccau

SEQ ID NO: 313887 - RNA, 64 nt, hsa
uacaugaaaguugcacagaggagaggcgcccuaagaauguaagcauugugggaaagcauucaua

SEQ ID NO: 313888 - RNA, 64 nt, hsa
auacaugcaaaacacacacuggagagaaaccuaugaauguaaggaaugcaaacaagcauucaau

SEQ ID NO: 313889 - RNA, 64 nt, hsa
acaugaaaggacucauacgagagagaauccguaugaauguaaggauugugggaaagcauucagc

SEQ ID NO: 313890 - RNA, 64 nt, hsa
agacauguaaagacacaccagaaggaaacccuaugaauguaagcaauguggcaaaagcuuucac

SEQ ID NO: 313891 - RNA, 64 nt, hsa
gcauggaagcacucacacuuggcagaaacucuaugaauguaagcaguaugggaaagccuucaga

SEQ ID NO: 313892 - RNA, 64 nt, hsa
ucagaucggcuaggauucuuugaauacaaauaaugaauguaaacaauuaacuguuuauaauaac

SEQ ID NO: 313893 - RNA, 60 nt, hsa
augcgaaaucauacagcugagaaacccuaugaauguaaggaauguggaaaagccuucagc

SEQ ID NO: 313894 - RNA, 64 nt, hsa
ucaugugagaagucacacaggggagaaacccuaugaauguaauaaaugugggaaagccuuuucu

SEQ ID NO: 313895 - RNA, 64 nt, hsa
acauaugagaagucauacuggugagaaacccuuugaauguaaugaaugugggaaagcauucucu

SEQ ID NO: 313896 - RNA, 64 nt, hsa
acaugaacgaauucauacuggagagaaacccuaugaauguaaagaauguggaaaacccuucagu

SEQ ID NO: 313897 - RNA, 64 nt, hsa
acaugaaagaacccacacuggagagaaaccuuaugaauguaaacagugugguaaagccuucagu

SEQ ID NO: 313898 - RNA, 64 nt, hsa
acaugaaaggaugcacacugcaaagaaacaguaugaauguaaaaaaugugggaaaacauacauu

SEQ ID NO: 313899 - RNA, 64 nt, hsa
acaugagaggaaucacacugcacagaaacacuaugaauguaaacugugugggaaaacuuacuug

SEQ ID NO: 313900 - RNA, 64 nt, hsa
acaugaaagaacucacacuggagaaaaacccuaugaauguaaaaaaugugggaaaguguucgua

SEQ ID NO: 313901 - RNA, 64 nt, hsa
acaugaaaggaaucacacuguacagaaacgcuaugaauguaaacaauguggaaaaaccuacaua

SEQ ID NO: 313902 - RNA, 64 nt, hsa
gauagaaauaauucucauuggagauaaacccuaugaauguaaacacauaguaaagccuuaauuu

SEQ ID NO: 313903 - RNA, 64 nt, hsa
acaugaaaggauucacucuggagagaagucauaugaauguaagaaauguagaaaagcauugagu

SEQ ID NO: 313904 - RNA, 64 nt, hsa
aaaauaaaaaaaaagaaaaagaaauaaacucuaugaauguaaaccauguggugaaggcuuaagu

SEQ ID NO: 313905 - RNA, 64 nt, hsa
acaugaaagaacucauaccgcaaagaagcuaugugaauguaaggaauguggaaaagcauugagu

SEQ ID NO: 313906 - RNA, 64 nt, hsa
acaugaaaggauucacacuggagagaagccguaugaauguaaggaaugcaggaaagcauucucu

SEQ ID NO: 313907 - RNA, 64 nt, hsa
ucaugagacaacucauaugggagagaagccauaugaauguaaauaaugugggaaagcauuuggu

SEQ ID NO: 313908 - RNA, 64 nt, hsa
acgugaaaccacucacagugcagagaaaccccaugaauguaagcaaugugggaaagcauuugau

SEQ ID NO: 313909 - RNA, 64 nt, hsa
acaugaaagaacacguacuggggagaaacuguaugaauguaagcaguguucuaaagccuucccu

SEQ ID NO: 313910 - RNA, 64 nt, hsa
gcaugaaagaacucacucuggagagaaacuauaugaauguaagcaguguucuaaagccuuucau

SEQ ID NO: 313911 - RNA, 64 nt, hsa
acaucaaagaauuccuacuggugagaaacccuaugaauguaaugaaugugagaaggccucuucu

SEQ ID NO: 313912 - RNA, 64 nt, hsa
acaucagacaauucacacuggugacaaacccuaugaauguaaagauuguaaaaaagcuuuucuu

SEQ ID NO: 313913 - RNA, 64 nt, hsa
acaucaaagaauucauaccagugugaaacccuaugaauguaaggaauguguaaagaccuuuacu

SEQ ID NO: 313914 - RNA, 64 nt, hsa
acaucagagaauucacaguggggagaaacccuaugaauguaaugaaugugggaaugccuucauu

SEQ ID NO: 313915 - RNA, 64 nt, hsa
aaccaccagcccauccugaggaaagccuccuauggaauguaaagugcaaucauuucuucagaua

SEQ ID NO: 313916 - RNA, 64 nt, hsa
uuucaaaccauuuaccaucugaaaguuuugauuugaauguaaaacaggaaauuggaauuccuuu

SEQ ID NO: 313917 - RNA, 64 nt, hsa
gagacuuaugaaggcauuaggauagauagcucaggaauguaaagguucagaaaaggucuguuuu

SEQ ID NO: 313918 - RNA, 64 nt, hsa
guccuaaaaauggccagauuguggaacagcuguugaauguaauacuuccaaaauguacauaucu

SEQ ID NO: 313919 - RNA, 64 nt, hsa; identical to SEQ ID NO: 280098

SEQ ID NO: 313920 - RNA, 64 nt, hsa; identical to SEQ ID NO: 280099

SEQ ID NO: 313921 - RNA, 64 nt, hsa; identical to SEQ ID NO: 280100

SEQ ID NO: 313922 - RNA, 64 nt, hsa; identical to SEQ ID NO: 280101

SEQ ID NO: 313923 - RNA, 64 nt, hsa; identical to SEQ ID NO: 280102

SEQ ID NO: 313924 - RNA, 64 nt, hsa; identical to SEQ ID NO: 280103

SEQ ID NO: 313925 - RNA, 64 nt, hsa; identical to SEQ ID NO: 280104

SEQ ID NO: 313926 - RNA, 64 nt, hsa; identical to SEQ ID NO: 280105

SEQ ID NO: 313927 - RNA, 64 nt, hsa; identical to SEQ ID NO: 280106

SEQ ID NO: 313928 - RNA, 64 nt, hsa; identical to SEQ ID NO: 280107

SEQ ID NO: 313929 - RNA, 64 nt, hsa; identical to SEQ ID NO: 280108

SEQ ID NO: 313930 - RNA, 64 nt, hsa; identical to SEQ ID NO: 280109

SEQ ID NO: 313931 - RNA, 64 nt, hsa; identical to SEQ ID NO: 280110

SEQ ID NO: 313932 - RNA, 64 nt, hsa; identical to SEQ ID NO: 280111

SEQ ID NO: 313933 - RNA, 64 nt, hsa; identical to SEQ ID NO: 280112

SEQ ID NO: 313934 - RNA, 64 nt, hsa; identical to SEQ ID NO: 280113

SEQ ID NO: 313935 - RNA, 64 nt, hsa; identical to SEQ ID NO: 280114

SEQ ID NO: 313936 - RNA, 64 nt, hsa; identical to SEQ ID NO: 280115

SEQ ID NO: 313937 - RNA, 64 nt, hsa; identical to SEQ ID NO: 280116

SEQ ID NO: 313938 - RNA, 64 nt, hsa; identical to SEQ ID NO: 280117

SEQ ID NO: 313939 - RNA, 64 nt, hsa; identical to SEQ ID NO: 280118

SEQ ID NO: 313940 - RNA, 64 nt, hsa; identical to SEQ ID NO: 280119

SEQ ID NO: 313941 - RNA, 64 nt, hsa; identical to SEQ ID NO: 280120

SEQ ID NO: 313942 - RNA, 64 nt, hsa; identical to SEQ ID NO: 280121

SEQ ID NO: 313943 - RNA, 64 nt, hsa; identical to SEQ ID NO: 280122

SEQ ID NO: 313944 - RNA, 64 nt, hsa; identical to SEQ ID NO: 280123

SEQ ID NO: 313945 - RNA, 64 nt, hsa; identical to SEQ ID NO: 280124

SEQ ID NO: 313946 - RNA, 64 nt, hsa; identical to SEQ ID NO: 280125

SEQ ID NO: 313947 - RNA, 64 nt, hsa; identical to SEQ ID NO: 280126

SEQ ID NO: 313948 - RNA, 64 nt, hsa; identical to SEQ ID NO: 280127

SEQ ID NO: 313949 - RNA, 64 nt, hsa; identical to SEQ ID NO: 280128

SEQ ID NO: 313950 - RNA, 64 nt, hsa; identical to SEQ ID NO: 280129

SEQ ID NO: 313951 - RNA, 64 nt, hsa; identical to SEQ ID NO: 280130

SEQ ID NO: 313952 - RNA, 64 nt, hsa; identical to SEQ ID NO: 280131

SEQ ID NO: 313953 - RNA, 64 nt, hsa; identical to SEQ ID NO: 280132

SEQ ID NO: 313954 - RNA, 64 nt, hsa; identical to SEQ ID NO: 280133

SEQ ID NO: 313955 - RNA, 64 nt, hsa; identical to SEQ ID NO: 280134

SEQ ID NO: 313956 - RNA, 64 nt, hsa; identical to SEQ ID NO: 280135

SEQ ID NO: 313957 - RNA, 64 nt, hsa; identical to SEQ ID NO: 280136

SEQ ID NO: 313958 - RNA, 64 nt, hsa; identical to SEQ ID NO: 280137

SEQ ID NO: 313959 - RNA, 64 nt, hsa; identical to SEQ ID NO: 280138

SEQ ID NO: 313960 - RNA, 64 nt, hsa; identical to SEQ ID NO: 280139

SEQ ID NO: 313961 - RNA, 64 nt, hsa; identical to SEQ ID NO: 280140

SEQ ID NO: 313962 - RNA, 64 nt, hsa; identical to SEQ ID NO: 280141

SEQ ID NO: 313963 - RNA, 64 nt, hsa; identical to SEQ ID NO: 280142

SEQ ID NO: 313964 - RNA, 64 nt, hsa; identical to SEQ ID NO: 280143

SEQ ID NO: 313965 - RNA, 64 nt, hsa; identical to SEQ ID NO: 280144

SEQ ID NO: 313966 - RNA, 64 nt, hsa; identical to SEQ ID NO: 280145

SEQ ID NO: 313967 - RNA, 64 nt, hsa; identical to SEQ ID NO: 280146

SEQ ID NO: 313968 - RNA, 64 nt, hsa; identical to SEQ ID NO: 280147

SEQ ID NO: 313969 - RNA, 64 nt, hsa; identical to SEQ ID NO: 280148

SEQ ID NO: 313970 - RNA, 64 nt, hsa; identical to SEQ ID NO: 280149

SEQ ID NO: 313971 - RNA, 64 nt, hsa; identical to SEQ ID NO: 280150

SEQ ID NO: 313972 - RNA, 64 nt, hsa; identical to SEQ ID NO: 280151

SEQ ID NO: 313973 - RNA, 64 nt, hsa; identical to SEQ ID NO: 280152

SEQ ID NO: 313974 - RNA, 64 nt, hsa; identical to SEQ ID NO: 280153

SEQ ID NO: 313975 - RNA, 64 nt, hsa; identical to SEQ ID NO: 280154

SEQ ID NO: 313976 - RNA, 64 nt, hsa; identical to SEQ ID NO: 280155

SEQ ID NO: 313977 - RNA, 64 nt, hsa; identical to SEQ ID NO: 280156

SEQ ID NO: 313978 - RNA, 64 nt, hsa; identical to SEQ ID NO: 280157

SEQ ID NO: 313979 - RNA, 64 nt, hsa; identical to SEQ ID NO: 280158

SEQ ID NO: 313980 - RNA, 64 nt, hsa; identical to SEQ ID NO: 280159

SEQ ID NO: 313981 - RNA, 64 nt, hsa; identical to SEQ ID NO: 280160

SEQ ID NO: 313982 - RNA, 64 nt, hsa; identical to SEQ ID NO: 280161

SEQ ID NO: 313983 - RNA, 64 nt, hsa; identical to SEQ ID NO: 280162

SEQ ID NO: 313984 - RNA, 64 nt, hsa; identical to SEQ ID NO: 280163

SEQ ID NO: 313985 - RNA, 64 nt, hsa; identical to SEQ ID NO: 280164

SEQ ID NO: 313986 - RNA, 64 nt, hsa; identical to SEQ ID NO: 280165

SEQ ID NO: 313987 - RNA, 54 nt, hsa; identical to SEQ ID NO: 280166

SEQ ID NO: 313988 - RNA, 64 nt, hsa; identical to SEQ ID NO: 280167

SEQ ID NO: 313989 - RNA, 64 nt, hsa; identical to SEQ ID NO: 280168

SEQ ID NO: 313990 - RNA, 64 nt, hsa; identical to SEQ ID NO: 280169

SEQ ID NO: 313991 - RNA, 64 nt, hsa; identical to SEQ ID NO: 280170

SEQ ID NO: 313992 - RNA, 64 nt, hsa; identical to SEQ ID NO: 280171

SEQ ID NO: 313993 - RNA, 64 nt, hsa; identical to SEQ ID NO: 280172

SEQ ID NO: 313994 - RNA, 64 nt, hsa; identical to SEQ ID NO: 280173

SEQ ID NO: 313995 - RNA, 64 nt, hsa; identical to SEQ ID NO: 280174

SEQ ID NO: 313996 - RNA, 64 nt, hsa; identical to SEQ ID NO: 280175

SEQ ID NO: 313997 - RNA, 64 nt, hsa; identical to SEQ ID NO: 280176

SEQ ID NO: 313998 - RNA, 64 nt, hsa; identical to SEQ ID NO: 280177

SEQ ID NO: 313999 - RNA, 64 nt, hsa; identical to SEQ ID NO: 280178

SEQ ID NO: 314000 - RNA, 64 nt, hsa; identical to SEQ ID NO: 280179

SEQ ID NO: 314001 - RNA, 64 nt, hsa; identical to SEQ ID NO: 280180

SEQ ID NO: 314002 - RNA, 64 nt, hsa; identical to SEQ ID NO: 280181

SEQ ID NO: 314003 - RNA, 64 nt, hsa; identical to SEQ ID NO: 280182

SEQ ID NO: 314004 - RNA, 64 nt, hsa; identical to SEQ ID NO: 280183

SEQ ID NO: 314005 - RNA, 64 nt, hsa; identical to SEQ ID NO: 280184

SEQ ID NO: 314006 - RNA, 64 nt, hsa; identical to SEQ ID NO: 280185

SEQ ID NO: 314007 - RNA, 64 nt, hsa; identical to SEQ ID NO: 280186

SEQ ID NO: 314008 - RNA, 64 nt, hsa; identical to SEQ ID NO: 280187

SEQ ID NO: 314009 - RNA, 64 nt, hsa; identical to SEQ ID NO: 280188

SEQ ID NO: 314010 - RNA, 64 nt, hsa; identical to SEQ ID NO: 280189

SEQ ID NO: 314011 - RNA, 64 nt, hsa; identical to SEQ ID NO: 280190

SEQ ID NO: 314012 - RNA, 64 nt, hsa; identical to SEQ ID NO: 280191

SEQ ID NO: 314013 - RNA, 64 nt, hsa; identical to SEQ ID NO: 280192

SEQ ID NO: 314014 - RNA, 64 nt, hsa; identical to SEQ ID NO: 280193

SEQ ID NO: 314015 - RNA, 64 nt, hsa; identical to SEQ ID NO: 280194

SEQ ID NO: 314016 - RNA, 64 nt, hsa; identical to SEQ ID NO: 280195

SEQ ID NO: 314017 - RNA, 64 nt, hsa; identical to SEQ ID NO: 280196

SEQ ID NO: 314018 - RNA, 64 nt, hsa; identical to SEQ ID NO: 280197

SEQ ID NO: 314019 - RNA, 64 nt, hsa; identical to SEQ ID NO: 280198

SEQ ID NO: 314020 - RNA, 64 nt, hsa; identical to SEQ ID NO: 280199

SEQ ID NO: 314021 - RNA, 64 nt, hsa; identical to SEQ ID NO: 280200

SEQ ID NO: 314022 - RNA, 64 nt, hsa; identical to SEQ ID NO: 280201

SEQ ID NO: 314023 - RNA, 64 nt, hsa; identical to SEQ ID NO: 280202

SEQ ID NO: 314024 - RNA, 64 nt, hsa; identical to SEQ ID NO: 280203

SEQ ID NO: 314025 - RNA, 64 nt, hsa; identical to SEQ ID NO: 280204

SEQ ID NO: 314026 - RNA, 64 nt, hsa; identical to SEQ ID NO: 280205

SEQ ID NO: 314027 - RNA, 64 nt, hsa; identical to SEQ ID NO: 280206

SEQ ID NO: 314028 - RNA, 64 nt, hsa; identical to SEQ ID NO: 280207

SEQ ID NO: 314029 - RNA, 64 nt, hsa; identical to SEQ ID NO: 280208

SEQ ID NO: 314030 - RNA, 64 nt, hsa; identical to SEQ ID NO: 280209

SEQ ID NO: 314031 - RNA, 64 nt, hsa; identical to SEQ ID NO: 280210

SEQ ID NO: 314032 - RNA, 64 nt, hsa; identical to SEQ ID NO: 280211

SEQ ID NO: 314033 - RNA, 64 nt, hsa; identical to SEQ ID NO: 280212

SEQ ID NO: 314034 - RNA, 64 nt, hsa; identical to SEQ ID NO: 280213

SEQ ID NO: 314035 - RNA, 64 nt, hsa; identical to SEQ ID NO: 280214

SEQ ID NO: 314036 - RNA, 64 nt, hsa; identical to SEQ ID NO: 280215

SEQ ID NO: 314037 - RNA, 64 nt, hsa; identical to SEQ ID NO: 280216

SEQ ID NO: 314038 - RNA, 64 nt, hsa; identical to SEQ ID NO: 280217

SEQ ID NO: 314039 - RNA, 64 nt, hsa; identical to SEQ ID NO: 280218

SEQ ID NO: 314040 - RNA, 64 nt, hsa; identical to SEQ ID NO: 280219

SEQ ID NO: 314041 - RNA, 64 nt, hsa; identical to SEQ ID NO: 280220

SEQ ID NO: 314042 - RNA, 64 nt, hsa; identical to SEQ ID NO: 280221

SEQ ID NO: 314043 - RNA, 64 nt, hsa; identical to SEQ ID NO: 280222

SEQ ID NO: 314044 - RNA, 64 nt, hsa; identical to SEQ ID NO: 280223

SEQ ID NO: 314045 - RNA, 64 nt, hsa; identical to SEQ ID NO: 280224

SEQ ID NO: 314046 - RNA, 64 nt, hsa; identical to SEQ ID NO: 280225

SEQ ID NO: 314047 - RNA, 64 nt, hsa; identical to SEQ ID NO: 280226

SEQ ID NO: 314048 - RNA, 64 nt, hsa; identical to SEQ ID NO: 280227

SEQ ID NO: 314049 - RNA, 64 nt, hsa; identical to SEQ ID NO: 280228

SEQ ID NO: 314050 - RNA, 64 nt, hsa; identical to SEQ ID NO: 280229

SEQ ID NO: 314051 - RNA, 64 nt, hsa; identical to SEQ ID NO: 280230

SEQ ID NO: 314052 - RNA, 64 nt, hsa; identical to SEQ ID NO: 280231

SEQ ID NO: 314053 - RNA, 64 nt, hsa; identical to SEQ ID NO: 280232

SEQ ID NO: 314054 - RNA, 64 nt, hsa; identical to SEQ ID NO: 280233

SEQ ID NO: 314055 - RNA, 64 nt, hsa; identical to SEQ ID NO: 280234

SEQ ID NO: 314056 - RNA, 64 nt, hsa; identical to SEQ ID NO: 280235

SEQ ID NO: 314057 - RNA, 64 nt, hsa; identical to SEQ ID NO: 280236

SEQ ID NO: 314058 - RNA, 64 nt, hsa; identical to SEQ ID NO: 280237

SEQ ID NO: 314059 - RNA, 64 nt, hsa; identical to SEQ ID NO: 280238

SEQ ID NO: 314060 - RNA, 64 nt, hsa; identical to SEQ ID NO: 280239

SEQ ID NO: 314061 - RNA, 64 nt, hsa; identical to SEQ ID NO: 280240

SEQ ID NO: 314062 - RNA, 64 nt, hsa; identical to SEQ ID NO: 280241

SEQ ID NO: 314063 - RNA, 64 nt, hsa; identical to SEQ ID NO: 280242

SEQ ID NO: 314064 - RNA, 64 nt, hsa; identical to SEQ ID NO: 280243

SEQ ID NO: 314065 - RNA, 64 nt, hsa; identical to SEQ ID NO: 280244

SEQ ID NO: 314066 - RNA, 64 nt, hsa; identical to SEQ ID NO: 280245

SEQ ID NO: 314067 - RNA, 64 nt, hsa; identical to SEQ ID NO: 280246

SEQ ID NO: 314068 - RNA, 64 nt, hsa; identical to SEQ ID NO: 280247

SEQ ID NO: 314069 - RNA, 64 nt, hsa; identical to SEQ ID NO: 280248

SEQ ID NO: 314070 - RNA, 64 nt, hsa; identical to SEQ ID NO: 280249

SEQ ID NO: 314071 - RNA, 64 nt, hsa; identical to SEQ ID NO: 280250

SEQ ID NO: 314072 - RNA, 64 nt, hsa; identical to SEQ ID NO: 280251

SEQ ID NO: 314073 - RNA, 64 nt, hsa; identical to SEQ ID NO: 280252

SEQ ID NO: 314074 - RNA, 64 nt, hsa; identical to SEQ ID NO: 280253

SEQ ID NO: 314075 - RNA, 64 nt, hsa; identical to SEQ ID NO: 280254

SEQ ID NO: 314076 - RNA, 64 nt, hsa; identical to SEQ ID NO: 280255

SEQ ID NO: 314077 - RNA, 64 nt, hsa; identical to SEQ ID NO: 280256

SEQ ID NO: 314078 - RNA, 64 nt, hsa; identical to SEQ ID NO: 280257

SEQ ID NO: 314079 - RNA, 64 nt, hsa; identical to SEQ ID NO: 280258

SEQ ID NO: 314080 - RNA, 64 nt, hsa; identical to SEQ ID NO: 280259

SEQ ID NO: 314081 - RNA, 64 nt, hsa; identical to SEQ ID NO: 280260

SEQ ID NO: 314082 - RNA, 64 nt, hsa; identical to SEQ ID NO: 280261

SEQ ID NO: 314083 - RNA, 64 nt, hsa; identical to SEQ ID NO: 280262

SEQ ID NO: 314084 - RNA, 64 nt, hsa; identical to SEQ ID NO: 280263

SEQ ID NO: 314085 - RNA, 64 nt, hsa; identical to SEQ ID NO: 280264

SEQ ID NO: 314086 - RNA, 64 nt, hsa; identical to SEQ ID NO: 280265

SEQ ID NO: 314087 - RNA, 64 nt, hsa; identical to SEQ ID NO: 280266

SEQ ID NO: 314088 - RNA, 64 nt, hsa; identical to SEQ ID NO: 280267

SEQ ID NO: 314089 - RNA, 64 nt, hsa; identical to SEQ ID NO: 280268

SEQ ID NO: 314090 - RNA, 64 nt, hsa; identical to SEQ ID NO: 280269

SEQ ID NO: 314091 - RNA, 64 nt, hsa; identical to SEQ ID NO: 280270

SEQ ID NO: 314092 - RNA, 64 nt, hsa; identical to SEQ ID NO: 280271

SEQ ID NO: 314093 - RNA, 64 nt, hsa; identical to SEQ ID NO: 280272

SEQ ID NO: 314094 - RNA, 64 nt, hsa; identical to SEQ ID NO: 280273

SEQ ID NO: 314095 - RNA, 64 nt, hsa; identical to SEQ ID NO: 280274

SEQ ID NO: 314096 - RNA, 64 nt, hsa; identical to SEQ ID NO: 280275

SEQ ID NO: 314097 - RNA, 64 nt, hsa; identical to SEQ ID NO: 280276

SEQ ID NO: 314098 - RNA, 64 nt, hsa; identical to SEQ ID NO: 280277

SEQ ID NO: 314099 - RNA, 64 nt, hsa; identical to SEQ ID NO: 280278

SEQ ID NO: 314100 - RNA, 64 nt, hsa; identical to SEQ ID NO: 280279

SEQ ID NO: 314101 - RNA, 64 nt, hsa; identical to SEQ ID NO: 280280

SEQ ID NO: 314102 - RNA, 57 nt, hsa; identical to SEQ ID NO: 280281

SEQ ID NO: 314103 - RNA, 64 nt, hsa; identical to SEQ ID NO: 280282

SEQ ID NO: 314104 - RNA, 64 nt, hsa; identical to SEQ ID NO: 280283

SEQ ID NO: 314105 - RNA, 64 nt, hsa; identical to SEQ ID NO: 280284

SEQ ID NO: 314106 - RNA, 64 nt, hsa; identical to SEQ ID NO: 280285

SEQ ID NO: 314107 - RNA, 64 nt, hsa; identical to SEQ ID NO: 280286

SEQ ID NO: 314108 - RNA, 64 nt, hsa; identical to SEQ ID NO: 280287

SEQ ID NO: 314109 - RNA, 64 nt, hsa; identical to SEQ ID NO: 280288

SEQ ID NO: 314110 - RNA, 64 nt, hsa; identical to SEQ ID NO: 280289

SEQ ID NO: 314111 - RNA, 64 nt, hsa; identical to SEQ ID NO: 280290

SEQ ID NO: 314112 - RNA, 64 nt, hsa; identical to SEQ ID NO: 280291

SEQ ID NO: 314113 - RNA, 64 nt, hsa; identical to SEQ ID NO: 280292

SEQ ID NO: 314114 - RNA, 64 nt, hsa; identical to SEQ ID NO: 280293

SEQ ID NO: 314115 - RNA, 64 nt, hsa; identical to SEQ ID NO: 280294

SEQ ID NO: 314116 - RNA, 64 nt, hsa; identical to SEQ ID NO: 280295

SEQ ID NO: 314117 - RNA, 64 nt, hsa; identical to SEQ ID NO: 280296

SEQ ID NO: 314118 - RNA, 64 nt, hsa; identical to SEQ ID NO: 280297

SEQ ID NO: 314119 - RNA, 64 nt, hsa; identical to SEQ ID NO: 280298

SEQ ID NO: 314120 - RNA, 64 nt, hsa; identical to SEQ ID NO: 280299

SEQ ID NO: 314121 - RNA, 64 nt, hsa; identical to SEQ ID NO: 280300

SEQ ID NO: 314122 - RNA, 64 nt, hsa; identical to SEQ ID NO: 280301

SEQ ID NO: 314123 - RNA, 64 nt, hsa; identical to SEQ ID NO: 280302

SEQ ID NO: 314124 - RNA, 64 nt, hsa; identical to SEQ ID NO: 280303

SEQ ID NO: 314125 - RNA, 64 nt, hsa; identical to SEQ ID NO: 280304

SEQ ID NO: 314126 - RNA, 64 nt, hsa; identical to SEQ ID NO: 280305

SEQ ID NO: 314127 - RNA, 64 nt, hsa; identical to SEQ ID NO: 280306

SEQ ID NO: 314128 - RNA, 64 nt, hsa; identical to SEQ ID NO: 280307

SEQ ID NO: 314129 - RNA, 64 nt, hsa; identical to SEQ ID NO: 280308

SEQ ID NO: 314130 - RNA, 64 nt, hsa; identical to SEQ ID NO: 280309

SEQ ID NO: 314131 - RNA, 64 nt, hsa; identical to SEQ ID NO: 280310

SEQ ID NO: 314132 - RNA, 64 nt, hsa; identical to SEQ ID NO: 280311

SEQ ID NO: 314133 - RNA, 64 nt, hsa; identical to SEQ ID NO: 280312

SEQ ID NO: 314134 - RNA, 64 nt, hsa; identical to SEQ ID NO: 280313

SEQ ID NO: 314135 - RNA, 64 nt, hsa; identical to SEQ ID NO: 280314

SEQ ID NO: 314136 - RNA, 64 nt, hsa; identical to SEQ ID NO: 280315

SEQ ID NO: 314137 - RNA, 64 nt, hsa; identical to SEQ ID NO: 280316

SEQ ID NO: 314138 - RNA, 64 nt, hsa; identical to SEQ ID NO: 280317

SEQ ID NO: 314139 - RNA, 64 nt, hsa; identical to SEQ ID NO: 280318

SEQ ID NO: 314140 - RNA, 64 nt, hsa; identical to SEQ ID NO: 280319

SEQ ID NO: 314141 - RNA, 64 nt, hsa; identical to SEQ ID NO: 280320

SEQ ID NO: 314142 - RNA, 64 nt, hsa; identical to SEQ ID NO: 280321

SEQ ID NO: 314143 - RNA, 64 nt, hsa; identical to SEQ ID NO: 280322

SEQ ID NO: 314144 - RNA, 64 nt, hsa; identical to SEQ ID NO: 280323

SEQ ID NO: 314145 - RNA, 64 nt, hsa; identical to SEQ ID NO: 280324

SEQ ID NO: 314146 - RNA, 64 nt, hsa; identical to SEQ ID NO: 280325

SEQ ID NO: 314147 - RNA, 64 nt, hsa; identical to SEQ ID NO: 280326

SEQ ID NO: 314148 - RNA, 64 nt, hsa; identical to SEQ ID NO: 280327

SEQ ID NO: 314149 - RNA, 64 nt, hsa; identical to SEQ ID NO: 280328

SEQ ID NO: 314150 - RNA, 64 nt, hsa; identical to SEQ ID NO: 280329

SEQ ID NO: 314151 - RNA, 64 nt, hsa; identical to SEQ ID NO: 280330

SEQ ID NO: 314152 - RNA, 64 nt, hsa; identical to SEQ ID NO: 280331

SEQ ID NO: 314153 - RNA, 64 nt, hsa; identical to SEQ ID NO: 280332

SEQ ID NO: 314154 - RNA, 64 nt, hsa; identical to SEQ ID NO: 280333

SEQ ID NO: 314155 - RNA, 64 nt, hsa; identical to SEQ ID NO: 280334

SEQ ID NO: 314156 - RNA, 64 nt, hsa; identical to SEQ ID NO: 280335

SEQ ID NO: 314157 - RNA, 64 nt, hsa; identical to SEQ ID NO: 280336

SEQ ID NO: 314158 - RNA, 64 nt, hsa; identical to SEQ ID NO: 280337

SEQ ID NO: 314159 - RNA, 64 nt, hsa; identical to SEQ ID NO: 280338

SEQ ID NO: 314160 - RNA, 64 nt, hsa; identical to SEQ ID NO: 280339

SEQ ID NO: 314161 - RNA, 64 nt, hsa; identical to SEQ ID NO: 280340

SEQ ID NO: 314162 - RNA, 64 nt, hsa; identical to SEQ ID NO: 280341

SEQ ID NO: 314163 - RNA, 64 nt, hsa; identical to SEQ ID NO: 280342

SEQ ID NO: 314164 - RNA, 64 nt, hsa; identical to SEQ ID NO: 280343

SEQ ID NO: 314165 - RNA, 64 nt, hsa; identical to SEQ ID NO: 280344

SEQ ID NO: 314166 - RNA, 64 nt, hsa; identical to SEQ ID NO: 280345

SEQ ID NO: 314167 - RNA, 64 nt, hsa; identical to SEQ ID NO: 280346

SEQ ID NO: 314168 - RNA, 64 nt, hsa; identical to SEQ ID NO: 280347

SEQ ID NO: 314169 - RNA, 64 nt, hsa; identical to SEQ ID NO: 280348

SEQ ID NO: 314170 - RNA, 64 nt, hsa; identical to SEQ ID NO: 280349

SEQ ID NO: 314171 - RNA, 64 nt, hsa; identical to SEQ ID NO: 280350

SEQ ID NO: 314172 - RNA, 64 nt, hsa; identical to SEQ ID NO: 280351

SEQ ID NO: 314173 - RNA, 64 nt, hsa; identical to SEQ ID NO: 280352

SEQ ID NO: 314174 - RNA, 64 nt, hsa; identical to SEQ ID NO: 280353

SEQ ID NO: 314175 - RNA, 64 nt, hsa; identical to SEQ ID NO: 280354

SEQ ID NO: 314176 - RNA, 64 nt, hsa; identical to SEQ ID NO: 280355

SEQ ID NO: 314177 - RNA, 64 nt, hsa; identical to SEQ ID NO: 280356

SEQ ID NO: 314178 - RNA, 64 nt, hsa; identical to SEQ ID NO: 280357

SEQ ID NO: 314179 - RNA, 64 nt, hsa; identical to SEQ ID NO: 280358

SEQ ID NO: 314180 - RNA, 64 nt, hsa; identical to SEQ ID NO: 280359

SEQ ID NO: 314181 - RNA, 64 nt, hsa; identical to SEQ ID NO: 280360

SEQ ID NO: 314182 - RNA, 64 nt, hsa; identical to SEQ ID NO: 280361

SEQ ID NO: 314183 - RNA, 64 nt, hsa; identical to SEQ ID NO: 280362

SEQ ID NO: 314184 - RNA, 64 nt, hsa; identical to SEQ ID NO: 280363

SEQ ID NO: 314185 - RNA, 64 nt, hsa; identical to SEQ ID NO: 280364

SEQ ID NO: 314186 - RNA, 64 nt, hsa; identical to SEQ ID NO: 280365

SEQ ID NO: 314187 - RNA, 64 nt, hsa; identical to SEQ ID NO: 280366

SEQ ID NO: 314188 - RNA, 64 nt, hsa; identical to SEQ ID NO: 280367

SEQ ID NO: 314189 - RNA, 64 nt, hsa; identical to SEQ ID NO: 280368

SEQ ID NO: 314190 - RNA, 64 nt, hsa; identical to SEQ ID NO: 280369

SEQ ID NO: 314191 - RNA, 64 nt, hsa; identical to SEQ ID NO: 280370

SEQ ID NO: 314192 - RNA, 64 nt, hsa; identical to SEQ ID NO: 280371

SEQ ID NO: 314193 - RNA, 64 nt, hsa; identical to SEQ ID NO: 280372

SEQ ID NO: 314194 - RNA, 64 nt, hsa; identical to SEQ ID NO: 280373

SEQ ID NO: 314195 - RNA, 64 nt, hsa; identical to SEQ ID NO: 280374

SEQ ID NO: 314196 - RNA, 64 nt, hsa; identical to SEQ ID NO: 280375

SEQ ID NO: 314197 - RNA, 64 nt, hsa; identical to SEQ ID NO: 280376

SEQ ID NO: 314198 - RNA, 64 nt, hsa; identical to SEQ ID NO: 280377

SEQ ID NO: 314199 - RNA, 64 nt, hsa; identical to SEQ ID NO: 280378

SEQ ID NO: 314200 - RNA, 64 nt, hsa; identical to SEQ ID NO: 280379

SEQ ID NO: 314201 - RNA, 64 nt, hsa; identical to SEQ ID NO: 280380

SEQ ID NO: 314202 - RNA, 64 nt, hsa; identical to SEQ ID NO: 280381

SEQ ID NO: 314203 - RNA, 64 nt, hsa; identical to SEQ ID NO: 280382

SEQ ID NO: 314204 - RNA, 64 nt, hsa; identical to SEQ ID NO: 280383

SEQ ID NO: 314205 - RNA, 64 nt, hsa; identical to SEQ ID NO: 280384

SEQ ID NO: 314206 - RNA, 64 nt, hsa; identical to SEQ ID NO: 280385

SEQ ID NO: 314207 - RNA, 64 nt, hsa; identical to SEQ ID NO: 280386

SEQ ID NO: 314208 - RNA, 64 nt, hsa; identical to SEQ ID NO: 280387

SEQ ID NO: 314209 - RNA, 64 nt, hsa; identical to SEQ ID NO: 280388

SEQ ID NO: 314210 - RNA, 64 nt, hsa; identical to SEQ ID NO: 280389

SEQ ID NO: 314211 - RNA, 64 nt, hsa; identical to SEQ ID NO: 280390

SEQ ID NO: 314212 - RNA, 64 nt, hsa; identical to SEQ ID NO: 280391

SEQ ID NO: 314213 - RNA, 64 nt, hsa; identical to SEQ ID NO: 280392

SEQ ID NO: 314214 - RNA, 64 nt, hsa; identical to SEQ ID NO: 280393

SEQ ID NO: 314215 - RNA, 64 nt, hsa; identical to SEQ ID NO: 280394

SEQ ID NO: 314216 - RNA, 64 nt, hsa; identical to SEQ ID NO: 280395

SEQ ID NO: 314217 - RNA, 64 nt, hsa; identical to SEQ ID NO: 280396

SEQ ID NO: 314218 - RNA, 64 nt, hsa; identical to SEQ ID NO: 280397

SEQ ID NO: 314219 - RNA, 64 nt, hsa; identical to SEQ ID NO: 280398

SEQ ID NO: 314220 - RNA, 64 nt, hsa; identical to SEQ ID NO: 280399

SEQ ID NO: 314221 - RNA, 64 nt, hsa; identical to SEQ ID NO: 280400

SEQ ID NO: 314222 - RNA, 64 nt, hsa; identical to SEQ ID NO: 280401

SEQ ID NO: 314223 - RNA, 64 nt, hsa; identical to SEQ ID NO: 280402

SEQ ID NO: 314224 - RNA, 64 nt, hsa; identical to SEQ ID NO: 280403

SEQ ID NO: 314225 - RNA, 64 nt, hsa; identical to SEQ ID NO: 280404

SEQ ID NO: 314226 - RNA, 64 nt, hsa; identical to SEQ ID NO: 280405

SEQ ID NO: 314227 - RNA, 64 nt, hsa; identical to SEQ ID NO: 280406

SEQ ID NO: 314228 - RNA, 64 nt, hsa; identical to SEQ ID NO: 280407

SEQ ID NO: 314229 - RNA, 64 nt, hsa; identical to SEQ ID NO: 280408

SEQ ID NO: 314230 - RNA, 64 nt, hsa; identical to SEQ ID NO: 280409

SEQ ID NO: 314231 - RNA, 64 nt, hsa; identical to SEQ ID NO: 280410

SEQ ID NO: 314232 - RNA, 64 nt, hsa; identical to SEQ ID NO: 280411

SEQ ID NO: 314233 - RNA, 64 nt, hsa; identical to SEQ ID NO: 280412

SEQ ID NO: 314234 - RNA, 64 nt, hsa; identical to SEQ ID NO: 280413

SEQ ID NO: 314235 - RNA, 64 nt, hsa; identical to SEQ ID NO: 280414

SEQ ID NO: 314236 - RNA, 64 nt, hsa; identical to SEQ ID NO: 280415

SEQ ID NO: 314237 - RNA, 64 nt, hsa; identical to SEQ ID NO: 280416

SEQ ID NO: 314238 - RNA, 64 nt, hsa; identical to SEQ ID NO: 280417

SEQ ID NO: 314239 - RNA, 64 nt, hsa; identical to SEQ ID NO: 280418

SEQ ID NO: 314240 - RNA, 64 nt, hsa; identical to SEQ ID NO: 280419

SEQ ID NO: 314241 - RNA, 64 nt, hsa; identical to SEQ ID NO: 280420

SEQ ID NO: 314242 - RNA, 64 nt, hsa; identical to SEQ ID NO: 280421

SEQ ID NO: 314243 - RNA, 64 nt, hsa; identical to SEQ ID NO: 280422

SEQ ID NO: 314244 - RNA, 64 nt, hsa; identical to SEQ ID NO: 280423

SEQ ID NO: 314245 - RNA, 64 nt, hsa; identical to SEQ ID NO: 280424

SEQ ID NO: 314246 - RNA, 64 nt, hsa; identical to SEQ ID NO: 280425

SEQ ID NO: 314247 - RNA, 64 nt, hsa; identical to SEQ ID NO: 280426

SEQ ID NO: 314248 - RNA, 64 nt, hsa; identical to SEQ ID NO: 280427

SEQ ID NO: 314249 - RNA, 64 nt, hsa; identical to SEQ ID NO: 280428

SEQ ID NO: 314250 - RNA, 64 nt, hsa; identical to SEQ ID NO: 280429

SEQ ID NO: 314251 - RNA, 64 nt, hsa; identical to SEQ ID NO: 280430

SEQ ID NO: 314252 - RNA, 64 nt, hsa; identical to SEQ ID NO: 280431

SEQ ID NO: 314253 - RNA, 64 nt, hsa; identical to SEQ ID NO: 280432

SEQ ID NO: 314254 - RNA, 64 nt, hsa; identical to SEQ ID NO: 280433

SEQ ID NO: 314255 - RNA, 64 nt, hsa; identical to SEQ ID NO: 280434

SEQ ID NO: 314256 - RNA, 64 nt, hsa; identical to SEQ ID NO: 280435

SEQ ID NO: 314257 - RNA, 64 nt, hsa; identical to SEQ ID NO: 280436

SEQ ID NO: 314258 - RNA, 64 nt, hsa; identical to SEQ ID NO: 280437

SEQ ID NO: 314259 - RNA, 64 nt, hsa; identical to SEQ ID NO: 280438

SEQ ID NO: 314260 - RNA, 64 nt, hsa; identical to SEQ ID NO: 280439

SEQ ID NO: 314261 - RNA, 64 nt, hsa; identical to SEQ ID NO: 280440

SEQ ID NO: 314262 - RNA, 64 nt, hsa; identical to SEQ ID NO: 280441

SEQ ID NO: 314263 - RNA, 64 nt, hsa; identical to SEQ ID NO: 280442

SEQ ID NO: 314264 - RNA, 64 nt, hsa; identical to SEQ ID NO: 280443

SEQ ID NO: 314265 - RNA, 64 nt, hsa; identical to SEQ ID NO: 280444

SEQ ID NO: 314266 - RNA, 64 nt, hsa; identical to SEQ ID NO: 280445

SEQ ID NO: 314267 - RNA, 64 nt, hsa; identical to SEQ ID NO: 280446

SEQ ID NO: 314268 - RNA, 64 nt, hsa; identical to SEQ ID NO: 280447

SEQ ID NO: 314269 - RNA, 64 nt, hsa; identical to SEQ ID NO: 280448

SEQ ID NO: 314270 - RNA, 64 nt, hsa; identical to SEQ ID NO: 280449

SEQ ID NO: 314271 - RNA, 64 nt, hsa; identical to SEQ ID NO: 280450

SEQ ID NO: 314272 - RNA, 64 nt, hsa; identical to SEQ ID NO: 280451

SEQ ID NO: 314273 - RNA, 64 nt, hsa; identical to SEQ ID NO: 280452

SEQ ID NO: 314274 - RNA, 64 nt, hsa; identical to SEQ ID NO: 280453

SEQ ID NO: 314275 - RNA, 64 nt, hsa; identical to SEQ ID NO: 280454

SEQ ID NO: 314276 - RNA, 64 nt, hsa; identical to SEQ ID NO: 280455

SEQ ID NO: 314277 - RNA, 64 nt, hsa; identical to SEQ ID NO: 280456

SEQ ID NO: 314278 - RNA, 64 nt, hsa; identical to SEQ ID NO: 280457

SEQ ID NO: 314279 - RNA, 64 nt, hsa; identical to SEQ ID NO: 280458

SEQ ID NO: 314280 - RNA, 64 nt, hsa; identical to SEQ ID NO: 280459

SEQ ID NO: 314281 - RNA, 64 nt, hsa; identical to SEQ ID NO: 280460

SEQ ID NO: 314282 - RNA, 64 nt, hsa; identical to SEQ ID NO: 280461

SEQ ID NO: 314283 - RNA, 64 nt, hsa; identical to SEQ ID NO: 280462

SEQ ID NO: 314284 - RNA, 64 nt, hsa; identical to SEQ ID NO: 280463

SEQ ID NO: 314285 - RNA, 64 nt, hsa; identical to SEQ ID NO: 280464

SEQ ID NO: 314286 - RNA, 64 nt, hsa; identical to SEQ ID NO: 280465

SEQ ID NO: 314287 - RNA, 64 nt, hsa; identical to SEQ ID NO: 280466

SEQ ID NO: 314288 - RNA, 64 nt, hsa; identical to SEQ ID NO: 280467

SEQ ID NO: 314289 - RNA, 64 nt, hsa; identical to SEQ ID NO: 280468

SEQ ID NO: 314290 - RNA, 64 nt, hsa; identical to SEQ ID NO: 280469

SEQ ID NO: 314291 - RNA, 64 nt, hsa; identical to SEQ ID NO: 280470

SEQ ID NO: 314292 - RNA, 64 nt, hsa; identical to SEQ ID NO: 280471

SEQ ID NO: 314293 - RNA, 64 nt, hsa; identical to SEQ ID NO: 280472

SEQ ID NO: 314294 - RNA, 64 nt, hsa; identical to SEQ ID NO: 280473

SEQ ID NO: 314295 - RNA, 64 nt, hsa; identical to SEQ ID NO: 280474

SEQ ID NO: 314296 - RNA, 64 nt, hsa; identical to SEQ ID NO: 280475

SEQ ID NO: 314297 - RNA, 64 nt, hsa; identical to SEQ ID NO: 280476

SEQ ID NO: 314298 - RNA, 64 nt, hsa; identical to SEQ ID NO: 280477

SEQ ID NO: 314299 - RNA, 64 nt, hsa; identical to SEQ ID NO: 280478

SEQ ID NO: 314300 - RNA, 64 nt, hsa; identical to SEQ ID NO: 280479

SEQ ID NO: 314301 - RNA, 64 nt, hsa; identical to SEQ ID NO: 280480

SEQ ID NO: 314302 - RNA, 64 nt, hsa; identical to SEQ ID NO: 280481

SEQ ID NO: 314303 - RNA, 64 nt, hsa; identical to SEQ ID NO: 280482

SEQ ID NO: 314304 - RNA, 64 nt, hsa; identical to SEQ ID NO: 280483

SEQ ID NO: 314305 - RNA, 54 nt, hsa; identical to SEQ ID NO: 280484

SEQ ID NO: 314306 - RNA, 64 nt, hsa; identical to SEQ ID NO: 280485

SEQ ID NO: 314307 - RNA, 64 nt, hsa; identical to SEQ ID NO: 280486

SEQ ID NO: 314308 - RNA, 64 nt, hsa; identical to SEQ ID NO: 280487

SEQ ID NO: 314309 - RNA, 64 nt, hsa; identical to SEQ ID NO: 280488

SEQ ID NO: 314310 - RNA, 64 nt, hsa; identical to SEQ ID NO: 280489

SEQ ID NO: 314311 - RNA, 64 nt, hsa; identical to SEQ ID NO: 280490

SEQ ID NO: 314312 - RNA, 64 nt, hsa; identical to SEQ ID NO: 280491

SEQ ID NO: 314313 - RNA, 64 nt, hsa; identical to SEQ ID NO: 280492

SEQ ID NO: 314314 - RNA, 64 nt, hsa; identical to SEQ ID NO: 280493

SEQ ID NO: 314315 - RNA, 64 nt, hsa; identical to SEQ ID NO: 280494

SEQ ID NO: 314316 - RNA, 64 nt, hsa; identical to SEQ ID NO: 280495

SEQ ID NO: 314317 - RNA, 64 nt, hsa; identical to SEQ ID NO: 280496

SEQ ID NO: 314318 - RNA, 64 nt, hsa; identical to SEQ ID NO: 280497

SEQ ID NO: 314319 - RNA, 64 nt, hsa; identical to SEQ ID NO: 280498

SEQ ID NO: 314320 - RNA, 64 nt, hsa; identical to SEQ ID NO: 280499

SEQ ID NO: 314321 - RNA, 64 nt, hsa; identical to SEQ ID NO: 280500

SEQ ID NO: 314322 - RNA, 64 nt, hsa; identical to SEQ ID NO: 280501

SEQ ID NO: 314323 - RNA, 64 nt, hsa; identical to SEQ ID NO: 280502

SEQ ID NO: 314324 - RNA, 64 nt, hsa; identical to SEQ ID NO: 280503

SEQ ID NO: 314325 - RNA, 64 nt, hsa; identical to SEQ ID NO: 280504

SEQ ID NO: 314326 - RNA, 64 nt, hsa; identical to SEQ ID NO: 280505

SEQ ID NO: 314327 - RNA, 64 nt, hsa; identical to SEQ ID NO: 280506

SEQ ID NO: 314328 - RNA, 64 nt, hsa; identical to SEQ ID NO: 280507

SEQ ID NO: 314329 - RNA, 64 nt, hsa; identical to SEQ ID NO: 280508

SEQ ID NO: 314330 - RNA, 64 nt, hsa; identical to SEQ ID NO: 280509

SEQ ID NO: 314331 - RNA, 64 nt, hsa; identical to SEQ ID NO: 280510

SEQ ID NO: 314332 - RNA, 64 nt, hsa; identical to SEQ ID NO: 280511

SEQ ID NO: 314333 - RNA, 64 nt, hsa; identical to SEQ ID NO: 280512

SEQ ID NO: 314334 - RNA, 64 nt, hsa; identical to SEQ ID NO: 280513

SEQ ID NO: 314335 - RNA, 64 nt, hsa; identical to SEQ ID NO: 280514

SEQ ID NO: 314336 - RNA, 64 nt, hsa; identical to SEQ ID NO: 280515

SEQ ID NO: 314337 - RNA, 64 nt, hsa; identical to SEQ ID NO: 280516

SEQ ID NO: 314338 - RNA, 64 nt, hsa; identical to SEQ ID NO: 280517

SEQ ID NO: 314339 - RNA, 64 nt, hsa; identical to SEQ ID NO: 280518

SEQ ID NO: 314340 - RNA, 64 nt, hsa; identical to SEQ ID NO: 280519

SEQ ID NO: 314341 - RNA, 64 nt, hsa; identical to SEQ ID NO: 280520

SEQ ID NO: 314342 - RNA, 64 nt, hsa; identical to SEQ ID NO: 280521

SEQ ID NO: 314343 - RNA, 64 nt, hsa; identical to SEQ ID NO: 280522

SEQ ID NO: 314344 - RNA, 64 nt, hsa; identical to SEQ ID NO: 280523

SEQ ID NO: 314345 - RNA, 64 nt, hsa; identical to SEQ ID NO: 280524

SEQ ID NO: 314346 - RNA, 64 nt, hsa; identical to SEQ ID NO: 280525

SEQ ID NO: 314347 - RNA, 64 nt, hsa; identical to SEQ ID NO: 280526

SEQ ID NO: 314348 - RNA, 64 nt, hsa; identical to SEQ ID NO: 280527

SEQ ID NO: 314349 - RNA, 64 nt, hsa; identical to SEQ ID NO: 280528

SEQ ID NO: 314350 - RNA, 64 nt, hsa; identical to SEQ ID NO: 280529

SEQ ID NO: 314351 - RNA, 64 nt, hsa; identical to SEQ ID NO: 280530

SEQ ID NO: 314352 - RNA, 64 nt, hsa; identical to SEQ ID NO: 280531

SEQ ID NO: 314353 - RNA, 64 nt, hsa; identical to SEQ ID NO: 280532

SEQ ID NO: 314354 - RNA, 64 nt, hsa; identical to SEQ ID NO: 280533

SEQ ID NO: 314355 - RNA, 64 nt, hsa; identical to SEQ ID NO: 280534

SEQ ID NO: 314356 - RNA, 64 nt, hsa; identical to SEQ ID NO: 280535

SEQ ID NO: 314357 - RNA, 64 nt, hsa; identical to SEQ ID NO: 280536

SEQ ID NO: 314358 - RNA, 64 nt, hsa; identical to SEQ ID NO: 280537

SEQ ID NO: 314359 - RNA, 64 nt, hsa; identical to SEQ ID NO: 280538

SEQ ID NO: 314360 - RNA, 64 nt, hsa; identical to SEQ ID NO: 280539

SEQ ID NO: 314361 - RNA, 64 nt, hsa; identical to SEQ ID NO: 280540

SEQ ID NO: 314362 - RNA, 64 nt, hsa; identical to SEQ ID NO: 280541

SEQ ID NO: 314363 - RNA, 64 nt, hsa; identical to SEQ ID NO: 280542

SEQ ID NO: 314364 - RNA, 64 nt, hsa; identical to SEQ ID NO: 280543

SEQ ID NO: 314365 - RNA, 64 nt, hsa; identical to SEQ ID NO: 280544

SEQ ID NO: 314366 - RNA, 64 nt, hsa; identical to SEQ ID NO: 280545

SEQ ID NO: 314367 - RNA, 64 nt, hsa; identical to SEQ ID NO: 280546

SEQ ID NO: 314368 - RNA, 64 nt, hsa; identical to SEQ ID NO: 280547

SEQ ID NO: 314369 - RNA, 64 nt, hsa; identical to SEQ ID NO: 280548

SEQ ID NO: 314370 - RNA, 64 nt, hsa; identical to SEQ ID NO: 280549

SEQ ID NO: 314371 - RNA, 64 nt, hsa; identical to SEQ ID NO: 280550

SEQ ID NO: 314372 - RNA, 64 nt, hsa; identical to SEQ ID NO: 280551

SEQ ID NO: 314373 - RNA, 64 nt, hsa; identical to SEQ ID NO: 280552

SEQ ID NO: 314374 - RNA, 64 nt, hsa; identical to SEQ ID NO: 280553

SEQ ID NO: 314375 - RNA, 64 nt, hsa; identical to SEQ ID NO: 280554

SEQ ID NO: 314376 - RNA, 64 nt, hsa; identical to SEQ ID NO: 280555

SEQ ID NO: 314377 - RNA, 64 nt, hsa; identical to SEQ ID NO: 280556

SEQ ID NO: 314378 - RNA, 64 nt, hsa; identical to SEQ ID NO: 280557

SEQ ID NO: 314379 - RNA, 64 nt, hsa; identical to SEQ ID NO: 280558

SEQ ID NO: 314380 - RNA, 64 nt, hsa; identical to SEQ ID NO: 280559

SEQ ID NO: 314381 - RNA, 60 nt, hsa; identical to SEQ ID NO: 280560

SEQ ID NO: 314382 - RNA, 64 nt, hsa; identical to SEQ ID NO: 280561

SEQ ID NO: 314383 - RNA, 64 nt, hsa; identical to SEQ ID NO: 280562

SEQ ID NO: 314384 - RNA, 64 nt, hsa; identical to SEQ ID NO: 280563

SEQ ID NO: 314385 - RNA, 64 nt, hsa; identical to SEQ ID NO: 280564

SEQ ID NO: 314386 - RNA, 64 nt, hsa; identical to SEQ ID NO: 280565

SEQ ID NO: 314387 - RNA, 64 nt, hsa; identical to SEQ ID NO: 280566

SEQ ID NO: 314388 - RNA, 64 nt, hsa; identical to SEQ ID NO: 280567

SEQ ID NO: 314389 - RNA, 64 nt, hsa; identical to SEQ ID NO: 280568

SEQ ID NO: 314390 - RNA, 64 nt, hsa; identical to SEQ ID NO: 280569

SEQ ID NO: 314391 - RNA, 64 nt, hsa; identical to SEQ ID NO: 280570

SEQ ID NO: 314392 - RNA, 64 nt, hsa; identical to SEQ ID NO: 280571

SEQ ID NO: 314393 - RNA, 64 nt, hsa; identical to SEQ ID NO: 280572

SEQ ID NO: 314394 - RNA, 64 nt, hsa; identical to SEQ ID NO: 280573

SEQ ID NO: 314395 - RNA, 64 nt, hsa; identical to SEQ ID NO: 280574

SEQ ID NO: 314396 - RNA, 64 nt, hsa; identical to SEQ ID NO: 280575

SEQ ID NO: 314397 - RNA, 64 nt, hsa; identical to SEQ ID NO: 280576

SEQ ID NO: 314398 - RNA, 64 nt, hsa; identical to SEQ ID NO: 280577

SEQ ID NO: 314399 - RNA, 64 nt, hsa; identical to SEQ ID NO: 280578

SEQ ID NO: 314400 - RNA, 64 nt, hsa; identical to SEQ ID NO: 280579

SEQ ID NO: 314401 - RNA, 64 nt, hsa; identical to SEQ ID NO: 280580

SEQ ID NO: 314402 - RNA, 64 nt, hsa; identical to SEQ ID NO: 280581

SEQ ID NO: 314403 - RNA, 64 nt, hsa; identical to SEQ ID NO: 280582

SEQ ID NO: 314404 - RNA, 64 nt, hsa; identical to SEQ ID NO: 280583

SEQ ID NO: 314405 - RNA, 64 nt, hsa; identical to SEQ ID NO: 280584

SEQ ID NO: 314406 - RNA, 64 nt, hsa; identical to SEQ ID NO: 280585

SEQ ID NO: 314407 - RNA, 64 nt, hsa; identical to SEQ ID NO: 280586

SEQ ID NO: 314408 - RNA, 64 nt, hsa; identical to SEQ ID NO: 280587

SEQ ID NO: 314409 - RNA, 64 nt, hsa; identical to SEQ ID NO: 280588

SEQ ID NO: 314410 - RNA, 64 nt, hsa; identical to SEQ ID NO: 280589

SEQ ID NO: 314411 - RNA, 64 nt, hsa; identical to SEQ ID NO: 280590

SEQ ID NO: 314412 - RNA, 64 nt, hsa; identical to SEQ ID NO: 280591

SEQ ID NO: 314413 - RNA, 64 nt, hsa; identical to SEQ ID NO: 280592

SEQ ID NO: 314414 - RNA, 64 nt, hsa; identical to SEQ ID NO: 280593

SEQ ID NO: 314415 - RNA, 64 nt, hsa; identical to SEQ ID NO: 280594

SEQ ID NO: 314416 - RNA, 64 nt, hsa; identical to SEQ ID NO: 280595

SEQ ID NO: 314417 - RNA, 64 nt, hsa; identical to SEQ ID NO: 280596

SEQ ID NO: 314418 - RNA, 64 nt, hsa; identical to SEQ ID NO: 280597

SEQ ID NO: 314419 - RNA, 64 nt, hsa; identical to SEQ ID NO: 280598

SEQ ID NO: 314420 - RNA, 64 nt, hsa; identical to SEQ ID NO: 280599

SEQ ID NO: 314421 - RNA, 64 nt, hsa; identical to SEQ ID NO: 280600

SEQ ID NO: 314422 - RNA, 64 nt, hsa; identical to SEQ ID NO: 280601

SEQ ID NO: 314423 - RNA, 64 nt, hsa; identical to SEQ ID NO: 280602

SEQ ID NO: 314424 - RNA, 64 nt, hsa; identical to SEQ ID NO: 280603

SEQ ID NO: 314425 - RNA, 64 nt, hsa; identical to SEQ ID NO: 280604

SEQ ID NO: 314426 - RNA, 64 nt, hsa; identical to SEQ ID NO: 280605

SEQ ID NO: 314427 - RNA, 64 nt, hsa; identical to SEQ ID NO: 280606

SEQ ID NO: 314428 - RNA, 64 nt, hsa; identical to SEQ ID NO: 280607

SEQ ID NO: 314429 - RNA, 64 nt, hsa; identical to SEQ ID NO: 280608

SEQ ID NO: 314430 - RNA, 64 nt, hsa; identical to SEQ ID NO: 280609

SEQ ID NO: 314431 - RNA, 64 nt, hsa; identical to SEQ ID NO: 280610

SEQ ID NO: 314432 - RNA, 64 nt, hsa; identical to SEQ ID NO: 280611

SEQ ID NO: 314433 - RNA, 64 nt, hsa; identical to SEQ ID NO: 280612

SEQ ID NO: 314434 - RNA, 64 nt, hsa; identical to SEQ ID NO: 280613

SEQ ID NO: 314435 - RNA, 64 nt, hsa; identical to SEQ ID NO: 280614

SEQ ID NO: 314436 - RNA, 64 nt, hsa; identical to SEQ ID NO: 280615

SEQ ID NO: 314437 - RNA, 64 nt, hsa; identical to SEQ ID NO: 280616

SEQ ID NO: 314438 - RNA, 64 nt, hsa; identical to SEQ ID NO: 280617

SEQ ID NO: 314439 - RNA, 64 nt, hsa; identical to SEQ ID NO: 280618

SEQ ID NO: 314440 - RNA, 64 nt, hsa; identical to SEQ ID NO: 280619

SEQ ID NO: 314441 - RNA, 64 nt, hsa; identical to SEQ ID NO: 280620

SEQ ID NO: 314442 - RNA, 64 nt, hsa; identical to SEQ ID NO: 280621

SEQ ID NO: 314443 - RNA, 64 nt, hsa; identical to SEQ ID NO: 280622

SEQ ID NO: 314444 - RNA, 64 nt, hsa; identical to SEQ ID NO: 280623

SEQ ID NO: 314445 - RNA, 64 nt, hsa; identical to SEQ ID NO: 280624

SEQ ID NO: 314446 - RNA, 64 nt, hsa; identical to SEQ ID NO: 280625

SEQ ID NO: 314447 - RNA, 64 nt, hsa; identical to SEQ ID NO: 280626

SEQ ID NO: 314448 - RNA, 64 nt, hsa; identical to SEQ ID NO: 280627

SEQ ID NO: 314449 - RNA, 64 nt, hsa; identical to SEQ ID NO: 280628

SEQ ID NO: 314450 - RNA, 64 nt, hsa; identical to SEQ ID NO: 280629

SEQ ID NO: 314451 - RNA, 64 nt, hsa; identical to SEQ ID NO: 280630

SEQ ID NO: 314452 - RNA, 64 nt, hsa; identical to SEQ ID NO: 280631

SEQ ID NO: 314453 - RNA, 64 nt, hsa; identical to SEQ ID NO: 280632

SEQ ID NO: 314454 - RNA, 64 nt, hsa; identical to SEQ ID NO: 280633

SEQ ID NO: 314455 - RNA, 64 nt, hsa; identical to SEQ ID NO: 280634

SEQ ID NO: 314456 - RNA, 64 nt, hsa; identical to SEQ ID NO: 280635

SEQ ID NO: 314457 - RNA, 64 nt, hsa; identical to SEQ ID NO: 280636

SEQ ID NO: 314458 - RNA, 64 nt, hsa; identical to SEQ ID NO: 280637

SEQ ID NO: 314459 - RNA, 64 nt, hsa; identical to SEQ ID NO: 280638

SEQ ID NO: 314460 - RNA, 64 nt, hsa; identical to SEQ ID NO: 280639

SEQ ID NO: 314461 - RNA, 64 nt, hsa; identical to SEQ ID NO: 280640

SEQ ID NO: 314462 - RNA, 64 nt, hsa; identical to SEQ ID NO: 280641

SEQ ID NO: 314463 - RNA, 64 nt, hsa; identical to SEQ ID NO: 280642

SEQ ID NO: 314464 - RNA, 64 nt, hsa; identical to SEQ ID NO: 280643

SEQ ID NO: 314465 - RNA, 64 nt, hsa; identical to SEQ ID NO: 280644

SEQ ID NO: 314466 - RNA, 64 nt, hsa; identical to SEQ ID NO: 280645

SEQ ID NO: 314467 - RNA, 64 nt, hsa; identical to SEQ ID NO: 280646

SEQ ID NO: 314468 - RNA, 64 nt, hsa; identical to SEQ ID NO: 280647

SEQ ID NO: 314469 - RNA, 64 nt, hsa; identical to SEQ ID NO: 280648

SEQ ID NO: 314470 - RNA, 64 nt, hsa; identical to SEQ ID NO: 280649

SEQ ID NO: 314471 - RNA, 64 nt, hsa; identical to SEQ ID NO: 280650

SEQ ID NO: 314472 - RNA, 64 nt, hsa; identical to SEQ ID NO: 280651

SEQ ID NO: 314473 - RNA, 64 nt, hsa; identical to SEQ ID NO: 280652

SEQ ID NO: 314474 - RNA, 64 nt, hsa; identical to SEQ ID NO: 280653

SEQ ID NO: 314475 - RNA, 64 nt, hsa; identical to SEQ ID NO: 280654

SEQ ID NO: 314476 - RNA, 64 nt, hsa; identical to SEQ ID NO: 280655

SEQ ID NO: 314477 - RNA, 64 nt, hsa; identical to SEQ ID NO: 280656

SEQ ID NO: 314478 - RNA, 64 nt, hsa; identical to SEQ ID NO: 280657

SEQ ID NO: 314479 - RNA, 64 nt, hsa; identical to SEQ ID NO: 280658

SEQ ID NO: 314480 - RNA, 64 nt, hsa; identical to SEQ ID NO: 280659

SEQ ID NO: 314481 - RNA, 64 nt, hsa; identical to SEQ ID NO: 280660

SEQ ID NO: 314482 - RNA, 64 nt, hsa; identical to SEQ ID NO: 280661

SEQ ID NO: 314483 - RNA, 64 nt, hsa; identical to SEQ ID NO: 280662

SEQ ID NO: 314484 - RNA, 64 nt, hsa; identical to SEQ ID NO: 280663

SEQ ID NO: 314485 - RNA, 64 nt, hsa; identical to SEQ ID NO: 280664

SEQ ID NO: 314486 - RNA, 64 nt, hsa; identical to SEQ ID NO: 280665

SEQ ID NO: 314487 - RNA, 64 nt, hsa; identical to SEQ ID NO: 280666

SEQ ID NO: 314488 - RNA, 64 nt, hsa; identical to SEQ ID NO: 280667

SEQ ID NO: 314489 - RNA, 64 nt, hsa; identical to SEQ ID NO: 280668

SEQ ID NO: 314490 - RNA, 64 nt, hsa; identical to SEQ ID NO: 280669

SEQ ID NO: 314491 - RNA, 64 nt, hsa; identical to SEQ ID NO: 280670

SEQ ID NO: 314492 - RNA, 64 nt, hsa; identical to SEQ ID NO: 280671

SEQ ID NO: 314493 - RNA, 64 nt, hsa; identical to SEQ ID NO: 280672

SEQ ID NO: 314494 - RNA, 64 nt, hsa; identical to SEQ ID NO: 280673

SEQ ID NO: 314495 - RNA, 64 nt, hsa; identical to SEQ ID NO: 280674

SEQ ID NO: 314496 - RNA, 64 nt, hsa; identical to SEQ ID NO: 280675

SEQ ID NO: 314497 - RNA, 64 nt, hsa; identical to SEQ ID NO: 280676

SEQ ID NO: 314498 - RNA, 64 nt, hsa; identical to SEQ ID NO: 280677

SEQ ID NO: 314499 - RNA, 64 nt, hsa; identical to SEQ ID NO: 280678

SEQ ID NO: 314500 - RNA, 64 nt, hsa; identical to SEQ ID NO: 280679

SEQ ID NO: 314501 - RNA, 64 nt, hsa; identical to SEQ ID NO: 280680

SEQ ID NO: 314502 - RNA, 64 nt, hsa; identical to SEQ ID NO: 280681

SEQ ID NO: 314503 - RNA, 64 nt, hsa; identical to SEQ ID NO: 280682

SEQ ID NO: 314504 - RNA, 64 nt, hsa; identical to SEQ ID NO: 280683

SEQ ID NO: 314505 - RNA, 64 nt, hsa; identical to SEQ ID NO: 280684

SEQ ID NO: 314506 - RNA, 64 nt, hsa; identical to SEQ ID NO: 280685

SEQ ID NO: 314507 - RNA, 64 nt, hsa; identical to SEQ ID NO: 280686

SEQ ID NO: 314508 - RNA, 64 nt, hsa; identical to SEQ ID NO: 280687

SEQ ID NO: 314509 - RNA, 64 nt, hsa; identical to SEQ ID NO: 280688

SEQ ID NO: 314510 - RNA, 64 nt, hsa; identical to SEQ ID NO: 280689

SEQ ID NO: 314511 - RNA, 64 nt, hsa; identical to SEQ ID NO: 280690

SEQ ID NO: 314512 - RNA, 64 nt, hsa; identical to SEQ ID NO: 280691

SEQ ID NO: 314513 - RNA, 64 nt, hsa; identical to SEQ ID NO: 280692

SEQ ID NO: 314514 - RNA, 64 nt, hsa; identical to SEQ ID NO: 280693

SEQ ID NO: 314515 - RNA, 64 nt, hsa; identical to SEQ ID NO: 280694

SEQ ID NO: 314516 - RNA, 64 nt, hsa; identical to SEQ ID NO: 280695

SEQ ID NO: 314517 - RNA, 64 nt, hsa; identical to SEQ ID NO: 280696

SEQ ID NO: 314518 - RNA, 64 nt, hsa; identical to SEQ ID NO: 280697

SEQ ID NO: 314519 - RNA, 64 nt, hsa; identical to SEQ ID NO: 280698

SEQ ID NO: 314520 - RNA, 64 nt, hsa; identical to SEQ ID NO: 280699

SEQ ID NO: 314521 - RNA, 64 nt, hsa; identical to SEQ ID NO: 280700

SEQ ID NO: 314522 - RNA, 64 nt, hsa; identical to SEQ ID NO: 280701

SEQ ID NO: 314523 - RNA, 64 nt, hsa; identical to SEQ ID NO: 280702

SEQ ID NO: 314524 - RNA, 64 nt, hsa; identical to SEQ ID NO: 280703

SEQ ID NO: 314525 - RNA, 64 nt, hsa; identical to SEQ ID NO: 280704

SEQ ID NO: 314526 - RNA, 64 nt, hsa; identical to SEQ ID NO: 280705

SEQ ID NO: 314527 - RNA, 64 nt, hsa; identical to SEQ ID NO: 280706

SEQ ID NO: 314528 - RNA, 64 nt, hsa; identical to SEQ ID NO: 280707

SEQ ID NO: 314529 - RNA, 64 nt, hsa; identical to SEQ ID NO: 280708

SEQ ID NO: 314530 - RNA, 64 nt, hsa; identical to SEQ ID NO: 280709

SEQ ID NO: 314531 - RNA, 64 nt, hsa; identical to SEQ ID NO: 280710

SEQ ID NO: 314532 - RNA, 64 nt, hsa; identical to SEQ ID NO: 280711

SEQ ID NO: 314533 - RNA, 64 nt, hsa; identical to SEQ ID NO: 280712

SEQ ID NO: 314534 - RNA, 64 nt, hsa; identical to SEQ ID NO: 280713

SEQ ID NO: 314535 - RNA, 64 nt, hsa; identical to SEQ ID NO: 280714

SEQ ID NO: 314536 - RNA, 64 nt, hsa; identical to SEQ ID NO: 280715

SEQ ID NO: 314537 - RNA, 64 nt, hsa; identical to SEQ ID NO: 280716

SEQ ID NO: 314538 - RNA, 64 nt, hsa; identical to SEQ ID NO: 280717

SEQ ID NO: 314539 - RNA, 64 nt, hsa; identical to SEQ ID NO: 280718

SEQ ID NO: 314540 - RNA, 64 nt, hsa; identical to SEQ ID NO: 280719

SEQ ID NO: 314541 - RNA, 64 nt, hsa; identical to SEQ ID NO: 280720

SEQ ID NO: 314542 - RNA, 64 nt, hsa; identical to SEQ ID NO: 280721

SEQ ID NO: 314543 - RNA, 64 nt, hsa; identical to SEQ ID NO: 280722

SEQ ID NO: 314544 - RNA, 64 nt, hsa; identical to SEQ ID NO: 280723

SEQ ID NO: 314545 - RNA, 64 nt, hsa; identical to SEQ ID NO: 280724

SEQ ID NO: 314546 - RNA, 64 nt, hsa; identical to SEQ ID NO: 280725

SEQ ID NO: 314547 - RNA, 64 nt, hsa; identical to SEQ ID NO: 280726

SEQ ID NO: 314548 - RNA, 64 nt, hsa; identical to SEQ ID NO: 280727

SEQ ID NO: 314549 - RNA, 64 nt, hsa; identical to SEQ ID NO: 280728

SEQ ID NO: 314550 - RNA, 64 nt, hsa; identical to SEQ ID NO: 280729

SEQ ID NO: 314551 - RNA, 64 nt, hsa; identical to SEQ ID NO: 280730

SEQ ID NO: 314552 - RNA, 64 nt, hsa; identical to SEQ ID NO: 280731

SEQ ID NO: 314553 - RNA, 64 nt, hsa; identical to SEQ ID NO: 280732

SEQ ID NO: 314554 - RNA, 64 nt, hsa; identical to SEQ ID NO: 280733

SEQ ID NO: 314555 - RNA, 64 nt, hsa; identical to SEQ ID NO: 280734

SEQ ID NO: 314556 - RNA, 64 nt, hsa; identical to SEQ ID NO: 280735

SEQ ID NO: 314557 - RNA, 64 nt, hsa; identical to SEQ ID NO: 280736

SEQ ID NO: 314558 - RNA, 64 nt, hsa; identical to SEQ ID NO: 280737

SEQ ID NO: 314559 - RNA, 64 nt, hsa; identical to SEQ ID NO: 280738

SEQ ID NO: 314560 - RNA, 64 nt, hsa; identical to SEQ ID NO: 280739

SEQ ID NO: 314561 - RNA, 64 nt, hsa; identical to SEQ ID NO: 280740

SEQ ID NO: 314562 - RNA, 64 nt, hsa; identical to SEQ ID NO: 280741

SEQ ID NO: 314563 - RNA, 64 nt, hsa; identical to SEQ ID NO: 280742

SEQ ID NO: 314564 - RNA, 64 nt, hsa; identical to SEQ ID NO: 280743

SEQ ID NO: 314565 - RNA, 64 nt, hsa; identical to SEQ ID NO: 280744

SEQ ID NO: 314566 - RNA, 64 nt, hsa; identical to SEQ ID NO: 280745

SEQ ID NO: 314567 - RNA, 64 nt, hsa; identical to SEQ ID NO: 280746

SEQ ID NO: 314568 - RNA, 64 nt, hsa; identical to SEQ ID NO: 280747

SEQ ID NO: 314569 - RNA, 64 nt, hsa; identical to SEQ ID NO: 280748

SEQ ID NO: 314570 - RNA, 64 nt, hsa; identical to SEQ ID NO: 280749

SEQ ID NO: 314571 - RNA, 64 nt, hsa; identical to SEQ ID NO: 280750

SEQ ID NO: 314572 - RNA, 64 nt, hsa; identical to SEQ ID NO: 280751

SEQ ID NO: 314573 - RNA, 64 nt, hsa; identical to SEQ ID NO: 280752

SEQ ID NO: 314574 - RNA, 64 nt, hsa; identical to SEQ ID NO: 280753

SEQ ID NO: 314575 - RNA, 64 nt, hsa; identical to SEQ ID NO: 280754

SEQ ID NO: 314576 - RNA, 64 nt, hsa; identical to SEQ ID NO: 280755

SEQ ID NO: 314577 - RNA, 64 nt, hsa; identical to SEQ ID NO: 280756

SEQ ID NO: 314578 - RNA, 64 nt, hsa; identical to SEQ ID NO: 280757

SEQ ID NO: 314579 - RNA, 64 nt, hsa; identical to SEQ ID NO: 280758

SEQ ID NO: 314580 - RNA, 64 nt, hsa; identical to SEQ ID NO: 280759

SEQ ID NO: 314581 - RNA, 64 nt, hsa; identical to SEQ ID NO: 280760

SEQ ID NO: 314582 - RNA, 64 nt, hsa; identical to SEQ ID NO: 280761

SEQ ID NO: 314583 - RNA, 64 nt, hsa; identical to SEQ ID NO: 280762

SEQ ID NO: 314584 - RNA, 64 nt, hsa; identical to SEQ ID NO: 280763

SEQ ID NO: 314585 - RNA, 64 nt, hsa; identical to SEQ ID NO: 280764

SEQ ID NO: 314586 - RNA, 64 nt, hsa; identical to SEQ ID NO: 280765

SEQ ID NO: 314587 - RNA, 64 nt, hsa; identical to SEQ ID NO: 280766

SEQ ID NO: 314588 - RNA, 64 nt, hsa; identical to SEQ ID NO: 280767

SEQ ID NO: 314589 - RNA, 64 nt, hsa; identical to SEQ ID NO: 280768

SEQ ID NO: 314590 - RNA, 64 nt, hsa; identical to SEQ ID NO: 280769

SEQ ID NO: 314591 - RNA, 64 nt, hsa; identical to SEQ ID NO: 280770

SEQ ID NO: 314592 - RNA, 64 nt, hsa; identical to SEQ ID NO: 280771

SEQ ID NO: 314593 - RNA, 64 nt, hsa; identical to SEQ ID NO: 280772

SEQ ID NO: 314594 - RNA, 64 nt, hsa; identical to SEQ ID NO: 280773

SEQ ID NO: 314595 - RNA, 64 nt, hsa; identical to SEQ ID NO: 280774

SEQ ID NO: 314596 - RNA, 64 nt, hsa; identical to SEQ ID NO: 280775

SEQ ID NO: 314597 - RNA, 64 nt, hsa; identical to SEQ ID NO: 280776

SEQ ID NO: 314598 - RNA, 64 nt, hsa; identical to SEQ ID NO: 280777

SEQ ID NO: 314599 - RNA, 64 nt, hsa; identical to SEQ ID NO: 280778

SEQ ID NO: 314600 - RNA, 64 nt, hsa; identical to SEQ ID NO: 280779

SEQ ID NO: 314601 - RNA, 64 nt, hsa; identical to SEQ ID NO: 280780

SEQ ID NO: 314602 - RNA, 64 nt, hsa; identical to SEQ ID NO: 280781

SEQ ID NO: 314603 - RNA, 64 nt, hsa; identical to SEQ ID NO: 280782

SEQ ID NO: 314604 - RNA, 64 nt, hsa; identical to SEQ ID NO: 280783

SEQ ID NO: 314605 - RNA, 64 nt, hsa; identical to SEQ ID NO: 280784

SEQ ID NO: 314606 - RNA, 64 nt, hsa; identical to SEQ ID NO: 280785

SEQ ID NO: 314607 - RNA, 64 nt, hsa; identical to SEQ ID NO: 280786

SEQ ID NO: 314608 - RNA, 64 nt, hsa; identical to SEQ ID NO: 280787

SEQ ID NO: 314609 - RNA, 64 nt, hsa; identical to SEQ ID NO: 280788

SEQ ID NO: 314610 - RNA, 64 nt, hsa; identical to SEQ ID NO: 280789

SEQ ID NO: 314611 - RNA, 64 nt, hsa; identical to SEQ ID NO: 280790

SEQ ID NO: 314612 - RNA, 64 nt, hsa; identical to SEQ ID NO: 280791

SEQ ID NO: 314613 - RNA, 64 nt, hsa; identical to SEQ ID NO: 280792

SEQ ID NO: 314614 - RNA, 64 nt, hsa; identical to SEQ ID NO: 280793

SEQ ID NO: 314615 - RNA, 64 nt, hsa; identical to SEQ ID NO: 280794

SEQ ID NO: 314616 - RNA, 64 nt, hsa; identical to SEQ ID NO: 280795

SEQ ID NO: 314617 - RNA, 64 nt, hsa; identical to SEQ ID NO: 280796

SEQ ID NO: 314618 - RNA, 64 nt, hsa; identical to SEQ ID NO: 280797

SEQ ID NO: 314619 - RNA, 64 nt, hsa; identical to SEQ ID NO: 280798

SEQ ID NO: 314620 - RNA, 64 nt, hsa; identical to SEQ ID NO: 280799

SEQ ID NO: 314621 - RNA, 64 nt, hsa; identical to SEQ ID NO: 280800

SEQ ID NO: 314622 - RNA, 64 nt, hsa; identical to SEQ ID NO: 280801

SEQ ID NO: 314623 - RNA, 64 nt, hsa; identical to SEQ ID NO: 280802

SEQ ID NO: 314624 - RNA, 64 nt, hsa; identical to SEQ ID NO: 280803

SEQ ID NO: 314625 - RNA, 64 nt, hsa; identical to SEQ ID NO: 280804

SEQ ID NO: 314626 - RNA, 64 nt, hsa; identical to SEQ ID NO: 280805

SEQ ID NO: 314627 - RNA, 64 nt, hsa; identical to SEQ ID NO: 280806

SEQ ID NO: 314628 - RNA, 64 nt, hsa; identical to SEQ ID NO: 280807

SEQ ID NO: 314629 - RNA, 64 nt, hsa; identical to SEQ ID NO: 280808

SEQ ID NO: 314630 - RNA, 64 nt, hsa; identical to SEQ ID NO: 280809

SEQ ID NO: 314631 - RNA, 64 nt, hsa; identical to SEQ ID NO: 280810

SEQ ID NO: 314632 - RNA, 64 nt, hsa; identical to SEQ ID NO: 280811

SEQ ID NO: 314633 - RNA, 64 nt, hsa; identical to SEQ ID NO: 280812

SEQ ID NO: 314634 - RNA, 64 nt, hsa; identical to SEQ ID NO: 280813

SEQ ID NO: 314635 - RNA, 64 nt, hsa; identical to SEQ ID NO: 280814

SEQ ID NO: 314636 - RNA, 64 nt, hsa; identical to SEQ ID NO: 280815

SEQ ID NO: 314637 - RNA, 64 nt, hsa; identical to SEQ ID NO: 280816

SEQ ID NO: 314638 - RNA, 64 nt, hsa; identical to SEQ ID NO: 280817

SEQ ID NO: 314639 - RNA, 64 nt, hsa; identical to SEQ ID NO: 280818

SEQ ID NO: 314640 - RNA, 64 nt, hsa; identical to SEQ ID NO: 280819

SEQ ID NO: 314641 - RNA, 64 nt, hsa; identical to SEQ ID NO: 280820

SEQ ID NO: 314642 - RNA, 64 nt, hsa; identical to SEQ ID NO: 280821

SEQ ID NO: 314643 - RNA, 64 nt, hsa; identical to SEQ ID NO: 280822

SEQ ID NO: 314644 - RNA, 64 nt, hsa; identical to SEQ ID NO: 280823

SEQ ID NO: 314645 - RNA, 64 nt, hsa; identical to SEQ ID NO: 280824

SEQ ID NO: 314646 - RNA, 64 nt, hsa; identical to SEQ ID NO: 280825

SEQ ID NO: 314647 - RNA, 64 nt, hsa; identical to SEQ ID NO: 280826

SEQ ID NO: 314648 - RNA, 64 nt, hsa; identical to SEQ ID NO: 280827

SEQ ID NO: 314649 - RNA, 64 nt, hsa; identical to SEQ ID NO: 280828

SEQ ID NO: 314650 - RNA, 64 nt, hsa; identical to SEQ ID NO: 280829

SEQ ID NO: 314651 - RNA, 64 nt, hsa; identical to SEQ ID NO: 280830

SEQ ID NO: 314652 - RNA, 64 nt, hsa; identical to SEQ ID NO: 280831

SEQ ID NO: 314653 - RNA, 64 nt, hsa; identical to SEQ ID NO: 280832

SEQ ID NO: 314654 - RNA, 64 nt, hsa; identical to SEQ ID NO: 280833

SEQ ID NO: 314655 - RNA, 64 nt, hsa; identical to SEQ ID NO: 280834

SEQ ID NO: 314656 - RNA, 64 nt, hsa; identical to SEQ ID NO: 280835

SEQ ID NO: 314657 - RNA, 64 nt, hsa; identical to SEQ ID NO: 280836

SEQ ID NO: 314658 - RNA, 64 nt, hsa; identical to SEQ ID NO: 280837

SEQ ID NO: 314659 - RNA, 64 nt, hsa; identical to SEQ ID NO: 280838

SEQ ID NO: 314660 - RNA, 64 nt, hsa; identical to SEQ ID NO: 280839

SEQ ID NO: 314661 - RNA, 64 nt, hsa; identical to SEQ ID NO: 280840

SEQ ID NO: 314662 - RNA, 64 nt, hsa; identical to SEQ ID NO: 280841

SEQ ID NO: 314663 - RNA, 58 nt, hsa; identical to SEQ ID NO: 280842

SEQ ID NO: 314664 - RNA, 53 nt, hsa; identical to SEQ ID NO: 280843

SEQ ID NO: 314665 - RNA, 64 nt, hsa; identical to SEQ ID NO: 280820

SEQ ID NO: 314666 - RNA, 64 nt, hsa; identical to SEQ ID NO: 280819

SEQ ID NO: 314667 - RNA, 64 nt, hsa; identical to SEQ ID NO: 280846

SEQ ID NO: 314668 - RNA, 64 nt, hsa; identical to SEQ ID NO: 280847

SEQ ID NO: 314669 - RNA, 64 nt, hsa; identical to SEQ ID NO: 280848

SEQ ID NO: 314670 - RNA, 64 nt, hsa; identical to SEQ ID NO: 280849

SEQ ID NO: 314671 - RNA, 64 nt, hsa; identical to SEQ ID NO: 280850

SEQ ID NO: 314672 - RNA, 64 nt, hsa; identical to SEQ ID NO: 280851

SEQ ID NO: 314673 - RNA, 64 nt, hsa; identical to SEQ ID NO: 280852

SEQ ID NO: 314674 - RNA, 64 nt, hsa; identical to SEQ ID NO: 280853

SEQ ID NO: 314675 - RNA, 64 nt, hsa; identical to SEQ ID NO: 280854

SEQ ID NO: 314676 - RNA, 64 nt, hsa; identical to SEQ ID NO: 280855

SEQ ID NO: 314677 - RNA, 64 nt, hsa; identical to SEQ ID NO: 280856

SEQ ID NO: 314678 - RNA, 64 nt, hsa; identical to SEQ ID NO: 280857

SEQ ID NO: 314679 - RNA, 64 nt, hsa; identical to SEQ ID NO: 280858

SEQ ID NO: 314680 - RNA, 64 nt, hsa; identical to SEQ ID NO: 280859

SEQ ID NO: 314681 - RNA, 64 nt, hsa; identical to SEQ ID NO: 280860

SEQ ID NO: 314682 - RNA, 64 nt, hsa; identical to SEQ ID NO: 280861

SEQ ID NO: 314683 - RNA, 64 nt, hsa; identical to SEQ ID NO: 280862

SEQ ID NO: 314684 - RNA, 64 nt, hsa; identical to SEQ ID NO: 280863

SEQ ID NO: 314685 - RNA, 64 nt, hsa; identical to SEQ ID NO: 280864

SEQ ID NO: 314686 - RNA, 64 nt, hsa; identical to SEQ ID NO: 280865

SEQ ID NO: 314687 - RNA, 64 nt, hsa; identical to SEQ ID NO: 280866

SEQ ID NO: 314688 - RNA, 64 nt, hsa; identical to SEQ ID NO: 280867

SEQ ID NO: 314689 - RNA, 64 nt, hsa; identical to SEQ ID NO: 280868

SEQ ID NO: 314690 - RNA, 64 nt, hsa; identical to SEQ ID NO: 280869

SEQ ID NO: 314691 - RNA, 64 nt, hsa; identical to SEQ ID NO: 280870

SEQ ID NO: 314692 - RNA, 64 nt, hsa; identical to SEQ ID NO: 280871

SEQ ID NO: 314693 - RNA, 64 nt, hsa; identical to SEQ ID NO: 280872

SEQ ID NO: 314694 - RNA, 64 nt, hsa; identical to SEQ ID NO: 280873

SEQ ID NO: 314695 - RNA, 64 nt, hsa; identical to SEQ ID NO: 280874

SEQ ID NO: 314696 - RNA, 64 nt, hsa; identical to SEQ ID NO: 280875

SEQ ID NO: 314697 - RNA, 64 nt, hsa; identical to SEQ ID NO: 280876

SEQ ID NO: 314698 - RNA, 64 nt, hsa; identical to SEQ ID NO: 280877

SEQ ID NO: 314699 - RNA, 64 nt, hsa; identical to SEQ ID NO: 280878

SEQ ID NO: 314700 - RNA, 64 nt, hsa; identical to SEQ ID NO: 280879

SEQ ID NO: 314701 - RNA, 60 nt, hsa; identical to SEQ ID NO: 280880

SEQ ID NO: 314702 - RNA, 64 nt, hsa; identical to SEQ ID NO: 280881

SEQ ID NO: 314703 - RNA, 64 nt, hsa; identical to SEQ ID NO: 280882

SEQ ID NO: 314704 - RNA, 64 nt, hsa; identical to SEQ ID NO: 280883

SEQ ID NO: 314705 - RNA, 64 nt, hsa; identical to SEQ ID NO: 280884

SEQ ID NO: 314706 - RNA, 64 nt, hsa; identical to SEQ ID NO: 280885

SEQ ID NO: 314707 - RNA, 64 nt, hsa; identical to SEQ ID NO: 280886

SEQ ID NO: 314708 - RNA, 64 nt, hsa; identical to SEQ ID NO: 280887

SEQ ID NO: 314709 - RNA, 64 nt, hsa; identical to SEQ ID NO: 280888

SEQ ID NO: 314710 - RNA, 64 nt, hsa; identical to SEQ ID NO: 280889

SEQ ID NO: 314711 - RNA, 64 nt, hsa; identical to SEQ ID NO: 280890

SEQ ID NO: 314712 - RNA, 64 nt, hsa; identical to SEQ ID NO: 280891

SEQ ID NO: 314713 - RNA, 64 nt, hsa; identical to SEQ ID NO: 280892

SEQ ID NO: 314714 - RNA, 64 nt, hsa; identical to SEQ ID NO: 280893

SEQ ID NO: 314715 - RNA, 64 nt, hsa; identical to SEQ ID NO: 280894

SEQ ID NO: 314716 - RNA, 64 nt, hsa; identical to SEQ ID NO: 280895

SEQ ID NO: 314717 - RNA, 64 nt, hsa; identical to SEQ ID NO: 280896

SEQ ID NO: 314718 - RNA, 64 nt, hsa; identical to SEQ ID NO: 280897

SEQ ID NO: 314719 - RNA, 64 nt, hsa; identical to SEQ ID NO: 280898

SEQ ID NO: 314720 - RNA, 64 nt, hsa; identical to SEQ ID NO: 280899

SEQ ID NO: 314721 - RNA, 64 nt, hsa; identical to SEQ ID NO: 280900

SEQ ID NO: 314722 - RNA, 64 nt, hsa; identical to SEQ ID NO: 280901

SEQ ID NO: 314723 - RNA, 64 nt, hsa; identical to SEQ ID NO: 280902

SEQ ID NO: 314724 - RNA, 64 nt, hsa; identical to SEQ ID NO: 280903

SEQ ID NO: 314725 - RNA, 64 nt, hsa; identical to SEQ ID NO: 280904

SEQ ID NO: 314726 - RNA, 64 nt, hsa; identical to SEQ ID NO: 280905

SEQ ID NO: 314727 - RNA, 64 nt, hsa; identical to SEQ ID NO: 280906

SEQ ID NO: 314728 - RNA, 64 nt, hsa; identical to SEQ ID NO: 280907

SEQ ID NO: 314729 - RNA, 64 nt, hsa; identical to SEQ ID NO: 280908

SEQ ID NO: 314730 - RNA, 64 nt, hsa; identical to SEQ ID NO: 280909

SEQ ID NO: 314731 - RNA, 64 nt, hsa; identical to SEQ ID NO: 280910

SEQ ID NO: 314732 - RNA, 64 nt, hsa; identical to SEQ ID NO: 280911

SEQ ID NO: 314733 - RNA, 64 nt, hsa; identical to SEQ ID NO: 280912

SEQ ID NO: 314734 - RNA, 64 nt, hsa; identical to SEQ ID NO: 280913

SEQ ID NO: 314735 - RNA, 64 nt, hsa; identical to SEQ ID NO: 280914

SEQ ID NO: 314736 - RNA, 64 nt, hsa; identical to SEQ ID NO: 280915

SEQ ID NO: 314737 - RNA, 64 nt, hsa; identical to SEQ ID NO: 280916

SEQ ID NO: 314738 - RNA, 64 nt, hsa; identical to SEQ ID NO: 280917

SEQ ID NO: 314739 - RNA, 64 nt, hsa; identical to SEQ ID NO: 280918

SEQ ID NO: 314740 - RNA, 64 nt, hsa; identical to SEQ ID NO: 280919

SEQ ID NO: 314741 - RNA, 64 nt, hsa; identical to SEQ ID NO: 280920

SEQ ID NO: 314742 - RNA, 64 nt, hsa; identical to SEQ ID NO: 280921

SEQ ID NO: 314743 - RNA, 64 nt, hsa; identical to SEQ ID NO: 280922

SEQ ID NO: 314744 - RNA, 64 nt, hsa; identical to SEQ ID NO: 280923

SEQ ID NO: 314745 - RNA, 64 nt, hsa; identical to SEQ ID NO: 280924

SEQ ID NO: 314746 - RNA, 64 nt, hsa; identical to SEQ ID NO: 280925

SEQ ID NO: 314747 - RNA, 64 nt, hsa; identical to SEQ ID NO: 280926

SEQ ID NO: 314748 - RNA, 64 nt, hsa; identical to SEQ ID NO: 280927

SEQ ID NO: 314749 - RNA, 64 nt, hsa; identical to SEQ ID NO: 280928

SEQ ID NO: 314750 - RNA, 64 nt, hsa; identical to SEQ ID NO: 280929

SEQ ID NO: 314751 - RNA, 64 nt, hsa; identical to SEQ ID NO: 280930

SEQ ID NO: 314752 - RNA, 64 nt, hsa; identical to SEQ ID NO: 280931

SEQ ID NO: 314753 - RNA, 64 nt, hsa; identical to SEQ ID NO: 280932

SEQ ID NO: 314754 - RNA, 64 nt, hsa; identical to SEQ ID NO: 280933

SEQ ID NO: 314755 - RNA, 64 nt, hsa; identical to SEQ ID NO: 280934

SEQ ID NO: 314756 - RNA, 64 nt, hsa; identical to SEQ ID NO: 280935

SEQ ID NO: 314757 - RNA, 64 nt, hsa; identical to SEQ ID NO: 280936

SEQ ID NO: 314758 - RNA, 64 nt, hsa; identical to SEQ ID NO: 280937

SEQ ID NO: 314759 - RNA, 64 nt, hsa; identical to SEQ ID NO: 280938

SEQ ID NO: 314760 - RNA, 64 nt, hsa; identical to SEQ ID NO: 280939

SEQ ID NO: 314761 - RNA, 64 nt, hsa; identical to SEQ ID NO: 280940

SEQ ID NO: 314762 - RNA, 64 nt, hsa; identical to SEQ ID NO: 280941

SEQ ID NO: 314763 - RNA, 64 nt, hsa; identical to SEQ ID NO: 280942

SEQ ID NO: 314764 - RNA, 64 nt, hsa; identical to SEQ ID NO: 280943

SEQ ID NO: 314765 - RNA, 64 nt, hsa; identical to SEQ ID NO: 280944

SEQ ID NO: 314766 - RNA, 64 nt, hsa; identical to SEQ ID NO: 280945

SEQ ID NO: 314767 - RNA, 64 nt, hsa; identical to SEQ ID NO: 280946

SEQ ID NO: 314768 - RNA, 64 nt, hsa; identical to SEQ ID NO: 280947

SEQ ID NO: 314769 - RNA, 64 nt, hsa; identical to SEQ ID NO: 280948

SEQ ID NO: 314770 - RNA, 64 nt, hsa; identical to SEQ ID NO: 280949

SEQ ID NO: 314771 - RNA, 64 nt, hsa; identical to SEQ ID NO: 280950

SEQ ID NO: 314772 - RNA, 64 nt, hsa; identical to SEQ ID NO: 280951

SEQ ID NO: 314773 - RNA, 64 nt, hsa; identical to SEQ ID NO: 280952

SEQ ID NO: 314774 - RNA, 64 nt, hsa; identical to SEQ ID NO: 280953

SEQ ID NO: 314775 - RNA, 64 nt, hsa; identical to SEQ ID NO: 280954

SEQ ID NO: 314776 - RNA, 64 nt, hsa; identical to SEQ ID NO: 280955

SEQ ID NO: 314777 - RNA, 64 nt, hsa; identical to SEQ ID NO: 280956

SEQ ID NO: 314778 - RNA, 64 nt, hsa; identical to SEQ ID NO: 280957

SEQ ID NO: 314779 - RNA, 64 nt, hsa; identical to SEQ ID NO: 280958

SEQ ID NO: 314780 - RNA, 64 nt, hsa; identical to SEQ ID NO: 280959

SEQ ID NO: 314781 - RNA, 64 nt, hsa; identical to SEQ ID NO: 280960

SEQ ID NO: 314782 - RNA, 64 nt, hsa; identical to SEQ ID NO: 280961

SEQ ID NO: 314783 - RNA, 64 nt, hsa; identical to SEQ ID NO: 280962

SEQ ID NO: 314784 - RNA, 64 nt, hsa; identical to SEQ ID NO: 280963

SEQ ID NO: 314785 - RNA, 64 nt, hsa; identical to SEQ ID NO: 280964

SEQ ID NO: 314786 - RNA, 64 nt, hsa; identical to SEQ ID NO: 280965

SEQ ID NO: 314787 - RNA, 64 nt, hsa; identical to SEQ ID NO: 280966

SEQ ID NO: 314788 - RNA, 64 nt, hsa; identical to SEQ ID NO: 280967

SEQ ID NO: 314789 - RNA, 64 nt, hsa; identical to SEQ ID NO: 280968

SEQ ID NO: 314790 - RNA, 64 nt, hsa; identical to SEQ ID NO: 280969

SEQ ID NO: 314791 - RNA, 64 nt, hsa; identical to SEQ ID NO: 280970

SEQ ID NO: 314792 - RNA, 64 nt, hsa; identical to SEQ ID NO: 280971

SEQ ID NO: 314793 - RNA, 64 nt, hsa; identical to SEQ ID NO: 280972

SEQ ID NO: 314794 - RNA, 64 nt, hsa; identical to SEQ ID NO: 280973

SEQ ID NO: 314795 - RNA, 64 nt, hsa; identical to SEQ ID NO: 280974

SEQ ID NO: 314796 - RNA, 64 nt, hsa; identical to SEQ ID NO: 280975

SEQ ID NO: 314797 - RNA, 64 nt, hsa; identical to SEQ ID NO: 280976

SEQ ID NO: 314798 - RNA, 64 nt, hsa; identical to SEQ ID NO: 280977

SEQ ID NO: 314799 - RNA, 64 nt, hsa; identical to SEQ ID NO: 280978

SEQ ID NO: 314800 - RNA, 64 nt, hsa; identical to SEQ ID NO: 280979

SEQ ID NO: 314801 - RNA, 64 nt, hsa; identical to SEQ ID NO: 280980

SEQ ID NO: 314802 - RNA, 64 nt, hsa; identical to SEQ ID NO: 280981

SEQ ID NO: 314803 - RNA, 64 nt, hsa; identical to SEQ ID NO: 280982

SEQ ID NO: 314804 - RNA, 64 nt, hsa; identical to SEQ ID NO: 280983

SEQ ID NO: 314805 - RNA, 64 nt, hsa; identical to SEQ ID NO: 280984

SEQ ID NO: 314806 - RNA, 64 nt, hsa; identical to SEQ ID NO: 280985

SEQ ID NO: 314807 - RNA, 64 nt, hsa; identical to SEQ ID NO: 280986

SEQ ID NO: 314808 - RNA, 64 nt, hsa; identical to SEQ ID NO: 280987

SEQ ID NO: 314809 - RNA, 64 nt, hsa; identical to SEQ ID NO: 280988

SEQ ID NO: 314810 - RNA, 64 nt, hsa; identical to SEQ ID NO: 280989

SEQ ID NO: 314811 - RNA, 64 nt, hsa; identical to SEQ ID NO: 280990

SEQ ID NO: 314812 - RNA, 64 nt, hsa; identical to SEQ ID NO: 280991

SEQ ID NO: 314813 - RNA, 64 nt, hsa; identical to SEQ ID NO: 280992

SEQ ID NO: 314814 - RNA, 64 nt, hsa; identical to SEQ ID NO: 280993

SEQ ID NO: 314815 - RNA, 64 nt, hsa; identical to SEQ ID NO: 280994

SEQ ID NO: 314816 - RNA, 64 nt, hsa; identical to SEQ ID NO: 280995

SEQ ID NO: 314817 - RNA, 64 nt, hsa; identical to SEQ ID NO: 280996

SEQ ID NO: 314818 - RNA, 64 nt, hsa; identical to SEQ ID NO: 280997

SEQ ID NO: 314819 - RNA, 64 nt, hsa; identical to SEQ ID NO: 280998

SEQ ID NO: 314820 - RNA, 64 nt, hsa; identical to SEQ ID NO: 280999

SEQ ID NO: 314821 - RNA, 64 nt, hsa; identical to SEQ ID NO: 281000

SEQ ID NO: 314822 - RNA, 64 nt, hsa; identical to SEQ ID NO: 281001

SEQ ID NO: 314823 - RNA, 64 nt, hsa; identical to SEQ ID NO: 281002

SEQ ID NO: 314824 - RNA, 64 nt, hsa; identical to SEQ ID NO: 281003

SEQ ID NO: 314825 - RNA, 64 nt, hsa; identical to SEQ ID NO: 281004

SEQ ID NO: 314826 - RNA, 64 nt, hsa; identical to SEQ ID NO: 281005

SEQ ID NO: 314827 - RNA, 64 nt, hsa; identical to SEQ ID NO: 281006

SEQ ID NO: 314828 - RNA, 64 nt, hsa; identical to SEQ ID NO: 281007

SEQ ID NO: 314829 - RNA, 64 nt, hsa; identical to SEQ ID NO: 281008

SEQ ID NO: 314830 - RNA, 64 nt, hsa; identical to SEQ ID NO: 281009

SEQ ID NO: 314831 - RNA, 64 nt, hsa; identical to SEQ ID NO: 281010

SEQ ID NO: 314832 - RNA, 64 nt, hsa; identical to SEQ ID NO: 281011

SEQ ID NO: 314833 - RNA, 64 nt, hsa; identical to SEQ ID NO: 281012

SEQ ID NO: 314834 - RNA, 64 nt, hsa; identical to SEQ ID NO: 281013

SEQ ID NO: 314835 - RNA, 64 nt, hsa; identical to SEQ ID NO: 281014

SEQ ID NO: 314836 - RNA, 64 nt, hsa; identical to SEQ ID NO: 281015

SEQ ID NO: 314837 - RNA, 64 nt, hsa; identical to SEQ ID NO: 281016

SEQ ID NO: 314838 - RNA, 64 nt, hsa; identical to SEQ ID NO: 281017

SEQ ID NO: 314839 - RNA, 64 nt, hsa; identical to SEQ ID NO: 281018

SEQ ID NO: 314840 - RNA, 64 nt, hsa; identical to SEQ ID NO: 281019

SEQ ID NO: 314841 - RNA, 64 nt, hsa; identical to SEQ ID NO: 281020

SEQ ID NO: 314842 - RNA, 64 nt, hsa; identical to SEQ ID NO: 281021

SEQ ID NO: 314843 - RNA, 64 nt, hsa; identical to SEQ ID NO: 281022

SEQ ID NO: 314844 - RNA, 64 nt, hsa; identical to SEQ ID NO: 281023

SEQ ID NO: 314845 - RNA, 64 nt, hsa; identical to SEQ ID NO: 281024

SEQ ID NO: 314846 - RNA, 64 nt, hsa; identical to SEQ ID NO: 281025

SEQ ID NO: 314847 - RNA, 64 nt, hsa; identical to SEQ ID NO: 281026

SEQ ID NO: 314848 - RNA, 64 nt, hsa; identical to SEQ ID NO: 281027

SEQ ID NO: 314849 - RNA, 64 nt, hsa; identical to SEQ ID NO: 281028

SEQ ID NO: 314850 - RNA, 64 nt, hsa; identical to SEQ ID NO: 281029

SEQ ID NO: 314851 - RNA, 64 nt, hsa; identical to SEQ ID NO: 281030

SEQ ID NO: 314852 - RNA, 64 nt, hsa; identical to SEQ ID NO: 281031

SEQ ID NO: 314853 - RNA, 64 nt, hsa; identical to SEQ ID NO: 281032

SEQ ID NO: 314854 - RNA, 64 nt, hsa; identical to SEQ ID NO: 281033

SEQ ID NO: 314855 - RNA, 64 nt, hsa; identical to SEQ ID NO: 281034

SEQ ID NO: 314856 - RNA, 64 nt, hsa; identical to SEQ ID NO: 281035

SEQ ID NO: 314857 - RNA, 64 nt, hsa; identical to SEQ ID NO: 281036

SEQ ID NO: 314858 - RNA, 64 nt, hsa; identical to SEQ ID NO: 281037

SEQ ID NO: 314859 - RNA, 64 nt, hsa; identical to SEQ ID NO: 281038

SEQ ID NO: 314860 - RNA, 64 nt, hsa; identical to SEQ ID NO: 281039

SEQ ID NO: 314861 - RNA, 64 nt, hsa; identical to SEQ ID NO: 281040

SEQ ID NO: 314862 - RNA, 64 nt, hsa; identical to SEQ ID NO: 281041

SEQ ID NO: 314863 - RNA, 64 nt, hsa; identical to SEQ ID NO: 281042

SEQ ID NO: 314864 - RNA, 64 nt, hsa; identical to SEQ ID NO: 281043

SEQ ID NO: 314865 - RNA, 64 nt, hsa; identical to SEQ ID NO: 281044

SEQ ID NO: 314866 - RNA, 64 nt, hsa; identical to SEQ ID NO: 281045

SEQ ID NO: 314867 - RNA, 64 nt, hsa; identical to SEQ ID NO: 281046

SEQ ID NO: 314868 - RNA, 64 nt, hsa; identical to SEQ ID NO: 281047

SEQ ID NO: 314869 - RNA, 64 nt, hsa; identical to SEQ ID NO: 281048

SEQ ID NO: 314870 - RNA, 64 nt, hsa; identical to SEQ ID NO: 281049

SEQ ID NO: 314871 - RNA, 64 nt, hsa; identical to SEQ ID NO: 281050

SEQ ID NO: 314872 - RNA, 64 nt, hsa; identical to SEQ ID NO: 281051

SEQ ID NO: 314873 - RNA, 64 nt, hsa; identical to SEQ ID NO: 281052

SEQ ID NO: 314874 - RNA, 64 nt, hsa; identical to SEQ ID NO: 281053

SEQ ID NO: 314875 - RNA, 64 nt, hsa; identical to SEQ ID NO: 281054

SEQ ID NO: 314876 - RNA, 64 nt, hsa; identical to SEQ ID NO: 281055

SEQ ID NO: 314877 - RNA, 64 nt, hsa; identical to SEQ ID NO: 281056

SEQ ID NO: 314878 - RNA, 64 nt, hsa; identical to SEQ ID NO: 281057

SEQ ID NO: 314879 - RNA, 64 nt, hsa; identical to SEQ ID NO: 281058

SEQ ID NO: 314880 - RNA, 64 nt, hsa; identical to SEQ ID NO: 281059

SEQ ID NO: 314881 - RNA, 64 nt, hsa; identical to SEQ ID NO: 281060

SEQ ID NO: 314882 - RNA, 64 nt, hsa; identical to SEQ ID NO: 281061

SEQ ID NO: 314883 - RNA, 64 nt, hsa; identical to SEQ ID NO: 281062

SEQ ID NO: 314884 - RNA, 64 nt, hsa; identical to SEQ ID NO: 281063

SEQ ID NO: 314885 - RNA, 64 nt, hsa; identical to SEQ ID NO: 281064

SEQ ID NO: 314886 - RNA, 64 nt, hsa; identical to SEQ ID NO: 281065

SEQ ID NO: 314887 - RNA, 64 nt, hsa; identical to SEQ ID NO: 281066

SEQ ID NO: 314888 - RNA, 64 nt, hsa; identical to SEQ ID NO: 281067

SEQ ID NO: 314889 - RNA, 64 nt, hsa; identical to SEQ ID NO: 281068

SEQ ID NO: 314890 - RNA, 64 nt, hsa; identical to SEQ ID NO: 281069

SEQ ID NO: 314891 - RNA, 64 nt, hsa; identical to SEQ ID NO: 281070

SEQ ID NO: 314892 - RNA, 64 nt, hsa; identical to SEQ ID NO: 281071

SEQ ID NO: 314893 - RNA, 64 nt, hsa; identical to SEQ ID NO: 281072

SEQ ID NO: 314894 - RNA, 64 nt, hsa; identical to SEQ ID NO: 281073

SEQ ID NO: 314895 - RNA, 64 nt, hsa; identical to SEQ ID NO: 281074

SEQ ID NO: 314896 - RNA, 64 nt, hsa; identical to SEQ ID NO: 281075

SEQ ID NO: 314897 - RNA, 64 nt, hsa; identical to SEQ ID NO: 281076

SEQ ID NO: 314898 - RNA, 64 nt, hsa; identical to SEQ ID NO: 281077

SEQ ID NO: 314899 - RNA, 64 nt, hsa; identical to SEQ ID NO: 281078

SEQ ID NO: 314900 - RNA, 64 nt, hsa; identical to SEQ ID NO: 281079

SEQ ID NO: 314901 - RNA, 64 nt, hsa; identical to SEQ ID NO: 281080

SEQ ID NO: 314902 - RNA, 64 nt, hsa; identical to SEQ ID NO: 281081

SEQ ID NO: 314903 - RNA, 64 nt, hsa; identical to SEQ ID NO: 281082

SEQ ID NO: 314904 - RNA, 64 nt, hsa; identical to SEQ ID NO: 281083

SEQ ID NO: 314905 - RNA, 64 nt, hsa; identical to SEQ ID NO: 281084

SEQ ID NO: 314906 - RNA, 64 nt, hsa; identical to SEQ ID NO: 281085

SEQ ID NO: 314907 - RNA, 64 nt, hsa; identical to SEQ ID NO: 281086

SEQ ID NO: 314908 - RNA, 64 nt, hsa; identical to SEQ ID NO: 281087

SEQ ID NO: 314909 - RNA, 64 nt, hsa; identical to SEQ ID NO: 281088

SEQ ID NO: 314910 - RNA, 64 nt, hsa; identical to SEQ ID NO: 281089

SEQ ID NO: 314911 - RNA, 64 nt, hsa; identical to SEQ ID NO: 281090

SEQ ID NO: 314912 - RNA, 64 nt, hsa; identical to SEQ ID NO: 281091

SEQ ID NO: 314913 - RNA, 64 nt, hsa; identical to SEQ ID NO: 281092

SEQ ID NO: 314914 - RNA, 64 nt, hsa; identical to SEQ ID NO: 281093

SEQ ID NO: 314915 - RNA, 64 nt, hsa; identical to SEQ ID NO: 281094

SEQ ID NO: 314916 - RNA, 64 nt, hsa; identical to SEQ ID NO: 281095

SEQ ID NO: 314917 - RNA, 64 nt, hsa; identical to SEQ ID NO: 281096

SEQ ID NO: 314918 - RNA, 64 nt, hsa; identical to SEQ ID NO: 281097

SEQ ID NO: 314919 - RNA, 64 nt, hsa; identical to SEQ ID NO: 281098

SEQ ID NO: 314920 - RNA, 64 nt, hsa; identical to SEQ ID NO: 281099

SEQ ID NO: 314921 - RNA, 64 nt, hsa; identical to SEQ ID NO: 281100

SEQ ID NO: 314922 - RNA, 64 nt, hsa; identical to SEQ ID NO: 281101

SEQ ID NO: 314923 - RNA, 64 nt, hsa; identical to SEQ ID NO: 281102

SEQ ID NO: 314924 - RNA, 64 nt, hsa; identical to SEQ ID NO: 281103

SEQ ID NO: 314925 - RNA, 64 nt, hsa; identical to SEQ ID NO: 46940

SEQ ID NO: 314926 - RNA, 64 nt, hsa; identical to SEQ ID NO: 46941

SEQ ID NO: 314927 - RNA, 64 nt, hsa; identical to SEQ ID NO: 46942

SEQ ID NO: 314928 - RNA, 64 nt, hsa; identical to SEQ ID NO: 46943

SEQ ID NO: 314929 - RNA, 64 nt, hsa; identical to SEQ ID NO: 46944

SEQ ID NO: 314930 - RNA, 64 nt, hsa; identical to SEQ ID NO: 46945

SEQ ID NO: 314931 - RNA, 64 nt, hsa; identical to SEQ ID NO: 46946

SEQ ID NO: 314932 - RNA, 64 nt, hsa; identical to SEQ ID NO: 46947

SEQ ID NO: 314933 - RNA, 64 nt, hsa; identical to SEQ ID NO: 46948

SEQ ID NO: 314934 - RNA, 64 nt, hsa; identical to SEQ ID NO: 46949

SEQ ID NO: 314935 - RNA, 64 nt, hsa; identical to SEQ ID NO: 46950

SEQ ID NO: 314936 - RNA, 64 nt, hsa; identical to SEQ ID NO: 46951

SEQ ID NO: 314937 - RNA, 64 nt, hsa; identical to SEQ ID NO: 46952

SEQ ID NO: 314938 - RNA, 64 nt, hsa; identical to SEQ ID NO: 46953

SEQ ID NO: 314939 - RNA, 64 nt, hsa; identical to SEQ ID NO: 46954

SEQ ID NO: 314940 - RNA, 64 nt, hsa; identical to SEQ ID NO: 46955

SEQ ID NO: 314941 - RNA, 64 nt, hsa; identical to SEQ ID NO: 46956

SEQ ID NO: 314942 - RNA, 64 nt, hsa; identical to SEQ ID NO: 46957

SEQ ID NO: 314943 - RNA, 64 nt, hsa; identical to SEQ ID NO: 46958

SEQ ID NO: 314944 - RNA, 60 nt, hsa; identical to SEQ ID NO: 46959

SEQ ID NO: 314945 - RNA, 64 nt, hsa; identical to SEQ ID NO: 46960

SEQ ID NO: 314946 - RNA, 64 nt, hsa; identical to SEQ ID NO: 46961

SEQ ID NO: 314947 - RNA, 64 nt, hsa; identical to SEQ ID NO: 46962

SEQ ID NO: 314948 - RNA, 64 nt, hsa; identical to SEQ ID NO: 46963

SEQ ID NO: 314949 - RNA, 64 nt, hsa; identical to SEQ ID NO: 46964

SEQ ID NO: 314950 - RNA, 64 nt, hsa; identical to SEQ ID NO: 46965

SEQ ID NO: 314951 - RNA, 64 nt, hsa; identical to SEQ ID NO: 46966

SEQ ID NO: 314952 - RNA, 64 nt, hsa; identical to SEQ ID NO: 46967

SEQ ID NO: 314953 - RNA, 64 nt, hsa; identical to SEQ ID NO: 46968

SEQ ID NO: 314954 - RNA, 64 nt, hsa; identical to SEQ ID NO: 46969

SEQ ID NO: 314955 - RNA, 64 nt, hsa; identical to SEQ ID NO: 46970

SEQ ID NO: 314956 - RNA, 64 nt, hsa; identical to SEQ ID NO: 46971

SEQ ID NO: 314957 - RNA, 64 nt, hsa; identical to SEQ ID NO: 46972

SEQ ID NO: 314958 - RNA, 64 nt, hsa; identical to SEQ ID NO: 46973

SEQ ID NO: 314959 - RNA, 64 nt, hsa; identical to SEQ ID NO: 46974

SEQ ID NO: 314960 - RNA, 64 nt, hsa; identical to SEQ ID NO: 46975

SEQ ID NO: 314961 - RNA, 64 nt, hsa; identical to SEQ ID NO: 46976

SEQ ID NO: 314962 - RNA, 64 nt, hsa; identical to SEQ ID NO: 46977

SEQ ID NO: 314963 - RNA, 64 nt, hsa; identical to SEQ ID NO: 46978

SEQ ID NO: 314964 - RNA, 64 nt, hsa; identical to SEQ ID NO: 46979

SEQ ID NO: 314965 - RNA, 64 nt, hsa; identical to SEQ ID NO: 46980

SEQ ID NO: 314966 - RNA, 64 nt, hsa; identical to SEQ ID NO: 46981

SEQ ID NO: 314967 - RNA, 64 nt, hsa; identical to SEQ ID NO: 46982

SEQ ID NO: 314968 - RNA, 64 nt, hsa; identical to SEQ ID NO: 46983

SEQ ID NO: 314969 - RNA, 64 nt, hsa; identical to SEQ ID NO: 46984

SEQ ID NO: 314970 - RNA, 64 nt, hsa; identical to SEQ ID NO: 46985

SEQ ID NO: 314971 - RNA, 64 nt, hsa; identical to SEQ ID NO: 46986

SEQ ID NO: 314972 - RNA, 64 nt, hsa; identical to SEQ ID NO: 46987

SEQ ID NO: 314973 - RNA, 64 nt, hsa; identical to SEQ ID NO: 46988

SEQ ID NO: 314974 - RNA, 64 nt, hsa; identical to SEQ ID NO: 46989

SEQ ID NO: 314975 - RNA, 64 nt, hsa; identical to SEQ ID NO: 46990

SEQ ID NO: 314976 - RNA, 64 nt, hsa; identical to SEQ ID NO: 46991

SEQ ID NO: 314977 - RNA, 64 nt, hsa; identical to SEQ ID NO: 46992

SEQ ID NO: 314978 - RNA, 64 nt, hsa; identical to SEQ ID NO: 46993

SEQ ID NO: 314979 - RNA, 64 nt, hsa; identical to SEQ ID NO: 46994

SEQ ID NO: 314980 - RNA, 64 nt, hsa; identical to SEQ ID NO: 46995

SEQ ID NO: 314981 - RNA, 64 nt, hsa; identical to SEQ ID NO: 46996

SEQ ID NO: 314982 - RNA, 64 nt, hsa; identical to SEQ ID NO: 46997

SEQ ID NO: 314983 - RNA, 64 nt, hsa; identical to SEQ ID NO: 46998

SEQ ID NO: 314984 - RNA, 64 nt, hsa; identical to SEQ ID NO: 46999

SEQ ID NO: 314985 - RNA, 64 nt, hsa; identical to SEQ ID NO: 47000

SEQ ID NO: 314986 - RNA, 64 nt, hsa; identical to SEQ ID NO: 81713

SEQ ID NO: 314987 - RNA, 64 nt, hsa; identical to SEQ ID NO: 81714

SEQ ID NO: 314988 - RNA, 64 nt, hsa; identical to SEQ ID NO: 81715

SEQ ID NO: 314989 - RNA, 64 nt, hsa; identical to SEQ ID NO: 81716

SEQ ID NO: 314990 - RNA, 64 nt, hsa; identical to SEQ ID NO: 81717

SEQ ID NO: 314991 - RNA, 64 nt, hsa; identical to SEQ ID NO: 81718

SEQ ID NO: 314992 - RNA, 64 nt, hsa
uuucaucuugguaauaucaaaacaacuuuuuaaaugaacugauugauauauguuauuucuugcg

SEQ ID NO: 314993 - RNA, 64 nt, hsa
auuuuacugagaaaugaccugcauuuguaugaagugaacugagcgucacacccuguacuucauu

SEQ ID NO: 314994 - RNA, 64 nt, hsa
uaggcaggagugccaaaggacacuaugaacuuuuugaacugacaguuucuccuaacuuucugcu

SEQ ID NO: 314995 - RNA, 64 nt, hsa
ugcucaguggacuucuauagaugguuuugaaaaaugaacugagcugccuucccccgucgcauaa

SEQ ID NO: 314996 - RNA, 64 nt, hsa
ugcuaaaugacuccacacucagccuucucuacccugaacugaauuaucacccuuuucuccaugu

SEQ ID NO: 314997 - RNA, 64 nt, hsa
auauuuacaaaguccuucuacccacuaucaaaaaugaacugaucugcauucagcaggaaaaggg

SEQ ID NO: 314998 - RNA, 64 nt, hsa
acacuagcuuuguauuuuuuuuucuguaaaacugugaacugauauauuuuccuuuaucacuuua

SEQ ID NO: 314999 - RNA, 64 nt, hsa
agaaucgcuugaaccugggagguggaaguuguagugaacugagaucgcaccacugcacuccagc

SEQ ID NO: 315000 - RNA, 64 nt, hsa
aauggaaaaagcuuucuucugacugugacccucuugaacugaaucagaccaacuggaaucccag

SEQ ID NO: 315001 - RNA, 64 nt, hsa
ugaagacagcuugggcaggugaaaccagaauaugugaacugaguggacacccgaggcugccacu

SEQ ID NO: 315002 - RNA, 64 nt, hsa
gaauuuauuucauauaaaauaauaauauaaaguuugaacugauuagaauguuccuuaaaucaug

SEQ ID NO: 315003 - RNA, 64 nt, hsa
ucauuuaucaaaccuuuuauuacagaaaaaaaucugaacugagaaaggagcucugaauuuauuu

SEQ ID NO: 315004 - RNA, 64 nt, hsa
agugaauuugaaaauuugucuguauuuaauggccugaacugagaguugauauggccaaagggag

SEQ ID NO: 315005 - RNA, 64 nt, hsa
aggaucacuugagccugggagguugaggcugcagugaacugagaucacgacacugcacuccagc

SEQ ID NO: 315006 - RNA, 64 nt, hsa
uuucacuuaaagaaaaaaaaugccaugaaacauuugaacugaugagccacagaacuucaguuga

SEQ ID NO: 315007 - RNA, 64 nt, hsa
uuauuaugcuuuuaguuguaugagucucuuucuaugaacugaacacaaaacucaggaauuggug

SEQ ID NO: 315008 - RNA, 64 nt, hsa
guuauuuauaugcccaacaaauuucauagccugcugaacugaacugagugugucagaagugcug

SEQ ID NO: 315009 - RNA, 64 nt, hsa
uuauaugcccaacaaauuucauagccugcugaacugaacugagugugucagaagugcugguuaa

SEQ ID NO: 315010 - RNA, 64 nt, hsa
aucagugcuuuuagaaaugcaggccuuaacuuacugaacugaacuuucugaaaacguaauguag

SEQ ID NO: 315011 - RNA, 64 nt, hsa
guguacaugaugaucauggguugucagugauuugugaacugagagcagcaacaacauuauuuuu

SEQ ID NO: 315012 - RNA, 64 nt, hsa
ugucgggagggaagagaacugggccugaccuaccugaacugacuggcccuccgaggugggucug

SEQ ID NO: 315013 - RNA, 64 nt, hsa
ccagugugcacccagcgcuccauagacgccuuugugaacugaaaagagacuggcagagucccga

SEQ ID NO: 315014 - RNA, 64 nt, hsa
gccuugagaacaaagucaccuuugucacucccagugaacugaaugaggaacaugcugucuccug

SEQ ID NO: 315015 - RNA, 64 nt, hsa
ugccuguugguccaggacccugcagaaaguggccugaacugaccucugaacagcaucugucaaa

SEQ ID NO: 315016 - RNA, 64 nt, hsa
ccuuggccagcaaguuagagaaucuggcaauggaugaacugaaagugaugaacuggcagggaua

SEQ ID NO: 315017 - RNA, 64 nt, hsa
uuggggcuaaagacugaucucaggggucuuaccuugaacugaaggccacuugaguuggggccau

SEQ ID NO: 315018 - RNA, 64 nt, hsa
ccacuuuggaucaguucacagcauuaacuacaagugaacugaucaucuucucuauauucauuuc

SEQ ID NO: 315019 - RNA, 64 nt, hsa
caguucuuuuauuuccaaaacaugcucuccuacuugaacugaaaaguaagagaaauaaauagaa

SEQ ID NO: 315020 - RNA, 64 nt, hsa; identical to SEQ ID NO: 175595

SEQ ID NO: 315021 - RNA, 64 nt, hsa; identical to SEQ ID NO: 175596

SEQ ID NO: 315022 - RNA, 64 nt, hsa; identical to SEQ ID NO: 175597

SEQ ID NO: 315023 - RNA, 64 nt, hsa; identical to SEQ ID NO: 175598

SEQ ID NO: 315024 - RNA, 64 nt, hsa; identical to SEQ ID NO: 175599

SEQ ID NO: 315025 - RNA, 64 nt, hsa; identical to SEQ ID NO: 175600

SEQ ID NO: 315026 - RNA, 64 nt, hsa; identical to SEQ ID NO: 175601

SEQ ID NO: 315027 - RNA, 64 nt, hsa; identical to SEQ ID NO: 175602

SEQ ID NO: 315028 - RNA, 64 nt, hsa; identical to SEQ ID NO: 175603

SEQ ID NO: 315029 - RNA, 64 nt, hsa; identical to SEQ ID NO: 175604

SEQ ID NO: 315030 - RNA, 64 nt, hsa; identical to SEQ ID NO: 175605

SEQ ID NO: 315031 - RNA, 64 nt, hsa; identical to SEQ ID NO: 175606

SEQ ID NO: 315032 - RNA, 64 nt, hsa; identical to SEQ ID NO: 175607

SEQ ID NO: 315033 - RNA, 64 nt, hsa; identical to SEQ ID NO: 175608

SEQ ID NO: 315034 - RNA, 64 nt, hsa; identical to SEQ ID NO: 175609

SEQ ID NO: 315035 - RNA, 64 nt, hsa; identical to SEQ ID NO: 175610

SEQ ID NO: 315036 - RNA, 64 nt, hsa; identical to SEQ ID NO: 175611

SEQ ID NO: 315037 - RNA, 64 nt, hsa; identical to SEQ ID NO: 175612

SEQ ID NO: 315038 - RNA, 64 nt, hsa; identical to SEQ ID NO: 175613

SEQ ID NO: 315039 - RNA, 64 nt, hsa; identical to SEQ ID NO: 175614

SEQ ID NO: 315040 - RNA, 64 nt, hsa; identical to SEQ ID NO: 175615

SEQ ID NO: 315041 - RNA, 64 nt, hsa; identical to SEQ ID NO: 175616

SEQ ID NO: 315042 - RNA, 64 nt, hsa; identical to SEQ ID NO: 175617

SEQ ID NO: 315043 - RNA, 64 nt, hsa; identical to SEQ ID NO: 175618

SEQ ID NO: 315044 - RNA, 64 nt, hsa
uuuucagggcagugggauggugacuucugagcuaagccugcaagggaaguggcuguucccagac

SEQ ID NO: 315045 - RNA, 64 nt, hsa
aucccuucccaccucucccccacuucuucccuccagccugcaugcccuccucuggaacugggau

SEQ ID NO: 315046 - RNA, 64 nt, hsa
ugauguguguuuguggauaccugggcaucgacccagccugcaggugagcucugggccauguugc

SEQ ID NO: 315047 - RNA, 64 nt, hsa
acagucuaagacuucagggccgggaccuuuguccagccugcacaguagagugaggcugccucuc

SEQ ID NO: 315048 - RNA, 64 nt, hsa
gugaggggcgcauuccuccagcgccaagcgucagagccugcagacaacggagggcagcgccccc

SEQ ID NO: 315049 - RNA, 64 nt, hsa
gggaagcuucuccuccccaaggcggccauggggcagccugcagaggacaguggacguggagcug

SEQ ID NO: 315050 - RNA, 64 nt, hsa
gcacgggugccuccagccugagacaucaggggagagccugcagcugaguucagcagaaaggagg

SEQ ID NO: 315051 - RNA, 64 nt, hsa
cugggcuccucagagccugaagcaagcuuuuggaagccugcaguccucccagcuccagugcaga

SEQ ID NO: 315052 - RNA, 64 nt, hsa
ggccaggcuggaccccggcuccacacccacauccagccugcaggccucucugcaguccucucac

SEQ ID NO: 315053 - RNA, 64 nt, hsa
uggccccugacaccucccccagccccagcacaccagccugcaccucuuaucccguguuaagucc

SEQ ID NO: 315054 - RNA, 64 nt, hsa
agggaggacugcuugaagccagaaguucaagaccagccugcacaucacgagacccgcccucccc

SEQ ID NO: 315055 - RNA, 64 nt, hsa
agaggcagcuugucccccgaccuucaggaauggcagccugcagcaacuggaacaaggccccacc

SEQ ID NO: 315056 - RNA, 64 nt, hsa
cccguacuccuccacccagaugagggcccuccagagccugcaggcaucuguggggaaucccagc

SEQ ID NO: 315057 - RNA, 64 nt, hsa
ccuccagagccugcaggcaucuguggggaaucccagccugcagguucuuggagaagcaggugaa

SEQ ID NO: 315058 - RNA, 64 nt, hsa
uggaagcccuuuguuccuucccggguuuguccugagccugcacuguccucgccugcagccucag

SEQ ID NO: 315059 - RNA, 64 nt, hsa
ccauguuaacgugagcaaauuccucucaugaaauagccugcagcuauuaagaagcacgugugug

SEQ ID NO: 315060 - RNA, 64 nt, hsa
ccuucacugaucccagccaccccagaaaagcugcagccugcaggcaccagccgggccauaugcc

SEQ ID NO: 315061 - RNA, 64 nt, hsa
gccugaaugucaugcucccuggggcaggaccuugagccugcagcacacacuaggccaccugcag

SEQ ID NO: 315062 - RNA, 64 nt, hsa
uuugaaucucagucuucagccugcacugauuuguagccugcacugucuuacugauuuacaaacu

SEQ ID NO: 315063 - RNA, 64 nt, hsa
uuuuaaguggaagaucauuugaaucucagucuucagccugcacugauuuguagccugcacuguc

SEQ ID NO: 315064 - RNA, 64 nt, hsa
ccccaguuuagguucugagcaguauuggacuuguagccugcaguugucuuuugacuugcaggcc

SEQ ID NO: 315065 - RNA, 64 nt, hsa
gagcauuggaauccucuucuuccagggaggaauuagccugcaagguuaggacuugaagagggaa

SEQ ID NO: 315066 - RNA, 64 nt, hsa
ggagaggcaccugccaacuacuugcuuucccuggagccugcaugugccugugggguggggaggc

SEQ ID NO: 315067 - RNA, 64 nt, hsa
cagaaccaauaacuucugcaucaaaacauguuacagccugcaucaagggcuuuaccccaaccug

SEQ ID NO: 315068 - RNA, 57 nt, hsa
ugcccagcgacaaucacugaacgccgaagccugcagccaugcgaccccacgccaccc

SEQ ID NO: 315069 - RNA, 64 nt, hsa
accccacgccaccccgugccuccugccuccgcgcagccugcagcgggagacccuguccccgccc

SEQ ID NO: 315070 - RNA, 64 nt, hsa
cucaugccagcggcuuuggcugggguuggucugaagccugcacgcggcaguucuuuguuaaaga

SEQ ID NO: 315071 - RNA, 64 nt, hsa
aauccaggcgucgaccugguggggcccggggccaagccugcauucuggcugcccagcuucggac

SEQ ID NO: 315072 - RNA, 64 nt, hsa
uagcacuuuaaacgccgaagacagcccugcagcaagccugcacacgggcuuggguggguuccuu

SEQ ID NO: 315073 - RNA, 64 nt, hsa
ugccccaaaccggccuagacacgaagaccaaagcagccugcacagggcaaggcccccgcggaau

SEQ ID NO: 315074 - RNA, 64 nt, hsa
cuagacaaauguuuucaaauaaauuucacugcccagccugcacagauuuccauuugaaguacuu

SEQ ID NO: 315075 - RNA, 64 nt, hsa
uggcuggguuuuuuaaaaauagaaucucacugauagccugcaagaaacagaugcagugccugcu

SEQ ID NO: 315076 - RNA, 64 nt, hsa
acauuaauugcaagaaauaacuauauacuacuuugagaaguaaacaugucaaaaaaaacaaagu

SEQ ID NO: 315077 - RNA, 64 nt, hsa
aguaaacugcacuguuucugugauaaugugaaaugagaaguauuuacauuggagggccaauggc

SEQ ID NO: 315078 - RNA, 64 nt, hsa
uauguacaguucauaaauuuguugucauguguaugagaaguacuuugugcugaucgccuuauuu

SEQ ID NO: 315079 - RNA, 64 nt, hsa
ccuuuaacuaucagagggaucuaggucuugguuagagaaguaagcagaguucuuugcaagcuua

SEQ ID NO: 315080 - RNA, 64 nt, hsa
uugcagagcaaacaaagcagaggcaagaacugaggagaaguaucagagacaaacgggacuuuua

SEQ ID NO: 315081 - RNA, 64 nt, hsa
aaguggaaucuuccuuaaaggugaaacauaaguugagaaguagugcuugguuauuaagccugga

SEQ ID NO: 315082 - RNA, 64 nt, hsa
uuuaacagaguugaaaggccagaacgaucugggagagaaguaucagggcacagugugagaggcg

SEQ ID NO: 315083 - RNA, 64 nt, hsa
ccaccaagaaaugaacuuagagaaucagacaggcgagaaguacgaggggagcgagacgaaagga

SEQ ID NO: 315084 - RNA, 64 nt, hsa; identical to SEQ ID NO: 249571

SEQ ID NO: 315085 - RNA, 64 nt, hsa; identical to SEQ ID NO: 249572

SEQ ID NO: 315086 - RNA, 64 nt, hsa; identical to SEQ ID NO: 249573

SEQ ID NO: 315087 - RNA, 64 nt, hsa; identical to SEQ ID NO: 249574

SEQ ID NO: 315088 - RNA, 64 nt, hsa; identical to SEQ ID NO: 249575

SEQ ID NO: 315089 - RNA, 64 nt, hsa; identical to SEQ ID NO: 249576

SEQ ID NO: 315090 - RNA, 64 nt, hsa; identical to SEQ ID NO: 249577

SEQ ID NO: 315091 - RNA, 64 nt, hsa; identical to SEQ ID NO: 249578

SEQ ID NO: 315092 - RNA, 64 nt, hsa; identical to SEQ ID NO: 249579

SEQ ID NO: 315093 - RNA, 64 nt, hsa; identical to SEQ ID NO: 249580

SEQ ID NO: 315094 - RNA, 64 nt, hsa; identical to SEQ ID NO: 249581

SEQ ID NO: 315095 - RNA, 64 nt, hsa; identical to SEQ ID NO: 249582

SEQ ID NO: 315096 - RNA, 64 nt, hsa; identical to SEQ ID NO: 249583

SEQ ID NO: 315097 - RNA, 64 nt, hsa; identical to SEQ ID NO: 249584

SEQ ID NO: 315098 - RNA, 64 nt, hsa; identical to SEQ ID NO: 249585

SEQ ID NO: 315099 - RNA, 64 nt, hsa; identical to SEQ ID NO: 249586

SEQ ID NO: 315100 - RNA, 64 nt, hsa; identical to SEQ ID NO: 249587

SEQ ID NO: 315101 - RNA, 64 nt, hsa; identical to SEQ ID NO: 249588

SEQ ID NO: 315102 - RNA, 64 nt, hsa; identical to SEQ ID NO: 249589

SEQ ID NO: 315103 - RNA, 64 nt, hsa; identical to SEQ ID NO: 249590

SEQ ID NO: 315104 - RNA, 64 nt, hsa; identical to SEQ ID NO: 249591

SEQ ID NO: 315105 - RNA, 64 nt, hsa; identical to SEQ ID NO: 249592

SEQ ID NO: 315106 - RNA, 64 nt, hsa; identical to SEQ ID NO: 249593

SEQ ID NO: 315107 - RNA, 64 nt, hsa; identical to SEQ ID NO: 249594

SEQ ID NO: 315108 - RNA, 64 nt, hsa; identical to SEQ ID NO: 249595

SEQ ID NO: 315109 - RNA, 64 nt, hsa; identical to SEQ ID NO: 249596

SEQ ID NO: 315110 - RNA, 64 nt, hsa; identical to SEQ ID NO: 249597

SEQ ID NO: 315111 - RNA, 64 nt, hsa; identical to SEQ ID NO: 249598

SEQ ID NO: 315112 - RNA, 64 nt, hsa; identical to SEQ ID NO: 249599

SEQ ID NO: 315113 - RNA, 64 nt, hsa; identical to SEQ ID NO: 249600

SEQ ID NO: 315114 - RNA, 64 nt, hsa; identical to SEQ ID NO: 249601

SEQ ID NO: 315115 - RNA, 64 nt, hsa; identical to SEQ ID NO: 249602

SEQ ID NO: 315116 - RNA, 64 nt, hsa; identical to SEQ ID NO: 249603

SEQ ID NO: 315117 - RNA, 64 nt, hsa; identical to SEQ ID NO: 249604

SEQ ID NO: 315118 - RNA, 64 nt, hsa; identical to SEQ ID NO: 249605

SEQ ID NO: 315119 - RNA, 64 nt, hsa; identical to SEQ ID NO: 249606

SEQ ID NO: 315120 - RNA, 55 nt, hsa
ccaggguggcucugauauagcagcccugguguauuuucgauauuucaggaagacu

SEQ ID NO: 315121 - RNA, 64 nt, hsa
acccuccuaauagucauacuaguagucauacucccugguguaguguauucucuaaaagcuuuaa

SEQ ID NO: 315122 - RNA, 64 nt, hsa; identical to SEQ ID NO: 164717

SEQ ID NO: 315123 - RNA, 64 nt, hsa; identical to SEQ ID NO: 164718

SEQ ID NO: 315124 - RNA, 64 nt, hsa; identical to SEQ ID NO: 164719

SEQ ID NO: 315125 - RNA, 64 nt, hsa; identical to SEQ ID NO: 164720

SEQ ID NO: 315126 - RNA, 64 nt, hsa; identical to SEQ ID NO: 164721

SEQ ID NO: 315127 - RNA, 64 nt, hsa; identical to SEQ ID NO: 164722

SEQ ID NO: 315128 - RNA, 64 nt, hsa; identical to SEQ ID NO: 164723

SEQ ID NO: 315129 - RNA, 64 nt, hsa; identical to SEQ ID NO: 164724

SEQ ID NO: 315130 - RNA, 64 nt, hsa; identical to SEQ ID NO: 164725

SEQ ID NO: 315131 - RNA, 64 nt, hsa; identical to SEQ ID NO: 164726

SEQ ID NO: 315132 - RNA, 65 nt, hsa
gcuugcuggaacauucuaacauuuacacuuuuguuauaagcuauuuaaaaccaguaaggagacuu

SEQ ID NO: 315133 - RNA, 65 nt, hsa
ucuaucuauuuaauuggauauuggacucugcucauauaagcuacagacaaaagccaaaagacucu

SEQ ID NO: 315134 - RNA, 65 nt, hsa
uauucacaguugguguccugucacuuuguuuuaaaauaagcuagaaccaggaugcuuccuuauug

SEQ ID NO: 315135 - RNA, 64 nt, hsa
ccauucacacagauauuuugggauaauaaaggaaaauaagcuacaauugcuugucgucuuuuuu

SEQ ID NO: 315136 - RNA, 65 nt, hsa
aguuauugcccuuuuauauugugaauguaaugugcauaagcuauauccguagauguuauuguuuu

SEQ ID NO: 315137 - RNA, 65 nt, hsa
auuugcacagggagaauugaaacugaguauaaucaauaagcuagauacgaaaucaguuucucaaa

SEQ ID NO: 315138 - RNA, 65 nt, hsa
auauguaaaauuucucaccauuuuggugggguaagauaagcuauuauuaagauuuaauccuuaua

SEQ ID NO: 315139 - RNA, 65 nt, hsa
aaaaaucacuauaaggcagcucuaaauuugccuugauaagcuaaauaaauuacuuuuauaacuua

SEQ ID NO: 315140 - RNA, 65 nt, hsa
cagagaagggaaaugacaaaggggcagcuggccagauaagcuaggaugagagcagagacucagug

SEQ ID NO: 315141 - RNA, 65 nt, hsa
agcccccagcccugggaaccacucccaccacaggcauaagcuaucaccuagcagccucaaaacgg

SEQ ID NO: 315142 - RNA, 65 nt, hsa
uaagggauggaaaaggaagacuagaggcuugcauaauaagcuaaagaggcugaaagaggccaaug

SEQ ID NO: 315143 - RNA, 65 nt, hsa
aauucuggauuuuguccuacaagucugugccauuuauaagcuaaguugaggguucagagggagac

SEQ ID NO: 315144 - RNA, 65 nt, hsa
auaggcuuauuccauggaacaagaauuaaaaaugaauaagcuaucaauauauaauuuaaguacaa

SEQ ID NO: 315145 - RNA, 65 nt, hsa
ugggaugaauguuuuuauaggguuuuuguuguaacauaagcuauuuucuaauaugcugccaggua

SEQ ID NO: 315146 - RNA, 65 nt, hsa
accccaggucugucucuugccuuuucuuggggcauauaagcuacugaguggaacauggagcugau

SEQ ID NO: 315147 - RNA, 65 nt, hsa
cuucauuaguuuacgaaccacaaaauugcaaauaaauaagcuaugaacuuugauguacacuauaa

SEQ ID NO: 315148 - RNA, 65 nt, hsa
uuaauaauacuuauguuaauaacucuaugaaacauauaagcuaacuauauaucaaacauuucauu

SEQ ID NO: 315149 - RNA, 65 nt, hsa
aaguccuguuccagaaguaccaggcuguagauuugauaagcuagaugcaguagaccgaaaccauc

SEQ ID NO: 315150 - RNA, 65 nt, hsa
ugccgagauguuauaacaaggacucguucauguauauaagcuauuucuugauccauuuaaaagga

SEQ ID NO: 315151 - RNA, 65 nt, hsa
cugugaagcuugauuucugcuggugacuucugaccauaagcuagaaccauggucgccacuguuuu

SEQ ID NO: 315152 - RNA, 65 nt, hsa
agaaaucauacauaaaaauguagccugccuuacauauaagcuaauguagaaaaguuuagacuuau

SEQ ID NO: 315153 - RNA, 65 nt, hsa
augcauaacacugaguguuaauucuugugaaauaaauaagcuagacugccuucucuuuaauuaga

SEQ ID NO: 315154 - RNA, 65 nt, hsa
ucaacuucaaaucugugauugcuuacaggaggaagauaagcuacuaauugaaaaugguuuuuaca

SEQ ID NO: 315155 - RNA, 65 nt, hsa
uagcacugagacccccaugguaauguaacuuaauuauaagcuaugucacuacccuccuguaaaau

SEQ ID NO: 315156 - RNA, 65 nt, hsa
augcgauucuucuguuguaaaaaaauauauguacuauaagcuacauaaaauauuuucuauuuuuu

SEQ ID NO: 315157 - RNA, 65 nt, hsa
gacgguuaacauuuagcagaaaaacaaaccauugaauaagcuacuaggugaaaugcaaaacaacc

SEQ ID NO: 315158 - RNA, 65 nt, hsa
agaguuaaugaacagucuaauauugacuuaucagaauaagcuaacucuaaauuuaaugcucuaca

SEQ ID NO: 315159 - RNA, 65 nt, hsa
ugaaaaaucccaguaauggaaugaagguaauauugauaagcuauugucuguaauaguuuuauauu

SEQ ID NO: 315160 - RNA, 65 nt, hsa
uuacauguuuuccaacauauccuaaaaacugugauauaagcuaacauauaauuugccuuacguca

SEQ ID NO: 315161 - RNA, 65 nt, hsa
augaguuggcaugcauacaagauuuacuaagugggauaagcuaauuauacuuuuuguuguggaua

SEQ ID NO: 315162 - RNA, 65 nt, hsa
cuaaaucuauacauauuacuuguaucuagugcagaauaagcuauaacaucccauugaggaaucuu

SEQ ID NO: 315163 - RNA, 65 nt, hsa
ccagguagagagaccacaagcaggcucaacauaacauaagcuagaaaaauuagaugacugaauuu

SEQ ID NO: 315164 - RNA, 65 nt, hsa
gugaaggaaaaggggacaggaacaaaggaccaaaaauaagcuacauguuuuauuucuucaucgug

SEQ ID NO: 315165 - RNA, 65 nt, hsa
guuuucuguguuuagcuauuuaauacuaauuuuccauaagcuauuuugguuuagugcaaaguaua

SEQ ID NO: 315166 - RNA, 65 nt, hsa
cagucauugguuauacauguguaguuccaaagcacauaagcuagaagaagaaauauuucuaggag

SEQ ID NO: 315167 - RNA, 65 nt, hsa
ugguacuauuugccauuuaaaacuagaacagguauauaagcuaauauugauacaaugaugauuaa

SEQ ID NO: 315168 - RNA, 65 nt, hsa
cagaccauugucuugcaggacuacauuauaaauuuauaagcuaagugaguuggguuuucgaaccu

SEQ ID NO: 315169 - RNA, 65 nt, hsa
cucacuuugcuggccuuugaaauguguucuccgugauaagcuauccauguguuugugauaagagu

SEQ ID NO: 315170 - RNA, 65 nt, hsa
acaaaauaucuuuaaaaguuaaaacauccagauauauaagcuauuuuuuccuaaggauaaaguac

SEQ ID NO: 315171 - RNA, 65 nt, hsa
cauagaccaguauuucugacagguaaaaugcuaaaauaagcuaccuguaauaaguguggauuaua

SEQ ID NO: 315172 - RNA, 65 nt, hsa
gcuauaggccuagaguaugcuacagucacuuaagcauaagcuacaguauguaaacuaaaaggggg

SEQ ID NO: 315173 - RNA, 65 nt, hsa
cauugugaaaauucugaguugaagguuaguuuaagauaagcuaacaauaacagucuguguuuucu

SEQ ID NO: 315174 - RNA, 65 nt, hsa
ccuaagcugugguugcagaaaccguggccauuuauauaagcuauaacaucaaaucagggaaaaau

SEQ ID NO: 315175 - RNA, 65 nt, hsa
uaauauuuuuuuccuauuuuauacucauggaagagauaagcuaaagaggggacaauaaugagaaa

SEQ ID NO: 315176 - RNA, 65 nt, hsa
aaucaaguauuggcaaagauguggggaaaauucucauaagcuacugaugagaauuuauaaauuau

SEQ ID NO: 315177 - RNA, 65 nt, hsa
uuuauuccugccuuuaauauggggaggaagguuccauaagcuacauguuuccuaguuaagcucuu

SEQ ID NO: 315178 - RNA, 65 nt, hsa
ccacacaucuuuggacuuuucuuaaaaguucaguaauaagcuaacuguguuuauaaaauguaagu

SEQ ID NO: 315179 - RNA, 65 nt, hsa
gagagagcuacacggcaggggcagacacugugaguauaagcuacuuuccucccuggagugcucua

SEQ ID NO: 315180 - RNA, 65 nt, hsa
acaggaaaauaaguuuugauugcauuguuuuuaaaauaagcuaguuuucugagguguuuucacac

SEQ ID NO: 315181 - RNA, 65 nt, hsa
uccuguuucuuucauguacucauuuacuuucaaaaauaagcuagaauauauuaaagaaaauagaa

SEQ ID NO: 315182 - RNA, 65 nt, hsa
gagcucuauuuccccaccccacuauccucacucccauaagcuaagccuuaugugagccccuucag

SEQ ID NO: 315183 - RNA, 65 nt, hsa
guuuuucauucacuuuaauagaagggcaaauauuuauaagcuauuucuguaccaaaguguuugug

SEQ ID NO: 315184 - RNA, 65 nt, hsa
aucaugggacccucucuaauccuuccaccaaucaaauaagcuauugcuauugguuuggaguugag

SEQ ID NO: 315185 - RNA, 65 nt, hsa
uaugaaaaucauagcuggcuucuuuacagaaauugauaagcuagucccaaaauucauaaagaaau

SEQ ID NO: 315186 - RNA, 65 nt, hsa
caccugugaaauaacuauuuugacugaaauguaaaauaagcuauucaacaaagaacauauuaaaa

SEQ ID NO: 315187 - RNA, 65 nt, hsa
auuuuaaauugacccuuagcuauagagaauuugcuauaagcuagucuuguuuguaaaaaaaaaaa

SEQ ID NO: 315188 - RNA, 65 nt, hsa
uaguauaaagagucuguauuuuuaauaaauguuaaauaagcuaacaauguuuguacuuaugcauu

SEQ ID NO: 315189 - RNA, 65 nt, hsa
ggugagagcguuggacccaggcuuggcugccugacauaagcuaaaucucccagacccaccacugg

SEQ ID NO: 315190 - RNA, 65 nt, hsa
cuauuuuacccugugacauuuaaauauacuuuugaauaagcuacuauccugaggcugaggguuuu

SEQ ID NO: 315191 - RNA, 65 nt, hsa
aaagaauagucagacugauaaagaagugcuaacagauaagcuauaguuggggaaauuuguggguu

SEQ ID NO: 315192 - RNA, 65 nt, hsa
gaauccaguaguuuuucuaugcuauuuguuguuguauaagcuacuguaagaaacuuaucauaagg

SEQ ID NO: 315193 - RNA, 65 nt, hsa
uuaagugugcuguaaggaaaagucuuagaaacauaauaagcuaaaaucccauucacacauggcca

SEQ ID NO: 315194 - RNA, 65 nt, hsa
uagcuugcuuucaagcuucaccccuugcacuuaacauaagcuauuuuuggcauuguguuaucauc

SEQ ID NO: 315195 - RNA, 65 nt, hsa
guuauauucuuuucucauuucuuccccacccaaaaauaagcuaccauauagcuuauaagucucaa

SEQ ID NO: 315196 - RNA, 65 nt, hsa
aauaacugugcauggucugagauuuuacccuacuuauaagcuaacaaguuagccuguuacuguuu

SEQ ID NO: 315197 - RNA, 65 nt, hsa
uugguuuuuuaaaaagcaacuguuuaauugcuuaaauaagcuauguauuaaaucugucuccaguu

SEQ ID NO: 315198 - RNA, 56 nt, hsa
gaacauuugacuggcacugauuugcaauaagcuaagcucagaaacuuuccuacugu

SEQ ID NO: 315199 - RNA, 65 nt, hsa
uugacacauugcuugaccugauuuaugcagaauuaauaagcuauuuggauaguguagcuuuaaug

SEQ ID NO: 315200 - RNA, 65 nt, hsa
aggccuuagacuaauuuucgauuuucuuucuugaaauaagcuaauggcuuguuuguguaaagcuu

SEQ ID NO: 315201 - RNA, 65 nt, hsa
acuuugccaaauagugaaaaguagagcaaucguguauaagcuaauguuuaaaagcaaaacugcaa

SEQ ID NO: 315202 - RNA, 65 nt, hsa
cugagaauuuuuuaacauaugcaagucagccaaacauaagcuaccaaaauaaagagcaauguguu

SEQ ID NO: 315203 - RNA, 65 nt, hsa
uuguuucuuuuuuuuuaacuggucagucauucacaauaagcuaugaggguaaauaaauauguguu

SEQ ID NO: 315204 - RNA, 65 nt, hsa
auguuuguacuacuuuuuagaugcuuaaacuauacauaagcuauuaucuauuguuccuaguaauc

SEQ ID NO: 315205 - RNA, 65 nt, hsa
ggaggagaaaugagagggcuuaaaugaaauuuaaaauaagcuauauuauacaaauacuaucucug

SEQ ID NO: 315206 - RNA, 65 nt, hsa
ucucaaaaucugggccaagaaugauugcuagguccauaagcuaauuugucuggccuugccauuua

SEQ ID NO: 315207 - RNA, 65 nt, hsa
uuuucauguaucauuauuuuuacaaggaacuauauauaagcuagcacauaauuauccuucuguuc

SEQ ID NO: 315208 - RNA, 65 nt, hsa
uaaagcccuugcacagcuggagaaauggcaucauuauaagcuaugaguugaaauguucugucaaa

SEQ ID NO: 315209 - RNA, 65 nt, hsa
auuuauaaaaucuaaauuuggacuacuugcaaaugauaagcuauucuaguagccuuuaguuuaaa

SEQ ID NO: 315210 - RNA, 65 nt, hsa
gagguuuuaggauuuucaugguaacaagcucugguauaagcuaaggcuggcaaguucagauacua

SEQ ID NO: 315211 - RNA, 65 nt, hsa
aguugaggagguuucugcauagagucuuuauguccauaagcuacggguaggucuauuuucagagc

SEQ ID NO: 315212 - RNA, 65 nt, hsa
ugccucuaacuuugugguauaagaauuauauaugaauaagcuauuauuuuuauaaaggaaaacuu

SEQ ID NO: 315213 - RNA, 65 nt, hsa
cucugaaguucccccauuuccuucaguaccagucuauaagcuacuguccgccacugauuuucauu

SEQ ID NO: 315214 - RNA, 65 nt, hsa
caggcacugagaaugauaguaauaggauacaauguauaagcuacucacuuaucugauacuuauuu

SEQ ID NO: 315215 - RNA, 65 nt, hsa
agcuuucuggguaauucaccaauuuccuuuaaaacauaagcuaccugaauggagaauacaucuug

SEQ ID NO: 315216 - RNA, 65 nt, hsa
aaaugugagcucuccugguaaauaguauacauuuuauaagcuauauuuuaaaggccuaagaacau

SEQ ID NO: 315217 - RNA, 65 nt, hsa
uauauauauauauauauauauauaugguauaggagauaagcuauuucuuuccaaaaucuauaaau

SEQ ID NO: 315218 - RNA, 65 nt, hsa
ucaagucuauguuaaaguugcuuuccugcuguuaaauaagcuaugauauuaagauauucugacuu

SEQ ID NO: 315219 - RNA, 65 nt, hsa
cuugguugcuggaaaaaucuuuggggaaagcugguauaagcuacacacugaccuguccccagugu

SEQ ID NO: 315220 - RNA, 65 nt, hsa
uuuaaagaauuauauuggauaaggugguuuucaccauaagcuaauuuacucucugcagccgucua

SEQ ID NO: 315221 - RNA, 65 nt, hsa
acacauuuccacuauaauuuuacaaaguuaaauuuauaagcuagcauuaaguaaagugaagucca

SEQ ID NO: 315222 - RNA, 65 nt, hsa
cuuuuuuccccucauaaccuuguuuuugguagaaaauaagcuagagaaauuaagccaucguguug

SEQ ID NO: 315223 - RNA, 65 nt, hsa
ggagagauuagaagacaacaggcauagcaaaugacauaagcuaccgauuaacuaaucggaacaug

SEQ ID NO: 315224 - RNA, 65 nt, hsa
ugacuuauuugguggucugucaagaagaaaguuguauaagcuauugauaaggguguguaucuuaa

SEQ ID NO: 315225 - RNA, 65 nt, hsa
aguuuauuaugcaacucuggagguauagagggcauauaagcuaugggacauaugcugaucacagg

SEQ ID NO: 315226 - RNA, 65 nt, hsa
ucaaacccucaugacaaaguaggcacaagucuacaauaagcuaaaucagaauuuacaaauacaag

SEQ ID NO: 315227 - RNA, 65 nt, hsa
caggugggauauguccucagccuuugggggccuggauaagcuauugcagcacuuucugaggcuuu

SEQ ID NO: 315228 - RNA, 65 nt, hsa
guuaaguacuacaauguaaucuguuucccagggaaauaagcuauugguaguuguaggaaaucuua

SEQ ID NO: 315229 - RNA, 65 nt, hsa
aaucucucccccacucccuugccccauaaccaaacauaagcuagcuagucuugucuaauagaugg

SEQ ID NO: 315230 - RNA, 65 nt, hsa
uuugaaaauccuccaaaaaaaggagcaaagaaugcauaagcuauguguuggcaaaaguaauuuau

SEQ ID NO: 315231 - RNA, 65 nt, hsa
auagaugaagagccaacuugaugaaugugcuauucauaagcuagaaacuacaguuuuuccaaacu

SEQ ID NO: 315232 - RNA, 65 nt, hsa
guguaauauaccaauuaguuuuauauaauauccucauaagcuauucuaauuuuugagagaaacac

SEQ ID NO: 315233 - RNA, 65 nt, hsa
ggcuucaggaucaauuuuguuggcaagcaguaaaaauaagcuaucuaccuauggccgugcaaaca

SEQ ID NO: 315234 - RNA, 65 nt, hsa
gaaguaaccucagcacuacuauucucucuuaaaagauaagcuauuuaaccccaaacauuuggauu

SEQ ID NO: 315235 - RNA, 65 nt, hsa
gauuuguguuagcuaugggaauaacuugauuuuguauaagcuauuuagagugaggcuggaggugg

SEQ ID NO: 315236 - RNA, 65 nt, hsa
aagaaugcacauauguagacgauuaaguguauauuauaagcuauaugcugaaaauggcuuccaua

SEQ ID NO: 315237 - RNA, 65 nt, hsa
cugcuuaggauucuguucccugggcugaaacugaaauaagcuaauuuuuugggucacgguggcag

SEQ ID NO: 315238 - RNA, 65 nt, hsa
uuacuguaauugccagaggcagaaauggucuggguauaagcuauuucauaaaagcagcuuuaaau

SEQ ID NO: 315239 - RNA, 65 nt, hsa
cagaauucuaagaugaauuuaccaggugagaaugaauaagcuaugcaagguauuuuguaauauac

SEQ ID NO: 315240 - RNA, 65 nt, hsa
uacucccuauuuucauuccuuuuuuaaaaaauaauauaagcuacagaaaccagguaagcccuuua

SEQ ID NO: 315241 - RNA, 65 nt, hsa
uuauacucuccuuuugaaaagauaccauaaagcacauaagcuagaucacuacaaggagcuguuau

SEQ ID NO: 315242 - RNA, 65 nt, hsa
uuuauucaaaguguuagccuguuuuucuaccaacaauaagcuagaaaagacaaaaaaaacaaaaa

SEQ ID NO: 315243 - RNA, 65 nt, hsa
aaauugaauacuuugaauguguuucacaguuugaaauaagcuauuugauguaauacuucuugugu

SEQ ID NO: 315244 - RNA, 65 nt, hsa
guucauaguaacauuauacuucauagccagaaaguauaagcuaauacccaucaggcugggugugg

SEQ ID NO: 315245 - RNA, 65 nt, hsa
uauauauccaguuuucauuuuuuuacgucuugccuauaagcuaauaucauaaauaagguuguuua

SEQ ID NO: 315246 - RNA, 65 nt, hsa
ggauccaccacaccccaccgagcacuagaagcugcauaagcuacacaggaugugcuucugcagcc

SEQ ID NO: 315247 - RNA, 65 nt, hsa
uuaacugacuuucuagaugccuuaauauuugcaugauaagcuaguuuuauugguuuaguauucuu

SEQ ID NO: 315248 - RNA, 65 nt, hsa
guugugaaaauuucagaaacaauagauucuuaaagauaagcuagcuaugucuaggagcuuuaucu

SEQ ID NO: 315249 - RNA, 65 nt, hsa
ggguagauuuucaagagugugaacacaaauuuaaaauaagcuauaaucagcaacaacacaaugac

SEQ ID NO: 315250 - RNA, 65 nt, hsa
uuuuuuuuuuuugagaguuauucuggaaauguguuauaagcuaggagaaucccuuuggacagucu

SEQ ID NO: 315251 - RNA, 65 nt, hsa
aagacaaaauuuuucuuuucuugauuuuuuuaaacauaagcuaaaucauauuaguauuaauacua

SEQ ID NO: 315252 - RNA, 65 nt, hsa
auuagauuuucccauuucuaauaguuggcaccauuauaagcuauaagguucagaaucagaauuuu

SEQ ID NO: 315253 - RNA, 65 nt, hsa
acugcccagcauacuuaaaaaguagauccuugggcauaagcuaagcaccuuauuugcuuaucaua

SEQ ID NO: 315254 - RNA, 65 nt, hsa
ccauaucaugaaaaauucuacuuagcuauauuauuauaagcuacauuugcccugaauuugaacac

SEQ ID NO: 315255 - RNA, 65 nt, hsa
augauuagagacaucaccgcuaaaaaacuacauuuauaagcuaggauuuguuauaugcaaauauu

SEQ ID NO: 315256 - RNA, 65 nt, hsa
cagaaaaguaaccucuucuuaaguggaauauucuaauaagcuaccuuuuguaagugccauguuua

SEQ ID NO: 315257 - RNA, 65 nt, hsa
uuauuacacguuccaguuugucucgcuguguaggcauaagcuaaugguuuauuuucagaaagcug

SEQ ID NO: 315258 - RNA, 65 nt, hsa
augcauaaagaaugcaccacucaacuuuuuuauucauaagcuaauauuuuuuuaaaguuacauua

SEQ ID NO: 315259 - RNA, 65 nt, hsa
ugacuuugcuaauggcuauucuccaauuuguuccaauaagcuaagggcuuuucauacacaggaca

SEQ ID NO: 315260 - RNA, 65 nt, hsa
ggacaaggaguucuggugacaagcuauaccuaauuauaagcuauaaaacaauagauaugaguguu

SEQ ID NO: 315261 - RNA, 65 nt, hsa
auauagguaaauauagugauuuauaccaauaauuaauaagcuauuagguauagaaaaacauuuua

SEQ ID NO: 315262 - RNA, 65 nt, hsa
uuuuugguaugaaauugucuuucuccauugcagaaauaagcuagggaaacacuaacccaaaaacu

SEQ ID NO: 315263 - RNA, 65 nt, hsa
agcggugcaguggcaaggggggcuacuuguguggcauaagcuagaggagccggugccgccugaau

SEQ ID NO: 315264 - RNA, 65 nt, hsa
aaaacguucccacaaugcacaaauuaagaaucuauauaagcuauaaaaauacucauuuuuuaaaa

SEQ ID NO: 315265 - RNA, 65 nt, hsa
uuaacauuugaguuuguuuaagguauaagcagaagauaagcuaauauagcuuguuuuguugaaau

SEQ ID NO: 315266 - RNA, 65 nt, hsa
cuuugucacuugaaaggaaugaaacugaaugcaaaauaagcuaauuccauauuugcugugcauca

SEQ ID NO: 315267 - RNA, 65 nt, hsa
gagugauggggcacucaagaaaguucagaggaggcauaagcuauggagguuggaaaggaagaaag

SEQ ID NO: 315268 - RNA, 65 nt, hsa
aaaggaacaaaacgagcaugaauuaacucuucaauauaagcuaugaaguaauaguugguugugaa

SEQ ID NO: 315269 - RNA, 65 nt, hsa
uagaaaaucugugcuagaaccugugucuuauuccuauaagcuauguguucagacugaaacuggag

SEQ ID NO: 315270 - RNA, 65 nt, hsa
aggaggcuggcuuguccccuccucacucccuucccauaagcuauagacccgaggaaacucagagu

SEQ ID NO: 315271 - RNA, 65 nt, hsa
auauauugcaaaaacauaguuuguaaaggcauucuauaagcuauuuauguaaaaucaauaaaagu

SEQ ID NO: 315272 - RNA, 65 nt, hsa
ucaggggaguaggagaaugucuuccagaaaaauacauaagcuaguuucuguucuguaaagugaua

SEQ ID NO: 315273 - RNA, 65 nt, hsa
acaguuacaauaaauaacuuuaugcagauuaauauauaagcuacacaugauguaaaaaccuuacu

SEQ ID NO: 315274 - RNA, 65 nt, hsa
uucuuauuucuuucagaagacauuucugaaaucuuauaagcuacuuaagcuacguugucaguuuu

SEQ ID NO: 315275 - RNA, 65 nt, hsa
ccagccacuucugaauacaauauguagcugauuuaauaagcuaguuagugaauggaaaauaagug

SEQ ID NO: 315276 - RNA, 65 nt, hsa
gcuccuucuccaagacucaggccugugggcacucuauaagcuaguugaucuuggcucuccugaua

SEQ ID NO: 315277 - RNA, 65 nt, hsa
aggguaagggaauagaucacucagauguauuuuagauaagcuauuuagccuuugauggaaucaua

SEQ ID NO: 315278 - RNA, 65 nt, hsa
gcuugauucacagauggaugugaccuaaaggauaaauaagcuauuacuuaugugcugaucucuug

SEQ ID NO: 315279 - RNA, 65 nt, hsa
ugcuguauuuuccccccacuucucuauguaacgauauaagcuaucggagggugguaccgaucagg

SEQ ID NO: 315280 - RNA, 65 nt, hsa
caagcaaacaacaauaucaacaacaagagauugaaauaagcuauggguaaaauaaugccaguaau

SEQ ID NO: 315281 - RNA, 65 nt, hsa
gcuggucgacuuuuuaaaaaacaugaucacacuguauaagcuacuuagaacuuugaagggcauua

SEQ ID NO: 315282 - RNA, 65 nt, hsa
uauguuucucuuugauuauuugcauguuauguuuaauaagcuacuagcaaaauaaaacauagcaa

SEQ ID NO: 315283 - RNA, 65 nt, hsa
aagaauaggaugggauaaagaaaguggacacuuaaauaagcuauaaauuauaugguccuugucua

SEQ ID NO: 315284 - RNA, 65 nt, hsa
acauuuguuacccaugguguucuuuguuccuuuucauaagcuaauaccacuguagggauuuuguu

SEQ ID NO: 315285 - RNA, 65 nt, hsa
gauaguuacaaaauacaaaaguucaaccucuuacaauaagcuaaacgcaaugucauuuuuaaaaa

SEQ ID NO: 315286 - RNA, 65 nt, hsa
guauacuaguuuuucuuucugauugucagugauuuauaagcuauaaaugaccaagguccucagac

SEQ ID NO: 315287 - RNA, 65 nt, hsa
guucccuuugaaauaacgcuugccacaaguauauaauaagcuauauuaauuguguuuugcauaaa

SEQ ID NO: 315288 - RNA, 65 nt, hsa
uguuuugugagguaauacugauuuugaaaauauauauaagcuaaaaacaguauuucguugauauc

SEQ ID NO: 315289 - RNA, 65 nt, hsa
guuuuucuuuuaauaggcugggccacauguuggaaauaagcuaguaauguuguuuucugucaaua

SEQ ID NO: 315290 - RNA, 65 nt, hsa
guaugagauacagaacuuggugacccauguauugcauaagcuaaagcaacacagacacuccuagg

SEQ ID NO: 315291 - RNA, 65 nt, hsa
gagauaauugucuaguuagggggcagcuggagaaaauaagcuaaguuugcaauaacagaguacac

SEQ ID NO: 315292 - RNA, 63 nt, hsa
cccccagaacugugagaaauaaauuucuguuguuuauaagcuacccaguuuaugccauuuugu

SEQ ID NO: 315293 - RNA, 65 nt, hsa
acagcauuguacaauuagcuuaguaacacuauggaauaagcuaaaacauaucacaguuuuuacau

SEQ ID NO: 315294 - RNA, 65 nt, hsa
gagagaauuuaucacaccacguccuuauuggaauaauaagcuacuugccuugaguuuauaauuca

SEQ ID NO: 315295 - RNA, 65 nt, hsa
gacguaguaguuuguaaaaacguuuucuaugacgcauaagcuagcaugccuaugauuuauuuccu

SEQ ID NO: 315296 - RNA, 65 nt, hsa
aucgucaaugugaauagcuuagaauacugcaaaggauaagcuaauugaaugccuugaaaguauua

SEQ ID NO: 315297 - RNA, 65 nt, hsa
aaaaaaauaauuaaaaaagaaacagugcucaugucauaagcuauguugacaguugccaguggaaa

SEQ ID NO: 315298 - RNA, 65 nt, hsa
auaaaacaaaacaaaacaaaaaaaacuugugccugauaagcuaaggcucauuuauuuuuaaaagg

SEQ ID NO: 315299 - RNA, 65 nt, hsa
uacauguucagguuuuuuuuuuuuuuuuuuuuucaauaagcuauuuuuuuucuuuucuuauuuua

SEQ ID NO: 315300 - RNA, 65 nt, hsa
ggucuugaucaaaucaaacuaagaagaccuuagaaauaagcuaccauuuugccacagagcagcuu

SEQ ID NO: 315301 - RNA, 65 nt, hsa
ucaacuuagaaucugugauugcuuacaggaagaagauaagcuacuaauagaaaauguuuuuaccu

SEQ ID NO: 315302 - RNA, 65 nt, hsa
ugcuuaacugucuucacuauuaauacuauuuagaaauaagcuaauuggaucaguggcuuaaauaa

SEQ ID NO: 315303 - RNA, 65 nt, hsa
uuuauaaaaaucuugaguuuguucacuaaugugaaauaagcuauguguccaggguauugcucccc

SEQ ID NO: 315304 - RNA, 65 nt, hsa
uuggauuuauucugccaaaccuguguaggcauuuuauaagcuacauguucuaauuuuuaccgaug

SEQ ID NO: 315305 - RNA, 65 nt, hsa
uaaaugaggcuagagaggcagaggaaggcuagucaauaagcuaaggaggcuccuugccugagucc

SEQ ID NO: 315306 - RNA, 65 nt, hsa
ggaacaaagagauugugguggugcuaaaggaggccauaagcuacacagaggccuuggguguucca

SEQ ID NO: 315307 - RNA, 65 nt, hsa
gucagggccccccugccccaccgcacccccagaauauaagcuaucaagaguauuaauuuauuggg

SEQ ID NO: 315308 - RNA, 65 nt, hsa
auacauugguguuuugauuggaauaaagaaauccuauaagcuauuugggaaaaauuauaguguau

SEQ ID NO: 315309 - RNA, 65 nt, hsa
cugccuuggccucccgaagugcugggauugcaggcauaagcuaccaugcugggccugaacauaau

SEQ ID NO: 315310 - RNA, 65 nt, hsa
acucacugucaguauuaaggcccagcagccuguugauaagcuacccugucucaccaugugcuggu

SEQ ID NO: 315311 - RNA, 65 nt, hsa
gcaacccugggggccaguucaggugguccccaaccauaagcuaggucugaaaguuacacagccaa

SEQ ID NO: 315312 - RNA, 65 nt, hsa
gccuugaauugauuuuuuucucauaaaauagucugauaagcuaauuuuuaaaaagaaaugccauu

SEQ ID NO: 315313 - RNA, 65 nt, hsa
cagccccaucugcgggggcagugcucacccacaccauaagcuacugccauccuggcccagggcau

SEQ ID NO: 315314 - RNA, 65 nt, hsa
uguuguugguauuaugcugcagaguugugugcuacauaagcuauuauuaaaugugagugggcauu

SEQ ID NO: 315315 - RNA, 65 nt, hsa
cuuuugcuaggucacagaggaucugcuuggucuugauaagcuauguuguugcacuuuaaacauuu

SEQ ID NO: 315316 - RNA, 65 nt, hsa
gcuaccucaaccaaugccaaaaaaagacagggcugauaagcuaacaccagacagacaacacuggg

SEQ ID NO: 315317 - RNA, 65 nt, hsa
cuuuuguucccauaccaguuugguuucgcuaccuuauaagcuauggggaguuugguaacguaacu

SEQ ID NO: 315318 - RNA, 65 nt, hsa
aggaauucaagguugguucaacaucuaaaaaucaaauaagcuaauauacagucaguucucauuau

SEQ ID NO: 315319 - RNA, 65 nt, hsa
aggaauucaagguuuguucaacaucuaaaaaucaaauaagcuaauaaagaaaagagguuuauacu

SEQ ID NO: 315320 - RNA, 65 nt, hsa
aacuuauauuaauaguaauuuguaaaguugguuggauaagcuauccguguugcagguucauggau

SEQ ID NO: 315321 - RNA, 65 nt, hsa
uguucuuagcucaaugagcauguuuagacuuuaacauaagcuauuuuucuaacuacaaagguuua

SEQ ID NO: 315322 - RNA, 65 nt, hsa
auauuuuuuucauauguguaggugaaaugguaugaauaagcuaacaggaauaguaucuaaaaaca

SEQ ID NO: 315323 - RNA, 65 nt, hsa
cauuuuaacaauguuaauucuugcagaccaugaacauaagcuaccuucccauuuauaugcgucuu

SEQ ID NO: 315324 - RNA, 65 nt, hsa
ggacuacaggcaugcgcagccacuaugcccggccaauaagcuauauuuauucuuauuugaugugg

SEQ ID NO: 315325 - RNA, 65 nt, hsa
gcgguuccuggacuaaguccggcucguucaagaacauaagcuaccaccuucucccuccccacccc

SEQ ID NO: 315326 - RNA, 65 nt, hsa
uuuuuuuuaaucuacugcauuuagggaguauucuaauaagcuaguugaauacuugaaccauaaaa

SEQ ID NO: 315327 - RNA, 65 nt, hsa
auagcggaugccuccucaggaauauucucgauuuaauaagcuaaaaaaaaaaaguucuguguuug

SEQ ID NO: 315328 - RNA, 65 nt, hsa
auuacaggaacugugcaucagcuauuuaugauucuauaagcuauuucagcagaaugagauauuaa

SEQ ID NO: 315329 - RNA, 65 nt, hsa
uuuguauacacauuugcauauacccacauggggacauaagcuaauuuuuuuacaggacacagaau

SEQ ID NO: 315330 - RNA, 65 nt, hsa
gcaaagcgaugucagagggcgguuuugagcuuucuauaagcuauagcuuuguuuauuucacccgu

SEQ ID NO: 315331 - RNA, 65 nt, hsa
ugugcccagcagcucuuggucaaagcacuguugcuauaagcuaucucugggaugccucuaggccc

SEQ ID NO: 315332 - RNA, 65 nt, hsa
cauacaaaucuuuuagguaguagaguuuaacguguauaagcuaaaagugaaaguaacugaguguu

SEQ ID NO: 315333 - RNA, 65 nt, hsa
cuuaaaaacaaacaaacaaaaaaaaaaucuguuagauaagcuaucaaaaugcagcuguuguuuug

SEQ ID NO: 315334 - RNA, 65 nt, hsa
aaaacagagucucaagacccccgcucuggacugucauaagcuagcacccgugguaagcgggacga

SEQ ID NO: 315335 - RNA, 65 nt, hsa
gugaguguguguguacgcacacacacuggggauagauaagcuaccugguaaaggguuugaacauu

SEQ ID NO: 315336 - RNA, 65 nt, hsa
auaaauagagaaaaagugugugugagcaauaaugcauaagcuacugauaacuugcuuacagcaga

SEQ ID NO: 315337 - RNA, 65 nt, hsa
uuuuuccucaaagcucaauuagaauagcaaaauuuauaagcuaguaaacuuauacuauagcaagu

SEQ ID NO: 315338 - RNA, 65 nt, hsa
accuugugacuuuuagguaagaaauaggcaugaugauaagcuaugcagauuauuaaaaagcuuga

SEQ ID NO: 315339 - RNA, 65 nt, hsa
acuucauuuguuugcuguucaucuuuugggagggaauaagcuagagccaucaauacaauuccgcu

SEQ ID NO: 315340 - RNA, 65 nt, hsa
accuaaacugacaaugaauugguuauacaucaugcauaagcuacacuuuuauauuaguuuauauu

SEQ ID NO: 315341 - RNA, 65 nt, hsa
ugaauaaacguaaaggacaaguaaacaauuugaugauaagcuacaguuuuucuuagaaaguaaau

SEQ ID NO: 315342 - RNA, 65 nt, hsa
ucacugaccagcauggacucaggcaacugguaaugauaagcuaugagcuccagugcuuuugccaa

SEQ ID NO: 315343 - RNA, 65 nt, hsa
uauuugaccccaaaaccuuuuucauauacccaauaauaagcuacagaacuaauauucugcaaaug

SEQ ID NO: 315344 - RNA, 65 nt, hsa
aaauuuaaaaacuugugauuuaagaagaggaaaagauaagcuacagauugagaugaauuugcaaa

SEQ ID NO: 315345 - RNA, 65 nt, hsa
agcaaucaauuauacccaccaacaccacugaaaucauaagcuauucacgacucaaaauauucuaa

SEQ ID NO: 315346 - RNA, 65 nt, hsa
uuguuauuacuuuguguaacuuugauguaauguuuauaagcuaugagaaucaguuauaaaaguau

SEQ ID NO: 315347 - RNA, 65 nt, hsa
guuggugaguuuaguugugcaugccuuuguuguauauaagcuaaauucuagugacccauguguca

SEQ ID NO: 315348 - RNA, 65 nt, hsa
caacucauuuuauucucggcaacaucuggagaagcauaagcuaauuaagggcgaugauuauuauu

SEQ ID NO: 315349 - RNA, 65 nt, hsa
uugcuuauacacucugauuccuauaauacagugcuauaagcuaugcacagaaaauaaaauguuug

SEQ ID NO: 315350 - RNA, 65 nt, hsa
gacugcagacuacugcuuugaaugaguugaauuacauaagcuaagaucacuauagguccauuucu

SEQ ID NO: 315351 - RNA, 65 nt, hsa
uuugcccuuugcuugaauuccuggaaugcauacauauaagcuaaacagaugucugcaguuauaaa

SEQ ID NO: 315352 - RNA, 64 nt, hsa; identical to SEQ ID NO: 125643

SEQ ID NO: 315353 - RNA, 64 nt, hsa; identical to SEQ ID NO: 125644

SEQ ID NO: 315354 - RNA, 64 nt, hsa; identical to SEQ ID NO: 125645

SEQ ID NO: 315355 - RNA, 64 nt, hsa; identical to SEQ ID NO: 125646

SEQ ID NO: 315356 - RNA, 64 nt, hsa; identical to SEQ ID NO: 125647

SEQ ID NO: 315357 - RNA, 64 nt, hsa; identical to SEQ ID NO: 125648

SEQ ID NO: 315358 - RNA, 64 nt, hsa; identical to SEQ ID NO: 125649

SEQ ID NO: 315359 - RNA, 64 nt, hsa; identical to SEQ ID NO: 125650

SEQ ID NO: 315360 - RNA, 64 nt, hsa; identical to SEQ ID NO: 125651

SEQ ID NO: 315361 - RNA, 64 nt, hsa; identical to SEQ ID NO: 125652

SEQ ID NO: 315362 - RNA, 64 nt, hsa; identical to SEQ ID NO: 125653

SEQ ID NO: 315363 - RNA, 64 nt, hsa; identical to SEQ ID NO: 125654

SEQ ID NO: 315364 - RNA, 64 nt, hsa; identical to SEQ ID NO: 125655

SEQ ID NO: 315365 - RNA, 64 nt, hsa; identical to SEQ ID NO: 125656

SEQ ID NO: 315366 - RNA, 62 nt, hsa
aguuaagugauuucugaagcguuuguguguguguugaucagguugugugauauuuuugcuug

SEQ ID NO: 315367 - RNA, 62 nt, hsa
uaaauacauugaaguuuacauuuccaugugcuguugaucaacggcgccaccuguguuugcug

SEQ ID NO: 315368 - RNA, 62 nt, hsa
cuuuuaaauaacugguugugacaaagcuuguuguugaucagauucacuguuucaucauauuu

SEQ ID NO: 315369 - RNA, 62 nt, hsa
agacuuaauuaacuaauauaguauuuucuaagguugaucaucuuauaccacgaaucguuaau

SEQ ID NO: 315370 - RNA, 62 nt, hsa
ugagggaaguaaagacagugaagggguggaggguugaucagggcacaguggacagggagacc

SEQ ID NO: 315371 - RNA, 62 nt, hsa
acuguuucacagcacaaacucaucuuuacaguguugaucaaugcaucaguuaagaaauaaug

SEQ ID NO: 315372 - RNA, 62 nt, hsa
aaccuacugggcuacuaauacuucucucagcaguugaucaaauacaauagaccauguaagcu

SEQ ID NO: 315373 - RNA, 62 nt, hsa
gcgugacauauacuaaauaaaaaaaugaauauguugaucauuaggggugugggagcagagaa

SEQ ID NO: 315374 - RNA, 62 nt, hsa
gcauacuucuaggauagcuaacuguaaaucauguugaucauguacuuuuuaguaauuucuuu

SEQ ID NO: 315375 - RNA, 62 nt, hsa
aauaauuuauuauuaagguaacuacugcuaauguugaucagcaaauuuaagagaagaccuag

SEQ ID NO: 315376 - RNA, 62 nt, hsa
uuuaacaauuccaaaggaaucuccaguuuucaguugaucacuggcaaugaaaaauucucagu

SEQ ID NO: 315377 - RNA, 62 nt, hsa
aauuuugcuaaaugcuuaucagcaugaaauauguugaucagugaugaguugggcuuaaugca

SEQ ID NO: 315378 - RNA, 62 nt, hsa
uguaaucccagcacuuugggaggccaaggcggguugaucacccgaggucaggaguucaagac

SEQ ID NO: 315379 - RNA, 62 nt, hsa
ccauccagaaaauuacaacuccacuugauuuaguugaucaccaucucagucuucaaaagaua

SEQ ID NO: 315380 - RNA, 62 nt, hsa
gcugagagagaaucuuggaaacacacauaccuguugaucaugggcccugcagaauuggcccu

SEQ ID NO: 315381 - RNA, 62 nt, hsa
accuuuagaugaauucccugugagugagagaaguugaucaccccaggaauuagucacuaaga

SEQ ID NO: 315382 - RNA, 62 nt, hsa
gugauucuucagaugcccuucccaacugguuaguugaucaagaauuuuggggguggggguug

SEQ ID NO: 315383 - RNA, 62 nt, hsa
cugugguugaggaagugguguuuagaaugucaguugaucagcuagauuuguguccacacuac

SEQ ID NO: 315384 - RNA, 62 nt, hsa
accauaauuuugcucauugaaggcuaucuccaguugaucauugggaugagcaucuuugugca

SEQ ID NO: 315385 - RNA, 62 nt, hsa
uccucccucuucuaagccuuggccugaaucugguugaucagaggcaaguguggauccuuugg

SEQ ID NO: 315386 - RNA, 62 nt, hsa
gucuccuuguuuuucuaggucguacauuuccuguugaucaauuuuuuuuggaagaugcaauu

SEQ ID NO: 315387 - RNA, 62 nt, hsa
gccagagcuaucuuccuaaaaugcauugcauaguugaucaagucacucucuggccuaaaacc

SEQ ID NO: 315388 - RNA, 62 nt, hsa
ugcuggauguaaauuguucuuuucuugguaauguugaucauuaugugcaaagacugacuacu

SEQ ID NO: 315389 - RNA, 62 nt, hsa
auagauauauuuuaguaaaaaaggaacaugacguugaucauuugggcaaauuuuacguaaag

SEQ ID NO: 315390 - RNA, 62 nt, hsa
uuaaauuuggcucuaaaguugguguagcagcaguugaucagacugaaaaacgguuuuuaguc

SEQ ID NO: 315391 - RNA, 62 nt, hsa
cauuuuguauaauuuuuuuuucuuugagcaguguugaucaagccagguugaauauuugccau

SEQ ID NO: 315392 - RNA, 62 nt, hsa
aauguggaccuuagaauacaguuuugaguagaguugaucaaaaucaauuaaaauagucucuu

SEQ ID NO: 315393 - RNA, 62 nt, hsa
agucagguucggggugcaugggcuguggugguguugaucaguugcuccaguguuugaaauaa

SEQ ID NO: 315394 - RNA, 62 nt, hsa
agcaguuucagagaacuuuuugcaugcuuaugguugaucaguuaaaaaagaauguuacagua

SEQ ID NO: 315395 - RNA, 62 nt, hsa
ucucguucuguuguccaggauggagugcagugguugaucauagcucccgggcuguagucucc

SEQ ID NO: 315396 - RNA, 62 nt, hsa
uucaccaugccccagacgccagaaggucagccguugaucaauggaggcugagaccaugaugc

SEQ ID NO: 315397 - RNA, 62 nt, hsa
gaucuuugcaacacuccaaccagccaggaccaguugaucagaacugaucuuauuggucugau

SEQ ID NO: 315398 - RNA, 62 nt, hsa
cuuuaucugaugaagccaaauauccucuuauuguugaucaaaggaggcaaaagaauuuagag

SEQ ID NO: 315399 - RNA, 62 nt, hsa
ugguagaucaagcauuacacacaaaaaaucaaguugaucagaguauggguucuccauauagc

SEQ ID NO: 315400 - RNA, 62 nt, hsa
gcaagaagaaagaugggaaacugaauaaagcaguugaucagcaucauuggaacauggggacg

SEQ ID NO: 315401 - RNA, 62 nt, hsa
uuucauacauuuuugcuuaucccauaaguacaguugaucaaagucauaguagguaaaugcuu

SEQ ID NO: 315402 - RNA, 62 nt, hsa
uuguaaacuuuuauuuuuacucuuuacguugaguugaucaauuuuccauacuaagauuuuca

SEQ ID NO: 315403 - RNA, 62 nt, hsa
agcaagauuccguaagcugagaacucuggacaguugaucagcuuuaccuauggugcuuugcc

SEQ ID NO: 315404 - RNA, 62 nt, hsa
gucucagauacuugggaggcugaggugggaggguugaucacuugaggcugagaggucaaggu

SEQ ID NO: 315405 - RNA, 62 nt, hsa
gaagagagaacuuucugugaguagccauguguguugaucagauacaguuuuucugagaucuu

SEQ ID NO: 315406 - RNA, 62 nt, hsa
cuucaacguuauauauguacagaagaaaaaaaguugaucauagcuuuuugucaaguagcaug

SEQ ID NO: 315407 - RNA, 62 nt, hsa
cauugccaguuuucuucauucagaaucuguuuguugaucaagugacuguccccguaaaaagu

SEQ ID NO: 315408 - RNA, 62 nt, hsa
guuaugagaggauuuaguuaggucauuaagauguugaucacacagcuucaaucacaauaugc

SEQ ID NO: 315409 - RNA, 62 nt, hsa
uuaccgaauaagguaccaagaucacaaauaguguugaucagaucuuacaaguuuauguggca

SEQ ID NO: 315410 - RNA, 62 nt, hsa
gguugcgaagagauucuuaaaaguaucuguguguugaucaucaguuuuacaaaaacaccuau

SEQ ID NO: 315411 - RNA, 62 nt, hsa
cucacucugucacccaggcuggaguacaguggguugaucauggcucacugcauccuugacuu

SEQ ID NO: 315412 - RNA, 62 nt, hsa
gcuguaguacugagguuugaggaaaaauaaauguugaucagcagaccacguauuuaaaauuc

SEQ ID NO: 315413 - RNA, 62 nt, hsa
agcacugcaugugugaugguuguuugccaucuguugaucaggaacuacuucagcuacuugca

SEQ ID NO: 315414 - RNA, 62 nt, hsa
gugugauuuuuguuuguuuccuuuuaaguacuguugaucaguugugacacuuacugguuaaa

SEQ ID NO: 315415 - RNA, 62 nt, hsa
guaaaguucuuguacaaaaaauggaaugauagguugaucagauucaguaaaguugaucugua

SEQ ID NO: 315416 - RNA, 62 nt, hsa
aggaaagugguuuauaggccauucauacuuaaguugaucacuugcccaugguggacauuuuu

SEQ ID NO: 315417 - RNA, 62 nt, hsa
auucucuuaaaguugauaucuuaauauuuuguguugaucauuauuuccauucuuaaugugaa

SEQ ID NO: 315418 - RNA, 62 nt, hsa
acguuauuaaaauuguaauaccuagguaguugguugaucacaguuuguuaauuguauaaaaa

SEQ ID NO: 315419 - RNA, 62 nt, hsa
cuuuacugugcuuauuuuuuuaagaaaaaaguguugaucaaccauucgaccuauaagaagcc

SEQ ID NO: 315420 - RNA, 62 nt, hsa
gcuuaagauuuugaugcauaaaugaggucacuguugaucaguguugcuaguagcuuggcagc

SEQ ID NO: 315421 - RNA, 62 nt, hsa
aguagggccucuguaaaauuggagacugauagguugaucagaaacucacccuaaaucugaac

SEQ ID NO: 315422 - RNA, 62 nt, hsa
aauguaauuucacaacaccuaaggauuuuuugguugaucagguuacuguagauuuuuacuga

SEQ ID NO: 315423 - RNA, 62 nt, hsa
acauaaaaugacagcaaagagacugagagacuguugaucaaagcacagaacagguucaaaua

SEQ ID NO: 315424 - RNA, 62 nt, hsa
guaacccaaugguagauaaaugaauucaaccaguugaucaaauggcagaaaagcaguuagac

SEQ ID NO: 315425 - RNA, 62 nt, hsa
uuguauaaaaugaaguuuuuaaauugucaggaguugaucaugaggacaguagcauuaaauaa

SEQ ID NO: 315426 - RNA, 62 nt, hsa
uggaaaggcagcucuaaaugucaaucagccuaguugaucagcuuauugucuagugaaacucg

SEQ ID NO: 315427 - RNA, 62 nt, hsa
gguccuuggugugacccucugaaugguccaggguugaucacacucuggguuuauuacauggc

SEQ ID NO: 315428 - RNA, 62 nt, hsa
guaucgucagacaugagaauaauaaaaacggaguugaucaagaaauuaucuuuccuccaaua

SEQ ID NO: 315429 - RNA, 62 nt, hsa
ggcauccgagugguguccugugugggcugauaguugaucacacauugugcuuuugauuuuug

SEQ ID NO: 315430 - RNA, 62 nt, hsa
aauaaaaucagugcuguaggaagauggacuguguugaucauggguguaagcaacccaguuua

SEQ ID NO: 315431 - RNA, 62 nt, hsa
cuuaggccugaaggacaagaagcaacaacucuguugaucagaaccuguggaaaaccucuggc

SEQ ID NO: 315432 - RNA, 62 nt, hsa
acuaagguuugacugcuauaauuauuuguacuguugaucacauguacuuaaaacaucugaua

SEQ ID NO: 315433 - RNA, 62 nt, hsa
ggcuaggaagugaaaggaucaagauauuuacuguugaucaguuaugaaauguuacuucguuc

SEQ ID NO: 315434 - RNA, 62 nt, hsa
uaacauaccugcagcugcuuuucuaacaaacuguugaucagcaaaaauaaaggggcuacaga

SEQ ID NO: 315435 - RNA, 62 nt, hsa
uucagagcccuuuguuaaauaagaggggcgacguugaucauagaugccaccugguuagcacc

SEQ ID NO: 315436 - RNA, 62 nt, hsa
uggauuuuucauaccuauaaagucaaucuugaguugaucagagaaagggaaacuuacuccua

SEQ ID NO: 315437 - RNA, 62 nt, hsa
agaacaaaggaaaaauauagaaagcaacaucuguugaucauuuagguuuuuuuuuaaaccac

SEQ ID NO: 315438 - RNA, 62 nt, hsa
aguuuugcguggguucugcucuuccucccuauguugaucagugucaugugagcauaagccaa

SEQ ID NO: 315439 - RNA, 62 nt, hsa
ccucuugcauugauucaguuauugagauauucguugaucaccuccuauuucccaggcacugu

SEQ ID NO: 315440 - RNA, 62 nt, hsa
ugugacauugcacaucuaaauaccacauuuaaguugaucauuaauaugcaaugguagaucag

SEQ ID NO: 315441 - RNA, 62 nt, hsa
cugaaaggauucacuuuugacuuuauaugacaguugaucaagaacagguacuaccccuuuuu

SEQ ID NO: 315442 - RNA, 62 nt, hsa
auaccucacuaucauuucaaaagguuaaaugaguugaucacuaucucugcucugugcuccuc

SEQ ID NO: 315443 - RNA, 62 nt, hsa
uggggcucagcuuccaaggugcucaccugguuguugaucagagagcguguccguugugaucc

SEQ ID NO: 315444 - RNA, 62 nt, hsa
uguauucucagcacuuugggaggccgaggcagguugaucaccugaggucaggaguuugagac

SEQ ID NO: 315445 - RNA, 62 nt, hsa
ugcuuuucuuauuuuagucgggcaaaccucuuguugaucauagucuucaaguugaacaucaa

SEQ ID NO: 315446 - RNA, 62 nt, hsa
uugguaaaaaauaaaaaauucuaugcuauauuguugaucaaguguaaaugugaccuuguaca

SEQ ID NO: 315447 - RNA, 62 nt, hsa
gauacuuauaggugucagcccuugggccgauuguugaucauccagagccucaguucuguacu

SEQ ID NO: 315448 - RNA, 62 nt, hsa
uucuacuucaccuaaaaaaauaaaauaaaaauguugaucaagacauggaguugauuuuauga

SEQ ID NO: 315449 - RNA, 62 nt, hsa
ugguagcaaacugguucuuucggagccauccuguugaucaugcagcuccaccaaaccuuagg

SEQ ID NO: 315450 - RNA, 62 nt, hsa
gcaaucacuguguuguauauaauaguucauagguugaucacucauaauaauugacucuaagg

SEQ ID NO: 315451 - RNA, 62 nt, hsa
uucuauaagcuauuuauguaaaaucaauaaaaguugaucauaauuaaacuguaucaguugag

SEQ ID NO: 315452 - RNA, 62 nt, hsa
agauaaaucacuucaaaaccaagcaaaaugaaguugaucaaaucugcuuuucaaaguuuauc

SEQ ID NO: 315453 - RNA, 62 nt, hsa
guacuuuuguucuauagccugugaaauggcuaguugaucauuuuuccacaaagaauuaggug

SEQ ID NO: 315454 - RNA, 62 nt, hsa
auuaacagaacaggaauaucagaaacgaaguuguugaucaggcccacugcgaccuuccuuuc

SEQ ID NO: 315455 - RNA, 62 nt, hsa
uagaggcuuucaaagcugugaaaaaucaaaacguugaucacuuuagcagguugcagcuugga

SEQ ID NO: 315456 - RNA, 62 nt, hsa
aaugaucuuucuccauacugacuuuuaacaauguugaucauugaggcuaaauuaauauauau

SEQ ID NO: 315457 - RNA, 62 nt, hsa
aaaaaugcauuugaccaggauaaaugagguauguugaucauggcuuugcuuuauaucuugau

SEQ ID NO: 315458 - RNA, 62 nt, hsa
acauucagcagggacucgugaaacagcaggauguugaucagauguuuugggagguuaugcag

SEQ ID NO: 315459 - RNA, 62 nt, hsa
uagaucaaagcaaauguggacugaaucugcuuguugaucaguguugaagaaagugcaaaagg

SEQ ID NO: 315460 - RNA, 62 nt, hsa
ggggaugggguuggggagacguuuacaaagagguugaucauuuaauaaccucucaguuuggg

SEQ ID NO: 315461 - RNA, 62 nt, hsa
aaagaaaauuaaacuuucuuugaucuguacaaguugaucaaacaaauggggucauucuuguc

SEQ ID NO: 315462 - RNA, 62 nt, hsa
uaauuggcugcaauuauuuaauguuuaauuggguugaucaaaugagauucagcaauucacaa

SEQ ID NO: 315463 - RNA, 62 nt, hsa
ugauguucgguuguguugucaacaacuguugaguugaucacauacauccaaaaguauaguuu

SEQ ID NO: 315464 - RNA, 62 nt, hsa
aguuucuagaauuuuauaucauuggaugauauguugaucagccuuauguggaagaacuguga

SEQ ID NO: 315465 - RNA, 62 nt, hsa
ggaucuuuaggaggaacccacacacccuacaaguugaucaugcaggaacugaaaaccagucu

SEQ ID NO: 315466 - RNA, 62 nt, hsa
aagccaaaaacagagacagggaagaacucauuguugaucacacuguugccuuggaacccacg

SEQ ID NO: 315467 - RNA, 62 nt, hsa
auauaggaacuaaguuaaacuuguacauuucuguugaucacgccguuauguugccucaaaua

SEQ ID NO: 315468 - RNA, 62 nt, hsa
uuucaucauugucuucaggagagcuuuccagaguugaucauuuccucucaugguacucugcu

SEQ ID NO: 315469 - RNA, 62 nt, hsa
cauguagaguagguauuuuuuauagauugaagguugaucaauuuuuuaauacuuucaagaga

SEQ ID NO: 315470 - RNA, 62 nt, hsa
uguccuggaggaagagcuagcuccagacauggguugaucaccuagaggagcucuggcuaagg

SEQ ID NO: 315471 - RNA, 62 nt, hsa
cccauucacaacuacuuucucgcucccagaagguugaucagauauucuacaaucacagagua

SEQ ID NO: 315472 - RNA, 62 nt, hsa
aaaucuucaggggugcuaauccuguugcaucaguugaucauacuaacgagaacgguaaugcg

SEQ ID NO: 315473 - RNA, 62 nt, hsa
uucuugugccucuaauagcccaagaaugggagguugaucagaucugacaugauuccuuccug

SEQ ID NO: 315474 - RNA, 62 nt, hsa
ucaauggcgacuuuccguguccuucugauacaguugaucagaccccugcccaccgcccaggc

SEQ ID NO: 315475 - RNA, 62 nt, hsa
ggacaacuuccccaggaaccccguaccagccuguugaucaucaauaacacaggugaaaagaa

SEQ ID NO: 315476 - RNA, 62 nt, hsa
ucuccuggcgcugagagguggguccaagcagaguugaucagucccugccugcccugccuagg

SEQ ID NO: 315477 - RNA, 62 nt, hsa
uuuaugcuuagaugugaaaauaaauguuauuuguugaucauuucuauaauccagagcuuuag

SEQ ID NO: 315478 - RNA, 59 nt, hsa
uuaagucuucugaagaaugaagauaaaauguugaucauguauauauauccauagugaau

SEQ ID NO: 315479 - RNA, 62 nt, hsa
cuaagcauuucuacugggcaguuucauuuuuaguugaucagguuuuaaguuuuugaacuaaa

SEQ ID NO: 315480 - RNA, 62 nt, hsa
ggagcggguuugaacaggacccuggcuuagggguugaucacuuuccuagcaaaggggagacc

SEQ ID NO: 315481 - RNA, 62 nt, hsa
uaaaugugguauuugagaagauaaaugauguaguugaucaguauuccuccucuaucaccuuu

SEQ ID NO: 315482 - RNA, 62 nt, hsa
uuuuaauguaaucauuuugaacaugugugaaaguugaucauacgaauuggaucaaucuugaa

SEQ ID NO: 315483 - RNA, 62 nt, hsa
gucaaugaaagagauugagaauguuaacauuuguugaucaauguggagcuguccacauucgg

SEQ ID NO: 315484 - RNA, 62 nt, hsa
uuuauaauuagucauuuacauauuuuugucuuguugaucauuaccuguaaaugaaagaccuu

SEQ ID NO: 315485 - RNA, 62 nt, hsa
auuguccacuuugacgaucagucauucgguccguugaucaauaauccuucgaucuugucucc

SEQ ID NO: 315486 - RNA, 62 nt, hsa
gacauuuucuucuagaggaaaacucugaagcaguugaucaaacuuuguucaacaucagggaa

SEQ ID NO: 315487 - RNA, 62 nt, hsa
cugcccuugcccccuuccccagaacaaaacauguugaucaugugcaauauuucuuacugugc

SEQ ID NO: 315488 - RNA, 62 nt, hsa
auuaguuuagccucagauucugcagcugagaaguugaucagccaccucugaaggacaugcag

SEQ ID NO: 315489 - RNA, 62 nt, hsa
aaaccucacugaaaccugcuccgugcccggauguugaucaugcugguggcuugguuacugug

SEQ ID NO: 315490 - RNA, 62 nt, hsa
ccguccucaccgagcuccugcaucccuugaguguugaucaggaggcguccacagcauuguuc

SEQ ID NO: 315491 - RNA, 62 nt, hsa
uuguauuuuuaguagagaugggguuucuccauguugaucagacuagucuugaacucccgacc

SEQ ID NO: 315492 - RNA, 62 nt, hsa
uguaccauuuucuuguuuaacuuuagcauguuguugaucauggaucauacuccccuuguuuc

SEQ ID NO: 315493 - RNA, 62 nt, hsa
cuuggcacacagcaggcuuucaagaagugccaguugaucaaugaauaaauaaacgagccuau

SEQ ID NO: 315494 - RNA, 62 nt, hsa
gaggggauugggugaggacaguggucuuuccuguugaucaugaugauaaaguaaugauggcu

SEQ ID NO: 315495 - RNA, 62 nt, hsa
uauguguauucauauagcuguauacauauucaguugaucauuuuauaaacauaugaaggcau

SEQ ID NO: 315496 - RNA, 62 nt, hsa
uuucugguagguucugucugugccaagggcagguugaucagugagcucaggagagagcuucc

SEQ ID NO: 315497 - RNA, 62 nt, hsa
ggugugauuuauguguuaaccucagucacgagguugaucagcuaauugugggaccaaaaugu

SEQ ID NO: 315498 - RNA, 62 nt, hsa
cgugccaggaccaccugcaaaagccagggugcguugaucauucucagaucauugauuggccu

SEQ ID NO: 315499 - RNA, 62 nt, hsa
aagggggugucaaacagaggcaucagccugcuguugaucacagagagaaauugaguagaaag

SEQ ID NO: 315500 - RNA, 62 nt, hsa
agcuuggcuagaaccgguaagauggugacauuguugaucaagacugggaauauaagagagaa

SEQ ID NO: 315501 - RNA, 62 nt, hsa
cugucucauaaagacaggauugugcaaucuaaguugaucagucucucagugggguucugugu

SEQ ID NO: 315502 - RNA, 62 nt, hsa
aguguaugcuuccugaauaaaaaggagccaaaguugaucagaaugguggcgugcucauuucc

SEQ ID NO: 315503 - RNA, 62 nt, hsa
aaucgaacccaugagugaacauaaauuaaaaaguugaucaaccuauuaaaauguguauuuca

SEQ ID NO: 315504 - RNA, 62 nt, hsa
ggacuucccuccccaaauggacagucuucucuguugaucacagagggagccugaguacaggc

SEQ ID NO: 315505 - RNA, 64 nt, hsa
gcaggagaaucgcuugaacucgggagguggagguugcagucagccaagaucgugccacugcaca

SEQ ID NO: 315506 - RNA, 64 nt, hsa
aaaccaagucagaugagaugacugccauguacacugcagucaagggcagggaggggaggaauga

SEQ ID NO: 315507 - RNA, 64 nt, hsa
acagcaccacuuagguguagcauggauuuuaaacugcagucaguaucagauccuguuugauaaa

SEQ ID NO: 315508 - RNA, 64 nt, hsa
uaaaugaacccacugccuuaaaugucuugaauguugcagucaagugucugucauguguugauau

SEQ ID NO: 315509 - RNA, 64 nt, hsa
ugggacuuucaaaaaaaaaagaucaggcugaaacugcagucagauuuaugacagcugacaguuu

SEQ ID NO: 315510 - RNA, 64 nt, hsa
gaguggguugcuuucucacaaagaugggguucugugcagucacaggucacuuccuugacaacac

SEQ ID NO: 315511 - RNA, 64 nt, hsa
acagaggacagcuuccccaucgccuucuggcugcugcagucagcacagagagcggcuuccccau

SEQ ID NO: 315512 - RNA, 64 nt, hsa
acagaggacggcuuccccaucgccuucuggccgcugcagucagcacagagagcggcuuccccau

SEQ ID NO: 315513 - RNA, 64 nt, hsa
aggaggcccaggauccccaaaauauuauaagcauugcagucagaugauauagcacuagcaaagc

SEQ ID NO: 315514 - RNA, 64 nt, hsa
ccacagaacuuuggcacauucugaagaaaaucucugcagucaauuuuuaucuccucugcuugac

SEQ ID NO: 315515 - RNA, 64 nt, hsa
cucaaaguacuguauuuuuuauuuuuaccugauuugcagucauaaacacugcacuuuggugcug

SEQ ID NO: 315516 - RNA, 64 nt, hsa
cccugaaaccaggugcuuccuugggguugaguaaugcagucagaaaguaguuuguaauugauau

SEQ ID NO: 315517 - RNA, 64 nt, hsa
ucucuugagagcaugaauuaagagacauggagacugcagucacuugggaguagacaccugaaac

SEQ ID NO: 315518 - RNA, 64 nt, hsa
augugacuaaggguagggguauaagucuguuccaugcagucacucagggacccagucuccuuuu

SEQ ID NO: 315519 - RNA, 64 nt, hsa
cuuugcugugagcaggucagcaggaacccuuuucugcagucacucagggacccagacuuacaga

SEQ ID NO: 315520 - RNA, 64 nt, hsa
ugguaggaucugaguugacccugcaguucgguuaugcagucaauuauuucuuuuuaagaggagg

SEQ ID NO: 315521 - RNA, 64 nt, hsa
ugugcagcacucaaucccacuggaagccuaaugcugcagucagaagcaaugccuggcuggggca

SEQ ID NO: 315522 - RNA, 64 nt, hsa
aaacccuguccacccaaccccgagagcccuagcgugcagucagcgucagcacggcgcucccaga

SEQ ID NO: 315523 - RNA, 64 nt, hsa
cacccacacaaguggagcucacaggguagcugugugcagucacugcagcuugccaggcugucau

SEQ ID NO: 315524 - RNA, 64 nt, hsa
aauguagcccauuaccacauguagccuuggagacccaggcaaggacaaguacacguguacucac

SEQ ID NO: 315525 - RNA, 64 nt, hsa
agagaauccucaccaguucucaccaaccuuccccccaggcaagggcagcugccagcauggugcu

SEQ ID NO: 315526 - RNA, 64 nt, hsa
aaaagaaaacaaaagccagacaaacccaaguuguccaggcaaauaaacucaaaucuuugucacg

SEQ ID NO: 315527 - RNA, 64 nt, hsa
aaccaacagaaguuauuuacagaaauucauauauccaggcaacacaaaacuccuuuauucaaaa

SEQ ID NO: 315528 - RNA, 64 nt, hsa
ggucccuaugggcuuccgcacaugccgcgggcggccaggcaacgugcgugucucugccaugugg

SEQ ID NO: 315529 - RNA, 64 nt, hsa
gcaggggcucugcuuccucagcccuagaggcgagccaggcaagguuggcgacugucauguggcu

SEQ ID NO: 315530 - RNA, 64 nt, hsa
uccccuuggaucugccuuuguccugcuuguguauccaggcaaccucuuuucaaguuggucaggc

SEQ ID NO: 315531 - RNA, 64 nt, hsa
ugauaguuaccuucacaauggugcuaccccuugcccaggcaaggaaagacagcagugaugacac

SEQ ID NO: 315532 - RNA, 64 nt, hsa
gccaucucuggaugccugauugccaagcucaggaccaggcaaugugacuuugcaucagcaacaa

SEQ ID NO: 315533 - RNA, 64 nt, hsa
gugggccugggguaccaagagacuccuugagagaccaggcaaagcaagugauugggacagaggu

SEQ ID NO: 315534 - RNA, 64 nt, hsa
gccucuccuucucagugcagggacgucaccccugccaggcaagcccagggcacagaugccagga

SEQ ID NO: 315535 - RNA, 64 nt, hsa
ggcuucucccucucagugcgaggcuucaccccugccaggcaagcccagggcauagaugcugaga

SEQ ID NO: 315536 - RNA, 64 nt, hsa
gccucucccucucagugcagggacgucaccccugccaggcaagcccagggcacagaggccggga

SEQ ID NO: 315537 - RNA, 64 nt, hsa
gccccucccucucagugcgggaacgucaccccugccaggcaagcccagggcacagaugcugcga

SEQ ID NO: 315538 - RNA, 64 nt, hsa
agcugugugaccauccagggguggagggggaaaaccaggcaauuucguuccuggaaucaaccaa

SEQ ID NO: 315539 - RNA, 64 nt, hsa
ccauggcagggguggauucgggagcugggaguaaccaggcaaagucaaccagaugccuagcucc

SEQ ID NO: 315540 - RNA, 64 nt, hsa; identical to SEQ ID NO: 283773

SEQ ID NO: 315541 - RNA, 64 nt, hsa; identical to SEQ ID NO: 283774

SEQ ID NO: 315542 - RNA, 64 nt, hsa; identical to SEQ ID NO: 283775

SEQ ID NO: 315543 - RNA, 64 nt, hsa; identical to SEQ ID NO: 283776

SEQ ID NO: 315544 - RNA, 64 nt, hsa; identical to SEQ ID NO: 283777

SEQ ID NO: 315545 - RNA, 64 nt, hsa; identical to SEQ ID NO: 283778

SEQ ID NO: 315546 - RNA, 64 nt, hsa; identical to SEQ ID NO: 283779

SEQ ID NO: 315547 - RNA, 64 nt, hsa; identical to SEQ ID NO: 283780

SEQ ID NO: 315548 - RNA, 64 nt, hsa; identical to SEQ ID NO: 283781

SEQ ID NO: 315549 - RNA, 64 nt, hsa; identical to SEQ ID NO: 283782

SEQ ID NO: 315550 - RNA, 64 nt, hsa; identical to SEQ ID NO: 283783

SEQ ID NO: 315551 - RNA, 64 nt, hsa; identical to SEQ ID NO: 283784

SEQ ID NO: 315552 - RNA, 64 nt, hsa; identical to SEQ ID NO: 283785

SEQ ID NO: 315553 - RNA, 64 nt, hsa; identical to SEQ ID NO: 283786

SEQ ID NO: 315554 - RNA, 64 nt, hsa; identical to SEQ ID NO: 283787

SEQ ID NO: 315555 - RNA, 64 nt, hsa; identical to SEQ ID NO: 283788

SEQ ID NO: 315556 - RNA, 64 nt, hsa; identical to SEQ ID NO: 283789

SEQ ID NO: 315557 - RNA, 64 nt, hsa; identical to SEQ ID NO: 283790

SEQ ID NO: 315558 - RNA, 64 nt, hsa; identical to SEQ ID NO: 283791

SEQ ID NO: 315559 - RNA, 64 nt, hsa; identical to SEQ ID NO: 283792

SEQ ID NO: 315560 - RNA, 64 nt, hsa; identical to SEQ ID NO: 283793

SEQ ID NO: 315561 - RNA, 64 nt, hsa; identical to SEQ ID NO: 283794

SEQ ID NO: 315562 - RNA, 64 nt, hsa; identical to SEQ ID NO: 283795

SEQ ID NO: 315563 - RNA, 64 nt, hsa; identical to SEQ ID NO: 283796

SEQ ID NO: 315564 - RNA, 64 nt, hsa; identical to SEQ ID NO: 283797

SEQ ID NO: 315565 - RNA, 64 nt, hsa; identical to SEQ ID NO: 283798

SEQ ID NO: 315566 - RNA, 64 nt, hsa; identical to SEQ ID NO: 283799

SEQ ID NO: 315567 - RNA, 64 nt, hsa; identical to SEQ ID NO: 283800

SEQ ID NO: 315568 - RNA, 64 nt, hsa; identical to SEQ ID NO: 283801

SEQ ID NO: 315569 - RNA, 64 nt, hsa; identical to SEQ ID NO: 283802

SEQ ID NO: 315570 - RNA, 64 nt, hsa; identical to SEQ ID NO: 283803

SEQ ID NO: 315571 - RNA, 64 nt, hsa; identical to SEQ ID NO: 283804

SEQ ID NO: 315572 - RNA, 64 nt, hsa; identical to SEQ ID NO: 283805

SEQ ID NO: 315573 - RNA, 64 nt, hsa; identical to SEQ ID NO: 283806

SEQ ID NO: 315574 - RNA, 64 nt, hsa; identical to SEQ ID NO: 283807

SEQ ID NO: 315575 - RNA, 64 nt, hsa; identical to SEQ ID NO: 283808

SEQ ID NO: 315576 - RNA, 64 nt, hsa; identical to SEQ ID NO: 210960

SEQ ID NO: 315577 - RNA, 64 nt, hsa; identical to SEQ ID NO: 210961

SEQ ID NO: 315578 - RNA, 64 nt, hsa; identical to SEQ ID NO: 210962

SEQ ID NO: 315579 - RNA, 64 nt, hsa; identical to SEQ ID NO: 210963

SEQ ID NO: 315580 - RNA, 64 nt, hsa; identical to SEQ ID NO: 210964

SEQ ID NO: 315581 - RNA, 64 nt, hsa; identical to SEQ ID NO: 210965

SEQ ID NO: 315582 - RNA, 64 nt, hsa
uccucguuccucuccuggaugggacagaauguggcguggagaaggucagagccaagagugaaug

SEQ ID NO: 315583 - RNA, 64 nt, hsa
gugccgggccauuggcgagagcuucaucaugaagcguggagacagcuuccucgaugggacccgg

SEQ ID NO: 315584 - RNA, 64 nt, hsa
gcuacagcugccaggucaugcacgaagggagcaccguggagaagacgguggccccugcagaaug

SEQ ID NO: 315585 - RNA, 64 nt, hsa
ccuggaaggcagaugguacccccaucacccagggcguggagaugaccacgcccuccaaacagag

SEQ ID NO: 315586 - RNA, 64 nt, hsa
uaguuagacaauguccuguugggugguccuguugcguggagaucuccucugguccuuucaaagg

SEQ ID NO: 315587 - RNA, 64 nt, hsa
cucgauccuagccugugucagcuggauguguuuacguggagaggcguggccacuuuuuagguca

SEQ ID NO: 315588 - RNA, 60 nt, hsa
uagccacagagucugagauucugaguucagccuagccacagagucuaagauucuguaucc

SEQ ID NO: 315589 - RNA, 60 nt, hsa
uauuucaaagccacagcauaagaaugucagccuagccacagagucugagauucugaguuc

SEQ ID NO: 315590 - RNA, 60 nt, hsa
ccacccaccacacugauccagcccugaguuccuagccaccgccuccuacagcccaccugg

SEQ ID NO: 315591 - RNA, 60 nt, hsa
uccagguggcaucagugucuuuccacuccuccuagccacccaccacacugauccagcccu

SEQ ID NO: 315592 - RNA, 60 nt, hsa
ccccucagaaggcugucuggcacccaguguccuagccaggccaaguauaugagaaaggua

SEQ ID NO: 315593 - RNA, 60 nt, hsa
cacuugccccagagaagcuacucggccaaaccuagccagggucuguucuuguggaccaga

SEQ ID NO: 315594 - RNA, 60 nt, hsa
gcuggggugcugagccugccuuccucaccaccuagccauagucucaaaccuguggggaag

SEQ ID NO: 315595 - RNA, 64 nt, hsa
uuagaagcaaaauuaaaaguacaagcugggcaaacugacagaauacuagauaggagagacuaau

SEQ ID NO: 315596 - RNA, 64 nt, hsa
uuuuuuuuaaacauuucugaguucgaagguaauacugacagauuucuucccucuucccucccca

SEQ ID NO: 315597 - RNA, 64 nt, hsa
uaggcaagaagaggugugaguaauugaggaaaaacugacagaugcuuuugcuaauaccaaaauu

SEQ ID NO: 315598 - RNA, 64 nt, hsa
uagccuacagacauggaacaguguaaaucccagacugacagacuuagaaccugaggucucauuc

SEQ ID NO: 315599 - RNA, 64 nt, hsa
uggauaaaccauaauuuauuuaaucagucccucacugacagacguuuccauuguuuccugucuu

SEQ ID NO: 315600 - RNA, 64 nt, hsa
gcaagcaugugggaaauagguacucucauaacagcugacagaaguacauauugaagaggacaau

SEQ ID NO: 315601 - RNA, 64 nt, hsa
cuggggagggggccaucugcugcgcccggccccacugacagaucugaagagcacaguaggaagg

SEQ ID NO: 315602 - RNA, 64 nt, hsa
auuucacaguagugggugggccuguuuuaaggcucugacagauaccacgaaacaugaagcacgu

SEQ ID NO: 315603 - RNA, 64 nt, hsa
ugaagugcauagugcugcucccaggagaccacugcugacagauacacagagaagagaucagaga

SEQ ID NO: 315604 - RNA, 64 nt, hsa
uuuaaccgugugucaagauuugguuaagucuugccugacagaacucaaagacacgucuaucagc

SEQ ID NO: 315605 - RNA, 64 nt, hsa
caccaguggugacauccuucagucccucacaucucugacagagcgggacagaauggauauuugg

SEQ ID NO: 315606 - RNA, 64 nt, hsa
gucugugccugugauuccagucacccuguaguuacugacagaaauugacuggacugucauugug

SEQ ID NO: 315607 - RNA, 64 nt, hsa
cuugaccagaaaaagauuuguuuaccuaccauuucauugguaguauggcccacggugaccauuu

SEQ ID NO: 315608 - RNA, 64 nt, hsa
uugguuauaguguuuaggcuagaaaugccucccacauugguaauaaacauuacaaaauacaaug

SEQ ID NO: 315609 - RNA, 64 nt, hsa
cuaaacagagaugaggugguaucuucacguagaacauugguauucgcuugagaaaaaaagaaua

SEQ ID NO: 315610 - RNA, 64 nt, hsa
cauaaaugauuaauuaaauagcuuuugugucuuacauugguagccagccagccaaggcucuguu

SEQ ID NO: 315611 - RNA, 64 nt, hsa; identical to SEQ ID NO: 163826

SEQ ID NO: 315612 - RNA, 64 nt, hsa; identical to SEQ ID NO: 163827

SEQ ID NO: 315613 - RNA, 64 nt, hsa; identical to SEQ ID NO: 163828

SEQ ID NO: 315614 - RNA, 64 nt, hsa; identical to SEQ ID NO: 163829

SEQ ID NO: 315615 - RNA, 64 nt, hsa; identical to SEQ ID NO: 163830

SEQ ID NO: 315616 - RNA, 64 nt, hsa; identical to SEQ ID NO: 163831

SEQ ID NO: 315617 - RNA, 64 nt, hsa; identical to SEQ ID NO: 163832

SEQ ID NO: 315618 - RNA, 64 nt, hsa; identical to SEQ ID NO: 163833

SEQ ID NO: 315619 - RNA, 64 nt, hsa; identical to SEQ ID NO: 163834

SEQ ID NO: 315620 - RNA, 64 nt, hsa; identical to SEQ ID NO: 163835

SEQ ID NO: 315621 - RNA, 64 nt, hsa; identical to SEQ ID NO: 163836

SEQ ID NO: 315622 - RNA, 64 nt, hsa; identical to SEQ ID NO: 163837

SEQ ID NO: 315623 - RNA, 64 nt, hsa; identical to SEQ ID NO: 163838

SEQ ID NO: 315624 - RNA, 64 nt, hsa; identical to SEQ ID NO: 163839

SEQ ID NO: 315625 - RNA, 64 nt, hsa; identical to SEQ ID NO: 163840

SEQ ID NO: 315626 - RNA, 64 nt, hsa; identical to SEQ ID NO: 163841

SEQ ID NO: 315627 - RNA, 64 nt, hsa; identical to SEQ ID NO: 163842

SEQ ID NO: 315628 - RNA, 64 nt, hsa; identical to SEQ ID NO: 163843

SEQ ID NO: 315629 - RNA, 64 nt, hsa; identical to SEQ ID NO: 163844

SEQ ID NO: 315630 - RNA, 64 nt, hsa; identical to SEQ ID NO: 163845

SEQ ID NO: 315631 - RNA, 64 nt, hsa; identical to SEQ ID NO: 163846

SEQ ID NO: 315632 - RNA, 64 nt, hsa; identical to SEQ ID NO: 163847

SEQ ID NO: 315633 - RNA, 64 nt, hsa; identical to SEQ ID NO: 163848

SEQ ID NO: 315634 - RNA, 64 nt, hsa; identical to SEQ ID NO: 163849

SEQ ID NO: 315635 - RNA, 64 nt, hsa; identical to SEQ ID NO: 163850

SEQ ID NO: 315636 - RNA, 64 nt, hsa; identical to SEQ ID NO: 163851

SEQ ID NO: 315637 - RNA, 64 nt, hsa; identical to SEQ ID NO: 163852

SEQ ID NO: 315638 - RNA, 64 nt, hsa; identical to SEQ ID NO: 163853

SEQ ID NO: 315639 - RNA, 64 nt, hsa; identical to SEQ ID NO: 163854

SEQ ID NO: 315640 - RNA, 64 nt, hsa; identical to SEQ ID NO: 163855

SEQ ID NO: 315641 - RNA, 64 nt, hsa; identical to SEQ ID NO: 163856

SEQ ID NO: 315642 - RNA, 64 nt, hsa; identical to SEQ ID NO: 163857

SEQ ID NO: 315643 - RNA, 64 nt, hsa; identical to SEQ ID NO: 163858

SEQ ID NO: 315644 - RNA, 64 nt, hsa; identical to SEQ ID NO: 163859

SEQ ID NO: 315645 - RNA, 64 nt, hsa; identical to SEQ ID NO: 163860

SEQ ID NO: 315646 - RNA, 64 nt, hsa; identical to SEQ ID NO: 163861

SEQ ID NO: 315647 - RNA, 64 nt, hsa; identical to SEQ ID NO: 163862

SEQ ID NO: 315648 - RNA, 64 nt, hsa; identical to SEQ ID NO: 163863

SEQ ID NO: 315649 - RNA, 64 nt, hsa; identical to SEQ ID NO: 163864

SEQ ID NO: 315650 - RNA, 64 nt, hsa; identical to SEQ ID NO: 163865

SEQ ID NO: 315651 - RNA, 64 nt, hsa; identical to SEQ ID NO: 163866

SEQ ID NO: 315652 - RNA, 64 nt, hsa; identical to SEQ ID NO: 163867

SEQ ID NO: 315653 - RNA, 64 nt, hsa; identical to SEQ ID NO: 163868

SEQ ID NO: 315654 - RNA, 64 nt, hsa; identical to SEQ ID NO: 163869

SEQ ID NO: 315655 - RNA, 64 nt, hsa; identical to SEQ ID NO: 163870

SEQ ID NO: 315656 - RNA, 64 nt, hsa; identical to SEQ ID NO: 163871

SEQ ID NO: 315657 - RNA, 64 nt, hsa; identical to SEQ ID NO: 163872

SEQ ID NO: 315658 - RNA, 64 nt, hsa; identical to SEQ ID NO: 163873

SEQ ID NO: 315659 - RNA, 64 nt, hsa; identical to SEQ ID NO: 163874

SEQ ID NO: 315660 - RNA, 64 nt, hsa; identical to SEQ ID NO: 163875

SEQ ID NO: 315661 - RNA, 64 nt, hsa; identical to SEQ ID NO: 163876

SEQ ID NO: 315662 - RNA, 64 nt, hsa; identical to SEQ ID NO: 163877

SEQ ID NO: 315663 - RNA, 64 nt, hsa; identical to SEQ ID NO: 163878

SEQ ID NO: 315664 - RNA, 64 nt, hsa; identical to SEQ ID NO: 163879

SEQ ID NO: 315665 - RNA, 64 nt, hsa; identical to SEQ ID NO: 163880

SEQ ID NO: 315666 - RNA, 64 nt, hsa; identical to SEQ ID NO: 163881

SEQ ID NO: 315667 - RNA, 64 nt, hsa; identical to SEQ ID NO: 163882

SEQ ID NO: 315668 - RNA, 64 nt, hsa; identical to SEQ ID NO: 163883

SEQ ID NO: 315669 - RNA, 64 nt, hsa; identical to SEQ ID NO: 163884

SEQ ID NO: 315670 - RNA, 64 nt, hsa; identical to SEQ ID NO: 163885

SEQ ID NO: 315671 - RNA, 64 nt, hsa; identical to SEQ ID NO: 163886

SEQ ID NO: 315672 - RNA, 64 nt, hsa; identical to SEQ ID NO: 163887

SEQ ID NO: 315673 - RNA, 64 nt, hsa; identical to SEQ ID NO: 163888

SEQ ID NO: 315674 - RNA, 64 nt, hsa; identical to SEQ ID NO: 163889

SEQ ID NO: 315675 - RNA, 64 nt, hsa; identical to SEQ ID NO: 163890

SEQ ID NO: 315676 - RNA, 64 nt, hsa; identical to SEQ ID NO: 163891

SEQ ID NO: 315677 - RNA, 64 nt, hsa; identical to SEQ ID NO: 163892

SEQ ID NO: 315678 - RNA, 64 nt, hsa; identical to SEQ ID NO: 163893

SEQ ID NO: 315679 - RNA, 64 nt, hsa; identical to SEQ ID NO: 163894

SEQ ID NO: 315680 - RNA, 64 nt, hsa; identical to SEQ ID NO: 163895

SEQ ID NO: 315681 - RNA, 64 nt, hsa; identical to SEQ ID NO: 163896

SEQ ID NO: 315682 - RNA, 64 nt, hsa; identical to SEQ ID NO: 163897

SEQ ID NO: 315683 - RNA, 64 nt, hsa; identical to SEQ ID NO: 163898

SEQ ID NO: 315684 - RNA, 64 nt, hsa; identical to SEQ ID NO: 163899

SEQ ID NO: 315685 - RNA, 64 nt, hsa; identical to SEQ ID NO: 163900

SEQ ID NO: 315686 - RNA, 64 nt, hsa; identical to SEQ ID NO: 163901

SEQ ID NO: 315687 - RNA, 64 nt, hsa; identical to SEQ ID NO: 163902

SEQ ID NO: 315688 - RNA, 64 nt, hsa; identical to SEQ ID NO: 163903

SEQ ID NO: 315689 - RNA, 64 nt, hsa; identical to SEQ ID NO: 163904

SEQ ID NO: 315690 - RNA, 64 nt, hsa; identical to SEQ ID NO: 163905

SEQ ID NO: 315691 - RNA, 64 nt, hsa; identical to SEQ ID NO: 163906

SEQ ID NO: 315692 - RNA, 64 nt, hsa; identical to SEQ ID NO: 163907

SEQ ID NO: 315693 - RNA, 64 nt, hsa; identical to SEQ ID NO: 163908

SEQ ID NO: 315694 - RNA, 64 nt, hsa; identical to SEQ ID NO: 163909

SEQ ID NO: 315695 - RNA, 64 nt, hsa; identical to SEQ ID NO: 163910

SEQ ID NO: 315696 - RNA, 64 nt, hsa; identical to SEQ ID NO: 163911

SEQ ID NO: 315697 - RNA, 64 nt, hsa; identical to SEQ ID NO: 163912

SEQ ID NO: 315698 - RNA, 64 nt, hsa; identical to SEQ ID NO: 163913

SEQ ID NO: 315699 - RNA, 64 nt, hsa; identical to SEQ ID NO: 163914

SEQ ID NO: 315700 - RNA, 64 nt, hsa; identical to SEQ ID NO: 163915

SEQ ID NO: 315701 - RNA, 64 nt, hsa; identical to SEQ ID NO: 163916

SEQ ID NO: 315702 - RNA, 64 nt, hsa; identical to SEQ ID NO: 163917

SEQ ID NO: 315703 - RNA, 64 nt, hsa; identical to SEQ ID NO: 163918

SEQ ID NO: 315704 - RNA, 64 nt, hsa; identical to SEQ ID NO: 163919

SEQ ID NO: 315705 - RNA, 64 nt, hsa; identical to SEQ ID NO: 163920

SEQ ID NO: 315706 - RNA, 64 nt, hsa; identical to SEQ ID NO: 163921

SEQ ID NO: 315707 - RNA, 64 nt, hsa; identical to SEQ ID NO: 163922

SEQ ID NO: 315708 - RNA, 64 nt, hsa; identical to SEQ ID NO: 163923

SEQ ID NO: 315709 - RNA, 64 nt, hsa; identical to SEQ ID NO: 163924

SEQ ID NO: 315710 - RNA, 64 nt, hsa; identical to SEQ ID NO: 163925

SEQ ID NO: 315711 - RNA, 64 nt, hsa; identical to SEQ ID NO: 163926

SEQ ID NO: 315712 - RNA, 64 nt, hsa; identical to SEQ ID NO: 163927

SEQ ID NO: 315713 - RNA, 64 nt, hsa; identical to SEQ ID NO: 163928

SEQ ID NO: 315714 - RNA, 64 nt, hsa; identical to SEQ ID NO: 163929

SEQ ID NO: 315715 - RNA, 64 nt, hsa; identical to SEQ ID NO: 163930

SEQ ID NO: 315716 - RNA, 64 nt, hsa; identical to SEQ ID NO: 163931

SEQ ID NO: 315717 - RNA, 64 nt, hsa; identical to SEQ ID NO: 163932

SEQ ID NO: 315718 - RNA, 64 nt, hsa; identical to SEQ ID NO: 163933

SEQ ID NO: 315719 - RNA, 64 nt, hsa; identical to SEQ ID NO: 163934

SEQ ID NO: 315720 - RNA, 64 nt, hsa; identical to SEQ ID NO: 163935

SEQ ID NO: 315721 - RNA, 64 nt, hsa; identical to SEQ ID NO: 163936

SEQ ID NO: 315722 - RNA, 64 nt, hsa; identical to SEQ ID NO: 163937

SEQ ID NO: 315723 - RNA, 64 nt, hsa; identical to SEQ ID NO: 163938

SEQ ID NO: 315724 - RNA, 64 nt, hsa; identical to SEQ ID NO: 163939

SEQ ID NO: 315725 - RNA, 64 nt, hsa; identical to SEQ ID NO: 163940

SEQ ID NO: 315726 - RNA, 64 nt, hsa
ugaggagagucaaaaacaugcagccuuaagccucagcaaagagcauaauccaacucaguaugaa

SEQ ID NO: 315727 - RNA, 64 nt, hsa
caauaucccagaugguaaagacugaagggaaaggagcaaagagaaaaaccuccgaggaagagaa

SEQ ID NO: 315728 - RNA, 64 nt, hsa
agaagcagacaccuccagugaacuagcaaagaaaagcaaagaaguauucagaaaagagguaagg

SEQ ID NO: 315729 - RNA, 64 nt, hsa
ccaagacagcagaagcagacaccuccagugaacuagcaaagaaaagcaaagaaguauucagaaa

SEQ ID NO: 315730 - RNA, 64 nt, hsa
guagauugagcugaauaaccaugggaagugaccaagcaaagacacucgauuggagucaguugaa

SEQ ID NO: 315731 - RNA, 64 nt, hsa
gcaguugugaaaauugcuaauggugccaaggccaagcaaagaguuucagaaaaugacugagaag

SEQ ID NO: 315732 - RNA, 64 nt, hsa
aagcacuuuuuaaauggcucuaagaauaagccacagcaaagaauuuaaaguggcuccuuuaauu

SEQ ID NO: 315733 - RNA, 64 nt, hsa
auuguuggauacugaaugacagacaaucuuauguagcaaagauuaugccugaaaaggaaaauua

SEQ ID NO: 315734 - RNA, 64 nt, hsa
uugggaagcuaauuuuguugaauguuuagaauugagcaaagauguaaauuuuugaagggcaguu

SEQ ID NO: 315735 - RNA, 64 nt, hsa
aauacaugaacaaauggaaaguuacuucuagaaaagcaaagaaauuggguaucauuuuuguuuc

SEQ ID NO: 315736 - RNA, 64 nt, hsa
gaagacugugaugugugguccccauauguggcucagcaaagacucgagagaucaucccuuuguc

SEQ ID NO: 315737 - RNA, 64 nt, hsa
ggguccauguacucagauaaacaugaagaaaauaagcaaagaaaaauggagacugggaaagcaa

SEQ ID NO: 315738 - RNA, 64 nt, hsa
uaagcuagaugaugacagugaugaugaugaagaaagcaaagaaggccaagaaaguucuaguagu

SEQ ID NO: 315739 - RNA, 64 nt, hsa
agaaguuaaaccacccgauaggccuucgagcaaaagcaaagauccaccgagagaagaagagaaa

SEQ ID NO: 315740 - RNA, 64 nt, hsa
aauugcuugaacccaggaggcggagguaguggugagcaaagaucguaccgcugcacuccagccu

SEQ ID NO: 315741 - RNA, 64 nt, hsa
gguggccaucuuuuccuacuaccuagagaaagccagcaaagaaugaaggcaacaaaggaaacag

SEQ ID NO: 315742 - RNA, 64 nt, hsa
auguccuaaagcauuuuggugacuucuagggaauagcaaagaccuauuucauuguccccaggua

SEQ ID NO: 315743 - RNA, 64 nt, hsa
gcaacccagccagggucuugguggcauuuguaaaagcaaagagcuguggacugccgugguccua

SEQ ID NO: 315744 - RNA, 64 nt, hsa
gugucugccuucauuagacuaugaugucuuugagagcaaagacuauuuuuccuuacucuuugca

SEQ ID NO: 315745 - RNA, 55 nt, hsa
uguugguuuguuuuuccagaugaacagcaaagauguucaguauugugcugaaaga

SEQ ID NO: 315746 - RNA, 64 nt, hsa
guccaggaugucugcacaacugagcagcucgcucacucccuaaagaaaccuauuggcagcuuca

SEQ ID NO: 315747 - RNA, 64 nt, hsa
acagaccuggguucaaguccucaguccccugcccacucccuacgugacuuugaucaggucacua

SEQ ID NO: 315748 - RNA, 64 nt, hsa
ccagcgguggcuucuugaugcugcgcggucccccacucccuacaucagaaugcaucccgcaucc

SEQ ID NO: 315749 - RNA, 64 nt, hsa
uuucagugcaagucuugaugcugcgccgucccccacucccuacaucagaacgcaucccucaucu

SEQ ID NO: 315750 - RNA, 64 nt, hsa
augggguuaggcuucaugccuucaugcccaggcagccacagaaacccacucuuccccgccucac

SEQ ID NO: 315751 - RNA, 64 nt, hsa
cacgaaguuggagaaccugacagggcugguccaggccacagaggaugggguuaggcuucaugcc

SEQ ID NO: 315752 - RNA, 64 nt, hsa
uacaagugacgacaaagauucuguuucaaauauagccacagaaauaaaggagggaccaauaucu

SEQ ID NO: 315753 - RNA, 64 nt, hsa
uacaagugacgagaaagauucuguuucaaauauagccacagaaauaaagaagggacaacaaucu

SEQ ID NO: 315754 - RNA, 64 nt, hsa
uacaacugacgaggaagacucuguuucgaauauagccacagaaauaaaggauggagaaaaaucu

SEQ ID NO: 315755 - RNA, 64 nt, hsa
uacaacugaugagaaagauucuguuucgaacauagccacagaaauaaaggauggagaaaaaucu

SEQ ID NO: 315756 - RNA, 64 nt, hsa
uagccacagagucugagauucugaguucagccuagccacagagucuaagauucuguauccucug

SEQ ID NO: 315757 - RNA, 64 nt, hsa
uauuucaaagccacagcauaagaaugucagccuagccacagagucugagauucugaguucagcc

SEQ ID NO: 315758 - RNA, 64 nt, hsa
gaaagccacagaguugaaagccacagaguugaaagccacagaguuaagugaccucagguaacau

SEQ ID NO: 315759 - RNA, 64 nt, hsa
accgccaucuuacacgaaagccacagaguugaaagccacagaguugaaagccacagaguuaagu

SEQ ID NO: 315760 - RNA, 64 nt, hsa
uguccauggcccuauaccgccaucuuacacgaaagccacagaguugaaagccacagaguugaaa

SEQ ID NO: 315761 - RNA, 64 nt, hsa
gucaccucuuuuacaguuagaaacaccagccgaggccacagaaucccaucccuuuccugaguca

SEQ ID NO: 315762 - RNA, 64 nt, hsa
accauugucucaauucaaauccauagauuucgaagccacagagucucucccuggagcagcagac

SEQ ID NO: 315763 - RNA, 64 nt, hsa
uccagaauggagcuuagugcuacugaauacccuggccacagagccaccucaggauauucuuuuc

SEQ ID NO: 315764 - RNA, 64 nt, hsa
gaauaauuuacaaaaaucaaaugaguauugagaagccacagaaauaucaaaaauggugacauca

SEQ ID NO: 315765 - RNA, 64 nt, hsa
cagaagagacaguagucugcauacaucgcugcaggccacagagcagcuuggguuggaagagaga

SEQ ID NO: 315766 - RNA, 64 nt, hsa
aauacuagugaaucacccacaaggaaaagccacugccacagaggaggcggguccccuugugcgg

SEQ ID NO: 315767 - RNA, 64 nt, hsa
aggaaucaccccucugccccugcagcuggaaugugccacagaggccccaccugaaggguggaug

SEQ ID NO: 315768 - RNA, 64 nt, hsa
ucacugggccagucaacggggggcuccugcccaggccacagagaaccugaguucccgggagcug

SEQ ID NO: 315769 - RNA, 64 nt, hsa
cuuugggagguguuaacucaaaggugacuucugggccacagaucaagaaagcauuugaucugac

SEQ ID NO: 315770 - RNA, 64 nt, hsa
ugaaagcaagcacaacuaaaccuucuuaauauccgccacagaaggcucaagaauccagcccuaa

SEQ ID NO: 315771 - RNA, 64 nt, hsa
cacacagacacacaaucacacgcagccccuccccgccacagagacacaccauuacauacacaga

SEQ ID NO: 315772 - RNA, 64 nt, hsa
uacacagacacgcaaucgcagauacgcccuuccggccacagaaacacaccauuacacacacaua

SEQ ID NO: 315773 - RNA, 64 nt, hsa
gacacagacacaaaaucacacacacacccuccccgccacagagacacaccauuacauacacaga

SEQ ID NO: 315774 - RNA, 64 nt, hsa
cacacagacacaaaaucacacacacacccuccccgccacagagacaccauuacauacacagaca

SEQ ID NO: 315775 - RNA, 64 nt, hsa
cagagacacggucacugauucacacccagucccugccacagaccgucucagacacgcacagugg

SEQ ID NO: 315776 - RNA, 64 nt, hsa
agugggccugcugcaugauucacacccagucccugccacagaccgucucagacacgcacagugg

SEQ ID NO: 315777 - RNA, 64 nt, hsa; identical to SEQ ID NO: 315776

SEQ ID NO: 315778 - RNA, 64 nt, hsa
caccuuuagaucccuuccccuccaugggcuuugggccacagaaugaaccuuugaggccuguaaa

SEQ ID NO: 315779 - RNA, 64 nt, hsa
ugguacuucaguuuggaucuauugggggaguguggccacagaccgggggaugauugaauuguuc

SEQ ID NO: 315780 - RNA, 60 nt, hsa
ccuacuacccaucugggugacccggggcaggccacagaggccaggccagggcuggaagga

SEQ ID NO: 315781 - RNA, 64 nt, hsa
cucucugugcagccucacagggcuuugccacggagccacagagagaugcuggguccccgaggcc

SEQ ID NO: 315782 - RNA, 64 nt, hsa
aaccccccagugccuuggcgagggcagguuccaagccacagacgccugccccgaguggacucug

SEQ ID NO: 315783 - RNA, 64 nt, hsa
gcgccacucucugcccugccaugcggcugguggugccacagagccucaccgugccugaguggca

SEQ ID NO: 315784 - RNA, 64 nt, hsa
gucaggaagccaggcaaggagagggacagcacaggccacagagggcugcccccaccacacacac

SEQ ID NO: 315785 - RNA, 64 nt, hsa
ccagauucucugagcacuuucccccauccccagggccacagauccccuuccuuacuuguugggg

SEQ ID NO: 315786 - RNA, 64 nt, hsa
ugcacagguagccccgacccucucaggcauuccagccacagaacaucaaagugagcgaguacug

SEQ ID NO: 315787 - RNA, 64 nt, hsa
aagcaccuccgguuggaggcacccaggcuugccagccacagagcgccccaaagucaccgucauc

SEQ ID NO: 315788 - RNA, 64 nt, hsa; identical to SEQ ID NO: 311016

SEQ ID NO: 315789 - RNA, 64 nt, hsa; identical to SEQ ID NO: 311017

SEQ ID NO: 315790 - RNA, 64 nt, hsa; identical to SEQ ID NO: 311018

SEQ ID NO: 315791 - RNA, 64 nt, hsa; identical to SEQ ID NO: 311019

SEQ ID NO: 315792 - RNA, 64 nt, hsa; identical to SEQ ID NO: 311020

SEQ ID NO: 315793 - RNA, 64 nt, hsa; identical to SEQ ID NO: 311021

SEQ ID NO: 315794 - RNA, 64 nt, hsa; identical to SEQ ID NO: 311022

SEQ ID NO: 315795 - RNA, 64 nt, hsa; identical to SEQ ID NO: 311023

SEQ ID NO: 315796 - RNA, 64 nt, hsa; identical to SEQ ID NO: 311024

SEQ ID NO: 315797 - RNA, 64 nt, hsa; identical to SEQ ID NO: 311025

SEQ ID NO: 315798 - RNA, 64 nt, hsa; identical to SEQ ID NO: 311026

SEQ ID NO: 315799 - RNA, 64 nt, hsa; identical to SEQ ID NO: 311027

SEQ ID NO: 315800 - RNA, 64 nt, hsa; identical to SEQ ID NO: 311028

SEQ ID NO: 315801 - RNA, 64 nt, hsa; identical to SEQ ID NO: 311029

SEQ ID NO: 315802 - RNA, 64 nt, hsa; identical to SEQ ID NO: 311030

SEQ ID NO: 315803 - RNA, 64 nt, hsa; identical to SEQ ID NO: 311031

SEQ ID NO: 315804 - RNA, 64 nt, hsa; identical to SEQ ID NO: 311032

SEQ ID NO: 315805 - RNA, 64 nt, hsa; identical to SEQ ID NO: 311033

SEQ ID NO: 315806 - RNA, 64 nt, hsa; identical to SEQ ID NO: 311034

SEQ ID NO: 315807 - RNA, 64 nt, hsa; identical to SEQ ID NO: 250930

SEQ ID NO: 315808 - RNA, 64 nt, hsa; identical to SEQ ID NO: 250931

SEQ ID NO: 315809 - RNA, 64 nt, hsa; identical to SEQ ID NO: 250932

SEQ ID NO: 315810 - RNA, 64 nt, hsa; identical to SEQ ID NO: 250933

SEQ ID NO: 315811 - RNA, 64 nt, hsa; identical to SEQ ID NO: 250934

SEQ ID NO: 315812 - RNA, 64 nt, hsa; identical to SEQ ID NO: 250935

SEQ ID NO: 315813 - RNA, 64 nt, hsa
cagugugcacaucaugugcagacaccuuggaaaccuuucccaagccuuccuggcccacaguggc

SEQ ID NO: 315814 - RNA, 64 nt, hsa
cugcccuccagcaauacaugugcagggguugcugcuuucccagugccaggagaacccccgcucc

SEQ ID NO: 315815 - RNA, 64 nt, hsa
agcucccuuggauacuauauuguaugauuucuuccuuucccacuaauaugcacauccagaaaaa

SEQ ID NO: 315816 - RNA, 64 nt, hsa
agucaacaagcuuaggcagcauugauuuaggucacuuucccagugaggaaaauuucuguguuuu

SEQ ID NO: 315817 - RNA, 64 nt, hsa
cuggggaagggugcaggcgggaagagugggcugucuuucccagggugaugcaagcaugccgcag

SEQ ID NO: 315818 - RNA, 64 nt, hsa
cgggugugcccagaggcaagaggguugggugguucuuucccagccuacagaacaauggccauuc

SEQ ID NO: 315819 - RNA, 64 nt, hsa
ccagaccagcccucucaccacacccagaagaggccuuucccaucuggagagaagcuuccagacc

SEQ ID NO: 315820 - RNA, 64 nt, hsa
gaccagcccuucacacaccacagccaggaggggccuuucccaccuggagagaaacuuccagacc

SEQ ID NO: 315821 - RNA, 64 nt, hsa
cagaccauccccucucaccacagccaggagaggccuuucccaccgguagagaaacuuccagacc

SEQ ID NO: 315822 - RNA, 64 nt, hsa
gacaagccucucacacaccacagccaggagaggccuuucccaccuggacagaaacuuccagacc

SEQ ID NO: 315823 - RNA, 64 nt, hsa
cagaccagccccucacaccacagccaggagaggccuuucccaccuggagagaaacuuccagacc

SEQ ID NO: 315824 - RNA, 64 nt, hsa
cagaccagccccucacaccaccgccaggagaggccuuucccaccgggagagaaacuuccagacc

SEQ ID NO: 315825 - RNA, 64 nt, hsa
cagaccagccccucacaccacagccaggagaggccuuucccaccgggagagaaacuuccagacc

SEQ ID NO: 315826 - RNA, 64 nt, hsa
ccagaccagcccucucacuacagccagaagaggccuuucccaccgggagaggaacuuccagacc

SEQ ID NO: 315827 - RNA, 64 nt, hsa
cagaccagcccuucacaccacagccaggagaggccuuucccaccuggagagaaacuuccagacc

SEQ ID NO: 315828 - RNA, 64 nt, hsa
ccucuuucacagcccuuuuaaaguucuaucuucccuuucccaccuuuuuugaccuuccacuaga

SEQ ID NO: 315829 - RNA, 64 nt, hsa
gaugaggaaacugaagcucaaagaggcucaaugacuuucccaagguggucguagugguggaguu

SEQ ID NO: 315830 - RNA, 64 nt, hsa
ccccauacccaugagcagucaguucccaccucugcuuucccaagccugcgguaaacacuaaucu

SEQ ID NO: 315831 - RNA, 64 nt, hsa
ggugacuggagcaaagcugcugugagagaguguccuuucccaucugugacuuuccuggugcauc

SEQ ID NO: 315832 - RNA, 64 nt, hsa
uuuaaucuuucacaugagggggagaugagcuguucuuucccacuaaaaauugcugcuguagaag

SEQ ID NO: 315833 - RNA, 64 nt, hsa
guuaagcccugggaagacguucuggauaguucuucuuucccaaccagggcucaugucugauucu

SEQ ID NO: 315834 - RNA, 64 nt, hsa
aucaccgugggcucccugacugggaguugaucgccuuucccaggugcuacacccuuuuccagcu

SEQ ID NO: 315835 - RNA, 64 nt, hsa
guccacaaaauaaccaauccuggacaugaagauucuuucccaauucacaucuaaccucaucuuc

SEQ ID NO: 315836 - RNA, 64 nt, hsa
gaagugccuuuugccucccaccaugauucugaggcuuucccagccauguggaacuguaagucca

SEQ ID NO: 315837 - RNA, 64 nt, hsa
auuaaaguauauuauguaugucuuuaacuucuuucuuucccauugauaaacuggcacccuucuu

SEQ ID NO: 315838 - RNA, 64 nt, hsa
uccacagaaauaaguugccauccucagguuggcccuuucccaagcacuguaagugaguggguca

SEQ ID NO: 315839 - RNA, 64 nt, hsa
ccuuuucuuccuuuccccugucuucaugccacugcuuucccaugcuucuuucggguuguagggg

SEQ ID NO: 315840 - RNA, 64 nt, hsa
gaggcaggcaagccguggauuuugcacauggugacuuucccacugugccaugauacagucugca

SEQ ID NO: 315841 - RNA, 64 nt, hsa
aguagauacagucuucaggacaccauuagaugggcuuucccaauaggccaaaaaaaugcugcgc

SEQ ID NO: 315842 - RNA, 64 nt, hsa
gaccggccagguuagccucuccccucuuggccuccuuucccacacgggcagaucaucagccuuc

SEQ ID NO: 315843 - RNA, 64 nt, hsa
uuucugccuccucuuccacacauccugggucagccuuucccaagugauacugccccuggggugu

SEQ ID NO: 315844 - RNA, 64 nt, hsa
uaugcgaaguaugguuucuacugaauguguauugcuuucccaucaucauaaaauuuuuaaaaau

SEQ ID NO: 315845 - RNA, 64 nt, hsa
uuuagauuguaaugauuaacagaaacagggguaccuuucccagggguguccaccagaagaguug

SEQ ID NO: 315846 - RNA, 64 nt, hsa
uaggaaaagauucaaagcucuaauagagucacagcuuucccagguauaaaaccuaaaauuaaga

SEQ ID NO: 315847 - RNA, 64 nt, hsa
gacugucccauucuccacucacugcauuuggggccuuucccauuggucugcaugucuuuuauca

SEQ ID NO: 315848 - RNA, 64 nt, hsa
agaagaaagagaagaaaugaagugaccauccagccuuucccaauuagacuuccucuccuuccac

SEQ ID NO: 315849 - RNA, 64 nt, hsa
gggaccagcagagggcgccaacuucaggaguccgcuuucccaccaggcuucauucacccagugg

SEQ ID NO: 315850 - RNA, 64 nt, hsa
uuucugcuuugccuucacaaaaguaauguguucccuuucccaccccuugccugacccucaggga

SEQ ID NO: 315851 - RNA, 64 nt, hsa
aaggaggucaggcaaaagggaggaguuuucuguccuuucccagguuucacacucaauuugauau

SEQ ID NO: 315852 - RNA, 64 nt, hsa
cccauggcccugaaacacacacauuucccccuuccuuucccagaagccacuggccccccauagc

SEQ ID NO: 315853 - RNA, 64 nt, hsa
cuuaugguauguagccagcugugcacuuucuucucuuucccaaccccaggaaagguuuuccuua

SEQ ID NO: 315854 - RNA, 64 nt, hsa
ccaaccccaggaaagguuuuccuuauuuugugugcuuucccagucccauuccucagcuucuuca

SEQ ID NO: 315855 - RNA, 64 nt, hsa
guugguuaauuagaucuggggcccgaugaccucccuuucccacugcuacagcccuuuugacuuc

SEQ ID NO: 315856 - RNA, 64 nt, hsa
ccucuccagacuaauguuccugucaccugcugagcuuucccagugucacuucugcaguccuccu

SEQ ID NO: 315857 - RNA, 64 nt, hsa
ucccugccccuggcuuccucuuccauguucugcccuuucccacaccuuuguuccucaauagcug

SEQ ID NO: 315858 - RNA, 64 nt, hsa
ucccugccccuggcuuccucuuccauguucugcccuuucccacauguuggaggcuuuuccaacg

SEQ ID NO: 315859 - RNA, 64 nt, hsa
agucuuucccacgguuuaugugugugccucauuccuuucccaccaagaauccaucuuagcgccu

SEQ ID NO: 315860 - RNA, 64 nt, hsa
aucccucuucuggcuugggcccugacaccuaagucuuucccacgguuuaugugugugccucauu

SEQ ID NO: 315861 - RNA, 64 nt, hsa
cugcugaagaaccagaaaaaagaaagcacaacaccuuucccaugccuccucuggagccuucgcc

SEQ ID NO: 315862 - RNA, 64 nt, hsa
ucuucucaauagcccauugacuuagaaacuguuacuuucccauuuuacacacagugaaacugag

SEQ ID NO: 315863 - RNA, 64 nt, hsa
ucugggcaccauugcuccagacguguuccgaccccuuucccagcccacagggcuugaagugaag

SEQ ID NO: 315864 - RNA, 64 nt, hsa
cuggcccagccccaccucagucuccaggacauuccuuucccagcuccagccuggagggaagggg

SEQ ID NO: 315865 - RNA, 64 nt, hsa
aacuuugaugauucuauguccagcuucagagcugcuuucccagaaauucacgcuuaaacaacca

SEQ ID NO: 315866 - RNA, 64 nt, hsa
aggugugacauggucagggggcccaucugcuacucuuucccaccagcuccccuguuccaguucu

SEQ ID NO: 315867 - RNA, 64 nt, hsa
agccuggguccccuccucccaauagaggcugagccggagccagggcaguaugagguggggcugc

SEQ ID NO: 315868 - RNA, 64 nt, hsa
gccccagagaugaaggggcagcuuugcaaggauccggagccagcucccaggggcccagagcccc

SEQ ID NO: 315869 - RNA, 62 nt, hsa
uaaguguacagugggcuugcauuggggauggggguguguacagaugaagucaguggcuuguc

SEQ ID NO: 315870 - RNA, 62 nt, hsa
ugcuagagauaaacuuuccaauuuuuaagcuugguguguacccagggaaguuaucuugguau

SEQ ID NO: 315871 - RNA, 62 nt, hsa
gugugaggaugaaauaaugaccuugauuuuuggguguguauugcagaagccucgucgcuuuc

SEQ ID NO: 315872 - RNA, 62 nt, hsa
acaagaaagcaaguacaguguggauuucaaaugguguguaacuucagcuccagcugguuuuu

SEQ ID NO: 315873 - RNA, 62 nt, hsa
guuauaugggaauuaaaauauguuuaggcagggguguguaaaaagguuaaguuuuuguuucu

SEQ ID NO: 315874 - RNA, 62 nt, hsa
ggcauccagcagccacuaacaaacacacaacugguguguaaaaggcaggccuuacauuagaa

SEQ ID NO: 315875 - RNA, 62 nt, hsa
acaagauauuuggggaauaaaaauaacagcuugguguguagcaucugcagccacuuggcaaa

SEQ ID NO: 315876 - RNA, 62 nt, hsa
uguaugggugugugugggugggugugaguguggguguguacguaccaauaaacaaccugguu

SEQ ID NO: 315877 - RNA, 62 nt, hsa
uucccuccaugcugucgucaucgacauauacagguguguacguagguguauguguguacucu

SEQ ID NO: 315878 - RNA, 62 nt, hsa
gaccccuccccgccacgaucgucgcugugcuugguguguaggacccuaggcuccccgcccac

SEQ ID NO: 315879 - RNA, 62 nt, hsa
gcauagggaccagucuacuacccacugggccugguguguagagggggagaggguagcaaggu

SEQ ID NO: 315880 - RNA, 62 nt, hsa
gaaggguuccuaacccaaccuacuccccuuaggguguguauccaacccagugcuuccuaaga

SEQ ID NO: 315881 - RNA, 62 nt, hsa
auagacuugcugaugugcauguggggggaugagguguguauaugccuuucuccugacuggcc

SEQ ID NO: 315882 - RNA, 62 nt, hsa
gugacuguccguggaggggugacuguguccgugguguguauuaugcugucauaucagaguca

SEQ ID NO: 315883 - RNA, 62 nt, hsa
augcagccuaaaguacagccuggaccaccccugguguguagcuaguaagauuacccugagcu

SEQ ID NO: 315884 - RNA, 62 nt, hsa
ggagggugugggugugcgugugugcaugugcugguguguaagggggaaagggucuuuccugg

SEQ ID NO: 315885 - RNA, 62 nt, hsa
gaccccacccugagguccugcauuucucagucgguguguaaucacguuccagggcccaaagc

SEQ ID NO: 315886 - RNA, 62 nt, hsa
auugugcagaauauucuaagaggucagaaauugguguguauaacuacauuuuuagugaugca

SEQ ID NO: 315887 - RNA, 62 nt, hsa
ccugcugccucugacuacucagccuuguuuucgguguguaggccccagcugcccacuggaac

SEQ ID NO: 315888 - RNA, 62 nt, hsa
agcuggcugaggcaucgcucaagcuggggggugguguguaagaagcacguggagccacaaga

SEQ ID NO: 315889 - RNA, 62 nt, hsa
cuuucacuuucauuugcuggugugagccaugggguguguauuuguauguggggaguaggugu

SEQ ID NO: 315890 - RNA, 62 nt, hsa
auaguugaaacuguagaaagggucagguuggagguguguaauaaaaaagaauuaccuagguu

SEQ ID NO: 315891 - RNA, 62 nt, hsa
gucuuccacuucaaugcacauggugcaguuuugguguguaacuuagaaggauugaacuucuu

SEQ ID NO: 315892 - RNA, 62 nt, hsa
uuuuaaaucuuuuuuuaacuaauaagauuuacgguguguauuuuauacagaaaugcauuaua

SEQ ID NO: 315893 - RNA, 62 nt, hsa
gcaauugccugccuuguacuuuaugggcuugggguguguagaaugauuuugcgggggagugg

SEQ ID NO: 315894 - RNA, 62 nt, hsa
guuguggccccugcaggggcagaguauccuaggguguguauccaucuggcugucuguccauu

SEQ ID NO: 315895 - RNA, 62 nt, hsa
uguggaaacccuucucccugugccuuagagcagguguguacaucucucacuaccuuucucau

SEQ ID NO: 315896 - RNA, 62 nt, hsa
cauuauuuuuuuuuggcugaguaguauucugugguguguauguguguguguguaugcauaua

SEQ ID NO: 315897 - RNA, 62 nt, hsa
uuuuauagaaguuugaaaauuuaaugcaggcagguguguaauaaauuauuuuugaauugaac

SEQ ID NO: 315898 - RNA, 62 nt, hsa
agaaggguaccaguaauacacuaaauuuucaagguguguagagaaauaauauggaauuagca

SEQ ID NO: 315899 - RNA, 62 nt, hsa
uuugaaaguuuacauuuuuuaugcuuuguguugguguguaauuuuuguacucuugguggcua

SEQ ID NO: 315900 - RNA, 62 nt, hsa
agucguaggccuuaugauaauuaccccgcggugguguguagaaaaguauguaaauuugcucu

SEQ ID NO: 315901 - RNA, 62 nt, hsa
uauuuucuuuaguuuaaucuuggucauguuuugguguguauuuuuaauuuuuuucuuaaauu

SEQ ID NO: 315902 - RNA, 62 nt, hsa
uacuaaaaauacaaaaauuagcuggguguggugguguguaccuguagucccagcuacccagg

SEQ ID NO: 315903 - RNA, 62 nt, hsa
aggugagccgaagaucaauucgacagacagaugguguguaugccccucccuguuugacuuca

SEQ ID NO: 315904 - RNA, 62 nt, hsa
uaaaauuuguaagguugccccuuuguggcacugguguguaaaauacacagacuaucacuaaa

SEQ ID NO: 315905 - RNA, 62 nt, hsa
acuggauucccacaguaauauagacugugcaugguguguauauuucauugcgauuuccuguu

SEQ ID NO: 315906 - RNA, 62 nt, hsa
uggucaauucagaagaaagugucucugccauagguguguauguguauaugugugcguguggu

SEQ ID NO: 315907 - RNA, 62 nt, hsa
gugccuaagccuccugaguagcugggaucacagguguguaccaccacgcccagcugauuuuu

SEQ ID NO: 315908 - RNA, 62 nt, hsa
uacuuuuagcuucauucucccauauuuugaaggguguguaacuucagcucugcaggauugca

SEQ ID NO: 315909 - RNA, 62 nt, hsa
cuugagcagauccagggaucagugagaggagugguguguaccccuaaauccucccaccccag

SEQ ID NO: 315910 - RNA, 62 nt, hsa
uauaaggaaaaaaaauagccugccuugggacagguguguaauguuagugugcaugacuaaug

SEQ ID NO: 315911 - RNA, 62 nt, hsa
uauauuuggaaacucuuggugagagaaugaaugguguguauacauacucuguacauuuuucu

SEQ ID NO: 315912 - RNA, 62 nt, hsa
aacccuaauugaugagaggcucgcugcuugaugguguguacaaacucaccugaaugggacuu

SEQ ID NO: 315913 - RNA, 62 nt, hsa
agcucccagggaaaaacgaagugcauuugauugguguguauuggccaaguuuugcuuguugu

SEQ ID NO: 315914 - RNA, 62 nt, hsa
uagacugauuacacugaggugaggcuacaagggguguguaaccguguaacacgugaaggcaa

SEQ ID NO: 315915 - RNA, 62 nt, hsa
cuggccccuuugguuuccgugucauccuuuuugguguguaggacaaggagccagggaauugg

SEQ ID NO: 315916 - RNA, 62 nt, hsa
ugagguuagggugaggggucaggguuuaggaggguguguauguugggaggacaggcuaguug

SEQ ID NO: 315917 - RNA, 62 nt, hsa
auaguaaaacuagccuuucacauuaagguuuugguguguauuuuguuaaauaacuaacaugc

SEQ ID NO: 315918 - RNA, 62 nt, hsa
cuacagcagaaguucugagccugaccacagaugguguguaaucuaucaaacacaccccuggc

SEQ ID NO: 315919 - RNA, 62 nt, hsa
uuauaccugagcccaguacaacaaaggugacggguguguagguacacacccagagauggagc

SEQ ID NO: 315920 - RNA, 62 nt, hsa
uuuucuucuguuuuuauugaggguggggguuggguguguaauuuguaaguacuuuugugcau

SEQ ID NO: 315921 - RNA, 62 nt, hsa
uacuuggcaugaaagggugcccuggauaggaggguguguacagggcaaaaugccaaaaagca

SEQ ID NO: 315922 - RNA, 62 nt, hsa
uuugugaauuaucugcaugugugcuuuuuuuugguguguauuucauuaaaaaauauaaauau

SEQ ID NO: 315923 - RNA, 62 nt, hsa
agaggaugcucacuguaagacuguuggacagugguguguauugaggggaugaaucggaacga

SEQ ID NO: 315924 - RNA, 62 nt, hsa
auucucuuuuucauacuaagcuuucgaaaucugguguguauuuuacacuuucugcacaucuc

SEQ ID NO: 315925 - RNA, 62 nt, hsa
agaaagcuguuuaagaaggccaugacucuuuagguguguauguguaccuuucagcauccuag

SEQ ID NO: 315926 - RNA, 62 nt, hsa
uuuugaccuguucagugucugucuuccagcacgguguguacacuucuucaaaauuguacaca

SEQ ID NO: 315927 - RNA, 62 nt, hsa
cauggauuaguuuuccugacaaagcauguuuugguguguagucuuacuuuuuagaaauagcu

SEQ ID NO: 315928 - RNA, 62 nt, hsa
gucaaagauguguucaggcauuccagguaacagguguguauguaaaguuaaaaauaggcuuu

SEQ ID NO: 315929 - RNA, 62 nt, hsa
ucaagaagaaaguuguauaagcuauugauaaggguguguaucuuaauguuguugaguuuugu

SEQ ID NO: 315930 - RNA, 62 nt, hsa
agcccuucuuuccacagaagcuccagguagaggguguguaaguagauaggccaugggcacug

SEQ ID NO: 315931 - RNA, 62 nt, hsa
cagcaguugaaggaagagagugcauggcaccugguguguaacgacacaaucagcacaacugg

SEQ ID NO: 315932 - RNA, 62 nt, hsa
acacuggacaggguucucuaagcagugaggcugguguguaugauugucuuaaaauuuuuuaa

SEQ ID NO: 315933 - RNA, 62 nt, hsa
acacauccccaggcaggacagaucggggaagggguguguaccaggcuaugauuucucuugca

SEQ ID NO: 315934 - RNA, 62 nt, hsa
uauuacauuguacagaaucuguacuuauguuugguguguaauauaccaauuaguuuuauaua

SEQ ID NO: 315935 - RNA, 62 nt, hsa
aaaaaaagaaaaaagaaaaagccgggugaggugguguguaccuguagucacagguacuuggg

SEQ ID NO: 315936 - RNA, 62 nt, hsa
cugcaccaacacugucguauccuuguuaaaaugguguguaccuuacaaauuauaauuuaugu

SEQ ID NO: 315937 - RNA, 62 nt, hsa
gcagggagcugcgccuuccuggggugcccggugguguguagagaaaagcugcuuguuuacuc

SEQ ID NO: 315938 - RNA, 62 nt, hsa
aaaucuucuauuguguggaaaauguugugaaggguguguaggugugguacauguguauguca

SEQ ID NO: 315939 - RNA, 62 nt, hsa
uuacgagaaaaagaaggggaaugguggggaaugguguguaccgauauauaguauuucuuuag

SEQ ID NO: 315940 - RNA, 62 nt, hsa
ccagggacauggacuuggguguucuuauuuaugguguguauguaaagagauaggggagaaaa

SEQ ID NO: 315941 - RNA, 62 nt, hsa
caauggaacaaaacucaucuggcugcaucccagguguguagcaaaguccacauguaaauuua

SEQ ID NO: 315942 - RNA, 62 nt, hsa
ggggccugggcuguggacagaaggaugucccggguguguacaccaagguuaccaacuaccua

SEQ ID NO: 315943 - RNA, 62 nt, hsa
aaagguaauauaauuuuagguuuaccaaauaugguguguauucaaauaauacuugaccagcu

SEQ ID NO: 315944 - RNA, 62 nt, hsa
gucaguauuuuuccuuuuuaaccauuccaaucgguguguagugauguuucauuuugguuuua

SEQ ID NO: 315945 - RNA, 62 nt, hsa
ccagaguugggagauaagauaguuuccaugaagguguguauguuuuauacgauguuuguuau

SEQ ID NO: 315946 - RNA, 62 nt, hsa
aggagucccuaacuuucuuaucccaugagagagguguguaaaggagaaagcuagaggugaac

SEQ ID NO: 315947 - RNA, 62 nt, hsa
gaaaucuuuauuaauguuuagauuuuucauuugguguguaagaaaauauucuuuguaugauu

SEQ ID NO: 315948 - RNA, 62 nt, hsa
gauaguugacuuucuaucuuuuggcauucuuugguguguagaauuacuguaauacuucugca

SEQ ID NO: 315949 - RNA, 62 nt, hsa
uccaucugugcauaaggagaggaaaguuccaggguguguauguuucaggggcuucacaugga

SEQ ID NO: 315950 - RNA, 62 nt, hsa
caggauaauagguuuuucauaaagaaacguaggguguguaugugaaaguggggugagguucc

SEQ ID NO: 315951 - RNA, 62 nt, hsa
cagaggaggugcuggcggccccagggaaggaggguguguaccccaaggcccccuggcugugc

SEQ ID NO: 315952 - RNA, 62 nt, hsa
cuugaaugcugguacuauugugaccacaggcugguguguaggugguaaaaccuguucuccau

SEQ ID NO: 315953 - RNA, 62 nt, hsa
guuagccuugcuggggccauaauaugcuucaggguguguaaaagaagaaaucucuuuguggc

SEQ ID NO: 315954 - RNA, 62 nt, hsa; identical to SEQ ID NO: 315953

SEQ ID NO: 315955 - RNA, 62 nt, hsa
gcauuuuguuaaugcacauucuguuuguuuaagguguguaagauacacacccuucuagauga

SEQ ID NO: 315956 - RNA, 62 nt, hsa
uugcugauugcauuuccucucauuaacaauuggguguguaauaaaaagcauuguacuucauc

SEQ ID NO: 315957 - RNA, 62 nt, hsa
cagcccauuagguuaaacaccaaagaaagacugguguguacugaauaggaaagggaaguuuu

SEQ ID NO: 315958 - RNA, 62 nt, hsa
ucuaguuugcacauccagaacggcgaaggcuggguguguauuccacuaacugaaauauggca

SEQ ID NO: 315959 - RNA, 62 nt, hsa
agauaccagauuugauauaauguuguaacauagguguguagauaguggauccuggauggaac

SEQ ID NO: 315960 - RNA, 62 nt, hsa
aaacuuaacauucuuguaauagaaaccagcaggguguguacacuuuugugugugugcgcagg

SEQ ID NO: 315961 - RNA, 62 nt, hsa
gccugcugagcucugguuagguuacagcuggagguguguauauauacacacacacacaugua

SEQ ID NO: 315962 - RNA, 62 nt, hsa
gccuuuaaagauacagugugaaaauuugcucggguguguagcaguaauuacacgaggcaaac

SEQ ID NO: 315963 - RNA, 62 nt, hsa
ggacaggugaauaccugcuccucgccuggauggguguguauuuugaucugcauugacaccag

SEQ ID NO: 315964 - RNA, 62 nt, hsa
uguaaaacuugaagccauaaaaauauuaguuugguguguauuggggaaaauagcuaaaaguc

SEQ ID NO: 315965 - RNA, 62 nt, hsa
gccuguguugugcaaaagaauuggaaggaugugguguguaccuguagccugaagaacuggag

SEQ ID NO: 315966 - RNA, 62 nt, hsa
ucuuccuaauaucaggcgccuacuuaaccuaugguguguacuuuuuguaaguuguaacuuga

SEQ ID NO: 315967 - RNA, 62 nt, hsa
gcaggugggcuggacuucuaccugcccucaaggguguguauauuguauaggggcaacuguau

SEQ ID NO: 315968 - RNA, 62 nt, hsa
gcgccugcugcugugacccguuuuggaaaacugguguguaccgaggcgcugacugcacggcu

SEQ ID NO: 315969 - RNA, 62 nt, hsa
augacagcuuuccuucacacacuauuuuuguggguguguauauaucugauuugggaagaauu

SEQ ID NO: 315970 - RNA, 62 nt, hsa
uggaggccaguguuggggagccuguggaggcagguguguagaauuguguucgggaggugggg

SEQ ID NO: 315971 - RNA, 62 nt, hsa
gauucugugccaucugaacaugcucuccuguugguguguaugucacuagggcaguggggaga

SEQ ID NO: 315972 - RNA, 62 nt, hsa
cucuguggcaaagcgugucccauagaaaauuggguguguauacuuguauaacuuuguaaaua

SEQ ID NO: 315973 - RNA, 62 nt, hsa
gcauacauauguguguauauaugguuuugucagguguguaaauuugcaaauuguuuccuuua

SEQ ID NO: 315974 - RNA, 62 nt, hsa
gauguguaauccaguaaaaucucccuuuuucggguguguaugugggcaugugcccauuucua

SEQ ID NO: 315975 - RNA, 62 nt, hsa
uuauucugaagaauaaaccuagcuggcaugcugguguguaccuguaguccuagcuauuuggg

SEQ ID NO: 315976 - RNA, 62 nt, hsa
gcauaaugaauauaauuuacccaguggacaaagguguguaccaagugaauuuaaauaauugg

SEQ ID NO: 315977 - RNA, 62 nt, hsa
ugugacgucgggcauucauauaggaagaacgcgguguguaacacuguguacaccucaaauac

SEQ ID NO: 315978 - RNA, 62 nt, hsa
uacugcgucuguccacacucgauugggccccagguguguaugaggcgcucugguaaggugcu

SEQ ID NO: 315979 - RNA, 62 nt, hsa
uaugucuuuauuccuuauuucacaauguauuugguguguaggggaggggggagaacuaaaug

SEQ ID NO: 315980 - RNA, 62 nt, hsa
gaacaaaaaugggaggagguguccacauuuaugguguguauagguaacauggggaaaaugcu

SEQ ID NO: 315981 - RNA, 62 nt, hsa
gccccuaugugggauuuuuuaaaaagcaaacugguguguauucucaugugguuugcacagcc

SEQ ID NO: 315982 - RNA, 62 nt, hsa
cuuguguuguguguuucugucugaggacaguggguguguacuggccucccgggagccacugu

SEQ ID NO: 315983 - RNA, 62 nt, hsa
ggacaucucuuccagaguuaucccacuggcuugguguguauacauuaggggaggauaaucug

SEQ ID NO: 315984 - RNA, 62 nt, hsa
guccuguguauguguggguguguguguauuuggguguguaaauguugguucuuccacuacug

SEQ ID NO: 315985 - RNA, 62 nt, hsa
gguagggggcacagaacaccagaaagaguguugguguguagguagauuccauauuaaugagg

SEQ ID NO: 315986 - RNA, 62 nt, hsa
agcccuuuccccuagacaucuacccaaaugcagguguguagguugagucuuuaacaaaguga

SEQ ID NO: 315987 - RNA, 62 nt, hsa
gcugugaggagugagugagacaggacaugaaagguguguaugaacugugauaacuguugccc

SEQ ID NO: 315988 - RNA, 62 nt, hsa
aucuuccaaggaaaaacauaauucuuucaaacgguguguauuuggcaaagagcucuucaaau

SEQ ID NO: 315989 - RNA, 62 nt, hsa
cuguugguuugaaguguuagacuauagccccugguguguaaauaauguacauagagugagaa

SEQ ID NO: 315990 - RNA, 62 nt, hsa
auauugaugauaguugaaauauucuuagaagggguguguaugucuagcugugucuaccaugu

SEQ ID NO: 315991 - RNA, 62 nt, hsa
agaaggagaugaaggaguguguguagcauggggguguguacaacuuaacaccuggacuuuua

SEQ ID NO: 315992 - RNA, 62 nt, hsa
cacuggggggguuggggugggcuuggaacacagguguguacagcgugcuguaguggaaguuu

SEQ ID NO: 315993 - RNA, 62 nt, hsa
gcuuucaagcaaaaugccugggcuugggggaagguguguaucuguccauguguggauguugg

SEQ ID NO: 315994 - RNA, 62 nt, hsa
agaauuaauagcccuuagcaacgacugcugcugguguguauuuuuguaaauguuaugcacuc

SEQ ID NO: 315995 - RNA, 62 nt, hsa
cugccagccucucacaucuugcacacuuuuuggguguguaaaugacacaaaaguuauuuaca

SEQ ID NO: 315996 - RNA, 62 nt, hsa
uaccaaaaauacaaaauguauccagacauggugguguguaccuguagucccagcuacucagg

SEQ ID NO: 315997 - RNA, 62 nt, hsa
acagcuugugcugcuugcacaacugagcugcugguguguaccccuuagcagggugucugggg

SEQ ID NO: 315998 - RNA, 62 nt, hsa
uuaccucuucuuggucagaauucuauucucaggguguguaccaugauuugucugcuaagaag

SEQ ID NO: 315999 - RNA, 62 nt, hsa
gggcaucugaauacaggaguaggggggguguggguguguaaccagagaccgagagcaugagu

SEQ ID NO: 316000 - RNA, 62 nt, hsa
aagugcucccuucccagaggaggggccccaucgguguguaagguggccuauuccucugugug

SEQ ID NO: 316001 - RNA, 62 nt, hsa
caccuggggggcccuuccccagcauaccugcugguguguaaguguggacuaacccgccgcca

SEQ ID NO: 316002 - RNA, 62 nt, hsa
gugguggccuguuugaaaguaaaaaccugcuugguguguagguuccguaucucccuggagaa

SEQ ID NO: 316003 - RNA, 62 nt, hsa
aaucuucugcuaauggugaugugaauucuuaggguguguacguacgcagccuccagggcacc

SEQ ID NO: 316004 - RNA, 62 nt, hsa
cagacagagugaagcuggcuggggggcacagugguguguagugcugcuguguaucaaaagac

SEQ ID NO: 316005 - RNA, 62 nt, hsa
gggaugguggagugagagccuuugccuuuagggguguguauucacauaguccucagggcuca

SEQ ID NO: 316006 - RNA, 62 nt, hsa
auagugucgggcuuccggggaaagcaaucauugguguguauguguaugugcaugcacacacg

SEQ ID NO: 316007 - RNA, 62 nt, hsa
ccaccucagccgccgaaguagcugggacuauagguguguaccaucacaccuggcuaauuuuu

SEQ ID NO: 316008 - RNA, 62 nt, hsa
gaagugagcgcugggaacagaguggagucuccgguguguaccucagacugauggugcccaug

SEQ ID NO: 316009 - RNA, 62 nt, hsa
aggcacggggaagguuuuggaguagaaccagggguguguaugaaggggggugacaagguccc

SEQ ID NO: 316010 - RNA, 62 nt, hsa
gguaccccccaaccuccaggagcuaguggagggguguguaacagggucauacccccucccuc

SEQ ID NO: 316011 - RNA, 62 nt, hsa
guugaccucugguucagccaaggaccaaagaagguguguaagugaagugguucucagucccc

SEQ ID NO: 316012 - RNA, 62 nt, hsa
uucuccaauuuggcugggauuauucaaaguaggguguguauguaacuuaucacuggaccacu

SEQ ID NO: 316013 - RNA, 62 nt, hsa
aguguguggaugcgugugaacgcaugugguaagguguguacucagggcauucuguuggccua

SEQ ID NO: 316014 - RNA, 62 nt, hsa
uccuccucucagccugaguaacugggacuacagguguguaccacuacauccagcuaaaggag

SEQ ID NO: 316015 - RNA, 62 nt, hsa
aaggggguguguguaguguguguugggugugggguguguacaccuggcaucuguggcaugug

SEQ ID NO: 316016 - RNA, 62 nt, hsa
uaaugccuguccugccucuggccuguguccuggguguguaccauaccugcugggccaguccc

SEQ ID NO: 316017 - RNA, 62 nt, hsa
aagcaguacuagaaacuuuccaaggagucuuggguguguagccaagaggagccaugagcuau

SEQ ID NO: 316018 - RNA, 62 nt, hsa
ccugugugcucacccacagagcaugggguaaugguguguagacacaggcccucugcagaagc

SEQ ID NO: 316019 - RNA, 62 nt, hsa
gguugaauaguucuauacaaaugaaguauggagguguguauguuuauauguauauaacaaaa

SEQ ID NO: 316020 - RNA, 62 nt, hsa
ucugugaaagcaacaugaaaugaacuguaguagguguguaguuuggggaagucaaauggcca

SEQ ID NO: 316021 - RNA, 62 nt, hsa
uuuuuuagcaagauugaccaaaacaggugguagguguguaauuuuuaacugucaugaaauac

SEQ ID NO: 316022 - RNA, 62 nt, hsa
caacauuauuaagacacagcugagaguugauggguguguaaugcauaugccaaggaaauguc

SEQ ID NO: 316023 - RNA, 62 nt, hsa
acgcuaauaaaauguguugcgaggcugacgcugguguguaugcgagcgcccgccucccagcc

SEQ ID NO: 316024 - RNA, 62 nt, hsa
acugcuuuucucagccccaagccucuagucuggguguguacggagggucuagccugggugug

SEQ ID NO: 316025 - RNA, 62 nt, hsa
cuagucuggguguguacggagggucuagccuggguguguacggagggucuagccugggugag

SEQ ID NO: 316026 - RNA, 62 nt, hsa
cuagccugggugaguacggagggucuagccuggguguguauggaggaucuagccugggugag

SEQ ID NO: 316027 - RNA, 62 nt, hsa
cuagccugggugaguauggagggucuagccuggguguguauggagggucuagccugggugag

SEQ ID NO: 316028 - RNA, 62 nt, hsa; identical to SEQ ID NO: 316027

SEQ ID NO: 316029 - RNA, 62 nt, hsa
cuagccugggugaguauggagggucuagccuggguguguacggagggucuagucugagugcg

SEQ ID NO: 316030 - RNA, 62 nt, hsa
gggcuggggggcaggcugaauguguguguguggguguguauguguggagugugugugugugu

SEQ ID NO: 316031 - RNA, 62 nt, hsa
cuugaaaaagaaacuuuagagaaagcaucagggguguguacucaguauuucaaaucagaaca

SEQ ID NO: 316032 - RNA, 62 nt, hsa
gagauggagguguaggcuggagagacauuguggguguguaucuucuuaucucauuucacaag

SEQ ID NO: 316033 - RNA, 62 nt, hsa
cagagccuugacuggauggagguggggagugugguguguaaagucucuggccucauaaaagg

SEQ ID NO: 316034 - RNA, 62 nt, hsa
cauuuucuauaauuuuauaaaugaaaccauaugguguguacuuuuuaggggguggggcucug

SEQ ID NO: 316035 - RNA, 62 nt, hsa
ccucagucccccuccagguauuugaaacuacagguguguaccaccacaccgggcuaauuuuu

SEQ ID NO: 316036 - RNA, 62 nt, hsa
augcaaacaugagcagaaaauauuuucccacugguguguagccugcuacaaggaguuguugg

SEQ ID NO: 316037 - RNA, 62 nt, hsa
aagcauggcuuuauuuucuuaauggaugucuugguguguaggagcaugcauuuguaggcacc

SEQ ID NO: 316038 - RNA, 62 nt, hsa
agaaacuuccaaacgcagugcccuguucugccgguguguacagccucagcgcaccaggagac

SEQ ID NO: 316039 - RNA, 62 nt, hsa
acgaggaaacauuauucauuggaaaagugcaugguguguauuuuagggauuaugagcuucuu

SEQ ID NO: 316040 - RNA, 62 nt, hsa
uuuuaaguccuguauauguauguaguaguuuggguguguauauauaguagcauuucaaaaug

SEQ ID NO: 316041 - RNA, 62 nt, hsa
aaccuguaagcccagcauuugagagaagguaggguguguauauauaaaagguuguguacaac

SEQ ID NO: 316042 - RNA, 62 nt, hsa
acagaaaaauuuuaaaauuagcugggcguggugguguguaccuguaggccuagcugcucagg

SEQ ID NO: 316043 - RNA, 62 nt, hsa
cugagcaagccaggaagggaaggagucugugugguguguaugugcaugcagccuacacccac

SEQ ID NO: 316044 - RNA, 62 nt, hsa
ucacauaaauauagcgagcucuacuaaguacagguguguauaauguaucagggaccauggcc

SEQ ID NO: 316045 - RNA, 62 nt, hsa
ucagcauggcggggcggggggcggggggcggggguguguaugggaaucccucccccucuuac

SEQ ID NO: 316046 - RNA, 62 nt, hsa
acaaggaggaugaaacgccggaacaaaaaugagguguguagaacagggucccacagguuugg

SEQ ID NO: 316047 - RNA, 62 nt, hsa
acaucugcuauuuccugugguguucugggcaugguguguaagacccacagaggcuccgggug

SEQ ID NO: 316048 - RNA, 62 nt, hsa
agccuaacauuguucaggcgcauggccccugcgguguguacacgaacucggcuucuuuuguc

SEQ ID NO: 316049 - RNA, 62 nt, hsa
cgggcaugagcagaggugagcgugagcgagcggguguguauguacgagugugcacgugugug

SEQ ID NO: 316050 - RNA, 62 nt, hsa
cccuagccuuuguccucaccuacccuaaggcagguguguaugcuugaauuccuuccguaugg

SEQ ID NO: 316051 - RNA, 62 nt, hsa
cccagccacgacugccauguaagguugugcaggguguguacugcacaaggacauuguaugca

SEQ ID NO: 316052 - RNA, 62 nt, hsa
augccggcuggaagaagaaccucgcaucuuuugguguguaugcaccuuggcagccagcagga

SEQ ID NO: 316053 - RNA, 62 nt, hsa
ucucuaagggcuuuacaaggaucaaauaagaugguguguauguaagaaauuuguaaaaugug

SEQ ID NO: 316054 - RNA, 62 nt, hsa
auguguguguguguguguguguguguguguaugguguguauuccauaucuauucccauguaa

SEQ ID NO: 316055 - RNA, 62 nt, hsa
uuuguuuguuucuuuuucaugguauuacugaagguguguauacucccuaauacacauuuaug

SEQ ID NO: 316056 - RNA, 62 nt, hsa
ccauggguuuuuuaaccccaaauuauccacaugguguguauuaugaauucuuugaacucuua

SEQ ID NO: 316057 - RNA, 62 nt, hsa
aagucaguuaugauugucuggagagaagcugugguguguaugcuguagaguuuccacauuuc

SEQ ID NO: 316058 - RNA, 62 nt, hsa
cuggguucauguuguaauaaaagaagauuguugguguguaauuaauuuguucaaaagaaaaa

SEQ ID NO: 316059 - RNA, 62 nt, hsa
auguaaucagauuuauuuaauuggguggggcagguguguauuuacuuuagaaaaaaugaaaa

SEQ ID NO: 316060 - RNA, 62 nt, hsa
ccaaguauagauuaaggcaacaaacauauuuggguguguaauuugaaguuuuggacugaaau

SEQ ID NO: 316061 - RNA, 62 nt, hsa
uuccccaguacuuuuagccaaccuuaccaagugguguguaaacuaguauguaugugcuuugc

SEQ ID NO: 316062 - RNA, 60 nt, hsa
gaguuucucuugagggcaauaaaaguugucaugguguguacguggugcggugugugacug

SEQ ID NO: 316063 - RNA, 62 nt, hsa
guaaauuguggacucaggauuuuuugaaacuugguguguaacucuaaaucuuguauaugcau

SEQ ID NO: 316064 - RNA, 62 nt, hsa; identical to SEQ ID NO: 316055

SEQ ID NO: 316065 - RNA, 62 nt, hsa
cuacuggcaucuguuaucuaguaugcauuucugguguguaucugaaaggaagacauuuucua

SEQ ID NO: 316066 - RNA, 63 nt, hsa
guaaguguacagugggcuugcauuggggauggggguguguacagaugaagucaguggcuuguc

SEQ ID NO: 316067 - RNA, 63 nt, hsa
augcuagagauaaacuuuccaauuuuuaagcuugguguguacccagggaaguuaucuugguau

SEQ ID NO: 316068 - RNA, 63 nt, hsa
ggugugaggaugaaauaaugaccuugauuuuuggguguguauugcagaagccucgucgcuuuc

SEQ ID NO: 316069 - RNA, 63 nt, hsa
cacaagaaagcaaguacaguguggauuucaaaugguguguaacuucagcuccagcugguuuuu

SEQ ID NO: 316070 - RNA, 63 nt, hsa
uguuauaugggaauuaaaauauguuuaggcagggguguguaaaaagguuaaguuuuuguuucu

SEQ ID NO: 316071 - RNA, 63 nt, hsa
uggcauccagcagccacuaacaaacacacaacugguguguaaaaggcaggccuuacauuagaa

SEQ ID NO: 316072 - RNA, 63 nt, hsa
cacaagauauuuggggaauaaaaauaacagcuugguguguagcaucugcagccacuuggcaaa

SEQ ID NO: 316073 - RNA, 63 nt, hsa
guguaugggugugugugggugggugugaguguggguguguacguaccaauaaacaaccugguu

SEQ ID NO: 316074 - RNA, 63 nt, hsa
auucccuccaugcugucgucaucgacauauacagguguguacguagguguauguguguacucu

SEQ ID NO: 316075 - RNA, 63 nt, hsa
agaccccuccccgccacgaucgucgcugugcuugguguguaggacccuaggcuccccgcccac

SEQ ID NO: 316076 - RNA, 63 nt, hsa
ggcauagggaccagucuacuacccacugggccugguguguagagggggagaggguagcaaggu

SEQ ID NO: 316077 - RNA, 63 nt, hsa
ggaaggguuccuaacccaaccuacuccccuuaggguguguauccaacccagugcuuccuaaga

SEQ ID NO: 316078 - RNA, 63 nt, hsa
gauagacuugcugaugugcauguggggggaugagguguguauaugccuuucuccugacuggcc

SEQ ID NO: 316079 - RNA, 63 nt, hsa
ggugacuguccguggaggggugacuguguccgugguguguauuaugcugucauaucagaguca

SEQ ID NO: 316080 - RNA, 63 nt, hsa
caugcagccuaaaguacagccuggaccaccccugguguguagcuaguaagauuacccugagcu

SEQ ID NO: 316081 - RNA, 63 nt, hsa
gggagggugugggugugcgugugugcaugugcugguguguaagggggaaagggucuuuccugg

SEQ ID NO: 316082 - RNA, 63 nt, hsa
agaccccacccugagguccugcauuucucagucgguguguaaucacguuccagggcccaaagc

SEQ ID NO: 316083 - RNA, 63 nt, hsa
gauugugcagaauauucuaagaggucagaaauugguguguauaacuacauuuuuagugaugca

SEQ ID NO: 316084 - RNA, 63 nt, hsa
uccugcugccucugacuacucagccuuguuuucgguguguaggccccagcugcccacuggaac

SEQ ID NO: 316085 - RNA, 63 nt, hsa
gagcuggcugaggcaucgcucaagcuggggggugguguguaagaagcacguggagccacaaga

SEQ ID NO: 316086 - RNA, 63 nt, hsa
ucuuucacuuucauuugcuggugugagccaugggguguguauuuguauguggggaguaggugu

SEQ ID NO: 316087 - RNA, 63 nt, hsa
uauaguugaaacuguagaaagggucagguuggagguguguaauaaaaaagaauuaccuagguu

SEQ ID NO: 316088 - RNA, 63 nt, hsa
agucuuccacuucaaugcacauggugcaguuuugguguguaacuuagaaggauugaacuucuu

SEQ ID NO: 316089 - RNA, 63 nt, hsa
uuuuuaaaucuuuuuuuaacuaauaagauuuacgguguguauuuuauacagaaaugcauuaua

SEQ ID NO: 316090 - RNA, 63 nt, hsa
agcaauugccugccuuguacuuuaugggcuugggguguguagaaugauuuugcgggggagugg

SEQ ID NO: 316091 - RNA, 63 nt, hsa
gguuguggccccugcaggggcagaguauccuaggguguguauccaucuggcugucuguccauu

SEQ ID NO: 316092 - RNA, 63 nt, hsa
cuguggaaacccuucucccugugccuuagagcagguguguacaucucucacuaccuuucucau

SEQ ID NO: 316093 - RNA, 63 nt, hsa
ucauuauuuuuuuuuggcugaguaguauucugugguguguauguguguguguguaugcauaua

SEQ ID NO: 316094 - RNA, 63 nt, hsa
uuuuuauagaaguuugaaaauuuaaugcaggcagguguguaauaaauuauuuuugaauugaac

SEQ ID NO: 316095 - RNA, 63 nt, hsa
cagaaggguaccaguaauacacuaaauuuucaagguguguagagaaauaauauggaauuagca

SEQ ID NO: 316096 - RNA, 63 nt, hsa
auuugaaaguuuacauuuuuuaugcuuuguguugguguguaauuuuuguacucuugguggcua

SEQ ID NO: 316097 - RNA, 63 nt, hsa
uagucguaggccuuaugauaauuaccccgcggugguguguagaaaaguauguaaauuugcucu

SEQ ID NO: 316098 - RNA, 63 nt, hsa
uuauuuucuuuaguuuaaucuuggucauguuuugguguguauuuuuaauuuuuuucuuaaauu

SEQ ID NO: 316099 - RNA, 63 nt, hsa
cuacuaaaaauacaaaaauuagcuggguguggugguguguaccuguagucccagcuacccagg

SEQ ID NO: 316100 - RNA, 63 nt, hsa
gaggugagccgaagaucaauucgacagacagaugguguguaugccccucccuguuugacuuca

SEQ ID NO: 316101 - RNA, 63 nt, hsa
auaaaauuuguaagguugccccuuuguggcacugguguguaaaauacacagacuaucacuaaa

SEQ ID NO: 316102 - RNA, 63 nt, hsa
uacuggauucccacaguaauauagacugugcaugguguguauauuucauugcgauuuccuguu

SEQ ID NO: 316103 - RNA, 63 nt, hsa
auggucaauucagaagaaagugucucugccauagguguguauguguauaugugugcguguggu

SEQ ID NO: 316104 - RNA, 63 nt, hsa
ugugccuaagccuccugaguagcugggaucacagguguguaccaccacgcccagcugauuuuu

SEQ ID NO: 316105 - RNA, 63 nt, hsa
cuacuuuuagcuucauucucccauauuuugaaggguguguaacuucagcucugcaggauugca

SEQ ID NO: 316106 - RNA, 63 nt, hsa
ccuugagcagauccagggaucagugagaggagugguguguaccccuaaauccucccaccccag

SEQ ID NO: 316107 - RNA, 63 nt, hsa
auauaaggaaaaaaaauagccugccuugggacagguguguaauguuagugugcaugacuaaug

SEQ ID NO: 316108 - RNA, 63 nt, hsa
auauauuuggaaacucuuggugagagaaugaaugguguguauacauacucuguacauuuuucu

SEQ ID NO: 316109 - RNA, 63 nt, hsa
uaacccuaauugaugagaggcucgcugcuugaugguguguacaaacucaccugaaugggacuu

SEQ ID NO: 316110 - RNA, 63 nt, hsa
gagcucccagggaaaaacgaagugcauuugauugguguguauuggccaaguuuugcuuguugu

SEQ ID NO: 316111 - RNA, 63 nt, hsa
guagacugauuacacugaggugaggcuacaagggguguguaaccguguaacacgugaaggcaa

SEQ ID NO: 316112 - RNA, 63 nt, hsa
ucuggccccuuugguuuccgugucauccuuuuugguguguaggacaaggagccagggaauugg

SEQ ID NO: 316113 - RNA, 63 nt, hsa
uugagguuagggugaggggucaggguuuaggaggguguguauguugggaggacaggcuaguug

SEQ ID NO: 316114 - RNA, 63 nt, hsa
uauaguaaaacuagccuuucacauuaagguuuugguguguauuuuguuaaauaacuaacaugc

SEQ ID NO: 316115 - RNA, 63 nt, hsa
ccuacagcagaaguucugagccugaccacagaugguguguaaucuaucaaacacaccccuggc

SEQ ID NO: 316116 - RNA, 63 nt, hsa
cuuauaccugagcccaguacaacaaaggugacggguguguagguacacacccagagauggagc

SEQ ID NO: 316117 - RNA, 63 nt, hsa
uuuuucuucuguuuuuauugaggguggggguuggguguguaauuuguaaguacuuuugugcau

SEQ ID NO: 316118 - RNA, 63 nt, hsa
cuacuuggcaugaaagggugcccuggauaggaggguguguacagggcaaaaugccaaaaagca

SEQ ID NO: 316119 - RNA, 63 nt, hsa
guuugugaauuaucugcaugugugcuuuuuuuugguguguauuucauuaaaaaauauaaauau

SEQ ID NO: 316120 - RNA, 63 nt, hsa
gagaggaugcucacuguaagacuguuggacagugguguguauugaggggaugaaucggaacga

SEQ ID NO: 316121 - RNA, 63 nt, hsa
cauucucuuuuucauacuaagcuuucgaaaucugguguguauuuuacacuuucugcacaucuc

SEQ ID NO: 316122 - RNA, 63 nt, hsa
aagaaagcuguuuaagaaggccaugacucuuuagguguguauguguaccuuucagcauccuag

SEQ ID NO: 316123 - RNA, 63 nt, hsa
auuuugaccuguucagugucugucuuccagcacgguguguacacuucuucaaaauuguacaca

SEQ ID NO: 316124 - RNA, 63 nt, hsa
gcauggauuaguuuuccugacaaagcauguuuugguguguagucuuacuuuuuagaaauagcu

SEQ ID NO: 316125 - RNA, 63 nt, hsa
ggucaaagauguguucaggcauuccagguaacagguguguauguaaaguuaaaaauaggcuuu

SEQ ID NO: 316126 - RNA, 63 nt, hsa
gucaagaagaaaguuguauaagcuauugauaaggguguguaucuuaauguuguugaguuuugu

SEQ ID NO: 316127 - RNA, 63 nt, hsa
cagcccuucuuuccacagaagcuccagguagaggguguguaaguagauaggccaugggcacug

SEQ ID NO: 316128 - RNA, 63 nt, hsa
ccagcaguugaaggaagagagugcauggcaccugguguguaacgacacaaucagcacaacugg

SEQ ID NO: 316129 - RNA, 63 nt, hsa
cacacuggacaggguucucuaagcagugaggcugguguguaugauugucuuaaaauuuuuuaa

SEQ ID NO: 316130 - RNA, 63 nt, hsa
aacacauccccaggcaggacagaucggggaagggguguguaccaggcuaugauuucucuugca

SEQ ID NO: 316131 - RNA, 63 nt, hsa
cuauuacauuguacagaaucuguacuuauguuugguguguaauauaccaauuaguuuuauaua

SEQ ID NO: 316132 - RNA, 63 nt, hsa
aaaaaaaagaaaaaagaaaaagccgggugaggugguguguaccuguagucacagguacuuggg

SEQ ID NO: 316133 - RNA, 63 nt, hsa
acugcaccaacacugucguauccuuguuaaaaugguguguaccuuacaaauuauaauuuaugu

SEQ ID NO: 316134 - RNA, 63 nt, hsa
agcagggagcugcgccuuccuggggugcccggugguguguagagaaaagcugcuuguuuacuc

SEQ ID NO: 316135 - RNA, 63 nt, hsa
caaaucuucuauuguguggaaaauguugugaaggguguguaggugugguacauguguauguca

SEQ ID NO: 316136 - RNA, 63 nt, hsa
uuuacgagaaaaagaaggggaaugguggggaaugguguguaccgauauauaguauuucuuuag

SEQ ID NO: 316137 - RNA, 63 nt, hsa
cccagggacauggacuuggguguucuuauuuaugguguguauguaaagagauaggggagaaaa

SEQ ID NO: 316138 - RNA, 63 nt, hsa
gcaauggaacaaaacucaucuggcugcaucccagguguguagcaaaguccacauguaaauuua

SEQ ID NO: 316139 - RNA, 63 nt, hsa
uggggccugggcuguggacagaaggaugucccggguguguacaccaagguuaccaacuaccua

SEQ ID NO: 316140 - RNA, 63 nt, hsa
aaaagguaauauaauuuuagguuuaccaaauaugguguguauucaaauaauacuugaccagcu

SEQ ID NO: 316141 - RNA, 63 nt, hsa
ugucaguauuuuuccuuuuuaaccauuccaaucgguguguagugauguuucauuuugguuuua

SEQ ID NO: 316142 - RNA, 63 nt, hsa
accagaguugggagauaagauaguuuccaugaagguguguauguuuuauacgauguuuguuau

SEQ ID NO: 316143 - RNA, 63 nt, hsa
aaggagucccuaacuuucuuaucccaugagagagguguguaaaggagaaagcuagaggugaac

SEQ ID NO: 316144 - RNA, 63 nt, hsa
agaaaucuuuauuaauguuuagauuuuucauuugguguguaagaaaauauucuuuguaugauu

SEQ ID NO: 316145 - RNA, 63 nt, hsa
agauaguugacuuucuaucuuuuggcauucuuugguguguagaauuacuguaauacuucugca

SEQ ID NO: 316146 - RNA, 63 nt, hsa
guccaucugugcauaaggagaggaaaguuccaggguguguauguuucaggggcuucacaugga

SEQ ID NO: 316147 - RNA, 63 nt, hsa
acaggauaauagguuuuucauaaagaaacguaggguguguaugugaaaguggggugagguucc

SEQ ID NO: 316148 - RNA, 63 nt, hsa
gcagaggaggugcuggcggccccagggaaggaggguguguaccccaaggcccccuggcugugc

SEQ ID NO: 316149 - RNA, 63 nt, hsa
gcuugaaugcugguacuauugugaccacaggcugguguguaggugguaaaaccuguucuccau

SEQ ID NO: 316150 - RNA, 63 nt, hsa
aguuagccuugcuggggccauaauaugcuucaggguguguaaaagaagaaaucucuuuguggc

SEQ ID NO: 316151 - RNA, 63 nt, hsa; identical to SEQ ID NO: 316150

SEQ ID NO: 316152 - RNA, 63 nt, hsa
ugcauuuuguuaaugcacauucuguuuguuuaagguguguaagauacacacccuucuagauga

SEQ ID NO: 316153 - RNA, 63 nt, hsa
guugcugauugcauuuccucucauuaacaauuggguguguaauaaaaagcauuguacuucauc

SEQ ID NO: 316154 - RNA, 63 nt, hsa
ucagcccauuagguuaaacaccaaagaaagacugguguguacugaauaggaaagggaaguuuu

SEQ ID NO: 316155 - RNA, 63 nt, hsa
uucuaguuugcacauccagaacggcgaaggcuggguguguauuccacuaacugaaauauggca

SEQ ID NO: 316156 - RNA, 63 nt, hsa
cagauaccagauuugauauaauguuguaacauagguguguagauaguggauccuggauggaac

SEQ ID NO: 316157 - RNA, 63 nt, hsa
caaacuuaacauucuuguaauagaaaccagcaggguguguacacuuuugugugugugcgcagg

SEQ ID NO: 316158 - RNA, 63 nt, hsa
ggccugcugagcucugguuagguuacagcuggagguguguauauauacacacacacacaugua

SEQ ID NO: 316159 - RNA, 63 nt, hsa
ugccuuuaaagauacagugugaaaauuugcucggguguguagcaguaauuacacgaggcaaac

SEQ ID NO: 316160 - RNA, 63 nt, hsa
gggacaggugaauaccugcuccucgccuggauggguguguauuuugaucugcauugacaccag

SEQ ID NO: 316161 - RNA, 63 nt, hsa
uuguaaaacuugaagccauaaaaauauuaguuugguguguauuggggaaaauagcuaaaaguc

SEQ ID NO: 316162 - RNA, 63 nt, hsa
agccuguguugugcaaaagaauuggaaggaugugguguguaccuguagccugaagaacuggag

SEQ ID NO: 316163 - RNA, 63 nt, hsa
aucuuccuaauaucaggcgccuacuuaaccuaugguguguacuuuuuguaaguuguaacuuga

SEQ ID NO: 316164 - RNA, 63 nt, hsa
cgcaggugggcuggacuucuaccugcccucaaggguguguauauuguauaggggcaacuguau

SEQ ID NO: 316165 - RNA, 63 nt, hsa
cgcgccugcugcugugacccguuuuggaaaacugguguguaccgaggcgcugacugcacggcu

SEQ ID NO: 316166 - RNA, 63 nt, hsa
uaugacagcuuuccuucacacacuauuuuuguggguguguauauaucugauuugggaagaauu

SEQ ID NO: 316167 - RNA, 63 nt, hsa
auggaggccaguguuggggagccuguggaggcagguguguagaauuguguucgggaggugggg

SEQ ID NO: 316168 - RNA, 63 nt, hsa
ggauucugugccaucugaacaugcucuccuguugguguguaugucacuagggcaguggggaga

SEQ ID NO: 316169 - RNA, 63 nt, hsa
ccucuguggcaaagcgugucccauagaaaauuggguguguauacuuguauaacuuuguaaaua

SEQ ID NO: 316170 - RNA, 63 nt, hsa
ugcauacauauguguguauauaugguuuugucagguguguaaauuugcaaauuguuuccuuua

SEQ ID NO: 316171 - RNA, 63 nt, hsa
ugauguguaauccaguaaaaucucccuuuuucggguguguaugugggcaugugcccauuucua

SEQ ID NO: 316172 - RNA, 63 nt, hsa
uuuauucugaagaauaaaccuagcuggcaugcugguguguaccuguaguccuagcuauuuggg

SEQ ID NO: 316173 - RNA, 63 nt, hsa
ggcauaaugaauauaauuuacccaguggacaaagguguguaccaagugaauuuaaauaauugg

SEQ ID NO: 316174 - RNA, 63 nt, hsa
uugugacgucgggcauucauauaggaagaacgcgguguguaacacuguguacaccucaaauac

SEQ ID NO: 316175 - RNA, 63 nt, hsa
guacugcgucuguccacacucgauugggccccagguguguaugaggcgcucugguaaggugcu

SEQ ID NO: 316176 - RNA, 63 nt, hsa
uuaugucuuuauuccuuauuucacaauguauuugguguguaggggaggggggagaacuaaaug

SEQ ID NO: 316177 - RNA, 63 nt, hsa
agaacaaaaaugggaggagguguccacauuuaugguguguauagguaacauggggaaaaugcu

SEQ ID NO: 316178 - RNA, 63 nt, hsa
ggccccuaugugggauuuuuuaaaaagcaaacugguguguauucucaugugguuugcacagcc

SEQ ID NO: 316179 - RNA, 63 nt, hsa
ccuuguguuguguguuucugucugaggacaguggguguguacuggccucccgggagccacugu

SEQ ID NO: 316180 - RNA, 63 nt, hsa
uggacaucucuuccagaguuaucccacuggcuugguguguauacauuaggggaggauaaucug

SEQ ID NO: 316181 - RNA, 63 nt, hsa
uguccuguguauguguggguguguguguauuuggguguguaaauguugguucuuccacuacug

SEQ ID NO: 316182 - RNA, 63 nt, hsa
ggguagggggcacagaacaccagaaagaguguugguguguagguagauuccauauuaaugagg

SEQ ID NO: 316183 - RNA, 63 nt, hsa
cagcccuuuccccuagacaucuacccaaaugcagguguguagguugagucuuuaacaaaguga

SEQ ID NO: 316184 - RNA, 63 nt, hsa
ggcugugaggagugagugagacaggacaugaaagguguguaugaacugugauaacuguugccc

SEQ ID NO: 316185 - RNA, 63 nt, hsa
gaucuuccaaggaaaaacauaauucuuucaaacgguguguauuuggcaaagagcucuucaaau

SEQ ID NO: 316186 - RNA, 63 nt, hsa
ccuguugguuugaaguguuagacuauagccccugguguguaaauaauguacauagagugagaa

SEQ ID NO: 316187 - RNA, 63 nt, hsa
gauauugaugauaguugaaauauucuuagaagggguguguaugucuagcugugucuaccaugu

SEQ ID NO: 316188 - RNA, 63 nt, hsa
gagaaggagaugaaggaguguguguagcauggggguguguacaacuuaacaccuggacuuuua

SEQ ID NO: 316189 - RNA, 63 nt, hsa
gcacuggggggguuggggugggcuuggaacacagguguguacagcgugcuguaguggaaguuu

SEQ ID NO: 316190 - RNA, 63 nt, hsa
ugcuuucaagcaaaaugccugggcuugggggaagguguguaucuguccauguguggauguugg

SEQ ID NO: 316191 - RNA, 63 nt, hsa
cagaauuaauagcccuuagcaacgacugcugcugguguguauuuuuguaaauguuaugcacuc

SEQ ID NO: 316192 - RNA, 63 nt, hsa
gcugccagccucucacaucuugcacacuuuuuggguguguaaaugacacaaaaguuauuuaca

SEQ ID NO: 316193 - RNA, 63 nt, hsa
cuaccaaaaauacaaaauguauccagacauggugguguguaccuguagucccagcuacucagg

SEQ ID NO: 316194 - RNA, 63 nt, hsa
gacagcuugugcugcuugcacaacugagcugcugguguguaccccuuagcagggugucugggg

SEQ ID NO: 316195 - RNA, 63 nt, hsa
auuaccucuucuuggucagaauucuauucucaggguguguaccaugauuugucugcuaagaag

SEQ ID NO: 316196 - RNA, 63 nt, hsa
agggcaucugaauacaggaguaggggggguguggguguguaaccagagaccgagagcaugagu

SEQ ID NO: 316197 - RNA, 63 nt, hsa
aaagugcucccuucccagaggaggggccccaucgguguguaagguggccuauuccucugugug

SEQ ID NO: 316198 - RNA, 63 nt, hsa
ccaccuggggggcccuuccccagcauaccugcugguguguaaguguggacuaacccgccgcca

SEQ ID NO: 316199 - RNA, 63 nt, hsa
ggugguggccuguuugaaaguaaaaaccugcuugguguguagguuccguaucucccuggagaa

SEQ ID NO: 316200 - RNA, 63 nt, hsa
uaaucuucugcuaauggugaugugaauucuuaggguguguacguacgcagccuccagggcacc

SEQ ID NO: 316201 - RNA, 63 nt, hsa
gcagacagagugaagcuggcuggggggcacagugguguguagugcugcuguguaucaaaagac

SEQ ID NO: 316202 - RNA, 63 nt, hsa
agggaugguggagugagagccuuugccuuuagggguguguauucacauaguccucagggcuca

SEQ ID NO: 316203 - RNA, 63 nt, hsa
uauagugucgggcuuccggggaaagcaaucauugguguguauguguaugugcaugcacacacg

SEQ ID NO: 316204 - RNA, 63 nt, hsa
cccaccucagccgccgaaguagcugggacuauagguguguaccaucacaccuggcuaauuuuu

SEQ ID NO: 316205 - RNA, 63 nt, hsa
agaagugagcgcugggaacagaguggagucuccgguguguaccucagacugauggugcccaug

SEQ ID NO: 316206 - RNA, 63 nt, hsa
gaggcacggggaagguuuuggaguagaaccagggguguguaugaaggggggugacaagguccc

SEQ ID NO: 316207 - RNA, 63 nt, hsa
ggguaccccccaaccuccaggagcuaguggagggguguguaacagggucauacccccucccuc

SEQ ID NO: 316208 - RNA, 63 nt, hsa
aguugaccucugguucagccaaggaccaaagaagguguguaagugaagugguucucagucccc

SEQ ID NO: 316209 - RNA, 63 nt, hsa
uuucuccaauuuggcugggauuauucaaaguaggguguguauguaacuuaucacuggaccacu

SEQ ID NO: 316210 - RNA, 63 nt, hsa
gaguguguggaugcgugugaacgcaugugguaagguguguacucagggcauucuguuggccua

SEQ ID NO: 316211 - RNA, 63 nt, hsa
auccuccucucagccugaguaacugggacuacagguguguaccacuacauccagcuaaaggag

SEQ ID NO: 316212 - RNA, 63 nt, hsa
uaaggggguguguguaguguguguugggugugggguguguacaccuggcaucuguggcaugug

SEQ ID NO: 316213 - RNA, 63 nt, hsa
cuaaugccuguccugccucuggccuguguccuggguguguaccauaccugcugggccaguccc

SEQ ID NO: 316214 - RNA, 63 nt, hsa
gaagcaguacuagaaacuuuccaaggagucuuggguguguagccaagaggagccaugagcuau

SEQ ID NO: 316215 - RNA, 63 nt, hsa
accugugugcucacccacagagcaugggguaaugguguguagacacaggcccucugcagaagc

SEQ ID NO: 316216 - RNA, 63 nt, hsa
ugguugaauaguucuauacaaaugaaguauggagguguguauguuuauauguauauaacaaaa

SEQ ID NO: 316217 - RNA, 63 nt, hsa
cucugugaaagcaacaugaaaugaacuguaguagguguguaguuuggggaagucaaauggcca

SEQ ID NO: 316218 - RNA, 63 nt, hsa
cuuuuuuagcaagauugaccaaaacaggugguagguguguaauuuuuaacugucaugaaauac

SEQ ID NO: 316219 - RNA, 63 nt, hsa
acaacauuauuaagacacagcugagaguugauggguguguaaugcauaugccaaggaaauguc

SEQ ID NO: 316220 - RNA, 63 nt, hsa
cacgcuaauaaaauguguugcgaggcugacgcugguguguaugcgagcgcccgccucccagcc

SEQ ID NO: 316221 - RNA, 63 nt, hsa
gacugcuuuucucagccccaagccucuagucuggguguguacggagggucuagccugggugug

SEQ ID NO: 316222 - RNA, 63 nt, hsa
ucuagucuggguguguacggagggucuagccuggguguguacggagggucuagccugggugag

SEQ ID NO: 316223 - RNA, 63 nt, hsa
ucuagccugggugaguacggagggucuagccuggguguguauggaggaucuagccugggugag

SEQ ID NO: 316224 - RNA, 63 nt, hsa
ucuagccugggugaguauggagggucuagccuggguguguauggagggucuagccugggugag

SEQ ID NO: 316225 - RNA, 63 nt, hsa; identical to SEQ ID NO: 316224

SEQ ID NO: 316226 - RNA, 63 nt, hsa
ucuagccugggugaguauggagggucuagccuggguguguacggagggucuagucugagugcg

SEQ ID NO: 316227 - RNA, 63 nt, hsa
ggggcuggggggcaggcugaauguguguguguggguguguauguguggagugugugugugugu

SEQ ID NO: 316228 - RNA, 63 nt, hsa
ucuugaaaaagaaacuuuagagaaagcaucagggguguguacucaguauuucaaaucagaaca

SEQ ID NO: 316229 - RNA, 63 nt, hsa
ggagauggagguguaggcuggagagacauuguggguguguaucuucuuaucucauuucacaag

SEQ ID NO: 316230 - RNA, 63 nt, hsa
gcagagccuugacuggauggagguggggagugugguguguaaagucucuggccucauaaaagg

SEQ ID NO: 316231 - RNA, 63 nt, hsa
gcauuuucuauaauuuuauaaaugaaaccauaugguguguacuuuuuaggggguggggcucug

SEQ ID NO: 316232 - RNA, 63 nt, hsa
gccucagucccccuccagguauuugaaacuacagguguguaccaccacaccgggcuaauuuuu

SEQ ID NO: 316233 - RNA, 63 nt, hsa
aaugcaaacaugagcagaaaauauuuucccacugguguguagccugcuacaaggaguuguugg

SEQ ID NO: 316234 - RNA, 63 nt, hsa
aaagcauggcuuuauuuucuuaauggaugucuugguguguaggagcaugcauuuguaggcacc

SEQ ID NO: 316235 - RNA, 63 nt, hsa
cagaaacuuccaaacgcagugcccuguucugccgguguguacagccucagcgcaccaggagac

SEQ ID NO: 316236 - RNA, 63 nt, hsa
cacgaggaaacauuauucauuggaaaagugcaugguguguauuuuagggauuaugagcuucuu

SEQ ID NO: 316237 - RNA, 63 nt, hsa
uuuuuaaguccuguauauguauguaguaguuuggguguguauauauaguagcauuucaaaaug

SEQ ID NO: 316238 - RNA, 63 nt, hsa
aaaccuguaagcccagcauuugagagaagguaggguguguauauauaaaagguuguguacaac

SEQ ID NO: 316239 - RNA, 63 nt, hsa
uacagaaaaauuuuaaaauuagcugggcguggugguguguaccuguaggccuagcugcucagg

SEQ ID NO: 316240 - RNA, 63 nt, hsa
gcugagcaagccaggaagggaaggagucugugugguguguaugugcaugcagccuacacccac

SEQ ID NO: 316241 - RNA, 63 nt, hsa
aucacauaaauauagcgagcucuacuaaguacagguguguauaauguaucagggaccauggcc

SEQ ID NO: 316242 - RNA, 63 nt, hsa
aucagcauggcggggcggggggcggggggcggggguguguaugggaaucccucccccucuuac

SEQ ID NO: 316243 - RNA, 63 nt, hsa
cacaaggaggaugaaacgccggaacaaaaaugagguguguagaacagggucccacagguuugg

SEQ ID NO: 316244 - RNA, 63 nt, hsa
cacaucugcuauuuccugugguguucugggcaugguguguaagacccacagaggcuccgggug

SEQ ID NO: 316245 - RNA, 63 nt, hsa
cagccuaacauuguucaggcgcauggccccugcgguguguacacgaacucggcuucuuuuguc

SEQ ID NO: 316246 - RNA, 63 nt, hsa
acgggcaugagcagaggugagcgugagcgagcggguguguauguacgagugugcacgugugug

SEQ ID NO: 316247 - RNA, 63 nt, hsa
ccccuagccuuuguccucaccuacccuaaggcagguguguaugcuugaauuccuuccguaugg

SEQ ID NO: 316248 - RNA, 63 nt, hsa
acccagccacgacugccauguaagguugugcaggguguguacugcacaaggacauuguaugca

SEQ ID NO: 316249 - RNA, 63 nt, hsa
caugccggcuggaagaagaaccucgcaucuuuugguguguaugcaccuuggcagccagcagga

SEQ ID NO: 316250 - RNA, 63 nt, hsa
uucucuaagggcuuuacaaggaucaaauaagaugguguguauguaagaaauuuguaaaaugug

SEQ ID NO: 316251 - RNA, 63 nt, hsa
uauguguguguguguguguguguguguguguaugguguguauuccauaucuauucccauguaa

SEQ ID NO: 316252 - RNA, 63 nt, hsa
uuuuguuuguuucuuuuucaugguauuacugaagguguguauacucccuaauacacauuuaug

SEQ ID NO: 316253 - RNA, 63 nt, hsa
gccauggguuuuuuaaccccaaauuauccacaugguguguauuaugaauucuuugaacucuua

SEQ ID NO: 316254 - RNA, 63 nt, hsa
aaagucaguuaugauugucuggagagaagcugugguguguaugcuguagaguuuccacauuuc

SEQ ID NO: 316255 - RNA, 63 nt, hsa
ccuggguucauguuguaauaaaagaagauuguugguguguaauuaauuuguucaaaagaaaaa

SEQ ID NO: 316256 - RNA, 63 nt, hsa
cauguaaucagauuuauuuaauuggguggggcagguguguauuuacuuuagaaaaaaugaaaa

SEQ ID NO: 316257 - RNA, 63 nt, hsa
uccaaguauagauuaaggcaacaaacauauuuggguguguaauuugaaguuuuggacugaaau

SEQ ID NO: 316258 - RNA, 63 nt, hsa
uuuccccaguacuuuuagccaaccuuaccaagugguguguaaacuaguauguaugugcuuugc

SEQ ID NO: 316259 - RNA, 61 nt, hsa
ggaguuucucuugagggcaauaaaaguugucaugguguguacguggugcggugugugacug

SEQ ID NO: 316260 - RNA, 63 nt, hsa
gguaaauuguggacucaggauuuuuugaaacuugguguguaacucuaaaucuuguauaugcau

SEQ ID NO: 316261 - RNA, 63 nt, hsa; identical to SEQ ID NO: 316252

SEQ ID NO: 316262 - RNA, 63 nt, hsa
gcuacuggcaucuguuaucuaguaugcauuucugguguguaucugaaaggaagacauuuucua

SEQ ID NO: 316263 - RNA, 64 nt, hsa
uguaaguguacagugggcuugcauuggggauggggguguguacagaugaagucaguggcuuguc

SEQ ID NO: 316264 - RNA, 64 nt, hsa
uaugcuagagauaaacuuuccaauuuuuaagcuugguguguacccagggaaguuaucuugguau

SEQ ID NO: 316265 - RNA, 64 nt, hsa
aggugugaggaugaaauaaugaccuugauuuuuggguguguauugcagaagccucgucgcuuuc

SEQ ID NO: 316266 - RNA, 64 nt, hsa
ucacaagaaagcaaguacaguguggauuucaaaugguguguaacuucagcuccagcugguuuuu

SEQ ID NO: 316267 - RNA, 64 nt, hsa
cuguuauaugggaauuaaaauauguuuaggcagggguguguaaaaagguuaaguuuuuguuucu

SEQ ID NO: 316268 - RNA, 64 nt, hsa
cuggcauccagcagccacuaacaaacacacaacugguguguaaaaggcaggccuuacauuagaa

SEQ ID NO: 316269 - RNA, 64 nt, hsa
ccacaagauauuuggggaauaaaaauaacagcuugguguguagcaucugcagccacuuggcaaa

SEQ ID NO: 316270 - RNA, 64 nt, hsa
gguguaugggugugugugggugggugugaguguggguguguacguaccaauaaacaaccugguu

SEQ ID NO: 316271 - RNA, 64 nt, hsa
cauucccuccaugcugucgucaucgacauauacagguguguacguagguguauguguguacucu

SEQ ID NO: 316272 - RNA, 64 nt, hsa
cagaccccuccccgccacgaucgucgcugugcuugguguguaggacccuaggcuccccgcccac

SEQ ID NO: 316273 - RNA, 64 nt, hsa
uggcauagggaccagucuacuacccacugggccugguguguagagggggagaggguagcaaggu

SEQ ID NO: 316274 - RNA, 64 nt, hsa
uggaaggguuccuaacccaaccuacuccccuuaggguguguauccaacccagugcuuccuaaga

SEQ ID NO: 316275 - RNA, 64 nt, hsa
ugauagacuugcugaugugcauguggggggaugagguguguauaugccuuucuccugacuggcc

SEQ ID NO: 316276 - RNA, 64 nt, hsa
gggugacuguccguggaggggugacuguguccgugguguguauuaugcugucauaucagaguca

SEQ ID NO: 316277 - RNA, 64 nt, hsa
ucaugcagccuaaaguacagccuggaccaccccugguguguagcuaguaagauuacccugagcu

SEQ ID NO: 316278 - RNA, 64 nt, hsa
agggagggugugggugugcgugugugcaugugcugguguguaagggggaaagggucuuuccugg

SEQ ID NO: 316279 - RNA, 64 nt, hsa
uagaccccacccugagguccugcauuucucagucgguguguaaucacguuccagggcccaaagc

SEQ ID NO: 316280 - RNA, 64 nt, hsa
ugauugugcagaauauucuaagaggucagaaauugguguguauaacuacauuuuuagugaugca

SEQ ID NO: 316281 - RNA, 64 nt, hsa
uuccugcugccucugacuacucagccuuguuuucgguguguaggccccagcugcccacuggaac

SEQ ID NO: 316282 - RNA, 64 nt, hsa
ugagcuggcugaggcaucgcucaagcuggggggugguguguaagaagcacguggagccacaaga

SEQ ID NO: 316283 - RNA, 64 nt, hsa
cucuuucacuuucauuugcuggugugagccaugggguguguauuuguauguggggaguaggugu

SEQ ID NO: 316284 - RNA, 64 nt, hsa
uuauaguugaaacuguagaaagggucagguuggagguguguaauaaaaaagaauuaccuagguu

SEQ ID NO: 316285 - RNA, 64 nt, hsa
gagucuuccacuucaaugcacauggugcaguuuugguguguaacuuagaaggauugaacuucuu

SEQ ID NO: 316286 - RNA, 64 nt, hsa
guuuuuaaaucuuuuuuuaacuaauaagauuuacgguguguauuuuauacagaaaugcauuaua

SEQ ID NO: 316287 - RNA, 64 nt, hsa
aagcaauugccugccuuguacuuuaugggcuugggguguguagaaugauuuugcgggggagugg

SEQ ID NO: 316288 - RNA, 64 nt, hsa
agguuguggccccugcaggggcagaguauccuaggguguguauccaucuggcugucuguccauu

SEQ ID NO: 316289 - RNA, 64 nt, hsa
ccuguggaaacccuucucccugugccuuagagcagguguguacaucucucacuaccuuucucau

SEQ ID NO: 316290 - RNA, 64 nt, hsa
uucauuauuuuuuuuuggcugaguaguauucugugguguguauguguguguguguaugcauaua

SEQ ID NO: 316291 - RNA, 64 nt, hsa
auuuuuauagaaguuugaaaauuuaaugcaggcagguguguaauaaauuauuuuugaauugaac

SEQ ID NO: 316292 - RNA, 64 nt, hsa
acagaaggguaccaguaauacacuaaauuuucaagguguguagagaaauaauauggaauuagca

SEQ ID NO: 316293 - RNA, 64 nt, hsa
aauuugaaaguuuacauuuuuuaugcuuuguguugguguguaauuuuuguacucuugguggcua

SEQ ID NO: 316294 - RNA, 64 nt, hsa
uuagucguaggccuuaugauaauuaccccgcggugguguguagaaaaguauguaaauuugcucu

SEQ ID NO: 316295 - RNA, 64 nt, hsa
auuauuuucuuuaguuuaaucuuggucauguuuugguguguauuuuuaauuuuuuucuuaaauu

SEQ ID NO: 316296 - RNA, 64 nt, hsa
ucuacuaaaaauacaaaaauuagcuggguguggugguguguaccuguagucccagcuacccagg

SEQ ID NO: 316297 - RNA, 64 nt, hsa
agaggugagccgaagaucaauucgacagacagaugguguguaugccccucccuguuugacuuca

SEQ ID NO: 316298 - RNA, 64 nt, hsa
gauaaaauuuguaagguugccccuuuguggcacugguguguaaaauacacagacuaucacuaaa

SEQ ID NO: 316299 - RNA, 64 nt, hsa
uuacuggauucccacaguaauauagacugugcaugguguguauauuucauugcgauuuccuguu

SEQ ID NO: 316300 - RNA, 64 nt, hsa
aauggucaauucagaagaaagugucucugccauagguguguauguguauaugugugcguguggu

SEQ ID NO: 316301 - RNA, 64 nt, hsa
augugccuaagccuccugaguagcugggaucacagguguguaccaccacgcccagcugauuuuu

SEQ ID NO: 316302 - RNA, 64 nt, hsa
ucuacuuuuagcuucauucucccauauuuugaaggguguguaacuucagcucugcaggauugca

SEQ ID NO: 316303 - RNA, 64 nt, hsa
accuugagcagauccagggaucagugagaggagugguguguaccccuaaauccucccaccccag

SEQ ID NO: 316304 - RNA, 64 nt, hsa
uauauaaggaaaaaaaauagccugccuugggacagguguguaauguuagugugcaugacuaaug

SEQ ID NO: 316305 - RNA, 64 nt, hsa
gauauauuuggaaacucuuggugagagaaugaaugguguguauacauacucuguacauuuuucu

SEQ ID NO: 316306 - RNA, 64 nt, hsa
cuaacccuaauugaugagaggcucgcugcuugaugguguguacaaacucaccugaaugggacuu

SEQ ID NO: 316307 - RNA, 64 nt, hsa
ggagcucccagggaaaaacgaagugcauuugauugguguguauuggccaaguuuugcuuguugu

SEQ ID NO: 316308 - RNA, 64 nt, hsa
aguagacugauuacacugaggugaggcuacaagggguguguaaccguguaacacgugaaggcaa

SEQ ID NO: 316309 - RNA, 64 nt, hsa
gucuggccccuuugguuuccgugucauccuuuuugguguguaggacaaggagccagggaauugg

SEQ ID NO: 316310 - RNA, 64 nt, hsa
auugagguuagggugaggggucaggguuuaggaggguguguauguugggaggacaggcuaguug

SEQ ID NO: 316311 - RNA, 64 nt, hsa
uuauaguaaaacuagccuuucacauuaagguuuugguguguauuuuguuaaauaacuaacaugc

SEQ ID NO: 316312 - RNA, 64 nt, hsa
uccuacagcagaaguucugagccugaccacagaugguguguaaucuaucaaacacaccccuggc

SEQ ID NO: 316313 - RNA, 64 nt, hsa
acuuauaccugagcccaguacaacaaaggugacggguguguagguacacacccagagauggagc

SEQ ID NO: 316314 - RNA, 64 nt, hsa
cuuuuucuucuguuuuuauugaggguggggguuggguguguaauuuguaaguacuuuugugcau

SEQ ID NO: 316315 - RNA, 64 nt, hsa
ucuacuuggcaugaaagggugcccuggauaggaggguguguacagggcaaaaugccaaaaagca

SEQ ID NO: 316316 - RNA, 64 nt, hsa
uguuugugaauuaucugcaugugugcuuuuuuuugguguguauuucauuaaaaaauauaaauau

SEQ ID NO: 316317 - RNA, 64 nt, hsa
ugagaggaugcucacuguaagacuguuggacagugguguguauugaggggaugaaucggaacga

SEQ ID NO: 316318 - RNA, 64 nt, hsa
acauucucuuuuucauacuaagcuuucgaaaucugguguguauuuuacacuuucugcacaucuc

SEQ ID NO: 316319 - RNA, 64 nt, hsa
uaagaaagcuguuuaagaaggccaugacucuuuagguguguauguguaccuuucagcauccuag

SEQ ID NO: 316320 - RNA, 64 nt, hsa
cauuuugaccuguucagugucugucuuccagcacgguguguacacuucuucaaaauuguacaca

SEQ ID NO: 316321 - RNA, 64 nt, hsa
ugcauggauuaguuuuccugacaaagcauguuuugguguguagucuuacuuuuuagaaauagcu

SEQ ID NO: 316322 - RNA, 64 nt, hsa
aggucaaagauguguucaggcauuccagguaacagguguguauguaaaguuaaaaauaggcuuu

SEQ ID NO: 316323 - RNA, 64 nt, hsa
ugucaagaagaaaguuguauaagcuauugauaaggguguguaucuuaauguuguugaguuuugu

SEQ ID NO: 316324 - RNA, 64 nt, hsa
acagcccuucuuuccacagaagcuccagguagaggguguguaaguagauaggccaugggcacug

SEQ ID NO: 316325 - RNA, 64 nt, hsa
accagcaguugaaggaagagagugcauggcaccugguguguaacgacacaaucagcacaacugg

SEQ ID NO: 316326 - RNA, 64 nt, hsa
gcacacuggacaggguucucuaagcagugaggcugguguguaugauugucuuaaaauuuuuuaa

SEQ ID NO: 316327 - RNA, 64 nt, hsa
aaacacauccccaggcaggacagaucggggaagggguguguaccaggcuaugauuucucuugca

SEQ ID NO: 316328 - RNA, 64 nt, hsa
acuauuacauuguacagaaucuguacuuauguuugguguguaauauaccaauuaguuuuauaua

SEQ ID NO: 316329 - RNA, 64 nt, hsa
aaaaaaaaagaaaaaagaaaaagccgggugaggugguguguaccuguagucacagguacuuggg

SEQ ID NO: 316330 - RNA, 64 nt, hsa
cacugcaccaacacugucguauccuuguuaaaaugguguguaccuuacaaauuauaauuuaugu

SEQ ID NO: 316331 - RNA, 64 nt, hsa
gagcagggagcugcgccuuccuggggugcccggugguguguagagaaaagcugcuuguuuacuc

SEQ ID NO: 316332 - RNA, 64 nt, hsa
acaaaucuucuauuguguggaaaauguugugaaggguguguaggugugguacauguguauguca

SEQ ID NO: 316333 - RNA, 64 nt, hsa
uuuuacgagaaaaagaaggggaaugguggggaaugguguguaccgauauauaguauuucuuuag

SEQ ID NO: 316334 - RNA, 64 nt, hsa
acccagggacauggacuuggguguucuuauuuaugguguguauguaaagagauaggggagaaaa

SEQ ID NO: 316335 - RNA, 64 nt, hsa
ugcaauggaacaaaacucaucuggcugcaucccagguguguagcaaaguccacauguaaauuua

SEQ ID NO: 316336 - RNA, 64 nt, hsa
cuggggccugggcuguggacagaaggaugucccggguguguacaccaagguuaccaacuaccua

SEQ ID NO: 316337 - RNA, 64 nt, hsa
gaaaagguaauauaauuuuagguuuaccaaauaugguguguauucaaauaauacuugaccagcu

SEQ ID NO: 316338 - RNA, 64 nt, hsa
uugucaguauuuuuccuuuuuaaccauuccaaucgguguguagugauguuucauuuugguuuua

SEQ ID NO: 316339 - RNA, 64 nt, hsa
uaccagaguugggagauaagauaguuuccaugaagguguguauguuuuauacgauguuuguuau

SEQ ID NO: 316340 - RNA, 64 nt, hsa
caaggagucccuaacuuucuuaucccaugagagagguguguaaaggagaaagcuagaggugaac

SEQ ID NO: 316341 - RNA, 64 nt, hsa
aagaaaucuuuauuaauguuuagauuuuucauuugguguguaagaaaauauucuuuguaugauu

SEQ ID NO: 316342 - RNA, 64 nt, hsa
cagauaguugacuuucuaucuuuuggcauucuuugguguguagaauuacuguaauacuucugca

SEQ ID NO: 316343 - RNA, 64 nt, hsa
uguccaucugugcauaaggagaggaaaguuccaggguguguauguuucaggggcuucacaugga

SEQ ID NO: 316344 - RNA, 64 nt, hsa
cacaggauaauagguuuuucauaaagaaacguaggguguguaugugaaaguggggugagguucc

SEQ ID NO: 316345 - RNA, 64 nt, hsa
ggcagaggaggugcuggcggccccagggaaggaggguguguaccccaaggcccccuggcugugc

SEQ ID NO: 316346 - RNA, 64 nt, hsa
ugcuugaaugcugguacuauugugaccacaggcugguguguaggugguaaaaccuguucuccau

SEQ ID NO: 316347 - RNA, 64 nt, hsa
uaguuagccuugcuggggccauaauaugcuucaggguguguaaaagaagaaaucucuuuguggc

SEQ ID NO: 316348 - RNA, 64 nt, hsa; identical to SEQ ID NO: 316347

SEQ ID NO: 316349 - RNA, 64 nt, hsa
augcauuuuguuaaugcacauucuguuuguuuaagguguguaagauacacacccuucuagauga

SEQ ID NO: 316350 - RNA, 64 nt, hsa
aguugcugauugcauuuccucucauuaacaauuggguguguaauaaaaagcauuguacuucauc

SEQ ID NO: 316351 - RNA, 64 nt, hsa
cucagcccauuagguuaaacaccaaagaaagacugguguguacugaauaggaaagggaaguuuu

SEQ ID NO: 316352 - RNA, 64 nt, hsa
uuucuaguuugcacauccagaacggcgaaggcuggguguguauuccacuaacugaaauauggca

SEQ ID NO: 316353 - RNA, 64 nt, hsa
ucagauaccagauuugauauaauguuguaacauagguguguagauaguggauccuggauggaac

SEQ ID NO: 316354 - RNA, 64 nt, hsa
ccaaacuuaacauucuuguaauagaaaccagcaggguguguacacuuuugugugugugcgcagg

SEQ ID NO: 316355 - RNA, 64 nt, hsa
gggccugcugagcucugguuagguuacagcuggagguguguauauauacacacacacacaugua

SEQ ID NO: 316356 - RNA, 64 nt, hsa
uugccuuuaaagauacagugugaaaauuugcucggguguguagcaguaauuacacgaggcaaac

SEQ ID NO: 316357 - RNA, 64 nt, hsa
ggggacaggugaauaccugcuccucgccuggauggguguguauuuugaucugcauugacaccag

SEQ ID NO: 316358 - RNA, 64 nt, hsa
uuuguaaaacuugaagccauaaaaauauuaguuugguguguauuggggaaaauagcuaaaaguc

SEQ ID NO: 316359 - RNA, 64 nt, hsa
uagccuguguugugcaaaagaauuggaaggaugugguguguaccuguagccugaagaacuggag

SEQ ID NO: 316360 - RNA, 64 nt, hsa
gaucuuccuaauaucaggcgccuacuuaaccuaugguguguacuuuuuguaaguuguaacuuga

SEQ ID NO: 316361 - RNA, 64 nt, hsa
gcgcaggugggcuggacuucuaccugcccucaaggguguguauauuguauaggggcaacuguau

SEQ ID NO: 316362 - RNA, 64 nt, hsa
ucgcgccugcugcugugacccguuuuggaaaacugguguguaccgaggcgcugacugcacggcu

SEQ ID NO: 316363 - RNA, 64 nt, hsa
guaugacagcuuuccuucacacacuauuuuuguggguguguauauaucugauuugggaagaauu

SEQ ID NO: 316364 - RNA, 64 nt, hsa
cauggaggccaguguuggggagccuguggaggcagguguguagaauuguguucgggaggugggg

SEQ ID NO: 316365 - RNA, 64 nt, hsa
uggauucugugccaucugaacaugcucuccuguugguguguaugucacuagggcaguggggaga

SEQ ID NO: 316366 - RNA, 64 nt, hsa
uccucuguggcaaagcgugucccauagaaaauuggguguguauacuuguauaacuuuguaaaua

SEQ ID NO: 316367 - RNA, 64 nt, hsa
augcauacauauguguguauauaugguuuugucagguguguaaauuugcaaauuguuuccuuua

SEQ ID NO: 316368 - RNA, 64 nt, hsa
cugauguguaauccaguaaaaucucccuuuuucggguguguaugugggcaugugcccauuucua

SEQ ID NO: 316369 - RNA, 64 nt, hsa
cuuuauucugaagaauaaaccuagcuggcaugcugguguguaccuguaguccuagcuauuuggg

SEQ ID NO: 316370 - RNA, 64 nt, hsa
gggcauaaugaauauaauuuacccaguggacaaagguguguaccaagugaauuuaaauaauugg

SEQ ID NO: 316371 - RNA, 64 nt, hsa
cuugugacgucgggcauucauauaggaagaacgcgguguguaacacuguguacaccucaaauac

SEQ ID NO: 316372 - RNA, 64 nt, hsa
uguacugcgucuguccacacucgauugggccccagguguguaugaggcgcucugguaaggugcu

SEQ ID NO: 316373 - RNA, 64 nt, hsa
auuaugucuuuauuccuuauuucacaauguauuugguguguaggggaggggggagaacuaaaug

SEQ ID NO: 316374 - RNA, 64 nt, hsa
aagaacaaaaaugggaggagguguccacauuuaugguguguauagguaacauggggaaaaugcu

SEQ ID NO: 316375 - RNA, 64 nt, hsa
gggccccuaugugggauuuuuuaaaaagcaaacugguguguauucucaugugguuugcacagcc

SEQ ID NO: 316376 - RNA, 64 nt, hsa
cccuuguguuguguguuucugucugaggacaguggguguguacuggccucccgggagccacugu

SEQ ID NO: 316377 - RNA, 64 nt, hsa
cuggacaucucuuccagaguuaucccacuggcuugguguguauacauuaggggaggauaaucug

SEQ ID NO: 316378 - RNA, 64 nt, hsa
guguccuguguauguguggguguguguguauuuggguguguaaauguugguucuuccacuacug

SEQ ID NO: 316379 - RNA, 64 nt, hsa
gggguagggggcacagaacaccagaaagaguguugguguguagguagauuccauauuaaugagg

SEQ ID NO: 316380 - RNA, 64 nt, hsa
gcagcccuuuccccuagacaucuacccaaaugcagguguguagguugagucuuuaacaaaguga

SEQ ID NO: 316381 - RNA, 64 nt, hsa
uggcugugaggagugagugagacaggacaugaaagguguguaugaacugugauaacuguugccc

SEQ ID NO: 316382 - RNA, 64 nt, hsa
agaucuuccaaggaaaaacauaauucuuucaaacgguguguauuuggcaaagagcucuucaaau

SEQ ID NO: 316383 - RNA, 64 nt, hsa
cccuguugguuugaaguguuagacuauagccccugguguguaaauaauguacauagagugagaa

SEQ ID NO: 316384 - RNA, 64 nt, hsa
agauauugaugauaguugaaauauucuuagaagggguguguaugucuagcugugucuaccaugu

SEQ ID NO: 316385 - RNA, 64 nt, hsa
ugagaaggagaugaaggaguguguguagcauggggguguguacaacuuaacaccuggacuuuua

SEQ ID NO: 316386 - RNA, 64 nt, hsa
agcacuggggggguuggggugggcuuggaacacagguguguacagcgugcuguaguggaaguuu

SEQ ID NO: 316387 - RNA, 64 nt, hsa
uugcuuucaagcaaaaugccugggcuugggggaagguguguaucuguccauguguggauguugg

SEQ ID NO: 316388 - RNA, 64 nt, hsa
acagaauuaauagcccuuagcaacgacugcugcugguguguauuuuuguaaauguuaugcacuc

SEQ ID NO: 316389 - RNA, 64 nt, hsa
ggcugccagccucucacaucuugcacacuuuuuggguguguaaaugacacaaaaguuauuuaca

SEQ ID NO: 316390 - RNA, 64 nt, hsa
ucuaccaaaaauacaaaauguauccagacauggugguguguaccuguagucccagcuacucagg

SEQ ID NO: 316391 - RNA, 64 nt, hsa
agacagcuugugcugcuugcacaacugagcugcugguguguaccccuuagcagggugucugggg

SEQ ID NO: 316392 - RNA, 64 nt, hsa
uauuaccucuucuuggucagaauucuauucucaggguguguaccaugauuugucugcuaagaag

SEQ ID NO: 316393 - RNA, 64 nt, hsa
gagggcaucugaauacaggaguaggggggguguggguguguaaccagagaccgagagcaugagu

SEQ ID NO: 316394 - RNA, 64 nt, hsa
caaagugcucccuucccagaggaggggccccaucgguguguaagguggccuauuccucugugug

SEQ ID NO: 316395 - RNA, 64 nt, hsa
uccaccuggggggcccuuccccagcauaccugcugguguguaaguguggacuaacccgccgcca

SEQ ID NO: 316396 - RNA, 64 nt, hsa
uggugguggccuguuugaaaguaaaaaccugcuugguguguagguuccguaucucccuggagaa

SEQ ID NO: 316397 - RNA, 64 nt, hsa
cuaaucuucugcuaauggugaugugaauucuuaggguguguacguacgcagccuccagggcacc

SEQ ID NO: 316398 - RNA, 64 nt, hsa
agcagacagagugaagcuggcuggggggcacagugguguguagugcugcuguguaucaaaagac

SEQ ID NO: 316399 - RNA, 64 nt, hsa
aagggaugguggagugagagccuuugccuuuagggguguguauucacauaguccucagggcuca

SEQ ID NO: 316400 - RNA, 64 nt, hsa
uuauagugucgggcuuccggggaaagcaaucauugguguguauguguaugugcaugcacacacg

SEQ ID NO: 316401 - RNA, 64 nt, hsa
ucccaccucagccgccgaaguagcugggacuauagguguguaccaucacaccuggcuaauuuuu

SEQ ID NO: 316402 - RNA, 64 nt, hsa
cagaagugagcgcugggaacagaguggagucuccgguguguaccucagacugauggugcccaug

SEQ ID NO: 316403 - RNA, 64 nt, hsa
ggaggcacggggaagguuuuggaguagaaccagggguguguaugaaggggggugacaagguccc

SEQ ID NO: 316404 - RNA, 64 nt, hsa
uggguaccccccaaccuccaggagcuaguggagggguguguaacagggucauacccccucccuc

SEQ ID NO: 316405 - RNA, 64 nt, hsa
gaguugaccucugguucagccaaggaccaaagaagguguguaagugaagugguucucagucccc

SEQ ID NO: 316406 - RNA, 64 nt, hsa
uuuucuccaauuuggcugggauuauucaaaguaggguguguauguaacuuaucacuggaccacu

SEQ ID NO: 316407 - RNA, 64 nt, hsa
ugaguguguggaugcgugugaacgcaugugguaagguguguacucagggcauucuguuggccua

SEQ ID NO: 316408 - RNA, 64 nt, hsa
aauccuccucucagccugaguaacugggacuacagguguguaccacuacauccagcuaaaggag

SEQ ID NO: 316409 - RNA, 64 nt, hsa
auaaggggguguguguaguguguguugggugugggguguguacaccuggcaucuguggcaugug

SEQ ID NO: 316410 - RNA, 64 nt, hsa
acuaaugccuguccugccucuggccuguguccuggguguguaccauaccugcugggccaguccc

SEQ ID NO: 316411 - RNA, 64 nt, hsa
agaagcaguacuagaaacuuuccaaggagucuuggguguguagccaagaggagccaugagcuau

SEQ ID NO: 316412 - RNA, 64 nt, hsa
aaccugugugcucacccacagagcaugggguaaugguguguagacacaggcccucugcagaagc

SEQ ID NO: 316413 - RNA, 64 nt, hsa
uugguugaauaguucuauacaaaugaaguauggagguguguauguuuauauguauauaacaaaa

SEQ ID NO: 316414 - RNA, 64 nt, hsa
ucucugugaaagcaacaugaaaugaacuguaguagguguguaguuuggggaagucaaauggcca

SEQ ID NO: 316415 - RNA, 64 nt, hsa
ucuuuuuuagcaagauugaccaaaacaggugguagguguguaauuuuuaacugucaugaaauac

SEQ ID NO: 316416 - RNA, 64 nt, hsa
uacaacauuauuaagacacagcugagaguugauggguguguaaugcauaugccaaggaaauguc

SEQ ID NO: 316417 - RNA, 64 nt, hsa
ccacgcuaauaaaauguguugcgaggcugacgcugguguguaugcgagcgcccgccucccagcc

SEQ ID NO: 316418 - RNA, 64 nt, hsa
ugacugcuuuucucagccccaagccucuagucuggguguguacggagggucuagccugggugug

SEQ ID NO: 316419 - RNA, 64 nt, hsa
cucuagucuggguguguacggagggucuagccuggguguguacggagggucuagccugggugag

SEQ ID NO: 316420 - RNA, 64 nt, hsa
gucuagccugggugaguacggagggucuagccuggguguguauggaggaucuagccugggugag

SEQ ID NO: 316421 - RNA, 64 nt, hsa
gucuagccugggugaguauggagggucuagccuggguguguauggagggucuagccugggugag

SEQ ID NO: 316422 - RNA, 64 nt, hsa; identical to SEQ ID NO: 316421

SEQ ID NO: 316423 - RNA, 64 nt, hsa
gucuagccugggugaguauggagggucuagccuggguguguacggagggucuagucugagugcg

SEQ ID NO: 316424 - RNA, 64 nt, hsa
gggggcuggggggcaggcugaauguguguguguggguguguauguguggagugugugugugugu

SEQ ID NO: 316425 - RNA, 64 nt, hsa
aucuugaaaaagaaacuuuagagaaagcaucagggguguguacucaguauuucaaaucagaaca

SEQ ID NO: 316426 - RNA, 64 nt, hsa
cggagauggagguguaggcuggagagacauuguggguguguaucuucuuaucucauuucacaag

SEQ ID NO: 316427 - RNA, 64 nt, hsa
ggcagagccuugacuggauggagguggggagugugguguguaaagucucuggccucauaaaagg

SEQ ID NO: 316428 - RNA, 64 nt, hsa
agcauuuucuauaauuuuauaaaugaaaccauaugguguguacuuuuuaggggguggggcucug

SEQ ID NO: 316429 - RNA, 64 nt, hsa
ugccucagucccccuccagguauuugaaacuacagguguguaccaccacaccgggcuaauuuuu

SEQ ID NO: 316430 - RNA, 64 nt, hsa
aaaugcaaacaugagcagaaaauauuuucccacugguguguagccugcuacaaggaguuguugg

SEQ ID NO: 316431 - RNA, 64 nt, hsa
gaaagcauggcuuuauuuucuuaauggaugucuugguguguaggagcaugcauuuguaggcacc

SEQ ID NO: 316432 - RNA, 64 nt, hsa
ucagaaacuuccaaacgcagugcccuguucugccgguguguacagccucagcgcaccaggagac

SEQ ID NO: 316433 - RNA, 64 nt, hsa
acacgaggaaacauuauucauuggaaaagugcaugguguguauuuuagggauuaugagcuucuu

SEQ ID NO: 316434 - RNA, 64 nt, hsa
guuuuuaaguccuguauauguauguaguaguuuggguguguauauauaguagcauuucaaaaug

SEQ ID NO: 316435 - RNA, 64 nt, hsa
uaaaccuguaagcccagcauuugagagaagguaggguguguauauauaaaagguuguguacaac

SEQ ID NO: 316436 - RNA, 64 nt, hsa
cuacagaaaaauuuuaaaauuagcugggcguggugguguguaccuguaggccuagcugcucagg

SEQ ID NO: 316437 - RNA, 64 nt, hsa
ggcugagcaagccaggaagggaaggagucugugugguguguaugugcaugcagccuacacccac

SEQ ID NO: 316438 - RNA, 64 nt, hsa
aaucacauaaauauagcgagcucuacuaaguacagguguguauaauguaucagggaccauggcc

SEQ ID NO: 316439 - RNA, 64 nt, hsa
caucagcauggcggggcggggggcggggggcggggguguguaugggaaucccucccccucuuac

SEQ ID NO: 316440 - RNA, 64 nt, hsa
acacaaggaggaugaaacgccggaacaaaaaugagguguguagaacagggucccacagguuugg

SEQ ID NO: 316441 - RNA, 64 nt, hsa
acacaucugcuauuuccugugguguucugggcaugguguguaagacccacagaggcuccgggug

SEQ ID NO: 316442 - RNA, 64 nt, hsa
gcagccuaacauuguucaggcgcauggccccugcgguguguacacgaacucggcuucuuuuguc

SEQ ID NO: 316443 - RNA, 64 nt, hsa
aacgggcaugagcagaggugagcgugagcgagcggguguguauguacgagugugcacgugugug

SEQ ID NO: 316444 - RNA, 64 nt, hsa
uccccuagccuuuguccucaccuacccuaaggcagguguguaugcuugaauuccuuccguaugg

SEQ ID NO: 316445 - RNA, 64 nt, hsa
aacccagccacgacugccauguaagguugugcaggguguguacugcacaaggacauuguaugca

SEQ ID NO: 316446 - RNA, 64 nt, hsa
ccaugccggcuggaagaagaaccucgcaucuuuugguguguaugcaccuuggcagccagcagga

SEQ ID NO: 316447 - RNA, 64 nt, hsa
cuucucuaagggcuuuacaaggaucaaauaagaugguguguauguaagaaauuuguaaaaugug

SEQ ID NO: 316448 - RNA, 64 nt, hsa
uuauguguguguguguguguguguguguguguaugguguguauuccauaucuauucccauguaa

SEQ ID NO: 316449 - RNA, 64 nt, hsa
uuuuuguuuguuucuuuuucaugguauuacugaagguguguauacucccuaauacacauuuaug

SEQ ID NO: 316450 - RNA, 64 nt, hsa
agccauggguuuuuuaaccccaaauuauccacaugguguguauuaugaauucuuugaacucuua

SEQ ID NO: 316451 - RNA, 64 nt, hsa
aaaagucaguuaugauugucuggagagaagcugugguguguaugcuguagaguuuccacauuuc

SEQ ID NO: 316452 - RNA, 64 nt, hsa
uccuggguucauguuguaauaaaagaagauuguugguguguaauuaauuuguucaaaagaaaaa

SEQ ID NO: 316453 - RNA, 64 nt, hsa
ccauguaaucagauuuauuuaauuggguggggcagguguguauuuacuuuagaaaaaaugaaaa

SEQ ID NO: 316454 - RNA, 64 nt, hsa
guccaaguauagauuaaggcaacaaacauauuuggguguguaauuugaaguuuuggacugaaau

SEQ ID NO: 316455 - RNA, 64 nt, hsa
auuuccccaguacuuuuagccaaccuuaccaagugguguguaaacuaguauguaugugcuuugc

SEQ ID NO: 316456 - RNA, 62 nt, hsa
uggaguuucucuugagggcaauaaaaguugucaugguguguacguggugcggugugugacug

SEQ ID NO: 316457 - RNA, 64 nt, hsa
agguaaauuguggacucaggauuuuuugaaacuugguguguaacucuaaaucuuguauaugcau

SEQ ID NO: 316458 - RNA, 64 nt, hsa; identical to SEQ ID NO: 316449

SEQ ID NO: 316459 - RNA, 64 nt, hsa
cgcuacuggcaucuguuaucuaguaugcauuucugguguguaucugaaaggaagacauuuucua

SEQ ID NO: 316460 - RNA, 61 nt, hsa
ccaccucagccucccaaagugcugggaugacaggugugagccacugcgcccagccugaauc

SEQ ID NO: 316461 - RNA, 61 nt, hsa
ccaucucagccucccagagugcugggauuacaggugugagcuacugcgcccagccccagaa

SEQ ID NO: 316462 - RNA, 61 nt, hsa
gacauucggauaauucgggcuauuuguauucaggugugagcuggcaaauccgagaccuguu

SEQ ID NO: 316463 - RNA, 61 nt, hsa
gugcucagucugaagacguuggacccaaguuaggugugacacguucacacgacuauguagc

SEQ ID NO: 316464 - RNA, 61 nt, hsa
cugccucggccucccaaagugcugggauuacaggugugagccaccgugcccagccuauacu

SEQ ID NO: 316465 - RNA, 61 nt, hsa
auacagcuuggcacuuuaaagcauuaacagcaggugugacccugagggcuccuccauggug

SEQ ID NO: 316466 - RNA, 61 nt, hsa
caaaauaguagaacucgugguugcuuuggacaggugugauuugugcaagccagguucaacc

SEQ ID NO: 316467 - RNA, 61 nt, hsa
uuuuuguuuuguuuuguuuucuuucuaaucgaggugugaaaaaguucuagguucaguugaa

SEQ ID NO: 316468 - RNA, 61 nt, hsa
ccaucuucgccucccaaaguucugagauagcaggugugagucaucaugcccagccuccuug

SEQ ID NO: 316469 - RNA, 61 nt, hsa
ccaccuuggccucccaaagugcugggauuacaggugugagccaccacgcccggccgauuug

SEQ ID NO: 316470 - RNA, 61 nt, hsa
guauugauuucaaauaggaaguugguagacuaggugugaggaugaaauaaugaccuugauu

SEQ ID NO: 316471 - RNA, 61 nt, hsa
cugccucugccucccaaagugcugggauuacaggugugacccacugcgcacagccccagcu

SEQ ID NO: 316472 - RNA, 61 nt, hsa
caacuagugaaaggcuuugccuccggggggcaggugugacuuccauuucaucagugccugc

SEQ ID NO: 316473 - RNA, 61 nt, hsa
guuucacaguauuucaugaauuuacccacacaggugugauccuccuugagcauugaggagg

SEQ ID NO: 316474 - RNA, 61 nt, hsa
gcacgaucuguauauaguacaucaaacuuagaggugugaccuuaaauuuaacuuuuuuuaa

SEQ ID NO: 316475 - RNA, 55 nt, hsa
uuuacccuaagucgaacugaguauaaggugugacuauuggauucuugaacuaaaa

SEQ ID NO: 316476 - RNA, 61 nt, hsa
ccaccucagccucccaaagugcugggauuacaggugugagccaccacgcccggcuauguuu

SEQ ID NO: 316477 - RNA, 61 nt, hsa
cugccucggccucccaaagugcugagacuacaggugugagccaccgugcucagccacuagc

SEQ ID NO: 316478 - RNA, 61 nt, hsa
ugauuuucgagcuucuguaugcuaagaaaauaggugugaaaaacugguguucugaaauagc

SEQ ID NO: 316479 - RNA, 61 nt, hsa
ccgccucggccucccaaagugccgagauuacaggugugagccaccgcgcucggccagagcu

SEQ ID NO: 316480 - RNA, 61 nt, hsa
gaguucuggggugggaguuuugcucucugucaggugugauaaaauguugaacccuccccac

SEQ ID NO: 316481 - RNA, 61 nt, hsa
accaggaugaaggcgugcaaggggcucagcaaggugugaaugaccuuaguccgcaaguuca

SEQ ID NO: 316482 - RNA, 61 nt, hsa
aggcuucccuuggcucccaaggagguguagcaggugugagcaauauuagugccaugugccu

SEQ ID NO: 316483 - RNA, 61 nt, hsa
uuaggacuuuuuuugaaguuccuuuuuacuuaggugugaaagaugguucuuuguugaaaua

SEQ ID NO: 316484 - RNA, 61 nt, hsa
gaucuuauaagaaaugcaagaggauauugauaggugugaacuaguucaucaaguagcccaa

SEQ ID NO: 316485 - RNA, 61 nt, hsa
uuuucccauuauguucccuuuuauaccauuuaggugugaguuccuuagcuucugccuauag

SEQ ID NO: 316486 - RNA, 61 nt, hsa
ggaaugugauauacagcacccugauccuaacaggugugauuguuacguaagacgcugauac

SEQ ID NO: 316487 - RNA, 61 nt, hsa
cugccuuggccucccaaagugcugggauuacaggugugagcugccacgcccagccccagua

SEQ ID NO: 316488 - RNA, 61 nt, hsa
aggggcuguuauauacauauauacacaaccaaggugugaucugaauuuaauccacauuugg

SEQ ID NO: 316489 - RNA, 61 nt, hsa
ccauuuucugucuuuaauuaaccaagguguuaggugugacugucacaacuguuauguuuuc

SEQ ID NO: 316490 - RNA, 61 nt, hsa
gaguaucauuugccaaccaaaaggcuuucagaggugugaauggaucuccaaggauaagugu

SEQ ID NO: 316491 - RNA, 61 nt, hsa
ccaccucggcuucccaaagugcugagauuacaggugugagccaccgcacccggccaacuuu

SEQ ID NO: 316492 - RNA, 61 nt, hsa
ucagaauuccagccgcucaucugaacacagaaggugugaacugaccucuaaagcagcguga

SEQ ID NO: 316493 - RNA, 61 nt, hsa
cagauccuuuuccagaaauaccugucuaggaaggugugaugucagaaacaaugacauccag

SEQ ID NO: 316494 - RNA, 61 nt, hsa
aguugggaggcauguuucugaaaagcaacugaggugugacuguuuggacccaggccucauc

SEQ ID NO: 316495 - RNA, 61 nt, hsa
uaccaaucuuuugugacauauugucaugcugaggugugacaccugcugcacucaucugaug

SEQ ID NO: 316496 - RNA, 61 nt, hsa
guugaagucugagcacuuuauguaaauuucuaggugugagccgugaucacauuuucuauuu

SEQ ID NO: 316497 - RNA, 61 nt, hsa
cugccuuggucuccuaaagugcugggauuauaggugugagccauggcacccggucuugguu

SEQ ID NO: 316498 - RNA, 61 nt, hsa
ucaccucagccucccgaguagggaggaccacaggugugagccaccacaccuggcuaauuuu

SEQ ID NO: 316499 - RNA, 61 nt, hsa
ccaccucagccucccaaagugcugggauuacaggugugagccaccgcacccggcuggccaa

SEQ ID NO: 316500 - RNA, 61 nt, hsa
gcccaagcccuuccaccagaaaagcuagucuaggugugagagcccacauugucuguagcca

SEQ ID NO: 316501 - RNA, 61 nt, hsa
uugcaaauaugcauuuccaaacuugaaauauaggugugaacaguguguaccaguuuaaagc

SEQ ID NO: 316502 - RNA, 61 nt, hsa
ccaccucggccucccaaagugcugggauuacaggugugagccacagcgccuggcccagugu

SEQ ID NO: 316503 - RNA, 61 nt, hsa
ccgccucagccucccaaagugcugggauuacaggugugagccacugcacccagccuaccuu

SEQ ID NO: 316504 - RNA, 61 nt, hsa
aauuuuaaaaucaggaaagaauaaaucagccaggugugaugacuuguaacuguaaucccag

SEQ ID NO: 316505 - RNA, 61 nt, hsa
gcagaggccuccaccaaggccaucaauaaccaggugugagcuacaggucucuguguaaugu

SEQ ID NO: 316506 - RNA, 61 nt, hsa
aauagugggucugcugcuacuuucuguuuuaaggugugagguaacaauucaaucucuucuu

SEQ ID NO: 316507 - RNA, 61 nt, hsa
ggagagugcagagaaauaucuaccucccuggaggugugaagacuagguuuuucuucuuccu

SEQ ID NO: 316508 - RNA, 61 nt, hsa
gugcucagucugaagacaauggacccacguuaggugugacacguucacauaacugugcagc

SEQ ID NO: 316509 - RNA, 61 nt, hsa
ugucuuuggacuuguagaccucuuggauuccaggugugauggaguaaagugugggauuguu

SEQ ID NO: 316510 - RNA, 61 nt, hsa
cuuugcugacugccaacuuagugccaagaggaggugugaugacagcuauggaggcccccag

SEQ ID NO: 316511 - RNA, 61 nt, hsa
aaugcucaagaugugaugggccuggugguacaggugugacauuuguuaccacccauuucuc

SEQ ID NO: 316512 - RNA, 61 nt, hsa
cugccucggccucccaaagugcugggauuacaggugugagccaccacgcccgguacauauu

SEQ ID NO: 316513 - RNA, 61 nt, hsa
cgcuccaccccuuagccugggaacccaccgcaggugugaguucugugagucacugcuaaga

SEQ ID NO: 316514 - RNA, 61 nt, hsa
caagagaagcuaagcggaaauggaggguggaaggugugaucugugggacugucugggccug

SEQ ID NO: 316515 - RNA, 61 nt, hsa
ccaccucggccucccaaaguucugggauuacaggugugagcgaccacauccggucaaguuc

SEQ ID NO: 316516 - RNA, 61 nt, hsa
ugaaauucucugaaaaucccauuaggaaaccaggugugaaaagggcucaguagcuucucug

SEQ ID NO: 316517 - RNA, 61 nt, hsa
cugccucggacucccaaagugcugggauuacaggugugagccaccgcaccuggccuaaacc

SEQ ID NO: 316518 - RNA, 61 nt, hsa
cauuuauauugcccaucuccugugucuucaaaggugugagagcugaggaauauguguuccu

SEQ ID NO: 316519 - RNA, 61 nt, hsa
ccaaaacaggacuguggugacaacucuggucaggugugauuugacaugagggccggaggcg

SEQ ID NO: 316520 - RNA, 61 nt, hsa
ggcugcauuuagaucaccgugugcucaggccaggugugaauccugagguccauggaggugc

SEQ ID NO: 316521 - RNA, 61 nt, hsa
acccaccuuagccucccaaagugcugggauuaggugugagccaccgcaccuggccgauauu

SEQ ID NO: 316522 - RNA, 61 nt, hsa
ugucggcuuuuugccaucugugauaugccauaggugugacaauccgagcaguggagucauu

SEQ ID NO: 316523 - RNA, 61 nt, hsa
aaaggccagagaugggccuccuucccuggggaggugugauguaguuaucacauucaggacc

SEQ ID NO: 316524 - RNA, 61 nt, hsa
caauagacuggccccaacucaggcuggacuaaggugugauuaauucuuuguuuuuugugug

SEQ ID NO: 316525 - RNA, 61 nt, hsa
uugcgcgcggugccggcugggucuguaccaaaggugugaaggaaagaagacaccgaccacg

SEQ ID NO: 316526 - RNA, 61 nt, hsa
uuauccucucaacuagauuguaagcacuuggaggugugacuuacaggucuuuguaucucac

SEQ ID NO: 316527 - RNA, 61 nt, hsa
cugcucaagagaaacccugagaaaccccaguaggugugagcuccuggguguucauucauuu

SEQ ID NO: 316528 - RNA, 61 nt, hsa
ccaccucggccuccgaaagugcuaggauuacaggugugagccacugugccuggccuccggu

SEQ ID NO: 316529 - RNA, 61 nt, hsa
acuuuaaucugcuuuuauguuuucaggcugaaggugugaaaauccuaagaggauuucauau

SEQ ID NO: 316530 - RNA, 61 nt, hsa
cugccucagccucccaaagugcugagauuacaggugugagccaccaggcucagcccccuaa

SEQ ID NO: 316531 - RNA, 61 nt, hsa
aauaugugacuuuuuaaaaaagcugucaaauaggugugacccuacuaauaauuauuagaaa

SEQ ID NO: 316532 - RNA, 61 nt, hsa
cugccuuggccuuccagagugcugggauuacaggugugagccaccacgcccagccuugcau

SEQ ID NO: 316533 - RNA, 61 nt, hsa
ccgccuuggccucccaaagugcugggauuacaggugugagccacuauacccgaccagauca

SEQ ID NO: 316534 - RNA, 61 nt, hsa
caaguucucccugaaagagggcagucacaagaggugugaagaguagcagccgaugcucucu

SEQ ID NO: 316535 - RNA, 61 nt, hsa
ugggcuuccccuuacccagggcugcacagccaggugugagggucaccggcaggugggcugg

SEQ ID NO: 316536 - RNA, 61 nt, hsa
uguugcaauuaaguuuuaguacuuguaugaaaggugugaauuagaaagucacauauauaca

SEQ ID NO: 316537 - RNA, 61 nt, hsa
cuuucccugcaguccuuccaugugggagcagaggugugaagagaauuuacgugguugugau

SEQ ID NO: 316538 - RNA, 61 nt, hsa
cacaggagguccugaugucaucacugcacgcaggugugagaggagagaccucuucugcacc

SEQ ID NO: 316539 - RNA, 61 nt, hsa
gagcugacuaucucuuuugauguguguacauaggugugagugugucuguaugcgugccugu

SEQ ID NO: 316540 - RNA, 61 nt, hsa
ccgccucagccucccaaagugcugggauuacaggugugagccaccaggcccagccuauauc

SEQ ID NO: 316541 - RNA, 61 nt, hsa
ugaaauaaauacuagcugaguaaaggcaagcaggugugaagagcagggcucagcagcaagu

SEQ ID NO: 316542 - RNA, 61 nt, hsa
cuguuuaaggcucuucauccugguuagcaaaaggugugaauguaaugugauggaauuuaaa

SEQ ID NO: 316543 - RNA, 61 nt, hsa
auuuuagcaaggggagguaggaguggaagagaggugugaagaaaccucuccgaacaaauga

SEQ ID NO: 316544 - RNA, 61 nt, hsa
gggagugagucacaggagccugucccccaacaggugugacugcucugacaaccuguggcau

SEQ ID NO: 316545 - RNA, 61 nt, hsa
ccgccuuggccucccaaagugcugggauuacaggugugagccaccaugccuggcccuaauu

SEQ ID NO: 316546 - RNA, 61 nt, hsa
cugccucagccucccaaagugcugggauuacaggugugagucaccacaucuggucggauuu

SEQ ID NO: 316547 - RNA, 61 nt, hsa
ucagcuugaacugccagugcaccagcaguuuaggugugaugagagaauucagauauacuuu

SEQ ID NO: 316548 - RNA, 61 nt, hsa
ugggggcugaagaccauccucuugaccacagaggugugacugugggaauuccucccaauuu

SEQ ID NO: 316549 - RNA, 61 nt, hsa
aggagaguaccugcugcaggaccuggaggucaggugugaaugcuguauuggcacagggaau

SEQ ID NO: 316550 - RNA, 61 nt, hsa
ucccugcauuuuuuuuuuuuuuuugagagagaggugugaugagggaugugugugugcagcu

SEQ ID NO: 316551 - RNA, 61 nt, hsa
ccgucucagccucccaaagggcugagauuacaggugugagcuaccucaccuggccaaaaca

SEQ ID NO: 316552 - RNA, 61 nt, hsa
ccaccucagccucccaaacugcugggauuacaggugugagccaccgugaccagccaaugug

SEQ ID NO: 316553 - RNA, 61 nt, hsa
cugccucagucucucaaagugcugggauuacaggugugagccacugugcccagccuaauug

SEQ ID NO: 316554 - RNA, 61 nt, hsa
aaguggguugggguacagacgaaacaggaguaggugugaguugauaauguugaaguugagu

SEQ ID NO: 316555 - RNA, 61 nt, hsa
ccucauaccuugcccauucccucugaauauuaggugugaugucaacagcauguuagaagga

SEQ ID NO: 316556 - RNA, 61 nt, hsa
agaaccuuggagaucagaacugauucucaccaggugugagaggugugguagcagauugcaa

SEQ ID NO: 316557 - RNA, 61 nt, hsa
caaacaggaucuaagcuuaggaauaauauuuaggugugauauaguguuagauuuuuuugau

SEQ ID NO: 316558 - RNA, 61 nt, hsa
ugaggaaaaaagauugcacuccaggauuaggaggugugagauauuuuagcuuuuuugucuu

SEQ ID NO: 316559 - RNA, 61 nt, hsa
ccgccucggccucccaaaaugcugggauuacaggugugagccacugugcccggccaaaaga

SEQ ID NO: 316560 - RNA, 61 nt, hsa
ccgccuuggccacccaaagugcugggauuacaggugugagacacugugccuggccagauau

SEQ ID NO: 316561 - RNA, 61 nt, hsa
cccaccuugccucccaaagugcugggauuacaggugugagccaccacgcauggcccugaac

SEQ ID NO: 316562 - RNA, 61 nt, hsa
aauguuaccagcccaccuucugaagccugggaggugugaacccagggcccgccaaccgcug

SEQ ID NO: 316563 - RNA, 61 nt, hsa
uugcugggugaucauacauacaucaacaugaaggugugacaucagaaucaugagcaccaug

SEQ ID NO: 316564 - RNA, 61 nt, hsa
ccgccucggccucccgaagugcugggauuacaggugugagccacugggcccggucuuuuuu

SEQ ID NO: 316565 - RNA, 61 nt, hsa
ccuccccagccucccaaagugcugggauuacaggugugagccaccacagccagccaguaug

SEQ ID NO: 316566 - RNA, 61 nt, hsa
ccuccacagccucccaaacugcugggauuacaggugugagccaccgcacguagcauuuaca

SEQ ID NO: 316567 - RNA, 61 nt, hsa
ccgccucagcuucccaaagugcugggauuacaggugugagucacugcacccagccgaguug

SEQ ID NO: 316568 - RNA, 61 nt, hsa
aaguuaacaaaucaacuuccauuuggauuguaggugugaaggcacaacucuaauugcuauu

SEQ ID NO: 316569 - RNA, 61 nt, hsa
ccaccucagccucccaaagugcugggauuacaggugugagccaccacacuuggccaguaua

SEQ ID NO: 316570 - RNA, 61 nt, hsa
gucuuaugaaccuuaugagaaaacuccgaagaggugugagcaggauucuucugaaugacug

SEQ ID NO: 316571 - RNA, 61 nt, hsa
ccaccucggccucccaaagugcugggauuacaggugugagccacugugccuggccccccac

SEQ ID NO: 316572 - RNA, 61 nt, hsa
ccgucucggccucccaaagugcugggauuacaggugugagccaccacgccuggcccaugaa

SEQ ID NO: 316573 - RNA, 61 nt, hsa
cugccuuggccucccaaagugcugggauuacaggugugagccaccacgccuggccggcuua

SEQ ID NO: 316574 - RNA, 61 nt, hsa
augcugcaugaaagcguuaucucuuccuuacaggugugagcaccuuuccugaaauucugac

SEQ ID NO: 316575 - RNA, 61 nt, hsa
agauguauucauccugguguuacugaaaaacaggugugauccuguuacugauacuauaagu

SEQ ID NO: 316576 - RNA, 61 nt, hsa
aagagaggcagaucaggaugucagcgugaugaggugugagacagacuugacuugcuguugc

SEQ ID NO: 316577 - RNA, 61 nt, hsa
uccuucauucagacgggcucugauuuacugaaggugugauggagcuuauugucaaagccaa

SEQ ID NO: 316578 - RNA, 61 nt, hsa
cugaguguguccagauaccaagugaggaaugaggugugauuugcuguaucauuugaaccaa

SEQ ID NO: 316579 - RNA, 61 nt, hsa
ccgccuuggccucccaaagugcugggauuacaggugugagccaccgugcccggccaaguaa

SEQ ID NO: 316580 - RNA, 61 nt, hsa
ugugucaacuuugauccuuugucucccaggaaggugugaccucuccuuugccugcauaccu

SEQ ID NO: 316581 - RNA, 61 nt, hsa
ccagccucggccuucugaagugcugggauucaggugugagccacugugcccagcagggaug

SEQ ID NO: 316582 - RNA, 61 nt, hsa
cugccucugccucccgaagugcuuggauuacaggugugagccacuguguccagccuguaac

SEQ ID NO: 316583 - RNA, 61 nt, hsa
guuuugagaaggcccaacaggaguuugcaacaggugugauguccaacaaaacuguccagac

SEQ ID NO: 316584 - RNA, 61 nt, hsa
ccgccucagccucccaaaguguugggauuacaggugugagccacugcgccuggccuaaaca

SEQ ID NO: 316585 - RNA, 61 nt, hsa
gugugacaagccaguucuacaggcauuaccuaggugugagacuaaaagcuuuucuuauuga

SEQ ID NO: 316586 - RNA, 61 nt, hsa
uuucuuauugacuuaaauuuggauaacagcaaggugugaggggggugguggguauggugug

SEQ ID NO: 316587 - RNA, 61 nt, hsa
ccacuucagacccccaaagugcugggauuccaggugugagccgcugcggccgaccacauuu

SEQ ID NO: 316588 - RNA, 61 nt, hsa
uuguggagcagaagaaggagucccucacccuaggugugagaugggauucuggaagcuuccu

SEQ ID NO: 316589 - RNA, 61 nt, hsa
ugugcuaucgugcuguuccuacucaguaaacaggugugaugaguuaacaagaaauaacacu

SEQ ID NO: 316590 - RNA, 61 nt, hsa
aaucccucuccuuccgcuggguccccuggggaggugugaacucaagggccuagccccaaaa

SEQ ID NO: 316591 - RNA, 61 nt, hsa
aaaaaaacaaaaauguacaugugauguuaguaggugugauaugcaaccugguauacagaca

SEQ ID NO: 316592 - RNA, 61 nt, hsa
aagguggcuagcuaagugaaaaaagccugcuaggugugagucaacuuaagaauauguaaau

SEQ ID NO: 316593 - RNA, 61 nt, hsa
ccacuucagcuucccaaagcacugggauuacaggugugagccacugugcccggcaaauuuu

SEQ ID NO: 316594 - RNA, 61 nt, hsa
cugccuccaccucccaaaaugcugagauuacaggugugagccaccaugccuggccuaaacu

SEQ ID NO: 316595 - RNA, 61 nt, hsa
ccaccucagccucccaaagugcugggauuacaggugugagccaccgcagccggaccauuuu

SEQ ID NO: 316596 - RNA, 61 nt, hsa
uagcaaggugccuuuguaccucagguguuuuaggugugagauguuucagugaaccaaaguu

SEQ ID NO: 316597 - RNA, 61 nt, hsa
gcauuuaauaaaaaaaaagagagagagagagaggugugagggacaaaaugcaaaccuauuu

SEQ ID NO: 316598 - RNA, 61 nt, hsa
acacaaucaaauauaaauugcaagaugucacaggugugaugaagggagaguaggagagacc

SEQ ID NO: 316599 - RNA, 61 nt, hsa
ccugucucuacuaaaaauacaaaaauuagccaggugugauggugggugccuguaaucccag

SEQ ID NO: 316600 - RNA, 61 nt, hsa
caguuuccaucucccuaagagcugggauuacaggugugagccgcuguacccgaacuuuuuu

SEQ ID NO: 316601 - RNA, 61 nt, hsa
cugccucagccucccugguagcugggauuacaggugugagccacugcacccacccaagaca

SEQ ID NO: 316602 - RNA, 61 nt, hsa
ccucccaaaaugcugggagccaccaggcaccaggugugaucuaccacaccugucuaaaaag

SEQ ID NO: 316603 - RNA, 61 nt, hsa
cugccucggccucccaaagugcugagauuacaggugugagccacccugcccagccgucaaa

SEQ ID NO: 316604 - RNA, 61 nt, hsa
cugccuuggccucccaaaaugcugagauuacaggugugagccacugcaccucgccagaugu

SEQ ID NO: 316605 - RNA, 61 nt, hsa
cugccuuggcacccaaaguguugagauuuacaggugugagccaccacaccaggccagagcu

SEQ ID NO: 316606 - RNA, 61 nt, hsa
ggaucugagcaagugcaagccuggcugacacaggugugaagaggccauccuggaacccagg

SEQ ID NO: 316607 - RNA, 61 nt, hsa
gguuggggacccagggaacaucggucuacucaggugugagggggcaggucugaccugcccc

SEQ ID NO: 316608 - RNA, 61 nt, hsa
acagcaccuuguugccagagauucuacacaaaggugugauggacacugaugcucuauuaag

SEQ ID NO: 316609 - RNA, 61 nt, hsa
gagcgaguauugugauuuugcugaaaagacaaggugugaaggagcaacuucaguugacaca

SEQ ID NO: 316610 - RNA, 61 nt, hsa
ccgccucagccucccaaagugcugggauuacaggugugagccaccgcaccuggccucuguc

SEQ ID NO: 316611 - RNA, 61 nt, hsa
uucacugcuacauaggauuuugucaaauugaaggugugacaagaugguguucugcuaaugu

SEQ ID NO: 316612 - RNA, 61 nt, hsa
ucuaacgcaaaaauagcucuugcuuugacuuaggugugaagacccagacaggacugcagag

SEQ ID NO: 316613 - RNA, 61 nt, hsa
cugccucggccucccaaagugcagggcuuacaggugugagccacagugcccagcuuuuuuu

SEQ ID NO: 316614 - RNA, 61 nt, hsa
aaacagaaauagaugguggaagaacugccuaaggugugaaaagcugaagauucuaccacug

SEQ ID NO: 316615 - RNA, 61 nt, hsa
uauauaugcuuaauggccuggggcucaauacaggugugaaucuauacaaagugauggaagc

SEQ ID NO: 316616 - RNA, 61 nt, hsa
ccauauuuuuuuaaugggacauuuuagagaaaggugugauuugacugguuuuauuuuucuc

SEQ ID NO: 316617 - RNA, 61 nt, hsa
cugucucggccucccgaagugcugggauuauaggugugagccaccgcacccaguugggaac

SEQ ID NO: 316618 - RNA, 61 nt, hsa
ccgccucgaccucccaaagugcugugauuacaggugugagccacugcacccggccugaaau

SEQ ID NO: 316619 - RNA, 61 nt, hsa
ccaggcagacacaccccgcugugccuuaggaaggugugagaccggcuucccccauccccac

SEQ ID NO: 316620 - RNA, 61 nt, hsa
cuacuucuuccucccaaaguguugggauuauaggugugagccacugcacccagccuacuuc

SEQ ID NO: 316621 - RNA, 61 nt, hsa
ccaccucgaccucccaaagugcugggauuacaggugugagccaccucgccugggcccccuu

SEQ ID NO: 316622 - RNA, 61 nt, hsa
ccuucuuugguuuaauuuucuaugugcuuuuaggugugaauccagauaugcggucuuaauu

SEQ ID NO: 316623 - RNA, 61 nt, hsa
cccgccuuggccuccaaagugcugggauuacaggugugagcuaccgcgcccggccuauuau

SEQ ID NO: 316624 - RNA, 61 nt, hsa
cucagaaguaggacugaauucuacuauugcuaggugugagaaagugguggugagaaccuua

SEQ ID NO: 316625 - RNA, 61 nt, hsa
auguggucucugugugugcgugugugggcacaggugugagugugugagugacaguuacccc

SEQ ID NO: 316626 - RNA, 61 nt, hsa
aaaaagaaaagaaaaagccuguuuaaugcacaggugugaguggauugcuuauggcuaugag

SEQ ID NO: 316627 - RNA, 61 nt, hsa
ccuccuuggccucccagagugcugggauuacaggugugagccacugugccgggcccguccc

SEQ ID NO: 316628 - RNA, 61 nt, hsa
ccacgccaaguggaagccacuggaccacaggaggugugauagagccuuugaucuucaggau

SEQ ID NO: 316629 - RNA, 61 nt, hsa
ggacaagcuguuuccuucuucugaccaacccaggugugaccuggggaugcagagcuuucug

SEQ ID NO: 316630 - RNA, 61 nt, hsa
ccaccuuggccucccaaaguucuaggauuacaggugugagccaccacguccggccaauuuu

SEQ ID NO: 316631 - RNA, 61 nt, hsa
uuaauucuuaagauguguagaccuugaugguaggugugacauguuaguuuuucuuacuugc

SEQ ID NO: 316632 - RNA, 58 nt, hsa
gucaugugcaggagcacugaggcaucccaggugugacacucuuccaccuagagcauuc

SEQ ID NO: 316633 - RNA, 61 nt, hsa
uguaguacaagauuaucuuauuccccugcccaggugugagcacgugcucucgcucccuuuc

SEQ ID NO: 316634 - RNA, 61 nt, hsa
ccugcaaacgugcuuuuugaacucauuggccaggugugauuuuuacacaagguaaacgugg

SEQ ID NO: 316635 - RNA, 61 nt, hsa
uuuaucaggacuaacauuuucagaaauagcaaggugugaucuaguauuagauucacagaac

SEQ ID NO: 316636 - RNA, 61 nt, hsa
cccuuugccacguccccuuagcuuagugaucaggugugagaguggccauuuccuuaccuuu

SEQ ID NO: 316637 - RNA, 61 nt, hsa
acaaagagaugcuuggagcaaucagaacuucaggugugacucuagcaaggcucaucuuucu

SEQ ID NO: 316638 - RNA, 61 nt, hsa
cuuuguuucuuuguuuuauuuaggcaagaagaggugugaguaauugaggaaaaacugacag

SEQ ID NO: 316639 - RNA, 61 nt, hsa
ggaaaaauuugaaguauuagacuucuaaauaaggugugaaaucaucaaaaagaaaaaucaa

SEQ ID NO: 316640 - RNA, 61 nt, hsa
cuauaggaugauuggaauuauuaauuuuuaaaggugugauaagauacugcacuuggcuggg

SEQ ID NO: 316641 - RNA, 61 nt, hsa
aaggauuuugacaggugaccauaaaaaccagaggugugacaggcucuagucuccucccugu

SEQ ID NO: 316642 - RNA, 61 nt, hsa
caggccagcuccucugcccacaugucauacaaggugugaauuugagcacaguccagaaaug

SEQ ID NO: 316643 - RNA, 61 nt, hsa
acacaaguaauacuacuggguaaccagaaucaggugugaauguguugagauuuuuuacugu

SEQ ID NO: 316644 - RNA, 61 nt, hsa
augcuguguucacccuucuugguagaagcuaaggugugagcugggagguugcuggacagga

SEQ ID NO: 316645 - RNA, 61 nt, hsa
auuugacauuauuuuagaucccagagaaaucaggugugauuaguucuccaggcaugaaugc

SEQ ID NO: 316646 - RNA, 61 nt, hsa
ccaccuccaccucccaaacugcugggauuacaggugugagccaccaugcccaacacccacu

SEQ ID NO: 316647 - RNA, 61 nt, hsa
cuaguuggaaucguuuacucugcuagaauuuaggugugagauuuuuuguuucccagguaua

SEQ ID NO: 316648 - RNA, 61 nt, hsa
ucacaguagggugaguuaaguaugugcccucaggugugaaggagcacaggugagggggugc

SEQ ID NO: 316649 - RNA, 61 nt, hsa
ucaccucggccucccaaagugcugggauuacaggugugagccaccaugccugggcuaaacu

SEQ ID NO: 316650 - RNA, 61 nt, hsa
aagagcaauagaaccuuuaagacaguauuaaaggugugaaacaauggcauucaaagugucu

SEQ ID NO: 316651 - RNA, 61 nt, hsa
auguaauacaagcguuucuacaggguaccagaggugugaaauaugugacacuuaagaacag

SEQ ID NO: 316652 - RNA, 61 nt, hsa
cuuccucauccuucuaaagugcugggauuacaggugugagccacagcacucggccuaaaua

SEQ ID NO: 316653 - RNA, 61 nt, hsa
cucuuggccuuuccccuugcagggguugugcaggugugaauaaagagaauaaggaaguucu

SEQ ID NO: 316654 - RNA, 61 nt, hsa
uugauuuggauccacaggcagagccaagggaaggugugauucucugaggaaagagugauuc

SEQ ID NO: 316655 - RNA, 61 nt, hsa
uagggguuuacucauuuuucuucccugagccaggugugacaagccaacucugucaccauuc

SEQ ID NO: 316656 - RNA, 61 nt, hsa
ugagcacagggaugggcaccugcaccccagaaggugugagcugucucucugccaggagcua

SEQ ID NO: 316657 - RNA, 61 nt, hsa
uaaucuguuguaguggugagcugauacauucaggugugaccguuggugaaaacuugugccc

SEQ ID NO: 316658 - RNA, 61 nt, hsa
caaacaaggucagucuaaaguggcagguccuaggugugaccugauaccaccacccuuugug

SEQ ID NO: 316659 - RNA, 61 nt, hsa
ccaccucggccucccaaagugcugggauuauaggugugagccaccgcgccgggccgguugc

SEQ ID NO: 316660 - RNA, 61 nt, hsa
gaaccucccccauuuaaauacucagaagauaaggugugaauguauguauuauuagaguccg

SEQ ID NO: 316661 - RNA, 61 nt, hsa
cagcagacagcuacuugggcaugaagagccaaggugugaaaagcagauuugauuuuucagu

SEQ ID NO: 316662 - RNA, 61 nt, hsa
ucccacagcagccgguaaggaaguggguggcaggugugaggggaugcuguguuuggggggu

SEQ ID NO: 316663 - RNA, 61 nt, hsa
ccgccucagccucccaaagugcugagauuacaggugugagcuaccgcaccccgccgagguu

SEQ ID NO: 316664 - RNA, 61 nt, hsa
guuaacuugcauauuguuggcacagaacaggaggugugaaugcacguuucaaagcuuuccu

SEQ ID NO: 316665 - RNA, 61 nt, hsa
cuaucuugugugugcguuagacuugaugagaaggugugaacucugcagaaagucucuucuu

SEQ ID NO: 316666 - RNA, 61 nt, hsa
augugaaugcaaccagcaaauuuauccuugaaggugugaugguagaaauaggaaaacaaca

SEQ ID NO: 316667 - RNA, 61 nt, hsa
cucauguccaccugccugccagccaggcuacaggugugacuuccuucucuaaacuguuaca

SEQ ID NO: 316668 - RNA, 61 nt, hsa
cugucucggccucccaaagugcugggauuaaaggugugauccaccaugcccgggcugaaau

SEQ ID NO: 316669 - RNA, 61 nt, hsa
cccugagacuuggugauggggggauugcgguaggugugacccaccagccucugagacacca

SEQ ID NO: 316670 - RNA, 61 nt, hsa
ccacccuggccucccagagugcugggauuacaggugugagccaccaugcucugccaauuau

SEQ ID NO: 316671 - RNA, 61 nt, hsa
uguugcugguaguaugugaaucuuccaaucuaggugugaucguguccucauaugaaucagg

SEQ ID NO: 316672 - RNA, 61 nt, hsa
cagacugucuguauucaauggcuaucuucacaggugugaucauaccacauucacuucugaa

SEQ ID NO: 316673 - RNA, 61 nt, hsa
gaagaguggcucuuagcagaggcacuuuggaaggugugaggcauaaaugcuuccuucuacg

SEQ ID NO: 316674 - RNA, 59 nt, hsa
ugccaccucagagagagugaacccagcagaggugugacgggaggcuggggagagacccc

SEQ ID NO: 316675 - RNA, 61 nt, hsa
uagcagccccagggaggaugcugccuccaagaggugugagcccucugucucggggaugaac

SEQ ID NO: 316676 - RNA, 61 nt, hsa
ggcugacgugugagggaggacaggcgggaggaggugugaggaggaggcucccgaggggaag

SEQ ID NO: 316677 - RNA, 61 nt, hsa
cugccucggccucucagagagcugggauuacaggugugagccgccgugcccagccauugca

SEQ ID NO: 316678 - RNA, 61 nt, hsa
uagacucuguugaaaagaaagaagcuaagcuaggugugaagaauggaauuggaagcccacu

SEQ ID NO: 316679 - RNA, 61 nt, hsa
auguggaauuuuccagcaaaauguuuaacucaggugugauuuuugaaaaugucucuguaau

SEQ ID NO: 316680 - RNA, 61 nt, hsa
ccaccucagcgucccgaagugcugggauuacaggugugagccaccgcgccuggccugggcu

SEQ ID NO: 316681 - RNA, 61 nt, hsa
cugccccugucucccaaagugcuaggauuacaggugugagccaccacaccuggcccauagu

SEQ ID NO: 316682 - RNA, 61 nt, hsa
ccgccucagccucccaaaguguugggauuacaggugugaaccacugugcccggccugugua

SEQ ID NO: 316683 - RNA, 61 nt, hsa
ccacuugaaggaagaagucuaagagugaaguaggugugacuugaacuagauugcaugcuuc

SEQ ID NO: 316684 - RNA, 61 nt, hsa
ucucagccugccuccgaguagcugggacuacaggugugagucaccacuguauuuuuugcag

SEQ ID NO: 316685 - RNA, 61 nt, hsa
cguggccgccacgcagugugcuuagggccugaggugugaaagcccagggcuccagagcucg

SEQ ID NO: 316686 - RNA, 61 nt, hsa
aauucguguguuuuuuuaugaauggguggaaaggugugagacugggaaggcuugggauuug

SEQ ID NO: 316687 - RNA, 61 nt, hsa
ccaccuugaccucccaaagugcugggacuauaggugugagccacuguaccaggcuauauau

SEQ ID NO: 316688 - RNA, 61 nt, hsa
cugcaaagaagucaagcuuuuuucagacaaaaggugugagggggcuugcuugguaugcuua

SEQ ID NO: 316689 - RNA, 61 nt, hsa
ccaccucagccuuucaaagugcuggaauuacaggugugagccacucugccuggccuaccac

SEQ ID NO: 316690 - RNA, 61 nt, hsa
agaaaaaaagcugcaaaaauuauauauugcaaggugugauggucuggcuugggugaauuuc

SEQ ID NO: 316691 - RNA, 61 nt, hsa
ccuaucaccuccagcacaaucccagugaaaaaggugugaagcacccaccauguucuugaac

SEQ ID NO: 316692 - RNA, 61 nt, hsa
aucccaaaugcagcaguggguucugaguuguaggugugacucccacuugcuggugaauaau

SEQ ID NO: 316693 - RNA, 61 nt, hsa
cugccucggccucccaaagugcugggauuacaggugugagccacccugcucaaccagguuu

SEQ ID NO: 316694 - RNA, 61 nt, hsa
uguccuccugcaaggacgcaacugugagcugaggugugagccuaggagcccaggaccccug

SEQ ID NO: 316695 - RNA, 61 nt, hsa
ucaaacgcaacuguuucuacuuccccauuucaggugugagauguaacccaccuugaccaua

SEQ ID NO: 316696 - RNA, 61 nt, hsa
ccucuucauucccccuccuguggugagggcuaggugugaucaacacuuuucuucuccauuc

SEQ ID NO: 316697 - RNA, 61 nt, hsa
ugcuguuuacagugucagauuaacauuugaaaggugugauuucuccaauuuacccucuuug

SEQ ID NO: 316698 - RNA, 61 nt, hsa
caggcagcugccacaggccuaaggcugagugaggugugauugggcccuccggcuggauguu

SEQ ID NO: 316699 - RNA, 61 nt, hsa
ccaaccccauuuccucucccuguuguccucaaggugugaugcuucgaugcaaggaguccag

SEQ ID NO: 316700 - RNA, 61 nt, hsa
acuggcagaguaagagaaggggagagauaauaggugugauuauuuuaauauggagguggga

SEQ ID NO: 316701 - RNA, 61 nt, hsa
auucuuuauugacuuuuugcccuaaauugcuaggugugacccagcaaucuuuuaggaagag

SEQ ID NO: 316702 - RNA, 61 nt, hsa
ccaccuuggccucccaaagugcugggauuacaggugugagucaccacaccuggcugcauag

SEQ ID NO: 316703 - RNA, 61 nt, hsa
uagugccuuuacuucaggcuugauaauacuuaggugugauuauaaaaucaugaagcaggua

SEQ ID NO: 316704 - RNA, 61 nt, hsa
acgguggcagaugagugggagacugguugcaaggugugaccgcaggaauccuggaggaaua

SEQ ID NO: 316705 - RNA, 61 nt, hsa
acuguggcagaugagugggagacugguugcaaggugugaccgcaggaauccuggaggaaca

SEQ ID NO: 316706 - RNA, 61 nt, hsa
gucguuaugaagcauucaacugugcucugugaggugugaaauuaaaaacauuauguuucac

SEQ ID NO: 316707 - RNA, 61 nt, hsa
gaagugugaguuaaaaauauugaauauuggcaggugugaaaacaagugucaaaauuccuca

SEQ ID NO: 316708 - RNA, 61 nt, hsa
agcagccuuccuaaacucagaguuuuaauaaaggugugaggaggcuggggccaguugacac

SEQ ID NO: 316709 - RNA, 61 nt, hsa
uuuuauaaaacuacaaacugaggcucagagaaggugugaccucuuguugcuugaggcacag

SEQ ID NO: 316710 - RNA, 61 nt, hsa
cugccucggccucccaaagugcugggauuacaggugugagccaccgugcccagccaaagac

SEQ ID NO: 316711 - RNA, 61 nt, hsa
auuuauauccuacugcucaaggucaucgccaaggugugauuggaaaaauucaaaaaauugc

SEQ ID NO: 316712 - RNA, 61 nt, hsa
ccgccucagccucccaaagugcugggauuacaggugugagcugccgcacccggccguuccc

SEQ ID NO: 316713 - RNA, 61 nt, hsa
ccacauuggccucccaaagugcugggauuacaggugugauccaccgcaccuggcccuaacu

SEQ ID NO: 316714 - RNA, 61 nt, hsa
guaagcugugcagaaccugcugcuaacaccaaggugugaacaugcccugaugccuaaccaa

SEQ ID NO: 316715 - RNA, 61 nt, hsa
gauguaguuauuguuauaauccucauccuaaaggugugagaaacagaguuauuaaguaagu

SEQ ID NO: 316716 - RNA, 61 nt, hsa
ugccagauccucuucucaaagcugggauuacaggugugagcauagugagaccuuggcgcua

SEQ ID NO: 316717 - RNA, 61 nt, hsa
cuaccucggcuucccaaagugcucggauuacaggugugagccacugugccuagccuauaau

SEQ ID NO: 316718 - RNA, 61 nt, hsa
caugagucuaaguauagccacugauggugacaggugugagucuggcuggaacacuuucagu

SEQ ID NO: 316719 - RNA, 61 nt, hsa
cugccucagccucccaaaguacugggauuauaggugugagcuacuguacccagccuuaacc

SEQ ID NO: 316720 - RNA, 61 nt, hsa
ccgccucggccucccaaaaugcugggauuagaggugugagccacugugcccagcccaucaa

SEQ ID NO: 316721 - RNA, 61 nt, hsa
gucuccaggggaucccuguuucccaacugaaaggugugaacggacacacacacagccugga

SEQ ID NO: 316722 - RNA, 61 nt, hsa
ggugcucaggcuuugcccaggugccaggagaaggugugagcaugagccuauuggacacacc

SEQ ID NO: 316723 - RNA, 61 nt, hsa
cccaccuuggccucccaaagugcuggauuacaggugugagccaccgugccuggccuaaaua

SEQ ID NO: 316724 - RNA, 61 nt, hsa
uagaacacaauagagaacuucaaaauaaaacaggugugagaauugugugugugaaaaagcu

SEQ ID NO: 316725 - RNA, 61 nt, hsa
ccaucucggcuucccaaugugugaagguuacaggugugagcccuuauauguggcccucgug

SEQ ID NO: 316726 - RNA, 61 nt, hsa
accaaaacugaucaucugagucgauugauagaggugugacuaguccuuagcacuuuuucuc

SEQ ID NO: 316727 - RNA, 61 nt, hsa
aguaacauuuucacgauuguuauaaaauuauaggugugaacuucuaaaauaaaggaaugcu

SEQ ID NO: 316728 - RNA, 61 nt, hsa
ccagccucaaggcaaggagggcgcuucacugaggugugaauuguacguacaggcuuuuuau

SEQ ID NO: 316729 - RNA, 61 nt, hsa
uguccacgcccagaacaacaguuggcaggacaggugugacacagccacagcagaggcaagg

SEQ ID NO: 316730 - RNA, 61 nt, hsa
aagugcuaaguuuauaauucagguuugaucaaggugugaauaacugaagaaaauaacuugc

SEQ ID NO: 316731 - RNA, 61 nt, hsa
aguagaguagcgcuguuggccaggaggugucaggugugaguguauucugccagcuuuucau

SEQ ID NO: 316732 - RNA, 61 nt, hsa
cugccucagccucccaaagugcugggauuacaggugugagccaccacgccuggccccaguc

SEQ ID NO: 316733 - RNA, 61 nt, hsa
aagaggguaugggggaaagguucauagacuuaggugugagaaugaggugggaggugucugg

SEQ ID NO: 316734 - RNA, 61 nt, hsa
cugccuuggcuucccaaaguccugggauuacaggugugagccaccacauccagccuaacuu

SEQ ID NO: 316735 - RNA, 61 nt, hsa
gccucgaccucucucaaagugcuggcauuacaggugugagccacggugcccggcccacaau

SEQ ID NO: 316736 - RNA, 61 nt, hsa
gagcuaaaguaaaauaucuaacaggugaaaaaggugugaggauugaacucaauaaaccuuc

SEQ ID NO: 316737 - RNA, 61 nt, hsa
uaucucuguaggacuuaagagaauagcuaaaaggugugacuugccuuauugaaaugauacu

SEQ ID NO: 316738 - RNA, 61 nt, hsa
aggugugcacggacaccugguccguggaaacaggugugaugggcacaggcugcugcccuuc

SEQ ID NO: 316739 - RNA, 61 nt, hsa
aaaugugugacugcucaugguuaaugcaggcaggugugaacaugggggaacaaugagcaga

SEQ ID NO: 316740 - RNA, 61 nt, hsa
gauaauacaccacuacauucuguuaaucauuaggugugacugaauuucuuuugccguuauu

SEQ ID NO: 316741 - RNA, 61 nt, hsa
gcagauaggagccaggcugcaucucuuugaaaggugugagaucuuccuccuaaaccugaug

SEQ ID NO: 316742 - RNA, 61 nt, hsa
uggccaguguuuuaacuugugacaaguacucaggugugaggacaagaaugcaaauggcucu

SEQ ID NO: 316743 - RNA, 61 nt, hsa
ccuucugaaccucuacaccaauaacugcugcaggugugauuuuggucugucacacuguaca

SEQ ID NO: 316744 - RNA, 61 nt, hsa
agagaaauaaaacauuuggcacauuguuuacaggugugaaaacuuuguggguuuguguuau

SEQ ID NO: 316745 - RNA, 61 nt, hsa
ccgccuuggccucccaaagugcuggcauuacaggugugagccaccgugcccggccaccaga

SEQ ID NO: 316746 - RNA, 61 nt, hsa
ucugagcacuuaccgggcgugaccguuucuuaggugugagaggggcuguggcuuuugugca

SEQ ID NO: 316747 - RNA, 61 nt, hsa
caauucaagcaggcgccaagugcuaugacagaggugugaauaaaagcaucaggaaaucgga

SEQ ID NO: 316748 - RNA, 61 nt, hsa
ccaccucagccucccgaauagcugggacuacaggugugagucaccaagcccaguuaaucuu

SEQ ID NO: 316749 - RNA, 61 nt, hsa
cugccucagccucccaaagugcugggauuacaggugugaaccaccacacccagcccacuuc

SEQ ID NO: 316750 - RNA, 61 nt, hsa
ccguuucgacuucccaaagugcugggauuacaggugugagccacuucaccaggcccauuuu

SEQ ID NO: 316751 - RNA, 61 nt, hsa
ccaccucagccuccuaaagcacugggauuacaggugugaaccaccguacccagccuaucuu

SEQ ID NO: 316752 - RNA, 61 nt, hsa
aucaccuugaucuugggcuuucagcccccaaaggugugagaaaauaaacuucgguugauaa

SEQ ID NO: 316753 - RNA, 61 nt, hsa
cccaucucuacuaaaaauacaaaaauuagccaggugugauggugcaugccuguaaucccag

SEQ ID NO: 316754 - RNA, 61 nt, hsa
augcaaccagaguagaggggaccugcucagcaggugugaccaggguucucugaaucuguua

SEQ ID NO: 316755 - RNA, 61 nt, hsa
gcagccccuguccucaccaugggccugggccaggugugacagaguagagguagcacagggg

SEQ ID NO: 316756 - RNA, 61 nt, hsa
agcccgccagcggaaaguguucauucugcauaggugugaggcuuuaucugcacacaggaca

SEQ ID NO: 316757 - RNA, 61 nt, hsa
cacuccacucgcacgugauuacagucuguaaaggugugacuuuauaaagacaucuccagcu

SEQ ID NO: 316758 - RNA, 61 nt, hsa
ccuccccccauuagcuguaagguuuccugucaggugugacugucaguuugcuggucuucca

SEQ ID NO: 316759 - RNA, 61 nt, hsa
ccaagcucugcucuuucaggucguguaugagaggugugaaaagcugcggcccacgcuguuc

SEQ ID NO: 316760 - RNA, 61 nt, hsa
ccgccuuggccucccuaaguguugggauuauaggugugagccagcagccauaccccucuuc

SEQ ID NO: 316761 - RNA, 61 nt, hsa
cugaggccccggacgcccccggacacaauaaaggugugaagcuucgagucugcggcucugu

SEQ ID NO: 316762 - RNA, 61 nt, hsa
uccuugagcccaggagguugaggcugcagugaggugugauugcgccacugcauuccagcuu

SEQ ID NO: 316763 - RNA, 61 nt, hsa
uuauuccugguuuaauucagcagagaagguaaggugugaaccuaccugccuuggagagggc

SEQ ID NO: 316764 - RNA, 61 nt, hsa
ccgccuuggccucccaaagugcuggaauuacaggugugagccacugugcccagcugaguaa

SEQ ID NO: 316765 - RNA, 61 nt, hsa
gggaggggauucuuuccucuugcuaguuuaaaggugugauuuguacuccuuguuuguccca

SEQ ID NO: 316766 - RNA, 61 nt, hsa
gucaggaagaggcgaacagcucaggcagcgcaggugugaugggcacaguacgcagagcaag

SEQ ID NO: 316767 - RNA, 61 nt, hsa
ucagugacuauggcccccacguucaggaggaaggugugaugccgucauacaguuacaggaa

SEQ ID NO: 316768 - RNA, 61 nt, hsa
ccaccucagccucccaaggugcugggauuacaggugugagccaccacaccuggccaagaau

SEQ ID NO: 316769 - RNA, 61 nt, hsa
ccaccuuggccucccaaagugcugggauuacaggugugagccaccacacugggccaaugcu

SEQ ID NO: 316770 - RNA, 61 nt, hsa
agggggugccuaacugagcaguagggauagaaggugugaaccugggagugcuuuuauaaau

SEQ ID NO: 316771 - RNA, 50 nt, hsa
aucuccaaugugccgcauaaaggugugagggcauaggagaaacacuaggc

SEQ ID NO: 316772 - RNA, 61 nt, hsa
ucaucaucuuugccucuagccaccguagauaaggugugaagggacugcuguuugcaauggg

SEQ ID NO: 316773 - RNA, 61 nt, hsa
accuacguacuuauaucagcaccauguauguaggugugauaguacuuucaaacagcgccuc

SEQ ID NO: 316774 - RNA, 61 nt, hsa
ccgccucggccucccaaagugcugggauuacaggugugagccaccgcacccaauccuauua

SEQ ID NO: 316775 - RNA, 61 nt, hsa
gucuccccuuccccgagucuugccucaccccaggugugaagaccccugccccacugguacc

SEQ ID NO: 316776 - RNA, 61 nt, hsa
ccgccuuggccucccaaagugcugggauuacaggugugagccgcugcgcucggccuucuuu

SEQ ID NO: 316777 - RNA, 61 nt, hsa
ccaccucggccucccaaagugcugggauuacaggugugagccuccacaccuggcuguuuuc

SEQ ID NO: 316778 - RNA, 61 nt, hsa
guuggugcagguugaugugcuggcugcaggcaggugugaccaucucucgugccugccaccu

SEQ ID NO: 316779 - RNA, 61 nt, hsa
ccacccaggccucccaaagugcugggauuaaaggugugagccaccaugccuggcccuaugu

SEQ ID NO: 316780 - RNA, 61 nt, hsa
ccaccucagccuuccaaagugcuaggauuacaggugugagccacugcaguggaccaauuuu

SEQ ID NO: 316781 - RNA, 61 nt, hsa
cuuaaggacuuuucccuucaagugugaaggaaggugugaugaaugcuguggagaggcaucu

SEQ ID NO: 316782 - RNA, 61 nt, hsa
cuauugaagaagcauuagggguaugccuggcaggugugagcauccuggcucgcuggauuug

SEQ ID NO: 316783 - RNA, 61 nt, hsa
cugccuuggccucccaaagugcugggauuacaggugugagccaccacacccggccuuaucu

SEQ ID NO: 316784 - RNA, 61 nt, hsa
cugccccagcauuccaaagugcugggauuacaggugugagccacugccuggccuggccgua

SEQ ID NO: 316785 - RNA, 61 nt, hsa
cuguccucugacccaccggcagcgagugcgcaggugugaguguaaguucauguaggagagu

SEQ ID NO: 316786 - RNA, 61 nt, hsa
cuucucugccucccuaaguugcugggauuacaggugugagccacagugccuggcccauucu

SEQ ID NO: 316787 - RNA, 61 nt, hsa
auuuccugacauagaugguguguucaugugcaggugugagugugcuguccuucugaucucu

SEQ ID NO: 316788 - RNA, 61 nt, hsa
auggcucagccgccugaguagcugggauuacaggugugagccaacaagcccggcuaauuuu

SEQ ID NO: 316789 - RNA, 61 nt, hsa
cugccucggccucccaaagugcugggauuacaggugugagcugccgcacccagccaagaaa

SEQ ID NO: 316790 - RNA, 61 nt, hsa
aucgaucuuccugccaagguuuuggaauuacaggugugagccaccaugccuggccugcuuu

SEQ ID NO: 316791 - RNA, 61 nt, hsa
uuuaacaaaaauguucugugugucaggaaagaggugugagagugguaggcagccugccgca

SEQ ID NO: 316792 - RNA, 61 nt, hsa
ucuuuaaaaaagggaagucuugagguuuuagaggugugaauuauguuucaucaaugugcag

SEQ ID NO: 316793 - RNA, 61 nt, hsa
cuaccuuagucucccaaagugcugggauuacaggugugagccaccacgucuugucccccgc

SEQ ID NO: 316794 - RNA, 61 nt, hsa
uuuaaguauaaauccuacuagaguaaaaauuaggugugaaaauaggaaaauacagugcaaa

SEQ ID NO: 316795 - RNA, 61 nt, hsa
cuguguuucaaauggacuguuacagacugaaaggugugaacagcuuuguauguuuaugaag

SEQ ID NO: 316796 - RNA, 61 nt, hsa
uuggccaggcuggucucgaacuccuggccucaggugugauccgcccgccuccgccucccca

SEQ ID NO: 316797 - RNA, 61 nt, hsa
ccgccuccgccuccccaagcgcugagauuacaggugugagccaccgugcccagccccucag

SEQ ID NO: 316798 - RNA, 61 nt, hsa
acuccccuagucugcagauugaguugguaggaggugugauuuguuuacaugcaccuuuguu

SEQ ID NO: 316799 - RNA, 61 nt, hsa
cguuguauauucagagagagagagggagucaaggugugaccgucgaccacagccaguguca

SEQ ID NO: 316800 - RNA, 61 nt, hsa
cagacuuuagagcuuguggcuugaauguuaaaggugugaccaccgacaccacucaugucaa

SEQ ID NO: 316801 - RNA, 61 nt, hsa
uuuaauacuaucucucauuguuuuggaaacaaggugugauuaugcuauacuauaaccagcc

SEQ ID NO: 316802 - RNA, 61 nt, hsa
cugcuuuggccucccaaagcgcuaggauuccaggugugagcuacugugcccagcuaaaaua

SEQ ID NO: 316803 - RNA, 61 nt, hsa
guaaaaagaggggguugcuagaaggaaaaacaggugugaccugauccugccccuuccuucu

SEQ ID NO: 316804 - RNA, 61 nt, hsa
gccugccucagccucccagugcugggauuauaggugugagccacugcgccuggcuaaguua

SEQ ID NO: 316805 - RNA, 61 nt, hsa
cugccuugaccucccaaagugcuaggauaacaggugugagccaccgcacccugccaaguua

SEQ ID NO: 316806 - RNA, 61 nt, hsa
ccguguaucugggauauuuccauauggcaauaggugugaacagggaacucagaauacagac

SEQ ID NO: 316807 - RNA, 61 nt, hsa
cugccccagccucccaaguagcugggaggacaggugugagcugccgcacccagccuguuuc

SEQ ID NO: 316808 - RNA, 61 nt, hsa
cacucucuagaccaacugaugcagaaacaggaggugugagccagcaaucagauggagauuc

SEQ ID NO: 316809 - RNA, 61 nt, hsa
ccgccucggccccccaaagugcugggguuacaggugugagccacugcacccggccacaaga

SEQ ID NO: 316810 - RNA, 61 nt, hsa
cagguaagaacaguaauuggcccagacagguaggugugauaaacagaguagaaaagauugu

SEQ ID NO: 316811 - RNA, 61 nt, hsa
accucaagugaucugccugccucagcuucucaggugugaccuacugugcuuggccuaaugu

SEQ ID NO: 316812 - RNA, 61 nt, hsa
uccugcauguguugaugccaccuguaugugcaggugugaccucaggugugugaguaucccu

SEQ ID NO: 316813 - RNA, 61 nt, hsa
ccaccucagccuccacagcagcuggaacuccaggugugaaucaccaugcccggcuaacuuu

SEQ ID NO: 316814 - RNA, 61 nt, hsa
cgccucggccucccaaaauugcugggauuacaggugugagccaccgcgccuggccuauuau

SEQ ID NO: 316815 - RNA, 61 nt, hsa
ccgccuuggccucccaaagugcugggauuacaggugugagucaccgcgccuggccuuuuuu

SEQ ID NO: 316816 - RNA, 61 nt, hsa
cugccucggccucccaaagugcugggauuacaggugugagccacagcacccaaccuuuuuu

SEQ ID NO: 316817 - RNA, 61 nt, hsa
agguccucuucaauccagcagccccucccagaggugugaucagcaggaugcugaggaacca

SEQ ID NO: 316818 - RNA, 61 nt, hsa
ccaccucagccucucaaagugcugggauuacaggugugagccacuguggccgaccuacuau

SEQ ID NO: 316819 - RNA, 61 nt, hsa
cugcuucggccucccaaagugcuaggauuacaggugugagccaccacgccuggcuaauuuu

SEQ ID NO: 316820 - RNA, 61 nt, hsa
augaguuagauguggaggucagaguggaagcaggugugagagggucccgcagaagaaaaca

SEQ ID NO: 316821 - RNA, 61 nt, hsa
cugccucagccucccaaaguucugggauuacaggugugagccaccgcgcccagcccguuuu

SEQ ID NO: 316822 - RNA, 61 nt, hsa
cugccucggccucccaaagugcugggauuacaggugugagccaccacaccugacccauagg

SEQ ID NO: 316823 - RNA, 61 nt, hsa
ggugggggcgagaggaggacuugggagcuggaggugugacaccuucaguucuguuccuauu

SEQ ID NO: 316824 - RNA, 61 nt, hsa
ccgccucagccucccaaaguguugggauuacaggugugagccacagcaccuggccaaccaa

SEQ ID NO: 316825 - RNA, 61 nt, hsa
cugccucggccucccaaagugcugggauuacaggugugagccaccacgcccugccuacucu

SEQ ID NO: 316826 - RNA, 61 nt, hsa
acugggguguguggcagagccaggacccaggaggugugauuccugaaggcauccccaggcc

SEQ ID NO: 316827 - RNA, 61 nt, hsa
uaaaaugccuagauuuccauugccuaaaguaaggugugaccagugaaacaacagcagagaa

SEQ ID NO: 316828 - RNA, 61 nt, hsa
acagcuguguuaaccaaugaggucugcugccaggugugaacaagcaugucucuacgaauga

SEQ ID NO: 316829 - RNA, 61 nt, hsa
gggcauggucguacacugcucauugugccacaggugugacuggaaagcaugauauucuagg

SEQ ID NO: 316830 - RNA, 61 nt, hsa
uuuccggauccagagccacagaaagaaauguaggugugaaguauuaggcugcugucaggga

SEQ ID NO: 316831 - RNA, 61 nt, hsa
agaucccauuuccgucugcccccucgucaccaggugugauagccccagccaggucacaccu

SEQ ID NO: 316832 - RNA, 61 nt, hsa
cccacaaggaacccucaggccacccuccacgaggugugacuaacuaugcaauaauccaccc

SEQ ID NO: 316833 - RNA, 61 nt, hsa
cuugauccucccgagcugugagcgcagucugaggugugaggacacggccuccuguuggagu

SEQ ID NO: 316834 - RNA, 61 nt, hsa
uggcauuuucuuaauugaaaauccgggaagcaggugugauuacuuuuuugcucguagauau

SEQ ID NO: 316835 - RNA, 61 nt, hsa
ccaccuuggccucccaaagugcugggauuacaggugugagccacggcacccagccuagcuc

SEQ ID NO: 316836 - RNA, 61 nt, hsa
ggcuuuuaucauuuuaaaugguaggaauuuaaggugugacuucagggagaaacaaacuugc

SEQ ID NO: 316837 - RNA, 61 nt, hsa
agauagccagagagagaccuggcccucaaaaaggugugaacaagacugaaaaggagguccg

SEQ ID NO: 316838 - RNA, 61 nt, hsa
ccgccucggccucccaaagugcugggauuacaggugugagccaccgcgcccagccaagaau

SEQ ID NO: 316839 - RNA, 61 nt, hsa
ccaccucagccucccaaagugcugggauuacaggugugagccaccaugccuggccgugguu

SEQ ID NO: 316840 - RNA, 61 nt, hsa
gagaccuuccccucccuauccccaacuuuaaaggugugagaguauuaggaaacaugagcag

SEQ ID NO: 316841 - RNA, 61 nt, hsa
ccuaaagcaaguuagaaguuuuuagcauuuaaggugugaaaugcuccucaacacgauggau

SEQ ID NO: 316842 - RNA, 61 nt, hsa
guggccccaccuguucuuuccuccccugccgaggugugaccccaccugcucuuuccucccu

SEQ ID NO: 316843 - RNA, 61 nt, hsa
uggagggaggcugugcugugugucccccugcaggugugaccccgccugcucuuuccucccc

SEQ ID NO: 316844 - RNA, 61 nt, hsa
uggccuggagucuucaacuuuugaccggugcaggugugaccagagaccaccucuguggcca

SEQ ID NO: 316845 - RNA, 61 nt, hsa
ccgcuucggccucccaaaguucugggauuacaggugugagccaccgugcacggccggccug

SEQ ID NO: 316846 - RNA, 61 nt, hsa
ccguuucuucauauaauccgaccacagugggaggugugauuuacccauuacacaaugagaa

SEQ ID NO: 316847 - RNA, 61 nt, hsa
cugccucagccucccaaagugcugggauuacaggugugagccaccgcgcccggccgagaau

SEQ ID NO: 316848 - RNA, 61 nt, hsa
caaggacaaaaauaaguguguuuguuuuuacaggugugaaagucacagcuuguaaauaagu

SEQ ID NO: 316849 - RNA, 61 nt, hsa
gugccggagaugaaugagccccagcaguccaaggugugaugugggaagacaccgcagagcu

SEQ ID NO: 316850 - RNA, 61 nt, hsa
aagugguuucuaagauuuuuauauuaaaaauaggugugauuuccuaauaugaucuaaaacc

SEQ ID NO: 316851 - RNA, 61 nt, hsa
cugucuuggccucccaaagugcugagauuacaggugugagccacugugcccagcaguuucc

SEQ ID NO: 316852 - RNA, 61 nt, hsa
ccgccuuggccucccaaagugcugggauuacaggugugagccaccacacccagccucugua

SEQ ID NO: 316853 - RNA, 61 nt, hsa
aguugcauaggauguguggaggugcuuauccaggugugauuuauguguuaaccucagucac

SEQ ID NO: 316854 - RNA, 61 nt, hsa
ggagucaaaaagaaccacuugugguucuaaaaggugugaaggugauuuaagggcccagguc

SEQ ID NO: 316855 - RNA, 61 nt, hsa
cgacaaucaauggauggugcugucuaugcacaggugugaguccucuguuugcacuggacau

SEQ ID NO: 316856 - RNA, 61 nt, hsa
cgacaaucaguggauggugcugucuaugcacaggugugaguccucuguuugcacuggacau

SEQ ID NO: 316857 - RNA, 61 nt, hsa
aaagcagguggcaugaauugaucagcgagaaaggugugagccgaggcaguuccugcguucu

SEQ ID NO: 316858 - RNA, 61 nt, hsa
ccgccucggccucucaaaaugcugggauuacaggugugagccaccgugccuggccaauucc

SEQ ID NO: 316859 - RNA, 61 nt, hsa
gaauucaagacagggcagugcagcacuaggcaggugugaggagcccugcugaggucacugu

SEQ ID NO: 316860 - RNA, 61 nt, hsa
gaaaccccaucucuuaaagaaaaaguuagccaggugugaugaugugcaccuauagucccag

SEQ ID NO: 316861 - RNA, 61 nt, hsa
gaacuugggcuaaaaucaaaccuuggcacacaggugugauacaacuuaacaggaaucaucg

SEQ ID NO: 316862 - RNA, 61 nt, hsa
ccaccucagccucccaaagagcugggauuacaggugugagcuaccgcgccuggccaugaug

SEQ ID NO: 316863 - RNA, 61 nt, hsa
cccuggagcccccuuuggggcggaguggggaaggugugagucagcgccccuggacgggccg

SEQ ID NO: 316864 - RNA, 61 nt, hsa
cugaaagagaggacugguucugaggccagaaaggugugaggagagaggaggaaaagucuuc

SEQ ID NO: 316865 - RNA, 61 nt, hsa
ccgccuuggccucccaaagugcugggauuacaggugugagccuccaugcccagccuaaauu

SEQ ID NO: 316866 - RNA, 61 nt, hsa
cuaccucggccuccuaaagugcugagauuacaggugugagccaccgugcccggcccauucu

SEQ ID NO: 316867 - RNA, 61 nt, hsa
cauauuaaaugaaagaauaucuaauugggggaggugugaagggaaagaaauucuuuucaaa

SEQ ID NO: 316868 - RNA, 61 nt, hsa
cugccuuggccucccaaagcgcuaggauuagaggugugagccgcugcacccugccccagua

SEQ ID NO: 316869 - RNA, 61 nt, hsa
cucccaaaggcauaggcuugcaaagagcagaaggugugaaaucacacucuuccucugggca

SEQ ID NO: 316870 - RNA, 61 nt, hsa
cugccucagccucccaaagugcugggauuacaggugugagccaccgugcccggcccagaua

SEQ ID NO: 316871 - RNA, 61 nt, hsa
cccuauaggaacagcccagcacagguauuucaggugugaaagaaucaguaggaccaggcca

SEQ ID NO: 316872 - RNA, 61 nt, hsa
auuguuauuauuaagguuuaaaaaugagaacaggugugaguuuuccaaaauacuuaaaaau

SEQ ID NO: 316873 - RNA, 61 nt, hsa
gcugcaacuggcaaaggagaaggguaguuugaggugugacaccaguuugcuccagaaaguu

SEQ ID NO: 316874 - RNA, 61 nt, hsa
uccccccugucuucccccacaucuuugccagaggugugacauggucagggggcccaucugc

SEQ ID NO: 316875 - RNA, 61 nt, hsa
ccgccucguccucccaaagugcugggauuacaggugugagccacugcacccgaccgauacu

SEQ ID NO: 316876 - RNA, 61 nt, hsa
ucccuguacaucuguucacgugcuuguguccaggugugacuuguaaacugucuaguguuug

SEQ ID NO: 316877 - RNA, 61 nt, hsa
gaggaaaagcuggggccagccagggcaggagaggugugaaaucugccacgaggggccugcu

SEQ ID NO: 316878 - RNA, 61 nt, hsa
cucccccacucccaaccacguugggacagggaggugugaggcaggagagacaguuggauuc

SEQ ID NO: 316879 - RNA, 64 nt, hsa; identical to SEQ ID NO: 235822

SEQ ID NO: 316880 - RNA, 64 nt, hsa; identical to SEQ ID NO: 235823

SEQ ID NO: 316881 - RNA, 64 nt, hsa; identical to SEQ ID NO: 235824

SEQ ID NO: 316882 - RNA, 64 nt, hsa; identical to SEQ ID NO: 235825

SEQ ID NO: 316883 - RNA, 64 nt, hsa; identical to SEQ ID NO: 235826

SEQ ID NO: 316884 - RNA, 64 nt, hsa; identical to SEQ ID NO: 235827

SEQ ID NO: 316885 - RNA, 64 nt, hsa; identical to SEQ ID NO: 235828

SEQ ID NO: 316886 - RNA, 64 nt, hsa; identical to SEQ ID NO: 235829

SEQ ID NO: 316887 - RNA, 64 nt, hsa; identical to SEQ ID NO: 235830

SEQ ID NO: 316888 - RNA, 64 nt, hsa; identical to SEQ ID NO: 235831

SEQ ID NO: 316889 - RNA, 64 nt, hsa; identical to SEQ ID NO: 235832

SEQ ID NO: 316890 - RNA, 64 nt, hsa; identical to SEQ ID NO: 235833

SEQ ID NO: 316891 - RNA, 64 nt, hsa; identical to SEQ ID NO: 235834

SEQ ID NO: 316892 - RNA, 64 nt, hsa; identical to SEQ ID NO: 235835

SEQ ID NO: 316893 - RNA, 64 nt, hsa; identical to SEQ ID NO: 235836

SEQ ID NO: 316894 - RNA, 64 nt, hsa; identical to SEQ ID NO: 235837

SEQ ID NO: 316895 - RNA, 64 nt, hsa; identical to SEQ ID NO: 235838

SEQ ID NO: 316896 - RNA, 64 nt, hsa; identical to SEQ ID NO: 235839

SEQ ID NO: 316897 - RNA, 64 nt, hsa; identical to SEQ ID NO: 235840

SEQ ID NO: 316898 - RNA, 64 nt, hsa; identical to SEQ ID NO: 235841

SEQ ID NO: 316899 - RNA, 64 nt, hsa; identical to SEQ ID NO: 235842

SEQ ID NO: 316900 - RNA, 64 nt, hsa; identical to SEQ ID NO: 235843

SEQ ID NO: 316901 - RNA, 64 nt, hsa; identical to SEQ ID NO: 235844

SEQ ID NO: 316902 - RNA, 64 nt, hsa; identical to SEQ ID NO: 235845

SEQ ID NO: 316903 - RNA, 55 nt, hsa; identical to SEQ ID NO: 235846

SEQ ID NO: 316904 - RNA, 64 nt, hsa; identical to SEQ ID NO: 235847

SEQ ID NO: 316905 - RNA, 64 nt, hsa; identical to SEQ ID NO: 235848

SEQ ID NO: 316906 - RNA, 64 nt, hsa; identical to SEQ ID NO: 235849

SEQ ID NO: 316907 - RNA, 64 nt, hsa; identical to SEQ ID NO: 235850

SEQ ID NO: 316908 - RNA, 64 nt, hsa; identical to SEQ ID NO: 235851

SEQ ID NO: 316909 - RNA, 64 nt, hsa; identical to SEQ ID NO: 235852

SEQ ID NO: 316910 - RNA, 64 nt, hsa; identical to SEQ ID NO: 235853

SEQ ID NO: 316911 - RNA, 64 nt, hsa; identical to SEQ ID NO: 235854

SEQ ID NO: 316912 - RNA, 64 nt, hsa; identical to SEQ ID NO: 235855

SEQ ID NO: 316913 - RNA, 64 nt, hsa; identical to SEQ ID NO: 235856

SEQ ID NO: 316914 - RNA, 64 nt, hsa; identical to SEQ ID NO: 235857

SEQ ID NO: 316915 - RNA, 64 nt, hsa; identical to SEQ ID NO: 235858

SEQ ID NO: 316916 - RNA, 64 nt, hsa; identical to SEQ ID NO: 235859

SEQ ID NO: 316917 - RNA, 64 nt, hsa; identical to SEQ ID NO: 235860

SEQ ID NO: 316918 - RNA, 64 nt, hsa; identical to SEQ ID NO: 235861

SEQ ID NO: 316919 - RNA, 64 nt, hsa; identical to SEQ ID NO: 235862

SEQ ID NO: 316920 - RNA, 64 nt, hsa; identical to SEQ ID NO: 235863

SEQ ID NO: 316921 - RNA, 64 nt, hsa; identical to SEQ ID NO: 235864

SEQ ID NO: 316922 - RNA, 64 nt, hsa; identical to SEQ ID NO: 235865

SEQ ID NO: 316923 - RNA, 64 nt, hsa; identical to SEQ ID NO: 235866

SEQ ID NO: 316924 - RNA, 64 nt, hsa; identical to SEQ ID NO: 235867

SEQ ID NO: 316925 - RNA, 64 nt, hsa; identical to SEQ ID NO: 235868

SEQ ID NO: 316926 - RNA, 64 nt, hsa; identical to SEQ ID NO: 235869

SEQ ID NO: 316927 - RNA, 64 nt, hsa; identical to SEQ ID NO: 235870

SEQ ID NO: 316928 - RNA, 64 nt, hsa; identical to SEQ ID NO: 235871

SEQ ID NO: 316929 - RNA, 64 nt, hsa; identical to SEQ ID NO: 235872

SEQ ID NO: 316930 - RNA, 64 nt, hsa; identical to SEQ ID NO: 235873

SEQ ID NO: 316931 - RNA, 64 nt, hsa; identical to SEQ ID NO: 235874

SEQ ID NO: 316932 - RNA, 64 nt, hsa; identical to SEQ ID NO: 235875

SEQ ID NO: 316933 - RNA, 64 nt, hsa; identical to SEQ ID NO: 235876

SEQ ID NO: 316934 - RNA, 64 nt, hsa; identical to SEQ ID NO: 235877

SEQ ID NO: 316935 - RNA, 64 nt, hsa; identical to SEQ ID NO: 235878

SEQ ID NO: 316936 - RNA, 64 nt, hsa; identical to SEQ ID NO: 235879

SEQ ID NO: 316937 - RNA, 64 nt, hsa; identical to SEQ ID NO: 235880

SEQ ID NO: 316938 - RNA, 64 nt, hsa; identical to SEQ ID NO: 235881

SEQ ID NO: 316939 - RNA, 64 nt, hsa; identical to SEQ ID NO: 235882

SEQ ID NO: 316940 - RNA, 64 nt, hsa; identical to SEQ ID NO: 235883

SEQ ID NO: 316941 - RNA, 64 nt, hsa; identical to SEQ ID NO: 235884

SEQ ID NO: 316942 - RNA, 64 nt, hsa; identical to SEQ ID NO: 235885

SEQ ID NO: 316943 - RNA, 64 nt, hsa; identical to SEQ ID NO: 235886

SEQ ID NO: 316944 - RNA, 64 nt, hsa
caauguuguguucacagucuaauuuccaaaagaccaucaauaaaaaagagagcauguuuaaauu

SEQ ID NO: 316945 - RNA, 64 nt, hsa
cauugauacucauuaaugcaaauucauuauuuaacaucaauaucagaguaaucuucaaggucug

SEQ ID NO: 316946 - RNA, 64 nt, hsa
caucauauuaaauaaaauguagcagaaccaucugcaucaauauauuccuguuuagauuuuugca

SEQ ID NO: 316947 - RNA, 64 nt, hsa
ggcucauuuuuauguuuauuuuagaaaacuguugcaucaauauauuauguuucuuggcauuguu

SEQ ID NO: 316948 - RNA, 64 nt, hsa
uuaccuacuccuuauuuacgacgcaauaaaauaacaucaauagauuuuuaggcugaauuaauuu

SEQ ID NO: 316949 - RNA, 64 nt, hsa
uggugcacuacucugaggccuguauggccccuuucaucaauaucuauucaaauauacaggugca

SEQ ID NO: 316950 - RNA, 64 nt, hsa
aagaucagcagaaauaggguuuucucaucuucaccaucaauaaacauuuauugcguaccuccua

SEQ ID NO: 316951 - RNA, 64 nt, hsa
aaaagucagaacuagaauuguucauucuuucauucaucaauaaauguauuuugagugccuaaga

SEQ ID NO: 316952 - RNA, 64 nt, hsa; identical to SEQ ID NO: 220958

SEQ ID NO: 316953 - RNA, 64 nt, hsa; identical to SEQ ID NO: 220959

SEQ ID NO: 316954 - RNA, 55 nt, hsa
ucaucaacaagguggugugauggcuccugcacaggcccugcacauaggaugaggg

SEQ ID NO: 316955 - RNA, 64 nt, hsa
aucaacaagguggugugauggcuccugcacaggcccugcacauaggaugagggcaucugcuccc

SEQ ID NO: 316956 - RNA, 64 nt, hsa
ucuccuucaccccuauggugcucagcccugagauccugcacaagguggaguguacuggcuacgc

SEQ ID NO: 316957 - RNA, 64 nt, hsa
accccugaaacuggaccugcauagcuacgugaggccugcacagcuaaguguggagcuggacuac

SEQ ID NO: 316958 - RNA, 64 nt, hsa
uugugccagcaguggcuccucucugccuuugagcccugcacagcuggacccauccuaagugcca

SEQ ID NO: 316959 - RNA, 64 nt, hsa
agucuaagacuucagggccgggaccuuuguccagccugcacaguagagugaggcugccucuccc

SEQ ID NO: 316960 - RNA, 64 nt, hsa
gguacauguuuaccuauguaacaaaccugcacauccugcacauguacccuggaacuuaauaaaa

SEQ ID NO: 316961 - RNA, 64 nt, hsa
aagcaccaugguacauguuuaccuauguaacaaaccugcacauccugcacauguacccuggaac

SEQ ID NO: 316962 - RNA, 64 nt, hsa
cugccacuuucugucggugcuaauggauggaacuccugcacaaguuuuaacugaacaagaaauc

SEQ ID NO: 316963 - RNA, 64 nt, hsa
uaguaaauaaaauaauagagagcccagaaaucaaccugcacaccuaccgccaucuaaucuucaa

SEQ ID NO: 316964 - RNA, 64 nt, hsa
ggucuccccagggcuccucccccugcacaacacuccugcacacgugcaaaccugcuguccucug

SEQ ID NO: 316965 - RNA, 64 nt, hsa
gccaccaggguagggucuccccagggcuccucccccugcacaacacuccugcacacgugcaaac

SEQ ID NO: 316966 - RNA, 64 nt, hsa
cccgugcacaggcacacgugcuggucugcacacaccugcacacaccugcacacucgcuaugcca

SEQ ID NO: 316967 - RNA, 64 nt, hsa
ggcacacgugcuggucugcacacaccugcacacaccugcacacucgcuaugccaggccuccugg

SEQ ID NO: 316968 - RNA, 64 nt, hsa
aacaaggguggguuugcacagauuggagcacauuccugcacaaacuaccaaguauacuggugaa

SEQ ID NO: 316969 - RNA, 64 nt, hsa
cuuuagcuggucacuuggaacuuuggagcagaauccugcacauuaaaggaugggguuggggggg

SEQ ID NO: 316970 - RNA, 64 nt, hsa
accccagccucuguccacuuccuaacccagggacccugcacagccagaacugccuuuggcccua

SEQ ID NO: 316971 - RNA, 64 nt, hsa
ccaggagucgccauaccugugagguguccaccucccugcacauggcacuacccagacugccaga

SEQ ID NO: 316972 - RNA, 64 nt, hsa
ggaggggggagcugaaaggaaucugaugcucaggccugcacaaagcaaccgccaaauuguuuca

SEQ ID NO: 316973 - RNA, 64 nt, hsa
gcgggggcagcggccccggcuccuucuuguagcgccugcacaccuggguguugcagggacccgc

SEQ ID NO: 316974 - RNA, 64 nt, hsa
auauguacauguacccaccacaaacgugcaagcuccugcacacaugcaugcacacaaacgugua

SEQ ID NO: 316975 - RNA, 64 nt, hsa
acgcacacguacauucacuacaaacgugcagccuccugcacacgugcacauucauguguacacc

SEQ ID NO: 316976 - RNA, 64 nt, hsa
auaugcccagugccagcuagggcccaccgcccauccugcacacggggccgcugggcaggugccc

SEQ ID NO: 316977 - RNA, 64 nt, hsa
acuggcaagagucccaggcuccaaggacacccucccugcacaugauuggguguuaaugguggcc

SEQ ID NO: 316978 - RNA, 64 nt, hsa
cagcaguggacagcaugguccucacacccagcucccugcacacccaggccagccaccccucccg

SEQ ID NO: 316979 - RNA, 64 nt, hsa
cacaugcugucacgcauacacacacgcacauacuccugcacauguucccaugcaugugugugca

SEQ ID NO: 316980 - RNA, 64 nt, hsa
ucaugaacauuaaaugugaugaugauuucuuuucccugcacacaucuuuccggugcaauaucua

SEQ ID NO: 316981 - RNA, 64 nt, hsa
cuauugagcugguaguggcagaggacugaggguaccugcacaguuugauucuuuuccacgugua

SEQ ID NO: 316982 - RNA, 64 nt, hsa
ugcacgugcacacaccugcacaccccugcacacaccugcacaccgucccucuccccggacaagc

SEQ ID NO: 316983 - RNA, 64 nt, hsa
aguuugccucugcacgugcacacaccugcacaccccugcacacaccugcacaccgucccucucc

SEQ ID NO: 316984 - RNA, 64 nt, hsa
cugcccuagcaguuugccucugcacgugcacacaccugcacaccccugcacacaccugcacacc

SEQ ID NO: 316985 - RNA, 64 nt, hsa
uugauaccacgcagaccuuggguggggagagcuuccugcacagcucucagcggccuguggccuu

SEQ ID NO: 316986 - RNA, 64 nt, hsa
ugggcaggccuuuccaccuggggagcuggcucauccugcacagcugggccguggugggccuguc

SEQ ID NO: 316987 - RNA, 64 nt, hsa
aagagcuaaagauucucagggcaucugccgagacccugcacaguuugcaaacagcuuuuaccug

SEQ ID NO: 316988 - RNA, 64 nt, hsa
gcacuuuaaacgccgaagacagcccugcagcaagccugcacacgggcuuggguggguuccuuug

SEQ ID NO: 316989 - RNA, 64 nt, hsa
ccccaaaccggccuagacacgaagaccaaagcagccugcacagggcaaggcccccgcggaaucc

SEQ ID NO: 316990 - RNA, 64 nt, hsa
ugcuaacuggggccugcguggaaggccuccgcucccugcacacacacggacaggaauuuccgug

SEQ ID NO: 316991 - RNA, 64 nt, hsa
caagucuagcauguuccugucuccaacaccgccuccugcacaugcagagcagacagaaauaccc

SEQ ID NO: 316992 - RNA, 64 nt, hsa
gucaggacuauuccuucuggacucugugccuuugccugcacagcuaguguugauggcuuguuug

SEQ ID NO: 316993 - RNA, 64 nt, hsa
ggcacacguucaccuauguaacaaaccugcacauccugcacauguaccccggaacuuacuuaaa

SEQ ID NO: 316994 - RNA, 64 nt, hsa
aaccaccauggcacacguucaccuauguaacaaaccugcacauccugcacauguaccccggaac

SEQ ID NO: 316995 - RNA, 64 nt, hsa
ccaggugcaguccccgccccgccuaguccucggcgucacgcaaugcucaccucgccucuucccc

SEQ ID NO: 316996 - RNA, 64 nt, hsa
uuaaagagaucugggccucauguagcucaccccggucacgcaugaaggcaaaagcaggucagaa

SEQ ID NO: 316997 - RNA, 64 nt, hsa
cauucuugucaaguugcccagcuuggaguugucugucacgcacauguguccugugguuauagcu

SEQ ID NO: 316998 - RNA, 64 nt, hsa
cugaggcccagaggcggagggcagucugcucaaggucacgcagcuggugacugguuggggcaga

SEQ ID NO: 316999 - RNA, 64 nt, hsa
guagagcacccucaggagaaguggcgccgcaggggucacgcaugguccagcccucaggugggag

SEQ ID NO: 317000 - RNA, 64 nt, hsa
gccaacgggucuucaguacuuuuauuaaaaaauagucacgcagacagugcccugguggcucugc

SEQ ID NO: 317001 - RNA, 64 nt, hsa
cuacucuccaguaugucuuauuacucuccaguaugucacgcaucuuuaacuuuucacguccuau

SEQ ID NO: 317002 - RNA, 64 nt, hsa
cagccacugagcugucgugccagcaccauuccuggucacgcaaaacagaacccaguuagcagca

SEQ ID NO: 317003 - RNA, 64 nt, hsa
uggcugugugacacacguaaggaaaggaaagggggucacgcacaucauguacuggaaugaucug

SEQ ID NO: 317004 - RNA, 60 nt, hsa
ggcccagagagaugaaguagcuugucuagggucacgcagcuuguaaguggcagagcuggc

SEQ ID NO: 317005 - RNA, 64 nt, hsa
ugcccaaggaugcugucaagcaccugcaugugcugucacgcacaagggcacgugaagucauuga

SEQ ID NO: 317006 - RNA, 64 nt, hsa
uucacucugcuuucuguauaaagggcagucuguggucacgcaagacuuuaaaaaaaaaaaaaaa

SEQ ID NO: 317007 - RNA, 64 nt, hsa
aggacacgaaaggcauagaaggagaagacaaagugucacgcaguugacugguuuucggccuuuc

SEQ ID NO: 317008 - RNA, 64 nt, hsa
ugacuuuggaccauaucuaguauauaauauuuuugucacgcaccugcugcauugcucuaacuua

SEQ ID NO: 317009 - RNA, 64 nt, hsa
acauugauauuuggaauuaauuacguuuguuuaagucacgcaaaagauuuucagaaaauguucg

SEQ ID NO: 317010 - RNA, 64 nt, hsa
uggacccccuucuccuuuccuuucuuuccuucaggucacgcagcccuguacuguauccagcacc

SEQ ID NO: 317011 - RNA, 64 nt, hsa
ucgugugcucaucucacacacaccccccucccgggucacgcagacaccccccaaccacacacau

SEQ ID NO: 317012 - RNA, 64 nt, hsa
aagcagagacagauguagacccuuucccuccagagucacgcacauacucgucaucgcaucacuu

SEQ ID NO: 317013 - RNA, 64 nt, hsa
ucuuaauaucagcacagcaauucauuuuaguuuggucacgcauuugccuguucaaguucucauu

SEQ ID NO: 317014 - RNA, 64 nt, hsa
uuuuccaacacaucuauauauauauggacacacagucacgcaagcuaguucccaugacuccugg

SEQ ID NO: 317015 - RNA, 64 nt, hsa
aagcccuccagccucuaggucaggccaugcagcagucacgcagucggcuuucaggaggugccag

SEQ ID NO: 317016 - RNA, 64 nt, hsa
ugcaacgggugaccuaagcguggugcacccaucagucacgcaggaggacugacuugacagacga

SEQ ID NO: 317017 - RNA, 64 nt, hsa
cuaaaguugcuucuccuacccuaucccauccccugucacgcaucuggaagcuaaauugccuccu

SEQ ID NO: 317018 - RNA, 64 nt, hsa
cuacagauauuaauguuaacaagacaaaauaaaugucacgcaacuuauuuuuuuaauacucgug

SEQ ID NO: 317019 - RNA, 64 nt, hsa
uuguuaccggagccacgggaagaaagcagccggagucacgcacgugcagagcugggcaugggag

SEQ ID NO: 317020 - RNA, 64 nt, hsa
cagaaaacgcuuuauuagugaaccuugggaccaugucacgcaagagauucagcacugggaaaga

SEQ ID NO: 317021 - RNA, 64 nt, hsa
uuuuucugccagcuauguugaaugcacaaauucugucacgcauguucauucauugcuacauaau

SEQ ID NO: 317022 - RNA, 62 nt, hsa
ucaaaguaaaaagaauuugagccacgcauagugucacgcaccugugaucccagcuacuuagg

SEQ ID NO: 317023 - RNA, 64 nt, hsa
cacugugucuggccuaguguaugauuaugcaugagucacgcaauguucugguccuggauuccag

SEQ ID NO: 317024 - RNA, 64 nt, hsa
ggauagagguuggguuuccccccuuuuauagauggucacgcaccuggguguuacaaaguuguau

SEQ ID NO: 317025 - RNA, 64 nt, hsa
uagucuaggaaauugagauuuugauacaccuaaggucacgcagcuggguagauauacagcuguc

SEQ ID NO: 317026 - RNA, 64 nt, hsa
cugcagaugaggaaaccgagagaaguggcccaaggucacgcaacucugagaugccacauuucau

SEQ ID NO: 317027 - RNA, 64 nt, hsa
uguucacacaugcacacucacgcucacacaugcugucacgcauacacacacgcacauacuccug

SEQ ID NO: 317028 - RNA, 64 nt, hsa
uugcucgcuucuguguugacuuagaucaagacacgucacgcauccuuucugggguaguaccugu

SEQ ID NO: 317029 - RNA, 64 nt, hsa
ccacgcucaguuuggaccauuggaggaacuuagugucacgcacaaauggggcuauuccuacgcu

SEQ ID NO: 317030 - RNA, 53 nt, hsa
cugagccaacuccgaugugagacgucacgcaggacagauaccgcuccacacuc

SEQ ID NO: 317031 - RNA, 54 nt, hsa
ccgcuuccggggagaagugaggacgucacgcagacagcacugucaacacugggc

SEQ ID NO: 317032 - RNA, 64 nt, hsa
ugaccgaaugcucauagagguugacccccacagggucacgcaggacucggacacugcccuggaa

SEQ ID NO: 317033 - RNA, 64 nt, hsa
aggccucaggagugaccauagccacugcugaaaagucacgcagcugcucccucggaccccccaa

SEQ ID NO: 317034 - RNA, 64 nt, hsa
acaauguaauguuagagauaaaggagcaaauagagucacgcaucacuuaaugacagagauaugu

SEQ ID NO: 317035 - RNA, 64 nt, hsa
gaaggugacguucccaggagagggcaccuacacagucacgcaaacacacacuaauuccuggcag

SEQ ID NO: 317036 - RNA, 64 nt, hsa
uuuuaaugcaaagcgccuuuuuugagcagguagagucacgcauccggcaggcggggcgagcucc

SEQ ID NO: 317037 - RNA, 64 nt, hsa
ucccucacccagagcacacggccgcggagaugacgucacgcaagcaacggcgcugacgucacau

SEQ ID NO: 317038 - RNA, 64 nt, hsa
gguuuucucacuauuuuugggagauucugcacgagucacgcacccccuucacaugacgcuaugu

SEQ ID NO: 317039 - RNA, 64 nt, hsa
ucuaggacauucuccccucuccuaggagacggaugucacgcacaaauggggagagaaguguuua

SEQ ID NO: 317040 - RNA, 64 nt, hsa
ugcguggcagccucuuccaguugagguguuuuaugucacgcacacuccaucccaguguacaaaa

SEQ ID NO: 317041 - RNA, 64 nt, hsa
uacauacauagagagagacaguuuuccaaacugugucacgcaggcugagugcacuggcaggauc

SEQ ID NO: 317042 - RNA, 64 nt, hsa
gguagcagggcgcguuuccacuuaaggugugucugucacgcaccucauucuccccagacagucu

SEQ ID NO: 317043 - RNA, 64 nt, hsa
uuaaagaaauaacgugcaugcuuuaaaaaacacagucacgcaccaagcaggcaaauagcuuuag

SEQ ID NO: 317044 - RNA, 64 nt, hsa
agagacaaaccaauuuaauuccaugucuucaauugucacgcauuucuucuuuuacucuuugaaa

SEQ ID NO: 317045 - RNA, 64 nt, hsa
ccagggaggccaagcagccgagcgagagcagcaggucacgcagaaaaaacugagcagcgccaac

SEQ ID NO: 317046 - RNA, 64 nt, hsa
ccgccucuuccccuuucugucccgggauaccuggcggcaagagacuucuuggcuauuguccaug

SEQ ID NO: 317047 - RNA, 64 nt, hsa
cuaugggcucccuggccucccaggccaccaaggacggcaagaaggacaagaaggaggaagacaa

SEQ ID NO: 317048 - RNA, 64 nt, hsa
uuaucuccucucauacaucaagccccagaggaggcggcaagaggaacagccacaaacaaguacu

SEQ ID NO: 317049 - RNA, 64 nt, hsa
cggcaaggcacggacgacugugcagacacagcagcggcaagaagcgagaacugcccucccccuc

SEQ ID NO: 317050 - RNA, 64 nt, hsa
gcaggugcaucgcgucgagguggggcacggccgccggcaagaaacccacccuguccggaggcgg

SEQ ID NO: 317051 - RNA, 64 nt, hsa
uagacuccugagcugcagagucccccccgguugccggcaagaccgcacaggcaaggccgaugac

SEQ ID NO: 317052 - RNA, 64 nt, hsa
aagggauagaaaggaacuauguucacaagaacaacggcaagacagugccuauacugccucuaca

SEQ ID NO: 317053 - RNA, 64 nt, hsa
gcuuggaggaccgaccccauggcugagaauaugacggcaagaggaacagaguuugcuccaagug

SEQ ID NO: 317054 - RNA, 64 nt, hsa
uugggagaggcauguucuugggcagggcuggcuacggcaagagggaaccaauuccuuuccccuu

SEQ ID NO: 317055 - RNA, 64 nt, hsa
gcuccuccaccagcuccacccugagcuuccucuucggcaagaggagcuuuuccagcgcgcucgu

SEQ ID NO: 317056 - RNA, 64 nt, hsa
cugggaaccccgcagcgcgaggcugccucaucaacggcaagaggaaaggaggggucucgggaca

SEQ ID NO: 317057 - RNA, 64 nt, hsa
aacccuuugauuguuuucuaaaaggagacucccucggcaagauggcagaggguacggagucuuc

SEQ ID NO: 317058 - RNA, 64 nt, hsa
acccggguucugaaaaugugcuguguuccuaccucggcaagaucaccagcacugaggggcccag

SEQ ID NO: 317059 - RNA, 64 nt, hsa
ccugggagguggcagacagaagcacccccugccccggcaagaaacucccaggcucaaucaaggu

SEQ ID NO: 317060 - RNA, 64 nt, hsa
gugaaaggccucagcucugacggccugaccacugcggcaagaggaccccagcuggggugcuuac

SEQ ID NO: 317061 - RNA, 64 nt, hsa
ccuauugaucagugacacugccagaggcccauaccggcaagaggaagaggacgucauuuuguaa

SEQ ID NO: 317062 - RNA, 64 nt, hsa
cugccggaggggugccaggagggggcagcaacaacggcaagacucccgugugucaccagugcca

SEQ ID NO: 317063 - RNA, 64 nt, hsa
uccacacccuagguugccuggcagagcagugguccggcaagaagggagacacagcugcccuggg

SEQ ID NO: 317064 - RNA, 64 nt, hsa
aggcuccgaaucaccaucucccucacauguuauccggcaagagugaauucuaccaauggaagcc

SEQ ID NO: 317065 - RNA, 55 nt, hsa
agcuccaagacucaaaguagcccggcggcaagaggcccauguuccggagagaagc

SEQ ID NO: 317066 - RNA, 64 nt, hsa
agggugcaugcgucuccugcuggugaaucacaugcggcaagaggcaacuggcuccacagccugg

SEQ ID NO: 317067 - RNA, 63 nt, hsa
caugugggaacggacccugaccaucggcagcgccggcaagaccuucagcgccacuggcuggaa

SEQ ID NO: 317068 - RNA, 64 nt, hsa
aagaucacaccacuacacuccagccugggcgagacggcaagacuccaucucaaaaaaaaaagaa

SEQ ID NO: 317069 - RNA, 64 nt, hsa
acaauucaacuacauguucuacccagcauuuuaacggcaagaacuuuauauuuauucucaagca

SEQ ID NO: 317070 - RNA, 64 nt, hsa
agaggaaaggagccacaggagcgggugcuacacccggcaagacagagcgucuccaucuaaaauu

SEQ ID NO: 317071 - RNA, 64 nt, hsa
accuuguaaccagugcagaaaugaaauagcuuagcggcaagaagccguugaggcgguuuccuga

SEQ ID NO: 317072 - RNA, 64 nt, hsa
gcacaggauguggggcgagggcacagcuggggaacggcaagaaaggaauggacccugugugugg

SEQ ID NO: 317073 - RNA, 64 nt, hsa
acguccauccugggacagacgggccuggacuucacggcaagaccccccucucuuccccacuggg

SEQ ID NO: 317074 - RNA, 64 nt, hsa
cucccggugcccccagaccccgcagcucugugcccggcaagaagcagcuagacacacgccaggg

SEQ ID NO: 317075 - RNA, 64 nt, hsa
cucaggaccuucaagauuccaucugugggcuggccggcaagauggcaccaguggggacccacac

SEQ ID NO: 317076 - RNA, 64 nt, hsa
ugaaggagagauacuuaggaaauccuaaaagaggcggcaagaagguaccucccuguguaacuca

SEQ ID NO: 317077 - RNA, 64 nt, hsa
cagugaauaagcaacuuucuacaguuuugcaccacggcaagaaaaccaaaaaccaaaacaaaca

SEQ ID NO: 317078 - RNA, 64 nt, hsa
uugugaugaagaaaagugggccagugugggaaugcggcaagaaggaauugacuucgacugugac

SEQ ID NO: 317079 - RNA, 64 nt, hsa
agcacccaggagagccuugcugugucugucugcccggcaagaguccauucucacugcugggaca

SEQ ID NO: 317080 - RNA, 64 nt, hsa
cugcucacacagucacccuccgcucuugcuacuucggcaagacaucuuaagaaugugacacauu

SEQ ID NO: 317081 - RNA, 64 nt, hsa
acuauacaaauuaagugguaagcaguuauaaagacggcaagaccaugcuauugaaaaaguucag

SEQ ID NO: 317082 - RNA, 64 nt, hsa
ccacugacugugccgaggggcgggggcaggaggacggcaagaccuauuuauaauauuuagcgaa

SEQ ID NO: 317083 - RNA, 64 nt, hsa
cuggcuaugaaaccuugugagcagaaggcaagagcggcaagaugaguuuugagcguuguauucc

SEQ ID NO: 317084 - RNA, 64 nt, hsa
caaagaguccccacuuaacaauaccccccccccacggcaagaaugcccaaauccgaaugacccc

SEQ ID NO: 317085 - RNA, 64 nt, hsa
guugaagacaagcugcuugucaagaagcauuucccggcaagagaggggcaagucuggggcucca

SEQ ID NO: 317086 - RNA, 64 nt, hsa
gagcugagauugcgccacugcacuccagucuggucggcaagagugagacuccgucucaaaaaca

SEQ ID NO: 317087 - RNA, 64 nt, hsa
acaaccaccugcgacgccacgaacugcgccugcgcggcaagaaugucuagccugcccgcccgca

SEQ ID NO: 317088 - RNA, 64 nt, hsa
ccuaacuguuuuguauaugcugcauugagacuuacggcaagaaggcauuuuuuuuuuuuaaagg

SEQ ID NO: 317089 - RNA, 64 nt, hsa
ccgggagaacaucaaugcuuuuccucaggaaauucggcaagacuuggagaaaaggaaagcucca

SEQ ID NO: 317090 - RNA, 64 nt, hsa
aaauaguugaaucagugaucuaguauuuuccuuucggcaagauuuguuagguuuuuaccccuuc

SEQ ID NO: 317091 - RNA, 64 nt, hsa; identical to SEQ ID NO: 316995

SEQ ID NO: 317092 - RNA, 64 nt, hsa; identical to SEQ ID NO: 316996

SEQ ID NO: 317093 - RNA, 64 nt, hsa; identical to SEQ ID NO: 316997

SEQ ID NO: 317094 - RNA, 64 nt, hsa; identical to SEQ ID NO: 316998

SEQ ID NO: 317095 - RNA, 64 nt, hsa; identical to SEQ ID NO: 316999

SEQ ID NO: 317096 - RNA, 64 nt, hsa; identical to SEQ ID NO: 317000

SEQ ID NO: 317097 - RNA, 64 nt, hsa; identical to SEQ ID NO: 317001

SEQ ID NO: 317098 - RNA, 64 nt, hsa; identical to SEQ ID NO: 317002

SEQ ID NO: 317099 - RNA, 64 nt, hsa; identical to SEQ ID NO: 317003

SEQ ID NO: 317100 - RNA, 60 nt, hsa; identical to SEQ ID NO: 317004

SEQ ID NO: 317101 - RNA, 64 nt, hsa; identical to SEQ ID NO: 317005

SEQ ID NO: 317102 - RNA, 64 nt, hsa; identical to SEQ ID NO: 317006

SEQ ID NO: 317103 - RNA, 64 nt, hsa; identical to SEQ ID NO: 317007

SEQ ID NO: 317104 - RNA, 64 nt, hsa; identical to SEQ ID NO: 317008

SEQ ID NO: 317105 - RNA, 64 nt, hsa; identical to SEQ ID NO: 317009

SEQ ID NO: 317106 - RNA, 64 nt, hsa; identical to SEQ ID NO: 317010

SEQ ID NO: 317107 - RNA, 64 nt, hsa; identical to SEQ ID NO: 317011

SEQ ID NO: 317108 - RNA, 64 nt, hsa; identical to SEQ ID NO: 317012

SEQ ID NO: 317109 - RNA, 64 nt, hsa; identical to SEQ ID NO: 317013

SEQ ID NO: 317110 - RNA, 64 nt, hsa; identical to SEQ ID NO: 317014

SEQ ID NO: 317111 - RNA, 64 nt, hsa; identical to SEQ ID NO: 317015

SEQ ID NO: 317112 - RNA, 64 nt, hsa; identical to SEQ ID NO: 317016

SEQ ID NO: 317113 - RNA, 64 nt, hsa; identical to SEQ ID NO: 317017

SEQ ID NO: 317114 - RNA, 64 nt, hsa; identical to SEQ ID NO: 317018

SEQ ID NO: 317115 - RNA, 64 nt, hsa; identical to SEQ ID NO: 317019

SEQ ID NO: 317116 - RNA, 64 nt, hsa; identical to SEQ ID NO: 317020

SEQ ID NO: 317117 - RNA, 64 nt, hsa; identical to SEQ ID NO: 317021

SEQ ID NO: 317118 - RNA, 62 nt, hsa; identical to SEQ ID NO: 317022

SEQ ID NO: 317119 - RNA, 64 nt, hsa; identical to SEQ ID NO: 317023

SEQ ID NO: 317120 - RNA, 64 nt, hsa; identical to SEQ ID NO: 317024

SEQ ID NO: 317121 - RNA, 64 nt, hsa; identical to SEQ ID NO: 317025

SEQ ID NO: 317122 - RNA, 64 nt, hsa; identical to SEQ ID NO: 317026

SEQ ID NO: 317123 - RNA, 64 nt, hsa; identical to SEQ ID NO: 317027

SEQ ID NO: 317124 - RNA, 64 nt, hsa; identical to SEQ ID NO: 317028

SEQ ID NO: 317125 - RNA, 64 nt, hsa; identical to SEQ ID NO: 317029

SEQ ID NO: 317126 - RNA, 53 nt, hsa; identical to SEQ ID NO: 317030

SEQ ID NO: 317127 - RNA, 54 nt, hsa; identical to SEQ ID NO: 317031

SEQ ID NO: 317128 - RNA, 64 nt, hsa; identical to SEQ ID NO: 317032

SEQ ID NO: 317129 - RNA, 64 nt, hsa; identical to SEQ ID NO: 317033

SEQ ID NO: 317130 - RNA, 64 nt, hsa; identical to SEQ ID NO: 317034

SEQ ID NO: 317131 - RNA, 64 nt, hsa; identical to SEQ ID NO: 317035

SEQ ID NO: 317132 - RNA, 64 nt, hsa; identical to SEQ ID NO: 317036

SEQ ID NO: 317133 - RNA, 64 nt, hsa; identical to SEQ ID NO: 317037

SEQ ID NO: 317134 - RNA, 64 nt, hsa; identical to SEQ ID NO: 317038

SEQ ID NO: 317135 - RNA, 64 nt, hsa; identical to SEQ ID NO: 317039

SEQ ID NO: 317136 - RNA, 64 nt, hsa; identical to SEQ ID NO: 317040

SEQ ID NO: 317137 - RNA, 64 nt, hsa; identical to SEQ ID NO: 317041

SEQ ID NO: 317138 - RNA, 64 nt, hsa; identical to SEQ ID NO: 317042

SEQ ID NO: 317139 - RNA, 64 nt, hsa; identical to SEQ ID NO: 317043

SEQ ID NO: 317140 - RNA, 64 nt, hsa; identical to SEQ ID NO: 317044

SEQ ID NO: 317141 - RNA, 64 nt, hsa; identical to SEQ ID NO: 317045

SEQ ID NO: 317142 - RNA, 64 nt, hsa; identical to SEQ ID NO: 317046

SEQ ID NO: 317143 - RNA, 64 nt, hsa; identical to SEQ ID NO: 317047

SEQ ID NO: 317144 - RNA, 64 nt, hsa; identical to SEQ ID NO: 317048

SEQ ID NO: 317145 - RNA, 64 nt, hsa; identical to SEQ ID NO: 317049

SEQ ID NO: 317146 - RNA, 64 nt, hsa; identical to SEQ ID NO: 317050

SEQ ID NO: 317147 - RNA, 64 nt, hsa; identical to SEQ ID NO: 317051

SEQ ID NO: 317148 - RNA, 64 nt, hsa; identical to SEQ ID NO: 317052

SEQ ID NO: 317149 - RNA, 64 nt, hsa; identical to SEQ ID NO: 317053

SEQ ID NO: 317150 - RNA, 64 nt, hsa; identical to SEQ ID NO: 317054

SEQ ID NO: 317151 - RNA, 64 nt, hsa; identical to SEQ ID NO: 317055

SEQ ID NO: 317152 - RNA, 64 nt, hsa; identical to SEQ ID NO: 317056

SEQ ID NO: 317153 - RNA, 64 nt, hsa; identical to SEQ ID NO: 317057

SEQ ID NO: 317154 - RNA, 64 nt, hsa; identical to SEQ ID NO: 317058

SEQ ID NO: 317155 - RNA, 64 nt, hsa; identical to SEQ ID NO: 317059

SEQ ID NO: 317156 - RNA, 64 nt, hsa; identical to SEQ ID NO: 317060

SEQ ID NO: 317157 - RNA, 64 nt, hsa; identical to SEQ ID NO: 317061

SEQ ID NO: 317158 - RNA, 64 nt, hsa; identical to SEQ ID NO: 317062

SEQ ID NO: 317159 - RNA, 64 nt, hsa; identical to SEQ ID NO: 317063

SEQ ID NO: 317160 - RNA, 64 nt, hsa; identical to SEQ ID NO: 317064

SEQ ID NO: 317161 - RNA, 55 nt, hsa; identical to SEQ ID NO: 317065

SEQ ID NO: 317162 - RNA, 64 nt, hsa; identical to SEQ ID NO: 317066

SEQ ID NO: 317163 - RNA, 63 nt, hsa; identical to SEQ ID NO: 317067

SEQ ID NO: 317164 - RNA, 64 nt, hsa; identical to SEQ ID NO: 317068

SEQ ID NO: 317165 - RNA, 64 nt, hsa; identical to SEQ ID NO: 317069

SEQ ID NO: 317166 - RNA, 64 nt, hsa; identical to SEQ ID NO: 317070

SEQ ID NO: 317167 - RNA, 64 nt, hsa; identical to SEQ ID NO: 317071

SEQ ID NO: 317168 - RNA, 64 nt, hsa; identical to SEQ ID NO: 317072

SEQ ID NO: 317169 - RNA, 64 nt, hsa; identical to SEQ ID NO: 317073

SEQ ID NO: 317170 - RNA, 64 nt, hsa; identical to SEQ ID NO: 317074

SEQ ID NO: 317171 - RNA, 64 nt, hsa; identical to SEQ ID NO: 317075

SEQ ID NO: 317172 - RNA, 64 nt, hsa; identical to SEQ ID NO: 317076

SEQ ID NO: 317173 - RNA, 64 nt, hsa; identical to SEQ ID NO: 317077

SEQ ID NO: 317174 - RNA, 64 nt, hsa; identical to SEQ ID NO: 317078

SEQ ID NO: 317175 - RNA, 64 nt, hsa; identical to SEQ ID NO: 317079

SEQ ID NO: 317176 - RNA, 64 nt, hsa; identical to SEQ ID NO: 317080

SEQ ID NO: 317177 - RNA, 64 nt, hsa; identical to SEQ ID NO: 317081

SEQ ID NO: 317178 - RNA, 64 nt, hsa; identical to SEQ ID NO: 317082

SEQ ID NO: 317179 - RNA, 64 nt, hsa; identical to SEQ ID NO: 317083

SEQ ID NO: 317180 - RNA, 64 nt, hsa; identical to SEQ ID NO: 317084

SEQ ID NO: 317181 - RNA, 64 nt, hsa; identical to SEQ ID NO: 317085

SEQ ID NO: 317182 - RNA, 64 nt, hsa; identical to SEQ ID NO: 317086

SEQ ID NO: 317183 - RNA, 64 nt, hsa; identical to SEQ ID NO: 317087

SEQ ID NO: 317184 - RNA, 64 nt, hsa; identical to SEQ ID NO: 317088

SEQ ID NO: 317185 - RNA, 64 nt, hsa; identical to SEQ ID NO: 317089

SEQ ID NO: 317186 - RNA, 64 nt, hsa; identical to SEQ ID NO: 317090

SEQ ID NO: 317187 - RNA, 64 nt, hsa
ccuggcgccuggcggucaccuggugccuacuguccgacaggaugccuugauccucgugcgaccc

SEQ ID NO: 317188 - RNA, 64 nt, hsa
cagcggguuacauccacacugcugaucacaccaacgacaggagcugauaagcaagaaagcguca

SEQ ID NO: 317189 - RNA, 64 nt, hsa
acggaugcccacagggccugggcaguugcuguggcgacaggaagagcuaaucuucagagagcuc

SEQ ID NO: 317190 - RNA, 64 nt, hsa
aaauaacggugcuugugucacuagcauagaauagcgacaggaauagaugugguccuuaggagac

SEQ ID NO: 317191 - RNA, 64 nt, hsa
aggaggccugcagauccagccuuccugucaacagcgacaggaaaucucuagguuggugagugcu

SEQ ID NO: 317192 - RNA, 64 nt, hsa
uaguugucacuuuauuuuggaccugcugugaucucgacaggaaacgugccacagagcaguagug

SEQ ID NO: 317193 - RNA, 64 nt, hsa
gaaggugaggucugggaugcugcgugcggcgcgacgacaggagguaugaccuggguggggucag

SEQ ID NO: 317194 - RNA, 64 nt, hsa
ccauuguuguuuacuuuaguucuggaacugaaaccgacaggaagaaacuuuggaauaaggaaga

SEQ ID NO: 317195 - RNA, 64 nt, hsa
uuuccuugcucucacccacggauaaaaccagaagcgacaggaggccagcuccugggguuccugg

SEQ ID NO: 317196 - RNA, 64 nt, hsa
caagauaaaaccagagcaggaaagaugaugcaagcgacaggaaaggcccucugcuuuucuuccc

SEQ ID NO: 317197 - RNA, 64 nt, hsa
gaggaacucuccuguggccugcucaucacccuuccgacaggagcacugcaugucagagcacuuu

SEQ ID NO: 317198 - RNA, 64 nt, hsa
gucuguccacguggagagaaguugcccuccaggccgacaggaggccaugcccaccgccccugga

SEQ ID NO: 317199 - RNA, 64 nt, hsa
ugucccauggcuacauccugugggugggggcccucgacaggacagcaggacgguuuguuuucag

SEQ ID NO: 317200 - RNA, 64 nt, hsa
uaccgucacuagcccagccaggcuucagucuguccgacaggaagcugcuggguggggguggggg

SEQ ID NO: 317201 - RNA, 64 nt, hsa
cuuuaauguugcccacauuaagcacuguggaucacgacaggaaaaagguuggagcagugcuuuu

SEQ ID NO: 317202 - RNA, 64 nt, hsa
uugcuaggauggaauugcaauuugcaagcuucuucgacaggaaacuacaaguuccacacuuuaa

SEQ ID NO: 317203 - RNA, 64 nt, hsa
uugugucccugaaguucccuguugcaugagccugcgacaggaccucacccccaccaccaggcuu

SEQ ID NO: 317204 - RNA, 64 nt, hsa
cccaccaaucuggugaggauaaugguggcuccagcgacaggaggccaacccuggagaccaagaa

SEQ ID NO: 317205 - RNA, 64 nt, hsa
agcuaguugggcgccccccacccucccccggacucgacaggagccuggaccuccggcuucauuu

SEQ ID NO: 317206 - RNA, 64 nt, hsa
aggcugcuggacacgucggacagcgaaguauccccgacaggacgggcuugggcuuccauuugug

SEQ ID NO: 317207 - RNA, 64 nt, hsa
cccagcaccagagcacaaugagaaacggcagcgccgacaggagcggcggcagaugaagcgguua

SEQ ID NO: 317208 - RNA, 64 nt, hsa
caggcagcucccugaccauuuggacacauugccacgacaggagccuccaaguaugugggagggg

SEQ ID NO: 317209 - RNA, 64 nt, hsa
ugggcuccugggcugaacauggaccacgcaguugcgacaggaggccaggggaaaaaccccugcu

SEQ ID NO: 317210 - RNA, 64 nt, hsa
ucagccugcuuugagccucagugagaaguccuuccgacaggagcugacucaugucaggauggca

SEQ ID NO: 317211 - RNA, 64 nt, hsa
cucagaaguugcugccaccaacucuuuaagaaggcgacaggaucaguccuucucucggguucug

SEQ ID NO: 317212 - RNA, 64 nt, hsa
gaggccaccuccaagccgcgggugcccccuagggcgacaggagccagcgggacgccgcacgcgg

SEQ ID NO: 317213 - RNA, 64 nt, hsa
auaaaggaaagguacuggcuugaagucacaaccacgacaggaguaaggauuuggaauaaggauu

SEQ ID NO: 317214 - RNA, 64 nt, hsa
ccaagggcugaauccaguggagcugggccaaguacgacaggaguccagauaaagguguaggggc

SEQ ID NO: 317215 - RNA, 64 nt, hsa
ccgaacacacgcugugagccaccaagaccuggggcgacaggagaaccgguccucucucugacgg

SEQ ID NO: 317216 - RNA, 64 nt, hsa
ucuuacaggugguugucugggguggguggaguggcgacaggauagagcugaaggacuaugcaaa

SEQ ID NO: 317217 - RNA, 64 nt, hsa
acaacacucuagaacuggagagagguccagauugcgacaggagccacaccagagugugcaggcu

SEQ ID NO: 317218 - RNA, 64 nt, hsa
uagaggacugucacucuagcaucuuugaggacugcgacaggaccgggacagcaggccccuugac

SEQ ID NO: 317219 - RNA, 64 nt, hsa
aagcugacccugugaucucugcccugucuucgggcgacaggagccagaaaaucagggacauggc

SEQ ID NO: 317220 - RNA, 64 nt, hsa
cuuugaggugucucaaucugaucugagugagaggcgacaggaguauuuuuuuuuuuuuacagcu

SEQ ID NO: 317221 - RNA, 64 nt, hsa
gggggaagaacuaggggcuccauuguucuucaggcgacaggagaccguugcuccagugcauguc

SEQ ID NO: 317222 - RNA, 51 nt, hsa
aggaccacgagcggaaguagccgacaggagggcgaggccccugggacggac

SEQ ID NO: 317223 - RNA, 64 nt, hsa
agaaccggcgcugggcaacacgggccugcaaacucgacaggacccugcccgaggggcccucgcg

SEQ ID NO: 317224 - RNA, 64 nt, hsa
aacccggcagacgggugcaggcccggccuuuccccacgcggacuccgcgcgaccccggcccucu

SEQ ID NO: 317225 - RNA, 64 nt, hsa
gguggcgggugcacagagacggucuggaaggaaacacgcggaucugaacagcaguaauccuggg

SEQ ID NO: 317226 - RNA, 64 nt, hsa
caagaugcagguggaguacaugucauucagcgcacacgcggacgccaagggcaucaugcagcug

SEQ ID NO: 317227 - RNA, 64 nt, hsa
gcgguaccugcagaugaaggcgaagcgacagggccacgcggagccucagcccuagacucccucc

SEQ ID NO: 317228 - RNA, 64 nt, hsa
cagcucagagugcccgucagggccugugcauccgcacgcggagccgucuguuaggagcuuccag

SEQ ID NO: 317229 - RNA, 64 nt, hsa
cgggacagacgccggcgacgcgcagacacacggacacgcggaagccaagcacacucuggcgggu

SEQ ID NO: 317230 - RNA, 64 nt, hsa
gggcgagggcggcggggccugggucccccuccugcacgcggacuccgggguucggaucgcuccg

SEQ ID NO: 317231 - RNA, 64 nt, hsa
ucacacugaccaagauacuuaagugcugcaauugcacgcggagugaguuuuuuagugcgugcag

SEQ ID NO: 317232 - RNA, 64 nt, hsa
accgacgcuuacugugcgagaaucggagggcgcgcacgcggaucccccgccuggccuggacccc

SEQ ID NO: 317233 - RNA, 64 nt, hsa
gcagauagaaacugggacggauucaagucacaugcacgcggauagcaguaagccacacaccugc

SEQ ID NO: 317234 - RNA, 64 nt, hsa
gaaguuuauacuuagaacugaccaccuccccggccacgcggagagcuguacaguguguaaaucu

SEQ ID NO: 317235 - RNA, 64 nt, hsa
ucacuugaccaauacugacccucuuuaccucgcccacgcggacacacgccuccuguagucgcuu

SEQ ID NO: 317236 - RNA, 64 nt, hsa
cgcgucaggaggaaagaauugcuccaaaaaucugcacgcggagcgaaacaguuugaaagggacu

SEQ ID NO: 317237 - RNA, 64 nt, hsa
ggcaacaauuaaggccccaggggaacuggcagcgcacgcggaugcuacuacugcagucuuuauu

SEQ ID NO: 317238 - RNA, 64 nt, hsa
ccaucaaaccuugacaccgggugcucugcacacccacgcggauguugcaccucauucucccgau

SEQ ID NO: 317239 - RNA, 64 nt, hsa
gaggcaaacggaggcaaagcuggcucaccuuccgcacgcggauuaauuugcaucugaaauagga

SEQ ID NO: 317240 - RNA, 64 nt, hsa
guguucacacgcggggucgguuuaauggaguguccacgcggagauaacugcgauauuggaacac

SEQ ID NO: 317241 - RNA, 64 nt, hsa
agugggaggucaucugaaggagcccuggccgagucacgcggaggggcccggcgucuguggcggg

SEQ ID NO: 317242 - RNA, 64 nt, hsa
cuguguccccaucucggccggcccggagcucgcccacgcggacccccgcccugccccagcucag

SEQ ID NO: 317243 - RNA, 64 nt, hsa
agccucuuuccacagacuuaggaagccccccgaccacgcggacgcucgcugggcugcacucagc

SEQ ID NO: 317244 - RNA, 57 nt, hsa
gcuaccgcguccaggugugaguccagccacgcggaugccgccucaagggucuucagg

SEQ ID NO: 317245 - RNA, 64 nt, hsa
gaugggcuaugaguuuggcaaggguuugggccgacacgcggaaggccggguggagcccauccau

SEQ ID NO: 317246 - RNA, 64 nt, hsa
agcagagccggcccugaggacaguccugcccauccacgcggagauguggcugccgcguuugcau

SEQ ID NO: 317247 - RNA, 64 nt, hsa
ccucgggugcgaaaucagacccaccugacaccaucacgcggaggcccagcagcaccugcaccca

SEQ ID NO: 317248 - RNA, 64 nt, hsa
ugugaugaaaaacuuggccuuacagggcucuaguuaugguuacuuucccuagucaaugcucuga

SEQ ID NO: 317249 - RNA, 64 nt, hsa
aacaaauuuucucacugucauaaaaggcucuaauuaugguuacuuuccuugugaugaaaaacuu

SEQ ID NO: 317250 - RNA, 64 nt, hsa; identical to SEQ ID NO: 180837

SEQ ID NO: 317251 - RNA, 64 nt, hsa; identical to SEQ ID NO: 180838

SEQ ID NO: 317252 - RNA, 64 nt, hsa; identical to SEQ ID NO: 180839

SEQ ID NO: 317253 - RNA, 64 nt, hsa; identical to SEQ ID NO: 180840

SEQ ID NO: 317254 - RNA, 64 nt, hsa; identical to SEQ ID NO: 180841

SEQ ID NO: 317255 - RNA, 64 nt, hsa; identical to SEQ ID NO: 180842

SEQ ID NO: 317256 - RNA, 64 nt, hsa; identical to SEQ ID NO: 180843

SEQ ID NO: 317257 - RNA, 64 nt, hsa; identical to SEQ ID NO: 180844

SEQ ID NO: 317258 - RNA, 64 nt, hsa; identical to SEQ ID NO: 180845

SEQ ID NO: 317259 - RNA, 64 nt, hsa; identical to SEQ ID NO: 180846

SEQ ID NO: 317260 - RNA, 64 nt, hsa; identical to SEQ ID NO: 180847

SEQ ID NO: 317261 - RNA, 64 nt, hsa; identical to SEQ ID NO: 180848

SEQ ID NO: 317262 - RNA, 64 nt, hsa; identical to SEQ ID NO: 180849

SEQ ID NO: 317263 - RNA, 64 nt, hsa; identical to SEQ ID NO: 180850

SEQ ID NO: 317264 - RNA, 64 nt, hsa; identical to SEQ ID NO: 180851

SEQ ID NO: 317265 - RNA, 64 nt, hsa; identical to SEQ ID NO: 180852

SEQ ID NO: 317266 - RNA, 63 nt, hsa; identical to SEQ ID NO: 102980

SEQ ID NO: 317267 - RNA, 63 nt, hsa; identical to SEQ ID NO: 102981

SEQ ID NO: 317268 - RNA, 63 nt, hsa; identical to SEQ ID NO: 102982

SEQ ID NO: 317269 - RNA, 63 nt, hsa; identical to SEQ ID NO: 102983

SEQ ID NO: 317270 - RNA, 63 nt, hsa; identical to SEQ ID NO: 102984

SEQ ID NO: 317271 - RNA, 63 nt, hsa; identical to SEQ ID NO: 102985

SEQ ID NO: 317272 - RNA, 63 nt, hsa; identical to SEQ ID NO: 102986

SEQ ID NO: 317273 - RNA, 63 nt, hsa; identical to SEQ ID NO: 102987

SEQ ID NO: 317274 - RNA, 63 nt, hsa; identical to SEQ ID NO: 102988

SEQ ID NO: 317275 - RNA, 63 nt, hsa; identical to SEQ ID NO: 102989

SEQ ID NO: 317276 - RNA, 63 nt, hsa; identical to SEQ ID NO: 102990

SEQ ID NO: 317277 - RNA, 58 nt, hsa; identical to SEQ ID NO: 102991

SEQ ID NO: 317278 - RNA, 63 nt, hsa; identical to SEQ ID NO: 102992

SEQ ID NO: 317279 - RNA, 63 nt, hsa; identical to SEQ ID NO: 102993

SEQ ID NO: 317280 - RNA, 63 nt, hsa; identical to SEQ ID NO: 102994

SEQ ID NO: 317281 - RNA, 63 nt, hsa; identical to SEQ ID NO: 102995

SEQ ID NO: 317282 - RNA, 63 nt, hsa; identical to SEQ ID NO: 102996

SEQ ID NO: 317283 - RNA, 63 nt, hsa; identical to SEQ ID NO: 102997

SEQ ID NO: 317284 - RNA, 63 nt, hsa; identical to SEQ ID NO: 102998

SEQ ID NO: 317285 - RNA, 63 nt, hsa; identical to SEQ ID NO: 102999

SEQ ID NO: 317286 - RNA, 63 nt, hsa; identical to SEQ ID NO: 103000

SEQ ID NO: 317287 - RNA, 63 nt, hsa; identical to SEQ ID NO: 103001

SEQ ID NO: 317288 - RNA, 63 nt, hsa; identical to SEQ ID NO: 103002

SEQ ID NO: 317289 - RNA, 63 nt, hsa; identical to SEQ ID NO: 103003

SEQ ID NO: 317290 - RNA, 63 nt, hsa; identical to SEQ ID NO: 103004

SEQ ID NO: 317291 - RNA, 63 nt, hsa; identical to SEQ ID NO: 103005

SEQ ID NO: 317292 - RNA, 63 nt, hsa; identical to SEQ ID NO: 103006

SEQ ID NO: 317293 - RNA, 63 nt, hsa; identical to SEQ ID NO: 103007

SEQ ID NO: 317294 - RNA, 63 nt, hsa; identical to SEQ ID NO: 103008

SEQ ID NO: 317295 - RNA, 63 nt, hsa; identical to SEQ ID NO: 103009

SEQ ID NO: 317296 - RNA, 63 nt, hsa; identical to SEQ ID NO: 103010

SEQ ID NO: 317297 - RNA, 63 nt, hsa; identical to SEQ ID NO: 103011

SEQ ID NO: 317298 - RNA, 63 nt, hsa; identical to SEQ ID NO: 103012

SEQ ID NO: 317299 - RNA, 63 nt, hsa; identical to SEQ ID NO: 103013

SEQ ID NO: 317300 - RNA, 53 nt, hsa; identical to SEQ ID NO: 103014

SEQ ID NO: 317301 - RNA, 63 nt, hsa; identical to SEQ ID NO: 103015

SEQ ID NO: 317302 - RNA, 63 nt, hsa; identical to SEQ ID NO: 103016

SEQ ID NO: 317303 - RNA, 63 nt, hsa; identical to SEQ ID NO: 103017

SEQ ID NO: 317304 - RNA, 63 nt, hsa; identical to SEQ ID NO: 103018

SEQ ID NO: 317305 - RNA, 63 nt, hsa; identical to SEQ ID NO: 103019

SEQ ID NO: 317306 - RNA, 63 nt, hsa; identical to SEQ ID NO: 103020

SEQ ID NO: 317307 - RNA, 63 nt, hsa; identical to SEQ ID NO: 103021

SEQ ID NO: 317308 - RNA, 63 nt, hsa; identical to SEQ ID NO: 103022

SEQ ID NO: 317309 - RNA, 63 nt, hsa; identical to SEQ ID NO: 103023

SEQ ID NO: 317310 - RNA, 63 nt, hsa; identical to SEQ ID NO: 103024

SEQ ID NO: 317311 - RNA, 63 nt, hsa; identical to SEQ ID NO: 103025

SEQ ID NO: 317312 - RNA, 63 nt, hsa; identical to SEQ ID NO: 103026

SEQ ID NO: 317313 - RNA, 63 nt, hsa; identical to SEQ ID NO: 103027

SEQ ID NO: 317314 - RNA, 63 nt, hsa; identical to SEQ ID NO: 103028

SEQ ID NO: 317315 - RNA, 63 nt, hsa; identical to SEQ ID NO: 103029

SEQ ID NO: 317316 - RNA, 63 nt, hsa; identical to SEQ ID NO: 103030

SEQ ID NO: 317317 - RNA, 63 nt, hsa; identical to SEQ ID NO: 103031

SEQ ID NO: 317318 - RNA, 63 nt, hsa; identical to SEQ ID NO: 103032

SEQ ID NO: 317319 - RNA, 63 nt, hsa; identical to SEQ ID NO: 103033

SEQ ID NO: 317320 - RNA, 63 nt, hsa; identical to SEQ ID NO: 103034

SEQ ID NO: 317321 - RNA, 63 nt, hsa; identical to SEQ ID NO: 103035

SEQ ID NO: 317322 - RNA, 63 nt, hsa; identical to SEQ ID NO: 103036

SEQ ID NO: 317323 - RNA, 63 nt, hsa; identical to SEQ ID NO: 103037

SEQ ID NO: 317324 - RNA, 63 nt, hsa; identical to SEQ ID NO: 103038

SEQ ID NO: 317325 - RNA, 63 nt, hsa; identical to SEQ ID NO: 103039

SEQ ID NO: 317326 - RNA, 63 nt, hsa; identical to SEQ ID NO: 103040

SEQ ID NO: 317327 - RNA, 63 nt, hsa; identical to SEQ ID NO: 103041

SEQ ID NO: 317328 - RNA, 63 nt, hsa; identical to SEQ ID NO: 103042

SEQ ID NO: 317329 - RNA, 63 nt, hsa; identical to SEQ ID NO: 103043

SEQ ID NO: 317330 - RNA, 63 nt, hsa; identical to SEQ ID NO: 103044

SEQ ID NO: 317331 - RNA, 63 nt, hsa; identical to SEQ ID NO: 103045

SEQ ID NO: 317332 - RNA, 63 nt, hsa; identical to SEQ ID NO: 103046

SEQ ID NO: 317333 - RNA, 63 nt, hsa; identical to SEQ ID NO: 103047

SEQ ID NO: 317334 - RNA, 63 nt, hsa; identical to SEQ ID NO: 103048

SEQ ID NO: 317335 - RNA, 63 nt, hsa; identical to SEQ ID NO: 103049

SEQ ID NO: 317336 - RNA, 63 nt, hsa; identical to SEQ ID NO: 103050

SEQ ID NO: 317337 - RNA, 63 nt, hsa; identical to SEQ ID NO: 103051

SEQ ID NO: 317338 - RNA, 63 nt, hsa; identical to SEQ ID NO: 103052

SEQ ID NO: 317339 - RNA, 63 nt, hsa; identical to SEQ ID NO: 103053

SEQ ID NO: 317340 - RNA, 63 nt, hsa; identical to SEQ ID NO: 103054

SEQ ID NO: 317341 - RNA, 63 nt, hsa; identical to SEQ ID NO: 103055

SEQ ID NO: 317342 - RNA, 63 nt, hsa; identical to SEQ ID NO: 103056

SEQ ID NO: 317343 - RNA, 63 nt, hsa; identical to SEQ ID NO: 103057

SEQ ID NO: 317344 - RNA, 63 nt, hsa; identical to SEQ ID NO: 103058

SEQ ID NO: 317345 - RNA, 63 nt, hsa; identical to SEQ ID NO: 103059

SEQ ID NO: 317346 - RNA, 63 nt, hsa; identical to SEQ ID NO: 103060

SEQ ID NO: 317347 - RNA, 63 nt, hsa; identical to SEQ ID NO: 103061

SEQ ID NO: 317348 - RNA, 63 nt, hsa; identical to SEQ ID NO: 103062

SEQ ID NO: 317349 - RNA, 63 nt, hsa; identical to SEQ ID NO: 103063

SEQ ID NO: 317350 - RNA, 63 nt, hsa; identical to SEQ ID NO: 103064

SEQ ID NO: 317351 - RNA, 63 nt, hsa; identical to SEQ ID NO: 103065

SEQ ID NO: 317352 - RNA, 63 nt, hsa; identical to SEQ ID NO: 103066

SEQ ID NO: 317353 - RNA, 63 nt, hsa; identical to SEQ ID NO: 103067

SEQ ID NO: 317354 - RNA, 63 nt, hsa; identical to SEQ ID NO: 103068

SEQ ID NO: 317355 - RNA, 63 nt, hsa; identical to SEQ ID NO: 103069

SEQ ID NO: 317356 - RNA, 63 nt, hsa; identical to SEQ ID NO: 103070

SEQ ID NO: 317357 - RNA, 63 nt, hsa; identical to SEQ ID NO: 103071

SEQ ID NO: 317358 - RNA, 63 nt, hsa; identical to SEQ ID NO: 103072

SEQ ID NO: 317359 - RNA, 63 nt, hsa; identical to SEQ ID NO: 103073

SEQ ID NO: 317360 - RNA, 63 nt, hsa; identical to SEQ ID NO: 103074

SEQ ID NO: 317361 - RNA, 63 nt, hsa; identical to SEQ ID NO: 103075

SEQ ID NO: 317362 - RNA, 63 nt, hsa; identical to SEQ ID NO: 103076

SEQ ID NO: 317363 - RNA, 63 nt, hsa; identical to SEQ ID NO: 103077

SEQ ID NO: 317364 - RNA, 63 nt, hsa; identical to SEQ ID NO: 103078

SEQ ID NO: 317365 - RNA, 63 nt, hsa; identical to SEQ ID NO: 103079

SEQ ID NO: 317366 - RNA, 63 nt, hsa; identical to SEQ ID NO: 103080

SEQ ID NO: 317367 - RNA, 63 nt, hsa; identical to SEQ ID NO: 103081

SEQ ID NO: 317368 - RNA, 63 nt, hsa; identical to SEQ ID NO: 103082

SEQ ID NO: 317369 - RNA, 63 nt, hsa; identical to SEQ ID NO: 103083

SEQ ID NO: 317370 - RNA, 63 nt, hsa; identical to SEQ ID NO: 103084

SEQ ID NO: 317371 - RNA, 63 nt, hsa; identical to SEQ ID NO: 103085

SEQ ID NO: 317372 - RNA, 63 nt, hsa; identical to SEQ ID NO: 103086

SEQ ID NO: 317373 - RNA, 63 nt, hsa; identical to SEQ ID NO: 103087

SEQ ID NO: 317374 - RNA, 63 nt, hsa; identical to SEQ ID NO: 103088

SEQ ID NO: 317375 - RNA, 63 nt, hsa; identical to SEQ ID NO: 103089

SEQ ID NO: 317376 - RNA, 63 nt, hsa; identical to SEQ ID NO: 103090

SEQ ID NO: 317377 - RNA, 63 nt, hsa; identical to SEQ ID NO: 103091

SEQ ID NO: 317378 - RNA, 63 nt, hsa; identical to SEQ ID NO: 103092

SEQ ID NO: 317379 - RNA, 63 nt, hsa; identical to SEQ ID NO: 103093

SEQ ID NO: 317380 - RNA, 63 nt, hsa; identical to SEQ ID NO: 103094

SEQ ID NO: 317381 - RNA, 63 nt, hsa; identical to SEQ ID NO: 103095

SEQ ID NO: 317382 - RNA, 63 nt, hsa; identical to SEQ ID NO: 103096

SEQ ID NO: 317383 - RNA, 63 nt, hsa; identical to SEQ ID NO: 103097

SEQ ID NO: 317384 - RNA, 60 nt, hsa; identical to SEQ ID NO: 103098

SEQ ID NO: 317385 - RNA, 63 nt, hsa; identical to SEQ ID NO: 103099

SEQ ID NO: 317386 - RNA, 63 nt, hsa; identical to SEQ ID NO: 103100

SEQ ID NO: 317387 - RNA, 63 nt, hsa; identical to SEQ ID NO: 103101

SEQ ID NO: 317388 - RNA, 63 nt, hsa; identical to SEQ ID NO: 103102

SEQ ID NO: 317389 - RNA, 63 nt, hsa; identical to SEQ ID NO: 103103

SEQ ID NO: 317390 - RNA, 63 nt, hsa; identical to SEQ ID NO: 103104

SEQ ID NO: 317391 - RNA, 63 nt, hsa; identical to SEQ ID NO: 103105

SEQ ID NO: 317392 - RNA, 63 nt, hsa; identical to SEQ ID NO: 103106

SEQ ID NO: 317393 - RNA, 63 nt, hsa; identical to SEQ ID NO: 103107

SEQ ID NO: 317394 - RNA, 63 nt, hsa; identical to SEQ ID NO: 103108

SEQ ID NO: 317395 - RNA, 63 nt, hsa; identical to SEQ ID NO: 103109

SEQ ID NO: 317396 - RNA, 63 nt, hsa; identical to SEQ ID NO: 103110

SEQ ID NO: 317397 - RNA, 63 nt, hsa; identical to SEQ ID NO: 103111

SEQ ID NO: 317398 - RNA, 63 nt, hsa; identical to SEQ ID NO: 103112

SEQ ID NO: 317399 - RNA, 63 nt, hsa; identical to SEQ ID NO: 103113

SEQ ID NO: 317400 - RNA, 63 nt, hsa; identical to SEQ ID NO: 103114

SEQ ID NO: 317401 - RNA, 63 nt, hsa; identical to SEQ ID NO: 103115

SEQ ID NO: 317402 - RNA, 63 nt, hsa; identical to SEQ ID NO: 103116

SEQ ID NO: 317403 - RNA, 63 nt, hsa; identical to SEQ ID NO: 103117

SEQ ID NO: 317404 - RNA, 63 nt, hsa; identical to SEQ ID NO: 103118

SEQ ID NO: 317405 - RNA, 63 nt, hsa; identical to SEQ ID NO: 103119

SEQ ID NO: 317406 - RNA, 63 nt, hsa; identical to SEQ ID NO: 103120

SEQ ID NO: 317407 - RNA, 63 nt, hsa; identical to SEQ ID NO: 103121

SEQ ID NO: 317408 - RNA, 63 nt, hsa; identical to SEQ ID NO: 103122

SEQ ID NO: 317409 - RNA, 63 nt, hsa; identical to SEQ ID NO: 103123

SEQ ID NO: 317410 - RNA, 63 nt, hsa; identical to SEQ ID NO: 103124

SEQ ID NO: 317411 - RNA, 63 nt, hsa; identical to SEQ ID NO: 103125

SEQ ID NO: 317412 - RNA, 63 nt, hsa; identical to SEQ ID NO: 103126

SEQ ID NO: 317413 - RNA, 63 nt, hsa; identical to SEQ ID NO: 103127

SEQ ID NO: 317414 - RNA, 63 nt, hsa; identical to SEQ ID NO: 103128

SEQ ID NO: 317415 - RNA, 63 nt, hsa; identical to SEQ ID NO: 103129

SEQ ID NO: 317416 - RNA, 63 nt, hsa; identical to SEQ ID NO: 103130

SEQ ID NO: 317417 - RNA, 63 nt, hsa; identical to SEQ ID NO: 103131

SEQ ID NO: 317418 - RNA, 63 nt, hsa; identical to SEQ ID NO: 103132

SEQ ID NO: 317419 - RNA, 63 nt, hsa; identical to SEQ ID NO: 103133

SEQ ID NO: 317420 - RNA, 63 nt, hsa; identical to SEQ ID NO: 103134

SEQ ID NO: 317421 - RNA, 63 nt, hsa; identical to SEQ ID NO: 103135

SEQ ID NO: 317422 - RNA, 63 nt, hsa; identical to SEQ ID NO: 103136

SEQ ID NO: 317423 - RNA, 63 nt, hsa; identical to SEQ ID NO: 103137

SEQ ID NO: 317424 - RNA, 63 nt, hsa; identical to SEQ ID NO: 103138

SEQ ID NO: 317425 - RNA, 63 nt, hsa; identical to SEQ ID NO: 103139

SEQ ID NO: 317426 - RNA, 63 nt, hsa; identical to SEQ ID NO: 103140

SEQ ID NO: 317427 - RNA, 63 nt, hsa; identical to SEQ ID NO: 103141

SEQ ID NO: 317428 - RNA, 63 nt, hsa; identical to SEQ ID NO: 103142

SEQ ID NO: 317429 - RNA, 63 nt, hsa; identical to SEQ ID NO: 103143

SEQ ID NO: 317430 - RNA, 63 nt, hsa; identical to SEQ ID NO: 103144

SEQ ID NO: 317431 - RNA, 63 nt, hsa; identical to SEQ ID NO: 103145

SEQ ID NO: 317432 - RNA, 63 nt, hsa; identical to SEQ ID NO: 103146

SEQ ID NO: 317433 - RNA, 63 nt, hsa; identical to SEQ ID NO: 103147

SEQ ID NO: 317434 - RNA, 63 nt, hsa; identical to SEQ ID NO: 103148

SEQ ID NO: 317435 - RNA, 63 nt, hsa; identical to SEQ ID NO: 103149

SEQ ID NO: 317436 - RNA, 63 nt, hsa; identical to SEQ ID NO: 103150

SEQ ID NO: 317437 - RNA, 63 nt, hsa; identical to SEQ ID NO: 103151

SEQ ID NO: 317438 - RNA, 63 nt, hsa; identical to SEQ ID NO: 103152

SEQ ID NO: 317439 - RNA, 63 nt, hsa; identical to SEQ ID NO: 103153

SEQ ID NO: 317440 - RNA, 63 nt, hsa; identical to SEQ ID NO: 103154

SEQ ID NO: 317441 - RNA, 63 nt, hsa; identical to SEQ ID NO: 103155

SEQ ID NO: 317442 - RNA, 63 nt, hsa; identical to SEQ ID NO: 103156

SEQ ID NO: 317443 - RNA, 63 nt, hsa; identical to SEQ ID NO: 103157

SEQ ID NO: 317444 - RNA, 63 nt, hsa; identical to SEQ ID NO: 103158

SEQ ID NO: 317445 - RNA, 63 nt, hsa; identical to SEQ ID NO: 103159

SEQ ID NO: 317446 - RNA, 63 nt, hsa; identical to SEQ ID NO: 103160

SEQ ID NO: 317447 - RNA, 63 nt, hsa; identical to SEQ ID NO: 103161

SEQ ID NO: 317448 - RNA, 63 nt, hsa; identical to SEQ ID NO: 103162

SEQ ID NO: 317449 - RNA, 63 nt, hsa; identical to SEQ ID NO: 103163

SEQ ID NO: 317450 - RNA, 63 nt, hsa; identical to SEQ ID NO: 103164

SEQ ID NO: 317451 - RNA, 63 nt, hsa; identical to SEQ ID NO: 103165

SEQ ID NO: 317452 - RNA, 63 nt, hsa; identical to SEQ ID NO: 103166

SEQ ID NO: 317453 - RNA, 63 nt, hsa; identical to SEQ ID NO: 103167

SEQ ID NO: 317454 - RNA, 63 nt, hsa; identical to SEQ ID NO: 103168

SEQ ID NO: 317455 - RNA, 63 nt, hsa; identical to SEQ ID NO: 103169

SEQ ID NO: 317456 - RNA, 63 nt, hsa; identical to SEQ ID NO: 103170

SEQ ID NO: 317457 - RNA, 63 nt, hsa; identical to SEQ ID NO: 103171

SEQ ID NO: 317458 - RNA, 63 nt, hsa; identical to SEQ ID NO: 103172

SEQ ID NO: 317459 - RNA, 63 nt, hsa; identical to SEQ ID NO: 103173

SEQ ID NO: 317460 - RNA, 63 nt, hsa; identical to SEQ ID NO: 103174

SEQ ID NO: 317461 - RNA, 63 nt, hsa; identical to SEQ ID NO: 103175

SEQ ID NO: 317462 - RNA, 63 nt, hsa; identical to SEQ ID NO: 103176

SEQ ID NO: 317463 - RNA, 63 nt, hsa; identical to SEQ ID NO: 103177

SEQ ID NO: 317464 - RNA, 63 nt, hsa; identical to SEQ ID NO: 103178

SEQ ID NO: 317465 - RNA, 63 nt, hsa; identical to SEQ ID NO: 103179

SEQ ID NO: 317466 - RNA, 63 nt, hsa; identical to SEQ ID NO: 103180

SEQ ID NO: 317467 - RNA, 63 nt, hsa; identical to SEQ ID NO: 103181

SEQ ID NO: 317468 - RNA, 63 nt, hsa; identical to SEQ ID NO: 103182

SEQ ID NO: 317469 - RNA, 63 nt, hsa; identical to SEQ ID NO: 103183

SEQ ID NO: 317470 - RNA, 63 nt, hsa; identical to SEQ ID NO: 103184

SEQ ID NO: 317471 - RNA, 63 nt, hsa; identical to SEQ ID NO: 103185

SEQ ID NO: 317472 - RNA, 63 nt, hsa; identical to SEQ ID NO: 103186

SEQ ID NO: 317473 - RNA, 63 nt, hsa; identical to SEQ ID NO: 103187

SEQ ID NO: 317474 - RNA, 63 nt, hsa; identical to SEQ ID NO: 103188

SEQ ID NO: 317475 - RNA, 63 nt, hsa; identical to SEQ ID NO: 103189

SEQ ID NO: 317476 - RNA, 63 nt, hsa; identical to SEQ ID NO: 103190

SEQ ID NO: 317477 - RNA, 63 nt, hsa; identical to SEQ ID NO: 103191

SEQ ID NO: 317478 - RNA, 63 nt, hsa; identical to SEQ ID NO: 103192

SEQ ID NO: 317479 - RNA, 63 nt, hsa; identical to SEQ ID NO: 103193

SEQ ID NO: 317480 - RNA, 63 nt, hsa; identical to SEQ ID NO: 103194

SEQ ID NO: 317481 - RNA, 63 nt, hsa; identical to SEQ ID NO: 103195

SEQ ID NO: 317482 - RNA, 51 nt, hsa; identical to SEQ ID NO: 103196

SEQ ID NO: 317483 - RNA, 63 nt, hsa; identical to SEQ ID NO: 103197

SEQ ID NO: 317484 - RNA, 63 nt, hsa; identical to SEQ ID NO: 103198

SEQ ID NO: 317485 - RNA, 63 nt, hsa; identical to SEQ ID NO: 103199

SEQ ID NO: 317486 - RNA, 63 nt, hsa; identical to SEQ ID NO: 103200

SEQ ID NO: 317487 - RNA, 63 nt, hsa; identical to SEQ ID NO: 103201

SEQ ID NO: 317488 - RNA, 63 nt, hsa; identical to SEQ ID NO: 103202

SEQ ID NO: 317489 - RNA, 63 nt, hsa; identical to SEQ ID NO: 103203

SEQ ID NO: 317490 - RNA, 63 nt, hsa; identical to SEQ ID NO: 103204

SEQ ID NO: 317491 - RNA, 63 nt, hsa; identical to SEQ ID NO: 103205

SEQ ID NO: 317492 - RNA, 63 nt, hsa; identical to SEQ ID NO: 103206

SEQ ID NO: 317493 - RNA, 63 nt, hsa; identical to SEQ ID NO: 103207

SEQ ID NO: 317494 - RNA, 63 nt, hsa; identical to SEQ ID NO: 103208

SEQ ID NO: 317495 - RNA, 63 nt, hsa; identical to SEQ ID NO: 103209

SEQ ID NO: 317496 - RNA, 63 nt, hsa; identical to SEQ ID NO: 103210

SEQ ID NO: 317497 - RNA, 63 nt, hsa; identical to SEQ ID NO: 103211

SEQ ID NO: 317498 - RNA, 63 nt, hsa; identical to SEQ ID NO: 103212

SEQ ID NO: 317499 - RNA, 63 nt, hsa; identical to SEQ ID NO: 103213

SEQ ID NO: 317500 - RNA, 63 nt, hsa; identical to SEQ ID NO: 103214

SEQ ID NO: 317501 - RNA, 63 nt, hsa; identical to SEQ ID NO: 103215

SEQ ID NO: 317502 - RNA, 63 nt, hsa; identical to SEQ ID NO: 103216

SEQ ID NO: 317503 - RNA, 63 nt, hsa; identical to SEQ ID NO: 103217

SEQ ID NO: 317504 - RNA, 63 nt, hsa; identical to SEQ ID NO: 103218

SEQ ID NO: 317505 - RNA, 63 nt, hsa; identical to SEQ ID NO: 103219

SEQ ID NO: 317506 - RNA, 63 nt, hsa; identical to SEQ ID NO: 103220

SEQ ID NO: 317507 - RNA, 63 nt, hsa; identical to SEQ ID NO: 103221

SEQ ID NO: 317508 - RNA, 63 nt, hsa; identical to SEQ ID NO: 103222

SEQ ID NO: 317509 - RNA, 63 nt, hsa; identical to SEQ ID NO: 103223

SEQ ID NO: 317510 - RNA, 63 nt, hsa; identical to SEQ ID NO: 103224

SEQ ID NO: 317511 - RNA, 63 nt, hsa; identical to SEQ ID NO: 103225

SEQ ID NO: 317512 - RNA, 63 nt, hsa; identical to SEQ ID NO: 103226

SEQ ID NO: 317513 - RNA, 63 nt, hsa; identical to SEQ ID NO: 103227

SEQ ID NO: 317514 - RNA, 63 nt, hsa; identical to SEQ ID NO: 103228

SEQ ID NO: 317515 - RNA, 63 nt, hsa; identical to SEQ ID NO: 103229

SEQ ID NO: 317516 - RNA, 63 nt, hsa; identical to SEQ ID NO: 103230

SEQ ID NO: 317517 - RNA, 63 nt, hsa; identical to SEQ ID NO: 103231

SEQ ID NO: 317518 - RNA, 63 nt, hsa; identical to SEQ ID NO: 103232

SEQ ID NO: 317519 - RNA, 63 nt, hsa; identical to SEQ ID NO: 103233

SEQ ID NO: 317520 - RNA, 63 nt, hsa; identical to SEQ ID NO: 103234

SEQ ID NO: 317521 - RNA, 63 nt, hsa; identical to SEQ ID NO: 103235

SEQ ID NO: 317522 - RNA, 63 nt, hsa; identical to SEQ ID NO: 103236

SEQ ID NO: 317523 - RNA, 63 nt, hsa; identical to SEQ ID NO: 103237

SEQ ID NO: 317524 - RNA, 63 nt, hsa; identical to SEQ ID NO: 103238

SEQ ID NO: 317525 - RNA, 63 nt, hsa; identical to SEQ ID NO: 103239

SEQ ID NO: 317526 - RNA, 63 nt, hsa; identical to SEQ ID NO: 103240

SEQ ID NO: 317527 - RNA, 63 nt, hsa; identical to SEQ ID NO: 103241

SEQ ID NO: 317528 - RNA, 63 nt, hsa; identical to SEQ ID NO: 103242

SEQ ID NO: 317529 - RNA, 63 nt, hsa; identical to SEQ ID NO: 103243

SEQ ID NO: 317530 - RNA, 63 nt, hsa; identical to SEQ ID NO: 103244

SEQ ID NO: 317531 - RNA, 63 nt, hsa; identical to SEQ ID NO: 103245

SEQ ID NO: 317532 - RNA, 63 nt, hsa; identical to SEQ ID NO: 103246

SEQ ID NO: 317533 - RNA, 63 nt, hsa; identical to SEQ ID NO: 103247

SEQ ID NO: 317534 - RNA, 63 nt, hsa; identical to SEQ ID NO: 103248

SEQ ID NO: 317535 - RNA, 63 nt, hsa; identical to SEQ ID NO: 103249

SEQ ID NO: 317536 - RNA, 63 nt, hsa; identical to SEQ ID NO: 103250

SEQ ID NO: 317537 - RNA, 63 nt, hsa; identical to SEQ ID NO: 103251

SEQ ID NO: 317538 - RNA, 63 nt, hsa; identical to SEQ ID NO: 103252

SEQ ID NO: 317539 - RNA, 63 nt, hsa; identical to SEQ ID NO: 103253

SEQ ID NO: 317540 - RNA, 63 nt, hsa; identical to SEQ ID NO: 103254

SEQ ID NO: 317541 - RNA, 63 nt, hsa; identical to SEQ ID NO: 103255

SEQ ID NO: 317542 - RNA, 63 nt, hsa; identical to SEQ ID NO: 103256

SEQ ID NO: 317543 - RNA, 63 nt, hsa; identical to SEQ ID NO: 103257

SEQ ID NO: 317544 - RNA, 63 nt, hsa; identical to SEQ ID NO: 103258

SEQ ID NO: 317545 - RNA, 63 nt, hsa; identical to SEQ ID NO: 103259

SEQ ID NO: 317546 - RNA, 63 nt, hsa; identical to SEQ ID NO: 103260

SEQ ID NO: 317547 - RNA, 63 nt, hsa; identical to SEQ ID NO: 103261

SEQ ID NO: 317548 - RNA, 63 nt, hsa; identical to SEQ ID NO: 103262

SEQ ID NO: 317549 - RNA, 63 nt, hsa; identical to SEQ ID NO: 103263

SEQ ID NO: 317550 - RNA, 63 nt, hsa; identical to SEQ ID NO: 103264

SEQ ID NO: 317551 - RNA, 63 nt, hsa; identical to SEQ ID NO: 103265

SEQ ID NO: 317552 - RNA, 63 nt, hsa; identical to SEQ ID NO: 103266

SEQ ID NO: 317553 - RNA, 63 nt, hsa; identical to SEQ ID NO: 103267

SEQ ID NO: 317554 - RNA, 63 nt, hsa; identical to SEQ ID NO: 103268

SEQ ID NO: 317555 - RNA, 63 nt, hsa; identical to SEQ ID NO: 103269

SEQ ID NO: 317556 - RNA, 63 nt, hsa; identical to SEQ ID NO: 103270

SEQ ID NO: 317557 - RNA, 63 nt, hsa; identical to SEQ ID NO: 103271

SEQ ID NO: 317558 - RNA, 63 nt, hsa; identical to SEQ ID NO: 103272

SEQ ID NO: 317559 - RNA, 63 nt, hsa; identical to SEQ ID NO: 103273

SEQ ID NO: 317560 - RNA, 63 nt, hsa; identical to SEQ ID NO: 103274

SEQ ID NO: 317561 - RNA, 63 nt, hsa; identical to SEQ ID NO: 103275

SEQ ID NO: 317562 - RNA, 63 nt, hsa; identical to SEQ ID NO: 103276

SEQ ID NO: 317563 - RNA, 63 nt, hsa; identical to SEQ ID NO: 103277

SEQ ID NO: 317564 - RNA, 63 nt, hsa; identical to SEQ ID NO: 103278

SEQ ID NO: 317565 - RNA, 63 nt, hsa; identical to SEQ ID NO: 103279

SEQ ID NO: 317566 - RNA, 63 nt, hsa; identical to SEQ ID NO: 103280

SEQ ID NO: 317567 - RNA, 63 nt, hsa; identical to SEQ ID NO: 103281

SEQ ID NO: 317568 - RNA, 63 nt, hsa; identical to SEQ ID NO: 103282

SEQ ID NO: 317569 - RNA, 63 nt, hsa; identical to SEQ ID NO: 103283

SEQ ID NO: 317570 - RNA, 63 nt, hsa; identical to SEQ ID NO: 103284

SEQ ID NO: 317571 - RNA, 63 nt, hsa; identical to SEQ ID NO: 103285

SEQ ID NO: 317572 - RNA, 63 nt, hsa; identical to SEQ ID NO: 103286

SEQ ID NO: 317573 - RNA, 63 nt, hsa; identical to SEQ ID NO: 103287

SEQ ID NO: 317574 - RNA, 63 nt, hsa; identical to SEQ ID NO: 103288

SEQ ID NO: 317575 - RNA, 62 nt, hsa; identical to SEQ ID NO: 103289

SEQ ID NO: 317576 - RNA, 62 nt, hsa; identical to SEQ ID NO: 103290

SEQ ID NO: 317577 - RNA, 62 nt, hsa; identical to SEQ ID NO: 103291

SEQ ID NO: 317578 - RNA, 62 nt, hsa; identical to SEQ ID NO: 103292

SEQ ID NO: 317579 - RNA, 62 nt, hsa; identical to SEQ ID NO: 103293

SEQ ID NO: 317580 - RNA, 62 nt, hsa; identical to SEQ ID NO: 103294

SEQ ID NO: 317581 - RNA, 62 nt, hsa; identical to SEQ ID NO: 103295

SEQ ID NO: 317582 - RNA, 62 nt, hsa; identical to SEQ ID NO: 103296

SEQ ID NO: 317583 - RNA, 62 nt, hsa; identical to SEQ ID NO: 103297

SEQ ID NO: 317584 - RNA, 62 nt, hsa; identical to SEQ ID NO: 103298

SEQ ID NO: 317585 - RNA, 62 nt, hsa; identical to SEQ ID NO: 103299

SEQ ID NO: 317586 - RNA, 57 nt, hsa; identical to SEQ ID NO: 103300

SEQ ID NO: 317587 - RNA, 62 nt, hsa; identical to SEQ ID NO: 103301

SEQ ID NO: 317588 - RNA, 62 nt, hsa; identical to SEQ ID NO: 103302

SEQ ID NO: 317589 - RNA, 62 nt, hsa; identical to SEQ ID NO: 103303

SEQ ID NO: 317590 - RNA, 62 nt, hsa; identical to SEQ ID NO: 103304

SEQ ID NO: 317591 - RNA, 62 nt, hsa; identical to SEQ ID NO: 103305

SEQ ID NO: 317592 - RNA, 62 nt, hsa; identical to SEQ ID NO: 103306

SEQ ID NO: 317593 - RNA, 62 nt, hsa; identical to SEQ ID NO: 103307

SEQ ID NO: 317594 - RNA, 62 nt, hsa; identical to SEQ ID NO: 103308

SEQ ID NO: 317595 - RNA, 62 nt, hsa; identical to SEQ ID NO: 103309

SEQ ID NO: 317596 - RNA, 62 nt, hsa; identical to SEQ ID NO: 103310

SEQ ID NO: 317597 - RNA, 62 nt, hsa; identical to SEQ ID NO: 103311

SEQ ID NO: 317598 - RNA, 62 nt, hsa; identical to SEQ ID NO: 103312

SEQ ID NO: 317599 - RNA, 62 nt, hsa; identical to SEQ ID NO: 103313

SEQ ID NO: 317600 - RNA, 62 nt, hsa; identical to SEQ ID NO: 103314

SEQ ID NO: 317601 - RNA, 62 nt, hsa; identical to SEQ ID NO: 103315

SEQ ID NO: 317602 - RNA, 62 nt, hsa; identical to SEQ ID NO: 103316

SEQ ID NO: 317603 - RNA, 62 nt, hsa; identical to SEQ ID NO: 103317

SEQ ID NO: 317604 - RNA, 62 nt, hsa; identical to SEQ ID NO: 103318

SEQ ID NO: 317605 - RNA, 62 nt, hsa; identical to SEQ ID NO: 103319

SEQ ID NO: 317606 - RNA, 62 nt, hsa; identical to SEQ ID NO: 103320

SEQ ID NO: 317607 - RNA, 62 nt, hsa; identical to SEQ ID NO: 103321

SEQ ID NO: 317608 - RNA, 62 nt, hsa; identical to SEQ ID NO: 103322

SEQ ID NO: 317609 - RNA, 62 nt, hsa; identical to SEQ ID NO: 103323

SEQ ID NO: 317610 - RNA, 62 nt, hsa; identical to SEQ ID NO: 103324

SEQ ID NO: 317611 - RNA, 62 nt, hsa; identical to SEQ ID NO: 103325

SEQ ID NO: 317612 - RNA, 62 nt, hsa; identical to SEQ ID NO: 103326

SEQ ID NO: 317613 - RNA, 62 nt, hsa; identical to SEQ ID NO: 103327

SEQ ID NO: 317614 - RNA, 62 nt, hsa; identical to SEQ ID NO: 103328

SEQ ID NO: 317615 - RNA, 62 nt, hsa; identical to SEQ ID NO: 103329

SEQ ID NO: 317616 - RNA, 62 nt, hsa; identical to SEQ ID NO: 103330

SEQ ID NO: 317617 - RNA, 62 nt, hsa; identical to SEQ ID NO: 103331

SEQ ID NO: 317618 - RNA, 62 nt, hsa; identical to SEQ ID NO: 103332

SEQ ID NO: 317619 - RNA, 62 nt, hsa; identical to SEQ ID NO: 103333

SEQ ID NO: 317620 - RNA, 62 nt, hsa; identical to SEQ ID NO: 103334

SEQ ID NO: 317621 - RNA, 62 nt, hsa; identical to SEQ ID NO: 103335

SEQ ID NO: 317622 - RNA, 62 nt, hsa; identical to SEQ ID NO: 103336

SEQ ID NO: 317623 - RNA, 62 nt, hsa; identical to SEQ ID NO: 103337

SEQ ID NO: 317624 - RNA, 62 nt, hsa; identical to SEQ ID NO: 103338

SEQ ID NO: 317625 - RNA, 62 nt, hsa; identical to SEQ ID NO: 103339

SEQ ID NO: 317626 - RNA, 62 nt, hsa; identical to SEQ ID NO: 103340

SEQ ID NO: 317627 - RNA, 62 nt, hsa; identical to SEQ ID NO: 103341

SEQ ID NO: 317628 - RNA, 62 nt, hsa; identical to SEQ ID NO: 103342

SEQ ID NO: 317629 - RNA, 62 nt, hsa; identical to SEQ ID NO: 103343

SEQ ID NO: 317630 - RNA, 62 nt, hsa; identical to SEQ ID NO: 103344

SEQ ID NO: 317631 - RNA, 62 nt, hsa; identical to SEQ ID NO: 103345

SEQ ID NO: 317632 - RNA, 62 nt, hsa; identical to SEQ ID NO: 103346

SEQ ID NO: 317633 - RNA, 62 nt, hsa; identical to SEQ ID NO: 103347

SEQ ID NO: 317634 - RNA, 62 nt, hsa; identical to SEQ ID NO: 103348

SEQ ID NO: 317635 - RNA, 62 nt, hsa; identical to SEQ ID NO: 103349

SEQ ID NO: 317636 - RNA, 62 nt, hsa; identical to SEQ ID NO: 103350

SEQ ID NO: 317637 - RNA, 62 nt, hsa; identical to SEQ ID NO: 103351

SEQ ID NO: 317638 - RNA, 62 nt, hsa; identical to SEQ ID NO: 103352

SEQ ID NO: 317639 - RNA, 62 nt, hsa; identical to SEQ ID NO: 103353

SEQ ID NO: 317640 - RNA, 62 nt, hsa; identical to SEQ ID NO: 103354

SEQ ID NO: 317641 - RNA, 62 nt, hsa; identical to SEQ ID NO: 103355

SEQ ID NO: 317642 - RNA, 62 nt, hsa; identical to SEQ ID NO: 103356

SEQ ID NO: 317643 - RNA, 62 nt, hsa; identical to SEQ ID NO: 103357

SEQ ID NO: 317644 - RNA, 62 nt, hsa; identical to SEQ ID NO: 103358

SEQ ID NO: 317645 - RNA, 62 nt, hsa; identical to SEQ ID NO: 103359

SEQ ID NO: 317646 - RNA, 62 nt, hsa; identical to SEQ ID NO: 103360

SEQ ID NO: 317647 - RNA, 62 nt, hsa; identical to SEQ ID NO: 103361

SEQ ID NO: 317648 - RNA, 62 nt, hsa; identical to SEQ ID NO: 103362

SEQ ID NO: 317649 - RNA, 62 nt, hsa; identical to SEQ ID NO: 103363

SEQ ID NO: 317650 - RNA, 62 nt, hsa; identical to SEQ ID NO: 103364

SEQ ID NO: 317651 - RNA, 62 nt, hsa; identical to SEQ ID NO: 103365

SEQ ID NO: 317652 - RNA, 62 nt, hsa; identical to SEQ ID NO: 103366

SEQ ID NO: 317653 - RNA, 62 nt, hsa; identical to SEQ ID NO: 103367

SEQ ID NO: 317654 - RNA, 62 nt, hsa; identical to SEQ ID NO: 103368

SEQ ID NO: 317655 - RNA, 62 nt, hsa; identical to SEQ ID NO: 103369

SEQ ID NO: 317656 - RNA, 62 nt, hsa; identical to SEQ ID NO: 103370

SEQ ID NO: 317657 - RNA, 62 nt, hsa; identical to SEQ ID NO: 103371

SEQ ID NO: 317658 - RNA, 59 nt, hsa; identical to SEQ ID NO: 103372

SEQ ID NO: 317659 - RNA, 62 nt, hsa; identical to SEQ ID NO: 103373

SEQ ID NO: 317660 - RNA, 62 nt, hsa; identical to SEQ ID NO: 103374

SEQ ID NO: 317661 - RNA, 62 nt, hsa; identical to SEQ ID NO: 103375

SEQ ID NO: 317662 - RNA, 62 nt, hsa; identical to SEQ ID NO: 103376

SEQ ID NO: 317663 - RNA, 62 nt, hsa; identical to SEQ ID NO: 103377

SEQ ID NO: 317664 - RNA, 62 nt, hsa; identical to SEQ ID NO: 103378

SEQ ID NO: 317665 - RNA, 62 nt, hsa; identical to SEQ ID NO: 103379

SEQ ID NO: 317666 - RNA, 62 nt, hsa; identical to SEQ ID NO: 103380

SEQ ID NO: 317667 - RNA, 62 nt, hsa; identical to SEQ ID NO: 103381

SEQ ID NO: 317668 - RNA, 62 nt, hsa; identical to SEQ ID NO: 103382

SEQ ID NO: 317669 - RNA, 62 nt, hsa; identical to SEQ ID NO: 103383

SEQ ID NO: 317670 - RNA, 62 nt, hsa; identical to SEQ ID NO: 103384

SEQ ID NO: 317671 - RNA, 62 nt, hsa; identical to SEQ ID NO: 103385

SEQ ID NO: 317672 - RNA, 62 nt, hsa; identical to SEQ ID NO: 103386

SEQ ID NO: 317673 - RNA, 62 nt, hsa; identical to SEQ ID NO: 103387

SEQ ID NO: 317674 - RNA, 62 nt, hsa; identical to SEQ ID NO: 103388

SEQ ID NO: 317675 - RNA, 62 nt, hsa; identical to SEQ ID NO: 103389

SEQ ID NO: 317676 - RNA, 62 nt, hsa; identical to SEQ ID NO: 103390

SEQ ID NO: 317677 - RNA, 62 nt, hsa; identical to SEQ ID NO: 103391

SEQ ID NO: 317678 - RNA, 62 nt, hsa; identical to SEQ ID NO: 103392

SEQ ID NO: 317679 - RNA, 60 nt, hsa; identical to SEQ ID NO: 103393

SEQ ID NO: 317680 - RNA, 62 nt, hsa; identical to SEQ ID NO: 103394

SEQ ID NO: 317681 - RNA, 62 nt, hsa; identical to SEQ ID NO: 103395

SEQ ID NO: 317682 - RNA, 62 nt, hsa; identical to SEQ ID NO: 103396

SEQ ID NO: 317683 - RNA, 62 nt, hsa; identical to SEQ ID NO: 103397

SEQ ID NO: 317684 - RNA, 62 nt, hsa; identical to SEQ ID NO: 103398

SEQ ID NO: 317685 - RNA, 62 nt, hsa; identical to SEQ ID NO: 103399

SEQ ID NO: 317686 - RNA, 62 nt, hsa; identical to SEQ ID NO: 103400

SEQ ID NO: 317687 - RNA, 62 nt, hsa; identical to SEQ ID NO: 103401

SEQ ID NO: 317688 - RNA, 62 nt, hsa; identical to SEQ ID NO: 103402

SEQ ID NO: 317689 - RNA, 62 nt, hsa; identical to SEQ ID NO: 103403

SEQ ID NO: 317690 - RNA, 62 nt, hsa; identical to SEQ ID NO: 103404

SEQ ID NO: 317691 - RNA, 62 nt, hsa; identical to SEQ ID NO: 103405

SEQ ID NO: 317692 - RNA, 62 nt, hsa; identical to SEQ ID NO: 103406

SEQ ID NO: 317693 - RNA, 62 nt, hsa; identical to SEQ ID NO: 103407

SEQ ID NO: 317694 - RNA, 62 nt, hsa; identical to SEQ ID NO: 103408

SEQ ID NO: 317695 - RNA, 62 nt, hsa; identical to SEQ ID NO: 103409

SEQ ID NO: 317696 - RNA, 62 nt, hsa; identical to SEQ ID NO: 103410

SEQ ID NO: 317697 - RNA, 62 nt, hsa; identical to SEQ ID NO: 103411

SEQ ID NO: 317698 - RNA, 62 nt, hsa; identical to SEQ ID NO: 103412

SEQ ID NO: 317699 - RNA, 62 nt, hsa; identical to SEQ ID NO: 103413

SEQ ID NO: 317700 - RNA, 62 nt, hsa; identical to SEQ ID NO: 103414

SEQ ID NO: 317701 - RNA, 62 nt, hsa; identical to SEQ ID NO: 103415

SEQ ID NO: 317702 - RNA, 62 nt, hsa; identical to SEQ ID NO: 103416

SEQ ID NO: 317703 - RNA, 62 nt, hsa; identical to SEQ ID NO: 103417

SEQ ID NO: 317704 - RNA, 62 nt, hsa; identical to SEQ ID NO: 103418

SEQ ID NO: 317705 - RNA, 62 nt, hsa; identical to SEQ ID NO: 103419

SEQ ID NO: 317706 - RNA, 62 nt, hsa; identical to SEQ ID NO: 103420

SEQ ID NO: 317707 - RNA, 62 nt, hsa; identical to SEQ ID NO: 103421

SEQ ID NO: 317708 - RNA, 62 nt, hsa; identical to SEQ ID NO: 103422

SEQ ID NO: 317709 - RNA, 62 nt, hsa; identical to SEQ ID NO: 103423

SEQ ID NO: 317710 - RNA, 62 nt, hsa; identical to SEQ ID NO: 103424

SEQ ID NO: 317711 - RNA, 62 nt, hsa; identical to SEQ ID NO: 103425

SEQ ID NO: 317712 - RNA, 62 nt, hsa; identical to SEQ ID NO: 103426

SEQ ID NO: 317713 - RNA, 62 nt, hsa; identical to SEQ ID NO: 103427

SEQ ID NO: 317714 - RNA, 62 nt, hsa; identical to SEQ ID NO: 103428

SEQ ID NO: 317715 - RNA, 62 nt, hsa; identical to SEQ ID NO: 103429

SEQ ID NO: 317716 - RNA, 62 nt, hsa; identical to SEQ ID NO: 103430

SEQ ID NO: 317717 - RNA, 62 nt, hsa; identical to SEQ ID NO: 103431

SEQ ID NO: 317718 - RNA, 62 nt, hsa; identical to SEQ ID NO: 103432

SEQ ID NO: 317719 - RNA, 62 nt, hsa; identical to SEQ ID NO: 103433

SEQ ID NO: 317720 - RNA, 62 nt, hsa; identical to SEQ ID NO: 103434

SEQ ID NO: 317721 - RNA, 62 nt, hsa; identical to SEQ ID NO: 103435

SEQ ID NO: 317722 - RNA, 62 nt, hsa; identical to SEQ ID NO: 103436

SEQ ID NO: 317723 - RNA, 62 nt, hsa; identical to SEQ ID NO: 103437

SEQ ID NO: 317724 - RNA, 62 nt, hsa; identical to SEQ ID NO: 103438

SEQ ID NO: 317725 - RNA, 62 nt, hsa; identical to SEQ ID NO: 103439

SEQ ID NO: 317726 - RNA, 62 nt, hsa; identical to SEQ ID NO: 103440

SEQ ID NO: 317727 - RNA, 62 nt, hsa; identical to SEQ ID NO: 103441

SEQ ID NO: 317728 - RNA, 62 nt, hsa; identical to SEQ ID NO: 103442

SEQ ID NO: 317729 - RNA, 62 nt, hsa; identical to SEQ ID NO: 103443

SEQ ID NO: 317730 - RNA, 62 nt, hsa; identical to SEQ ID NO: 103444

SEQ ID NO: 317731 - RNA, 62 nt, hsa; identical to SEQ ID NO: 103445

SEQ ID NO: 317732 - RNA, 62 nt, hsa; identical to SEQ ID NO: 103446

SEQ ID NO: 317733 - RNA, 62 nt, hsa; identical to SEQ ID NO: 103447

SEQ ID NO: 317734 - RNA, 62 nt, hsa; identical to SEQ ID NO: 103448

SEQ ID NO: 317735 - RNA, 62 nt, hsa; identical to SEQ ID NO: 103449

SEQ ID NO: 317736 - RNA, 62 nt, hsa; identical to SEQ ID NO: 103450

SEQ ID NO: 317737 - RNA, 62 nt, hsa; identical to SEQ ID NO: 103451

SEQ ID NO: 317738 - RNA, 62 nt, hsa; identical to SEQ ID NO: 103452

SEQ ID NO: 317739 - RNA, 62 nt, hsa; identical to SEQ ID NO: 103453

SEQ ID NO: 317740 - RNA, 62 nt, hsa; identical to SEQ ID NO: 103454

SEQ ID NO: 317741 - RNA, 62 nt, hsa; identical to SEQ ID NO: 103455

SEQ ID NO: 317742 - RNA, 62 nt, hsa; identical to SEQ ID NO: 103456

SEQ ID NO: 317743 - RNA, 62 nt, hsa; identical to SEQ ID NO: 103457

SEQ ID NO: 317744 - RNA, 62 nt, hsa; identical to SEQ ID NO: 103458

SEQ ID NO: 317745 - RNA, 62 nt, hsa; identical to SEQ ID NO: 103459

SEQ ID NO: 317746 - RNA, 62 nt, hsa; identical to SEQ ID NO: 103460

SEQ ID NO: 317747 - RNA, 62 nt, hsa; identical to SEQ ID NO: 103461

SEQ ID NO: 317748 - RNA, 62 nt, hsa; identical to SEQ ID NO: 103462

SEQ ID NO: 317749 - RNA, 62 nt, hsa; identical to SEQ ID NO: 103463

SEQ ID NO: 317750 - RNA, 62 nt, hsa; identical to SEQ ID NO: 103464

SEQ ID NO: 317751 - RNA, 62 nt, hsa; identical to SEQ ID NO: 103465

SEQ ID NO: 317752 - RNA, 62 nt, hsa; identical to SEQ ID NO: 103466

SEQ ID NO: 317753 - RNA, 62 nt, hsa; identical to SEQ ID NO: 103467

SEQ ID NO: 317754 - RNA, 62 nt, hsa; identical to SEQ ID NO: 103468

SEQ ID NO: 317755 - RNA, 62 nt, hsa; identical to SEQ ID NO: 103469

SEQ ID NO: 317756 - RNA, 62 nt, hsa; identical to SEQ ID NO: 103470

SEQ ID NO: 317757 - RNA, 62 nt, hsa; identical to SEQ ID NO: 103471

SEQ ID NO: 317758 - RNA, 62 nt, hsa; identical to SEQ ID NO: 103472

SEQ ID NO: 317759 - RNA, 62 nt, hsa; identical to SEQ ID NO: 103473

SEQ ID NO: 317760 - RNA, 62 nt, hsa; identical to SEQ ID NO: 103474

SEQ ID NO: 317761 - RNA, 62 nt, hsa; identical to SEQ ID NO: 103475

SEQ ID NO: 317762 - RNA, 62 nt, hsa; identical to SEQ ID NO: 103476

SEQ ID NO: 317763 - RNA, 62 nt, hsa; identical to SEQ ID NO: 103477

SEQ ID NO: 317764 - RNA, 62 nt, hsa; identical to SEQ ID NO: 103478

SEQ ID NO: 317765 - RNA, 62 nt, hsa; identical to SEQ ID NO: 103479

SEQ ID NO: 317766 - RNA, 62 nt, hsa; identical to SEQ ID NO: 103480

SEQ ID NO: 317767 - RNA, 62 nt, hsa; identical to SEQ ID NO: 103481

SEQ ID NO: 317768 - RNA, 62 nt, hsa; identical to SEQ ID NO: 103482

SEQ ID NO: 317769 - RNA, 62 nt, hsa; identical to SEQ ID NO: 103483

SEQ ID NO: 317770 - RNA, 62 nt, hsa; identical to SEQ ID NO: 103484

SEQ ID NO: 317771 - RNA, 62 nt, hsa; identical to SEQ ID NO: 103485

SEQ ID NO: 317772 - RNA, 62 nt, hsa; identical to SEQ ID NO: 103486

SEQ ID NO: 317773 - RNA, 62 nt, hsa; identical to SEQ ID NO: 103487

SEQ ID NO: 317774 - RNA, 62 nt, hsa; identical to SEQ ID NO: 103488

SEQ ID NO: 317775 - RNA, 62 nt, hsa; identical to SEQ ID NO: 103489

SEQ ID NO: 317776 - RNA, 62 nt, hsa; identical to SEQ ID NO: 103490

SEQ ID NO: 317777 - RNA, 62 nt, hsa; identical to SEQ ID NO: 103491

SEQ ID NO: 317778 - RNA, 62 nt, hsa; identical to SEQ ID NO: 103492

SEQ ID NO: 317779 - RNA, 62 nt, hsa; identical to SEQ ID NO: 103493

SEQ ID NO: 317780 - RNA, 62 nt, hsa; identical to SEQ ID NO: 103494

SEQ ID NO: 317781 - RNA, 62 nt, hsa; identical to SEQ ID NO: 103495

SEQ ID NO: 317782 - RNA, 62 nt, hsa; identical to SEQ ID NO: 103496

SEQ ID NO: 317783 - RNA, 62 nt, hsa; identical to SEQ ID NO: 103497

SEQ ID NO: 317784 - RNA, 62 nt, hsa; identical to SEQ ID NO: 103498

SEQ ID NO: 317785 - RNA, 62 nt, hsa; identical to SEQ ID NO: 103499

SEQ ID NO: 317786 - RNA, 62 nt, hsa; identical to SEQ ID NO: 103500

SEQ ID NO: 317787 - RNA, 62 nt, hsa; identical to SEQ ID NO: 103501

SEQ ID NO: 317788 - RNA, 62 nt, hsa; identical to SEQ ID NO: 103502

SEQ ID NO: 317789 - RNA, 62 nt, hsa; identical to SEQ ID NO: 103503

SEQ ID NO: 317790 - RNA, 62 nt, hsa; identical to SEQ ID NO: 103504

SEQ ID NO: 317791 - RNA, 62 nt, hsa; identical to SEQ ID NO: 103505

SEQ ID NO: 317792 - RNA, 62 nt, hsa; identical to SEQ ID NO: 103506

SEQ ID NO: 317793 - RNA, 62 nt, hsa; identical to SEQ ID NO: 103507

SEQ ID NO: 317794 - RNA, 63 nt, hsa; identical to SEQ ID NO: 103508

SEQ ID NO: 317795 - RNA, 63 nt, hsa; identical to SEQ ID NO: 103509

SEQ ID NO: 317796 - RNA, 63 nt, hsa; identical to SEQ ID NO: 103510

SEQ ID NO: 317797 - RNA, 63 nt, hsa; identical to SEQ ID NO: 103511

SEQ ID NO: 317798 - RNA, 63 nt, hsa; identical to SEQ ID NO: 103512

SEQ ID NO: 317799 - RNA, 63 nt, hsa; identical to SEQ ID NO: 103513

SEQ ID NO: 317800 - RNA, 63 nt, hsa; identical to SEQ ID NO: 103514

SEQ ID NO: 317801 - RNA, 63 nt, hsa; identical to SEQ ID NO: 103515

SEQ ID NO: 317802 - RNA, 63 nt, hsa; identical to SEQ ID NO: 103516

SEQ ID NO: 317803 - RNA, 63 nt, hsa; identical to SEQ ID NO: 103517

SEQ ID NO: 317804 - RNA, 63 nt, hsa; identical to SEQ ID NO: 103518

SEQ ID NO: 317805 - RNA, 57 nt, hsa; identical to SEQ ID NO: 103300

SEQ ID NO: 317806 - RNA, 63 nt, hsa; identical to SEQ ID NO: 103520

SEQ ID NO: 317807 - RNA, 63 nt, hsa; identical to SEQ ID NO: 103521

SEQ ID NO: 317808 - RNA, 63 nt, hsa; identical to SEQ ID NO: 103522

SEQ ID NO: 317809 - RNA, 63 nt, hsa; identical to SEQ ID NO: 103523

SEQ ID NO: 317810 - RNA, 63 nt, hsa; identical to SEQ ID NO: 103524

SEQ ID NO: 317811 - RNA, 63 nt, hsa; identical to SEQ ID NO: 103525

SEQ ID NO: 317812 - RNA, 63 nt, hsa; identical to SEQ ID NO: 103526

SEQ ID NO: 317813 - RNA, 63 nt, hsa; identical to SEQ ID NO: 103527

SEQ ID NO: 317814 - RNA, 63 nt, hsa; identical to SEQ ID NO: 103528

SEQ ID NO: 317815 - RNA, 63 nt, hsa; identical to SEQ ID NO: 103529

SEQ ID NO: 317816 - RNA, 63 nt, hsa; identical to SEQ ID NO: 103530

SEQ ID NO: 317817 - RNA, 63 nt, hsa; identical to SEQ ID NO: 103531

SEQ ID NO: 317818 - RNA, 63 nt, hsa; identical to SEQ ID NO: 103532

SEQ ID NO: 317819 - RNA, 63 nt, hsa; identical to SEQ ID NO: 103533

SEQ ID NO: 317820 - RNA, 63 nt, hsa; identical to SEQ ID NO: 103534

SEQ ID NO: 317821 - RNA, 63 nt, hsa; identical to SEQ ID NO: 103535

SEQ ID NO: 317822 - RNA, 63 nt, hsa; identical to SEQ ID NO: 103536

SEQ ID NO: 317823 - RNA, 63 nt, hsa; identical to SEQ ID NO: 103537

SEQ ID NO: 317824 - RNA, 63 nt, hsa; identical to SEQ ID NO: 103538

SEQ ID NO: 317825 - RNA, 63 nt, hsa; identical to SEQ ID NO: 103539

SEQ ID NO: 317826 - RNA, 63 nt, hsa; identical to SEQ ID NO: 103540

SEQ ID NO: 317827 - RNA, 63 nt, hsa; identical to SEQ ID NO: 103541

SEQ ID NO: 317828 - RNA, 63 nt, hsa; identical to SEQ ID NO: 103542

SEQ ID NO: 317829 - RNA, 63 nt, hsa; identical to SEQ ID NO: 103543

SEQ ID NO: 317830 - RNA, 63 nt, hsa; identical to SEQ ID NO: 103544

SEQ ID NO: 317831 - RNA, 63 nt, hsa; identical to SEQ ID NO: 103545

SEQ ID NO: 317832 - RNA, 63 nt, hsa; identical to SEQ ID NO: 103546

SEQ ID NO: 317833 - RNA, 63 nt, hsa; identical to SEQ ID NO: 103547

SEQ ID NO: 317834 - RNA, 63 nt, hsa; identical to SEQ ID NO: 103548

SEQ ID NO: 317835 - RNA, 63 nt, hsa; identical to SEQ ID NO: 103549

SEQ ID NO: 317836 - RNA, 63 nt, hsa; identical to SEQ ID NO: 103550

SEQ ID NO: 317837 - RNA, 63 nt, hsa; identical to SEQ ID NO: 103551

SEQ ID NO: 317838 - RNA, 63 nt, hsa; identical to SEQ ID NO: 103552

SEQ ID NO: 317839 - RNA, 63 nt, hsa; identical to SEQ ID NO: 103553

SEQ ID NO: 317840 - RNA, 63 nt, hsa; identical to SEQ ID NO: 103554

SEQ ID NO: 317841 - RNA, 63 nt, hsa; identical to SEQ ID NO: 103555

SEQ ID NO: 317842 - RNA, 63 nt, hsa; identical to SEQ ID NO: 103556

SEQ ID NO: 317843 - RNA, 63 nt, hsa; identical to SEQ ID NO: 103557

SEQ ID NO: 317844 - RNA, 63 nt, hsa; identical to SEQ ID NO: 103558

SEQ ID NO: 317845 - RNA, 63 nt, hsa; identical to SEQ ID NO: 103559

SEQ ID NO: 317846 - RNA, 63 nt, hsa; identical to SEQ ID NO: 103560

SEQ ID NO: 317847 - RNA, 63 nt, hsa; identical to SEQ ID NO: 103561

SEQ ID NO: 317848 - RNA, 63 nt, hsa; identical to SEQ ID NO: 103562

SEQ ID NO: 317849 - RNA, 63 nt, hsa; identical to SEQ ID NO: 103563

SEQ ID NO: 317850 - RNA, 63 nt, hsa; identical to SEQ ID NO: 103564

SEQ ID NO: 317851 - RNA, 63 nt, hsa; identical to SEQ ID NO: 103565

SEQ ID NO: 317852 - RNA, 63 nt, hsa; identical to SEQ ID NO: 103566

SEQ ID NO: 317853 - RNA, 63 nt, hsa; identical to SEQ ID NO: 103567

SEQ ID NO: 317854 - RNA, 63 nt, hsa; identical to SEQ ID NO: 103568

SEQ ID NO: 317855 - RNA, 63 nt, hsa; identical to SEQ ID NO: 103569

SEQ ID NO: 317856 - RNA, 63 nt, hsa; identical to SEQ ID NO: 103570

SEQ ID NO: 317857 - RNA, 63 nt, hsa; identical to SEQ ID NO: 103571

SEQ ID NO: 317858 - RNA, 63 nt, hsa; identical to SEQ ID NO: 103572

SEQ ID NO: 317859 - RNA, 63 nt, hsa; identical to SEQ ID NO: 103573

SEQ ID NO: 317860 - RNA, 63 nt, hsa; identical to SEQ ID NO: 103574

SEQ ID NO: 317861 - RNA, 63 nt, hsa; identical to SEQ ID NO: 103575

SEQ ID NO: 317862 - RNA, 63 nt, hsa; identical to SEQ ID NO: 103576

SEQ ID NO: 317863 - RNA, 63 nt, hsa; identical to SEQ ID NO: 103577

SEQ ID NO: 317864 - RNA, 63 nt, hsa; identical to SEQ ID NO: 103578

SEQ ID NO: 317865 - RNA, 63 nt, hsa; identical to SEQ ID NO: 103579

SEQ ID NO: 317866 - RNA, 63 nt, hsa; identical to SEQ ID NO: 103580

SEQ ID NO: 317867 - RNA, 63 nt, hsa; identical to SEQ ID NO: 103581

SEQ ID NO: 317868 - RNA, 63 nt, hsa; identical to SEQ ID NO: 103582

SEQ ID NO: 317869 - RNA, 63 nt, hsa; identical to SEQ ID NO: 103583

SEQ ID NO: 317870 - RNA, 63 nt, hsa; identical to SEQ ID NO: 103584

SEQ ID NO: 317871 - RNA, 63 nt, hsa; identical to SEQ ID NO: 103585

SEQ ID NO: 317872 - RNA, 63 nt, hsa; identical to SEQ ID NO: 103586

SEQ ID NO: 317873 - RNA, 63 nt, hsa; identical to SEQ ID NO: 103587

SEQ ID NO: 317874 - RNA, 63 nt, hsa; identical to SEQ ID NO: 103588

SEQ ID NO: 317875 - RNA, 63 nt, hsa; identical to SEQ ID NO: 103589

SEQ ID NO: 317876 - RNA, 63 nt, hsa; identical to SEQ ID NO: 103590

SEQ ID NO: 317877 - RNA, 59 nt, hsa; identical to SEQ ID NO: 103372

SEQ ID NO: 317878 - RNA, 63 nt, hsa; identical to SEQ ID NO: 103592

SEQ ID NO: 317879 - RNA, 63 nt, hsa; identical to SEQ ID NO: 103593

SEQ ID NO: 317880 - RNA, 63 nt, hsa; identical to SEQ ID NO: 103594

SEQ ID NO: 317881 - RNA, 63 nt, hsa; identical to SEQ ID NO: 103595

SEQ ID NO: 317882 - RNA, 63 nt, hsa; identical to SEQ ID NO: 103596

SEQ ID NO: 317883 - RNA, 63 nt, hsa; identical to SEQ ID NO: 103597

SEQ ID NO: 317884 - RNA, 63 nt, hsa; identical to SEQ ID NO: 103598

SEQ ID NO: 317885 - RNA, 63 nt, hsa; identical to SEQ ID NO: 103599

SEQ ID NO: 317886 - RNA, 63 nt, hsa; identical to SEQ ID NO: 103600

SEQ ID NO: 317887 - RNA, 63 nt, hsa; identical to SEQ ID NO: 103601

SEQ ID NO: 317888 - RNA, 63 nt, hsa; identical to SEQ ID NO: 103602

SEQ ID NO: 317889 - RNA, 63 nt, hsa; identical to SEQ ID NO: 103603

SEQ ID NO: 317890 - RNA, 63 nt, hsa; identical to SEQ ID NO: 103604

SEQ ID NO: 317891 - RNA, 63 nt, hsa; identical to SEQ ID NO: 103605

SEQ ID NO: 317892 - RNA, 63 nt, hsa; identical to SEQ ID NO: 103606

SEQ ID NO: 317893 - RNA, 63 nt, hsa; identical to SEQ ID NO: 103607

SEQ ID NO: 317894 - RNA, 63 nt, hsa; identical to SEQ ID NO: 103608

SEQ ID NO: 317895 - RNA, 63 nt, hsa; identical to SEQ ID NO: 103609

SEQ ID NO: 317896 - RNA, 63 nt, hsa; identical to SEQ ID NO: 103610

SEQ ID NO: 317897 - RNA, 63 nt, hsa; identical to SEQ ID NO: 103611

SEQ ID NO: 317898 - RNA, 61 nt, hsa; identical to SEQ ID NO: 103612

SEQ ID NO: 317899 - RNA, 63 nt, hsa; identical to SEQ ID NO: 103613

SEQ ID NO: 317900 - RNA, 63 nt, hsa; identical to SEQ ID NO: 103614

SEQ ID NO: 317901 - RNA, 63 nt, hsa; identical to SEQ ID NO: 103615

SEQ ID NO: 317902 - RNA, 63 nt, hsa; identical to SEQ ID NO: 103616

SEQ ID NO: 317903 - RNA, 63 nt, hsa; identical to SEQ ID NO: 103617

SEQ ID NO: 317904 - RNA, 63 nt, hsa; identical to SEQ ID NO: 103618

SEQ ID NO: 317905 - RNA, 63 nt, hsa; identical to SEQ ID NO: 103619

SEQ ID NO: 317906 - RNA, 63 nt, hsa; identical to SEQ ID NO: 103620

SEQ ID NO: 317907 - RNA, 63 nt, hsa; identical to SEQ ID NO: 103621

SEQ ID NO: 317908 - RNA, 63 nt, hsa; identical to SEQ ID NO: 103622

SEQ ID NO: 317909 - RNA, 63 nt, hsa; identical to SEQ ID NO: 103623

SEQ ID NO: 317910 - RNA, 63 nt, hsa; identical to SEQ ID NO: 103624

SEQ ID NO: 317911 - RNA, 63 nt, hsa; identical to SEQ ID NO: 103625

SEQ ID NO: 317912 - RNA, 63 nt, hsa; identical to SEQ ID NO: 103626

SEQ ID NO: 317913 - RNA, 63 nt, hsa; identical to SEQ ID NO: 103627

SEQ ID NO: 317914 - RNA, 63 nt, hsa; identical to SEQ ID NO: 103628

SEQ ID NO: 317915 - RNA, 63 nt, hsa; identical to SEQ ID NO: 103629

SEQ ID NO: 317916 - RNA, 63 nt, hsa; identical to SEQ ID NO: 103630

SEQ ID NO: 317917 - RNA, 63 nt, hsa; identical to SEQ ID NO: 103631

SEQ ID NO: 317918 - RNA, 63 nt, hsa; identical to SEQ ID NO: 103632

SEQ ID NO: 317919 - RNA, 63 nt, hsa; identical to SEQ ID NO: 103633

SEQ ID NO: 317920 - RNA, 63 nt, hsa; identical to SEQ ID NO: 103634

SEQ ID NO: 317921 - RNA, 63 nt, hsa; identical to SEQ ID NO: 103635

SEQ ID NO: 317922 - RNA, 63 nt, hsa; identical to SEQ ID NO: 103636

SEQ ID NO: 317923 - RNA, 63 nt, hsa; identical to SEQ ID NO: 103637

SEQ ID NO: 317924 - RNA, 63 nt, hsa; identical to SEQ ID NO: 103638

SEQ ID NO: 317925 - RNA, 63 nt, hsa; identical to SEQ ID NO: 103639

SEQ ID NO: 317926 - RNA, 63 nt, hsa; identical to SEQ ID NO: 103640

SEQ ID NO: 317927 - RNA, 63 nt, hsa; identical to SEQ ID NO: 103641

SEQ ID NO: 317928 - RNA, 63 nt, hsa; identical to SEQ ID NO: 103642

SEQ ID NO: 317929 - RNA, 63 nt, hsa; identical to SEQ ID NO: 103643

SEQ ID NO: 317930 - RNA, 63 nt, hsa; identical to SEQ ID NO: 103644

SEQ ID NO: 317931 - RNA, 63 nt, hsa; identical to SEQ ID NO: 103645

SEQ ID NO: 317932 - RNA, 63 nt, hsa; identical to SEQ ID NO: 103646

SEQ ID NO: 317933 - RNA, 63 nt, hsa; identical to SEQ ID NO: 103647

SEQ ID NO: 317934 - RNA, 63 nt, hsa; identical to SEQ ID NO: 103648

SEQ ID NO: 317935 - RNA, 63 nt, hsa; identical to SEQ ID NO: 103649

SEQ ID NO: 317936 - RNA, 63 nt, hsa; identical to SEQ ID NO: 103650

SEQ ID NO: 317937 - RNA, 63 nt, hsa; identical to SEQ ID NO: 103651

SEQ ID NO: 317938 - RNA, 63 nt, hsa; identical to SEQ ID NO: 103652

SEQ ID NO: 317939 - RNA, 63 nt, hsa; identical to SEQ ID NO: 103653

SEQ ID NO: 317940 - RNA, 63 nt, hsa; identical to SEQ ID NO: 103654

SEQ ID NO: 317941 - RNA, 63 nt, hsa; identical to SEQ ID NO: 103655

SEQ ID NO: 317942 - RNA, 63 nt, hsa; identical to SEQ ID NO: 103656

SEQ ID NO: 317943 - RNA, 63 nt, hsa; identical to SEQ ID NO: 103657

SEQ ID NO: 317944 - RNA, 63 nt, hsa; identical to SEQ ID NO: 103658

SEQ ID NO: 317945 - RNA, 63 nt, hsa; identical to SEQ ID NO: 103659

SEQ ID NO: 317946 - RNA, 63 nt, hsa; identical to SEQ ID NO: 103660

SEQ ID NO: 317947 - RNA, 63 nt, hsa; identical to SEQ ID NO: 103661

SEQ ID NO: 317948 - RNA, 63 nt, hsa; identical to SEQ ID NO: 103662

SEQ ID NO: 317949 - RNA, 63 nt, hsa; identical to SEQ ID NO: 103663

SEQ ID NO: 317950 - RNA, 63 nt, hsa; identical to SEQ ID NO: 103664

SEQ ID NO: 317951 - RNA, 63 nt, hsa; identical to SEQ ID NO: 103665

SEQ ID NO: 317952 - RNA, 63 nt, hsa; identical to SEQ ID NO: 103666

SEQ ID NO: 317953 - RNA, 63 nt, hsa; identical to SEQ ID NO: 103667

SEQ ID NO: 317954 - RNA, 63 nt, hsa; identical to SEQ ID NO: 103668

SEQ ID NO: 317955 - RNA, 63 nt, hsa; identical to SEQ ID NO: 103669

SEQ ID NO: 317956 - RNA, 63 nt, hsa; identical to SEQ ID NO: 103670

SEQ ID NO: 317957 - RNA, 63 nt, hsa; identical to SEQ ID NO: 103671

SEQ ID NO: 317958 - RNA, 63 nt, hsa; identical to SEQ ID NO: 103672

SEQ ID NO: 317959 - RNA, 63 nt, hsa; identical to SEQ ID NO: 103673

SEQ ID NO: 317960 - RNA, 63 nt, hsa; identical to SEQ ID NO: 103674

SEQ ID NO: 317961 - RNA, 63 nt, hsa; identical to SEQ ID NO: 103675

SEQ ID NO: 317962 - RNA, 63 nt, hsa; identical to SEQ ID NO: 103676

SEQ ID NO: 317963 - RNA, 63 nt, hsa; identical to SEQ ID NO: 103677

SEQ ID NO: 317964 - RNA, 63 nt, hsa; identical to SEQ ID NO: 103678

SEQ ID NO: 317965 - RNA, 63 nt, hsa; identical to SEQ ID NO: 103679

SEQ ID NO: 317966 - RNA, 63 nt, hsa; identical to SEQ ID NO: 103680

SEQ ID NO: 317967 - RNA, 63 nt, hsa; identical to SEQ ID NO: 103681

SEQ ID NO: 317968 - RNA, 63 nt, hsa; identical to SEQ ID NO: 103682

SEQ ID NO: 317969 - RNA, 63 nt, hsa; identical to SEQ ID NO: 103683

SEQ ID NO: 317970 - RNA, 63 nt, hsa; identical to SEQ ID NO: 103684

SEQ ID NO: 317971 - RNA, 63 nt, hsa; identical to SEQ ID NO: 103685

SEQ ID NO: 317972 - RNA, 63 nt, hsa; identical to SEQ ID NO: 103686

SEQ ID NO: 317973 - RNA, 63 nt, hsa; identical to SEQ ID NO: 103687

SEQ ID NO: 317974 - RNA, 63 nt, hsa; identical to SEQ ID NO: 103688

SEQ ID NO: 317975 - RNA, 63 nt, hsa; identical to SEQ ID NO: 103689

SEQ ID NO: 317976 - RNA, 63 nt, hsa; identical to SEQ ID NO: 103690

SEQ ID NO: 317977 - RNA, 63 nt, hsa; identical to SEQ ID NO: 103691

SEQ ID NO: 317978 - RNA, 63 nt, hsa; identical to SEQ ID NO: 103692

SEQ ID NO: 317979 - RNA, 63 nt, hsa; identical to SEQ ID NO: 103693

SEQ ID NO: 317980 - RNA, 63 nt, hsa; identical to SEQ ID NO: 103694

SEQ ID NO: 317981 - RNA, 63 nt, hsa; identical to SEQ ID NO: 103695

SEQ ID NO: 317982 - RNA, 63 nt, hsa; identical to SEQ ID NO: 103696

SEQ ID NO: 317983 - RNA, 63 nt, hsa; identical to SEQ ID NO: 103697

SEQ ID NO: 317984 - RNA, 63 nt, hsa; identical to SEQ ID NO: 103698

SEQ ID NO: 317985 - RNA, 63 nt, hsa; identical to SEQ ID NO: 103699

SEQ ID NO: 317986 - RNA, 63 nt, hsa; identical to SEQ ID NO: 103700

SEQ ID NO: 317987 - RNA, 63 nt, hsa; identical to SEQ ID NO: 103701

SEQ ID NO: 317988 - RNA, 63 nt, hsa; identical to SEQ ID NO: 103702

SEQ ID NO: 317989 - RNA, 63 nt, hsa; identical to SEQ ID NO: 103703

SEQ ID NO: 317990 - RNA, 63 nt, hsa; identical to SEQ ID NO: 103704

SEQ ID NO: 317991 - RNA, 63 nt, hsa; identical to SEQ ID NO: 103705

SEQ ID NO: 317992 - RNA, 63 nt, hsa; identical to SEQ ID NO: 103706

SEQ ID NO: 317993 - RNA, 63 nt, hsa; identical to SEQ ID NO: 103707

SEQ ID NO: 317994 - RNA, 63 nt, hsa; identical to SEQ ID NO: 103708

SEQ ID NO: 317995 - RNA, 63 nt, hsa; identical to SEQ ID NO: 103709

SEQ ID NO: 317996 - RNA, 63 nt, hsa; identical to SEQ ID NO: 103710

SEQ ID NO: 317997 - RNA, 63 nt, hsa; identical to SEQ ID NO: 103711

SEQ ID NO: 317998 - RNA, 63 nt, hsa; identical to SEQ ID NO: 103712

SEQ ID NO: 317999 - RNA, 63 nt, hsa; identical to SEQ ID NO: 103713

SEQ ID NO: 318000 - RNA, 63 nt, hsa; identical to SEQ ID NO: 103714

SEQ ID NO: 318001 - RNA, 63 nt, hsa; identical to SEQ ID NO: 103715

SEQ ID NO: 318002 - RNA, 63 nt, hsa; identical to SEQ ID NO: 103716

SEQ ID NO: 318003 - RNA, 63 nt, hsa; identical to SEQ ID NO: 103717

SEQ ID NO: 318004 - RNA, 63 nt, hsa; identical to SEQ ID NO: 103718

SEQ ID NO: 318005 - RNA, 63 nt, hsa; identical to SEQ ID NO: 103719

SEQ ID NO: 318006 - RNA, 63 nt, hsa; identical to SEQ ID NO: 103720

SEQ ID NO: 318007 - RNA, 63 nt, hsa; identical to SEQ ID NO: 103721

SEQ ID NO: 318008 - RNA, 63 nt, hsa; identical to SEQ ID NO: 103722

SEQ ID NO: 318009 - RNA, 63 nt, hsa; identical to SEQ ID NO: 103723

SEQ ID NO: 318010 - RNA, 63 nt, hsa; identical to SEQ ID NO: 103724

SEQ ID NO: 318011 - RNA, 63 nt, hsa; identical to SEQ ID NO: 103725

SEQ ID NO: 318012 - RNA, 63 nt, hsa; identical to SEQ ID NO: 103726

SEQ ID NO: 318013 - RNA, 64 nt, hsa
agguggacagcccagacccugaaaggacguguggagacagcagcaguccuguggugcaguuacu

SEQ ID NO: 318014 - RNA, 64 nt, hsa
uaguuaugcuaaaguggagguuucagccuccagaagacagcagagccuucuagggucaccuuaa

SEQ ID NO: 318015 - RNA, 64 nt, hsa
cccgccucccccgcagguuaugucagcagcucugagacagcaguaucacaggccagauguuguu

SEQ ID NO: 318016 - RNA, 64 nt, hsa
agaugagccccacguggagcucgggacggauaguagacagcaauaacucgguguguggccgccu

SEQ ID NO: 318017 - RNA, 64 nt, hsa
agauaaaaaagggaaaacuauagcuuugaguggcagacagcacacaucacaugcaucaacucac

SEQ ID NO: 318018 - RNA, 64 nt, hsa
cagcuuucuccuacagggcuuuuccugaguccccagacagcagaguaugaacugcugacaccca

SEQ ID NO: 318019 - RNA, 64 nt, hsa
ugugaaugaaugaaaguugagucuuucuuaaucuagacagcaaacuuaacaggcuuuccaauua

SEQ ID NO: 318020 - RNA, 64 nt, hsa
uacaaagacaaguacaacuccauuagaaaaauucagacagcaucuucucuauuggccucucagg

SEQ ID NO: 318021 - RNA, 64 nt, hsa
gugaagcugucagcuuaauaacaagaauggccuaagacagcaaagacagcacuguuccugggcu

SEQ ID NO: 318022 - RNA, 64 nt, hsa
ucagcuuaauaacaagaauggccuaagacagcaaagacagcacuguuccugggcugggacgcaa

SEQ ID NO: 318023 - RNA, 64 nt, hsa
gugaaaaaagaaacaugccacuugauuaggagagagacagcaguguuugaacuacagcaucuuu

SEQ ID NO: 318024 - RNA, 64 nt, hsa
uuuggaggucagagucugcuuucguaggcucuuuagacagcaccuaccacuugguucuccagcg

SEQ ID NO: 318025 - RNA, 64 nt, hsa
uaaagaaauucaugcuugcaccgaguacaaggacagacagcaggcacggcccgcagccuggcau

SEQ ID NO: 318026 - RNA, 64 nt, hsa
cuucaagcauccucagaagccucgacugagcuuuagacagcagagcagaugccgcaggcgcggc

SEQ ID NO: 318027 - RNA, 64 nt, hsa
ccuagccaggccccagggagccuccgcugggcccagacagcagcguuugguuuuauccacuuuu

SEQ ID NO: 318028 - RNA, 64 nt, hsa
ugucucaaaaaaaaaaaaaaaaacaauggaaggcagacagcaagucccugaggacacaucacac

SEQ ID NO: 318029 - RNA, 64 nt, hsa; identical to SEQ ID NO: 98595

SEQ ID NO: 318030 - RNA, 64 nt, hsa; identical to SEQ ID NO: 98596

SEQ ID NO: 318031 - RNA, 64 nt, hsa; identical to SEQ ID NO: 98597

SEQ ID NO: 318032 - RNA, 64 nt, hsa; identical to SEQ ID NO: 98598

SEQ ID NO: 318033 - RNA, 64 nt, hsa; identical to SEQ ID NO: 98599

SEQ ID NO: 318034 - RNA, 64 nt, hsa; identical to SEQ ID NO: 98600

SEQ ID NO: 318035 - RNA, 64 nt, hsa; identical to SEQ ID NO: 98601

SEQ ID NO: 318036 - RNA, 64 nt, hsa; identical to SEQ ID NO: 98602

SEQ ID NO: 318037 - RNA, 64 nt, hsa; identical to SEQ ID NO: 98603

SEQ ID NO: 318038 - RNA, 64 nt, hsa; identical to SEQ ID NO: 98604

SEQ ID NO: 318039 - RNA, 64 nt, hsa; identical to SEQ ID NO: 98605

SEQ ID NO: 318040 - RNA, 64 nt, hsa; identical to SEQ ID NO: 98606

SEQ ID NO: 318041 - RNA, 64 nt, hsa; identical to SEQ ID NO: 98607

SEQ ID NO: 318042 - RNA, 64 nt, hsa; identical to SEQ ID NO: 98608

SEQ ID NO: 318043 - RNA, 64 nt, hsa; identical to SEQ ID NO: 98609

SEQ ID NO: 318044 - RNA, 64 nt, hsa; identical to SEQ ID NO: 98610

SEQ ID NO: 318045 - RNA, 64 nt, hsa; identical to SEQ ID NO: 98611

SEQ ID NO: 318046 - RNA, 64 nt, hsa; identical to SEQ ID NO: 98612

SEQ ID NO: 318047 - RNA, 64 nt, hsa; identical to SEQ ID NO: 98613

SEQ ID NO: 318048 - RNA, 64 nt, hsa; identical to SEQ ID NO: 98614

SEQ ID NO: 318049 - RNA, 64 nt, hsa; identical to SEQ ID NO: 98615

SEQ ID NO: 318050 - RNA, 57 nt, hsa; identical to SEQ ID NO: 98616

SEQ ID NO: 318051 - RNA, 64 nt, hsa; identical to SEQ ID NO: 98617

SEQ ID NO: 318052 - RNA, 64 nt, hsa; identical to SEQ ID NO: 98618

SEQ ID NO: 318053 - RNA, 64 nt, hsa; identical to SEQ ID NO: 98619

SEQ ID NO: 318054 - RNA, 64 nt, hsa; identical to SEQ ID NO: 98620

SEQ ID NO: 318055 - RNA, 64 nt, hsa; identical to SEQ ID NO: 98621

SEQ ID NO: 318056 - RNA, 64 nt, hsa; identical to SEQ ID NO: 98622

SEQ ID NO: 318057 - RNA, 64 nt, hsa; identical to SEQ ID NO: 98623

SEQ ID NO: 318058 - RNA, 64 nt, hsa; identical to SEQ ID NO: 98624

SEQ ID NO: 318059 - RNA, 64 nt, hsa; identical to SEQ ID NO: 98625

SEQ ID NO: 318060 - RNA, 64 nt, hsa; identical to SEQ ID NO: 98626

SEQ ID NO: 318061 - RNA, 64 nt, hsa; identical to SEQ ID NO: 98627

SEQ ID NO: 318062 - RNA, 64 nt, hsa; identical to SEQ ID NO: 98628

SEQ ID NO: 318063 - RNA, 64 nt, hsa; identical to SEQ ID NO: 98629

SEQ ID NO: 318064 - RNA, 64 nt, hsa; identical to SEQ ID NO: 98630

SEQ ID NO: 318065 - RNA, 64 nt, hsa; identical to SEQ ID NO: 98631

SEQ ID NO: 318066 - RNA, 64 nt, hsa; identical to SEQ ID NO: 98632

SEQ ID NO: 318067 - RNA, 64 nt, hsa; identical to SEQ ID NO: 98633

SEQ ID NO: 318068 - RNA, 64 nt, hsa; identical to SEQ ID NO: 98634

SEQ ID NO: 318069 - RNA, 64 nt, hsa; identical to SEQ ID NO: 98635

SEQ ID NO: 318070 - RNA, 64 nt, hsa; identical to SEQ ID NO: 98636

SEQ ID NO: 318071 - RNA, 64 nt, hsa; identical to SEQ ID NO: 98637

SEQ ID NO: 318072 - RNA, 64 nt, hsa; identical to SEQ ID NO: 98638

SEQ ID NO: 318073 - RNA, 64 nt, hsa; identical to SEQ ID NO: 98639

SEQ ID NO: 318074 - RNA, 64 nt, hsa; identical to SEQ ID NO: 98640

SEQ ID NO: 318075 - RNA, 64 nt, hsa; identical to SEQ ID NO: 98641

SEQ ID NO: 318076 - RNA, 64 nt, hsa; identical to SEQ ID NO: 98642

SEQ ID NO: 318077 - RNA, 64 nt, hsa; identical to SEQ ID NO: 98643

SEQ ID NO: 318078 - RNA, 64 nt, hsa; identical to SEQ ID NO: 98644

SEQ ID NO: 318079 - RNA, 64 nt, hsa; identical to SEQ ID NO: 98645

SEQ ID NO: 318080 - RNA, 64 nt, hsa; identical to SEQ ID NO: 98646

SEQ ID NO: 318081 - RNA, 64 nt, hsa; identical to SEQ ID NO: 98647

SEQ ID NO: 318082 - RNA, 64 nt, hsa; identical to SEQ ID NO: 98648

SEQ ID NO: 318083 - RNA, 64 nt, hsa; identical to SEQ ID NO: 98649

SEQ ID NO: 318084 - RNA, 64 nt, hsa; identical to SEQ ID NO: 98650

SEQ ID NO: 318085 - RNA, 64 nt, hsa; identical to SEQ ID NO: 98651

SEQ ID NO: 318086 - RNA, 64 nt, hsa; identical to SEQ ID NO: 98652

SEQ ID NO: 318087 - RNA, 64 nt, hsa; identical to SEQ ID NO: 98653

SEQ ID NO: 318088 - RNA, 64 nt, hsa; identical to SEQ ID NO: 98654

SEQ ID NO: 318089 - RNA, 64 nt, hsa; identical to SEQ ID NO: 98655

SEQ ID NO: 318090 - RNA, 64 nt, hsa; identical to SEQ ID NO: 98656

SEQ ID NO: 318091 - RNA, 64 nt, hsa; identical to SEQ ID NO: 98657

SEQ ID NO: 318092 - RNA, 64 nt, hsa; identical to SEQ ID NO: 98658

SEQ ID NO: 318093 - RNA, 64 nt, hsa; identical to SEQ ID NO: 98659

SEQ ID NO: 318094 - RNA, 64 nt, hsa; identical to SEQ ID NO: 98660

SEQ ID NO: 318095 - RNA, 64 nt, hsa; identical to SEQ ID NO: 98661

SEQ ID NO: 318096 - RNA, 64 nt, hsa; identical to SEQ ID NO: 98662

SEQ ID NO: 318097 - RNA, 64 nt, hsa; identical to SEQ ID NO: 98663

SEQ ID NO: 318098 - RNA, 64 nt, hsa; identical to SEQ ID NO: 98664

SEQ ID NO: 318099 - RNA, 64 nt, hsa; identical to SEQ ID NO: 98665

SEQ ID NO: 318100 - RNA, 64 nt, hsa; identical to SEQ ID NO: 98666

SEQ ID NO: 318101 - RNA, 64 nt, hsa; identical to SEQ ID NO: 98667

SEQ ID NO: 318102 - RNA, 64 nt, hsa; identical to SEQ ID NO: 98668

SEQ ID NO: 318103 - RNA, 64 nt, hsa; identical to SEQ ID NO: 98669

SEQ ID NO: 318104 - RNA, 64 nt, hsa; identical to SEQ ID NO: 98670

SEQ ID NO: 318105 - RNA, 64 nt, hsa; identical to SEQ ID NO: 98671

SEQ ID NO: 318106 - RNA, 64 nt, hsa; identical to SEQ ID NO: 312698

SEQ ID NO: 318107 - RNA, 64 nt, hsa; identical to SEQ ID NO: 312699

SEQ ID NO: 318108 - RNA, 64 nt, hsa; identical to SEQ ID NO: 312700

SEQ ID NO: 318109 - RNA, 64 nt, hsa; identical to SEQ ID NO: 312701

SEQ ID NO: 318110 - RNA, 64 nt, hsa; identical to SEQ ID NO: 312702

SEQ ID NO: 318111 - RNA, 64 nt, hsa; identical to SEQ ID NO: 312703

SEQ ID NO: 318112 - RNA, 64 nt, hsa; identical to SEQ ID NO: 312704

SEQ ID NO: 318113 - RNA, 64 nt, hsa; identical to SEQ ID NO: 312705

SEQ ID NO: 318114 - RNA, 64 nt, hsa; identical to SEQ ID NO: 312706

SEQ ID NO: 318115 - RNA, 64 nt, hsa; identical to SEQ ID NO: 312707

SEQ ID NO: 318116 - RNA, 64 nt, hsa; identical to SEQ ID NO: 312708

SEQ ID NO: 318117 - RNA, 64 nt, hsa; identical to SEQ ID NO: 312709

SEQ ID NO: 318118 - RNA, 64 nt, hsa; identical to SEQ ID NO: 312710

SEQ ID NO: 318119 - RNA, 64 nt, hsa; identical to SEQ ID NO: 312711

SEQ ID NO: 318120 - RNA, 64 nt, hsa; identical to SEQ ID NO: 312712

SEQ ID NO: 318121 - RNA, 64 nt, hsa; identical to SEQ ID NO: 312713

SEQ ID NO: 318122 - RNA, 64 nt, hsa; identical to SEQ ID NO: 312714

SEQ ID NO: 318123 - RNA, 64 nt, hsa; identical to SEQ ID NO: 312715

SEQ ID NO: 318124 - RNA, 64 nt, hsa; identical to SEQ ID NO: 312716

SEQ ID NO: 318125 - RNA, 64 nt, hsa; identical to SEQ ID NO: 312717

SEQ ID NO: 318126 - RNA, 64 nt, hsa; identical to SEQ ID NO: 312718

SEQ ID NO: 318127 - RNA, 64 nt, hsa; identical to SEQ ID NO: 312719

SEQ ID NO: 318128 - RNA, 64 nt, hsa; identical to SEQ ID NO: 312720

SEQ ID NO: 318129 - RNA, 64 nt, hsa; identical to SEQ ID NO: 312721

SEQ ID NO: 318130 - RNA, 64 nt, hsa; identical to SEQ ID NO: 312722

SEQ ID NO: 318131 - RNA, 64 nt, hsa; identical to SEQ ID NO: 312723

SEQ ID NO: 318132 - RNA, 64 nt, hsa; identical to SEQ ID NO: 312724

SEQ ID NO: 318133 - RNA, 64 nt, hsa; identical to SEQ ID NO: 312725

SEQ ID NO: 318134 - RNA, 64 nt, hsa; identical to SEQ ID NO: 312726

SEQ ID NO: 318135 - RNA, 64 nt, hsa; identical to SEQ ID NO: 312727

SEQ ID NO: 318136 - RNA, 64 nt, hsa; identical to SEQ ID NO: 312728

SEQ ID NO: 318137 - RNA, 64 nt, hsa; identical to SEQ ID NO: 312729

SEQ ID NO: 318138 - RNA, 64 nt, hsa; identical to SEQ ID NO: 312730

SEQ ID NO: 318139 - RNA, 64 nt, hsa; identical to SEQ ID NO: 312731

SEQ ID NO: 318140 - RNA, 64 nt, hsa; identical to SEQ ID NO: 312732

SEQ ID NO: 318141 - RNA, 64 nt, hsa; identical to SEQ ID NO: 312733

SEQ ID NO: 318142 - RNA, 64 nt, hsa; identical to SEQ ID NO: 312734

SEQ ID NO: 318143 - RNA, 64 nt, hsa; identical to SEQ ID NO: 312735

SEQ ID NO: 318144 - RNA, 64 nt, hsa; identical to SEQ ID NO: 312736

SEQ ID NO: 318145 - RNA, 64 nt, hsa; identical to SEQ ID NO: 312737

SEQ ID NO: 318146 - RNA, 64 nt, hsa; identical to SEQ ID NO: 312738

SEQ ID NO: 318147 - RNA, 64 nt, hsa; identical to SEQ ID NO: 312739

SEQ ID NO: 318148 - RNA, 64 nt, hsa; identical to SEQ ID NO: 312740

SEQ ID NO: 318149 - RNA, 64 nt, hsa; identical to SEQ ID NO: 312741

SEQ ID NO: 318150 - RNA, 64 nt, hsa; identical to SEQ ID NO: 312742

SEQ ID NO: 318151 - RNA, 64 nt, hsa; identical to SEQ ID NO: 312743

SEQ ID NO: 318152 - RNA, 64 nt, hsa; identical to SEQ ID NO: 312744

SEQ ID NO: 318153 - RNA, 64 nt, hsa; identical to SEQ ID NO: 312745

SEQ ID NO: 318154 - RNA, 64 nt, hsa; identical to SEQ ID NO: 312746

SEQ ID NO: 318155 - RNA, 64 nt, hsa; identical to SEQ ID NO: 312747

SEQ ID NO: 318156 - RNA, 64 nt, hsa; identical to SEQ ID NO: 312748

SEQ ID NO: 318157 - RNA, 64 nt, hsa; identical to SEQ ID NO: 312749

SEQ ID NO: 318158 - RNA, 64 nt, hsa; identical to SEQ ID NO: 312750

SEQ ID NO: 318159 - RNA, 64 nt, hsa; identical to SEQ ID NO: 312751

SEQ ID NO: 318160 - RNA, 64 nt, hsa; identical to SEQ ID NO: 312752

SEQ ID NO: 318161 - RNA, 64 nt, hsa; identical to SEQ ID NO: 312753

SEQ ID NO: 318162 - RNA, 64 nt, hsa; identical to SEQ ID NO: 312754

SEQ ID NO: 318163 - RNA, 64 nt, hsa; identical to SEQ ID NO: 312755

SEQ ID NO: 318164 - RNA, 64 nt, hsa; identical to SEQ ID NO: 312756

SEQ ID NO: 318165 - RNA, 64 nt, hsa; identical to SEQ ID NO: 312757

SEQ ID NO: 318166 - RNA, 64 nt, hsa; identical to SEQ ID NO: 312758

SEQ ID NO: 318167 - RNA, 64 nt, hsa; identical to SEQ ID NO: 312759

SEQ ID NO: 318168 - RNA, 64 nt, hsa; identical to SEQ ID NO: 312760

SEQ ID NO: 318169 - RNA, 64 nt, hsa; identical to SEQ ID NO: 312761

SEQ ID NO: 318170 - RNA, 64 nt, hsa; identical to SEQ ID NO: 312762

SEQ ID NO: 318171 - RNA, 64 nt, hsa; identical to SEQ ID NO: 312763

SEQ ID NO: 318172 - RNA, 64 nt, hsa; identical to SEQ ID NO: 312764

SEQ ID NO: 318173 - RNA, 64 nt, hsa; identical to SEQ ID NO: 312765

SEQ ID NO: 318174 - RNA, 64 nt, hsa; identical to SEQ ID NO: 312766

SEQ ID NO: 318175 - RNA, 64 nt, hsa; identical to SEQ ID NO: 312767

SEQ ID NO: 318176 - RNA, 64 nt, hsa; identical to SEQ ID NO: 312768

SEQ ID NO: 318177 - RNA, 64 nt, hsa; identical to SEQ ID NO: 312769

SEQ ID NO: 318178 - RNA, 64 nt, hsa; identical to SEQ ID NO: 312770

SEQ ID NO: 318179 - RNA, 64 nt, hsa; identical to SEQ ID NO: 312771

SEQ ID NO: 318180 - RNA, 64 nt, hsa; identical to SEQ ID NO: 312772

SEQ ID NO: 318181 - RNA, 64 nt, hsa; identical to SEQ ID NO: 312773

SEQ ID NO: 318182 - RNA, 64 nt, hsa; identical to SEQ ID NO: 312774

SEQ ID NO: 318183 - RNA, 64 nt, hsa; identical to SEQ ID NO: 312775

SEQ ID NO: 318184 - RNA, 64 nt, hsa; identical to SEQ ID NO: 312776

SEQ ID NO: 318185 - RNA, 64 nt, hsa; identical to SEQ ID NO: 312777

SEQ ID NO: 318186 - RNA, 64 nt, hsa; identical to SEQ ID NO: 312778

SEQ ID NO: 318187 - RNA, 64 nt, hsa; identical to SEQ ID NO: 312779

SEQ ID NO: 318188 - RNA, 64 nt, hsa; identical to SEQ ID NO: 312780

SEQ ID NO: 318189 - RNA, 64 nt, hsa; identical to SEQ ID NO: 312781

SEQ ID NO: 318190 - RNA, 64 nt, hsa; identical to SEQ ID NO: 312782

SEQ ID NO: 318191 - RNA, 64 nt, hsa; identical to SEQ ID NO: 312783

SEQ ID NO: 318192 - RNA, 64 nt, hsa; identical to SEQ ID NO: 312784

SEQ ID NO: 318193 - RNA, 64 nt, hsa; identical to SEQ ID NO: 312785

SEQ ID NO: 318194 - RNA, 64 nt, hsa; identical to SEQ ID NO: 312786

SEQ ID NO: 318195 - RNA, 64 nt, hsa; identical to SEQ ID NO: 312787

SEQ ID NO: 318196 - RNA, 64 nt, hsa; identical to SEQ ID NO: 312788

SEQ ID NO: 318197 - RNA, 64 nt, hsa; identical to SEQ ID NO: 312789

SEQ ID NO: 318198 - RNA, 64 nt, hsa; identical to SEQ ID NO: 312790

SEQ ID NO: 318199 - RNA, 64 nt, hsa; identical to SEQ ID NO: 312791

SEQ ID NO: 318200 - RNA, 64 nt, hsa; identical to SEQ ID NO: 312792

SEQ ID NO: 318201 - RNA, 64 nt, hsa; identical to SEQ ID NO: 312793

SEQ ID NO: 318202 - RNA, 64 nt, hsa; identical to SEQ ID NO: 312794

SEQ ID NO: 318203 - RNA, 64 nt, hsa; identical to SEQ ID NO: 312795

SEQ ID NO: 318204 - RNA, 64 nt, hsa; identical to SEQ ID NO: 312796

SEQ ID NO: 318205 - RNA, 64 nt, hsa; identical to SEQ ID NO: 312797

SEQ ID NO: 318206 - RNA, 64 nt, hsa; identical to SEQ ID NO: 312798

SEQ ID NO: 318207 - RNA, 64 nt, hsa; identical to SEQ ID NO: 312799

SEQ ID NO: 318208 - RNA, 64 nt, hsa; identical to SEQ ID NO: 312800

SEQ ID NO: 318209 - RNA, 64 nt, hsa; identical to SEQ ID NO: 312801

SEQ ID NO: 318210 - RNA, 64 nt, hsa; identical to SEQ ID NO: 312802

SEQ ID NO: 318211 - RNA, 64 nt, hsa; identical to SEQ ID NO: 312803

SEQ ID NO: 318212 - RNA, 64 nt, hsa; identical to SEQ ID NO: 312804

SEQ ID NO: 318213 - RNA, 64 nt, hsa; identical to SEQ ID NO: 312805

SEQ ID NO: 318214 - RNA, 64 nt, hsa; identical to SEQ ID NO: 312806

SEQ ID NO: 318215 - RNA, 64 nt, hsa; identical to SEQ ID NO: 312807

SEQ ID NO: 318216 - RNA, 64 nt, hsa; identical to SEQ ID NO: 312808

SEQ ID NO: 318217 - RNA, 64 nt, hsa; identical to SEQ ID NO: 312809

SEQ ID NO: 318218 - RNA, 64 nt, hsa; identical to SEQ ID NO: 312810

SEQ ID NO: 318219 - RNA, 64 nt, hsa; identical to SEQ ID NO: 312811

SEQ ID NO: 318220 - RNA, 64 nt, hsa; identical to SEQ ID NO: 312812

SEQ ID NO: 318221 - RNA, 64 nt, hsa; identical to SEQ ID NO: 312813

SEQ ID NO: 318222 - RNA, 64 nt, hsa; identical to SEQ ID NO: 312814

SEQ ID NO: 318223 - RNA, 64 nt, hsa; identical to SEQ ID NO: 312815

SEQ ID NO: 318224 - RNA, 64 nt, hsa; identical to SEQ ID NO: 312816

SEQ ID NO: 318225 - RNA, 64 nt, hsa; identical to SEQ ID NO: 312817

SEQ ID NO: 318226 - RNA, 64 nt, hsa; identical to SEQ ID NO: 312818

SEQ ID NO: 318227 - RNA, 64 nt, hsa; identical to SEQ ID NO: 312819

SEQ ID NO: 318228 - RNA, 64 nt, hsa; identical to SEQ ID NO: 312820

SEQ ID NO: 318229 - RNA, 64 nt, hsa; identical to SEQ ID NO: 312821

SEQ ID NO: 318230 - RNA, 64 nt, hsa; identical to SEQ ID NO: 312822

SEQ ID NO: 318231 - RNA, 64 nt, hsa; identical to SEQ ID NO: 312823

SEQ ID NO: 318232 - RNA, 64 nt, hsa; identical to SEQ ID NO: 312824

SEQ ID NO: 318233 - RNA, 64 nt, hsa; identical to SEQ ID NO: 312825

SEQ ID NO: 318234 - RNA, 64 nt, hsa; identical to SEQ ID NO: 312826

SEQ ID NO: 318235 - RNA, 64 nt, hsa; identical to SEQ ID NO: 312827

SEQ ID NO: 318236 - RNA, 64 nt, hsa; identical to SEQ ID NO: 312828

SEQ ID NO: 318237 - RNA, 64 nt, hsa; identical to SEQ ID NO: 312829

SEQ ID NO: 318238 - RNA, 64 nt, hsa; identical to SEQ ID NO: 312830

SEQ ID NO: 318239 - RNA, 64 nt, hsa; identical to SEQ ID NO: 312831

SEQ ID NO: 318240 - RNA, 64 nt, hsa; identical to SEQ ID NO: 312832

SEQ ID NO: 318241 - RNA, 64 nt, hsa; identical to SEQ ID NO: 312833

SEQ ID NO: 318242 - RNA, 64 nt, hsa; identical to SEQ ID NO: 312834

SEQ ID NO: 318243 - RNA, 64 nt, hsa; identical to SEQ ID NO: 312835

SEQ ID NO: 318244 - RNA, 64 nt, hsa; identical to SEQ ID NO: 312836

SEQ ID NO: 318245 - RNA, 64 nt, hsa; identical to SEQ ID NO: 312837

SEQ ID NO: 318246 - RNA, 64 nt, hsa; identical to SEQ ID NO: 312838

SEQ ID NO: 318247 - RNA, 64 nt, hsa; identical to SEQ ID NO: 312839

SEQ ID NO: 318248 - RNA, 64 nt, hsa; identical to SEQ ID NO: 312840

SEQ ID NO: 318249 - RNA, 64 nt, hsa; identical to SEQ ID NO: 312841

SEQ ID NO: 318250 - RNA, 64 nt, hsa; identical to SEQ ID NO: 312842

SEQ ID NO: 318251 - RNA, 64 nt, hsa; identical to SEQ ID NO: 312843

SEQ ID NO: 318252 - RNA, 64 nt, hsa; identical to SEQ ID NO: 312844

SEQ ID NO: 318253 - RNA, 64 nt, hsa; identical to SEQ ID NO: 312845

SEQ ID NO: 318254 - RNA, 64 nt, hsa; identical to SEQ ID NO: 312846

SEQ ID NO: 318255 - RNA, 64 nt, hsa; identical to SEQ ID NO: 312847

SEQ ID NO: 318256 - RNA, 64 nt, hsa; identical to SEQ ID NO: 312848

SEQ ID NO: 318257 - RNA, 64 nt, hsa; identical to SEQ ID NO: 312849

SEQ ID NO: 318258 - RNA, 64 nt, hsa; identical to SEQ ID NO: 312850

SEQ ID NO: 318259 - RNA, 64 nt, hsa; identical to SEQ ID NO: 312851

SEQ ID NO: 318260 - RNA, 64 nt, hsa; identical to SEQ ID NO: 312852

SEQ ID NO: 318261 - RNA, 64 nt, hsa; identical to SEQ ID NO: 312853

SEQ ID NO: 318262 - RNA, 64 nt, hsa
gcccaccacaucgcagcacuuuuaccacguuuuguccucagaccccgcccaugcuguguggucu

SEQ ID NO: 318263 - RNA, 64 nt, hsa
gagggccuccccugcugguggcccuguccugggauccucagaagccugacuguccuaugggcuu

SEQ ID NO: 318264 - RNA, 60 nt, hsa
cuguuaagaccuccuauugaguuuuccagguccucagaugggaauugcacaguaggaugu

SEQ ID NO: 318265 - RNA, 64 nt, hsa
uaaaauagucgugaaucuuguucaaaaugcagauuccucagauucaauaaugagagcucagacu

SEQ ID NO: 318266 - RNA, 64 nt, hsa
ucagaaggaccauucaagguucacuguuguuuuguccucagaaccaggagcuucagauccuaag

SEQ ID NO: 318267 - RNA, 64 nt, hsa
ucauuagugaauagaugauguuggaagucauggguccucagagugggggcuccuuaagccucca

SEQ ID NO: 318268 - RNA, 64 nt, hsa
ggugaugcggucacccugcaaaagacuugcacuuuccucagaaccaacaugacgcagcucaaua

SEQ ID NO: 318269 - RNA, 64 nt, hsa
cccuaagauuucugguaaaccugaaggguggcccuccucagacaauuuaucucccagcaaugac

SEQ ID NO: 318270 - RNA, 64 nt, hsa
caaaguugaacugggcuaccucucuacagcuguuuccucagagggaaaaaucuugagaccagau

SEQ ID NO: 318271 - RNA, 64 nt, hsa
uagguggugcuuacuaauuaccuucucaggauuuuccucagauugaaaagcuuaugaggauuuc

SEQ ID NO: 318272 - RNA, 64 nt, hsa
cggagcccccgcauaucagcaguucacccaguacuccucagagacugguuucccucuaaaccca

SEQ ID NO: 318273 - RNA, 64 nt, hsa
gaugcgucccagccagccccgucgcucucguccauccucagagacaaagaagagggcagggagu

SEQ ID NO: 318274 - RNA, 64 nt, hsa
gcgcgcugcuuuggugagacacccccaugcaagguccucagaguagccggguucuaccacaaac

SEQ ID NO: 318275 - RNA, 64 nt, hsa
aagagaguguuuugccagggacacagucuguuccuccucagaaaacaccccccaaaugcuaaca

SEQ ID NO: 318276 - RNA, 64 nt, hsa
gccugccaacuuguaacuuaauaaauacaggaaauccucagagaaggugauauuuucaggaaaa

SEQ ID NO: 318277 - RNA, 64 nt, hsa
ucagcgggaccccuucaucuguuggccuuaccuguccucagaaaggaagaggugaccccaccca

SEQ ID NO: 318278 - RNA, 64 nt, hsa
ccuaauaugaucuaaaacccuaaaugguuauuuuuccucagaaugauuuguaaauagcuacugg

SEQ ID NO: 318279 - RNA, 64 nt, hsa
guuucuuguguuugagaaccaugacuuaugacuuuccucagaacaugagacuguaaaacaaaaa

SEQ ID NO: 318280 - RNA, 64 nt, hsa
cucaucacuuuuuuuuaaauaucauuuugggaagggaagacaggguuaaggaacuuuauuuaaa

SEQ ID NO: 318281 - RNA, 64 nt, hsa
ccagagccugccaguggaggcuuaucuguugggaggaagacagcucuucacagaagcaaagaac

SEQ ID NO: 318282 - RNA, 64 nt, hsa
uuuucaaaagcaauucagaaaggaugcacagucaggaagacacacuggaugugauuauuaauau

SEQ ID NO: 318283 - RNA, 64 nt, hsa
guuuaaauuugagaaucaaacauucuauguguuuggaagacaacucugcuugcucauccaagga

SEQ ID NO: 318284 - RNA, 64 nt, hsa
ccaccgcgcccagcccuggagugauacuuuuuauggaagacaaaagccccccaaaucuguguaa

SEQ ID NO: 318285 - RNA, 64 nt, hsa
gacaaguccuuacuauauugcccugucucucaagggaagacaucaagacuggacuugaacuccu

SEQ ID NO: 318286 - RNA, 64 nt, hsa
auaacccugagguuuuguacuuacuuuccccauaggaagacagaccauaggcaaacucuguuuu

SEQ ID NO: 318287 - RNA, 64 nt, hsa
uccauuguugcucucuauacccgaccuaagguuuggaagacaacugcuuguucccagaggauuc

SEQ ID NO: 318288 - RNA, 64 nt, hsa
gcgcucuuuaauuuguuguagauuaggucuugcuggaagacagagaaaacuugccuuucaguau

SEQ ID NO: 318289 - RNA, 64 nt, hsa
auguauuaauguauguaggagcugcaguucuuguggaagacacuugcugagugaaggaaaugaa

SEQ ID NO: 318290 - RNA, 64 nt, hsa
caccgaauauugagcaauaugucagucacuaaaaggaagacaguucuacagaaaaacaauggua

SEQ ID NO: 318291 - RNA, 64 nt, hsa
auacuuaaaaauuuauuagcccugcauuuucauaggaagacacauuaucuucuggacuauagcu

SEQ ID NO: 318292 - RNA, 64 nt, hsa
guggaaauguaaauuaaauuaguucagccauuguggaagacaguguggggauaaagacagagau

SEQ ID NO: 318293 - RNA, 64 nt, hsa
gacuuaauguaaaacccaaaacaguaaaaauccuggaagacaacccaggcaguaccauucagga

SEQ ID NO: 318294 - RNA, 64 nt, hsa
auacuuaguuguuccaggcaccuaaaaucaauuaggaagacauaguucccuucuuuuuugggua

SEQ ID NO: 318295 - RNA, 64 nt, hsa
ugggguuauugagacauuggaugugaaauaccuaggaagacauguauggagaaugcuuaacaaa

SEQ ID NO: 318296 - RNA, 64 nt, hsa
acagcucuuggguuuuuaguccugcuguguguugggaagacaucaggccugaaagcugagggca

SEQ ID NO: 318297 - RNA, 64 nt, hsa
aauugucacuuuccaguuuguuuuucucuauuaaggaagacauuuucuaauugcaucuccaugg

SEQ ID NO: 318298 - RNA, 64 nt, hsa
ugagcccaugagccccaccacuacacuccagccuggaagacaccaugacacacagugaggccug

SEQ ID NO: 318299 - RNA, 64 nt, hsa
uacacaaacuaaugcucguguuucccaagcaccuggaagacaugccagauccaugugcaguaau

SEQ ID NO: 318300 - RNA, 64 nt, hsa
agcuccugaacugguggccagcccacgggguacuggaagacagugguucugauggguucagccc

SEQ ID NO: 318301 - RNA, 64 nt, hsa
auauauaaaauauauaaaugcauaaaaaaauccuggaagacacagcaaaauguuaacagugguc

SEQ ID NO: 318302 - RNA, 64 nt, hsa
uuccuguuugacacaggguaucuaggaggggcggggaagacauggauaguauaggaagacauua

SEQ ID NO: 318303 - RNA, 64 nt, hsa
aucuaggaggggcggggaagacauggauaguauaggaagacauuaauccuagcauugucauuua

SEQ ID NO: 318304 - RNA, 64 nt, hsa
agugagccgagaucgugccuuugcacuccagcguggaagacagugagacuccgucucaaaaaaa

SEQ ID NO: 318305 - RNA, 64 nt, hsa
agugggccgggaucguacuacugcacuccagcauggaagacagcgagacuccgucuccaaaaaa

SEQ ID NO: 318306 - RNA, 64 nt, hsa
gggggaugacagugugggagcugugggguacugaggaagacaccauuccuugacggugucuaag

SEQ ID NO: 318307 - RNA, 64 nt, hsa
uugcagcugaggugggaguggagaaugguucccaggaagacaguuccaccucuaagguccgaaa

SEQ ID NO: 318308 - RNA, 64 nt, hsa
agacuuggagcuucuuggaagacauggauuguccggaagacauggauugucuggaagaugugga

SEQ ID NO: 318309 - RNA, 64 nt, hsa
aagacuugauuuacuggaagacuuggagcuucuuggaagacauggauuguccggaagacaugga

SEQ ID NO: 318310 - RNA, 64 nt, hsa
agaucuguauuugauggaagaccuugaaauuauuggaagacauggauuuccuggaagacgugga

SEQ ID NO: 318311 - RNA, 64 nt, hsa
agacuuggauuugguggaagacacagauuuuucuggaagacauggauuagcuggaagaucugua

SEQ ID NO: 318312 - RNA, 64 nt, hsa
aagaacuagauuuacuggaagacuuggauuugguggaagacacagauuuuucuggaagacaugg

SEQ ID NO: 318313 - RNA, 64 nt, hsa; identical to SEQ ID NO: 247878

SEQ ID NO: 318314 - RNA, 64 nt, hsa; identical to SEQ ID NO: 247879

SEQ ID NO: 318315 - RNA, 64 nt, hsa; identical to SEQ ID NO: 247880

SEQ ID NO: 318316 - RNA, 64 nt, hsa; identical to SEQ ID NO: 247881

SEQ ID NO: 318317 - RNA, 64 nt, hsa
cugcuucaagguuucuuuuguauauaauucuuagaaugcucauuucuuuuaaaugguuuaauuu

SEQ ID NO: 318318 - RNA, 64 nt, hsa
auuaccuaauacugaguuuuugcaaaaaacaaugaaugcucauauguaauugaaauacuucaga

SEQ ID NO: 318319 - RNA, 64 nt, hsa
acauuuuauuuuuucuugcaaauaccuccucccuaaugcucaccuuuaucaccucauucugaac

SEQ ID NO: 318320 - RNA, 64 nt, hsa
cuuggcuuguuauugccucuacuuugauucugauaaugcucacuugguccuaccuauuauccuu

SEQ ID NO: 318321 - RNA, 64 nt, hsa
aucugucuagaauccugcuuuacaggaucauguaaaugcucaaagauguaauguaguucuuugu

SEQ ID NO: 318322 - RNA, 64 nt, hsa
gccaggauuuuguauugccaucgggugccaaauaaaugcucauauuuauuacugaugugugcuc

SEQ ID NO: 318323 - RNA, 64 nt, hsa
cgugauuuucucaaaauauuguaaaacuuuugacaaugcucauuaauauuauuuuuucuauuug

SEQ ID NO: 318324 - RNA, 51 nt, hsa
auaguuauguuuuguuuuaacaaugcucaaccauaaaguugugguccaaug

SEQ ID NO: 318325 - RNA, 64 nt, hsa
gauaaguagaccagucaaggucuacagcuaguaaaaugcucagauugaaaccuaaaucuuuucu

SEQ ID NO: 318326 - RNA, 64 nt, hsa
guaagugaauacuuaauuuaaaaguguuaacauuaaugcucaauaaacaaauucccugcaguug

SEQ ID NO: 318327 - RNA, 64 nt, hsa
caccgagugaggccauagcaacuccccuacaucaaaugcucaagcccugaguugccgccgagaa

SEQ ID NO: 318328 - RNA, 64 nt, hsa
caccaagugaggccauagcaauuccccuacaucaaaugcucaagcccccagcuggaaguuaaga

SEQ ID NO: 318329 - RNA, 64 nt, hsa
auaagcacucuaauuuuuaaaguaaaucucuuauuuuagcaaauauuauauuucaugacaaugg

SEQ ID NO: 318330 - RNA, 64 nt, hsa
auuuuuguuguuuuuguuuuuguuuguuuugcuauuuagcaauaacauggucaaaaaggcaauc

SEQ ID NO: 318331 - RNA, 64 nt, hsa
guagccucuuucaucccauacucaaaauacccaguuuagcaagcaacugagauuuaagucucuc

SEQ ID NO: 318332 - RNA, 64 nt, hsa
gaggaccaugaaacauuguagguauauauggggcuuuagcaaguuugagcauaggcucuuuuug

SEQ ID NO: 318333 - RNA, 64 nt, hsa
ucccuagcaggccauuuucccuuuuuccugggaguuuagcaaguuuaggagagaauagucauga

SEQ ID NO: 318334 - RNA, 64 nt, hsa
ugcauuuugcaaaaaaaaaaaaaaaaaguaaucuuuuagcaaccccaguauuccuucacuauuu

SEQ ID NO: 318335 - RNA, 64 nt, hsa
acccacaaacauucaccaaucauuuauucguucauuuagcaaauaugcagccuccgcaagauga

SEQ ID NO: 318336 - RNA, 64 nt, hsa
guuuugucuggaaucuggggacaugggguuuggcuuuagcaaccugucuuggcccuaaugagaa

SEQ ID NO: 318337 - RNA, 64 nt, hsa
aucuugguaucucuuccucugcuaacuuccuacuuuuagcaaaauucuuucacuuggaacucua

SEQ ID NO: 318338 - RNA, 64 nt, hsa
uuaaaucacaaauggauaagugagaccaaggcaauuuagcaaauucuacuauuucuguauucac

SEQ ID NO: 318339 - RNA, 64 nt, hsa
acuugucauuuggacuuuuuuuuaaauggaguucuuuagcaacaaaguauagaaacauguucau

SEQ ID NO: 318340 - RNA, 64 nt, hsa
uggcauugucaucgacacucaauuucaugugaauuuuagcaaaacaggaaacaaagauaaugac

SEQ ID NO: 318341 - RNA, 64 nt, hsa
uuuacuucauuguuuuguacuacagauacauccuuuuagcaaaagacuggaauuuuauccuuuc

SEQ ID NO: 318342 - RNA, 64 nt, hsa
uguuccauauuaaccacagacuguccucuccaccuuuagcaaacauaugguuuacuucauuguu

SEQ ID NO: 318343 - RNA, 64 nt, hsa
uauuuuuaugcuguagcaaaugugacaggcucuuuuuagcaaaauuuuugaaaauuuuuuuggu

SEQ ID NO: 318344 - RNA, 64 nt, hsa
guagacaucacuacaccgauguaguuucucaaauuuuagcaauaugcucuacauaaaaucacua

SEQ ID NO: 318345 - RNA, 64 nt, hsa
ugaucauauaaaaagggaggguuacugaaagaauuuuagcaauauauugauucaggaaaaggag

SEQ ID NO: 318346 - RNA, 64 nt, hsa
gagucuuuguaucuacuuuuuuauuaaagugaaauuuagcaauaguuaauauuaggugacauaa

SEQ ID NO: 318347 - RNA, 64 nt, hsa
caacuguguuuucauuuuuucaaaugucuggccauuuagcaaaguuauuuacuauuuacugugu

SEQ ID NO: 318348 - RNA, 64 nt, hsa
augaguuugggaaaugcugaacacuucauucuucuuuagcaaguacagucaguacaucaaagac

SEQ ID NO: 318349 - RNA, 64 nt, hsa
uaaaaauuuaaaaauugaagugcaaaaaaaauuuuuuagcaauuuuuguaaaacuguguagcau

SEQ ID NO: 318350 - RNA, 64 nt, hsa
cgaggcuuccagcugcccaguggcucuuaaacaguuuagcaacuaauaaccggagaacuaacau

SEQ ID NO: 318351 - RNA, 64 nt, hsa
uauuaucucuauuuuucagaugaggaaguaaggguuuagcaagguuaagagaucuauccaauuu

SEQ ID NO: 318352 - RNA, 64 nt, hsa
uaagaggaaaacaguauaaguaucucauucaguauuuagcaauucuguaaaauaaguauuaucu

SEQ ID NO: 318353 - RNA, 64 nt, hsa
aaucucuugcuggagugguguaauguaucuaacuuuuagcaaaggaggguugcagagcagcuua

SEQ ID NO: 318354 - RNA, 64 nt, hsa
aauuuuucacagcacaggucuucucauuuucuuuuuuagcaaaaaauacuugacuauauaaaca

SEQ ID NO: 318355 - RNA, 64 nt, hsa
gucuaaauggugcauauaggaaauacugacaguguuuagcaacaugcagcccuuugagauuucu

SEQ ID NO: 318356 - RNA, 64 nt, hsa
cgcuguaagcaggauuucacuaccucucuuaagguuuagcaaacuucuaaauagcccauuuuaa

SEQ ID NO: 318357 - RNA, 64 nt, hsa
ugcauucaaaguggcuuuauaaaagaagauuuucuuuagcaagaauaaugaggucaugucauuu

SEQ ID NO: 318358 - RNA, 64 nt, hsa
gaagaaaucucucccaauacccauuuauccuauuuuuagcaauaauucguuaaugauuccacuu

SEQ ID NO: 318359 - RNA, 64 nt, hsa
uuucagaugcucauaaaaguuacuuagcuaaaauuuuagcaauuuauugcauuuugaaauaauc

SEQ ID NO: 318360 - RNA, 64 nt, hsa
uauuaacuguucaugguguuagaguugcaaacuuuuuagcaagaaaauauggauuuccucauuu

SEQ ID NO: 318361 - RNA, 64 nt, hsa
aaagccauauaaauguagugagugugggaaagcuuuuagcaaaggcucgaaucuuacugcccau

SEQ ID NO: 318362 - RNA, 64 nt, hsa
aaaaguuguaugaagguggugaacaugggagacuuuuagcaaugaugcagauuuuuuuauuaga

SEQ ID NO: 318363 - RNA, 64 nt, hsa
ucauuuauuccuaaguauuucuuacuuuaaguucuuuagcaaaugaaaguguuuuuuuaauuuu

SEQ ID NO: 318364 - RNA, 64 nt, hsa
uguguugaaucuacaucacauucaguuauaaucauuuagcaauauuauuccauucaauauggcu

SEQ ID NO: 318365 - RNA, 64 nt, hsa; identical to SEQ ID NO: 110836

SEQ ID NO: 318366 - RNA, 64 nt, hsa; identical to SEQ ID NO: 110837

SEQ ID NO: 318367 - RNA, 64 nt, hsa; identical to SEQ ID NO: 110838

SEQ ID NO: 318368 - RNA, 64 nt, hsa; identical to SEQ ID NO: 110839

SEQ ID NO: 318369 - RNA, 64 nt, hsa; identical to SEQ ID NO: 110840

SEQ ID NO: 318370 - RNA, 64 nt, hsa; identical to SEQ ID NO: 110841

SEQ ID NO: 318371 - RNA, 64 nt, hsa; identical to SEQ ID NO: 110842

SEQ ID NO: 318372 - RNA, 64 nt, hsa; identical to SEQ ID NO: 110843

SEQ ID NO: 318373 - RNA, 64 nt, hsa; identical to SEQ ID NO: 110844

SEQ ID NO: 318374 - RNA, 64 nt, hsa; identical to SEQ ID NO: 110845

SEQ ID NO: 318375 - RNA, 64 nt, hsa; identical to SEQ ID NO: 110846

SEQ ID NO: 318376 - RNA, 64 nt, hsa; identical to SEQ ID NO: 110847

SEQ ID NO: 318377 - RNA, 64 nt, hsa; identical to SEQ ID NO: 110848

SEQ ID NO: 318378 - RNA, 64 nt, hsa; identical to SEQ ID NO: 110849

SEQ ID NO: 318379 - RNA, 64 nt, hsa; identical to SEQ ID NO: 110850

SEQ ID NO: 318380 - RNA, 64 nt, hsa; identical to SEQ ID NO: 110851

SEQ ID NO: 318381 - RNA, 64 nt, hsa; identical to SEQ ID NO: 110852

SEQ ID NO: 318382 - RNA, 64 nt, hsa; identical to SEQ ID NO: 110853

SEQ ID NO: 318383 - RNA, 64 nt, hsa; identical to SEQ ID NO: 110854

SEQ ID NO: 318384 - RNA, 64 nt, hsa; identical to SEQ ID NO: 110855

SEQ ID NO: 318385 - RNA, 64 nt, hsa; identical to SEQ ID NO: 110856

SEQ ID NO: 318386 - RNA, 64 nt, hsa; identical to SEQ ID NO: 110857

SEQ ID NO: 318387 - RNA, 50 nt, hsa; identical to SEQ ID NO: 110858

SEQ ID NO: 318388 - RNA, 64 nt, hsa; identical to SEQ ID NO: 110859

SEQ ID NO: 318389 - RNA, 64 nt, hsa; identical to SEQ ID NO: 110860

SEQ ID NO: 318390 - RNA, 64 nt, hsa; identical to SEQ ID NO: 110861

SEQ ID NO: 318391 - RNA, 64 nt, hsa; identical to SEQ ID NO: 110862

SEQ ID NO: 318392 - RNA, 64 nt, hsa; identical to SEQ ID NO: 110863

SEQ ID NO: 318393 - RNA, 64 nt, hsa; identical to SEQ ID NO: 110864

SEQ ID NO: 318394 - RNA, 64 nt, hsa; identical to SEQ ID NO: 110865

SEQ ID NO: 318395 - RNA, 64 nt, hsa; identical to SEQ ID NO: 110866

SEQ ID NO: 318396 - RNA, 64 nt, hsa; identical to SEQ ID NO: 110867

SEQ ID NO: 318397 - RNA, 61 nt, hsa; identical to SEQ ID NO: 110868

SEQ ID NO: 318398 - RNA, 64 nt, hsa; identical to SEQ ID NO: 110869

SEQ ID NO: 318399 - RNA, 64 nt, hsa; identical to SEQ ID NO: 110870

SEQ ID NO: 318400 - RNA, 64 nt, hsa; identical to SEQ ID NO: 110871

SEQ ID NO: 318401 - RNA, 64 nt, hsa; identical to SEQ ID NO: 110872

SEQ ID NO: 318402 - RNA, 64 nt, hsa; identical to SEQ ID NO: 110873

SEQ ID NO: 318403 - RNA, 64 nt, hsa; identical to SEQ ID NO: 110874

SEQ ID NO: 318404 - RNA, 64 nt, hsa; identical to SEQ ID NO: 110875

SEQ ID NO: 318405 - RNA, 64 nt, hsa; identical to SEQ ID NO: 110876

SEQ ID NO: 318406 - RNA, 64 nt, hsa; identical to SEQ ID NO: 110877

SEQ ID NO: 318407 - RNA, 64 nt, hsa; identical to SEQ ID NO: 110878

SEQ ID NO: 318408 - RNA, 64 nt, hsa; identical to SEQ ID NO: 110879

SEQ ID NO: 318409 - RNA, 64 nt, hsa; identical to SEQ ID NO: 110880

SEQ ID NO: 318410 - RNA, 64 nt, hsa; identical to SEQ ID NO: 110881

SEQ ID NO: 318411 - RNA, 55 nt, hsa; identical to SEQ ID NO: 110882

SEQ ID NO: 318412 - RNA, 64 nt, hsa; identical to SEQ ID NO: 110883

SEQ ID NO: 318413 - RNA, 64 nt, hsa; identical to SEQ ID NO: 110884

SEQ ID NO: 318414 - RNA, 64 nt, hsa; identical to SEQ ID NO: 110885

SEQ ID NO: 318415 - RNA, 64 nt, hsa; identical to SEQ ID NO: 110886

SEQ ID NO: 318416 - RNA, 64 nt, hsa; identical to SEQ ID NO: 110887

SEQ ID NO: 318417 - RNA, 64 nt, hsa; identical to SEQ ID NO: 110888

SEQ ID NO: 318418 - RNA, 64 nt, hsa; identical to SEQ ID NO: 110889

SEQ ID NO: 318419 - RNA, 64 nt, hsa; identical to SEQ ID NO: 110890

SEQ ID NO: 318420 - RNA, 61 nt, hsa; identical to SEQ ID NO: 110891

SEQ ID NO: 318421 - RNA, 64 nt, hsa; identical to SEQ ID NO: 110892

SEQ ID NO: 318422 - RNA, 64 nt, hsa; identical to SEQ ID NO: 110893

SEQ ID NO: 318423 - RNA, 64 nt, hsa; identical to SEQ ID NO: 110894

SEQ ID NO: 318424 - RNA, 64 nt, hsa; identical to SEQ ID NO: 110895

SEQ ID NO: 318425 - RNA, 64 nt, hsa; identical to SEQ ID NO: 110896

SEQ ID NO: 318426 - RNA, 64 nt, hsa; identical to SEQ ID NO: 110897

SEQ ID NO: 318427 - RNA, 64 nt, hsa; identical to SEQ ID NO: 110898

SEQ ID NO: 318428 - RNA, 64 nt, hsa; identical to SEQ ID NO: 110899

SEQ ID NO: 318429 - RNA, 64 nt, hsa; identical to SEQ ID NO: 110900

SEQ ID NO: 318430 - RNA, 64 nt, hsa; identical to SEQ ID NO: 110901

SEQ ID NO: 318431 - RNA, 64 nt, hsa; identical to SEQ ID NO: 110902

SEQ ID NO: 318432 - RNA, 64 nt, hsa; identical to SEQ ID NO: 110903

SEQ ID NO: 318433 - RNA, 64 nt, hsa; identical to SEQ ID NO: 110904

SEQ ID NO: 318434 - RNA, 64 nt, hsa; identical to SEQ ID NO: 110905

SEQ ID NO: 318435 - RNA, 64 nt, hsa; identical to SEQ ID NO: 110906

SEQ ID NO: 318436 - RNA, 64 nt, hsa; identical to SEQ ID NO: 110907

SEQ ID NO: 318437 - RNA, 64 nt, hsa; identical to SEQ ID NO: 110908

SEQ ID NO: 318438 - RNA, 64 nt, hsa; identical to SEQ ID NO: 110909

SEQ ID NO: 318439 - RNA, 64 nt, hsa; identical to SEQ ID NO: 110910

SEQ ID NO: 318440 - RNA, 64 nt, hsa; identical to SEQ ID NO: 110911

SEQ ID NO: 318441 - RNA, 64 nt, hsa; identical to SEQ ID NO: 110912

SEQ ID NO: 318442 - RNA, 64 nt, hsa; identical to SEQ ID NO: 110913

SEQ ID NO: 318443 - RNA, 64 nt, hsa; identical to SEQ ID NO: 110914

SEQ ID NO: 318444 - RNA, 64 nt, hsa; identical to SEQ ID NO: 110915

SEQ ID NO: 318445 - RNA, 64 nt, hsa; identical to SEQ ID NO: 110916

SEQ ID NO: 318446 - RNA, 62 nt, hsa
guagaagucugucuuucuauagaaauauugugcuuacucaaguguuaaauuauuuuuucuau

SEQ ID NO: 318447 - RNA, 62 nt, hsa
auagaggccaagguauucuauucuaauaacugcuuacucaacacuaccaccuuuuccuuaua

SEQ ID NO: 318448 - RNA, 62 nt, hsa
aaaccucucaacacagaaggaauacaggagaacuuacucaauuugauaaagaacuacuacaa

SEQ ID NO: 318449 - RNA, 62 nt, hsa
gaaaucgauguuaccuugcuaguagaugcagacuuacucagauuuugcuaugguuugcgugc

SEQ ID NO: 318450 - RNA, 62 nt, hsa
guuauuaugccacagacauuaaccuauuccaccuuacucaaggguguacguaaaacauggua

SEQ ID NO: 318451 - RNA, 62 nt, hsa
acugugaaaaagccauuaauacaugcucacaucuuacucaacaucagagaguucauacucaa

SEQ ID NO: 318452 - RNA, 62 nt, hsa
aauguaggaaggccuuuaggcagagggcgcaucuuacucaacaucaaagaauuccuacuggu

SEQ ID NO: 318453 - RNA, 62 nt, hsa
aaugugggaagguuuuuaauaauuauccaacucuuacucaacaucaaagaauucauaccagu

SEQ ID NO: 318454 - RNA, 64 nt, hsa; identical to SEQ ID NO: 270805

SEQ ID NO: 318455 - RNA, 64 nt, hsa; identical to SEQ ID NO: 270806

SEQ ID NO: 318456 - RNA, 64 nt, hsa; identical to SEQ ID NO: 270807

SEQ ID NO: 318457 - RNA, 64 nt, hsa; identical to SEQ ID NO: 270808

SEQ ID NO: 318458 - RNA, 64 nt, hsa; identical to SEQ ID NO: 270809

SEQ ID NO: 318459 - RNA, 64 nt, hsa; identical to SEQ ID NO: 270810

SEQ ID NO: 318460 - RNA, 64 nt, hsa; identical to SEQ ID NO: 270811

SEQ ID NO: 318461 - RNA, 64 nt, hsa; identical to SEQ ID NO: 270812

SEQ ID NO: 318462 - RNA, 64 nt, hsa; identical to SEQ ID NO: 270813

SEQ ID NO: 318463 - RNA, 64 nt, hsa; identical to SEQ ID NO: 270814

SEQ ID NO: 318464 - RNA, 64 nt, hsa; identical to SEQ ID NO: 270815

SEQ ID NO: 318465 - RNA, 64 nt, hsa; identical to SEQ ID NO: 270816

SEQ ID NO: 318466 - RNA, 64 nt, hsa; identical to SEQ ID NO: 234057

SEQ ID NO: 318467 - RNA, 64 nt, hsa; identical to SEQ ID NO: 234058

SEQ ID NO: 318468 - RNA, 64 nt, hsa; identical to SEQ ID NO: 234059

SEQ ID NO: 318469 - RNA, 64 nt, hsa; identical to SEQ ID NO: 234060

SEQ ID NO: 318470 - RNA, 64 nt, hsa; identical to SEQ ID NO: 119680

SEQ ID NO: 318471 - RNA, 64 nt, hsa; identical to SEQ ID NO: 119681

SEQ ID NO: 318472 - RNA, 64 nt, hsa; identical to SEQ ID NO: 119682

SEQ ID NO: 318473 - RNA, 64 nt, hsa; identical to SEQ ID NO: 119683

SEQ ID NO: 318474 - RNA, 64 nt, hsa; identical to SEQ ID NO: 119684

SEQ ID NO: 318475 - RNA, 64 nt, hsa; identical to SEQ ID NO: 119685

SEQ ID NO: 318476 - RNA, 64 nt, hsa; identical to SEQ ID NO: 119686

SEQ ID NO: 318477 - RNA, 64 nt, hsa; identical to SEQ ID NO: 119687

SEQ ID NO: 318478 - RNA, 64 nt, hsa; identical to SEQ ID NO: 119688

SEQ ID NO: 318479 - RNA, 64 nt, hsa; identical to SEQ ID NO: 119689

SEQ ID NO: 318480 - RNA, 64 nt, hsa; identical to SEQ ID NO: 119690

SEQ ID NO: 318481 - RNA, 64 nt, hsa; identical to SEQ ID NO: 119691

SEQ ID NO: 318482 - RNA, 64 nt, hsa; identical to SEQ ID NO: 119692

SEQ ID NO: 318483 - RNA, 64 nt, hsa; identical to SEQ ID NO: 119693

SEQ ID NO: 318484 - RNA, 64 nt, hsa; identical to SEQ ID NO: 119694

SEQ ID NO: 318485 - RNA, 64 nt, hsa; identical to SEQ ID NO: 119695

SEQ ID NO: 318486 - RNA, 64 nt, hsa; identical to SEQ ID NO: 119696

SEQ ID NO: 318487 - RNA, 64 nt, hsa; identical to SEQ ID NO: 119697

SEQ ID NO: 318488 - RNA, 64 nt, hsa; identical to SEQ ID NO: 119698

SEQ ID NO: 318489 - RNA, 64 nt, hsa; identical to SEQ ID NO: 119699

SEQ ID NO: 318490 - RNA, 64 nt, hsa; identical to SEQ ID NO: 119700

SEQ ID NO: 318491 - RNA, 64 nt, hsa; identical to SEQ ID NO: 119701

SEQ ID NO: 318492 - RNA, 64 nt, hsa; identical to SEQ ID NO: 119702

SEQ ID NO: 318493 - RNA, 64 nt, hsa; identical to SEQ ID NO: 119703

SEQ ID NO: 318494 - RNA, 64 nt, hsa; identical to SEQ ID NO: 119704

SEQ ID NO: 318495 - RNA, 64 nt, hsa; identical to SEQ ID NO: 119705

SEQ ID NO: 318496 - RNA, 64 nt, hsa; identical to SEQ ID NO: 119706

SEQ ID NO: 318497 - RNA, 64 nt, hsa; identical to SEQ ID NO: 119707

SEQ ID NO: 318498 - RNA, 64 nt, hsa; identical to SEQ ID NO: 119708

SEQ ID NO: 318499 - RNA, 64 nt, hsa; identical to SEQ ID NO: 119709

SEQ ID NO: 318500 - RNA, 64 nt, hsa; identical to SEQ ID NO: 119710

SEQ ID NO: 318501 - RNA, 64 nt, hsa; identical to SEQ ID NO: 119711

SEQ ID NO: 318502 - RNA, 64 nt, hsa; identical to SEQ ID NO: 119712

SEQ ID NO: 318503 - RNA, 64 nt, hsa; identical to SEQ ID NO: 119713

SEQ ID NO: 318504 - RNA, 64 nt, hsa; identical to SEQ ID NO: 119714

SEQ ID NO: 318505 - RNA, 64 nt, hsa; identical to SEQ ID NO: 119715

SEQ ID NO: 318506 - RNA, 64 nt, hsa; identical to SEQ ID NO: 119716

SEQ ID NO: 318507 - RNA, 64 nt, hsa
agcagccaacccugaucuggaagacagggccccggcuggacacacguggaaccaagccagggau

SEQ ID NO: 318508 - RNA, 64 nt, hsa
cauccaagagacuuugcagaggcguaggaaugaggcuggacagauggcggaagcagagguuccc

SEQ ID NO: 318509 - RNA, 64 nt, hsa
ccuacguuugugccucugcuuuuaaaggugcugugcuggacaguuggcaugccaggguucgaga

SEQ ID NO: 318510 - RNA, 64 nt, hsa
ggagaugcuggugucuggguagucauggauuucugcuggacauuugaaugugauaaacaaucca

SEQ ID NO: 318511 - RNA, 64 nt, hsa
gccuggagccaagggaugagguuguccaggcugugcuggacagcaccaccuucuucccugaaga

SEQ ID NO: 318512 - RNA, 64 nt, hsa
ugcaggagcuggagccggucaucucccgcgcggugcuggacaacccgcaccgugagucuggcuc

SEQ ID NO: 318513 - RNA, 64 nt, hsa
cggggcugcaccagggacccaugggggcugcccagcuggacagauggcuuccugcuccccaggc

SEQ ID NO: 318514 - RNA, 64 nt, hsa
auggggugcagaccccccucauggaguauggggcgcuggacacauggccggggcugcaccaggg

SEQ ID NO: 318515 - RNA, 64 nt, hsa
ccgccucugcccgggagaaagcccaggccagccugcuggacaagcagagaccaugagaaggaga

SEQ ID NO: 318516 - RNA, 64 nt, hsa
ggaggcugugaaugcugagaccagaguuuaucaugcuggacaagccuggaaggaggcaauaagu

SEQ ID NO: 318517 - RNA, 64 nt, hsa
ggcuggagggugagaucaacacguacuggggccugcuggacagcgaggacagcaggcaaguucc

SEQ ID NO: 318518 - RNA, 64 nt, hsa
uucgugaacagcuuggcgaccgccucaguguggagcuggacacugcccccacccuugaccucaa

SEQ ID NO: 318519 - RNA, 64 nt, hsa
cauugacccaugccuacuccaugccaggcccagugcuggacacagagacaugaagcucugucug

SEQ ID NO: 318520 - RNA, 64 nt, hsa
gucaagugucaugagcaggagaaaaggcaugggagcuggacagauuauagugguugaagucugu

SEQ ID NO: 318521 - RNA, 64 nt, hsa
guugacaggucagaagaucaggaaagaggucggggcuggacagauggggagagcgcagauagau

SEQ ID NO: 318522 - RNA, 64 nt, hsa
agcugaggccgaugcuaaggagauagugucucgagcuggacagugaggcaaggccaggagugcc

SEQ ID NO: 318523 - RNA, 57 nt, hsa
ccugguggaccagcaacuagcccuggggcuggacaguggacccuaccagccugcggg

SEQ ID NO: 318524 - RNA, 64 nt, hsa
cgggggugagauucaaguaggacaauaacaagaggcuggacacccuacagaugucuuugauguu

SEQ ID NO: 318525 - RNA, 64 nt, hsa
caucuguagcuacauaaccuauauaccuccagcagcuggacauggggaggcgacaguccuaucu

SEQ ID NO: 318526 - RNA, 64 nt, hsa; identical to SEQ ID NO: 82791

SEQ ID NO: 318527 - RNA, 64 nt, hsa; identical to SEQ ID NO: 82792

SEQ ID NO: 318528 - RNA, 64 nt, hsa; identical to SEQ ID NO: 82793

SEQ ID NO: 318529 - RNA, 64 nt, hsa; identical to SEQ ID NO: 82794

SEQ ID NO: 318530 - RNA, 64 nt, hsa; identical to SEQ ID NO: 82795

SEQ ID NO: 318531 - RNA, 64 nt, hsa; identical to SEQ ID NO: 82796

SEQ ID NO: 318532 - RNA, 64 nt, hsa; identical to SEQ ID NO: 82797

SEQ ID NO: 318533 - RNA, 64 nt, hsa; identical to SEQ ID NO: 82798

SEQ ID NO: 318534 - RNA, 64 nt, hsa; identical to SEQ ID NO: 82799

SEQ ID NO: 318535 - RNA, 64 nt, hsa; identical to SEQ ID NO: 82800

SEQ ID NO: 318536 - RNA, 64 nt, hsa; identical to SEQ ID NO: 82801

SEQ ID NO: 318537 - RNA, 64 nt, hsa; identical to SEQ ID NO: 82802

SEQ ID NO: 318538 - RNA, 64 nt, hsa; identical to SEQ ID NO: 82803

SEQ ID NO: 318539 - RNA, 64 nt, hsa; identical to SEQ ID NO: 82804

SEQ ID NO: 318540 - RNA, 64 nt, hsa; identical to SEQ ID NO: 82805

SEQ ID NO: 318541 - RNA, 64 nt, hsa; identical to SEQ ID NO: 82806

SEQ ID NO: 318542 - RNA, 64 nt, hsa; identical to SEQ ID NO: 82807

SEQ ID NO: 318543 - RNA, 64 nt, hsa; identical to SEQ ID NO: 82808

SEQ ID NO: 318544 - RNA, 64 nt, hsa; identical to SEQ ID NO: 82809

SEQ ID NO: 318545 - RNA, 64 nt, hsa; identical to SEQ ID NO: 82810

SEQ ID NO: 318546 - RNA, 61 nt, hsa; identical to SEQ ID NO: 82811

SEQ ID NO: 318547 - RNA, 64 nt, hsa; identical to SEQ ID NO: 82812

SEQ ID NO: 318548 - RNA, 64 nt, hsa; identical to SEQ ID NO: 82813

SEQ ID NO: 318549 - RNA, 64 nt, hsa; identical to SEQ ID NO: 82814

SEQ ID NO: 318550 - RNA, 64 nt, hsa; identical to SEQ ID NO: 82815

SEQ ID NO: 318551 - RNA, 64 nt, hsa; identical to SEQ ID NO: 82816

SEQ ID NO: 318552 - RNA, 64 nt, hsa; identical to SEQ ID NO: 82817

SEQ ID NO: 318553 - RNA, 64 nt, hsa; identical to SEQ ID NO: 82818

SEQ ID NO: 318554 - RNA, 64 nt, hsa; identical to SEQ ID NO: 82819

SEQ ID NO: 318555 - RNA, 64 nt, hsa; identical to SEQ ID NO: 82820

SEQ ID NO: 318556 - RNA, 64 nt, hsa; identical to SEQ ID NO: 82821

SEQ ID NO: 318557 - RNA, 64 nt, hsa; identical to SEQ ID NO: 82822

SEQ ID NO: 318558 - RNA, 64 nt, hsa; identical to SEQ ID NO: 82823

SEQ ID NO: 318559 - RNA, 64 nt, hsa; identical to SEQ ID NO: 82824

SEQ ID NO: 318560 - RNA, 64 nt, hsa; identical to SEQ ID NO: 82825

SEQ ID NO: 318561 - RNA, 64 nt, hsa; identical to SEQ ID NO: 82826

SEQ ID NO: 318562 - RNA, 64 nt, hsa; identical to SEQ ID NO: 82827

SEQ ID NO: 318563 - RNA, 64 nt, hsa; identical to SEQ ID NO: 82828

SEQ ID NO: 318564 - RNA, 64 nt, hsa; identical to SEQ ID NO: 82829

SEQ ID NO: 318565 - RNA, 64 nt, hsa; identical to SEQ ID NO: 82830

SEQ ID NO: 318566 - RNA, 64 nt, hsa; identical to SEQ ID NO: 82831

SEQ ID NO: 318567 - RNA, 64 nt, hsa; identical to SEQ ID NO: 82832

SEQ ID NO: 318568 - RNA, 64 nt, hsa; identical to SEQ ID NO: 82833

SEQ ID NO: 318569 - RNA, 64 nt, hsa; identical to SEQ ID NO: 82834

SEQ ID NO: 318570 - RNA, 64 nt, hsa; identical to SEQ ID NO: 82835

SEQ ID NO: 318571 - RNA, 64 nt, hsa; identical to SEQ ID NO: 82836

SEQ ID NO: 318572 - RNA, 64 nt, hsa; identical to SEQ ID NO: 82837

SEQ ID NO: 318573 - RNA, 64 nt, hsa; identical to SEQ ID NO: 82838

SEQ ID NO: 318574 - RNA, 64 nt, hsa; identical to SEQ ID NO: 82839

SEQ ID NO: 318575 - RNA, 64 nt, hsa; identical to SEQ ID NO: 82840

SEQ ID NO: 318576 - RNA, 64 nt, hsa
gcuuccucaccuugagaguaaagugcugcccucugcccccaacacacacacauaucaauuccug

SEQ ID NO: 318577 - RNA, 64 nt, hsa
uccugcuggccuugggcuggagccuaggaaaguggcccccaaauccuuagugagcuaaagcugg

SEQ ID NO: 318578 - RNA, 64 nt, hsa
aaaagagcccuggagcaucagguuccccagauaggcccccaaauaaagaccugucuauggcucu

SEQ ID NO: 318579 - RNA, 64 nt, hsa
gaggagaucagaaaaucccucugacaucuccacugcccccaaagaccuccguugaacauucugu

SEQ ID NO: 318580 - RNA, 64 nt, hsa
uuucaguggaacccuugcccccaaaugucgaccagcccccaaaugucgaagaauuuucuucuug

SEQ ID NO: 318581 - RNA, 64 nt, hsa
gcgugaauuugggggauuuuucaguggaacccuugcccccaaaugucgaccagcccccaaaugu

SEQ ID NO: 318582 - RNA, 64 nt, hsa
cccccaacuccccgggcccggccccugcccugcugcccccaacagcgucuggcuccccuacuaa

SEQ ID NO: 318583 - RNA, 64 nt, hsa
ccuccccugcagcgacucggacccgcuacugccugcccccaacuccccgggcccggccccugcc

SEQ ID NO: 318584 - RNA, 64 nt, hsa
caguguccccugccccccucuucccccaccccaugcccccaauucuguggcgcauccagauugu

SEQ ID NO: 318585 - RNA, 64 nt, hsa
gaggguacagucccuuaaccugccacgggagggggcccccaaacuuucuuccccccacacuucu

SEQ ID NO: 318586 - RNA, 64 nt, hsa
gccccuccgcagccccuucccuugcucggggaaagcccccaauucugcccacacccauuuauuu

SEQ ID NO: 318587 - RNA, 64 nt, hsa
cuuuucuuuccuuccuuccuucuuuuuuguuuuugcccccaauucugcccauacccauuucuuu

SEQ ID NO: 318588 - RNA, 64 nt, hsa
cccaaccccuccucccucagacucagagguccaggcccccaaccccuccuuccccagacccaga

SEQ ID NO: 318589 - RNA, 64 nt, hsa
cccagccccuccucccucagacccagggguccaggcccccaaccccuccucccucagacucaga

SEQ ID NO: 318590 - RNA, 64 nt, hsa
acaaguuccagcuggucuuuugggaguggccccugcccccaaagguggucugcuuuugcugggg

SEQ ID NO: 318591 - RNA, 64 nt, hsa
gucauccaugcgugcacauaugggugcuggcagagcccccaaggacucuggccucucgaguucu

SEQ ID NO: 318592 - RNA, 64 nt, hsa
aacaacgagcagaaggcccuggcgacugggcugagcccccaagugaaacugagguucaggagac

SEQ ID NO: 318593 - RNA, 64 nt, hsa
ugggcuucagguaccuaaaacagauccaggaccugcccccaacuggccucccugagaugaaccu

SEQ ID NO: 318594 - RNA, 64 nt, hsa
cccugccccuggcaagcccugaagucgggagaggugaccacaggucugaaaaucagccagugcc

SEQ ID NO: 318595 - RNA, 64 nt, hsa
caacugagcccacauagcgcauucauaguuucccugaccacagccuugggaagacgguggaaac

SEQ ID NO: 318596 - RNA, 64 nt, hsa
accacauccacucucaaccccguccccuucgcacugaccacacccaccccguucggccccgccc

SEQ ID NO: 318597 - RNA, 64 nt, hsa
acccucaacccauugcgcccaguccccaccacagugaccacacccucacuggcucggcccugcc

SEQ ID NO: 318598 - RNA, 64 nt, hsa
cuuucuuaguaauuuggcuucaaagacaaauuuuugaccacaccuccguuuucuccgucagacu

SEQ ID NO: 318599 - RNA, 64 nt, hsa
ccccuuccccauuaaugugaguaaugaauuagccugaccacagguggucacuguaggcuaaugg

SEQ ID NO: 318600 - RNA, 64 nt, hsa; identical to SEQ ID NO: 228081

SEQ ID NO: 318601 - RNA, 64 nt, hsa; identical to SEQ ID NO: 228082

SEQ ID NO: 318602 - RNA, 64 nt, hsa; identical to SEQ ID NO: 228083

SEQ ID NO: 318603 - RNA, 64 nt, hsa; identical to SEQ ID NO: 228084

SEQ ID NO: 318604 - RNA, 64 nt, hsa; identical to SEQ ID NO: 228085

SEQ ID NO: 318605 - RNA, 64 nt, hsa; identical to SEQ ID NO: 228086

SEQ ID NO: 318606 - RNA, 64 nt, hsa; identical to SEQ ID NO: 228087

SEQ ID NO: 318607 - RNA, 64 nt, hsa; identical to SEQ ID NO: 228088

SEQ ID NO: 318608 - RNA, 64 nt, hsa; identical to SEQ ID NO: 228089

SEQ ID NO: 318609 - RNA, 64 nt, hsa; identical to SEQ ID NO: 228090

SEQ ID NO: 318610 - RNA, 64 nt, hsa; identical to SEQ ID NO: 228091

SEQ ID NO: 318611 - RNA, 64 nt, hsa; identical to SEQ ID NO: 228092

SEQ ID NO: 318612 - RNA, 64 nt, hsa; identical to SEQ ID NO: 228093

SEQ ID NO: 318613 - RNA, 64 nt, hsa; identical to SEQ ID NO: 228094

SEQ ID NO: 318614 - RNA, 64 nt, hsa; identical to SEQ ID NO: 228095

SEQ ID NO: 318615 - RNA, 64 nt, hsa; identical to SEQ ID NO: 228096

SEQ ID NO: 318616 - RNA, 64 nt, hsa; identical to SEQ ID NO: 228097

SEQ ID NO: 318617 - RNA, 64 nt, hsa; identical to SEQ ID NO: 228098

SEQ ID NO: 318618 - RNA, 64 nt, hsa; identical to SEQ ID NO: 228099

SEQ ID NO: 318619 - RNA, 64 nt, hsa; identical to SEQ ID NO: 228100

SEQ ID NO: 318620 - RNA, 64 nt, hsa; identical to SEQ ID NO: 228101

SEQ ID NO: 318621 - RNA, 64 nt, hsa; identical to SEQ ID NO: 228102

SEQ ID NO: 318622 - RNA, 64 nt, hsa; identical to SEQ ID NO: 228103

SEQ ID NO: 318623 - RNA, 64 nt, hsa; identical to SEQ ID NO: 228104

SEQ ID NO: 318624 - RNA, 64 nt, hsa; identical to SEQ ID NO: 228105

SEQ ID NO: 318625 - RNA, 64 nt, hsa; identical to SEQ ID NO: 228106

SEQ ID NO: 318626 - RNA, 64 nt, hsa; identical to SEQ ID NO: 228107

SEQ ID NO: 318627 - RNA, 64 nt, hsa; identical to SEQ ID NO: 228108

SEQ ID NO: 318628 - RNA, 64 nt, hsa; identical to SEQ ID NO: 228109

SEQ ID NO: 318629 - RNA, 64 nt, hsa; identical to SEQ ID NO: 228110

SEQ ID NO: 318630 - RNA, 64 nt, hsa; identical to SEQ ID NO: 228111

SEQ ID NO: 318631 - RNA, 64 nt, hsa; identical to SEQ ID NO: 228112

SEQ ID NO: 318632 - RNA, 64 nt, hsa; identical to SEQ ID NO: 228113

SEQ ID NO: 318633 - RNA, 64 nt, hsa; identical to SEQ ID NO: 228114

SEQ ID NO: 318634 - RNA, 64 nt, hsa; identical to SEQ ID NO: 228115

SEQ ID NO: 318635 - RNA, 64 nt, hsa; identical to SEQ ID NO: 228116

SEQ ID NO: 318636 - RNA, 64 nt, hsa; identical to SEQ ID NO: 228117

SEQ ID NO: 318637 - RNA, 64 nt, hsa; identical to SEQ ID NO: 228118

SEQ ID NO: 318638 - RNA, 64 nt, hsa; identical to SEQ ID NO: 228119

SEQ ID NO: 318639 - RNA, 64 nt, hsa; identical to SEQ ID NO: 228120

SEQ ID NO: 318640 - RNA, 64 nt, hsa; identical to SEQ ID NO: 228121

SEQ ID NO: 318641 - RNA, 64 nt, hsa; identical to SEQ ID NO: 228122

SEQ ID NO: 318642 - RNA, 64 nt, hsa; identical to SEQ ID NO: 228123

SEQ ID NO: 318643 - RNA, 64 nt, hsa; identical to SEQ ID NO: 228124

SEQ ID NO: 318644 - RNA, 64 nt, hsa; identical to SEQ ID NO: 228125

SEQ ID NO: 318645 - RNA, 64 nt, hsa; identical to SEQ ID NO: 228126

SEQ ID NO: 318646 - RNA, 64 nt, hsa; identical to SEQ ID NO: 228127

SEQ ID NO: 318647 - RNA, 64 nt, hsa; identical to SEQ ID NO: 228128

SEQ ID NO: 318648 - RNA, 64 nt, hsa; identical to SEQ ID NO: 228129

SEQ ID NO: 318649 - RNA, 64 nt, hsa; identical to SEQ ID NO: 228130

SEQ ID NO: 318650 - RNA, 64 nt, hsa; identical to SEQ ID NO: 228131

SEQ ID NO: 318651 - RNA, 64 nt, hsa; identical to SEQ ID NO: 228132

SEQ ID NO: 318652 - RNA, 64 nt, hsa; identical to SEQ ID NO: 228133

SEQ ID NO: 318653 - RNA, 64 nt, hsa; identical to SEQ ID NO: 228134

SEQ ID NO: 318654 - RNA, 64 nt, hsa; identical to SEQ ID NO: 228135

SEQ ID NO: 318655 - RNA, 64 nt, hsa; identical to SEQ ID NO: 228136

SEQ ID NO: 318656 - RNA, 64 nt, hsa; identical to SEQ ID NO: 228137

SEQ ID NO: 318657 - RNA, 64 nt, hsa; identical to SEQ ID NO: 228138

SEQ ID NO: 318658 - RNA, 64 nt, hsa; identical to SEQ ID NO: 228139

SEQ ID NO: 318659 - RNA, 64 nt, hsa; identical to SEQ ID NO: 228140

SEQ ID NO: 318660 - RNA, 64 nt, hsa; identical to SEQ ID NO: 228141

SEQ ID NO: 318661 - RNA, 64 nt, hsa; identical to SEQ ID NO: 228142

SEQ ID NO: 318662 - RNA, 64 nt, hsa; identical to SEQ ID NO: 228143

SEQ ID NO: 318663 - RNA, 64 nt, hsa; identical to SEQ ID NO: 228144

SEQ ID NO: 318664 - RNA, 64 nt, hsa; identical to SEQ ID NO: 228145

SEQ ID NO: 318665 - RNA, 64 nt, hsa; identical to SEQ ID NO: 228146

SEQ ID NO: 318666 - RNA, 64 nt, hsa; identical to SEQ ID NO: 228147

SEQ ID NO: 318667 - RNA, 64 nt, hsa; identical to SEQ ID NO: 228148

SEQ ID NO: 318668 - RNA, 64 nt, hsa; identical to SEQ ID NO: 228149

SEQ ID NO: 318669 - RNA, 64 nt, hsa; identical to SEQ ID NO: 228150

SEQ ID NO: 318670 - RNA, 64 nt, hsa; identical to SEQ ID NO: 228151

SEQ ID NO: 318671 - RNA, 64 nt, hsa; identical to SEQ ID NO: 228152

SEQ ID NO: 318672 - RNA, 64 nt, hsa; identical to SEQ ID NO: 228153

SEQ ID NO: 318673 - RNA, 64 nt, hsa; identical to SEQ ID NO: 228154

SEQ ID NO: 318674 - RNA, 64 nt, hsa; identical to SEQ ID NO: 228155

SEQ ID NO: 318675 - RNA, 64 nt, hsa; identical to SEQ ID NO: 228156

SEQ ID NO: 318676 - RNA, 64 nt, hsa; identical to SEQ ID NO: 228157

SEQ ID NO: 318677 - RNA, 64 nt, hsa; identical to SEQ ID NO: 228158

SEQ ID NO: 318678 - RNA, 64 nt, hsa; identical to SEQ ID NO: 228159

SEQ ID NO: 318679 - RNA, 64 nt, hsa; identical to SEQ ID NO: 228160

SEQ ID NO: 318680 - RNA, 64 nt, hsa; identical to SEQ ID NO: 228161

SEQ ID NO: 318681 - RNA, 64 nt, hsa; identical to SEQ ID NO: 228162

SEQ ID NO: 318682 - RNA, 64 nt, hsa; identical to SEQ ID NO: 228163

SEQ ID NO: 318683 - RNA, 64 nt, hsa; identical to SEQ ID NO: 228164

SEQ ID NO: 318684 - RNA, 64 nt, hsa; identical to SEQ ID NO: 228165

SEQ ID NO: 318685 - RNA, 64 nt, hsa; identical to SEQ ID NO: 228166

SEQ ID NO: 318686 - RNA, 64 nt, hsa; identical to SEQ ID NO: 228167

SEQ ID NO: 318687 - RNA, 64 nt, hsa; identical to SEQ ID NO: 228168

SEQ ID NO: 318688 - RNA, 52 nt, hsa; identical to SEQ ID NO: 228169

SEQ ID NO: 318689 - RNA, 64 nt, hsa; identical to SEQ ID NO: 228170

SEQ ID NO: 318690 - RNA, 64 nt, hsa; identical to SEQ ID NO: 228171

SEQ ID NO: 318691 - RNA, 64 nt, hsa; identical to SEQ ID NO: 228172

SEQ ID NO: 318692 - RNA, 64 nt, hsa; identical to SEQ ID NO: 228173

SEQ ID NO: 318693 - RNA, 64 nt, hsa; identical to SEQ ID NO: 228174

SEQ ID NO: 318694 - RNA, 64 nt, hsa; identical to SEQ ID NO: 228175

SEQ ID NO: 318695 - RNA, 64 nt, hsa; identical to SEQ ID NO: 228176

SEQ ID NO: 318696 - RNA, 64 nt, hsa; identical to SEQ ID NO: 228177

SEQ ID NO: 318697 - RNA, 64 nt, hsa; identical to SEQ ID NO: 228178

SEQ ID NO: 318698 - RNA, 64 nt, hsa; identical to SEQ ID NO: 228179

SEQ ID NO: 318699 - RNA, 64 nt, hsa; identical to SEQ ID NO: 228180

SEQ ID NO: 318700 - RNA, 64 nt, hsa; identical to SEQ ID NO: 228181

SEQ ID NO: 318701 - RNA, 64 nt, hsa; identical to SEQ ID NO: 228182

SEQ ID NO: 318702 - RNA, 64 nt, hsa; identical to SEQ ID NO: 228183

SEQ ID NO: 318703 - RNA, 64 nt, hsa; identical to SEQ ID NO: 228184

SEQ ID NO: 318704 - RNA, 64 nt, hsa; identical to SEQ ID NO: 228185

SEQ ID NO: 318705 - RNA, 64 nt, hsa; identical to SEQ ID NO: 228186

SEQ ID NO: 318706 - RNA, 64 nt, hsa; identical to SEQ ID NO: 228187

SEQ ID NO: 318707 - RNA, 64 nt, hsa; identical to SEQ ID NO: 228188

SEQ ID NO: 318708 - RNA, 64 nt, hsa; identical to SEQ ID NO: 228189

SEQ ID NO: 318709 - RNA, 64 nt, hsa; identical to SEQ ID NO: 228190

SEQ ID NO: 318710 - RNA, 64 nt, hsa; identical to SEQ ID NO: 228191

SEQ ID NO: 318711 - RNA, 64 nt, hsa; identical to SEQ ID NO: 228192

SEQ ID NO: 318712 - RNA, 64 nt, hsa; identical to SEQ ID NO: 228193

SEQ ID NO: 318713 - RNA, 64 nt, hsa; identical to SEQ ID NO: 228194

SEQ ID NO: 318714 - RNA, 64 nt, hsa; identical to SEQ ID NO: 228195

SEQ ID NO: 318715 - RNA, 64 nt, hsa; identical to SEQ ID NO: 228196

SEQ ID NO: 318716 - RNA, 64 nt, hsa; identical to SEQ ID NO: 228197

SEQ ID NO: 318717 - RNA, 64 nt, hsa; identical to SEQ ID NO: 228198

SEQ ID NO: 318718 - RNA, 64 nt, hsa; identical to SEQ ID NO: 228199

SEQ ID NO: 318719 - RNA, 64 nt, hsa; identical to SEQ ID NO: 228200

SEQ ID NO: 318720 - RNA, 64 nt, hsa; identical to SEQ ID NO: 228201

SEQ ID NO: 318721 - RNA, 64 nt, hsa; identical to SEQ ID NO: 228202

SEQ ID NO: 318722 - RNA, 64 nt, hsa; identical to SEQ ID NO: 228203

SEQ ID NO: 318723 - RNA, 64 nt, hsa; identical to SEQ ID NO: 228204

SEQ ID NO: 318724 - RNA, 64 nt, hsa; identical to SEQ ID NO: 228205

SEQ ID NO: 318725 - RNA, 64 nt, hsa; identical to SEQ ID NO: 228206

SEQ ID NO: 318726 - RNA, 64 nt, hsa; identical to SEQ ID NO: 228207

SEQ ID NO: 318727 - RNA, 64 nt, hsa; identical to SEQ ID NO: 228208

SEQ ID NO: 318728 - RNA, 64 nt, hsa; identical to SEQ ID NO: 228209

SEQ ID NO: 318729 - RNA, 64 nt, hsa; identical to SEQ ID NO: 228210

SEQ ID NO: 318730 - RNA, 64 nt, hsa; identical to SEQ ID NO: 228211

SEQ ID NO: 318731 - RNA, 64 nt, hsa; identical to SEQ ID NO: 228212

SEQ ID NO: 318732 - RNA, 64 nt, hsa; identical to SEQ ID NO: 228213

SEQ ID NO: 318733 - RNA, 64 nt, hsa; identical to SEQ ID NO: 228214

SEQ ID NO: 318734 - RNA, 64 nt, hsa; identical to SEQ ID NO: 228215

SEQ ID NO: 318735 - RNA, 64 nt, hsa; identical to SEQ ID NO: 228216

SEQ ID NO: 318736 - RNA, 64 nt, hsa; identical to SEQ ID NO: 228217

SEQ ID NO: 318737 - RNA, 64 nt, hsa; identical to SEQ ID NO: 228218

SEQ ID NO: 318738 - RNA, 64 nt, hsa; identical to SEQ ID NO: 228219

SEQ ID NO: 318739 - RNA, 64 nt, hsa; identical to SEQ ID NO: 49894

SEQ ID NO: 318740 - RNA, 64 nt, hsa; identical to SEQ ID NO: 49895

SEQ ID NO: 318741 - RNA, 64 nt, hsa; identical to SEQ ID NO: 49896

SEQ ID NO: 318742 - RNA, 64 nt, hsa; identical to SEQ ID NO: 49897

SEQ ID NO: 318743 - RNA, 64 nt, hsa; identical to SEQ ID NO: 49898

SEQ ID NO: 318744 - RNA, 64 nt, hsa; identical to SEQ ID NO: 49899

SEQ ID NO: 318745 - RNA, 64 nt, hsa; identical to SEQ ID NO: 49900

SEQ ID NO: 318746 - RNA, 64 nt, hsa; identical to SEQ ID NO: 49901

SEQ ID NO: 318747 - RNA, 64 nt, hsa; identical to SEQ ID NO: 49902

SEQ ID NO: 318748 - RNA, 64 nt, hsa; identical to SEQ ID NO: 49903

SEQ ID NO: 318749 - RNA, 64 nt, hsa; identical to SEQ ID NO: 49904

SEQ ID NO: 318750 - RNA, 64 nt, hsa; identical to SEQ ID NO: 49905

SEQ ID NO: 318751 - RNA, 64 nt, hsa; identical to SEQ ID NO: 49906

SEQ ID NO: 318752 - RNA, 64 nt, hsa; identical to SEQ ID NO: 49907

SEQ ID NO: 318753 - RNA, 64 nt, hsa; identical to SEQ ID NO: 49908

SEQ ID NO: 318754 - RNA, 64 nt, hsa; identical to SEQ ID NO: 49909

SEQ ID NO: 318755 - RNA, 64 nt, hsa; identical to SEQ ID NO: 49910

SEQ ID NO: 318756 - RNA, 64 nt, hsa; identical to SEQ ID NO: 49911

SEQ ID NO: 318757 - RNA, 64 nt, hsa; identical to SEQ ID NO: 49912

SEQ ID NO: 318758 - RNA, 64 nt, hsa; identical to SEQ ID NO: 49913

SEQ ID NO: 318759 - RNA, 64 nt, hsa; identical to SEQ ID NO: 49914

SEQ ID NO: 318760 - RNA, 64 nt, hsa; identical to SEQ ID NO: 49915

SEQ ID NO: 318761 - RNA, 64 nt, hsa; identical to SEQ ID NO: 49916

SEQ ID NO: 318762 - RNA, 64 nt, hsa; identical to SEQ ID NO: 49917

SEQ ID NO: 318763 - RNA, 64 nt, hsa; identical to SEQ ID NO: 49918

SEQ ID NO: 318764 - RNA, 64 nt, hsa; identical to SEQ ID NO: 49919

SEQ ID NO: 318765 - RNA, 64 nt, hsa; identical to SEQ ID NO: 49920

SEQ ID NO: 318766 - RNA, 64 nt, hsa; identical to SEQ ID NO: 49921

SEQ ID NO: 318767 - RNA, 52 nt, hsa; identical to SEQ ID NO: 49922

SEQ ID NO: 318768 - RNA, 64 nt, hsa; identical to SEQ ID NO: 49923

SEQ ID NO: 318769 - RNA, 64 nt, hsa; identical to SEQ ID NO: 49924

SEQ ID NO: 318770 - RNA, 64 nt, hsa; identical to SEQ ID NO: 49925

SEQ ID NO: 318771 - RNA, 64 nt, hsa; identical to SEQ ID NO: 49926

SEQ ID NO: 318772 - RNA, 64 nt, hsa; identical to SEQ ID NO: 49927

SEQ ID NO: 318773 - RNA, 64 nt, hsa; identical to SEQ ID NO: 49928

SEQ ID NO: 318774 - RNA, 64 nt, hsa; identical to SEQ ID NO: 49929

SEQ ID NO: 318775 - RNA, 64 nt, hsa; identical to SEQ ID NO: 49930

SEQ ID NO: 318776 - RNA, 64 nt, hsa; identical to SEQ ID NO: 49931

SEQ ID NO: 318777 - RNA, 64 nt, hsa; identical to SEQ ID NO: 49932

SEQ ID NO: 318778 - RNA, 64 nt, hsa; identical to SEQ ID NO: 49933

SEQ ID NO: 318779 - RNA, 64 nt, hsa; identical to SEQ ID NO: 49934

SEQ ID NO: 318780 - RNA, 64 nt, hsa; identical to SEQ ID NO: 146929

SEQ ID NO: 318781 - RNA, 64 nt, hsa; identical to SEQ ID NO: 146930

SEQ ID NO: 318782 - RNA, 64 nt, hsa; identical to SEQ ID NO: 146931

SEQ ID NO: 318783 - RNA, 64 nt, hsa; identical to SEQ ID NO: 146932

SEQ ID NO: 318784 - RNA, 64 nt, hsa; identical to SEQ ID NO: 146933

SEQ ID NO: 318785 - RNA, 64 nt, hsa; identical to SEQ ID NO: 146934

SEQ ID NO: 318786 - RNA, 64 nt, hsa
ccccgccuaggacagggucaaucgaggaaugccagaugugcacgguuuuuggcaaaguaggggg

SEQ ID NO: 318787 - RNA, 64 nt, hsa
ucugccaucgaucgcagauuucuguagaaacacggaugugcaugugcagauucccuuuugcagg

SEQ ID NO: 318788 - RNA, 64 nt, hsa
ccaaacacauauucauaaaaaaaaucaaguagcugaugugcaguugagaaaacuagaggacuga

SEQ ID NO: 318789 - RNA, 64 nt, hsa
acuuucccucagcugacugguguucuaccugcaagaugugcagagggcauaaaagcaaaucaac

SEQ ID NO: 318790 - RNA, 64 nt, hsa
cugaguggugggugguggggugguguuuguguaugaugugcagugugugugugugugguguguc

SEQ ID NO: 318791 - RNA, 64 nt, hsa
guuuuuuaagugccgggugaauuuuggaccucuggaugugcagcaaguuuuuaugcaauaagcc

SEQ ID NO: 318792 - RNA, 64 nt, hsa
ugcauguccucugcuugcccggcugcagagcagagaugugcagcccucuggucagcugguccag

SEQ ID NO: 318793 - RNA, 64 nt, hsa
ccaccuggcugacaggaagaauuucugagagcuggaugugcaugcccuguggacgaagguacag

SEQ ID NO: 318794 - RNA, 64 nt, hsa
cagugagagaaggcuugauguguauaaaagacgugaugugcaccaccucgaucucgguguuuca

SEQ ID NO: 318795 - RNA, 64 nt, hsa
gguggcugugaggugaccccagacacugcagaacgaugugcacccucugcguuuuggauguccu

SEQ ID NO: 318796 - RNA, 64 nt, hsa
aaaacuccccaaggugccugagauggcugugcccgaugugcaccuccccgaggugcagcugccg

SEQ ID NO: 318797 - RNA, 64 nt, hsa
gaaacuccccaaggugccugaaauggccgugcccgaugugcaccucccagaggugcagcugccc

SEQ ID NO: 318798 - RNA, 64 nt, hsa
gaaacucccgaaggugcccgagauggcugugcccgaugugcaccucccggaagugcagcucccg

SEQ ID NO: 318799 - RNA, 64 nt, hsa
gcaacucccgaaggugcccgagauggccgugcccgaugugcaccucccagaagugcagcuucca

SEQ ID NO: 318800 - RNA, 64 nt, hsa; identical to SEQ ID NO: 227757

SEQ ID NO: 318801 - RNA, 64 nt, hsa; identical to SEQ ID NO: 227758

SEQ ID NO: 318802 - RNA, 64 nt, hsa; identical to SEQ ID NO: 227759

SEQ ID NO: 318803 - RNA, 64 nt, hsa; identical to SEQ ID NO: 227760

SEQ ID NO: 318804 - RNA, 64 nt, hsa; identical to SEQ ID NO: 227761

SEQ ID NO: 318805 - RNA, 64 nt, hsa; identical to SEQ ID NO: 227762

SEQ ID NO: 318806 - RNA, 64 nt, hsa; identical to SEQ ID NO: 227763

SEQ ID NO: 318807 - RNA, 64 nt, hsa; identical to SEQ ID NO: 227764

SEQ ID NO: 318808 - RNA, 64 nt, hsa; identical to SEQ ID NO: 227765

SEQ ID NO: 318809 - RNA, 64 nt, hsa; identical to SEQ ID NO: 227766

SEQ ID NO: 318810 - RNA, 64 nt, hsa; identical to SEQ ID NO: 318786

SEQ ID NO: 318811 - RNA, 64 nt, hsa; identical to SEQ ID NO: 318787

SEQ ID NO: 318812 - RNA, 64 nt, hsa; identical to SEQ ID NO: 318788

SEQ ID NO: 318813 - RNA, 64 nt, hsa; identical to SEQ ID NO: 318789

SEQ ID NO: 318814 - RNA, 64 nt, hsa; identical to SEQ ID NO: 318790

SEQ ID NO: 318815 - RNA, 64 nt, hsa; identical to SEQ ID NO: 318791

SEQ ID NO: 318816 - RNA, 64 nt, hsa; identical to SEQ ID NO: 318792

SEQ ID NO: 318817 - RNA, 64 nt, hsa; identical to SEQ ID NO: 318793

SEQ ID NO: 318818 - RNA, 64 nt, hsa; identical to SEQ ID NO: 318794

SEQ ID NO: 318819 - RNA, 64 nt, hsa; identical to SEQ ID NO: 318795

SEQ ID NO: 318820 - RNA, 64 nt, hsa; identical to SEQ ID NO: 318796

SEQ ID NO: 318821 - RNA, 64 nt, hsa; identical to SEQ ID NO: 318797

SEQ ID NO: 318822 - RNA, 64 nt, hsa; identical to SEQ ID NO: 318798

SEQ ID NO: 318823 - RNA, 64 nt, hsa; identical to SEQ ID NO: 318799

SEQ ID NO: 318824 - RNA, 64 nt, hsa; identical to SEQ ID NO: 227757

SEQ ID NO: 318825 - RNA, 64 nt, hsa; identical to SEQ ID NO: 227758

SEQ ID NO: 318826 - RNA, 64 nt, hsa; identical to SEQ ID NO: 227759

SEQ ID NO: 318827 - RNA, 64 nt, hsa; identical to SEQ ID NO: 227760

SEQ ID NO: 318828 - RNA, 64 nt, hsa; identical to SEQ ID NO: 227761

SEQ ID NO: 318829 - RNA, 64 nt, hsa; identical to SEQ ID NO: 227762

SEQ ID NO: 318830 - RNA, 64 nt, hsa; identical to SEQ ID NO: 227763

SEQ ID NO: 318831 - RNA, 64 nt, hsa; identical to SEQ ID NO: 227764

SEQ ID NO: 318832 - RNA, 64 nt, hsa; identical to SEQ ID NO: 227765

SEQ ID NO: 318833 - RNA, 64 nt, hsa; identical to SEQ ID NO: 227766

SEQ ID NO: 318834 - RNA, 64 nt, hsa
uuuggaaaaaaaucucugggcuucgacugcugccagggaggagcugcugcaagccagagggagg

SEQ ID NO: 318835 - RNA, 64 nt, hsa
cgacugcugccagggaggagcugcugcaagccagagggaggaagggggagaauacgaacagccu

SEQ ID NO: 318836 - RNA, 62 nt, hsa
gccaguauuccuacuuauaguuggugagcaugagggaggaggaaucauggcuaccuucuccu

SEQ ID NO: 318837 - RNA, 64 nt, hsa
gucccugggguuagcccuguuggcccugacaggaagggaggaagccuggugaauuuagugagca

SEQ ID NO: 318838 - RNA, 64 nt, hsa
agagccggauggggagagucaacaggaaaaaaggagggaggaggaaaagccacaagagacauuc

SEQ ID NO: 318839 - RNA, 64 nt, hsa
ccaggagcccucagguggcuggagcuggaauagcagggaggacuggguguaccuaggcaguauu

SEQ ID NO: 318840 - RNA, 64 nt, hsa
ggguccugcggcccccuugcccaaccucggguuuagggaggaggguucacaguguuuuuguggg

SEQ ID NO: 318841 - RNA, 64 nt, hsa
cauuuccacccucgggaggcggcuccugagaaacagggaggaaggggcggagcaccuggacguc

SEQ ID NO: 318842 - RNA, 64 nt, hsa
gccagcccgcugcgaacccuccaccagcuaccggagggaggagggaggaugcgcugugggguug

SEQ ID NO: 318843 - RNA, 64 nt, hsa
cgcugcgaacccuccaccagcuaccggagggaggagggaggaugcgcugugggguuguuuuugc

SEQ ID NO: 318844 - RNA, 64 nt, hsa
gagcuaggagaucugagggcaggcgggcagcugcagggaggagaggugagaaaggaagcgucuu

SEQ ID NO: 318845 - RNA, 64 nt, hsa
caggcccccugcagccucccaggacaggcuggcaagggaggagggccggccagcauuugguggc

SEQ ID NO: 318846 - RNA, 64 nt, hsa
ugaaagaaaggaggggagcagcagaagccacggcagggaggaaaggagccggagaagccggagc

SEQ ID NO: 318847 - RNA, 64 nt, hsa
ggaaaagcccagguucuuaaaacacgagaguucuagggaggacagcaaauggagccauucugau

SEQ ID NO: 318848 - RNA, 64 nt, hsa
gugugugccccagggggucggggguaggggaugcagggaggaucuuagcauuuguuguuuucua

SEQ ID NO: 318849 - RNA, 64 nt, hsa
augugugucagagaaagagagagagagagagagaagggaggaugagaacgaauggggggaagag

SEQ ID NO: 318850 - RNA, 64 nt, hsa
guugcccuccagggucuagcccagccuauuuguuagggaggauagagaaacagagcacccccug

SEQ ID NO: 318851 - RNA, 64 nt, hsa
uagaggguaugaccugggguugcuggccagagccagggaggagccuuaagaagugaaaucuagg

SEQ ID NO: 318852 - RNA, 64 nt, hsa
gguggguggaaacggcucuuguuugaaagaacuuagggaggaccauuggcuugccaagaguaca

SEQ ID NO: 318853 - RNA, 64 nt, hsa
gagacguuaagagcugagcacaccacaggaaaggagggaggaugcugugugagagccaugcugu

SEQ ID NO: 318854 - RNA, 64 nt, hsa
uuauuagaauauaaaaaauguuauuacugaggaaagggaggagaggacaaguguaauaaaucaa

SEQ ID NO: 318855 - RNA, 64 nt, hsa
cacaguagcacacgugcuuccucucuugacaucaagggaggaaggggauggcccauuaagaguu

SEQ ID NO: 318856 - RNA, 64 nt, hsa
uccaccugcaccccacucccaaguagcuugaaaaagggaggacagucuuuccccagcagggguc

SEQ ID NO: 318857 - RNA, 64 nt, hsa
uguguggggauggugagggaagaggggucacaugagggaggaaacuguauccaugcaugcauga

SEQ ID NO: 318858 - RNA, 64 nt, hsa
caucccagguguguguaagagagagagagagaacagggaggauacagaaguauugcagcccaga

SEQ ID NO: 318859 - RNA, 64 nt, hsa
gguuggguggggaggggaaucauugguugggggaagggaggaaaccccaccuccagcccccgcc

SEQ ID NO: 318860 - RNA, 64 nt, hsa
gggccuugcgguucagagcucuuggcgaggguggagggaggagugucauuucuauguguaauuu

SEQ ID NO: 318861 - RNA, 64 nt, hsa
agccacauccaucuggcaguugugccaagggaggagggaggagguaaaaggcagggaguuaaua

SEQ ID NO: 318862 - RNA, 64 nt, hsa
gacuuccagccacauccaucuggcaguugugccaagggaggagggaggagguaaaaggcaggga

SEQ ID NO: 318863 - RNA, 64 nt, hsa
gcgcgcucugcuccuucccaugugcagacagaucagggaggaaccuccaaugggugggggacag

SEQ ID NO: 318864 - RNA, 64 nt, hsa
ggagggcaucugucugugggagcccagaggcugcagggaggaggaggagggagguaucuggugu

SEQ ID NO: 318865 - RNA, 64 nt, hsa
gcucauuugagggguggcuacuuggcuaugggauagggaggagggaauuacuagggaggagaga

SEQ ID NO: 318866 - RNA, 64 nt, hsa
uacuuggcuaugggauagggaggagggaauuacuagggaggagagaaagggacaaaagcacccu

SEQ ID NO: 318867 - RNA, 64 nt, hsa
ugagccaggccaacauuggugucccuguccccagagggaggagcaggcaggagagagaggggaa

SEQ ID NO: 318868 - RNA, 64 nt, hsa
cacccccaggaggccaagccugaaaacagaggggagggaggaaggaaggagucccagcaggagc

SEQ ID NO: 318869 - RNA, 64 nt, hsa
cugcggcuccuuagucaccucugauagcagauugagggaggaaaacagguaaggcaugaggaaa

SEQ ID NO: 318870 - RNA, 64 nt, hsa
ccacaguucuacaagacugcaggaauucuccuuaagggaggagagcaagcagguguggccccag

SEQ ID NO: 318871 - RNA, 64 nt, hsa
aaggcagcacguaauguguaaguucuagaucgucagggaggaagggucaguugggugccuguuu

SEQ ID NO: 318872 - RNA, 64 nt, hsa
gaggcagcacggaacauguagguuauagaucgucagggaggaggggucaguugggugcuuguuu

SEQ ID NO: 318873 - RNA, 64 nt, hsa
ccccucucccguguuuuguuuguccuguagauagagggaggaaagccgugcaguggcaggcggg

SEQ ID NO: 318874 - RNA, 64 nt, hsa
ccaccuggggagcugagaagaggaggcuggaguaagggaggacuugaucauccaagaaauacuu

SEQ ID NO: 318875 - RNA, 64 nt, hsa
uuugcaguguagugacacugggguuucugcagucagggaggagggaggguggccaggcugacag

SEQ ID NO: 318876 - RNA, 64 nt, hsa
acgguucugagacugaacacugagggcaggagcaagggaggaagccaggggcgaggcaggccgc

SEQ ID NO: 318877 - RNA, 64 nt, hsa
aggacuuccaggaggaccccaacccggcccggagagggaggaggaggccuccaggggcgcggag

SEQ ID NO: 318878 - RNA, 64 nt, hsa
gcucccggccagccgccggcccgcaggcagcgcgagggaggagcugcgccgccggcuccgccca

SEQ ID NO: 318879 - RNA, 64 nt, hsa
uggggcugagaacugcagcccugggucuucccuuagggaggaagggcagaugaacccagcaggc

SEQ ID NO: 318880 - RNA, 64 nt, hsa
ccugguuucccagaucuguauuucaguguuuacaagggaggaaggaccuuuccucaccucccuu

SEQ ID NO: 318881 - RNA, 64 nt, hsa
cugcagccauugccauccaguggggagauggguuagggaggaggacgggcugacuccucuccug

SEQ ID NO: 318882 - RNA, 64 nt, hsa
aaagaaaguuguggggcauaagacaccgggaaugagggaggaggaagacaguuguguuuucucu

SEQ ID NO: 318883 - RNA, 64 nt, hsa
aggugcaggggcuucuguuuggcaggccccugccagggaggaccugguggccuccucauucucu

SEQ ID NO: 318884 - RNA, 64 nt, hsa
guucugucucaggcuucuguggcaggacuggcccagggaggaggaagccagcagcacaccuggg

SEQ ID NO: 318885 - RNA, 64 nt, hsa
acaagcuaauagcaaauauuacccauugcuaucaagggaggaggggguagucuguagaacccau

SEQ ID NO: 318886 - RNA, 64 nt, hsa
aauucuauaacaguaaaccccauacgcaggugggagggaggaacaccggugccucggucacucu

SEQ ID NO: 318887 - RNA, 64 nt, hsa
ugggggaggcuguuucuucucaggauuccuugccagggaggaaggggagggaacaggguggguu

SEQ ID NO: 318888 - RNA, 64 nt, hsa
aggccuguaauuccagcacuuugggaggccgaggagggaggaucaccugaggucaggaguuuga

SEQ ID NO: 318889 - RNA, 64 nt, hsa
agaggcuccugaagaugcugggcgguccuggcacagggaggagcagcucuguaaaucugugcac

SEQ ID NO: 318890 - RNA, 64 nt, hsa
augccgaugcggcuuguggcacggcugggaugugagggaggacucagaucuacacacagaaacc

SEQ ID NO: 318891 - RNA, 64 nt, hsa
agguggcagggcagagaugucacucucauucaacagggaggaugucuguugcucagagagguug

SEQ ID NO: 318892 - RNA, 64 nt, hsa
ccccggcccucccuggcccggccacuccgaaggcagggaggaggacuuggcaacuggcuuuucu

SEQ ID NO: 318893 - RNA, 64 nt, hsa
ccagagaggacagacacagauuuccugcugggggagggaggaguccacgcauccugaugcugcc

SEQ ID NO: 318894 - RNA, 64 nt, hsa
gggacuuuagagagggaugaaaaugagcccugggagggaggaagggacgaggagggguggcugc

SEQ ID NO: 318895 - RNA, 64 nt, hsa
uaccucuccccacguggaggguggagcaguuaugagggaggaagucaacugcuguucagccuca

SEQ ID NO: 318896 - RNA, 64 nt, hsa
ugagaaucuccaagagaaaaauauuuggggaaggagggaggaaauaugucccuugcacaccacc

SEQ ID NO: 318897 - RNA, 64 nt, hsa
gaagccaccucccaucacaccccugagcagaguuagggaggaauucuacuucccauaaaaggac

SEQ ID NO: 318898 - RNA, 64 nt, hsa
auaguuaaaaagcauuauacuguggguaaugaaaagggaggaaaaaaaaagaaggaaaaggaau

SEQ ID NO: 318899 - RNA, 64 nt, hsa
uuuaugcucaggagcauuggaauccucuucuuccagggaggaauuagccugcaagguuaggacu

SEQ ID NO: 318900 - RNA, 64 nt, hsa
agaaaaacaggccgagugaaggugcuggaaagggagggaggacgcgaggggaaaggccuguggg

SEQ ID NO: 318901 - RNA, 64 nt, hsa
gaugaggcaccaggaaaggggugguagucagaggagggaggaggaauaaggggaaggaagagag

SEQ ID NO: 318902 - RNA, 64 nt, hsa
guugcaggaggaggagcugggcagggccugcaccagggaggaguggaggacgagguaacucagc

SEQ ID NO: 318903 - RNA, 64 nt, hsa
cagcuugcucccugccccagaccuguuucuucuaagggaggaggacaugguggagaccagggac

SEQ ID NO: 318904 - RNA, 64 nt, hsa
aagucccugcgcuccagcuggacggcccuguuccagggaggaggugcucgguugacaccaucag

SEQ ID NO: 318905 - RNA, 64 nt, hsa
aggagggcagggcgugcagggccuugugggccucagggaggacuugggcaccuacgccgaggga

SEQ ID NO: 318906 - RNA, 64 nt, hsa
agagcagcccuucucagcuccacccugcccggggagggaggaggagcucugguuucagagcagu

SEQ ID NO: 318907 - RNA, 64 nt, hsa
gggcagggccuugcaggggauugguacugaucccagggaggaaguguuggggcuucaugaacua

SEQ ID NO: 318908 - RNA, 64 nt, hsa
acacagcugaccgaauccggcuucggaugaggugagggaggagcaggucaggaggggggcccuc

SEQ ID NO: 318909 - RNA, 64 nt, hsa
aucucuggcagcccacuugggccagcuacgugggagggaggaauuacacagcugaccgaauccg

SEQ ID NO: 318910 - RNA, 64 nt, hsa
uccggaagucgcugugcccugguugagggggguuagggaggagugagugggacucaaauccaga

SEQ ID NO: 318911 - RNA, 64 nt, hsa
accaggaguccugagcacacugaacacaccucagagggaggauccuuguuguggauuuugcacc

SEQ ID NO: 318912 - RNA, 64 nt, hsa
accucccuucuacggagaugcaggcagugccacgagggaggaggggaccugcaaagcuagaauc

SEQ ID NO: 318913 - RNA, 64 nt, hsa
aaaauguuaucgauacuaaacaccaucaguucagagggaggaugugugugugugcccgcauaug

SEQ ID NO: 318914 - RNA, 64 nt, hsa
agcuggagaugaaggcacacucauaccacauacaagggaggauuuggagcuuuuaagccaguuu

SEQ ID NO: 318915 - RNA, 64 nt, hsa
uucuuuggaaguucagcagaugaaagcccaggccagggaggagaaggcuagaaagcaggugagc

SEQ ID NO: 318916 - RNA, 64 nt, hsa
ggagcggcagcgccucgcucgagagaagcagaugagggaggaggcugaacgcacgagggaugag

SEQ ID NO: 318917 - RNA, 58 nt, hsa
gccugacacgggaagagugacaguagggagggaggacagaccuccaccacacugacau

SEQ ID NO: 318918 - RNA, 64 nt, hsa
ucccaagcucccaucuauggggcuuagcaaaaaaagggaggaagugggggcuggauaugcccac

SEQ ID NO: 318919 - RNA, 64 nt, hsa
uacaaaggacccuuucaaugucccuggaguugggagggaggaaugggggacauaaagccugucc

SEQ ID NO: 318920 - RNA, 64 nt, hsa
agacagcuuauccuuuucaaccaacuuuuuggccagggaggaaugucccuuuuguucuuccccc

SEQ ID NO: 318921 - RNA, 61 nt, hsa
auuguccacauaacugaucacccauggcugccucuccuauuaucuauuaucacugaaacuu

SEQ ID NO: 318922 - RNA, 61 nt, hsa
cuuauuauuggccauugaucuugaauuugcccucuccuagugcugcagucccacuucaaag

SEQ ID NO: 318923 - RNA, 61 nt, hsa
ggugguauauuuuuccccucuuuuuuccuuccucuccuacaucucccuuuucccccgaucc

SEQ ID NO: 318924 - RNA, 61 nt, hsa
aaguagugauggauucaguacuccucaaccacucuccuaaugauuggaacaaaagcaaaca

SEQ ID NO: 318925 - RNA, 61 nt, hsa
cuguaaauacuggaucaaugaaugaauaaaacucuccuaagaaucuccugagaaaugaacc

SEQ ID NO: 318926 - RNA, 61 nt, hsa
guugacauaaguuccuaccugacuaugcuuucucuccuaggagcuguccuggugggcccag

SEQ ID NO: 318927 - RNA, 61 nt, hsa
uaucucucucucuaucuccucucucucucuccucuccuaucucuccucucucucucuccua

SEQ ID NO: 318928 - RNA, 61 nt, hsa
cucucucuccucuccuaucucuccucucucucucuccuauacuaacuuguuucaaauugga

SEQ ID NO: 318929 - RNA, 61 nt, hsa
auuaucuacagcuauuuuauuuuauuuaauucucuccuacaguacugggaccacuguaaac

SEQ ID NO: 318930 - RNA, 61 nt, hsa
gcuaugauagaaucucaucuaaucuugacaucucuccuaggggaagaauaucacaggcuaa

SEQ ID NO: 318931 - RNA, 61 nt, hsa
cuuuccagccuguuuccccaauuccucugugcucuccuagagcucugucugaauccucgca

SEQ ID NO: 318932 - RNA, 61 nt, hsa
uuggauuaggagaacagguguuccuccuccccucuccuagcagcccuaaugucugaccuag

SEQ ID NO: 318933 - RNA, 61 nt, hsa
gcagcagcaguggcucuucgauuaguuaaaacucuccuaggcugacacaucugggucucaa

SEQ ID NO: 318934 - RNA, 61 nt, hsa
auuugcuuuucaaaauggaaauaaauuccaacucuccuaagaggcauuuaauuaaggcucu

SEQ ID NO: 318935 - RNA, 61 nt, hsa
gcauaauuggugauccugaagaaagaggucucucuccuaagucucugucagaauugagcuu

SEQ ID NO: 318936 - RNA, 61 nt, hsa
uguacuucguuaacacgaaucuguuucagagcucuccuaccuugcucacugccuuaaucag

SEQ ID NO: 318937 - RNA, 64 nt, hsa
uuaaugacuggaaaaaacuugcuuauugccuuucccuauauaaauauuaauugucuagaaugaa

SEQ ID NO: 318938 - RNA, 64 nt, hsa
guaacccaaauucauaaagcaauaauaauaaaaaccuauauaguauguucucuccuccaaaguu

SEQ ID NO: 318939 - RNA, 64 nt, hsa
uuaggcagcauugcuuugaugcaauuucuauuguccuauauauucaaaaguaaugucuacauuc

SEQ ID NO: 318940 - RNA, 64 nt, hsa
cuagacauugacugcaagagaaucucugcaaccuccuauauaaaagcauuucuguuaauucauu

SEQ ID NO: 318941 - RNA, 64 nt, hsa
aaaaauguaacugcuuuauaauauuuuuuccuuaccuauauauucuauuuaauacuugguuuau

SEQ ID NO: 318942 - RNA, 64 nt, hsa
cuuagugcacaacacauuugugaaauaaccuacuccuauauacugaccugccuguccacgaaua

SEQ ID NO: 318943 - RNA, 64 nt, hsa
ugacauuuuaaucauuauuuuaaaagcuuugcaaccuauauauuuauauaacuuuguaauauaa

SEQ ID NO: 318944 - RNA, 64 nt, hsa
guggcccaauucuuuaaugggacaaauauuguuuccuauauauauguauauguuuuauauaugu

SEQ ID NO: 318945 - RNA, 64 nt, hsa
ugguguauaaacagggcauuacagaaugguacacccuauauauuucuguucaguauccauucac

SEQ ID NO: 318946 - RNA, 64 nt, hsa
ucuccucuguucuacuuggcaccacaagcuauguccuauauauguauuucugacuuggcaggau

SEQ ID NO: 318947 - RNA, 64 nt, hsa
uuuucaagaguaaaauuuaagauuaaaaauauauccuauauauagauaucuagaaaacuugguu

SEQ ID NO: 318948 - RNA, 64 nt, hsa
acauuuuuaaguuacucagcucuauccucaugggccuauauauuuaauaccuccaaagauauuu

SEQ ID NO: 318949 - RNA, 64 nt, hsa
aaaauuauaggauuuuuuucuuuuuuaguaaaaaccuauauaaaaaccaaaauuauaggauuuu

SEQ ID NO: 318950 - RNA, 64 nt, hsa
uuucggggguaauagagccacuggugaguaaaaaccuauauaaaaaccaaaauuauaggauuuu

SEQ ID NO: 318951 - RNA, 64 nt, hsa
uuuacuuaggugugaaagaugguucuuuguugaaauaauauagugguuuaguguuuucaaauca

SEQ ID NO: 318952 - RNA, 64 nt, hsa
aauuaagcuuuauaaugacauuucaaccaucaacauaauauagugaggaguagcauaauauuuu

SEQ ID NO: 318953 - RNA, 64 nt, hsa
ccaucacuuagaacgaaccccaaacaaaaaugccauaauauaaaugugugaaucagggcuguga

SEQ ID NO: 318954 - RNA, 64 nt, hsa
uaaaaugggguuugcaggcuuuuuauggugaagaauaauauaucucugucuauagcuuucccau

SEQ ID NO: 318955 - RNA, 64 nt, hsa
ggcugcugcaauugaaaacuuucuuucuaauaaaauaauauauauaucucugaaucugaugugc

SEQ ID NO: 318956 - RNA, 64 nt, hsa
cuuguauagaaauagucuucauuuuaucugagacauaauauaaacuuauuuacuuuccuuuuua

SEQ ID NO: 318957 - RNA, 64 nt, hsa
uuguacuuauaacuguuauuaaauaccaaaucaaauaauauaaaagcuguaacauuuccuuuaa

SEQ ID NO: 318958 - RNA, 64 nt, hsa
uaagucuugaaugaauacaaaaggagcccauuuuauaauauaaaccuugauguacauguugaga

SEQ ID NO: 318959 - RNA, 64 nt, hsa
agugaguugagggagcuaaucugauacacuuuugauaauauaaugccuuucaaauuaguuacca

SEQ ID NO: 318960 - RNA, 64 nt, hsa
uuuuaguaguaucuuccauuguguagauuucuauauaauauaaauacauuuuaauuauuuguac

SEQ ID NO: 318961 - RNA, 64 nt, hsa
uuuuuuaaauugaacaguauuuuucauuuugguuauaauauagucauuuugccuauguuucuac

SEQ ID NO: 318962 - RNA, 64 nt, hsa
acccaaccccuuacacuacacugaacacuaaagaauaauauauaagcacacaaauuggugacag

SEQ ID NO: 318963 - RNA, 64 nt, hsa
uuaugacaaaaguuaucugaaggacuugcuguuuauaauauaagcaacauuuagcuaguuguuu

SEQ ID NO: 318964 - RNA, 64 nt, hsa
caaauuugcuauaguuugucauuuuugcuuacaaauaauauaacuuuucaaccuucuaguuaua

SEQ ID NO: 318965 - RNA, 64 nt, hsa
agugguauuaauuguuuuaaucugcaguucaccaauaauauaugaauuuagcaucuuuucauau

SEQ ID NO: 318966 - RNA, 64 nt, hsa
uuuuucuuuuuucuuuuuuuaaagaaaugguagcauaauauacacaguuguccauuuuuuaaag

SEQ ID NO: 318967 - RNA, 64 nt, hsa
uuaaguguacaucguaauuugaccuaauuuaaaaauaauauauuuucgaaguaguagauucuca

SEQ ID NO: 318968 - RNA, 64 nt, hsa
cauuuaauaaaaauaaaugauuuugaaauuaaauauaauauagaauucacauuuuauauagcuc

SEQ ID NO: 318969 - RNA, 64 nt, hsa
aaggauaauacuuuauauaauguauaaaguauauauaauauaauauauauguuauauaaacugc

SEQ ID NO: 318970 - RNA, 64 nt, hsa
uaauacuuuauauaauguauaaaguauauauaauauaauauauauguuauauaaacugcacauu

SEQ ID NO: 318971 - RNA, 64 nt, hsa
auacaaggagcuauuucuaaaauuuggcuuauguauaauauauuuaaauggggaauuucaucua

SEQ ID NO: 318972 - RNA, 64 nt, hsa
acccaggcacucaauauucauccugaaauuuuuuauaauauauguaauuugucuagucuuaaag

SEQ ID NO: 318973 - RNA, 64 nt, hsa
uucaaaccauauggccuagguaacuuuaauugaaauaauauagauuuaguugaauacuauucag

SEQ ID NO: 318974 - RNA, 64 nt, hsa
uggcugcgguagccuaguaggaauggacuauauaauaauauagcaggugcucaauaacuguuug

SEQ ID NO: 318975 - RNA, 64 nt, hsa
gggcaacagagcaagacccugucucaaaauaauaauaauauauaauuuuacaccaaaaguuuca

SEQ ID NO: 318976 - RNA, 64 nt, hsa
aguacuuugauacucaaguuguuucacaagauuuauaauauagaugguuuuguuugacuaaaga

SEQ ID NO: 318977 - RNA, 64 nt, hsa
agaagagaauauacacaacucagagaugcaauggauaauauaaaaagaguaccugagauguauu

SEQ ID NO: 318978 - RNA, 64 nt, hsa
uaacuuaacuauaguauaaugaaaagaaugaccuauaauauagguguuuuguagauucuugugu

SEQ ID NO: 318979 - RNA, 64 nt, hsa
agaguauuuuggguuuuuaauuaaauuauuguuaauaauauaacauauaagaauacuuuuauua

SEQ ID NO: 318980 - RNA, 64 nt, hsa
cucuccuuuccccuucuggucccugcgcuuugguauaauauauauacuucuccauacacagacc

SEQ ID NO: 318981 - RNA, 64 nt, hsa
uugguacaaauaaaaacuguauaucuauauacaaauaauauauagauauauauguccaccagua

SEQ ID NO: 318982 - RNA, 64 nt, hsa
aaaaauguccauaugcacuauuuaaauguuuuaaauaauauauuccuucuuuauaaugcuaaau

SEQ ID NO: 318983 - RNA, 64 nt, hsa
cagucuguuuggccauuacuacacuuuuuacuuuauaauauaaaagcaaaguuuuugucauuaa

SEQ ID NO: 318984 - RNA, 64 nt, hsa
aaugcaauaaaguaauaaucucacuuuuauaugaauaauauauuucacaucuuuauuauugcag

SEQ ID NO: 318985 - RNA, 64 nt, hsa
aucugaaggcauuuucagcucuagcaauuuauuuauaauauauaaguucauauauuuuuuaauc

SEQ ID NO: 318986 - RNA, 64 nt, hsa
acaugcaauggaauauagauauguauauacacauauaauauauaugcuaaaguauaaagaguaa

SEQ ID NO: 318987 - RNA, 64 nt, hsa
uaauaaaaauuuaugaauauuaaaauuaucauuaauaauauaaaacacuuauuugagauuaaau

SEQ ID NO: 318988 - RNA, 64 nt, hsa
auauuuguuauucuaacucuauuuuuuaaaguuaauaauauaaaguggccauguaaaauauuuu

SEQ ID NO: 318989 - RNA, 64 nt, hsa
gaauauuugaauugaaacaauagaaauuuuucucauaauauauaccuaugugaaaccaacuuau

SEQ ID NO: 318990 - RNA, 64 nt, hsa
caccuaaauugaaagcuaagaaggaaauguaaauauaauauauauuuauauuugauguaauaug

SEQ ID NO: 318991 - RNA, 64 nt, hsa
agcucauacuuuauggugguucuucuccuccgaaauaauauacugcagaaaucccagacagagc

SEQ ID NO: 318992 - RNA, 64 nt, hsa
auggaauauguauauuauauauauuuuuauauauauaauauauauggaauauauauauuauaua

SEQ ID NO: 318993 - RNA, 64 nt, hsa
gaaagggaaaccuaaaacaaauacccuuccauauauaauauauauggaauauguauauuauaua

SEQ ID NO: 318994 - RNA, 64 nt, hsa
cauguggaauccauccauaaugguacauagcgaaauaauauaaucuuaguucaguaacuauuau

SEQ ID NO: 318995 - RNA, 64 nt, hsa
auuuuaucauauuuuaggcuuuucuaaauauuagauaauauagauggcagaagucaugcaaauu

SEQ ID NO: 318996 - RNA, 64 nt, hsa
uuuacccuuguauguuauccucagagggaagaugauaauauauaaauaauauaaugaacacacc

SEQ ID NO: 318997 - RNA, 64 nt, hsa
auguuauccucagagggaagaugauaauauauaaauaauauaaugaacacacccuuaguuucuc

SEQ ID NO: 318998 - RNA, 64 nt, hsa
aguacagugcaaguuuuuucacuuuuacuuaaacauaauauauaauggauauucauuuauacug

SEQ ID NO: 318999 - RNA, 64 nt, hsa
caucauugcugcauuuuguacuuugaacacacacauaauauauauaaccagugguaaaucauga

SEQ ID NO: 319000 - RNA, 64 nt, hsa
gacugaugcuuuaucuaaaaugcuuugaguuuguauaauauaucuugacaaauuuuacuaccau

SEQ ID NO: 319001 - RNA, 64 nt, hsa
gacuauaugucauuuuauuauacuccaucaaucuauaauauauuagacugaugcuuuaucuaaa

SEQ ID NO: 319002 - RNA, 64 nt, hsa
agacuucuaaguguccauaugcaucuuuuuugguauaauauauaaagucagcagggacuccccu

SEQ ID NO: 319003 - RNA, 64 nt, hsa
auauaauauaauauauuauauauauauuauauauauaauauauauauaaaauauauauauauau

SEQ ID NO: 319004 - RNA, 64 nt, hsa
uguguauauauauauuauauauauaauauauaauauaauauauuauauauauauuauauauaua

SEQ ID NO: 319005 - RNA, 64 nt, hsa
auauauguguauauauauauuauauauauaauauauaauauaauauauuauauauauauuauau

SEQ ID NO: 319006 - RNA, 64 nt, hsa
uaauauaauauauguguauauauauauuauauauauaauauauaauauaauauauuauauauau

SEQ ID NO: 319007 - RNA, 64 nt, hsa
auauauauauuauauauguguguauauauauaauauaauauauguguauauauauauuauauau

SEQ ID NO: 319008 - RNA, 64 nt, hsa
ucuccauauauauauuauauauguguguauauauauaauauaauauauguguauauauauauua

SEQ ID NO: 319009 - RNA, 64 nt, hsa
guagaacucauuuugcuggcugaaagaguauggaauaauauaucucaugucauuuuuuagaaga

SEQ ID NO: 319010 - RNA, 64 nt, hsa
augcuuuaauguuaucuuugagaaaucuauguaaauaauauagucuacaacauagagacuguau

SEQ ID NO: 319011 - RNA, 64 nt, hsa
aauguaugaacuuuuugcauuggcuugaagcaauauaauauauuguaaacaaaacacagcucuu

SEQ ID NO: 319012 - RNA, 64 nt, hsa
aaaaauuacacugugguaguggcauuuaaacaauauaauauauucuaaacacaaugaaauaggg

SEQ ID NO: 319013 - RNA, 64 nt, hsa
ugggcaacauagcgagacccuaucuaaaauaacaauaauauauggccaggcgggauggcucacg

SEQ ID NO: 319014 - RNA, 64 nt, hsa
cgggagugagacaccaucucaaaaaauacauauaauaauauaaauaaaaauaucuuuuuugaaa

SEQ ID NO: 319015 - RNA, 64 nt, hsa
ugccaaccucacugacacagggucauaguguauaauaauauacuguacuauauaauauaucauc

SEQ ID NO: 319016 - RNA, 64 nt, hsa
cagggucauaguguauaauaauauacuguacuauauaauauaucaucuuuagagguaugauuuu

SEQ ID NO: 319017 - RNA, 64 nt, hsa
gcaaugcuaguaacaggaugggaacaugggaaugauaauauauauuuuuucuuuuaauauuuua

SEQ ID NO: 319018 - RNA, 64 nt, hsa
ggcuuucaguuaaaguuuugacuucuuauuauaaauaauauaaagaaugucucaguaauuagaa

SEQ ID NO: 319019 - RNA, 64 nt, hsa
ugcaauuauauaucugauauauauuauauauaaaauaauauaccuaaguguuuuuuuaaacuau

SEQ ID NO: 319020 - RNA, 64 nt, hsa
uuggagaguuuuguauuauggauucaacuuauauauaauauauauaagguacauaauaugcaau

SEQ ID NO: 319021 - RNA, 64 nt, hsa
ggcuggaccacucaguuauuauugcuauuagaaaauaauauaucauguuuacuuuuguucuuca

SEQ ID NO: 319022 - RNA, 64 nt, hsa
auagaaaaauaauuaucuguaaaaaaugaaggggauaauauaugauaaauuauguucugauauc

SEQ ID NO: 319023 - RNA, 64 nt, hsa
uuauauuuuuugaaaucacauauaauuagacuuuauaauauauauacuuuuucauauauaauua

SEQ ID NO: 319024 - RNA, 64 nt, hsa
auccauuuaggauuugugauuuaugucuugaguaauaauauaaagucaacuccagacugauagg

SEQ ID NO: 319025 - RNA, 64 nt, hsa
uuccacuugauguaaacaaaacuuuuuuuuauacauaauauauauauauauauauaaaauaacu

SEQ ID NO: 319026 - RNA, 64 nt, hsa
aacgcagcagaggaaccauaaguagaaucacaggauaauauauacaaauauauauauauacaua

SEQ ID NO: 319027 - RNA, 64 nt, hsa
uuggaucacauacauuuaaggaucauauuauuaaauaauauaugcacagacauggagagaauua

SEQ ID NO: 319028 - RNA, 64 nt, hsa
guacuaaagacuaaaaugcaaaaagcaauacuuaauaauauaacaguuuuauaagaagauguuu

SEQ ID NO: 319029 - RNA, 64 nt, hsa
ugacucuucauauggaaaaauaauaucucccaucauaauauaaaauauuuuucuuaugaauucu

SEQ ID NO: 319030 - RNA, 64 nt, hsa
cagagagaaaagugggguuuuguuuccccaccuaauaauauauccuacaaccagccaaaugcac

SEQ ID NO: 319031 - RNA, 64 nt, hsa
uguguuugaacucugucguguuuaauugguuuauauaauauauguaugcuaucuugauucauga

SEQ ID NO: 319032 - RNA, 64 nt, hsa
cuuguaauuuuaaauuucagcuucacgauauaaaauaauauaagaacuucugguuuacaaaaug

SEQ ID NO: 319033 - RNA, 64 nt, hsa
gaagcagaaaaacauugauuuuuuuauaucuuucauaauauaauuuucuaacaaugcaauaaaa

SEQ ID NO: 319034 - RNA, 64 nt, hsa
aaagaaugaggaaccuguauuccucuucuucgugauaauauaaucucuauuuuuuuaggaaaac

SEQ ID NO: 319035 - RNA, 64 nt, hsa
guuguguuuuuuuuuuuuuuuuugaaauaaaacuauaauauaaauucuccuauuaaauaaaauu

SEQ ID NO: 319036 - RNA, 64 nt, hsa
uaugaauuauuaagcauaugugcuuucgcagcugauaauauaaaaggaaaucccacagucuaga

SEQ ID NO: 319037 - RNA, 64 nt, hsa
uguauacauaugccaaaauaucauuuuguaugccauaauauauaugauuuaugaauuauaguaa

SEQ ID NO: 319038 - RNA, 64 nt, hsa
aaccuauguaaugugauuaaaucaaauuaaauacauaauauauauuuacaaaauaauauaauua

SEQ ID NO: 319039 - RNA, 64 nt, hsa
aaaucaaauuaaauacauaauauauauuuacaaaauaauauaauuaauaaacuuccuacaucua

SEQ ID NO: 319040 - RNA, 64 nt, hsa
aguuucuuucagagaguuaaguuauuuuauauauauaauauauauauaaaauauauaauauaca

SEQ ID NO: 319041 - RNA, 64 nt, hsa
guuauuuuauauauauaauauauauauaaaauauauaauauacaauauaaauauauagugugug

SEQ ID NO: 319042 - RNA, 64 nt, hsa
cguuacaucaaauucaguuuuauauaggccauauauaauauauauuuauaauguauaauuuuua

SEQ ID NO: 319043 - RNA, 64 nt, hsa
caauguccaaucuaaaaacgucccucuuggcucuauaauauaagauacaacucuugcuugguau

SEQ ID NO: 319044 - RNA, 64 nt, hsa
aacaaaaguguacuauguuaugcacacauuacaaauaauauaaggggaaguuuuauuagcuuag

SEQ ID NO: 319045 - RNA, 64 nt, hsa
aaauacaauugaagcaaaaaauaacagcuaguauauaauauauacagucuguauuugcuuuuca

SEQ ID NO: 319046 - RNA, 64 nt, hsa
gugcagagugguaaccaugcuuacacacuaaacuauaauauaaaggaaaugaagccauguuaau

SEQ ID NO: 319047 - RNA, 64 nt, hsa
aauugaggccaaagggcugaucagaauugccuuuauaauauauuugauggaugccuauaaaugu

SEQ ID NO: 319048 - RNA, 64 nt, hsa; identical to SEQ ID NO: 39347

SEQ ID NO: 319049 - RNA, 64 nt, hsa; identical to SEQ ID NO: 39348

SEQ ID NO: 319050 - RNA, 64 nt, hsa; identical to SEQ ID NO: 39349

SEQ ID NO: 319051 - RNA, 64 nt, hsa; identical to SEQ ID NO: 39350

SEQ ID NO: 319052 - RNA, 64 nt, hsa; identical to SEQ ID NO: 39351

SEQ ID NO: 319053 - RNA, 64 nt, hsa; identical to SEQ ID NO: 39352

SEQ ID NO: 319054 - RNA, 64 nt, hsa; identical to SEQ ID NO: 39353

SEQ ID NO: 319055 - RNA, 64 nt, hsa; identical to SEQ ID NO: 39354

SEQ ID NO: 319056 - RNA, 64 nt, hsa; identical to SEQ ID NO: 39355

SEQ ID NO: 319057 - RNA, 64 nt, hsa; identical to SEQ ID NO: 39356

SEQ ID NO: 319058 - RNA, 64 nt, hsa; identical to SEQ ID NO: 39357

SEQ ID NO: 319059 - RNA, 64 nt, hsa; identical to SEQ ID NO: 39358

SEQ ID NO: 319060 - RNA, 64 nt, hsa; identical to SEQ ID NO: 39359

SEQ ID NO: 319061 - RNA, 64 nt, hsa; identical to SEQ ID NO: 39360

SEQ ID NO: 319062 - RNA, 64 nt, hsa; identical to SEQ ID NO: 39361

SEQ ID NO: 319063 - RNA, 64 nt, hsa; identical to SEQ ID NO: 39362

SEQ ID NO: 319064 - RNA, 64 nt, hsa; identical to SEQ ID NO: 39363

SEQ ID NO: 319065 - RNA, 64 nt, hsa; identical to SEQ ID NO: 39364

SEQ ID NO: 319066 - RNA, 64 nt, hsa; identical to SEQ ID NO: 39365

SEQ ID NO: 319067 - RNA, 64 nt, hsa; identical to SEQ ID NO: 39366

SEQ ID NO: 319068 - RNA, 64 nt, hsa; identical to SEQ ID NO: 39367

SEQ ID NO: 319069 - RNA, 64 nt, hsa; identical to SEQ ID NO: 39368

SEQ ID NO: 319070 - RNA, 64 nt, hsa; identical to SEQ ID NO: 39369

SEQ ID NO: 319071 - RNA, 64 nt, hsa; identical to SEQ ID NO: 39370

SEQ ID NO: 319072 - RNA, 64 nt, hsa; identical to SEQ ID NO: 39371

SEQ ID NO: 319073 - RNA, 64 nt, hsa; identical to SEQ ID NO: 39372

SEQ ID NO: 319074 - RNA, 64 nt, hsa; identical to SEQ ID NO: 39373

SEQ ID NO: 319075 - RNA, 64 nt, hsa; identical to SEQ ID NO: 39374

SEQ ID NO: 319076 - RNA, 64 nt, hsa; identical to SEQ ID NO: 39375

SEQ ID NO: 319077 - RNA, 64 nt, hsa; identical to SEQ ID NO: 39376

SEQ ID NO: 319078 - RNA, 64 nt, hsa; identical to SEQ ID NO: 39377

SEQ ID NO: 319079 - RNA, 64 nt, hsa; identical to SEQ ID NO: 39378

SEQ ID NO: 319080 - RNA, 64 nt, hsa; identical to SEQ ID NO: 39379

SEQ ID NO: 319081 - RNA, 64 nt, hsa; identical to SEQ ID NO: 39380

SEQ ID NO: 319082 - RNA, 64 nt, hsa; identical to SEQ ID NO: 39381

SEQ ID NO: 319083 - RNA, 64 nt, hsa; identical to SEQ ID NO: 39382

SEQ ID NO: 319084 - RNA, 64 nt, hsa; identical to SEQ ID NO: 39383

SEQ ID NO: 319085 - RNA, 64 nt, hsa; identical to SEQ ID NO: 39384

SEQ ID NO: 319086 - RNA, 64 nt, hsa; identical to SEQ ID NO: 39385

SEQ ID NO: 319087 - RNA, 64 nt, hsa; identical to SEQ ID NO: 39386

SEQ ID NO: 319088 - RNA, 64 nt, hsa; identical to SEQ ID NO: 39387

SEQ ID NO: 319089 - RNA, 64 nt, hsa; identical to SEQ ID NO: 39388

SEQ ID NO: 319090 - RNA, 64 nt, hsa; identical to SEQ ID NO: 39389

SEQ ID NO: 319091 - RNA, 64 nt, hsa; identical to SEQ ID NO: 39390

SEQ ID NO: 319092 - RNA, 64 nt, hsa; identical to SEQ ID NO: 39391

SEQ ID NO: 319093 - RNA, 64 nt, hsa; identical to SEQ ID NO: 39392

SEQ ID NO: 319094 - RNA, 64 nt, hsa; identical to SEQ ID NO: 39393

SEQ ID NO: 319095 - RNA, 64 nt, hsa; identical to SEQ ID NO: 39394

SEQ ID NO: 319096 - RNA, 64 nt, hsa; identical to SEQ ID NO: 39395

SEQ ID NO: 319097 - RNA, 64 nt, hsa; identical to SEQ ID NO: 39396

SEQ ID NO: 319098 - RNA, 64 nt, hsa; identical to SEQ ID NO: 39397

SEQ ID NO: 319099 - RNA, 64 nt, hsa; identical to SEQ ID NO: 39398

SEQ ID NO: 319100 - RNA, 64 nt, hsa; identical to SEQ ID NO: 39399

SEQ ID NO: 319101 - RNA, 64 nt, hsa; identical to SEQ ID NO: 39400

SEQ ID NO: 319102 - RNA, 64 nt, hsa; identical to SEQ ID NO: 39401

SEQ ID NO: 319103 - RNA, 64 nt, hsa; identical to SEQ ID NO: 39402

SEQ ID NO: 319104 - RNA, 64 nt, hsa; identical to SEQ ID NO: 39403

SEQ ID NO: 319105 - RNA, 64 nt, hsa; identical to SEQ ID NO: 39404

SEQ ID NO: 319106 - RNA, 64 nt, hsa; identical to SEQ ID NO: 39405

SEQ ID NO: 319107 - RNA, 64 nt, hsa; identical to SEQ ID NO: 39406

SEQ ID NO: 319108 - RNA, 64 nt, hsa; identical to SEQ ID NO: 39407

SEQ ID NO: 319109 - RNA, 64 nt, hsa; identical to SEQ ID NO: 39408

SEQ ID NO: 319110 - RNA, 64 nt, hsa; identical to SEQ ID NO: 39409

SEQ ID NO: 319111 - RNA, 64 nt, hsa; identical to SEQ ID NO: 39410

SEQ ID NO: 319112 - RNA, 64 nt, hsa; identical to SEQ ID NO: 39411

SEQ ID NO: 319113 - RNA, 64 nt, hsa; identical to SEQ ID NO: 39412

SEQ ID NO: 319114 - RNA, 64 nt, hsa; identical to SEQ ID NO: 39413

SEQ ID NO: 319115 - RNA, 64 nt, hsa; identical to SEQ ID NO: 39414

SEQ ID NO: 319116 - RNA, 64 nt, hsa; identical to SEQ ID NO: 39415

SEQ ID NO: 319117 - RNA, 64 nt, hsa; identical to SEQ ID NO: 39416

SEQ ID NO: 319118 - RNA, 64 nt, hsa; identical to SEQ ID NO: 39417

SEQ ID NO: 319119 - RNA, 64 nt, hsa; identical to SEQ ID NO: 39418

SEQ ID NO: 319120 - RNA, 64 nt, hsa; identical to SEQ ID NO: 39419

SEQ ID NO: 319121 - RNA, 64 nt, hsa; identical to SEQ ID NO: 39420

SEQ ID NO: 319122 - RNA, 64 nt, hsa; identical to SEQ ID NO: 39421

SEQ ID NO: 319123 - RNA, 64 nt, hsa; identical to SEQ ID NO: 39422

SEQ ID NO: 319124 - RNA, 64 nt, hsa; identical to SEQ ID NO: 39423

SEQ ID NO: 319125 - RNA, 64 nt, hsa; identical to SEQ ID NO: 39424

SEQ ID NO: 319126 - RNA, 64 nt, hsa; identical to SEQ ID NO: 39425

SEQ ID NO: 319127 - RNA, 64 nt, hsa; identical to SEQ ID NO: 39426

SEQ ID NO: 319128 - RNA, 64 nt, hsa; identical to SEQ ID NO: 39427

SEQ ID NO: 319129 - RNA, 64 nt, hsa; identical to SEQ ID NO: 39428

SEQ ID NO: 319130 - RNA, 64 nt, hsa; identical to SEQ ID NO: 39429

SEQ ID NO: 319131 - RNA, 64 nt, hsa; identical to SEQ ID NO: 39430

SEQ ID NO: 319132 - RNA, 64 nt, hsa; identical to SEQ ID NO: 39431

SEQ ID NO: 319133 - RNA, 64 nt, hsa; identical to SEQ ID NO: 39432

SEQ ID NO: 319134 - RNA, 64 nt, hsa; identical to SEQ ID NO: 39433

SEQ ID NO: 319135 - RNA, 64 nt, hsa; identical to SEQ ID NO: 39434

SEQ ID NO: 319136 - RNA, 64 nt, hsa; identical to SEQ ID NO: 39435

SEQ ID NO: 319137 - RNA, 64 nt, hsa; identical to SEQ ID NO: 39436

SEQ ID NO: 319138 - RNA, 64 nt, hsa; identical to SEQ ID NO: 39437

SEQ ID NO: 319139 - RNA, 64 nt, hsa; identical to SEQ ID NO: 39438

SEQ ID NO: 319140 - RNA, 64 nt, hsa; identical to SEQ ID NO: 39439

SEQ ID NO: 319141 - RNA, 64 nt, hsa; identical to SEQ ID NO: 39440

SEQ ID NO: 319142 - RNA, 64 nt, hsa; identical to SEQ ID NO: 39441

SEQ ID NO: 319143 - RNA, 64 nt, hsa; identical to SEQ ID NO: 39442

SEQ ID NO: 319144 - RNA, 64 nt, hsa; identical to SEQ ID NO: 39443

SEQ ID NO: 319145 - RNA, 64 nt, hsa; identical to SEQ ID NO: 39444

SEQ ID NO: 319146 - RNA, 64 nt, hsa; identical to SEQ ID NO: 39445

SEQ ID NO: 319147 - RNA, 64 nt, hsa; identical to SEQ ID NO: 39446

SEQ ID NO: 319148 - RNA, 64 nt, hsa; identical to SEQ ID NO: 39447

SEQ ID NO: 319149 - RNA, 64 nt, hsa; identical to SEQ ID NO: 39448

SEQ ID NO: 319150 - RNA, 64 nt, hsa; identical to SEQ ID NO: 39449

SEQ ID NO: 319151 - RNA, 64 nt, hsa; identical to SEQ ID NO: 39450

SEQ ID NO: 319152 - RNA, 64 nt, hsa; identical to SEQ ID NO: 39451

SEQ ID NO: 319153 - RNA, 64 nt, hsa; identical to SEQ ID NO: 39452

SEQ ID NO: 319154 - RNA, 64 nt, hsa; identical to SEQ ID NO: 39453

SEQ ID NO: 319155 - RNA, 64 nt, hsa; identical to SEQ ID NO: 39454

SEQ ID NO: 319156 - RNA, 64 nt, hsa; identical to SEQ ID NO: 39455

SEQ ID NO: 319157 - RNA, 64 nt, hsa; identical to SEQ ID NO: 39456

SEQ ID NO: 319158 - RNA, 64 nt, hsa; identical to SEQ ID NO: 39457

SEQ ID NO: 319159 - RNA, 64 nt, hsa; identical to SEQ ID NO: 39458

SEQ ID NO: 319160 - RNA, 64 nt, hsa; identical to SEQ ID NO: 39459

SEQ ID NO: 319161 - RNA, 64 nt, hsa; identical to SEQ ID NO: 39460

SEQ ID NO: 319162 - RNA, 64 nt, hsa; identical to SEQ ID NO: 39461

SEQ ID NO: 319163 - RNA, 64 nt, hsa; identical to SEQ ID NO: 39462

SEQ ID NO: 319164 - RNA, 64 nt, hsa; identical to SEQ ID NO: 39463

SEQ ID NO: 319165 - RNA, 64 nt, hsa; identical to SEQ ID NO: 39464

SEQ ID NO: 319166 - RNA, 64 nt, hsa; identical to SEQ ID NO: 39465

SEQ ID NO: 319167 - RNA, 64 nt, hsa; identical to SEQ ID NO: 39466

SEQ ID NO: 319168 - RNA, 64 nt, hsa; identical to SEQ ID NO: 39467

SEQ ID NO: 319169 - RNA, 64 nt, hsa; identical to SEQ ID NO: 39468

SEQ ID NO: 319170 - RNA, 64 nt, hsa; identical to SEQ ID NO: 39469

SEQ ID NO: 319171 - RNA, 64 nt, hsa; identical to SEQ ID NO: 39470

SEQ ID NO: 319172 - RNA, 64 nt, hsa; identical to SEQ ID NO: 39471

SEQ ID NO: 319173 - RNA, 64 nt, hsa; identical to SEQ ID NO: 39472

SEQ ID NO: 319174 - RNA, 64 nt, hsa; identical to SEQ ID NO: 39473

SEQ ID NO: 319175 - RNA, 64 nt, hsa; identical to SEQ ID NO: 39474

SEQ ID NO: 319176 - RNA, 64 nt, hsa; identical to SEQ ID NO: 39475

SEQ ID NO: 319177 - RNA, 64 nt, hsa; identical to SEQ ID NO: 39476

SEQ ID NO: 319178 - RNA, 64 nt, hsa; identical to SEQ ID NO: 39477

SEQ ID NO: 319179 - RNA, 64 nt, hsa; identical to SEQ ID NO: 39478

SEQ ID NO: 319180 - RNA, 64 nt, hsa; identical to SEQ ID NO: 39479

SEQ ID NO: 319181 - RNA, 64 nt, hsa; identical to SEQ ID NO: 39480

SEQ ID NO: 319182 - RNA, 64 nt, hsa; identical to SEQ ID NO: 39481

SEQ ID NO: 319183 - RNA, 64 nt, hsa; identical to SEQ ID NO: 39482

SEQ ID NO: 319184 - RNA, 64 nt, hsa; identical to SEQ ID NO: 39483

SEQ ID NO: 319185 - RNA, 64 nt, hsa; identical to SEQ ID NO: 39484

SEQ ID NO: 319186 - RNA, 64 nt, hsa; identical to SEQ ID NO: 39485

SEQ ID NO: 319187 - RNA, 64 nt, hsa; identical to SEQ ID NO: 39486

SEQ ID NO: 319188 - RNA, 64 nt, hsa; identical to SEQ ID NO: 39487

SEQ ID NO: 319189 - RNA, 64 nt, hsa; identical to SEQ ID NO: 39488

SEQ ID NO: 319190 - RNA, 64 nt, hsa; identical to SEQ ID NO: 39489

SEQ ID NO: 319191 - RNA, 64 nt, hsa; identical to SEQ ID NO: 39490

SEQ ID NO: 319192 - RNA, 64 nt, hsa; identical to SEQ ID NO: 39491

SEQ ID NO: 319193 - RNA, 64 nt, hsa; identical to SEQ ID NO: 39492

SEQ ID NO: 319194 - RNA, 64 nt, hsa; identical to SEQ ID NO: 39493

SEQ ID NO: 319195 - RNA, 64 nt, hsa; identical to SEQ ID NO: 39494

SEQ ID NO: 319196 - RNA, 64 nt, hsa; identical to SEQ ID NO: 39495

SEQ ID NO: 319197 - RNA, 64 nt, hsa; identical to SEQ ID NO: 39496

SEQ ID NO: 319198 - RNA, 64 nt, hsa; identical to SEQ ID NO: 39497

SEQ ID NO: 319199 - RNA, 64 nt, hsa; identical to SEQ ID NO: 39498

SEQ ID NO: 319200 - RNA, 64 nt, hsa; identical to SEQ ID NO: 39499

SEQ ID NO: 319201 - RNA, 64 nt, hsa; identical to SEQ ID NO: 39500

SEQ ID NO: 319202 - RNA, 64 nt, hsa; identical to SEQ ID NO: 39501

SEQ ID NO: 319203 - RNA, 64 nt, hsa; identical to SEQ ID NO: 39502

SEQ ID NO: 319204 - RNA, 64 nt, hsa; identical to SEQ ID NO: 39503

SEQ ID NO: 319205 - RNA, 64 nt, hsa; identical to SEQ ID NO: 39504

SEQ ID NO: 319206 - RNA, 64 nt, hsa; identical to SEQ ID NO: 39505

SEQ ID NO: 319207 - RNA, 64 nt, hsa; identical to SEQ ID NO: 39506

SEQ ID NO: 319208 - RNA, 64 nt, hsa; identical to SEQ ID NO: 39507

SEQ ID NO: 319209 - RNA, 64 nt, hsa; identical to SEQ ID NO: 39508

SEQ ID NO: 319210 - RNA, 64 nt, hsa; identical to SEQ ID NO: 39509

SEQ ID NO: 319211 - RNA, 64 nt, hsa; identical to SEQ ID NO: 39510

SEQ ID NO: 319212 - RNA, 64 nt, hsa; identical to SEQ ID NO: 39511

SEQ ID NO: 319213 - RNA, 64 nt, hsa; identical to SEQ ID NO: 39512

SEQ ID NO: 319214 - RNA, 64 nt, hsa; identical to SEQ ID NO: 39513

SEQ ID NO: 319215 - RNA, 64 nt, hsa; identical to SEQ ID NO: 39514

SEQ ID NO: 319216 - RNA, 64 nt, hsa; identical to SEQ ID NO: 39515

SEQ ID NO: 319217 - RNA, 64 nt, hsa; identical to SEQ ID NO: 39516

SEQ ID NO: 319218 - RNA, 64 nt, hsa; identical to SEQ ID NO: 39517

SEQ ID NO: 319219 - RNA, 64 nt, hsa; identical to SEQ ID NO: 39518

SEQ ID NO: 319220 - RNA, 64 nt, hsa; identical to SEQ ID NO: 39519

SEQ ID NO: 319221 - RNA, 64 nt, hsa; identical to SEQ ID NO: 39520

SEQ ID NO: 319222 - RNA, 64 nt, hsa; identical to SEQ ID NO: 39521

SEQ ID NO: 319223 - RNA, 64 nt, hsa; identical to SEQ ID NO: 39522

SEQ ID NO: 319224 - RNA, 64 nt, hsa; identical to SEQ ID NO: 39523

SEQ ID NO: 319225 - RNA, 64 nt, hsa; identical to SEQ ID NO: 39524

SEQ ID NO: 319226 - RNA, 64 nt, hsa; identical to SEQ ID NO: 39525

SEQ ID NO: 319227 - RNA, 64 nt, hsa; identical to SEQ ID NO: 39526

SEQ ID NO: 319228 - RNA, 64 nt, hsa; identical to SEQ ID NO: 39527

SEQ ID NO: 319229 - RNA, 64 nt, hsa; identical to SEQ ID NO: 39528

SEQ ID NO: 319230 - RNA, 64 nt, hsa; identical to SEQ ID NO: 39529

SEQ ID NO: 319231 - RNA, 64 nt, hsa; identical to SEQ ID NO: 39530

SEQ ID NO: 319232 - RNA, 64 nt, hsa; identical to SEQ ID NO: 39531

SEQ ID NO: 319233 - RNA, 64 nt, hsa; identical to SEQ ID NO: 39532

SEQ ID NO: 319234 - RNA, 64 nt, hsa; identical to SEQ ID NO: 39533

SEQ ID NO: 319235 - RNA, 64 nt, hsa; identical to SEQ ID NO: 39534

SEQ ID NO: 319236 - RNA, 64 nt, hsa; identical to SEQ ID NO: 39535

SEQ ID NO: 319237 - RNA, 64 nt, hsa; identical to SEQ ID NO: 39536

SEQ ID NO: 319238 - RNA, 64 nt, hsa; identical to SEQ ID NO: 39537

SEQ ID NO: 319239 - RNA, 64 nt, hsa; identical to SEQ ID NO: 39538

SEQ ID NO: 319240 - RNA, 64 nt, hsa; identical to SEQ ID NO: 39539

SEQ ID NO: 319241 - RNA, 64 nt, hsa; identical to SEQ ID NO: 39540

SEQ ID NO: 319242 - RNA, 64 nt, hsa; identical to SEQ ID NO: 39541

SEQ ID NO: 319243 - RNA, 64 nt, hsa; identical to SEQ ID NO: 39542

SEQ ID NO: 319244 - RNA, 64 nt, hsa; identical to SEQ ID NO: 39543

SEQ ID NO: 319245 - RNA, 64 nt, hsa; identical to SEQ ID NO: 39544

SEQ ID NO: 319246 - RNA, 64 nt, hsa; identical to SEQ ID NO: 39545

SEQ ID NO: 319247 - RNA, 64 nt, hsa; identical to SEQ ID NO: 39546

SEQ ID NO: 319248 - RNA, 64 nt, hsa; identical to SEQ ID NO: 39547

SEQ ID NO: 319249 - RNA, 64 nt, hsa; identical to SEQ ID NO: 39548

SEQ ID NO: 319250 - RNA, 64 nt, hsa; identical to SEQ ID NO: 39549

SEQ ID NO: 319251 - RNA, 64 nt, hsa; identical to SEQ ID NO: 39550

SEQ ID NO: 319252 - RNA, 64 nt, hsa; identical to SEQ ID NO: 39551

SEQ ID NO: 319253 - RNA, 64 nt, hsa; identical to SEQ ID NO: 39552

SEQ ID NO: 319254 - RNA, 64 nt, hsa; identical to SEQ ID NO: 39553

SEQ ID NO: 319255 - RNA, 64 nt, hsa; identical to SEQ ID NO: 39554

SEQ ID NO: 319256 - RNA, 64 nt, hsa; identical to SEQ ID NO: 39555

SEQ ID NO: 319257 - RNA, 64 nt, hsa; identical to SEQ ID NO: 39556

SEQ ID NO: 319258 - RNA, 64 nt, hsa; identical to SEQ ID NO: 39557

SEQ ID NO: 319259 - RNA, 64 nt, hsa; identical to SEQ ID NO: 39558

SEQ ID NO: 319260 - RNA, 64 nt, hsa; identical to SEQ ID NO: 39559

SEQ ID NO: 319261 - RNA, 64 nt, hsa; identical to SEQ ID NO: 39560

SEQ ID NO: 319262 - RNA, 64 nt, hsa; identical to SEQ ID NO: 39561

SEQ ID NO: 319263 - RNA, 64 nt, hsa; identical to SEQ ID NO: 39562

SEQ ID NO: 319264 - RNA, 64 nt, hsa; identical to SEQ ID NO: 39563

SEQ ID NO: 319265 - RNA, 64 nt, hsa; identical to SEQ ID NO: 39564

SEQ ID NO: 319266 - RNA, 64 nt, hsa; identical to SEQ ID NO: 39565

SEQ ID NO: 319267 - RNA, 64 nt, hsa; identical to SEQ ID NO: 39566

SEQ ID NO: 319268 - RNA, 64 nt, hsa; identical to SEQ ID NO: 39567

SEQ ID NO: 319269 - RNA, 64 nt, hsa; identical to SEQ ID NO: 39568

SEQ ID NO: 319270 - RNA, 64 nt, hsa; identical to SEQ ID NO: 39569

SEQ ID NO: 319271 - RNA, 64 nt, hsa; identical to SEQ ID NO: 39570

SEQ ID NO: 319272 - RNA, 64 nt, hsa; identical to SEQ ID NO: 39571

SEQ ID NO: 319273 - RNA, 64 nt, hsa; identical to SEQ ID NO: 39572

SEQ ID NO: 319274 - RNA, 64 nt, hsa; identical to SEQ ID NO: 39573

SEQ ID NO: 319275 - RNA, 64 nt, hsa; identical to SEQ ID NO: 39574

SEQ ID NO: 319276 - RNA, 64 nt, hsa; identical to SEQ ID NO: 39575

SEQ ID NO: 319277 - RNA, 64 nt, hsa; identical to SEQ ID NO: 39576

SEQ ID NO: 319278 - RNA, 64 nt, hsa; identical to SEQ ID NO: 39577

SEQ ID NO: 319279 - RNA, 64 nt, hsa; identical to SEQ ID NO: 39578

SEQ ID NO: 319280 - RNA, 64 nt, hsa; identical to SEQ ID NO: 39579

SEQ ID NO: 319281 - RNA, 64 nt, hsa; identical to SEQ ID NO: 39580

SEQ ID NO: 319282 - RNA, 64 nt, hsa; identical to SEQ ID NO: 39581

SEQ ID NO: 319283 - RNA, 64 nt, hsa; identical to SEQ ID NO: 39582

SEQ ID NO: 319284 - RNA, 64 nt, hsa; identical to SEQ ID NO: 39583

SEQ ID NO: 319285 - RNA, 64 nt, hsa; identical to SEQ ID NO: 39584

SEQ ID NO: 319286 - RNA, 64 nt, hsa; identical to SEQ ID NO: 39585

SEQ ID NO: 319287 - RNA, 64 nt, hsa; identical to SEQ ID NO: 39586

SEQ ID NO: 319288 - RNA, 64 nt, hsa; identical to SEQ ID NO: 39587

SEQ ID NO: 319289 - RNA, 64 nt, hsa; identical to SEQ ID NO: 39588

SEQ ID NO: 319290 - RNA, 64 nt, hsa; identical to SEQ ID NO: 39589

SEQ ID NO: 319291 - RNA, 64 nt, hsa; identical to SEQ ID NO: 39590

SEQ ID NO: 319292 - RNA, 64 nt, hsa; identical to SEQ ID NO: 39591

SEQ ID NO: 319293 - RNA, 64 nt, hsa; identical to SEQ ID NO: 39592

SEQ ID NO: 319294 - RNA, 64 nt, hsa; identical to SEQ ID NO: 39593

SEQ ID NO: 319295 - RNA, 64 nt, hsa; identical to SEQ ID NO: 39594

SEQ ID NO: 319296 - RNA, 64 nt, hsa; identical to SEQ ID NO: 39595

SEQ ID NO: 319297 - RNA, 64 nt, hsa; identical to SEQ ID NO: 39596

SEQ ID NO: 319298 - RNA, 64 nt, hsa; identical to SEQ ID NO: 39597

SEQ ID NO: 319299 - RNA, 64 nt, hsa; identical to SEQ ID NO: 39598

SEQ ID NO: 319300 - RNA, 64 nt, hsa; identical to SEQ ID NO: 39599

SEQ ID NO: 319301 - RNA, 64 nt, hsa; identical to SEQ ID NO: 39600

SEQ ID NO: 319302 - RNA, 64 nt, hsa; identical to SEQ ID NO: 39601

SEQ ID NO: 319303 - RNA, 64 nt, hsa; identical to SEQ ID NO: 39602

SEQ ID NO: 319304 - RNA, 64 nt, hsa; identical to SEQ ID NO: 39603

SEQ ID NO: 319305 - RNA, 64 nt, hsa; identical to SEQ ID NO: 39604

SEQ ID NO: 319306 - RNA, 64 nt, hsa; identical to SEQ ID NO: 39605

SEQ ID NO: 319307 - RNA, 64 nt, hsa; identical to SEQ ID NO: 39606

SEQ ID NO: 319308 - RNA, 64 nt, hsa; identical to SEQ ID NO: 39607

SEQ ID NO: 319309 - RNA, 64 nt, hsa; identical to SEQ ID NO: 39608

SEQ ID NO: 319310 - RNA, 64 nt, hsa; identical to SEQ ID NO: 39609

SEQ ID NO: 319311 - RNA, 64 nt, hsa; identical to SEQ ID NO: 39610

SEQ ID NO: 319312 - RNA, 64 nt, hsa; identical to SEQ ID NO: 39611

SEQ ID NO: 319313 - RNA, 64 nt, hsa; identical to SEQ ID NO: 39612

SEQ ID NO: 319314 - RNA, 64 nt, hsa; identical to SEQ ID NO: 39613

SEQ ID NO: 319315 - RNA, 64 nt, hsa; identical to SEQ ID NO: 39614

SEQ ID NO: 319316 - RNA, 64 nt, hsa; identical to SEQ ID NO: 39615

SEQ ID NO: 319317 - RNA, 64 nt, hsa; identical to SEQ ID NO: 39616

SEQ ID NO: 319318 - RNA, 64 nt, hsa; identical to SEQ ID NO: 39617

SEQ ID NO: 319319 - RNA, 64 nt, hsa; identical to SEQ ID NO: 39618

SEQ ID NO: 319320 - RNA, 64 nt, hsa; identical to SEQ ID NO: 39619

SEQ ID NO: 319321 - RNA, 64 nt, hsa; identical to SEQ ID NO: 39620

SEQ ID NO: 319322 - RNA, 64 nt, hsa; identical to SEQ ID NO: 39621

SEQ ID NO: 319323 - RNA, 64 nt, hsa; identical to SEQ ID NO: 39622

SEQ ID NO: 319324 - RNA, 64 nt, hsa; identical to SEQ ID NO: 39623

SEQ ID NO: 319325 - RNA, 64 nt, hsa; identical to SEQ ID NO: 39624

SEQ ID NO: 319326 - RNA, 64 nt, hsa; identical to SEQ ID NO: 39625

SEQ ID NO: 319327 - RNA, 64 nt, hsa; identical to SEQ ID NO: 39626

SEQ ID NO: 319328 - RNA, 64 nt, hsa; identical to SEQ ID NO: 39627

SEQ ID NO: 319329 - RNA, 64 nt, hsa; identical to SEQ ID NO: 39628

SEQ ID NO: 319330 - RNA, 64 nt, hsa; identical to SEQ ID NO: 39629

SEQ ID NO: 319331 - RNA, 64 nt, hsa; identical to SEQ ID NO: 39630

SEQ ID NO: 319332 - RNA, 64 nt, hsa; identical to SEQ ID NO: 39631

SEQ ID NO: 319333 - RNA, 64 nt, hsa; identical to SEQ ID NO: 39632

SEQ ID NO: 319334 - RNA, 64 nt, hsa; identical to SEQ ID NO: 39633

SEQ ID NO: 319335 - RNA, 64 nt, hsa; identical to SEQ ID NO: 39634

SEQ ID NO: 319336 - RNA, 64 nt, hsa; identical to SEQ ID NO: 39635

SEQ ID NO: 319337 - RNA, 64 nt, hsa; identical to SEQ ID NO: 39636

SEQ ID NO: 319338 - RNA, 64 nt, hsa; identical to SEQ ID NO: 39637

SEQ ID NO: 319339 - RNA, 64 nt, hsa; identical to SEQ ID NO: 39638

SEQ ID NO: 319340 - RNA, 64 nt, hsa; identical to SEQ ID NO: 39639

SEQ ID NO: 319341 - RNA, 64 nt, hsa; identical to SEQ ID NO: 39640

SEQ ID NO: 319342 - RNA, 64 nt, hsa; identical to SEQ ID NO: 39641

SEQ ID NO: 319343 - RNA, 64 nt, hsa; identical to SEQ ID NO: 39642

SEQ ID NO: 319344 - RNA, 64 nt, hsa; identical to SEQ ID NO: 39643

SEQ ID NO: 319345 - RNA, 64 nt, hsa; identical to SEQ ID NO: 39644

SEQ ID NO: 319346 - RNA, 64 nt, hsa; identical to SEQ ID NO: 39645

SEQ ID NO: 319347 - RNA, 64 nt, hsa; identical to SEQ ID NO: 39646

SEQ ID NO: 319348 - RNA, 64 nt, hsa; identical to SEQ ID NO: 39647

SEQ ID NO: 319349 - RNA, 64 nt, hsa; identical to SEQ ID NO: 39648

SEQ ID NO: 319350 - RNA, 64 nt, hsa; identical to SEQ ID NO: 39649

SEQ ID NO: 319351 - RNA, 64 nt, hsa; identical to SEQ ID NO: 39650

SEQ ID NO: 319352 - RNA, 64 nt, hsa; identical to SEQ ID NO: 39651

SEQ ID NO: 319353 - RNA, 64 nt, hsa; identical to SEQ ID NO: 39652

SEQ ID NO: 319354 - RNA, 64 nt, hsa; identical to SEQ ID NO: 39653

SEQ ID NO: 319355 - RNA, 64 nt, hsa; identical to SEQ ID NO: 39654

SEQ ID NO: 319356 - RNA, 64 nt, hsa; identical to SEQ ID NO: 39655

SEQ ID NO: 319357 - RNA, 64 nt, hsa; identical to SEQ ID NO: 39656

SEQ ID NO: 319358 - RNA, 64 nt, hsa; identical to SEQ ID NO: 39657

SEQ ID NO: 319359 - RNA, 64 nt, hsa; identical to SEQ ID NO: 39658

SEQ ID NO: 319360 - RNA, 64 nt, hsa; identical to SEQ ID NO: 39659

SEQ ID NO: 319361 - RNA, 64 nt, hsa; identical to SEQ ID NO: 39660

SEQ ID NO: 319362 - RNA, 64 nt, hsa; identical to SEQ ID NO: 39661

SEQ ID NO: 319363 - RNA, 64 nt, hsa; identical to SEQ ID NO: 39662

SEQ ID NO: 319364 - RNA, 64 nt, hsa; identical to SEQ ID NO: 39663

SEQ ID NO: 319365 - RNA, 64 nt, hsa; identical to SEQ ID NO: 39664

SEQ ID NO: 319366 - RNA, 64 nt, hsa; identical to SEQ ID NO: 39665

SEQ ID NO: 319367 - RNA, 64 nt, hsa; identical to SEQ ID NO: 39666

SEQ ID NO: 319368 - RNA, 64 nt, hsa; identical to SEQ ID NO: 39667

SEQ ID NO: 319369 - RNA, 64 nt, hsa; identical to SEQ ID NO: 39668

SEQ ID NO: 319370 - RNA, 64 nt, hsa; identical to SEQ ID NO: 39669

SEQ ID NO: 319371 - RNA, 64 nt, hsa; identical to SEQ ID NO: 39670

SEQ ID NO: 319372 - RNA, 64 nt, hsa; identical to SEQ ID NO: 39671

SEQ ID NO: 319373 - RNA, 64 nt, hsa; identical to SEQ ID NO: 39672

SEQ ID NO: 319374 - RNA, 64 nt, hsa; identical to SEQ ID NO: 39673

SEQ ID NO: 319375 - RNA, 64 nt, hsa; identical to SEQ ID NO: 39674

SEQ ID NO: 319376 - RNA, 64 nt, hsa; identical to SEQ ID NO: 39675

SEQ ID NO: 319377 - RNA, 64 nt, hsa; identical to SEQ ID NO: 39676

SEQ ID NO: 319378 - RNA, 64 nt, hsa; identical to SEQ ID NO: 39677

SEQ ID NO: 319379 - RNA, 64 nt, hsa; identical to SEQ ID NO: 39678

SEQ ID NO: 319380 - RNA, 64 nt, hsa; identical to SEQ ID NO: 39679

SEQ ID NO: 319381 - RNA, 64 nt, hsa; identical to SEQ ID NO: 39680

SEQ ID NO: 319382 - RNA, 64 nt, hsa; identical to SEQ ID NO: 39681

SEQ ID NO: 319383 - RNA, 64 nt, hsa; identical to SEQ ID NO: 39682

SEQ ID NO: 319384 - RNA, 64 nt, hsa; identical to SEQ ID NO: 39683

SEQ ID NO: 319385 - RNA, 64 nt, hsa; identical to SEQ ID NO: 39684

SEQ ID NO: 319386 - RNA, 64 nt, hsa; identical to SEQ ID NO: 39685

SEQ ID NO: 319387 - RNA, 64 nt, hsa; identical to SEQ ID NO: 39686

SEQ ID NO: 319388 - RNA, 64 nt, hsa; identical to SEQ ID NO: 39687

SEQ ID NO: 319389 - RNA, 64 nt, hsa; identical to SEQ ID NO: 39688

SEQ ID NO: 319390 - RNA, 64 nt, hsa; identical to SEQ ID NO: 39689

SEQ ID NO: 319391 - RNA, 64 nt, hsa; identical to SEQ ID NO: 39690

SEQ ID NO: 319392 - RNA, 64 nt, hsa; identical to SEQ ID NO: 39691

SEQ ID NO: 319393 - RNA, 64 nt, hsa; identical to SEQ ID NO: 39692

SEQ ID NO: 319394 - RNA, 64 nt, hsa; identical to SEQ ID NO: 39693

SEQ ID NO: 319395 - RNA, 64 nt, hsa; identical to SEQ ID NO: 39694

SEQ ID NO: 319396 - RNA, 64 nt, hsa; identical to SEQ ID NO: 39695

SEQ ID NO: 319397 - RNA, 64 nt, hsa; identical to SEQ ID NO: 39696

SEQ ID NO: 319398 - RNA, 64 nt, hsa; identical to SEQ ID NO: 39697

SEQ ID NO: 319399 - RNA, 64 nt, hsa; identical to SEQ ID NO: 39698

SEQ ID NO: 319400 - RNA, 64 nt, hsa; identical to SEQ ID NO: 39699

SEQ ID NO: 319401 - RNA, 64 nt, hsa; identical to SEQ ID NO: 39700

SEQ ID NO: 319402 - RNA, 64 nt, hsa; identical to SEQ ID NO: 39701

SEQ ID NO: 319403 - RNA, 64 nt, hsa; identical to SEQ ID NO: 39702

SEQ ID NO: 319404 - RNA, 64 nt, hsa; identical to SEQ ID NO: 39703

SEQ ID NO: 319405 - RNA, 64 nt, hsa; identical to SEQ ID NO: 39704

SEQ ID NO: 319406 - RNA, 64 nt, hsa; identical to SEQ ID NO: 39705

SEQ ID NO: 319407 - RNA, 64 nt, hsa; identical to SEQ ID NO: 39706

SEQ ID NO: 319408 - RNA, 64 nt, hsa; identical to SEQ ID NO: 39707

SEQ ID NO: 319409 - RNA, 64 nt, hsa; identical to SEQ ID NO: 39708

SEQ ID NO: 319410 - RNA, 64 nt, hsa; identical to SEQ ID NO: 39709

SEQ ID NO: 319411 - RNA, 64 nt, hsa; identical to SEQ ID NO: 39710

SEQ ID NO: 319412 - RNA, 64 nt, hsa; identical to SEQ ID NO: 39711

SEQ ID NO: 319413 - RNA, 64 nt, hsa; identical to SEQ ID NO: 39712

SEQ ID NO: 319414 - RNA, 64 nt, hsa; identical to SEQ ID NO: 39713

SEQ ID NO: 319415 - RNA, 64 nt, hsa; identical to SEQ ID NO: 39714

SEQ ID NO: 319416 - RNA, 64 nt, hsa; identical to SEQ ID NO: 39715

SEQ ID NO: 319417 - RNA, 64 nt, hsa; identical to SEQ ID NO: 39716

SEQ ID NO: 319418 - RNA, 64 nt, hsa; identical to SEQ ID NO: 39717

SEQ ID NO: 319419 - RNA, 64 nt, hsa; identical to SEQ ID NO: 39718

SEQ ID NO: 319420 - RNA, 64 nt, hsa; identical to SEQ ID NO: 39719

SEQ ID NO: 319421 - RNA, 64 nt, hsa; identical to SEQ ID NO: 39720

SEQ ID NO: 319422 - RNA, 64 nt, hsa; identical to SEQ ID NO: 39721

SEQ ID NO: 319423 - RNA, 64 nt, hsa; identical to SEQ ID NO: 39722

SEQ ID NO: 319424 - RNA, 64 nt, hsa; identical to SEQ ID NO: 39723

SEQ ID NO: 319425 - RNA, 64 nt, hsa; identical to SEQ ID NO: 39724

SEQ ID NO: 319426 - RNA, 64 nt, hsa; identical to SEQ ID NO: 39725

SEQ ID NO: 319427 - RNA, 64 nt, hsa; identical to SEQ ID NO: 39726

SEQ ID NO: 319428 - RNA, 64 nt, hsa; identical to SEQ ID NO: 39727

SEQ ID NO: 319429 - RNA, 64 nt, hsa; identical to SEQ ID NO: 39728

SEQ ID NO: 319430 - RNA, 64 nt, hsa; identical to SEQ ID NO: 39729

SEQ ID NO: 319431 - RNA, 64 nt, hsa; identical to SEQ ID NO: 39730

SEQ ID NO: 319432 - RNA, 64 nt, hsa; identical to SEQ ID NO: 39731

SEQ ID NO: 319433 - RNA, 64 nt, hsa; identical to SEQ ID NO: 39732

SEQ ID NO: 319434 - RNA, 64 nt, hsa; identical to SEQ ID NO: 39733

SEQ ID NO: 319435 - RNA, 64 nt, hsa; identical to SEQ ID NO: 39734

SEQ ID NO: 319436 - RNA, 64 nt, hsa; identical to SEQ ID NO: 39735

SEQ ID NO: 319437 - RNA, 64 nt, hsa; identical to SEQ ID NO: 39736

SEQ ID NO: 319438 - RNA, 64 nt, hsa; identical to SEQ ID NO: 39737

SEQ ID NO: 319439 - RNA, 64 nt, hsa; identical to SEQ ID NO: 39738

SEQ ID NO: 319440 - RNA, 64 nt, hsa; identical to SEQ ID NO: 39739

SEQ ID NO: 319441 - RNA, 64 nt, hsa; identical to SEQ ID NO: 39740

SEQ ID NO: 319442 - RNA, 64 nt, hsa; identical to SEQ ID NO: 39741

SEQ ID NO: 319443 - RNA, 64 nt, hsa; identical to SEQ ID NO: 39742

SEQ ID NO: 319444 - RNA, 64 nt, hsa; identical to SEQ ID NO: 39743

SEQ ID NO: 319445 - RNA, 64 nt, hsa; identical to SEQ ID NO: 39744

SEQ ID NO: 319446 - RNA, 64 nt, hsa; identical to SEQ ID NO: 39745

SEQ ID NO: 319447 - RNA, 64 nt, hsa; identical to SEQ ID NO: 39746

SEQ ID NO: 319448 - RNA, 64 nt, hsa; identical to SEQ ID NO: 39747

SEQ ID NO: 319449 - RNA, 64 nt, hsa; identical to SEQ ID NO: 39748

SEQ ID NO: 319450 - RNA, 64 nt, hsa; identical to SEQ ID NO: 39749

SEQ ID NO: 319451 - RNA, 64 nt, hsa; identical to SEQ ID NO: 39750

SEQ ID NO: 319452 - RNA, 64 nt, hsa; identical to SEQ ID NO: 39751

SEQ ID NO: 319453 - RNA, 64 nt, hsa; identical to SEQ ID NO: 39752

SEQ ID NO: 319454 - RNA, 64 nt, hsa; identical to SEQ ID NO: 39753

SEQ ID NO: 319455 - RNA, 64 nt, hsa; identical to SEQ ID NO: 39754

SEQ ID NO: 319456 - RNA, 64 nt, hsa; identical to SEQ ID NO: 39755

SEQ ID NO: 319457 - RNA, 64 nt, hsa; identical to SEQ ID NO: 39756

SEQ ID NO: 319458 - RNA, 64 nt, hsa; identical to SEQ ID NO: 39757

SEQ ID NO: 319459 - RNA, 64 nt, hsa; identical to SEQ ID NO: 39758

SEQ ID NO: 319460 - RNA, 64 nt, hsa; identical to SEQ ID NO: 39759

SEQ ID NO: 319461 - RNA, 64 nt, hsa; identical to SEQ ID NO: 39760

SEQ ID NO: 319462 - RNA, 64 nt, hsa; identical to SEQ ID NO: 39761

SEQ ID NO: 319463 - RNA, 64 nt, hsa; identical to SEQ ID NO: 39762

SEQ ID NO: 319464 - RNA, 64 nt, hsa; identical to SEQ ID NO: 39763

SEQ ID NO: 319465 - RNA, 64 nt, hsa; identical to SEQ ID NO: 39764

SEQ ID NO: 319466 - RNA, 64 nt, hsa; identical to SEQ ID NO: 39765

SEQ ID NO: 319467 - RNA, 64 nt, hsa; identical to SEQ ID NO: 39766

SEQ ID NO: 319468 - RNA, 64 nt, hsa; identical to SEQ ID NO: 39767

SEQ ID NO: 319469 - RNA, 64 nt, hsa; identical to SEQ ID NO: 39768

SEQ ID NO: 319470 - RNA, 64 nt, hsa; identical to SEQ ID NO: 39769

SEQ ID NO: 319471 - RNA, 64 nt, hsa; identical to SEQ ID NO: 39770

SEQ ID NO: 319472 - RNA, 64 nt, hsa; identical to SEQ ID NO: 39771

SEQ ID NO: 319473 - RNA, 64 nt, hsa; identical to SEQ ID NO: 39772

SEQ ID NO: 319474 - RNA, 64 nt, hsa; identical to SEQ ID NO: 39773

SEQ ID NO: 319475 - RNA, 64 nt, hsa; identical to SEQ ID NO: 39774

SEQ ID NO: 319476 - RNA, 64 nt, hsa; identical to SEQ ID NO: 39775

SEQ ID NO: 319477 - RNA, 64 nt, hsa; identical to SEQ ID NO: 39776

SEQ ID NO: 319478 - RNA, 64 nt, hsa; identical to SEQ ID NO: 39777

SEQ ID NO: 319479 - RNA, 64 nt, hsa; identical to SEQ ID NO: 39778

SEQ ID NO: 319480 - RNA, 64 nt, hsa; identical to SEQ ID NO: 39779

SEQ ID NO: 319481 - RNA, 64 nt, hsa; identical to SEQ ID NO: 39780

SEQ ID NO: 319482 - RNA, 64 nt, hsa; identical to SEQ ID NO: 39781

SEQ ID NO: 319483 - RNA, 64 nt, hsa; identical to SEQ ID NO: 39782

SEQ ID NO: 319484 - RNA, 64 nt, hsa; identical to SEQ ID NO: 39783

SEQ ID NO: 319485 - RNA, 64 nt, hsa; identical to SEQ ID NO: 39784

SEQ ID NO: 319486 - RNA, 64 nt, hsa; identical to SEQ ID NO: 39785

SEQ ID NO: 319487 - RNA, 64 nt, hsa; identical to SEQ ID NO: 39786

SEQ ID NO: 319488 - RNA, 64 nt, hsa; identical to SEQ ID NO: 39787

SEQ ID NO: 319489 - RNA, 64 nt, hsa; identical to SEQ ID NO: 39788

SEQ ID NO: 319490 - RNA, 64 nt, hsa; identical to SEQ ID NO: 39789

SEQ ID NO: 319491 - RNA, 64 nt, hsa; identical to SEQ ID NO: 39790

SEQ ID NO: 319492 - RNA, 64 nt, hsa; identical to SEQ ID NO: 39791

SEQ ID NO: 319493 - RNA, 64 nt, hsa; identical to SEQ ID NO: 39792

SEQ ID NO: 319494 - RNA, 64 nt, hsa; identical to SEQ ID NO: 39793

SEQ ID NO: 319495 - RNA, 64 nt, hsa; identical to SEQ ID NO: 39794

SEQ ID NO: 319496 - RNA, 64 nt, hsa; identical to SEQ ID NO: 39795

SEQ ID NO: 319497 - RNA, 64 nt, hsa; identical to SEQ ID NO: 39796

SEQ ID NO: 319498 - RNA, 64 nt, hsa; identical to SEQ ID NO: 39797

SEQ ID NO: 319499 - RNA, 64 nt, hsa; identical to SEQ ID NO: 39798

SEQ ID NO: 319500 - RNA, 64 nt, hsa; identical to SEQ ID NO: 39799

SEQ ID NO: 319501 - RNA, 64 nt, hsa; identical to SEQ ID NO: 39800

SEQ ID NO: 319502 - RNA, 64 nt, hsa; identical to SEQ ID NO: 39801

SEQ ID NO: 319503 - RNA, 64 nt, hsa; identical to SEQ ID NO: 39802

SEQ ID NO: 319504 - RNA, 64 nt, hsa; identical to SEQ ID NO: 39803

SEQ ID NO: 319505 - RNA, 64 nt, hsa; identical to SEQ ID NO: 39804

SEQ ID NO: 319506 - RNA, 64 nt, hsa; identical to SEQ ID NO: 39805

SEQ ID NO: 319507 - RNA, 64 nt, hsa; identical to SEQ ID NO: 39806

SEQ ID NO: 319508 - RNA, 64 nt, hsa; identical to SEQ ID NO: 39807

SEQ ID NO: 319509 - RNA, 64 nt, hsa; identical to SEQ ID NO: 39808

SEQ ID NO: 319510 - RNA, 64 nt, hsa; identical to SEQ ID NO: 39809

SEQ ID NO: 319511 - RNA, 64 nt, hsa; identical to SEQ ID NO: 39810

SEQ ID NO: 319512 - RNA, 64 nt, hsa; identical to SEQ ID NO: 39811

SEQ ID NO: 319513 - RNA, 64 nt, hsa; identical to SEQ ID NO: 39812

SEQ ID NO: 319514 - RNA, 64 nt, hsa; identical to SEQ ID NO: 39813

SEQ ID NO: 319515 - RNA, 64 nt, hsa; identical to SEQ ID NO: 39814

SEQ ID NO: 319516 - RNA, 64 nt, hsa; identical to SEQ ID NO: 39815

SEQ ID NO: 319517 - RNA, 64 nt, hsa; identical to SEQ ID NO: 39816

SEQ ID NO: 319518 - RNA, 64 nt, hsa; identical to SEQ ID NO: 39817

SEQ ID NO: 319519 - RNA, 64 nt, hsa; identical to SEQ ID NO: 39818

SEQ ID NO: 319520 - RNA, 64 nt, hsa; identical to SEQ ID NO: 39819

SEQ ID NO: 319521 - RNA, 64 nt, hsa; identical to SEQ ID NO: 39820

SEQ ID NO: 319522 - RNA, 64 nt, hsa; identical to SEQ ID NO: 39821

SEQ ID NO: 319523 - RNA, 64 nt, hsa; identical to SEQ ID NO: 39822

SEQ ID NO: 319524 - RNA, 64 nt, hsa; identical to SEQ ID NO: 39823

SEQ ID NO: 319525 - RNA, 64 nt, hsa; identical to SEQ ID NO: 39824

SEQ ID NO: 319526 - RNA, 64 nt, hsa; identical to SEQ ID NO: 39825

SEQ ID NO: 319527 - RNA, 64 nt, hsa; identical to SEQ ID NO: 39826

SEQ ID NO: 319528 - RNA, 64 nt, hsa; identical to SEQ ID NO: 39827

SEQ ID NO: 319529 - RNA, 64 nt, hsa; identical to SEQ ID NO: 39828

SEQ ID NO: 319530 - RNA, 64 nt, hsa; identical to SEQ ID NO: 39829

SEQ ID NO: 319531 - RNA, 64 nt, hsa; identical to SEQ ID NO: 39830

SEQ ID NO: 319532 - RNA, 64 nt, hsa; identical to SEQ ID NO: 39831

SEQ ID NO: 319533 - RNA, 64 nt, hsa; identical to SEQ ID NO: 39832

SEQ ID NO: 319534 - RNA, 64 nt, hsa; identical to SEQ ID NO: 39833

SEQ ID NO: 319535 - RNA, 64 nt, hsa; identical to SEQ ID NO: 39834

SEQ ID NO: 319536 - RNA, 64 nt, hsa; identical to SEQ ID NO: 39835

SEQ ID NO: 319537 - RNA, 64 nt, hsa; identical to SEQ ID NO: 39836

SEQ ID NO: 319538 - RNA, 64 nt, hsa; identical to SEQ ID NO: 39837

SEQ ID NO: 319539 - RNA, 64 nt, hsa; identical to SEQ ID NO: 39838

SEQ ID NO: 319540 - RNA, 64 nt, hsa; identical to SEQ ID NO: 39839

SEQ ID NO: 319541 - RNA, 64 nt, hsa; identical to SEQ ID NO: 39840

SEQ ID NO: 319542 - RNA, 64 nt, hsa; identical to SEQ ID NO: 39841

SEQ ID NO: 319543 - RNA, 64 nt, hsa; identical to SEQ ID NO: 39842

SEQ ID NO: 319544 - RNA, 64 nt, hsa; identical to SEQ ID NO: 39843

SEQ ID NO: 319545 - RNA, 64 nt, hsa; identical to SEQ ID NO: 39844

SEQ ID NO: 319546 - RNA, 64 nt, hsa; identical to SEQ ID NO: 39845

SEQ ID NO: 319547 - RNA, 64 nt, hsa; identical to SEQ ID NO: 39846

SEQ ID NO: 319548 - RNA, 64 nt, hsa; identical to SEQ ID NO: 39847

SEQ ID NO: 319549 - RNA, 64 nt, hsa; identical to SEQ ID NO: 39848

SEQ ID NO: 319550 - RNA, 64 nt, hsa; identical to SEQ ID NO: 39849

SEQ ID NO: 319551 - RNA, 64 nt, hsa; identical to SEQ ID NO: 39850

SEQ ID NO: 319552 - RNA, 64 nt, hsa; identical to SEQ ID NO: 39851

SEQ ID NO: 319553 - RNA, 64 nt, hsa; identical to SEQ ID NO: 39852

SEQ ID NO: 319554 - RNA, 64 nt, hsa; identical to SEQ ID NO: 39853

SEQ ID NO: 319555 - RNA, 64 nt, hsa; identical to SEQ ID NO: 39854

SEQ ID NO: 319556 - RNA, 64 nt, hsa; identical to SEQ ID NO: 39855

SEQ ID NO: 319557 - RNA, 64 nt, hsa; identical to SEQ ID NO: 39856

SEQ ID NO: 319558 - RNA, 64 nt, hsa; identical to SEQ ID NO: 39857

SEQ ID NO: 319559 - RNA, 64 nt, hsa; identical to SEQ ID NO: 39858

SEQ ID NO: 319560 - RNA, 64 nt, hsa; identical to SEQ ID NO: 39859

SEQ ID NO: 319561 - RNA, 64 nt, hsa; identical to SEQ ID NO: 39860

SEQ ID NO: 319562 - RNA, 64 nt, hsa; identical to SEQ ID NO: 39861

SEQ ID NO: 319563 - RNA, 64 nt, hsa; identical to SEQ ID NO: 39862

SEQ ID NO: 319564 - RNA, 64 nt, hsa; identical to SEQ ID NO: 39863

SEQ ID NO: 319565 - RNA, 64 nt, hsa; identical to SEQ ID NO: 39864

SEQ ID NO: 319566 - RNA, 64 nt, hsa; identical to SEQ ID NO: 39865

SEQ ID NO: 319567 - RNA, 64 nt, hsa; identical to SEQ ID NO: 39866

SEQ ID NO: 319568 - RNA, 64 nt, hsa; identical to SEQ ID NO: 39867

SEQ ID NO: 319569 - RNA, 64 nt, hsa; identical to SEQ ID NO: 39868

SEQ ID NO: 319570 - RNA, 64 nt, hsa; identical to SEQ ID NO: 39869

SEQ ID NO: 319571 - RNA, 64 nt, hsa; identical to SEQ ID NO: 39870

SEQ ID NO: 319572 - RNA, 64 nt, hsa; identical to SEQ ID NO: 39871

SEQ ID NO: 319573 - RNA, 64 nt, hsa; identical to SEQ ID NO: 39872

SEQ ID NO: 319574 - RNA, 64 nt, hsa; identical to SEQ ID NO: 39873

SEQ ID NO: 319575 - RNA, 64 nt, hsa; identical to SEQ ID NO: 39874

SEQ ID NO: 319576 - RNA, 64 nt, hsa; identical to SEQ ID NO: 39875

SEQ ID NO: 319577 - RNA, 64 nt, hsa; identical to SEQ ID NO: 39876

SEQ ID NO: 319578 - RNA, 64 nt, hsa; identical to SEQ ID NO: 39877

SEQ ID NO: 319579 - RNA, 64 nt, hsa; identical to SEQ ID NO: 39878

SEQ ID NO: 319580 - RNA, 64 nt, hsa; identical to SEQ ID NO: 39879

SEQ ID NO: 319581 - RNA, 64 nt, hsa; identical to SEQ ID NO: 39880

SEQ ID NO: 319582 - RNA, 64 nt, hsa; identical to SEQ ID NO: 39881

SEQ ID NO: 319583 - RNA, 64 nt, hsa; identical to SEQ ID NO: 39882

SEQ ID NO: 319584 - RNA, 64 nt, hsa; identical to SEQ ID NO: 39883

SEQ ID NO: 319585 - RNA, 64 nt, hsa; identical to SEQ ID NO: 39884

SEQ ID NO: 319586 - RNA, 64 nt, hsa; identical to SEQ ID NO: 39885

SEQ ID NO: 319587 - RNA, 64 nt, hsa; identical to SEQ ID NO: 39886

SEQ ID NO: 319588 - RNA, 64 nt, hsa; identical to SEQ ID NO: 39887

SEQ ID NO: 319589 - RNA, 64 nt, hsa; identical to SEQ ID NO: 39888

SEQ ID NO: 319590 - RNA, 64 nt, hsa; identical to SEQ ID NO: 39889

SEQ ID NO: 319591 - RNA, 64 nt, hsa; identical to SEQ ID NO: 39890

SEQ ID NO: 319592 - RNA, 64 nt, hsa; identical to SEQ ID NO: 39891

SEQ ID NO: 319593 - RNA, 64 nt, hsa; identical to SEQ ID NO: 39892

SEQ ID NO: 319594 - RNA, 64 nt, hsa; identical to SEQ ID NO: 39893

SEQ ID NO: 319595 - RNA, 64 nt, hsa; identical to SEQ ID NO: 39894

SEQ ID NO: 319596 - RNA, 64 nt, hsa; identical to SEQ ID NO: 39895

SEQ ID NO: 319597 - RNA, 64 nt, hsa; identical to SEQ ID NO: 39896

SEQ ID NO: 319598 - RNA, 64 nt, hsa; identical to SEQ ID NO: 39897

SEQ ID NO: 319599 - RNA, 64 nt, hsa; identical to SEQ ID NO: 39898

SEQ ID NO: 319600 - RNA, 64 nt, hsa; identical to SEQ ID NO: 39899

SEQ ID NO: 319601 - RNA, 64 nt, hsa; identical to SEQ ID NO: 39900

SEQ ID NO: 319602 - RNA, 64 nt, hsa; identical to SEQ ID NO: 39901

SEQ ID NO: 319603 - RNA, 64 nt, hsa; identical to SEQ ID NO: 39902

SEQ ID NO: 319604 - RNA, 64 nt, hsa; identical to SEQ ID NO: 39903

SEQ ID NO: 319605 - RNA, 64 nt, hsa; identical to SEQ ID NO: 39904

SEQ ID NO: 319606 - RNA, 64 nt, hsa; identical to SEQ ID NO: 39905

SEQ ID NO: 319607 - RNA, 64 nt, hsa; identical to SEQ ID NO: 39906

SEQ ID NO: 319608 - RNA, 64 nt, hsa; identical to SEQ ID NO: 39907

SEQ ID NO: 319609 - RNA, 64 nt, hsa; identical to SEQ ID NO: 39908

SEQ ID NO: 319610 - RNA, 64 nt, hsa; identical to SEQ ID NO: 39909

SEQ ID NO: 319611 - RNA, 64 nt, hsa; identical to SEQ ID NO: 39910

SEQ ID NO: 319612 - RNA, 64 nt, hsa; identical to SEQ ID NO: 39911

SEQ ID NO: 319613 - RNA, 64 nt, hsa; identical to SEQ ID NO: 39912

SEQ ID NO: 319614 - RNA, 64 nt, hsa; identical to SEQ ID NO: 39913

SEQ ID NO: 319615 - RNA, 64 nt, hsa; identical to SEQ ID NO: 39914

SEQ ID NO: 319616 - RNA, 64 nt, hsa; identical to SEQ ID NO: 39915

SEQ ID NO: 319617 - RNA, 64 nt, hsa; identical to SEQ ID NO: 39916

SEQ ID NO: 319618 - RNA, 64 nt, hsa; identical to SEQ ID NO: 39917

SEQ ID NO: 319619 - RNA, 64 nt, hsa; identical to SEQ ID NO: 39918

SEQ ID NO: 319620 - RNA, 64 nt, hsa; identical to SEQ ID NO: 39919

SEQ ID NO: 319621 - RNA, 64 nt, hsa; identical to SEQ ID NO: 39920

SEQ ID NO: 319622 - RNA, 64 nt, hsa; identical to SEQ ID NO: 39921

SEQ ID NO: 319623 - RNA, 64 nt, hsa; identical to SEQ ID NO: 39922

SEQ ID NO: 319624 - RNA, 64 nt, hsa; identical to SEQ ID NO: 39923

SEQ ID NO: 319625 - RNA, 64 nt, hsa; identical to SEQ ID NO: 39924

SEQ ID NO: 319626 - RNA, 64 nt, hsa; identical to SEQ ID NO: 39925

SEQ ID NO: 319627 - RNA, 64 nt, hsa; identical to SEQ ID NO: 39926

SEQ ID NO: 319628 - RNA, 64 nt, hsa; identical to SEQ ID NO: 39927

SEQ ID NO: 319629 - RNA, 64 nt, hsa; identical to SEQ ID NO: 39928

SEQ ID NO: 319630 - RNA, 64 nt, hsa; identical to SEQ ID NO: 39929

SEQ ID NO: 319631 - RNA, 64 nt, hsa; identical to SEQ ID NO: 39930

SEQ ID NO: 319632 - RNA, 64 nt, hsa; identical to SEQ ID NO: 39931

SEQ ID NO: 319633 - RNA, 64 nt, hsa; identical to SEQ ID NO: 39932

SEQ ID NO: 319634 - RNA, 64 nt, hsa; identical to SEQ ID NO: 39933

SEQ ID NO: 319635 - RNA, 64 nt, hsa; identical to SEQ ID NO: 39934

SEQ ID NO: 319636 - RNA, 64 nt, hsa; identical to SEQ ID NO: 39935

SEQ ID NO: 319637 - RNA, 64 nt, hsa; identical to SEQ ID NO: 39936

SEQ ID NO: 319638 - RNA, 64 nt, hsa; identical to SEQ ID NO: 39937

SEQ ID NO: 319639 - RNA, 64 nt, hsa; identical to SEQ ID NO: 39938

SEQ ID NO: 319640 - RNA, 64 nt, hsa; identical to SEQ ID NO: 39939

SEQ ID NO: 319641 - RNA, 64 nt, hsa; identical to SEQ ID NO: 39940

SEQ ID NO: 319642 - RNA, 64 nt, hsa; identical to SEQ ID NO: 39941

SEQ ID NO: 319643 - RNA, 64 nt, hsa; identical to SEQ ID NO: 39942

SEQ ID NO: 319644 - RNA, 64 nt, hsa; identical to SEQ ID NO: 39943

SEQ ID NO: 319645 - RNA, 64 nt, hsa; identical to SEQ ID NO: 39944

SEQ ID NO: 319646 - RNA, 64 nt, hsa; identical to SEQ ID NO: 39945

SEQ ID NO: 319647 - RNA, 64 nt, hsa; identical to SEQ ID NO: 39946

SEQ ID NO: 319648 - RNA, 64 nt, hsa; identical to SEQ ID NO: 39947

SEQ ID NO: 319649 - RNA, 64 nt, hsa; identical to SEQ ID NO: 39948

SEQ ID NO: 319650 - RNA, 64 nt, hsa; identical to SEQ ID NO: 39949

SEQ ID NO: 319651 - RNA, 64 nt, hsa; identical to SEQ ID NO: 39950

SEQ ID NO: 319652 - RNA, 64 nt, hsa; identical to SEQ ID NO: 39951

SEQ ID NO: 319653 - RNA, 64 nt, hsa; identical to SEQ ID NO: 39952

SEQ ID NO: 319654 - RNA, 64 nt, hsa; identical to SEQ ID NO: 39953

SEQ ID NO: 319655 - RNA, 64 nt, hsa; identical to SEQ ID NO: 39954

SEQ ID NO: 319656 - RNA, 64 nt, hsa; identical to SEQ ID NO: 39955

SEQ ID NO: 319657 - RNA, 64 nt, hsa; identical to SEQ ID NO: 39956

SEQ ID NO: 319658 - RNA, 64 nt, hsa; identical to SEQ ID NO: 39957

SEQ ID NO: 319659 - RNA, 64 nt, hsa; identical to SEQ ID NO: 39958

SEQ ID NO: 319660 - RNA, 64 nt, hsa; identical to SEQ ID NO: 39959

SEQ ID NO: 319661 - RNA, 64 nt, hsa; identical to SEQ ID NO: 39960

SEQ ID NO: 319662 - RNA, 64 nt, hsa; identical to SEQ ID NO: 39961

SEQ ID NO: 319663 - RNA, 64 nt, hsa; identical to SEQ ID NO: 39962

SEQ ID NO: 319664 - RNA, 64 nt, hsa; identical to SEQ ID NO: 39963

SEQ ID NO: 319665 - RNA, 64 nt, hsa; identical to SEQ ID NO: 39964

SEQ ID NO: 319666 - RNA, 64 nt, hsa; identical to SEQ ID NO: 39965

SEQ ID NO: 319667 - RNA, 64 nt, hsa; identical to SEQ ID NO: 39966

SEQ ID NO: 319668 - RNA, 64 nt, hsa; identical to SEQ ID NO: 39967

SEQ ID NO: 319669 - RNA, 64 nt, hsa; identical to SEQ ID NO: 39968

SEQ ID NO: 319670 - RNA, 64 nt, hsa; identical to SEQ ID NO: 39969

SEQ ID NO: 319671 - RNA, 64 nt, hsa; identical to SEQ ID NO: 39970

SEQ ID NO: 319672 - RNA, 64 nt, hsa; identical to SEQ ID NO: 39971

SEQ ID NO: 319673 - RNA, 64 nt, hsa; identical to SEQ ID NO: 39972

SEQ ID NO: 319674 - RNA, 64 nt, hsa; identical to SEQ ID NO: 39973

SEQ ID NO: 319675 - RNA, 64 nt, hsa; identical to SEQ ID NO: 39974

SEQ ID NO: 319676 - RNA, 64 nt, hsa; identical to SEQ ID NO: 39975

SEQ ID NO: 319677 - RNA, 64 nt, hsa; identical to SEQ ID NO: 39976

SEQ ID NO: 319678 - RNA, 64 nt, hsa; identical to SEQ ID NO: 39977

SEQ ID NO: 319679 - RNA, 64 nt, hsa; identical to SEQ ID NO: 39978

SEQ ID NO: 319680 - RNA, 64 nt, hsa; identical to SEQ ID NO: 39979

SEQ ID NO: 319681 - RNA, 64 nt, hsa; identical to SEQ ID NO: 39980

SEQ ID NO: 319682 - RNA, 64 nt, hsa; identical to SEQ ID NO: 39981

SEQ ID NO: 319683 - RNA, 64 nt, hsa; identical to SEQ ID NO: 39982

SEQ ID NO: 319684 - RNA, 64 nt, hsa; identical to SEQ ID NO: 39983

SEQ ID NO: 319685 - RNA, 64 nt, hsa; identical to SEQ ID NO: 39984

SEQ ID NO: 319686 - RNA, 64 nt, hsa; identical to SEQ ID NO: 39985

SEQ ID NO: 319687 - RNA, 64 nt, hsa; identical to SEQ ID NO: 39986

SEQ ID NO: 319688 - RNA, 64 nt, hsa; identical to SEQ ID NO: 39987

SEQ ID NO: 319689 - RNA, 64 nt, hsa; identical to SEQ ID NO: 39988

SEQ ID NO: 319690 - RNA, 64 nt, hsa; identical to SEQ ID NO: 39989

SEQ ID NO: 319691 - RNA, 64 nt, hsa; identical to SEQ ID NO: 39990

SEQ ID NO: 319692 - RNA, 64 nt, hsa; identical to SEQ ID NO: 39991

SEQ ID NO: 319693 - RNA, 64 nt, hsa; identical to SEQ ID NO: 39992

SEQ ID NO: 319694 - RNA, 64 nt, hsa; identical to SEQ ID NO: 39993

SEQ ID NO: 319695 - RNA, 64 nt, hsa; identical to SEQ ID NO: 39994

SEQ ID NO: 319696 - RNA, 64 nt, hsa; identical to SEQ ID NO: 39995

SEQ ID NO: 319697 - RNA, 64 nt, hsa; identical to SEQ ID NO: 39996

SEQ ID NO: 319698 - RNA, 64 nt, hsa; identical to SEQ ID NO: 39997

SEQ ID NO: 319699 - RNA, 64 nt, hsa; identical to SEQ ID NO: 39998

SEQ ID NO: 319700 - RNA, 64 nt, hsa; identical to SEQ ID NO: 39999

SEQ ID NO: 319701 - RNA, 64 nt, hsa; identical to SEQ ID NO: 40000

SEQ ID NO: 319702 - RNA, 64 nt, hsa; identical to SEQ ID NO: 40001

SEQ ID NO: 319703 - RNA, 64 nt, hsa; identical to SEQ ID NO: 40002

SEQ ID NO: 319704 - RNA, 64 nt, hsa; identical to SEQ ID NO: 40003

SEQ ID NO: 319705 - RNA, 64 nt, hsa; identical to SEQ ID NO: 40004

SEQ ID NO: 319706 - RNA, 64 nt, hsa; identical to SEQ ID NO: 40005

SEQ ID NO: 319707 - RNA, 64 nt, hsa; identical to SEQ ID NO: 40006

SEQ ID NO: 319708 - RNA, 64 nt, hsa; identical to SEQ ID NO: 40007

SEQ ID NO: 319709 - RNA, 64 nt, hsa; identical to SEQ ID NO: 40008

SEQ ID NO: 319710 - RNA, 64 nt, hsa; identical to SEQ ID NO: 40009

SEQ ID NO: 319711 - RNA, 64 nt, hsa; identical to SEQ ID NO: 40010

SEQ ID NO: 319712 - RNA, 64 nt, hsa; identical to SEQ ID NO: 40011

SEQ ID NO: 319713 - RNA, 64 nt, hsa; identical to SEQ ID NO: 40012

SEQ ID NO: 319714 - RNA, 64 nt, hsa; identical to SEQ ID NO: 40013

SEQ ID NO: 319715 - RNA, 64 nt, hsa; identical to SEQ ID NO: 40014

SEQ ID NO: 319716 - RNA, 64 nt, hsa; identical to SEQ ID NO: 40015

SEQ ID NO: 319717 - RNA, 64 nt, hsa; identical to SEQ ID NO: 40016

SEQ ID NO: 319718 - RNA, 64 nt, hsa; identical to SEQ ID NO: 40017

SEQ ID NO: 319719 - RNA, 64 nt, hsa; identical to SEQ ID NO: 40018

SEQ ID NO: 319720 - RNA, 64 nt, hsa; identical to SEQ ID NO: 40019

SEQ ID NO: 319721 - RNA, 64 nt, hsa; identical to SEQ ID NO: 40020

SEQ ID NO: 319722 - RNA, 64 nt, hsa; identical to SEQ ID NO: 40021

SEQ ID NO: 319723 - RNA, 64 nt, hsa; identical to SEQ ID NO: 40022

SEQ ID NO: 319724 - RNA, 64 nt, hsa; identical to SEQ ID NO: 40023

SEQ ID NO: 319725 - RNA, 64 nt, hsa; identical to SEQ ID NO: 40024

SEQ ID NO: 319726 - RNA, 64 nt, hsa; identical to SEQ ID NO: 40025

SEQ ID NO: 319727 - RNA, 64 nt, hsa; identical to SEQ ID NO: 40026

SEQ ID NO: 319728 - RNA, 64 nt, hsa; identical to SEQ ID NO: 40027

SEQ ID NO: 319729 - RNA, 64 nt, hsa; identical to SEQ ID NO: 40028

SEQ ID NO: 319730 - RNA, 64 nt, hsa; identical to SEQ ID NO: 40029

SEQ ID NO: 319731 - RNA, 64 nt, hsa; identical to SEQ ID NO: 40030

SEQ ID NO: 319732 - RNA, 64 nt, hsa; identical to SEQ ID NO: 40031

SEQ ID NO: 319733 - RNA, 64 nt, hsa; identical to SEQ ID NO: 40032

SEQ ID NO: 319734 - RNA, 64 nt, hsa; identical to SEQ ID NO: 40033

SEQ ID NO: 319735 - RNA, 64 nt, hsa; identical to SEQ ID NO: 40034

SEQ ID NO: 319736 - RNA, 64 nt, hsa; identical to SEQ ID NO: 40035

SEQ ID NO: 319737 - RNA, 64 nt, hsa; identical to SEQ ID NO: 40036

SEQ ID NO: 319738 - RNA, 64 nt, hsa; identical to SEQ ID NO: 40037

SEQ ID NO: 319739 - RNA, 64 nt, hsa; identical to SEQ ID NO: 40038

SEQ ID NO: 319740 - RNA, 64 nt, hsa; identical to SEQ ID NO: 40039

SEQ ID NO: 319741 - RNA, 64 nt, hsa; identical to SEQ ID NO: 40040

SEQ ID NO: 319742 - RNA, 64 nt, hsa; identical to SEQ ID NO: 40041

SEQ ID NO: 319743 - RNA, 64 nt, hsa; identical to SEQ ID NO: 40042

SEQ ID NO: 319744 - RNA, 64 nt, hsa; identical to SEQ ID NO: 40043

SEQ ID NO: 319745 - RNA, 64 nt, hsa; identical to SEQ ID NO: 40044

SEQ ID NO: 319746 - RNA, 64 nt, hsa; identical to SEQ ID NO: 40045

SEQ ID NO: 319747 - RNA, 64 nt, hsa; identical to SEQ ID NO: 40046

SEQ ID NO: 319748 - RNA, 64 nt, hsa; identical to SEQ ID NO: 40047

SEQ ID NO: 319749 - RNA, 64 nt, hsa; identical to SEQ ID NO: 40048

SEQ ID NO: 319750 - RNA, 64 nt, hsa; identical to SEQ ID NO: 40049

SEQ ID NO: 319751 - RNA, 64 nt, hsa; identical to SEQ ID NO: 40050

SEQ ID NO: 319752 - RNA, 64 nt, hsa; identical to SEQ ID NO: 40051

SEQ ID NO: 319753 - RNA, 64 nt, hsa; identical to SEQ ID NO: 40052

SEQ ID NO: 319754 - RNA, 64 nt, hsa; identical to SEQ ID NO: 40053

SEQ ID NO: 319755 - RNA, 64 nt, hsa; identical to SEQ ID NO: 40054

SEQ ID NO: 319756 - RNA, 64 nt, hsa; identical to SEQ ID NO: 40055

SEQ ID NO: 319757 - RNA, 64 nt, hsa; identical to SEQ ID NO: 40056

SEQ ID NO: 319758 - RNA, 64 nt, hsa; identical to SEQ ID NO: 40057

SEQ ID NO: 319759 - RNA, 64 nt, hsa; identical to SEQ ID NO: 40058

SEQ ID NO: 319760 - RNA, 64 nt, hsa; identical to SEQ ID NO: 40059

SEQ ID NO: 319761 - RNA, 64 nt, hsa; identical to SEQ ID NO: 40060

SEQ ID NO: 319762 - RNA, 64 nt, hsa; identical to SEQ ID NO: 40061

SEQ ID NO: 319763 - RNA, 64 nt, hsa; identical to SEQ ID NO: 40062

SEQ ID NO: 319764 - RNA, 64 nt, hsa; identical to SEQ ID NO: 40063

SEQ ID NO: 319765 - RNA, 64 nt, hsa; identical to SEQ ID NO: 40064

SEQ ID NO: 319766 - RNA, 64 nt, hsa; identical to SEQ ID NO: 40065

SEQ ID NO: 319767 - RNA, 64 nt, hsa; identical to SEQ ID NO: 40066

SEQ ID NO: 319768 - RNA, 64 nt, hsa; identical to SEQ ID NO: 40067

SEQ ID NO: 319769 - RNA, 64 nt, hsa; identical to SEQ ID NO: 40068

SEQ ID NO: 319770 - RNA, 64 nt, hsa; identical to SEQ ID NO: 40069

SEQ ID NO: 319771 - RNA, 64 nt, hsa; identical to SEQ ID NO: 40070

SEQ ID NO: 319772 - RNA, 64 nt, hsa; identical to SEQ ID NO: 40071

SEQ ID NO: 319773 - RNA, 64 nt, hsa; identical to SEQ ID NO: 40072

SEQ ID NO: 319774 - RNA, 64 nt, hsa; identical to SEQ ID NO: 40073

SEQ ID NO: 319775 - RNA, 64 nt, hsa; identical to SEQ ID NO: 40074

SEQ ID NO: 319776 - RNA, 64 nt, hsa; identical to SEQ ID NO: 40075

SEQ ID NO: 319777 - RNA, 64 nt, hsa; identical to SEQ ID NO: 40076

SEQ ID NO: 319778 - RNA, 64 nt, hsa; identical to SEQ ID NO: 40077

SEQ ID NO: 319779 - RNA, 64 nt, hsa; identical to SEQ ID NO: 40078

SEQ ID NO: 319780 - RNA, 64 nt, hsa; identical to SEQ ID NO: 40079

SEQ ID NO: 319781 - RNA, 64 nt, hsa; identical to SEQ ID NO: 40080

SEQ ID NO: 319782 - RNA, 64 nt, hsa; identical to SEQ ID NO: 40081

SEQ ID NO: 319783 - RNA, 64 nt, hsa; identical to SEQ ID NO: 40082

SEQ ID NO: 319784 - RNA, 64 nt, hsa; identical to SEQ ID NO: 40083

SEQ ID NO: 319785 - RNA, 64 nt, hsa; identical to SEQ ID NO: 40084

SEQ ID NO: 319786 - RNA, 64 nt, hsa; identical to SEQ ID NO: 40085

SEQ ID NO: 319787 - RNA, 64 nt, hsa; identical to SEQ ID NO: 40086

SEQ ID NO: 319788 - RNA, 64 nt, hsa; identical to SEQ ID NO: 40087

SEQ ID NO: 319789 - RNA, 64 nt, hsa; identical to SEQ ID NO: 40088

SEQ ID NO: 319790 - RNA, 64 nt, hsa; identical to SEQ ID NO: 40089

SEQ ID NO: 319791 - RNA, 64 nt, hsa; identical to SEQ ID NO: 40090

SEQ ID NO: 319792 - RNA, 64 nt, hsa; identical to SEQ ID NO: 40091

SEQ ID NO: 319793 - RNA, 64 nt, hsa; identical to SEQ ID NO: 40092

SEQ ID NO: 319794 - RNA, 64 nt, hsa; identical to SEQ ID NO: 40093

SEQ ID NO: 319795 - RNA, 64 nt, hsa; identical to SEQ ID NO: 40094

SEQ ID NO: 319796 - RNA, 64 nt, hsa; identical to SEQ ID NO: 40095

SEQ ID NO: 319797 - RNA, 64 nt, hsa; identical to SEQ ID NO: 40096

SEQ ID NO: 319798 - RNA, 64 nt, hsa; identical to SEQ ID NO: 40097

SEQ ID NO: 319799 - RNA, 64 nt, hsa; identical to SEQ ID NO: 40098

SEQ ID NO: 319800 - RNA, 64 nt, hsa; identical to SEQ ID NO: 40099

SEQ ID NO: 319801 - RNA, 64 nt, hsa; identical to SEQ ID NO: 40100

SEQ ID NO: 319802 - RNA, 64 nt, hsa; identical to SEQ ID NO: 40101

SEQ ID NO: 319803 - RNA, 64 nt, hsa; identical to SEQ ID NO: 40102

SEQ ID NO: 319804 - RNA, 64 nt, hsa; identical to SEQ ID NO: 40103

SEQ ID NO: 319805 - RNA, 64 nt, hsa; identical to SEQ ID NO: 40104

SEQ ID NO: 319806 - RNA, 64 nt, hsa; identical to SEQ ID NO: 40105

SEQ ID NO: 319807 - RNA, 64 nt, hsa; identical to SEQ ID NO: 40106

SEQ ID NO: 319808 - RNA, 64 nt, hsa; identical to SEQ ID NO: 40107

SEQ ID NO: 319809 - RNA, 64 nt, hsa; identical to SEQ ID NO: 40108

SEQ ID NO: 319810 - RNA, 64 nt, hsa; identical to SEQ ID NO: 40109

SEQ ID NO: 319811 - RNA, 64 nt, hsa; identical to SEQ ID NO: 40110

SEQ ID NO: 319812 - RNA, 64 nt, hsa; identical to SEQ ID NO: 40111

SEQ ID NO: 319813 - RNA, 64 nt, hsa; identical to SEQ ID NO: 40112

SEQ ID NO: 319814 - RNA, 64 nt, hsa; identical to SEQ ID NO: 40113

SEQ ID NO: 319815 - RNA, 64 nt, hsa; identical to SEQ ID NO: 40114

SEQ ID NO: 319816 - RNA, 64 nt, hsa; identical to SEQ ID NO: 40115

SEQ ID NO: 319817 - RNA, 64 nt, hsa; identical to SEQ ID NO: 40116

SEQ ID NO: 319818 - RNA, 64 nt, hsa; identical to SEQ ID NO: 40117

SEQ ID NO: 319819 - RNA, 64 nt, hsa; identical to SEQ ID NO: 40118

SEQ ID NO: 319820 - RNA, 64 nt, hsa; identical to SEQ ID NO: 40119

SEQ ID NO: 319821 - RNA, 64 nt, hsa; identical to SEQ ID NO: 40120

SEQ ID NO: 319822 - RNA, 64 nt, hsa; identical to SEQ ID NO: 40121

SEQ ID NO: 319823 - RNA, 64 nt, hsa; identical to SEQ ID NO: 40122

SEQ ID NO: 319824 - RNA, 64 nt, hsa; identical to SEQ ID NO: 40123

SEQ ID NO: 319825 - RNA, 64 nt, hsa; identical to SEQ ID NO: 40124

SEQ ID NO: 319826 - RNA, 64 nt, hsa; identical to SEQ ID NO: 40125

SEQ ID NO: 319827 - RNA, 64 nt, hsa; identical to SEQ ID NO: 40126

SEQ ID NO: 319828 - RNA, 64 nt, hsa; identical to SEQ ID NO: 40127

SEQ ID NO: 319829 - RNA, 64 nt, hsa; identical to SEQ ID NO: 40128

SEQ ID NO: 319830 - RNA, 64 nt, hsa; identical to SEQ ID NO: 40129

SEQ ID NO: 319831 - RNA, 64 nt, hsa; identical to SEQ ID NO: 40130

SEQ ID NO: 319832 - RNA, 64 nt, hsa; identical to SEQ ID NO: 40131

SEQ ID NO: 319833 - RNA, 64 nt, hsa; identical to SEQ ID NO: 40132

SEQ ID NO: 319834 - RNA, 64 nt, hsa; identical to SEQ ID NO: 40133

SEQ ID NO: 319835 - RNA, 64 nt, hsa; identical to SEQ ID NO: 40134

SEQ ID NO: 319836 - RNA, 64 nt, hsa; identical to SEQ ID NO: 40135

SEQ ID NO: 319837 - RNA, 64 nt, hsa; identical to SEQ ID NO: 40136

SEQ ID NO: 319838 - RNA, 64 nt, hsa; identical to SEQ ID NO: 40137

SEQ ID NO: 319839 - RNA, 64 nt, hsa; identical to SEQ ID NO: 40138

SEQ ID NO: 319840 - RNA, 64 nt, hsa; identical to SEQ ID NO: 40139

SEQ ID NO: 319841 - RNA, 64 nt, hsa; identical to SEQ ID NO: 40140

SEQ ID NO: 319842 - RNA, 64 nt, hsa; identical to SEQ ID NO: 40141

SEQ ID NO: 319843 - RNA, 64 nt, hsa; identical to SEQ ID NO: 40142

SEQ ID NO: 319844 - RNA, 64 nt, hsa; identical to SEQ ID NO: 40143

SEQ ID NO: 319845 - RNA, 64 nt, hsa; identical to SEQ ID NO: 40144

SEQ ID NO: 319846 - RNA, 64 nt, hsa; identical to SEQ ID NO: 40145

SEQ ID NO: 319847 - RNA, 64 nt, hsa; identical to SEQ ID NO: 40146

SEQ ID NO: 319848 - RNA, 64 nt, hsa; identical to SEQ ID NO: 40147

SEQ ID NO: 319849 - RNA, 64 nt, hsa; identical to SEQ ID NO: 40148

SEQ ID NO: 319850 - RNA, 64 nt, hsa; identical to SEQ ID NO: 40149

SEQ ID NO: 319851 - RNA, 64 nt, hsa; identical to SEQ ID NO: 40150

SEQ ID NO: 319852 - RNA, 64 nt, hsa; identical to SEQ ID NO: 40151

SEQ ID NO: 319853 - RNA, 64 nt, hsa; identical to SEQ ID NO: 40152

SEQ ID NO: 319854 - RNA, 64 nt, hsa; identical to SEQ ID NO: 40153

SEQ ID NO: 319855 - RNA, 64 nt, hsa; identical to SEQ ID NO: 40154

SEQ ID NO: 319856 - RNA, 64 nt, hsa; identical to SEQ ID NO: 40155

SEQ ID NO: 319857 - RNA, 64 nt, hsa; identical to SEQ ID NO: 40156

SEQ ID NO: 319858 - RNA, 64 nt, hsa; identical to SEQ ID NO: 40157

SEQ ID NO: 319859 - RNA, 64 nt, hsa; identical to SEQ ID NO: 40158

SEQ ID NO: 319860 - RNA, 64 nt, hsa; identical to SEQ ID NO: 40159

SEQ ID NO: 319861 - RNA, 64 nt, hsa; identical to SEQ ID NO: 40160

SEQ ID NO: 319862 - RNA, 64 nt, hsa; identical to SEQ ID NO: 40161

SEQ ID NO: 319863 - RNA, 64 nt, hsa; identical to SEQ ID NO: 40162

SEQ ID NO: 319864 - RNA, 64 nt, hsa; identical to SEQ ID NO: 40163

SEQ ID NO: 319865 - RNA, 64 nt, hsa; identical to SEQ ID NO: 40164

SEQ ID NO: 319866 - RNA, 64 nt, hsa; identical to SEQ ID NO: 40165

SEQ ID NO: 319867 - RNA, 64 nt, hsa; identical to SEQ ID NO: 40166

SEQ ID NO: 319868 - RNA, 64 nt, hsa; identical to SEQ ID NO: 40167

SEQ ID NO: 319869 - RNA, 64 nt, hsa; identical to SEQ ID NO: 40168

SEQ ID NO: 319870 - RNA, 64 nt, hsa; identical to SEQ ID NO: 40169

SEQ ID NO: 319871 - RNA, 64 nt, hsa; identical to SEQ ID NO: 40170

SEQ ID NO: 319872 - RNA, 64 nt, hsa; identical to SEQ ID NO: 40171

SEQ ID NO: 319873 - RNA, 64 nt, hsa; identical to SEQ ID NO: 40172

SEQ ID NO: 319874 - RNA, 64 nt, hsa; identical to SEQ ID NO: 40173

SEQ ID NO: 319875 - RNA, 64 nt, hsa; identical to SEQ ID NO: 40174

SEQ ID NO: 319876 - RNA, 64 nt, hsa; identical to SEQ ID NO: 40175

SEQ ID NO: 319877 - RNA, 64 nt, hsa; identical to SEQ ID NO: 40176

SEQ ID NO: 319878 - RNA, 64 nt, hsa; identical to SEQ ID NO: 40177

SEQ ID NO: 319879 - RNA, 64 nt, hsa; identical to SEQ ID NO: 40178

SEQ ID NO: 319880 - RNA, 64 nt, hsa; identical to SEQ ID NO: 40179

SEQ ID NO: 319881 - RNA, 64 nt, hsa; identical to SEQ ID NO: 40180

SEQ ID NO: 319882 - RNA, 64 nt, hsa; identical to SEQ ID NO: 40181

SEQ ID NO: 319883 - RNA, 64 nt, hsa; identical to SEQ ID NO: 40182

SEQ ID NO: 319884 - RNA, 64 nt, hsa; identical to SEQ ID NO: 40183

SEQ ID NO: 319885 - RNA, 64 nt, hsa; identical to SEQ ID NO: 40184

SEQ ID NO: 319886 - RNA, 64 nt, hsa; identical to SEQ ID NO: 40185

SEQ ID NO: 319887 - RNA, 64 nt, hsa; identical to SEQ ID NO: 40186

SEQ ID NO: 319888 - RNA, 64 nt, hsa; identical to SEQ ID NO: 40187

SEQ ID NO: 319889 - RNA, 64 nt, hsa; identical to SEQ ID NO: 40188

SEQ ID NO: 319890 - RNA, 64 nt, hsa; identical to SEQ ID NO: 40189

SEQ ID NO: 319891 - RNA, 64 nt, hsa; identical to SEQ ID NO: 40190

SEQ ID NO: 319892 - RNA, 64 nt, hsa; identical to SEQ ID NO: 40191

SEQ ID NO: 319893 - RNA, 64 nt, hsa; identical to SEQ ID NO: 40192

SEQ ID NO: 319894 - RNA, 64 nt, hsa; identical to SEQ ID NO: 40193

SEQ ID NO: 319895 - RNA, 64 nt, hsa; identical to SEQ ID NO: 40194

SEQ ID NO: 319896 - RNA, 64 nt, hsa; identical to SEQ ID NO: 40195

SEQ ID NO: 319897 - RNA, 64 nt, hsa; identical to SEQ ID NO: 40196

SEQ ID NO: 319898 - RNA, 64 nt, hsa; identical to SEQ ID NO: 40197

SEQ ID NO: 319899 - RNA, 64 nt, hsa; identical to SEQ ID NO: 40198

SEQ ID NO: 319900 - RNA, 64 nt, hsa; identical to SEQ ID NO: 40199

SEQ ID NO: 319901 - RNA, 64 nt, hsa; identical to SEQ ID NO: 40200

SEQ ID NO: 319902 - RNA, 64 nt, hsa; identical to SEQ ID NO: 40201

SEQ ID NO: 319903 - RNA, 64 nt, hsa; identical to SEQ ID NO: 40202

SEQ ID NO: 319904 - RNA, 64 nt, hsa; identical to SEQ ID NO: 40203

SEQ ID NO: 319905 - RNA, 64 nt, hsa; identical to SEQ ID NO: 40204

SEQ ID NO: 319906 - RNA, 64 nt, hsa; identical to SEQ ID NO: 40205

SEQ ID NO: 319907 - RNA, 64 nt, hsa; identical to SEQ ID NO: 40206

SEQ ID NO: 319908 - RNA, 64 nt, hsa; identical to SEQ ID NO: 40207

SEQ ID NO: 319909 - RNA, 64 nt, hsa; identical to SEQ ID NO: 40208

SEQ ID NO: 319910 - RNA, 64 nt, hsa; identical to SEQ ID NO: 40209

SEQ ID NO: 319911 - RNA, 64 nt, hsa; identical to SEQ ID NO: 40210

SEQ ID NO: 319912 - RNA, 64 nt, hsa; identical to SEQ ID NO: 40211

SEQ ID NO: 319913 - RNA, 64 nt, hsa; identical to SEQ ID NO: 40212

SEQ ID NO: 319914 - RNA, 64 nt, hsa; identical to SEQ ID NO: 40213

SEQ ID NO: 319915 - RNA, 64 nt, hsa; identical to SEQ ID NO: 40214

SEQ ID NO: 319916 - RNA, 64 nt, hsa; identical to SEQ ID NO: 40215

SEQ ID NO: 319917 - RNA, 64 nt, hsa; identical to SEQ ID NO: 40216

SEQ ID NO: 319918 - RNA, 64 nt, hsa; identical to SEQ ID NO: 40217

SEQ ID NO: 319919 - RNA, 64 nt, hsa; identical to SEQ ID NO: 40218

SEQ ID NO: 319920 - RNA, 64 nt, hsa; identical to SEQ ID NO: 40219

SEQ ID NO: 319921 - RNA, 64 nt, hsa; identical to SEQ ID NO: 40220

SEQ ID NO: 319922 - RNA, 64 nt, hsa; identical to SEQ ID NO: 40221

SEQ ID NO: 319923 - RNA, 64 nt, hsa; identical to SEQ ID NO: 40222

SEQ ID NO: 319924 - RNA, 64 nt, hsa; identical to SEQ ID NO: 40223

SEQ ID NO: 319925 - RNA, 64 nt, hsa; identical to SEQ ID NO: 40224

SEQ ID NO: 319926 - RNA, 64 nt, hsa; identical to SEQ ID NO: 40225

SEQ ID NO: 319927 - RNA, 64 nt, hsa; identical to SEQ ID NO: 40226

SEQ ID NO: 319928 - RNA, 64 nt, hsa; identical to SEQ ID NO: 40227

SEQ ID NO: 319929 - RNA, 64 nt, hsa; identical to SEQ ID NO: 40228

SEQ ID NO: 319930 - RNA, 64 nt, hsa; identical to SEQ ID NO: 40229

SEQ ID NO: 319931 - RNA, 64 nt, hsa; identical to SEQ ID NO: 40230

SEQ ID NO: 319932 - RNA, 64 nt, hsa; identical to SEQ ID NO: 40231

SEQ ID NO: 319933 - RNA, 64 nt, hsa; identical to SEQ ID NO: 40232

SEQ ID NO: 319934 - RNA, 64 nt, hsa; identical to SEQ ID NO: 40233

SEQ ID NO: 319935 - RNA, 64 nt, hsa; identical to SEQ ID NO: 40234

SEQ ID NO: 319936 - RNA, 64 nt, hsa; identical to SEQ ID NO: 40235

SEQ ID NO: 319937 - RNA, 64 nt, hsa; identical to SEQ ID NO: 40236

SEQ ID NO: 319938 - RNA, 64 nt, hsa; identical to SEQ ID NO: 40237

SEQ ID NO: 319939 - RNA, 64 nt, hsa; identical to SEQ ID NO: 40238

SEQ ID NO: 319940 - RNA, 64 nt, hsa; identical to SEQ ID NO: 40239

SEQ ID NO: 319941 - RNA, 64 nt, hsa; identical to SEQ ID NO: 40240

SEQ ID NO: 319942 - RNA, 64 nt, hsa; identical to SEQ ID NO: 40241

SEQ ID NO: 319943 - RNA, 64 nt, hsa; identical to SEQ ID NO: 40242

SEQ ID NO: 319944 - RNA, 64 nt, hsa; identical to SEQ ID NO: 40243

SEQ ID NO: 319945 - RNA, 64 nt, hsa; identical to SEQ ID NO: 40244

SEQ ID NO: 319946 - RNA, 64 nt, hsa; identical to SEQ ID NO: 40245

SEQ ID NO: 319947 - RNA, 64 nt, hsa; identical to SEQ ID NO: 40246

SEQ ID NO: 319948 - RNA, 64 nt, hsa; identical to SEQ ID NO: 40247

SEQ ID NO: 319949 - RNA, 64 nt, hsa; identical to SEQ ID NO: 40248

SEQ ID NO: 319950 - RNA, 64 nt, hsa; identical to SEQ ID NO: 40249

SEQ ID NO: 319951 - RNA, 64 nt, hsa; identical to SEQ ID NO: 40250

SEQ ID NO: 319952 - RNA, 64 nt, hsa; identical to SEQ ID NO: 40251

SEQ ID NO: 319953 - RNA, 64 nt, hsa; identical to SEQ ID NO: 40252

SEQ ID NO: 319954 - RNA, 64 nt, hsa; identical to SEQ ID NO: 40253

SEQ ID NO: 319955 - RNA, 64 nt, hsa; identical to SEQ ID NO: 40254

SEQ ID NO: 319956 - RNA, 64 nt, hsa; identical to SEQ ID NO: 40255

SEQ ID NO: 319957 - RNA, 64 nt, hsa; identical to SEQ ID NO: 40256

SEQ ID NO: 319958 - RNA, 64 nt, hsa; identical to SEQ ID NO: 40257

SEQ ID NO: 319959 - RNA, 64 nt, hsa; identical to SEQ ID NO: 40258

SEQ ID NO: 319960 - RNA, 64 nt, hsa; identical to SEQ ID NO: 40259

SEQ ID NO: 319961 - RNA, 64 nt, hsa; identical to SEQ ID NO: 40260

SEQ ID NO: 319962 - RNA, 64 nt, hsa; identical to SEQ ID NO: 40261

SEQ ID NO: 319963 - RNA, 64 nt, hsa; identical to SEQ ID NO: 40262

SEQ ID NO: 319964 - RNA, 64 nt, hsa; identical to SEQ ID NO: 40263

SEQ ID NO: 319965 - RNA, 64 nt, hsa; identical to SEQ ID NO: 40264

SEQ ID NO: 319966 - RNA, 64 nt, hsa; identical to SEQ ID NO: 40265

SEQ ID NO: 319967 - RNA, 64 nt, hsa; identical to SEQ ID NO: 40266

SEQ ID NO: 319968 - RNA, 64 nt, hsa; identical to SEQ ID NO: 40267

SEQ ID NO: 319969 - RNA, 64 nt, hsa; identical to SEQ ID NO: 40268

SEQ ID NO: 319970 - RNA, 64 nt, hsa; identical to SEQ ID NO: 40269

SEQ ID NO: 319971 - RNA, 64 nt, hsa; identical to SEQ ID NO: 40270

SEQ ID NO: 319972 - RNA, 64 nt, hsa; identical to SEQ ID NO: 40271

SEQ ID NO: 319973 - RNA, 64 nt, hsa; identical to SEQ ID NO: 40272

SEQ ID NO: 319974 - RNA, 64 nt, hsa; identical to SEQ ID NO: 40273

SEQ ID NO: 319975 - RNA, 64 nt, hsa; identical to SEQ ID NO: 40274

SEQ ID NO: 319976 - RNA, 64 nt, hsa; identical to SEQ ID NO: 40275

SEQ ID NO: 319977 - RNA, 64 nt, hsa; identical to SEQ ID NO: 40276

SEQ ID NO: 319978 - RNA, 64 nt, hsa; identical to SEQ ID NO: 40277

SEQ ID NO: 319979 - RNA, 64 nt, hsa; identical to SEQ ID NO: 40278

SEQ ID NO: 319980 - RNA, 64 nt, hsa; identical to SEQ ID NO: 40279

SEQ ID NO: 319981 - RNA, 64 nt, hsa; identical to SEQ ID NO: 40280

SEQ ID NO: 319982 - RNA, 64 nt, hsa; identical to SEQ ID NO: 40281

SEQ ID NO: 319983 - RNA, 64 nt, hsa; identical to SEQ ID NO: 40282

SEQ ID NO: 319984 - RNA, 64 nt, hsa; identical to SEQ ID NO: 40283

SEQ ID NO: 319985 - RNA, 64 nt, hsa; identical to SEQ ID NO: 40284

SEQ ID NO: 319986 - RNA, 64 nt, hsa; identical to SEQ ID NO: 40285

SEQ ID NO: 319987 - RNA, 64 nt, hsa; identical to SEQ ID NO: 40286

SEQ ID NO: 319988 - RNA, 64 nt, hsa; identical to SEQ ID NO: 40287

SEQ ID NO: 319989 - RNA, 64 nt, hsa; identical to SEQ ID NO: 40288

SEQ ID NO: 319990 - RNA, 64 nt, hsa; identical to SEQ ID NO: 40289

SEQ ID NO: 319991 - RNA, 64 nt, hsa; identical to SEQ ID NO: 40290

SEQ ID NO: 319992 - RNA, 64 nt, hsa; identical to SEQ ID NO: 40291

SEQ ID NO: 319993 - RNA, 64 nt, hsa; identical to SEQ ID NO: 40292

SEQ ID NO: 319994 - RNA, 64 nt, hsa; identical to SEQ ID NO: 40293

SEQ ID NO: 319995 - RNA, 64 nt, hsa; identical to SEQ ID NO: 40294

SEQ ID NO: 319996 - RNA, 64 nt, hsa; identical to SEQ ID NO: 40295

SEQ ID NO: 319997 - RNA, 64 nt, hsa; identical to SEQ ID NO: 40296

SEQ ID NO: 319998 - RNA, 64 nt, hsa; identical to SEQ ID NO: 40297

SEQ ID NO: 319999 - RNA, 64 nt, hsa; identical to SEQ ID NO: 40298

SEQ ID NO: 320000 - RNA, 64 nt, hsa; identical to SEQ ID NO: 40299

SEQ ID NO: 320001 - RNA, 64 nt, hsa; identical to SEQ ID NO: 40300

SEQ ID NO: 320002 - RNA, 64 nt, hsa; identical to SEQ ID NO: 40301

SEQ ID NO: 320003 - RNA, 64 nt, hsa; identical to SEQ ID NO: 40302

SEQ ID NO: 320004 - RNA, 64 nt, hsa; identical to SEQ ID NO: 40303

SEQ ID NO: 320005 - RNA, 64 nt, hsa; identical to SEQ ID NO: 40304

SEQ ID NO: 320006 - RNA, 64 nt, hsa; identical to SEQ ID NO: 40305

SEQ ID NO: 320007 - RNA, 64 nt, hsa; identical to SEQ ID NO: 40306

SEQ ID NO: 320008 - RNA, 64 nt, hsa; identical to SEQ ID NO: 40307

SEQ ID NO: 320009 - RNA, 64 nt, hsa; identical to SEQ ID NO: 40308

SEQ ID NO: 320010 - RNA, 64 nt, hsa; identical to SEQ ID NO: 40309

SEQ ID NO: 320011 - RNA, 64 nt, hsa; identical to SEQ ID NO: 40310

SEQ ID NO: 320012 - RNA, 64 nt, hsa; identical to SEQ ID NO: 40311

SEQ ID NO: 320013 - RNA, 64 nt, hsa; identical to SEQ ID NO: 40312

SEQ ID NO: 320014 - RNA, 64 nt, hsa; identical to SEQ ID NO: 40313

SEQ ID NO: 320015 - RNA, 64 nt, hsa; identical to SEQ ID NO: 40314

SEQ ID NO: 320016 - RNA, 64 nt, hsa; identical to SEQ ID NO: 40315

SEQ ID NO: 320017 - RNA, 64 nt, hsa; identical to SEQ ID NO: 40316

SEQ ID NO: 320018 - RNA, 64 nt, hsa; identical to SEQ ID NO: 40317

SEQ ID NO: 320019 - RNA, 64 nt, hsa; identical to SEQ ID NO: 40318

SEQ ID NO: 320020 - RNA, 64 nt, hsa; identical to SEQ ID NO: 40319

SEQ ID NO: 320021 - RNA, 64 nt, hsa; identical to SEQ ID NO: 40320

SEQ ID NO: 320022 - RNA, 64 nt, hsa; identical to SEQ ID NO: 40321

SEQ ID NO: 320023 - RNA, 64 nt, hsa; identical to SEQ ID NO: 40322

SEQ ID NO: 320024 - RNA, 64 nt, hsa; identical to SEQ ID NO: 40323

SEQ ID NO: 320025 - RNA, 64 nt, hsa; identical to SEQ ID NO: 40324

SEQ ID NO: 320026 - RNA, 64 nt, hsa; identical to SEQ ID NO: 40325

SEQ ID NO: 320027 - RNA, 64 nt, hsa; identical to SEQ ID NO: 40326

SEQ ID NO: 320028 - RNA, 64 nt, hsa; identical to SEQ ID NO: 40327

SEQ ID NO: 320029 - RNA, 64 nt, hsa; identical to SEQ ID NO: 40328

SEQ ID NO: 320030 - RNA, 64 nt, hsa; identical to SEQ ID NO: 40329

SEQ ID NO: 320031 - RNA, 64 nt, hsa; identical to SEQ ID NO: 40330

SEQ ID NO: 320032 - RNA, 64 nt, hsa; identical to SEQ ID NO: 40331

SEQ ID NO: 320033 - RNA, 64 nt, hsa; identical to SEQ ID NO: 40332

SEQ ID NO: 320034 - RNA, 64 nt, hsa; identical to SEQ ID NO: 40333

SEQ ID NO: 320035 - RNA, 64 nt, hsa; identical to SEQ ID NO: 40334

SEQ ID NO: 320036 - RNA, 64 nt, hsa; identical to SEQ ID NO: 40335

SEQ ID NO: 320037 - RNA, 64 nt, hsa; identical to SEQ ID NO: 40336

SEQ ID NO: 320038 - RNA, 64 nt, hsa; identical to SEQ ID NO: 40337

SEQ ID NO: 320039 - RNA, 64 nt, hsa; identical to SEQ ID NO: 40338

SEQ ID NO: 320040 - RNA, 64 nt, hsa; identical to SEQ ID NO: 40339

SEQ ID NO: 320041 - RNA, 64 nt, hsa; identical to SEQ ID NO: 40340

SEQ ID NO: 320042 - RNA, 64 nt, hsa; identical to SEQ ID NO: 40341

SEQ ID NO: 320043 - RNA, 64 nt, hsa; identical to SEQ ID NO: 40342

SEQ ID NO: 320044 - RNA, 64 nt, hsa; identical to SEQ ID NO: 40343

SEQ ID NO: 320045 - RNA, 64 nt, hsa; identical to SEQ ID NO: 40344

SEQ ID NO: 320046 - RNA, 64 nt, hsa; identical to SEQ ID NO: 40345

SEQ ID NO: 320047 - RNA, 64 nt, hsa; identical to SEQ ID NO: 40346

SEQ ID NO: 320048 - RNA, 64 nt, hsa; identical to SEQ ID NO: 40347

SEQ ID NO: 320049 - RNA, 64 nt, hsa; identical to SEQ ID NO: 40348

SEQ ID NO: 320050 - RNA, 64 nt, hsa; identical to SEQ ID NO: 40349

SEQ ID NO: 320051 - RNA, 64 nt, hsa; identical to SEQ ID NO: 40350

SEQ ID NO: 320052 - RNA, 64 nt, hsa; identical to SEQ ID NO: 40351

SEQ ID NO: 320053 - RNA, 64 nt, hsa; identical to SEQ ID NO: 40352

SEQ ID NO: 320054 - RNA, 64 nt, hsa; identical to SEQ ID NO: 40353

SEQ ID NO: 320055 - RNA, 64 nt, hsa; identical to SEQ ID NO: 40354

SEQ ID NO: 320056 - RNA, 64 nt, hsa; identical to SEQ ID NO: 40355

SEQ ID NO: 320057 - RNA, 64 nt, hsa; identical to SEQ ID NO: 40356

SEQ ID NO: 320058 - RNA, 64 nt, hsa; identical to SEQ ID NO: 40357

SEQ ID NO: 320059 - RNA, 64 nt, hsa; identical to SEQ ID NO: 40358

SEQ ID NO: 320060 - RNA, 64 nt, hsa; identical to SEQ ID NO: 40359

SEQ ID NO: 320061 - RNA, 64 nt, hsa; identical to SEQ ID NO: 40360

SEQ ID NO: 320062 - RNA, 64 nt, hsa; identical to SEQ ID NO: 40361

SEQ ID NO: 320063 - RNA, 64 nt, hsa; identical to SEQ ID NO: 40362

SEQ ID NO: 320064 - RNA, 64 nt, hsa; identical to SEQ ID NO: 40363

SEQ ID NO: 320065 - RNA, 64 nt, hsa; identical to SEQ ID NO: 40364

SEQ ID NO: 320066 - RNA, 64 nt, hsa; identical to SEQ ID NO: 40365

SEQ ID NO: 320067 - RNA, 64 nt, hsa; identical to SEQ ID NO: 40366

SEQ ID NO: 320068 - RNA, 64 nt, hsa; identical to SEQ ID NO: 40367

SEQ ID NO: 320069 - RNA, 64 nt, hsa; identical to SEQ ID NO: 40368

SEQ ID NO: 320070 - RNA, 64 nt, hsa; identical to SEQ ID NO: 40369

SEQ ID NO: 320071 - RNA, 64 nt, hsa; identical to SEQ ID NO: 40370

SEQ ID NO: 320072 - RNA, 64 nt, hsa; identical to SEQ ID NO: 40371

SEQ ID NO: 320073 - RNA, 64 nt, hsa; identical to SEQ ID NO: 40372

SEQ ID NO: 320074 - RNA, 64 nt, hsa; identical to SEQ ID NO: 40373

SEQ ID NO: 320075 - RNA, 64 nt, hsa; identical to SEQ ID NO: 40374

SEQ ID NO: 320076 - RNA, 64 nt, hsa; identical to SEQ ID NO: 40375

SEQ ID NO: 320077 - RNA, 64 nt, hsa; identical to SEQ ID NO: 40376

SEQ ID NO: 320078 - RNA, 64 nt, hsa; identical to SEQ ID NO: 40377

SEQ ID NO: 320079 - RNA, 64 nt, hsa; identical to SEQ ID NO: 40378

SEQ ID NO: 320080 - RNA, 64 nt, hsa; identical to SEQ ID NO: 40379

SEQ ID NO: 320081 - RNA, 64 nt, hsa; identical to SEQ ID NO: 40380

SEQ ID NO: 320082 - RNA, 64 nt, hsa; identical to SEQ ID NO: 40381

SEQ ID NO: 320083 - RNA, 64 nt, hsa; identical to SEQ ID NO: 40382

SEQ ID NO: 320084 - RNA, 64 nt, hsa; identical to SEQ ID NO: 40383

SEQ ID NO: 320085 - RNA, 64 nt, hsa; identical to SEQ ID NO: 40384

SEQ ID NO: 320086 - RNA, 64 nt, hsa; identical to SEQ ID NO: 40385

SEQ ID NO: 320087 - RNA, 64 nt, hsa; identical to SEQ ID NO: 40386

SEQ ID NO: 320088 - RNA, 64 nt, hsa; identical to SEQ ID NO: 40387

SEQ ID NO: 320089 - RNA, 64 nt, hsa; identical to SEQ ID NO: 40388

SEQ ID NO: 320090 - RNA, 64 nt, hsa; identical to SEQ ID NO: 40389

SEQ ID NO: 320091 - RNA, 64 nt, hsa; identical to SEQ ID NO: 40390

SEQ ID NO: 320092 - RNA, 64 nt, hsa; identical to SEQ ID NO: 40391

SEQ ID NO: 320093 - RNA, 64 nt, hsa; identical to SEQ ID NO: 40392

SEQ ID NO: 320094 - RNA, 64 nt, hsa; identical to SEQ ID NO: 40393

SEQ ID NO: 320095 - RNA, 64 nt, hsa; identical to SEQ ID NO: 40394

SEQ ID NO: 320096 - RNA, 64 nt, hsa; identical to SEQ ID NO: 40395

SEQ ID NO: 320097 - RNA, 64 nt, hsa; identical to SEQ ID NO: 40396

SEQ ID NO: 320098 - RNA, 64 nt, hsa; identical to SEQ ID NO: 40397

SEQ ID NO: 320099 - RNA, 64 nt, hsa; identical to SEQ ID NO: 40398

SEQ ID NO: 320100 - RNA, 64 nt, hsa; identical to SEQ ID NO: 40399

SEQ ID NO: 320101 - RNA, 64 nt, hsa; identical to SEQ ID NO: 40400

SEQ ID NO: 320102 - RNA, 64 nt, hsa; identical to SEQ ID NO: 40401

SEQ ID NO: 320103 - RNA, 64 nt, hsa; identical to SEQ ID NO: 40402

SEQ ID NO: 320104 - RNA, 64 nt, hsa; identical to SEQ ID NO: 40403

SEQ ID NO: 320105 - RNA, 64 nt, hsa; identical to SEQ ID NO: 40404

SEQ ID NO: 320106 - RNA, 64 nt, hsa; identical to SEQ ID NO: 40405

SEQ ID NO: 320107 - RNA, 64 nt, hsa; identical to SEQ ID NO: 40406

SEQ ID NO: 320108 - RNA, 64 nt, hsa; identical to SEQ ID NO: 40407

SEQ ID NO: 320109 - RNA, 64 nt, hsa; identical to SEQ ID NO: 40408

SEQ ID NO: 320110 - RNA, 64 nt, hsa; identical to SEQ ID NO: 40409

SEQ ID NO: 320111 - RNA, 64 nt, hsa; identical to SEQ ID NO: 40410

SEQ ID NO: 320112 - RNA, 64 nt, hsa; identical to SEQ ID NO: 40411

SEQ ID NO: 320113 - RNA, 64 nt, hsa; identical to SEQ ID NO: 40412

SEQ ID NO: 320114 - RNA, 64 nt, hsa; identical to SEQ ID NO: 40413

SEQ ID NO: 320115 - RNA, 64 nt, hsa; identical to SEQ ID NO: 40414

SEQ ID NO: 320116 - RNA, 64 nt, hsa; identical to SEQ ID NO: 40415

SEQ ID NO: 320117 - RNA, 64 nt, hsa; identical to SEQ ID NO: 40416

SEQ ID NO: 320118 - RNA, 64 nt, hsa; identical to SEQ ID NO: 40417

SEQ ID NO: 320119 - RNA, 64 nt, hsa; identical to SEQ ID NO: 40418

SEQ ID NO: 320120 - RNA, 64 nt, hsa; identical to SEQ ID NO: 40419

SEQ ID NO: 320121 - RNA, 64 nt, hsa; identical to SEQ ID NO: 40420

SEQ ID NO: 320122 - RNA, 64 nt, hsa; identical to SEQ ID NO: 40421

SEQ ID NO: 320123 - RNA, 64 nt, hsa; identical to SEQ ID NO: 40422

SEQ ID NO: 320124 - RNA, 64 nt, hsa; identical to SEQ ID NO: 40423

SEQ ID NO: 320125 - RNA, 64 nt, hsa; identical to SEQ ID NO: 40424

SEQ ID NO: 320126 - RNA, 64 nt, hsa; identical to SEQ ID NO: 40425

SEQ ID NO: 320127 - RNA, 64 nt, hsa; identical to SEQ ID NO: 40426

SEQ ID NO: 320128 - RNA, 64 nt, hsa; identical to SEQ ID NO: 40427

SEQ ID NO: 320129 - RNA, 64 nt, hsa; identical to SEQ ID NO: 40428

SEQ ID NO: 320130 - RNA, 64 nt, hsa; identical to SEQ ID NO: 40429

SEQ ID NO: 320131 - RNA, 64 nt, hsa; identical to SEQ ID NO: 40430

SEQ ID NO: 320132 - RNA, 64 nt, hsa; identical to SEQ ID NO: 40431

SEQ ID NO: 320133 - RNA, 64 nt, hsa; identical to SEQ ID NO: 40432

SEQ ID NO: 320134 - RNA, 64 nt, hsa; identical to SEQ ID NO: 40433

SEQ ID NO: 320135 - RNA, 64 nt, hsa; identical to SEQ ID NO: 40434

SEQ ID NO: 320136 - RNA, 64 nt, hsa; identical to SEQ ID NO: 40435

SEQ ID NO: 320137 - RNA, 64 nt, hsa; identical to SEQ ID NO: 40436

SEQ ID NO: 320138 - RNA, 64 nt, hsa; identical to SEQ ID NO: 40437

SEQ ID NO: 320139 - RNA, 64 nt, hsa; identical to SEQ ID NO: 40438

SEQ ID NO: 320140 - RNA, 64 nt, hsa; identical to SEQ ID NO: 40439

SEQ ID NO: 320141 - RNA, 64 nt, hsa; identical to SEQ ID NO: 40440

SEQ ID NO: 320142 - RNA, 64 nt, hsa; identical to SEQ ID NO: 40441

SEQ ID NO: 320143 - RNA, 64 nt, hsa; identical to SEQ ID NO: 40442

SEQ ID NO: 320144 - RNA, 64 nt, hsa; identical to SEQ ID NO: 40443

SEQ ID NO: 320145 - RNA, 64 nt, hsa; identical to SEQ ID NO: 40444

SEQ ID NO: 320146 - RNA, 64 nt, hsa; identical to SEQ ID NO: 40445

SEQ ID NO: 320147 - RNA, 64 nt, hsa; identical to SEQ ID NO: 40446

SEQ ID NO: 320148 - RNA, 64 nt, hsa; identical to SEQ ID NO: 40447

SEQ ID NO: 320149 - RNA, 64 nt, hsa; identical to SEQ ID NO: 40448

SEQ ID NO: 320150 - RNA, 64 nt, hsa; identical to SEQ ID NO: 40449

SEQ ID NO: 320151 - RNA, 64 nt, hsa; identical to SEQ ID NO: 40450

SEQ ID NO: 320152 - RNA, 64 nt, hsa; identical to SEQ ID NO: 40451

SEQ ID NO: 320153 - RNA, 64 nt, hsa; identical to SEQ ID NO: 40452

SEQ ID NO: 320154 - RNA, 64 nt, hsa; identical to SEQ ID NO: 40453

SEQ ID NO: 320155 - RNA, 64 nt, hsa; identical to SEQ ID NO: 40454

SEQ ID NO: 320156 - RNA, 64 nt, hsa; identical to SEQ ID NO: 40455

SEQ ID NO: 320157 - RNA, 64 nt, hsa; identical to SEQ ID NO: 40456

SEQ ID NO: 320158 - RNA, 64 nt, hsa; identical to SEQ ID NO: 40457

SEQ ID NO: 320159 - RNA, 64 nt, hsa; identical to SEQ ID NO: 40458

SEQ ID NO: 320160 - RNA, 64 nt, hsa; identical to SEQ ID NO: 40459

SEQ ID NO: 320161 - RNA, 64 nt, hsa; identical to SEQ ID NO: 40460

SEQ ID NO: 320162 - RNA, 64 nt, hsa; identical to SEQ ID NO: 40461

SEQ ID NO: 320163 - RNA, 64 nt, hsa; identical to SEQ ID NO: 40462

SEQ ID NO: 320164 - RNA, 64 nt, hsa; identical to SEQ ID NO: 40463

SEQ ID NO: 320165 - RNA, 64 nt, hsa; identical to SEQ ID NO: 40464

SEQ ID NO: 320166 - RNA, 64 nt, hsa; identical to SEQ ID NO: 40465

SEQ ID NO: 320167 - RNA, 64 nt, hsa; identical to SEQ ID NO: 40466

SEQ ID NO: 320168 - RNA, 64 nt, hsa; identical to SEQ ID NO: 40467

SEQ ID NO: 320169 - RNA, 64 nt, hsa; identical to SEQ ID NO: 40468

SEQ ID NO: 320170 - RNA, 64 nt, hsa; identical to SEQ ID NO: 40469

SEQ ID NO: 320171 - RNA, 64 nt, hsa; identical to SEQ ID NO: 40470

SEQ ID NO: 320172 - RNA, 64 nt, hsa; identical to SEQ ID NO: 40471

SEQ ID NO: 320173 - RNA, 64 nt, hsa; identical to SEQ ID NO: 40472

SEQ ID NO: 320174 - RNA, 64 nt, hsa; identical to SEQ ID NO: 40473

SEQ ID NO: 320175 - RNA, 64 nt, hsa; identical to SEQ ID NO: 40474

SEQ ID NO: 320176 - RNA, 64 nt, hsa; identical to SEQ ID NO: 40475

SEQ ID NO: 320177 - RNA, 64 nt, hsa; identical to SEQ ID NO: 40476

SEQ ID NO: 320178 - RNA, 64 nt, hsa; identical to SEQ ID NO: 40477

SEQ ID NO: 320179 - RNA, 64 nt, hsa; identical to SEQ ID NO: 40478

SEQ ID NO: 320180 - RNA, 64 nt, hsa; identical to SEQ ID NO: 40479

SEQ ID NO: 320181 - RNA, 64 nt, hsa; identical to SEQ ID NO: 40480

SEQ ID NO: 320182 - RNA, 64 nt, hsa; identical to SEQ ID NO: 40481

SEQ ID NO: 320183 - RNA, 64 nt, hsa; identical to SEQ ID NO: 40482

SEQ ID NO: 320184 - RNA, 64 nt, hsa; identical to SEQ ID NO: 40483

SEQ ID NO: 320185 - RNA, 64 nt, hsa; identical to SEQ ID NO: 40484

SEQ ID NO: 320186 - RNA, 64 nt, hsa; identical to SEQ ID NO: 40485

SEQ ID NO: 320187 - RNA, 64 nt, hsa; identical to SEQ ID NO: 40486

SEQ ID NO: 320188 - RNA, 64 nt, hsa; identical to SEQ ID NO: 40487

SEQ ID NO: 320189 - RNA, 64 nt, hsa; identical to SEQ ID NO: 40488

SEQ ID NO: 320190 - RNA, 64 nt, hsa; identical to SEQ ID NO: 40489

SEQ ID NO: 320191 - RNA, 64 nt, hsa; identical to SEQ ID NO: 40490

SEQ ID NO: 320192 - RNA, 64 nt, hsa; identical to SEQ ID NO: 40491

SEQ ID NO: 320193 - RNA, 64 nt, hsa; identical to SEQ ID NO: 40492

SEQ ID NO: 320194 - RNA, 64 nt, hsa; identical to SEQ ID NO: 40493

SEQ ID NO: 320195 - RNA, 64 nt, hsa; identical to SEQ ID NO: 40494

SEQ ID NO: 320196 - RNA, 64 nt, hsa; identical to SEQ ID NO: 40495

SEQ ID NO: 320197 - RNA, 64 nt, hsa; identical to SEQ ID NO: 40496

SEQ ID NO: 320198 - RNA, 64 nt, hsa; identical to SEQ ID NO: 40497

SEQ ID NO: 320199 - RNA, 64 nt, hsa; identical to SEQ ID NO: 40498

SEQ ID NO: 320200 - RNA, 64 nt, hsa; identical to SEQ ID NO: 40499

SEQ ID NO: 320201 - RNA, 64 nt, hsa; identical to SEQ ID NO: 40500

SEQ ID NO: 320202 - RNA, 64 nt, hsa; identical to SEQ ID NO: 40501

SEQ ID NO: 320203 - RNA, 64 nt, hsa; identical to SEQ ID NO: 40502

SEQ ID NO: 320204 - RNA, 64 nt, hsa; identical to SEQ ID NO: 40503

SEQ ID NO: 320205 - RNA, 64 nt, hsa; identical to SEQ ID NO: 40504

SEQ ID NO: 320206 - RNA, 64 nt, hsa; identical to SEQ ID NO: 40505

SEQ ID NO: 320207 - RNA, 64 nt, hsa; identical to SEQ ID NO: 40506

SEQ ID NO: 320208 - RNA, 64 nt, hsa; identical to SEQ ID NO: 40507

SEQ ID NO: 320209 - RNA, 64 nt, hsa; identical to SEQ ID NO: 40508

SEQ ID NO: 320210 - RNA, 64 nt, hsa; identical to SEQ ID NO: 40509

SEQ ID NO: 320211 - RNA, 64 nt, hsa; identical to SEQ ID NO: 40510

SEQ ID NO: 320212 - RNA, 64 nt, hsa; identical to SEQ ID NO: 40511

SEQ ID NO: 320213 - RNA, 64 nt, hsa; identical to SEQ ID NO: 40512

SEQ ID NO: 320214 - RNA, 64 nt, hsa; identical to SEQ ID NO: 40513

SEQ ID NO: 320215 - RNA, 64 nt, hsa; identical to SEQ ID NO: 40514

SEQ ID NO: 320216 - RNA, 64 nt, hsa; identical to SEQ ID NO: 40515

SEQ ID NO: 320217 - RNA, 64 nt, hsa; identical to SEQ ID NO: 40516

SEQ ID NO: 320218 - RNA, 64 nt, hsa; identical to SEQ ID NO: 40517

SEQ ID NO: 320219 - RNA, 64 nt, hsa; identical to SEQ ID NO: 40518

SEQ ID NO: 320220 - RNA, 64 nt, hsa; identical to SEQ ID NO: 40519

SEQ ID NO: 320221 - RNA, 64 nt, hsa; identical to SEQ ID NO: 40520

SEQ ID NO: 320222 - RNA, 64 nt, hsa; identical to SEQ ID NO: 40521

SEQ ID NO: 320223 - RNA, 64 nt, hsa; identical to SEQ ID NO: 40522

SEQ ID NO: 320224 - RNA, 64 nt, hsa; identical to SEQ ID NO: 40523

SEQ ID NO: 320225 - RNA, 64 nt, hsa; identical to SEQ ID NO: 40524

SEQ ID NO: 320226 - RNA, 64 nt, hsa; identical to SEQ ID NO: 40525

SEQ ID NO: 320227 - RNA, 64 nt, hsa; identical to SEQ ID NO: 40526

SEQ ID NO: 320228 - RNA, 64 nt, hsa; identical to SEQ ID NO: 40527

SEQ ID NO: 320229 - RNA, 64 nt, hsa; identical to SEQ ID NO: 40528

SEQ ID NO: 320230 - RNA, 64 nt, hsa; identical to SEQ ID NO: 40529

SEQ ID NO: 320231 - RNA, 64 nt, hsa; identical to SEQ ID NO: 40530

SEQ ID NO: 320232 - RNA, 64 nt, hsa; identical to SEQ ID NO: 40531

SEQ ID NO: 320233 - RNA, 64 nt, hsa; identical to SEQ ID NO: 40532

SEQ ID NO: 320234 - RNA, 64 nt, hsa; identical to SEQ ID NO: 40533

SEQ ID NO: 320235 - RNA, 64 nt, hsa; identical to SEQ ID NO: 40534

SEQ ID NO: 320236 - RNA, 64 nt, hsa; identical to SEQ ID NO: 40535

SEQ ID NO: 320237 - RNA, 64 nt, hsa; identical to SEQ ID NO: 40536

SEQ ID NO: 320238 - RNA, 64 nt, hsa; identical to SEQ ID NO: 40537

SEQ ID NO: 320239 - RNA, 64 nt, hsa; identical to SEQ ID NO: 40538

SEQ ID NO: 320240 - RNA, 64 nt, hsa; identical to SEQ ID NO: 40539

SEQ ID NO: 320241 - RNA, 64 nt, hsa; identical to SEQ ID NO: 40540

SEQ ID NO: 320242 - RNA, 64 nt, hsa; identical to SEQ ID NO: 40541

SEQ ID NO: 320243 - RNA, 64 nt, hsa; identical to SEQ ID NO: 40542

SEQ ID NO: 320244 - RNA, 64 nt, hsa; identical to SEQ ID NO: 40543

SEQ ID NO: 320245 - RNA, 64 nt, hsa; identical to SEQ ID NO: 40544

SEQ ID NO: 320246 - RNA, 64 nt, hsa; identical to SEQ ID NO: 40545

SEQ ID NO: 320247 - RNA, 64 nt, hsa; identical to SEQ ID NO: 40546

SEQ ID NO: 320248 - RNA, 64 nt, hsa; identical to SEQ ID NO: 40547

SEQ ID NO: 320249 - RNA, 64 nt, hsa; identical to SEQ ID NO: 40548

SEQ ID NO: 320250 - RNA, 64 nt, hsa; identical to SEQ ID NO: 40549

SEQ ID NO: 320251 - RNA, 64 nt, hsa; identical to SEQ ID NO: 40550

SEQ ID NO: 320252 - RNA, 64 nt, hsa; identical to SEQ ID NO: 40551

SEQ ID NO: 320253 - RNA, 64 nt, hsa; identical to SEQ ID NO: 40552

SEQ ID NO: 320254 - RNA, 64 nt, hsa; identical to SEQ ID NO: 40553

SEQ ID NO: 320255 - RNA, 64 nt, hsa; identical to SEQ ID NO: 40554

SEQ ID NO: 320256 - RNA, 64 nt, hsa; identical to SEQ ID NO: 40555

SEQ ID NO: 320257 - RNA, 64 nt, hsa; identical to SEQ ID NO: 40556

SEQ ID NO: 320258 - RNA, 64 nt, hsa; identical to SEQ ID NO: 40557

SEQ ID NO: 320259 - RNA, 64 nt, hsa; identical to SEQ ID NO: 40558

SEQ ID NO: 320260 - RNA, 64 nt, hsa; identical to SEQ ID NO: 40559

SEQ ID NO: 320261 - RNA, 64 nt, hsa; identical to SEQ ID NO: 40560

SEQ ID NO: 320262 - RNA, 64 nt, hsa; identical to SEQ ID NO: 40561

SEQ ID NO: 320263 - RNA, 64 nt, hsa; identical to SEQ ID NO: 40562

SEQ ID NO: 320264 - RNA, 64 nt, hsa; identical to SEQ ID NO: 40563

SEQ ID NO: 320265 - RNA, 64 nt, hsa; identical to SEQ ID NO: 40564

SEQ ID NO: 320266 - RNA, 64 nt, hsa; identical to SEQ ID NO: 40565

SEQ ID NO: 320267 - RNA, 64 nt, hsa; identical to SEQ ID NO: 40566

SEQ ID NO: 320268 - RNA, 64 nt, hsa; identical to SEQ ID NO: 40567

SEQ ID NO: 320269 - RNA, 64 nt, hsa; identical to SEQ ID NO: 40568

SEQ ID NO: 320270 - RNA, 64 nt, hsa; identical to SEQ ID NO: 40569

SEQ ID NO: 320271 - RNA, 64 nt, hsa; identical to SEQ ID NO: 40570

SEQ ID NO: 320272 - RNA, 64 nt, hsa; identical to SEQ ID NO: 40571

SEQ ID NO: 320273 - RNA, 64 nt, hsa; identical to SEQ ID NO: 40572

SEQ ID NO: 320274 - RNA, 64 nt, hsa; identical to SEQ ID NO: 40573

SEQ ID NO: 320275 - RNA, 64 nt, hsa; identical to SEQ ID NO: 40574

SEQ ID NO: 320276 - RNA, 64 nt, hsa; identical to SEQ ID NO: 40575

SEQ ID NO: 320277 - RNA, 64 nt, hsa; identical to SEQ ID NO: 40576

SEQ ID NO: 320278 - RNA, 64 nt, hsa; identical to SEQ ID NO: 40577

SEQ ID NO: 320279 - RNA, 64 nt, hsa; identical to SEQ ID NO: 40578

SEQ ID NO: 320280 - RNA, 64 nt, hsa; identical to SEQ ID NO: 40579

SEQ ID NO: 320281 - RNA, 64 nt, hsa; identical to SEQ ID NO: 40580

SEQ ID NO: 320282 - RNA, 64 nt, hsa; identical to SEQ ID NO: 40581

SEQ ID NO: 320283 - RNA, 64 nt, hsa; identical to SEQ ID NO: 40582

SEQ ID NO: 320284 - RNA, 64 nt, hsa; identical to SEQ ID NO: 40583

SEQ ID NO: 320285 - RNA, 64 nt, hsa; identical to SEQ ID NO: 40584

SEQ ID NO: 320286 - RNA, 64 nt, hsa; identical to SEQ ID NO: 40585

SEQ ID NO: 320287 - RNA, 64 nt, hsa; identical to SEQ ID NO: 40586

SEQ ID NO: 320288 - RNA, 64 nt, hsa; identical to SEQ ID NO: 40587

SEQ ID NO: 320289 - RNA, 64 nt, hsa; identical to SEQ ID NO: 40588

SEQ ID NO: 320290 - RNA, 64 nt, hsa; identical to SEQ ID NO: 40589

SEQ ID NO: 320291 - RNA, 64 nt, hsa; identical to SEQ ID NO: 40590

SEQ ID NO: 320292 - RNA, 64 nt, hsa; identical to SEQ ID NO: 40591

SEQ ID NO: 320293 - RNA, 64 nt, hsa; identical to SEQ ID NO: 40592

SEQ ID NO: 320294 - RNA, 64 nt, hsa; identical to SEQ ID NO: 40593

SEQ ID NO: 320295 - RNA, 64 nt, hsa; identical to SEQ ID NO: 40594

SEQ ID NO: 320296 - RNA, 64 nt, hsa; identical to SEQ ID NO: 40595

SEQ ID NO: 320297 - RNA, 64 nt, hsa; identical to SEQ ID NO: 40596

SEQ ID NO: 320298 - RNA, 64 nt, hsa; identical to SEQ ID NO: 40597

SEQ ID NO: 320299 - RNA, 64 nt, hsa; identical to SEQ ID NO: 40598

SEQ ID NO: 320300 - RNA, 64 nt, hsa; identical to SEQ ID NO: 40599

SEQ ID NO: 320301 - RNA, 64 nt, hsa; identical to SEQ ID NO: 40600

SEQ ID NO: 320302 - RNA, 64 nt, hsa; identical to SEQ ID NO: 40601

SEQ ID NO: 320303 - RNA, 64 nt, hsa; identical to SEQ ID NO: 40602

SEQ ID NO: 320304 - RNA, 64 nt, hsa; identical to SEQ ID NO: 40603

SEQ ID NO: 320305 - RNA, 64 nt, hsa; identical to SEQ ID NO: 40604

SEQ ID NO: 320306 - RNA, 64 nt, hsa; identical to SEQ ID NO: 40605

SEQ ID NO: 320307 - RNA, 64 nt, hsa; identical to SEQ ID NO: 40606

SEQ ID NO: 320308 - RNA, 64 nt, hsa; identical to SEQ ID NO: 40607

SEQ ID NO: 320309 - RNA, 64 nt, hsa; identical to SEQ ID NO: 40608

SEQ ID NO: 320310 - RNA, 64 nt, hsa; identical to SEQ ID NO: 40609

SEQ ID NO: 320311 - RNA, 64 nt, hsa; identical to SEQ ID NO: 40610

SEQ ID NO: 320312 - RNA, 64 nt, hsa; identical to SEQ ID NO: 40611

SEQ ID NO: 320313 - RNA, 64 nt, hsa; identical to SEQ ID NO: 40612

SEQ ID NO: 320314 - RNA, 64 nt, hsa; identical to SEQ ID NO: 40613

SEQ ID NO: 320315 - RNA, 64 nt, hsa; identical to SEQ ID NO: 40614

SEQ ID NO: 320316 - RNA, 64 nt, hsa; identical to SEQ ID NO: 40615

SEQ ID NO: 320317 - RNA, 64 nt, hsa; identical to SEQ ID NO: 40616

SEQ ID NO: 320318 - RNA, 64 nt, hsa; identical to SEQ ID NO: 40617

SEQ ID NO: 320319 - RNA, 64 nt, hsa; identical to SEQ ID NO: 40618

SEQ ID NO: 320320 - RNA, 64 nt, hsa; identical to SEQ ID NO: 40619

SEQ ID NO: 320321 - RNA, 64 nt, hsa; identical to SEQ ID NO: 40620

SEQ ID NO: 320322 - RNA, 64 nt, hsa; identical to SEQ ID NO: 40621

SEQ ID NO: 320323 - RNA, 64 nt, hsa; identical to SEQ ID NO: 40622

SEQ ID NO: 320324 - RNA, 64 nt, hsa; identical to SEQ ID NO: 40623

SEQ ID NO: 320325 - RNA, 64 nt, hsa; identical to SEQ ID NO: 40624

SEQ ID NO: 320326 - RNA, 64 nt, hsa; identical to SEQ ID NO: 40625

SEQ ID NO: 320327 - RNA, 64 nt, hsa; identical to SEQ ID NO: 40626

SEQ ID NO: 320328 - RNA, 64 nt, hsa; identical to SEQ ID NO: 40627

SEQ ID NO: 320329 - RNA, 64 nt, hsa; identical to SEQ ID NO: 40628

SEQ ID NO: 320330 - RNA, 64 nt, hsa; identical to SEQ ID NO: 40629

SEQ ID NO: 320331 - RNA, 64 nt, hsa; identical to SEQ ID NO: 40630

SEQ ID NO: 320332 - RNA, 64 nt, hsa; identical to SEQ ID NO: 40631

SEQ ID NO: 320333 - RNA, 64 nt, hsa; identical to SEQ ID NO: 40632

SEQ ID NO: 320334 - RNA, 64 nt, hsa; identical to SEQ ID NO: 40633

SEQ ID NO: 320335 - RNA, 64 nt, hsa; identical to SEQ ID NO: 40634

SEQ ID NO: 320336 - RNA, 64 nt, hsa; identical to SEQ ID NO: 40635

SEQ ID NO: 320337 - RNA, 64 nt, hsa; identical to SEQ ID NO: 40636

SEQ ID NO: 320338 - RNA, 64 nt, hsa; identical to SEQ ID NO: 40637

SEQ ID NO: 320339 - RNA, 64 nt, hsa; identical to SEQ ID NO: 40638

SEQ ID NO: 320340 - RNA, 64 nt, hsa; identical to SEQ ID NO: 40639

SEQ ID NO: 320341 - RNA, 64 nt, hsa; identical to SEQ ID NO: 40640

SEQ ID NO: 320342 - RNA, 64 nt, hsa; identical to SEQ ID NO: 40641

SEQ ID NO: 320343 - RNA, 64 nt, hsa; identical to SEQ ID NO: 40642

SEQ ID NO: 320344 - RNA, 64 nt, hsa; identical to SEQ ID NO: 40643

SEQ ID NO: 320345 - RNA, 64 nt, hsa; identical to SEQ ID NO: 40644

SEQ ID NO: 320346 - RNA, 64 nt, hsa; identical to SEQ ID NO: 40645

SEQ ID NO: 320347 - RNA, 64 nt, hsa; identical to SEQ ID NO: 40646

SEQ ID NO: 320348 - RNA, 64 nt, hsa; identical to SEQ ID NO: 40647

SEQ ID NO: 320349 - RNA, 64 nt, hsa; identical to SEQ ID NO: 40648

SEQ ID NO: 320350 - RNA, 64 nt, hsa; identical to SEQ ID NO: 40649

SEQ ID NO: 320351 - RNA, 64 nt, hsa; identical to SEQ ID NO: 40650

SEQ ID NO: 320352 - RNA, 64 nt, hsa; identical to SEQ ID NO: 40651

SEQ ID NO: 320353 - RNA, 64 nt, hsa; identical to SEQ ID NO: 40652

SEQ ID NO: 320354 - RNA, 64 nt, hsa; identical to SEQ ID NO: 40653

SEQ ID NO: 320355 - RNA, 64 nt, hsa; identical to SEQ ID NO: 40654

SEQ ID NO: 320356 - RNA, 64 nt, hsa; identical to SEQ ID NO: 40655

SEQ ID NO: 320357 - RNA, 64 nt, hsa; identical to SEQ ID NO: 40656

SEQ ID NO: 320358 - RNA, 64 nt, hsa; identical to SEQ ID NO: 40657

SEQ ID NO: 320359 - RNA, 64 nt, hsa; identical to SEQ ID NO: 40658

SEQ ID NO: 320360 - RNA, 64 nt, hsa; identical to SEQ ID NO: 40659

SEQ ID NO: 320361 - RNA, 64 nt, hsa; identical to SEQ ID NO: 40660

SEQ ID NO: 320362 - RNA, 64 nt, hsa; identical to SEQ ID NO: 40661

SEQ ID NO: 320363 - RNA, 64 nt, hsa; identical to SEQ ID NO: 40662

SEQ ID NO: 320364 - RNA, 64 nt, hsa; identical to SEQ ID NO: 40663

SEQ ID NO: 320365 - RNA, 64 nt, hsa; identical to SEQ ID NO: 40664

SEQ ID NO: 320366 - RNA, 64 nt, hsa; identical to SEQ ID NO: 40665

SEQ ID NO: 320367 - RNA, 64 nt, hsa; identical to SEQ ID NO: 40666

SEQ ID NO: 320368 - RNA, 64 nt, hsa; identical to SEQ ID NO: 40667

SEQ ID NO: 320369 - RNA, 64 nt, hsa; identical to SEQ ID NO: 40668

SEQ ID NO: 320370 - RNA, 64 nt, hsa; identical to SEQ ID NO: 40669

SEQ ID NO: 320371 - RNA, 64 nt, hsa; identical to SEQ ID NO: 40670

SEQ ID NO: 320372 - RNA, 64 nt, hsa; identical to SEQ ID NO: 40671

SEQ ID NO: 320373 - RNA, 64 nt, hsa; identical to SEQ ID NO: 40672

SEQ ID NO: 320374 - RNA, 64 nt, hsa; identical to SEQ ID NO: 40673

SEQ ID NO: 320375 - RNA, 64 nt, hsa; identical to SEQ ID NO: 40674

SEQ ID NO: 320376 - RNA, 64 nt, hsa; identical to SEQ ID NO: 40675

SEQ ID NO: 320377 - RNA, 64 nt, hsa; identical to SEQ ID NO: 40676

SEQ ID NO: 320378 - RNA, 64 nt, hsa; identical to SEQ ID NO: 40677

SEQ ID NO: 320379 - RNA, 64 nt, hsa; identical to SEQ ID NO: 40678

SEQ ID NO: 320380 - RNA, 64 nt, hsa; identical to SEQ ID NO: 40679

SEQ ID NO: 320381 - RNA, 64 nt, hsa; identical to SEQ ID NO: 40680

SEQ ID NO: 320382 - RNA, 64 nt, hsa; identical to SEQ ID NO: 40681

SEQ ID NO: 320383 - RNA, 64 nt, hsa; identical to SEQ ID NO: 40682

SEQ ID NO: 320384 - RNA, 64 nt, hsa; identical to SEQ ID NO: 40683

SEQ ID NO: 320385 - RNA, 64 nt, hsa; identical to SEQ ID NO: 40684

SEQ ID NO: 320386 - RNA, 64 nt, hsa; identical to SEQ ID NO: 40685

SEQ ID NO: 320387 - RNA, 64 nt, hsa; identical to SEQ ID NO: 40686

SEQ ID NO: 320388 - RNA, 64 nt, hsa; identical to SEQ ID NO: 40687

SEQ ID NO: 320389 - RNA, 64 nt, hsa; identical to SEQ ID NO: 40688

SEQ ID NO: 320390 - RNA, 64 nt, hsa; identical to SEQ ID NO: 40689

SEQ ID NO: 320391 - RNA, 64 nt, hsa; identical to SEQ ID NO: 40690

SEQ ID NO: 320392 - RNA, 64 nt, hsa; identical to SEQ ID NO: 40691

SEQ ID NO: 320393 - RNA, 64 nt, hsa; identical to SEQ ID NO: 40692

SEQ ID NO: 320394 - RNA, 64 nt, hsa; identical to SEQ ID NO: 40693

SEQ ID NO: 320395 - RNA, 64 nt, hsa; identical to SEQ ID NO: 40694

SEQ ID NO: 320396 - RNA, 64 nt, hsa; identical to SEQ ID NO: 40695

SEQ ID NO: 320397 - RNA, 64 nt, hsa; identical to SEQ ID NO: 40696

SEQ ID NO: 320398 - RNA, 64 nt, hsa; identical to SEQ ID NO: 40697

SEQ ID NO: 320399 - RNA, 64 nt, hsa; identical to SEQ ID NO: 40698

SEQ ID NO: 320400 - RNA, 64 nt, hsa; identical to SEQ ID NO: 40699

SEQ ID NO: 320401 - RNA, 64 nt, hsa; identical to SEQ ID NO: 40700

SEQ ID NO: 320402 - RNA, 64 nt, hsa; identical to SEQ ID NO: 40701

SEQ ID NO: 320403 - RNA, 64 nt, hsa; identical to SEQ ID NO: 40702

SEQ ID NO: 320404 - RNA, 64 nt, hsa; identical to SEQ ID NO: 40703

SEQ ID NO: 320405 - RNA, 64 nt, hsa; identical to SEQ ID NO: 40704

SEQ ID NO: 320406 - RNA, 64 nt, hsa; identical to SEQ ID NO: 40705

SEQ ID NO: 320407 - RNA, 64 nt, hsa; identical to SEQ ID NO: 40706

SEQ ID NO: 320408 - RNA, 64 nt, hsa; identical to SEQ ID NO: 40707

SEQ ID NO: 320409 - RNA, 64 nt, hsa; identical to SEQ ID NO: 40708

SEQ ID NO: 320410 - RNA, 64 nt, hsa; identical to SEQ ID NO: 40709

SEQ ID NO: 320411 - RNA, 64 nt, hsa; identical to SEQ ID NO: 40710

SEQ ID NO: 320412 - RNA, 64 nt, hsa; identical to SEQ ID NO: 40711

SEQ ID NO: 320413 - RNA, 64 nt, hsa; identical to SEQ ID NO: 40712

SEQ ID NO: 320414 - RNA, 64 nt, hsa; identical to SEQ ID NO: 40713

SEQ ID NO: 320415 - RNA, 64 nt, hsa; identical to SEQ ID NO: 40714

SEQ ID NO: 320416 - RNA, 64 nt, hsa; identical to SEQ ID NO: 40715

SEQ ID NO: 320417 - RNA, 64 nt, hsa; identical to SEQ ID NO: 40716

SEQ ID NO: 320418 - RNA, 64 nt, hsa; identical to SEQ ID NO: 40717

SEQ ID NO: 320419 - RNA, 64 nt, hsa; identical to SEQ ID NO: 40718

SEQ ID NO: 320420 - RNA, 64 nt, hsa; identical to SEQ ID NO: 40719

SEQ ID NO: 320421 - RNA, 64 nt, hsa; identical to SEQ ID NO: 40720

SEQ ID NO: 320422 - RNA, 64 nt, hsa; identical to SEQ ID NO: 40721

SEQ ID NO: 320423 - RNA, 64 nt, hsa; identical to SEQ ID NO: 40722

SEQ ID NO: 320424 - RNA, 64 nt, hsa; identical to SEQ ID NO: 40723

SEQ ID NO: 320425 - RNA, 64 nt, hsa; identical to SEQ ID NO: 40724

SEQ ID NO: 320426 - RNA, 64 nt, hsa; identical to SEQ ID NO: 40725

SEQ ID NO: 320427 - RNA, 64 nt, hsa; identical to SEQ ID NO: 40726

SEQ ID NO: 320428 - RNA, 64 nt, hsa; identical to SEQ ID NO: 40727

SEQ ID NO: 320429 - RNA, 64 nt, hsa; identical to SEQ ID NO: 40728

SEQ ID NO: 320430 - RNA, 64 nt, hsa; identical to SEQ ID NO: 40729

SEQ ID NO: 320431 - RNA, 64 nt, hsa; identical to SEQ ID NO: 40730

SEQ ID NO: 320432 - RNA, 64 nt, hsa; identical to SEQ ID NO: 40731

SEQ ID NO: 320433 - RNA, 64 nt, hsa; identical to SEQ ID NO: 40732

SEQ ID NO: 320434 - RNA, 64 nt, hsa; identical to SEQ ID NO: 40733

SEQ ID NO: 320435 - RNA, 64 nt, hsa; identical to SEQ ID NO: 40734

SEQ ID NO: 320436 - RNA, 64 nt, hsa; identical to SEQ ID NO: 40735

SEQ ID NO: 320437 - RNA, 64 nt, hsa; identical to SEQ ID NO: 40736

SEQ ID NO: 320438 - RNA, 64 nt, hsa; identical to SEQ ID NO: 40737

SEQ ID NO: 320439 - RNA, 64 nt, hsa; identical to SEQ ID NO: 40738

SEQ ID NO: 320440 - RNA, 64 nt, hsa; identical to SEQ ID NO: 40739

SEQ ID NO: 320441 - RNA, 64 nt, hsa; identical to SEQ ID NO: 40740

SEQ ID NO: 320442 - RNA, 64 nt, hsa; identical to SEQ ID NO: 40741

SEQ ID NO: 320443 - RNA, 64 nt, hsa; identical to SEQ ID NO: 40742

SEQ ID NO: 320444 - RNA, 64 nt, hsa; identical to SEQ ID NO: 40743

SEQ ID NO: 320445 - RNA, 64 nt, hsa; identical to SEQ ID NO: 40744

SEQ ID NO: 320446 - RNA, 64 nt, hsa; identical to SEQ ID NO: 40745

SEQ ID NO: 320447 - RNA, 64 nt, hsa; identical to SEQ ID NO: 40746

SEQ ID NO: 320448 - RNA, 64 nt, hsa; identical to SEQ ID NO: 40747

SEQ ID NO: 320449 - RNA, 64 nt, hsa; identical to SEQ ID NO: 40748

SEQ ID NO: 320450 - RNA, 64 nt, hsa; identical to SEQ ID NO: 40749

SEQ ID NO: 320451 - RNA, 64 nt, hsa; identical to SEQ ID NO: 40750

SEQ ID NO: 320452 - RNA, 64 nt, hsa; identical to SEQ ID NO: 40751

SEQ ID NO: 320453 - RNA, 64 nt, hsa; identical to SEQ ID NO: 40752

SEQ ID NO: 320454 - RNA, 64 nt, hsa; identical to SEQ ID NO: 40753

SEQ ID NO: 320455 - RNA, 64 nt, hsa; identical to SEQ ID NO: 40754

SEQ ID NO: 320456 - RNA, 64 nt, hsa; identical to SEQ ID NO: 40755

SEQ ID NO: 320457 - RNA, 64 nt, hsa; identical to SEQ ID NO: 40756

SEQ ID NO: 320458 - RNA, 64 nt, hsa; identical to SEQ ID NO: 40757

SEQ ID NO: 320459 - RNA, 64 nt, hsa; identical to SEQ ID NO: 40758

SEQ ID NO: 320460 - RNA, 64 nt, hsa; identical to SEQ ID NO: 40759

SEQ ID NO: 320461 - RNA, 64 nt, hsa; identical to SEQ ID NO: 40760

SEQ ID NO: 320462 - RNA, 64 nt, hsa; identical to SEQ ID NO: 40761

SEQ ID NO: 320463 - RNA, 64 nt, hsa; identical to SEQ ID NO: 40762

SEQ ID NO: 320464 - RNA, 64 nt, hsa; identical to SEQ ID NO: 40763

SEQ ID NO: 320465 - RNA, 64 nt, hsa; identical to SEQ ID NO: 40764

SEQ ID NO: 320466 - RNA, 64 nt, hsa; identical to SEQ ID NO: 40765

SEQ ID NO: 320467 - RNA, 64 nt, hsa; identical to SEQ ID NO: 40766

SEQ ID NO: 320468 - RNA, 64 nt, hsa; identical to SEQ ID NO: 40767

SEQ ID NO: 320469 - RNA, 64 nt, hsa; identical to SEQ ID NO: 40768

SEQ ID NO: 320470 - RNA, 64 nt, hsa; identical to SEQ ID NO: 40769

SEQ ID NO: 320471 - RNA, 64 nt, hsa; identical to SEQ ID NO: 40770

SEQ ID NO: 320472 - RNA, 64 nt, hsa; identical to SEQ ID NO: 40771

SEQ ID NO: 320473 - RNA, 64 nt, hsa; identical to SEQ ID NO: 40772

SEQ ID NO: 320474 - RNA, 64 nt, hsa; identical to SEQ ID NO: 40773

SEQ ID NO: 320475 - RNA, 64 nt, hsa; identical to SEQ ID NO: 40774

SEQ ID NO: 320476 - RNA, 64 nt, hsa; identical to SEQ ID NO: 40775

SEQ ID NO: 320477 - RNA, 64 nt, hsa; identical to SEQ ID NO: 40776

SEQ ID NO: 320478 - RNA, 64 nt, hsa; identical to SEQ ID NO: 40777

SEQ ID NO: 320479 - RNA, 64 nt, hsa; identical to SEQ ID NO: 40778

SEQ ID NO: 320480 - RNA, 64 nt, hsa; identical to SEQ ID NO: 40779

SEQ ID NO: 320481 - RNA, 64 nt, hsa; identical to SEQ ID NO: 40780

SEQ ID NO: 320482 - RNA, 64 nt, hsa; identical to SEQ ID NO: 40781

SEQ ID NO: 320483 - RNA, 64 nt, hsa; identical to SEQ ID NO: 40782

SEQ ID NO: 320484 - RNA, 64 nt, hsa; identical to SEQ ID NO: 40783

SEQ ID NO: 320485 - RNA, 64 nt, hsa; identical to SEQ ID NO: 40784

SEQ ID NO: 320486 - RNA, 64 nt, hsa; identical to SEQ ID NO: 40785

SEQ ID NO: 320487 - RNA, 64 nt, hsa; identical to SEQ ID NO: 40786

SEQ ID NO: 320488 - RNA, 64 nt, hsa; identical to SEQ ID NO: 40787

SEQ ID NO: 320489 - RNA, 64 nt, hsa; identical to SEQ ID NO: 40788

SEQ ID NO: 320490 - RNA, 64 nt, hsa; identical to SEQ ID NO: 40789

SEQ ID NO: 320491 - RNA, 64 nt, hsa; identical to SEQ ID NO: 40790

SEQ ID NO: 320492 - RNA, 64 nt, hsa; identical to SEQ ID NO: 40791

SEQ ID NO: 320493 - RNA, 64 nt, hsa; identical to SEQ ID NO: 40792

SEQ ID NO: 320494 - RNA, 64 nt, hsa; identical to SEQ ID NO: 40793

SEQ ID NO: 320495 - RNA, 64 nt, hsa; identical to SEQ ID NO: 40794

SEQ ID NO: 320496 - RNA, 64 nt, hsa; identical to SEQ ID NO: 40795

SEQ ID NO: 320497 - RNA, 64 nt, hsa; identical to SEQ ID NO: 40796

SEQ ID NO: 320498 - RNA, 64 nt, hsa; identical to SEQ ID NO: 40797

SEQ ID NO: 320499 - RNA, 64 nt, hsa; identical to SEQ ID NO: 40798

SEQ ID NO: 320500 - RNA, 64 nt, hsa; identical to SEQ ID NO: 40799

SEQ ID NO: 320501 - RNA, 64 nt, hsa; identical to SEQ ID NO: 40800

SEQ ID NO: 320502 - RNA, 64 nt, hsa; identical to SEQ ID NO: 40801

SEQ ID NO: 320503 - RNA, 64 nt, hsa; identical to SEQ ID NO: 40802

SEQ ID NO: 320504 - RNA, 64 nt, hsa; identical to SEQ ID NO: 40803

SEQ ID NO: 320505 - RNA, 64 nt, hsa; identical to SEQ ID NO: 40804

SEQ ID NO: 320506 - RNA, 64 nt, hsa; identical to SEQ ID NO: 40805

SEQ ID NO: 320507 - RNA, 64 nt, hsa; identical to SEQ ID NO: 40806

SEQ ID NO: 320508 - RNA, 64 nt, hsa; identical to SEQ ID NO: 40807

SEQ ID NO: 320509 - RNA, 64 nt, hsa; identical to SEQ ID NO: 40808

SEQ ID NO: 320510 - RNA, 64 nt, hsa; identical to SEQ ID NO: 40809

SEQ ID NO: 320511 - RNA, 64 nt, hsa; identical to SEQ ID NO: 40810

SEQ ID NO: 320512 - RNA, 64 nt, hsa; identical to SEQ ID NO: 40811

SEQ ID NO: 320513 - RNA, 64 nt, hsa; identical to SEQ ID NO: 40812

SEQ ID NO: 320514 - RNA, 64 nt, hsa; identical to SEQ ID NO: 40813

SEQ ID NO: 320515 - RNA, 64 nt, hsa; identical to SEQ ID NO: 40814

SEQ ID NO: 320516 - RNA, 64 nt, hsa; identical to SEQ ID NO: 40815

SEQ ID NO: 320517 - RNA, 64 nt, hsa; identical to SEQ ID NO: 40816

SEQ ID NO: 320518 - RNA, 64 nt, hsa; identical to SEQ ID NO: 40817

SEQ ID NO: 320519 - RNA, 64 nt, hsa; identical to SEQ ID NO: 40818

SEQ ID NO: 320520 - RNA, 64 nt, hsa; identical to SEQ ID NO: 40819

SEQ ID NO: 320521 - RNA, 64 nt, hsa; identical to SEQ ID NO: 40820

SEQ ID NO: 320522 - RNA, 64 nt, hsa; identical to SEQ ID NO: 40821

SEQ ID NO: 320523 - RNA, 64 nt, hsa; identical to SEQ ID NO: 40822

SEQ ID NO: 320524 - RNA, 64 nt, hsa; identical to SEQ ID NO: 40823

SEQ ID NO: 320525 - RNA, 64 nt, hsa; identical to SEQ ID NO: 40824

SEQ ID NO: 320526 - RNA, 64 nt, hsa; identical to SEQ ID NO: 40825

SEQ ID NO: 320527 - RNA, 64 nt, hsa; identical to SEQ ID NO: 40826

SEQ ID NO: 320528 - RNA, 64 nt, hsa; identical to SEQ ID NO: 40827

SEQ ID NO: 320529 - RNA, 64 nt, hsa; identical to SEQ ID NO: 40828

SEQ ID NO: 320530 - RNA, 64 nt, hsa; identical to SEQ ID NO: 40829

SEQ ID NO: 320531 - RNA, 64 nt, hsa; identical to SEQ ID NO: 40830

SEQ ID NO: 320532 - RNA, 64 nt, hsa; identical to SEQ ID NO: 40831

SEQ ID NO: 320533 - RNA, 64 nt, hsa; identical to SEQ ID NO: 40832

SEQ ID NO: 320534 - RNA, 64 nt, hsa; identical to SEQ ID NO: 40833

SEQ ID NO: 320535 - RNA, 64 nt, hsa; identical to SEQ ID NO: 40834

SEQ ID NO: 320536 - RNA, 64 nt, hsa; identical to SEQ ID NO: 40835

SEQ ID NO: 320537 - RNA, 64 nt, hsa; identical to SEQ ID NO: 40836

SEQ ID NO: 320538 - RNA, 64 nt, hsa; identical to SEQ ID NO: 40837

SEQ ID NO: 320539 - RNA, 64 nt, hsa; identical to SEQ ID NO: 40838

SEQ ID NO: 320540 - RNA, 64 nt, hsa; identical to SEQ ID NO: 40839

SEQ ID NO: 320541 - RNA, 64 nt, hsa; identical to SEQ ID NO: 40840

SEQ ID NO: 320542 - RNA, 64 nt, hsa; identical to SEQ ID NO: 40841

SEQ ID NO: 320543 - RNA, 64 nt, hsa; identical to SEQ ID NO: 40842

SEQ ID NO: 320544 - RNA, 64 nt, hsa; identical to SEQ ID NO: 40843

SEQ ID NO: 320545 - RNA, 64 nt, hsa; identical to SEQ ID NO: 40844

SEQ ID NO: 320546 - RNA, 64 nt, hsa; identical to SEQ ID NO: 40845

SEQ ID NO: 320547 - RNA, 64 nt, hsa; identical to SEQ ID NO: 40846

SEQ ID NO: 320548 - RNA, 64 nt, hsa; identical to SEQ ID NO: 40847

SEQ ID NO: 320549 - RNA, 64 nt, hsa; identical to SEQ ID NO: 40848

SEQ ID NO: 320550 - RNA, 64 nt, hsa; identical to SEQ ID NO: 40849

SEQ ID NO: 320551 - RNA, 64 nt, hsa; identical to SEQ ID NO: 40850

SEQ ID NO: 320552 - RNA, 64 nt, hsa; identical to SEQ ID NO: 40851

SEQ ID NO: 320553 - RNA, 64 nt, hsa; identical to SEQ ID NO: 40852

SEQ ID NO: 320554 - RNA, 64 nt, hsa; identical to SEQ ID NO: 40853

SEQ ID NO: 320555 - RNA, 64 nt, hsa; identical to SEQ ID NO: 40854

SEQ ID NO: 320556 - RNA, 64 nt, hsa; identical to SEQ ID NO: 40855

SEQ ID NO: 320557 - RNA, 64 nt, hsa; identical to SEQ ID NO: 40856

SEQ ID NO: 320558 - RNA, 64 nt, hsa; identical to SEQ ID NO: 40857

SEQ ID NO: 320559 - RNA, 64 nt, hsa; identical to SEQ ID NO: 40858

SEQ ID NO: 320560 - RNA, 64 nt, hsa; identical to SEQ ID NO: 40859

SEQ ID NO: 320561 - RNA, 64 nt, hsa; identical to SEQ ID NO: 40860

SEQ ID NO: 320562 - RNA, 64 nt, hsa; identical to SEQ ID NO: 40861

SEQ ID NO: 320563 - RNA, 64 nt, hsa; identical to SEQ ID NO: 40862

SEQ ID NO: 320564 - RNA, 64 nt, hsa; identical to SEQ ID NO: 40863

SEQ ID NO: 320565 - RNA, 64 nt, hsa; identical to SEQ ID NO: 40864

SEQ ID NO: 320566 - RNA, 64 nt, hsa; identical to SEQ ID NO: 40865

SEQ ID NO: 320567 - RNA, 64 nt, hsa; identical to SEQ ID NO: 40866

SEQ ID NO: 320568 - RNA, 64 nt, hsa; identical to SEQ ID NO: 40867

SEQ ID NO: 320569 - RNA, 64 nt, hsa; identical to SEQ ID NO: 40868

SEQ ID NO: 320570 - RNA, 64 nt, hsa; identical to SEQ ID NO: 40869

SEQ ID NO: 320571 - RNA, 64 nt, hsa; identical to SEQ ID NO: 40870

SEQ ID NO: 320572 - RNA, 64 nt, hsa; identical to SEQ ID NO: 40871

SEQ ID NO: 320573 - RNA, 64 nt, hsa; identical to SEQ ID NO: 40872

SEQ ID NO: 320574 - RNA, 64 nt, hsa; identical to SEQ ID NO: 40873

SEQ ID NO: 320575 - RNA, 64 nt, hsa; identical to SEQ ID NO: 40874

SEQ ID NO: 320576 - RNA, 64 nt, hsa; identical to SEQ ID NO: 40875

SEQ ID NO: 320577 - RNA, 64 nt, hsa; identical to SEQ ID NO: 40876

SEQ ID NO: 320578 - RNA, 64 nt, hsa; identical to SEQ ID NO: 40877

SEQ ID NO: 320579 - RNA, 64 nt, hsa; identical to SEQ ID NO: 40878

SEQ ID NO: 320580 - RNA, 64 nt, hsa; identical to SEQ ID NO: 40879

SEQ ID NO: 320581 - RNA, 64 nt, hsa; identical to SEQ ID NO: 40880

SEQ ID NO: 320582 - RNA, 64 nt, hsa; identical to SEQ ID NO: 40881

SEQ ID NO: 320583 - RNA, 64 nt, hsa; identical to SEQ ID NO: 40882

SEQ ID NO: 320584 - RNA, 64 nt, hsa; identical to SEQ ID NO: 40883

SEQ ID NO: 320585 - RNA, 64 nt, hsa; identical to SEQ ID NO: 40884

SEQ ID NO: 320586 - RNA, 64 nt, hsa; identical to SEQ ID NO: 40885

SEQ ID NO: 320587 - RNA, 64 nt, hsa; identical to SEQ ID NO: 40886

SEQ ID NO: 320588 - RNA, 64 nt, hsa; identical to SEQ ID NO: 40887

SEQ ID NO: 320589 - RNA, 64 nt, hsa; identical to SEQ ID NO: 40888

SEQ ID NO: 320590 - RNA, 64 nt, hsa; identical to SEQ ID NO: 40889

SEQ ID NO: 320591 - RNA, 64 nt, hsa; identical to SEQ ID NO: 40890

SEQ ID NO: 320592 - RNA, 64 nt, hsa; identical to SEQ ID NO: 40891

SEQ ID NO: 320593 - RNA, 64 nt, hsa; identical to SEQ ID NO: 40892

SEQ ID NO: 320594 - RNA, 64 nt, hsa; identical to SEQ ID NO: 40893

SEQ ID NO: 320595 - RNA, 64 nt, hsa; identical to SEQ ID NO: 40894

SEQ ID NO: 320596 - RNA, 64 nt, hsa; identical to SEQ ID NO: 40895

SEQ ID NO: 320597 - RNA, 64 nt, hsa; identical to SEQ ID NO: 40896

SEQ ID NO: 320598 - RNA, 64 nt, hsa; identical to SEQ ID NO: 40897

SEQ ID NO: 320599 - RNA, 64 nt, hsa; identical to SEQ ID NO: 40898

SEQ ID NO: 320600 - RNA, 64 nt, hsa; identical to SEQ ID NO: 40899

SEQ ID NO: 320601 - RNA, 64 nt, hsa; identical to SEQ ID NO: 40900

SEQ ID NO: 320602 - RNA, 64 nt, hsa; identical to SEQ ID NO: 40901

SEQ ID NO: 320603 - RNA, 64 nt, hsa; identical to SEQ ID NO: 40902

SEQ ID NO: 320604 - RNA, 64 nt, hsa; identical to SEQ ID NO: 40903

SEQ ID NO: 320605 - RNA, 64 nt, hsa; identical to SEQ ID NO: 40904

SEQ ID NO: 320606 - RNA, 64 nt, hsa; identical to SEQ ID NO: 40905

SEQ ID NO: 320607 - RNA, 64 nt, hsa; identical to SEQ ID NO: 40906

SEQ ID NO: 320608 - RNA, 64 nt, hsa; identical to SEQ ID NO: 40907

SEQ ID NO: 320609 - RNA, 64 nt, hsa; identical to SEQ ID NO: 40908

SEQ ID NO: 320610 - RNA, 64 nt, hsa; identical to SEQ ID NO: 40909

SEQ ID NO: 320611 - RNA, 64 nt, hsa; identical to SEQ ID NO: 40910

SEQ ID NO: 320612 - RNA, 64 nt, hsa; identical to SEQ ID NO: 40911

SEQ ID NO: 320613 - RNA, 64 nt, hsa; identical to SEQ ID NO: 40912

SEQ ID NO: 320614 - RNA, 64 nt, hsa; identical to SEQ ID NO: 40913

SEQ ID NO: 320615 - RNA, 64 nt, hsa; identical to SEQ ID NO: 40914

SEQ ID NO: 320616 - RNA, 64 nt, hsa; identical to SEQ ID NO: 40915

SEQ ID NO: 320617 - RNA, 64 nt, hsa; identical to SEQ ID NO: 40916

SEQ ID NO: 320618 - RNA, 64 nt, hsa; identical to SEQ ID NO: 40917

SEQ ID NO: 320619 - RNA, 64 nt, hsa; identical to SEQ ID NO: 40918

SEQ ID NO: 320620 - RNA, 64 nt, hsa; identical to SEQ ID NO: 40919

SEQ ID NO: 320621 - RNA, 64 nt, hsa; identical to SEQ ID NO: 40920

SEQ ID NO: 320622 - RNA, 64 nt, hsa; identical to SEQ ID NO: 40921

SEQ ID NO: 320623 - RNA, 64 nt, hsa; identical to SEQ ID NO: 40922

SEQ ID NO: 320624 - RNA, 64 nt, hsa; identical to SEQ ID NO: 40923

SEQ ID NO: 320625 - RNA, 64 nt, hsa; identical to SEQ ID NO: 40924

SEQ ID NO: 320626 - RNA, 64 nt, hsa; identical to SEQ ID NO: 40925

SEQ ID NO: 320627 - RNA, 64 nt, hsa; identical to SEQ ID NO: 40926

SEQ ID NO: 320628 - RNA, 64 nt, hsa; identical to SEQ ID NO: 40927

SEQ ID NO: 320629 - RNA, 64 nt, hsa; identical to SEQ ID NO: 40928

SEQ ID NO: 320630 - RNA, 64 nt, hsa; identical to SEQ ID NO: 40929

SEQ ID NO: 320631 - RNA, 64 nt, hsa; identical to SEQ ID NO: 40930

SEQ ID NO: 320632 - RNA, 64 nt, hsa; identical to SEQ ID NO: 40931

SEQ ID NO: 320633 - RNA, 64 nt, hsa; identical to SEQ ID NO: 40932

SEQ ID NO: 320634 - RNA, 64 nt, hsa; identical to SEQ ID NO: 40933

SEQ ID NO: 320635 - RNA, 64 nt, hsa; identical to SEQ ID NO: 40934

SEQ ID NO: 320636 - RNA, 64 nt, hsa; identical to SEQ ID NO: 40935

SEQ ID NO: 320637 - RNA, 64 nt, hsa; identical to SEQ ID NO: 40936

SEQ ID NO: 320638 - RNA, 64 nt, hsa; identical to SEQ ID NO: 40937

SEQ ID NO: 320639 - RNA, 64 nt, hsa; identical to SEQ ID NO: 40938

SEQ ID NO: 320640 - RNA, 64 nt, hsa; identical to SEQ ID NO: 40939

SEQ ID NO: 320641 - RNA, 64 nt, hsa; identical to SEQ ID NO: 40940

SEQ ID NO: 320642 - RNA, 64 nt, hsa; identical to SEQ ID NO: 40941

SEQ ID NO: 320643 - RNA, 64 nt, hsa; identical to SEQ ID NO: 40942

SEQ ID NO: 320644 - RNA, 64 nt, hsa; identical to SEQ ID NO: 40943

SEQ ID NO: 320645 - RNA, 64 nt, hsa; identical to SEQ ID NO: 40944

SEQ ID NO: 320646 - RNA, 64 nt, hsa; identical to SEQ ID NO: 40945

SEQ ID NO: 320647 - RNA, 64 nt, hsa; identical to SEQ ID NO: 40946

SEQ ID NO: 320648 - RNA, 64 nt, hsa; identical to SEQ ID NO: 40947

SEQ ID NO: 320649 - RNA, 64 nt, hsa; identical to SEQ ID NO: 40948

SEQ ID NO: 320650 - RNA, 64 nt, hsa; identical to SEQ ID NO: 40949

SEQ ID NO: 320651 - RNA, 64 nt, hsa; identical to SEQ ID NO: 40950

SEQ ID NO: 320652 - RNA, 64 nt, hsa; identical to SEQ ID NO: 40951

SEQ ID NO: 320653 - RNA, 64 nt, hsa; identical to SEQ ID NO: 40952

SEQ ID NO: 320654 - RNA, 64 nt, hsa; identical to SEQ ID NO: 40953

SEQ ID NO: 320655 - RNA, 64 nt, hsa; identical to SEQ ID NO: 40954

SEQ ID NO: 320656 - RNA, 64 nt, hsa; identical to SEQ ID NO: 40955

SEQ ID NO: 320657 - RNA, 64 nt, hsa; identical to SEQ ID NO: 40956

SEQ ID NO: 320658 - RNA, 64 nt, hsa; identical to SEQ ID NO: 40957

SEQ ID NO: 320659 - RNA, 64 nt, hsa; identical to SEQ ID NO: 40958

SEQ ID NO: 320660 - RNA, 64 nt, hsa; identical to SEQ ID NO: 40959

SEQ ID NO: 320661 - RNA, 64 nt, hsa; identical to SEQ ID NO: 40960

SEQ ID NO: 320662 - RNA, 64 nt, hsa; identical to SEQ ID NO: 40961

SEQ ID NO: 320663 - RNA, 64 nt, hsa; identical to SEQ ID NO: 40962

SEQ ID NO: 320664 - RNA, 64 nt, hsa; identical to SEQ ID NO: 40963

SEQ ID NO: 320665 - RNA, 64 nt, hsa; identical to SEQ ID NO: 40964

SEQ ID NO: 320666 - RNA, 64 nt, hsa; identical to SEQ ID NO: 40965

SEQ ID NO: 320667 - RNA, 64 nt, hsa; identical to SEQ ID NO: 40966

SEQ ID NO: 320668 - RNA, 64 nt, hsa; identical to SEQ ID NO: 40967

SEQ ID NO: 320669 - RNA, 64 nt, hsa; identical to SEQ ID NO: 40968

SEQ ID NO: 320670 - RNA, 64 nt, hsa; identical to SEQ ID NO: 40969

SEQ ID NO: 320671 - RNA, 64 nt, hsa; identical to SEQ ID NO: 40970

SEQ ID NO: 320672 - RNA, 64 nt, hsa; identical to SEQ ID NO: 40971

SEQ ID NO: 320673 - RNA, 64 nt, hsa; identical to SEQ ID NO: 40972

SEQ ID NO: 320674 - RNA, 64 nt, hsa; identical to SEQ ID NO: 40973

SEQ ID NO: 320675 - RNA, 64 nt, hsa; identical to SEQ ID NO: 40974

SEQ ID NO: 320676 - RNA, 64 nt, hsa; identical to SEQ ID NO: 40975

SEQ ID NO: 320677 - RNA, 64 nt, hsa; identical to SEQ ID NO: 40976

SEQ ID NO: 320678 - RNA, 64 nt, hsa; identical to SEQ ID NO: 40977

SEQ ID NO: 320679 - RNA, 64 nt, hsa; identical to SEQ ID NO: 40978

SEQ ID NO: 320680 - RNA, 64 nt, hsa; identical to SEQ ID NO: 40979

SEQ ID NO: 320681 - RNA, 64 nt, hsa; identical to SEQ ID NO: 40980

SEQ ID NO: 320682 - RNA, 64 nt, hsa; identical to SEQ ID NO: 40981

SEQ ID NO: 320683 - RNA, 64 nt, hsa; identical to SEQ ID NO: 40982

SEQ ID NO: 320684 - RNA, 64 nt, hsa; identical to SEQ ID NO: 40983

SEQ ID NO: 320685 - RNA, 64 nt, hsa; identical to SEQ ID NO: 40984

SEQ ID NO: 320686 - RNA, 64 nt, hsa; identical to SEQ ID NO: 40985

SEQ ID NO: 320687 - RNA, 64 nt, hsa; identical to SEQ ID NO: 40986

SEQ ID NO: 320688 - RNA, 64 nt, hsa; identical to SEQ ID NO: 40987

SEQ ID NO: 320689 - RNA, 64 nt, hsa; identical to SEQ ID NO: 40988

SEQ ID NO: 320690 - RNA, 64 nt, hsa; identical to SEQ ID NO: 40989

SEQ ID NO: 320691 - RNA, 64 nt, hsa; identical to SEQ ID NO: 40990

SEQ ID NO: 320692 - RNA, 64 nt, hsa; identical to SEQ ID NO: 40991

SEQ ID NO: 320693 - RNA, 64 nt, hsa; identical to SEQ ID NO: 40992

SEQ ID NO: 320694 - RNA, 64 nt, hsa; identical to SEQ ID NO: 40993

SEQ ID NO: 320695 - RNA, 64 nt, hsa; identical to SEQ ID NO: 40994

SEQ ID NO: 320696 - RNA, 64 nt, hsa; identical to SEQ ID NO: 40995

SEQ ID NO: 320697 - RNA, 64 nt, hsa; identical to SEQ ID NO: 40996

SEQ ID NO: 320698 - RNA, 64 nt, hsa; identical to SEQ ID NO: 40997

SEQ ID NO: 320699 - RNA, 64 nt, hsa; identical to SEQ ID NO: 40998

SEQ ID NO: 320700 - RNA, 64 nt, hsa; identical to SEQ ID NO: 40999

SEQ ID NO: 320701 - RNA, 64 nt, hsa; identical to SEQ ID NO: 41000

SEQ ID NO: 320702 - RNA, 64 nt, hsa; identical to SEQ ID NO: 41001

SEQ ID NO: 320703 - RNA, 64 nt, hsa; identical to SEQ ID NO: 41002

SEQ ID NO: 320704 - RNA, 64 nt, hsa; identical to SEQ ID NO: 41003

SEQ ID NO: 320705 - RNA, 64 nt, hsa; identical to SEQ ID NO: 41004

SEQ ID NO: 320706 - RNA, 64 nt, hsa; identical to SEQ ID NO: 41005

SEQ ID NO: 320707 - RNA, 64 nt, hsa; identical to SEQ ID NO: 41006

SEQ ID NO: 320708 - RNA, 63 nt, hsa; identical to SEQ ID NO: 41007

SEQ ID NO: 320709 - RNA, 64 nt, hsa; identical to SEQ ID NO: 41008

SEQ ID NO: 320710 - RNA, 64 nt, hsa; identical to SEQ ID NO: 41009

SEQ ID NO: 320711 - RNA, 64 nt, hsa; identical to SEQ ID NO: 41010

SEQ ID NO: 320712 - RNA, 64 nt, hsa; identical to SEQ ID NO: 41011

SEQ ID NO: 320713 - RNA, 64 nt, hsa; identical to SEQ ID NO: 41012

SEQ ID NO: 320714 - RNA, 64 nt, hsa; identical to SEQ ID NO: 41013

SEQ ID NO: 320715 - RNA, 64 nt, hsa; identical to SEQ ID NO: 41014

SEQ ID NO: 320716 - RNA, 64 nt, hsa; identical to SEQ ID NO: 41015

SEQ ID NO: 320717 - RNA, 64 nt, hsa; identical to SEQ ID NO: 41016

SEQ ID NO: 320718 - RNA, 64 nt, hsa; identical to SEQ ID NO: 41017

SEQ ID NO: 320719 - RNA, 64 nt, hsa; identical to SEQ ID NO: 41018

SEQ ID NO: 320720 - RNA, 64 nt, hsa; identical to SEQ ID NO: 41019

SEQ ID NO: 320721 - RNA, 64 nt, hsa; identical to SEQ ID NO: 41020

SEQ ID NO: 320722 - RNA, 64 nt, hsa; identical to SEQ ID NO: 41021

SEQ ID NO: 320723 - RNA, 64 nt, hsa; identical to SEQ ID NO: 41022

SEQ ID NO: 320724 - RNA, 64 nt, hsa; identical to SEQ ID NO: 41023

SEQ ID NO: 320725 - RNA, 64 nt, hsa; identical to SEQ ID NO: 41024

SEQ ID NO: 320726 - RNA, 64 nt, hsa; identical to SEQ ID NO: 41025

SEQ ID NO: 320727 - RNA, 64 nt, hsa; identical to SEQ ID NO: 41026

SEQ ID NO: 320728 - RNA, 64 nt, hsa; identical to SEQ ID NO: 41027

SEQ ID NO: 320729 - RNA, 64 nt, hsa; identical to SEQ ID NO: 41028

SEQ ID NO: 320730 - RNA, 64 nt, hsa; identical to SEQ ID NO: 41029

SEQ ID NO: 320731 - RNA, 64 nt, hsa; identical to SEQ ID NO: 41030

SEQ ID NO: 320732 - RNA, 64 nt, hsa; identical to SEQ ID NO: 41031

SEQ ID NO: 320733 - RNA, 64 nt, hsa; identical to SEQ ID NO: 41032

SEQ ID NO: 320734 - RNA, 64 nt, hsa; identical to SEQ ID NO: 41033

SEQ ID NO: 320735 - RNA, 64 nt, hsa; identical to SEQ ID NO: 41034

SEQ ID NO: 320736 - RNA, 64 nt, hsa; identical to SEQ ID NO: 41035

SEQ ID NO: 320737 - RNA, 64 nt, hsa; identical to SEQ ID NO: 41036

SEQ ID NO: 320738 - RNA, 64 nt, hsa; identical to SEQ ID NO: 41037

SEQ ID NO: 320739 - RNA, 64 nt, hsa; identical to SEQ ID NO: 41038

SEQ ID NO: 320740 - RNA, 64 nt, hsa; identical to SEQ ID NO: 41039

SEQ ID NO: 320741 - RNA, 64 nt, hsa; identical to SEQ ID NO: 41040

SEQ ID NO: 320742 - RNA, 64 nt, hsa; identical to SEQ ID NO: 41041

SEQ ID NO: 320743 - RNA, 64 nt, hsa; identical to SEQ ID NO: 41042

SEQ ID NO: 320744 - RNA, 64 nt, hsa; identical to SEQ ID NO: 41043

SEQ ID NO: 320745 - RNA, 64 nt, hsa; identical to SEQ ID NO: 41044

SEQ ID NO: 320746 - RNA, 64 nt, hsa; identical to SEQ ID NO: 41045

SEQ ID NO: 320747 - RNA, 64 nt, hsa; identical to SEQ ID NO: 41046

SEQ ID NO: 320748 - RNA, 64 nt, hsa; identical to SEQ ID NO: 41047

SEQ ID NO: 320749 - RNA, 64 nt, hsa; identical to SEQ ID NO: 41048

SEQ ID NO: 320750 - RNA, 64 nt, hsa; identical to SEQ ID NO: 41049

SEQ ID NO: 320751 - RNA, 64 nt, hsa; identical to SEQ ID NO: 41050

SEQ ID NO: 320752 - RNA, 64 nt, hsa; identical to SEQ ID NO: 41051

SEQ ID NO: 320753 - RNA, 64 nt, hsa; identical to SEQ ID NO: 41052

SEQ ID NO: 320754 - RNA, 64 nt, hsa; identical to SEQ ID NO: 41053

SEQ ID NO: 320755 - RNA, 64 nt, hsa; identical to SEQ ID NO: 41054

SEQ ID NO: 320756 - RNA, 64 nt, hsa; identical to SEQ ID NO: 41055

SEQ ID NO: 320757 - RNA, 64 nt, hsa; identical to SEQ ID NO: 41056

SEQ ID NO: 320758 - RNA, 64 nt, hsa; identical to SEQ ID NO: 41057

SEQ ID NO: 320759 - RNA, 64 nt, hsa; identical to SEQ ID NO: 41058

SEQ ID NO: 320760 - RNA, 64 nt, hsa; identical to SEQ ID NO: 41059

SEQ ID NO: 320761 - RNA, 64 nt, hsa; identical to SEQ ID NO: 41060

SEQ ID NO: 320762 - RNA, 64 nt, hsa; identical to SEQ ID NO: 41061

SEQ ID NO: 320763 - RNA, 64 nt, hsa; identical to SEQ ID NO: 41062

SEQ ID NO: 320764 - RNA, 64 nt, hsa; identical to SEQ ID NO: 41063

SEQ ID NO: 320765 - RNA, 64 nt, hsa; identical to SEQ ID NO: 41064

SEQ ID NO: 320766 - RNA, 64 nt, hsa; identical to SEQ ID NO: 41065

SEQ ID NO: 320767 - RNA, 64 nt, hsa; identical to SEQ ID NO: 41066

SEQ ID NO: 320768 - RNA, 64 nt, hsa; identical to SEQ ID NO: 41067

SEQ ID NO: 320769 - RNA, 64 nt, hsa; identical to SEQ ID NO: 41068

SEQ ID NO: 320770 - RNA, 64 nt, hsa; identical to SEQ ID NO: 41069

SEQ ID NO: 320771 - RNA, 64 nt, hsa; identical to SEQ ID NO: 41070

SEQ ID NO: 320772 - RNA, 64 nt, hsa; identical to SEQ ID NO: 41071

SEQ ID NO: 320773 - RNA, 64 nt, hsa; identical to SEQ ID NO: 41072

SEQ ID NO: 320774 - RNA, 64 nt, hsa; identical to SEQ ID NO: 41073

SEQ ID NO: 320775 - RNA, 64 nt, hsa; identical to SEQ ID NO: 41074

SEQ ID NO: 320776 - RNA, 64 nt, hsa; identical to SEQ ID NO: 41075

SEQ ID NO: 320777 - RNA, 64 nt, hsa; identical to SEQ ID NO: 41076

SEQ ID NO: 320778 - RNA, 64 nt, hsa; identical to SEQ ID NO: 41077

SEQ ID NO: 320779 - RNA, 64 nt, hsa; identical to SEQ ID NO: 41078

SEQ ID NO: 320780 - RNA, 64 nt, hsa; identical to SEQ ID NO: 41079

SEQ ID NO: 320781 - RNA, 64 nt, hsa; identical to SEQ ID NO: 41080

SEQ ID NO: 320782 - RNA, 64 nt, hsa; identical to SEQ ID NO: 41081

SEQ ID NO: 320783 - RNA, 64 nt, hsa; identical to SEQ ID NO: 41082

SEQ ID NO: 320784 - RNA, 64 nt, hsa; identical to SEQ ID NO: 41083

SEQ ID NO: 320785 - RNA, 64 nt, hsa; identical to SEQ ID NO: 41084

SEQ ID NO: 320786 - RNA, 64 nt, hsa; identical to SEQ ID NO: 41085

SEQ ID NO: 320787 - RNA, 64 nt, hsa; identical to SEQ ID NO: 41086

SEQ ID NO: 320788 - RNA, 64 nt, hsa; identical to SEQ ID NO: 41087

SEQ ID NO: 320789 - RNA, 64 nt, hsa; identical to SEQ ID NO: 41088

SEQ ID NO: 320790 - RNA, 64 nt, hsa; identical to SEQ ID NO: 41089

SEQ ID NO: 320791 - RNA, 64 nt, hsa; identical to SEQ ID NO: 41090

SEQ ID NO: 320792 - RNA, 64 nt, hsa; identical to SEQ ID NO: 41091

SEQ ID NO: 320793 - RNA, 64 nt, hsa; identical to SEQ ID NO: 41092

SEQ ID NO: 320794 - RNA, 64 nt, hsa; identical to SEQ ID NO: 41093

SEQ ID NO: 320795 - RNA, 64 nt, hsa; identical to SEQ ID NO: 41094

SEQ ID NO: 320796 - RNA, 64 nt, hsa; identical to SEQ ID NO: 41095

SEQ ID NO: 320797 - RNA, 64 nt, hsa; identical to SEQ ID NO: 41096

SEQ ID NO: 320798 - RNA, 64 nt, hsa; identical to SEQ ID NO: 41097

SEQ ID NO: 320799 - RNA, 64 nt, hsa; identical to SEQ ID NO: 41098

SEQ ID NO: 320800 - RNA, 64 nt, hsa; identical to SEQ ID NO: 41099

SEQ ID NO: 320801 - RNA, 64 nt, hsa; identical to SEQ ID NO: 41100

SEQ ID NO: 320802 - RNA, 64 nt, hsa; identical to SEQ ID NO: 41101

SEQ ID NO: 320803 - RNA, 64 nt, hsa; identical to SEQ ID NO: 41102

SEQ ID NO: 320804 - RNA, 64 nt, hsa; identical to SEQ ID NO: 41103

SEQ ID NO: 320805 - RNA, 64 nt, hsa; identical to SEQ ID NO: 41104

SEQ ID NO: 320806 - RNA, 64 nt, hsa; identical to SEQ ID NO: 41105

SEQ ID NO: 320807 - RNA, 64 nt, hsa; identical to SEQ ID NO: 41106

SEQ ID NO: 320808 - RNA, 64 nt, hsa; identical to SEQ ID NO: 41107

SEQ ID NO: 320809 - RNA, 64 nt, hsa; identical to SEQ ID NO: 41108

SEQ ID NO: 320810 - RNA, 64 nt, hsa; identical to SEQ ID NO: 41109

SEQ ID NO: 320811 - RNA, 64 nt, hsa; identical to SEQ ID NO: 41110

SEQ ID NO: 320812 - RNA, 64 nt, hsa; identical to SEQ ID NO: 41111

SEQ ID NO: 320813 - RNA, 64 nt, hsa; identical to SEQ ID NO: 41112

SEQ ID NO: 320814 - RNA, 64 nt, hsa; identical to SEQ ID NO: 41113

SEQ ID NO: 320815 - RNA, 64 nt, hsa; identical to SEQ ID NO: 41114

SEQ ID NO: 320816 - RNA, 64 nt, hsa; identical to SEQ ID NO: 41115

SEQ ID NO: 320817 - RNA, 64 nt, hsa; identical to SEQ ID NO: 41116

SEQ ID NO: 320818 - RNA, 64 nt, hsa; identical to SEQ ID NO: 41117

SEQ ID NO: 320819 - RNA, 64 nt, hsa; identical to SEQ ID NO: 41118

SEQ ID NO: 320820 - RNA, 64 nt, hsa; identical to SEQ ID NO: 41119

SEQ ID NO: 320821 - RNA, 64 nt, hsa; identical to SEQ ID NO: 41120

SEQ ID NO: 320822 - RNA, 64 nt, hsa; identical to SEQ ID NO: 41121

SEQ ID NO: 320823 - RNA, 64 nt, hsa; identical to SEQ ID NO: 41122

SEQ ID NO: 320824 - RNA, 64 nt, hsa; identical to SEQ ID NO: 41123

SEQ ID NO: 320825 - RNA, 64 nt, hsa; identical to SEQ ID NO: 41124

SEQ ID NO: 320826 - RNA, 64 nt, hsa; identical to SEQ ID NO: 41125

SEQ ID NO: 320827 - RNA, 64 nt, hsa; identical to SEQ ID NO: 41126

SEQ ID NO: 320828 - RNA, 64 nt, hsa; identical to SEQ ID NO: 41127

SEQ ID NO: 320829 - RNA, 64 nt, hsa; identical to SEQ ID NO: 41128

SEQ ID NO: 320830 - RNA, 64 nt, hsa; identical to SEQ ID NO: 41129

SEQ ID NO: 320831 - RNA, 64 nt, hsa; identical to SEQ ID NO: 41130

SEQ ID NO: 320832 - RNA, 64 nt, hsa; identical to SEQ ID NO: 41131

SEQ ID NO: 320833 - RNA, 64 nt, hsa; identical to SEQ ID NO: 41132

SEQ ID NO: 320834 - RNA, 64 nt, hsa; identical to SEQ ID NO: 41133

SEQ ID NO: 320835 - RNA, 64 nt, hsa; identical to SEQ ID NO: 41134

SEQ ID NO: 320836 - RNA, 64 nt, hsa; identical to SEQ ID NO: 41135

SEQ ID NO: 320837 - RNA, 64 nt, hsa; identical to SEQ ID NO: 41136

SEQ ID NO: 320838 - RNA, 64 nt, hsa; identical to SEQ ID NO: 41137

SEQ ID NO: 320839 - RNA, 64 nt, hsa; identical to SEQ ID NO: 41138

SEQ ID NO: 320840 - RNA, 64 nt, hsa; identical to SEQ ID NO: 41139

SEQ ID NO: 320841 - RNA, 64 nt, hsa; identical to SEQ ID NO: 41140

SEQ ID NO: 320842 - RNA, 64 nt, hsa; identical to SEQ ID NO: 41141

SEQ ID NO: 320843 - RNA, 64 nt, hsa; identical to SEQ ID NO: 41142

SEQ ID NO: 320844 - RNA, 64 nt, hsa; identical to SEQ ID NO: 41143

SEQ ID NO: 320845 - RNA, 64 nt, hsa; identical to SEQ ID NO: 41144

SEQ ID NO: 320846 - RNA, 64 nt, hsa; identical to SEQ ID NO: 41145

SEQ ID NO: 320847 - RNA, 64 nt, hsa; identical to SEQ ID NO: 41146

SEQ ID NO: 320848 - RNA, 64 nt, hsa; identical to SEQ ID NO: 41147

SEQ ID NO: 320849 - RNA, 64 nt, hsa; identical to SEQ ID NO: 41148

SEQ ID NO: 320850 - RNA, 64 nt, hsa; identical to SEQ ID NO: 41149

SEQ ID NO: 320851 - RNA, 64 nt, hsa; identical to SEQ ID NO: 41150

SEQ ID NO: 320852 - RNA, 64 nt, hsa; identical to SEQ ID NO: 41151

SEQ ID NO: 320853 - RNA, 64 nt, hsa; identical to SEQ ID NO: 41152

SEQ ID NO: 320854 - RNA, 64 nt, hsa; identical to SEQ ID NO: 41153

SEQ ID NO: 320855 - RNA, 64 nt, hsa; identical to SEQ ID NO: 41154

SEQ ID NO: 320856 - RNA, 64 nt, hsa; identical to SEQ ID NO: 41155

SEQ ID NO: 320857 - RNA, 64 nt, hsa; identical to SEQ ID NO: 41156

SEQ ID NO: 320858 - RNA, 64 nt, hsa; identical to SEQ ID NO: 41157

SEQ ID NO: 320859 - RNA, 64 nt, hsa; identical to SEQ ID NO: 41158

SEQ ID NO: 320860 - RNA, 64 nt, hsa; identical to SEQ ID NO: 41159

SEQ ID NO: 320861 - RNA, 64 nt, hsa; identical to SEQ ID NO: 41160

SEQ ID NO: 320862 - RNA, 64 nt, hsa; identical to SEQ ID NO: 41161

SEQ ID NO: 320863 - RNA, 64 nt, hsa; identical to SEQ ID NO: 41162

SEQ ID NO: 320864 - RNA, 64 nt, hsa; identical to SEQ ID NO: 41163

SEQ ID NO: 320865 - RNA, 64 nt, hsa; identical to SEQ ID NO: 41164

SEQ ID NO: 320866 - RNA, 64 nt, hsa; identical to SEQ ID NO: 41165

SEQ ID NO: 320867 - RNA, 64 nt, hsa; identical to SEQ ID NO: 41166

SEQ ID NO: 320868 - RNA, 64 nt, hsa; identical to SEQ ID NO: 41167

SEQ ID NO: 320869 - RNA, 64 nt, hsa; identical to SEQ ID NO: 41168

SEQ ID NO: 320870 - RNA, 64 nt, hsa; identical to SEQ ID NO: 41169

SEQ ID NO: 320871 - RNA, 64 nt, hsa; identical to SEQ ID NO: 41170

SEQ ID NO: 320872 - RNA, 64 nt, hsa; identical to SEQ ID NO: 41171

SEQ ID NO: 320873 - RNA, 64 nt, hsa; identical to SEQ ID NO: 41172

SEQ ID NO: 320874 - RNA, 64 nt, hsa; identical to SEQ ID NO: 41173

SEQ ID NO: 320875 - RNA, 64 nt, hsa; identical to SEQ ID NO: 41174

SEQ ID NO: 320876 - RNA, 64 nt, hsa; identical to SEQ ID NO: 41175

SEQ ID NO: 320877 - RNA, 64 nt, hsa; identical to SEQ ID NO: 41176

SEQ ID NO: 320878 - RNA, 64 nt, hsa; identical to SEQ ID NO: 41177

SEQ ID NO: 320879 - RNA, 64 nt, hsa; identical to SEQ ID NO: 41178

SEQ ID NO: 320880 - RNA, 64 nt, hsa; identical to SEQ ID NO: 41179

SEQ ID NO: 320881 - RNA, 64 nt, hsa; identical to SEQ ID NO: 41180

SEQ ID NO: 320882 - RNA, 64 nt, hsa; identical to SEQ ID NO: 41181

SEQ ID NO: 320883 - RNA, 64 nt, hsa; identical to SEQ ID NO: 41182

SEQ ID NO: 320884 - RNA, 64 nt, hsa; identical to SEQ ID NO: 41183

SEQ ID NO: 320885 - RNA, 64 nt, hsa; identical to SEQ ID NO: 41184

SEQ ID NO: 320886 - RNA, 64 nt, hsa; identical to SEQ ID NO: 41185

SEQ ID NO: 320887 - RNA, 64 nt, hsa; identical to SEQ ID NO: 41186

SEQ ID NO: 320888 - RNA, 64 nt, hsa; identical to SEQ ID NO: 41187

SEQ ID NO: 320889 - RNA, 64 nt, hsa; identical to SEQ ID NO: 41188

SEQ ID NO: 320890 - RNA, 64 nt, hsa; identical to SEQ ID NO: 41189

SEQ ID NO: 320891 - RNA, 64 nt, hsa; identical to SEQ ID NO: 41190

SEQ ID NO: 320892 - RNA, 64 nt, hsa; identical to SEQ ID NO: 41191

SEQ ID NO: 320893 - RNA, 64 nt, hsa; identical to SEQ ID NO: 41192

SEQ ID NO: 320894 - RNA, 64 nt, hsa; identical to SEQ ID NO: 41193

SEQ ID NO: 320895 - RNA, 64 nt, hsa; identical to SEQ ID NO: 41194

SEQ ID NO: 320896 - RNA, 64 nt, hsa; identical to SEQ ID NO: 41195

SEQ ID NO: 320897 - RNA, 64 nt, hsa; identical to SEQ ID NO: 41196

SEQ ID NO: 320898 - RNA, 64 nt, hsa; identical to SEQ ID NO: 41197

SEQ ID NO: 320899 - RNA, 64 nt, hsa; identical to SEQ ID NO: 41198

SEQ ID NO: 320900 - RNA, 64 nt, hsa; identical to SEQ ID NO: 41199

SEQ ID NO: 320901 - RNA, 64 nt, hsa; identical to SEQ ID NO: 41200

SEQ ID NO: 320902 - RNA, 64 nt, hsa; identical to SEQ ID NO: 41201

SEQ ID NO: 320903 - RNA, 64 nt, hsa; identical to SEQ ID NO: 41202

SEQ ID NO: 320904 - RNA, 64 nt, hsa; identical to SEQ ID NO: 41203

SEQ ID NO: 320905 - RNA, 64 nt, hsa; identical to SEQ ID NO: 41204

SEQ ID NO: 320906 - RNA, 64 nt, hsa; identical to SEQ ID NO: 41205

SEQ ID NO: 320907 - RNA, 64 nt, hsa; identical to SEQ ID NO: 41206

SEQ ID NO: 320908 - RNA, 64 nt, hsa; identical to SEQ ID NO: 41207

SEQ ID NO: 320909 - RNA, 64 nt, hsa; identical to SEQ ID NO: 41208

SEQ ID NO: 320910 - RNA, 64 nt, hsa; identical to SEQ ID NO: 41209

SEQ ID NO: 320911 - RNA, 64 nt, hsa; identical to SEQ ID NO: 41210

SEQ ID NO: 320912 - RNA, 64 nt, hsa; identical to SEQ ID NO: 41211

SEQ ID NO: 320913 - RNA, 64 nt, hsa; identical to SEQ ID NO: 41212

SEQ ID NO: 320914 - RNA, 64 nt, hsa; identical to SEQ ID NO: 41213

SEQ ID NO: 320915 - RNA, 64 nt, hsa; identical to SEQ ID NO: 41214

SEQ ID NO: 320916 - RNA, 64 nt, hsa; identical to SEQ ID NO: 41215

SEQ ID NO: 320917 - RNA, 64 nt, hsa; identical to SEQ ID NO: 41216

SEQ ID NO: 320918 - RNA, 64 nt, hsa; identical to SEQ ID NO: 41217

SEQ ID NO: 320919 - RNA, 64 nt, hsa; identical to SEQ ID NO: 41218

SEQ ID NO: 320920 - RNA, 64 nt, hsa; identical to SEQ ID NO: 41219

SEQ ID NO: 320921 - RNA, 64 nt, hsa; identical to SEQ ID NO: 41220

SEQ ID NO: 320922 - RNA, 64 nt, hsa; identical to SEQ ID NO: 41221

SEQ ID NO: 320923 - RNA, 64 nt, hsa; identical to SEQ ID NO: 41222

SEQ ID NO: 320924 - RNA, 64 nt, hsa; identical to SEQ ID NO: 41223

SEQ ID NO: 320925 - RNA, 64 nt, hsa; identical to SEQ ID NO: 41224

SEQ ID NO: 320926 - RNA, 64 nt, hsa; identical to SEQ ID NO: 41225

SEQ ID NO: 320927 - RNA, 64 nt, hsa; identical to SEQ ID NO: 41226

SEQ ID NO: 320928 - RNA, 64 nt, hsa; identical to SEQ ID NO: 41227

SEQ ID NO: 320929 - RNA, 64 nt, hsa; identical to SEQ ID NO: 41228

SEQ ID NO: 320930 - RNA, 64 nt, hsa; identical to SEQ ID NO: 41229

SEQ ID NO: 320931 - RNA, 64 nt, hsa; identical to SEQ ID NO: 41230

SEQ ID NO: 320932 - RNA, 64 nt, hsa; identical to SEQ ID NO: 41231

SEQ ID NO: 320933 - RNA, 64 nt, hsa; identical to SEQ ID NO: 41232

SEQ ID NO: 320934 - RNA, 64 nt, hsa; identical to SEQ ID NO: 41233

SEQ ID NO: 320935 - RNA, 64 nt, hsa; identical to SEQ ID NO: 41234

SEQ ID NO: 320936 - RNA, 64 nt, hsa; identical to SEQ ID NO: 41235

SEQ ID NO: 320937 - RNA, 62 nt, hsa; identical to SEQ ID NO: 41236

SEQ ID NO: 320938 - RNA, 60 nt, hsa; identical to SEQ ID NO: 41237

SEQ ID NO: 320939 - RNA, 58 nt, hsa; identical to SEQ ID NO: 41238

SEQ ID NO: 320940 - RNA, 56 nt, hsa; identical to SEQ ID NO: 41239

SEQ ID NO: 320941 - RNA, 54 nt, hsa; identical to SEQ ID NO: 41240

SEQ ID NO: 320942 - RNA, 64 nt, hsa; identical to SEQ ID NO: 41241

SEQ ID NO: 320943 - RNA, 64 nt, hsa; identical to SEQ ID NO: 41242

SEQ ID NO: 320944 - RNA, 64 nt, hsa; identical to SEQ ID NO: 41243

SEQ ID NO: 320945 - RNA, 64 nt, hsa; identical to SEQ ID NO: 41244

SEQ ID NO: 320946 - RNA, 64 nt, hsa; identical to SEQ ID NO: 41245

SEQ ID NO: 320947 - RNA, 64 nt, hsa; identical to SEQ ID NO: 41246

SEQ ID NO: 320948 - RNA, 64 nt, hsa; identical to SEQ ID NO: 41247

SEQ ID NO: 320949 - RNA, 64 nt, hsa; identical to SEQ ID NO: 41248

SEQ ID NO: 320950 - RNA, 64 nt, hsa; identical to SEQ ID NO: 41249

SEQ ID NO: 320951 - RNA, 64 nt, hsa; identical to SEQ ID NO: 41250

SEQ ID NO: 320952 - RNA, 64 nt, hsa; identical to SEQ ID NO: 41251

SEQ ID NO: 320953 - RNA, 64 nt, hsa; identical to SEQ ID NO: 41252

SEQ ID NO: 320954 - RNA, 64 nt, hsa; identical to SEQ ID NO: 41253

SEQ ID NO: 320955 - RNA, 64 nt, hsa; identical to SEQ ID NO: 41254

SEQ ID NO: 320956 - RNA, 64 nt, hsa; identical to SEQ ID NO: 41255

SEQ ID NO: 320957 - RNA, 64 nt, hsa; identical to SEQ ID NO: 41256

SEQ ID NO: 320958 - RNA, 64 nt, hsa; identical to SEQ ID NO: 41257

SEQ ID NO: 320959 - RNA, 64 nt, hsa; identical to SEQ ID NO: 41258

SEQ ID NO: 320960 - RNA, 64 nt, hsa; identical to SEQ ID NO: 41259

SEQ ID NO: 320961 - RNA, 64 nt, hsa; identical to SEQ ID NO: 41260

SEQ ID NO: 320962 - RNA, 64 nt, hsa; identical to SEQ ID NO: 41261

SEQ ID NO: 320963 - RNA, 64 nt, hsa; identical to SEQ ID NO: 41262

SEQ ID NO: 320964 - RNA, 64 nt, hsa; identical to SEQ ID NO: 41263

SEQ ID NO: 320965 - RNA, 64 nt, hsa; identical to SEQ ID NO: 41264

SEQ ID NO: 320966 - RNA, 64 nt, hsa; identical to SEQ ID NO: 41265

SEQ ID NO: 320967 - RNA, 64 nt, hsa; identical to SEQ ID NO: 41266

SEQ ID NO: 320968 - RNA, 64 nt, hsa; identical to SEQ ID NO: 41267

SEQ ID NO: 320969 - RNA, 64 nt, hsa; identical to SEQ ID NO: 41268

SEQ ID NO: 320970 - RNA, 64 nt, hsa; identical to SEQ ID NO: 41269

SEQ ID NO: 320971 - RNA, 64 nt, hsa; identical to SEQ ID NO: 41270

SEQ ID NO: 320972 - RNA, 64 nt, hsa; identical to SEQ ID NO: 41271

SEQ ID NO: 320973 - RNA, 64 nt, hsa; identical to SEQ ID NO: 41272

SEQ ID NO: 320974 - RNA, 64 nt, hsa; identical to SEQ ID NO: 41273

SEQ ID NO: 320975 - RNA, 64 nt, hsa; identical to SEQ ID NO: 41274

SEQ ID NO: 320976 - RNA, 64 nt, hsa; identical to SEQ ID NO: 41275

SEQ ID NO: 320977 - RNA, 64 nt, hsa; identical to SEQ ID NO: 41276

SEQ ID NO: 320978 - RNA, 64 nt, hsa; identical to SEQ ID NO: 41277

SEQ ID NO: 320979 - RNA, 64 nt, hsa; identical to SEQ ID NO: 41278

SEQ ID NO: 320980 - RNA, 64 nt, hsa; identical to SEQ ID NO: 41279

SEQ ID NO: 320981 - RNA, 64 nt, hsa; identical to SEQ ID NO: 41280

SEQ ID NO: 320982 - RNA, 64 nt, hsa; identical to SEQ ID NO: 41281

SEQ ID NO: 320983 - RNA, 64 nt, hsa; identical to SEQ ID NO: 41282

SEQ ID NO: 320984 - RNA, 64 nt, hsa; identical to SEQ ID NO: 41283

SEQ ID NO: 320985 - RNA, 64 nt, hsa; identical to SEQ ID NO: 41284

SEQ ID NO: 320986 - RNA, 64 nt, hsa; identical to SEQ ID NO: 41285

SEQ ID NO: 320987 - RNA, 64 nt, hsa; identical to SEQ ID NO: 41286

SEQ ID NO: 320988 - RNA, 64 nt, hsa; identical to SEQ ID NO: 41287

SEQ ID NO: 320989 - RNA, 64 nt, hsa; identical to SEQ ID NO: 41288

SEQ ID NO: 320990 - RNA, 64 nt, hsa; identical to SEQ ID NO: 41289

SEQ ID NO: 320991 - RNA, 64 nt, hsa; identical to SEQ ID NO: 41290

SEQ ID NO: 320992 - RNA, 64 nt, hsa; identical to SEQ ID NO: 41291

SEQ ID NO: 320993 - RNA, 64 nt, hsa; identical to SEQ ID NO: 41292

SEQ ID NO: 320994 - RNA, 64 nt, hsa; identical to SEQ ID NO: 41293

SEQ ID NO: 320995 - RNA, 64 nt, hsa; identical to SEQ ID NO: 41294

SEQ ID NO: 320996 - RNA, 64 nt, hsa; identical to SEQ ID NO: 41295

SEQ ID NO: 320997 - RNA, 64 nt, hsa; identical to SEQ ID NO: 41296

SEQ ID NO: 320998 - RNA, 64 nt, hsa; identical to SEQ ID NO: 41297

SEQ ID NO: 320999 - RNA, 64 nt, hsa; identical to SEQ ID NO: 41298

SEQ ID NO: 321000 - RNA, 64 nt, hsa; identical to SEQ ID NO: 41299

SEQ ID NO: 321001 - RNA, 64 nt, hsa; identical to SEQ ID NO: 41300

SEQ ID NO: 321002 - RNA, 64 nt, hsa; identical to SEQ ID NO: 41301

SEQ ID NO: 321003 - RNA, 64 nt, hsa; identical to SEQ ID NO: 41302

SEQ ID NO: 321004 - RNA, 64 nt, hsa; identical to SEQ ID NO: 41303

SEQ ID NO: 321005 - RNA, 64 nt, hsa; identical to SEQ ID NO: 41304

SEQ ID NO: 321006 - RNA, 64 nt, hsa; identical to SEQ ID NO: 41305

SEQ ID NO: 321007 - RNA, 64 nt, hsa; identical to SEQ ID NO: 41306

SEQ ID NO: 321008 - RNA, 64 nt, hsa; identical to SEQ ID NO: 41307

SEQ ID NO: 321009 - RNA, 64 nt, hsa; identical to SEQ ID NO: 41308

SEQ ID NO: 321010 - RNA, 64 nt, hsa; identical to SEQ ID NO: 41309

SEQ ID NO: 321011 - RNA, 64 nt, hsa; identical to SEQ ID NO: 41310

SEQ ID NO: 321012 - RNA, 64 nt, hsa; identical to SEQ ID NO: 41311

SEQ ID NO: 321013 - RNA, 64 nt, hsa; identical to SEQ ID NO: 41312

SEQ ID NO: 321014 - RNA, 64 nt, hsa; identical to SEQ ID NO: 41313

SEQ ID NO: 321015 - RNA, 64 nt, hsa; identical to SEQ ID NO: 41314

SEQ ID NO: 321016 - RNA, 64 nt, hsa; identical to SEQ ID NO: 41315

SEQ ID NO: 321017 - RNA, 64 nt, hsa; identical to SEQ ID NO: 41316

SEQ ID NO: 321018 - RNA, 64 nt, hsa; identical to SEQ ID NO: 41317

SEQ ID NO: 321019 - RNA, 64 nt, hsa; identical to SEQ ID NO: 41318

SEQ ID NO: 321020 - RNA, 64 nt, hsa; identical to SEQ ID NO: 41319

SEQ ID NO: 321021 - RNA, 64 nt, hsa; identical to SEQ ID NO: 41320

SEQ ID NO: 321022 - RNA, 64 nt, hsa; identical to SEQ ID NO: 41321

SEQ ID NO: 321023 - RNA, 64 nt, hsa; identical to SEQ ID NO: 41322

SEQ ID NO: 321024 - RNA, 64 nt, hsa; identical to SEQ ID NO: 41323

SEQ ID NO: 321025 - RNA, 64 nt, hsa; identical to SEQ ID NO: 41324

SEQ ID NO: 321026 - RNA, 64 nt, hsa; identical to SEQ ID NO: 41325

SEQ ID NO: 321027 - RNA, 64 nt, hsa; identical to SEQ ID NO: 41326

SEQ ID NO: 321028 - RNA, 64 nt, hsa; identical to SEQ ID NO: 41327

SEQ ID NO: 321029 - RNA, 64 nt, hsa; identical to SEQ ID NO: 41328

SEQ ID NO: 321030 - RNA, 64 nt, hsa; identical to SEQ ID NO: 41329

SEQ ID NO: 321031 - RNA, 64 nt, hsa; identical to SEQ ID NO: 41330

SEQ ID NO: 321032 - RNA, 64 nt, hsa; identical to SEQ ID NO: 41331

SEQ ID NO: 321033 - RNA, 64 nt, hsa; identical to SEQ ID NO: 41332

SEQ ID NO: 321034 - RNA, 64 nt, hsa; identical to SEQ ID NO: 41333

SEQ ID NO: 321035 - RNA, 64 nt, hsa; identical to SEQ ID NO: 41334

SEQ ID NO: 321036 - RNA, 64 nt, hsa; identical to SEQ ID NO: 41335

SEQ ID NO: 321037 - RNA, 64 nt, hsa; identical to SEQ ID NO: 41336

SEQ ID NO: 321038 - RNA, 64 nt, hsa; identical to SEQ ID NO: 41337

SEQ ID NO: 321039 - RNA, 64 nt, hsa; identical to SEQ ID NO: 41338

SEQ ID NO: 321040 - RNA, 64 nt, hsa; identical to SEQ ID NO: 41339

SEQ ID NO: 321041 - RNA, 64 nt, hsa; identical to SEQ ID NO: 41340

SEQ ID NO: 321042 - RNA, 64 nt, hsa; identical to SEQ ID NO: 41341

SEQ ID NO: 321043 - RNA, 64 nt, hsa; identical to SEQ ID NO: 41342

SEQ ID NO: 321044 - RNA, 64 nt, hsa; identical to SEQ ID NO: 41343

SEQ ID NO: 321045 - RNA, 64 nt, hsa; identical to SEQ ID NO: 41344

SEQ ID NO: 321046 - RNA, 64 nt, hsa; identical to SEQ ID NO: 41345

SEQ ID NO: 321047 - RNA, 64 nt, hsa; identical to SEQ ID NO: 41346

SEQ ID NO: 321048 - RNA, 64 nt, hsa; identical to SEQ ID NO: 41347

SEQ ID NO: 321049 - RNA, 64 nt, hsa; identical to SEQ ID NO: 41348

SEQ ID NO: 321050 - RNA, 64 nt, hsa; identical to SEQ ID NO: 41349

SEQ ID NO: 321051 - RNA, 64 nt, hsa; identical to SEQ ID NO: 41350

SEQ ID NO: 321052 - RNA, 64 nt, hsa; identical to SEQ ID NO: 41351

SEQ ID NO: 321053 - RNA, 64 nt, hsa; identical to SEQ ID NO: 41352

SEQ ID NO: 321054 - RNA, 64 nt, hsa; identical to SEQ ID NO: 41353

SEQ ID NO: 321055 - RNA, 64 nt, hsa; identical to SEQ ID NO: 41354

SEQ ID NO: 321056 - RNA, 64 nt, hsa; identical to SEQ ID NO: 41355

SEQ ID NO: 321057 - RNA, 64 nt, hsa; identical to SEQ ID NO: 41356

SEQ ID NO: 321058 - RNA, 64 nt, hsa; identical to SEQ ID NO: 41357

SEQ ID NO: 321059 - RNA, 64 nt, hsa; identical to SEQ ID NO: 41358

SEQ ID NO: 321060 - RNA, 64 nt, hsa; identical to SEQ ID NO: 41359

SEQ ID NO: 321061 - RNA, 64 nt, hsa; identical to SEQ ID NO: 41360

SEQ ID NO: 321062 - RNA, 64 nt, hsa; identical to SEQ ID NO: 41361

SEQ ID NO: 321063 - RNA, 64 nt, hsa; identical to SEQ ID NO: 41362

SEQ ID NO: 321064 - RNA, 64 nt, hsa; identical to SEQ ID NO: 41363

SEQ ID NO: 321065 - RNA, 64 nt, hsa; identical to SEQ ID NO: 41364

SEQ ID NO: 321066 - RNA, 64 nt, hsa; identical to SEQ ID NO: 41365

SEQ ID NO: 321067 - RNA, 64 nt, hsa; identical to SEQ ID NO: 41366

SEQ ID NO: 321068 - RNA, 64 nt, hsa; identical to SEQ ID NO: 41367

SEQ ID NO: 321069 - RNA, 64 nt, hsa; identical to SEQ ID NO: 41368

SEQ ID NO: 321070 - RNA, 64 nt, hsa; identical to SEQ ID NO: 41369

SEQ ID NO: 321071 - RNA, 64 nt, hsa; identical to SEQ ID NO: 41370

SEQ ID NO: 321072 - RNA, 64 nt, hsa; identical to SEQ ID NO: 41371

SEQ ID NO: 321073 - RNA, 64 nt, hsa; identical to SEQ ID NO: 41372

SEQ ID NO: 321074 - RNA, 64 nt, hsa; identical to SEQ ID NO: 41373

SEQ ID NO: 321075 - RNA, 64 nt, hsa; identical to SEQ ID NO: 41374

SEQ ID NO: 321076 - RNA, 64 nt, hsa; identical to SEQ ID NO: 41375

SEQ ID NO: 321077 - RNA, 64 nt, hsa; identical to SEQ ID NO: 41376

SEQ ID NO: 321078 - RNA, 64 nt, hsa; identical to SEQ ID NO: 41377

SEQ ID NO: 321079 - RNA, 64 nt, hsa; identical to SEQ ID NO: 41378

SEQ ID NO: 321080 - RNA, 64 nt, hsa; identical to SEQ ID NO: 41379

SEQ ID NO: 321081 - RNA, 64 nt, hsa; identical to SEQ ID NO: 41380

SEQ ID NO: 321082 - RNA, 64 nt, hsa; identical to SEQ ID NO: 41381

SEQ ID NO: 321083 - RNA, 64 nt, hsa; identical to SEQ ID NO: 41382

SEQ ID NO: 321084 - RNA, 64 nt, hsa; identical to SEQ ID NO: 41383

SEQ ID NO: 321085 - RNA, 64 nt, hsa; identical to SEQ ID NO: 41384

SEQ ID NO: 321086 - RNA, 64 nt, hsa; identical to SEQ ID NO: 41385

SEQ ID NO: 321087 - RNA, 64 nt, hsa; identical to SEQ ID NO: 41386

SEQ ID NO: 321088 - RNA, 64 nt, hsa; identical to SEQ ID NO: 41387

SEQ ID NO: 321089 - RNA, 64 nt, hsa; identical to SEQ ID NO: 41388

SEQ ID NO: 321090 - RNA, 64 nt, hsa; identical to SEQ ID NO: 41389

SEQ ID NO: 321091 - RNA, 64 nt, hsa; identical to SEQ ID NO: 41390

SEQ ID NO: 321092 - RNA, 64 nt, hsa; identical to SEQ ID NO: 41391

SEQ ID NO: 321093 - RNA, 64 nt, hsa; identical to SEQ ID NO: 41392

SEQ ID NO: 321094 - RNA, 64 nt, hsa; identical to SEQ ID NO: 41393

SEQ ID NO: 321095 - RNA, 64 nt, hsa; identical to SEQ ID NO: 41394

SEQ ID NO: 321096 - RNA, 64 nt, hsa; identical to SEQ ID NO: 41395

SEQ ID NO: 321097 - RNA, 64 nt, hsa; identical to SEQ ID NO: 41396

SEQ ID NO: 321098 - RNA, 64 nt, hsa; identical to SEQ ID NO: 41397

SEQ ID NO: 321099 - RNA, 64 nt, hsa; identical to SEQ ID NO: 41398

SEQ ID NO: 321100 - RNA, 64 nt, hsa; identical to SEQ ID NO: 41399

SEQ ID NO: 321101 - RNA, 64 nt, hsa; identical to SEQ ID NO: 41400

SEQ ID NO: 321102 - RNA, 64 nt, hsa; identical to SEQ ID NO: 41401

SEQ ID NO: 321103 - RNA, 64 nt, hsa; identical to SEQ ID NO: 41402

SEQ ID NO: 321104 - RNA, 64 nt, hsa; identical to SEQ ID NO: 41403

SEQ ID NO: 321105 - RNA, 64 nt, hsa; identical to SEQ ID NO: 41404

SEQ ID NO: 321106 - RNA, 64 nt, hsa; identical to SEQ ID NO: 41405

SEQ ID NO: 321107 - RNA, 64 nt, hsa; identical to SEQ ID NO: 41406

SEQ ID NO: 321108 - RNA, 64 nt, hsa; identical to SEQ ID NO: 41407

SEQ ID NO: 321109 - RNA, 64 nt, hsa; identical to SEQ ID NO: 41408

SEQ ID NO: 321110 - RNA, 64 nt, hsa; identical to SEQ ID NO: 41409

SEQ ID NO: 321111 - RNA, 64 nt, hsa; identical to SEQ ID NO: 41410

SEQ ID NO: 321112 - RNA, 64 nt, hsa; identical to SEQ ID NO: 41411

SEQ ID NO: 321113 - RNA, 64 nt, hsa; identical to SEQ ID NO: 41412

SEQ ID NO: 321114 - RNA, 64 nt, hsa; identical to SEQ ID NO: 41413

SEQ ID NO: 321115 - RNA, 64 nt, hsa; identical to SEQ ID NO: 41414

SEQ ID NO: 321116 - RNA, 64 nt, hsa; identical to SEQ ID NO: 41415

SEQ ID NO: 321117 - RNA, 64 nt, hsa; identical to SEQ ID NO: 41416

SEQ ID NO: 321118 - RNA, 64 nt, hsa; identical to SEQ ID NO: 41417

SEQ ID NO: 321119 - RNA, 64 nt, hsa; identical to SEQ ID NO: 41418

SEQ ID NO: 321120 - RNA, 64 nt, hsa; identical to SEQ ID NO: 41419

SEQ ID NO: 321121 - RNA, 64 nt, hsa; identical to SEQ ID NO: 41420

SEQ ID NO: 321122 - RNA, 64 nt, hsa; identical to SEQ ID NO: 41421

SEQ ID NO: 321123 - RNA, 64 nt, hsa; identical to SEQ ID NO: 41422

SEQ ID NO: 321124 - RNA, 64 nt, hsa; identical to SEQ ID NO: 41423

SEQ ID NO: 321125 - RNA, 64 nt, hsa; identical to SEQ ID NO: 41424

SEQ ID NO: 321126 - RNA, 64 nt, hsa; identical to SEQ ID NO: 41425

SEQ ID NO: 321127 - RNA, 64 nt, hsa; identical to SEQ ID NO: 41426

SEQ ID NO: 321128 - RNA, 64 nt, hsa; identical to SEQ ID NO: 41427

SEQ ID NO: 321129 - RNA, 64 nt, hsa; identical to SEQ ID NO: 41428

SEQ ID NO: 321130 - RNA, 64 nt, hsa; identical to SEQ ID NO: 41429

SEQ ID NO: 321131 - RNA, 64 nt, hsa; identical to SEQ ID NO: 41430

SEQ ID NO: 321132 - RNA, 64 nt, hsa; identical to SEQ ID NO: 41431

SEQ ID NO: 321133 - RNA, 64 nt, hsa; identical to SEQ ID NO: 41432

SEQ ID NO: 321134 - RNA, 64 nt, hsa; identical to SEQ ID NO: 41433

SEQ ID NO: 321135 - RNA, 64 nt, hsa; identical to SEQ ID NO: 41434

SEQ ID NO: 321136 - RNA, 64 nt, hsa; identical to SEQ ID NO: 41435

SEQ ID NO: 321137 - RNA, 64 nt, hsa; identical to SEQ ID NO: 41436

SEQ ID NO: 321138 - RNA, 64 nt, hsa; identical to SEQ ID NO: 41437

SEQ ID NO: 321139 - RNA, 64 nt, hsa; identical to SEQ ID NO: 41438

SEQ ID NO: 321140 - RNA, 64 nt, hsa; identical to SEQ ID NO: 41439

SEQ ID NO: 321141 - RNA, 64 nt, hsa; identical to SEQ ID NO: 41440

SEQ ID NO: 321142 - RNA, 64 nt, hsa; identical to SEQ ID NO: 41441

SEQ ID NO: 321143 - RNA, 64 nt, hsa; identical to SEQ ID NO: 41442

SEQ ID NO: 321144 - RNA, 64 nt, hsa; identical to SEQ ID NO: 41443

SEQ ID NO: 321145 - RNA, 64 nt, hsa; identical to SEQ ID NO: 41444

SEQ ID NO: 321146 - RNA, 64 nt, hsa; identical to SEQ ID NO: 41445

SEQ ID NO: 321147 - RNA, 64 nt, hsa; identical to SEQ ID NO: 41446

SEQ ID NO: 321148 - RNA, 64 nt, hsa; identical to SEQ ID NO: 41447

SEQ ID NO: 321149 - RNA, 64 nt, hsa; identical to SEQ ID NO: 41448

SEQ ID NO: 321150 - RNA, 64 nt, hsa; identical to SEQ ID NO: 41449

SEQ ID NO: 321151 - RNA, 64 nt, hsa; identical to SEQ ID NO: 41450

SEQ ID NO: 321152 - RNA, 64 nt, hsa; identical to SEQ ID NO: 41451

SEQ ID NO: 321153 - RNA, 64 nt, hsa; identical to SEQ ID NO: 41452

SEQ ID NO: 321154 - RNA, 64 nt, hsa; identical to SEQ ID NO: 41453

SEQ ID NO: 321155 - RNA, 64 nt, hsa; identical to SEQ ID NO: 41454

SEQ ID NO: 321156 - RNA, 64 nt, hsa; identical to SEQ ID NO: 41455

SEQ ID NO: 321157 - RNA, 64 nt, hsa; identical to SEQ ID NO: 41456

SEQ ID NO: 321158 - RNA, 64 nt, hsa; identical to SEQ ID NO: 41457

SEQ ID NO: 321159 - RNA, 64 nt, hsa; identical to SEQ ID NO: 41458

SEQ ID NO: 321160 - RNA, 64 nt, hsa; identical to SEQ ID NO: 41459

SEQ ID NO: 321161 - RNA, 64 nt, hsa; identical to SEQ ID NO: 41460

SEQ ID NO: 321162 - RNA, 64 nt, hsa; identical to SEQ ID NO: 41461

SEQ ID NO: 321163 - RNA, 64 nt, hsa; identical to SEQ ID NO: 41462

SEQ ID NO: 321164 - RNA, 64 nt, hsa; identical to SEQ ID NO: 41463

SEQ ID NO: 321165 - RNA, 64 nt, hsa; identical to SEQ ID NO: 41464

SEQ ID NO: 321166 - RNA, 64 nt, hsa; identical to SEQ ID NO: 41465

SEQ ID NO: 321167 - RNA, 64 nt, hsa; identical to SEQ ID NO: 41466

SEQ ID NO: 321168 - RNA, 64 nt, hsa; identical to SEQ ID NO: 41467

SEQ ID NO: 321169 - RNA, 64 nt, hsa; identical to SEQ ID NO: 41468

SEQ ID NO: 321170 - RNA, 64 nt, hsa; identical to SEQ ID NO: 41469

SEQ ID NO: 321171 - RNA, 64 nt, hsa; identical to SEQ ID NO: 41470

SEQ ID NO: 321172 - RNA, 64 nt, hsa; identical to SEQ ID NO: 41471

SEQ ID NO: 321173 - RNA, 64 nt, hsa; identical to SEQ ID NO: 41472

SEQ ID NO: 321174 - RNA, 64 nt, hsa; identical to SEQ ID NO: 41473

SEQ ID NO: 321175 - RNA, 64 nt, hsa; identical to SEQ ID NO: 41474

SEQ ID NO: 321176 - RNA, 64 nt, hsa; identical to SEQ ID NO: 41475

SEQ ID NO: 321177 - RNA, 64 nt, hsa; identical to SEQ ID NO: 41476

SEQ ID NO: 321178 - RNA, 64 nt, hsa; identical to SEQ ID NO: 41477

SEQ ID NO: 321179 - RNA, 64 nt, hsa; identical to SEQ ID NO: 41478

SEQ ID NO: 321180 - RNA, 64 nt, hsa; identical to SEQ ID NO: 41479

SEQ ID NO: 321181 - RNA, 64 nt, hsa; identical to SEQ ID NO: 41480

SEQ ID NO: 321182 - RNA, 64 nt, hsa; identical to SEQ ID NO: 41481

SEQ ID NO: 321183 - RNA, 64 nt, hsa; identical to SEQ ID NO: 41482

SEQ ID NO: 321184 - RNA, 64 nt, hsa; identical to SEQ ID NO: 41483

SEQ ID NO: 321185 - RNA, 64 nt, hsa; identical to SEQ ID NO: 41484

SEQ ID NO: 321186 - RNA, 64 nt, hsa; identical to SEQ ID NO: 41485

SEQ ID NO: 321187 - RNA, 64 nt, hsa; identical to SEQ ID NO: 41486

SEQ ID NO: 321188 - RNA, 64 nt, hsa; identical to SEQ ID NO: 41487

SEQ ID NO: 321189 - RNA, 64 nt, hsa; identical to SEQ ID NO: 41488

SEQ ID NO: 321190 - RNA, 64 nt, hsa; identical to SEQ ID NO: 41489

SEQ ID NO: 321191 - RNA, 64 nt, hsa; identical to SEQ ID NO: 41490

SEQ ID NO: 321192 - RNA, 64 nt, hsa; identical to SEQ ID NO: 41491

SEQ ID NO: 321193 - RNA, 64 nt, hsa; identical to SEQ ID NO: 41492

SEQ ID NO: 321194 - RNA, 64 nt, hsa; identical to SEQ ID NO: 41493

SEQ ID NO: 321195 - RNA, 64 nt, hsa; identical to SEQ ID NO: 41494

SEQ ID NO: 321196 - RNA, 64 nt, hsa; identical to SEQ ID NO: 41495

SEQ ID NO: 321197 - RNA, 64 nt, hsa; identical to SEQ ID NO: 41496

SEQ ID NO: 321198 - RNA, 64 nt, hsa; identical to SEQ ID NO: 41497

SEQ ID NO: 321199 - RNA, 64 nt, hsa; identical to SEQ ID NO: 41498

SEQ ID NO: 321200 - RNA, 64 nt, hsa; identical to SEQ ID NO: 41499

SEQ ID NO: 321201 - RNA, 64 nt, hsa; identical to SEQ ID NO: 41500

SEQ ID NO: 321202 - RNA, 64 nt, hsa; identical to SEQ ID NO: 41501

SEQ ID NO: 321203 - RNA, 64 nt, hsa; identical to SEQ ID NO: 41502

SEQ ID NO: 321204 - RNA, 64 nt, hsa; identical to SEQ ID NO: 41503

SEQ ID NO: 321205 - RNA, 64 nt, hsa; identical to SEQ ID NO: 41504

SEQ ID NO: 321206 - RNA, 64 nt, hsa; identical to SEQ ID NO: 41505

SEQ ID NO: 321207 - RNA, 64 nt, hsa; identical to SEQ ID NO: 41506

SEQ ID NO: 321208 - RNA, 64 nt, hsa; identical to SEQ ID NO: 41507

SEQ ID NO: 321209 - RNA, 64 nt, hsa; identical to SEQ ID NO: 41508

SEQ ID NO: 321210 - RNA, 64 nt, hsa; identical to SEQ ID NO: 41509

SEQ ID NO: 321211 - RNA, 64 nt, hsa; identical to SEQ ID NO: 41510

SEQ ID NO: 321212 - RNA, 64 nt, hsa; identical to SEQ ID NO: 41511

SEQ ID NO: 321213 - RNA, 64 nt, hsa; identical to SEQ ID NO: 41512

SEQ ID NO: 321214 - RNA, 64 nt, hsa; identical to SEQ ID NO: 41513

SEQ ID NO: 321215 - RNA, 64 nt, hsa; identical to SEQ ID NO: 41514

SEQ ID NO: 321216 - RNA, 64 nt, hsa; identical to SEQ ID NO: 41515

SEQ ID NO: 321217 - RNA, 64 nt, hsa; identical to SEQ ID NO: 41516

SEQ ID NO: 321218 - RNA, 64 nt, hsa; identical to SEQ ID NO: 41517

SEQ ID NO: 321219 - RNA, 64 nt, hsa; identical to SEQ ID NO: 41518

SEQ ID NO: 321220 - RNA, 64 nt, hsa; identical to SEQ ID NO: 41519

SEQ ID NO: 321221 - RNA, 64 nt, hsa; identical to SEQ ID NO: 41520

SEQ ID NO: 321222 - RNA, 64 nt, hsa; identical to SEQ ID NO: 41521

SEQ ID NO: 321223 - RNA, 64 nt, hsa; identical to SEQ ID NO: 41522

SEQ ID NO: 321224 - RNA, 64 nt, hsa; identical to SEQ ID NO: 41523

SEQ ID NO: 321225 - RNA, 64 nt, hsa; identical to SEQ ID NO: 41524

SEQ ID NO: 321226 - RNA, 64 nt, hsa; identical to SEQ ID NO: 41525

SEQ ID NO: 321227 - RNA, 64 nt, hsa; identical to SEQ ID NO: 41526

SEQ ID NO: 321228 - RNA, 64 nt, hsa; identical to SEQ ID NO: 41527

SEQ ID NO: 321229 - RNA, 64 nt, hsa; identical to SEQ ID NO: 41528

SEQ ID NO: 321230 - RNA, 64 nt, hsa; identical to SEQ ID NO: 41529

SEQ ID NO: 321231 - RNA, 64 nt, hsa; identical to SEQ ID NO: 41530

SEQ ID NO: 321232 - RNA, 64 nt, hsa; identical to SEQ ID NO: 41531

SEQ ID NO: 321233 - RNA, 64 nt, hsa; identical to SEQ ID NO: 41532

SEQ ID NO: 321234 - RNA, 64 nt, hsa; identical to SEQ ID NO: 41533

SEQ ID NO: 321235 - RNA, 64 nt, hsa; identical to SEQ ID NO: 41534

SEQ ID NO: 321236 - RNA, 64 nt, hsa; identical to SEQ ID NO: 41535

SEQ ID NO: 321237 - RNA, 64 nt, hsa; identical to SEQ ID NO: 41536

SEQ ID NO: 321238 - RNA, 64 nt, hsa; identical to SEQ ID NO: 41537

SEQ ID NO: 321239 - RNA, 64 nt, hsa; identical to SEQ ID NO: 41538

SEQ ID NO: 321240 - RNA, 64 nt, hsa; identical to SEQ ID NO: 41539

SEQ ID NO: 321241 - RNA, 64 nt, hsa; identical to SEQ ID NO: 41540

SEQ ID NO: 321242 - RNA, 64 nt, hsa; identical to SEQ ID NO: 41541

SEQ ID NO: 321243 - RNA, 64 nt, hsa; identical to SEQ ID NO: 41542

SEQ ID NO: 321244 - RNA, 64 nt, hsa; identical to SEQ ID NO: 41543

SEQ ID NO: 321245 - RNA, 64 nt, hsa; identical to SEQ ID NO: 41544

SEQ ID NO: 321246 - RNA, 64 nt, hsa; identical to SEQ ID NO: 41545

SEQ ID NO: 321247 - RNA, 64 nt, hsa; identical to SEQ ID NO: 41546

SEQ ID NO: 321248 - RNA, 64 nt, hsa; identical to SEQ ID NO: 41547

SEQ ID NO: 321249 - RNA, 64 nt, hsa; identical to SEQ ID NO: 41548

SEQ ID NO: 321250 - RNA, 64 nt, hsa; identical to SEQ ID NO: 41549

SEQ ID NO: 321251 - RNA, 64 nt, hsa; identical to SEQ ID NO: 41550

SEQ ID NO: 321252 - RNA, 64 nt, hsa; identical to SEQ ID NO: 41551

SEQ ID NO: 321253 - RNA, 64 nt, hsa; identical to SEQ ID NO: 41552

SEQ ID NO: 321254 - RNA, 64 nt, hsa; identical to SEQ ID NO: 41553

SEQ ID NO: 321255 - RNA, 64 nt, hsa; identical to SEQ ID NO: 41554

SEQ ID NO: 321256 - RNA, 64 nt, hsa; identical to SEQ ID NO: 41555

SEQ ID NO: 321257 - RNA, 64 nt, hsa; identical to SEQ ID NO: 41556

SEQ ID NO: 321258 - RNA, 64 nt, hsa; identical to SEQ ID NO: 41557

SEQ ID NO: 321259 - RNA, 64 nt, hsa; identical to SEQ ID NO: 41558

SEQ ID NO: 321260 - RNA, 64 nt, hsa; identical to SEQ ID NO: 41559

SEQ ID NO: 321261 - RNA, 64 nt, hsa; identical to SEQ ID NO: 41560

SEQ ID NO: 321262 - RNA, 64 nt, hsa; identical to SEQ ID NO: 41561

SEQ ID NO: 321263 - RNA, 64 nt, hsa; identical to SEQ ID NO: 41562

SEQ ID NO: 321264 - RNA, 64 nt, hsa; identical to SEQ ID NO: 41563

SEQ ID NO: 321265 - RNA, 64 nt, hsa; identical to SEQ ID NO: 41564

SEQ ID NO: 321266 - RNA, 64 nt, hsa; identical to SEQ ID NO: 41565

SEQ ID NO: 321267 - RNA, 64 nt, hsa; identical to SEQ ID NO: 41566

SEQ ID NO: 321268 - RNA, 64 nt, hsa; identical to SEQ ID NO: 41567

SEQ ID NO: 321269 - RNA, 64 nt, hsa; identical to SEQ ID NO: 41568

SEQ ID NO: 321270 - RNA, 64 nt, hsa; identical to SEQ ID NO: 41569

SEQ ID NO: 321271 - RNA, 64 nt, hsa; identical to SEQ ID NO: 41570

SEQ ID NO: 321272 - RNA, 64 nt, hsa; identical to SEQ ID NO: 41571

SEQ ID NO: 321273 - RNA, 64 nt, hsa; identical to SEQ ID NO: 41572

SEQ ID NO: 321274 - RNA, 64 nt, hsa; identical to SEQ ID NO: 41573

SEQ ID NO: 321275 - RNA, 64 nt, hsa; identical to SEQ ID NO: 41574

SEQ ID NO: 321276 - RNA, 64 nt, hsa; identical to SEQ ID NO: 41575

SEQ ID NO: 321277 - RNA, 64 nt, hsa; identical to SEQ ID NO: 41576

SEQ ID NO: 321278 - RNA, 64 nt, hsa; identical to SEQ ID NO: 41577

SEQ ID NO: 321279 - RNA, 64 nt, hsa; identical to SEQ ID NO: 41578

SEQ ID NO: 321280 - RNA, 64 nt, hsa; identical to SEQ ID NO: 41579

SEQ ID NO: 321281 - RNA, 64 nt, hsa; identical to SEQ ID NO: 41580

SEQ ID NO: 321282 - RNA, 64 nt, hsa; identical to SEQ ID NO: 41581

SEQ ID NO: 321283 - RNA, 64 nt, hsa; identical to SEQ ID NO: 41582

SEQ ID NO: 321284 - RNA, 64 nt, hsa; identical to SEQ ID NO: 41583

SEQ ID NO: 321285 - RNA, 64 nt, hsa; identical to SEQ ID NO: 41584

SEQ ID NO: 321286 - RNA, 64 nt, hsa; identical to SEQ ID NO: 41585

SEQ ID NO: 321287 - RNA, 64 nt, hsa; identical to SEQ ID NO: 41586

SEQ ID NO: 321288 - RNA, 64 nt, hsa; identical to SEQ ID NO: 41587

SEQ ID NO: 321289 - RNA, 64 nt, hsa; identical to SEQ ID NO: 41588

SEQ ID NO: 321290 - RNA, 64 nt, hsa; identical to SEQ ID NO: 41589

SEQ ID NO: 321291 - RNA, 64 nt, hsa; identical to SEQ ID NO: 41590

SEQ ID NO: 321292 - RNA, 64 nt, hsa; identical to SEQ ID NO: 41591

SEQ ID NO: 321293 - RNA, 64 nt, hsa; identical to SEQ ID NO: 41592

SEQ ID NO: 321294 - RNA, 64 nt, hsa; identical to SEQ ID NO: 41593

SEQ ID NO: 321295 - RNA, 64 nt, hsa; identical to SEQ ID NO: 41594

SEQ ID NO: 321296 - RNA, 64 nt, hsa; identical to SEQ ID NO: 41595

SEQ ID NO: 321297 - RNA, 64 nt, hsa; identical to SEQ ID NO: 41596

SEQ ID NO: 321298 - RNA, 64 nt, hsa; identical to SEQ ID NO: 41597

SEQ ID NO: 321299 - RNA, 64 nt, hsa; identical to SEQ ID NO: 41598

SEQ ID NO: 321300 - RNA, 64 nt, hsa; identical to SEQ ID NO: 41599

SEQ ID NO: 321301 - RNA, 64 nt, hsa; identical to SEQ ID NO: 41600

SEQ ID NO: 321302 - RNA, 64 nt, hsa; identical to SEQ ID NO: 41601

SEQ ID NO: 321303 - RNA, 64 nt, hsa; identical to SEQ ID NO: 41602

SEQ ID NO: 321304 - RNA, 64 nt, hsa; identical to SEQ ID NO: 41603

SEQ ID NO: 321305 - RNA, 64 nt, hsa; identical to SEQ ID NO: 41604

SEQ ID NO: 321306 - RNA, 64 nt, hsa; identical to SEQ ID NO: 41605

SEQ ID NO: 321307 - RNA, 64 nt, hsa; identical to SEQ ID NO: 41606

SEQ ID NO: 321308 - RNA, 64 nt, hsa; identical to SEQ ID NO: 41607

SEQ ID NO: 321309 - RNA, 64 nt, hsa; identical to SEQ ID NO: 41608

SEQ ID NO: 321310 - RNA, 64 nt, hsa; identical to SEQ ID NO: 41609

SEQ ID NO: 321311 - RNA, 64 nt, hsa; identical to SEQ ID NO: 41610

SEQ ID NO: 321312 - RNA, 64 nt, hsa; identical to SEQ ID NO: 41611

SEQ ID NO: 321313 - RNA, 64 nt, hsa; identical to SEQ ID NO: 41612

SEQ ID NO: 321314 - RNA, 64 nt, hsa; identical to SEQ ID NO: 41613

SEQ ID NO: 321315 - RNA, 64 nt, hsa; identical to SEQ ID NO: 41614

SEQ ID NO: 321316 - RNA, 64 nt, hsa; identical to SEQ ID NO: 41615

SEQ ID NO: 321317 - RNA, 64 nt, hsa; identical to SEQ ID NO: 41616

SEQ ID NO: 321318 - RNA, 64 nt, hsa; identical to SEQ ID NO: 41617

SEQ ID NO: 321319 - RNA, 64 nt, hsa; identical to SEQ ID NO: 41618

SEQ ID NO: 321320 - RNA, 64 nt, hsa; identical to SEQ ID NO: 41619

SEQ ID NO: 321321 - RNA, 64 nt, hsa; identical to SEQ ID NO: 41620

SEQ ID NO: 321322 - RNA, 64 nt, hsa; identical to SEQ ID NO: 41621

SEQ ID NO: 321323 - RNA, 63 nt, hsa; identical to SEQ ID NO: 41622

SEQ ID NO: 321324 - RNA, 64 nt, hsa; identical to SEQ ID NO: 41623

SEQ ID NO: 321325 - RNA, 64 nt, hsa; identical to SEQ ID NO: 41624

SEQ ID NO: 321326 - RNA, 64 nt, hsa; identical to SEQ ID NO: 41625

SEQ ID NO: 321327 - RNA, 64 nt, hsa; identical to SEQ ID NO: 41626

SEQ ID NO: 321328 - RNA, 64 nt, hsa; identical to SEQ ID NO: 41627

SEQ ID NO: 321329 - RNA, 64 nt, hsa; identical to SEQ ID NO: 41628

SEQ ID NO: 321330 - RNA, 64 nt, hsa; identical to SEQ ID NO: 41629

SEQ ID NO: 321331 - RNA, 64 nt, hsa; identical to SEQ ID NO: 41630

SEQ ID NO: 321332 - RNA, 64 nt, hsa; identical to SEQ ID NO: 41631

SEQ ID NO: 321333 - RNA, 64 nt, hsa; identical to SEQ ID NO: 41632

SEQ ID NO: 321334 - RNA, 64 nt, hsa; identical to SEQ ID NO: 41633

SEQ ID NO: 321335 - RNA, 64 nt, hsa; identical to SEQ ID NO: 41634

SEQ ID NO: 321336 - RNA, 64 nt, hsa; identical to SEQ ID NO: 41635

SEQ ID NO: 321337 - RNA, 64 nt, hsa; identical to SEQ ID NO: 41636

SEQ ID NO: 321338 - RNA, 64 nt, hsa; identical to SEQ ID NO: 41637

SEQ ID NO: 321339 - RNA, 64 nt, hsa; identical to SEQ ID NO: 41638

SEQ ID NO: 321340 - RNA, 64 nt, hsa; identical to SEQ ID NO: 41639

SEQ ID NO: 321341 - RNA, 64 nt, hsa; identical to SEQ ID NO: 41640

SEQ ID NO: 321342 - RNA, 64 nt, hsa; identical to SEQ ID NO: 41641

SEQ ID NO: 321343 - RNA, 64 nt, hsa; identical to SEQ ID NO: 41642

SEQ ID NO: 321344 - RNA, 64 nt, hsa; identical to SEQ ID NO: 41643

SEQ ID NO: 321345 - RNA, 64 nt, hsa; identical to SEQ ID NO: 41644

SEQ ID NO: 321346 - RNA, 64 nt, hsa; identical to SEQ ID NO: 41645

SEQ ID NO: 321347 - RNA, 64 nt, hsa; identical to SEQ ID NO: 41646

SEQ ID NO: 321348 - RNA, 64 nt, hsa; identical to SEQ ID NO: 41647

SEQ ID NO: 321349 - RNA, 64 nt, hsa; identical to SEQ ID NO: 41648

SEQ ID NO: 321350 - RNA, 64 nt, hsa; identical to SEQ ID NO: 41649

SEQ ID NO: 321351 - RNA, 64 nt, hsa; identical to SEQ ID NO: 41650

SEQ ID NO: 321352 - RNA, 64 nt, hsa; identical to SEQ ID NO: 41651

SEQ ID NO: 321353 - RNA, 64 nt, hsa; identical to SEQ ID NO: 41652

SEQ ID NO: 321354 - RNA, 64 nt, hsa; identical to SEQ ID NO: 41653

SEQ ID NO: 321355 - RNA, 64 nt, hsa; identical to SEQ ID NO: 41654

SEQ ID NO: 321356 - RNA, 64 nt, hsa; identical to SEQ ID NO: 41655

SEQ ID NO: 321357 - RNA, 64 nt, hsa; identical to SEQ ID NO: 41656

SEQ ID NO: 321358 - RNA, 64 nt, hsa; identical to SEQ ID NO: 41657

SEQ ID NO: 321359 - RNA, 64 nt, hsa; identical to SEQ ID NO: 41658

SEQ ID NO: 321360 - RNA, 64 nt, hsa; identical to SEQ ID NO: 41659

SEQ ID NO: 321361 - RNA, 64 nt, hsa; identical to SEQ ID NO: 41660

SEQ ID NO: 321362 - RNA, 64 nt, hsa; identical to SEQ ID NO: 41661

SEQ ID NO: 321363 - RNA, 64 nt, hsa; identical to SEQ ID NO: 41662

SEQ ID NO: 321364 - RNA, 64 nt, hsa; identical to SEQ ID NO: 41663

SEQ ID NO: 321365 - RNA, 64 nt, hsa; identical to SEQ ID NO: 41664

SEQ ID NO: 321366 - RNA, 64 nt, hsa; identical to SEQ ID NO: 41665

SEQ ID NO: 321367 - RNA, 64 nt, hsa; identical to SEQ ID NO: 41666

SEQ ID NO: 321368 - RNA, 64 nt, hsa; identical to SEQ ID NO: 41667

SEQ ID NO: 321369 - RNA, 64 nt, hsa; identical to SEQ ID NO: 41668

SEQ ID NO: 321370 - RNA, 64 nt, hsa; identical to SEQ ID NO: 41669

SEQ ID NO: 321371 - RNA, 64 nt, hsa; identical to SEQ ID NO: 41670

SEQ ID NO: 321372 - RNA, 64 nt, hsa; identical to SEQ ID NO: 41671

SEQ ID NO: 321373 - RNA, 64 nt, hsa; identical to SEQ ID NO: 41672

SEQ ID NO: 321374 - RNA, 64 nt, hsa; identical to SEQ ID NO: 41673

SEQ ID NO: 321375 - RNA, 64 nt, hsa; identical to SEQ ID NO: 41674

SEQ ID NO: 321376 - RNA, 64 nt, hsa; identical to SEQ ID NO: 41675

SEQ ID NO: 321377 - RNA, 64 nt, hsa; identical to SEQ ID NO: 41676

SEQ ID NO: 321378 - RNA, 64 nt, hsa; identical to SEQ ID NO: 41677

SEQ ID NO: 321379 - RNA, 64 nt, hsa; identical to SEQ ID NO: 41678

SEQ ID NO: 321380 - RNA, 64 nt, hsa; identical to SEQ ID NO: 41679

SEQ ID NO: 321381 - RNA, 64 nt, hsa; identical to SEQ ID NO: 41680

SEQ ID NO: 321382 - RNA, 64 nt, hsa; identical to SEQ ID NO: 41681

SEQ ID NO: 321383 - RNA, 64 nt, hsa; identical to SEQ ID NO: 41682

SEQ ID NO: 321384 - RNA, 64 nt, hsa; identical to SEQ ID NO: 41683

SEQ ID NO: 321385 - RNA, 64 nt, hsa; identical to SEQ ID NO: 41684

SEQ ID NO: 321386 - RNA, 64 nt, hsa; identical to SEQ ID NO: 41685

SEQ ID NO: 321387 - RNA, 64 nt, hsa; identical to SEQ ID NO: 41686

SEQ ID NO: 321388 - RNA, 64 nt, hsa; identical to SEQ ID NO: 41687

SEQ ID NO: 321389 - RNA, 64 nt, hsa; identical to SEQ ID NO: 41688

SEQ ID NO: 321390 - RNA, 64 nt, hsa; identical to SEQ ID NO: 41689

SEQ ID NO: 321391 - RNA, 64 nt, hsa; identical to SEQ ID NO: 41690

SEQ ID NO: 321392 - RNA, 64 nt, hsa; identical to SEQ ID NO: 41691

SEQ ID NO: 321393 - RNA, 64 nt, hsa; identical to SEQ ID NO: 41692

SEQ ID NO: 321394 - RNA, 64 nt, hsa; identical to SEQ ID NO: 41693

SEQ ID NO: 321395 - RNA, 64 nt, hsa; identical to SEQ ID NO: 41694

SEQ ID NO: 321396 - RNA, 64 nt, hsa; identical to SEQ ID NO: 41695

SEQ ID NO: 321397 - RNA, 64 nt, hsa; identical to SEQ ID NO: 41696

SEQ ID NO: 321398 - RNA, 64 nt, hsa; identical to SEQ ID NO: 41697

SEQ ID NO: 321399 - RNA, 64 nt, hsa; identical to SEQ ID NO: 41698

SEQ ID NO: 321400 - RNA, 64 nt, hsa; identical to SEQ ID NO: 41699

SEQ ID NO: 321401 - RNA, 64 nt, hsa; identical to SEQ ID NO: 41700

SEQ ID NO: 321402 - RNA, 64 nt, hsa; identical to SEQ ID NO: 41701

SEQ ID NO: 321403 - RNA, 64 nt, hsa; identical to SEQ ID NO: 41702

SEQ ID NO: 321404 - RNA, 64 nt, hsa; identical to SEQ ID NO: 41703

SEQ ID NO: 321405 - RNA, 64 nt, hsa; identical to SEQ ID NO: 41704

SEQ ID NO: 321406 - RNA, 64 nt, hsa; identical to SEQ ID NO: 41705

SEQ ID NO: 321407 - RNA, 64 nt, hsa; identical to SEQ ID NO: 41706

SEQ ID NO: 321408 - RNA, 64 nt, hsa; identical to SEQ ID NO: 41707

SEQ ID NO: 321409 - RNA, 64 nt, hsa; identical to SEQ ID NO: 41708

SEQ ID NO: 321410 - RNA, 64 nt, hsa; identical to SEQ ID NO: 41709

SEQ ID NO: 321411 - RNA, 64 nt, hsa; identical to SEQ ID NO: 41710

SEQ ID NO: 321412 - RNA, 64 nt, hsa; identical to SEQ ID NO: 41711

SEQ ID NO: 321413 - RNA, 64 nt, hsa; identical to SEQ ID NO: 41712

SEQ ID NO: 321414 - RNA, 64 nt, hsa; identical to SEQ ID NO: 41713

SEQ ID NO: 321415 - RNA, 64 nt, hsa; identical to SEQ ID NO: 41714

SEQ ID NO: 321416 - RNA, 64 nt, hsa; identical to SEQ ID NO: 41715

SEQ ID NO: 321417 - RNA, 64 nt, hsa; identical to SEQ ID NO: 41716

SEQ ID NO: 321418 - RNA, 64 nt, hsa; identical to SEQ ID NO: 41717

SEQ ID NO: 321419 - RNA, 64 nt, hsa; identical to SEQ ID NO: 41718

SEQ ID NO: 321420 - RNA, 64 nt, hsa; identical to SEQ ID NO: 41719

SEQ ID NO: 321421 - RNA, 64 nt, hsa; identical to SEQ ID NO: 41720

SEQ ID NO: 321422 - RNA, 64 nt, hsa; identical to SEQ ID NO: 41721

SEQ ID NO: 321423 - RNA, 64 nt, hsa; identical to SEQ ID NO: 41722

SEQ ID NO: 321424 - RNA, 64 nt, hsa; identical to SEQ ID NO: 41723

SEQ ID NO: 321425 - RNA, 64 nt, hsa; identical to SEQ ID NO: 41724

SEQ ID NO: 321426 - RNA, 64 nt, hsa; identical to SEQ ID NO: 41725

SEQ ID NO: 321427 - RNA, 64 nt, hsa; identical to SEQ ID NO: 41726

SEQ ID NO: 321428 - RNA, 64 nt, hsa; identical to SEQ ID NO: 41727

SEQ ID NO: 321429 - RNA, 64 nt, hsa; identical to SEQ ID NO: 41728

SEQ ID NO: 321430 - RNA, 64 nt, hsa; identical to SEQ ID NO: 41729

SEQ ID NO: 321431 - RNA, 64 nt, hsa; identical to SEQ ID NO: 41730

SEQ ID NO: 321432 - RNA, 64 nt, hsa; identical to SEQ ID NO: 41731

SEQ ID NO: 321433 - RNA, 64 nt, hsa; identical to SEQ ID NO: 41732

SEQ ID NO: 321434 - RNA, 64 nt, hsa; identical to SEQ ID NO: 41733

SEQ ID NO: 321435 - RNA, 64 nt, hsa; identical to SEQ ID NO: 41734

SEQ ID NO: 321436 - RNA, 64 nt, hsa; identical to SEQ ID NO: 41735

SEQ ID NO: 321437 - RNA, 64 nt, hsa; identical to SEQ ID NO: 41736

SEQ ID NO: 321438 - RNA, 64 nt, hsa; identical to SEQ ID NO: 41737

SEQ ID NO: 321439 - RNA, 64 nt, hsa; identical to SEQ ID NO: 41738

SEQ ID NO: 321440 - RNA, 64 nt, hsa; identical to SEQ ID NO: 41739

SEQ ID NO: 321441 - RNA, 64 nt, hsa; identical to SEQ ID NO: 41740

SEQ ID NO: 321442 - RNA, 64 nt, hsa; identical to SEQ ID NO: 41741

SEQ ID NO: 321443 - RNA, 64 nt, hsa; identical to SEQ ID NO: 41742

SEQ ID NO: 321444 - RNA, 64 nt, hsa; identical to SEQ ID NO: 41743

SEQ ID NO: 321445 - RNA, 64 nt, hsa; identical to SEQ ID NO: 41744

SEQ ID NO: 321446 - RNA, 64 nt, hsa; identical to SEQ ID NO: 41745

SEQ ID NO: 321447 - RNA, 64 nt, hsa; identical to SEQ ID NO: 41746

SEQ ID NO: 321448 - RNA, 64 nt, hsa; identical to SEQ ID NO: 41747

SEQ ID NO: 321449 - RNA, 64 nt, hsa; identical to SEQ ID NO: 41748

SEQ ID NO: 321450 - RNA, 64 nt, hsa; identical to SEQ ID NO: 41749

SEQ ID NO: 321451 - RNA, 64 nt, hsa; identical to SEQ ID NO: 41750

SEQ ID NO: 321452 - RNA, 64 nt, hsa; identical to SEQ ID NO: 41751

SEQ ID NO: 321453 - RNA, 64 nt, hsa; identical to SEQ ID NO: 41752

SEQ ID NO: 321454 - RNA, 64 nt, hsa; identical to SEQ ID NO: 41753

SEQ ID NO: 321455 - RNA, 64 nt, hsa; identical to SEQ ID NO: 41754

SEQ ID NO: 321456 - RNA, 64 nt, hsa; identical to SEQ ID NO: 41755

SEQ ID NO: 321457 - RNA, 64 nt, hsa; identical to SEQ ID NO: 41756

SEQ ID NO: 321458 - RNA, 64 nt, hsa; identical to SEQ ID NO: 41757

SEQ ID NO: 321459 - RNA, 64 nt, hsa; identical to SEQ ID NO: 41758

SEQ ID NO: 321460 - RNA, 64 nt, hsa; identical to SEQ ID NO: 41759

SEQ ID NO: 321461 - RNA, 64 nt, hsa; identical to SEQ ID NO: 41760

SEQ ID NO: 321462 - RNA, 64 nt, hsa; identical to SEQ ID NO: 41761

SEQ ID NO: 321463 - RNA, 64 nt, hsa; identical to SEQ ID NO: 41762

SEQ ID NO: 321464 - RNA, 64 nt, hsa; identical to SEQ ID NO: 41763

SEQ ID NO: 321465 - RNA, 64 nt, hsa; identical to SEQ ID NO: 41764

SEQ ID NO: 321466 - RNA, 64 nt, hsa; identical to SEQ ID NO: 41765

SEQ ID NO: 321467 - RNA, 64 nt, hsa; identical to SEQ ID NO: 41766

SEQ ID NO: 321468 - RNA, 64 nt, hsa; identical to SEQ ID NO: 41767

SEQ ID NO: 321469 - RNA, 64 nt, hsa; identical to SEQ ID NO: 41768

SEQ ID NO: 321470 - RNA, 64 nt, hsa; identical to SEQ ID NO: 41769

SEQ ID NO: 321471 - RNA, 64 nt, hsa; identical to SEQ ID NO: 41770

SEQ ID NO: 321472 - RNA, 64 nt, hsa; identical to SEQ ID NO: 41771

SEQ ID NO: 321473 - RNA, 64 nt, hsa; identical to SEQ ID NO: 41772

SEQ ID NO: 321474 - RNA, 64 nt, hsa; identical to SEQ ID NO: 41773

SEQ ID NO: 321475 - RNA, 64 nt, hsa; identical to SEQ ID NO: 41774

SEQ ID NO: 321476 - RNA, 64 nt, hsa; identical to SEQ ID NO: 41775

SEQ ID NO: 321477 - RNA, 64 nt, hsa; identical to SEQ ID NO: 41776

SEQ ID NO: 321478 - RNA, 64 nt, hsa; identical to SEQ ID NO: 41777

SEQ ID NO: 321479 - RNA, 64 nt, hsa; identical to SEQ ID NO: 41778

SEQ ID NO: 321480 - RNA, 64 nt, hsa; identical to SEQ ID NO: 41779

SEQ ID NO: 321481 - RNA, 64 nt, hsa; identical to SEQ ID NO: 41780

SEQ ID NO: 321482 - RNA, 64 nt, hsa; identical to SEQ ID NO: 41781

SEQ ID NO: 321483 - RNA, 64 nt, hsa; identical to SEQ ID NO: 41782

SEQ ID NO: 321484 - RNA, 64 nt, hsa; identical to SEQ ID NO: 41783

SEQ ID NO: 321485 - RNA, 64 nt, hsa; identical to SEQ ID NO: 41784

SEQ ID NO: 321486 - RNA, 64 nt, hsa; identical to SEQ ID NO: 41785

SEQ ID NO: 321487 - RNA, 64 nt, hsa; identical to SEQ ID NO: 41786

SEQ ID NO: 321488 - RNA, 64 nt, hsa; identical to SEQ ID NO: 41787

SEQ ID NO: 321489 - RNA, 64 nt, hsa; identical to SEQ ID NO: 41788

SEQ ID NO: 321490 - RNA, 64 nt, hsa; identical to SEQ ID NO: 41789

SEQ ID NO: 321491 - RNA, 64 nt, hsa; identical to SEQ ID NO: 41790

SEQ ID NO: 321492 - RNA, 64 nt, hsa; identical to SEQ ID NO: 41791

SEQ ID NO: 321493 - RNA, 64 nt, hsa; identical to SEQ ID NO: 41792

SEQ ID NO: 321494 - RNA, 64 nt, hsa; identical to SEQ ID NO: 41793

SEQ ID NO: 321495 - RNA, 64 nt, hsa; identical to SEQ ID NO: 41794

SEQ ID NO: 321496 - RNA, 64 nt, hsa; identical to SEQ ID NO: 41795

SEQ ID NO: 321497 - RNA, 64 nt, hsa; identical to SEQ ID NO: 41796

SEQ ID NO: 321498 - RNA, 64 nt, hsa; identical to SEQ ID NO: 41797

SEQ ID NO: 321499 - RNA, 64 nt, hsa; identical to SEQ ID NO: 41798

SEQ ID NO: 321500 - RNA, 64 nt, hsa; identical to SEQ ID NO: 41799

SEQ ID NO: 321501 - RNA, 64 nt, hsa; identical to SEQ ID NO: 41800

SEQ ID NO: 321502 - RNA, 64 nt, hsa; identical to SEQ ID NO: 41801

SEQ ID NO: 321503 - RNA, 64 nt, hsa; identical to SEQ ID NO: 41802

SEQ ID NO: 321504 - RNA, 64 nt, hsa; identical to SEQ ID NO: 41803

SEQ ID NO: 321505 - RNA, 64 nt, hsa; identical to SEQ ID NO: 41804

SEQ ID NO: 321506 - RNA, 64 nt, hsa; identical to SEQ ID NO: 41805

SEQ ID NO: 321507 - RNA, 64 nt, hsa; identical to SEQ ID NO: 41806

SEQ ID NO: 321508 - RNA, 64 nt, hsa; identical to SEQ ID NO: 41807

SEQ ID NO: 321509 - RNA, 64 nt, hsa; identical to SEQ ID NO: 41808

SEQ ID NO: 321510 - RNA, 64 nt, hsa; identical to SEQ ID NO: 41809

SEQ ID NO: 321511 - RNA, 64 nt, hsa; identical to SEQ ID NO: 41810

SEQ ID NO: 321512 - RNA, 64 nt, hsa; identical to SEQ ID NO: 41811

SEQ ID NO: 321513 - RNA, 64 nt, hsa; identical to SEQ ID NO: 41812

SEQ ID NO: 321514 - RNA, 64 nt, hsa; identical to SEQ ID NO: 41813

SEQ ID NO: 321515 - RNA, 64 nt, hsa; identical to SEQ ID NO: 41814

SEQ ID NO: 321516 - RNA, 64 nt, hsa; identical to SEQ ID NO: 41815

SEQ ID NO: 321517 - RNA, 64 nt, hsa; identical to SEQ ID NO: 41816

SEQ ID NO: 321518 - RNA, 64 nt, hsa; identical to SEQ ID NO: 41817

SEQ ID NO: 321519 - RNA, 64 nt, hsa; identical to SEQ ID NO: 41818

SEQ ID NO: 321520 - RNA, 64 nt, hsa; identical to SEQ ID NO: 41819

SEQ ID NO: 321521 - RNA, 64 nt, hsa; identical to SEQ ID NO: 41820

SEQ ID NO: 321522 - RNA, 64 nt, hsa; identical to SEQ ID NO: 41821

SEQ ID NO: 321523 - RNA, 64 nt, hsa; identical to SEQ ID NO: 41822

SEQ ID NO: 321524 - RNA, 64 nt, hsa; identical to SEQ ID NO: 41823

SEQ ID NO: 321525 - RNA, 64 nt, hsa; identical to SEQ ID NO: 41824

SEQ ID NO: 321526 - RNA, 64 nt, hsa; identical to SEQ ID NO: 41825

SEQ ID NO: 321527 - RNA, 64 nt, hsa; identical to SEQ ID NO: 41826

SEQ ID NO: 321528 - RNA, 64 nt, hsa; identical to SEQ ID NO: 41827

SEQ ID NO: 321529 - RNA, 64 nt, hsa; identical to SEQ ID NO: 41828

SEQ ID NO: 321530 - RNA, 64 nt, hsa; identical to SEQ ID NO: 41829

SEQ ID NO: 321531 - RNA, 64 nt, hsa; identical to SEQ ID NO: 41830

SEQ ID NO: 321532 - RNA, 64 nt, hsa; identical to SEQ ID NO: 41831

SEQ ID NO: 321533 - RNA, 64 nt, hsa; identical to SEQ ID NO: 41832

SEQ ID NO: 321534 - RNA, 64 nt, hsa; identical to SEQ ID NO: 41833

SEQ ID NO: 321535 - RNA, 64 nt, hsa; identical to SEQ ID NO: 41834

SEQ ID NO: 321536 - RNA, 64 nt, hsa; identical to SEQ ID NO: 41835

SEQ ID NO: 321537 - RNA, 64 nt, hsa; identical to SEQ ID NO: 41836

SEQ ID NO: 321538 - RNA, 64 nt, hsa; identical to SEQ ID NO: 41837

SEQ ID NO: 321539 - RNA, 64 nt, hsa; identical to SEQ ID NO: 41838

SEQ ID NO: 321540 - RNA, 64 nt, hsa; identical to SEQ ID NO: 41839

SEQ ID NO: 321541 - RNA, 64 nt, hsa; identical to SEQ ID NO: 41840

SEQ ID NO: 321542 - RNA, 64 nt, hsa; identical to SEQ ID NO: 41841

SEQ ID NO: 321543 - RNA, 64 nt, hsa; identical to SEQ ID NO: 41842

SEQ ID NO: 321544 - RNA, 64 nt, hsa; identical to SEQ ID NO: 41843

SEQ ID NO: 321545 - RNA, 64 nt, hsa; identical to SEQ ID NO: 41844

SEQ ID NO: 321546 - RNA, 64 nt, hsa; identical to SEQ ID NO: 41845

SEQ ID NO: 321547 - RNA, 64 nt, hsa; identical to SEQ ID NO: 41846

SEQ ID NO: 321548 - RNA, 64 nt, hsa; identical to SEQ ID NO: 41847

SEQ ID NO: 321549 - RNA, 64 nt, hsa; identical to SEQ ID NO: 41848

SEQ ID NO: 321550 - RNA, 64 nt, hsa; identical to SEQ ID NO: 41849

SEQ ID NO: 321551 - RNA, 64 nt, hsa; identical to SEQ ID NO: 41850

SEQ ID NO: 321552 - RNA, 64 nt, hsa; identical to SEQ ID NO: 41851

SEQ ID NO: 321553 - RNA, 64 nt, hsa; identical to SEQ ID NO: 41852

SEQ ID NO: 321554 - RNA, 64 nt, hsa; identical to SEQ ID NO: 41853

SEQ ID NO: 321555 - RNA, 64 nt, hsa; identical to SEQ ID NO: 41854

SEQ ID NO: 321556 - RNA, 64 nt, hsa; identical to SEQ ID NO: 41855

SEQ ID NO: 321557 - RNA, 64 nt, hsa; identical to SEQ ID NO: 41856

SEQ ID NO: 321558 - RNA, 64 nt, hsa; identical to SEQ ID NO: 41857

SEQ ID NO: 321559 - RNA, 64 nt, hsa; identical to SEQ ID NO: 41858

SEQ ID NO: 321560 - RNA, 64 nt, hsa; identical to SEQ ID NO: 41859

SEQ ID NO: 321561 - RNA, 64 nt, hsa; identical to SEQ ID NO: 41860

SEQ ID NO: 321562 - RNA, 64 nt, hsa; identical to SEQ ID NO: 41861

SEQ ID NO: 321563 - RNA, 64 nt, hsa; identical to SEQ ID NO: 41862

SEQ ID NO: 321564 - RNA, 64 nt, hsa; identical to SEQ ID NO: 41863

SEQ ID NO: 321565 - RNA, 64 nt, hsa; identical to SEQ ID NO: 41864

SEQ ID NO: 321566 - RNA, 64 nt, hsa; identical to SEQ ID NO: 41865

SEQ ID NO: 321567 - RNA, 64 nt, hsa; identical to SEQ ID NO: 41866

SEQ ID NO: 321568 - RNA, 64 nt, hsa; identical to SEQ ID NO: 41867

SEQ ID NO: 321569 - RNA, 64 nt, hsa; identical to SEQ ID NO: 41868

SEQ ID NO: 321570 - RNA, 64 nt, hsa; identical to SEQ ID NO: 41869

SEQ ID NO: 321571 - RNA, 64 nt, hsa; identical to SEQ ID NO: 41870

SEQ ID NO: 321572 - RNA, 64 nt, hsa; identical to SEQ ID NO: 41871

SEQ ID NO: 321573 - RNA, 64 nt, hsa; identical to SEQ ID NO: 41872

SEQ ID NO: 321574 - RNA, 64 nt, hsa; identical to SEQ ID NO: 41873

SEQ ID NO: 321575 - RNA, 64 nt, hsa; identical to SEQ ID NO: 41874

SEQ ID NO: 321576 - RNA, 64 nt, hsa; identical to SEQ ID NO: 41875

SEQ ID NO: 321577 - RNA, 64 nt, hsa; identical to SEQ ID NO: 41876

SEQ ID NO: 321578 - RNA, 64 nt, hsa; identical to SEQ ID NO: 41877

SEQ ID NO: 321579 - RNA, 64 nt, hsa; identical to SEQ ID NO: 41878

SEQ ID NO: 321580 - RNA, 64 nt, hsa; identical to SEQ ID NO: 41879

SEQ ID NO: 321581 - RNA, 64 nt, hsa; identical to SEQ ID NO: 41880

SEQ ID NO: 321582 - RNA, 64 nt, hsa; identical to SEQ ID NO: 41881

SEQ ID NO: 321583 - RNA, 64 nt, hsa; identical to SEQ ID NO: 41882

SEQ ID NO: 321584 - RNA, 64 nt, hsa; identical to SEQ ID NO: 41883

SEQ ID NO: 321585 - RNA, 64 nt, hsa; identical to SEQ ID NO: 41884

SEQ ID NO: 321586 - RNA, 64 nt, hsa; identical to SEQ ID NO: 41885

SEQ ID NO: 321587 - RNA, 64 nt, hsa; identical to SEQ ID NO: 41886

SEQ ID NO: 321588 - RNA, 64 nt, hsa; identical to SEQ ID NO: 41887

SEQ ID NO: 321589 - RNA, 64 nt, hsa; identical to SEQ ID NO: 41888

SEQ ID NO: 321590 - RNA, 64 nt, hsa; identical to SEQ ID NO: 41889

SEQ ID NO: 321591 - RNA, 64 nt, hsa; identical to SEQ ID NO: 41890

SEQ ID NO: 321592 - RNA, 64 nt, hsa; identical to SEQ ID NO: 41891

SEQ ID NO: 321593 - RNA, 64 nt, hsa; identical to SEQ ID NO: 41892

SEQ ID NO: 321594 - RNA, 64 nt, hsa; identical to SEQ ID NO: 41893

SEQ ID NO: 321595 - RNA, 64 nt, hsa; identical to SEQ ID NO: 41894

SEQ ID NO: 321596 - RNA, 64 nt, hsa; identical to SEQ ID NO: 41895

SEQ ID NO: 321597 - RNA, 64 nt, hsa; identical to SEQ ID NO: 41896

SEQ ID NO: 321598 - RNA, 64 nt, hsa; identical to SEQ ID NO: 41897

SEQ ID NO: 321599 - RNA, 64 nt, hsa; identical to SEQ ID NO: 41898

SEQ ID NO: 321600 - RNA, 64 nt, hsa; identical to SEQ ID NO: 41899

SEQ ID NO: 321601 - RNA, 64 nt, hsa; identical to SEQ ID NO: 41900

SEQ ID NO: 321602 - RNA, 64 nt, hsa; identical to SEQ ID NO: 41901

SEQ ID NO: 321603 - RNA, 64 nt, hsa; identical to SEQ ID NO: 41902

SEQ ID NO: 321604 - RNA, 64 nt, hsa; identical to SEQ ID NO: 41903

SEQ ID NO: 321605 - RNA, 64 nt, hsa; identical to SEQ ID NO: 41904

SEQ ID NO: 321606 - RNA, 64 nt, hsa; identical to SEQ ID NO: 41905

SEQ ID NO: 321607 - RNA, 64 nt, hsa; identical to SEQ ID NO: 41906

SEQ ID NO: 321608 - RNA, 64 nt, hsa; identical to SEQ ID NO: 41907

SEQ ID NO: 321609 - RNA, 64 nt, hsa; identical to SEQ ID NO: 41908

SEQ ID NO: 321610 - RNA, 64 nt, hsa; identical to SEQ ID NO: 41909

SEQ ID NO: 321611 - RNA, 64 nt, hsa; identical to SEQ ID NO: 41910

SEQ ID NO: 321612 - RNA, 64 nt, hsa; identical to SEQ ID NO: 41911

SEQ ID NO: 321613 - RNA, 64 nt, hsa; identical to SEQ ID NO: 41912

SEQ ID NO: 321614 - RNA, 64 nt, hsa; identical to SEQ ID NO: 41913

SEQ ID NO: 321615 - RNA, 64 nt, hsa; identical to SEQ ID NO: 41914

SEQ ID NO: 321616 - RNA, 64 nt, hsa; identical to SEQ ID NO: 41915

SEQ ID NO: 321617 - RNA, 64 nt, hsa; identical to SEQ ID NO: 41916

SEQ ID NO: 321618 - RNA, 64 nt, hsa; identical to SEQ ID NO: 41917

SEQ ID NO: 321619 - RNA, 64 nt, hsa; identical to SEQ ID NO: 41918

SEQ ID NO: 321620 - RNA, 64 nt, hsa; identical to SEQ ID NO: 41919

SEQ ID NO: 321621 - RNA, 64 nt, hsa; identical to SEQ ID NO: 41920

SEQ ID NO: 321622 - RNA, 64 nt, hsa; identical to SEQ ID NO: 41921

SEQ ID NO: 321623 - RNA, 64 nt, hsa; identical to SEQ ID NO: 41922

SEQ ID NO: 321624 - RNA, 64 nt, hsa; identical to SEQ ID NO: 41923

SEQ ID NO: 321625 - RNA, 64 nt, hsa; identical to SEQ ID NO: 41924

SEQ ID NO: 321626 - RNA, 64 nt, hsa; identical to SEQ ID NO: 41925

SEQ ID NO: 321627 - RNA, 64 nt, hsa; identical to SEQ ID NO: 41926

SEQ ID NO: 321628 - RNA, 64 nt, hsa; identical to SEQ ID NO: 41927

SEQ ID NO: 321629 - RNA, 64 nt, hsa; identical to SEQ ID NO: 41928

SEQ ID NO: 321630 - RNA, 64 nt, hsa; identical to SEQ ID NO: 41929

SEQ ID NO: 321631 - RNA, 64 nt, hsa; identical to SEQ ID NO: 41930

SEQ ID NO: 321632 - RNA, 64 nt, hsa; identical to SEQ ID NO: 41931

SEQ ID NO: 321633 - RNA, 64 nt, hsa; identical to SEQ ID NO: 41932

SEQ ID NO: 321634 - RNA, 64 nt, hsa; identical to SEQ ID NO: 41933

SEQ ID NO: 321635 - RNA, 64 nt, hsa; identical to SEQ ID NO: 41934

SEQ ID NO: 321636 - RNA, 64 nt, hsa; identical to SEQ ID NO: 41935

SEQ ID NO: 321637 - RNA, 64 nt, hsa; identical to SEQ ID NO: 41936

SEQ ID NO: 321638 - RNA, 64 nt, hsa; identical to SEQ ID NO: 41937

SEQ ID NO: 321639 - RNA, 64 nt, hsa; identical to SEQ ID NO: 41938

SEQ ID NO: 321640 - RNA, 64 nt, hsa; identical to SEQ ID NO: 41939

SEQ ID NO: 321641 - RNA, 64 nt, hsa; identical to SEQ ID NO: 41940

SEQ ID NO: 321642 - RNA, 64 nt, hsa; identical to SEQ ID NO: 41941

SEQ ID NO: 321643 - RNA, 64 nt, hsa; identical to SEQ ID NO: 41942

SEQ ID NO: 321644 - RNA, 64 nt, hsa; identical to SEQ ID NO: 41943

SEQ ID NO: 321645 - RNA, 64 nt, hsa; identical to SEQ ID NO: 41944

SEQ ID NO: 321646 - RNA, 64 nt, hsa; identical to SEQ ID NO: 41945

SEQ ID NO: 321647 - RNA, 64 nt, hsa; identical to SEQ ID NO: 41946

SEQ ID NO: 321648 - RNA, 64 nt, hsa; identical to SEQ ID NO: 41947

SEQ ID NO: 321649 - RNA, 64 nt, hsa; identical to SEQ ID NO: 41948

SEQ ID NO: 321650 - RNA, 64 nt, hsa; identical to SEQ ID NO: 41949

SEQ ID NO: 321651 - RNA, 64 nt, hsa; identical to SEQ ID NO: 41950

SEQ ID NO: 321652 - RNA, 64 nt, hsa; identical to SEQ ID NO: 41951

SEQ ID NO: 321653 - RNA, 64 nt, hsa; identical to SEQ ID NO: 41952

SEQ ID NO: 321654 - RNA, 64 nt, hsa; identical to SEQ ID NO: 41953

SEQ ID NO: 321655 - RNA, 64 nt, hsa; identical to SEQ ID NO: 41954

SEQ ID NO: 321656 - RNA, 64 nt, hsa; identical to SEQ ID NO: 41955

SEQ ID NO: 321657 - RNA, 64 nt, hsa; identical to SEQ ID NO: 41956

SEQ ID NO: 321658 - RNA, 64 nt, hsa; identical to SEQ ID NO: 41957

SEQ ID NO: 321659 - RNA, 64 nt, hsa; identical to SEQ ID NO: 41958

SEQ ID NO: 321660 - RNA, 64 nt, hsa; identical to SEQ ID NO: 41959

SEQ ID NO: 321661 - RNA, 64 nt, hsa; identical to SEQ ID NO: 41960

SEQ ID NO: 321662 - RNA, 64 nt, hsa; identical to SEQ ID NO: 41961

SEQ ID NO: 321663 - RNA, 64 nt, hsa; identical to SEQ ID NO: 41962

SEQ ID NO: 321664 - RNA, 64 nt, hsa; identical to SEQ ID NO: 41963

SEQ ID NO: 321665 - RNA, 64 nt, hsa; identical to SEQ ID NO: 41964

SEQ ID NO: 321666 - RNA, 64 nt, hsa; identical to SEQ ID NO: 41965

SEQ ID NO: 321667 - RNA, 64 nt, hsa; identical to SEQ ID NO: 41966

SEQ ID NO: 321668 - RNA, 64 nt, hsa; identical to SEQ ID NO: 41967

SEQ ID NO: 321669 - RNA, 64 nt, hsa; identical to SEQ ID NO: 41968

SEQ ID NO: 321670 - RNA, 64 nt, hsa; identical to SEQ ID NO: 41969

SEQ ID NO: 321671 - RNA, 64 nt, hsa; identical to SEQ ID NO: 41970

SEQ ID NO: 321672 - RNA, 64 nt, hsa; identical to SEQ ID NO: 41971

SEQ ID NO: 321673 - RNA, 64 nt, hsa; identical to SEQ ID NO: 41972

SEQ ID NO: 321674 - RNA, 64 nt, hsa; identical to SEQ ID NO: 41973

SEQ ID NO: 321675 - RNA, 64 nt, hsa; identical to SEQ ID NO: 41974

SEQ ID NO: 321676 - RNA, 64 nt, hsa; identical to SEQ ID NO: 41975

SEQ ID NO: 321677 - RNA, 64 nt, hsa; identical to SEQ ID NO: 41976

SEQ ID NO: 321678 - RNA, 64 nt, hsa; identical to SEQ ID NO: 41977

SEQ ID NO: 321679 - RNA, 64 nt, hsa; identical to SEQ ID NO: 41978

SEQ ID NO: 321680 - RNA, 64 nt, hsa; identical to SEQ ID NO: 41979

SEQ ID NO: 321681 - RNA, 64 nt, hsa; identical to SEQ ID NO: 41980

SEQ ID NO: 321682 - RNA, 64 nt, hsa; identical to SEQ ID NO: 41981

SEQ ID NO: 321683 - RNA, 64 nt, hsa; identical to SEQ ID NO: 41982

SEQ ID NO: 321684 - RNA, 64 nt, hsa; identical to SEQ ID NO: 41983

SEQ ID NO: 321685 - RNA, 64 nt, hsa; identical to SEQ ID NO: 41984

SEQ ID NO: 321686 - RNA, 64 nt, hsa; identical to SEQ ID NO: 41985

SEQ ID NO: 321687 - RNA, 64 nt, hsa; identical to SEQ ID NO: 41986

SEQ ID NO: 321688 - RNA, 64 nt, hsa; identical to SEQ ID NO: 41987

SEQ ID NO: 321689 - RNA, 64 nt, hsa; identical to SEQ ID NO: 41988

SEQ ID NO: 321690 - RNA, 64 nt, hsa; identical to SEQ ID NO: 41989

SEQ ID NO: 321691 - RNA, 64 nt, hsa; identical to SEQ ID NO: 41990

SEQ ID NO: 321692 - RNA, 64 nt, hsa; identical to SEQ ID NO: 41991

SEQ ID NO: 321693 - RNA, 64 nt, hsa; identical to SEQ ID NO: 41992

SEQ ID NO: 321694 - RNA, 64 nt, hsa; identical to SEQ ID NO: 41993

SEQ ID NO: 321695 - RNA, 64 nt, hsa; identical to SEQ ID NO: 41994

SEQ ID NO: 321696 - RNA, 64 nt, hsa; identical to SEQ ID NO: 41995

SEQ ID NO: 321697 - RNA, 64 nt, hsa; identical to SEQ ID NO: 41996

SEQ ID NO: 321698 - RNA, 64 nt, hsa; identical to SEQ ID NO: 41997

SEQ ID NO: 321699 - RNA, 64 nt, hsa; identical to SEQ ID NO: 41998

SEQ ID NO: 321700 - RNA, 64 nt, hsa; identical to SEQ ID NO: 41999

SEQ ID NO: 321701 - RNA, 64 nt, hsa; identical to SEQ ID NO: 42000

SEQ ID NO: 321702 - RNA, 64 nt, hsa; identical to SEQ ID NO: 42001

SEQ ID NO: 321703 - RNA, 64 nt, hsa; identical to SEQ ID NO: 42002

SEQ ID NO: 321704 - RNA, 64 nt, hsa; identical to SEQ ID NO: 42003

SEQ ID NO: 321705 - RNA, 64 nt, hsa; identical to SEQ ID NO: 42004

SEQ ID NO: 321706 - RNA, 64 nt, hsa; identical to SEQ ID NO: 42005

SEQ ID NO: 321707 - RNA, 64 nt, hsa; identical to SEQ ID NO: 42006

SEQ ID NO: 321708 - RNA, 64 nt, hsa; identical to SEQ ID NO: 42007

SEQ ID NO: 321709 - RNA, 64 nt, hsa; identical to SEQ ID NO: 42008

SEQ ID NO: 321710 - RNA, 64 nt, hsa; identical to SEQ ID NO: 42009

SEQ ID NO: 321711 - RNA, 64 nt, hsa; identical to SEQ ID NO: 42010

SEQ ID NO: 321712 - RNA, 64 nt, hsa; identical to SEQ ID NO: 42011

SEQ ID NO: 321713 - RNA, 64 nt, hsa; identical to SEQ ID NO: 42012

SEQ ID NO: 321714 - RNA, 64 nt, hsa; identical to SEQ ID NO: 42013

SEQ ID NO: 321715 - RNA, 64 nt, hsa; identical to SEQ ID NO: 42014

SEQ ID NO: 321716 - RNA, 64 nt, hsa; identical to SEQ ID NO: 42015

SEQ ID NO: 321717 - RNA, 64 nt, hsa; identical to SEQ ID NO: 42016

SEQ ID NO: 321718 - RNA, 64 nt, hsa; identical to SEQ ID NO: 42017

SEQ ID NO: 321719 - RNA, 64 nt, hsa; identical to SEQ ID NO: 42018

SEQ ID NO: 321720 - RNA, 64 nt, hsa; identical to SEQ ID NO: 42019

SEQ ID NO: 321721 - RNA, 64 nt, hsa; identical to SEQ ID NO: 42020

SEQ ID NO: 321722 - RNA, 64 nt, hsa; identical to SEQ ID NO: 42021

SEQ ID NO: 321723 - RNA, 64 nt, hsa; identical to SEQ ID NO: 42022

SEQ ID NO: 321724 - RNA, 64 nt, hsa; identical to SEQ ID NO: 42023

SEQ ID NO: 321725 - RNA, 64 nt, hsa; identical to SEQ ID NO: 42024

SEQ ID NO: 321726 - RNA, 64 nt, hsa; identical to SEQ ID NO: 42025

SEQ ID NO: 321727 - RNA, 64 nt, hsa; identical to SEQ ID NO: 42026

SEQ ID NO: 321728 - RNA, 64 nt, hsa; identical to SEQ ID NO: 42027

SEQ ID NO: 321729 - RNA, 64 nt, hsa; identical to SEQ ID NO: 42028

SEQ ID NO: 321730 - RNA, 64 nt, hsa; identical to SEQ ID NO: 42029

SEQ ID NO: 321731 - RNA, 64 nt, hsa; identical to SEQ ID NO: 42030

SEQ ID NO: 321732 - RNA, 64 nt, hsa; identical to SEQ ID NO: 42031

SEQ ID NO: 321733 - RNA, 64 nt, hsa; identical to SEQ ID NO: 42032

SEQ ID NO: 321734 - RNA, 64 nt, hsa; identical to SEQ ID NO: 42033

SEQ ID NO: 321735 - RNA, 64 nt, hsa; identical to SEQ ID NO: 42034

SEQ ID NO: 321736 - RNA, 64 nt, hsa; identical to SEQ ID NO: 42035

SEQ ID NO: 321737 - RNA, 64 nt, hsa; identical to SEQ ID NO: 42036

SEQ ID NO: 321738 - RNA, 64 nt, hsa; identical to SEQ ID NO: 42037

SEQ ID NO: 321739 - RNA, 64 nt, hsa; identical to SEQ ID NO: 42038

SEQ ID NO: 321740 - RNA, 64 nt, hsa; identical to SEQ ID NO: 42039

SEQ ID NO: 321741 - RNA, 64 nt, hsa; identical to SEQ ID NO: 42040

SEQ ID NO: 321742 - RNA, 64 nt, hsa; identical to SEQ ID NO: 42041

SEQ ID NO: 321743 - RNA, 64 nt, hsa; identical to SEQ ID NO: 42042

SEQ ID NO: 321744 - RNA, 64 nt, hsa; identical to SEQ ID NO: 42043

SEQ ID NO: 321745 - RNA, 64 nt, hsa; identical to SEQ ID NO: 42044

SEQ ID NO: 321746 - RNA, 64 nt, hsa; identical to SEQ ID NO: 42045

SEQ ID NO: 321747 - RNA, 64 nt, hsa; identical to SEQ ID NO: 42046

SEQ ID NO: 321748 - RNA, 64 nt, hsa; identical to SEQ ID NO: 42047

SEQ ID NO: 321749 - RNA, 64 nt, hsa; identical to SEQ ID NO: 42048

SEQ ID NO: 321750 - RNA, 64 nt, hsa; identical to SEQ ID NO: 42049

SEQ ID NO: 321751 - RNA, 64 nt, hsa; identical to SEQ ID NO: 42050

SEQ ID NO: 321752 - RNA, 64 nt, hsa; identical to SEQ ID NO: 42051

SEQ ID NO: 321753 - RNA, 64 nt, hsa; identical to SEQ ID NO: 42052

SEQ ID NO: 321754 - RNA, 64 nt, hsa; identical to SEQ ID NO: 42053

SEQ ID NO: 321755 - RNA, 64 nt, hsa; identical to SEQ ID NO: 42054

SEQ ID NO: 321756 - RNA, 64 nt, hsa; identical to SEQ ID NO: 42055

SEQ ID NO: 321757 - RNA, 64 nt, hsa; identical to SEQ ID NO: 42056

SEQ ID NO: 321758 - RNA, 64 nt, hsa; identical to SEQ ID NO: 42057

SEQ ID NO: 321759 - RNA, 64 nt, hsa; identical to SEQ ID NO: 42058

SEQ ID NO: 321760 - RNA, 64 nt, hsa; identical to SEQ ID NO: 42059

SEQ ID NO: 321761 - RNA, 64 nt, hsa; identical to SEQ ID NO: 42060

SEQ ID NO: 321762 - RNA, 64 nt, hsa; identical to SEQ ID NO: 42061

SEQ ID NO: 321763 - RNA, 64 nt, hsa; identical to SEQ ID NO: 42062

SEQ ID NO: 321764 - RNA, 64 nt, hsa; identical to SEQ ID NO: 42063

SEQ ID NO: 321765 - RNA, 64 nt, hsa; identical to SEQ ID NO: 42064

SEQ ID NO: 321766 - RNA, 64 nt, hsa; identical to SEQ ID NO: 42065

SEQ ID NO: 321767 - RNA, 64 nt, hsa; identical to SEQ ID NO: 42066

SEQ ID NO: 321768 - RNA, 64 nt, hsa; identical to SEQ ID NO: 42067

SEQ ID NO: 321769 - RNA, 64 nt, hsa; identical to SEQ ID NO: 42068

SEQ ID NO: 321770 - RNA, 64 nt, hsa; identical to SEQ ID NO: 42069

SEQ ID NO: 321771 - RNA, 64 nt, hsa; identical to SEQ ID NO: 42070

SEQ ID NO: 321772 - RNA, 64 nt, hsa; identical to SEQ ID NO: 42071

SEQ ID NO: 321773 - RNA, 64 nt, hsa; identical to SEQ ID NO: 42072

SEQ ID NO: 321774 - RNA, 64 nt, hsa; identical to SEQ ID NO: 42073

SEQ ID NO: 321775 - RNA, 64 nt, hsa; identical to SEQ ID NO: 42074

SEQ ID NO: 321776 - RNA, 64 nt, hsa; identical to SEQ ID NO: 42075

SEQ ID NO: 321777 - RNA, 64 nt, hsa; identical to SEQ ID NO: 42076

SEQ ID NO: 321778 - RNA, 64 nt, hsa; identical to SEQ ID NO: 42077

SEQ ID NO: 321779 - RNA, 64 nt, hsa; identical to SEQ ID NO: 42078

SEQ ID NO: 321780 - RNA, 64 nt, hsa; identical to SEQ ID NO: 42079

SEQ ID NO: 321781 - RNA, 64 nt, hsa; identical to SEQ ID NO: 42080

SEQ ID NO: 321782 - RNA, 64 nt, hsa; identical to SEQ ID NO: 42081

SEQ ID NO: 321783 - RNA, 64 nt, hsa; identical to SEQ ID NO: 42082

SEQ ID NO: 321784 - RNA, 64 nt, hsa; identical to SEQ ID NO: 42083

SEQ ID NO: 321785 - RNA, 64 nt, hsa; identical to SEQ ID NO: 42084

SEQ ID NO: 321786 - RNA, 64 nt, hsa; identical to SEQ ID NO: 42085

SEQ ID NO: 321787 - RNA, 64 nt, hsa; identical to SEQ ID NO: 42086

SEQ ID NO: 321788 - RNA, 64 nt, hsa; identical to SEQ ID NO: 42087

SEQ ID NO: 321789 - RNA, 64 nt, hsa; identical to SEQ ID NO: 42088

SEQ ID NO: 321790 - RNA, 64 nt, hsa; identical to SEQ ID NO: 42089

SEQ ID NO: 321791 - RNA, 64 nt, hsa; identical to SEQ ID NO: 42090

SEQ ID NO: 321792 - RNA, 64 nt, hsa; identical to SEQ ID NO: 42091

SEQ ID NO: 321793 - RNA, 64 nt, hsa; identical to SEQ ID NO: 42092

SEQ ID NO: 321794 - RNA, 64 nt, hsa; identical to SEQ ID NO: 42093

SEQ ID NO: 321795 - RNA, 64 nt, hsa; identical to SEQ ID NO: 42094

SEQ ID NO: 321796 - RNA, 64 nt, hsa; identical to SEQ ID NO: 42095

SEQ ID NO: 321797 - RNA, 64 nt, hsa; identical to SEQ ID NO: 42096

SEQ ID NO: 321798 - RNA, 64 nt, hsa; identical to SEQ ID NO: 42097

SEQ ID NO: 321799 - RNA, 64 nt, hsa; identical to SEQ ID NO: 42098

SEQ ID NO: 321800 - RNA, 64 nt, hsa; identical to SEQ ID NO: 42099

SEQ ID NO: 321801 - RNA, 64 nt, hsa; identical to SEQ ID NO: 42100

SEQ ID NO: 321802 - RNA, 64 nt, hsa; identical to SEQ ID NO: 42101

SEQ ID NO: 321803 - RNA, 64 nt, hsa; identical to SEQ ID NO: 41907

SEQ ID NO: 321804 - RNA, 64 nt, hsa; identical to SEQ ID NO: 41906

SEQ ID NO: 321805 - RNA, 64 nt, hsa; identical to SEQ ID NO: 41905

SEQ ID NO: 321806 - RNA, 64 nt, hsa; identical to SEQ ID NO: 41904

SEQ ID NO: 321807 - RNA, 64 nt, hsa; identical to SEQ ID NO: 42106

SEQ ID NO: 321808 - RNA, 64 nt, hsa; identical to SEQ ID NO: 42107

SEQ ID NO: 321809 - RNA, 64 nt, hsa; identical to SEQ ID NO: 42108

SEQ ID NO: 321810 - RNA, 64 nt, hsa; identical to SEQ ID NO: 42109

SEQ ID NO: 321811 - RNA, 64 nt, hsa; identical to SEQ ID NO: 42110

SEQ ID NO: 321812 - RNA, 64 nt, hsa; identical to SEQ ID NO: 42111

SEQ ID NO: 321813 - RNA, 64 nt, hsa; identical to SEQ ID NO: 42112

SEQ ID NO: 321814 - RNA, 64 nt, hsa; identical to SEQ ID NO: 42113

SEQ ID NO: 321815 - RNA, 64 nt, hsa; identical to SEQ ID NO: 42114

SEQ ID NO: 321816 - RNA, 64 nt, hsa; identical to SEQ ID NO: 42115

SEQ ID NO: 321817 - RNA, 64 nt, hsa; identical to SEQ ID NO: 42116

SEQ ID NO: 321818 - RNA, 64 nt, hsa; identical to SEQ ID NO: 42117

SEQ ID NO: 321819 - RNA, 64 nt, hsa; identical to SEQ ID NO: 42118

SEQ ID NO: 321820 - RNA, 64 nt, hsa; identical to SEQ ID NO: 42119

SEQ ID NO: 321821 - RNA, 64 nt, hsa; identical to SEQ ID NO: 42120

SEQ ID NO: 321822 - RNA, 64 nt, hsa; identical to SEQ ID NO: 42121

SEQ ID NO: 321823 - RNA, 64 nt, hsa; identical to SEQ ID NO: 42122

SEQ ID NO: 321824 - RNA, 64 nt, hsa; identical to SEQ ID NO: 42123

SEQ ID NO: 321825 - RNA, 64 nt, hsa; identical to SEQ ID NO: 42124

SEQ ID NO: 321826 - RNA, 64 nt, hsa; identical to SEQ ID NO: 42125

SEQ ID NO: 321827 - RNA, 64 nt, hsa; identical to SEQ ID NO: 42126

SEQ ID NO: 321828 - RNA, 64 nt, hsa; identical to SEQ ID NO: 42127

SEQ ID NO: 321829 - RNA, 64 nt, hsa; identical to SEQ ID NO: 42128

SEQ ID NO: 321830 - RNA, 64 nt, hsa; identical to SEQ ID NO: 42129

SEQ ID NO: 321831 - RNA, 64 nt, hsa; identical to SEQ ID NO: 42130

SEQ ID NO: 321832 - RNA, 64 nt, hsa; identical to SEQ ID NO: 42131

SEQ ID NO: 321833 - RNA, 64 nt, hsa; identical to SEQ ID NO: 42132

SEQ ID NO: 321834 - RNA, 64 nt, hsa; identical to SEQ ID NO: 42133

SEQ ID NO: 321835 - RNA, 64 nt, hsa; identical to SEQ ID NO: 42134

SEQ ID NO: 321836 - RNA, 64 nt, hsa; identical to SEQ ID NO: 42135

SEQ ID NO: 321837 - RNA, 64 nt, hsa; identical to SEQ ID NO: 42136

SEQ ID NO: 321838 - RNA, 64 nt, hsa; identical to SEQ ID NO: 42137

SEQ ID NO: 321839 - RNA, 64 nt, hsa; identical to SEQ ID NO: 42138

SEQ ID NO: 321840 - RNA, 64 nt, hsa; identical to SEQ ID NO: 42139

SEQ ID NO: 321841 - RNA, 64 nt, hsa; identical to SEQ ID NO: 42140

SEQ ID NO: 321842 - RNA, 64 nt, hsa; identical to SEQ ID NO: 42141

SEQ ID NO: 321843 - RNA, 64 nt, hsa; identical to SEQ ID NO: 42142

SEQ ID NO: 321844 - RNA, 64 nt, hsa; identical to SEQ ID NO: 42143

SEQ ID NO: 321845 - RNA, 64 nt, hsa; identical to SEQ ID NO: 42144

SEQ ID NO: 321846 - RNA, 64 nt, hsa; identical to SEQ ID NO: 42145

SEQ ID NO: 321847 - RNA, 64 nt, hsa; identical to SEQ ID NO: 42146

SEQ ID NO: 321848 - RNA, 64 nt, hsa; identical to SEQ ID NO: 42147

SEQ ID NO: 321849 - RNA, 64 nt, hsa; identical to SEQ ID NO: 42148

SEQ ID NO: 321850 - RNA, 64 nt, hsa; identical to SEQ ID NO: 42149

SEQ ID NO: 321851 - RNA, 64 nt, hsa; identical to SEQ ID NO: 42150

SEQ ID NO: 321852 - RNA, 64 nt, hsa; identical to SEQ ID NO: 42151

SEQ ID NO: 321853 - RNA, 64 nt, hsa; identical to SEQ ID NO: 42152

SEQ ID NO: 321854 - RNA, 64 nt, hsa; identical to SEQ ID NO: 42153

SEQ ID NO: 321855 - RNA, 64 nt, hsa; identical to SEQ ID NO: 42154

SEQ ID NO: 321856 - RNA, 64 nt, hsa; identical to SEQ ID NO: 42155

SEQ ID NO: 321857 - RNA, 64 nt, hsa; identical to SEQ ID NO: 42156

SEQ ID NO: 321858 - RNA, 64 nt, hsa; identical to SEQ ID NO: 42157

SEQ ID NO: 321859 - RNA, 64 nt, hsa; identical to SEQ ID NO: 42158

SEQ ID NO: 321860 - RNA, 64 nt, hsa; identical to SEQ ID NO: 42159

SEQ ID NO: 321861 - RNA, 64 nt, hsa; identical to SEQ ID NO: 42160

SEQ ID NO: 321862 - RNA, 64 nt, hsa; identical to SEQ ID NO: 42161

SEQ ID NO: 321863 - RNA, 64 nt, hsa; identical to SEQ ID NO: 42162

SEQ ID NO: 321864 - RNA, 64 nt, hsa; identical to SEQ ID NO: 42163

SEQ ID NO: 321865 - RNA, 64 nt, hsa; identical to SEQ ID NO: 42164

SEQ ID NO: 321866 - RNA, 64 nt, hsa; identical to SEQ ID NO: 42165

SEQ ID NO: 321867 - RNA, 64 nt, hsa; identical to SEQ ID NO: 42166

SEQ ID NO: 321868 - RNA, 64 nt, hsa; identical to SEQ ID NO: 42167

SEQ ID NO: 321869 - RNA, 64 nt, hsa; identical to SEQ ID NO: 42168

SEQ ID NO: 321870 - RNA, 64 nt, hsa; identical to SEQ ID NO: 42169

SEQ ID NO: 321871 - RNA, 64 nt, hsa; identical to SEQ ID NO: 42170

SEQ ID NO: 321872 - RNA, 64 nt, hsa; identical to SEQ ID NO: 42171

SEQ ID NO: 321873 - RNA, 64 nt, hsa; identical to SEQ ID NO: 42172

SEQ ID NO: 321874 - RNA, 64 nt, hsa; identical to SEQ ID NO: 42173

SEQ ID NO: 321875 - RNA, 64 nt, hsa; identical to SEQ ID NO: 42174

SEQ ID NO: 321876 - RNA, 64 nt, hsa; identical to SEQ ID NO: 42175

SEQ ID NO: 321877 - RNA, 64 nt, hsa; identical to SEQ ID NO: 42176

SEQ ID NO: 321878 - RNA, 64 nt, hsa; identical to SEQ ID NO: 42177

SEQ ID NO: 321879 - RNA, 64 nt, hsa; identical to SEQ ID NO: 42178

SEQ ID NO: 321880 - RNA, 64 nt, hsa; identical to SEQ ID NO: 42179

SEQ ID NO: 321881 - RNA, 64 nt, hsa; identical to SEQ ID NO: 42180

SEQ ID NO: 321882 - RNA, 64 nt, hsa; identical to SEQ ID NO: 42181

SEQ ID NO: 321883 - RNA, 64 nt, hsa; identical to SEQ ID NO: 42182

SEQ ID NO: 321884 - RNA, 64 nt, hsa; identical to SEQ ID NO: 42183

SEQ ID NO: 321885 - RNA, 64 nt, hsa; identical to SEQ ID NO: 42184

SEQ ID NO: 321886 - RNA, 64 nt, hsa; identical to SEQ ID NO: 42185

SEQ ID NO: 321887 - RNA, 64 nt, hsa; identical to SEQ ID NO: 42186

SEQ ID NO: 321888 - RNA, 64 nt, hsa; identical to SEQ ID NO: 42187

SEQ ID NO: 321889 - RNA, 64 nt, hsa; identical to SEQ ID NO: 42188

SEQ ID NO: 321890 - RNA, 64 nt, hsa; identical to SEQ ID NO: 42189

SEQ ID NO: 321891 - RNA, 64 nt, hsa; identical to SEQ ID NO: 42190

SEQ ID NO: 321892 - RNA, 64 nt, hsa; identical to SEQ ID NO: 42191

SEQ ID NO: 321893 - RNA, 64 nt, hsa; identical to SEQ ID NO: 42192

SEQ ID NO: 321894 - RNA, 64 nt, hsa; identical to SEQ ID NO: 42193

SEQ ID NO: 321895 - RNA, 64 nt, hsa; identical to SEQ ID NO: 42194

SEQ ID NO: 321896 - RNA, 64 nt, hsa; identical to SEQ ID NO: 42195

SEQ ID NO: 321897 - RNA, 64 nt, hsa; identical to SEQ ID NO: 42196

SEQ ID NO: 321898 - RNA, 64 nt, hsa; identical to SEQ ID NO: 42197

SEQ ID NO: 321899 - RNA, 64 nt, hsa; identical to SEQ ID NO: 42198

SEQ ID NO: 321900 - RNA, 64 nt, hsa; identical to SEQ ID NO: 42199

SEQ ID NO: 321901 - RNA, 64 nt, hsa; identical to SEQ ID NO: 42200

SEQ ID NO: 321902 - RNA, 64 nt, hsa; identical to SEQ ID NO: 42201

SEQ ID NO: 321903 - RNA, 64 nt, hsa; identical to SEQ ID NO: 42202

SEQ ID NO: 321904 - RNA, 64 nt, hsa; identical to SEQ ID NO: 42203

SEQ ID NO: 321905 - RNA, 64 nt, hsa; identical to SEQ ID NO: 42204

SEQ ID NO: 321906 - RNA, 64 nt, hsa; identical to SEQ ID NO: 42205

SEQ ID NO: 321907 - RNA, 64 nt, hsa; identical to SEQ ID NO: 42206

SEQ ID NO: 321908 - RNA, 64 nt, hsa; identical to SEQ ID NO: 42207

SEQ ID NO: 321909 - RNA, 64 nt, hsa; identical to SEQ ID NO: 42208

SEQ ID NO: 321910 - RNA, 64 nt, hsa; identical to SEQ ID NO: 42209

SEQ ID NO: 321911 - RNA, 64 nt, hsa; identical to SEQ ID NO: 42210

SEQ ID NO: 321912 - RNA, 64 nt, hsa; identical to SEQ ID NO: 42211

SEQ ID NO: 321913 - RNA, 64 nt, hsa; identical to SEQ ID NO: 42212

SEQ ID NO: 321914 - RNA, 64 nt, hsa; identical to SEQ ID NO: 42213

SEQ ID NO: 321915 - RNA, 64 nt, hsa; identical to SEQ ID NO: 42214

SEQ ID NO: 321916 - RNA, 64 nt, hsa; identical to SEQ ID NO: 42215

SEQ ID NO: 321917 - RNA, 64 nt, hsa; identical to SEQ ID NO: 42216

SEQ ID NO: 321918 - RNA, 64 nt, hsa; identical to SEQ ID NO: 42217

SEQ ID NO: 321919 - RNA, 64 nt, hsa; identical to SEQ ID NO: 42218

SEQ ID NO: 321920 - RNA, 64 nt, hsa; identical to SEQ ID NO: 42219

SEQ ID NO: 321921 - RNA, 64 nt, hsa; identical to SEQ ID NO: 42220

SEQ ID NO: 321922 - RNA, 64 nt, hsa; identical to SEQ ID NO: 42221

SEQ ID NO: 321923 - RNA, 64 nt, hsa; identical to SEQ ID NO: 42222

SEQ ID NO: 321924 - RNA, 64 nt, hsa; identical to SEQ ID NO: 42223

SEQ ID NO: 321925 - RNA, 64 nt, hsa; identical to SEQ ID NO: 42224

SEQ ID NO: 321926 - RNA, 64 nt, hsa; identical to SEQ ID NO: 42225

SEQ ID NO: 321927 - RNA, 64 nt, hsa; identical to SEQ ID NO: 42226

SEQ ID NO: 321928 - RNA, 64 nt, hsa; identical to SEQ ID NO: 42227

SEQ ID NO: 321929 - RNA, 64 nt, hsa; identical to SEQ ID NO: 42228

SEQ ID NO: 321930 - RNA, 64 nt, hsa; identical to SEQ ID NO: 42229

SEQ ID NO: 321931 - RNA, 64 nt, hsa; identical to SEQ ID NO: 42230

SEQ ID NO: 321932 - RNA, 64 nt, hsa; identical to SEQ ID NO: 42231

SEQ ID NO: 321933 - RNA, 64 nt, hsa; identical to SEQ ID NO: 42232

SEQ ID NO: 321934 - RNA, 64 nt, hsa; identical to SEQ ID NO: 42233

SEQ ID NO: 321935 - RNA, 64 nt, hsa; identical to SEQ ID NO: 42234

SEQ ID NO: 321936 - RNA, 64 nt, hsa; identical to SEQ ID NO: 42235

SEQ ID NO: 321937 - RNA, 64 nt, hsa
ucucaagucagcucccuagacucaucccaugucagcucccuaggagccacagcaccaggaaggg

SEQ ID NO: 321938 - RNA, 64 nt, hsa
ggccacuaggggaugaaggacccaucucaagucagcucccuagacucaucccaugucagcuccc

SEQ ID NO: 321939 - RNA, 64 nt, hsa
uuaacccaggcaugcaaugcuagauaauaaaauugcucccuauuggcugaucagagaggagucu

SEQ ID NO: 321940 - RNA, 64 nt, hsa
acuuuugugaacaaaaauuauaacauuuacuuuugcucccuaccugacugccacagaacugggc

SEQ ID NO: 321941 - RNA, 64 nt, hsa; identical to SEQ ID NO: 266801

SEQ ID NO: 321942 - RNA, 64 nt, hsa; identical to SEQ ID NO: 266802

SEQ ID NO: 321943 - RNA, 64 nt, hsa; identical to SEQ ID NO: 266803

SEQ ID NO: 321944 - RNA, 64 nt, hsa; identical to SEQ ID NO: 266804

SEQ ID NO: 321945 - RNA, 64 nt, hsa; identical to SEQ ID NO: 266805

SEQ ID NO: 321946 - RNA, 64 nt, hsa; identical to SEQ ID NO: 266806

SEQ ID NO: 321947 - RNA, 64 nt, hsa; identical to SEQ ID NO: 116628

SEQ ID NO: 321948 - RNA, 64 nt, hsa; identical to SEQ ID NO: 116629

SEQ ID NO: 321949 - RNA, 64 nt, hsa; identical to SEQ ID NO: 116630

SEQ ID NO: 321950 - RNA, 64 nt, hsa; identical to SEQ ID NO: 116631

SEQ ID NO: 321951 - RNA, 64 nt, hsa; identical to SEQ ID NO: 116632

SEQ ID NO: 321952 - RNA, 64 nt, hsa; identical to SEQ ID NO: 116633

SEQ ID NO: 321953 - RNA, 64 nt, hsa; identical to SEQ ID NO: 55975

SEQ ID NO: 321954 - RNA, 64 nt, hsa; identical to SEQ ID NO: 55976

SEQ ID NO: 321955 - RNA, 64 nt, hsa; identical to SEQ ID NO: 55977

SEQ ID NO: 321956 - RNA, 64 nt, hsa; identical to SEQ ID NO: 55978

SEQ ID NO: 321957 - RNA, 64 nt, hsa; identical to SEQ ID NO: 55979

SEQ ID NO: 321958 - RNA, 64 nt, hsa; identical to SEQ ID NO: 55980

SEQ ID NO: 321959 - RNA, 64 nt, hsa; identical to SEQ ID NO: 55981

SEQ ID NO: 321960 - RNA, 64 nt, hsa; identical to SEQ ID NO: 55982

SEQ ID NO: 321961 - RNA, 64 nt, hsa; identical to SEQ ID NO: 55983

SEQ ID NO: 321962 - RNA, 64 nt, hsa; identical to SEQ ID NO: 55984

SEQ ID NO: 321963 - RNA, 64 nt, hsa; identical to SEQ ID NO: 55985

SEQ ID NO: 321964 - RNA, 64 nt, hsa; identical to SEQ ID NO: 55986

SEQ ID NO: 321965 - RNA, 64 nt, hsa; identical to SEQ ID NO: 55987

SEQ ID NO: 321966 - RNA, 64 nt, hsa; identical to SEQ ID NO: 55988

SEQ ID NO: 321967 - RNA, 64 nt, hsa; identical to SEQ ID NO: 55989

SEQ ID NO: 321968 - RNA, 64 nt, hsa; identical to SEQ ID NO: 55990

SEQ ID NO: 321969 - RNA, 64 nt, hsa; identical to SEQ ID NO: 55991

SEQ ID NO: 321970 - RNA, 64 nt, hsa; identical to SEQ ID NO: 55992

SEQ ID NO: 321971 - RNA, 64 nt, hsa; identical to SEQ ID NO: 55993

SEQ ID NO: 321972 - RNA, 64 nt, hsa; identical to SEQ ID NO: 55994

SEQ ID NO: 321973 - RNA, 64 nt, hsa; identical to SEQ ID NO: 55995

SEQ ID NO: 321974 - RNA, 64 nt, hsa; identical to SEQ ID NO: 55996

SEQ ID NO: 321975 - RNA, 64 nt, hsa; identical to SEQ ID NO: 55997

SEQ ID NO: 321976 - RNA, 64 nt, hsa; identical to SEQ ID NO: 55998

SEQ ID NO: 321977 - RNA, 64 nt, hsa; identical to SEQ ID NO: 55999

SEQ ID NO: 321978 - RNA, 64 nt, hsa; identical to SEQ ID NO: 56000

SEQ ID NO: 321979 - RNA, 64 nt, hsa; identical to SEQ ID NO: 56001

SEQ ID NO: 321980 - RNA, 64 nt, hsa; identical to SEQ ID NO: 56002

SEQ ID NO: 321981 - RNA, 64 nt, hsa; identical to SEQ ID NO: 56003

SEQ ID NO: 321982 - RNA, 64 nt, hsa; identical to SEQ ID NO: 56004

SEQ ID NO: 321983 - RNA, 64 nt, hsa; identical to SEQ ID NO: 56005

SEQ ID NO: 321984 - RNA, 64 nt, hsa; identical to SEQ ID NO: 56006

SEQ ID NO: 321985 - RNA, 64 nt, hsa; identical to SEQ ID NO: 56007

SEQ ID NO: 321986 - RNA, 64 nt, hsa; identical to SEQ ID NO: 56008

SEQ ID NO: 321987 - RNA, 64 nt, hsa; identical to SEQ ID NO: 56009

SEQ ID NO: 321988 - RNA, 64 nt, hsa; identical to SEQ ID NO: 56010

SEQ ID NO: 321989 - RNA, 64 nt, hsa; identical to SEQ ID NO: 56011

SEQ ID NO: 321990 - RNA, 64 nt, hsa; identical to SEQ ID NO: 56012

SEQ ID NO: 321991 - RNA, 64 nt, hsa; identical to SEQ ID NO: 56013

SEQ ID NO: 321992 - RNA, 64 nt, hsa; identical to SEQ ID NO: 56014

SEQ ID NO: 321993 - RNA, 64 nt, hsa; identical to SEQ ID NO: 56015

SEQ ID NO: 321994 - RNA, 64 nt, hsa; identical to SEQ ID NO: 56016

SEQ ID NO: 321995 - RNA, 64 nt, hsa; identical to SEQ ID NO: 56017

SEQ ID NO: 321996 - RNA, 64 nt, hsa; identical to SEQ ID NO: 56018

SEQ ID NO: 321997 - RNA, 64 nt, hsa; identical to SEQ ID NO: 56019

SEQ ID NO: 321998 - RNA, 64 nt, hsa; identical to SEQ ID NO: 56020

SEQ ID NO: 321999 - RNA, 64 nt, hsa; identical to SEQ ID NO: 56021

SEQ ID NO: 322000 - RNA, 64 nt, hsa; identical to SEQ ID NO: 56022

SEQ ID NO: 322001 - RNA, 64 nt, hsa; identical to SEQ ID NO: 56023

SEQ ID NO: 322002 - RNA, 64 nt, hsa; identical to SEQ ID NO: 56024

SEQ ID NO: 322003 - RNA, 64 nt, hsa; identical to SEQ ID NO: 56025

SEQ ID NO: 322004 - RNA, 64 nt, hsa; identical to SEQ ID NO: 56026

SEQ ID NO: 322005 - RNA, 64 nt, hsa; identical to SEQ ID NO: 56027

SEQ ID NO: 322006 - RNA, 64 nt, hsa; identical to SEQ ID NO: 56028

SEQ ID NO: 322007 - RNA, 64 nt, hsa; identical to SEQ ID NO: 56029

SEQ ID NO: 322008 - RNA, 64 nt, hsa; identical to SEQ ID NO: 56030

SEQ ID NO: 322009 - RNA, 64 nt, hsa; identical to SEQ ID NO: 56031

SEQ ID NO: 322010 - RNA, 64 nt, hsa; identical to SEQ ID NO: 56032

SEQ ID NO: 322011 - RNA, 64 nt, hsa; identical to SEQ ID NO: 56033

SEQ ID NO: 322012 - RNA, 64 nt, hsa; identical to SEQ ID NO: 56034

SEQ ID NO: 322013 - RNA, 64 nt, hsa; identical to SEQ ID NO: 56035

SEQ ID NO: 322014 - RNA, 64 nt, hsa; identical to SEQ ID NO: 56036

SEQ ID NO: 322015 - RNA, 64 nt, hsa; identical to SEQ ID NO: 56037

SEQ ID NO: 322016 - RNA, 64 nt, hsa; identical to SEQ ID NO: 56038

SEQ ID NO: 322017 - RNA, 64 nt, hsa; identical to SEQ ID NO: 56039

SEQ ID NO: 322018 - RNA, 64 nt, hsa; identical to SEQ ID NO: 56040

SEQ ID NO: 322019 - RNA, 64 nt, hsa; identical to SEQ ID NO: 56041

SEQ ID NO: 322020 - RNA, 64 nt, hsa; identical to SEQ ID NO: 56042

SEQ ID NO: 322021 - RNA, 64 nt, hsa; identical to SEQ ID NO: 56043

SEQ ID NO: 322022 - RNA, 64 nt, hsa; identical to SEQ ID NO: 56044

SEQ ID NO: 322023 - RNA, 64 nt, hsa; identical to SEQ ID NO: 56045

SEQ ID NO: 322024 - RNA, 64 nt, hsa; identical to SEQ ID NO: 56046

SEQ ID NO: 322025 - RNA, 64 nt, hsa; identical to SEQ ID NO: 56047

SEQ ID NO: 322026 - RNA, 64 nt, hsa; identical to SEQ ID NO: 56048

SEQ ID NO: 322027 - RNA, 64 nt, hsa; identical to SEQ ID NO: 56049

SEQ ID NO: 322028 - RNA, 64 nt, hsa; identical to SEQ ID NO: 56050

SEQ ID NO: 322029 - RNA, 64 nt, hsa; identical to SEQ ID NO: 56051

SEQ ID NO: 322030 - RNA, 64 nt, hsa; identical to SEQ ID NO: 56052

SEQ ID NO: 322031 - RNA, 64 nt, hsa; identical to SEQ ID NO: 56053

SEQ ID NO: 322032 - RNA, 64 nt, hsa; identical to SEQ ID NO: 56054

SEQ ID NO: 322033 - RNA, 64 nt, hsa; identical to SEQ ID NO: 56055

SEQ ID NO: 322034 - RNA, 64 nt, hsa; identical to SEQ ID NO: 56056

SEQ ID NO: 322035 - RNA, 64 nt, hsa; identical to SEQ ID NO: 56057

SEQ ID NO: 322036 - RNA, 64 nt, hsa; identical to SEQ ID NO: 56058

SEQ ID NO: 322037 - RNA, 64 nt, hsa; identical to SEQ ID NO: 56059

SEQ ID NO: 322038 - RNA, 64 nt, hsa; identical to SEQ ID NO: 56060

SEQ ID NO: 322039 - RNA, 64 nt, hsa; identical to SEQ ID NO: 56061

SEQ ID NO: 322040 - RNA, 64 nt, hsa; identical to SEQ ID NO: 56062

SEQ ID NO: 322041 - RNA, 64 nt, hsa; identical to SEQ ID NO: 56063

SEQ ID NO: 322042 - RNA, 64 nt, hsa; identical to SEQ ID NO: 56064

SEQ ID NO: 322043 - RNA, 64 nt, hsa; identical to SEQ ID NO: 56065

SEQ ID NO: 322044 - RNA, 64 nt, hsa; identical to SEQ ID NO: 56066

SEQ ID NO: 322045 - RNA, 64 nt, hsa; identical to SEQ ID NO: 56067

SEQ ID NO: 322046 - RNA, 64 nt, hsa; identical to SEQ ID NO: 56068

SEQ ID NO: 322047 - RNA, 64 nt, hsa; identical to SEQ ID NO: 56069

SEQ ID NO: 322048 - RNA, 64 nt, hsa; identical to SEQ ID NO: 56070

SEQ ID NO: 322049 - RNA, 64 nt, hsa; identical to SEQ ID NO: 56071

SEQ ID NO: 322050 - RNA, 64 nt, hsa; identical to SEQ ID NO: 56072

SEQ ID NO: 322051 - RNA, 64 nt, hsa; identical to SEQ ID NO: 56073

SEQ ID NO: 322052 - RNA, 64 nt, hsa; identical to SEQ ID NO: 56074

SEQ ID NO: 322053 - RNA, 64 nt, hsa; identical to SEQ ID NO: 56075

SEQ ID NO: 322054 - RNA, 64 nt, hsa; identical to SEQ ID NO: 56076

SEQ ID NO: 322055 - RNA, 64 nt, hsa; identical to SEQ ID NO: 56077

SEQ ID NO: 322056 - RNA, 64 nt, hsa; identical to SEQ ID NO: 56078

SEQ ID NO: 322057 - RNA, 64 nt, hsa; identical to SEQ ID NO: 56079

SEQ ID NO: 322058 - RNA, 64 nt, hsa; identical to SEQ ID NO: 56080

SEQ ID NO: 322059 - RNA, 64 nt, hsa; identical to SEQ ID NO: 56081

SEQ ID NO: 322060 - RNA, 64 nt, hsa; identical to SEQ ID NO: 56082

SEQ ID NO: 322061 - RNA, 64 nt, hsa; identical to SEQ ID NO: 56083

SEQ ID NO: 322062 - RNA, 64 nt, hsa; identical to SEQ ID NO: 56084

SEQ ID NO: 322063 - RNA, 64 nt, hsa; identical to SEQ ID NO: 56085

SEQ ID NO: 322064 - RNA, 64 nt, hsa; identical to SEQ ID NO: 56086

SEQ ID NO: 322065 - RNA, 64 nt, hsa; identical to SEQ ID NO: 56087

SEQ ID NO: 322066 - RNA, 64 nt, hsa; identical to SEQ ID NO: 56088

SEQ ID NO: 322067 - RNA, 64 nt, hsa; identical to SEQ ID NO: 56089

SEQ ID NO: 322068 - RNA, 64 nt, hsa; identical to SEQ ID NO: 56090

SEQ ID NO: 322069 - RNA, 64 nt, hsa; identical to SEQ ID NO: 56091

SEQ ID NO: 322070 - RNA, 64 nt, hsa; identical to SEQ ID NO: 56092

SEQ ID NO: 322071 - RNA, 64 nt, hsa; identical to SEQ ID NO: 56093

SEQ ID NO: 322072 - RNA, 64 nt, hsa; identical to SEQ ID NO: 56094

SEQ ID NO: 322073 - RNA, 64 nt, hsa; identical to SEQ ID NO: 56095

SEQ ID NO: 322074 - RNA, 64 nt, hsa; identical to SEQ ID NO: 56096

SEQ ID NO: 322075 - RNA, 64 nt, hsa; identical to SEQ ID NO: 56097

SEQ ID NO: 322076 - RNA, 64 nt, hsa; identical to SEQ ID NO: 56098

SEQ ID NO: 322077 - RNA, 64 nt, hsa; identical to SEQ ID NO: 56099

SEQ ID NO: 322078 - RNA, 64 nt, hsa; identical to SEQ ID NO: 56100

SEQ ID NO: 322079 - RNA, 64 nt, hsa; identical to SEQ ID NO: 56101

SEQ ID NO: 322080 - RNA, 64 nt, hsa; identical to SEQ ID NO: 56102

SEQ ID NO: 322081 - RNA, 64 nt, hsa; identical to SEQ ID NO: 56103

SEQ ID NO: 322082 - RNA, 64 nt, hsa; identical to SEQ ID NO: 56104

SEQ ID NO: 322083 - RNA, 64 nt, hsa; identical to SEQ ID NO: 56105

SEQ ID NO: 322084 - RNA, 64 nt, hsa; identical to SEQ ID NO: 56106

SEQ ID NO: 322085 - RNA, 64 nt, hsa; identical to SEQ ID NO: 56107

SEQ ID NO: 322086 - RNA, 64 nt, hsa; identical to SEQ ID NO: 56108

SEQ ID NO: 322087 - RNA, 64 nt, hsa; identical to SEQ ID NO: 56109

SEQ ID NO: 322088 - RNA, 64 nt, hsa; identical to SEQ ID NO: 56110

SEQ ID NO: 322089 - RNA, 64 nt, hsa; identical to SEQ ID NO: 56111

SEQ ID NO: 322090 - RNA, 64 nt, hsa; identical to SEQ ID NO: 56112

SEQ ID NO: 322091 - RNA, 64 nt, hsa; identical to SEQ ID NO: 56113

SEQ ID NO: 322092 - RNA, 64 nt, hsa; identical to SEQ ID NO: 56114

SEQ ID NO: 322093 - RNA, 64 nt, hsa; identical to SEQ ID NO: 56115

SEQ ID NO: 322094 - RNA, 64 nt, hsa; identical to SEQ ID NO: 56116

SEQ ID NO: 322095 - RNA, 64 nt, hsa; identical to SEQ ID NO: 56117

SEQ ID NO: 322096 - RNA, 64 nt, hsa; identical to SEQ ID NO: 56118

SEQ ID NO: 322097 - RNA, 64 nt, hsa; identical to SEQ ID NO: 56119

SEQ ID NO: 322098 - RNA, 64 nt, hsa; identical to SEQ ID NO: 56120

SEQ ID NO: 322099 - RNA, 64 nt, hsa; identical to SEQ ID NO: 56121

SEQ ID NO: 322100 - RNA, 64 nt, hsa; identical to SEQ ID NO: 56122

SEQ ID NO: 322101 - RNA, 64 nt, hsa; identical to SEQ ID NO: 56123

SEQ ID NO: 322102 - RNA, 64 nt, hsa; identical to SEQ ID NO: 56124

SEQ ID NO: 322103 - RNA, 64 nt, hsa; identical to SEQ ID NO: 56125

SEQ ID NO: 322104 - RNA, 64 nt, hsa; identical to SEQ ID NO: 56126

SEQ ID NO: 322105 - RNA, 64 nt, hsa; identical to SEQ ID NO: 56127

SEQ ID NO: 322106 - RNA, 64 nt, hsa; identical to SEQ ID NO: 56128

SEQ ID NO: 322107 - RNA, 64 nt, hsa; identical to SEQ ID NO: 56129

SEQ ID NO: 322108 - RNA, 64 nt, hsa; identical to SEQ ID NO: 56130

SEQ ID NO: 322109 - RNA, 64 nt, hsa; identical to SEQ ID NO: 56131

SEQ ID NO: 322110 - RNA, 64 nt, hsa; identical to SEQ ID NO: 56132

SEQ ID NO: 322111 - RNA, 64 nt, hsa; identical to SEQ ID NO: 56133

SEQ ID NO: 322112 - RNA, 64 nt, hsa; identical to SEQ ID NO: 56134

SEQ ID NO: 322113 - RNA, 64 nt, hsa; identical to SEQ ID NO: 56135

SEQ ID NO: 322114 - RNA, 64 nt, hsa; identical to SEQ ID NO: 56136

SEQ ID NO: 322115 - RNA, 64 nt, hsa; identical to SEQ ID NO: 56137

SEQ ID NO: 322116 - RNA, 64 nt, hsa; identical to SEQ ID NO: 56138

SEQ ID NO: 322117 - RNA, 64 nt, hsa; identical to SEQ ID NO: 56139

SEQ ID NO: 322118 - RNA, 64 nt, hsa; identical to SEQ ID NO: 56140

SEQ ID NO: 322119 - RNA, 64 nt, hsa; identical to SEQ ID NO: 56141

SEQ ID NO: 322120 - RNA, 64 nt, hsa; identical to SEQ ID NO: 56142

SEQ ID NO: 322121 - RNA, 64 nt, hsa; identical to SEQ ID NO: 56143

SEQ ID NO: 322122 - RNA, 64 nt, hsa; identical to SEQ ID NO: 56144

SEQ ID NO: 322123 - RNA, 64 nt, hsa; identical to SEQ ID NO: 56145

SEQ ID NO: 322124 - RNA, 64 nt, hsa; identical to SEQ ID NO: 56146

SEQ ID NO: 322125 - RNA, 64 nt, hsa; identical to SEQ ID NO: 56147

SEQ ID NO: 322126 - RNA, 64 nt, hsa; identical to SEQ ID NO: 56148

SEQ ID NO: 322127 - RNA, 64 nt, hsa; identical to SEQ ID NO: 56149

SEQ ID NO: 322128 - RNA, 64 nt, hsa; identical to SEQ ID NO: 56150

SEQ ID NO: 322129 - RNA, 64 nt, hsa; identical to SEQ ID NO: 56151

SEQ ID NO: 322130 - RNA, 64 nt, hsa; identical to SEQ ID NO: 56152

SEQ ID NO: 322131 - RNA, 64 nt, hsa; identical to SEQ ID NO: 56153

SEQ ID NO: 322132 - RNA, 64 nt, hsa; identical to SEQ ID NO: 56154

SEQ ID NO: 322133 - RNA, 64 nt, hsa; identical to SEQ ID NO: 56155

SEQ ID NO: 322134 - RNA, 64 nt, hsa; identical to SEQ ID NO: 56156

SEQ ID NO: 322135 - RNA, 64 nt, hsa; identical to SEQ ID NO: 56157

SEQ ID NO: 322136 - RNA, 64 nt, hsa; identical to SEQ ID NO: 56158

SEQ ID NO: 322137 - RNA, 64 nt, hsa; identical to SEQ ID NO: 56159

SEQ ID NO: 322138 - RNA, 64 nt, hsa
uagaaggaaaugauagucaaauacacguuuagauuaaaacuaguuuaaaaaauuauaaaugaau

SEQ ID NO: 322139 - RNA, 64 nt, hsa
aaagaaaauuggaugcaagacaauggagaaacuuuaaaacuaaacaggaccacccuuuauucuu

SEQ ID NO: 322140 - RNA, 64 nt, hsa
aaggugagcuccucaacaauaacuuugcaauaauuaaaacuacccuaaguaacuuuggcuuaua

SEQ ID NO: 322141 - RNA, 64 nt, hsa
uguuuauguuuuaagaaugaacacuuuucaaauauaaaacuauauaauaauuauaauccaguuu

SEQ ID NO: 322142 - RNA, 64 nt, hsa
aacugccagcagaaaaacuccauacuguucauuguaaaacuaaaagugaggaaggcucgugggu

SEQ ID NO: 322143 - RNA, 64 nt, hsa
agaauccuuaaaaagaaaaauugacuugcuugccuaaaacuacagugcccccuuagccuccauu

SEQ ID NO: 322144 - RNA, 64 nt, hsa
ugaaggguuuuuuaaaagaacuaaauaaaacaaauaaaacuaggcuacagguauagcugaccaa

SEQ ID NO: 322145 - RNA, 64 nt, hsa
uaaaaaugaguaaacuacagcagagaaauaagaauaaaacuaaugaaggguuuuuuaaaagaac

SEQ ID NO: 322146 - RNA, 64 nt, hsa
uagauuuaaaaguauaugacauguauuuuguauuuaaaacuagaauagccaguauuuauguuuu

SEQ ID NO: 322147 - RNA, 64 nt, hsa
ucugaaccaacaugcuacaguagcuaagaaguauuaaaacuauauacauccauauaaagaugaa

SEQ ID NO: 322148 - RNA, 64 nt, hsa
aagggggacuucuaggaauuuauaaccaaaauuuuaaaacuauuuuuauauuuuuuuaaaucuu

SEQ ID NO: 322149 - RNA, 64 nt, hsa
aauugcauagcuuuuuguaacauuuacuuaauuuuaaaacuaaacucauacuuuugcuaucuuu

SEQ ID NO: 322150 - RNA, 64 nt, hsa
uuuucaucacuuuuuauucauaacuucagauuuguaaaacuaauuuccaaaauauaagcuguuu

SEQ ID NO: 322151 - RNA, 64 nt, hsa
gcaaaauuuuacaaaucauuuguggaaugaaugguaaaacuaaucugaugaaauggaaaauuau

SEQ ID NO: 322152 - RNA, 64 nt, hsa
aauguuaaauauaguaucuauguagauugguuaguaaaacuauuuaauaaauuugauaaauaua

SEQ ID NO: 322153 - RNA, 64 nt, hsa
guuugcuaccuauuguaacuauuauucuuaaucuuaaaacuauaaauauggaucuuuuaugauu

SEQ ID NO: 322154 - RNA, 64 nt, hsa
gaaaugcaauucauuuuguacauacauaguauauuaaaacuauauaauaguucauagaaauguu

SEQ ID NO: 322155 - RNA, 64 nt, hsa
acauuaucugauccaguccucacauuuuuaaauauaaaacuaaagagagaaugcuucuuacagg

SEQ ID NO: 322156 - RNA, 64 nt, hsa
uauuuauuucugaaacaaaagaggcauuuuucaauaaaacuacugaaaauuugacauggcaugu

SEQ ID NO: 322157 - RNA, 64 nt, hsa
caugaggagccucaguuuugaaagaggugcauaauaaaacuacuaaccagaggagucuaugcca

SEQ ID NO: 322158 - RNA, 64 nt, hsa
gugggagacuaugaauauuccugaugagcacaaguaaaacuaaggcuucagccauaauauggag

SEQ ID NO: 322159 - RNA, 64 nt, hsa
aauuaccuugcuccuacuucuuuugauuacauccuaaaacuacaugcuuccccccuuccaguag

SEQ ID NO: 322160 - RNA, 64 nt, hsa
uuacuuuaaauuugccaauauuuugggagaacaauaaaacuacauuuuuuccucuuccauacug

SEQ ID NO: 322161 - RNA, 64 nt, hsa
uaagaaagaugucaacaugcuagaaaauuaauuuuaaaacuaaguuauuccaacacuaaaagca

SEQ ID NO: 322162 - RNA, 64 nt, hsa
uaaaaacaaggaaauguaccucuuucuucagaauuaaaacuaaaaucuuaaauaaaacagaaaa

SEQ ID NO: 322163 - RNA, 64 nt, hsa
aaaagaaaacagaaaccugguuauaaccugacgcuaaaacuaaaaacaaggaaauguaccucuu

SEQ ID NO: 322164 - RNA, 64 nt, hsa
aggcucaaaugagccaaagguuauaaacuugccuuaaaacuauaguccuauacaaaaauuagcu

SEQ ID NO: 322165 - RNA, 64 nt, hsa
gucugaacccucucccaguccucaucuuccacccuaaaacuagagugaucuuccuaaaacuuca

SEQ ID NO: 322166 - RNA, 64 nt, hsa
ccuguggacauguagcaaugucuauauuggcucauaaaacuaaccugaaaaacaaauaaaugcu

SEQ ID NO: 322167 - RNA, 64 nt, hsa
auaauuuaucuuuauuuaaaagcuuagccugccuuaaaacuagagaucaacuuucucagcugca

SEQ ID NO: 322168 - RNA, 64 nt, hsa
guauuuaaaaggguuucaugaauggaaaccuaaguaaaacuaagcucauuagugacagacuugu

SEQ ID NO: 322169 - RNA, 64 nt, hsa
acuuauugcauauuuucauaaucagucaaaauaauaaaacuaaaaacaaaaaguaaaaauuagu

SEQ ID NO: 322170 - RNA, 64 nt, hsa
uuuuuaucuuuaaaucugagacaaguauuauauuuaaaacuagaucuauuaauacauucaucac

SEQ ID NO: 322171 - RNA, 64 nt, hsa
auauacugaaacauauaauggaagaugcagaugauaaaacuaauuuugaacuuuuuaauuuaua

SEQ ID NO: 322172 - RNA, 64 nt, hsa
cccaauuauuguucuuuuaugaauccaaugaauuuaaaacuauuguuaaauauaauacugcccc

SEQ ID NO: 322173 - RNA, 64 nt, hsa
caugguguacugaucagaaauguucaguuuuaacuaaaacuaaauuuauguuauuuggcuaaau

SEQ ID NO: 322174 - RNA, 64 nt, hsa
uacccugcaaguucacugcaugucugaugcuugguaaaacuagucuucccuguaaaaugcagau

SEQ ID NO: 322175 - RNA, 64 nt, hsa
aauagauuuuaagccaauucuaguaagaaauuaauaaaacuaccuuauuuuguauuucacuuaa

SEQ ID NO: 322176 - RNA, 64 nt, hsa
auuccauucuugaauguagaaauuucagauucucuaaaacuacaugucacuguuuuuauccuag

SEQ ID NO: 322177 - RNA, 64 nt, hsa
auauuugaaugcauggguagaaaauaucauauuuuaaaacuauguauauuuaaauuuaguaauu

SEQ ID NO: 322178 - RNA, 64 nt, hsa
cacugaauguuuauagacaaaagaaaauacacacuaaaacuaaucuucauuuuaaaaggguaaa

SEQ ID NO: 322179 - RNA, 64 nt, hsa
uuauaguagaugccucuuguaauuauggcuuucuuaaaacuauaauccuagcagaggacaucag

SEQ ID NO: 322180 - RNA, 64 nt, hsa
auguagcccuuauuuaaaaaagugaauuccauacuaaaacuaggaaugaaagugagagauuucu

SEQ ID NO: 322181 - RNA, 64 nt, hsa
ucccugaguauccaaguauagugcagauucuauguaaaacuacuaaaugacacuggaauauguu

SEQ ID NO: 322182 - RNA, 64 nt, hsa
uauauuugucuaaaaugaaagcucuuuugcguucuaaaacuacaauauaugucaucuuauuuuc

SEQ ID NO: 322183 - RNA, 64 nt, hsa
uuaaauaaaagugaaccauauuuaucugguuauauaaaacuaaaaauggggguguuuauauaaa

SEQ ID NO: 322184 - RNA, 64 nt, hsa
ugguuauauaaaacuaaaaauggggguguuuauauaaaacuaaaaacuaagaaugauguaaccu

SEQ ID NO: 322185 - RNA, 64 nt, hsa
ccuaguacuaagaauugguuauggauaaauuauguaaaacuaaagaauggauugaaaggauaug

SEQ ID NO: 322186 - RNA, 64 nt, hsa
cauuuuugugauguuuugcuacauauaugaauuguaaaacuagaaucaucaaaauuauuuguug

SEQ ID NO: 322187 - RNA, 64 nt, hsa
uguguguguuuuuuuccuuccagcuuaaacaaauuaaaacuaaauaucuaaaccuuguauacag

SEQ ID NO: 322188 - RNA, 64 nt, hsa
gauccaaaugaagagaacucuuuuaaauauuugauaaaacuacucacccaguaagucucuuaaa

SEQ ID NO: 322189 - RNA, 64 nt, hsa
uauuuacuuuuguaaucuuggauuuuguagcuuuuaaaacuagaaaccauuguucuaacaaagc

SEQ ID NO: 322190 - RNA, 64 nt, hsa
acacaugaauguguauaaucauguuaaaugcaaauaaaacuaguucauagauuuguuuuccuuu

SEQ ID NO: 322191 - RNA, 64 nt, hsa
aguaauauuugaagauuuguagaauauucaccuuuaaaacuaguuaguaugcauuuauaauuuu

SEQ ID NO: 322192 - RNA, 64 nt, hsa
uuguuuucuuaaagaaaucuaugcauuuuaaggauaaaacuaaagcauauggguuuacaugaaa

SEQ ID NO: 322193 - RNA, 64 nt, hsa; identical to SEQ ID NO: 223226

SEQ ID NO: 322194 - RNA, 64 nt, hsa; identical to SEQ ID NO: 223227

SEQ ID NO: 322195 - RNA, 64 nt, hsa; identical to SEQ ID NO: 223228

SEQ ID NO: 322196 - RNA, 64 nt, hsa; identical to SEQ ID NO: 223229

SEQ ID NO: 322197 - RNA, 64 nt, hsa; identical to SEQ ID NO: 223230

SEQ ID NO: 322198 - RNA, 64 nt, hsa; identical to SEQ ID NO: 223231

SEQ ID NO: 322199 - RNA, 64 nt, hsa; identical to SEQ ID NO: 223232

SEQ ID NO: 322200 - RNA, 64 nt, hsa; identical to SEQ ID NO: 223233

SEQ ID NO: 322201 - RNA, 64 nt, hsa; identical to SEQ ID NO: 223234

SEQ ID NO: 322202 - RNA, 64 nt, hsa; identical to SEQ ID NO: 223235

SEQ ID NO: 322203 - RNA, 64 nt, hsa; identical to SEQ ID NO: 223236

SEQ ID NO: 322204 - RNA, 64 nt, hsa; identical to SEQ ID NO: 223237

SEQ ID NO: 322205 - RNA, 64 nt, hsa; identical to SEQ ID NO: 223238

SEQ ID NO: 322206 - RNA, 64 nt, hsa; identical to SEQ ID NO: 223239

SEQ ID NO: 322207 - RNA, 64 nt, hsa; identical to SEQ ID NO: 223240

SEQ ID NO: 322208 - RNA, 64 nt, hsa; identical to SEQ ID NO: 223241

SEQ ID NO: 322209 - RNA, 64 nt, hsa; identical to SEQ ID NO: 223242

SEQ ID NO: 322210 - RNA, 64 nt, hsa; identical to SEQ ID NO: 223243

SEQ ID NO: 322211 - RNA, 64 nt, hsa; identical to SEQ ID NO: 223244

SEQ ID NO: 322212 - RNA, 64 nt, hsa; identical to SEQ ID NO: 223245

SEQ ID NO: 322213 - RNA, 64 nt, hsa; identical to SEQ ID NO: 223246

SEQ ID NO: 322214 - RNA, 64 nt, hsa; identical to SEQ ID NO: 223247

SEQ ID NO: 322215 - RNA, 64 nt, hsa; identical to SEQ ID NO: 223248

SEQ ID NO: 322216 - RNA, 64 nt, hsa; identical to SEQ ID NO: 223249

SEQ ID NO: 322217 - RNA, 64 nt, hsa; identical to SEQ ID NO: 223250

SEQ ID NO: 322218 - RNA, 64 nt, hsa; identical to SEQ ID NO: 223251

SEQ ID NO: 322219 - RNA, 64 nt, hsa; identical to SEQ ID NO: 223252

SEQ ID NO: 322220 - RNA, 64 nt, hsa; identical to SEQ ID NO: 223253

SEQ ID NO: 322221 - RNA, 64 nt, hsa; identical to SEQ ID NO: 223254

SEQ ID NO: 322222 - RNA, 64 nt, hsa; identical to SEQ ID NO: 223255

SEQ ID NO: 322223 - RNA, 64 nt, hsa; identical to SEQ ID NO: 223256

SEQ ID NO: 322224 - RNA, 64 nt, hsa; identical to SEQ ID NO: 223257

SEQ ID NO: 322225 - RNA, 64 nt, hsa; identical to SEQ ID NO: 223258

SEQ ID NO: 322226 - RNA, 64 nt, hsa; identical to SEQ ID NO: 223259

SEQ ID NO: 322227 - RNA, 64 nt, hsa; identical to SEQ ID NO: 223260

SEQ ID NO: 322228 - RNA, 64 nt, hsa; identical to SEQ ID NO: 223261

SEQ ID NO: 322229 - RNA, 64 nt, hsa; identical to SEQ ID NO: 223262

SEQ ID NO: 322230 - RNA, 64 nt, hsa; identical to SEQ ID NO: 223263

SEQ ID NO: 322231 - RNA, 64 nt, hsa; identical to SEQ ID NO: 223264

SEQ ID NO: 322232 - RNA, 64 nt, hsa; identical to SEQ ID NO: 223265

SEQ ID NO: 322233 - RNA, 64 nt, hsa; identical to SEQ ID NO: 223266

SEQ ID NO: 322234 - RNA, 64 nt, hsa; identical to SEQ ID NO: 223267

SEQ ID NO: 322235 - RNA, 64 nt, hsa; identical to SEQ ID NO: 223268

SEQ ID NO: 322236 - RNA, 64 nt, hsa; identical to SEQ ID NO: 223269

SEQ ID NO: 322237 - RNA, 64 nt, hsa; identical to SEQ ID NO: 223270

SEQ ID NO: 322238 - RNA, 64 nt, hsa; identical to SEQ ID NO: 223271

SEQ ID NO: 322239 - RNA, 64 nt, hsa; identical to SEQ ID NO: 223272

SEQ ID NO: 322240 - RNA, 64 nt, hsa; identical to SEQ ID NO: 223273

SEQ ID NO: 322241 - RNA, 64 nt, hsa; identical to SEQ ID NO: 223274

SEQ ID NO: 322242 - RNA, 64 nt, hsa; identical to SEQ ID NO: 223275

SEQ ID NO: 322243 - RNA, 64 nt, hsa; identical to SEQ ID NO: 223276

SEQ ID NO: 322244 - RNA, 64 nt, hsa; identical to SEQ ID NO: 223277

SEQ ID NO: 322245 - RNA, 64 nt, hsa; identical to SEQ ID NO: 223278

SEQ ID NO: 322246 - RNA, 64 nt, hsa; identical to SEQ ID NO: 223279

SEQ ID NO: 322247 - RNA, 64 nt, hsa; identical to SEQ ID NO: 223280

SEQ ID NO: 322248 - RNA, 64 nt, hsa; identical to SEQ ID NO: 223281

SEQ ID NO: 322249 - RNA, 64 nt, hsa; identical to SEQ ID NO: 223282

SEQ ID NO: 322250 - RNA, 64 nt, hsa; identical to SEQ ID NO: 223283

SEQ ID NO: 322251 - RNA, 64 nt, hsa; identical to SEQ ID NO: 223284

SEQ ID NO: 322252 - RNA, 64 nt, hsa; identical to SEQ ID NO: 223285

SEQ ID NO: 322253 - RNA, 64 nt, hsa; identical to SEQ ID NO: 223286

SEQ ID NO: 322254 - RNA, 64 nt, hsa; identical to SEQ ID NO: 223287

SEQ ID NO: 322255 - RNA, 64 nt, hsa; identical to SEQ ID NO: 223288

SEQ ID NO: 322256 - RNA, 64 nt, hsa; identical to SEQ ID NO: 223289

SEQ ID NO: 322257 - RNA, 64 nt, hsa; identical to SEQ ID NO: 223290

SEQ ID NO: 322258 - RNA, 64 nt, hsa; identical to SEQ ID NO: 223291

SEQ ID NO: 322259 - RNA, 64 nt, hsa; identical to SEQ ID NO: 223292

SEQ ID NO: 322260 - RNA, 64 nt, hsa; identical to SEQ ID NO: 223293

SEQ ID NO: 322261 - RNA, 64 nt, hsa; identical to SEQ ID NO: 223294

SEQ ID NO: 322262 - RNA, 64 nt, hsa; identical to SEQ ID NO: 223295

SEQ ID NO: 322263 - RNA, 64 nt, hsa; identical to SEQ ID NO: 223296

SEQ ID NO: 322264 - RNA, 64 nt, hsa; identical to SEQ ID NO: 223297

SEQ ID NO: 322265 - RNA, 64 nt, hsa; identical to SEQ ID NO: 223298

SEQ ID NO: 322266 - RNA, 64 nt, hsa; identical to SEQ ID NO: 223299

SEQ ID NO: 322267 - RNA, 64 nt, hsa; identical to SEQ ID NO: 223300

SEQ ID NO: 322268 - RNA, 64 nt, hsa; identical to SEQ ID NO: 223301

SEQ ID NO: 322269 - RNA, 64 nt, hsa; identical to SEQ ID NO: 223302

SEQ ID NO: 322270 - RNA, 64 nt, hsa; identical to SEQ ID NO: 223303

SEQ ID NO: 322271 - RNA, 64 nt, hsa; identical to SEQ ID NO: 223304

SEQ ID NO: 322272 - RNA, 64 nt, hsa; identical to SEQ ID NO: 223305

SEQ ID NO: 322273 - RNA, 64 nt, hsa; identical to SEQ ID NO: 223306

SEQ ID NO: 322274 - RNA, 64 nt, hsa; identical to SEQ ID NO: 223307

SEQ ID NO: 322275 - RNA, 64 nt, hsa; identical to SEQ ID NO: 223308

SEQ ID NO: 322276 - RNA, 64 nt, hsa; identical to SEQ ID NO: 223309

SEQ ID NO: 322277 - RNA, 64 nt, hsa; identical to SEQ ID NO: 223310

SEQ ID NO: 322278 - RNA, 64 nt, hsa; identical to SEQ ID NO: 223311

SEQ ID NO: 322279 - RNA, 64 nt, hsa; identical to SEQ ID NO: 223312

SEQ ID NO: 322280 - RNA, 64 nt, hsa; identical to SEQ ID NO: 223313

SEQ ID NO: 322281 - RNA, 64 nt, hsa; identical to SEQ ID NO: 223314

SEQ ID NO: 322282 - RNA, 64 nt, hsa; identical to SEQ ID NO: 223315

SEQ ID NO: 322283 - RNA, 64 nt, hsa; identical to SEQ ID NO: 223316

SEQ ID NO: 322284 - RNA, 64 nt, hsa; identical to SEQ ID NO: 223317

SEQ ID NO: 322285 - RNA, 64 nt, hsa; identical to SEQ ID NO: 223318

SEQ ID NO: 322286 - RNA, 64 nt, hsa; identical to SEQ ID NO: 223319

SEQ ID NO: 322287 - RNA, 64 nt, hsa; identical to SEQ ID NO: 223320

SEQ ID NO: 322288 - RNA, 64 nt, hsa; identical to SEQ ID NO: 223321

SEQ ID NO: 322289 - RNA, 64 nt, hsa; identical to SEQ ID NO: 223322

SEQ ID NO: 322290 - RNA, 64 nt, hsa; identical to SEQ ID NO: 223323

SEQ ID NO: 322291 - RNA, 64 nt, hsa; identical to SEQ ID NO: 223324

SEQ ID NO: 322292 - RNA, 64 nt, hsa; identical to SEQ ID NO: 223325

SEQ ID NO: 322293 - RNA, 64 nt, hsa; identical to SEQ ID NO: 223326

SEQ ID NO: 322294 - RNA, 64 nt, hsa; identical to SEQ ID NO: 223327

SEQ ID NO: 322295 - RNA, 64 nt, hsa; identical to SEQ ID NO: 223328

SEQ ID NO: 322296 - RNA, 64 nt, hsa; identical to SEQ ID NO: 223329

SEQ ID NO: 322297 - RNA, 64 nt, hsa; identical to SEQ ID NO: 223330

SEQ ID NO: 322298 - RNA, 64 nt, hsa; identical to SEQ ID NO: 223331

SEQ ID NO: 322299 - RNA, 64 nt, hsa; identical to SEQ ID NO: 223332

SEQ ID NO: 322300 - RNA, 64 nt, hsa; identical to SEQ ID NO: 223333

SEQ ID NO: 322301 - RNA, 64 nt, hsa; identical to SEQ ID NO: 223334

SEQ ID NO: 322302 - RNA, 64 nt, hsa; identical to SEQ ID NO: 223335

SEQ ID NO: 322303 - RNA, 64 nt, hsa; identical to SEQ ID NO: 223336

SEQ ID NO: 322304 - RNA, 64 nt, hsa; identical to SEQ ID NO: 223337

SEQ ID NO: 322305 - RNA, 64 nt, hsa; identical to SEQ ID NO: 223338

SEQ ID NO: 322306 - RNA, 64 nt, hsa; identical to SEQ ID NO: 223339

SEQ ID NO: 322307 - RNA, 64 nt, hsa; identical to SEQ ID NO: 223340

SEQ ID NO: 322308 - RNA, 64 nt, hsa; identical to SEQ ID NO: 223341

SEQ ID NO: 322309 - RNA, 64 nt, hsa; identical to SEQ ID NO: 223342

SEQ ID NO: 322310 - RNA, 64 nt, hsa; identical to SEQ ID NO: 223343

SEQ ID NO: 322311 - RNA, 64 nt, hsa; identical to SEQ ID NO: 223344

SEQ ID NO: 322312 - RNA, 64 nt, hsa; identical to SEQ ID NO: 223345

SEQ ID NO: 322313 - RNA, 64 nt, hsa; identical to SEQ ID NO: 223346

SEQ ID NO: 322314 - RNA, 64 nt, hsa; identical to SEQ ID NO: 223347

SEQ ID NO: 322315 - RNA, 64 nt, hsa; identical to SEQ ID NO: 223348

SEQ ID NO: 322316 - RNA, 64 nt, hsa; identical to SEQ ID NO: 223349

SEQ ID NO: 322317 - RNA, 64 nt, hsa; identical to SEQ ID NO: 223350

SEQ ID NO: 322318 - RNA, 64 nt, hsa; identical to SEQ ID NO: 223351

SEQ ID NO: 322319 - RNA, 64 nt, hsa; identical to SEQ ID NO: 223352

SEQ ID NO: 322320 - RNA, 64 nt, hsa; identical to SEQ ID NO: 223353

SEQ ID NO: 322321 - RNA, 64 nt, hsa; identical to SEQ ID NO: 223354

SEQ ID NO: 322322 - RNA, 64 nt, hsa; identical to SEQ ID NO: 223355

SEQ ID NO: 322323 - RNA, 64 nt, hsa; identical to SEQ ID NO: 223356

SEQ ID NO: 322324 - RNA, 64 nt, hsa; identical to SEQ ID NO: 223357

SEQ ID NO: 322325 - RNA, 64 nt, hsa; identical to SEQ ID NO: 223358

SEQ ID NO: 322326 - RNA, 64 nt, hsa; identical to SEQ ID NO: 223359

SEQ ID NO: 322327 - RNA, 64 nt, hsa; identical to SEQ ID NO: 223360

SEQ ID NO: 322328 - RNA, 64 nt, hsa; identical to SEQ ID NO: 223361

SEQ ID NO: 322329 - RNA, 64 nt, hsa; identical to SEQ ID NO: 223362

SEQ ID NO: 322330 - RNA, 64 nt, hsa; identical to SEQ ID NO: 223363

SEQ ID NO: 322331 - RNA, 64 nt, hsa; identical to SEQ ID NO: 223364

SEQ ID NO: 322332 - RNA, 64 nt, hsa; identical to SEQ ID NO: 223365

SEQ ID NO: 322333 - RNA, 64 nt, hsa; identical to SEQ ID NO: 223366

SEQ ID NO: 322334 - RNA, 64 nt, hsa; identical to SEQ ID NO: 223367

SEQ ID NO: 322335 - RNA, 64 nt, hsa; identical to SEQ ID NO: 223368

SEQ ID NO: 322336 - RNA, 64 nt, hsa; identical to SEQ ID NO: 223369

SEQ ID NO: 322337 - RNA, 64 nt, hsa; identical to SEQ ID NO: 223370

SEQ ID NO: 322338 - RNA, 64 nt, hsa; identical to SEQ ID NO: 223371

SEQ ID NO: 322339 - RNA, 64 nt, hsa; identical to SEQ ID NO: 223372

SEQ ID NO: 322340 - RNA, 64 nt, hsa; identical to SEQ ID NO: 223373

SEQ ID NO: 322341 - RNA, 64 nt, hsa; identical to SEQ ID NO: 223374

SEQ ID NO: 322342 - RNA, 64 nt, hsa; identical to SEQ ID NO: 223375

SEQ ID NO: 322343 - RNA, 64 nt, hsa; identical to SEQ ID NO: 223376

SEQ ID NO: 322344 - RNA, 64 nt, hsa; identical to SEQ ID NO: 223377

SEQ ID NO: 322345 - RNA, 64 nt, hsa; identical to SEQ ID NO: 223378

SEQ ID NO: 322346 - RNA, 64 nt, hsa; identical to SEQ ID NO: 223379

SEQ ID NO: 322347 - RNA, 64 nt, hsa; identical to SEQ ID NO: 223380

SEQ ID NO: 322348 - RNA, 64 nt, hsa; identical to SEQ ID NO: 223381

SEQ ID NO: 322349 - RNA, 64 nt, hsa; identical to SEQ ID NO: 223382

SEQ ID NO: 322350 - RNA, 64 nt, hsa; identical to SEQ ID NO: 223383

SEQ ID NO: 322351 - RNA, 64 nt, hsa; identical to SEQ ID NO: 223384

SEQ ID NO: 322352 - RNA, 64 nt, hsa; identical to SEQ ID NO: 223385

SEQ ID NO: 322353 - RNA, 64 nt, hsa; identical to SEQ ID NO: 223386

SEQ ID NO: 322354 - RNA, 64 nt, hsa; identical to SEQ ID NO: 223387

SEQ ID NO: 322355 - RNA, 64 nt, hsa; identical to SEQ ID NO: 223388

SEQ ID NO: 322356 - RNA, 64 nt, hsa; identical to SEQ ID NO: 223389

SEQ ID NO: 322357 - RNA, 64 nt, hsa; identical to SEQ ID NO: 223390

SEQ ID NO: 322358 - RNA, 64 nt, hsa; identical to SEQ ID NO: 223391

SEQ ID NO: 322359 - RNA, 64 nt, hsa; identical to SEQ ID NO: 223392

SEQ ID NO: 322360 - RNA, 64 nt, hsa; identical to SEQ ID NO: 223393

SEQ ID NO: 322361 - RNA, 64 nt, hsa; identical to SEQ ID NO: 223394

SEQ ID NO: 322362 - RNA, 64 nt, hsa; identical to SEQ ID NO: 223395

SEQ ID NO: 322363 - RNA, 64 nt, hsa; identical to SEQ ID NO: 223396

SEQ ID NO: 322364 - RNA, 64 nt, hsa; identical to SEQ ID NO: 223397

SEQ ID NO: 322365 - RNA, 64 nt, hsa; identical to SEQ ID NO: 223398

SEQ ID NO: 322366 - RNA, 64 nt, hsa; identical to SEQ ID NO: 223399

SEQ ID NO: 322367 - RNA, 64 nt, hsa; identical to SEQ ID NO: 223400

SEQ ID NO: 322368 - RNA, 64 nt, hsa; identical to SEQ ID NO: 223401

SEQ ID NO: 322369 - RNA, 64 nt, hsa; identical to SEQ ID NO: 223402

SEQ ID NO: 322370 - RNA, 56 nt, hsa; identical to SEQ ID NO: 223403

SEQ ID NO: 322371 - RNA, 51 nt, hsa; identical to SEQ ID NO: 223404

SEQ ID NO: 322372 - RNA, 64 nt, hsa; identical to SEQ ID NO: 223405

SEQ ID NO: 322373 - RNA, 64 nt, hsa; identical to SEQ ID NO: 223406

SEQ ID NO: 322374 - RNA, 64 nt, hsa; identical to SEQ ID NO: 223407

SEQ ID NO: 322375 - RNA, 64 nt, hsa; identical to SEQ ID NO: 223408

SEQ ID NO: 322376 - RNA, 64 nt, hsa; identical to SEQ ID NO: 223409

SEQ ID NO: 322377 - RNA, 64 nt, hsa; identical to SEQ ID NO: 223410

SEQ ID NO: 322378 - RNA, 64 nt, hsa; identical to SEQ ID NO: 223411

SEQ ID NO: 322379 - RNA, 64 nt, hsa; identical to SEQ ID NO: 223412

SEQ ID NO: 322380 - RNA, 64 nt, hsa; identical to SEQ ID NO: 223413

SEQ ID NO: 322381 - RNA, 64 nt, hsa; identical to SEQ ID NO: 223414

SEQ ID NO: 322382 - RNA, 64 nt, hsa; identical to SEQ ID NO: 223415

SEQ ID NO: 322383 - RNA, 64 nt, hsa; identical to SEQ ID NO: 223416

SEQ ID NO: 322384 - RNA, 64 nt, hsa; identical to SEQ ID NO: 223417

SEQ ID NO: 322385 - RNA, 64 nt, hsa; identical to SEQ ID NO: 223418

SEQ ID NO: 322386 - RNA, 64 nt, hsa; identical to SEQ ID NO: 223419

SEQ ID NO: 322387 - RNA, 64 nt, hsa; identical to SEQ ID NO: 223420

SEQ ID NO: 322388 - RNA, 64 nt, hsa; identical to SEQ ID NO: 223421

SEQ ID NO: 322389 - RNA, 64 nt, hsa; identical to SEQ ID NO: 223422

SEQ ID NO: 322390 - RNA, 64 nt, hsa; identical to SEQ ID NO: 223423

SEQ ID NO: 322391 - RNA, 64 nt, hsa; identical to SEQ ID NO: 223424

SEQ ID NO: 322392 - RNA, 64 nt, hsa; identical to SEQ ID NO: 223425

SEQ ID NO: 322393 - RNA, 64 nt, hsa; identical to SEQ ID NO: 223426

SEQ ID NO: 322394 - RNA, 64 nt, hsa; identical to SEQ ID NO: 223427

SEQ ID NO: 322395 - RNA, 64 nt, hsa; identical to SEQ ID NO: 223428

SEQ ID NO: 322396 - RNA, 64 nt, hsa; identical to SEQ ID NO: 223429

SEQ ID NO: 322397 - RNA, 64 nt, hsa; identical to SEQ ID NO: 223430

SEQ ID NO: 322398 - RNA, 64 nt, hsa; identical to SEQ ID NO: 223431

SEQ ID NO: 322399 - RNA, 64 nt, hsa; identical to SEQ ID NO: 223432

SEQ ID NO: 322400 - RNA, 64 nt, hsa; identical to SEQ ID NO: 223433

SEQ ID NO: 322401 - RNA, 64 nt, hsa; identical to SEQ ID NO: 223434

SEQ ID NO: 322402 - RNA, 64 nt, hsa; identical to SEQ ID NO: 223435

SEQ ID NO: 322403 - RNA, 64 nt, hsa; identical to SEQ ID NO: 223436

SEQ ID NO: 322404 - RNA, 64 nt, hsa; identical to SEQ ID NO: 223437

SEQ ID NO: 322405 - RNA, 64 nt, hsa; identical to SEQ ID NO: 223438

SEQ ID NO: 322406 - RNA, 64 nt, hsa; identical to SEQ ID NO: 223439

SEQ ID NO: 322407 - RNA, 64 nt, hsa; identical to SEQ ID NO: 223440

SEQ ID NO: 322408 - RNA, 64 nt, hsa; identical to SEQ ID NO: 223441

SEQ ID NO: 322409 - RNA, 64 nt, hsa; identical to SEQ ID NO: 223442

SEQ ID NO: 322410 - RNA, 64 nt, hsa; identical to SEQ ID NO: 223443

SEQ ID NO: 322411 - RNA, 64 nt, hsa; identical to SEQ ID NO: 223444

SEQ ID NO: 322412 - RNA, 64 nt, hsa; identical to SEQ ID NO: 223445

SEQ ID NO: 322413 - RNA, 64 nt, hsa; identical to SEQ ID NO: 223446

SEQ ID NO: 322414 - RNA, 64 nt, hsa; identical to SEQ ID NO: 223447

SEQ ID NO: 322415 - RNA, 64 nt, hsa; identical to SEQ ID NO: 223448

SEQ ID NO: 322416 - RNA, 64 nt, hsa; identical to SEQ ID NO: 223449

SEQ ID NO: 322417 - RNA, 64 nt, hsa; identical to SEQ ID NO: 223450

SEQ ID NO: 322418 - RNA, 64 nt, hsa; identical to SEQ ID NO: 223451

SEQ ID NO: 322419 - RNA, 64 nt, hsa; identical to SEQ ID NO: 223452

SEQ ID NO: 322420 - RNA, 64 nt, hsa; identical to SEQ ID NO: 223453

SEQ ID NO: 322421 - RNA, 64 nt, hsa; identical to SEQ ID NO: 223454

SEQ ID NO: 322422 - RNA, 64 nt, hsa; identical to SEQ ID NO: 223455

SEQ ID NO: 322423 - RNA, 64 nt, hsa; identical to SEQ ID NO: 223456

SEQ ID NO: 322424 - RNA, 64 nt, hsa; identical to SEQ ID NO: 223457

SEQ ID NO: 322425 - RNA, 64 nt, hsa; identical to SEQ ID NO: 223458

SEQ ID NO: 322426 - RNA, 64 nt, hsa
gugaaguaauuuaaaauauaaauccauucaggugacaacccaucaucaaaauuacaaauuuucu

SEQ ID NO: 322427 - RNA, 64 nt, hsa
auacaguggaccuggagaccauccccuuggaaagacaacccagagauguucagcauccuguauc

SEQ ID NO: 322428 - RNA, 64 nt, hsa
agcuagaggagaagucuuagauuuuaagaguaauacaacccaucuaucuuauuagucuugugcc

SEQ ID NO: 322429 - RNA, 64 nt, hsa
uuugauaaaguaaauauuuugaccacuauuuucaacaacccagggcuuauuuucuucugacuuc

SEQ ID NO: 322430 - RNA, 64 nt, hsa
uccuccugucaguugcgugaauuuuuuuuaagaaacaacccagugaagaguucuaccauagcaa

SEQ ID NO: 322431 - RNA, 64 nt, hsa
uuguauaaucuuguagaauuucucauucugugguacaacccagggguaaacuauuauuccagua

SEQ ID NO: 322432 - RNA, 64 nt, hsa; identical to SEQ ID NO: 78937

SEQ ID NO: 322433 - RNA, 64 nt, hsa; identical to SEQ ID NO: 78938

SEQ ID NO: 322434 - RNA, 64 nt, hsa; identical to SEQ ID NO: 78939

SEQ ID NO: 322435 - RNA, 64 nt, hsa; identical to SEQ ID NO: 78940

SEQ ID NO: 322436 - RNA, 64 nt, hsa; identical to SEQ ID NO: 78941

SEQ ID NO: 322437 - RNA, 64 nt, hsa; identical to SEQ ID NO: 78942

SEQ ID NO: 322438 - RNA, 64 nt, hsa; identical to SEQ ID NO: 78943

SEQ ID NO: 322439 - RNA, 64 nt, hsa; identical to SEQ ID NO: 78944

SEQ ID NO: 322440 - RNA, 64 nt, hsa; identical to SEQ ID NO: 78945

SEQ ID NO: 322441 - RNA, 64 nt, hsa; identical to SEQ ID NO: 78946

SEQ ID NO: 322442 - RNA, 64 nt, hsa; identical to SEQ ID NO: 78947

SEQ ID NO: 322443 - RNA, 64 nt, hsa; identical to SEQ ID NO: 78948

SEQ ID NO: 322444 - RNA, 64 nt, hsa; identical to SEQ ID NO: 78949

SEQ ID NO: 322445 - RNA, 64 nt, hsa; identical to SEQ ID NO: 78950

SEQ ID NO: 322446 - RNA, 64 nt, hsa; identical to SEQ ID NO: 78951

SEQ ID NO: 322447 - RNA, 64 nt, hsa; identical to SEQ ID NO: 78952

SEQ ID NO: 322448 - RNA, 64 nt, hsa; identical to SEQ ID NO: 78953

SEQ ID NO: 322449 - RNA, 64 nt, hsa; identical to SEQ ID NO: 78954

SEQ ID NO: 322450 - RNA, 64 nt, hsa; identical to SEQ ID NO: 78955

SEQ ID NO: 322451 - RNA, 64 nt, hsa; identical to SEQ ID NO: 78956

SEQ ID NO: 322452 - RNA, 64 nt, hsa; identical to SEQ ID NO: 78957

SEQ ID NO: 322453 - RNA, 64 nt, hsa; identical to SEQ ID NO: 78958

SEQ ID NO: 322454 - RNA, 64 nt, hsa; identical to SEQ ID NO: 78959

SEQ ID NO: 322455 - RNA, 64 nt, hsa; identical to SEQ ID NO: 78960

SEQ ID NO: 322456 - RNA, 64 nt, hsa; identical to SEQ ID NO: 78961

SEQ ID NO: 322457 - RNA, 64 nt, hsa; identical to SEQ ID NO: 78962

SEQ ID NO: 322458 - RNA, 64 nt, hsa; identical to SEQ ID NO: 78963

SEQ ID NO: 322459 - RNA, 64 nt, hsa; identical to SEQ ID NO: 78964

SEQ ID NO: 322460 - RNA, 64 nt, hsa; identical to SEQ ID NO: 78965

SEQ ID NO: 322461 - RNA, 64 nt, hsa; identical to SEQ ID NO: 78966

SEQ ID NO: 322462 - RNA, 64 nt, hsa; identical to SEQ ID NO: 78967

SEQ ID NO: 322463 - RNA, 64 nt, hsa; identical to SEQ ID NO: 78968

SEQ ID NO: 322464 - RNA, 64 nt, hsa; identical to SEQ ID NO: 78969

SEQ ID NO: 322465 - RNA, 64 nt, hsa; identical to SEQ ID NO: 78970

SEQ ID NO: 322466 - RNA, 64 nt, hsa; identical to SEQ ID NO: 78971

SEQ ID NO: 322467 - RNA, 64 nt, hsa; identical to SEQ ID NO: 78972

SEQ ID NO: 322468 - RNA, 64 nt, hsa; identical to SEQ ID NO: 78973

SEQ ID NO: 322469 - RNA, 64 nt, hsa; identical to SEQ ID NO: 78974

SEQ ID NO: 322470 - RNA, 64 nt, hsa; identical to SEQ ID NO: 78975

SEQ ID NO: 322471 - RNA, 64 nt, hsa; identical to SEQ ID NO: 78976

SEQ ID NO: 322472 - RNA, 64 nt, hsa; identical to SEQ ID NO: 78977

SEQ ID NO: 322473 - RNA, 64 nt, hsa; identical to SEQ ID NO: 78978

SEQ ID NO: 322474 - RNA, 64 nt, hsa; identical to SEQ ID NO: 78979

SEQ ID NO: 322475 - RNA, 64 nt, hsa; identical to SEQ ID NO: 78980

SEQ ID NO: 322476 - RNA, 64 nt, hsa; identical to SEQ ID NO: 78981

SEQ ID NO: 322477 - RNA, 64 nt, hsa; identical to SEQ ID NO: 78982

SEQ ID NO: 322478 - RNA, 64 nt, hsa; identical to SEQ ID NO: 78983

SEQ ID NO: 322479 - RNA, 64 nt, hsa; identical to SEQ ID NO: 78984

SEQ ID NO: 322480 - RNA, 64 nt, hsa; identical to SEQ ID NO: 78985

SEQ ID NO: 322481 - RNA, 64 nt, hsa; identical to SEQ ID NO: 78986

SEQ ID NO: 322482 - RNA, 64 nt, hsa; identical to SEQ ID NO: 78987

SEQ ID NO: 322483 - RNA, 64 nt, hsa; identical to SEQ ID NO: 78988

SEQ ID NO: 322484 - RNA, 64 nt, hsa; identical to SEQ ID NO: 78989

SEQ ID NO: 322485 - RNA, 64 nt, hsa; identical to SEQ ID NO: 78990

SEQ ID NO: 322486 - RNA, 64 nt, hsa; identical to SEQ ID NO: 78991

SEQ ID NO: 322487 - RNA, 64 nt, hsa; identical to SEQ ID NO: 78992

SEQ ID NO: 322488 - RNA, 64 nt, hsa; identical to SEQ ID NO: 78993

SEQ ID NO: 322489 - RNA, 64 nt, hsa; identical to SEQ ID NO: 78994

SEQ ID NO: 322490 - RNA, 64 nt, hsa; identical to SEQ ID NO: 78995

SEQ ID NO: 322491 - RNA, 64 nt, hsa; identical to SEQ ID NO: 78996

SEQ ID NO: 322492 - RNA, 64 nt, hsa; identical to SEQ ID NO: 78997

SEQ ID NO: 322493 - RNA, 64 nt, hsa; identical to SEQ ID NO: 78998

SEQ ID NO: 322494 - RNA, 64 nt, hsa; identical to SEQ ID NO: 78999

SEQ ID NO: 322495 - RNA, 64 nt, hsa; identical to SEQ ID NO: 79000

SEQ ID NO: 322496 - RNA, 64 nt, hsa; identical to SEQ ID NO: 79001

SEQ ID NO: 322497 - RNA, 64 nt, hsa; identical to SEQ ID NO: 79002

SEQ ID NO: 322498 - RNA, 64 nt, hsa; identical to SEQ ID NO: 79003

SEQ ID NO: 322499 - RNA, 64 nt, hsa; identical to SEQ ID NO: 79004

SEQ ID NO: 322500 - RNA, 64 nt, hsa; identical to SEQ ID NO: 79005

SEQ ID NO: 322501 - RNA, 64 nt, hsa; identical to SEQ ID NO: 79006

SEQ ID NO: 322502 - RNA, 64 nt, hsa; identical to SEQ ID NO: 79007

SEQ ID NO: 322503 - RNA, 64 nt, hsa; identical to SEQ ID NO: 79008

SEQ ID NO: 322504 - RNA, 64 nt, hsa; identical to SEQ ID NO: 79009

SEQ ID NO: 322505 - RNA, 64 nt, hsa; identical to SEQ ID NO: 79010

SEQ ID NO: 322506 - RNA, 64 nt, hsa; identical to SEQ ID NO: 79011

SEQ ID NO: 322507 - RNA, 64 nt, hsa; identical to SEQ ID NO: 79012

SEQ ID NO: 322508 - RNA, 64 nt, hsa; identical to SEQ ID NO: 79013

SEQ ID NO: 322509 - RNA, 64 nt, hsa; identical to SEQ ID NO: 79014

SEQ ID NO: 322510 - RNA, 64 nt, hsa; identical to SEQ ID NO: 79015

SEQ ID NO: 322511 - RNA, 64 nt, hsa; identical to SEQ ID NO: 79016

SEQ ID NO: 322512 - RNA, 64 nt, hsa; identical to SEQ ID NO: 79017

SEQ ID NO: 322513 - RNA, 64 nt, hsa; identical to SEQ ID NO: 79018

SEQ ID NO: 322514 - RNA, 64 nt, hsa; identical to SEQ ID NO: 79019

SEQ ID NO: 322515 - RNA, 64 nt, hsa; identical to SEQ ID NO: 79020

SEQ ID NO: 322516 - RNA, 64 nt, hsa; identical to SEQ ID NO: 79021

SEQ ID NO: 322517 - RNA, 64 nt, hsa; identical to SEQ ID NO: 79022

SEQ ID NO: 322518 - RNA, 64 nt, hsa; identical to SEQ ID NO: 79023

SEQ ID NO: 322519 - RNA, 64 nt, hsa; identical to SEQ ID NO: 79024

SEQ ID NO: 322520 - RNA, 64 nt, hsa; identical to SEQ ID NO: 79025

SEQ ID NO: 322521 - RNA, 64 nt, hsa; identical to SEQ ID NO: 79026

SEQ ID NO: 322522 - RNA, 64 nt, hsa; identical to SEQ ID NO: 79027

SEQ ID NO: 322523 - RNA, 64 nt, hsa; identical to SEQ ID NO: 79028

SEQ ID NO: 322524 - RNA, 64 nt, hsa; identical to SEQ ID NO: 79029

SEQ ID NO: 322525 - RNA, 64 nt, hsa; identical to SEQ ID NO: 79030

SEQ ID NO: 322526 - RNA, 64 nt, hsa; identical to SEQ ID NO: 79031

SEQ ID NO: 322527 - RNA, 64 nt, hsa; identical to SEQ ID NO: 79032

SEQ ID NO: 322528 - RNA, 64 nt, hsa; identical to SEQ ID NO: 79033

SEQ ID NO: 322529 - RNA, 64 nt, hsa; identical to SEQ ID NO: 79034

SEQ ID NO: 322530 - RNA, 64 nt, hsa; identical to SEQ ID NO: 79035

SEQ ID NO: 322531 - RNA, 64 nt, hsa; identical to SEQ ID NO: 79036

SEQ ID NO: 322532 - RNA, 64 nt, hsa; identical to SEQ ID NO: 79037

SEQ ID NO: 322533 - RNA, 64 nt, hsa; identical to SEQ ID NO: 79038

SEQ ID NO: 322534 - RNA, 64 nt, hsa; identical to SEQ ID NO: 79039

SEQ ID NO: 322535 - RNA, 64 nt, hsa; identical to SEQ ID NO: 79040

SEQ ID NO: 322536 - RNA, 64 nt, hsa; identical to SEQ ID NO: 79041

SEQ ID NO: 322537 - RNA, 64 nt, hsa; identical to SEQ ID NO: 79042

SEQ ID NO: 322538 - RNA, 64 nt, hsa; identical to SEQ ID NO: 79043

SEQ ID NO: 322539 - RNA, 64 nt, hsa; identical to SEQ ID NO: 79044

SEQ ID NO: 322540 - RNA, 64 nt, hsa; identical to SEQ ID NO: 79045

SEQ ID NO: 322541 - RNA, 64 nt, hsa; identical to SEQ ID NO: 79046

SEQ ID NO: 322542 - RNA, 64 nt, hsa; identical to SEQ ID NO: 79047

SEQ ID NO: 322543 - RNA, 64 nt, hsa; identical to SEQ ID NO: 79048

SEQ ID NO: 322544 - RNA, 64 nt, hsa; identical to SEQ ID NO: 79049

SEQ ID NO: 322545 - RNA, 64 nt, hsa; identical to SEQ ID NO: 79050

SEQ ID NO: 322546 - RNA, 64 nt, hsa; identical to SEQ ID NO: 172495

SEQ ID NO: 322547 - RNA, 64 nt, hsa; identical to SEQ ID NO: 172496

SEQ ID NO: 322548 - RNA, 64 nt, hsa; identical to SEQ ID NO: 143712

SEQ ID NO: 322549 - RNA, 64 nt, hsa; identical to SEQ ID NO: 143713

SEQ ID NO: 322550 - RNA, 64 nt, hsa; identical to SEQ ID NO: 143714

SEQ ID NO: 322551 - RNA, 64 nt, hsa; identical to SEQ ID NO: 143715

SEQ ID NO: 322552 - RNA, 64 nt, hsa; identical to SEQ ID NO: 143716

SEQ ID NO: 322553 - RNA, 64 nt, hsa; identical to SEQ ID NO: 143717

SEQ ID NO: 322554 - RNA, 64 nt, hsa; identical to SEQ ID NO: 143718

SEQ ID NO: 322555 - RNA, 64 nt, hsa; identical to SEQ ID NO: 143719

SEQ ID NO: 322556 - RNA, 64 nt, hsa; identical to SEQ ID NO: 143720

SEQ ID NO: 322557 - RNA, 64 nt, hsa; identical to SEQ ID NO: 143721

SEQ ID NO: 322558 - RNA, 64 nt, hsa; identical to SEQ ID NO: 143722

SEQ ID NO: 322559 - RNA, 64 nt, hsa; identical to SEQ ID NO: 143723

SEQ ID NO: 322560 - RNA, 64 nt, hsa; identical to SEQ ID NO: 143724

SEQ ID NO: 322561 - RNA, 64 nt, hsa; identical to SEQ ID NO: 143725

SEQ ID NO: 322562 - RNA, 64 nt, hsa; identical to SEQ ID NO: 143726

SEQ ID NO: 322563 - RNA, 64 nt, hsa; identical to SEQ ID NO: 143727

SEQ ID NO: 322564 - RNA, 64 nt, hsa; identical to SEQ ID NO: 143728

SEQ ID NO: 322565 - RNA, 64 nt, hsa; identical to SEQ ID NO: 143729

SEQ ID NO: 322566 - RNA, 64 nt, hsa; identical to SEQ ID NO: 143730

SEQ ID NO: 322567 - RNA, 64 nt, hsa; identical to SEQ ID NO: 143731

SEQ ID NO: 322568 - RNA, 64 nt, hsa; identical to SEQ ID NO: 143732

SEQ ID NO: 322569 - RNA, 64 nt, hsa; identical to SEQ ID NO: 143733

SEQ ID NO: 322570 - RNA, 64 nt, hsa; identical to SEQ ID NO: 143734

SEQ ID NO: 322571 - RNA, 64 nt, hsa; identical to SEQ ID NO: 143735

SEQ ID NO: 322572 - RNA, 64 nt, hsa; identical to SEQ ID NO: 143736

SEQ ID NO: 322573 - RNA, 64 nt, hsa; identical to SEQ ID NO: 143737

SEQ ID NO: 322574 - RNA, 64 nt, hsa; identical to SEQ ID NO: 143738

SEQ ID NO: 322575 - RNA, 64 nt, hsa; identical to SEQ ID NO: 143739

SEQ ID NO: 322576 - RNA, 64 nt, hsa; identical to SEQ ID NO: 143740

SEQ ID NO: 322577 - RNA, 64 nt, hsa; identical to SEQ ID NO: 143741

SEQ ID NO: 322578 - RNA, 64 nt, hsa; identical to SEQ ID NO: 143742

SEQ ID NO: 322579 - RNA, 64 nt, hsa; identical to SEQ ID NO: 143743

SEQ ID NO: 322580 - RNA, 64 nt, hsa; identical to SEQ ID NO: 143744

SEQ ID NO: 322581 - RNA, 64 nt, hsa; identical to SEQ ID NO: 143745

SEQ ID NO: 322582 - RNA, 64 nt, hsa; identical to SEQ ID NO: 143746

SEQ ID NO: 322583 - RNA, 64 nt, hsa; identical to SEQ ID NO: 143747

SEQ ID NO: 322584 - RNA, 64 nt, hsa; identical to SEQ ID NO: 143748

SEQ ID NO: 322585 - RNA, 64 nt, hsa; identical to SEQ ID NO: 143749

SEQ ID NO: 322586 - RNA, 64 nt, hsa; identical to SEQ ID NO: 143750

SEQ ID NO: 322587 - RNA, 64 nt, hsa; identical to SEQ ID NO: 143751

SEQ ID NO: 322588 - RNA, 64 nt, hsa; identical to SEQ ID NO: 143752

SEQ ID NO: 322589 - RNA, 64 nt, hsa; identical to SEQ ID NO: 143753

SEQ ID NO: 322590 - RNA, 64 nt, hsa; identical to SEQ ID NO: 143754

SEQ ID NO: 322591 - RNA, 64 nt, hsa; identical to SEQ ID NO: 143755

SEQ ID NO: 322592 - RNA, 64 nt, hsa; identical to SEQ ID NO: 143756

SEQ ID NO: 322593 - RNA, 64 nt, hsa; identical to SEQ ID NO: 143757

SEQ ID NO: 322594 - RNA, 64 nt, hsa; identical to SEQ ID NO: 143758

SEQ ID NO: 322595 - RNA, 64 nt, hsa; identical to SEQ ID NO: 143759

SEQ ID NO: 322596 - RNA, 64 nt, hsa; identical to SEQ ID NO: 143760

SEQ ID NO: 322597 - RNA, 64 nt, hsa; identical to SEQ ID NO: 143761

SEQ ID NO: 322598 - RNA, 64 nt, hsa; identical to SEQ ID NO: 143762

SEQ ID NO: 322599 - RNA, 64 nt, hsa; identical to SEQ ID NO: 143763

SEQ ID NO: 322600 - RNA, 64 nt, hsa; identical to SEQ ID NO: 143764

SEQ ID NO: 322601 - RNA, 64 nt, hsa; identical to SEQ ID NO: 143765

SEQ ID NO: 322602 - RNA, 64 nt, hsa; identical to SEQ ID NO: 143766

SEQ ID NO: 322603 - RNA, 64 nt, hsa; identical to SEQ ID NO: 143767

SEQ ID NO: 322604 - RNA, 64 nt, hsa; identical to SEQ ID NO: 143768

SEQ ID NO: 322605 - RNA, 64 nt, hsa; identical to SEQ ID NO: 143769

SEQ ID NO: 322606 - RNA, 64 nt, hsa; identical to SEQ ID NO: 143770

SEQ ID NO: 322607 - RNA, 64 nt, hsa; identical to SEQ ID NO: 143771

SEQ ID NO: 322608 - RNA, 64 nt, hsa; identical to SEQ ID NO: 143772

SEQ ID NO: 322609 - RNA, 64 nt, hsa; identical to SEQ ID NO: 143773

SEQ ID NO: 322610 - RNA, 64 nt, hsa; identical to SEQ ID NO: 143774

SEQ ID NO: 322611 - RNA, 64 nt, hsa; identical to SEQ ID NO: 143775

SEQ ID NO: 322612 - RNA, 64 nt, hsa; identical to SEQ ID NO: 143776

SEQ ID NO: 322613 - RNA, 64 nt, hsa; identical to SEQ ID NO: 143777

SEQ ID NO: 322614 - RNA, 64 nt, hsa; identical to SEQ ID NO: 143778

SEQ ID NO: 322615 - RNA, 64 nt, hsa; identical to SEQ ID NO: 143779

SEQ ID NO: 322616 - RNA, 64 nt, hsa; identical to SEQ ID NO: 143780

SEQ ID NO: 322617 - RNA, 64 nt, hsa; identical to SEQ ID NO: 143781

SEQ ID NO: 322618 - RNA, 64 nt, hsa; identical to SEQ ID NO: 143782

SEQ ID NO: 322619 - RNA, 64 nt, hsa; identical to SEQ ID NO: 143783

SEQ ID NO: 322620 - RNA, 64 nt, hsa; identical to SEQ ID NO: 143784

SEQ ID NO: 322621 - RNA, 64 nt, hsa; identical to SEQ ID NO: 143785

SEQ ID NO: 322622 - RNA, 64 nt, hsa; identical to SEQ ID NO: 143786

SEQ ID NO: 322623 - RNA, 64 nt, hsa; identical to SEQ ID NO: 143787

SEQ ID NO: 322624 - RNA, 64 nt, hsa; identical to SEQ ID NO: 143788

SEQ ID NO: 322625 - RNA, 64 nt, hsa; identical to SEQ ID NO: 143789

SEQ ID NO: 322626 - RNA, 57 nt, hsa; identical to SEQ ID NO: 143790

SEQ ID NO: 322627 - RNA, 64 nt, hsa; identical to SEQ ID NO: 143791

SEQ ID NO: 322628 - RNA, 64 nt, hsa; identical to SEQ ID NO: 143792

SEQ ID NO: 322629 - RNA, 64 nt, hsa; identical to SEQ ID NO: 143793

SEQ ID NO: 322630 - RNA, 64 nt, hsa; identical to SEQ ID NO: 143794

SEQ ID NO: 322631 - RNA, 64 nt, hsa; identical to SEQ ID NO: 143795

SEQ ID NO: 322632 - RNA, 64 nt, hsa; identical to SEQ ID NO: 143796

SEQ ID NO: 322633 - RNA, 64 nt, hsa; identical to SEQ ID NO: 143797

SEQ ID NO: 322634 - RNA, 64 nt, hsa; identical to SEQ ID NO: 143798

SEQ ID NO: 322635 - RNA, 64 nt, hsa; identical to SEQ ID NO: 143799

SEQ ID NO: 322636 - RNA, 64 nt, hsa; identical to SEQ ID NO: 143800

SEQ ID NO: 322637 - RNA, 64 nt, hsa; identical to SEQ ID NO: 143801

SEQ ID NO: 322638 - RNA, 64 nt, hsa; identical to SEQ ID NO: 143802

SEQ ID NO: 322639 - RNA, 64 nt, hsa; identical to SEQ ID NO: 143803

SEQ ID NO: 322640 - RNA, 64 nt, hsa; identical to SEQ ID NO: 143804

SEQ ID NO: 322641 - RNA, 64 nt, hsa; identical to SEQ ID NO: 143805

SEQ ID NO: 322642 - RNA, 64 nt, hsa; identical to SEQ ID NO: 143806

SEQ ID NO: 322643 - RNA, 64 nt, hsa; identical to SEQ ID NO: 143807

SEQ ID NO: 322644 - RNA, 64 nt, hsa; identical to SEQ ID NO: 143808

SEQ ID NO: 322645 - RNA, 64 nt, hsa; identical to SEQ ID NO: 143809

SEQ ID NO: 322646 - RNA, 64 nt, hsa; identical to SEQ ID NO: 143810

SEQ ID NO: 322647 - RNA, 64 nt, hsa; identical to SEQ ID NO: 143811

SEQ ID NO: 322648 - RNA, 64 nt, hsa; identical to SEQ ID NO: 143812

SEQ ID NO: 322649 - RNA, 64 nt, hsa; identical to SEQ ID NO: 161026

SEQ ID NO: 322650 - RNA, 64 nt, hsa; identical to SEQ ID NO: 161027

SEQ ID NO: 322651 - RNA, 64 nt, hsa; identical to SEQ ID NO: 161028

SEQ ID NO: 322652 - RNA, 64 nt, hsa; identical to SEQ ID NO: 161029

SEQ ID NO: 322653 - RNA, 64 nt, hsa; identical to SEQ ID NO: 161030

SEQ ID NO: 322654 - RNA, 64 nt, hsa; identical to SEQ ID NO: 161031

SEQ ID NO: 322655 - RNA, 64 nt, hsa; identical to SEQ ID NO: 161032

SEQ ID NO: 322656 - RNA, 64 nt, hsa; identical to SEQ ID NO: 161033

SEQ ID NO: 322657 - RNA, 64 nt, hsa; identical to SEQ ID NO: 161034

SEQ ID NO: 322658 - RNA, 50 nt, hsa; identical to SEQ ID NO: 161035

SEQ ID NO: 322659 - RNA, 64 nt, hsa; identical to SEQ ID NO: 161036

SEQ ID NO: 322660 - RNA, 64 nt, hsa; identical to SEQ ID NO: 161037

SEQ ID NO: 322661 - RNA, 64 nt, hsa; identical to SEQ ID NO: 161038

SEQ ID NO: 322662 - RNA, 64 nt, hsa; identical to SEQ ID NO: 161039

SEQ ID NO: 322663 - RNA, 64 nt, hsa; identical to SEQ ID NO: 161040

SEQ ID NO: 322664 - RNA, 64 nt, hsa; identical to SEQ ID NO: 161041

SEQ ID NO: 322665 - RNA, 64 nt, hsa; identical to SEQ ID NO: 161042

SEQ ID NO: 322666 - RNA, 64 nt, hsa; identical to SEQ ID NO: 161043

SEQ ID NO: 322667 - RNA, 64 nt, hsa; identical to SEQ ID NO: 161044

SEQ ID NO: 322668 - RNA, 64 nt, hsa; identical to SEQ ID NO: 161045

SEQ ID NO: 322669 - RNA, 64 nt, hsa; identical to SEQ ID NO: 161046

SEQ ID NO: 322670 - RNA, 64 nt, hsa; identical to SEQ ID NO: 161047

SEQ ID NO: 322671 - RNA, 64 nt, hsa; identical to SEQ ID NO: 72441

SEQ ID NO: 322672 - RNA, 64 nt, hsa; identical to SEQ ID NO: 72442

SEQ ID NO: 322673 - RNA, 64 nt, hsa; identical to SEQ ID NO: 72443

SEQ ID NO: 322674 - RNA, 64 nt, hsa; identical to SEQ ID NO: 72444

SEQ ID NO: 322675 - RNA, 64 nt, hsa; identical to SEQ ID NO: 72445

SEQ ID NO: 322676 - RNA, 64 nt, hsa; identical to SEQ ID NO: 72446

SEQ ID NO: 322677 - RNA, 64 nt, hsa; identical to SEQ ID NO: 72447

SEQ ID NO: 322678 - RNA, 64 nt, hsa; identical to SEQ ID NO: 72448

SEQ ID NO: 322679 - RNA, 64 nt, hsa; identical to SEQ ID NO: 72449

SEQ ID NO: 322680 - RNA, 64 nt, hsa; identical to SEQ ID NO: 72450

SEQ ID NO: 322681 - RNA, 64 nt, hsa; identical to SEQ ID NO: 72451

SEQ ID NO: 322682 - RNA, 64 nt, hsa; identical to SEQ ID NO: 72452

SEQ ID NO: 322683 - RNA, 64 nt, hsa; identical to SEQ ID NO: 72453

SEQ ID NO: 322684 - RNA, 64 nt, hsa; identical to SEQ ID NO: 72454

SEQ ID NO: 322685 - RNA, 64 nt, hsa; identical to SEQ ID NO: 72455

SEQ ID NO: 322686 - RNA, 64 nt, hsa; identical to SEQ ID NO: 72456

SEQ ID NO: 322687 - RNA, 64 nt, hsa; identical to SEQ ID NO: 72457

SEQ ID NO: 322688 - RNA, 64 nt, hsa; identical to SEQ ID NO: 72458

SEQ ID NO: 322689 - RNA, 64 nt, hsa; identical to SEQ ID NO: 72459

SEQ ID NO: 322690 - RNA, 64 nt, hsa; identical to SEQ ID NO: 72460

SEQ ID NO: 322691 - RNA, 64 nt, hsa; identical to SEQ ID NO: 72461

SEQ ID NO: 322692 - RNA, 64 nt, hsa; identical to SEQ ID NO: 72462

SEQ ID NO: 322693 - RNA, 64 nt, hsa; identical to SEQ ID NO: 72463

SEQ ID NO: 322694 - RNA, 64 nt, hsa; identical to SEQ ID NO: 72464

SEQ ID NO: 322695 - RNA, 64 nt, hsa; identical to SEQ ID NO: 72465

SEQ ID NO: 322696 - RNA, 64 nt, hsa; identical to SEQ ID NO: 72466

SEQ ID NO: 322697 - RNA, 64 nt, hsa; identical to SEQ ID NO: 72467

SEQ ID NO: 322698 - RNA, 64 nt, hsa; identical to SEQ ID NO: 72468

SEQ ID NO: 322699 - RNA, 64 nt, hsa; identical to SEQ ID NO: 72469

SEQ ID NO: 322700 - RNA, 64 nt, hsa; identical to SEQ ID NO: 72470

SEQ ID NO: 322701 - RNA, 64 nt, hsa; identical to SEQ ID NO: 72471

SEQ ID NO: 322702 - RNA, 64 nt, hsa; identical to SEQ ID NO: 72472

SEQ ID NO: 322703 - RNA, 64 nt, hsa; identical to SEQ ID NO: 72473

SEQ ID NO: 322704 - RNA, 64 nt, hsa; identical to SEQ ID NO: 72474

SEQ ID NO: 322705 - RNA, 64 nt, hsa; identical to SEQ ID NO: 72475

SEQ ID NO: 322706 - RNA, 64 nt, hsa; identical to SEQ ID NO: 72476

SEQ ID NO: 322707 - RNA, 64 nt, hsa; identical to SEQ ID NO: 72477

SEQ ID NO: 322708 - RNA, 64 nt, hsa; identical to SEQ ID NO: 72478

SEQ ID NO: 322709 - RNA, 64 nt, hsa; identical to SEQ ID NO: 72479

SEQ ID NO: 322710 - RNA, 64 nt, hsa; identical to SEQ ID NO: 72480

SEQ ID NO: 322711 - RNA, 64 nt, hsa; identical to SEQ ID NO: 72481

SEQ ID NO: 322712 - RNA, 64 nt, hsa; identical to SEQ ID NO: 72482

SEQ ID NO: 322713 - RNA, 64 nt, hsa; identical to SEQ ID NO: 72483

SEQ ID NO: 322714 - RNA, 64 nt, hsa; identical to SEQ ID NO: 72484

SEQ ID NO: 322715 - RNA, 64 nt, hsa; identical to SEQ ID NO: 72485

SEQ ID NO: 322716 - RNA, 64 nt, hsa; identical to SEQ ID NO: 72486

SEQ ID NO: 322717 - RNA, 64 nt, hsa; identical to SEQ ID NO: 72487

SEQ ID NO: 322718 - RNA, 64 nt, hsa; identical to SEQ ID NO: 72488

SEQ ID NO: 322719 - RNA, 64 nt, hsa; identical to SEQ ID NO: 72489

SEQ ID NO: 322720 - RNA, 64 nt, hsa; identical to SEQ ID NO: 72490

SEQ ID NO: 322721 - RNA, 64 nt, hsa; identical to SEQ ID NO: 72491

SEQ ID NO: 322722 - RNA, 64 nt, hsa; identical to SEQ ID NO: 72492

SEQ ID NO: 322723 - RNA, 64 nt, hsa; identical to SEQ ID NO: 72493

SEQ ID NO: 322724 - RNA, 62 nt, hsa
acggugaccucuccgcuugccaaaauaaccgaaggaaagaccguucaccagacuuggcuccu

SEQ ID NO: 322725 - RNA, 62 nt, hsa
gccaguuuuauaacauucacuuucugccucugaggaaagauacagggaacaaaaaucaauuu

SEQ ID NO: 322726 - RNA, 62 nt, hsa
auuuuuaacacuaaaauucaaggaagcaguggaggaaagaaugcauuacuaccacagauaga

SEQ ID NO: 322727 - RNA, 62 nt, hsa
ucuuuuggaggguuccucaugaagugugcuugaggaaagaaauucugauucuaggcagagga

SEQ ID NO: 322728 - RNA, 62 nt, hsa
cacaguagaagaauggcugcuuuugaauggggaggaaagaagacauuuuucuuaauauccuu

SEQ ID NO: 322729 - RNA, 62 nt, hsa
gagugcauuagucugaagaguauacauuggauaggaaagaauuuccuucuuuuguuucucca

SEQ ID NO: 322730 - RNA, 62 nt, hsa
uggcaggacacagagagguaggugaacauuccaggaaagaagcagcuuagagaaaaugugga

SEQ ID NO: 322731 - RNA, 62 nt, hsa
augcuaugcuggauaugaacuuuuggggccucaggaaagaaaaaccaggaacuaguuucaau

SEQ ID NO: 322732 - RNA, 62 nt, hsa
ugccccaaagugagaacuugcucuacguggucaggaaagagcagggagaccaagcagagucg

SEQ ID NO: 322733 - RNA, 62 nt, hsa
augaugacauuaagguuuuuggccugaauagcaggaaagauggaguuaccaguuacugaaau

SEQ ID NO: 322734 - RNA, 62 nt, hsa
ugaucaaaaucaauuaaaauagucucuuuaaaaggaaagaaaacaucuuuaaggggaggaac

SEQ ID NO: 322735 - RNA, 62 nt, hsa
aguccaucugcgugugugcagggagacuggguaggaaagaggaagcaaauagaagagagagg

SEQ ID NO: 322736 - RNA, 62 nt, hsa
aaaaaccccacaaucuaggaugggaacaaggaaggaaagaugugaauaggcugaugggcaaa

SEQ ID NO: 322737 - RNA, 62 nt, hsa
gaugagaacaagcuauuugggcacaacacaucaggaaagagagcaccacgugauggaguuuc

SEQ ID NO: 322738 - RNA, 62 nt, hsa
acuguaggaagaaauggaauaauuuaaaugugaggaaagauaucugugguagacauguccuu

SEQ ID NO: 322739 - RNA, 62 nt, hsa
cauuaguggaggauagugcuuuugagccaucuaggaaagauauggaugaaguugaagagaaa

SEQ ID NO: 322740 - RNA, 62 nt, hsa
uuugauuucuuauuucuugggcaggcaauuugaggaaagaagaaauggcauggggaauauau

SEQ ID NO: 322741 - RNA, 62 nt, hsa
gugaaccacuauguaauauuaggccauucuaaaggaaagauguuccaugucaucagagaugg

SEQ ID NO: 322742 - RNA, 62 nt, hsa
auauuguuucuuuagucucaaaacaagagacuaggaaagauccaaaacacagagcaggaguc

SEQ ID NO: 322743 - RNA, 62 nt, hsa
caaggcuaguuccugcaccacccaggauucaaaggaaagacgaagggagcagaacuuguggc

SEQ ID NO: 322744 - RNA, 62 nt, hsa
caacagugggcuuaagggugucugagcaggagaggaaagauaagcucuucguggugcccacg

SEQ ID NO: 322745 - RNA, 62 nt, hsa
ggccucuuugauacacuuuugcuugccuccccaggaaagaaggaauugcauccaagguauac

SEQ ID NO: 322746 - RNA, 62 nt, hsa
agccugagaucaauaagaaauguucaggagagaggaaagaaaaaaaauauaugcuccacaau

SEQ ID NO: 322747 - RNA, 62 nt, hsa
guccagcaacugaaccugccauuaccugggcaaggaaagaucccuuugcucuaggaaagcuu

SEQ ID NO: 322748 - RNA, 62 nt, hsa
gcuuauguaaccauuuuaaacgugguuucuauaggaaagaccaacauuuguuuagcuugcuu

SEQ ID NO: 322749 - RNA, 62 nt, hsa
gcagucggacucuaccuuaaggagggaugggaaggaaagaguugaguugguuucuuucugau

SEQ ID NO: 322750 - RNA, 62 nt, hsa
gauuuguuaaaacgguuaggacuguuuuguccaggaaagauaagaggaccaaacauauaagg

SEQ ID NO: 322751 - RNA, 62 nt, hsa
auuagguauaaaaccuacugcaacuuagaaaaaggaaagaaaaaagaaaacuuuuccaacug

SEQ ID NO: 322752 - RNA, 62 nt, hsa
guuacucaguaaacaaaagagaaauaccagguaggaaagaagaguuacuauuccugagaaau

SEQ ID NO: 322753 - RNA, 62 nt, hsa
uuacaccugugugcaccuguauuacugaauauaggaaagagauacccauuacauaguuacuc

SEQ ID NO: 322754 - RNA, 62 nt, hsa
gauguuggauuugcaccauuuggaguuucuuuaggaaagaaaaguuuucugcuuuuuuauag

SEQ ID NO: 322755 - RNA, 62 nt, hsa
auagcuggaauacugaguucaguucagaaggcaggaaagacagucacaccgacguguccuga

SEQ ID NO: 322756 - RNA, 62 nt, hsa
ucuugugagacuuacuaucacgagaauagcacaggaaagacuggcccccaugauucaauuac

SEQ ID NO: 322757 - RNA, 62 nt, hsa
ucucaugagacuuacuaucaugagaauagcacaggaaagacuggccccccugauucgaugac

SEQ ID NO: 322758 - RNA, 62 nt, hsa
uguuggcauuuaguagaaauagugauaaguugaggaaagaaauaauacaaauuggcuuucaa

SEQ ID NO: 322759 - RNA, 62 nt, hsa
cucucuuagaauuggaggauuugccauuguccaggaaagaaacuugcagcuuuaaccugcug

SEQ ID NO: 322760 - RNA, 62 nt, hsa
ugaaagagcaagaggaaagaaaaaagaaaagaaggaaagaagaauaaagaagagaaacgugu

SEQ ID NO: 322761 - RNA, 62 nt, hsa
uaguuccaagaggugguuuuugaaagagcaagaggaaagaaaaaagaaaagaaggaaagaag

SEQ ID NO: 322762 - RNA, 62 nt, hsa
gaaggccacagugcugggcggcaucccugcagaggaaagacaggacccggggcccgccucac

SEQ ID NO: 322763 - RNA, 62 nt, hsa
cacuuugucuaguguauucucuucacagugccaggaaagagugguuucugcguguguauauu

SEQ ID NO: 322764 - RNA, 62 nt, hsa
auaauugucuccccuccauaggaauuucucccaggaaagaaauauauccccaucuccguuuc

SEQ ID NO: 322765 - RNA, 62 nt, hsa
cuaguugagacauugggaaauggaacauaaucaggaaagacuaucucucugacuaguacaaa

SEQ ID NO: 322766 - RNA, 62 nt, hsa
gucagcaguaagguuucaagguacaguuauggaggaaagaagaaaaugacacauugauaaca

SEQ ID NO: 322767 - RNA, 62 nt, hsa
aagaaauaccccaaacuggguaauuauuauaaaggaaagagguuuaauggacucaguuccgc

SEQ ID NO: 322768 - RNA, 62 nt, hsa
ggguccugaaguuugcugguucaggaaagaacaggaaagagaaaagccuucugugcccaggc

SEQ ID NO: 322769 - RNA, 62 nt, hsa
aguccagucaggguccugaaguuugcugguucaggaaagaacaggaaagagaaaagccuucu

SEQ ID NO: 322770 - RNA, 62 nt, hsa
auugaucguuugcugccagcccagaaggaugaaggaaagaagcaccucacagcuccuuucua

SEQ ID NO: 322771 - RNA, 62 nt, hsa
cuuucugguuucuucauuuucuuccauuacuuaggaaagaguggaaacuccacuaaaauuuc

SEQ ID NO: 322772 - RNA, 62 nt, hsa
uucuuuuccuucugccuuuuugggaaagagacaggaaagauucacuugaaaacauaaaugaa

SEQ ID NO: 322773 - RNA, 62 nt, hsa
aaggguuucuugaaaagcuugucgguucaaagaggaaagaugaauuucaaugugaaaacacg

SEQ ID NO: 322774 - RNA, 62 nt, hsa
uugaacgccauggacgggacacaagcggaccaaggaaagaguggcaugguccacccucucaa

SEQ ID NO: 322775 - RNA, 62 nt, hsa
gucuagauaaaaaaagagauaaagacuacagaaggaaagagaucuugccuuuugaaaagaug

SEQ ID NO: 322776 - RNA, 62 nt, hsa
gcggugacagaagagaaagggucauuuacaucaggaaagaggucuuguaucugggaguagag

SEQ ID NO: 322777 - RNA, 62 nt, hsa
gguaguaggacaaugaaaauuguucuaagcaaaggaaagaaaacugacuuuguugcacuuuu

SEQ ID NO: 322778 - RNA, 62 nt, hsa
gcguugugcugugugucccucgcaagaagcacaggaaagagaaguuucuuuaguagccacua

SEQ ID NO: 322779 - RNA, 62 nt, hsa
ccagcccaguaaugcugaggaguucaguugugaggaaagaaggcuggagcugugagauucgc

SEQ ID NO: 322780 - RNA, 62 nt, hsa
aaguggucccgcuaccauuggggaaucaggaaaggaaagacugagaugguugccaggacuug

SEQ ID NO: 322781 - RNA, 62 nt, hsa
cagcucccugcagcugggcccuagccacucuuaggaaagacuauugggaguauuugcuggcc

SEQ ID NO: 322782 - RNA, 62 nt, hsa
uguucauaucuuuaaauuaggauugcaaaccaaggaaagaacgcauuugagauuuuaagaug

SEQ ID NO: 322783 - RNA, 62 nt, hsa
uuagucauugauuuuuguguuuaaaaaaaaauaggaaagagggaaacugcagcuuucauuac

SEQ ID NO: 322784 - RNA, 62 nt, hsa
auucugacuugcagaaaugcagacauacagucaggaaagaacaaacuucaauuaaauguaua

SEQ ID NO: 322785 - RNA, 62 nt, hsa
caaacauauuugaaaguuaacuuuuggaugauaggaaagaucguacagugacauaaguucau

SEQ ID NO: 322786 - RNA, 62 nt, hsa
aggggccaggauccaguucccucaucucuggcaggaaagauccacagcuuuuccuccauguc

SEQ ID NO: 322787 - RNA, 62 nt, hsa
uuaaaaaagcaccguggagaauggcccucuucaggaaagaaaaauaagcaaaugaauggucc

SEQ ID NO: 322788 - RNA, 62 nt, hsa
aaaaaaacaaccaaccaaaaaaaaaaaaaaaaaggaaagaaacuaaccaacaaaagagaaaa

SEQ ID NO: 322789 - RNA, 62 nt, hsa
gcagaggguccucagagcaggagugacaagggaggaaagaccaaaaaaacaaccaaccaaaa

SEQ ID NO: 322790 - RNA, 62 nt, hsa
gagauuuuggaauucgugcaggaagccaugaaaggaaagaucagugaagacagcaaucacgg

SEQ ID NO: 322791 - RNA, 62 nt, hsa
uguaauuuuaugugcuuucaucacaaauccaaaggaaagaauaaaaauuucuuaacacaacc

SEQ ID NO: 322792 - RNA, 59 nt, hsa
ccuaucugugauaggcaugaagaaucgagaggaaagaucccagcauuuuuucgacacau

SEQ ID NO: 322793 - RNA, 62 nt, hsa
gcggaccugguauucccugacaaacauugcuuaggaaagagggccggagaauaagaagccag

SEQ ID NO: 322794 - RNA, 62 nt, hsa
ugcuguugcauuuagaacuuucugcuuugcacaggaaagagucacacaauuaaucaacaugu

SEQ ID NO: 322795 - RNA, 62 nt, hsa
cugaccuuggcugacuggggcuggggugagagaggaaagaccuacauucccucuccugccca

SEQ ID NO: 322796 - RNA, 62 nt, hsa
cccacugccccggccucaauuaccuuggcugaaggaaagauggcgguaggagagaaaaguga

SEQ ID NO: 322797 - RNA, 62 nt, hsa
ugaccugguggauguggcugcaguccagagaaaggaaagauugagguggcagagcagaccac

SEQ ID NO: 322798 - RNA, 62 nt, hsa
cccacagucuugcauuugcaagcuagagacucaggaaagacaguggcauaaugcagucugag

SEQ ID NO: 322799 - RNA, 62 nt, hsa
cacgggcaggagaagguggauauuucagcuccaggaaagagagcuaauucacucucucuuua

SEQ ID NO: 322800 - RNA, 62 nt, hsa
aauauaccuuauauucuuuaaggaaaacggaaaggaaagaucagcagaaauaggguuuucuc

SEQ ID NO: 322801 - RNA, 62 nt, hsa
cuggaauaaaaugccucuacucagaaacaggcaggaaagaauugcuccaaggaauacuuuuu

SEQ ID NO: 322802 - RNA, 62 nt, hsa
uaaauuuucuucucuuccuguuucuuauguuaaggaaagauacucuguguuuuggcauaugu

SEQ ID NO: 322803 - RNA, 62 nt, hsa
auuguuugcacuuguaauuucccagaguugaaaggaaagauugaacuggaauauuguguaaa

SEQ ID NO: 322804 - RNA, 62 nt, hsa
aaggguacuuccacugauggaaacaaaguggaaggaaagaugcucagguacagagaaggaau

SEQ ID NO: 322805 - RNA, 62 nt, hsa
aaaaaaaaaaaagucugauugguuuuaauugaaggaaagauuuguacuacaguucuuuuguu

SEQ ID NO: 322806 - RNA, 62 nt, hsa
ucagcaacauagaagagggaaggaaagagagaaggaaagagagagagaaagaaagucuccag

SEQ ID NO: 322807 - RNA, 62 nt, hsa
ugcccuacccgcucagcaacauagaagagggaaggaaagagagaaggaaagagagagagaaa

SEQ ID NO: 322808 - RNA, 62 nt, hsa
ucugagcacaugcugggugaagucacagcucaaggaaagauaaagcugggcggaaggaggug

SEQ ID NO: 322809 - RNA, 62 nt, hsa
cacugcagaaaugccucugcguggugccaugaaggaaagaaaccuuggccuggucucgagaa

SEQ ID NO: 322810 - RNA, 62 nt, hsa
ugagagucgacuggauucugucaguucaaaaaaggaaagaaacaaaacuucccuacaauuuu

SEQ ID NO: 322811 - RNA, 62 nt, hsa
acaaauugucccaugcaaauuacccuauaacuaggaaagagacacuauaacccaaaugccau

SEQ ID NO: 322812 - RNA, 64 nt, hsa; identical to SEQ ID NO: 84343

SEQ ID NO: 322813 - RNA, 64 nt, hsa; identical to SEQ ID NO: 84344

SEQ ID NO: 322814 - RNA, 64 nt, hsa; identical to SEQ ID NO: 84345

SEQ ID NO: 322815 - RNA, 64 nt, hsa; identical to SEQ ID NO: 84346

SEQ ID NO: 322816 - RNA, 64 nt, hsa; identical to SEQ ID NO: 84347

SEQ ID NO: 322817 - RNA, 64 nt, hsa; identical to SEQ ID NO: 84348

SEQ ID NO: 322818 - RNA, 64 nt, hsa; identical to SEQ ID NO: 84349

SEQ ID NO: 322819 - RNA, 64 nt, hsa; identical to SEQ ID NO: 84350

SEQ ID NO: 322820 - RNA, 64 nt, hsa; identical to SEQ ID NO: 84351

SEQ ID NO: 322821 - RNA, 64 nt, hsa; identical to SEQ ID NO: 84352

SEQ ID NO: 322822 - RNA, 64 nt, hsa; identical to SEQ ID NO: 84353

SEQ ID NO: 322823 - RNA, 64 nt, hsa; identical to SEQ ID NO: 84354

SEQ ID NO: 322824 - RNA, 64 nt, hsa; identical to SEQ ID NO: 84355

SEQ ID NO: 322825 - RNA, 64 nt, hsa; identical to SEQ ID NO: 84356

SEQ ID NO: 322826 - RNA, 64 nt, hsa; identical to SEQ ID NO: 84357

SEQ ID NO: 322827 - RNA, 64 nt, hsa; identical to SEQ ID NO: 84358

SEQ ID NO: 322828 - RNA, 64 nt, hsa; identical to SEQ ID NO: 84359

SEQ ID NO: 322829 - RNA, 64 nt, hsa; identical to SEQ ID NO: 84360

SEQ ID NO: 322830 - RNA, 64 nt, hsa; identical to SEQ ID NO: 84361

SEQ ID NO: 322831 - RNA, 64 nt, hsa; identical to SEQ ID NO: 84362

SEQ ID NO: 322832 - RNA, 64 nt, hsa; identical to SEQ ID NO: 84363

SEQ ID NO: 322833 - RNA, 64 nt, hsa; identical to SEQ ID NO: 84364

SEQ ID NO: 322834 - RNA, 64 nt, hsa; identical to SEQ ID NO: 84365

SEQ ID NO: 322835 - RNA, 64 nt, hsa; identical to SEQ ID NO: 84366

SEQ ID NO: 322836 - RNA, 64 nt, hsa; identical to SEQ ID NO: 84367

SEQ ID NO: 322837 - RNA, 64 nt, hsa; identical to SEQ ID NO: 84368

SEQ ID NO: 322838 - RNA, 64 nt, hsa; identical to SEQ ID NO: 84369

SEQ ID NO: 322839 - RNA, 64 nt, hsa; identical to SEQ ID NO: 84370

SEQ ID NO: 322840 - RNA, 64 nt, hsa; identical to SEQ ID NO: 84371

SEQ ID NO: 322841 - RNA, 64 nt, hsa; identical to SEQ ID NO: 84372

SEQ ID NO: 322842 - RNA, 64 nt, hsa; identical to SEQ ID NO: 84373

SEQ ID NO: 322843 - RNA, 64 nt, hsa; identical to SEQ ID NO: 84374

SEQ ID NO: 322844 - RNA, 64 nt, hsa; identical to SEQ ID NO: 84375

SEQ ID NO: 322845 - RNA, 64 nt, hsa; identical to SEQ ID NO: 84376

SEQ ID NO: 322846 - RNA, 64 nt, hsa
cugaaccacuccuccuccugauuucccugcucucucugcucagaacacuaccauucaccccauc

SEQ ID NO: 322847 - RNA, 64 nt, hsa
ucugucgccgaggcugcagugcagcggugcgaucucugcucacugcaaccucugccuccugggu

SEQ ID NO: 322848 - RNA, 64 nt, hsa
guaacuuccaauccuccuucuauguauuccuuucucugcucauugacuuauaaauaguuuucau

SEQ ID NO: 322849 - RNA, 64 nt, hsa
uaggaugugacagagaagggauagggaaauccucucugcucauugggccuuacaugauggguga

SEQ ID NO: 322850 - RNA, 64 nt, hsa
gaaauguagguucacugccacuucaugagauaucucugcucacgcuuccaaguuguucucaaug

SEQ ID NO: 322851 - RNA, 64 nt, hsa
auaguugcuugaauuaugaucaucuaccaccaacucugcucagcccuguaacaggguagggaga

SEQ ID NO: 322852 - RNA, 64 nt, hsa
cuaugucugaugacauaaggaaaacuuggcuuccucugcucaagguuccccucugcucaucccu

SEQ ID NO: 322853 - RNA, 64 nt, hsa
aggaaaacuuggcuuccucugcucaagguuccccucugcucaucccuccucauucagacauccu

SEQ ID NO: 322854 - RNA, 64 nt, hsa
ggccucaaacugugcauguaagccuuuguuuuguucugcucagauauucuggauauuaccucuu

SEQ ID NO: 322855 - RNA, 64 nt, hsa
cugcagcuaauggaggcuggaauucagcuuguguucugcucacuaagcugugugcgugcccugg

SEQ ID NO: 322856 - RNA, 64 nt, hsa
uaaaaaaugugggaaaguguucguauaucacaacucugcucaaagacaugaaaagacucauacu

SEQ ID NO: 322857 - RNA, 64 nt, hsa
uaaagaauguggaaaagcauuccgauaccaccaaucugcucaaaaacaugaaaaggcucauacu

SEQ ID NO: 322858 - RNA, 64 nt, hsa
uaaugaauguagaacaucuugcuucugcucagaaucugcucauucuuagaaggccuacauuaac

SEQ ID NO: 322859 - RNA, 64 nt, hsa
uuucauaucuauaaugaauguagaacaucuugcuucugcucagaaucugcucauucuuagaagg

SEQ ID NO: 322860 - RNA, 64 nt, hsa
gaaucuauauuuaacaagaucugcagggggugugucugcucaguaauuugaggacaaccauucc

SEQ ID NO: 322861 - RNA, 64 nt, hsa
cugugccugacccuacuucuuuugcucuuagcugucugcucagacagaaccccuacaugaaaca

SEQ ID NO: 322862 - RNA, 64 nt, hsa
ggagagcuauuuaacacaaauccuaagauuuuuuucugcucaggaaggggugaaauagcuggca

SEQ ID NO: 322863 - RNA, 64 nt, hsa
gcgugcacuuuuuaauaucacaucuauuugucugucugcucauuguuuuguugcuggaacuaaa

SEQ ID NO: 322864 - RNA, 64 nt, hsa
gguguguuucuugagaagcucccuuuuuucuugcucugcucaccgguguggccugggcuggagu

SEQ ID NO: 322865 - RNA, 64 nt, hsa
cucagaagauucacugaggaaacucauggaagccucugcucauuugggucacugggacaccccu

SEQ ID NO: 322866 - RNA, 64 nt, hsa
caaaugaccaaaagcccaagguaggggaguuuccucugcucacaguucuuaccuucaaggcgga

SEQ ID NO: 322867 - RNA, 64 nt, hsa
uuucuuacaaaagccuaaguagcagggguaauuuucugcucauuuuuugucucagugauacugu

SEQ ID NO: 322868 - RNA, 64 nt, hsa; identical to SEQ ID NO: 43762

SEQ ID NO: 322869 - RNA, 64 nt, hsa; identical to SEQ ID NO: 43763

SEQ ID NO: 322870 - RNA, 64 nt, hsa; identical to SEQ ID NO: 43764

SEQ ID NO: 322871 - RNA, 64 nt, hsa; identical to SEQ ID NO: 43765

SEQ ID NO: 322872 - RNA, 64 nt, hsa; identical to SEQ ID NO: 43766

SEQ ID NO: 322873 - RNA, 64 nt, hsa; identical to SEQ ID NO: 43767

SEQ ID NO: 322874 - RNA, 64 nt, hsa; identical to SEQ ID NO: 43768

SEQ ID NO: 322875 - RNA, 64 nt, hsa; identical to SEQ ID NO: 43769

SEQ ID NO: 322876 - RNA, 64 nt, hsa; identical to SEQ ID NO: 43770

SEQ ID NO: 322877 - RNA, 64 nt, hsa; identical to SEQ ID NO: 43771

SEQ ID NO: 322878 - RNA, 64 nt, hsa; identical to SEQ ID NO: 43772

SEQ ID NO: 322879 - RNA, 64 nt, hsa; identical to SEQ ID NO: 43773

SEQ ID NO: 322880 - RNA, 64 nt, hsa; identical to SEQ ID NO: 43774

SEQ ID NO: 322881 - RNA, 64 nt, hsa; identical to SEQ ID NO: 43775

SEQ ID NO: 322882 - RNA, 64 nt, hsa; identical to SEQ ID NO: 43776

SEQ ID NO: 322883 - RNA, 64 nt, hsa; identical to SEQ ID NO: 43777

SEQ ID NO: 322884 - RNA, 64 nt, hsa; identical to SEQ ID NO: 43778

SEQ ID NO: 322885 - RNA, 64 nt, hsa; identical to SEQ ID NO: 43779

SEQ ID NO: 322886 - RNA, 64 nt, hsa; identical to SEQ ID NO: 43780

SEQ ID NO: 322887 - RNA, 64 nt, hsa; identical to SEQ ID NO: 43781

SEQ ID NO: 322888 - RNA, 64 nt, hsa; identical to SEQ ID NO: 43782

SEQ ID NO: 322889 - RNA, 64 nt, hsa
gccagaccauagggcuaugaucugcaguaguccuguggugaagagacuuguuucaucuccggaa

SEQ ID NO: 322890 - RNA, 64 nt, hsa
ucacucacugacggcagcagccaugucucucaaaguggugaaacuaauaucugagcaucuuuua

SEQ ID NO: 322891 - RNA, 64 nt, hsa
uguggaccugcccugcgaaucggcagaggccuccguggugaagacagaagcuccgugaaccaac

SEQ ID NO: 322892 - RNA, 64 nt, hsa
gggccuuccgggugaccguggccguggagcagucguggugaaaccggucagcuguggaccugcc

SEQ ID NO: 322893 - RNA, 64 nt, hsa
augaggucaggagaucgagaccauccuggcuaacguggugaaaccccgucucuuacuaaaaaua

SEQ ID NO: 322894 - RNA, 64 nt, hsa
agcgagaucaaaguuguauaucugagguguaccaguggugaagucagugccacaucugcacugg

SEQ ID NO: 322895 - RNA, 64 nt, hsa
cccauugcucuccuccaggggcagaacauggggaggggacuagaugggcaaggggcagcacugc

SEQ ID NO: 322896 - RNA, 64 nt, hsa
uuuaccccacagcuuaguggccaguaaacacccuggggacuaggaaaaggaaccaacuguaggc

SEQ ID NO: 322897 - RNA, 64 nt, hsa
gucugagggauaauaauuuaauuguucuagacaaggggacuauagggacugacuguuauuaaaa

SEQ ID NO: 322898 - RNA, 64 nt, hsa
cugcccaacccucauccccaucuucucaggggcaggggacuaccuuccagugucucccuccagc

SEQ ID NO: 322899 - RNA, 64 nt, hsa
cacacacacacacacacacacacacacucuuuuaggggacuaagagagagaagcauguuauuac

SEQ ID NO: 322900 - RNA, 64 nt, hsa
cuggcaguugaaaucucuggaagagggaacauguggggacuacucagaggcaaagaggagcugc

SEQ ID NO: 322901 - RNA, 64 nt, hsa
uuuauuuuuguauaauuuaaggaagguaaaguuaggggacuagaagacucuaaauuggcuucua

SEQ ID NO: 322902 - RNA, 64 nt, hsa
uauagaauugaagguucuuaucagaugggauacuggggacuauaaacaauggaaauaaagccac

SEQ ID NO: 322903 - RNA, 64 nt, hsa
uguuuuaagucuucauggauguucugcaugucauggggacuaaaacucacccaacagaucuuuc

SEQ ID NO: 322904 - RNA, 64 nt, hsa
cacucucuuccuuggguguuuggugcuggcuccuggggacuacaaaucccagagugcggugugc

SEQ ID NO: 322905 - RNA, 64 nt, hsa
agcccaggagagagaaagccaggcagguagccagggggacuagccccuguggagacuggggggc

SEQ ID NO: 322906 - RNA, 64 nt, hsa
gacccuugguaaaccccugauucgggguggggugggggacuaggcucagccggaaccagcaccu

SEQ ID NO: 322907 - RNA, 64 nt, hsa
gccuggagaguguucuugucucuagcagcugguuggggacuauauucugucacuggaguuuuga

SEQ ID NO: 322908 - RNA, 64 nt, hsa
cuuggaaagguagucaucaaaugagacuauuugaggggacuauuugaaaugauucugguauuuc

SEQ ID NO: 322909 - RNA, 64 nt, hsa
uauacaaaagacaugauagagaaaagaugagagaggggacuaauuauuuuguuuaugaaaaugg

SEQ ID NO: 322910 - RNA, 64 nt, hsa
gguguguuuuggggcauuuguggaacuuacccauggggacuaauauggaaaaggucuguccaua

SEQ ID NO: 322911 - RNA, 64 nt, hsa
aacuuuuaugagagagauccuggacuucuuuuugggggacuauuuuuguacagagaaaaccugg

SEQ ID NO: 322912 - RNA, 64 nt, hsa
ccagcgacccugugacaccggucugcagggaguuggggacuaagggcuuccagagaguggcugg

SEQ ID NO: 322913 - RNA, 64 nt, hsa
auggccuuguugcuggcaucccggccaggugggcggggacuaacaaagacagcuguuuaggguc

SEQ ID NO: 322914 - RNA, 64 nt, hsa
gaaauagugguuguggaacaguagaaaaccauauggggacuauagugcaaccuauuuggguaaa

SEQ ID NO: 322915 - RNA, 64 nt, hsa
cugccuucuugggauacuaagacuugaauuuuuuggggacuauuaaggguguuagucuuggaga

SEQ ID NO: 322916 - RNA, 64 nt, hsa
auacauuguuauauguaccccaguuguuguuaguggggacuaugauacuguaauaauauuuuua

SEQ ID NO: 322917 - RNA, 64 nt, hsa
ugaaccuucggaucuaugaaagaaaauauaguagggggacuaaggaacauagaauuuuauuagc

SEQ ID NO: 322918 - RNA, 64 nt, hsa
cuauaucuuguucugaacaacacacugugauaaaggggacuagaguggaagauucccuauuuaa

SEQ ID NO: 322919 - RNA, 64 nt, hsa
ucggguggccaacuugcuaucuggugggugacuuggggacuagaaagaauaaagccuuuucuaa

SEQ ID NO: 322920 - RNA, 64 nt, hsa
auggaggagcuugggggaugacuagaggcagggaggggacuauuuaugaaggcaaaaaaauuaa

SEQ ID NO: 322921 - RNA, 64 nt, hsa
ucaucauugcucagcuccucagagugggccgggaggggacuagaagagcugcaugaugguggcu

SEQ ID NO: 322922 - RNA, 64 nt, hsa
uucuacugcuuacacuuuagaauguuuauuuuauggggacuaagggauuaggagugugaacuaa

SEQ ID NO: 322923 - RNA, 64 nt, hsa
auggaaaccaaggaaagugaaacuuuggauaaguggggacuaguguauuuauauauuuaauuga

SEQ ID NO: 322924 - RNA, 64 nt, hsa
ggaggggcgaagcuuuggugacagacggagagugggggacuagcugugcauggcaccugcucug

SEQ ID NO: 322925 - RNA, 64 nt, hsa
agaggcucaaaugcuguccccggcagcuuuccugggggacuagagcuccuucuggccauguuau

SEQ ID NO: 322926 - RNA, 64 nt, hsa
gaauguuuaugucuucaagugaccuguacugcuuggggacuauuggagaaaauaagguggaguc

SEQ ID NO: 322927 - RNA, 64 nt, hsa
agaaaauuguuaggauuuuggaguauuuggggagggggacuacuggaaugcuguccaaguuuua

SEQ ID NO: 322928 - RNA, 64 nt, hsa
cuccaaaggccccaccuccuaauaccaucacucuggggacuaggugucagcaugugaauuuugg

SEQ ID NO: 322929 - RNA, 64 nt, hsa
gggaaagcaaagaagcugcuuuaaaaaauaaaaaggggacuaaaaauuuguuuuguauaaagag

SEQ ID NO: 322930 - RNA, 64 nt, hsa
auugccaacuaggcaggcacaaaucuugggucuuggggacuaacccaaugccugugaagcaguc

SEQ ID NO: 322931 - RNA, 64 nt, hsa
uggugacugauggauggguagugggcugagaagaggggacuaggaagggcuauuccaggcucag

SEQ ID NO: 322932 - RNA, 64 nt, hsa
gcaaaucacauggccaagucuagagucagaaugaggggacuacacaagcugacagcggauggua

SEQ ID NO: 322933 - RNA, 51 nt, hsa; identical to SEQ ID NO: 201885

SEQ ID NO: 322934 - RNA, 64 nt, hsa
cauggcaauaaauauucuagcaucccuaacuaaaggggacuagacaguuagagacucugucacc

SEQ ID NO: 322935 - RNA, 64 nt, hsa
gguuuccugcaccccaaagugagccgcacucucaggggacuagccaccuccuucuuaagagggu

SEQ ID NO: 322936 - RNA, 64 nt, hsa
ugccacuggggcuuugauuuggaggaauggggcaggggacuaucugaagcgcuuccauccuaaa

SEQ ID NO: 322937 - RNA, 64 nt, hsa
cggacgcagcggcuucgggaacaaguuagcgcugggggacuaucugggcucgucucucucugcu

SEQ ID NO: 322938 - RNA, 64 nt, hsa
uuaccaaguugccuuuugccacuguagcugaccaggggacuagguuguagaggugggaaggccc

SEQ ID NO: 322939 - RNA, 64 nt, hsa
ugaggaguacccccagcccaagagaugaacaucuggggacuaauaucauagacccaucuggagg

SEQ ID NO: 322940 - RNA, 64 nt, hsa
cagaacacuaaucagauuucaaggcccacaacuuggggacuagaccaccuuauguugagggaac

SEQ ID NO: 322941 - RNA, 64 nt, hsa
acaauuuuaaauaagauggagaauaaauuauugaggggacuaggcuauaugcauuugccuucau

SEQ ID NO: 322942 - RNA, 64 nt, hsa
ccuguuccaaucuucugccucccagucacucccuggggacuaugggaucacuguccccccaccu

SEQ ID NO: 322943 - RNA, 64 nt, hsa
uuauaagugagagaaaugaaguuuauauuaucaaggggacuaaagucacacggcuugugggcac

SEQ ID NO: 322944 - RNA, 64 nt, hsa
uucuugaggacagggacuucggcauuuacuaaugggggacuacugugggguaagggggcgccug

SEQ ID NO: 322945 - RNA, 64 nt, hsa
cuggggucaggccagaccauguuucgucagccuuggggacuaggccaguguugggcaccuccag

SEQ ID NO: 322946 - RNA, 64 nt, hsa
aaguaucuguuaucuccugcguaguaccaagguaggggacuaguggaucuuaucauaguuuugg

SEQ ID NO: 322947 - RNA, 64 nt, hsa
ugagcaguucuacaaaagaauggccagcacgagcggggacuagaggguccugauuuugugucug

SEQ ID NO: 322948 - RNA, 64 nt, hsa
uguggggaacgggggcucuugaagccagguagcuggggacuauggugucugcccuuccaaucac

SEQ ID NO: 322949 - RNA, 64 nt, hsa
gugagaggaagggugggucuguaagaccuugguaggggacuaauucacuggcgaggugcggcca

SEQ ID NO: 322950 - RNA, 64 nt, hsa
uucagcagcuugcccagcucuugaguacagugguggggacuaaaaaugugggcauguggagagg

SEQ ID NO: 322951 - RNA, 64 nt, hsa
acuuaagucucagacugauuucuugcgggaggagggggacuaaacucaaccuaacacauuaaau

SEQ ID NO: 322952 - RNA, 64 nt, hsa
ccagggaacuuccaaggaaggagccugagccacuggggacuaagugggcagaagaaacccuugg

SEQ ID NO: 322953 - RNA, 64 nt, hsa
agauuacauuuugaaaaggaaaucuagcaugugaggggacuaaguguucucagagugauguuuu

SEQ ID NO: 322954 - RNA, 64 nt, hsa
agucuaucugcagagguauucaguuccuggcacaggggacuaggggcauguagaguauaugagg

SEQ ID NO: 322955 - RNA, 64 nt, hsa
ucccucucuauuuucagguuugcagagcaugccaggggacuacguuucucagggugguccuaug

SEQ ID NO: 322956 - RNA, 64 nt, hsa
cuuugaugauguucccagccauacuccagucaacggggacuacuagucccucacucuuagguuu

SEQ ID NO: 322957 - RNA, 64 nt, hsa
acggacucccgggcugggcuuuugaauuggccuuggggacuacucggcucucacucagcuccca

SEQ ID NO: 322958 - RNA, 64 nt, hsa
uauuacugaaagcuaaauccucaaaaccuaguaaggggacuaaugauucauuaaaguaaauuga

SEQ ID NO: 322959 - RNA, 64 nt, hsa
uucaacaauaagucaguucuaguggcugucgccuggggacuagugagaaagcuacucuucuccc

SEQ ID NO: 322960 - RNA, 64 nt, hsa
gaaggacuauggacucuuguuguguggaauggaaggggacuagccagcucucugcauggcacau

SEQ ID NO: 322961 - RNA, 64 nt, hsa
auucuucggaggagguggacauuucggaagugguggggacuaagggaagaacucucuaguuccc

SEQ ID NO: 322962 - RNA, 64 nt, hsa
ggaaggauaguucuguguacuccuuuagggagugggggacuagaacugggaugucuuggcuugu

SEQ ID NO: 322963 - RNA, 64 nt, hsa
acaacaaauuucugcucaacugacucaucuuuugggggacuaauuuaauuugcugcugacagcc

SEQ ID NO: 322964 - RNA, 64 nt, hsa
acaacaacuuucugcucaacugacuuaucuuuugggggacuaauuuaauuugcugcugacagcc

SEQ ID NO: 322965 - RNA, 64 nt, hsa
aagccaagagggaaagccagaguucccuguucuaggggacuagccaaaugccuacaucagcugu

SEQ ID NO: 322966 - RNA, 64 nt, hsa
ccccaccacgucaugauggauggggcaaggugguggggacuaggggagccugguauacaugcgg

SEQ ID NO: 322967 - RNA, 64 nt, hsa
aguaagcagagcugccaggcucccaggagagcauggggacuaggaggaaggguguggcauggcu

SEQ ID NO: 322968 - RNA, 64 nt, hsa
auccugccaccaccuucucuucucuugucacuagggggacuaggggguccccaaaguggcccac

SEQ ID NO: 322969 - RNA, 64 nt, hsa
ccggcucugcccaccaccacugccaggcugaacaggggacuagugcccaggugacacugcacac

SEQ ID NO: 322970 - RNA, 64 nt, hsa
auuauucuucucauguuaaacccaccaaaauaaaggggacuaaauagguaaugauuuuccuagu

SEQ ID NO: 322971 - RNA, 64 nt, hsa
uguguccucauuauagcaaaggguuacuggugcaggggacuaggaaaaacccguccaguguggu

SEQ ID NO: 322972 - RNA, 54 nt, hsa; identical to SEQ ID NO: 201924

SEQ ID NO: 322973 - RNA, 64 nt, hsa
cacccccagcccugucccugccaccccuccuaguggggacuagugaaugacuugaccugugacc

SEQ ID NO: 322974 - RNA, 64 nt, hsa
cccugcgccugggggcugggguaggcgaggccguggggacuacccauuuuauagcuggggaaac

SEQ ID NO: 322975 - RNA, 64 nt, hsa
cccuggggacagaggucagccuaaggugacacacggggacuacugugcuuccggaggcucccug

SEQ ID NO: 322976 - RNA, 64 nt, hsa
cuguucuuuuauuucuuuuucucuuugauugaaaggggacuacgucuuagcaggaaaaaaaacu

SEQ ID NO: 322977 - RNA, 64 nt, hsa
gacccuccugccucagccuccugaguacccuccuggggacuacaggugcgugcuaccauaccca

SEQ ID NO: 322978 - RNA, 64 nt, hsa
ugucccccaccugugguucuggccucugagguugggggacuacuuguuucccaccccagguucc

SEQ ID NO: 322979 - RNA, 64 nt, hsa
cugcugcccauucuccauuucugugugugucaaaggggacuaacagcagaaucuaccucccaac

SEQ ID NO: 322980 - RNA, 64 nt, hsa
cucccuugacucuggggguccacauccacuccaaggggacuauucccccgaccccaccccaguc

SEQ ID NO: 322981 - RNA, 64 nt, hsa
gagacuggccccgucugaaccuucucugggcacuggggacuaagguugcaggccuuagccucgu

SEQ ID NO: 322982 - RNA, 64 nt, hsa
caaaguggauaaacuaguacgagauauuuauggaggggacuaugagagguuuggacugccaggc

SEQ ID NO: 322983 - RNA, 64 nt, hsa
aggcaugugccuucugccaccugacuuuccgugaggggacuaaaauuuacuaauuguaguugcu

SEQ ID NO: 322984 - RNA, 64 nt, hsa
ucaauuuucauagaccuaauuugcaaacucaaucggggacuaaaauuucccacugaaaauguua

SEQ ID NO: 322985 - RNA, 64 nt, hsa
cugccacuggcggcuucccuucuuggcucuugggggggacuagauccuguggagaagaugacuu

SEQ ID NO: 322986 - RNA, 64 nt, hsa
ggggcugcuuacuucugggguauuggaaauguuuggggacuagguagaggugaauguacuaaau

SEQ ID NO: 322987 - RNA, 64 nt, hsa
ugaaacaaacagucacaagcaaaggaagaggcugggggacuagaaagaggcccugcccucuaga

SEQ ID NO: 322988 - RNA, 64 nt, hsa
ggagggaggcaggcugcagcuucagccacagaauggggacuauggaagacagcaggagcucauu

SEQ ID NO: 322989 - RNA, 64 nt, hsa
cucucccaugugggaacccagccuccgaugccccggggacuaggggaaacaguuggagguucgu

SEQ ID NO: 322990 - RNA, 64 nt, hsa
agagacacaugucuuacuuucagaauuuccacggggggacuaggagggcagcauugcuggggag

SEQ ID NO: 322991 - RNA, 64 nt, hsa
cucccaucuguuuauucuuugggcucugggaacaggggacuacuuuggggcuuucuccagacuu

SEQ ID NO: 322992 - RNA, 64 nt, hsa
aauggaccccuggguuccuugagagccuuucaggggggacuaugagaucaaaauauuuuuauua

SEQ ID NO: 322993 - RNA, 64 nt, hsa
cccccgcccgccauccccaguugcagggggaucuggggacuaccagagacucugggaaauggac

SEQ ID NO: 322994 - RNA, 64 nt, hsa
uuaccuaagagccacaauaagccacugguaucugggggacuagaacacaaauccaacgcuuuuc

SEQ ID NO: 322995 - RNA, 64 nt, hsa; identical to SEQ ID NO: 104950

SEQ ID NO: 322996 - RNA, 64 nt, hsa; identical to SEQ ID NO: 104951

SEQ ID NO: 322997 - RNA, 64 nt, hsa
ugcacuuacauuuaaaaaaacaacaacaacauuuuuucaacaauuucaacaaugacacaaaaau

SEQ ID NO: 322998 - RNA, 64 nt, hsa
auuuaaaaaaacaacaacaacauuuuuucaacaauuucaacaaugacacaaaaauucacaugga

SEQ ID NO: 322999 - RNA, 64 nt, hsa
uucauaauaauaaaacaacucauguuagagacccuuucaacaugaaagguuuguaguugagaca

SEQ ID NO: 323000 - RNA, 64 nt, hsa
guuggaagaaggauccuaaggaugugacacugguuuucaacaacaugcuuagagaacucaugaa

SEQ ID NO: 323001 - RNA, 64 nt, hsa
cuaucaaauuaucuucacccucauccuuuacauuuuucaacauuuuuuuuucuccauaaaugac

SEQ ID NO: 323002 - RNA, 64 nt, hsa
aaaucuccauuaaaguuauaacuaguaauuauguuuucaacacuuuuugguuuuuuucauuuug

SEQ ID NO: 323003 - RNA, 64 nt, hsa
uggucauauuuaaacagaaguauacguuuuucaguuucaacaugaauuuuuuuauuucugucag

SEQ ID NO: 323004 - RNA, 64 nt, hsa
uaaaguauuuggguuuuguucuuguauugcuuucuuucaacaguuucaaaauaaaauaucauau

SEQ ID NO: 323005 - RNA, 64 nt, hsa
auuuuuuucaucaccuuacauguguuaacagcuguuucaacauaaacuccauuauaaucuauau

SEQ ID NO: 323006 - RNA, 64 nt, hsa
gccuguguugagcaagacuaucagugccauuuuuuuucaacagcaugugcucauuucauuuuuc

SEQ ID NO: 323007 - RNA, 64 nt, hsa
agcaucauauacgacugaaagaagaaaacuagauuuucaacauuacaggguugaaaugaaugau

SEQ ID NO: 323008 - RNA, 64 nt, hsa
cugcagaugauggagaacuaccuaggcuucaucuuuucaacauaugucuacacaaccagaaaaa

SEQ ID NO: 323009 - RNA, 64 nt, hsa
cuucaggggucucagcugccuuagacuaaaggacuuucaacacacuggucucuuuuaauuuagu

SEQ ID NO: 323010 - RNA, 64 nt, hsa
aaaaagcaagccacaauaccaugauuccuuccauuuucaacaguagaugaaggaaaugauacug

SEQ ID NO: 323011 - RNA, 64 nt, hsa
acccacagcgucauuuugaaucaucaugugacgcuuucaacaacguucuuaguuuacuuauacc

SEQ ID NO: 323012 - RNA, 64 nt, hsa
aaaaacaaaaccacacaaggagaacccaauuuuguuucaacaauuuuugaucaauguauaugaa

SEQ ID NO: 323013 - RNA, 64 nt, hsa
ugaacuucauuuugucuuuguguaagggaagaaauuucaacagacucggguuugagauauccuc

SEQ ID NO: 323014 - RNA, 61 nt, hsa
uuauucgucaaagaauuuagaccacaauguauuucaacaaagaucaucaaugcuaacaccu

SEQ ID NO: 323015 - RNA, 64 nt, hsa
aggaauuaaauacuauugaguauagaacuguugauuucaacauacacuauagcacuuugacuaa

SEQ ID NO: 323016 - RNA, 64 nt, hsa
ccaagaacaguugagcucucucagggccuuccccuuucaacaauuuaguugaaugacucccuuc

SEQ ID NO: 323017 - RNA, 64 nt, hsa
auaaaaguuuauuuaauccaacauuugccaaauauuucaacauauaaaaauauauuagugagac

SEQ ID NO: 323018 - RNA, 64 nt, hsa
uucgucuuuucugagaaacauaaauuuacauauuuuucaacagaaggcuaucaaaauuuuaauu

SEQ ID NO: 323019 - RNA, 64 nt, hsa
cugagugucuaaaacuugacaccccugguaaaucuuucaacacacuuccacugccugcguaaug

SEQ ID NO: 323020 - RNA, 64 nt, hsa
uucucaauaaaagaaaaucaugaaugcuccacaauuucaacauaccacaagagaaguuaauuuc

SEQ ID NO: 323021 - RNA, 64 nt, hsa
uugucgcuugagaaaaaaaggcaacagcugauucuuucaacaacugucacagaauggcugggcu

SEQ ID NO: 323022 - RNA, 64 nt, hsa
uguuccuccggguguucgacaccagacguggggauuucaacaggggaggagccaaggaauucug

SEQ ID NO: 323023 - RNA, 64 nt, hsa
aaaggcaaacucaugaaaugccacugaaaagaacuuucaacacagcauacuucauguaaaagaa

SEQ ID NO: 323024 - RNA, 64 nt, hsa
ucaaacacaguuaucuuaguuuaccgguggaguauuucaacaccaaccacauuucccuuccucc

SEQ ID NO: 323025 - RNA, 64 nt, hsa
uuuuuaagcaaagaaauauuuuaaauaaauccuauuucaacacugaaauuguugaaaaccgucu

SEQ ID NO: 323026 - RNA, 64 nt, hsa
cuuaucgcuagcggauucacaccugagacagacauuucaacaaugauacaguccugucauuuau

SEQ ID NO: 323027 - RNA, 64 nt, hsa
auccaccugucucuauagguaucauuuucaauacuuucaacauuuggugguuuucuauugggua

SEQ ID NO: 323028 - RNA, 64 nt, hsa
auaaauaccguuuuuccaaagguauuuuacaauauuucaacagcagaccuucugcucuucgagu

SEQ ID NO: 323029 - RNA, 64 nt, hsa
cauauggagaaagucccuuugucuuaugcccaaauuucaacaggaauaauuggcuuguauaauc

SEQ ID NO: 323030 - RNA, 64 nt, hsa
gguuguuaagucuccuuuguauguaagguaguuuuuucaacaucuaaaauuuuuguuuuagccu

SEQ ID NO: 323031 - RNA, 64 nt, hsa
aacuauuaacagagugcauuucuugcuugcuggguuucaacagacaucagccaaaagaacaaaa

SEQ ID NO: 323032 - RNA, 64 nt, hsa
aacuacugcaauuagaaaauaaaauaugaacaacuuucaacaauguauacaauugauucuuuuc

SEQ ID NO: 323033 - RNA, 64 nt, hsa
cuuguaaaaaauaaaauacuuguugaaaagccuuuuucaacauaucccuaagcuaagggaagag

SEQ ID NO: 323034 - RNA, 64 nt, hsa
auaaaggaacuugaaauguggggagugauaauaguccagugauuaaacuacaguccagugauua

SEQ ID NO: 323035 - RNA, 64 nt, hsa
ggggagugauaauaguccagugauuaaacuacaguccagugauuaccaccaacuuucugacuaa

SEQ ID NO: 323036 - RNA, 64 nt, hsa
aucagggauucuggaacuaagucugauaaaagauuccagugaagcccuguucugagaacgagca

SEQ ID NO: 323037 - RNA, 64 nt, hsa
uucaggugcuuugccaaacucuuaaaagaaaguguccagugaacuuggaagugggccccugagc

SEQ ID NO: 323038 - RNA, 64 nt, hsa
acuccaugaguagacuccaagugcugcgguugauuccagugagggagaaagugaucugcaggga

SEQ ID NO: 323039 - RNA, 64 nt, hsa
ucacgauuuuucugccacuucaccuuagggagcuuccagugauugauuuuaggaggcccacacc

SEQ ID NO: 323040 - RNA, 64 nt, hsa
ugcagccucagagcccucccagguugcugcuguuuccagugaaucacauuucgucauuugaagc

SEQ ID NO: 323041 - RNA, 64 nt, hsa
caugaguuuucucugcucugacauuccuuauacauccagugaacaaagcuggaauagaaaaccu

SEQ ID NO: 323042 - RNA, 64 nt, hsa
agauugccuucugggaaaucccgcgauacuaaaauccagugagcuuugggagaucauucccuaa

SEQ ID NO: 323043 - RNA, 64 nt, hsa
uuuaaagaaaugcacuugccuaugauacugucucuccagugaaaugauuacuccuccauuacuc

SEQ ID NO: 323044 - RNA, 64 nt, hsa
ggguagguggggcuuucccuaauuuaucuucauguccagugagcaguguugcguuuuuccuugu

SEQ ID NO: 323045 - RNA, 64 nt, hsa
cagcucaggcucucugccuuccagaggccgcuucuccagugacuaaccuccuccucuggcuccu

SEQ ID NO: 323046 - RNA, 64 nt, hsa
uaauaacuggagccucuaaauuuauuauccauuauccagugauggaaaguuguauuucucaauc

SEQ ID NO: 323047 - RNA, 64 nt, hsa
agaaacgauuguuagaaauugacgauguguuuguuccagugauacugaaaguagugggggcaag

SEQ ID NO: 323048 - RNA, 64 nt, hsa
uaguagccuugcuuucuauagagcaugcaccaaauccagugaguccauguggagagagcacugu

SEQ ID NO: 323049 - RNA, 64 nt, hsa
cucagucauaaaggaaugaccaagagagugggucuccagugagagaaaugccuaugaaagaggg

SEQ ID NO: 323050 - RNA, 64 nt, hsa
guguuccucaguagaagacaagcagguggaggcauccagugauuucuacccuguggaggcugag

SEQ ID NO: 323051 - RNA, 64 nt, hsa
ugcccagcucucugacgcuugugacagugccucuuccagugaacauucccagcccagccccgcc

SEQ ID NO: 323052 - RNA, 64 nt, hsa
ggaacuagcuucaggcacagccugauucuggugauccagugaucuauggaagucgugucuuacu

SEQ ID NO: 323053 - RNA, 64 nt, hsa
cugauauuuagaaaggugcuuuuguucuccagacuccagugauucugcacugggcauuauggaa

SEQ ID NO: 323054 - RNA, 64 nt, hsa
cuucuuaguagccacuucacaaagcaaaaugaaauccagugaagaaaugaucaaaagugagcug

SEQ ID NO: 323055 - RNA, 64 nt, hsa
gccaggccacauucacauuccccucccccugugguccagugaagccuccggaccccaggcucug

SEQ ID NO: 323056 - RNA, 64 nt, hsa
cacagccgcgcugccgagggccaagcacaaagguuccagugagcgcaugucccagccccuggug

SEQ ID NO: 323057 - RNA, 64 nt, hsa
cuggccucagcaaggggccuuccugaccucuggcuccagugaagcugaauguccucacuuugug

SEQ ID NO: 323058 - RNA, 64 nt, hsa
accucucguuccagcaggaccaagggagccagccuccagugagugacuccagcaagugcagcca

SEQ ID NO: 323059 - RNA, 64 nt, hsa
ccuguaccaggucauucuuaagauuucuccugacuccagugagcuggaauucuaaaugcugguc

SEQ ID NO: 323060 - RNA, 64 nt, hsa
uccuaucuucuccauucuagaugcuucccuuguauccagugaugugcuggagcuggcuuugcca

SEQ ID NO: 323061 - RNA, 64 nt, hsa; identical to SEQ ID NO: 165778

SEQ ID NO: 323062 - RNA, 64 nt, hsa; identical to SEQ ID NO: 165779

SEQ ID NO: 323063 - RNA, 64 nt, hsa; identical to SEQ ID NO: 165780

SEQ ID NO: 323064 - RNA, 64 nt, hsa; identical to SEQ ID NO: 165781

SEQ ID NO: 323065 - RNA, 64 nt, hsa; identical to SEQ ID NO: 165782

SEQ ID NO: 323066 - RNA, 64 nt, hsa; identical to SEQ ID NO: 165783

SEQ ID NO: 323067 - RNA, 64 nt, hsa; identical to SEQ ID NO: 165784

SEQ ID NO: 323068 - RNA, 64 nt, hsa; identical to SEQ ID NO: 165785

SEQ ID NO: 323069 - RNA, 64 nt, hsa; identical to SEQ ID NO: 165786

SEQ ID NO: 323070 - RNA, 64 nt, hsa; identical to SEQ ID NO: 165787

SEQ ID NO: 323071 - RNA, 64 nt, hsa; identical to SEQ ID NO: 165788

SEQ ID NO: 323072 - RNA, 64 nt, hsa; identical to SEQ ID NO: 165789

SEQ ID NO: 323073 - RNA, 64 nt, hsa; identical to SEQ ID NO: 165790

SEQ ID NO: 323074 - RNA, 64 nt, hsa; identical to SEQ ID NO: 165791

SEQ ID NO: 323075 - RNA, 64 nt, hsa; identical to SEQ ID NO: 165792

SEQ ID NO: 323076 - RNA, 64 nt, hsa; identical to SEQ ID NO: 165793

SEQ ID NO: 323077 - RNA, 64 nt, hsa; identical to SEQ ID NO: 165794

SEQ ID NO: 323078 - RNA, 64 nt, hsa; identical to SEQ ID NO: 165795

SEQ ID NO: 323079 - RNA, 64 nt, hsa; identical to SEQ ID NO: 165796

SEQ ID NO: 323080 - RNA, 64 nt, hsa; identical to SEQ ID NO: 165797

SEQ ID NO: 323081 - RNA, 64 nt, hsa; identical to SEQ ID NO: 165798

SEQ ID NO: 323082 - RNA, 64 nt, hsa; identical to SEQ ID NO: 165799

SEQ ID NO: 323083 - RNA, 64 nt, hsa; identical to SEQ ID NO: 165753

SEQ ID NO: 323084 - RNA, 64 nt, hsa; identical to SEQ ID NO: 165754

SEQ ID NO: 323085 - RNA, 64 nt, hsa; identical to SEQ ID NO: 165755

SEQ ID NO: 323086 - RNA, 64 nt, hsa; identical to SEQ ID NO: 165756

SEQ ID NO: 323087 - RNA, 64 nt, hsa; identical to SEQ ID NO: 165757

SEQ ID NO: 323088 - RNA, 64 nt, hsa; identical to SEQ ID NO: 165758

SEQ ID NO: 323089 - RNA, 64 nt, hsa; identical to SEQ ID NO: 165759

SEQ ID NO: 323090 - RNA, 64 nt, hsa; identical to SEQ ID NO: 165760

SEQ ID NO: 323091 - RNA, 64 nt, hsa; identical to SEQ ID NO: 165761

SEQ ID NO: 323092 - RNA, 64 nt, hsa; identical to SEQ ID NO: 165762

SEQ ID NO: 323093 - RNA, 64 nt, hsa; identical to SEQ ID NO: 165763

SEQ ID NO: 323094 - RNA, 64 nt, hsa; identical to SEQ ID NO: 165764

SEQ ID NO: 323095 - RNA, 64 nt, hsa; identical to SEQ ID NO: 165765

SEQ ID NO: 323096 - RNA, 64 nt, hsa; identical to SEQ ID NO: 165766

SEQ ID NO: 323097 - RNA, 64 nt, hsa; identical to SEQ ID NO: 165767

SEQ ID NO: 323098 - RNA, 64 nt, hsa; identical to SEQ ID NO: 165768

SEQ ID NO: 323099 - RNA, 64 nt, hsa; identical to SEQ ID NO: 165769

SEQ ID NO: 323100 - RNA, 64 nt, hsa; identical to SEQ ID NO: 165770

SEQ ID NO: 323101 - RNA, 64 nt, hsa; identical to SEQ ID NO: 165771

SEQ ID NO: 323102 - RNA, 64 nt, hsa; identical to SEQ ID NO: 165772

SEQ ID NO: 323103 - RNA, 64 nt, hsa; identical to SEQ ID NO: 165773

SEQ ID NO: 323104 - RNA, 64 nt, hsa; identical to SEQ ID NO: 165774

SEQ ID NO: 323105 - RNA, 64 nt, hsa; identical to SEQ ID NO: 165775

SEQ ID NO: 323106 - RNA, 64 nt, hsa; identical to SEQ ID NO: 165776

SEQ ID NO: 323107 - RNA, 64 nt, hsa; identical to SEQ ID NO: 165777

SEQ ID NO: 323108 - RNA, 64 nt, hsa
agaggaugacacaucaaauaauaacucggauuccagcccacauuggauucaucagcauuuggac

SEQ ID NO: 323109 - RNA, 64 nt, hsa
agcccacauuggauucaucagcauuuggaccaauagcccacagcugagaauguggaauaccuaa

SEQ ID NO: 323110 - RNA, 64 nt, hsa
cagcggggacggccuccugcugcagguccugggcagcccacaguagugcuagcugaggcccaga

SEQ ID NO: 323111 - RNA, 64 nt, hsa
ugccccuggaggccacgccaggcgcucaccccugagcccacagccccugcuugggcugccuggc

SEQ ID NO: 323112 - RNA, 64 nt, hsa
uccagaauacucucucugggguugugagucagucagcccacaagcauucacagagugcuuaccu

SEQ ID NO: 323113 - RNA, 64 nt, hsa
uuguuagucuccauuucauagaugaaaauagugaagcccacagaaaauaaguagcuccuccaca

SEQ ID NO: 323114 - RNA, 64 nt, hsa
agcuucuccaggcgucugcggagcccacaguugaagcccacaucguuuugcuguugaauggggu

SEQ ID NO: 323115 - RNA, 64 nt, hsa
aggugugggcuccagcuucuccaggcgucugcggagcccacaguugaagcccacaucguuuugc

SEQ ID NO: 323116 - RNA, 64 nt, hsa
uggccaucuagccccaguucagggcagcauccauagcccacaagccagcguggguggggcgggg

SEQ ID NO: 323117 - RNA, 64 nt, hsa
ucguugagggccauccauaugccagcugggggccagcccacaguggccauauuggcugcagcag

SEQ ID NO: 323118 - RNA, 64 nt, hsa
uuaugagcugaggucagccuggaucuggaauugcagcccacauaaacauaaaggaggauguccc

SEQ ID NO: 323119 - RNA, 64 nt, hsa
gugaagcacguuggccuaagugugccgugaucccagcccacacuagccugggugcaucugcuaa

SEQ ID NO: 323120 - RNA, 64 nt, hsa
ucccugagccagccuccgcucaguguggcuccucagcccacagaggggagggagcauggggcca

SEQ ID NO: 323121 - RNA, 64 nt, hsa
agggguaggccugagcgccagagucgcccagguuagcccacaggauuccuuugugugccaugga

SEQ ID NO: 323122 - RNA, 64 nt, hsa
ccagccagcauggccacccucaagaggcgagaugagcccacagaggcauauccugcggggaugc

SEQ ID NO: 323123 - RNA, 64 nt, hsa
ugaaugaaugaaugagccaaagaacaaauaaaugagcccacacacccugaacgcaugcgacaca

SEQ ID NO: 323124 - RNA, 64 nt, hsa
accauugcuccagacguguuccgaccccuuucccagcccacagggcuugaagugaaggaacaga

SEQ ID NO: 323125 - RNA, 64 nt, hsa
aggaaggaggugacagcacuugcauggucacuugagcccacacacacgcucaaccccaaguccu

SEQ ID NO: 323126 - RNA, 64 nt, hsa
ugccccuguacaguccugccccccagcacccuccagcccacaaacagggcccuaagcacuucau

SEQ ID NO: 323127 - RNA, 64 nt, hsa
caguuugcuccacauggccgccacccccugcaccagcccacauccccacugccccuguacaguc

SEQ ID NO: 323128 - RNA, 64 nt, hsa
aaaauuaucccaaagguagguuggugugauaguuuccgaguaagaccuuaaggacacagccaaa

SEQ ID NO: 323129 - RNA, 64 nt, hsa
uuaaaauaagucacuguugacagggucaugaguuuccgaguauaguuuucuuuuuaucuuauuu

SEQ ID NO: 323130 - RNA, 64 nt, hsa
aucccuggaaauauuuauuaaacuuuauaguuuauccgaguauguuggaugcuuugacaauaaa

SEQ ID NO: 323131 - RNA, 64 nt, hsa
uccuacuauauuuucuaaggagugaauaauauuguccgaguaacuaacuuauuuaaaagacauu

SEQ ID NO: 323132 - RNA, 64 nt, hsa
guuauuuuuaaacacuuuuuuucauaauacauauuccgaguagauauuuauaaaauauauguuu

SEQ ID NO: 323133 - RNA, 64 nt, hsa
uccuguuuaggaucugauagucuaugccuuugucuccgaguacugcagaacugacauuuugacg

SEQ ID NO: 323134 - RNA, 64 nt, hsa
gaugggcgccaugugccuucugcacgccucgcuguccgaguaugugcugcucuucggcaccgcc

SEQ ID NO: 323135 - RNA, 64 nt, hsa
ucuuaacuuuugcuucacuucacagucaggccucuccgaguauuuuuuacacauauccuggagu

SEQ ID NO: 323136 - RNA, 64 nt, hsa
ugucagcucuuuccuuuggcagcguguuuccuuuuccgaguaugugcuguuaaacuagauuggc

SEQ ID NO: 323137 - RNA, 64 nt, hsa
cucccaggcuuaggugauccuucugucucagccuuccgaguagcugggaccacaggcaugcaca

SEQ ID NO: 323138 - RNA, 64 nt, hsa
ccuccuggguucaagcaagucuccugccucagccuccgaguagcugggacuacaggugcacgcc

SEQ ID NO: 323139 - RNA, 64 nt, hsa
ucaggcucaggugauccucccaucucagccugccuccgaguagcugggacuacaggugugaguc

SEQ ID NO: 323140 - RNA, 64 nt, hsa
ggguguuguguagaacucuuuuuaaacucuaugcuccgaguagaguucaucuuuauauuaaacu

SEQ ID NO: 323141 - RNA, 64 nt, hsa
gauaaucaagaaacuuaguuuuauuucaaauuguuccgaguaacuauguuuuucuauuggagac

SEQ ID NO: 323142 - RNA, 64 nt, hsa
uagugugccuuggaaaaggccgcaaguugcuuacuccgaguagcugugcuagcucugucagacu

SEQ ID NO: 323143 - RNA, 64 nt, hsa
uguauguuuuucuauuucugaauuacgaaugaaauccgaguaccuauuagaaaugaguuaugca

SEQ ID NO: 323144 - RNA, 64 nt, hsa
uccaaaguuuuucuuagaaccaaccaaaaaacaauccgaguaggcccaagaauuugauaaugcu

SEQ ID NO: 323145 - RNA, 64 nt, hsa
gcugaguauaguacuagcugccuccccaccagguuccgaguagugucugagacucugcucugca

SEQ ID NO: 323146 - RNA, 64 nt, hsa
ccucugcgggacuuuaaaaaucuauucagauauuuccgaguaaguggcuuguuuaaauucuucc

SEQ ID NO: 323147 - RNA, 64 nt, hsa
uggggcagggaggcccaggagaugagagagaagguccgaguaggugauagaagacaagggggag

SEQ ID NO: 323148 - RNA, 64 nt, hsa
caucccugagcucauccacggcucaugcuguggcuccgaguagugguuugagugggcaggaagg

SEQ ID NO: 323149 - RNA, 64 nt, hsa
caccuagguucaagcgauucuugugccccaaacuuccgaguagcugggacuacaggcaugaguc

SEQ ID NO: 323150 - RNA, 64 nt, hsa
gauagcgccacccacgccccuccacaccccagacuccgaguaaagcgggcgguagggccggagu

SEQ ID NO: 323151 - RNA, 64 nt, hsa
cucccggguuccagcgauucuccugccucagccuuccgaguagcugggauuacaggcuccugcc

SEQ ID NO: 323152 - RNA, 64 nt, hsa
accaucgacuuggccagugagacugagaauggauuccgaguagugaugggccguuugcaccucg

SEQ ID NO: 323153 - RNA, 64 nt, hsa
cucccaggcucaagcacuuuuccugucucagccuuccgaguagcugggauuacaggugugugcc

SEQ ID NO: 323154 - RNA, 64 nt, hsa
cucccagguucaagcgauucucaugccucagcccuccgaguagcugggaccacagguguacgac

SEQ ID NO: 323155 - RNA, 64 nt, hsa
uggcuggucaacuauaugaaaccuuguucauuccuccgaguacuguaauguucacacuuguaca

SEQ ID NO: 323156 - RNA, 64 nt, hsa
cugggcaccacaguguuuccaagagcaagcuggauccgaguagauucccuagggcuuguuggag

SEQ ID NO: 323157 - RNA, 64 nt, hsa
uguaguggcgcgaucucggcucagccucccgaguagcugggauuacaggcaugugccaccacgc

SEQ ID NO: 323158 - RNA, 64 nt, hsa
guucaagugguucuccuuccucagccucccaaguagcugggauuacaggcaccuaccaccaggg

SEQ ID NO: 323159 - RNA, 64 nt, hsa
gcaugguguuccuccaaagaauaggguaaaggagagcugggagggagcccucuccguuggguga

SEQ ID NO: 323160 - RNA, 64 nt, hsa
accccuuggaacugugccgaguuccuuaaaucucagcugggauccuggaccugggaggccccug

SEQ ID NO: 323161 - RNA, 64 nt, hsa
cagcccuacccaccagcccccaggugaggcuuccagcugggaccugcccagacaggcugagccu

SEQ ID NO: 323162 - RNA, 64 nt, hsa
gcccuucucacuccagaggcuaguggucacagacagcugggaauggcagccacagagggucccc

SEQ ID NO: 323163 - RNA, 64 nt, hsa
guucaagcgauucuugugccucggccucccuaguagcugggauuacaggcgcacaccaccacac

SEQ ID NO: 323164 - RNA, 64 nt, hsa
cggguucaagccauucugccucagccucccaaguagcugggaguacaggcgucugccaccaugc

SEQ ID NO: 323165 - RNA, 64 nt, hsa
gcucaggugauccuuccgccucacccuccugaguagcugggacuacaggugugcaccaccacac

SEQ ID NO: 323166 - RNA, 64 nt, hsa
guucaagcgauucuccugccucagccucccaaguagcugggauuacaggcauacaccaccacgc

SEQ ID NO: 323167 - RNA, 64 nt, hsa
cccuacucgcucagagugggacaguagugaacagagcugggauuccaugcgacagcuugaaugc

SEQ ID NO: 323168 - RNA, 64 nt, hsa
guucaagcgauucuccugccucagccuccugaguagcugggauuacaggcacacaccaccacgc

SEQ ID NO: 323169 - RNA, 64 nt, hsa
uagugggucgggggauucuucaggaaugguuuggagcugggaguggguagggggauuuuaaaug

SEQ ID NO: 323170 - RNA, 64 nt, hsa
uccuuagaacugcccagaaacucugagucccagcagcugggagccagaacuuugccugcccucc

SEQ ID NO: 323171 - RNA, 64 nt, hsa
guucaagcgauucuccugccucagccuccugaguagcugggauuacaggugugcaccaacacac

SEQ ID NO: 323172 - RNA, 64 nt, hsa
gcucaggugauccuuccaccucagcuuccuaaguagcugggaccacaggcaugcgccaccaucc

SEQ ID NO: 323173 - RNA, 64 nt, hsa
cucaagugguccuccugcuucagccucccaaagcagcugggacuacaggcaugcaccaccauac

SEQ ID NO: 323174 - RNA, 64 nt, hsa
guucaagcaauucuccugccucagccucucgaguagcugggauuauaggcguccgccaccaugc

SEQ ID NO: 323175 - RNA, 64 nt, hsa
gugcaagcaauuauccugccucagccucccgaguagcugggacugcaggcacacacugccacgc

SEQ ID NO: 323176 - RNA, 64 nt, hsa
guucaagugauucucaugccucagccuccugaguagcugggauuacaggcuccugccaccacgc

SEQ ID NO: 323177 - RNA, 64 nt, hsa
ggcugcccuuucugggcaccggggccucggacuuagcugggagaaagagagagcuucuguugcu

SEQ ID NO: 323178 - RNA, 64 nt, hsa
cagucuucucucaccauggagacaacaccaguagagcugggagcuggggccugccacugaguaa

SEQ ID NO: 323179 - RNA, 64 nt, hsa
guucaagcgauucuccugcuucaaccuccugaguagcugggauuacaggugcgugccaccacac

SEQ ID NO: 323180 - RNA, 64 nt, hsa
guucaagcuauucucaugccucagccucucaaguagcugggacuacagaugugggccaccaugu

SEQ ID NO: 323181 - RNA, 64 nt, hsa
guugacaccauucuccugccucacccucccaaguagcugggacuacaggcgccugccagcacgc

SEQ ID NO: 323182 - RNA, 64 nt, hsa
guucaagcaauucuccuuccucagccucccaaguagcugggauuacaggcaugcaccaccaugc

SEQ ID NO: 323183 - RNA, 64 nt, hsa
gcucaagcgauucuccugccucagccucucgaguagcugggauuacaggcaugcgucaccacuc

SEQ ID NO: 323184 - RNA, 64 nt, hsa
uguguaccccaccucugaagaugcugggggaggcagcugggaugggagccagccccaugccugu

SEQ ID NO: 323185 - RNA, 64 nt, hsa
ccgggugccacuuaaugccaacagcccuuaccaaagcugggagccccauugccccggcagcucu

SEQ ID NO: 323186 - RNA, 64 nt, hsa
guucucaccauucuccugccucagccucccgaguagcugggacuacaggcgcccaccaccacgc

SEQ ID NO: 323187 - RNA, 64 nt, hsa
guucaagugauucuccagccucagccucccgaguagcugggauuaugggcgcccaccaccaugc

SEQ ID NO: 323188 - RNA, 64 nt, hsa
gugaaacuugguggggucagggaggaaaggcagaagcugggagccucccuucccuuugaaaauc

SEQ ID NO: 323189 - RNA, 64 nt, hsa
aagaaggagggacaggcaggcagcaggaggggcgagcugggaggcaggaggcagcggccuguca

SEQ ID NO: 323190 - RNA, 64 nt, hsa
guucaagcgauucuccugccccagccucccauauagcugggauuauaggugccugccaccaugc

SEQ ID NO: 323191 - RNA, 64 nt, hsa
cuucaagcgauucuccuguaucagccucccaaguagcugggauuauaggcaugugccaccaugc

SEQ ID NO: 323192 - RNA, 64 nt, hsa
uucacgccauucuccugccucagcccccccgaguagcugggacuacaggcgcccgccaccacgc

SEQ ID NO: 323193 - RNA, 64 nt, hsa
agugcugggauuacaggugucagccacugcgcucagcugggagaugaauuuucauuuaaugacu

SEQ ID NO: 323194 - RNA, 64 nt, hsa
guucaagugauucucuugccuuagccucccgagcagcugggauuauaggcguccaccaccacgc

SEQ ID NO: 323195 - RNA, 64 nt, hsa
ggcucuauuuuaauuuuuuucuuuuaaaauaaacagcugggaccaucccaaaagacaagccaug

SEQ ID NO: 323196 - RNA, 64 nt, hsa
aacauuucuuagcaugagcuaccucaucucuagaagcugggauggacuuacuauucuuguuuau

SEQ ID NO: 323197 - RNA, 64 nt, hsa
guucaagcgauucuccuccuucagacucucgaauagcugggauuacaggcacgccucaccacgc

SEQ ID NO: 323198 - RNA, 64 nt, hsa
auuaauuagcuuacaaaaugucuaagaggagcuaagcugggaugccacauaggcagaagccagg

SEQ ID NO: 323199 - RNA, 64 nt, hsa
gcaguaugguccaauaggcagcauccucugcugcagcugggagagcugaguuccagggcugugu

SEQ ID NO: 323200 - RNA, 64 nt, hsa
aguaagcugaugguacaugcauuuucuagaauagagcugggacuucccauguggcccacaucug

SEQ ID NO: 323201 - RNA, 64 nt, hsa
guucaagugauucuccugugucagccuccugaguagcugggauuacaggcgugugccaccaugc

SEQ ID NO: 323202 - RNA, 64 nt, hsa
ggucaaaugauucuccugcuuuagccucccaaguagcugggacuacagguguacgccaccacac

SEQ ID NO: 323203 - RNA, 64 nt, hsa
guucaugccauucuccuaccucagccucccgaguagcugggacuacaggcgcccaccaccaugc

SEQ ID NO: 323204 - RNA, 64 nt, hsa
guucaagcgauucuccugccucagccuccugaguagcugggauuacaggugugugccuccacac

SEQ ID NO: 323205 - RNA, 64 nt, hsa
guucaaguaauucuccugccucaggcuucugaguagcugggauuauaggugcgcaccaccacac

SEQ ID NO: 323206 - RNA, 64 nt, hsa
guuuaagcaauucuccugccucagccuccccaguagcugggauuacaggcaccuaccaccuugc

SEQ ID NO: 323207 - RNA, 64 nt, hsa
auucaagugauucuugugccuuagccucccaaguagcugggauuacaggcgugcaccaccacgc

SEQ ID NO: 323208 - RNA, 64 nt, hsa
guucaagcgauucuuuugccucagccaccugacuagcugggauugcagccugcaccaccacacc

SEQ ID NO: 323209 - RNA, 64 nt, hsa
acuggcucagagcccaugggggcuggaggggggcagcugggacucuggaaucuucuuuauaaua

SEQ ID NO: 323210 - RNA, 64 nt, hsa
agggaggguggaggggagggauggggggcacaggagcugggagccccgucuccaggaaaaggag

SEQ ID NO: 323211 - RNA, 64 nt, hsa
guucaagcgauuuuccugccucagccucccgaguagcugggauuccaggcgcccgccaccacgc

SEQ ID NO: 323212 - RNA, 64 nt, hsa
guucaaucgauucuccugccucacccucccauguagcugggauuacagcugccugccaaauuuu

SEQ ID NO: 323213 - RNA, 64 nt, hsa
guucaagugauucuugugccucagccuccugaguagcugggauuauaggcaugcaccaccaugc

SEQ ID NO: 323214 - RNA, 64 nt, hsa
guucaagcgauucuugugcuucagccuccugaguagcugggacuauaggccuguaccgucaugc

SEQ ID NO: 323215 - RNA, 64 nt, hsa
guucaagcaauucuucugccucagccucccaaguagcugggauuacaggugccugccaccaugc

SEQ ID NO: 323216 - RNA, 64 nt, hsa
guucaagugauucuccugccucagccuccugaguagcugggacuacaggcgccugccaccacgc

SEQ ID NO: 323217 - RNA, 64 nt, hsa
gcucagauuguccuuccaccuuagccucuggagcagcugggacuacaggugugcacuaccacac

SEQ ID NO: 323218 - RNA, 64 nt, hsa
guucaagcaauucuccugccucagccucccaaguagcugggauuacaggugucugccaccaugc

SEQ ID NO: 323219 - RNA, 64 nt, hsa
guucaagcaauucuccugccucagccuccugaguagcugggauuauaggcacaugccaccgcgc

SEQ ID NO: 323220 - RNA, 64 nt, hsa
guucacgccauucuccugccucagccucccgaguagcugggacuacaggcgccugccaccaugc

SEQ ID NO: 323221 - RNA, 64 nt, hsa
auuaggguggucuacuugaggcagaugggauaguagcugggaacuguucccuuucugauuaauu

SEQ ID NO: 323222 - RNA, 64 nt, hsa
guucaagugauucuccugucucagccucccaaguagcugggacuacaggcaugagccaucacac

SEQ ID NO: 323223 - RNA, 64 nt, hsa
cguggccaccacagccagacugaacguuugugaaagcugggacaucccaccacacgcugagcca

SEQ ID NO: 323224 - RNA, 64 nt, hsa
ccucacauggugcuaggcugggagcugcccugagagcugggaugcccaccaaggcccacagaac

SEQ ID NO: 323225 - RNA, 64 nt, hsa
gggagguggccugcuuggccgacgucauggagccagcugggagcagggcugagcguugaacccg

SEQ ID NO: 323226 - RNA, 64 nt, hsa
guucacgccauucuccugccucagcuucccgaguagcugggacuacaggggcccgccaccacgc

SEQ ID NO: 323227 - RNA, 64 nt, hsa
guucaagcaauucuguggcuucagccuccggaguagcugggauuacaggcacaugccaccacac

SEQ ID NO: 323228 - RNA, 64 nt, hsa
guugacgccauucuccugccucagccucccgaguagcugggacuacaggagcucgccaccacac

SEQ ID NO: 323229 - RNA, 64 nt, hsa
guucacgccauucuccugccucagccucccguguagcugggacuacaggcacgcgccaccaugc

SEQ ID NO: 323230 - RNA, 64 nt, hsa
uucaguggacugucugugucccccugccgaacaaagcugggaguaaaggcaaaaccuugacacg

SEQ ID NO: 323231 - RNA, 64 nt, hsa
ugggaguaaaggcaaaaccuugacacguguugguagcugggaccucaucuuccugagggcucug

SEQ ID NO: 323232 - RNA, 64 nt, hsa
ugcccuccugccccgugcuggaucuucccuccccagcugggaucugcucccaggcaacugugug

SEQ ID NO: 323233 - RNA, 64 nt, hsa
guucaagcgauucuccugacucagccucucaaguagcugggauuacaagcaugcgccaccaugc

SEQ ID NO: 323234 - RNA, 64 nt, hsa
uugcaagugauucuccugccucagccuccugaguagcugggauuacaggcacccgccaccacgc

SEQ ID NO: 323235 - RNA, 64 nt, hsa
gcucaagcgauucucucacuucagcuucccaaguagcugggacuacagguguucgccaccaugc

SEQ ID NO: 323236 - RNA, 64 nt, hsa
gcucaaggcauccucccaccucagcuuccugacuagcugggacuacuggugugcaccaccacac

SEQ ID NO: 323237 - RNA, 64 nt, hsa
ugccuagagagcuggcccagccaacacagcucuuagcugggagcuccuucugccauuccaacua

SEQ ID NO: 323238 - RNA, 64 nt, hsa
guucaagcgauucucgugccucagccuccggaguagcugggauugcaggcacccgccaccacgc

SEQ ID NO: 323239 - RNA, 64 nt, hsa
gcucaagcgauucucccaccucagccauccaaauagcugggaccacaggugugcaccaccacgc

SEQ ID NO: 323240 - RNA, 64 nt, hsa
gcuugagugauccucccgccccagccuccugaguagcugggacuagaggcacgcaccaccgcgc

SEQ ID NO: 323241 - RNA, 64 nt, hsa
ccgagcacgguugccugagguccgauggcccgagagcugggacucaguucuuggccugcuagcg

SEQ ID NO: 323242 - RNA, 64 nt, hsa
guucaagcgauucuccugccucagccucccuaguagcugggacuacagcacccaccaccacacc

SEQ ID NO: 323243 - RNA, 64 nt, hsa
guucaagugauucuccugccuuagccuccugaaaagcugggauuacagggcccugccaccaagc

SEQ ID NO: 323244 - RNA, 64 nt, hsa
uccacugagcuccuauccagaugggguaggagacagcugggaggcuccgcacgccagaggccuu

SEQ ID NO: 323245 - RNA, 64 nt, hsa
guuugagugauucucaugccucagccucccgaguagcugggauuacaggcaugagccacugugc

SEQ ID NO: 323246 - RNA, 64 nt, hsa
guagcugggauuacaggcaugagccacugugcccagcugggauauagaaucuaagaguugauug

SEQ ID NO: 323247 - RNA, 64 nt, hsa
ccccagggagacagggaugccaagaguagaccagagcugggacccacagacagaaccuccaccu

SEQ ID NO: 323248 - RNA, 64 nt, hsa
acagacagaaccuccaccugccugcugcccacugagcugggaccuggucaccuuggauuuuagc

SEQ ID NO: 323249 - RNA, 64 nt, hsa
uauggauggagcaaggucaaauaugagcugauggagcugggagcuaaauaaggguauaauaugc

SEQ ID NO: 323250 - RNA, 64 nt, hsa
guucaagcaauucuucugacucagccucccgaguagcugggaguacaggugcacaccaccaugc

SEQ ID NO: 323251 - RNA, 64 nt, hsa
gcuugagcgauucuugugucucagucuuccggguagcugggacuacaggugugcaccacuaugc

SEQ ID NO: 323252 - RNA, 64 nt, hsa
ccucaaguuccacacgaagaugcuuggaugagucagcugggaauauuguucuuguguaccucau

SEQ ID NO: 323253 - RNA, 64 nt, hsa
gcucaccccauucuccugccucagccuccugaguagcugggacuacaggcgcccgccaucacgc

SEQ ID NO: 323254 - RNA, 64 nt, hsa
cugaauuggagggcagugccagggcauuugcagaagcugggaaggaccaagccucagcacccca

SEQ ID NO: 323255 - RNA, 64 nt, hsa
ggccaagcgauccuccugccucagccuucugaguagcugggaccacaggcgugcaccaccaugc

SEQ ID NO: 323256 - RNA, 64 nt, hsa
ugcacuuaggucacuguaagguucuagggcugggagcugggauuugaaccaggaucugucagcg

SEQ ID NO: 323257 - RNA, 64 nt, hsa
acuuacaccacuguccugccucagccuccggaguagcugggacuacagacaccugccaccacgc

SEQ ID NO: 323258 - RNA, 64 nt, hsa
guucaagcgauucuccugccucagccucccaaguagcugggauuacuggcgcccgccaccaugc

SEQ ID NO: 323259 - RNA, 64 nt, hsa
gcucaacugaucuucccaccucagccuccugaauagcugggacuaccagcacgcuccaccaugc

SEQ ID NO: 323260 - RNA, 64 nt, hsa
agauaggcagccuuacccagaacacaacauuagcagcugggaaggugucugagguccccaauua

SEQ ID NO: 323261 - RNA, 64 nt, hsa
guucaagugauucuccuaucucagccucccaaguagcugggacuauaggcacacgccaccacgc

SEQ ID NO: 323262 - RNA, 64 nt, hsa
guucaagcaauucuccugccucagccucccgaguagcugggauuacaggcgaccgccaccacgc

SEQ ID NO: 323263 - RNA, 64 nt, hsa
ccucaagcgauucucuuaacucagccucuugaguagcugggauuacaggaacgcgccaccacgc

SEQ ID NO: 323264 - RNA, 64 nt, hsa
auucacgccauucuccugccucagccucccgaguagcugggacuacaggcgccuaucaccaugc

SEQ ID NO: 323265 - RNA, 64 nt, hsa
cuuaaaugcucugagaacacuuauauuagccuacagcugggaaaaaucauuuaacacaaagccu

SEQ ID NO: 323266 - RNA, 64 nt, hsa
guucaugccguucuccugccucagccucccuaguagcugggacuacaggugcccgccaccaugc

SEQ ID NO: 323267 - RNA, 64 nt, hsa
guucacgccauucuccugccucagccucccgagcagcugggacuacaggcgcccgccaccucgc

SEQ ID NO: 323268 - RNA, 64 nt, hsa
gaccuugugauccacccgccucggccucccuaacagcugggauuuacaggcgugagccaccgcg

SEQ ID NO: 323269 - RNA, 64 nt, hsa
cagcaugucuggaaucccgaggguuauauuuaggagcugggaagauuacccccaaagauguucu

SEQ ID NO: 323270 - RNA, 64 nt, hsa
uagcaaaugaaaauaccagaccaagaaaugagugagcugggaaguguuuccaaauacaguuagu

SEQ ID NO: 323271 - RNA, 64 nt, hsa
ugccucuuccaaacaaaaacagccuccucuccauagcugggaaguuuauuuuguuuugucucug

SEQ ID NO: 323272 - RNA, 64 nt, hsa
gaagcccaugagguugcccagggaagccuccaaaagcugggaugcuugaggguauccaaguuga

SEQ ID NO: 323273 - RNA, 64 nt, hsa
uggguuuuaggcuccuuuuuugagccaaaauggaagcugggaaucuggugccauaacuaaugag

SEQ ID NO: 323274 - RNA, 64 nt, hsa
cugguucaagcgauucugccucgaccucucaaguagcugggauuacaagcaccagccaccaugc

SEQ ID NO: 323275 - RNA, 64 nt, hsa
guucaagcaauucuccugccucagccucccaaguagcugggauuacagucaggcaccaccacac

SEQ ID NO: 323276 - RNA, 64 nt, hsa
cacugcagcuaucucucgccucagccccucaaguagcugggacuacaggugcaugccaccaugc

SEQ ID NO: 323277 - RNA, 64 nt, hsa
cggguucaagcaguucugucucagccuucugaguagcugggacuacaggugcaugccaccacac

SEQ ID NO: 323278 - RNA, 64 nt, hsa
uugcagacuaacuuuauuaggagaagccuaugccagcugggagugauugcuaagaggcuccagu

SEQ ID NO: 323279 - RNA, 64 nt, hsa
cagcggggcccugggcgggguuccaaggccugcgagcugggaaaggacagaugaggggaccucg

SEQ ID NO: 323280 - RNA, 64 nt, hsa
cccuugcugcuggagaucugaggucacugcugugagcugggagaacugcuguguaccucuugcu

SEQ ID NO: 323281 - RNA, 64 nt, hsa
guccacgccauucuccugccucagccuccagaguagcugggacuacgggcgccccaccaccacg

SEQ ID NO: 323282 - RNA, 64 nt, hsa
guucaagcaauucuccugccucagccucccgaguagcugggauuagaggcgccagccaacacac

SEQ ID NO: 323283 - RNA, 64 nt, hsa
guucaagccauucuccugccucggccuccugaguagcugggauuacaguugccgccacacccgg

SEQ ID NO: 323284 - RNA, 64 nt, hsa
auucaagcaauucuccugucucagccucccaaguagcugggauuacaggugcgcaccaccaugc

SEQ ID NO: 323285 - RNA, 64 nt, hsa
acauccauucagaaguuuuguuguuuuacucuaaagcugggaaaggaaaugagagggaaaagac

SEQ ID NO: 323286 - RNA, 64 nt, hsa
ugucaccaagcaggagaguuaaggauucaccaugagcugggaaaugcuuuugccaugaguauga

SEQ ID NO: 323287 - RNA, 64 nt, hsa
guucaagugauucucccaccucagccucccaaguagcugggacuacgggcacaugccacugcac

SEQ ID NO: 323288 - RNA, 64 nt, hsa
guucaagcgauucuccugccucagcaucucgaguagcugggauuacaggcaugcaccaccacgc

SEQ ID NO: 323289 - RNA, 64 nt, hsa
aguuuacaagcagagacucacuccaacccaaacuagcugggaguucagaaccaugguggaauaa

SEQ ID NO: 323290 - RNA, 64 nt, hsa
cagucacaggcaggggccuugaggaugauuuccuagcugggaagacaccgugacaucaggccag

SEQ ID NO: 323291 - RNA, 64 nt, hsa
auuuaagugauucuccugccucagccucccaaguagcugggauuacaggugugcaccaccaugc

SEQ ID NO: 323292 - RNA, 64 nt, hsa
guucaagcaauucucccaccucagccucccaaguagcugggauuacagacgugugccaccauac

SEQ ID NO: 323293 - RNA, 64 nt, hsa
gggagacgggugggggucgcugacuauagacuguagcugggaggaggggaugcucccagggcug

SEQ ID NO: 323294 - RNA, 64 nt, hsa
cuccugccucccugccucagccugggaccugaguagcugggaccacaggcaugcgccaccacuc

SEQ ID NO: 323295 - RNA, 64 nt, hsa
guucaagcgauucuucugcuucagccucccgaguagcugggacuacaggcacccaccaucaugu

SEQ ID NO: 323296 - RNA, 64 nt, hsa
ggcuaagugauccucccaccucagccucccgaauagcugggacuacaggugugagucaccaagc

SEQ ID NO: 323297 - RNA, 64 nt, hsa
guucaagcaauucuccugccucaggcuccugaguagcugggauuacaggcacgugacaccaggc

SEQ ID NO: 323298 - RNA, 64 nt, hsa
cggguucacgccauucugcgucagccucccaaguagcugggacuacaggcaccugccacgaugc

SEQ ID NO: 323299 - RNA, 64 nt, hsa
guucaaacgauccuacugccucauccuucggaguagcugggauuacaggcaggugccaccaugc

SEQ ID NO: 323300 - RNA, 64 nt, hsa
guucaagugauucucuugccucagccuccugaguagcugggauuacagguuccugcuaccacgc

SEQ ID NO: 323301 - RNA, 64 nt, hsa
guucaagcgauucucccaccccagccucccaaguagcugggauuacaggugugugccacuacgg

SEQ ID NO: 323302 - RNA, 64 nt, hsa
guucaagagauucuccugccucagccuccgaaguagcugggauuacaggcgcccgccaccaugc

SEQ ID NO: 323303 - RNA, 64 nt, hsa
guucaagcgauucuccugccucagccuccugagcagcugggauuacaggugcgugccaccacac

SEQ ID NO: 323304 - RNA, 64 nt, hsa
cacguucugcuucucacccucuggugacucugugagcugggaaaugagggacuggaagugaggc

SEQ ID NO: 323305 - RNA, 64 nt, hsa
guucaagcgauucucccgccucagguucccgaguagcugggacuacaggcaugugccaccaugc

SEQ ID NO: 323306 - RNA, 64 nt, hsa
caccauggauuuuuaauggaucuuuguucuaggcagcugggaauagacaugguacuuaccuuag

SEQ ID NO: 323307 - RNA, 64 nt, hsa
gcucaagcgauccucccgccuuaacugccugaguagcugggacuacaggcaugcaccaccacgc

SEQ ID NO: 323308 - RNA, 64 nt, hsa
ccggguuccugggucuggaagggccuucucuccaagcugggagcuccugggcccccaccauuca

SEQ ID NO: 323309 - RNA, 64 nt, hsa
ccugguuuuugcucagccugucuucagcuugaggagcugggaagcucugguggaugcuaugaac

SEQ ID NO: 323310 - RNA, 64 nt, hsa
aggucacauagcugggauuugaacugagccgugcagcugggauuugaaccaggccuucugauuu

SEQ ID NO: 323311 - RNA, 64 nt, hsa
caucauuugucuuugaacguacccaaggucacauagcugggauuugaacugagccgugcagcug

SEQ ID NO: 323312 - RNA, 64 nt, hsa
ccucugccuucauuucuccugucaccuuccggggagcugggacuucuuagugcaucaguggccu

SEQ ID NO: 323313 - RNA, 64 nt, hsa
gagccaucggcuuuguggucaucaugugccaccgagcugggacuucuggcaucacuugaguagu

SEQ ID NO: 323314 - RNA, 64 nt, hsa
agugcuaggauuacaggcgugagccaccaugcccagcugggagcguucuuucagcaaaaagucu

SEQ ID NO: 323315 - RNA, 64 nt, hsa
guucaagugauucuccugccucagccucccuaguagcugggauuacaggcaugcaccaccauac

SEQ ID NO: 323316 - RNA, 64 nt, hsa
auucaagcgacucuccugccucagccucccgaguagcugggauugcaggcaugcaccaucacac

SEQ ID NO: 323317 - RNA, 64 nt, hsa
guucaagcgauucuugugccuaagccaccugagcagcugggauuacaggugcaugccaccaugc

SEQ ID NO: 323318 - RNA, 64 nt, hsa
gcuccagcaaucuucuuacgucagccuccagaguagcugggaccgcaggcacuugccaccacgc

SEQ ID NO: 323319 - RNA, 64 nt, hsa
ggcuuaggugaucuucccacucagacuccugcguagcugggaccacagggguaugccaccacac

SEQ ID NO: 323320 - RNA, 64 nt, hsa
guucaagugauucuccugccuuagccucccagguagcugggacuacaagcgugugcccccacag

SEQ ID NO: 323321 - RNA, 64 nt, hsa
cgagggcugggaguaccuggggccccauccccccagcugggaugguggaagccggugguggcca

SEQ ID NO: 323322 - RNA, 64 nt, hsa
guucaagcaguucuccugccucagccucccaaauagcugggauuacaguugccugccaccacgc

SEQ ID NO: 323323 - RNA, 64 nt, hsa
guuuaugccauucuccugucucagccucccgaguagcugggacuacaggcacccgccaacacgc

SEQ ID NO: 323324 - RNA, 64 nt, hsa
gcucaagcaguucuccugccucagccuccugaguagcugggacuacaggcacccgccaccaugc

SEQ ID NO: 323325 - RNA, 64 nt, hsa
gcucaagcgcuucuccugccucagccuccugaguagcugggauuacaggcaugugccagcaugc

SEQ ID NO: 323326 - RNA, 64 nt, hsa
guucaagugauucuccugccucagccucuugaguagcugggacuacaggcgcacaccaccacgc

SEQ ID NO: 323327 - RNA, 64 nt, hsa
gaucaagcaacucuccugccucagccucccuaguagcugggauuacaggcaugcacuaccacgc

SEQ ID NO: 323328 - RNA, 64 nt, hsa
agaucaagagauucuccagucucagcucccaaguagcugggauuacaggcauguacuaccaugc

SEQ ID NO: 323329 - RNA, 64 nt, hsa
auucacgccauucuccugccucagccuccccagcagcugggacuacaggcacccaccgucacac

SEQ ID NO: 323330 - RNA, 64 nt, hsa
guucaagugauucuccugcuucagccucccaaguagcugggauuacaggugugcgccaccacgc

SEQ ID NO: 323331 - RNA, 64 nt, hsa
guucacgccauucuccugccucagccuccugaguagcugggacuacaggcaccugccaccaugc

SEQ ID NO: 323332 - RNA, 64 nt, hsa
guucaagcgauucuccugccucagccuccaaaguagcugggauuacaggcaugcgccaccacac

SEQ ID NO: 323333 - RNA, 64 nt, hsa
guucaagcaauucuccugccucagccuccugaguagcugggacuauaggcgcgugccaccacaa

SEQ ID NO: 323334 - RNA, 64 nt, hsa
guucacgccauucuccugccucagccucccgaguagcugggacuacaggcgcccgccaccacgc

SEQ ID NO: 323335 - RNA, 64 nt, hsa
guucaagcaauucuucugccucagccuuccaaguagcugggauuacaagugcccaccaccaugc

SEQ ID NO: 323336 - RNA, 64 nt, hsa
auucaagcaauucuccugccgcagccucccaagaagcugggauuacaggcaugcgccaccacgc

SEQ ID NO: 323337 - RNA, 64 nt, hsa
guucaagcaauuauccugccucagccucccaaguagcugggauuacaggcaccugccaccacau

SEQ ID NO: 323338 - RNA, 64 nt, hsa
guucacgcaauucuccugccucagccuccuaaguagcugggauuacaggcacccaccaccaugc

SEQ ID NO: 323339 - RNA, 64 nt, hsa
guucaagcgauuccccugccucagccugccaaguagcugggauuacaggcaugcgccaccaugc

SEQ ID NO: 323340 - RNA, 64 nt, hsa
gguucaggcuauucuccugcucagccuccugauuagcugggauuacaggcaugcgccaccauga

SEQ ID NO: 323341 - RNA, 64 nt, hsa
guucaagugauucuccugccucagccucccgaguagcugggauuacaggcaugcaccaccacgc

SEQ ID NO: 323342 - RNA, 64 nt, hsa
cccugcuccaccaggaugucccccagguccugccagcugggaagugccagcaugaacgccucca

SEQ ID NO: 323343 - RNA, 64 nt, hsa
ccuuaagugauccucccaccucagccuccugaguagcugggacuacaggcaugagccaccaugc

SEQ ID NO: 323344 - RNA, 64 nt, hsa
gcucaagcgauccuccugccucagccucccaaguagcugggagccugggcaugcaucgccacgu

SEQ ID NO: 323345 - RNA, 64 nt, hsa
gaacgagagugcacugcaugauagcguucuggugagcugggaaggacccaccacugccacugag

SEQ ID NO: 323346 - RNA, 64 nt, hsa
gaagguggggcuggaaaaggguuagaagccuccuagcugggauugucuuuguuucaccuuucuu

SEQ ID NO: 323347 - RNA, 64 nt, hsa
gguucaagcaauuauuugccucagccucccgaguagcugggauuauaggcacccgccaccaugu

SEQ ID NO: 323348 - RNA, 64 nt, hsa
cggcuccuagaauccuuagagucugaauuccuuuagcugggaacagcugucauggucaccccug

SEQ ID NO: 323349 - RNA, 64 nt, hsa
aucugccucccuccauggcagggguggauucgggagcugggaguaaccaggcaaagucaaccag

SEQ ID NO: 323350 - RNA, 64 nt, hsa
agaaggcaggggaaggaccugaugagaacagaauagcugggaggcugcagagggugcugggagc

SEQ ID NO: 323351 - RNA, 64 nt, hsa
guucaagggauccucccgccucagccuccugagcagcugggauuacaggcgcacaucaccaugc

SEQ ID NO: 323352 - RNA, 64 nt, hsa
gcucaagccauuuucccaccucagccucccgaguagcugggacuacaggugcacaccaccacac

SEQ ID NO: 323353 - RNA, 64 nt, hsa
ccagggagcuggugacacuugugugcuguggggcagcugggauccagguaagaccggauugaag

SEQ ID NO: 323354 - RNA, 64 nt, hsa
cuggugcggcucagagcucggcgaguuugcugggagcugggagcaggcuugccuggcagagaac

SEQ ID NO: 323355 - RNA, 64 nt, hsa
auucaagugauccucccaucucagccucccaaguagcugggacuacaguugugcaccacaaugc

SEQ ID NO: 323356 - RNA, 64 nt, hsa
guugaagcgauucuccugccucagccucccaaguagcugggauuacaggcaugcaccaccaugc

SEQ ID NO: 323357 - RNA, 64 nt, hsa
guucaugccauucuccugccucagccucccgaguagcugggacuacaggcacgugugaccaugc

SEQ ID NO: 323358 - RNA, 64 nt, hsa
guucaagcaauucuccugccucagccucccaaguagcugggacuacaggcaugcaccaccacac

SEQ ID NO: 323359 - RNA, 64 nt, hsa
guacaagagauucuccugccucagccucccgaguagcugggacuacaggcgugugccaccaugc

SEQ ID NO: 323360 - RNA, 64 nt, hsa
cuccuggcauaacacccagcuugguuuggguggcagcugggagaacuucucucccagcccugca

SEQ ID NO: 323361 - RNA, 64 nt, hsa
cugcacacacagcgguggggaggcggggaggagcagcugggacccagaacugagccugggaggg

SEQ ID NO: 323362 - RNA, 64 nt, hsa
gccccauuagcuuuaaaauguagccccagguuggagcugggaacacuguacuggccacuuaccc

SEQ ID NO: 323363 - RNA, 64 nt, hsa
ggagugguccacccacggucccagcacaaggcagagcugggaugaaaacagggcugaaaagacu

SEQ ID NO: 323364 - RNA, 64 nt, hsa
guucaagcgauucuccugccucagccuccugaguagcugggaauacaggcaugcgccacuacac

SEQ ID NO: 323365 - RNA, 64 nt, hsa
ccucaggugauccguccaccucagccucccaaagagcugggauuacaggugugagcuaccgcgc

SEQ ID NO: 323366 - RNA, 64 nt, hsa
guucaagcaauucuccuucuucagccucccgaguagcugggauuacaggcaugcaccaccacac

SEQ ID NO: 323367 - RNA, 64 nt, hsa
gguucaggcgauucuccugccucagccuccaaguagcugggacuacaggcgcgugccaccacgc

SEQ ID NO: 323368 - RNA, 64 nt, hsa
ggccacaagcccagggacaccuggagcccccaggagcugggagaggcaggaaggauccuccccu

SEQ ID NO: 323369 - RNA, 64 nt, hsa
ugccccaagcccagggaugccuggaguccccaggagcugggagaggcaggaaggacccuccccu

SEQ ID NO: 323370 - RNA, 61 nt, hsa
uacaggauggugggcaggaucucaagccagcccccuccagcucaugacacuguuuggccuu

SEQ ID NO: 323371 - RNA, 61 nt, hsa
ugacgcccagcuccgccugcugggaagagcuccccuccacagcugcagcugauccauagga

SEQ ID NO: 323372 - RNA, 61 nt, hsa
cacucacagaggcuccuggccuugaucccugccccuccagguguccaggguaaaguguaac

SEQ ID NO: 323373 - RNA, 61 nt, hsa
ggccgaccucacugcacagaccccacuccagccccuccaccccuucuucaugcacagcugc

SEQ ID NO: 323374 - RNA, 61 nt, hsa
gugcauguggaaaguaucagaguaaggcucuccccuccagagcccugaguuucuuggcugc

SEQ ID NO: 323375 - RNA, 61 nt, hsa
gcuuuccuagauccacacuuucaaagagaaaccccuccagaacucccacccugacagccca

SEQ ID NO: 323376 - RNA, 61 nt, hsa
guguggggcaggcuccguccucccugggagaccccuccagccaccgggugccacuuaaugc

SEQ ID NO: 323377 - RNA, 61 nt, hsa
cccuccuggaggaguccuguugccucuccugccccuccaggccacugaguguuuuggccac

SEQ ID NO: 323378 - RNA, 61 nt, hsa
agcacaaacccuggggacucugcuuggcuguccccuccaucuggggauggagaaugccagc

SEQ ID NO: 323379 - RNA, 61 nt, hsa
cccagaaggaacccggucccaggccgcauggccccuccaggaacauucccacauaauacau

SEQ ID NO: 323380 - RNA, 61 nt, hsa
agugacugaggcuggggugccucucccuggcccccuccaacugccaaauucugcuucccuc

SEQ ID NO: 323381 - RNA, 61 nt, hsa
guucagguggcuccaucgucuauucugugguccccuccaugagccuuugccccaggguggg

SEQ ID NO: 323382 - RNA, 61 nt, hsa
gggugcucccccgcccaucacccucccggggccccuccacugccuggcucagcgggccgga

SEQ ID NO: 323383 - RNA, 61 nt, hsa
gggggcgguguggcugcagccucagucccugccccuccagcccacagcccccaucccguag

SEQ ID NO: 323384 - RNA, 61 nt, hsa
ccugggggcggccauguuguccaggcccaggccccuccaggacuguggcugccuccccucc

SEQ ID NO: 323385 - RNA, 61 nt, hsa
ggcccaggccccuccaggacuguggcugccuccccuccacggccuccagggcggcuggcug

SEQ ID NO: 323386 - RNA, 61 nt, hsa
cccggcccggccuccagggcgcagaggcgccccccuccauccucccccaucccgggggcca

SEQ ID NO: 323387 - RNA, 61 nt, hsa
cacacuuaaaccuuccaaguagcacagaagcccccuccacgucagaggcccccuggccgcg

SEQ ID NO: 323388 - RNA, 61 nt, hsa
cccacauccucccugcuccucagacucacagccccuccauguuaccucccgcaccuccucc

SEQ ID NO: 323389 - RNA, 61 nt, hsa
ccccucugcagaucuccucuggccacugcagccccuccaaugggcuuuuucucucaugcau

SEQ ID NO: 323390 - RNA, 61 nt, hsa
ucuccagguuggguugggggcacugcuguccccccuccagcuaggacccagcccaucccca

SEQ ID NO: 323391 - RNA, 61 nt, hsa
gcugcauggccaggguggcaggaagacauccccccuccaucccagcccacuggaccagaac

SEQ ID NO: 323392 - RNA, 61 nt, hsa
gggcaaagagcgcucaauccagcuccuugaaccccuccagcccgcuucagccugggcauca

SEQ ID NO: 323393 - RNA, 61 nt, hsa
aaccccuguaccucccaccccuguauccccaccccuccacccaccccucucccaaccucuc

SEQ ID NO: 323394 - RNA, 61 nt, hsa
cuccaccccugccucuccuccaccccugccuccccuccaccccugccucuccuccacccgc

SEQ ID NO: 323395 - RNA, 61 nt, hsa
cuccaccccugccucuccuccaccccugccuccccuccaccugccccagugcccagaccaa

SEQ ID NO: 323396 - RNA, 61 nt, hsa
gacacugccacagggacgccuucccuccccuccccuccagcccaccccugcacagccccuc

SEQ ID NO: 323397 - RNA, 61 nt, hsa
uccccagcaggagagccuaguccucccccagccccuccagccaccaggguguccucuagga

SEQ ID NO: 323398 - RNA, 61 nt, hsa
cccgguggugaugacuccuacaucuaaguggccccuccacccucucccccagccgcacggg

SEQ ID NO: 323399 - RNA, 61 nt, hsa
ucauugagauacaaguuuccgaacaggagccccccuccacagguaagccccccuccacagg

SEQ ID NO: 323400 - RNA, 61 nt, hsa
ccugugcagaccuccacccuucuuuccuccaccccuccaucccccaaugcuuguagaccuu

SEQ ID NO: 323401 - RNA, 61 nt, hsa
agcucgagagccagacggccagacaggcagaccccuccagaggcccgccaggugggcaugg

SEQ ID NO: 323402 - RNA, 61 nt, hsa
cuccucuucaucucagcauucuccaucacuuccccuccagaaaaacggauggaaggaagcc

SEQ ID NO: 323403 - RNA, 61 nt, hsa
ucagugcagguugcccuuaauuuuccccaaaccccuccaucggcaagucuaguugcccuuu

SEQ ID NO: 323404 - RNA, 61 nt, hsa
uuaugcggagugcccgcaaggcugggguagcccccuccaguacaccccaaagugaaaggga

SEQ ID NO: 323405 - RNA, 61 nt, hsa
gcccugcccccggccccugccccugcccgccccccuccaguccaggcagucgagcuccacc

SEQ ID NO: 323406 - RNA, 61 nt, hsa
acagauaccauuuucucaauggaaucaguucccccuccacccauccccuucuguacauagc

SEQ ID NO: 323407 - RNA, 61 nt, hsa
aaaccccaccucccuuuauugacuccacauuccccuccaguguucccuccuugagagcuga

SEQ ID NO: 323408 - RNA, 61 nt, hsa
auaacuugacaugagcaccuuuagaucccuuccccuccaugggcuuugggccacagaauga

SEQ ID NO: 323409 - RNA, 61 nt, hsa
uuuguccccuggcugcugcccucccauucucccccuccaguaguagcugggugagaccugu

SEQ ID NO: 323410 - RNA, 61 nt, hsa
aggaaagaguuguuggugccauugcaggugcccccuccaggccugacuggcuccgccaggc

SEQ ID NO: 323411 - RNA, 61 nt, hsa
cuccuccccacacugagcuccuuuguuccucccccuccagccuuugccugggaacuggucc

SEQ ID NO: 323412 - RNA, 61 nt, hsa
gagcauccugcugggcucucugcccggcccaccccuccaaggggcuggccugugagccuug

SEQ ID NO: 323413 - RNA, 61 nt, hsa
ggaagcaccgucugcccgggcccaagcccugccccuccagaguccagagccaggaaggggc

SEQ ID NO: 323414 - RNA, 61 nt, hsa
cuugcagcugcagcccaucccugggccauguccccuccaucgagugcccggugcuuggggg

SEQ ID NO: 323415 - RNA, 61 nt, hsa
gguggauuuguuccaaagccucaaucccuacccccuccaaggggcagguuuccaguccagc

SEQ ID NO: 323416 - RNA, 61 nt, hsa
aggggccaggcuggacgcuuccugugggaguccccuccagaccuggcuggccccugcagcc

SEQ ID NO: 323417 - RNA, 61 nt, hsa
ccuguucuuggugaccccaguugggcuuuggccccuccagcaaccuugugucccagcccug

SEQ ID NO: 323418 - RNA, 61 nt, hsa
uaggaggugagacaugggguucugucaugccccccuccacugagccuuggcuacaucugug

SEQ ID NO: 323419 - RNA, 61 nt, hsa
aagaugaugggguuuagaucccucaggcucuccccuccagacuccgcccuucccucccucc

SEQ ID NO: 323420 - RNA, 61 nt, hsa
gggagggaggggaggaugagcacgcccagcuccccuccagggugugacuuggccccucugg

SEQ ID NO: 323421 - RNA, 61 nt, hsa
guguccaggggcuuggagagaccugcgcccaccccuccacucucccaggagucgcugauca

SEQ ID NO: 323422 - RNA, 61 nt, hsa
gccgugggcaaacccugaagacaccccugccccccuccagagagugaggagggggccugag

SEQ ID NO: 323423 - RNA, 61 nt, hsa
cccagcgaggacacacacuccacgagagcagccccuccacucugcccaggagaggggccga

SEQ ID NO: 323424 - RNA, 61 nt, hsa
ccagcucagggcggaaggucaggcuccccgcccccuccacguggagacauggccuaggggg

SEQ ID NO: 323425 - RNA, 61 nt, hsa
ugccggugcccugccccccagcacugcccuaccccuccacuccgagcugggggggaaucug

SEQ ID NO: 323426 - RNA, 61 nt, hsa
uccgccccuuccaguucacauagugagacccccccuccagggugggucuggggaggggaca

SEQ ID NO: 323427 - RNA, 61 nt, hsa
ccacgcuccccguccuuggccgccccuccacccccuccaacucugcuccucuagggccgcc

SEQ ID NO: 323428 - RNA, 61 nt, hsa
auaccccggccacgcuccccguccuuggccgccccuccacccccuccaacucugcuccucu

SEQ ID NO: 323429 - RNA, 61 nt, hsa
cuuccccugcaaccagacagucuacaacugcccccuccagcccauuuucugccgugaaacc

SEQ ID NO: 323430 - RNA, 61 nt, hsa
gacccuuccacugacacccucgcucucacacccccuccagcuuuccgaccccacaccgaca

SEQ ID NO: 323431 - RNA, 61 nt, hsa
cgcuggaggaaaccagcccuuuagccagcagccccuccaccacaggcacugcuguguggaa

SEQ ID NO: 323432 - RNA, 61 nt, hsa
caaggauuucacaugcagaagagaaaaggccccccuccaccccccgcauucccugccgagu

SEQ ID NO: 323433 - RNA, 61 nt, hsa
aggagacugaggcuuagagagaggaggcagcccccuccacaccaguggccucgugguuauu

SEQ ID NO: 323434 - RNA, 61 nt, hsa
agcuggguggggacagugauaggcccaagguccccuccacaucccagcagcccaagcuuaa

SEQ ID NO: 323435 - RNA, 61 nt, hsa
cuccugcaaggggcucaacccccuaccccgaccccuccacguaucuuuccuaggcagauca

SEQ ID NO: 323436 - RNA, 61 nt, hsa
ugaugcugccaggccugggaccucccacugcccccuccacuggaggggucuccucugcagc

SEQ ID NO: 323437 - RNA, 61 nt, hsa
uccauuucgagaacauaaauagauugcccagccccuccaguacaaucccacuggaagaaaa

SEQ ID NO: 323438 - RNA, 61 nt, hsa
agggcaucugacucccucuucaguguucuucccccuccauguugccugccccugaagaccu

SEQ ID NO: 323439 - RNA, 61 nt, hsa
gcccugugcuccuccccgcaggacauggcucccccuccaccugcucugugcccacccucca

SEQ ID NO: 323440 - RNA, 61 nt, hsa
ggcccccaaccccccauuucuuccccaccaaccccuccaaugcuguuaucccugccugguc

SEQ ID NO: 323441 - RNA, 61 nt, hsa
ccauagcagccccugcuucagccccaccgcaccccuccagggggccugccuuucccugaca

SEQ ID NO: 323442 - RNA, 61 nt, hsa
uaucacaacccaccaaaaauagaugccucucccccuccagcccuagccgagcugguccuag

SEQ ID NO: 323443 - RNA, 64 nt, hsa
cgugugggugggaauucucugacggugcucguucauagcacaagcuuacgcugaguucugaacu

SEQ ID NO: 323444 - RNA, 64 nt, hsa
uuccugggccagcuuccugcuugcagucacucgcauagcacagagguggggcuucgggcaggga

SEQ ID NO: 323445 - RNA, 64 nt, hsa
aacuugaagccacauccuacagauggcagcccaaauagcacaugggcaauuggcaccaucuuua

SEQ ID NO: 323446 - RNA, 64 nt, hsa
aaacuuugccucugaugcucagccccacccccaaauagcacacaagcuuguuaaccccaccucu

SEQ ID NO: 323447 - RNA, 64 nt, hsa
ccuaucagaucuugugagacuuacuaucacgagaauagcacaggaaagacuggcccccaugauu

SEQ ID NO: 323448 - RNA, 64 nt, hsa
cccaucagaucucaugagacuuacuaucaugagaauagcacaggaaagacuggccccccugauu

SEQ ID NO: 323449 - RNA, 64 nt, hsa
aucagaauuuuuuuaggauucacaacuaaucacuauagcacaugaccuugggauuacauuuuua

SEQ ID NO: 323450 - RNA, 64 nt, hsa
cuauuuugaaugcaugugacuaagagcaugauuuauagcacaaccuuuccaauaaucccuuaau

SEQ ID NO: 323451 - RNA, 64 nt, hsa
ugcucgcaucuuuguuuuuaaucuggcuucgaacauagcacaaguaacuugaauagcacaucaa

SEQ ID NO: 323452 - RNA, 64 nt, hsa
uaaucuggcuucgaacauagcacaaguaacuugaauagcacaucaauagguuacuggacaaaag

SEQ ID NO: 323453 - RNA, 64 nt, hsa
aagaaaagaagaaggggaagaaaagaaggggaagaagaucaaaacccaccaugccccagguaac

SEQ ID NO: 323454 - RNA, 64 nt, hsa
aaaagaaggggaaggggaagaaaagaaggggaagaagaucaaagaagaaaagaagaaggggaag

SEQ ID NO: 323455 - RNA, 64 nt, hsa
uguuuuuguuuuuaaagcgcuaucacacaccuccaagaucaagauccuguucugagucagauga

SEQ ID NO: 323456 - RNA, 64 nt, hsa
aaucucacucacagucuuauucuagaggaagcucaagaucaaggacugcgucaaaguccucauc

SEQ ID NO: 323457 - RNA, 64 nt, hsa
aaauggaaaauaaucuaacucgaaggcgccugaaaagaucaaauucuauaucccagauaccuuc

SEQ ID NO: 323458 - RNA, 64 nt, hsa
auuggauuuguagguccugugccaccaaaacccaaagaucaaagguccaucaucaaaacaccaa

SEQ ID NO: 323459 - RNA, 64 nt, hsa
ugcggagggggcagccucagcucucuuuucagagaagaucaaagcugggcuucccagggugccu

SEQ ID NO: 323460 - RNA, 64 nt, hsa
uggcugccugagaaaggucuuucuuuuuauagaaaagaucaaggcugucuggcgcgggacucca

SEQ ID NO: 323461 - RNA, 64 nt, hsa
caucucugggcuuguuccgggaagcgaaaagaccaagaucaaauaauagcugggguggagaaaa

SEQ ID NO: 323462 - RNA, 64 nt, hsa
ccuuuugagauucuccaacuugacaaaugugccaaagaucaacagacagaaaauaucauccugu

SEQ ID NO: 323463 - RNA, 64 nt, hsa
ccucuuccaguucuuuaaaaacguuuaugauauuaagaucaaagggaggaagggaagacagcag

SEQ ID NO: 323464 - RNA, 64 nt, hsa
gcauucucuaggccaaaagggcuagccagguggcaagaucaauuuagcuacuuuguauuuucag

SEQ ID NO: 323465 - RNA, 64 nt, hsa
uuucucauuuuaucccacuuaugagauugggaaaaagaucaauaugagaaauaccauacagaua

SEQ ID NO: 323466 - RNA, 64 nt, hsa
aaggagugccaaauaggacuuuccacucaugcucaagaucaaaacuuuauagaacagucaacau

SEQ ID NO: 323467 - RNA, 64 nt, hsa
guucaccugggggccauggaggggggacccacuaaagaucaagaucaaagauucuccccaucuc

SEQ ID NO: 323468 - RNA, 64 nt, hsa
cugggggccauggaggggggacccacuaaagaucaagaucaaagauucuccccaucucacagac

SEQ ID NO: 323469 - RNA, 64 nt, hsa; identical to SEQ ID NO: 303515

SEQ ID NO: 323470 - RNA, 64 nt, hsa; identical to SEQ ID NO: 303516

SEQ ID NO: 323471 - RNA, 64 nt, hsa; identical to SEQ ID NO: 303517

SEQ ID NO: 323472 - RNA, 64 nt, hsa; identical to SEQ ID NO: 303518

SEQ ID NO: 323473 - RNA, 64 nt, hsa; identical to SEQ ID NO: 303519

SEQ ID NO: 323474 - RNA, 64 nt, hsa; identical to SEQ ID NO: 303520

SEQ ID NO: 323475 - RNA, 64 nt, hsa; identical to SEQ ID NO: 303521

SEQ ID NO: 323476 - RNA, 64 nt, hsa; identical to SEQ ID NO: 303522

SEQ ID NO: 323477 - RNA, 64 nt, hsa; identical to SEQ ID NO: 303523

SEQ ID NO: 323478 - RNA, 64 nt, hsa; identical to SEQ ID NO: 303524

SEQ ID NO: 323479 - RNA, 64 nt, hsa; identical to SEQ ID NO: 303525

SEQ ID NO: 323480 - RNA, 64 nt, hsa; identical to SEQ ID NO: 303526

SEQ ID NO: 323481 - RNA, 64 nt, hsa; identical to SEQ ID NO: 303527

SEQ ID NO: 323482 - RNA, 64 nt, hsa; identical to SEQ ID NO: 303528

SEQ ID NO: 323483 - RNA, 64 nt, hsa; identical to SEQ ID NO: 303529

SEQ ID NO: 323484 - RNA, 64 nt, hsa; identical to SEQ ID NO: 303530

SEQ ID NO: 323485 - RNA, 64 nt, hsa; identical to SEQ ID NO: 303531

SEQ ID NO: 323486 - RNA, 64 nt, hsa; identical to SEQ ID NO: 303532

SEQ ID NO: 323487 - RNA, 64 nt, hsa; identical to SEQ ID NO: 303533

SEQ ID NO: 323488 - RNA, 64 nt, hsa; identical to SEQ ID NO: 303534

SEQ ID NO: 323489 - RNA, 64 nt, hsa; identical to SEQ ID NO: 303535

SEQ ID NO: 323490 - RNA, 64 nt, hsa; identical to SEQ ID NO: 303536

SEQ ID NO: 323491 - RNA, 64 nt, hsa; identical to SEQ ID NO: 303537

SEQ ID NO: 323492 - RNA, 64 nt, hsa; identical to SEQ ID NO: 303538

SEQ ID NO: 323493 - RNA, 64 nt, hsa; identical to SEQ ID NO: 210821

SEQ ID NO: 323494 - RNA, 64 nt, hsa; identical to SEQ ID NO: 210822

SEQ ID NO: 323495 - RNA, 64 nt, hsa; identical to SEQ ID NO: 210823

SEQ ID NO: 323496 - RNA, 64 nt, hsa; identical to SEQ ID NO: 210824

SEQ ID NO: 323497 - RNA, 64 nt, hsa; identical to SEQ ID NO: 210825

SEQ ID NO: 323498 - RNA, 64 nt, hsa; identical to SEQ ID NO: 210826

SEQ ID NO: 323499 - RNA, 64 nt, hsa; identical to SEQ ID NO: 210827

SEQ ID NO: 323500 - RNA, 64 nt, hsa; identical to SEQ ID NO: 210828

SEQ ID NO: 323501 - RNA, 64 nt, hsa; identical to SEQ ID NO: 210829

SEQ ID NO: 323502 - RNA, 64 nt, hsa; identical to SEQ ID NO: 210830

SEQ ID NO: 323503 - RNA, 64 nt, hsa; identical to SEQ ID NO: 210831

SEQ ID NO: 323504 - RNA, 64 nt, hsa; identical to SEQ ID NO: 210832

SEQ ID NO: 323505 - RNA, 64 nt, hsa; identical to SEQ ID NO: 210833

SEQ ID NO: 323506 - RNA, 64 nt, hsa; identical to SEQ ID NO: 210834

SEQ ID NO: 323507 - RNA, 64 nt, hsa; identical to SEQ ID NO: 210835

SEQ ID NO: 323508 - RNA, 64 nt, hsa; identical to SEQ ID NO: 210836

SEQ ID NO: 323509 - RNA, 64 nt, hsa; identical to SEQ ID NO: 210837

SEQ ID NO: 323510 - RNA, 64 nt, hsa; identical to SEQ ID NO: 210838

SEQ ID NO: 323511 - RNA, 64 nt, hsa; identical to SEQ ID NO: 210839

SEQ ID NO: 323512 - RNA, 64 nt, hsa; identical to SEQ ID NO: 210840

SEQ ID NO: 323513 - RNA, 64 nt, hsa; identical to SEQ ID NO: 210841

SEQ ID NO: 323514 - RNA, 64 nt, hsa; identical to SEQ ID NO: 226834

SEQ ID NO: 323515 - RNA, 64 nt, hsa; identical to SEQ ID NO: 226835

SEQ ID NO: 323516 - RNA, 64 nt, hsa; identical to SEQ ID NO: 226836

SEQ ID NO: 323517 - RNA, 64 nt, hsa; identical to SEQ ID NO: 226837

SEQ ID NO: 323518 - RNA, 64 nt, hsa; identical to SEQ ID NO: 226838

SEQ ID NO: 323519 - RNA, 64 nt, hsa; identical to SEQ ID NO: 226839

SEQ ID NO: 323520 - RNA, 64 nt, hsa; identical to SEQ ID NO: 226840

SEQ ID NO: 323521 - RNA, 64 nt, hsa; identical to SEQ ID NO: 226841

SEQ ID NO: 323522 - RNA, 64 nt, hsa; identical to SEQ ID NO: 226842

SEQ ID NO: 323523 - RNA, 64 nt, hsa; identical to SEQ ID NO: 226843

SEQ ID NO: 323524 - RNA, 64 nt, hsa; identical to SEQ ID NO: 226844

SEQ ID NO: 323525 - RNA, 64 nt, hsa; identical to SEQ ID NO: 226845

SEQ ID NO: 323526 - RNA, 64 nt, hsa; identical to SEQ ID NO: 226846

SEQ ID NO: 323527 - RNA, 64 nt, hsa; identical to SEQ ID NO: 226847

SEQ ID NO: 323528 - RNA, 64 nt, hsa; identical to SEQ ID NO: 226848

SEQ ID NO: 323529 - RNA, 64 nt, hsa; identical to SEQ ID NO: 226849

SEQ ID NO: 323530 - RNA, 64 nt, hsa; identical to SEQ ID NO: 226850

SEQ ID NO: 323531 - RNA, 64 nt, hsa; identical to SEQ ID NO: 226851

SEQ ID NO: 323532 - RNA, 64 nt, hsa; identical to SEQ ID NO: 226852

SEQ ID NO: 323533 - RNA, 64 nt, hsa; identical to SEQ ID NO: 226853

SEQ ID NO: 323534 - RNA, 64 nt, hsa; identical to SEQ ID NO: 226854

SEQ ID NO: 323535 - RNA, 64 nt, hsa; identical to SEQ ID NO: 226855

SEQ ID NO: 323536 - RNA, 64 nt, hsa; identical to SEQ ID NO: 226856

SEQ ID NO: 323537 - RNA, 64 nt, hsa; identical to SEQ ID NO: 226857

SEQ ID NO: 323538 - RNA, 64 nt, hsa; identical to SEQ ID NO: 226858

SEQ ID NO: 323539 - RNA, 64 nt, hsa; identical to SEQ ID NO: 226859

SEQ ID NO: 323540 - RNA, 64 nt, hsa; identical to SEQ ID NO: 226860

SEQ ID NO: 323541 - RNA, 64 nt, hsa; identical to SEQ ID NO: 226861

SEQ ID NO: 323542 - RNA, 64 nt, hsa; identical to SEQ ID NO: 226862

SEQ ID NO: 323543 - RNA, 64 nt, hsa; identical to SEQ ID NO: 226863

SEQ ID NO: 323544 - RNA, 64 nt, hsa; identical to SEQ ID NO: 226864

SEQ ID NO: 323545 - RNA, 64 nt, hsa; identical to SEQ ID NO: 226865

SEQ ID NO: 323546 - RNA, 64 nt, hsa; identical to SEQ ID NO: 226866

SEQ ID NO: 323547 - RNA, 64 nt, hsa; identical to SEQ ID NO: 226867

SEQ ID NO: 323548 - RNA, 64 nt, hsa; identical to SEQ ID NO: 226868

SEQ ID NO: 323549 - RNA, 64 nt, hsa; identical to SEQ ID NO: 226869

SEQ ID NO: 323550 - RNA, 64 nt, hsa; identical to SEQ ID NO: 226870

SEQ ID NO: 323551 - RNA, 64 nt, hsa; identical to SEQ ID NO: 226871

SEQ ID NO: 323552 - RNA, 64 nt, hsa; identical to SEQ ID NO: 226872

SEQ ID NO: 323553 - RNA, 64 nt, hsa; identical to SEQ ID NO: 226873

SEQ ID NO: 323554 - RNA, 64 nt, hsa; identical to SEQ ID NO: 226874

SEQ ID NO: 323555 - RNA, 64 nt, hsa; identical to SEQ ID NO: 226875

SEQ ID NO: 323556 - RNA, 64 nt, hsa; identical to SEQ ID NO: 226876

SEQ ID NO: 323557 - RNA, 64 nt, hsa; identical to SEQ ID NO: 226877

SEQ ID NO: 323558 - RNA, 64 nt, hsa; identical to SEQ ID NO: 226878

SEQ ID NO: 323559 - RNA, 64 nt, hsa; identical to SEQ ID NO: 226879

SEQ ID NO: 323560 - RNA, 64 nt, hsa; identical to SEQ ID NO: 226880

SEQ ID NO: 323561 - RNA, 64 nt, hsa; identical to SEQ ID NO: 226881

SEQ ID NO: 323562 - RNA, 64 nt, hsa; identical to SEQ ID NO: 226882

SEQ ID NO: 323563 - RNA, 64 nt, hsa; identical to SEQ ID NO: 226883

SEQ ID NO: 323564 - RNA, 64 nt, hsa; identical to SEQ ID NO: 226884

SEQ ID NO: 323565 - RNA, 64 nt, hsa; identical to SEQ ID NO: 226885

SEQ ID NO: 323566 - RNA, 64 nt, hsa; identical to SEQ ID NO: 226886

SEQ ID NO: 323567 - RNA, 64 nt, hsa; identical to SEQ ID NO: 226887

SEQ ID NO: 323568 - RNA, 64 nt, hsa; identical to SEQ ID NO: 226888

SEQ ID NO: 323569 - RNA, 64 nt, hsa; identical to SEQ ID NO: 226889

SEQ ID NO: 323570 - RNA, 64 nt, hsa; identical to SEQ ID NO: 226890

SEQ ID NO: 323571 - RNA, 64 nt, hsa; identical to SEQ ID NO: 236560

SEQ ID NO: 323572 - RNA, 64 nt, hsa; identical to SEQ ID NO: 236561

SEQ ID NO: 323573 - RNA, 64 nt, hsa; identical to SEQ ID NO: 236562

SEQ ID NO: 323574 - RNA, 64 nt, hsa; identical to SEQ ID NO: 236563

SEQ ID NO: 323575 - RNA, 64 nt, hsa; identical to SEQ ID NO: 236564

SEQ ID NO: 323576 - RNA, 64 nt, hsa; identical to SEQ ID NO: 236565

SEQ ID NO: 323577 - RNA, 64 nt, hsa; identical to SEQ ID NO: 236566

SEQ ID NO: 323578 - RNA, 64 nt, hsa; identical to SEQ ID NO: 236567

SEQ ID NO: 323579 - RNA, 64 nt, hsa; identical to SEQ ID NO: 236568

SEQ ID NO: 323580 - RNA, 64 nt, hsa; identical to SEQ ID NO: 236569

SEQ ID NO: 323581 - RNA, 64 nt, hsa; identical to SEQ ID NO: 236570

SEQ ID NO: 323582 - RNA, 64 nt, hsa; identical to SEQ ID NO: 236571

SEQ ID NO: 323583 - RNA, 64 nt, hsa; identical to SEQ ID NO: 236572

SEQ ID NO: 323584 - RNA, 64 nt, hsa; identical to SEQ ID NO: 236573

SEQ ID NO: 323585 - RNA, 64 nt, hsa; identical to SEQ ID NO: 236574

SEQ ID NO: 323586 - RNA, 64 nt, hsa; identical to SEQ ID NO: 236575

SEQ ID NO: 323587 - RNA, 64 nt, hsa; identical to SEQ ID NO: 236576

SEQ ID NO: 323588 - RNA, 64 nt, hsa; identical to SEQ ID NO: 236577

SEQ ID NO: 323589 - RNA, 64 nt, hsa; identical to SEQ ID NO: 236578

SEQ ID NO: 323590 - RNA, 64 nt, hsa; identical to SEQ ID NO: 236579

SEQ ID NO: 323591 - RNA, 64 nt, hsa
cagcaaguacugagaacucauuuucuacccugccucgucuuaagacauauuuauguaauaccau

SEQ ID NO: 323592 - RNA, 64 nt, hsa
gagcuuucauaauguauaacccuuuccacuuucaucgucuuauauaugaagcgccuugagugug

SEQ ID NO: 323593 - RNA, 64 nt, hsa
uaaaaagggagccguacaguuuguuugaagcacuucgucuuacccauuuauguaggggccccag

SEQ ID NO: 323594 - RNA, 64 nt, hsa
ugcccucuccaugucuucguccuggcaaacagggucgucuuaaaauuaugcgcuaauucuguau

SEQ ID NO: 323595 - RNA, 64 nt, hsa
augacugucaauaaaaugcggguuucugggccauucgucuuacuuucauuuuuugauuacaaau

SEQ ID NO: 323596 - RNA, 64 nt, hsa
cucaggggggguuuaagugccguuugcaauaaugucgucuuauuuauuuagcggggugaauauu

SEQ ID NO: 323597 - RNA, 64 nt, hsa
auuuuaagugacuuuuuauggguuauuuagguuuucgucuuaguuguagcacacuuacccuaau

SEQ ID NO: 323598 - RNA, 64 nt, hsa
gaggagaagagcauagggucauggagcagcagccucgucuuacagcgugacugcaaagaaaaag

SEQ ID NO: 323599 - RNA, 64 nt, hsa
ucuauucuucauuagcucagugacuuguccacacucgucuuagcacuuacguuucaaaagcuug

SEQ ID NO: 323600 - RNA, 64 nt, hsa
gauugcccauccaucugcuuacaauucccugcugucgucuuagcaagaaguaaaaugagaaauu

SEQ ID NO: 323601 - RNA, 64 nt, hsa
cuaagcucaucagaacaccaacagauucauguucucgucuuagcuuucaucuauucuggucuca

SEQ ID NO: 323602 - RNA, 64 nt, hsa
uugcaugcauuauugugacuucaaguuuaaaaaaucgucuuacauguguacaauaugcaaauua

SEQ ID NO: 323603 - RNA, 64 nt, hsa
auucaguuaaguguuaauaaggaucuacugagccucgucuuaguuaaucuguggaaaguccuuu

SEQ ID NO: 323604 - RNA, 64 nt, hsa
aggacuuuuuuugucuuucuuuaacgcccaggcuucgucuuauuucuacuguuuuugucgcaac

SEQ ID NO: 323605 - RNA, 64 nt, hsa
agugaaauuauggacaagagaaauaauuguaaaaucgucuuaaaggaaaauuuaauuuuuacuc

SEQ ID NO: 323606 - RNA, 64 nt, hsa
uuugcccuaauaccaaggcgcuacguuuauugccucgucuuauucacugaccuuuguaaugaua

SEQ ID NO: 323607 - RNA, 64 nt, hsa
ugaauucuaacacuugcaggagcagagcuggucaucgucuuagcauacauauccuacacugagu

SEQ ID NO: 323608 - RNA, 64 nt, hsa
agauaguaagacagcugaguuuuccucaguuuucucgucuuaacacuaguggacaauucuagca

SEQ ID NO: 323609 - RNA, 64 nt, hsa
uguccaacagggugucaggauuuaaggaaaaccuucgucuuaggcuaagucugaaaugguacug

SEQ ID NO: 323610 - RNA, 64 nt, hsa
acucugagccuuccagagcuucagccucucuucgucgucuuaccccacugaaaccaacagggau

SEQ ID NO: 323611 - RNA, 64 nt, hsa
uuaaauuuugugccaguauuuuuuuucuuaaaaaucgucuuaagcucuaagguggucucaguau

SEQ ID NO: 323612 - RNA, 64 nt, hsa
uaaauguaaaauauuugagaauaaguucauacaaucgucuuaaguuuuuuaugccuuuauauac

SEQ ID NO: 323613 - RNA, 64 nt, hsa
aagcgccgacugacuuaugguuuugauucaagaaucgucuuauucuggaaguagaucugaauag

SEQ ID NO: 323614 - RNA, 64 nt, hsa
cccucguccccauguccccacgcagggcucuccuucgucuuaggaucuguccagcgcugcucug

SEQ ID NO: 323615 - RNA, 64 nt, hsa
uccucagaaaugcuccaccuguaagaacagaaaaucgucuuauaguugagaauuuauccucaag

SEQ ID NO: 323616 - RNA, 64 nt, hsa
aacacugcaggcaucacagcuaacaauugugaagucgucuuaacucaccauaaaaaggaaucca

SEQ ID NO: 323617 - RNA, 64 nt, hsa
uucugguagaagugagcacuguucacuugugcagucgucuuauuuuccuucuuccuagaugacu

SEQ ID NO: 323618 - RNA, 64 nt, hsa
uagacaguuuaguuuuggggaacagaagcucucuucgucuuaagccagauucucugauucuuuu

SEQ ID NO: 323619 - RNA, 64 nt, hsa
guccguguuucagguuccacgcgagucaccucuuucgucuuaauguucaccguccacagcuuug

SEQ ID NO: 323620 - RNA, 64 nt, hsa
aucauuuuucaccuguacaaggaauacuaauggaucgucuuaaaauuggucuaggaaaaaaccu

SEQ ID NO: 323621 - RNA, 64 nt, hsa
uacagaucagcugcccccccacguagccuggacaucgucuuauccccauaauccuugccauccc

SEQ ID NO: 323622 - RNA, 64 nt, hsa
uugcuuuaaagcaauuggucuaaaauauauguaaucgucuuaauuaaaaaguugcaguaggguu

SEQ ID NO: 323623 - RNA, 64 nt, hsa
gccccucggagcucccccugccuccuccuccuccucgucuuaggggggucucccugcaaugcag

SEQ ID NO: 323624 - RNA, 64 nt, hsa
uuacaaaaagggagauuuuuccuuuguuaaaccaucgucuuauaagcaauagcaaauucauguu

SEQ ID NO: 323625 - RNA, 64 nt, hsa
ccuccgucccucuguccacuuguggguccuggggucgucuuagcagagccaccgccaagguuug

SEQ ID NO: 323626 - RNA, 51 nt, hsa
augcugaggagaagcaauaaaucgucuuauuuuauuuucuuuuccucucuu

SEQ ID NO: 323627 - RNA, 64 nt, hsa; identical to SEQ ID NO: 271308

SEQ ID NO: 323628 - RNA, 64 nt, hsa; identical to SEQ ID NO: 271309

SEQ ID NO: 323629 - RNA, 64 nt, hsa; identical to SEQ ID NO: 271310

SEQ ID NO: 323630 - RNA, 64 nt, hsa; identical to SEQ ID NO: 271311

SEQ ID NO: 323631 - RNA, 64 nt, hsa; identical to SEQ ID NO: 271312

SEQ ID NO: 323632 - RNA, 64 nt, hsa; identical to SEQ ID NO: 271313

SEQ ID NO: 323633 - RNA, 64 nt, hsa; identical to SEQ ID NO: 271314

SEQ ID NO: 323634 - RNA, 64 nt, hsa; identical to SEQ ID NO: 271315

SEQ ID NO: 323635 - RNA, 64 nt, hsa; identical to SEQ ID NO: 271316

SEQ ID NO: 323636 - RNA, 64 nt, hsa; identical to SEQ ID NO: 271317

SEQ ID NO: 323637 - RNA, 64 nt, hsa; identical to SEQ ID NO: 271318

SEQ ID NO: 323638 - RNA, 64 nt, hsa; identical to SEQ ID NO: 271319

SEQ ID NO: 323639 - RNA, 64 nt, hsa; identical to SEQ ID NO: 271320

SEQ ID NO: 323640 - RNA, 64 nt, hsa; identical to SEQ ID NO: 271321

SEQ ID NO: 323641 - RNA, 64 nt, hsa; identical to SEQ ID NO: 271322

SEQ ID NO: 323642 - RNA, 64 nt, hsa; identical to SEQ ID NO: 271323

SEQ ID NO: 323643 - RNA, 64 nt, hsa; identical to SEQ ID NO: 271324

SEQ ID NO: 323644 - RNA, 64 nt, hsa; identical to SEQ ID NO: 271325

SEQ ID NO: 323645 - RNA, 64 nt, hsa; identical to SEQ ID NO: 271326

SEQ ID NO: 323646 - RNA, 64 nt, hsa; identical to SEQ ID NO: 271327

SEQ ID NO: 323647 - RNA, 64 nt, hsa; identical to SEQ ID NO: 271328

SEQ ID NO: 323648 - RNA, 64 nt, hsa; identical to SEQ ID NO: 271329

SEQ ID NO: 323649 - RNA, 64 nt, hsa; identical to SEQ ID NO: 271330

SEQ ID NO: 323650 - RNA, 64 nt, hsa; identical to SEQ ID NO: 271331

SEQ ID NO: 323651 - RNA, 64 nt, hsa; identical to SEQ ID NO: 271332

SEQ ID NO: 323652 - RNA, 64 nt, hsa; identical to SEQ ID NO: 271333

SEQ ID NO: 323653 - RNA, 64 nt, hsa; identical to SEQ ID NO: 271334

SEQ ID NO: 323654 - RNA, 64 nt, hsa; identical to SEQ ID NO: 271335

SEQ ID NO: 323655 - RNA, 59 nt, hsa; identical to SEQ ID NO: 271336

SEQ ID NO: 323656 - RNA, 64 nt, hsa; identical to SEQ ID NO: 271337

SEQ ID NO: 323657 - RNA, 64 nt, hsa; identical to SEQ ID NO: 271338

SEQ ID NO: 323658 - RNA, 64 nt, hsa; identical to SEQ ID NO: 271339

SEQ ID NO: 323659 - RNA, 64 nt, hsa; identical to SEQ ID NO: 271340

SEQ ID NO: 323660 - RNA, 64 nt, hsa
cucuuccuaaggaugcuuguguugccucaaucuaucaaucuaucuuucuuguuuuggguuguuu

SEQ ID NO: 323661 - RNA, 64 nt, hsa
ucuuccuucucuuccuaaggaugcuuguguugccucaaucuaucaaucuaucuuucuuguuuug

SEQ ID NO: 323662 - RNA, 64 nt, hsa
gagaguuagcuacuagcugccuaagugugcacuuucaaucuaacugugaaagaaucuucugaug

SEQ ID NO: 323663 - RNA, 64 nt, hsa
uuauauuaacgaaauaaaucaaguugugguauagucaaucuauuucuuaauaauacugcaaaaa

SEQ ID NO: 323664 - RNA, 64 nt, hsa
uaccacuacggccaccccaaaggaccccgacgccaacagacagucaaacgcugauguugcgggc

SEQ ID NO: 323665 - RNA, 64 nt, hsa
aaucaccaccacgaggacaagagggcaaaagcaaaacagacaaaaagaaaaaaaaucgccgucu

SEQ ID NO: 323666 - RNA, 64 nt, hsa
auauuacaacauuuaugugagguaauuauugcucaacagacaauuagaaaaaaguccacacuug

SEQ ID NO: 323667 - RNA, 64 nt, hsa
aguccuggcccuggcccuuacuauuaggaaaauaaacagacaaaaacaaguaaauauauauggu

SEQ ID NO: 323668 - RNA, 64 nt, hsa
cccuucuuucagagagaacuacuguuaacauuuuaacagacaacuucauucuuuuccuauucuu

SEQ ID NO: 323669 - RNA, 64 nt, hsa
guuuagagguuaaaaugacacauuggggguaaauaacagacacuauauguuggaguugggaauc

SEQ ID NO: 323670 - RNA, 64 nt, hsa
cuucugcacagaaaaagaaacuagcaacacaguaaacagacagccuguagaauggggaaaacua

SEQ ID NO: 323671 - RNA, 64 nt, hsa
agaaaaaacccaauuaaaauugggcaaaggcaugaacagacacuuuucaaaagaagaccuacaa

SEQ ID NO: 323672 - RNA, 64 nt, hsa
gucagagaugguggugaggcugcagagcaaaagaaacagacacuguuggugggaaagcaaacuu

SEQ ID NO: 323673 - RNA, 64 nt, hsa
aaaccaccccauuaaaaagugggcaaaggacaugaacagacacuuuucaaaagaagacaucugu

SEQ ID NO: 323674 - RNA, 64 nt, hsa
gagcugcacagcaaaagaaacuaucaagagaguaaacagacagcuuacagaaugggagaaaauu

SEQ ID NO: 323675 - RNA, 64 nt, hsa
gguagaaguuacacagcaauuuagcaauguuguuaacagacauacagaauugugugugugugug

SEQ ID NO: 323676 - RNA, 64 nt, hsa
ugacaaaacaccuaagacuggguaguuuauaaagaacagacauucaggccaggcacggugacuc

SEQ ID NO: 323677 - RNA, 64 nt, hsa
caaauauaugcauuguguaauccacucagaauuaaacagacaaaagguaugcuugcuuuggaau

SEQ ID NO: 323678 - RNA, 64 nt, hsa
gcccuccaagucacacaagcuccaagacuaaacaaacagacagguccucugucuuaaaaagguu

SEQ ID NO: 323679 - RNA, 64 nt, hsa
gcgggccuucaagucucacuguuccguaugaggaaacagacagcggacugaggaagcgauggcc

SEQ ID NO: 323680 - RNA, 64 nt, hsa
agaaacaaacaaaauauauauauauauguccaaaaacagacaaauccaagggugugagguaaac

SEQ ID NO: 323681 - RNA, 64 nt, hsa
ggguacucacugggagugaaaaugacuucuucacaacagacauauuucugcuucuguguuuuug

SEQ ID NO: 323682 - RNA, 64 nt, hsa
gugagugaaauuaauguuacauuuuccagcuguaaacagacaucugcauuuccuagugagcugc

SEQ ID NO: 323683 - RNA, 64 nt, hsa
aucugugcuuauuacacaaaauuacuuugugguaaacagacaguauuguaaucccaucaaaaga

SEQ ID NO: 323684 - RNA, 64 nt, hsa
agccauaguucugaaugcacuucaauuaagccaaaacagacagcuagugaucuuuuuauaugcu

SEQ ID NO: 323685 - RNA, 64 nt, hsa
uguugucaaacaucuucagggaaaucaacaagccaacagacaagaaggagcgaaagugaguauc

SEQ ID NO: 323686 - RNA, 64 nt, hsa
gucugagagucuuccacgaccggcugaucagugaaacagacaagcagcuggucaguacauccaa

SEQ ID NO: 323687 - RNA, 64 nt, hsa
acgaacccaccugcugagagacccaaggaggaaaaacagacaaaaacagccucacagaagaaua

SEQ ID NO: 323688 - RNA, 64 nt, hsa
cgcugccuaaguggcugcugacugauguugagggaacagacaggagaaaugcauccauuccuca

SEQ ID NO: 323689 - RNA, 64 nt, hsa
acuauucuagauccagaagaugcaauguugaacaaacagacaaagcccugcccucagaaggcug

SEQ ID NO: 323690 - RNA, 64 nt, hsa
gguuuucagauccauuccaaccugacugaauguuaacagacagaauucuucacauuaaggaacu

SEQ ID NO: 323691 - RNA, 64 nt, hsa
gccccucagcaaggaugacucagcacugccgcucaacagacaugacucagggauggcuuaguac

SEQ ID NO: 323692 - RNA, 64 nt, hsa; identical to SEQ ID NO: 323691

SEQ ID NO: 323693 - RNA, 64 nt, hsa
gccccucaccaaggaugacucagcacugccgcucaacagacaugacucagggauggcuuaguac

SEQ ID NO: 323694 - RNA, 64 nt, hsa
cagacucagcagggaugacucagcacugccccucaacagacaugacucagcagggaugacucag

SEQ ID NO: 323695 - RNA, 64 nt, hsa
gacagacagacacagccugaaacagacccagacaaacagacagacagacacagccugaaacaga

SEQ ID NO: 323696 - RNA, 64 nt, hsa
gacagacagacacagauugaaacagacccagacaaacagacagacacagccugaaacagaccca

SEQ ID NO: 323697 - RNA, 64 nt, hsa
gacagacaggcagacguagucugaaacagaccugaacagacagacagacgcacacacacaacag

SEQ ID NO: 323698 - RNA, 64 nt, hsa
uaggacaccagagagcugauuuuucaagggauccaacagacagaaauucacccucauacaucug

SEQ ID NO: 323699 - RNA, 64 nt, hsa
gauuacuuguacuuucuaaucugcccaguguuacaacagacacuaccauguggcauauccucac

SEQ ID NO: 323700 - RNA, 64 nt, hsa
gaaggcaucaucuuggaaacagacaugagcccucaacagacaacugcaccuacugauguuuuga

SEQ ID NO: 323701 - RNA, 64 nt, hsa
uccaaaagaugcagcaugaaggcaucaucuuggaaacagacaugagcccucaacagacaacugc

SEQ ID NO: 323702 - RNA, 64 nt, hsa
aauguguuuuaaaauauaaagcuacauccaaagaaaugccaauaugugacauuaguaugaaauu

SEQ ID NO: 323703 - RNA, 64 nt, hsa
uauagacauggugguaggaauagcaacuaauacaaaugccaauaugauaauaaaauacauuugu

SEQ ID NO: 323704 - RNA, 64 nt, hsa
uuuauuuauacuauauucugcauacaguacuuuaaaugccaauuacagugcaaucuuuauuuau

SEQ ID NO: 323705 - RNA, 64 nt, hsa
uguuuuuaaaaagauaagagcaucuagugcauuaaaugccaaaaaaaaaauacauuaucaguga

SEQ ID NO: 323706 - RNA, 64 nt, hsa
ggaauaaggaagagaagauugaccaaaccauccaaaugccaaaaagaaaaagaaaaaaaaaagc

SEQ ID NO: 323707 - RNA, 64 nt, hsa
gcgaaugccccauagcagaagucccgggaagguaaaugccaaacccagagccaugugagauucu

SEQ ID NO: 323708 - RNA, 64 nt, hsa
agauauuuuuucuuauuugaguccaccaaaggauaaugccaacuuauauaaguucucaaaucau

SEQ ID NO: 323709 - RNA, 64 nt, hsa
gcuuggaaugagaaggggaaggaaagaauuaacaaaugccaagauuucuggagcagauuguaca

SEQ ID NO: 323710 - RNA, 64 nt, hsa
cuguaaguauggaucaaauugcaaaauaaagaaaaaugccaaccuuagaaaagacaauaaaugc

SEQ ID NO: 323711 - RNA, 64 nt, hsa
acuaagcauaaccaaauuucagaacagucuaaucaaugccaaguauccaaggcaaacucuaaua

SEQ ID NO: 323712 - RNA, 64 nt, hsa
uccugugguuggucagaaagauaagccaguugauaaugccaaauguaguaucaaaggaggcucu

SEQ ID NO: 323713 - RNA, 64 nt, hsa
uucugaugacucacaugauggggagucugaaucaaaugccaaaguagcugauguauuggacguu

SEQ ID NO: 323714 - RNA, 64 nt, hsa
aaggcugauaaccuauaugugauggagaucacccaaugccaagggcagaaagcaaaccuaguua

SEQ ID NO: 323715 - RNA, 64 nt, hsa
acauugagaagugguuaucauuguuaaugugguuaaugccaaaaagugguuaauauuaauaaga

SEQ ID NO: 323716 - RNA, 64 nt, hsa
acagagaugugcauguggguauuguuaggaaaugucaucaaacuccacccaccuggcuucauac

SEQ ID NO: 323717 - RNA, 64 nt, hsa
uucacacaaugcccaacuuacugucuucuucaugucaucaaaaucugcacagucacuggcccaa

SEQ ID NO: 323718 - RNA, 64 nt, hsa
ugcccuaugacauuucuacaucacuggcugcucuucaucaaaccuacuauaaaaaacauucaag

SEQ ID NO: 323719 - RNA, 64 nt, hsa
auaaaaacauaaauaauaccauaauacauggcuaucaucaaaaguguauagaauauuauaguuu

SEQ ID NO: 323720 - RNA, 64 nt, hsa
gaugaauguuugaugcuaugaaaagcuuuccauaucaucaaaacuaauuuguguagauuuuugc

SEQ ID NO: 323721 - RNA, 64 nt, hsa
ugauucaccuucagggggcugauaaccuaguaaaucaucaaaaugagaucauaaguguuaaugu

SEQ ID NO: 323722 - RNA, 64 nt, hsa
auugguuaguuuguucagauguugugcacagacaucaucaaaauuagcuaacauggguauuuuu

SEQ ID NO: 323723 - RNA, 64 nt, hsa
caguaguacuucaaagaagauagcuguauaaaugucaucaaacuauacuauauagagaaucuua

SEQ ID NO: 323724 - RNA, 64 nt, hsa
auaaagcugugauuauaucaaaaauccagauaaaucaucaaauauaucagauuaagaccagggu

SEQ ID NO: 323725 - RNA, 64 nt, hsa
auauucucacaauauagguuuuggggcuuccauaucaucaaaagacugaaaaauuauaauuuua

SEQ ID NO: 323726 - RNA, 64 nt, hsa
agaacuccuagcaccacggggaagaauagagguaucaucaaacguggcaaauuuucuuucagga

SEQ ID NO: 323727 - RNA, 64 nt, hsa
aucuugacaauuuacuuaacaaguaaccaguaguucaucaaaaccaacuuguacagacuaauaa

SEQ ID NO: 323728 - RNA, 64 nt, hsa
aagcuaccaguaagacaagugggaagaggcacguucaucaaaccuguuacuaaaccagccuagu

SEQ ID NO: 323729 - RNA, 64 nt, hsa
ucuucccucucuccugccuuuaugaggaaacugaucaucaaaaguucccacucccuacuucugc

SEQ ID NO: 323730 - RNA, 64 nt, hsa
gacccacucugaccccacuaaaaugaccccugauucaucaaaagugaggccuagaauuacccua

SEQ ID NO: 323731 - RNA, 64 nt, hsa
agguaucauuaucaguuacaaauugaguuauucuucaucaaaugacuuuuggaguagagauuuu

SEQ ID NO: 323732 - RNA, 64 nt, hsa
aggcaagugggguuuaaacagacccacagucuacucaucaaaccagguguccuuggcauugugu

SEQ ID NO: 323733 - RNA, 64 nt, hsa
ccucucagaggauacauuuguaaccauuacacagucaucaaaggaauaauuuuuuuuaaucacc

SEQ ID NO: 323734 - RNA, 64 nt, hsa
acaaaacacagcaaacauaaaaaguuguuacacuucaucaaaaguacaaaguucuguucaucaa

SEQ ID NO: 323735 - RNA, 64 nt, hsa
guuguuacacuucaucaaaaguacaaaguucuguucaucaaaugaugcuguuaagauagggaaa

SEQ ID NO: 323736 - RNA, 64 nt, hsa
acuguuuaaaaaauugagcucaucaaaaauauugucaucaaauacaggugguuaaucugacaua

SEQ ID NO: 323737 - RNA, 64 nt, hsa
ccaguaauaguauugacuguuuaaaaaauugagcucaucaaaaauauugucaucaaauacaggu

SEQ ID NO: 323738 - RNA, 64 nt, hsa
ccagggcaagggggccaucacugcagucaggcccucagaggaguccugcaggcuuccuaccagu

SEQ ID NO: 323739 - RNA, 64 nt, hsa
gacacucucgcauacuuugccaaaugaggccugcucagaggaguaggagcugaaagauggugcc

SEQ ID NO: 323740 - RNA, 64 nt, hsa
cagagacuggcagccagggagcccggggcagagcucagaggagucugggaaggggcgugucccu

SEQ ID NO: 323741 - RNA, 64 nt, hsa
ccccaagaggcuagccccagggugagcagggcccucagaggaaaggcaguauggcggaggccau

SEQ ID NO: 323742 - RNA, 64 nt, hsa
uuaggggauccugaugccacuuagcagugggauuucagaggaccuuucagaggagcuaagguaa

SEQ ID NO: 323743 - RNA, 64 nt, hsa
gaugccacuuagcagugggauuucagaggaccuuucagaggagcuaagguaagaugagauggag

SEQ ID NO: 323744 - RNA, 64 nt, hsa
gaagaucagugaucuugggucauugaucccuggcucagaggauagcgguuuccaucauaaacca

SEQ ID NO: 323745 - RNA, 64 nt, hsa
ggcuggcauucgagacuuccuccuguucccugggucagaggauagcgguuuccaucauaaacca

SEQ ID NO: 323746 - RNA, 64 nt, hsa
uugggguucccaaggcacccugugccugcuucccucagaggaccuuccaauccauuugccccgc

SEQ ID NO: 323747 - RNA, 64 nt, hsa
cgguucucuccuagccucagcccccagcugggucucagaggagcugggggagcgguggccagcc

SEQ ID NO: 323748 - RNA, 64 nt, hsa
gacucugggacuccugagaugggagaggcagggaucagaggacgaacaggugggacuuugcgag

SEQ ID NO: 323749 - RNA, 64 nt, hsa
ggaagauaccagcuuuuucucucaggguucugagucagaggacaccauccaagaauguuguuag

SEQ ID NO: 323750 - RNA, 64 nt, hsa
cuagugaaugugccuuaaaaaucaagacacuaguucagaggaagcacauaauguccagaucuau

SEQ ID NO: 323751 - RNA, 64 nt, hsa
ugugaggagugagggaacccuggggcucacccucucagaggaagggcacagagaggaagggaag

SEQ ID NO: 323752 - RNA, 64 nt, hsa
ggcgaauucccuguggccugccaugccuucggcaucagaggauggaguggucgaggcuagugga

SEQ ID NO: 323753 - RNA, 64 nt, hsa
aagagugaacuucuuaugggaggcugcagcuggaucagaggaaaaauccagugugacagagugc

SEQ ID NO: 323754 - RNA, 64 nt, hsa
cuagacaguaacuucuaaggucacguuuacuauuucagaggaaauaucuugccaggauaccuac

SEQ ID NO: 323755 - RNA, 64 nt, hsa
caacauaggccugcucagccucuagcaccaggacucagaggaugaggucaauuuccugaugcau

SEQ ID NO: 323756 - RNA, 64 nt, hsa
gaaauaccagggcuugugccccgcuauuccucacucagaggaagacuuugauccaggugccaag

SEQ ID NO: 323757 - RNA, 64 nt, hsa
agcaggcaacagugugggauaaacagagucacgaucagaggaaccccagggucuggugauggca

SEQ ID NO: 323758 - RNA, 64 nt, hsa
gauauauauauauauauaaauaauauacuuuuccucagaggagcaggcaacagugugggauaaa

SEQ ID NO: 323759 - RNA, 64 nt, hsa
acccaaaucccaucucaauuuuaauccccaugugucagaggagggccuuggugggagaugacug

SEQ ID NO: 323760 - RNA, 64 nt, hsa
gacuguuuuaucuugcagguaagcuuuacagcuuucagaggaguuguaguacacuacagaaaua

SEQ ID NO: 323761 - RNA, 64 nt, hsa
ggcaggagagggauauggagagcaggugguggaaucagaggacgaggcugcucuaaagacuguu

SEQ ID NO: 323762 - RNA, 64 nt, hsa
gagaacagcuggcccaggagcuaccacuggcuacucagaggaggcucauuagcuggcuacaugc

SEQ ID NO: 323763 - RNA, 64 nt, hsa
cacgaggaugcccagugagagcuucuagcugaucucagaggaccagagugacugaggguaaagu

SEQ ID NO: 323764 - RNA, 64 nt, hsa
ccucuucugcagguccagcccuggcgagggcaggucagaggaagugaagaaaucaagagcaaag

SEQ ID NO: 323765 - RNA, 64 nt, hsa
uaaacugccuuguaaacaaaaaugagagcuugagucagaggaagccgagacaauauccuuccuc

SEQ ID NO: 323766 - RNA, 64 nt, hsa
gggcacugugguugcugugguuggaauucuucuuucagaggagcgccuggggcuccugcaaguc

SEQ ID NO: 323767 - RNA, 64 nt, hsa
ugacuuaaugcuuaaaaguauaucauaguuuucuuacggaaaagaucaguagaugagauugggg

SEQ ID NO: 323768 - RNA, 64 nt, hsa
cuccaggaugagcuaucccaucuucaggaguuauuacggaaauggacaccaagaauaucuccug

SEQ ID NO: 323769 - RNA, 64 nt, hsa
auaacuuuguugauacguaaauugucuugggguuuacggaaauuaacuauuauguuugcacuaa

SEQ ID NO: 323770 - RNA, 64 nt, hsa
uuuuagauuggaagauagcacucuagaguggacauacggaaagacugugacuuuauuuuguaau

SEQ ID NO: 323771 - RNA, 64 nt, hsa
ucuuacauugcagaacuaaugguaaaguaaauuuuacggaaaaaguuaagauagcuuugggaac

SEQ ID NO: 323772 - RNA, 64 nt, hsa
agucugguggagguggagugggcacgccuuagccuacggaaaggcccauuucugggcccacuga

SEQ ID NO: 323773 - RNA, 64 nt, hsa
accuguuauuuaucaauuuuucccaguauuuuuauacggaaaaaauuguauugaaaacacuuag

SEQ ID NO: 323774 - RNA, 64 nt, hsa
aaaaaaguauagaguuggaaacucugggaaaacuuacggaaauacacaaaugcuucucuguaau

SEQ ID NO: 323775 - RNA, 64 nt, hsa
aaagagcauagagaaacaaaaaucuuuuaugauguacggaaaaaaaccaugcugauacagcugg

SEQ ID NO: 323776 - RNA, 64 nt, hsa
ugugacuuuuuuuccucuaauaucaauuuuacaguacggaaauaguauuuuaaaauaguauugg

SEQ ID NO: 323777 - RNA, 64 nt, hsa
aauaaaaggguaaccagaacggcccacucucuuuuacggaaaaaucccuaggcuuuggagaucc

SEQ ID NO: 323778 - RNA, 64 nt, hsa
aguuuuuaauacauugguuaggacucagaggaaauacggaaaaaacauuguagaugguuaauuu

SEQ ID NO: 323779 - RNA, 64 nt, hsa
gguuagaaauauuuuguggcaaugaagaaaacacuacggaaaauaaaaaauaagauaaagccuu

SEQ ID NO: 323780 - RNA, 64 nt, hsa
uguuuaucacaaaagacuguauuugaaauaugcauacggaaaauugaaauuauauuaguaauaa

SEQ ID NO: 323781 - RNA, 64 nt, hsa
acauacacaacaacauagggaguuguaugacugauacggaaaacuuccagaaaguuuuaaucaa

SEQ ID NO: 323782 - RNA, 64 nt, hsa
aauuucuagguguuugggucacaguuccuacaaauacggaaaaggggguuaaaaagcagugcuu

SEQ ID NO: 323783 - RNA, 64 nt, hsa
gagaaaaauccuguucaaccuggguucucccaguuacggaaaccuuuuaaagauccacauuagc

SEQ ID NO: 323784 - RNA, 64 nt, hsa
cagagcuggaaauggggggugggggacagauucuuacggaaauuuuuuuaccugacuugcuaug

SEQ ID NO: 323785 - RNA, 64 nt, hsa
gauggcuuccaggcaaggaaguucuaucuugugauacggaaacaauaaauuccugagauacauu

SEQ ID NO: 323786 - RNA, 64 nt, hsa
ucacaguaaagggaaacccugccagugugaugaguacggaaaagucuucagagguuggaacuug

SEQ ID NO: 323787 - RNA, 64 nt, hsa
gccagcacucugaaacugagaaauguucagaauguacggaaagaugaucagcuauuuucaacau

SEQ ID NO: 323788 - RNA, 64 nt, hsa
ggguauuauaaauuuagagugauuggugguauauuacggaaauacggaaccuuuagggauaguu

SEQ ID NO: 323789 - RNA, 64 nt, hsa
uccuguguugugcugggagcaggacugauugaauuacggaaaaugccuguaaagucugaguaag

SEQ ID NO: 323790 - RNA, 64 nt, hsa
aauucuuaccacagcaaaggcauaagaugcuugauacggaaaaucagaaacuuaacucuuuugu

SEQ ID NO: 323791 - RNA, 64 nt, hsa
gaugcuagccaucuccaggagacaggaucaguuuuacggaaacaacucaguuaguauagagaug

SEQ ID NO: 323792 - RNA, 64 nt, hsa
gggagguaucaaggagcauaauuaaacuugucaauacggaaaguuguuuuuucuaacacaacaa

SEQ ID NO: 323793 - RNA, 64 nt, hsa
cuaagaacugucuucucagcaguugauccagcuguacggaaauuuaggguauuuaaacuuuuaa

SEQ ID NO: 323794 - RNA, 64 nt, hsa
aaaaauucuuaucccuugcugcucagaaaaaguuuacggaaaacaccaguucacuaaaagcacc

SEQ ID NO: 323795 - RNA, 64 nt, hsa
uguaauauguaacuauucuaauccaguggaaucuuacggaaaacacagagaaaaccccuuuuau

SEQ ID NO: 323796 - RNA, 64 nt, hsa
aguugucagaagacaucauugguucuguguuuccuacggaaauaagaaacgauaaauauugcac

SEQ ID NO: 323797 - RNA, 64 nt, hsa
cugugguucccucucauuugucccaguuacuaacuacggaaauagcauccucugcuggugcuaa

SEQ ID NO: 323798 - RNA, 64 nt, hsa
ccaccucuccugggggccuggagaggacugagccuacggaaaggggauaccuucccacucagca

SEQ ID NO: 323799 - RNA, 64 nt, hsa
acauuuuauuccuacuuucagaagaaaaauauaauacggaaaaaauuauagauuuacuuguagc

SEQ ID NO: 323800 - RNA, 64 nt, hsa
agugccaugauugauuagcaaugucugcacuggauacggaaaaaagaaggugcuugcagguuua

SEQ ID NO: 323801 - RNA, 64 nt, hsa
auauuucuuugcacugaggccuugcugcuguggauacggaaaugguuaaguacugugcuuccuc

SEQ ID NO: 323802 - RNA, 64 nt, hsa
aaagauaugaugucagaauaaaauguggaaaacauacggaaaacuagucuagacuuuaaagaau

SEQ ID NO: 323803 - RNA, 64 nt, hsa
acaugggagggcuagccccgggacuuggggccaauacggaaacccuaccccuuccaugcucauc

SEQ ID NO: 323804 - RNA, 64 nt, hsa
ggcugcugcaccgcguuuccauagcagcauguccuacggaaacccagcacguguguagagccuc

SEQ ID NO: 323805 - RNA, 64 nt, hsa
gauggguguacagauuuguauauaaugucauuuuuacggaaacccuuucggcgugcauaaggaa

SEQ ID NO: 323806 - RNA, 64 nt, hsa
gaccauuaagcuauauguuuagaaauggucauuuuacggaaaaauuagaaaaauucugauaaua

SEQ ID NO: 323807 - RNA, 64 nt, hsa
auuaacucuguucugccuggaaauuuaggcuucauacggaaaguguuugagagcaaguaguuga

SEQ ID NO: 323808 - RNA, 64 nt, hsa
uuauacuccauaccugcuuuucccauggccgcccuacggaaaaucccauccacagaggccaggg

SEQ ID NO: 323809 - RNA, 64 nt, hsa
uuuauggacuuauuucuccccaggaaaugauucuuacggaaaaaaauugcuuuuguauguagaa

SEQ ID NO: 323810 - RNA, 64 nt, hsa
guuuugucugaguucaaacuagugccuguguuguuacggaaagcagcaguguaccagugucacu

SEQ ID NO: 323811 - RNA, 64 nt, hsa
ccaacgaugagcauuucuuaggcucagcucuugauacggaaacgagugucuucacuccagccag

SEQ ID NO: 323812 - RNA, 64 nt, hsa
guuuuccuuuggaauauggauaaauacaccaugauacggaaacuagaaggacaucaccaugaug

SEQ ID NO: 323813 - RNA, 64 nt, hsa
aguagcagaauuaacacaggguuuuaacuugcaauacggaaaagacauuucaguugagaaugaa

SEQ ID NO: 323814 - RNA, 64 nt, hsa
ccuguuuuugguugguaguuaagcaaacugacauuacggaaagugccuuagacacuacaguacu

SEQ ID NO: 323815 - RNA, 64 nt, hsa
cuggguaggccccacaaggccuggucugggaguauacggaaacaaaaaugauccucagugcaaa

SEQ ID NO: 323816 - RNA, 64 nt, hsa
acacgugcuccugugaacuuuccaugguuaugucuacggaaaaugccacuagagagagagugau

SEQ ID NO: 323817 - RNA, 64 nt, hsa
ucagagauguauauauugugaauuacugcuuaauuacggaaagaguuucuuagguucuauguga

SEQ ID NO: 323818 - RNA, 64 nt, hsa
acuggcugggaguggggagggcguggagacagucuacggaaagcgcuagcagacccccgagagg

SEQ ID NO: 323819 - RNA, 53 nt, hsa
gguacugguggaaaaacugaagauacggaaaccugccccacucacacccaucu

SEQ ID NO: 323820 - RNA, 64 nt, hsa
acacggacccauagacagcccugggggagccucuuacggaaaauccgacaagccuucagccaca

SEQ ID NO: 323821 - RNA, 64 nt, hsa
cagggcuuggcaacugaaauagcuauguggcggauacggaaaacagaggacaauuugaggaucu

SEQ ID NO: 323822 - RNA, 64 nt, hsa
ccaaaaaaauugaaggaauaucaccagcauguuguacggaaacucucccacugaagcaggcuuu

SEQ ID NO: 323823 - RNA, 64 nt, hsa
guucgucgugguugagaugauuaccucggacgucuacggaaacgagcgggcgcauuguuguccg

SEQ ID NO: 323824 - RNA, 64 nt, hsa
auuuaaaacaaagcaacccccuuuccccuaccacuacggaaaagagcaagcucauuuuuccgug

SEQ ID NO: 323825 - RNA, 62 nt, hsa
cucugggucauauggugcagacugugaccagcaccaggcaggcaguccugucugcgugugga

SEQ ID NO: 323826 - RNA, 62 nt, hsa
aagguuggagucugcuggugcgguguuuacacaccaggcagggcugucugccaccuugugug

SEQ ID NO: 323827 - RNA, 62 nt, hsa
ucuuuggguuuagaagaccaaguauggggaaaaccaggcaccagccucugcagcaauggguc

SEQ ID NO: 323828 - RNA, 62 nt, hsa
gcagcauggaacaugcagcugggcuuccugugaccaggcacccucuggcacuguugcuugcc

SEQ ID NO: 323829 - RNA, 62 nt, hsa
aggcugaggauggccugaaccuggagcagcggaccaggcagacgggcugaagugggguccca

SEQ ID NO: 323830 - RNA, 62 nt, hsa
auggcuaaauauuuauggagggccuacuguggaccaggcacugggcuaaauacuuacauuua

SEQ ID NO: 323831 - RNA, 62 nt, hsa
uguccuuugaggggcugauggcaauaucuaaaaccaggcaccagcaugaacaccaagcuggg

SEQ ID NO: 323832 - RNA, 62 nt, hsa
ugauucacagugugaaucuuggugucuacguuaccaggcaggaaggcugagaggagagagac

SEQ ID NO: 323833 - RNA, 62 nt, hsa
cugaugcaagcaagaaacacugggcuucuagaaccaggcaacuugggaacuagacucccaag

SEQ ID NO: 323834 - RNA, 62 nt, hsa
ucauuucauccuggucagucuagagucugugcaccaggcaguccauccacugaaggcugugu

SEQ ID NO: 323835 - RNA, 62 nt, hsa
ucauuccucaggcacuugagugacaguuguuuaccaggcacuguguguagccccaggguuug

SEQ ID NO: 323836 - RNA, 62 nt, hsa
auucaucccuucaguucuggagaaagccugauaccaggcacagccuacugaccccaaggagc

SEQ ID NO: 323837 - RNA, 62 nt, hsa
uaggaaccuucuuggagaccccuuugaagaaaaccaggcagccaagggagccaaacacacua

SEQ ID NO: 323838 - RNA, 62 nt, hsa
ugggcaaggcgcucaggcaugcaaccaugggcaccaggcaauacccauccaucacccaucuc

SEQ ID NO: 323839 - RNA, 62 nt, hsa
cuaucucacacugcaccaagcacccacugugcaccaggcacuaagucucuagccucuuucuc

SEQ ID NO: 323840 - RNA, 62 nt, hsa
ucauggcacuuuuuaacgcuucagcaacaaacaccaggcagcuguugccacuggccuccuac

SEQ ID NO: 323841 - RNA, 62 nt, hsa
agaggugagaauggggaggcaagaucucaggcaccaggcaggaggugccuuguaagcuaacu

SEQ ID NO: 323842 - RNA, 62 nt, hsa
ccaucucuggaugccugauugccaagcucaggaccaggcaaugugacuuugcaucagcaaca

SEQ ID NO: 323843 - RNA, 62 nt, hsa
ugggccugggguaccaagagacuccuugagagaccaggcaaagcaagugauugggacagagg

SEQ ID NO: 323844 - RNA, 62 nt, hsa
gccauccagggcuacccacugcuuacucagggaccaggcagcccccauggcaguaaaagcag

SEQ ID NO: 323845 - RNA, 62 nt, hsa
aagcccuggcuggccccacuugguaccaauccaccaggcagcucagggcuccugcccagccc

SEQ ID NO: 323846 - RNA, 62 nt, hsa
accuacgagugaaacucuguccucccgcgaggaccaggcaucgcugugugaggacggcacgg

SEQ ID NO: 323847 - RNA, 62 nt, hsa
ggggagccauccccgccgcccucacaggacccaccaggcagcggagacauguggaauuagag

SEQ ID NO: 323848 - RNA, 62 nt, hsa
gccggcaggcgccccuguacgucugcucaugcaccaggcagcacagccgcaguuccucaguu

SEQ ID NO: 323849 - RNA, 62 nt, hsa
gccaccagugauccccaagcauccaguacagaaccaggcaucgagcuagcucccugcacggc

SEQ ID NO: 323850 - RNA, 62 nt, hsa
uggugccaaaccccaaaucuccaaagagacauaccaggcaagacaaacccccaaacaccucc

SEQ ID NO: 323851 - RNA, 62 nt, hsa
ucuggccugcacccuugacaaaggaccccaggaccaggcagaaggcgccuccguccuagcca

SEQ ID NO: 323852 - RNA, 62 nt, hsa
gcugugugaccauccagggguggagggggaaaaccaggcaauuucguuccuggaaucaacca

SEQ ID NO: 323853 - RNA, 62 nt, hsa
cauggcagggguggauucgggagcugggaguaaccaggcaaagucaaccagaugccuagcuc

SEQ ID NO: 323854 - RNA, 62 nt, hsa
auucugggaacauguuguaagcacugacugggaccaggcaccaggcagggucuagaaggcug

SEQ ID NO: 323855 - RNA, 62 nt, hsa
gaacauguuguaagcacugacugggaccaggcaccaggcagggucuagaaggcuguggugag

SEQ ID NO: 323856 - RNA, 62 nt, hsa
aggcuggacucagcaggaacaccaaaucccggaccaggcagaaaccacccaagacugagggg

SEQ ID NO: 323857 - RNA, 62 nt, hsa
agacuaacggcuaaagagacugaugcaucaacaccaggcagagaauaaagcagauuuuuuug

SEQ ID NO: 323858 - RNA, 64 nt, hsa
uguagacccuuucauguacuguacuguacaccugauacuguaaacauacuguaauaauaauguc

SEQ ID NO: 323859 - RNA, 64 nt, hsa
ucauguacuguacuguacaccugauacuguaaacauacuguaauaauaaugucucacauggaaa

SEQ ID NO: 323860 - RNA, 64 nt, hsa
caacuguaauucuauuuuuaauaauaaaaauggcauacuguagggucuucagaguaguguagga

SEQ ID NO: 323861 - RNA, 64 nt, hsa
uggcauacuguagggucuucagaguaguguaggaauacuguagaaauacuuuuucagaaacgaa

SEQ ID NO: 323862 - RNA, 64 nt, hsa
cugggauuacaggcgugagccacugcgcccagcuauacuguauauuuuaagaaguuccagcaug

SEQ ID NO: 323863 - RNA, 64 nt, hsa
auacuauccagcucuaagucucaacugcucuuuuauacuguacuuuuuuuuuugagacggaguu

SEQ ID NO: 323864 - RNA, 64 nt, hsa
guauuugucuaacuggggauauaauacuauauuuauacuguauauauaauacugacugagaaua

SEQ ID NO: 323865 - RNA, 64 nt, hsa
uuauacuguauauauaauacugacugagaauauaauacuguauuugagaauauaaaaaacuuuu

SEQ ID NO: 323866 - RNA, 64 nt, hsa
caagucuuuaucuccacauaugauaguguuauaaauacuguaaaagcauggaaggugcaaaacu

SEQ ID NO: 323867 - RNA, 64 nt, hsa
aagaugccucaagcauucauuauuuaugauuugaauacuguagcuauuuuuuguugcuuggcuu

SEQ ID NO: 323868 - RNA, 64 nt, hsa
auuagaaaaaaauguaaaacaugauuuaugugaaauacuguauaguaaaaguuggucuaauagu

SEQ ID NO: 323869 - RNA, 64 nt, hsa
agcuguccuuuccaacacauugcuacuuuuuuaaauacuguaucauaaguucagccugucauac

SEQ ID NO: 323870 - RNA, 64 nt, hsa
uacuuuagaagccugcauaauguuucuggauuucauacuguaacauucaggaauucuuggagaa

SEQ ID NO: 323871 - RNA, 64 nt, hsa
acugaacucuagugcgguuuacucacugcugcaaauacuguauauucaggacuugaaagaaaug

SEQ ID NO: 323872 - RNA, 64 nt, hsa
aauuugguauaauuauggugggugauuauuuuuuauacuguaugugccaaagcuuuacuacugu

SEQ ID NO: 323873 - RNA, 64 nt, hsa
acacuucugcuuucacuuaagugucuggcccgcaauacuguaggaacaagcaugaucuuguuac

SEQ ID NO: 323874 - RNA, 64 nt, hsa
auuuuggaauucugcacauucauggagugcaauaauacuguauagcuuuccccaccucccacaa

SEQ ID NO: 323875 - RNA, 64 nt, hsa
aauggucuugauugugauagcuucaagguggaacauacuguaaucuccagaugcuaggaaguua

SEQ ID NO: 323876 - RNA, 64 nt, hsa
guagaauauuucaguauuuaaguggaauuucaguauacuguacuauccuuuauaagucauuaaa

SEQ ID NO: 323877 - RNA, 64 nt, hsa
ugcuaaguaagucugaaaauguaauauuuugauaauacuguaauauaccugucacacaaaugcu

SEQ ID NO: 323878 - RNA, 64 nt, hsa
uuguagauauauauuuccaaauauucuaaaaaagauacuguauaugucaaaaauauuuuuaugu

SEQ ID NO: 323879 - RNA, 64 nt, hsa
aauagcuuuuauugaguaauauuacauuucauuuauacuguagcaauauauuuguagguauacu

SEQ ID NO: 323880 - RNA, 64 nt, hsa
uuaaaugaaguuguaacuucgguauaacucaaguauacuguauauucuuugcuuuuaguuaaaa

SEQ ID NO: 323881 - RNA, 64 nt, hsa
uuuguuuuuguuuuuguuuuuguuuuccuugcagauacuguacaguaauggucaacuuugccac

SEQ ID NO: 323882 - RNA, 64 nt, hsa
cucugccuuguuagugcauauuuuuacuuuucugauacuguaaagaauauauccaguauguaaa

SEQ ID NO: 323883 - RNA, 64 nt, hsa
uaugccaaauuauuuaugauaauuugccauugcuauacuguaccagugucaaaugcugcagccu

SEQ ID NO: 323884 - RNA, 64 nt, hsa
ucagaaguuuccuggaguuuucaggcuaucauauauacuguauccugaaaggcaacauaauucu

SEQ ID NO: 323885 - RNA, 64 nt, hsa
gaaaguuuuaauaccuaagucauuccuccagugcauacuguaggucauuuuuuuugcuucuggc

SEQ ID NO: 323886 - RNA, 64 nt, hsa
ggcagagggaggaagguccaugaugcucagccacauacuguagagagaggcaauuuaauguuaa

SEQ ID NO: 323887 - RNA, 64 nt, hsa
uugguuauaucagagcacuuuaaucugaaggaugauacuguaacuugauuuaucuaauuagcuu

SEQ ID NO: 323888 - RNA, 64 nt, hsa
auaacugcuuacucaacacuaccaccuuuuccuuauacuguauaugauuauggccuacaauguu

SEQ ID NO: 323889 - RNA, 64 nt, hsa
uacuuguuuucaauguguuggaaacuguaaaaugauacuguagaaccugucuccuacuuugaaa

SEQ ID NO: 323890 - RNA, 64 nt, hsa
uuguacuguugaucacauguacuuaaaacaucugauacuguauucuaagacagguuguuuuugc

SEQ ID NO: 323891 - RNA, 64 nt, hsa
agguguuuauacugauuugauugugcuggcaaauauacuguauuguuaauauugaacuguuuau

SEQ ID NO: 323892 - RNA, 64 nt, hsa
uguacccuuguuauuaucuacuaguaauaauguaauacuguagaaauauugcucuaauucuuuu

SEQ ID NO: 323893 - RNA, 64 nt, hsa
gagccagaaguugaugugggaagaaguaaacuggauacuguacugauacuauucaaugcaaugc

SEQ ID NO: 323894 - RNA, 64 nt, hsa
uguggaauuuuauuguauuauucuuccauucuuaauacuguaccacauuccugcucagaaacug

SEQ ID NO: 323895 - RNA, 64 nt, hsa
ugcaguuaaagcucaauaugccuuuuuuuacuggauacuguacauuuggcuaaaagcuuuuauu

SEQ ID NO: 323896 - RNA, 64 nt, hsa
ucuuuagagaccagaaaaacuaucuuaauacuguauacuguauuaacuauucgugacauaguuc

SEQ ID NO: 323897 - RNA, 64 nt, hsa
uaccauuucuuuagagaccagaaaaacuaucuuaauacuguauacuguauuaacuauucgugac

SEQ ID NO: 323898 - RNA, 64 nt, hsa
uuucuaagugguaagaaugaccugucacuauaauauacuguauguuuacauuuuauuuaaauuu

SEQ ID NO: 323899 - RNA, 64 nt, hsa
aacaauuuuuaauguaaucuugauuuuaccucauauacuguacauuccaaaaacucuaaacuuu

SEQ ID NO: 323900 - RNA, 64 nt, hsa
cugucagugucggaguguauaagaaugcuuguaaauacuguaauauauuuauuaauauuugaaa

SEQ ID NO: 323901 - RNA, 64 nt, hsa
aaaugucucaguguguuuggcucauacgugggcuauacuguauuauuuugguaugcuuacaaau

SEQ ID NO: 323902 - RNA, 64 nt, hsa
ugagcaauugcaacauaauauucucuaauauuguauacuguaaauuuauucagcugcccucguu

SEQ ID NO: 323903 - RNA, 64 nt, hsa
aauaauaaacauaauauggaacaauuauaacaauauacuguaaucauaaaaguuaugugaauau

SEQ ID NO: 323904 - RNA, 64 nt, hsa
gaaaaagagauagaaggaaccaccuaugcuuaaaauacuguaaauaugcagugagguuuggcaa

SEQ ID NO: 323905 - RNA, 64 nt, hsa
uuuuuaaauggaauuuugcacauaauacauuguaauacuguaugauaaucaugugugaaaauaa

SEQ ID NO: 323906 - RNA, 64 nt, hsa
gagccccgccugcaggcgguguagauacauguagauacuguagauacuguagauaccgccccgg

SEQ ID NO: 323907 - RNA, 64 nt, hsa
cugcaggcgguguagauacauguagauacuguagauacuguagauaccgccccggcgccgacuu

SEQ ID NO: 323908 - RNA, 64 nt, hsa
ugagauuuucugccaguuaaacuaaaacaagaucauacuguaaauguuuguaacuugcuucccc

SEQ ID NO: 323909 - RNA, 64 nt, hsa
cuguaaauguuuguaacuugcuuccccccacuguauacuguaaacaucuuugcaugucaauaaa

SEQ ID NO: 323910 - RNA, 64 nt, hsa; identical to SEQ ID NO: 301531

SEQ ID NO: 323911 - RNA, 64 nt, hsa; identical to SEQ ID NO: 301532

SEQ ID NO: 323912 - RNA, 64 nt, hsa; identical to SEQ ID NO: 301533

SEQ ID NO: 323913 - RNA, 64 nt, hsa; identical to SEQ ID NO: 301534

SEQ ID NO: 323914 - RNA, 64 nt, hsa; identical to SEQ ID NO: 301535

SEQ ID NO: 323915 - RNA, 64 nt, hsa; identical to SEQ ID NO: 301536

SEQ ID NO: 323916 - RNA, 64 nt, hsa; identical to SEQ ID NO: 301537

SEQ ID NO: 323917 - RNA, 64 nt, hsa; identical to SEQ ID NO: 301538

SEQ ID NO: 323918 - RNA, 64 nt, hsa; identical to SEQ ID NO: 301539

SEQ ID NO: 323919 - RNA, 64 nt, hsa; identical to SEQ ID NO: 301540

SEQ ID NO: 323920 - RNA, 64 nt, hsa; identical to SEQ ID NO: 301541

SEQ ID NO: 323921 - RNA, 64 nt, hsa; identical to SEQ ID NO: 301542

SEQ ID NO: 323922 - RNA, 64 nt, hsa; identical to SEQ ID NO: 301543

SEQ ID NO: 323923 - RNA, 64 nt, hsa; identical to SEQ ID NO: 301544

SEQ ID NO: 323924 - RNA, 64 nt, hsa; identical to SEQ ID NO: 301545

SEQ ID NO: 323925 - RNA, 64 nt, hsa; identical to SEQ ID NO: 301546

SEQ ID NO: 323926 - RNA, 64 nt, hsa; identical to SEQ ID NO: 301547

SEQ ID NO: 323927 - RNA, 64 nt, hsa; identical to SEQ ID NO: 301548

SEQ ID NO: 323928 - RNA, 64 nt, hsa; identical to SEQ ID NO: 301549

SEQ ID NO: 323929 - RNA, 64 nt, hsa; identical to SEQ ID NO: 301550

SEQ ID NO: 323930 - RNA, 64 nt, hsa; identical to SEQ ID NO: 301551

SEQ ID NO: 323931 - RNA, 64 nt, hsa; identical to SEQ ID NO: 301552

SEQ ID NO: 323932 - RNA, 64 nt, hsa; identical to SEQ ID NO: 301553

SEQ ID NO: 323933 - RNA, 64 nt, hsa; identical to SEQ ID NO: 301554

SEQ ID NO: 323934 - RNA, 64 nt, hsa; identical to SEQ ID NO: 301555

SEQ ID NO: 323935 - RNA, 64 nt, hsa; identical to SEQ ID NO: 301556

SEQ ID NO: 323936 - RNA, 64 nt, hsa; identical to SEQ ID NO: 301557

SEQ ID NO: 323937 - RNA, 64 nt, hsa; identical to SEQ ID NO: 301558

SEQ ID NO: 323938 - RNA, 64 nt, hsa; identical to SEQ ID NO: 301559

SEQ ID NO: 323939 - RNA, 64 nt, hsa; identical to SEQ ID NO: 301560

SEQ ID NO: 323940 - RNA, 60 nt, hsa; identical to SEQ ID NO: 301561

SEQ ID NO: 323941 - RNA, 64 nt, hsa; identical to SEQ ID NO: 301562

SEQ ID NO: 323942 - RNA, 64 nt, hsa; identical to SEQ ID NO: 301563

SEQ ID NO: 323943 - RNA, 64 nt, hsa; identical to SEQ ID NO: 301564

SEQ ID NO: 323944 - RNA, 64 nt, hsa; identical to SEQ ID NO: 301565

SEQ ID NO: 323945 - RNA, 64 nt, hsa; identical to SEQ ID NO: 301566

SEQ ID NO: 323946 - RNA, 64 nt, hsa; identical to SEQ ID NO: 301567

SEQ ID NO: 323947 - RNA, 64 nt, hsa; identical to SEQ ID NO: 301568

SEQ ID NO: 323948 - RNA, 64 nt, hsa; identical to SEQ ID NO: 301569

SEQ ID NO: 323949 - RNA, 64 nt, hsa; identical to SEQ ID NO: 301570

SEQ ID NO: 323950 - RNA, 64 nt, hsa; identical to SEQ ID NO: 301571

SEQ ID NO: 323951 - RNA, 64 nt, hsa; identical to SEQ ID NO: 301572

SEQ ID NO: 323952 - RNA, 64 nt, hsa; identical to SEQ ID NO: 301573

SEQ ID NO: 323953 - RNA, 64 nt, hsa; identical to SEQ ID NO: 301574

SEQ ID NO: 323954 - RNA, 64 nt, hsa; identical to SEQ ID NO: 301575

SEQ ID NO: 323955 - RNA, 64 nt, hsa; identical to SEQ ID NO: 301576

SEQ ID NO: 323956 - RNA, 64 nt, hsa; identical to SEQ ID NO: 301577

SEQ ID NO: 323957 - RNA, 64 nt, hsa; identical to SEQ ID NO: 301578

SEQ ID NO: 323958 - RNA, 64 nt, hsa; identical to SEQ ID NO: 301579

SEQ ID NO: 323959 - RNA, 64 nt, hsa; identical to SEQ ID NO: 301580

SEQ ID NO: 323960 - RNA, 64 nt, hsa; identical to SEQ ID NO: 301581

SEQ ID NO: 323961 - RNA, 64 nt, hsa; identical to SEQ ID NO: 301582

SEQ ID NO: 323962 - RNA, 64 nt, hsa; identical to SEQ ID NO: 301583

SEQ ID NO: 323963 - RNA, 64 nt, hsa; identical to SEQ ID NO: 301584

SEQ ID NO: 323964 - RNA, 64 nt, hsa; identical to SEQ ID NO: 301585

SEQ ID NO: 323965 - RNA, 64 nt, hsa; identical to SEQ ID NO: 301586

SEQ ID NO: 323966 - RNA, 64 nt, hsa; identical to SEQ ID NO: 301587

SEQ ID NO: 323967 - RNA, 64 nt, hsa; identical to SEQ ID NO: 301588

SEQ ID NO: 323968 - RNA, 64 nt, hsa; identical to SEQ ID NO: 301589

SEQ ID NO: 323969 - RNA, 64 nt, hsa; identical to SEQ ID NO: 301590

SEQ ID NO: 323970 - RNA, 64 nt, hsa; identical to SEQ ID NO: 301591

SEQ ID NO: 323971 - RNA, 64 nt, hsa; identical to SEQ ID NO: 301592

SEQ ID NO: 323972 - RNA, 64 nt, hsa; identical to SEQ ID NO: 301593

SEQ ID NO: 323973 - RNA, 64 nt, hsa; identical to SEQ ID NO: 301594

SEQ ID NO: 323974 - RNA, 64 nt, hsa; identical to SEQ ID NO: 301595

SEQ ID NO: 323975 - RNA, 64 nt, hsa; identical to SEQ ID NO: 301596

SEQ ID NO: 323976 - RNA, 64 nt, hsa; identical to SEQ ID NO: 301597

SEQ ID NO: 323977 - RNA, 64 nt, hsa; identical to SEQ ID NO: 301598

SEQ ID NO: 323978 - RNA, 64 nt, hsa; identical to SEQ ID NO: 301599

SEQ ID NO: 323979 - RNA, 64 nt, hsa; identical to SEQ ID NO: 301600

SEQ ID NO: 323980 - RNA, 64 nt, hsa; identical to SEQ ID NO: 301601

SEQ ID NO: 323981 - RNA, 64 nt, hsa; identical to SEQ ID NO: 301602

SEQ ID NO: 323982 - RNA, 64 nt, hsa; identical to SEQ ID NO: 301603

SEQ ID NO: 323983 - RNA, 64 nt, hsa; identical to SEQ ID NO: 301604

SEQ ID NO: 323984 - RNA, 64 nt, hsa; identical to SEQ ID NO: 301605

SEQ ID NO: 323985 - RNA, 64 nt, hsa; identical to SEQ ID NO: 301606

SEQ ID NO: 323986 - RNA, 64 nt, hsa; identical to SEQ ID NO: 301607

SEQ ID NO: 323987 - RNA, 64 nt, hsa; identical to SEQ ID NO: 301608

SEQ ID NO: 323988 - RNA, 64 nt, hsa; identical to SEQ ID NO: 301609

SEQ ID NO: 323989 - RNA, 64 nt, hsa; identical to SEQ ID NO: 301610

SEQ ID NO: 323990 - RNA, 64 nt, hsa; identical to SEQ ID NO: 301611

SEQ ID NO: 323991 - RNA, 64 nt, hsa; identical to SEQ ID NO: 301612

SEQ ID NO: 323992 - RNA, 64 nt, hsa; identical to SEQ ID NO: 301613

SEQ ID NO: 323993 - RNA, 64 nt, hsa; identical to SEQ ID NO: 301614

SEQ ID NO: 323994 - RNA, 64 nt, hsa; identical to SEQ ID NO: 301615

SEQ ID NO: 323995 - RNA, 64 nt, hsa; identical to SEQ ID NO: 301616

SEQ ID NO: 323996 - RNA, 64 nt, hsa; identical to SEQ ID NO: 301617

SEQ ID NO: 323997 - RNA, 64 nt, hsa; identical to SEQ ID NO: 301618

SEQ ID NO: 323998 - RNA, 64 nt, hsa; identical to SEQ ID NO: 301619

SEQ ID NO: 323999 - RNA, 64 nt, hsa; identical to SEQ ID NO: 301620

SEQ ID NO: 324000 - RNA, 64 nt, hsa; identical to SEQ ID NO: 301621

SEQ ID NO: 324001 - RNA, 64 nt, hsa; identical to SEQ ID NO: 301622

SEQ ID NO: 324002 - RNA, 64 nt, hsa; identical to SEQ ID NO: 301623

SEQ ID NO: 324003 - RNA, 64 nt, hsa; identical to SEQ ID NO: 301624

SEQ ID NO: 324004 - RNA, 64 nt, hsa; identical to SEQ ID NO: 301625

SEQ ID NO: 324005 - RNA, 64 nt, hsa; identical to SEQ ID NO: 301626

SEQ ID NO: 324006 - RNA, 64 nt, hsa; identical to SEQ ID NO: 301627

SEQ ID NO: 324007 - RNA, 64 nt, hsa; identical to SEQ ID NO: 301628

SEQ ID NO: 324008 - RNA, 64 nt, hsa; identical to SEQ ID NO: 301629

SEQ ID NO: 324009 - RNA, 64 nt, hsa; identical to SEQ ID NO: 301630

SEQ ID NO: 324010 - RNA, 64 nt, hsa; identical to SEQ ID NO: 301631

SEQ ID NO: 324011 - RNA, 64 nt, hsa; identical to SEQ ID NO: 301632

SEQ ID NO: 324012 - RNA, 64 nt, hsa; identical to SEQ ID NO: 301633

SEQ ID NO: 324013 - RNA, 64 nt, hsa; identical to SEQ ID NO: 301634

SEQ ID NO: 324014 - RNA, 64 nt, hsa; identical to SEQ ID NO: 301635

SEQ ID NO: 324015 - RNA, 64 nt, hsa; identical to SEQ ID NO: 301636

SEQ ID NO: 324016 - RNA, 64 nt, hsa; identical to SEQ ID NO: 301637

SEQ ID NO: 324017 - RNA, 64 nt, hsa; identical to SEQ ID NO: 301638

SEQ ID NO: 324018 - RNA, 64 nt, hsa; identical to SEQ ID NO: 301639

SEQ ID NO: 324019 - RNA, 64 nt, hsa; identical to SEQ ID NO: 301640

SEQ ID NO: 324020 - RNA, 64 nt, hsa; identical to SEQ ID NO: 301641

SEQ ID NO: 324021 - RNA, 64 nt, hsa; identical to SEQ ID NO: 301642

SEQ ID NO: 324022 - RNA, 64 nt, hsa; identical to SEQ ID NO: 301643

SEQ ID NO: 324023 - RNA, 64 nt, hsa; identical to SEQ ID NO: 301644

SEQ ID NO: 324024 - RNA, 64 nt, hsa; identical to SEQ ID NO: 301645

SEQ ID NO: 324025 - RNA, 64 nt, hsa; identical to SEQ ID NO: 301646

SEQ ID NO: 324026 - RNA, 64 nt, hsa; identical to SEQ ID NO: 301647

SEQ ID NO: 324027 - RNA, 64 nt, hsa; identical to SEQ ID NO: 301648

SEQ ID NO: 324028 - RNA, 64 nt, hsa; identical to SEQ ID NO: 301649

SEQ ID NO: 324029 - RNA, 64 nt, hsa; identical to SEQ ID NO: 301650

SEQ ID NO: 324030 - RNA, 64 nt, hsa; identical to SEQ ID NO: 301651

SEQ ID NO: 324031 - RNA, 64 nt, hsa; identical to SEQ ID NO: 301652

SEQ ID NO: 324032 - RNA, 64 nt, hsa; identical to SEQ ID NO: 301653

SEQ ID NO: 324033 - RNA, 64 nt, hsa; identical to SEQ ID NO: 301654

SEQ ID NO: 324034 - RNA, 64 nt, hsa; identical to SEQ ID NO: 301655

SEQ ID NO: 324035 - RNA, 64 nt, hsa; identical to SEQ ID NO: 301656

SEQ ID NO: 324036 - RNA, 64 nt, hsa; identical to SEQ ID NO: 301657

SEQ ID NO: 324037 - RNA, 64 nt, hsa; identical to SEQ ID NO: 301658

SEQ ID NO: 324038 - RNA, 64 nt, hsa; identical to SEQ ID NO: 301659

SEQ ID NO: 324039 - RNA, 64 nt, hsa; identical to SEQ ID NO: 301660

SEQ ID NO: 324040 - RNA, 64 nt, hsa; identical to SEQ ID NO: 301661

SEQ ID NO: 324041 - RNA, 64 nt, hsa; identical to SEQ ID NO: 301662

SEQ ID NO: 324042 - RNA, 64 nt, hsa; identical to SEQ ID NO: 301663

SEQ ID NO: 324043 - RNA, 64 nt, hsa; identical to SEQ ID NO: 301664

SEQ ID NO: 324044 - RNA, 64 nt, hsa; identical to SEQ ID NO: 301665

SEQ ID NO: 324045 - RNA, 64 nt, hsa; identical to SEQ ID NO: 301666

SEQ ID NO: 324046 - RNA, 64 nt, hsa; identical to SEQ ID NO: 301667

SEQ ID NO: 324047 - RNA, 62 nt, hsa; identical to SEQ ID NO: 301668

SEQ ID NO: 324048 - RNA, 59 nt, hsa; identical to SEQ ID NO: 301669

SEQ ID NO: 324049 - RNA, 64 nt, hsa; identical to SEQ ID NO: 301670

SEQ ID NO: 324050 - RNA, 64 nt, hsa; identical to SEQ ID NO: 301671

SEQ ID NO: 324051 - RNA, 64 nt, hsa; identical to SEQ ID NO: 301672

SEQ ID NO: 324052 - RNA, 64 nt, hsa; identical to SEQ ID NO: 301673

SEQ ID NO: 324053 - RNA, 64 nt, hsa; identical to SEQ ID NO: 301674

SEQ ID NO: 324054 - RNA, 64 nt, hsa; identical to SEQ ID NO: 301675

SEQ ID NO: 324055 - RNA, 64 nt, hsa; identical to SEQ ID NO: 301676

SEQ ID NO: 324056 - RNA, 64 nt, hsa; identical to SEQ ID NO: 301677

SEQ ID NO: 324057 - RNA, 64 nt, hsa; identical to SEQ ID NO: 301678

SEQ ID NO: 324058 - RNA, 64 nt, hsa; identical to SEQ ID NO: 301679

SEQ ID NO: 324059 - RNA, 64 nt, hsa; identical to SEQ ID NO: 301680

SEQ ID NO: 324060 - RNA, 64 nt, hsa; identical to SEQ ID NO: 301681

SEQ ID NO: 324061 - RNA, 64 nt, hsa; identical to SEQ ID NO: 301682

SEQ ID NO: 324062 - RNA, 64 nt, hsa; identical to SEQ ID NO: 301683

SEQ ID NO: 324063 - RNA, 64 nt, hsa; identical to SEQ ID NO: 301684

SEQ ID NO: 324064 - RNA, 64 nt, hsa; identical to SEQ ID NO: 301685

SEQ ID NO: 324065 - RNA, 64 nt, hsa; identical to SEQ ID NO: 301686

SEQ ID NO: 324066 - RNA, 64 nt, hsa; identical to SEQ ID NO: 301687

SEQ ID NO: 324067 - RNA, 64 nt, hsa; identical to SEQ ID NO: 301688

SEQ ID NO: 324068 - RNA, 64 nt, hsa; identical to SEQ ID NO: 301689

SEQ ID NO: 324069 - RNA, 64 nt, hsa; identical to SEQ ID NO: 301690

SEQ ID NO: 324070 - RNA, 64 nt, hsa; identical to SEQ ID NO: 301691

SEQ ID NO: 324071 - RNA, 64 nt, hsa; identical to SEQ ID NO: 301692

SEQ ID NO: 324072 - RNA, 64 nt, hsa; identical to SEQ ID NO: 301693

SEQ ID NO: 324073 - RNA, 64 nt, hsa; identical to SEQ ID NO: 301694

SEQ ID NO: 324074 - RNA, 64 nt, hsa; identical to SEQ ID NO: 301695

SEQ ID NO: 324075 - RNA, 64 nt, hsa; identical to SEQ ID NO: 301696

SEQ ID NO: 324076 - RNA, 64 nt, hsa; identical to SEQ ID NO: 301697

SEQ ID NO: 324077 - RNA, 64 nt, hsa; identical to SEQ ID NO: 301698

SEQ ID NO: 324078 - RNA, 64 nt, hsa; identical to SEQ ID NO: 301699

SEQ ID NO: 324079 - RNA, 64 nt, hsa; identical to SEQ ID NO: 301700

SEQ ID NO: 324080 - RNA, 64 nt, hsa; identical to SEQ ID NO: 301701

SEQ ID NO: 324081 - RNA, 64 nt, hsa; identical to SEQ ID NO: 301702

SEQ ID NO: 324082 - RNA, 65 nt, hsa
aaucaggguagcugaccauguuuggcagauacuauaauggagacacagaagugugcauggcccaa

SEQ ID NO: 324083 - RNA, 65 nt, hsa
ggcugcuuuugauauguucccugacacauaucuugaauggagaccucccuaccaagugaugaaag

SEQ ID NO: 324084 - RNA, 65 nt, hsa
auuccuuucaccaucauuuagaaaugguuugccuuaauggagacaauagcagauccuguaguauu

SEQ ID NO: 324085 - RNA, 65 nt, hsa
gaagcugggcagcgucugcucuguguucuguguggaauggagaaaaaaacgccugcccugcugcc

SEQ ID NO: 324086 - RNA, 65 nt, hsa
aaguccaaaugaugaaggaaauguuuuaauucacaaauggagauuuguauguguuaucagguuca

SEQ ID NO: 324087 - RNA, 65 nt, hsa
cuucgcuauuaaauaaagaaaauuggaugcaagacaauggagaaacuuuaaaacuaaacaggacc

SEQ ID NO: 324088 - RNA, 65 nt, hsa
ucuagagacagaggaggccuggcaggggugauaaaaauggagauugaaaugaagagaaauagcca

SEQ ID NO: 324089 - RNA, 65 nt, hsa
cuuuaaagacuacaagauuugcuagauaaacuggaaauggagaaguuauugcagacagucaugaa

SEQ ID NO: 324090 - RNA, 65 nt, hsa
aauucaccaauuuccuuuaaaacauaagcuaccugaauggagaauacaucuuguuucugaguuuc

SEQ ID NO: 324091 - RNA, 65 nt, hsa
gucuuccauuaagaacacuaaaaaguccuugcaagaauggagauaugcauucaagagaggugcua

SEQ ID NO: 324092 - RNA, 65 nt, hsa
ugaccccucucuccccaguauuaucuuacuugcaaaauggagaccaaauucuauccugugaggcu

SEQ ID NO: 324093 - RNA, 65 nt, hsa
uuaaagucacugguacuauggacaacuccauagugaauggagauacuugcagagcuugucaugca

SEQ ID NO: 324094 - RNA, 65 nt, hsa
cugucacauagcagcauuccgauucuauguaacugaauggagaugauaagugcuuuccccucuuu

SEQ ID NO: 324095 - RNA, 65 nt, hsa
auuuauaacagucauucuuugauagucaacucuuaaauggagacuugagaugcuuaaauauugua

SEQ ID NO: 324096 - RNA, 59 nt, hsa; identical to SEQ ID NO: 173059

SEQ ID NO: 324097 - RNA, 65 nt, hsa
caccagcaccagcucccugucucuucuagccacuuaauggagacacaauggagagguaagacaga

SEQ ID NO: 324098 - RNA, 65 nt, hsa
gcucccugucucuucuagccacuuaauggagacacaauggagagguaagacagaccacaaacuag

SEQ ID NO: 324099 - RNA, 65 nt, hsa
acaggguuauaggccucuccuuucacauuccagacaauggagaguguuuaugguuucaggaaaag

SEQ ID NO: 324100 - RNA, 65 nt, hsa
auaagaauguuaucagaaucuggucuacuuaggacaauggagacuuuuucaguuuuauaaaggga

SEQ ID NO: 324101 - RNA, 53 nt, hsa; identical to SEQ ID NO: 173064

SEQ ID NO: 324102 - RNA, 65 nt, hsa
auugacuagaucaagaacuguuuauagcuuuagcaaauggagacagcuuugugaaacuucuucac

SEQ ID NO: 324103 - RNA, 65 nt, hsa
ugagccaccgugccuggccaggccccuucucuuuuaauggagacagggucuugcacuaucaccca

SEQ ID NO: 324104 - RNA, 65 nt, hsa
aagaaacauuuucucugaaauauauuauuaagggcaauggagauaaauuaauaguagaugugguu

SEQ ID NO: 324105 - RNA, 65 nt, hsa
agugggaucaacaaugauuuucuugaaugggcaugaauggagaugcccgcacaguaauguagaaa

SEQ ID NO: 324106 - RNA, 65 nt, hsa
gcaagaauuucuggaagaaaggcuguggaagggccaauggagaaaaugaauggacaaagcucagg

SEQ ID NO: 324107 - RNA, 65 nt, hsa
uuaugugugcagacaauucucccugagguuagcccaauggagaaaugaagcagaggaaggaaaca

SEQ ID NO: 324108 - RNA, 65 nt, hsa
cuacuaugggcagggccccccaccaagcugagccgaauggagacagcugagcugaggccugacuu

SEQ ID NO: 324109 - RNA, 65 nt, hsa
gcuaggucuccuuggaaaccaggccugggccucaaaauggagauggaucccaggucuugugggac

SEQ ID NO: 324110 - RNA, 65 nt, hsa
ugaagccaaagcugggcucaguggggaaggucaggaauggagaaauugccuuuucucguuagccu

SEQ ID NO: 324111 - RNA, 65 nt, hsa
guuggagaucauuauucuaagugaaauaacucaggaauggagaaccaaauauuguacauccucac

SEQ ID NO: 324112 - RNA, 65 nt, hsa
cugccaagauccuuugaauacaugcaagaacacacaauggagagaaacccuaugaauguaaagaa

SEQ ID NO: 324113 - RNA, 65 nt, hsa
ugggaggccgaggcgggcggaucacuaggucaggaaauggagaccauccuggccaacacagugaa

SEQ ID NO: 324114 - RNA, 65 nt, hsa
cugagguuugugaaacaguaggauucucuuuuggcaauggagaauugcaucugaugguucaagug

SEQ ID NO: 324115 - RNA, 65 nt, hsa
auguggcuuuuguugaguuaaauaagaugcuauauaauggagaagaauuugaaaaugcacaaaaa

SEQ ID NO: 324116 - RNA, 64 nt, hsa
cggcuacaugacucugaaccccagggcaccuacugacgaugauaaaaacaucuaccugacucuu

SEQ ID NO: 324117 - RNA, 64 nt, hsa
auugcaccgaaagcaggcccuuagggcaggaagggacgaugagcaagucugccacaccaccugg

SEQ ID NO: 324118 - RNA, 64 nt, hsa
ucaucugcaccuacuuguucccaccuugggagaggacgaugacuugggagggacgcgugaaggg

SEQ ID NO: 324119 - RNA, 64 nt, hsa
gaaugacucugucuugugggugucugacaguggcgacgaugaacaugccguugguuuuauuggc

SEQ ID NO: 324120 - RNA, 64 nt, hsa
aacaaguacguguggcuacucauuggucuaugaggacgaugacaggcuucgacucugugguuuc

SEQ ID NO: 324121 - RNA, 64 nt, hsa
cugcagcugcaggagugcuugugggcugcuaugggacgaugacuugggagcgcuaugggccugc

SEQ ID NO: 324122 - RNA, 64 nt, hsa
gcccucagggcuuccagcaggauugagucacccugacgaugaccggggagaagccgugugcucu

SEQ ID NO: 324123 - RNA, 64 nt, hsa
gauagguaucuagagcuuaaugcuacaugugagugacgaugauguacagauucuuucaguucuu

SEQ ID NO: 324124 - RNA, 64 nt, hsa
uuggugaagaaacugugugagcuguccugaccuggacgaugacguggggaaacccuccaccucc

SEQ ID NO: 324125 - RNA, 64 nt, hsa
ccuggccacagcugcacuuacaggaugccucauagacgaugaggggucugaaaggccaacccga

SEQ ID NO: 324126 - RNA, 64 nt, hsa
ccuuaaaaaaacacggaagcacaguuggaggugggacgaugagacuuugaaacuaucucaugcc

SEQ ID NO: 324127 - RNA, 64 nt, hsa
auguaaaguuucucgguguguucuguuaauguaagacgaugaacaguuguguauaguguuuuac

SEQ ID NO: 324128 - RNA, 64 nt, hsa
guucaagccuuagcaagcccagaggcccccagcagacgaugaggacauugucggcucaacaucu

SEQ ID NO: 324129 - RNA, 64 nt, hsa
caucaucggguauuagaaaauguagucuggcugagacgaugaguuaucuucuacauucuagaaa

SEQ ID NO: 324130 - RNA, 64 nt, hsa
uaggucuuuguuauuuucaacuguucuaugcugugacgaugaggaggagaugucuguuggauuc

SEQ ID NO: 324131 - RNA, 64 nt, hsa
uguuguggggucaaccguacaauggugugggagugacgaugaugugaguauuuagaauguacca

SEQ ID NO: 324132 - RNA, 64 nt, hsa
cacucuacuugcugaccacauuucccagagcuaugacgaugagaggaagacugcgcuguauuuu

SEQ ID NO: 324133 - RNA, 64 nt, hsa
uguggagcaccagccucgguuuuucaggaaauccgacgaugacucuugggugagcaacggcacc

SEQ ID NO: 324134 - RNA, 64 nt, hsa
ucuggcagaaugugugaaugccauaucuguagaugacgaugaaugugaaggguuaauguagaaa

SEQ ID NO: 324135 - RNA, 64 nt, hsa
cuacuugaccuuuucuucccuggcuacagcaaaggacgaugaucugccugcuuucacuguguug

SEQ ID NO: 324136 - RNA, 64 nt, hsa
aacauuuuuaucuacguuuuauaacuuggugagugacgaugagagcccugcaccuggccagagu

SEQ ID NO: 324137 - RNA, 64 nt, hsa
uccugcccuuucaaagaauaaccacagcucagaagacgaugacguggucaucugugucgccauc

SEQ ID NO: 324138 - RNA, 64 nt, hsa
gaaucacgcccuccugggccauguugucuuugaugacgaugaugccguuggggcggaggcugcc

SEQ ID NO: 324139 - RNA, 64 nt, hsa
gagaugucacuuuacaugggaguuauccauugaugacgaugaaaugccugauuuagaaaacaga

SEQ ID NO: 324140 - RNA, 64 nt, hsa
uuugaaacguaacugguucccugaccaggucaccgacgaugagggcgcaccugcuguccuggag

SEQ ID NO: 324141 - RNA, 64 nt, hsa
acauccaucggcuccccauggugucuucacaccugacgaugagccaggccugagccccacacag

SEQ ID NO: 324142 - RNA, 64 nt, hsa
ugccguguggcccugggacccugggcccagaaaggacgaugaacuaccugcaguggugauggcc

SEQ ID NO: 324143 - RNA, 64 nt, hsa
ucuuugacuguaagacagggcucuguaucagugagacgaugagaaaagucccaggcuaauggca

SEQ ID NO: 324144 - RNA, 64 nt, hsa
gagccacgcaaggcugcaccucuguguguugggagacgaugaugauguccauugcugugugaug

SEQ ID NO: 324145 - RNA, 64 nt, hsa
gcucccagcccagagcagccaucaggcuggaggugacgaugaguuccugaaacuuggaggggca

SEQ ID NO: 324146 - RNA, 64 nt, hsa
ccguggacucacuccaccagcuuccuauaacuuggacgaugaccaggcggcuugggagaaugag

SEQ ID NO: 324147 - RNA, 64 nt, hsa
caggcuucugccaaaaaaaaaaagagaagaagaugacgaugaugaccagucguacuaucuuacu

SEQ ID NO: 324148 - RNA, 64 nt, hsa
guccucuuguacuucgugugcuccgacccauggugacgaugacacacccugguggcaugcccgu

SEQ ID NO: 324149 - RNA, 64 nt, hsa
caacccucaguaccgucugaagcuccuggaggaggacgaugacccugaugacucggaggugauu

SEQ ID NO: 324150 - RNA, 64 nt, hsa
gugcaaauggcugucucggguuuucauagaacaagacgaugacaugcuggaggcugccaaggca

SEQ ID NO: 324151 - RNA, 64 nt, hsa
gauggguccacucauggccucagcugagaaaggagacgaugaacguguagcugacaugcacgaa

SEQ ID NO: 324152 - RNA, 64 nt, hsa
cacgcuguuccgguuggcgagugacaccacugaugacgaugaugcacucgguaaguuuucuuuc

SEQ ID NO: 324153 - RNA, 58 nt, hsa
uuucuuugcacuggucuugaagagaguggacgaugaggaggauacuguggccccgcug

SEQ ID NO: 324154 - RNA, 64 nt, hsa
ccaggccccugaugcuccaaccucccggggggacgacgaugacaaugugaaaccaucacagcug

SEQ ID NO: 324155 - RNA, 64 nt, hsa
guagcuauuaugcgcccgucuacagggggugcccgacgaugacggugccuucgcagucaaauua

SEQ ID NO: 324156 - RNA, 64 nt, hsa
agaaguccuucuggacagugugaugccccugucagacgaugaccaguuuucaccggaagcagau

SEQ ID NO: 324157 - RNA, 64 nt, hsa
cccucacccgccgggguccccuccgggcggggcagacgaugacucgccccucgcccacccgcuc

SEQ ID NO: 324158 - RNA, 64 nt, hsa
cagggucagacgugcuguuaagagcaaagccacagacgaugacuuguccauucucaguggaugc

SEQ ID NO: 324159 - RNA, 64 nt, hsa
caggaagggccugcacgaacccuacagcgagagugacgaugauuggugcuaagcccgggcgagg

SEQ ID NO: 324160 - RNA, 64 nt, hsa
cgugcuggacuucuacgagccgcggcggccagaggacgaugacccuacagaacaggugggcccc

SEQ ID NO: 324161 - RNA, 64 nt, hsa
ucccugcccucauggugcucauucuacuugaguagacgaugaacuaguaaacaaauaaacaaga

SEQ ID NO: 324162 - RNA, 64 nt, hsa
cuggagcccgaguggaccaaucggaagccuaagugacgaugacccucgcauguccuaggucccu

SEQ ID NO: 324163 - RNA, 64 nt, hsa
cugcuaggcagagagcgcacccuacucuuuccgugacgaugagggcggcaaaaacagacauuuc

SEQ ID NO: 324164 - RNA, 64 nt, hsa
auguuuuauauauauauuuuuuccuuucaaaucagacgaugagacuagaaggagaaauacuuuc

SEQ ID NO: 324165 - RNA, 64 nt, hsa
aauuuaaucuggcacuuugcacugccacagaggugacgaugaacuauguauauaguuagauguu

SEQ ID NO: 324166 - RNA, 64 nt, hsa
cagaagguauuuuuuaacucccaagcaguagcaggacgaugauagggcuggagggcuauggauu

SEQ ID NO: 324167 - RNA, 64 nt, hsa
aauuuuacuggauuuaucuuaauaaaaagacucugacgaugauuguguuuuguuauaucuucaa

SEQ ID NO: 324168 - RNA, 63 nt, hsa
agcacuuugaaauuuauuacuagcuugcuacccacgaugaaaucaacaaccuguaucugguau

SEQ ID NO: 324169 - RNA, 63 nt, hsa
aucuuuuccaucuuccugagggcaagauuuugcacgaugaaggcaaugauuguaacuuuucuc

SEQ ID NO: 324170 - RNA, 63 nt, hsa
ugagcucaggaguucaagaucagucugggcaacacgaugaaacuccgucucuacuaaaauaca

SEQ ID NO: 324171 - RNA, 63 nt, hsa
ugucagauauuuuuucagaaauaugugguuuccacgaugaaaaacuuccaugaggccaaacgu

SEQ ID NO: 324172 - RNA, 63 nt, hsa
cugaggcaaaccuuuguggacaugaauuguucuacgaugaauuuuugcuuuaguauuuuaaua

SEQ ID NO: 324173 - RNA, 63 nt, hsa
auuggauacaaggaucagaauggaaagaaacucacgaugaaauugaaccugguuuuuguauau

SEQ ID NO: 324174 - RNA, 63 nt, hsa
augacucugucuugugggugucugacaguggcgacgaugaacaugccguugguuuuauuggca

SEQ ID NO: 324175 - RNA, 63 nt, hsa
augagcugcagcucccaaauuucaaauuuuggcacgaugaauuauuuuuguuucucuuugcag

SEQ ID NO: 324176 - RNA, 63 nt, hsa
aguggcucuuggggaaaagcaauuuaauguaccacgaugaauagcuaacuguucccaaguguu

SEQ ID NO: 324177 - RNA, 63 nt, hsa
agacuguuuucccuguagcagauaacagaaccuacgaugaaaugguaagggucaacugggcua

SEQ ID NO: 324178 - RNA, 63 nt, hsa
ugcugaaaaguuagucuuaauuaucuauuggccacgaugaaacagauuucaacugauaaagag

SEQ ID NO: 324179 - RNA, 63 nt, hsa
aguaaauugccugauuuguuuucauuauagacaacgaugaauuucuucuaauuauuuaaauaa

SEQ ID NO: 324180 - RNA, 63 nt, hsa
uaguuggcaaucauaagaaacaucugaauaacaacgaugaaugggaaacuaguguugaaauag

SEQ ID NO: 324181 - RNA, 63 nt, hsa
aaauauuuucuaaaaagauaaaaaauauacauaacgaugaaaaauaauacaaauuuaaaaacc

SEQ ID NO: 324182 - RNA, 63 nt, hsa
aaggcuuuguauaaucccacccaccucaccaaaacgaugaaguuaugcugucaugguccuuuc

SEQ ID NO: 324183 - RNA, 63 nt, hsa
guaaaguuucucgguguguucuguuaauguaagacgaugaacaguuguguauaguguuuuacc

SEQ ID NO: 324184 - RNA, 63 nt, hsa
uauggugagucauuacucagcaucauggaguccacgaugaagagaaucucuuuucaaucugug

SEQ ID NO: 324185 - RNA, 63 nt, hsa
ugaaaauaugaggcuugauaauauuagguugucacgaugaagcaugcuagaagcuguaacaga

SEQ ID NO: 324186 - RNA, 63 nt, hsa
uggcagaaugugugaaugccauaucuguagaugacgaugaaugugaaggguuaauguagaaau

SEQ ID NO: 324187 - RNA, 63 nt, hsa
uucucaaggaaggaggcaaagagcuacugaguaacgaugaaagcgaggcugcaggacugaaga

SEQ ID NO: 324188 - RNA, 63 nt, hsa
ccaguggcagacaaacagaccauaaauaaggaaacgaugaaauaagauauauacaaggugagu

SEQ ID NO: 324189 - RNA, 63 nt, hsa
cuagcacagggcccagacagggcuggacuagacacgaugaaaacagccuguauuugagggaga

SEQ ID NO: 324190 - RNA, 63 nt, hsa
ccugcccggccucggaaccagcuuuucucucuuacgaugaaggcugaugccgagagcgggcug

SEQ ID NO: 324191 - RNA, 63 nt, hsa
gaugucacuuuacaugggaguuauccauugaugacgaugaaaugccugauuuagaaaacagag

SEQ ID NO: 324192 - RNA, 63 nt, hsa
gcaccugaacccuagaaaaagagccaguuugcuacgaugaaggugacauuucucuggucauuu

SEQ ID NO: 324193 - RNA, 63 nt, hsa
uaacuugcugaugugguuuacaauagugugacaacgaugaaaaugcuugguuauguaaaguga

SEQ ID NO: 324194 - RNA, 63 nt, hsa
ccguguggcccugggacccugggcccagaaaggacgaugaacuaccugcaguggugauggccu

SEQ ID NO: 324195 - RNA, 63 nt, hsa
caccacuuuucuauuucagugggugucguugcuacgaugaagacuuuggaaauuuccuuucuc

SEQ ID NO: 324196 - RNA, 63 nt, hsa
guccuaaugaaauuucugacauugucauauacaacgaugaauaucauuaaaauuuuuaaaaua

SEQ ID NO: 324197 - RNA, 63 nt, hsa
ggacuuugauagcaacuuccaggaaugucacacacgaugaaauaucucugcugaagacagugg

SEQ ID NO: 324198 - RNA, 63 nt, hsa
uuacaaaugucguagaagaaaucaugcagcuaaacgaugaagaagcccaacuggaguguugcu

SEQ ID NO: 324199 - RNA, 63 nt, hsa
caagagcucggccaucacgucaagcuuuggauaacgaugaaugagccguauacaaggaauaug

SEQ ID NO: 324200 - RNA, 63 nt, hsa
uuggaaacaugauugcggaugauaugucuaacuacgaugaagaagguaccggaaguugugcuu

SEQ ID NO: 324201 - RNA, 63 nt, hsa
uuauuuaaaacugucauagcaguaaaaaguauuacgaugaaauuguuaggguauuaauggaac

SEQ ID NO: 324202 - RNA, 63 nt, hsa
caaccugcacagauccugaacaacaaaugaauaacgaugaaugucuuuuugguuguaauuuaa

SEQ ID NO: 324203 - RNA, 63 nt, hsa
uggguccacucauggccucagcugagaaaggagacgaugaacguguagcugacaugcacgaag

SEQ ID NO: 324204 - RNA, 63 nt, hsa
cagucuguaugucugugucucccuagaauucauacgaugaaaucuucacucucaaguugauag

SEQ ID NO: 324205 - RNA, 63 nt, hsa
aauuccuauugcuuccuugcgcaacuucucaaaacgaugaaagucagaaggcugucaaacuca

SEQ ID NO: 324206 - RNA, 63 nt, hsa
cuagggacaccccaggcaguccuggguguggacacgaugaagcaccggcuccauaagacaccu

SEQ ID NO: 324207 - RNA, 63 nt, hsa
ggauuuugggguucaccagaugcuuccuggcccacgaugaaaccugagagggguguccccuug

SEQ ID NO: 324208 - RNA, 63 nt, hsa
aauguucauggcagcccuauucacaguagccaaacgaugaaaacaaccccaagcuauauauua

SEQ ID NO: 324209 - RNA, 63 nt, hsa
ugugcaaagugaaaacacugggcucccuguuaaacgaugaagaauucaagacagugacagcau

SEQ ID NO: 324210 - RNA, 63 nt, hsa
aaauaggcauucaagaaguauugucuuaaauuuacgaugaauuucuugugagcagaggacgaa

SEQ ID NO: 324211 - RNA, 63 nt, hsa
aauguucauggcggcccuauucacaguagccaaacgaugaaaacaaccccaagcuauauauua

SEQ ID NO: 324212 - RNA, 63 nt, hsa
ccugcccucauggugcucauucuacuugaguagacgaugaacuaguaaacaaauaaacaagaa

SEQ ID NO: 324213 - RNA, 63 nt, hsa
ugauuuuaauugcugucuaaugacggggaaagcacgaugaaaagauguacaauccugcauccu

SEQ ID NO: 324214 - RNA, 63 nt, hsa
gugccucaaagcaaaggcaagcaaaggaaccccacgaugaacuugcucuuuuccuuugaugag

SEQ ID NO: 324215 - RNA, 63 nt, hsa
uuucucuaugcaagacuggcauccugggacugcacgaugaacuauuggagcauacaguacugc

SEQ ID NO: 324216 - RNA, 63 nt, hsa
uuuaaucuggcacuuugcacugccacagaggugacgaugaacuauguauauaguuagauguuu

SEQ ID NO: 324217 - RNA, 63 nt, hsa
cuuugcuuguugcugggcggaugauguuuacuaacgaugaauuuuacauccaaagggggauag

SEQ ID NO: 324218 - RNA, 64 nt, hsa
caauaaaaacuugcauccaacaugaauuuccagccgaugauaauccaggccaaagguuuaguug

SEQ ID NO: 324219 - RNA, 64 nt, hsa
gcuacaugacucugaaccccagggcaccuacugacgaugauaaaaacaucuaccugacucuucc

SEQ ID NO: 324220 - RNA, 64 nt, hsa
uuguccgugaagagaaagacaguauuugcagugccgaugauauagagugacuuggagagagauu

SEQ ID NO: 324221 - RNA, 64 nt, hsa
gacagagaaauugaggaugccccuggggcuagaucgaugauaugaccagaaaucaaaaagggaa

SEQ ID NO: 324222 - RNA, 64 nt, hsa
uaaaaagaacaguuguaguaaauuauuauaaagccgaugauauuucauggcagguuauucuacc

SEQ ID NO: 324223 - RNA, 64 nt, hsa
cacucacagagcuuacaugccagugagugaagaucgaugauaaauaaagcaaaugcaucauaug

SEQ ID NO: 324224 - RNA, 64 nt, hsa
gagaugggaugguaucuaaaaacucaaguauuuucgaugauagagguaagaaaauaaacaauag

SEQ ID NO: 324225 - RNA, 64 nt, hsa
uuugccagagccugagagagcgauguccucgaggcgaugauauucucaccauccugacugaagu

SEQ ID NO: 324226 - RNA, 64 nt, hsa
ggagacuuggaagaguuggaggguuggcagggggcgaugauaauuuacuuaauggguacaaugu

SEQ ID NO: 324227 - RNA, 64 nt, hsa
guuuucuuugguagaguauauggcagucccacaucgaugauaauuggugcucccuucauccaac

SEQ ID NO: 324228 - RNA, 64 nt, hsa
gacaaaacgaauuuaaguaccagccaaguacacacgaugauagcuucaaggaauacaacugacu

SEQ ID NO: 324229 - RNA, 64 nt, hsa
cuuccagcugaccugugacuuauacugcucuuaccgaugauacuuuuggaaaaaauagagcgug

SEQ ID NO: 324230 - RNA, 64 nt, hsa
gcuucaguuguucuuuagaggcuuucaaauguaccgaugauacuguuucuugcacugaauauau

SEQ ID NO: 324231 - RNA, 64 nt, hsa
ucuugaugccucgacgggaccccuugaaggcugucgaugauagguuagaaauagcaaaccuguc

SEQ ID NO: 324232 - RNA, 64 nt, hsa
uagcuaccgugaguucucagcaggaacuucccagcgaugauaauguacaugaaauuagccacgu

SEQ ID NO: 324233 - RNA, 64 nt, hsa
acuggaaagauaauuuaucguguuaggagaagaacgaugauaccuacuuaacaccucagcaucu

SEQ ID NO: 324234 - RNA, 64 nt, hsa
ucuucaaaccgugguacccccccuuuucuccccacgaugauaucuauauauguaucuacaauac

SEQ ID NO: 324235 - RNA, 64 nt, hsa
uauguuacaauaagccuccauuagucccucaaaacgaugauauaaauaagucuguacaaccuag

SEQ ID NO: 324236 - RNA, 64 nt, hsa
cuuaagguugaaacuguaaugacauaaaaagggucgaugauauuucacugaugguagaucgcag

SEQ ID NO: 324237 - RNA, 64 nt, hsa
ccuaauggcccaacagggaaauucucauuuuggucgaugauauucugauggacugguuuggucu

SEQ ID NO: 324238 - RNA, 64 nt, hsa
aaucagcuuuacauaaauauaccuuguaugcaaacgaugauaaacuagucaggaugagcagagc

SEQ ID NO: 324239 - RNA, 64 nt, hsa
uuuguuugcauacuggucuucagauuaugagacucgaugauaacaguaugguacugcuucugug

SEQ ID NO: 324240 - RNA, 64 nt, hsa
agugaaugugugagaacacuaagaccacucugaacgaugauaaugaguugggggguggacugcu

SEQ ID NO: 324241 - RNA, 64 nt, hsa
cuucaaauucagcuguggugucucggcaaaggcacgaugauaccagaguccacgcugacauaca

SEQ ID NO: 324242 - RNA, 64 nt, hsa; identical to SEQ ID NO: 324241

SEQ ID NO: 324243 - RNA, 64 nt, hsa
ucauuguuccagcaguuugaaaauaaauuguugucgaugauagucaccuuuagugcugcagaac

SEQ ID NO: 324244 - RNA, 64 nt, hsa
aagcaugcaaaaauaccaaggaagaacuucucuucgaugauaaugucgaguggaaaucaugcuu

SEQ ID NO: 324245 - RNA, 64 nt, hsa
aggugggggcuguggccauguguggccgugaugucgaugauacucguuuucccugauccguggu

SEQ ID NO: 324246 - RNA, 64 nt, hsa
gaagguauuuuuuaacucccaagcaguagcaggacgaugauagggcuggagggcuauggauucc

SEQ ID NO: 324247 - RNA, 62 nt, hsa
gcuacaugacucugaaccccagggcaccuacugacgaugauaaaaacaucuaccugacucuu

SEQ ID NO: 324248 - RNA, 62 nt, hsa
ugcaccgaaagcaggcccuuagggcaggaagggacgaugagcaagucugccacaccaccugg

SEQ ID NO: 324249 - RNA, 62 nt, hsa
aucugcaccuacuuguucccaccuugggagaggacgaugacuugggagggacgcgugaaggg

SEQ ID NO: 324250 - RNA, 62 nt, hsa
augacucugucuugugggugucugacaguggcgacgaugaacaugccguugguuuuauuggc

SEQ ID NO: 324251 - RNA, 62 nt, hsa
caaguacguguggcuacucauuggucuaugaggacgaugacaggcuucgacucugugguuuc

SEQ ID NO: 324252 - RNA, 62 nt, hsa
gcagcugcaggagugcuugugggcugcuaugggacgaugacuugggagcgcuaugggccugc

SEQ ID NO: 324253 - RNA, 62 nt, hsa
ccucagggcuuccagcaggauugagucacccugacgaugaccggggagaagccgugugcucu

SEQ ID NO: 324254 - RNA, 62 nt, hsa
uagguaucuagagcuuaaugcuacaugugagugacgaugauguacagauucuuucaguucuu

SEQ ID NO: 324255 - RNA, 62 nt, hsa
ggugaagaaacugugugagcuguccugaccuggacgaugacguggggaaacccuccaccucc

SEQ ID NO: 324256 - RNA, 62 nt, hsa
uggccacagcugcacuuacaggaugccucauagacgaugaggggucugaaaggccaacccga

SEQ ID NO: 324257 - RNA, 62 nt, hsa
uuaaaaaaacacggaagcacaguuggaggugggacgaugagacuuugaaacuaucucaugcc

SEQ ID NO: 324258 - RNA, 62 nt, hsa
guaaaguuucucgguguguucuguuaauguaagacgaugaacaguuguguauaguguuuuac

SEQ ID NO: 324259 - RNA, 62 nt, hsa
ucaagccuuagcaagcccagaggcccccagcagacgaugaggacauugucggcucaacaucu

SEQ ID NO: 324260 - RNA, 62 nt, hsa
ucaucggguauuagaaaauguagucuggcugagacgaugaguuaucuucuacauucuagaaa

SEQ ID NO: 324261 - RNA, 62 nt, hsa
ggucuuuguuauuuucaacuguucuaugcugugacgaugaggaggagaugucuguuggauuc

SEQ ID NO: 324262 - RNA, 62 nt, hsa
uuguggggucaaccguacaauggugugggagugacgaugaugugaguauuuagaauguacca

SEQ ID NO: 324263 - RNA, 62 nt, hsa
cucuacuugcugaccacauuucccagagcuaugacgaugagaggaagacugcgcuguauuuu

SEQ ID NO: 324264 - RNA, 62 nt, hsa
uggagcaccagccucgguuuuucaggaaauccgacgaugacucuugggugagcaacggcacc

SEQ ID NO: 324265 - RNA, 62 nt, hsa
uggcagaaugugugaaugccauaucuguagaugacgaugaaugugaaggguuaauguagaaa

SEQ ID NO: 324266 - RNA, 62 nt, hsa
acuugaccuuuucuucccuggcuacagcaaaggacgaugaucugccugcuuucacuguguug

SEQ ID NO: 324267 - RNA, 62 nt, hsa
cauuuuuaucuacguuuuauaacuuggugagugacgaugagagcccugcaccuggccagagu

SEQ ID NO: 324268 - RNA, 62 nt, hsa
cugcccuuucaaagaauaaccacagcucagaagacgaugacguggucaucugugucgccauc

SEQ ID NO: 324269 - RNA, 62 nt, hsa
aucacgcccuccugggccauguugucuuugaugacgaugaugccguuggggcggaggcugcc

SEQ ID NO: 324270 - RNA, 62 nt, hsa
gaugucacuuuacaugggaguuauccauugaugacgaugaaaugccugauuuagaaaacaga

SEQ ID NO: 324271 - RNA, 62 nt, hsa
ugaaacguaacugguucccugaccaggucaccgacgaugagggcgcaccugcuguccuggag

SEQ ID NO: 324272 - RNA, 62 nt, hsa
auccaucggcuccccauggugucuucacaccugacgaugagccaggccugagccccacacag

SEQ ID NO: 324273 - RNA, 62 nt, hsa
ccguguggcccugggacccugggcccagaaaggacgaugaacuaccugcaguggugauggcc

SEQ ID NO: 324274 - RNA, 62 nt, hsa
uuugacuguaagacagggcucuguaucagugagacgaugagaaaagucccaggcuaauggca

SEQ ID NO: 324275 - RNA, 62 nt, hsa
gccacgcaaggcugcaccucuguguguugggagacgaugaugauguccauugcugugugaug

SEQ ID NO: 324276 - RNA, 62 nt, hsa
ucccagcccagagcagccaucaggcuggaggugacgaugaguuccugaaacuuggaggggca

SEQ ID NO: 324277 - RNA, 62 nt, hsa
guggacucacuccaccagcuuccuauaacuuggacgaugaccaggcggcuugggagaaugag

SEQ ID NO: 324278 - RNA, 62 nt, hsa
ggcuucugccaaaaaaaaaaagagaagaagaugacgaugaugaccagucguacuaucuuacu

SEQ ID NO: 324279 - RNA, 62 nt, hsa
ccucuuguacuucgugugcuccgacccauggugacgaugacacacccugguggcaugcccgu

SEQ ID NO: 324280 - RNA, 62 nt, hsa
acccucaguaccgucugaagcuccuggaggaggacgaugacccugaugacucggaggugauu

SEQ ID NO: 324281 - RNA, 62 nt, hsa
gcaaauggcugucucggguuuucauagaacaagacgaugacaugcuggaggcugccaaggca

SEQ ID NO: 324282 - RNA, 62 nt, hsa
uggguccacucauggccucagcugagaaaggagacgaugaacguguagcugacaugcacgaa

SEQ ID NO: 324283 - RNA, 62 nt, hsa
cgcuguuccgguuggcgagugacaccacugaugacgaugaugcacucgguaaguuuucuuuc

SEQ ID NO: 324284 - RNA, 58 nt, hsa; identical to SEQ ID NO: 324153

SEQ ID NO: 324285 - RNA, 62 nt, hsa
aggccccugaugcuccaaccucccggggggacgacgaugacaaugugaaaccaucacagcug

SEQ ID NO: 324286 - RNA, 62 nt, hsa
agcuauuaugcgcccgucuacagggggugcccgacgaugacggugccuucgcagucaaauua

SEQ ID NO: 324287 - RNA, 62 nt, hsa
aaguccuucuggacagugugaugccccugucagacgaugaccaguuuucaccggaagcagau

SEQ ID NO: 324288 - RNA, 62 nt, hsa
cucacccgccgggguccccuccgggcggggcagacgaugacucgccccucgcccacccgcuc

SEQ ID NO: 324289 - RNA, 62 nt, hsa
gggucagacgugcuguuaagagcaaagccacagacgaugacuuguccauucucaguggaugc

SEQ ID NO: 324290 - RNA, 62 nt, hsa
ggaagggccugcacgaacccuacagcgagagugacgaugauuggugcuaagcccgggcgagg

SEQ ID NO: 324291 - RNA, 62 nt, hsa
ugcuggacuucuacgagccgcggcggccagaggacgaugacccuacagaacaggugggcccc

SEQ ID NO: 324292 - RNA, 62 nt, hsa
ccugcccucauggugcucauucuacuugaguagacgaugaacuaguaaacaaauaaacaaga

SEQ ID NO: 324293 - RNA, 62 nt, hsa
ggagcccgaguggaccaaucggaagccuaagugacgaugacccucgcauguccuaggucccu

SEQ ID NO: 324294 - RNA, 62 nt, hsa
gcuaggcagagagcgcacccuacucuuuccgugacgaugagggcggcaaaaacagacauuuc

SEQ ID NO: 324295 - RNA, 62 nt, hsa
guuuuauauauauauuuuuuccuuucaaaucagacgaugagacuagaaggagaaauacuuuc

SEQ ID NO: 324296 - RNA, 62 nt, hsa
uuuaaucuggcacuuugcacugccacagaggugacgaugaacuauguauauaguuagauguu

SEQ ID NO: 324297 - RNA, 62 nt, hsa
gaagguauuuuuuaacucccaagcaguagcaggacgaugauagggcuggagggcuauggauu

SEQ ID NO: 324298 - RNA, 62 nt, hsa
uuuuacuggauuuaucuuaauaaaaagacucugacgaugauuguguuuuguuauaucuucaa

SEQ ID NO: 324299 - RNA, 64 nt, hsa
uauuauggaacagaucuugauagaugguuuaauuuucuccuaaagagaaauaaucaguugagaa

SEQ ID NO: 324300 - RNA, 64 nt, hsa
uuaaaaaagucguuucaggcuuaucagauaauaauucuccuauauuugaggggggcaugggaua

SEQ ID NO: 324301 - RNA, 64 nt, hsa
gcccagacuucuccuagacaucuagucuaaaacauucuccuaggaccagggaagccuggcuuac

SEQ ID NO: 324302 - RNA, 64 nt, hsa
gcaggucuaugaagaccagugguagugcccagacuucuccuagacaucuagucuaaaacauucu

SEQ ID NO: 324303 - RNA, 64 nt, hsa
ccaaaggacacuaugaacuuuuugaacugacaguuucuccuaacuuucugcuuuagcguaauug

SEQ ID NO: 324304 - RNA, 64 nt, hsa
auucugucugccuaagagaaucaaccaaaggugauucuccuaaagagcagugaaggaaauguca

SEQ ID NO: 324305 - RNA, 64 nt, hsa
aaaaagcaauucuuagaauacuuccuuuacauuauucuccuauuuuagacauuuugugaaagag

SEQ ID NO: 324306 - RNA, 64 nt, hsa
uaaaucuguagccuggguguacguuucacucaaguucuccuacugaggacucuugacuaacagc

SEQ ID NO: 324307 - RNA, 64 nt, hsa
gguccccuucaguaccucacgcaugguccccagcuucuccuaggaucccaguggcguuuaucag

SEQ ID NO: 324308 - RNA, 64 nt, hsa
caagcaucacugggaagggcauagccggagaccuuucuccuagugacugguagucaguggggca

SEQ ID NO: 324309 - RNA, 64 nt, hsa
uuuuuuuuuaacuaccuuaaacuuaagggaaaaguucuccuaucuugauuucacuggaauauag

SEQ ID NO: 324310 - RNA, 64 nt, hsa
ggcucauaacuuggccauguucuccaugaauuaguucuccuauuuuuuuuuuuaacuaccuuaa

SEQ ID NO: 324311 - RNA, 54 nt, hsa
aggggccaacguugcugugaauauuucuccuacccgauuccccaacaccacuag

SEQ ID NO: 324312 - RNA, 64 nt, hsa
acgucgcuaaacaggauaggacuaaaauuuccaauucuccuacacucugucagaagccuagaac

SEQ ID NO: 324313 - RNA, 64 nt, hsa
acagcccugucaaggaauaccaacagaauauugauucuccuaaacuguauaguaaccugcuaac

SEQ ID NO: 324314 - RNA, 64 nt, hsa
aaucauguugucuguguuguguuaugugagaauuuucuccuaagucaugcagguaaugacaaua

SEQ ID NO: 324315 - RNA, 64 nt, hsa
acaguuuuaaaaagaaaaaaaggucuauuuuuuuuucuccuauacuugggcuacauuuuuugau

SEQ ID NO: 324316 - RNA, 64 nt, hsa
caucuauguuuguguuugcucuuuaaacuauuguuucuccuaucccaaguucgcuuugcaucua

SEQ ID NO: 324317 - RNA, 64 nt, hsa
aacaagagagagagaaaguaaaggcaguaaugccuucuccuauuucuccaaagccuugugugaa

SEQ ID NO: 324318 - RNA, 64 nt, hsa
cuguagggguagagggguggggacagaaacaacuuucuccuacucuuccuuccuaauaggcauc

SEQ ID NO: 324319 - RNA, 64 nt, hsa
gccaagaccuuaggacauugggauuuuugugggaggagaguaauagguaauuagacacugauug

SEQ ID NO: 324320 - RNA, 64 nt, hsa
uucugauaauguucagggugccuuucuccuaccaggagaguacuguggcuuagaggaaagaaau

SEQ ID NO: 324321 - RNA, 64 nt, hsa; identical to SEQ ID NO: 89905

SEQ ID NO: 324322 - RNA, 64 nt, hsa; identical to SEQ ID NO: 89906

SEQ ID NO: 324323 - RNA, 64 nt, hsa; identical to SEQ ID NO: 89907

SEQ ID NO: 324324 - RNA, 64 nt, hsa; identical to SEQ ID NO: 89908

SEQ ID NO: 324325 - RNA, 64 nt, hsa; identical to SEQ ID NO: 89909

SEQ ID NO: 324326 - RNA, 64 nt, hsa; identical to SEQ ID NO: 89910

SEQ ID NO: 324327 - RNA, 64 nt, hsa; identical to SEQ ID NO: 89911

SEQ ID NO: 324328 - RNA, 64 nt, hsa; identical to SEQ ID NO: 89912

SEQ ID NO: 324329 - RNA, 64 nt, hsa; identical to SEQ ID NO: 89913

SEQ ID NO: 324330 - RNA, 64 nt, hsa; identical to SEQ ID NO: 89914

SEQ ID NO: 324331 - RNA, 64 nt, hsa; identical to SEQ ID NO: 89915

SEQ ID NO: 324332 - RNA, 64 nt, hsa; identical to SEQ ID NO: 89916

SEQ ID NO: 324333 - RNA, 64 nt, hsa; identical to SEQ ID NO: 89917

SEQ ID NO: 324334 - RNA, 64 nt, hsa; identical to SEQ ID NO: 89918

SEQ ID NO: 324335 - RNA, 64 nt, hsa; identical to SEQ ID NO: 89919

SEQ ID NO: 324336 - RNA, 64 nt, hsa; identical to SEQ ID NO: 89920

SEQ ID NO: 324337 - RNA, 64 nt, hsa; identical to SEQ ID NO: 89921

SEQ ID NO: 324338 - RNA, 64 nt, hsa; identical to SEQ ID NO: 89922

SEQ ID NO: 324339 - RNA, 64 nt, hsa; identical to SEQ ID NO: 89923

SEQ ID NO: 324340 - RNA, 64 nt, hsa; identical to SEQ ID NO: 89924

SEQ ID NO: 324341 - RNA, 64 nt, hsa; identical to SEQ ID NO: 89925

SEQ ID NO: 324342 - RNA, 64 nt, hsa; identical to SEQ ID NO: 89926

SEQ ID NO: 324343 - RNA, 64 nt, hsa; identical to SEQ ID NO: 89927

SEQ ID NO: 324344 - RNA, 64 nt, hsa; identical to SEQ ID NO: 89928

SEQ ID NO: 324345 - RNA, 50 nt, hsa; identical to SEQ ID NO: 89929

SEQ ID NO: 324346 - RNA, 64 nt, hsa; identical to SEQ ID NO: 89930

SEQ ID NO: 324347 - RNA, 64 nt, hsa; identical to SEQ ID NO: 89931

SEQ ID NO: 324348 - RNA, 64 nt, hsa; identical to SEQ ID NO: 89932

SEQ ID NO: 324349 - RNA, 64 nt, hsa; identical to SEQ ID NO: 89933

SEQ ID NO: 324350 - RNA, 64 nt, hsa; identical to SEQ ID NO: 89934

SEQ ID NO: 324351 - RNA, 64 nt, hsa; identical to SEQ ID NO: 89935

SEQ ID NO: 324352 - RNA, 64 nt, hsa; identical to SEQ ID NO: 89936

SEQ ID NO: 324353 - RNA, 64 nt, hsa; identical to SEQ ID NO: 89937

SEQ ID NO: 324354 - RNA, 64 nt, hsa; identical to SEQ ID NO: 89938

SEQ ID NO: 324355 - RNA, 64 nt, hsa; identical to SEQ ID NO: 89939

SEQ ID NO: 324356 - RNA, 64 nt, hsa; identical to SEQ ID NO: 89940

SEQ ID NO: 324357 - RNA, 64 nt, hsa; identical to SEQ ID NO: 89941

SEQ ID NO: 324358 - RNA, 55 nt, hsa; identical to SEQ ID NO: 89942

SEQ ID NO: 324359 - RNA, 64 nt, hsa; identical to SEQ ID NO: 89943

SEQ ID NO: 324360 - RNA, 64 nt, hsa; identical to SEQ ID NO: 89944

SEQ ID NO: 324361 - RNA, 64 nt, hsa; identical to SEQ ID NO: 89945

SEQ ID NO: 324362 - RNA, 64 nt, hsa; identical to SEQ ID NO: 89946

SEQ ID NO: 324363 - RNA, 64 nt, hsa; identical to SEQ ID NO: 89947

SEQ ID NO: 324364 - RNA, 64 nt, hsa; identical to SEQ ID NO: 89948

SEQ ID NO: 324365 - RNA, 64 nt, hsa; identical to SEQ ID NO: 89949

SEQ ID NO: 324366 - RNA, 64 nt, hsa; identical to SEQ ID NO: 89950

SEQ ID NO: 324367 - RNA, 64 nt, hsa; identical to SEQ ID NO: 89951

SEQ ID NO: 324368 - RNA, 64 nt, hsa; identical to SEQ ID NO: 89952

SEQ ID NO: 324369 - RNA, 64 nt, hsa; identical to SEQ ID NO: 89953

SEQ ID NO: 324370 - RNA, 64 nt, hsa; identical to SEQ ID NO: 89954

SEQ ID NO: 324371 - RNA, 64 nt, hsa; identical to SEQ ID NO: 89955

SEQ ID NO: 324372 - RNA, 64 nt, hsa; identical to SEQ ID NO: 89956

SEQ ID NO: 324373 - RNA, 64 nt, hsa; identical to SEQ ID NO: 89957

SEQ ID NO: 324374 - RNA, 64 nt, hsa; identical to SEQ ID NO: 89958

SEQ ID NO: 324375 - RNA, 64 nt, hsa; identical to SEQ ID NO: 89959

SEQ ID NO: 324376 - RNA, 64 nt, hsa; identical to SEQ ID NO: 89960

SEQ ID NO: 324377 - RNA, 64 nt, hsa; identical to SEQ ID NO: 89961

SEQ ID NO: 324378 - RNA, 64 nt, hsa; identical to SEQ ID NO: 89962

SEQ ID NO: 324379 - RNA, 64 nt, hsa; identical to SEQ ID NO: 89963

SEQ ID NO: 324380 - RNA, 64 nt, hsa; identical to SEQ ID NO: 89964

SEQ ID NO: 324381 - RNA, 64 nt, hsa; identical to SEQ ID NO: 89965

SEQ ID NO: 324382 - RNA, 64 nt, hsa; identical to SEQ ID NO: 89966

SEQ ID NO: 324383 - RNA, 64 nt, hsa; identical to SEQ ID NO: 89967

SEQ ID NO: 324384 - RNA, 64 nt, hsa; identical to SEQ ID NO: 89968

SEQ ID NO: 324385 - RNA, 64 nt, hsa; identical to SEQ ID NO: 89969

SEQ ID NO: 324386 - RNA, 64 nt, hsa; identical to SEQ ID NO: 89970

SEQ ID NO: 324387 - RNA, 64 nt, hsa; identical to SEQ ID NO: 89971

SEQ ID NO: 324388 - RNA, 64 nt, hsa; identical to SEQ ID NO: 89972

SEQ ID NO: 324389 - RNA, 64 nt, hsa; identical to SEQ ID NO: 89973

SEQ ID NO: 324390 - RNA, 64 nt, hsa; identical to SEQ ID NO: 89974

SEQ ID NO: 324391 - RNA, 64 nt, hsa; identical to SEQ ID NO: 89975

SEQ ID NO: 324392 - RNA, 64 nt, hsa; identical to SEQ ID NO: 89976

SEQ ID NO: 324393 - RNA, 64 nt, hsa; identical to SEQ ID NO: 89977

SEQ ID NO: 324394 - RNA, 64 nt, hsa; identical to SEQ ID NO: 89978

SEQ ID NO: 324395 - RNA, 64 nt, hsa; identical to SEQ ID NO: 89979

SEQ ID NO: 324396 - RNA, 64 nt, hsa; identical to SEQ ID NO: 89980

SEQ ID NO: 324397 - RNA, 64 nt, hsa; identical to SEQ ID NO: 89981

SEQ ID NO: 324398 - RNA, 64 nt, hsa; identical to SEQ ID NO: 89982

SEQ ID NO: 324399 - RNA, 64 nt, hsa; identical to SEQ ID NO: 89983

SEQ ID NO: 324400 - RNA, 64 nt, hsa; identical to SEQ ID NO: 89984

SEQ ID NO: 324401 - RNA, 64 nt, hsa; identical to SEQ ID NO: 89985

SEQ ID NO: 324402 - RNA, 64 nt, hsa; identical to SEQ ID NO: 89986

SEQ ID NO: 324403 - RNA, 64 nt, hsa; identical to SEQ ID NO: 89987

SEQ ID NO: 324404 - RNA, 64 nt, hsa; identical to SEQ ID NO: 89988

SEQ ID NO: 324405 - RNA, 59 nt, hsa; identical to SEQ ID NO: 89989

SEQ ID NO: 324406 - RNA, 64 nt, hsa; identical to SEQ ID NO: 89990

SEQ ID NO: 324407 - RNA, 64 nt, hsa; identical to SEQ ID NO: 89991

SEQ ID NO: 324408 - RNA, 64 nt, hsa; identical to SEQ ID NO: 89992

SEQ ID NO: 324409 - RNA, 64 nt, hsa; identical to SEQ ID NO: 89993

SEQ ID NO: 324410 - RNA, 64 nt, hsa; identical to SEQ ID NO: 89994

SEQ ID NO: 324411 - RNA, 64 nt, hsa; identical to SEQ ID NO: 89995

SEQ ID NO: 324412 - RNA, 64 nt, hsa; identical to SEQ ID NO: 89996

SEQ ID NO: 324413 - RNA, 64 nt, hsa; identical to SEQ ID NO: 89997

SEQ ID NO: 324414 - RNA, 64 nt, hsa; identical to SEQ ID NO: 89998

SEQ ID NO: 324415 - RNA, 64 nt, hsa; identical to SEQ ID NO: 89999

SEQ ID NO: 324416 - RNA, 64 nt, hsa; identical to SEQ ID NO: 90000

SEQ ID NO: 324417 - RNA, 64 nt, hsa; identical to SEQ ID NO: 90001

SEQ ID NO: 324418 - RNA, 64 nt, hsa; identical to SEQ ID NO: 90002

SEQ ID NO: 324419 - RNA, 64 nt, hsa; identical to SEQ ID NO: 90003

SEQ ID NO: 324420 - RNA, 64 nt, hsa; identical to SEQ ID NO: 90004

SEQ ID NO: 324421 - RNA, 64 nt, hsa; identical to SEQ ID NO: 90005

SEQ ID NO: 324422 - RNA, 64 nt, hsa; identical to SEQ ID NO: 90006

SEQ ID NO: 324423 - RNA, 64 nt, hsa; identical to SEQ ID NO: 90007

SEQ ID NO: 324424 - RNA, 64 nt, hsa; identical to SEQ ID NO: 90008

SEQ ID NO: 324425 - RNA, 64 nt, hsa; identical to SEQ ID NO: 90009

SEQ ID NO: 324426 - RNA, 64 nt, hsa; identical to SEQ ID NO: 90010

SEQ ID NO: 324427 - RNA, 64 nt, hsa; identical to SEQ ID NO: 90011

SEQ ID NO: 324428 - RNA, 64 nt, hsa; identical to SEQ ID NO: 90012

SEQ ID NO: 324429 - RNA, 64 nt, hsa; identical to SEQ ID NO: 90013

SEQ ID NO: 324430 - RNA, 64 nt, hsa; identical to SEQ ID NO: 90014

SEQ ID NO: 324431 - RNA, 64 nt, hsa; identical to SEQ ID NO: 90015

SEQ ID NO: 324432 - RNA, 64 nt, hsa; identical to SEQ ID NO: 90016

SEQ ID NO: 324433 - RNA, 64 nt, hsa; identical to SEQ ID NO: 90017

SEQ ID NO: 324434 - RNA, 64 nt, hsa; identical to SEQ ID NO: 90018

SEQ ID NO: 324435 - RNA, 64 nt, hsa; identical to SEQ ID NO: 90019

SEQ ID NO: 324436 - RNA, 64 nt, hsa; identical to SEQ ID NO: 90020

SEQ ID NO: 324437 - RNA, 64 nt, hsa; identical to SEQ ID NO: 90021

SEQ ID NO: 324438 - RNA, 64 nt, hsa; identical to SEQ ID NO: 90022

SEQ ID NO: 324439 - RNA, 64 nt, hsa; identical to SEQ ID NO: 90023

SEQ ID NO: 324440 - RNA, 64 nt, hsa; identical to SEQ ID NO: 90024

SEQ ID NO: 324441 - RNA, 64 nt, hsa; identical to SEQ ID NO: 90025

SEQ ID NO: 324442 - RNA, 64 nt, hsa; identical to SEQ ID NO: 90026

SEQ ID NO: 324443 - RNA, 64 nt, hsa; identical to SEQ ID NO: 90027

SEQ ID NO: 324444 - RNA, 64 nt, hsa; identical to SEQ ID NO: 90028

SEQ ID NO: 324445 - RNA, 64 nt, hsa; identical to SEQ ID NO: 90029

SEQ ID NO: 324446 - RNA, 64 nt, hsa; identical to SEQ ID NO: 90030

SEQ ID NO: 324447 - RNA, 64 nt, hsa; identical to SEQ ID NO: 90031

SEQ ID NO: 324448 - RNA, 64 nt, hsa; identical to SEQ ID NO: 90032

SEQ ID NO: 324449 - RNA, 64 nt, hsa; identical to SEQ ID NO: 90033

SEQ ID NO: 324450 - RNA, 64 nt, hsa; identical to SEQ ID NO: 90034

SEQ ID NO: 324451 - RNA, 64 nt, hsa; identical to SEQ ID NO: 90035

SEQ ID NO: 324452 - RNA, 64 nt, hsa; identical to SEQ ID NO: 90036

SEQ ID NO: 324453 - RNA, 64 nt, hsa; identical to SEQ ID NO: 90037

SEQ ID NO: 324454 - RNA, 64 nt, hsa; identical to SEQ ID NO: 90038

SEQ ID NO: 324455 - RNA, 64 nt, hsa; identical to SEQ ID NO: 90039

SEQ ID NO: 324456 - RNA, 64 nt, hsa; identical to SEQ ID NO: 90040

SEQ ID NO: 324457 - RNA, 64 nt, hsa; identical to SEQ ID NO: 90041

SEQ ID NO: 324458 - RNA, 64 nt, hsa; identical to SEQ ID NO: 90042

SEQ ID NO: 324459 - RNA, 64 nt, hsa; identical to SEQ ID NO: 90043

SEQ ID NO: 324460 - RNA, 64 nt, hsa; identical to SEQ ID NO: 90044

SEQ ID NO: 324461 - RNA, 64 nt, hsa; identical to SEQ ID NO: 90045

SEQ ID NO: 324462 - RNA, 64 nt, hsa; identical to SEQ ID NO: 90046

SEQ ID NO: 324463 - RNA, 64 nt, hsa; identical to SEQ ID NO: 90047

SEQ ID NO: 324464 - RNA, 64 nt, hsa; identical to SEQ ID NO: 90048

SEQ ID NO: 324465 - RNA, 64 nt, hsa; identical to SEQ ID NO: 90049

SEQ ID NO: 324466 - RNA, 64 nt, hsa; identical to SEQ ID NO: 90050

SEQ ID NO: 324467 - RNA, 64 nt, hsa; identical to SEQ ID NO: 90051

SEQ ID NO: 324468 - RNA, 64 nt, hsa; identical to SEQ ID NO: 90052

SEQ ID NO: 324469 - RNA, 64 nt, hsa; identical to SEQ ID NO: 90053

SEQ ID NO: 324470 - RNA, 64 nt, hsa; identical to SEQ ID NO: 90054

SEQ ID NO: 324471 - RNA, 64 nt, hsa; identical to SEQ ID NO: 90055

SEQ ID NO: 324472 - RNA, 64 nt, hsa; identical to SEQ ID NO: 90056

SEQ ID NO: 324473 - RNA, 64 nt, hsa; identical to SEQ ID NO: 90057

SEQ ID NO: 324474 - RNA, 64 nt, hsa; identical to SEQ ID NO: 90058

SEQ ID NO: 324475 - RNA, 64 nt, hsa; identical to SEQ ID NO: 90059

SEQ ID NO: 324476 - RNA, 64 nt, hsa; identical to SEQ ID NO: 90060

SEQ ID NO: 324477 - RNA, 64 nt, hsa; identical to SEQ ID NO: 90061

SEQ ID NO: 324478 - RNA, 64 nt, hsa; identical to SEQ ID NO: 90062

SEQ ID NO: 324479 - RNA, 64 nt, hsa; identical to SEQ ID NO: 90063

SEQ ID NO: 324480 - RNA, 64 nt, hsa; identical to SEQ ID NO: 90064

SEQ ID NO: 324481 - RNA, 64 nt, hsa; identical to SEQ ID NO: 90065

SEQ ID NO: 324482 - RNA, 64 nt, hsa; identical to SEQ ID NO: 90066

SEQ ID NO: 324483 - RNA, 64 nt, hsa; identical to SEQ ID NO: 90067

SEQ ID NO: 324484 - RNA, 64 nt, hsa; identical to SEQ ID NO: 90068

SEQ ID NO: 324485 - RNA, 64 nt, hsa; identical to SEQ ID NO: 90069

SEQ ID NO: 324486 - RNA, 64 nt, hsa; identical to SEQ ID NO: 90070

SEQ ID NO: 324487 - RNA, 64 nt, hsa; identical to SEQ ID NO: 90071

SEQ ID NO: 324488 - RNA, 64 nt, hsa; identical to SEQ ID NO: 90072

SEQ ID NO: 324489 - RNA, 64 nt, hsa; identical to SEQ ID NO: 90073

SEQ ID NO: 324490 - RNA, 64 nt, hsa; identical to SEQ ID NO: 90074

SEQ ID NO: 324491 - RNA, 64 nt, hsa; identical to SEQ ID NO: 90075

SEQ ID NO: 324492 - RNA, 64 nt, hsa; identical to SEQ ID NO: 90076

SEQ ID NO: 324493 - RNA, 64 nt, hsa; identical to SEQ ID NO: 90077

SEQ ID NO: 324494 - RNA, 64 nt, hsa; identical to SEQ ID NO: 90078

SEQ ID NO: 324495 - RNA, 64 nt, hsa; identical to SEQ ID NO: 90079

SEQ ID NO: 324496 - RNA, 64 nt, hsa; identical to SEQ ID NO: 90080

SEQ ID NO: 324497 - RNA, 64 nt, hsa; identical to SEQ ID NO: 90081

SEQ ID NO: 324498 - RNA, 64 nt, hsa; identical to SEQ ID NO: 90082

SEQ ID NO: 324499 - RNA, 64 nt, hsa; identical to SEQ ID NO: 90083

SEQ ID NO: 324500 - RNA, 64 nt, hsa; identical to SEQ ID NO: 90084

SEQ ID NO: 324501 - RNA, 64 nt, hsa; identical to SEQ ID NO: 22031

SEQ ID NO: 324502 - RNA, 64 nt, hsa; identical to SEQ ID NO: 22032

SEQ ID NO: 324503 - RNA, 64 nt, hsa; identical to SEQ ID NO: 22033

SEQ ID NO: 324504 - RNA, 64 nt, hsa; identical to SEQ ID NO: 22034

SEQ ID NO: 324505 - RNA, 64 nt, hsa; identical to SEQ ID NO: 22035

SEQ ID NO: 324506 - RNA, 64 nt, hsa; identical to SEQ ID NO: 22036

SEQ ID NO: 324507 - RNA, 64 nt, hsa; identical to SEQ ID NO: 22037

SEQ ID NO: 324508 - RNA, 64 nt, hsa; identical to SEQ ID NO: 22038

SEQ ID NO: 324509 - RNA, 64 nt, hsa; identical to SEQ ID NO: 22039

SEQ ID NO: 324510 - RNA, 64 nt, hsa; identical to SEQ ID NO: 22040

SEQ ID NO: 324511 - RNA, 64 nt, hsa; identical to SEQ ID NO: 22041

SEQ ID NO: 324512 - RNA, 64 nt, hsa; identical to SEQ ID NO: 22042

SEQ ID NO: 324513 - RNA, 64 nt, hsa; identical to SEQ ID NO: 22043

SEQ ID NO: 324514 - RNA, 64 nt, hsa; identical to SEQ ID NO: 22044

SEQ ID NO: 324515 - RNA, 64 nt, hsa; identical to SEQ ID NO: 22045

SEQ ID NO: 324516 - RNA, 64 nt, hsa; identical to SEQ ID NO: 22046

SEQ ID NO: 324517 - RNA, 64 nt, hsa; identical to SEQ ID NO: 22047

SEQ ID NO: 324518 - RNA, 64 nt, hsa; identical to SEQ ID NO: 22048

SEQ ID NO: 324519 - RNA, 64 nt, hsa; identical to SEQ ID NO: 22049

SEQ ID NO: 324520 - RNA, 64 nt, hsa; identical to SEQ ID NO: 22050

SEQ ID NO: 324521 - RNA, 64 nt, hsa; identical to SEQ ID NO: 22051

SEQ ID NO: 324522 - RNA, 64 nt, hsa; identical to SEQ ID NO: 22052

SEQ ID NO: 324523 - RNA, 64 nt, hsa; identical to SEQ ID NO: 22053

SEQ ID NO: 324524 - RNA, 64 nt, hsa; identical to SEQ ID NO: 22054

SEQ ID NO: 324525 - RNA, 64 nt, hsa; identical to SEQ ID NO: 22055

SEQ ID NO: 324526 - RNA, 64 nt, hsa; identical to SEQ ID NO: 22056

SEQ ID NO: 324527 - RNA, 64 nt, hsa; identical to SEQ ID NO: 22057

SEQ ID NO: 324528 - RNA, 64 nt, hsa; identical to SEQ ID NO: 22058

SEQ ID NO: 324529 - RNA, 64 nt, hsa; identical to SEQ ID NO: 22059

SEQ ID NO: 324530 - RNA, 64 nt, hsa; identical to SEQ ID NO: 22060

SEQ ID NO: 324531 - RNA, 64 nt, hsa; identical to SEQ ID NO: 22061

SEQ ID NO: 324532 - RNA, 64 nt, hsa; identical to SEQ ID NO: 22062

SEQ ID NO: 324533 - RNA, 64 nt, hsa; identical to SEQ ID NO: 22063

SEQ ID NO: 324534 - RNA, 64 nt, hsa; identical to SEQ ID NO: 22064

SEQ ID NO: 324535 - RNA, 64 nt, hsa; identical to SEQ ID NO: 22065

SEQ ID NO: 324536 - RNA, 64 nt, hsa; identical to SEQ ID NO: 22066

SEQ ID NO: 324537 - RNA, 64 nt, hsa; identical to SEQ ID NO: 22067

SEQ ID NO: 324538 - RNA, 52 nt, hsa; identical to SEQ ID NO: 22068

SEQ ID NO: 324539 - RNA, 64 nt, hsa; identical to SEQ ID NO: 22069

SEQ ID NO: 324540 - RNA, 64 nt, hsa; identical to SEQ ID NO: 22070

SEQ ID NO: 324541 - RNA, 64 nt, hsa; identical to SEQ ID NO: 22071

SEQ ID NO: 324542 - RNA, 64 nt, hsa; identical to SEQ ID NO: 22072

SEQ ID NO: 324543 - RNA, 64 nt, hsa; identical to SEQ ID NO: 22073

SEQ ID NO: 324544 - RNA, 64 nt, hsa; identical to SEQ ID NO: 22074

SEQ ID NO: 324545 - RNA, 64 nt, hsa; identical to SEQ ID NO: 22075

SEQ ID NO: 324546 - RNA, 64 nt, hsa; identical to SEQ ID NO: 22076

SEQ ID NO: 324547 - RNA, 64 nt, hsa; identical to SEQ ID NO: 22077

SEQ ID NO: 324548 - RNA, 64 nt, hsa; identical to SEQ ID NO: 22078

SEQ ID NO: 324549 - RNA, 64 nt, hsa; identical to SEQ ID NO: 22079

SEQ ID NO: 324550 - RNA, 64 nt, hsa; identical to SEQ ID NO: 22080

SEQ ID NO: 324551 - RNA, 64 nt, hsa; identical to SEQ ID NO: 22081

SEQ ID NO: 324552 - RNA, 64 nt, hsa; identical to SEQ ID NO: 22082

SEQ ID NO: 324553 - RNA, 53 nt, hsa; identical to SEQ ID NO: 22083

SEQ ID NO: 324554 - RNA, 64 nt, hsa; identical to SEQ ID NO: 22084

SEQ ID NO: 324555 - RNA, 64 nt, hsa; identical to SEQ ID NO: 22085

SEQ ID NO: 324556 - RNA, 64 nt, hsa; identical to SEQ ID NO: 22086

SEQ ID NO: 324557 - RNA, 64 nt, hsa; identical to SEQ ID NO: 22087

SEQ ID NO: 324558 - RNA, 64 nt, hsa; identical to SEQ ID NO: 22088

SEQ ID NO: 324559 - RNA, 64 nt, hsa; identical to SEQ ID NO: 22089

SEQ ID NO: 324560 - RNA, 64 nt, hsa; identical to SEQ ID NO: 22090

SEQ ID NO: 324561 - RNA, 64 nt, hsa; identical to SEQ ID NO: 22091

SEQ ID NO: 324562 - RNA, 64 nt, hsa; identical to SEQ ID NO: 82929

SEQ ID NO: 324563 - RNA, 64 nt, hsa; identical to SEQ ID NO: 82930

SEQ ID NO: 324564 - RNA, 64 nt, hsa; identical to SEQ ID NO: 82931

SEQ ID NO: 324565 - RNA, 64 nt, hsa; identical to SEQ ID NO: 82932

SEQ ID NO: 324566 - RNA, 64 nt, hsa; identical to SEQ ID NO: 82933

SEQ ID NO: 324567 - RNA, 64 nt, hsa; identical to SEQ ID NO: 82934

SEQ ID NO: 324568 - RNA, 64 nt, hsa; identical to SEQ ID NO: 82935

SEQ ID NO: 324569 - RNA, 64 nt, hsa; identical to SEQ ID NO: 82936

SEQ ID NO: 324570 - RNA, 64 nt, hsa; identical to SEQ ID NO: 82937

SEQ ID NO: 324571 - RNA, 64 nt, hsa; identical to SEQ ID NO: 82938

SEQ ID NO: 324572 - RNA, 64 nt, hsa; identical to SEQ ID NO: 82939

SEQ ID NO: 324573 - RNA, 64 nt, hsa; identical to SEQ ID NO: 82940

SEQ ID NO: 324574 - RNA, 64 nt, hsa; identical to SEQ ID NO: 82941

SEQ ID NO: 324575 - RNA, 64 nt, hsa; identical to SEQ ID NO: 82942

SEQ ID NO: 324576 - RNA, 64 nt, hsa; identical to SEQ ID NO: 82943

SEQ ID NO: 324577 - RNA, 64 nt, hsa; identical to SEQ ID NO: 82944

SEQ ID NO: 324578 - RNA, 64 nt, hsa; identical to SEQ ID NO: 82945

SEQ ID NO: 324579 - RNA, 64 nt, hsa; identical to SEQ ID NO: 82946

SEQ ID NO: 324580 - RNA, 64 nt, hsa; identical to SEQ ID NO: 82947

SEQ ID NO: 324581 - RNA, 64 nt, hsa; identical to SEQ ID NO: 82948

SEQ ID NO: 324582 - RNA, 64 nt, hsa; identical to SEQ ID NO: 82949

SEQ ID NO: 324583 - RNA, 64 nt, hsa; identical to SEQ ID NO: 82950

SEQ ID NO: 324584 - RNA, 64 nt, hsa; identical to SEQ ID NO: 82951

SEQ ID NO: 324585 - RNA, 64 nt, hsa; identical to SEQ ID NO: 82952

SEQ ID NO: 324586 - RNA, 64 nt, hsa; identical to SEQ ID NO: 82953

SEQ ID NO: 324587 - RNA, 64 nt, hsa; identical to SEQ ID NO: 82954

SEQ ID NO: 324588 - RNA, 64 nt, hsa; identical to SEQ ID NO: 82955

SEQ ID NO: 324589 - RNA, 64 nt, hsa; identical to SEQ ID NO: 82956

SEQ ID NO: 324590 - RNA, 64 nt, hsa; identical to SEQ ID NO: 82957

SEQ ID NO: 324591 - RNA, 64 nt, hsa; identical to SEQ ID NO: 82958

SEQ ID NO: 324592 - RNA, 64 nt, hsa; identical to SEQ ID NO: 82959

SEQ ID NO: 324593 - RNA, 64 nt, hsa; identical to SEQ ID NO: 82960

SEQ ID NO: 324594 - RNA, 64 nt, hsa; identical to SEQ ID NO: 82961

SEQ ID NO: 324595 - RNA, 64 nt, hsa; identical to SEQ ID NO: 82962

SEQ ID NO: 324596 - RNA, 64 nt, hsa; identical to SEQ ID NO: 82963

SEQ ID NO: 324597 - RNA, 64 nt, hsa; identical to SEQ ID NO: 82964

SEQ ID NO: 324598 - RNA, 64 nt, hsa; identical to SEQ ID NO: 82965

SEQ ID NO: 324599 - RNA, 64 nt, hsa; identical to SEQ ID NO: 82966

SEQ ID NO: 324600 - RNA, 64 nt, hsa; identical to SEQ ID NO: 82967

SEQ ID NO: 324601 - RNA, 64 nt, hsa; identical to SEQ ID NO: 82968

SEQ ID NO: 324602 - RNA, 64 nt, hsa; identical to SEQ ID NO: 82969

SEQ ID NO: 324603 - RNA, 64 nt, hsa; identical to SEQ ID NO: 82970

SEQ ID NO: 324604 - RNA, 64 nt, hsa; identical to SEQ ID NO: 82971

SEQ ID NO: 324605 - RNA, 64 nt, hsa; identical to SEQ ID NO: 82972

SEQ ID NO: 324606 - RNA, 64 nt, hsa; identical to SEQ ID NO: 82973

SEQ ID NO: 324607 - RNA, 64 nt, hsa; identical to SEQ ID NO: 82974

SEQ ID NO: 324608 - RNA, 64 nt, hsa; identical to SEQ ID NO: 82975

SEQ ID NO: 324609 - RNA, 64 nt, hsa; identical to SEQ ID NO: 82976

SEQ ID NO: 324610 - RNA, 64 nt, hsa; identical to SEQ ID NO: 82977

SEQ ID NO: 324611 - RNA, 64 nt, hsa; identical to SEQ ID NO: 82978

SEQ ID NO: 324612 - RNA, 64 nt, hsa; identical to SEQ ID NO: 82979

SEQ ID NO: 324613 - RNA, 64 nt, hsa; identical to SEQ ID NO: 82980

SEQ ID NO: 324614 - RNA, 64 nt, hsa; identical to SEQ ID NO: 82981

SEQ ID NO: 324615 - RNA, 64 nt, hsa; identical to SEQ ID NO: 82982

SEQ ID NO: 324616 - RNA, 64 nt, hsa
agaucuuagguuccaagauuuuacuucaaauuacaccuucaaaacuggagcagcauauagccga

SEQ ID NO: 324617 - RNA, 64 nt, hsa
auacaguuguuuuugaaauuuaacuuuuguuuguaccuucaauguguaaguacaugcauguuuu

SEQ ID NO: 324618 - RNA, 64 nt, hsa
gauuguuugagcgagggaaguugaggcugcagugaacuaugauuuuaccacugcacuccagcuu

SEQ ID NO: 324619 - RNA, 64 nt, hsa
auuuaaucuggaagagaacauaugccaauuuuuaaacuaugacagcuuuuuuuuuucucuuucc

SEQ ID NO: 324620 - RNA, 64 nt, hsa
acuauuuuuguaauaaaacaaugacagcuguaguaacuaugauggguguaacaacauuuuuuua

SEQ ID NO: 324621 - RNA, 64 nt, hsa
aucacacauuuaaaaaaucuguagaauuuauuuuaacuaugaccuuuaauugaaaauaaauaau

SEQ ID NO: 324622 - RNA, 64 nt, hsa
uuauuaaaucuguauccauuaaaguaacuuuuuuaacuaugagaauuagaaaauaagggacaac

SEQ ID NO: 324623 - RNA, 64 nt, hsa
ccuagaacuaagaucuuauaaccacacuccaugcaacuaugagucucuaaaucucucuguaaga

SEQ ID NO: 324624 - RNA, 64 nt, hsa
acuaaagaccagaauauaaaaagcaaaauuuuaaaacuaugaugaaaguagaauccguuacuuu

SEQ ID NO: 324625 - RNA, 64 nt, hsa
cauugcacauuacaugaucacuuccagaguagaaaacuaugaaugugggauagccuucugaaaa

SEQ ID NO: 324626 - RNA, 64 nt, hsa; identical to SEQ ID NO: 154357

SEQ ID NO: 324627 - RNA, 64 nt, hsa; identical to SEQ ID NO: 154358

SEQ ID NO: 324628 - RNA, 64 nt, hsa; identical to SEQ ID NO: 154359

SEQ ID NO: 324629 - RNA, 64 nt, hsa; identical to SEQ ID NO: 154360

SEQ ID NO: 324630 - RNA, 64 nt, hsa; identical to SEQ ID NO: 154361

SEQ ID NO: 324631 - RNA, 64 nt, hsa; identical to SEQ ID NO: 154362

SEQ ID NO: 324632 - RNA, 64 nt, hsa; identical to SEQ ID NO: 154363

SEQ ID NO: 324633 - RNA, 64 nt, hsa; identical to SEQ ID NO: 154364

SEQ ID NO: 324634 - RNA, 64 nt, hsa; identical to SEQ ID NO: 154365

SEQ ID NO: 324635 - RNA, 64 nt, hsa; identical to SEQ ID NO: 154366

SEQ ID NO: 324636 - RNA, 64 nt, hsa; identical to SEQ ID NO: 154367

SEQ ID NO: 324637 - RNA, 64 nt, hsa; identical to SEQ ID NO: 154368

SEQ ID NO: 324638 - RNA, 64 nt, hsa; identical to SEQ ID NO: 154369

SEQ ID NO: 324639 - RNA, 64 nt, hsa; identical to SEQ ID NO: 154370

SEQ ID NO: 324640 - RNA, 64 nt, hsa; identical to SEQ ID NO: 154371

SEQ ID NO: 324641 - RNA, 64 nt, hsa; identical to SEQ ID NO: 154372

SEQ ID NO: 324642 - RNA, 64 nt, hsa; identical to SEQ ID NO: 154373

SEQ ID NO: 324643 - RNA, 64 nt, hsa; identical to SEQ ID NO: 154374

SEQ ID NO: 324644 - RNA, 64 nt, hsa; identical to SEQ ID NO: 154375

SEQ ID NO: 324645 - RNA, 64 nt, hsa; identical to SEQ ID NO: 154376

SEQ ID NO: 324646 - RNA, 64 nt, hsa; identical to SEQ ID NO: 154377

SEQ ID NO: 324647 - RNA, 64 nt, hsa; identical to SEQ ID NO: 154378

SEQ ID NO: 324648 - RNA, 64 nt, hsa; identical to SEQ ID NO: 154379

SEQ ID NO: 324649 - RNA, 64 nt, hsa; identical to SEQ ID NO: 154380

SEQ ID NO: 324650 - RNA, 64 nt, hsa; identical to SEQ ID NO: 154381

SEQ ID NO: 324651 - RNA, 64 nt, hsa; identical to SEQ ID NO: 154382

SEQ ID NO: 324652 - RNA, 64 nt, hsa; identical to SEQ ID NO: 154383

SEQ ID NO: 324653 - RNA, 64 nt, hsa; identical to SEQ ID NO: 154384

SEQ ID NO: 324654 - RNA, 64 nt, hsa; identical to SEQ ID NO: 154385

SEQ ID NO: 324655 - RNA, 64 nt, hsa; identical to SEQ ID NO: 154386

SEQ ID NO: 324656 - RNA, 64 nt, hsa; identical to SEQ ID NO: 154387

SEQ ID NO: 324657 - RNA, 64 nt, hsa; identical to SEQ ID NO: 154388

SEQ ID NO: 324658 - RNA, 64 nt, hsa; identical to SEQ ID NO: 154389

SEQ ID NO: 324659 - RNA, 64 nt, hsa; identical to SEQ ID NO: 154390

SEQ ID NO: 324660 - RNA, 64 nt, hsa
uuuauauuucguuuuaaaaacacccaugauguggcacaguaaacaaacccuguuaugcuguauu

SEQ ID NO: 324661 - RNA, 64 nt, hsa
cacagccgagaaacagugcagcaguauaugugcacacaguaaguacacaaauuugagcaacagu

SEQ ID NO: 324662 - RNA, 64 nt, hsa
ucaaugcuauuaaaucauacaaaagcaaauuuugcacaguaaaccaauaguuugagauuuaaaa

SEQ ID NO: 324663 - RNA, 64 nt, hsa
cuauuucauauuaauuccaggugauuuguuuuuucacaguaaaccauguaaguggaagcuuuac

SEQ ID NO: 324664 - RNA, 64 nt, hsa
uacaauguaaaccuaggagcauuaagacuugucacacaguaaaccugauacaucagaggugaau

SEQ ID NO: 324665 - RNA, 64 nt, hsa
gaccacacagaaccagggcugccccuguaauccccacaguaagaaaguuguauggcauauucca

SEQ ID NO: 324666 - RNA, 64 nt, hsa
cguacauaugauaaaguucaguuuauaaguuaggcacaguaagagacuaacaacagcucacagc

SEQ ID NO: 324667 - RNA, 64 nt, hsa
agguuuuccuagauacaaaauggaauuucaggagcacaguaaauuucagggucugucuaucuua

SEQ ID NO: 324668 - RNA, 64 nt, hsa
gaaagcggacuuuaaaaaaaauaaugugcuguaacacaguaaauauguacuuguagccuggaua

SEQ ID NO: 324669 - RNA, 64 nt, hsa
caauugaugugaccacacucuucuuaauuuuguucacaguaaaaacacuuuuuugaguuauuag

SEQ ID NO: 324670 - RNA, 64 nt, hsa; identical to SEQ ID NO: 296934

SEQ ID NO: 324671 - RNA, 64 nt, hsa; identical to SEQ ID NO: 296935

SEQ ID NO: 324672 - RNA, 64 nt, hsa; identical to SEQ ID NO: 296936

SEQ ID NO: 324673 - RNA, 64 nt, hsa; identical to SEQ ID NO: 296937

SEQ ID NO: 324674 - RNA, 64 nt, hsa; identical to SEQ ID NO: 296938

SEQ ID NO: 324675 - RNA, 64 nt, hsa; identical to SEQ ID NO: 296939

SEQ ID NO: 324676 - RNA, 64 nt, hsa; identical to SEQ ID NO: 296940

SEQ ID NO: 324677 - RNA, 64 nt, hsa; identical to SEQ ID NO: 296941

SEQ ID NO: 324678 - RNA, 64 nt, hsa; identical to SEQ ID NO: 296942

SEQ ID NO: 324679 - RNA, 64 nt, hsa; identical to SEQ ID NO: 296943

SEQ ID NO: 324680 - RNA, 64 nt, hsa; identical to SEQ ID NO: 296944

SEQ ID NO: 324681 - RNA, 64 nt, hsa; identical to SEQ ID NO: 296945

SEQ ID NO: 324682 - RNA, 64 nt, hsa; identical to SEQ ID NO: 296946

SEQ ID NO: 324683 - RNA, 64 nt, hsa; identical to SEQ ID NO: 296947

SEQ ID NO: 324684 - RNA, 64 nt, hsa; identical to SEQ ID NO: 296948

SEQ ID NO: 324685 - RNA, 64 nt, hsa; identical to SEQ ID NO: 296949

SEQ ID NO: 324686 - RNA, 64 nt, hsa; identical to SEQ ID NO: 296950

SEQ ID NO: 324687 - RNA, 64 nt, hsa; identical to SEQ ID NO: 296951

SEQ ID NO: 324688 - RNA, 64 nt, hsa; identical to SEQ ID NO: 296952

SEQ ID NO: 324689 - RNA, 64 nt, hsa; identical to SEQ ID NO: 296953

SEQ ID NO: 324690 - RNA, 64 nt, hsa; identical to SEQ ID NO: 296954

SEQ ID NO: 324691 - RNA, 64 nt, hsa; identical to SEQ ID NO: 296955

SEQ ID NO: 324692 - RNA, 64 nt, hsa; identical to SEQ ID NO: 296956

SEQ ID NO: 324693 - RNA, 64 nt, hsa; identical to SEQ ID NO: 296957

SEQ ID NO: 324694 - RNA, 64 nt, hsa; identical to SEQ ID NO: 296958

SEQ ID NO: 324695 - RNA, 64 nt, hsa; identical to SEQ ID NO: 296959

SEQ ID NO: 324696 - RNA, 64 nt, hsa; identical to SEQ ID NO: 296960

SEQ ID NO: 324697 - RNA, 64 nt, hsa; identical to SEQ ID NO: 296961

SEQ ID NO: 324698 - RNA, 64 nt, hsa; identical to SEQ ID NO: 296962

SEQ ID NO: 324699 - RNA, 64 nt, hsa; identical to SEQ ID NO: 296963

SEQ ID NO: 324700 - RNA, 64 nt, hsa; identical to SEQ ID NO: 296964

SEQ ID NO: 324701 - RNA, 64 nt, hsa; identical to SEQ ID NO: 296965

SEQ ID NO: 324702 - RNA, 64 nt, hsa; identical to SEQ ID NO: 296966

SEQ ID NO: 324703 - RNA, 64 nt, hsa; identical to SEQ ID NO: 296967

SEQ ID NO: 324704 - RNA, 64 nt, hsa; identical to SEQ ID NO: 296968

SEQ ID NO: 324705 - RNA, 64 nt, hsa; identical to SEQ ID NO: 296969

SEQ ID NO: 324706 - RNA, 64 nt, hsa; identical to SEQ ID NO: 296970

SEQ ID NO: 324707 - RNA, 64 nt, hsa; identical to SEQ ID NO: 296971

SEQ ID NO: 324708 - RNA, 64 nt, hsa; identical to SEQ ID NO: 296972

SEQ ID NO: 324709 - RNA, 64 nt, hsa; identical to SEQ ID NO: 296973

SEQ ID NO: 324710 - RNA, 64 nt, hsa; identical to SEQ ID NO: 296974

SEQ ID NO: 324711 - RNA, 64 nt, hsa; identical to SEQ ID NO: 296975

SEQ ID NO: 324712 - RNA, 64 nt, hsa; identical to SEQ ID NO: 296976

SEQ ID NO: 324713 - RNA, 64 nt, hsa; identical to SEQ ID NO: 296977

SEQ ID NO: 324714 - RNA, 64 nt, hsa; identical to SEQ ID NO: 296978

SEQ ID NO: 324715 - RNA, 64 nt, hsa; identical to SEQ ID NO: 296979

SEQ ID NO: 324716 - RNA, 64 nt, hsa; identical to SEQ ID NO: 296980

SEQ ID NO: 324717 - RNA, 64 nt, hsa; identical to SEQ ID NO: 296981

SEQ ID NO: 324718 - RNA, 64 nt, hsa; identical to SEQ ID NO: 296982

SEQ ID NO: 324719 - RNA, 64 nt, hsa; identical to SEQ ID NO: 296983

SEQ ID NO: 324720 - RNA, 64 nt, hsa; identical to SEQ ID NO: 296984

SEQ ID NO: 324721 - RNA, 64 nt, hsa; identical to SEQ ID NO: 296985

SEQ ID NO: 324722 - RNA, 64 nt, hsa; identical to SEQ ID NO: 296986

SEQ ID NO: 324723 - RNA, 64 nt, hsa; identical to SEQ ID NO: 296987

SEQ ID NO: 324724 - RNA, 64 nt, hsa; identical to SEQ ID NO: 296988

SEQ ID NO: 324725 - RNA, 64 nt, hsa; identical to SEQ ID NO: 296989

SEQ ID NO: 324726 - RNA, 64 nt, hsa; identical to SEQ ID NO: 296990

SEQ ID NO: 324727 - RNA, 64 nt, hsa; identical to SEQ ID NO: 296991

SEQ ID NO: 324728 - RNA, 64 nt, hsa; identical to SEQ ID NO: 296992

SEQ ID NO: 324729 - RNA, 64 nt, hsa; identical to SEQ ID NO: 296993

SEQ ID NO: 324730 - RNA, 64 nt, hsa; identical to SEQ ID NO: 296994

SEQ ID NO: 324731 - RNA, 64 nt, hsa
gagaccauauuuucucucccuccauuucuacccagaccuccaggccuccuucuggaaucauaga

SEQ ID NO: 324732 - RNA, 64 nt, hsa
ccaacacugcaccuuaucccaggaaccugcccuagaccuccagagaccauauuuucucucccuc

SEQ ID NO: 324733 - RNA, 64 nt, hsa
auaacucaccaaagcucaacgcugccccugccucgaccuccaugggucucuucguguuccucgu

SEQ ID NO: 324734 - RNA, 64 nt, hsa
agggagcggagauuccucauaggugaguccaaaugaccuccagccucucgaaggcaucaagaca

SEQ ID NO: 324735 - RNA, 64 nt, hsa
cuaccagaagaaggguggagucagaaaccaaagugaccuccagagcuguccuccuggcaccuga

SEQ ID NO: 324736 - RNA, 64 nt, hsa
gacagaggcagggcagcauggagacagguagacagaccuccaggucccuaagcuggggacagag

SEQ ID NO: 324737 - RNA, 64 nt, hsa
aaaaaaauguagcgacagcauuuuaagguucucagaccuccagugaguaccugcaaaaaugagu

SEQ ID NO: 324738 - RNA, 64 nt, hsa
ucuguuacccagggcucugcagcaccucaccugagaccuccacuccacaucugcaucacucaug

SEQ ID NO: 324739 - RNA, 64 nt, hsa
cagcuaaaaugugauuauuuuccaagcucaguuggaccuccagacccaucacugaccauuugcc

SEQ ID NO: 324740 - RNA, 64 nt, hsa
ccuuggggggugaagcugucaaugccaccaguuggaccuccauacauucugagcuaacccagaa

SEQ ID NO: 324741 - RNA, 64 nt, hsa
uugcuugaaaucaaggugcuccaacuuaguuuaagaccuccagacucuaacuuuauagaucauc

SEQ ID NO: 324742 - RNA, 64 nt, hsa
gagaaguguauaguaguacacggggggaagaggggaccuccaugucccuuuguuggauacauau

SEQ ID NO: 324743 - RNA, 60 nt, hsa
gggaugggcucgcugaaccucgaggaacuccaggacgaggaggacaugggacuugcgugg

SEQ ID NO: 324744 - RNA, 60 nt, hsa
aggccugcggggcgggggcgggguggcgcccaggacgacuccccgggcucagcuuggcug

SEQ ID NO: 324745 - RNA, 60 nt, hsa
caugaccguaacaugugaccugugugcuggcaggacgacucacugcggcugcgccacugg

SEQ ID NO: 324746 - RNA, 60 nt, hsa
augcagcuuucccuagggggaggccuacaacaggacgaccauucugagccagugagucua

SEQ ID NO: 324747 - RNA, 60 nt, hsa
accaaggugcugcuggucuccuggaccuaccaggacgaggagcuggggagcuuccucaca

SEQ ID NO: 324748 - RNA, 60 nt, hsa
uuuccuuguggcccugccaaccagcucuuccaggacgaacucaguccagcaugguuuuga

SEQ ID NO: 324749 - RNA, 60 nt, hsa
aguggggagggggagauuuauucucauuuucaggacgagacuuuugcccuacaucuuucc

SEQ ID NO: 324750 - RNA, 60 nt, hsa
gacacacuccaccuccagcacgcgacuucucaggacgacgaaucuucucaaugggggggc

SEQ ID NO: 324751 - RNA, 60 nt, hsa
uuuuccaaacacaggcaaauccgaaaucagcaggacgacuguuuucccaacacggguaaa

SEQ ID NO: 324752 - RNA, 60 nt, hsa
gagcagaugaccaccaugcucugugucagccaggacgaagggagacaucugggugccagg

SEQ ID NO: 324753 - RNA, 60 nt, hsa
gugaaaaacauccagauacacccaaaguaucaggacgagaaugaggguccuuugggaaag

SEQ ID NO: 324754 - RNA, 60 nt, hsa
auccuuuuuuaaaaaaucugccaauagacccaggacgaguaagagaggaagcaucaaccu

SEQ ID NO: 324755 - RNA, 60 nt, hsa
agacaacggagggcagcgcccccccgagaucaggacgaaggaccaccgucgguccucagc

SEQ ID NO: 324756 - RNA, 60 nt, hsa
caccuggaggauguaccagaagcacuagaccaggacgaccuccagcgcgaucuccagcag

SEQ ID NO: 324757 - RNA, 60 nt, hsa
uaggaggagauguuaaaguaacccaucuugcaggacgacauugaagauuggucuucuguu

SEQ ID NO: 324758 - RNA, 60 nt, hsa
gucaggaaaaggcaauauaucaggucuccucaggacgauggaggccuuauaugguguguu

SEQ ID NO: 324759 - RNA, 60 nt, hsa
auguauuuuugucaauuaccagaaagauaacaggacgagaugacgguguuauuccaaggg

SEQ ID NO: 324760 - RNA, 60 nt, hsa
guagucccagcuacucaggaggcucagcagcaggacgacuugagcccaagaguuccagac

SEQ ID NO: 324761 - RNA, 60 nt, hsa
accugccgcuggaagcuauugggcuggcagcaggacgacuggcuguccuccugcccaccc

SEQ ID NO: 324762 - RNA, 60 nt, hsa
ugcguguugagggcucaucugcuucucguccaggacgacauuuccagcuucaucuuugau

SEQ ID NO: 324763 - RNA, 60 nt, hsa
caacuucaaauagucugaugccugcuuccccaggacgagugacucuuccacggugugcug

SEQ ID NO: 324764 - RNA, 60 nt, hsa
gugugucagggucacgaacccguuacauuucaggacgauccuuuuuccuucagcagcauu

SEQ ID NO: 324765 - RNA, 60 nt, hsa
cuguuuuugaacacggggucauucugcagucaggacgaaccgguccccgucgcagacgga

SEQ ID NO: 324766 - RNA, 60 nt, hsa
gaugcuguuucuccggcagaaccaacccuccaggacgaaguuucagaauuggcugauggu

SEQ ID NO: 324767 - RNA, 60 nt, hsa
caguuccagaaagaacccaagcucaagacgcaggacgagcucaguuguagagggcuaauu

SEQ ID NO: 324768 - RNA, 60 nt, hsa
ucuuuucuaaaugaaacuccauguagcaaccaggacgaaguugagaaggaaaacgccaaa

SEQ ID NO: 324769 - RNA, 60 nt, hsa
caugacuuuuagauaugagaugacgggaagcaggacgaaauaucggcguguggcuggagc

SEQ ID NO: 324770 - RNA, 60 nt, hsa
ucuaaacggaugcugcuggguguugcgacccaggacgagaugccuuguuucuuuuacaau

SEQ ID NO: 324771 - RNA, 60 nt, hsa
cucagagcgccaggaagccagagccccaagcaggacgaaaaagaggcauacacacagcag

SEQ ID NO: 324772 - RNA, 60 nt, hsa
cuuuaacauggacacucaugagucauccuccaggacgaccagugcauccucaagcucugc

SEQ ID NO: 324773 - RNA, 60 nt, hsa
caagggcuggccgcagcuccugugcccugucaggacgacugagggcucaaacacaccaca

SEQ ID NO: 324774 - RNA, 60 nt, hsa
cuguaaucccagcuacucgggaggcugaggcaggacgauuacuugagcuugggaaaucaa

SEQ ID NO: 324775 - RNA, 60 nt, hsa
ucauguaucucucuguggugguucauuccacaggacgaaugcauauucaacacacugccu

SEQ ID NO: 324776 - RNA, 60 nt, hsa
gcucaucauucagauggcuuuccagaugaccaggacgagugggauauuuugcccccaacu

SEQ ID NO: 324777 - RNA, 60 nt, hsa
auagugguccucuuacagagaaacggggagcaggacgacgggggggcuggggguggcggg

SEQ ID NO: 324778 - RNA, 60 nt, hsa
ggaccucuaaugugggcaugucguccaccccaggacgagccaucagggacagacccccca

SEQ ID NO: 324779 - RNA, 60 nt, hsa
agcugugugucuugggccaccaguggccugcaggacgaagguacuguuccaucaccugcg

SEQ ID NO: 324780 - RNA, 60 nt, hsa
agacugcuaaguaggggcagugaugguugccaggacgaauugagauaauaucugugaggu

SEQ ID NO: 324781 - RNA, 60 nt, hsa
uaauaaacacauuuguaaauacauuguuugcaggacgaaaacuucugaguuacagcucag

SEQ ID NO: 324782 - RNA, 60 nt, hsa
ugggaggccgaggcgggcggaucacaaagucaggacgagaccauccuggcuaacacggug

SEQ ID NO: 324783 - RNA, 60 nt, hsa
guuucagcaauuccugcagagccugcagcccaggacgacugaaggugaggcaggagggug

SEQ ID NO: 324784 - RNA, 60 nt, hsa
aggguacgaugaggccugggcucagugagccaggacgaaugugacagacaccccuugcug

SEQ ID NO: 324785 - RNA, 60 nt, hsa
ucucugcuucucagcagcuguccuacuccccaggacgaguuuucacuagagggcccacga

SEQ ID NO: 324786 - RNA, 60 nt, hsa
uuuuccaagccgccaggguccugacggcagcaggacgaagccuguuguggcgucuucugg

SEQ ID NO: 324787 - RNA, 60 nt, hsa
gauggcugagguuagugugcuuggaggcugcaggacgaacugucgauguuucuuagcaga

SEQ ID NO: 324788 - RNA, 60 nt, hsa
gccaggcagagucuugugcuguucccagaacaggacgacagugaaaagaacacucuugac

SEQ ID NO: 324789 - RNA, 60 nt, hsa
gaagcagucccuccucaccagcucuccagccaggacgaucacacagagaugaauggcauc

SEQ ID NO: 324790 - RNA, 60 nt, hsa
gugccccaucagcagcuugacgcguggucacaggacgauuucacugacacugcgaacucu

SEQ ID NO: 324791 - RNA, 60 nt, hsa
caccaccccccugcugagggggccuccaggcaggacgagacuccucgggcaagggccgug

SEQ ID NO: 324792 - RNA, 60 nt, hsa
cuggaggccauggacagcccugugagccuacaggacgagcaccagggccgcagcuuccgg

SEQ ID NO: 324793 - RNA, 60 nt, hsa
cugcugugggccaaagccaagcccaucugccaggacgagguaaugucagagcuccaucag

SEQ ID NO: 324794 - RNA, 60 nt, hsa
accgcggccccuguaggccaaggcgccaggcaggacgacagcagcagcagcgcgucuccu

SEQ ID NO: 324795 - RNA, 60 nt, hsa
ccaggacaggccaucugcagugacccagcccaggacgaaguuuacaaacaccuccuggaa

SEQ ID NO: 324796 - RNA, 60 nt, hsa
gcaucugacuugccacuagcacaggaagcucaggacgaaggcagcguuaggagaauaguu

SEQ ID NO: 324797 - RNA, 60 nt, hsa
cuguaaucccagcacuuugggaggccaaagcaggacgaucacuugagcccaggaguucaa

SEQ ID NO: 324798 - RNA, 60 nt, hsa
cugugggguuugcagaauuagugaaggguccaggacgaucccagugggcucgcuuccaaa

SEQ ID NO: 324799 - RNA, 60 nt, hsa
gcugauggcacacccauccuuaagcuaagacaggacgauugugguccucccacacuaagg

SEQ ID NO: 324800 - RNA, 60 nt, hsa
gagugucacaucucugccuggaacuucuaccaggacgacgauuucaggugcucacagcgg

SEQ ID NO: 324801 - RNA, 60 nt, hsa
caaaggaugaggaaucugaguugccaacuucaggacgacaccuggcuugccacccacagu

SEQ ID NO: 324802 - RNA, 60 nt, hsa
cgcccgggagugggguagaggaagacgagacaggacgaggcagaaaagcacauuuuaaaa

SEQ ID NO: 324803 - RNA, 60 nt, hsa
ugcuggccugagacaguaucccagcuacaacaggacgacaccggguucaggaauaugugg

SEQ ID NO: 324804 - RNA, 60 nt, hsa
agaaggcuggcauuggcaggaggagagcaccaggacgaggaugggaagcgaccuccagau

SEQ ID NO: 324805 - RNA, 60 nt, hsa
auccuucaccuccuaucccccacuccaaaccaggacgaccugcaaggucccagccagcag

SEQ ID NO: 324806 - RNA, 60 nt, hsa
gaaccgcucaccccaacaugugucuuaaggcaggacgacuuggaaaaaaaggcggcggac

SEQ ID NO: 324807 - RNA, 60 nt, hsa
ugaguagugucacugggccaaaagauagaucaggacgacagccuuuaguuuuccugaaau

SEQ ID NO: 324808 - RNA, 55 nt, hsa
cagacguggaugaagaauagcucugcaggacgaaugccuuaguuuccacuuucca

SEQ ID NO: 324809 - RNA, 60 nt, hsa
gcccugcuucucaguguggggcaggugucucaggacgaaggcgccgcgugaccacauggg

SEQ ID NO: 324810 - RNA, 60 nt, hsa
ugacaagcaauccaggaacaaaauacucaccaggacgaggaagaggacuuugggggacag

SEQ ID NO: 324811 - RNA, 60 nt, hsa
gagugaggggagagcugcccggugcagacccaggacgagggcugcacuugguguggccgu

SEQ ID NO: 324812 - RNA, 60 nt, hsa
agaagguauuuuuuaacucccaagcaguagcaggacgaugauagggcuggagggcuaugg

SEQ ID NO: 324813 - RNA, 64 nt, hsa; identical to SEQ ID NO: 55647

SEQ ID NO: 324814 - RNA, 64 nt, hsa; identical to SEQ ID NO: 55648

SEQ ID NO: 324815 - RNA, 64 nt, hsa; identical to SEQ ID NO: 55649

SEQ ID NO: 324816 - RNA, 64 nt, hsa; identical to SEQ ID NO: 55650

SEQ ID NO: 324817 - RNA, 64 nt, hsa; identical to SEQ ID NO: 55651

SEQ ID NO: 324818 - RNA, 64 nt, hsa; identical to SEQ ID NO: 55652

SEQ ID NO: 324819 - RNA, 64 nt, hsa; identical to SEQ ID NO: 55653

SEQ ID NO: 324820 - RNA, 64 nt, hsa; identical to SEQ ID NO: 55654

SEQ ID NO: 324821 - RNA, 64 nt, hsa; identical to SEQ ID NO: 55655

SEQ ID NO: 324822 - RNA, 64 nt, hsa; identical to SEQ ID NO: 55656

SEQ ID NO: 324823 - RNA, 64 nt, hsa; identical to SEQ ID NO: 55657

SEQ ID NO: 324824 - RNA, 64 nt, hsa; identical to SEQ ID NO: 55658

SEQ ID NO: 324825 - RNA, 64 nt, hsa; identical to SEQ ID NO: 55659

SEQ ID NO: 324826 - RNA, 64 nt, hsa; identical to SEQ ID NO: 55660

SEQ ID NO: 324827 - RNA, 64 nt, hsa; identical to SEQ ID NO: 55661

SEQ ID NO: 324828 - RNA, 64 nt, hsa; identical to SEQ ID NO: 55662

SEQ ID NO: 324829 - RNA, 64 nt, hsa; identical to SEQ ID NO: 55663

SEQ ID NO: 324830 - RNA, 64 nt, hsa; identical to SEQ ID NO: 55664

SEQ ID NO: 324831 - RNA, 64 nt, hsa; identical to SEQ ID NO: 55665

SEQ ID NO: 324832 - RNA, 64 nt, hsa; identical to SEQ ID NO: 55666

SEQ ID NO: 324833 - RNA, 64 nt, hsa; identical to SEQ ID NO: 134178

SEQ ID NO: 324834 - RNA, 64 nt, hsa; identical to SEQ ID NO: 134179

SEQ ID NO: 324835 - RNA, 64 nt, hsa; identical to SEQ ID NO: 134180

SEQ ID NO: 324836 - RNA, 64 nt, hsa; identical to SEQ ID NO: 134181

SEQ ID NO: 324837 - RNA, 64 nt, hsa; identical to SEQ ID NO: 134182

SEQ ID NO: 324838 - RNA, 64 nt, hsa; identical to SEQ ID NO: 134183

SEQ ID NO: 324839 - RNA, 64 nt, hsa; identical to SEQ ID NO: 134184

SEQ ID NO: 324840 - RNA, 64 nt, hsa; identical to SEQ ID NO: 134185

SEQ ID NO: 324841 - RNA, 64 nt, hsa; identical to SEQ ID NO: 134186

SEQ ID NO: 324842 - RNA, 64 nt, hsa; identical to SEQ ID NO: 134187

SEQ ID NO: 324843 - RNA, 64 nt, hsa; identical to SEQ ID NO: 134188

SEQ ID NO: 324844 - RNA, 64 nt, hsa; identical to SEQ ID NO: 134189

SEQ ID NO: 324845 - RNA, 64 nt, hsa
ucccuccugcugcgguuucucuuggccuguccucacuggaaaaacagucuccaucuccucaaaa

SEQ ID NO: 324846 - RNA, 64 nt, hsa
agcccccucugcauuuacacagauuugagucagaacuggaaagugucccccacccccaccaccc

SEQ ID NO: 324847 - RNA, 64 nt, hsa
uucaguauaagcugaauaaauuuagagcuuucaaacuggaaaaaaaaaugaaacaaaacaaaua

SEQ ID NO: 324848 - RNA, 64 nt, hsa
aucguguguccaggcaaacgcacacuagugucugacuggaaagcucaggaauuuuaaucuugca

SEQ ID NO: 324849 - RNA, 64 nt, hsa
acaauuacaugauuugaaaacaguacucaaugagacuggaaauaccuuuuguaccuaaauguuu

SEQ ID NO: 324850 - RNA, 64 nt, hsa
cuugaaauuaaacuaugaaauuaaaggcagaaaaacuggaaaaccuacugcagguccagagacu

SEQ ID NO: 324851 - RNA, 64 nt, hsa
auaaaggucaaacaucagugagcaagcuguguacacuggaaaacacugaaucaauacaaugcgu

SEQ ID NO: 324852 - RNA, 64 nt, hsa
gcaaaauaccacauggcuucucccgcauaucgucacuggaaacuuccucucucgacauucucuc

SEQ ID NO: 324853 - RNA, 64 nt, hsa
uagcagacugguguguguggaucugcagugcuucacuggaaauaauuuauucauugcagauacu

SEQ ID NO: 324854 - RNA, 64 nt, hsa
cccaggccccacuuacguaaaacauuucagggucacuggaaacagugaagugccauuuguugaa

SEQ ID NO: 324855 - RNA, 64 nt, hsa
caauuccuaaaagcugaauggauaauaaaauuggacuggaaaguaaguagguggcugguccuca

SEQ ID NO: 324856 - RNA, 64 nt, hsa
uggcuuauucaaccauagccccuccaacauaucuacuggaaauucugcugguuaacuuuaucuc

SEQ ID NO: 324857 - RNA, 64 nt, hsa
uccagggcgggaggcaagcccccuugccuuucaaacuggaaaccccagagaaaacggugccccc

SEQ ID NO: 324858 - RNA, 64 nt, hsa
guauaacucuaaacgcccaugauaguagcuucaaacuggaaauagcgaaauaaaauaacucagu

SEQ ID NO: 324859 - RNA, 64 nt, hsa
uccuuaacccuuaacuguagauaagaaaauucauacuggaaagaaacccuacaaaugugaaguc

SEQ ID NO: 324860 - RNA, 64 nt, hsa
auucucaacucuuacuacauguaagaguauuuauacuggaaagaaacccuacaaauguaaaaaa

SEQ ID NO: 324861 - RNA, 64 nt, hsa
cuuuggauaacuguaaagggacccaugcugauagacuggaaauagaaguaaauguguuuauuga

SEQ ID NO: 324862 - RNA, 64 nt, hsa
ccaccccuugcucuuugagggcuggcuauugagaacuggaaagaguaaaaugauaacuuaccuu

SEQ ID NO: 324863 - RNA, 64 nt, hsa
uguaaaaaaaaaaaaaaaaaaaaagaaccaaaccacuggaaauaaucaaaugcaaaaagguaac

SEQ ID NO: 324864 - RNA, 64 nt, hsa
aaauaaucaaaugcaaaaagguaacaaauucauaacuggaaagcaaagagaagaacaaguauga

SEQ ID NO: 324865 - RNA, 64 nt, hsa
cccauugacuuugccacauagcugaacuguguuuacuggaaaaauucagaggccuaaaguuuaa

SEQ ID NO: 324866 - RNA, 64 nt, hsa
auaaaaagagggccaaggagguaugagccaucagacuggaaaaaaggaugacuauaugaugagg

SEQ ID NO: 324867 - RNA, 64 nt, hsa
uuuuggaaaagaaaacaaagugcaauuguuuuuuacuggaaaguuacccaauagcaugagguga

SEQ ID NO: 324868 - RNA, 64 nt, hsa
gucuuuaaauuuuauaugggcuuuguuaucuuccacuggaaaaguguaauagcauacaucaaug

SEQ ID NO: 324869 - RNA, 64 nt, hsa
gcuauccauuccucuccugagauuuuaacuuacuacuggaaauccuuaaccaauuauaauagcu

SEQ ID NO: 324870 - RNA, 64 nt, hsa
aagcauuuuguucacaccacgcuuugauaacuaaacuggaaaacaaagguguuaaguaccucug

SEQ ID NO: 324871 - RNA, 64 nt, hsa
gcugcaguuagcacuguuaucugagcaugaaagaacuggaaacgcuccuuacgucgagauguug

SEQ ID NO: 324872 - RNA, 64 nt, hsa
ugugggcuggggcagaggucuuuuuucauuuaauacuggaaaaauauugaagagcauccauguu

SEQ ID NO: 324873 - RNA, 64 nt, hsa
aacgcuugagaggcacuuuguaaagauuuguuaaacuggaaacguuuuacaugaucugauacaa

SEQ ID NO: 324874 - RNA, 64 nt, hsa
aaugcuugagaggcacugaguaaagauuuguugaacuggaaauguuuuacaugauucuuaaacu

SEQ ID NO: 324875 - RNA, 64 nt, hsa
cagaggcauccuugagcuuuaaagcauugaacaaacuggaaaaugcaacauaccacauaacuga

SEQ ID NO: 324876 - RNA, 64 nt, hsa
uccugcugucaucaacuugggcaacaaaugacccacuggaaaggcaaauccacuuaaaagaucu

SEQ ID NO: 324877 - RNA, 64 nt, hsa
aaguauauuccuauuguacuaaauauuuuucccaacuggaaagcacuugauuguacccguaagu

SEQ ID NO: 324878 - RNA, 64 nt, hsa
uccuuccguuuccagaaagagcuguggauauuuuacuggaaauuaagaacuugcugcuguuuua

SEQ ID NO: 324879 - RNA, 64 nt, hsa
acauuuuucauuauaacuuuaaauuuuuuaagcaacuggaaaaguguuccuugcucucuugggg

SEQ ID NO: 324880 - RNA, 64 nt, hsa
gauacucgccaaggcagagcgcaaagugcuagccacuggaaaugcaugacuucccuccaccccu

SEQ ID NO: 324881 - RNA, 64 nt, hsa
gauuuuuuuuuuuuuugcaaaggaaaaaauugauacuggaaaagauuguugugcauaguuauua

SEQ ID NO: 324882 - RNA, 64 nt, hsa
aaagguaucuucuggaguuuuugggaggagagaaacuggaaaauuaaauuguauuuuugccaga

SEQ ID NO: 324883 - RNA, 58 nt, hsa
cuuucuguucugucugccauggguuuguccagcucagguagcucuaggagcaccaucc

SEQ ID NO: 324884 - RNA, 58 nt, hsa
uaaaauuaaaaauaauuccgaagauacaccagcucacaaaugaaaacgucagccucug

SEQ ID NO: 324885 - RNA, 58 nt, hsa
auggccugcugggcccaagugaggagugccagcucaaguuggaguugacugcucauac

SEQ ID NO: 324886 - RNA, 58 nt, hsa
cggugccacugaggacccgugugacucgccagcucauucucaccaaucgcuccccaau

SEQ ID NO: 324887 - RNA, 58 nt, hsa
ugaagguguucuuagaauucgcauuuugccagcucagcgcaccuccacaacgaaugaa

SEQ ID NO: 324888 - RNA, 58 nt, hsa
uuuucccuccuugugugcccauggggcaccagcucauggucuuuuucagucaucccag

SEQ ID NO: 324889 - RNA, 58 nt, hsa
gauuggcugugaggucccuccgcaucacccagcucacgucccccaaaacgugcauggu

SEQ ID NO: 324890 - RNA, 58 nt, hsa
gccauccucaggugggaggugucagagcccagcucaugcacaucagcugguggagcag

SEQ ID NO: 324891 - RNA, 58 nt, hsa
cacaggccacaggcccuccaccucaccuccagcucaggggccgcaccccgccgcuggc

SEQ ID NO: 324892 - RNA, 58 nt, hsa
ccagaugcagagcgaguggaugcacuucccagcucaucucuggaagccuuugcuacuc

SEQ ID NO: 324893 - RNA, 58 nt, hsa
gagcugugcuucucucuccgguacgugcccagcucaggccggcugaccgugguggugc

SEQ ID NO: 324894 - RNA, 58 nt, hsa
uugcccucccagagcccuacgugaagguccagcucaugcugaaccagaggaaguggaa

SEQ ID NO: 324895 - RNA, 58 nt, hsa
cagccccaggccagagaggccucccgguccagcucagggaugcuccugccagcacagg

SEQ ID NO: 324896 - RNA, 58 nt, hsa
ggcacauagugagcccgggcagcccugcccagcucaggccccuuuccuuccccauuga

SEQ ID NO: 324897 - RNA, 58 nt, hsa
gcugguuuucuacccaacggcccugcagccagcucacguccagguucaacccacagcu

SEQ ID NO: 324898 - RNA, 58 nt, hsa
uuuaaagagacuccaaaucucaaugaagccagcucacagugcugugugccccggucac

SEQ ID NO: 324899 - RNA, 58 nt, hsa
aagggagccgagacccuggauggggcuuccagcucagaacccaucccucuggugggua

SEQ ID NO: 324900 - RNA, 58 nt, hsa
cccuuugggcggccucugggcuugggcaccagcucaugccagccccagagggucaggg

SEQ ID NO: 324901 - RNA, 58 nt, hsa
gugugugugagagagagcccucccacugccagcucagguuguucacagauuuggaaug

SEQ ID NO: 324902 - RNA, 58 nt, hsa
ccagagaggcucaaagcagccuuuugucccagcucagcuuugaucuacaccucuugcc

SEQ ID NO: 324903 - RNA, 58 nt, hsa
gggaaaaaagaaagugguaccaguguuaccagcucaacuaaaaccugcaauucugcau

SEQ ID NO: 324904 - RNA, 58 nt, hsa
gacaguaggacauuguggcugagucuacccagcucaagguaaaggagaauguugcuaa

SEQ ID NO: 324905 - RNA, 58 nt, hsa
gcuuccuccaggguuccccagccaccucccagcucagggcacaguguaucgacaaucu

SEQ ID NO: 324906 - RNA, 58 nt, hsa
gaggacaccuccccaucacucagcauucccagcucagggcacaggcaggcuggggucc

SEQ ID NO: 324907 - RNA, 58 nt, hsa
aguugcaauugcuauuuucuucucagucccagcucagaucgaauuauauauccauaua

SEQ ID NO: 324908 - RNA, 58 nt, hsa
acccacgggggcuccucccugccgggguccagcucagaaccacgggggucugugccgg

SEQ ID NO: 324909 - RNA, 58 nt, hsa
ccuccacagagcccccuugcugggacagccagcucaccuccaaggacauccccuccug

SEQ ID NO: 324910 - RNA, 58 nt, hsa
caggcacuguagggucacccauaugccuccagcucaguugacgcuuaaaaacaggugc

SEQ ID NO: 324911 - RNA, 58 nt, hsa
cuuauggggaaggcucugacacuccaccccagcucaggccaugggcagcagggcucca

SEQ ID NO: 324912 - RNA, 58 nt, hsa
ugcaauuggguguugccucaguuuccucccagcucaguuuuauuagaucaaagcuguu

SEQ ID NO: 324913 - RNA, 58 nt, hsa
aacauuagagaaaauguuuuuaaagaagccagcucaagcaauauuaaugaaguagguu

SEQ ID NO: 324914 - RNA, 58 nt, hsa
guggagccauguggcacaaauacucaugccagcucauuacagcaugagaacagcaguu

SEQ ID NO: 324915 - RNA, 58 nt, hsa
ucugaugguggugagaccaggggaaaggccagcucagaggguggucacagcauguguc

SEQ ID NO: 324916 - RNA, 58 nt, hsa
gggugggguggggguacugacgcccuucccagcucauccagggguggagccuggccug

SEQ ID NO: 324917 - RNA, 58 nt, hsa
cugggauuacaggugggugucaccacacccagcucaguauuguauuuuuagcagagau

SEQ ID NO: 324918 - RNA, 58 nt, hsa
uccccaagagugaugcccggcagcauucccagcucagggcuaaugguucacggaagcc

SEQ ID NO: 324919 - RNA, 58 nt, hsa
ugcaugggacaggcccugccuagaaacaccagcucagcauggcagcagugcggaggcc

SEQ ID NO: 324920 - RNA, 58 nt, hsa
ucuccccucccccaccacccggugcugcccagcucaagccagaagcugacuuuggccg

SEQ ID NO: 324921 - RNA, 58 nt, hsa
acggcguguguuggucccaucucucagaccagcucacugaggcagaggaguugcucag

SEQ ID NO: 324922 - RNA, 58 nt, hsa
cggaugaacuucagcacccgagucagucccagcucauccuccccaguuuaccacuuug

SEQ ID NO: 324923 - RNA, 64 nt, hsa
ccccuggaagcagcauugugugauauucucagaggcaggggaaaauagagggaaaaauagagac

SEQ ID NO: 324924 - RNA, 64 nt, hsa
cagggccacaggguugcuuucugucuuugguggggcaggggaguugacagggaugaggguccaa

SEQ ID NO: 324925 - RNA, 64 nt, hsa
uggcacaccagcucagacaggggccugcgcagcugcaggggacagacgccaaucacugucacag

SEQ ID NO: 324926 - RNA, 64 nt, hsa
ccucucaguguguccaggauggcauucccagaaugcaggggagagcaggaugccggguggagga

SEQ ID NO: 324927 - RNA, 64 nt, hsa
aagagugggaacagguggggucaggggccagagugcaggggagggggcaaugguggagguggcg

SEQ ID NO: 324928 - RNA, 64 nt, hsa
ggaggcuaccuguggaauggcugagccugguucugcaggggaggaaggcugccaggagcugagg

SEQ ID NO: 324929 - RNA, 64 nt, hsa
ccacagggcaccagggaugauccugauguggcaggcaggggagacucacagaaaaaucugccca

SEQ ID NO: 324930 - RNA, 64 nt, hsa
ucggugccugucaacugcuuuucagcaguggacugcaggggaaagagcagugauuuggggugag

SEQ ID NO: 324931 - RNA, 64 nt, hsa
cagacaaccuuugaauugugccuacuaaauuauagcaggggacuuuggcacccaaggaguucug

SEQ ID NO: 324932 - RNA, 64 nt, hsa
aacugguuaggaaagcccagggggaagggagggggcaggggaggaggcaauucugaaugaauga

SEQ ID NO: 324933 - RNA, 64 nt, hsa
cucgugguggugcaggggacaagaggcugugggugcaggggacaccuguggagggcauuucccg

SEQ ID NO: 324934 - RNA, 64 nt, hsa
ccggacacauuucacaccucaggcucgugguggugcaggggacaagaggcugugggugcagggg

SEQ ID NO: 324935 - RNA, 64 nt, hsa
ccuucaagaggcgccauagacccuagcggggagggcaggggagggacggaaggcuggcaccucu

SEQ ID NO: 324936 - RNA, 64 nt, hsa
ccgagggccaguuucaggucuggaaggggaggaagcaggggaaggugaccugaggaggcucggc

SEQ ID NO: 324937 - RNA, 64 nt, hsa
aguucuuccuuccccaucugggccuucauaaaaugcaggggaagccagacuggucucaggagcg

SEQ ID NO: 324938 - RNA, 64 nt, hsa
gacaggcacaggcugggcagaggcacagggcagugcaggggacucugcaguggggucgggaagu

SEQ ID NO: 324939 - RNA, 64 nt, hsa
uauucuucuguccaucuuuggccugcuggugccagcaggggacacagacugcaaagagaagcac

SEQ ID NO: 324940 - RNA, 64 nt, hsa
acagccucauccuguauaguuuaaugaugaaugugcaggggaccugucucaggcuccuauaugg

SEQ ID NO: 324941 - RNA, 64 nt, hsa
gccgugcagagccugggcuccggcagggagaggugcaggggagucaccgcccagaccuccccag

SEQ ID NO: 324942 - RNA, 64 nt, hsa
gcagacaucugccaugucccugagacugcgggaggcaggggaugcauggguguccccaucuguc

SEQ ID NO: 324943 - RNA, 64 nt, hsa
cccaggcugcacagcaggcagggagggaggcaaggcaggggaguggggccugagcugagcacug

SEQ ID NO: 324944 - RNA, 64 nt, hsa
cugagggagccaggaggccggggggccgggggcugcaggggaggcuguggggguccuggcagcc

SEQ ID NO: 324945 - RNA, 64 nt, hsa
aaggcagggucguaucuguggggaccugacaagggcaggggaagcggagaccagggugcaggcu

SEQ ID NO: 324946 - RNA, 64 nt, hsa
aguuuauuucaaauacaguuuuccccugacauaugcaggggauuaauuccagcagucccugauc

SEQ ID NO: 324947 - RNA, 64 nt, hsa
cgcaccuguagucccagcuacucuggaggcugaggcaggggaauggcucgaacacaggagacgg

SEQ ID NO: 324948 - RNA, 64 nt, hsa
agugccuagguuucucauaccccacaaggucacagcaggggagggagggacaauuuuauaauga

SEQ ID NO: 324949 - RNA, 59 nt, hsa
uggagcaccgagacuccugagggcugugggcaggggaccugugugccccgcacccccca

SEQ ID NO: 324950 - RNA, 64 nt, hsa
cucuguuuuccaggggagaaaccugagucucagagcaggggaguggcuucccaaggucucacag

SEQ ID NO: 324951 - RNA, 64 nt, hsa
acagaaauccagaguggggagacagagaccaagagcaggggauagaagccgggcgaaguggccc

SEQ ID NO: 324952 - RNA, 64 nt, hsa
gccucugugcugcuggggucacgcgaggcuguuugcaggggacacggucacaggagcucuucug

SEQ ID NO: 324953 - RNA, 64 nt, hsa
gccagguggcagcuugagcauggacucccagacugcaggggagcacuuggggcagcccccagaa

SEQ ID NO: 324954 - RNA, 64 nt, hsa
guuagugacuuuggcauuucuguagcugagcacagcaggggagggguuaaugcagauggcaagu

SEQ ID NO: 324955 - RNA, 64 nt, hsa
ugccauacccacugaccccagaccagugcagccagcaggggaggugagccauacacaggccacg

SEQ ID NO: 324956 - RNA, 62 nt, hsa
ucugcccuuccucacccccacgccccaccccacucccccagaguacuccccacugugaaaag

SEQ ID NO: 324957 - RNA, 62 nt, hsa
gaggcauugucacccuagaccccucuuccucucucccccaccauagugugcaauaaaguguc

SEQ ID NO: 324958 - RNA, 62 nt, hsa
gugucuaaagacuugguguccccuucucucuccucccccacccgccacuccuggguacaucu

SEQ ID NO: 324959 - RNA, 62 nt, hsa
uugcaguaauuuauuuucuguauggacugucccucccccagaggcuuccccacccuccauug

SEQ ID NO: 324960 - RNA, 62 nt, hsa
ccagccacugugggaccaacaccccucccacacucccccagacugcucgucuaucaccagga

SEQ ID NO: 324961 - RNA, 62 nt, hsa
cccagcccugccccucaccugccugcccuccccucccccacucuauacuagggacuggaucu

SEQ ID NO: 324962 - RNA, 62 nt, hsa
cacacacacuccuuccccuugucccuggggcacucccccaggauugugcaauagucagagug

SEQ ID NO: 324963 - RNA, 62 nt, hsa
cccuuccucaucugugccugucuguccaaccccucccccacgucucucugccugcugggcuc

SEQ ID NO: 324964 - RNA, 62 nt, hsa
uaacuaauauuaggcaguugauacucccccaccucccccauuuagauacacuacuguauuag

SEQ ID NO: 324965 - RNA, 62 nt, hsa
aaaauucaguaacuaauauuaggcaguugauacucccccaccucccccauuuagauacacua

SEQ ID NO: 324966 - RNA, 62 nt, hsa
auuccugggcucccagccuuaaaacucacugccucccccaagggcccccucuaaggagggug

SEQ ID NO: 324967 - RNA, 62 nt, hsa
acaggccuucuguacccagcguuuguacuugccucccccaacagugggccuguucuacccgu

SEQ ID NO: 324968 - RNA, 62 nt, hsa
uuuagcagaugugguuucaaaguaaaggccuccucccccaccccuuaggccccguggugaca

SEQ ID NO: 324969 - RNA, 62 nt, hsa
ucagcuucccagccaugcccaggacguccuaucucccccaacccaccucuggcccuguguag

SEQ ID NO: 324970 - RNA, 62 nt, hsa
cgccacacucagugccauggggaagcgggcgucucccccaccagccccaccaggcgguguag

SEQ ID NO: 324971 - RNA, 62 nt, hsa
agacuucugccuuaaccagccccggggcuuggcucccccagcucugagcgugggggcauagg

SEQ ID NO: 324972 - RNA, 62 nt, hsa
gggaugucaaguggugaugucguugugcuccccucccccagagcgggugggcggggggugaa

SEQ ID NO: 324973 - RNA, 62 nt, hsa
aguguguuuccuuucgugucugcccaccucuucucccccaccucccgggucccuucugucgg

SEQ ID NO: 324974 - RNA, 62 nt, hsa
aauuauuauaauuauuauaauuauuuuauccccucccccaccgccucgcugcccccgcccag

SEQ ID NO: 324975 - RNA, 62 nt, hsa
gagcccccaucccuuaucuuacccccaccgcgcucccccaggagcgcucccucagcucucuc

SEQ ID NO: 324976 - RNA, 62 nt, hsa
aguuauugaccucccggucccgccugcccgcccucccccacguggccccuugacccgggcgg

SEQ ID NO: 324977 - RNA, 62 nt, hsa
ccggagguacaguuuuuccaggugcuuaagcccucccccacugugccacccuugugaccuuc

SEQ ID NO: 324978 - RNA, 62 nt, hsa
uucagaaaggcacaauguggagccuggggugucucccccaccccaggaccgucagguuuacc

SEQ ID NO: 324979 - RNA, 62 nt, hsa; identical to SEQ ID NO: 113690

SEQ ID NO: 324980 - RNA, 62 nt, hsa
aucuguuggccaccugcaggccagucucaacccucccccaggugggcaggcacuugauggcu

SEQ ID NO: 324981 - RNA, 59 nt, hsa; identical to SEQ ID NO: 113692

SEQ ID NO: 324982 - RNA, 62 nt, hsa
aggccugaaacauuucuuuucuuucuuuuuuccucccccaauuuacccugggccuggagcag

SEQ ID NO: 324983 - RNA, 62 nt, hsa
ccacccuccuccacagguccaggugccgcucccucccccaccacacaucagugucuccuccc

SEQ ID NO: 324984 - RNA, 62 nt, hsa
agugggaggguugguugccccucaccucagagcucccccaaaggccaguaauggauccccgg

SEQ ID NO: 324985 - RNA, 62 nt, hsa
uggaugcacguucacuacugugacggccgcaccucccccaugcaccccacccucccccaaag

SEQ ID NO: 324986 - RNA, 62 nt, hsa
gugacggccgcaccucccccaugcaccccacccucccccaaagcccggaucccgagaaagau

SEQ ID NO: 324987 - RNA, 62 nt, hsa
ccagagcggggugagggggcuuaugccccccccucccccaguguguugggugggguggaauu

SEQ ID NO: 324988 - RNA, 62 nt, hsa
ggggaacuuacucuaggaaaagccaugucucucucccccaggguggggggaccuguguugga

SEQ ID NO: 324989 - RNA, 62 nt, hsa
gagaccccucccuuccagaauccaggccccaucucccccaacuccacagccccucccgagcc

SEQ ID NO: 324990 - RNA, 62 nt, hsa
uccccccaaccaccagcagcagcagggcccuccucccccaccagcucuccccacagggcccc

SEQ ID NO: 324991 - RNA, 62 nt, hsa
caagcugcuaagccaaagauggccccugacaccucccccagccccagcacaccagccugcac

SEQ ID NO: 324992 - RNA, 62 nt, hsa
cgggggcuggggguaagagaaaucuaacugcgcucccccaaccccucgcccugccaucuucc

SEQ ID NO: 324993 - RNA, 62 nt, hsa
ccggcagcucagggaguguuuuccugugaggccucccccaucaguggaccagagggagaagc

SEQ ID NO: 324994 - RNA, 62 nt, hsa
ggcacuguccagcucugggcuagccagaucaacucccccacccgucuucuuccucuguccca

SEQ ID NO: 324995 - RNA, 62 nt, hsa
aggcuuuggugguaauccugugauuuuuuuuucucccccauccccucacuggcccaucccuc

SEQ ID NO: 324996 - RNA, 62 nt, hsa
agcacuccagucccaucaccugaaccuucagucucccccaucuguuacacuagagggcugca

SEQ ID NO: 324997 - RNA, 62 nt, hsa
auccccagcacccccugcuacaccucagcagccucccccaugcaaaaaggaaagagaaaaau

SEQ ID NO: 324998 - RNA, 62 nt, hsa
aggguggcaggucacugucacugccgacaucccucccccagcagaauggaggcaggggacaa

SEQ ID NO: 324999 - RNA, 62 nt, hsa
acacaucugggugcccugaaagggcccuuccccucccccacuccucuaagacaaaguagauu

SEQ ID NO: 325000 - RNA, 62 nt, hsa
caccacggggucgggggaggagcacccccagccucccccaggcugcgccugcccgcccgccg

SEQ ID NO: 325001 - RNA, 62 nt, hsa
ccuugaccccacacgccggggcuggcccugcccucccccacggccgucccugacuucccagc

SEQ ID NO: 325002 - RNA, 62 nt, hsa
acuuuuuuaaaggggauuaaaaaacacagccucucccccaaaggguguccguucuuaauucc

SEQ ID NO: 325003 - RNA, 62 nt, hsa
gggaggagcagcuguguguccccggcaccucacucccccaaaaugacacccaccgucgucag

SEQ ID NO: 325004 - RNA, 62 nt, hsa
aagugcucuuggggguggcucuaccccauuaccucccccagccacaacuccuggccuucgac

SEQ ID NO: 325005 - RNA, 62 nt, hsa
ugcagccacucuggcucccaagacuucccugacucccccacuccccuccuugccaggggcac

SEQ ID NO: 325006 - RNA, 62 nt, hsa
caccccaacuugugacugcucacuuaugacgucucccccaguacccuccaucucaaauaggc

SEQ ID NO: 325007 - RNA, 62 nt, hsa
ccccuauuuuuuccaagcacgaagccaccagucucccccagggagcaucaggaagggacaug

SEQ ID NO: 325008 - RNA, 62 nt, hsa
cagauaaguggcucuuacccagcucucagugacucccccacaaaacagcaacagccuccacc

SEQ ID NO: 325009 - RNA, 62 nt, hsa
gcugcuggagcaggcaccuugggcugggccugcucccccagggcccagggccccccagcuua

SEQ ID NO: 325010 - RNA, 62 nt, hsa
uugacuuuguuauaaaaauagggcucccccaccucccccauuucuguguccuuuauuguagc

SEQ ID NO: 325011 - RNA, 62 nt, hsa
cagaucuguuugacuuuguuauaaaaauagggcucccccaccucccccauuucuguguccuu

SEQ ID NO: 325012 - RNA, 62 nt, hsa
gagcuuugacucaggagccugugacauacccccucccccaccguugucucaugccaguaaca

SEQ ID NO: 325013 - RNA, 62 nt, hsa
cacccccgucaagagugaauucccucacucgucucccccaacagcuggacccugaccagcuc

SEQ ID NO: 325014 - RNA, 62 nt, hsa
acacucuguaaggaccuggggcaggauaucuucucccccagggaucuucuauuuaaguggcu

SEQ ID NO: 325015 - RNA, 62 nt, hsa
cucacagcccccugucuccagugugagucaugcucccccaggaguuccaggagaacucagcc

SEQ ID NO: 325016 - RNA, 62 nt, hsa
ggaauccugguccccagcaggagagccuaguccucccccagccccuccagccaccagggugu

SEQ ID NO: 325017 - RNA, 62 nt, hsa
cauuuugaaaguguuuuucucauucuccauaccucccccaagcucuccuccagcccuuccca

SEQ ID NO: 325018 - RNA, 62 nt, hsa
gaggggaccccuugggcccucuggggcuuccccucccccaccugguugggguagagcaaaag

SEQ ID NO: 325019 - RNA, 62 nt, hsa
ucuuccgaggucucccugaaaugaauguauuucucccccaaaagagcugauauuuaauguuu

SEQ ID NO: 325020 - RNA, 62 nt, hsa
cucccccagccgcacgggcacuggaggucucgcucccccagccuccgacccgaggcagaaua

SEQ ID NO: 325021 - RNA, 62 nt, hsa
ugacuccuacaucuaaguggccccuccacccucucccccagccgcacgggcacuggaggucu

SEQ ID NO: 325022 - RNA, 62 nt, hsa
aucuggggggagagaggaaggacaggucaggucucccccagccccuucugcuccugucuccu

SEQ ID NO: 325023 - RNA, 62 nt, hsa
gguugguuccauuucggccaccaggacugccccucccccacuccucccaauuccuauggagc

SEQ ID NO: 325024 - RNA, 62 nt, hsa
uugaugucaucagcaccauccaucaggacuggcucccccaucugcuccaagggagcgugguc

SEQ ID NO: 325025 - RNA, 62 nt, hsa
gggaagggucagagaugccagcccccugggaccucccccauccuuuuugccuccaaguuucu

SEQ ID NO: 325026 - RNA, 62 nt, hsa
uuuaaauuuuaacuuauaucagucacuugccacucccccacccuccuguccacaacuccuuu

SEQ ID NO: 325027 - RNA, 62 nt, hsa
uaaaaaacuuucuccucuuuguccuccuuuuucucccccacucugagguuuccccaagagaa

SEQ ID NO: 325028 - RNA, 62 nt, hsa
cucuuagggacccagaccccuaaauucuccuccucccccauuuugauguuaagguggagagg

SEQ ID NO: 325029 - RNA, 62 nt, hsa
cuuguugcccuagagugggacccagcccucaccucccccagagcuaaccugggaggugcuga

SEQ ID NO: 325030 - RNA, 62 nt, hsa
gaaagagccgcccucccuuccccaaggauccacucccccagcuccuuuagagaauggcuacu

SEQ ID NO: 325031 - RNA, 62 nt, hsa
aucccaacauuugacaccccagcaaugugugacucccccaacauuccacuaugccauccugc

SEQ ID NO: 325032 - RNA, 62 nt, hsa
gaaggacaugucccacuccaucccccuuccugcucccccauuuccuaacucccccaguguga

SEQ ID NO: 325033 - RNA, 62 nt, hsa
uccaucccccuuccugcucccccauuuccuaacucccccagugugaauucucagggucacuu

SEQ ID NO: 325034 - RNA, 62 nt, hsa
gaagugggcccuucccugggucucugcacugacucccccacuccugacccuggugauggucg

SEQ ID NO: 325035 - RNA, 62 nt, hsa
ccagguccugugaggaagccuggagcaagggucucccccagcaggauggguggggccugcuc

SEQ ID NO: 325036 - RNA, 62 nt, hsa
uccaugggcagggagcuggggggacaucucaccucccccauggcacagagcccuccacaccc

SEQ ID NO: 325037 - RNA, 62 nt, hsa
ggccccuuuuauuuuuaccugccacccagcaucucccccaccugccccuucugggugacaca

SEQ ID NO: 325038 - RNA, 62 nt, hsa
agacggccccucucuucccagcacuucccugccucccccaggccucaggcccagcacccagu

SEQ ID NO: 325039 - RNA, 62 nt, hsa
gcucccgccugugccccuucuccucaccaugucucccccacccugccucaguucuccguucc

SEQ ID NO: 325040 - RNA, 62 nt, hsa
cauccucauccuguaccuauagaguucgugcacucccccauccaugcuaccuaccuccccgu

SEQ ID NO: 325041 - RNA, 62 nt, hsa
ucucagccccuuaggacgcgggucuccuugggcucccccaaggguucugcgaagaggcagug

SEQ ID NO: 325042 - RNA, 62 nt, hsa
acuacugacguccucccugaucccacccccuccucccccaguguccccuuucuuccuauuua

SEQ ID NO: 325043 - RNA, 62 nt, hsa
cuuggcuuucagagccagccuggcucugcccccucccccaugggcuguguccuaaggcccau

SEQ ID NO: 325044 - RNA, 62 nt, hsa
cagcagcaagugacccuucuccggccugcagccucccccaggguggaagccguggggucccu

SEQ ID NO: 325045 - RNA, 62 nt, hsa
caaauguccccacuaccccagggaucccccagcucccccagccccuggcuuccugacccugc

SEQ ID NO: 325046 - RNA, 62 nt, hsa
ucauuuuccaaaccucuuguacccuccucucccucccccagcugguauguaagugucuugaa

SEQ ID NO: 325047 - RNA, 62 nt, hsa
ccgaggagucugcccugccuagagaagggccucucccccaacccucagccguuccuccaccu

SEQ ID NO: 325048 - RNA, 62 nt, hsa
gacccucguacccaaaggccccugccccacuucucccccacaaagcggggucucaagccaca

SEQ ID NO: 325049 - RNA, 62 nt, hsa
uaauacagcugcuuuucucggugccaaccucccucccccaagcucagauccuccucuuaugc

SEQ ID NO: 325050 - RNA, 62 nt, hsa
cuuccccuccuccccuauuuaaaccacucugucucccccacaacccuccccuggcccucuga

SEQ ID NO: 325051 - RNA, 62 nt, hsa
cccccugagccuucuuguaaauaccugccucccucccccaucaccgaacuuccccuccuccc

SEQ ID NO: 325052 - RNA, 62 nt, hsa
cucccccauguucugucccuugccccccuggccucccccacuuucuuucuuucuuuaaaaaa

SEQ ID NO: 325053 - RNA, 62 nt, hsa
gagcuccccuccccaacugaccaccuuuguuucucccccauguucugucccuugccccccug

SEQ ID NO: 325054 - RNA, 61 nt, hsa; identical to SEQ ID NO: 113765

SEQ ID NO: 325055 - RNA, 62 nt, hsa
ucuuuuguacugccccccgcucauuaaacagccucccccagcccugagugcacugauguccg

SEQ ID NO: 325056 - RNA, 62 nt, hsa
auuccccagccacuucccuuccgcacuuaccacucccccagccacgccccuccccgcugacc

SEQ ID NO: 325057 - RNA, 62 nt, hsa
ucaccucugucuaguuacagaacgguuucuuucucccccaaagaaaccccaucgccaucagc

SEQ ID NO: 325058 - RNA, 62 nt, hsa
gaaaccccaucgccaucagcacucacuccccacucccccagccccuggcaaccacaaaucuu

SEQ ID NO: 325059 - RNA, 62 nt, hsa
gggguucucucacccucuuucucuuuccuucccucccccauucuccagaucucccucugucu

SEQ ID NO: 325060 - RNA, 62 nt, hsa
gccccugucucucuccauguuggggguccuaacucccccaccccauaucuacguguccuccg

SEQ ID NO: 325061 - RNA, 62 nt, hsa
gucccgggaccugcugggagggacaagaggcccucccccaggcagaagagcaugcccuuugc

SEQ ID NO: 325062 - RNA, 62 nt, hsa
ccucuucccucgcccaccugccugcccccauacucccccagcggagagcaugauccgugccc

SEQ ID NO: 325063 - RNA, 62 nt, hsa
cucccccagcgcugaagcacgggguucagcggcucccccagugcugcaggugccgccaggac

SEQ ID NO: 325064 - RNA, 62 nt, hsa
caugguuuguggcggaagacggggcccagcggcucccccagcgcugaagcacgggguucagc

SEQ ID NO: 325065 - RNA, 62 nt, hsa
ccacccucacuccauccaccucggagaccacccucccccagccagauacggaauaaaacuac

SEQ ID NO: 325066 - RNA, 62 nt, hsa
ggaagaugaagcccaaacacccacaccucugucucccccagggcucgggaugucuccagcag

SEQ ID NO: 325067 - RNA, 62 nt, hsa
gcccccucuccccccgcaugugggugcccccacucccccaucguggggucuguguagccuuc

SEQ ID NO: 325068 - RNA, 62 nt, hsa
gcccgccgcccacccccacugacccccgcugccucccccaacaccgacacccuccucggccu

SEQ ID NO: 325069 - RNA, 62 nt, hsa
uggcuggguccucugcccucucuggaguuugccucccccagcccccuccccaucaauaaaac

SEQ ID NO: 325070 - RNA, 62 nt, hsa
ggaauggggggccacagcugcagaccuaagcccucccccaccccuggaaaggucccucccca

SEQ ID NO: 325071 - RNA, 62 nt, hsa
uauggcgcccccaucugacuguccagcucucucucccccaccccucccgguguuguuauuaa

SEQ ID NO: 325072 - RNA, 62 nt, hsa
cacacagcugagggagaggcccagcccugagccucccccaccaggacugggccuccccggca

SEQ ID NO: 325073 - RNA, 62 nt, hsa
ccuccagcuuagcugucagcuguccaucaccucucccccacuuucucauuugugcuuuuuuc

SEQ ID NO: 325074 - RNA, 62 nt, hsa
gcugccuguuuuacucacccaccagcuuccgccucccccauccugggcgccccuccuccagc

SEQ ID NO: 325075 - RNA, 62 nt, hsa
aacaucccagacccguuacccacuacccuucucucccccagcucaucaucagucgcugucuc

SEQ ID NO: 325076 - RNA, 62 nt, hsa
acauuuugaaccugcaacuucagacauuccagcucccccacucgcccuccacuaccucugag

SEQ ID NO: 325077 - RNA, 62 nt, hsa
gcggacgaucgcaucuugugucgcugaagcgccucccccagggaccggcggaccccagccau

SEQ ID NO: 325078 - RNA, 62 nt, hsa
agggggcaagaggaauuacgugcucugugggucucccccaacgcgccucgccggaucugagg

SEQ ID NO: 325079 - RNA, 62 nt, hsa
cucccgggccuguccccaacuccuccccaccccucccccaucuccucuuugaaagccagaac

SEQ ID NO: 325080 - RNA, 62 nt, hsa
gugcagacccugccaugcagacccaugccccccucccccaggcagcuccaagaaagcucccu

SEQ ID NO: 325081 - RNA, 62 nt, hsa
cagggaaacagggccagcacagaggggccuuccucccccacagagcccccaugacauagucu

SEQ ID NO: 325082 - RNA, 62 nt, hsa
ugcccccaguguccucugauccuguccggugccucccccaacccccacacccaugcagaacu

SEQ ID NO: 325083 - RNA, 62 nt, hsa
cccccgccagguguggccccgccugcucuuuccucccccaccaguauggccccaccugcucu

SEQ ID NO: 325084 - RNA, 62 nt, hsa
aaagaugcagguuuauauggaacccccacccccucccccacucucccacucuguucguucug

SEQ ID NO: 325085 - RNA, 62 nt, hsa
augucuucacgagcgugcaucagggcgccuggcucccccaccucagccagugagucagacac

SEQ ID NO: 325086 - RNA, 62 nt, hsa
ggggcaggcucuuugucuuggggaccaggaugcucccccaguccuucccagaugauggcugc

SEQ ID NO: 325087 - RNA, 62 nt, hsa
ccagaugauggcugccugugggaccccagcuacucccccagacccaaguucugcagaacuaa

SEQ ID NO: 325088 - RNA, 62 nt, hsa
uccuggccccgggcuguggcgagacagcccaacucccccagcccagcucccccagcccagag

SEQ ID NO: 325089 - RNA, 62 nt, hsa
uguggcgagacagcccaacucccccagcccagcucccccagcccagagccagggaagaggaa

SEQ ID NO: 325090 - RNA, 62 nt, hsa
agaccaggagagggccaccucacugggccugccucccccaccuccugggccucucugaccuc

SEQ ID NO: 325091 - RNA, 62 nt, hsa
cccgggcuguugggcucugcuuccucccucugcucccccaugucucccugaguucucccacc

SEQ ID NO: 325092 - RNA, 62 nt, hsa
ggaaggguauaaaugcauguuccugaggugcccucccccaaagaauguaccugcacucaaac

SEQ ID NO: 325093 - RNA, 62 nt, hsa
ccgugcuugguggggggaugugaacuuucucucucccccagcagugucugcucaggccugac

SEQ ID NO: 325094 - RNA, 62 nt, hsa
gacugacugagggggccugaagcuacaugcaccucccccacugcugcccuccugucgagaau

SEQ ID NO: 325095 - RNA, 62 nt, hsa
ggcgaagguucugauggcugccuugcuccuugcucccccacccccugugaggacuucucuag

SEQ ID NO: 325096 - RNA, 62 nt, hsa
ggaagggauuugggggggaaucuuccugccgccucccccacuccaaguguuuauuuuugaua

SEQ ID NO: 325097 - RNA, 62 nt, hsa
ccugaccuaaccuuuuagggugguuaggacaucucccccaccuccccacuuuuuuccccaag

SEQ ID NO: 325098 - RNA, 62 nt, hsa
uggggcuaggucauuaaggccacauccacagucucccccacccuuguuccaguuguuaguua

SEQ ID NO: 325099 - RNA, 62 nt, hsa
gccccgucuacagcucccccagcuccccccaccucccccacucccaaccacguugggacagg

SEQ ID NO: 325100 - RNA, 62 nt, hsa
cguuuucggugccaucagugccccgucuacagcucccccagcuccccccaccucccccacuc

SEQ ID NO: 325101 - RNA, 64 nt, hsa; identical to SEQ ID NO: 110167

SEQ ID NO: 325102 - RNA, 64 nt, hsa; identical to SEQ ID NO: 110168

SEQ ID NO: 325103 - RNA, 64 nt, hsa; identical to SEQ ID NO: 110169

SEQ ID NO: 325104 - RNA, 64 nt, hsa; identical to SEQ ID NO: 110170

SEQ ID NO: 325105 - RNA, 64 nt, hsa; identical to SEQ ID NO: 110171

SEQ ID NO: 325106 - RNA, 64 nt, hsa; identical to SEQ ID NO: 110172

SEQ ID NO: 325107 - RNA, 64 nt, hsa
ccuucuauagaggugguguaagaguggggaacagggccagcaagacagaccaccagccagaaau

SEQ ID NO: 325108 - RNA, 64 nt, hsa
uuuuuggauacuuuuuuuuucuguuugugaauaaggccagcacucaagaugggcagccaagggu

SEQ ID NO: 325109 - RNA, 64 nt, hsa
cuggucagaaacaaagggcuggucaccugauuuaggccagcaaccagggaagcucuuagaaucc

SEQ ID NO: 325110 - RNA, 64 nt, hsa
gugagucacugcuaagagacagagcacauuuucaggccagcaacuauccuugccagaguuuuuu

SEQ ID NO: 325111 - RNA, 64 nt, hsa
cacagcugggcccaccgaggugcuauccugcccaggccagcacuuggcugaguuggguuggagu

SEQ ID NO: 325112 - RNA, 64 nt, hsa
gagcgggugccgaagcuacuggacuaugcugaugggccagcaggagccagccaaggccgcugug

SEQ ID NO: 325113 - RNA, 64 nt, hsa
cugauggagaugcucaaggccagcaagccccucaggccagcacuucgcuugcagaagccaucca

SEQ ID NO: 325114 - RNA, 64 nt, hsa
cuccuagccccgaggugcugauggagaugcucaaggccagcaagccccucaggccagcacuucg

SEQ ID NO: 325115 - RNA, 64 nt, hsa
gccacagccugugcuccugguccucaccuggaggggccagcaggcugccgucccaccacacgug

SEQ ID NO: 325116 - RNA, 64 nt, hsa
gaacuuccaggccucagcgcagagcccugcuuggggccagcacggugggcagcugccggccgcu

SEQ ID NO: 325117 - RNA, 64 nt, hsa
acagauucccaccuguauguagcacgccaugcugggccagcagugucauaggaguggaggggga

SEQ ID NO: 325118 - RNA, 64 nt, hsa
gggccugggcuugaaugugacucuguugagacauggccagcaauucuggcacuuggcugucauu

SEQ ID NO: 325119 - RNA, 64 nt, hsa
guggucaccaaggcagugagccccgcugaccccgggccagcacuuggcaggcaggaggugcggu

SEQ ID NO: 325120 - RNA, 64 nt, hsa
uggguccgcuggugucacuauggccugggugagaggccagcacugcugcugcccugaggggaaa

SEQ ID NO: 325121 - RNA, 56 nt, hsa
ccagcugguucgggcugugacgggguggccagcagggacgcgccccaggugggcag

SEQ ID NO: 325122 - RNA, 64 nt, hsa
cggcauccccagcugguucgggccgugacggggcggccagcagggacgcgccccaggugggcag

SEQ ID NO: 325123 - RNA, 64 nt, hsa
ggauggcccggccccggggcccguacacaggcggggccagcacaguagugaaggcggucuccug

SEQ ID NO: 325124 - RNA, 64 nt, hsa
caguccuggggggcugggacgcccaagaucaagaggccagcagauucggacuccgcugagggcu

SEQ ID NO: 325125 - RNA, 64 nt, hsa
ugaaugcugaaggaaccaacaguccaccucagcgggccagcagcccagggaaccccugcccacc

SEQ ID NO: 325126 - RNA, 64 nt, hsa
caccuaaacagaaucagugacccgggugcuuuguggccagcagcacagaaucaaacccgcaucc

SEQ ID NO: 325127 - RNA, 64 nt, hsa
cugcuguauuuggaaaccccuucuuuacuucccaggccagcaagcucuucacugaaacugguug

SEQ ID NO: 325128 - RNA, 64 nt, hsa
accccagcccauguacguccccacgaacuggccuggccagcaccccacacuggagccaucucuu

SEQ ID NO: 325129 - RNA, 64 nt, hsa
ggaagucuggucgcaguggcaaagccagcaccauggccagcagagcggugagcagcacucccac

SEQ ID NO: 325130 - RNA, 64 nt, hsa
uggcauugguucuaggaaccugagaguggagugaggccagcaugcaggaaggaguuuggagaga

SEQ ID NO: 325131 - RNA, 64 nt, hsa
agaaggagggagaaaaccgugagaggauguguguggccagcagcucuucagcuuugagauggug

SEQ ID NO: 325132 - RNA, 64 nt, hsa
ucaccuccugaguuuauuuuuccagagauuccagggccagcaaagccggcguucagaaggaggg

SEQ ID NO: 325133 - RNA, 64 nt, hsa
gaccagggggucucacuuuggccaccaguucuucggccagcaccucugcccuccagaaccugca

SEQ ID NO: 325134 - RNA, 64 nt, hsa
ugcuagccagcaggcuccugucugggugccacggggccagcauuuuggagggagcuuccuuccu

SEQ ID NO: 325135 - RNA, 64 nt, hsa
uuccugcuucucaagggacacaguggccugcaugggccagcauggacccugggcugaucaugug

SEQ ID NO: 325136 - RNA, 64 nt, hsa
uccugcuucucuggggacacagugggcccacaugggccagcauggacccugggcuagagcaagc

SEQ ID NO: 325137 - RNA, 64 nt, hsa
ucuggggccagcauuuggccaagcucggaggcuuggccagcacugcuggauggcucagagcaag

SEQ ID NO: 325138 - RNA, 64 nt, hsa
gaggugaggggcgggagaagguugucuccucuggggccagcauuuggccaagcucggaggcuug

SEQ ID NO: 325139 - RNA, 64 nt, hsa
uggauaaauauauagauauugagugcuuggaauccuagccuacuaugugaaaauuaagucuaau

SEQ ID NO: 325140 - RNA, 64 nt, hsa
aucuauucccagcuuuaucacuuauuuagccaugcuagccuaggccucuauuuccuugucucca

SEQ ID NO: 325141 - RNA, 64 nt, hsa
ccaaguguauaugcuuuacuaccuaacaauuauucuagccuaggugaaucccuaauugaaacac

SEQ ID NO: 325142 - RNA, 64 nt, hsa
uuaacagaguuauaauaaaacaguguuuuaaaaucuagccuauaaacaaaaacuaguuugaggc

SEQ ID NO: 325143 - RNA, 64 nt, hsa
gugggaaucagaaaaaccuguucccaucaccggccuagccuagaauccuagccuagaagcccuc

SEQ ID NO: 325144 - RNA, 64 nt, hsa
aaaccuguucccaucaccggccuagccuagaauccuagccuagaagcccucucucccucugggc

SEQ ID NO: 325145 - RNA, 64 nt, hsa
ccaggguuccuggccaggugcccccuuagcauuuguucuucaucuccugucucuucaagccucc

SEQ ID NO: 325146 - RNA, 64 nt, hsa
gcugccugguccuggccuggggcagagccuguguguucuucaccugugccugcuccuggugguc

SEQ ID NO: 325147 - RNA, 64 nt, hsa
gccucaggcaagucacugcccaccuaagaugaugguucuucaacuauaaaauggagauaauggu

SEQ ID NO: 325148 - RNA, 64 nt, hsa
cgugugccacuugccagcuucuugggcacacagaguucuucaauccaaguuaucagauuguauu

SEQ ID NO: 325149 - RNA, 64 nt, hsa
ugucggggaggugccaggcucuuuuuaacaagcaguucuucaggaacuaagagugagucacucc

SEQ ID NO: 325150 - RNA, 64 nt, hsa
gaauauaugacaugcuaaauuuuauuuuuaaacgguucuucaagucagauuaaaguaauaauag

SEQ ID NO: 325151 - RNA, 64 nt, hsa
agacauacagauuuaauuuggaauaugaacuuugguucuucaugagugcauuuugaaaaagaaa

SEQ ID NO: 325152 - RNA, 64 nt, hsa
aaucacaaaaaaaaaccccaguucaaaauguguaguucuucauuguuggguugauuccccaaaa

SEQ ID NO: 325153 - RNA, 64 nt, hsa
aguugcugucuagugcauucaaaggucacuuuuuguucuucacagaucuuuuuaauguucuuuc

SEQ ID NO: 325154 - RNA, 64 nt, hsa
ugccugcugucggcguuugaccuuccacgugacaguucuucacaauuccuuucaucauuuuuua

SEQ ID NO: 325155 - RNA, 64 nt, hsa
agauguuggcuuuucuggauuuuuuuugccauggguucuucacugaccuuggacuuuggcauga

SEQ ID NO: 325156 - RNA, 64 nt, hsa
cucuucucagagcaacucuuccuuugggaaaagaguucuucagaucauagaccaaaaaagucau

SEQ ID NO: 325157 - RNA, 64 nt, hsa
uucuccuuuugagacuccucauccaguuucuuuaguucuucauauaucacuguuuuucagaucu

SEQ ID NO: 325158 - RNA, 64 nt, hsa
aacccugagaccccagguacccacagcauuggcuguucuucauaggagacucagagaagacuuc

SEQ ID NO: 325159 - RNA, 64 nt, hsa
gcaccaagagagcgaugauggacuugagcgccguguucuucagccucagcuggaaggggaaaag

SEQ ID NO: 325160 - RNA, 64 nt, hsa
gggcucuguggggagagauacagggaaaggagcuguucuucaagguccccucaacaugagcgga

SEQ ID NO: 325161 - RNA, 64 nt, hsa
gguucuugaaguuuuuacaauauauuccuuguagguucuucacucacucacucaacaaauaccc

SEQ ID NO: 325162 - RNA, 64 nt, hsa
augccccuacaguagagauuccuccccugcuaaaguucuucaugguagugagccucccaggauc

SEQ ID NO: 325163 - RNA, 64 nt, hsa
uggcacuugucauggguuuggaagacccagccaucugcagcagaggcagccuaucccauugcaa

SEQ ID NO: 325164 - RNA, 64 nt, hsa
gcucaaugcuugguguucuaguucaacuuuuauccugcagcaaguaagccuagauaacucuaca

SEQ ID NO: 325165 - RNA, 64 nt, hsa
uuccucauucaggaaaucaaaucagucuuccggucugcagcacggaaaagcacauaaucuuucu

SEQ ID NO: 325166 - RNA, 64 nt, hsa
aggaaagcaaucacuucucacuuugcauaauugccugcagcaggaacaucucuucacugggcuc

SEQ ID NO: 325167 - RNA, 64 nt, hsa
gguucucuccccugccgcugagagggccucuccccugcagcaaacguuugccugggcauugagg

SEQ ID NO: 325168 - RNA, 64 nt, hsa
uuaguaaugcaaaauaacucauuuccaacuacugcugcagcauuuugguaaaaaccuguagcga

SEQ ID NO: 325169 - RNA, 64 nt, hsa
aaaauaaaacagaggauacuacaggcugggaaagcugcagcaaagggagacuagagagagauuu

SEQ ID NO: 325170 - RNA, 64 nt, hsa
uguauauuaaagagacauuugaacccuauguuuacugcagcacuauucacaauagccaagauau

SEQ ID NO: 325171 - RNA, 64 nt, hsa
augcacuaagccuuaauccuggacaccaguaccccugcagcauggcuugcucaacaacagucuu

SEQ ID NO: 325172 - RNA, 64 nt, hsa
acucaggaugaacucucugagcagggaccugcuccugcagcaaccaaacuuggagugguuauug

SEQ ID NO: 325173 - RNA, 64 nt, hsa
ggaaggauacauagugauucguauacaauuuugucugcagcauucuugaauauuuuuaacacug

SEQ ID NO: 325174 - RNA, 64 nt, hsa
gggguuucaaugugcccuuaaaauugugcuggggcugcagcaaauaaauaauauugggacucau

SEQ ID NO: 325175 - RNA, 64 nt, hsa
acuccagcgcagcuugaggggcugaggacggaggcugcagcaucugugucguucuacugagcac

SEQ ID NO: 325176 - RNA, 64 nt, hsa
gccccucacccugcaucacugaagagcggcgccucugcagcaagcagggcuucaggaggugccc

SEQ ID NO: 325177 - RNA, 64 nt, hsa
cccgcuggccgccagcugcccguccccagagccacugcagcaggagucgggcccugccucccuc

SEQ ID NO: 325178 - RNA, 64 nt, hsa
gacagcccagaggggggcuacagagaggagucggcugcagcagagggcaggagccccagcuuag

SEQ ID NO: 325179 - RNA, 64 nt, hsa
uuggggcagggagagagggaaccugcucacggcccugcagcagagcagggcgcaaacccaggac

SEQ ID NO: 325180 - RNA, 64 nt, hsa
guuucccugcccugggcucaguggcacugcugagcugcagcaguccuagaguuuuccagggggu

SEQ ID NO: 325181 - RNA, 64 nt, hsa
gggugagcuccgucugccacugggcaccguggaucugcagcauguucuggagcacugguaccug

SEQ ID NO: 325182 - RNA, 64 nt, hsa
ggugcaccugggugcccgggccucggggcagccccugcagcacugggcagacaugcuggcccac

SEQ ID NO: 325183 - RNA, 64 nt, hsa
ggccacgcaccagcggaagcuccggcagaagcagcugcagcagcaguuccgggagcggauggag

SEQ ID NO: 325184 - RNA, 64 nt, hsa
cugccgaccgaacauggcccugggacacccacagcugcagcaggugaccuccccuuccagaccc

SEQ ID NO: 325185 - RNA, 64 nt, hsa
aguggguacuaucauuagucccauguuauagaaacugcagcagaguugaaaauugccuccaaau

SEQ ID NO: 325186 - RNA, 64 nt, hsa
accuccuccuccuggugacagaccccaccugugacugcagcaucuucccaccagugcugcagga

SEQ ID NO: 325187 - RNA, 64 nt, hsa
cacggaggcccccagcugcccuccgagcccaggccugcagcacugaaagacgaccugccauguc

SEQ ID NO: 325188 - RNA, 64 nt, hsa
ugaggaggaggaggcagagguguaccugcggaagcugcagcagguguacaagcugaacaggaag

SEQ ID NO: 325189 - RNA, 64 nt, hsa
acacacccaaaaucaagggccuggaugccagcagcugcagcaagcagguuuuuccucccuguug

SEQ ID NO: 325190 - RNA, 64 nt, hsa
uuauaagaucgaauuuaauuuccuuucccucauucugcagcaaucagaauacacaaucuuaacc

SEQ ID NO: 325191 - RNA, 64 nt, hsa
ccugacucuaggggcacauccagucuccaucgugcugcagcagcuggacugagggcagagccug

SEQ ID NO: 325192 - RNA, 64 nt, hsa
ggagccucaguucccuccugugucaaguagcuaacugcagcagcuggacugagggcagagucug

SEQ ID NO: 325193 - RNA, 64 nt, hsa
gcaguuauuucugcagauccagcucguggaccagcugcagcaccagagaaaagaguagcagaga

SEQ ID NO: 325194 - RNA, 64 nt, hsa
ccugccgcagcggggagaccagugcugaggucuucugcagcaguacuaucagcagcugaucucu

SEQ ID NO: 325195 - RNA, 64 nt, hsa
cacuccacccuccaccuuccauuuucccccacuacugcagcaccuccaggccuguugcuauaga

SEQ ID NO: 325196 - RNA, 64 nt, hsa
guuugcaccuguccccacccuccacucagcuguccugcagcaaacacuccacccuccaccuucc

SEQ ID NO: 325197 - RNA, 64 nt, hsa
caaguaccgccugucucaggaugaccgcgauggccugcagcaacucuaugguagggggagaggg

SEQ ID NO: 325198 - RNA, 64 nt, hsa
gccgcgaaaccaucauugccccauccaguguccucugcagcagggccaggggacgcacaccugc

SEQ ID NO: 325199 - RNA, 64 nt, hsa
auauccgagaggaagcugaugcaacaggauuugucugcagcagccucugguaccaccucugagu

SEQ ID NO: 325200 - RNA, 64 nt, hsa
uuccccuuuaacucucuccuucuggugacacauccugcagcagcugagggggugcccuggcacu

SEQ ID NO: 325201 - RNA, 64 nt, hsa
gaaaauaaucaugcagucauuccucaauuacugccugcagcaauuccuccauuuuuaugaaucu

SEQ ID NO: 325202 - RNA, 64 nt, hsa
cgacccuggccuccccuguggccucuuugagugucugcagcagcccuggacuuccagacuucua

SEQ ID NO: 325203 - RNA, 64 nt, hsa
uugucaaugcacacagaauacaaccucaugcucccugcagcaagaccccugaaagugauucaug

SEQ ID NO: 325204 - RNA, 64 nt, hsa
uugggaauguuucacugcuacccgcauccagcgacugcagcaccagaaaacgacuaauguaacu

SEQ ID NO: 325205 - RNA, 64 nt, hsa
uacagaacaguuucucauuagaugaguguuucuccugcagcacuccaaaacccacucugcacug

SEQ ID NO: 325206 - RNA, 64 nt, hsa
guuucuccugcagcacuccaaaacccacucugcacugcagcacagugaaugauaugcacucacc

SEQ ID NO: 325207 - RNA, 64 nt, hsa
ggccggggcucugcguggcuugcugggaggugggcugcagcacagaggccugugacugcguucc

SEQ ID NO: 325208 - RNA, 64 nt, hsa
augcucccuggucaccccacuucccggucgccgucugcagcacuccuggagcagccugggcccu

SEQ ID NO: 325209 - RNA, 64 nt, hsa
uuccugcuauucagaauaaguaggagaaugaaaacugcagcauaucagacagcaauuuaacagc

SEQ ID NO: 325210 - RNA, 64 nt, hsa
uuguaaaaaugauuguaacagauaaaaaauguaucugcagcaacucugcagguuugugaaauag

SEQ ID NO: 325211 - RNA, 64 nt, hsa; identical to SEQ ID NO: 132800

SEQ ID NO: 325212 - RNA, 64 nt, hsa; identical to SEQ ID NO: 132801

SEQ ID NO: 325213 - RNA, 64 nt, hsa; identical to SEQ ID NO: 132802

SEQ ID NO: 325214 - RNA, 64 nt, hsa; identical to SEQ ID NO: 132803

SEQ ID NO: 325215 - RNA, 64 nt, hsa; identical to SEQ ID NO: 132804

SEQ ID NO: 325216 - RNA, 64 nt, hsa; identical to SEQ ID NO: 132805

SEQ ID NO: 325217 - RNA, 64 nt, hsa; identical to SEQ ID NO: 132806

SEQ ID NO: 325218 - RNA, 64 nt, hsa; identical to SEQ ID NO: 132807

SEQ ID NO: 325219 - RNA, 64 nt, hsa; identical to SEQ ID NO: 132808

SEQ ID NO: 325220 - RNA, 64 nt, hsa; identical to SEQ ID NO: 132809

SEQ ID NO: 325221 - RNA, 64 nt, hsa; identical to SEQ ID NO: 132810

SEQ ID NO: 325222 - RNA, 64 nt, hsa; identical to SEQ ID NO: 132811

SEQ ID NO: 325223 - RNA, 64 nt, hsa; identical to SEQ ID NO: 132812

SEQ ID NO: 325224 - RNA, 64 nt, hsa; identical to SEQ ID NO: 132813

SEQ ID NO: 325225 - RNA, 64 nt, hsa; identical to SEQ ID NO: 132814

SEQ ID NO: 325226 - RNA, 64 nt, hsa; identical to SEQ ID NO: 132815

SEQ ID NO: 325227 - RNA, 64 nt, hsa; identical to SEQ ID NO: 132816

SEQ ID NO: 325228 - RNA, 64 nt, hsa; identical to SEQ ID NO: 132817

SEQ ID NO: 325229 - RNA, 64 nt, hsa; identical to SEQ ID NO: 132818

SEQ ID NO: 325230 - RNA, 64 nt, hsa; identical to SEQ ID NO: 132819

SEQ ID NO: 325231 - RNA, 64 nt, hsa; identical to SEQ ID NO: 132820

SEQ ID NO: 325232 - RNA, 64 nt, hsa; identical to SEQ ID NO: 132821

SEQ ID NO: 325233 - RNA, 64 nt, hsa; identical to SEQ ID NO: 132822

SEQ ID NO: 325234 - RNA, 64 nt, hsa; identical to SEQ ID NO: 132823

SEQ ID NO: 325235 - RNA, 64 nt, hsa; identical to SEQ ID NO: 132824

SEQ ID NO: 325236 - RNA, 64 nt, hsa; identical to SEQ ID NO: 132825

SEQ ID NO: 325237 - RNA, 64 nt, hsa; identical to SEQ ID NO: 132826

SEQ ID NO: 325238 - RNA, 64 nt, hsa; identical to SEQ ID NO: 132827

SEQ ID NO: 325239 - RNA, 64 nt, hsa; identical to SEQ ID NO: 132828

SEQ ID NO: 325240 - RNA, 64 nt, hsa; identical to SEQ ID NO: 132829

SEQ ID NO: 325241 - RNA, 64 nt, hsa; identical to SEQ ID NO: 132830

SEQ ID NO: 325242 - RNA, 64 nt, hsa; identical to SEQ ID NO: 132831

SEQ ID NO: 325243 - RNA, 64 nt, hsa; identical to SEQ ID NO: 132832

SEQ ID NO: 325244 - RNA, 64 nt, hsa; identical to SEQ ID NO: 132833

SEQ ID NO: 325245 - RNA, 64 nt, hsa; identical to SEQ ID NO: 132834

SEQ ID NO: 325246 - RNA, 64 nt, hsa; identical to SEQ ID NO: 132835

SEQ ID NO: 325247 - RNA, 64 nt, hsa; identical to SEQ ID NO: 132836

SEQ ID NO: 325248 - RNA, 64 nt, hsa; identical to SEQ ID NO: 132837

SEQ ID NO: 325249 - RNA, 64 nt, hsa; identical to SEQ ID NO: 132838

SEQ ID NO: 325250 - RNA, 64 nt, hsa; identical to SEQ ID NO: 132839

SEQ ID NO: 325251 - RNA, 64 nt, hsa; identical to SEQ ID NO: 132840

SEQ ID NO: 325252 - RNA, 64 nt, hsa; identical to SEQ ID NO: 132841

SEQ ID NO: 325253 - RNA, 64 nt, hsa; identical to SEQ ID NO: 132842

SEQ ID NO: 325254 - RNA, 64 nt, hsa; identical to SEQ ID NO: 132843

SEQ ID NO: 325255 - RNA, 64 nt, hsa; identical to SEQ ID NO: 132844

SEQ ID NO: 325256 - RNA, 58 nt, hsa; identical to SEQ ID NO: 132845

SEQ ID NO: 325257 - RNA, 64 nt, hsa; identical to SEQ ID NO: 132846

SEQ ID NO: 325258 - RNA, 64 nt, hsa; identical to SEQ ID NO: 132847

SEQ ID NO: 325259 - RNA, 64 nt, hsa; identical to SEQ ID NO: 132848

SEQ ID NO: 325260 - RNA, 64 nt, hsa; identical to SEQ ID NO: 132849

SEQ ID NO: 325261 - RNA, 64 nt, hsa; identical to SEQ ID NO: 132850

SEQ ID NO: 325262 - RNA, 64 nt, hsa; identical to SEQ ID NO: 132851

SEQ ID NO: 325263 - RNA, 64 nt, hsa; identical to SEQ ID NO: 132852

SEQ ID NO: 325264 - RNA, 64 nt, hsa; identical to SEQ ID NO: 132853

SEQ ID NO: 325265 - RNA, 64 nt, hsa; identical to SEQ ID NO: 132854

SEQ ID NO: 325266 - RNA, 64 nt, hsa; identical to SEQ ID NO: 132855

SEQ ID NO: 325267 - RNA, 64 nt, hsa; identical to SEQ ID NO: 132856

SEQ ID NO: 325268 - RNA, 64 nt, hsa; identical to SEQ ID NO: 132857

SEQ ID NO: 325269 - RNA, 64 nt, hsa; identical to SEQ ID NO: 132858

SEQ ID NO: 325270 - RNA, 64 nt, hsa; identical to SEQ ID NO: 132859

SEQ ID NO: 325271 - RNA, 64 nt, hsa; identical to SEQ ID NO: 132860

SEQ ID NO: 325272 - RNA, 64 nt, hsa; identical to SEQ ID NO: 132861

SEQ ID NO: 325273 - RNA, 64 nt, hsa; identical to SEQ ID NO: 132862

SEQ ID NO: 325274 - RNA, 64 nt, hsa; identical to SEQ ID NO: 132863

SEQ ID NO: 325275 - RNA, 64 nt, hsa; identical to SEQ ID NO: 132864

SEQ ID NO: 325276 - RNA, 64 nt, hsa; identical to SEQ ID NO: 132865

SEQ ID NO: 325277 - RNA, 64 nt, hsa; identical to SEQ ID NO: 132866

SEQ ID NO: 325278 - RNA, 64 nt, hsa; identical to SEQ ID NO: 132867

SEQ ID NO: 325279 - RNA, 64 nt, hsa; identical to SEQ ID NO: 132868

SEQ ID NO: 325280 - RNA, 64 nt, hsa; identical to SEQ ID NO: 132869

SEQ ID NO: 325281 - RNA, 64 nt, hsa; identical to SEQ ID NO: 132870

SEQ ID NO: 325282 - RNA, 64 nt, hsa; identical to SEQ ID NO: 132871

SEQ ID NO: 325283 - RNA, 64 nt, hsa; identical to SEQ ID NO: 132872

SEQ ID NO: 325284 - RNA, 64 nt, hsa; identical to SEQ ID NO: 132873

SEQ ID NO: 325285 - RNA, 64 nt, hsa; identical to SEQ ID NO: 132874

SEQ ID NO: 325286 - RNA, 64 nt, hsa; identical to SEQ ID NO: 132875

SEQ ID NO: 325287 - RNA, 64 nt, hsa; identical to SEQ ID NO: 132876

SEQ ID NO: 325288 - RNA, 64 nt, hsa; identical to SEQ ID NO: 132877

SEQ ID NO: 325289 - RNA, 64 nt, hsa; identical to SEQ ID NO: 132878

SEQ ID NO: 325290 - RNA, 64 nt, hsa; identical to SEQ ID NO: 132879

SEQ ID NO: 325291 - RNA, 64 nt, hsa; identical to SEQ ID NO: 132880

SEQ ID NO: 325292 - RNA, 64 nt, hsa; identical to SEQ ID NO: 132881

SEQ ID NO: 325293 - RNA, 64 nt, hsa; identical to SEQ ID NO: 132882

SEQ ID NO: 325294 - RNA, 64 nt, hsa; identical to SEQ ID NO: 132883

SEQ ID NO: 325295 - RNA, 64 nt, hsa; identical to SEQ ID NO: 132884

SEQ ID NO: 325296 - RNA, 64 nt, hsa; identical to SEQ ID NO: 132885

SEQ ID NO: 325297 - RNA, 64 nt, hsa; identical to SEQ ID NO: 132886

SEQ ID NO: 325298 - RNA, 64 nt, hsa; identical to SEQ ID NO: 132887

SEQ ID NO: 325299 - RNA, 64 nt, hsa; identical to SEQ ID NO: 132888

SEQ ID NO: 325300 - RNA, 64 nt, hsa; identical to SEQ ID NO: 132889

SEQ ID NO: 325301 - RNA, 64 nt, hsa
acagcagagcaaguauucacugaguaggggugucccaugacacuauuucauauucuacagaagu

SEQ ID NO: 325302 - RNA, 64 nt, hsa
guagucauuuugagagguacaaagcucauaauuaccaugacaacaugguaauguccauagacau

SEQ ID NO: 325303 - RNA, 64 nt, hsa
gcuacacugcaacuuccguccagugcugugaugcccaugacaccugcaaaauaaguucugccug

SEQ ID NO: 325304 - RNA, 64 nt, hsa
auuuucugcuaccauuucuuuuccucugaagcggccaugacauucccuuuggcaacuaacguag

SEQ ID NO: 325305 - RNA, 64 nt, hsa
gugcaagugguagggacaagcagugaggugguggccaugacacuggagaccaagccucagcgga

SEQ ID NO: 325306 - RNA, 64 nt, hsa
uggcugcccugcccuacugugggcauagcgcccgccaugacacgcugcccgugccccuagcagg

SEQ ID NO: 325307 - RNA, 64 nt, hsa
aaaucccuagucuucaucagcucacaucacauuuccaugacaauccccuuugauuccucagaau

SEQ ID NO: 325308 - RNA, 64 nt, hsa
cuccacaaaugcaaaagauguauuuuccuguggcccaugacauuugcaguuauucccagugaga

SEQ ID NO: 325309 - RNA, 64 nt, hsa
gcgaaacccggugcaucuggcacguggccaggagccaugacaggggcgcuugggaggggccgga

SEQ ID NO: 325310 - RNA, 64 nt, hsa
ucucagacuguggaaccaaagcuggcccaguuguccaugacaaaagaggcuuuugggccaaaau

SEQ ID NO: 325311 - RNA, 64 nt, hsa
auaugaaguaugcuuuguugauuauagugagaacccaugacauaguuaaccaaagaauauguuu

SEQ ID NO: 325312 - RNA, 64 nt, hsa
cugaaacacacaauugacuggacagguccacgcgccaugacaaaacuauaaucaaguuauuaaa

SEQ ID NO: 325313 - RNA, 64 nt, hsa
caagauucuauggagguuggccacagucaccacuccaugacaucccugucuuccucaacgacuu

SEQ ID NO: 325314 - RNA, 64 nt, hsa
acaaugaggcaaggggcugauagagaagagucccccaugacaggaguuugugugcaacagaguc

SEQ ID NO: 325315 - RNA, 64 nt, hsa
gaaauacccucaaugaucuccugaagcaucugaaugacccaaauaguaaccccaaagccaucau

SEQ ID NO: 325316 - RNA, 64 nt, hsa
agauuaccaagcaguuugcuaaaaauucaaucuuugacccaagcuguagcauuuuuuuuucaug

SEQ ID NO: 325317 - RNA, 64 nt, hsa
ccaugccugggggccgagauucuccagcagaaagaugcaauauuuuuuguuuccuuuuuuucca

SEQ ID NO: 325318 - RNA, 64 nt, hsa
uagucuccuuugcauggacuucaagcugcaugaaaugcaauaaaucucauuuuagauaauuuag

SEQ ID NO: 325319 - RNA, 64 nt, hsa
aggauaaauuuuuugaccuauuuuaggguucuaaaugcaauaagauuuaguugaguuauuccac

SEQ ID NO: 325320 - RNA, 64 nt, hsa
uaaaaaacuguauaaggagauucuguguauuaacaugcaauaacaagcaugcauaaaucaaugg

SEQ ID NO: 325321 - RNA, 64 nt, hsa
uuuugaaaacagaugacuuauuucuccauuaaaaaugcaauaaaaauaaauggcaaacaagcaa

SEQ ID NO: 325322 - RNA, 64 nt, hsa
acuggauuuaugcuugaugcauuguugggaaaauaugcaauacaaacugguaucagaauuccuu

SEQ ID NO: 325323 - RNA, 64 nt, hsa
uucuaauauuucaguugagcugcuguuuucuuccaugcaauauuguauacucaauuguguauag

SEQ ID NO: 325324 - RNA, 64 nt, hsa
cauauaagcuugcuaaaaauauuaagaccaagucaugcaauaauugaauguaccucaaauuuuu

SEQ ID NO: 325325 - RNA, 64 nt, hsa
gagacaaacuguaaaaaauguguguauucuuaaaaugcaauauuuguaaggcuuguuccaaugc

SEQ ID NO: 325326 - RNA, 64 nt, hsa
cagcucccauucuaugugucaucaauaguguccuaugcaauaaaauuauuugcaggucuuuaaa

SEQ ID NO: 325327 - RNA, 64 nt, hsa
caacuugcugaaauacaccauuauuauuuguuguaugcaauacuggauuuauuuugauaacgua

SEQ ID NO: 325328 - RNA, 64 nt, hsa
acauucuuguaauaucuuugccagguucuauaaaaugcaauaauaagcaaauaaauuacuuugu

SEQ ID NO: 325329 - RNA, 64 nt, hsa
uguauugaucauggaugcccuccuuaauagccauaugcaauaaaauaaaguacauuauuuauga

SEQ ID NO: 325330 - RNA, 64 nt, hsa
uuuccucuauccuguacauuucacaaaaaggcauaugcaauauuuacauuuuuaauuuaguuua

SEQ ID NO: 325331 - RNA, 64 nt, hsa; identical to SEQ ID NO: 56842

SEQ ID NO: 325332 - RNA, 64 nt, hsa; identical to SEQ ID NO: 56843

SEQ ID NO: 325333 - RNA, 64 nt, hsa; identical to SEQ ID NO: 56844

SEQ ID NO: 325334 - RNA, 64 nt, hsa; identical to SEQ ID NO: 56845

SEQ ID NO: 325335 - RNA, 64 nt, hsa; identical to SEQ ID NO: 56846

SEQ ID NO: 325336 - RNA, 64 nt, hsa; identical to SEQ ID NO: 56847

SEQ ID NO: 325337 - RNA, 64 nt, hsa; identical to SEQ ID NO: 56848

SEQ ID NO: 325338 - RNA, 64 nt, hsa; identical to SEQ ID NO: 56849

SEQ ID NO: 325339 - RNA, 64 nt, hsa; identical to SEQ ID NO: 56850

SEQ ID NO: 325340 - RNA, 64 nt, hsa; identical to SEQ ID NO: 56851

SEQ ID NO: 325341 - RNA, 64 nt, hsa; identical to SEQ ID NO: 56852

SEQ ID NO: 325342 - RNA, 64 nt, hsa; identical to SEQ ID NO: 56853

SEQ ID NO: 325343 - RNA, 64 nt, hsa; identical to SEQ ID NO: 56854

SEQ ID NO: 325344 - RNA, 64 nt, hsa; identical to SEQ ID NO: 56855

SEQ ID NO: 325345 - RNA, 64 nt, hsa; identical to SEQ ID NO: 56856

SEQ ID NO: 325346 - RNA, 64 nt, hsa; identical to SEQ ID NO: 56857

SEQ ID NO: 325347 - RNA, 64 nt, hsa; identical to SEQ ID NO: 124312

SEQ ID NO: 325348 - RNA, 64 nt, hsa; identical to SEQ ID NO: 124313

SEQ ID NO: 325349 - RNA, 64 nt, hsa; identical to SEQ ID NO: 124314

SEQ ID NO: 325350 - RNA, 64 nt, hsa; identical to SEQ ID NO: 124315

SEQ ID NO: 325351 - RNA, 64 nt, hsa; identical to SEQ ID NO: 124316

SEQ ID NO: 325352 - RNA, 64 nt, hsa; identical to SEQ ID NO: 124317

SEQ ID NO: 325353 - RNA, 64 nt, hsa; identical to SEQ ID NO: 124318

SEQ ID NO: 325354 - RNA, 64 nt, hsa; identical to SEQ ID NO: 124319

SEQ ID NO: 325355 - RNA, 64 nt, hsa; identical to SEQ ID NO: 124320

SEQ ID NO: 325356 - RNA, 64 nt, hsa; identical to SEQ ID NO: 124321

SEQ ID NO: 325357 - RNA, 64 nt, hsa; identical to SEQ ID NO: 124322

SEQ ID NO: 325358 - RNA, 64 nt, hsa; identical to SEQ ID NO: 124323

SEQ ID NO: 325359 - RNA, 64 nt, hsa; identical to SEQ ID NO: 124324

SEQ ID NO: 325360 - RNA, 64 nt, hsa; identical to SEQ ID NO: 124325

SEQ ID NO: 325361 - RNA, 64 nt, hsa; identical to SEQ ID NO: 124326

SEQ ID NO: 325362 - RNA, 64 nt, hsa; identical to SEQ ID NO: 124327

SEQ ID NO: 325363 - RNA, 64 nt, hsa; identical to SEQ ID NO: 124328

SEQ ID NO: 325364 - RNA, 64 nt, hsa; identical to SEQ ID NO: 124329

SEQ ID NO: 325365 - RNA, 64 nt, hsa; identical to SEQ ID NO: 124330

SEQ ID NO: 325366 - RNA, 64 nt, hsa; identical to SEQ ID NO: 124331

SEQ ID NO: 325367 - RNA, 64 nt, hsa; identical to SEQ ID NO: 124332

SEQ ID NO: 325368 - RNA, 64 nt, hsa; identical to SEQ ID NO: 124324

SEQ ID NO: 325369 - RNA, 64 nt, hsa; identical to SEQ ID NO: 124325

SEQ ID NO: 325370 - RNA, 64 nt, hsa; identical to SEQ ID NO: 124335

SEQ ID NO: 325371 - RNA, 64 nt, hsa; identical to SEQ ID NO: 124336

SEQ ID NO: 325372 - RNA, 64 nt, hsa; identical to SEQ ID NO: 124337

SEQ ID NO: 325373 - RNA, 64 nt, hsa; identical to SEQ ID NO: 124338

SEQ ID NO: 325374 - RNA, 64 nt, hsa; identical to SEQ ID NO: 124339

SEQ ID NO: 325375 - RNA, 64 nt, hsa; identical to SEQ ID NO: 124340

SEQ ID NO: 325376 - RNA, 64 nt, hsa; identical to SEQ ID NO: 124341

SEQ ID NO: 325377 - RNA, 64 nt, hsa; identical to SEQ ID NO: 124342

SEQ ID NO: 325378 - RNA, 64 nt, hsa; identical to SEQ ID NO: 124343

SEQ ID NO: 325379 - RNA, 64 nt, hsa; identical to SEQ ID NO: 124344

SEQ ID NO: 325380 - RNA, 64 nt, hsa; identical to SEQ ID NO: 124345

SEQ ID NO: 325381 - RNA, 64 nt, hsa; identical to SEQ ID NO: 124346

SEQ ID NO: 325382 - RNA, 64 nt, hsa; identical to SEQ ID NO: 124347

SEQ ID NO: 325383 - RNA, 64 nt, hsa; identical to SEQ ID NO: 124348

SEQ ID NO: 325384 - RNA, 64 nt, hsa; identical to SEQ ID NO: 124349

SEQ ID NO: 325385 - RNA, 64 nt, hsa; identical to SEQ ID NO: 124350

SEQ ID NO: 325386 - RNA, 64 nt, hsa; identical to SEQ ID NO: 124351

SEQ ID NO: 325387 - RNA, 64 nt, hsa; identical to SEQ ID NO: 124352

SEQ ID NO: 325388 - RNA, 64 nt, hsa; identical to SEQ ID NO: 124353

SEQ ID NO: 325389 - RNA, 64 nt, hsa; identical to SEQ ID NO: 124354

SEQ ID NO: 325390 - RNA, 64 nt, hsa; identical to SEQ ID NO: 124355

SEQ ID NO: 325391 - RNA, 64 nt, hsa; identical to SEQ ID NO: 124356

SEQ ID NO: 325392 - RNA, 64 nt, hsa; identical to SEQ ID NO: 124357

SEQ ID NO: 325393 - RNA, 64 nt, hsa; identical to SEQ ID NO: 124358

SEQ ID NO: 325394 - RNA, 64 nt, hsa; identical to SEQ ID NO: 124359

SEQ ID NO: 325395 - RNA, 64 nt, hsa; identical to SEQ ID NO: 124360

SEQ ID NO: 325396 - RNA, 64 nt, hsa; identical to SEQ ID NO: 124361

SEQ ID NO: 325397 - RNA, 64 nt, hsa; identical to SEQ ID NO: 124362

SEQ ID NO: 325398 - RNA, 64 nt, hsa; identical to SEQ ID NO: 124363

SEQ ID NO: 325399 - RNA, 64 nt, hsa; identical to SEQ ID NO: 124364

SEQ ID NO: 325400 - RNA, 64 nt, hsa; identical to SEQ ID NO: 124365

SEQ ID NO: 325401 - RNA, 64 nt, hsa; identical to SEQ ID NO: 124366

SEQ ID NO: 325402 - RNA, 61 nt, hsa; identical to SEQ ID NO: 124367

SEQ ID NO: 325403 - RNA, 64 nt, hsa; identical to SEQ ID NO: 124368

SEQ ID NO: 325404 - RNA, 64 nt, hsa; identical to SEQ ID NO: 124369

SEQ ID NO: 325405 - RNA, 64 nt, hsa; identical to SEQ ID NO: 124370

SEQ ID NO: 325406 - RNA, 64 nt, hsa; identical to SEQ ID NO: 124371

SEQ ID NO: 325407 - RNA, 64 nt, hsa; identical to SEQ ID NO: 124372

SEQ ID NO: 325408 - RNA, 64 nt, hsa; identical to SEQ ID NO: 124373

SEQ ID NO: 325409 - RNA, 64 nt, hsa; identical to SEQ ID NO: 124374

SEQ ID NO: 325410 - RNA, 64 nt, hsa; identical to SEQ ID NO: 124375

SEQ ID NO: 325411 - RNA, 64 nt, hsa; identical to SEQ ID NO: 124376

SEQ ID NO: 325412 - RNA, 64 nt, hsa; identical to SEQ ID NO: 64767

SEQ ID NO: 325413 - RNA, 64 nt, hsa; identical to SEQ ID NO: 64768

SEQ ID NO: 325414 - RNA, 64 nt, hsa; identical to SEQ ID NO: 64769

SEQ ID NO: 325415 - RNA, 64 nt, hsa; identical to SEQ ID NO: 64770

SEQ ID NO: 325416 - RNA, 64 nt, hsa; identical to SEQ ID NO: 64771

SEQ ID NO: 325417 - RNA, 64 nt, hsa; identical to SEQ ID NO: 64772

SEQ ID NO: 325418 - RNA, 64 nt, hsa; identical to SEQ ID NO: 64773

SEQ ID NO: 325419 - RNA, 64 nt, hsa; identical to SEQ ID NO: 64774

SEQ ID NO: 325420 - RNA, 64 nt, hsa; identical to SEQ ID NO: 64775

SEQ ID NO: 325421 - RNA, 64 nt, hsa; identical to SEQ ID NO: 64776

SEQ ID NO: 325422 - RNA, 64 nt, hsa; identical to SEQ ID NO: 64777

SEQ ID NO: 325423 - RNA, 64 nt, hsa; identical to SEQ ID NO: 64778

SEQ ID NO: 325424 - RNA, 64 nt, hsa; identical to SEQ ID NO: 64779

SEQ ID NO: 325425 - RNA, 64 nt, hsa; identical to SEQ ID NO: 64780

SEQ ID NO: 325426 - RNA, 64 nt, hsa; identical to SEQ ID NO: 64781

SEQ ID NO: 325427 - RNA, 64 nt, hsa; identical to SEQ ID NO: 64782

SEQ ID NO: 325428 - RNA, 64 nt, hsa; identical to SEQ ID NO: 64783

SEQ ID NO: 325429 - RNA, 64 nt, hsa; identical to SEQ ID NO: 64784

SEQ ID NO: 325430 - RNA, 64 nt, hsa; identical to SEQ ID NO: 64785

SEQ ID NO: 325431 - RNA, 64 nt, hsa; identical to SEQ ID NO: 64786

SEQ ID NO: 325432 - RNA, 64 nt, hsa; identical to SEQ ID NO: 64787

SEQ ID NO: 325433 - RNA, 64 nt, hsa; identical to SEQ ID NO: 64788

SEQ ID NO: 325434 - RNA, 64 nt, hsa; identical to SEQ ID NO: 64789

SEQ ID NO: 325435 - RNA, 64 nt, hsa; identical to SEQ ID NO: 64790

SEQ ID NO: 325436 - RNA, 64 nt, hsa; identical to SEQ ID NO: 64791

SEQ ID NO: 325437 - RNA, 64 nt, hsa; identical to SEQ ID NO: 64792

SEQ ID NO: 325438 - RNA, 64 nt, hsa; identical to SEQ ID NO: 64793

SEQ ID NO: 325439 - RNA, 64 nt, hsa; identical to SEQ ID NO: 64794

SEQ ID NO: 325440 - RNA, 64 nt, hsa; identical to SEQ ID NO: 64795

SEQ ID NO: 325441 - RNA, 64 nt, hsa; identical to SEQ ID NO: 64796

SEQ ID NO: 325442 - RNA, 64 nt, hsa; identical to SEQ ID NO: 64797

SEQ ID NO: 325443 - RNA, 64 nt, hsa; identical to SEQ ID NO: 64798

SEQ ID NO: 325444 - RNA, 64 nt, hsa; identical to SEQ ID NO: 64799

SEQ ID NO: 325445 - RNA, 64 nt, hsa; identical to SEQ ID NO: 64800

SEQ ID NO: 325446 - RNA, 64 nt, hsa; identical to SEQ ID NO: 64801

SEQ ID NO: 325447 - RNA, 64 nt, hsa; identical to SEQ ID NO: 64802

SEQ ID NO: 325448 - RNA, 64 nt, hsa; identical to SEQ ID NO: 64803

SEQ ID NO: 325449 - RNA, 64 nt, hsa
uuuccuacauuuauuagauuuucauuuucuauuaacaauugaauaccauuucaguuuauagacu

SEQ ID NO: 325450 - RNA, 64 nt, hsa
aguuaaguuguugcuaucgcaacaauccuggcagacaauugaguaauauuuugaugauuuauuu

SEQ ID NO: 325451 - RNA, 64 nt, hsa
uuaguugaucucgauaauuugaggauaacagaugacaauugaauuuuuaauugauuuaguauuu

SEQ ID NO: 325452 - RNA, 64 nt, hsa
gugucuuuauacuuuacugguuugugaauuuuauacaauugaaagucuuuuuuucuugcuucuu

SEQ ID NO: 325453 - RNA, 64 nt, hsa
uugauguaacaucuuaauuaaccuuuuaauuuucacaauugaugacagugugaguuugaugaaa

SEQ ID NO: 325454 - RNA, 64 nt, hsa
uguguagucuggaauuguuaacauuuuaauuuuuacaauugauguaacaucuuaauuaaccuuu

SEQ ID NO: 325455 - RNA, 64 nt, hsa
ucucauuagaucaaaagggacuuauguacauacaacaauugaaaguguuugcucaugaaaucag

SEQ ID NO: 325456 - RNA, 64 nt, hsa
uuugcacaagagucuguguuuucagccucuguauacaauugagggcagucuagcccuuuggaug

SEQ ID NO: 325457 - RNA, 64 nt, hsa
agggagaguuagguuauucaaaaauuaguaugggacaauugaauaugccuuuuucugcgggagu

SEQ ID NO: 325458 - RNA, 64 nt, hsa
aaggcuuugaauaagaaauuuucuguugcucuuaacaauugauacaaguuagggauuugccagc

SEQ ID NO: 325459 - RNA, 64 nt, hsa
uguucucaauuauuugcgggaucuaaaagucaaaacaauugaacucauggauauagagaguaga

SEQ ID NO: 325460 - RNA, 64 nt, hsa
ugaaaucauguuuuuuuaacaaaagagauaaaauacaauugaagcaaaaaauaacagcuaguau

SEQ ID NO: 325461 - RNA, 64 nt, hsa
ggacaggggguuuucaaaaggaacauggcucacucagagcuauaugguuagacguuucuccccu

SEQ ID NO: 325462 - RNA, 64 nt, hsa
cggacccacgcccagaggaacgugcagaaaaaagcagagcuacauggcugugggcaacuauaag

SEQ ID NO: 325463 - RNA, 64 nt, hsa
ugcugccucaggucaggccagggcagugcugcugcagagcuagaaggcccugcagcuacagcug

SEQ ID NO: 325464 - RNA, 64 nt, hsa
cccguuccagaacuugcauacacugagcgggcuacagagcuagaaggcccugcagcuacagcug

SEQ ID NO: 325465 - RNA, 64 nt, hsa
acuauuuugcuccuuuucugguguuacacauacacacucauacguguguguguguguaugugug

SEQ ID NO: 325466 - RNA, 64 nt, hsa
cacagacuuccaccaugugcaucaggaaacaccucacucauacugucauauaaugcaacaggga

SEQ ID NO: 325467 - RNA, 64 nt, hsa
agcaauuacagcagagaaaauucauuagugcucccacucauauccuuaugugugaguuggugaa

SEQ ID NO: 325468 - RNA, 64 nt, hsa
cacuugacucauuacgucgucauucuuguuacaucacucauacuuuuagcugcaaccacacuaa

SEQ ID NO: 325469 - RNA, 64 nt, hsa; identical to SEQ ID NO: 134270

SEQ ID NO: 325470 - RNA, 64 nt, hsa; identical to SEQ ID NO: 134271

SEQ ID NO: 325471 - RNA, 64 nt, hsa; identical to SEQ ID NO: 134272

SEQ ID NO: 325472 - RNA, 64 nt, hsa; identical to SEQ ID NO: 134273

SEQ ID NO: 325473 - RNA, 64 nt, hsa; identical to SEQ ID NO: 134274

SEQ ID NO: 325474 - RNA, 64 nt, hsa; identical to SEQ ID NO: 134275

SEQ ID NO: 325475 - RNA, 64 nt, hsa; identical to SEQ ID NO: 134276

SEQ ID NO: 325476 - RNA, 64 nt, hsa; identical to SEQ ID NO: 134277

SEQ ID NO: 325477 - RNA, 64 nt, hsa; identical to SEQ ID NO: 134278

SEQ ID NO: 325478 - RNA, 64 nt, hsa; identical to SEQ ID NO: 134279

SEQ ID NO: 325479 - RNA, 64 nt, hsa; identical to SEQ ID NO: 134280

SEQ ID NO: 325480 - RNA, 64 nt, hsa; identical to SEQ ID NO: 134281

SEQ ID NO: 325481 - RNA, 64 nt, hsa; identical to SEQ ID NO: 134282

SEQ ID NO: 325482 - RNA, 64 nt, hsa; identical to SEQ ID NO: 134283

SEQ ID NO: 325483 - RNA, 64 nt, hsa; identical to SEQ ID NO: 134284

SEQ ID NO: 325484 - RNA, 64 nt, hsa; identical to SEQ ID NO: 134285

SEQ ID NO: 325485 - RNA, 64 nt, hsa; identical to SEQ ID NO: 134286

SEQ ID NO: 325486 - RNA, 64 nt, hsa; identical to SEQ ID NO: 134287

SEQ ID NO: 325487 - RNA, 64 nt, hsa; identical to SEQ ID NO: 134288

SEQ ID NO: 325488 - RNA, 64 nt, hsa; identical to SEQ ID NO: 134289

SEQ ID NO: 325489 - RNA, 64 nt, hsa; identical to SEQ ID NO: 134290

SEQ ID NO: 325490 - RNA, 64 nt, hsa; identical to SEQ ID NO: 134291

SEQ ID NO: 325491 - RNA, 64 nt, hsa; identical to SEQ ID NO: 134292

SEQ ID NO: 325492 - RNA, 64 nt, hsa; identical to SEQ ID NO: 134293

SEQ ID NO: 325493 - RNA, 64 nt, hsa; identical to SEQ ID NO: 134294

SEQ ID NO: 325494 - RNA, 64 nt, hsa; identical to SEQ ID NO: 134295

SEQ ID NO: 325495 - RNA, 64 nt, hsa; identical to SEQ ID NO: 134296

SEQ ID NO: 325496 - RNA, 64 nt, hsa; identical to SEQ ID NO: 134297

SEQ ID NO: 325497 - RNA, 64 nt, hsa; identical to SEQ ID NO: 134298

SEQ ID NO: 325498 - RNA, 64 nt, hsa; identical to SEQ ID NO: 134299

SEQ ID NO: 325499 - RNA, 64 nt, hsa; identical to SEQ ID NO: 134300

SEQ ID NO: 325500 - RNA, 64 nt, hsa; identical to SEQ ID NO: 134301

SEQ ID NO: 325501 - RNA, 64 nt, hsa; identical to SEQ ID NO: 134302

SEQ ID NO: 325502 - RNA, 64 nt, hsa; identical to SEQ ID NO: 134303

SEQ ID NO: 325503 - RNA, 64 nt, hsa; identical to SEQ ID NO: 50556

SEQ ID NO: 325504 - RNA, 64 nt, hsa; identical to SEQ ID NO: 50557

SEQ ID NO: 325505 - RNA, 64 nt, hsa; identical to SEQ ID NO: 50558

SEQ ID NO: 325506 - RNA, 64 nt, hsa; identical to SEQ ID NO: 50559

SEQ ID NO: 325507 - RNA, 64 nt, hsa; identical to SEQ ID NO: 50560

SEQ ID NO: 325508 - RNA, 64 nt, hsa; identical to SEQ ID NO: 50561

SEQ ID NO: 325509 - RNA, 64 nt, hsa; identical to SEQ ID NO: 50562

SEQ ID NO: 325510 - RNA, 64 nt, hsa; identical to SEQ ID NO: 50563

SEQ ID NO: 325511 - RNA, 64 nt, hsa; identical to SEQ ID NO: 50564

SEQ ID NO: 325512 - RNA, 64 nt, hsa; identical to SEQ ID NO: 50565

SEQ ID NO: 325513 - RNA, 64 nt, hsa; identical to SEQ ID NO: 50566

SEQ ID NO: 325514 - RNA, 64 nt, hsa; identical to SEQ ID NO: 50567

SEQ ID NO: 325515 - RNA, 64 nt, hsa; identical to SEQ ID NO: 50568

SEQ ID NO: 325516 - RNA, 64 nt, hsa; identical to SEQ ID NO: 50569

SEQ ID NO: 325517 - RNA, 64 nt, hsa; identical to SEQ ID NO: 50570

SEQ ID NO: 325518 - RNA, 64 nt, hsa; identical to SEQ ID NO: 50571

SEQ ID NO: 325519 - RNA, 64 nt, hsa; identical to SEQ ID NO: 50572

SEQ ID NO: 325520 - RNA, 64 nt, hsa; identical to SEQ ID NO: 50573

SEQ ID NO: 325521 - RNA, 64 nt, hsa; identical to SEQ ID NO: 50574

SEQ ID NO: 325522 - RNA, 64 nt, hsa; identical to SEQ ID NO: 50575

SEQ ID NO: 325523 - RNA, 64 nt, hsa; identical to SEQ ID NO: 50576

SEQ ID NO: 325524 - RNA, 64 nt, hsa; identical to SEQ ID NO: 50577

SEQ ID NO: 325525 - RNA, 64 nt, hsa; identical to SEQ ID NO: 50578

SEQ ID NO: 325526 - RNA, 64 nt, hsa; identical to SEQ ID NO: 50579

SEQ ID NO: 325527 - RNA, 64 nt, hsa; identical to SEQ ID NO: 50580

SEQ ID NO: 325528 - RNA, 64 nt, hsa; identical to SEQ ID NO: 50581

SEQ ID NO: 325529 - RNA, 64 nt, hsa; identical to SEQ ID NO: 50582

SEQ ID NO: 325530 - RNA, 64 nt, hsa; identical to SEQ ID NO: 50583

SEQ ID NO: 325531 - RNA, 64 nt, hsa; identical to SEQ ID NO: 50584

SEQ ID NO: 325532 - RNA, 64 nt, hsa; identical to SEQ ID NO: 50585

SEQ ID NO: 325533 - RNA, 64 nt, hsa; identical to SEQ ID NO: 50586

SEQ ID NO: 325534 - RNA, 64 nt, hsa; identical to SEQ ID NO: 50587

SEQ ID NO: 325535 - RNA, 64 nt, hsa; identical to SEQ ID NO: 50588

SEQ ID NO: 325536 - RNA, 64 nt, hsa; identical to SEQ ID NO: 50589

SEQ ID NO: 325537 - RNA, 64 nt, hsa; identical to SEQ ID NO: 50590

SEQ ID NO: 325538 - RNA, 64 nt, hsa; identical to SEQ ID NO: 50591

SEQ ID NO: 325539 - RNA, 64 nt, hsa; identical to SEQ ID NO: 50592

SEQ ID NO: 325540 - RNA, 64 nt, hsa; identical to SEQ ID NO: 50593

SEQ ID NO: 325541 - RNA, 64 nt, hsa; identical to SEQ ID NO: 50594

SEQ ID NO: 325542 - RNA, 64 nt, hsa; identical to SEQ ID NO: 50595

SEQ ID NO: 325543 - RNA, 64 nt, hsa; identical to SEQ ID NO: 50596

SEQ ID NO: 325544 - RNA, 64 nt, hsa; identical to SEQ ID NO: 50597

SEQ ID NO: 325545 - RNA, 64 nt, hsa; identical to SEQ ID NO: 50598

SEQ ID NO: 325546 - RNA, 64 nt, hsa; identical to SEQ ID NO: 50599

SEQ ID NO: 325547 - RNA, 64 nt, hsa; identical to SEQ ID NO: 50600

SEQ ID NO: 325548 - RNA, 64 nt, hsa; identical to SEQ ID NO: 50601

SEQ ID NO: 325549 - RNA, 64 nt, hsa; identical to SEQ ID NO: 50602

SEQ ID NO: 325550 - RNA, 64 nt, hsa; identical to SEQ ID NO: 50603

SEQ ID NO: 325551 - RNA, 64 nt, hsa; identical to SEQ ID NO: 50604

SEQ ID NO: 325552 - RNA, 64 nt, hsa; identical to SEQ ID NO: 50605

SEQ ID NO: 325553 - RNA, 64 nt, hsa; identical to SEQ ID NO: 50606

SEQ ID NO: 325554 - RNA, 64 nt, hsa; identical to SEQ ID NO: 50607

SEQ ID NO: 325555 - RNA, 64 nt, hsa; identical to SEQ ID NO: 50608

SEQ ID NO: 325556 - RNA, 64 nt, hsa; identical to SEQ ID NO: 50609

SEQ ID NO: 325557 - RNA, 64 nt, hsa; identical to SEQ ID NO: 50610

SEQ ID NO: 325558 - RNA, 64 nt, hsa; identical to SEQ ID NO: 50611

SEQ ID NO: 325559 - RNA, 64 nt, hsa; identical to SEQ ID NO: 50612

SEQ ID NO: 325560 - RNA, 64 nt, hsa; identical to SEQ ID NO: 50613

SEQ ID NO: 325561 - RNA, 64 nt, hsa; identical to SEQ ID NO: 50614

SEQ ID NO: 325562 - RNA, 64 nt, hsa; identical to SEQ ID NO: 50615

SEQ ID NO: 325563 - RNA, 64 nt, hsa; identical to SEQ ID NO: 50616

SEQ ID NO: 325564 - RNA, 64 nt, hsa; identical to SEQ ID NO: 50617

SEQ ID NO: 325565 - RNA, 64 nt, hsa; identical to SEQ ID NO: 50618

SEQ ID NO: 325566 - RNA, 64 nt, hsa; identical to SEQ ID NO: 50619

SEQ ID NO: 325567 - RNA, 64 nt, hsa; identical to SEQ ID NO: 50620

SEQ ID NO: 325568 - RNA, 64 nt, hsa; identical to SEQ ID NO: 50621

SEQ ID NO: 325569 - RNA, 64 nt, hsa; identical to SEQ ID NO: 50622

SEQ ID NO: 325570 - RNA, 64 nt, hsa; identical to SEQ ID NO: 50623

SEQ ID NO: 325571 - RNA, 64 nt, hsa; identical to SEQ ID NO: 50624

SEQ ID NO: 325572 - RNA, 64 nt, hsa; identical to SEQ ID NO: 50625

SEQ ID NO: 325573 - RNA, 64 nt, hsa; identical to SEQ ID NO: 50626

SEQ ID NO: 325574 - RNA, 64 nt, hsa; identical to SEQ ID NO: 50627

SEQ ID NO: 325575 - RNA, 64 nt, hsa; identical to SEQ ID NO: 50628

SEQ ID NO: 325576 - RNA, 64 nt, hsa; identical to SEQ ID NO: 50629

SEQ ID NO: 325577 - RNA, 64 nt, hsa; identical to SEQ ID NO: 50630

SEQ ID NO: 325578 - RNA, 64 nt, hsa; identical to SEQ ID NO: 50631

SEQ ID NO: 325579 - RNA, 64 nt, hsa; identical to SEQ ID NO: 50632

SEQ ID NO: 325580 - RNA, 64 nt, hsa; identical to SEQ ID NO: 50633

SEQ ID NO: 325581 - RNA, 64 nt, hsa; identical to SEQ ID NO: 50634

SEQ ID NO: 325582 - RNA, 64 nt, hsa; identical to SEQ ID NO: 50635

SEQ ID NO: 325583 - RNA, 64 nt, hsa; identical to SEQ ID NO: 50636

SEQ ID NO: 325584 - RNA, 64 nt, hsa; identical to SEQ ID NO: 50637

SEQ ID NO: 325585 - RNA, 64 nt, hsa; identical to SEQ ID NO: 50638

SEQ ID NO: 325586 - RNA, 64 nt, hsa; identical to SEQ ID NO: 50639

SEQ ID NO: 325587 - RNA, 64 nt, hsa; identical to SEQ ID NO: 50640

SEQ ID NO: 325588 - RNA, 64 nt, hsa; identical to SEQ ID NO: 50641

SEQ ID NO: 325589 - RNA, 64 nt, hsa; identical to SEQ ID NO: 50642

SEQ ID NO: 325590 - RNA, 64 nt, hsa; identical to SEQ ID NO: 50643

SEQ ID NO: 325591 - RNA, 64 nt, hsa; identical to SEQ ID NO: 50644

SEQ ID NO: 325592 - RNA, 61 nt, hsa
ggauucaaauguuuucauguaacuauguaaaaagcucuaagcucuagagucuagauccagu

SEQ ID NO: 325593 - RNA, 61 nt, hsa
aauguuuucauguaacuauguaaaaagcucuaagcucuagagucuagauccagucacugac

SEQ ID NO: 325594 - RNA, 64 nt, hsa
uauaucccauauauuuaauaugucaaaaagggcuugaggugaauuucauuaaauggaauaauau

SEQ ID NO: 325595 - RNA, 64 nt, hsa
ccuaauauuuuguucugcaaauuaauguauaauuugaggugaaauucaguuauaaagucaagga

SEQ ID NO: 325596 - RNA, 64 nt, hsa
aaaguuuguuagguuacaugguuacacagugaggugaggugagguagcaagaaguuucugugag

SEQ ID NO: 325597 - RNA, 64 nt, hsa
cagugaaaguuuguuagguuacaugguuacacagugaggugaggugagguagcaagaaguuucu

SEQ ID NO: 325598 - RNA, 64 nt, hsa
cagguuugugauccucaggagacugcagacagagugaggugagcaccaugguuucucagccugc

SEQ ID NO: 325599 - RNA, 64 nt, hsa
gaagacacuacucguuacauauuggaugacucauugaggugaaaaccuuauuaguguugugaua

SEQ ID NO: 325600 - RNA, 64 nt, hsa
guggggacccaugauguaugggucucaccugacuugaggugaauuuuggagugaagggcccuga

SEQ ID NO: 325601 - RNA, 64 nt, hsa
aggagcuggggcagaggcugagccgggaggcccuugaggugaggacacagcaggcccaggacca

SEQ ID NO: 325602 - RNA, 64 nt, hsa; identical to SEQ ID NO: 284934

SEQ ID NO: 325603 - RNA, 64 nt, hsa; identical to SEQ ID NO: 284935

SEQ ID NO: 325604 - RNA, 64 nt, hsa; identical to SEQ ID NO: 284936

SEQ ID NO: 325605 - RNA, 64 nt, hsa; identical to SEQ ID NO: 284937

SEQ ID NO: 325606 - RNA, 64 nt, hsa; identical to SEQ ID NO: 284938

SEQ ID NO: 325607 - RNA, 64 nt, hsa; identical to SEQ ID NO: 284939

SEQ ID NO: 325608 - RNA, 64 nt, hsa; identical to SEQ ID NO: 284940

SEQ ID NO: 325609 - RNA, 64 nt, hsa; identical to SEQ ID NO: 284941

SEQ ID NO: 325610 - RNA, 64 nt, hsa; identical to SEQ ID NO: 284942

SEQ ID NO: 325611 - RNA, 64 nt, hsa; identical to SEQ ID NO: 284943

SEQ ID NO: 325612 - RNA, 64 nt, hsa; identical to SEQ ID NO: 284944

SEQ ID NO: 325613 - RNA, 64 nt, hsa; identical to SEQ ID NO: 284945

SEQ ID NO: 325614 - RNA, 64 nt, hsa; identical to SEQ ID NO: 284946

SEQ ID NO: 325615 - RNA, 64 nt, hsa; identical to SEQ ID NO: 284947

SEQ ID NO: 325616 - RNA, 64 nt, hsa; identical to SEQ ID NO: 284948

SEQ ID NO: 325617 - RNA, 63 nt, hsa; identical to SEQ ID NO: 284949

SEQ ID NO: 325618 - RNA, 64 nt, hsa
uugccuccccgaucagugugugccuguuuacagcacuaucuaucuuucucucuccaaaugucac

SEQ ID NO: 325619 - RNA, 64 nt, hsa
guuaucagacagagcacugacuauguacuaucaaacuaucuaacaaucugcauaagucugauuc

SEQ ID NO: 325620 - RNA, 64 nt, hsa
ucuguuuucgaauuucaacacuagaaugacuaaaacuaucuaccuauagaacuaucuguagaua

SEQ ID NO: 325621 - RNA, 64 nt, hsa
acuaucuaccuauagaacuaucuguagauaguauacuaucuacacucugcucaacaagcucaga

SEQ ID NO: 325622 - RNA, 64 nt, hsa
auuaaguggggucacugaauuccauuuguggacugaaaaguauucaauccacuuuugggguuca

SEQ ID NO: 325623 - RNA, 64 nt, hsa
gaagcaagagaguauuccuaguauucccaaccaugaaaaguaucauucuuugcaccaaauguua

SEQ ID NO: 325624 - RNA, 64 nt, hsa
aaaaucgccuguaugaaaaauaccucgcuggauggaaaaguagauaugaacuuacauuucugug

SEQ ID NO: 325625 - RNA, 64 nt, hsa
aggccacuuggcucacacagaagaaaggaguuaggaaaaguacugauugacuuaucaaaagaag

SEQ ID NO: 325626 - RNA, 64 nt, hsa
aaaggaaaaaaaccagaaauuuaaaauagauacagaaaaguacacugguaauauuuuuauuucc

SEQ ID NO: 325627 - RNA, 64 nt, hsa
guauaauauuuuuuccuuauaauuuagcauacaggaaaaguauuuauuuuuuaaguaggguauc

SEQ ID NO: 325628 - RNA, 64 nt, hsa
uaguccugccucguacuccccuuccccuaugauugaaaaguaaacaaaacccacauuuccuauc

SEQ ID NO: 325629 - RNA, 64 nt, hsa
gccuugaugauucacuguuggggagaagaaacaagaaaaguaacugguugucaccuaugagacc

SEQ ID NO: 325630 - RNA, 64 nt, hsa
ggaggugauagucacuaagaacuguugaauggcagaaaaguauuugcucucguuuuauguucug

SEQ ID NO: 325631 - RNA, 64 nt, hsa
acaaaaagcaauugcuauaugaaaauauucguaagaaaaguaaagcaaauuguuucuuugugcu

SEQ ID NO: 325632 - RNA, 64 nt, hsa
aaucuugaacagguucacuaagcacccacccugugaaaaguauuauggaaaucacugcugcaca

SEQ ID NO: 325633 - RNA, 64 nt, hsa
ugugaaaaguauuauggaaaucacugcugcacaggaaaaguaauucagauguuaaugccacuug

SEQ ID NO: 325634 - RNA, 64 nt, hsa
acuauuauuugggaaaauuguuuagguuauaugggaaaaguagcucuuuaaaaaucauauugcc

SEQ ID NO: 325635 - RNA, 64 nt, hsa
gccacagaaagggcucuuuuaacuuaagauaagugaaaaguacuaaaaaagauucagguaauua

SEQ ID NO: 325636 - RNA, 64 nt, hsa
gauaaauaugagcaaaugaaguguaauaucuauagaaaaguagagugagggugaauuuauauau

SEQ ID NO: 325637 - RNA, 64 nt, hsa
aaaguuuuugcuuguguccuccucagucagaauagaaaaguaacugaaauacuuuuaccuuucu

SEQ ID NO: 325638 - RNA, 64 nt, hsa
uucugguucaagacugucauuuucuauuucaaccgaaaaguaagcauuuaacccggugaauaaa

SEQ ID NO: 325639 - RNA, 64 nt, hsa
cuacuauaaaaagccaggaccauguuagaauuaggaaaaguaaccagcauuacugcaccucuug

SEQ ID NO: 325640 - RNA, 64 nt, hsa
acuuuuggaaaccaaccaaauuacuuaagaaauggaaaaguagucacagagaaauuuaguaauu

SEQ ID NO: 325641 - RNA, 64 nt, hsa
uauuuuaucaaauuugccuuaaaauaaugaaaaagaaaaguauaguuaaugguuucaaauaugc

SEQ ID NO: 325642 - RNA, 64 nt, hsa
uuuucuggucauucuugacuuggaaaacgguauggaaaaguauuuaguuacauguuuguuuguu

SEQ ID NO: 325643 - RNA, 64 nt, hsa
uguuccuauauuaccauauuuacugaauuuucuggaaaaguaacuuuaauaaaguuuaaucuca

SEQ ID NO: 325644 - RNA, 64 nt, hsa
gacuacacaauuauguaccaucacaguauuaguggaaaaguaccaugugauuuaauucuccauu

SEQ ID NO: 325645 - RNA, 64 nt, hsa
ugcagcaaaguuugggagcuacugauggacaugugaaaaguaaguauaaauggaauaaaauuaa

SEQ ID NO: 325646 - RNA, 64 nt, hsa
ggccuugagcucuuuguuuuuauauuaaugaggagaaaaguaugaaaacaagaagucuuaagua

SEQ ID NO: 325647 - RNA, 64 nt, hsa
uucuuaauugcuaaguaaucuguuugcacucuaggaaaaguaaauggagagguaaaagaaaggc

SEQ ID NO: 325648 - RNA, 64 nt, hsa
caguuaauuuuaacaugugugaugugccaugguggaaaaguacuaucggaauaacucugcagug

SEQ ID NO: 325649 - RNA, 64 nt, hsa
auggaaagcuguguuaaugguaugaggaaugugugaaaaguauacacaaagggcucugaagcuc

SEQ ID NO: 325650 - RNA, 64 nt, hsa
gaugguauugguuuguuugguagauaagugggaggaaaaguacuguugcuacacuauuauaggc

SEQ ID NO: 325651 - RNA, 64 nt, hsa
guucaucacucuuaaaauauguguuuucucuauagaaaaguaaaauguguuuauggucccaaac

SEQ ID NO: 325652 - RNA, 64 nt, hsa
ugugauuacaagcgugagccacggcaccugggcagaaaaguaucuuaauuaaugaaagagcuaa

SEQ ID NO: 325653 - RNA, 64 nt, hsa
uuagauuuuaaauuauuaaagucaaaaauccauagaaaaguaucccuuuuuuuuuuuuugagac

SEQ ID NO: 325654 - RNA, 64 nt, hsa
agacucugucucaaaaaaaaacaaaaaagaagaagaaaaguacuucuacagccauguccuauuc

SEQ ID NO: 325655 - RNA, 64 nt, hsa
gggggaggguucagggcagcaaugcugaguucaagaaaaguacuucaggcugggcacaguggcu

SEQ ID NO: 325656 - RNA, 64 nt, hsa
uaaggauaacauuaucuacccagagaguuuagaagaaaaguaggaguccaaaggaagaguaaac

SEQ ID NO: 325657 - RNA, 64 nt, hsa
uuugaacugauauaaaaaaaaaugcugaguaacagaaaaguauuaaugugcuugacaccaugac

SEQ ID NO: 325658 - RNA, 64 nt, hsa
uggaaggaucucuccacagggcuuguuuuccaaagaaaaguauuguuuggaggagcaaaguuaa

SEQ ID NO: 325659 - RNA, 64 nt, hsa
uauugaaguguucugagcuguaucuugauguuuagaaaaguauucguuacaucuuguaggaucu

SEQ ID NO: 325660 - RNA, 64 nt, hsa
aaauauugaaguguuuuuaaaaauuaaagaagaagaaaaguaaaagagcuuaccacuggcgccu

SEQ ID NO: 325661 - RNA, 64 nt, hsa
ugcuuuuggaaauggccuuggcuaaaguaaaagggaaaaguagauccgauaacuuaaaaacgua

SEQ ID NO: 325662 - RNA, 64 nt, hsa
aagagaaagagagagagagagaaagaaaaagaaagaaaaguaagaaagaaaaaagaaaaagaaa

SEQ ID NO: 325663 - RNA, 64 nt, hsa
gaaagaaaaguaagaaagaaaaaagaaaaagaaagaaaaguaagaaagaaaaaaagaaaaagaa

SEQ ID NO: 325664 - RNA, 64 nt, hsa
cacuccauuggaucuuuuacuuuaaaguagugaugaaaaguacauguugauacugucuuagaag

SEQ ID NO: 325665 - RNA, 64 nt, hsa
aaaagcaugguauaauugaaacuuuuuucauuuugaaaaguauugguuacuggugauguugaaa

SEQ ID NO: 325666 - RNA, 64 nt, hsa
aggugagauuuaaaauaaauaggaugagguugaagaaaaguauauuggagcgcagauaaauaua

SEQ ID NO: 325667 - RNA, 64 nt, hsa
gagcuuaccauaguuuuauagcauuguucaauuggaaaaguacauuccaaguucuagauuaccu

SEQ ID NO: 325668 - RNA, 64 nt, hsa; identical to SEQ ID NO: 200808

SEQ ID NO: 325669 - RNA, 64 nt, hsa; identical to SEQ ID NO: 200809

SEQ ID NO: 325670 - RNA, 64 nt, hsa; identical to SEQ ID NO: 200810

SEQ ID NO: 325671 - RNA, 64 nt, hsa; identical to SEQ ID NO: 200811

SEQ ID NO: 325672 - RNA, 64 nt, hsa; identical to SEQ ID NO: 200812

SEQ ID NO: 325673 - RNA, 64 nt, hsa; identical to SEQ ID NO: 200813

SEQ ID NO: 325674 - RNA, 64 nt, hsa; identical to SEQ ID NO: 200814

SEQ ID NO: 325675 - RNA, 64 nt, hsa; identical to SEQ ID NO: 200815

SEQ ID NO: 325676 - RNA, 64 nt, hsa; identical to SEQ ID NO: 216160

SEQ ID NO: 325677 - RNA, 64 nt, hsa; identical to SEQ ID NO: 216161

SEQ ID NO: 325678 - RNA, 64 nt, hsa; identical to SEQ ID NO: 216162

SEQ ID NO: 325679 - RNA, 64 nt, hsa; identical to SEQ ID NO: 216163

SEQ ID NO: 325680 - RNA, 64 nt, hsa; identical to SEQ ID NO: 216164

SEQ ID NO: 325681 - RNA, 64 nt, hsa; identical to SEQ ID NO: 216165

SEQ ID NO: 325682 - RNA, 64 nt, hsa; identical to SEQ ID NO: 216166

SEQ ID NO: 325683 - RNA, 64 nt, hsa; identical to SEQ ID NO: 216167

SEQ ID NO: 325684 - RNA, 64 nt, hsa; identical to SEQ ID NO: 216168

SEQ ID NO: 325685 - RNA, 64 nt, hsa; identical to SEQ ID NO: 216169

SEQ ID NO: 325686 - RNA, 64 nt, hsa; identical to SEQ ID NO: 216170

SEQ ID NO: 325687 - RNA, 64 nt, hsa; identical to SEQ ID NO: 216171

SEQ ID NO: 325688 - RNA, 64 nt, hsa; identical to SEQ ID NO: 216172

SEQ ID NO: 325689 - RNA, 64 nt, hsa; identical to SEQ ID NO: 216173

SEQ ID NO: 325690 - RNA, 64 nt, hsa; identical to SEQ ID NO: 216174

SEQ ID NO: 325691 - RNA, 64 nt, hsa; identical to SEQ ID NO: 216175

SEQ ID NO: 325692 - RNA, 64 nt, hsa; identical to SEQ ID NO: 216176

SEQ ID NO: 325693 - RNA, 64 nt, hsa; identical to SEQ ID NO: 216177

SEQ ID NO: 325694 - RNA, 64 nt, hsa; identical to SEQ ID NO: 216178

SEQ ID NO: 325695 - RNA, 64 nt, hsa; identical to SEQ ID NO: 216179

SEQ ID NO: 325696 - RNA, 64 nt, hsa; identical to SEQ ID NO: 70884

SEQ ID NO: 325697 - RNA, 64 nt, hsa; identical to SEQ ID NO: 70885

SEQ ID NO: 325698 - RNA, 64 nt, hsa; identical to SEQ ID NO: 70886

SEQ ID NO: 325699 - RNA, 64 nt, hsa; identical to SEQ ID NO: 70887

SEQ ID NO: 325700 - RNA, 64 nt, hsa; identical to SEQ ID NO: 70888

SEQ ID NO: 325701 - RNA, 64 nt, hsa; identical to SEQ ID NO: 70889

SEQ ID NO: 325702 - RNA, 64 nt, hsa
agagaaucuuuugaaauuguugugaucauauuuugcuuucuauggcuucuccuuaacuuauuga

SEQ ID NO: 325703 - RNA, 64 nt, hsa
acaucauuaucaauuuccacaugaaaaagguggagcuuucuagaaaaaccaaccucuaaggcau

SEQ ID NO: 325704 - RNA, 64 nt, hsa
uuucuugcagagaacaagucugcccagauuccaugcuuucuauaacuggaggaccuggcaaacc

SEQ ID NO: 325705 - RNA, 64 nt, hsa
ucuaagcaaaagauuugaguaugauaugauaaaggcuuucuacauucuaauuuacuuuuucccc

SEQ ID NO: 325706 - RNA, 64 nt, hsa
uacauaaguauuuguuacaaauauuuuagcaaaugcuuucuauuucucuugcuugugcauaucu

SEQ ID NO: 325707 - RNA, 64 nt, hsa
uacauauguaaauauuuauauauagauauauguagcuuucuauauauguaguagguuggcuuua

SEQ ID NO: 325708 - RNA, 64 nt, hsa
uuuugucugauuuuacaaaucagauuuuauucaagcuuucuaaauaucugugaaguagacccua

SEQ ID NO: 325709 - RNA, 64 nt, hsa
uaucucuaagaugucuauuauaugcucugucugugcuuucuagguuaccucaaauguuuuguuu

SEQ ID NO: 325710 - RNA, 64 nt, hsa
ucaaaccuguaacuuguauccugacuuaucucuugcuuucuaaaccuuguuucuaacugucuau

SEQ ID NO: 325711 - RNA, 64 nt, hsa
auuuuagcaaguuuucuuaugaaaauaccuuugugcuuucuaaguauaaagauuuaaauuauuu

SEQ ID NO: 325712 - RNA, 64 nt, hsa
acacuaacuauggaaaaugagcagcauuuuaaaugcuuucuagugaaaaauuauaaucuacuua

SEQ ID NO: 325713 - RNA, 64 nt, hsa
cagcugucacaagagucuagaucaguuagcacaugcuuucuacucuucgauuauuaguauuauu

SEQ ID NO: 325714 - RNA, 64 nt, hsa
aaaguacagaacauauccucuacgguuauuuccugcuuucuaauuaaaaaaauaauaaccaugg

SEQ ID NO: 325715 - RNA, 64 nt, hsa
uuauauucuaaauuuuuacuuaacuuaauucaaugcuuucuacucauuuuucuauacuuuuuuu

SEQ ID NO: 325716 - RNA, 64 nt, hsa
aagucucugggcuauuuuuuauuuuugcaaaugugcuuucuaauagccauugccuuccauguug

SEQ ID NO: 325717 - RNA, 64 nt, hsa
uaaaauccauucuuuaucaaucaguccuuuuauagcuuucuaaguucuuauugauggcuaauau

SEQ ID NO: 325718 - RNA, 64 nt, hsa; identical to SEQ ID NO: 117710

SEQ ID NO: 325719 - RNA, 64 nt, hsa; identical to SEQ ID NO: 117711

SEQ ID NO: 325720 - RNA, 64 nt, hsa; identical to SEQ ID NO: 117712

SEQ ID NO: 325721 - RNA, 64 nt, hsa; identical to SEQ ID NO: 117713

SEQ ID NO: 325722 - RNA, 64 nt, hsa; identical to SEQ ID NO: 117714

SEQ ID NO: 325723 - RNA, 64 nt, hsa; identical to SEQ ID NO: 117715

SEQ ID NO: 325724 - RNA, 64 nt, hsa; identical to SEQ ID NO: 117716

SEQ ID NO: 325725 - RNA, 64 nt, hsa; identical to SEQ ID NO: 117717

SEQ ID NO: 325726 - RNA, 64 nt, hsa; identical to SEQ ID NO: 117718

SEQ ID NO: 325727 - RNA, 64 nt, hsa; identical to SEQ ID NO: 117719

SEQ ID NO: 325728 - RNA, 64 nt, hsa; identical to SEQ ID NO: 117720

SEQ ID NO: 325729 - RNA, 64 nt, hsa; identical to SEQ ID NO: 117721

SEQ ID NO: 325730 - RNA, 64 nt, hsa; identical to SEQ ID NO: 117722

SEQ ID NO: 325731 - RNA, 64 nt, hsa; identical to SEQ ID NO: 117723

SEQ ID NO: 325732 - RNA, 64 nt, hsa; identical to SEQ ID NO: 117724

SEQ ID NO: 325733 - RNA, 64 nt, hsa; identical to SEQ ID NO: 117725

SEQ ID NO: 325734 - RNA, 64 nt, hsa; identical to SEQ ID NO: 117726

SEQ ID NO: 325735 - RNA, 64 nt, hsa; identical to SEQ ID NO: 117727

SEQ ID NO: 325736 - RNA, 64 nt, hsa; identical to SEQ ID NO: 117728

SEQ ID NO: 325737 - RNA, 64 nt, hsa; identical to SEQ ID NO: 117729

SEQ ID NO: 325738 - RNA, 64 nt, hsa; identical to SEQ ID NO: 117730

SEQ ID NO: 325739 - RNA, 64 nt, hsa; identical to SEQ ID NO: 117731

SEQ ID NO: 325740 - RNA, 64 nt, hsa; identical to SEQ ID NO: 117732

SEQ ID NO: 325741 - RNA, 64 nt, hsa; identical to SEQ ID NO: 117733

SEQ ID NO: 325742 - RNA, 64 nt, hsa; identical to SEQ ID NO: 117734

SEQ ID NO: 325743 - RNA, 64 nt, hsa; identical to SEQ ID NO: 117735

SEQ ID NO: 325744 - RNA, 64 nt, hsa; identical to SEQ ID NO: 117736

SEQ ID NO: 325745 - RNA, 64 nt, hsa; identical to SEQ ID NO: 117737

SEQ ID NO: 325746 - RNA, 64 nt, hsa; identical to SEQ ID NO: 117738

SEQ ID NO: 325747 - RNA, 64 nt, hsa; identical to SEQ ID NO: 117739

SEQ ID NO: 325748 - RNA, 64 nt, hsa; identical to SEQ ID NO: 117740

SEQ ID NO: 325749 - RNA, 64 nt, hsa; identical to SEQ ID NO: 117741

SEQ ID NO: 325750 - RNA, 64 nt, hsa; identical to SEQ ID NO: 117742

SEQ ID NO: 325751 - RNA, 64 nt, hsa; identical to SEQ ID NO: 117743

SEQ ID NO: 325752 - RNA, 64 nt, hsa; identical to SEQ ID NO: 117744

SEQ ID NO: 325753 - RNA, 64 nt, hsa; identical to SEQ ID NO: 117745

SEQ ID NO: 325754 - RNA, 64 nt, hsa; identical to SEQ ID NO: 117746

SEQ ID NO: 325755 - RNA, 64 nt, hsa; identical to SEQ ID NO: 117747

SEQ ID NO: 325756 - RNA, 64 nt, hsa; identical to SEQ ID NO: 117748

SEQ ID NO: 325757 - RNA, 64 nt, hsa; identical to SEQ ID NO: 117749

SEQ ID NO: 325758 - RNA, 64 nt, hsa; identical to SEQ ID NO: 117750

SEQ ID NO: 325759 - RNA, 64 nt, hsa; identical to SEQ ID NO: 117751

SEQ ID NO: 325760 - RNA, 64 nt, hsa; identical to SEQ ID NO: 117752

SEQ ID NO: 325761 - RNA, 64 nt, hsa; identical to SEQ ID NO: 117753

SEQ ID NO: 325762 - RNA, 64 nt, hsa; identical to SEQ ID NO: 117754

SEQ ID NO: 325763 - RNA, 64 nt, hsa; identical to SEQ ID NO: 117755

SEQ ID NO: 325764 - RNA, 64 nt, hsa; identical to SEQ ID NO: 117756

SEQ ID NO: 325765 - RNA, 64 nt, hsa; identical to SEQ ID NO: 117757

SEQ ID NO: 325766 - RNA, 64 nt, hsa; identical to SEQ ID NO: 117758

SEQ ID NO: 325767 - RNA, 64 nt, hsa; identical to SEQ ID NO: 117759

SEQ ID NO: 325768 - RNA, 64 nt, hsa; identical to SEQ ID NO: 117760

SEQ ID NO: 325769 - RNA, 64 nt, hsa; identical to SEQ ID NO: 117761

SEQ ID NO: 325770 - RNA, 64 nt, hsa; identical to SEQ ID NO: 117762

SEQ ID NO: 325771 - RNA, 64 nt, hsa; identical to SEQ ID NO: 117763

SEQ ID NO: 325772 - RNA, 64 nt, hsa; identical to SEQ ID NO: 117764

SEQ ID NO: 325773 - RNA, 64 nt, hsa; identical to SEQ ID NO: 117765

SEQ ID NO: 325774 - RNA, 64 nt, hsa; identical to SEQ ID NO: 117766

SEQ ID NO: 325775 - RNA, 64 nt, hsa; identical to SEQ ID NO: 117767

SEQ ID NO: 325776 - RNA, 64 nt, hsa; identical to SEQ ID NO: 117768

SEQ ID NO: 325777 - RNA, 64 nt, hsa; identical to SEQ ID NO: 117769

SEQ ID NO: 325778 - RNA, 64 nt, hsa; identical to SEQ ID NO: 117770

SEQ ID NO: 325779 - RNA, 64 nt, hsa; identical to SEQ ID NO: 117771

SEQ ID NO: 325780 - RNA, 64 nt, hsa; identical to SEQ ID NO: 117772

SEQ ID NO: 325781 - RNA, 64 nt, hsa; identical to SEQ ID NO: 117773

SEQ ID NO: 325782 - RNA, 64 nt, hsa; identical to SEQ ID NO: 117774

SEQ ID NO: 325783 - RNA, 64 nt, hsa; identical to SEQ ID NO: 117775

SEQ ID NO: 325784 - RNA, 64 nt, hsa; identical to SEQ ID NO: 117776

SEQ ID NO: 325785 - RNA, 64 nt, hsa; identical to SEQ ID NO: 117777

SEQ ID NO: 325786 - RNA, 64 nt, hsa; identical to SEQ ID NO: 117778

SEQ ID NO: 325787 - RNA, 64 nt, hsa; identical to SEQ ID NO: 117779

SEQ ID NO: 325788 - RNA, 64 nt, hsa; identical to SEQ ID NO: 117780

SEQ ID NO: 325789 - RNA, 64 nt, hsa; identical to SEQ ID NO: 117781

SEQ ID NO: 325790 - RNA, 64 nt, hsa; identical to SEQ ID NO: 117782

SEQ ID NO: 325791 - RNA, 64 nt, hsa; identical to SEQ ID NO: 117783

SEQ ID NO: 325792 - RNA, 64 nt, hsa; identical to SEQ ID NO: 117784

SEQ ID NO: 325793 - RNA, 64 nt, hsa; identical to SEQ ID NO: 117785

SEQ ID NO: 325794 - RNA, 64 nt, hsa; identical to SEQ ID NO: 117786

SEQ ID NO: 325795 - RNA, 59 nt, hsa; identical to SEQ ID NO: 58889

SEQ ID NO: 325796 - RNA, 64 nt, hsa; identical to SEQ ID NO: 117788

SEQ ID NO: 325797 - RNA, 64 nt, hsa; identical to SEQ ID NO: 117789

SEQ ID NO: 325798 - RNA, 64 nt, hsa; identical to SEQ ID NO: 117790

SEQ ID NO: 325799 - RNA, 64 nt, hsa; identical to SEQ ID NO: 117791

SEQ ID NO: 325800 - RNA, 64 nt, hsa; identical to SEQ ID NO: 117792

SEQ ID NO: 325801 - RNA, 64 nt, hsa; identical to SEQ ID NO: 117793

SEQ ID NO: 325802 - RNA, 64 nt, hsa; identical to SEQ ID NO: 117794

SEQ ID NO: 325803 - RNA, 64 nt, hsa; identical to SEQ ID NO: 117795

SEQ ID NO: 325804 - RNA, 64 nt, hsa; identical to SEQ ID NO: 117796

SEQ ID NO: 325805 - RNA, 64 nt, hsa; identical to SEQ ID NO: 117797

SEQ ID NO: 325806 - RNA, 64 nt, hsa; identical to SEQ ID NO: 117798

SEQ ID NO: 325807 - RNA, 64 nt, hsa; identical to SEQ ID NO: 117799

SEQ ID NO: 325808 - RNA, 64 nt, hsa; identical to SEQ ID NO: 117800

SEQ ID NO: 325809 - RNA, 64 nt, hsa; identical to SEQ ID NO: 117801

SEQ ID NO: 325810 - RNA, 64 nt, hsa; identical to SEQ ID NO: 117802

SEQ ID NO: 325811 - RNA, 64 nt, hsa; identical to SEQ ID NO: 117803

SEQ ID NO: 325812 - RNA, 64 nt, hsa; identical to SEQ ID NO: 117804

SEQ ID NO: 325813 - RNA, 64 nt, hsa; identical to SEQ ID NO: 117805

SEQ ID NO: 325814 - RNA, 64 nt, hsa; identical to SEQ ID NO: 117806

SEQ ID NO: 325815 - RNA, 64 nt, hsa; identical to SEQ ID NO: 117807

SEQ ID NO: 325816 - RNA, 64 nt, hsa; identical to SEQ ID NO: 117808

SEQ ID NO: 325817 - RNA, 64 nt, hsa; identical to SEQ ID NO: 117809

SEQ ID NO: 325818 - RNA, 64 nt, hsa; identical to SEQ ID NO: 117810

SEQ ID NO: 325819 - RNA, 64 nt, hsa; identical to SEQ ID NO: 117811

SEQ ID NO: 325820 - RNA, 64 nt, hsa; identical to SEQ ID NO: 117812

SEQ ID NO: 325821 - RNA, 64 nt, hsa; identical to SEQ ID NO: 117813

SEQ ID NO: 325822 - RNA, 64 nt, hsa; identical to SEQ ID NO: 117814

SEQ ID NO: 325823 - RNA, 64 nt, hsa; identical to SEQ ID NO: 117815

SEQ ID NO: 325824 - RNA, 64 nt, hsa; identical to SEQ ID NO: 117816

SEQ ID NO: 325825 - RNA, 64 nt, hsa; identical to SEQ ID NO: 117817

SEQ ID NO: 325826 - RNA, 64 nt, hsa; identical to SEQ ID NO: 117818

SEQ ID NO: 325827 - RNA, 64 nt, hsa; identical to SEQ ID NO: 117819

SEQ ID NO: 325828 - RNA, 64 nt, hsa; identical to SEQ ID NO: 117820

SEQ ID NO: 325829 - RNA, 64 nt, hsa; identical to SEQ ID NO: 117821

SEQ ID NO: 325830 - RNA, 64 nt, hsa; identical to SEQ ID NO: 117822

SEQ ID NO: 325831 - RNA, 64 nt, hsa; identical to SEQ ID NO: 117823

SEQ ID NO: 325832 - RNA, 64 nt, hsa
gaaaaagugaggccaacacacagggcaaguggugucgauggagucgaagcgcugaaggaauagg

SEQ ID NO: 325833 - RNA, 64 nt, hsa
ccugagacuggguaauuuauaaagaaaaauagguucgauggacucacagguccgcguggcuggg

SEQ ID NO: 325834 - RNA, 64 nt, hsa
acugcuucauugaauagauuuguucauugaccuaucgauggacaccuggguuguuuccaguuug

SEQ ID NO: 325835 - RNA, 64 nt, hsa
guuggguugauuccccaaaaccuugacagauguaucgauggaauaaaaguauguuuuaaagguu

SEQ ID NO: 325836 - RNA, 64 nt, hsa
accacuugcaacccacauguuuguagguguauggucgauggaaguuucuggcauccauguuggu

SEQ ID NO: 325837 - RNA, 64 nt, hsa
aagaaaaaagccugguuuuguuuuucccagaauaucgauggacuuaaaaaggcucagguuuuug

SEQ ID NO: 325838 - RNA, 64 nt, hsa
aauaaaaagcccuccucagauuggaacccccaaaucgauggagccacauuaauaauacuuuuca

SEQ ID NO: 325839 - RNA, 64 nt, hsa
ugacagccaugcuuuccuauacuuguucaaaggaucgauggaccguaaauaagcugccauuaac

SEQ ID NO: 325840 - RNA, 64 nt, hsa
aacaaacagacuugacuguugcucaaucuaaucuucgauggaaauucuaaaaauuaauacagag

SEQ ID NO: 325841 - RNA, 64 nt, hsa
uugcauacaaggcuuuguaacgaucaagugcuaaucgauggaaauguuaagguagauuaacaua

SEQ ID NO: 325842 - RNA, 64 nt, hsa
aguuuaggccacauaaaauugcuguuuaauguagucgauggaagacuuuaaacuaugcuucuag

SEQ ID NO: 325843 - RNA, 64 nt, hsa
uuccuuguuucuguauagauguaagcacauaaauucgauggaauagaauuacguuaacaauguu

SEQ ID NO: 325844 - RNA, 64 nt, hsa
caagguggggauggaagcacagucgggacagaauucgauggauuccuuuaguuggaguccgcgu

SEQ ID NO: 325845 - RNA, 64 nt, hsa
ccaugugugugccaagcccuggcccccacagcgcucgauggaccucagcaagcugcccagcccu

SEQ ID NO: 325846 - RNA, 64 nt, hsa
gcaagaaugaacugcuguuggguuugauugacugucgauggauuguggugugguguaucugaag

SEQ ID NO: 325847 - RNA, 64 nt, hsa
ggcagccagagcccuuggacuggcacagggacccucgauggagcgaagcccucaaacgggaugc

SEQ ID NO: 325848 - RNA, 64 nt, hsa
ugucuccagugggggcagcagcugucccccagccucgauggagacacuggggcagucugccuug

SEQ ID NO: 325849 - RNA, 64 nt, hsa
aagccugagaggcgccggcucucuugcuccuccaucgauggacacugcauugcuucucaucgga

SEQ ID NO: 325850 - RNA, 64 nt, hsa
aucuuaauuauuuucaauaggcuuguaaaucuuaucgauggaaggagaaaggagacaagaugug

SEQ ID NO: 325851 - RNA, 64 nt, hsa
ucuuuuuagcauucucaucagaaagucacaaaaaucgauggaaucauuuccacugggaagauug

SEQ ID NO: 325852 - RNA, 64 nt, hsa
ucccuguguuccagcguggagggacaaucgugccucgauggaugcgagugcggcggucuucaga

SEQ ID NO: 325853 - RNA, 64 nt, hsa
cuaccuaagugugugucgccacccgauggaagauucgauggacauggacaugagcccccugagg

SEQ ID NO: 325854 - RNA, 64 nt, hsa
cccuuugcugaccucugccaggacccacacagcuucgauggaucucaguguuuguuaacaaaau

SEQ ID NO: 325855 - RNA, 64 nt, hsa
cuaacaguuauuuccccggguccagcuuaaagacucgauggaaggagguagaaccucugcuguu

SEQ ID NO: 325856 - RNA, 64 nt, hsa
uaauggucacccuaaaaacacccacauaugcuuuucgauggaaccagguaaguugacgcuaaag

SEQ ID NO: 325857 - RNA, 64 nt, hsa
ucagauuauucugaguauuguuaacagugccuuuucgauggaaucacacuuuuuggcugucacc

SEQ ID NO: 325858 - RNA, 64 nt, hsa
uuuaaacaggguggauuccacucugugggagccuucgauggaacucaagguggagcucagccuu

SEQ ID NO: 325859 - RNA, 64 nt, hsa
ugcucauaauauauuccaauuuuuauuggaauuuucgauggaauguuauuucaauaaagccaug

SEQ ID NO: 325860 - RNA, 64 nt, hsa
gccuugggaccauggccaccccagagccauccgaucgauggaugggaugcacucucagaccaag

SEQ ID NO: 325861 - RNA, 64 nt, hsa
aagcccagcuccagggccagaugagcagaagcucucgauggacaaugaacggccuugcuggggg

SEQ ID NO: 325862 - RNA, 64 nt, hsa
gcagaccaggcugagauggaggaaccugcuaaaaucgauggagaugcuucuagccucccaguag

SEQ ID NO: 325863 - RNA, 64 nt, hsa
ucgugaagucacgucacacaggggagaggcgaggucgauggaacuggccacgcacaggcucugg

SEQ ID NO: 325864 - RNA, 64 nt, hsa
ccguggagcaacuuccugcuccacgggaaagaggucgauggauuuaccccuggacccauaaguc

SEQ ID NO: 325865 - RNA, 64 nt, hsa
gcagugcccagagcccacgcccccccaagagcccucgauggacagccucacccaccccaccugg

SEQ ID NO: 325866 - RNA, 64 nt, hsa
gugaccugaaucuuucccuuaaccguacaguuucucgauggaauugugugaucagaagguggaa

SEQ ID NO: 325867 - RNA, 64 nt, hsa
augccgcugggugcccggaggcggccauggugucucgauggacggcagccaggauggagcaccc

SEQ ID NO: 325868 - RNA, 64 nt, hsa
auuuuauuaaauuuuuuccuuuuuucuauucauuucgauggacgcaaucuuaagccacccuggc

SEQ ID NO: 325869 - RNA, 64 nt, hsa
guuuuuuaguuuuuccuuaaaaaaaaacaacacaucgauggacuuugcuucccuguucuugaag

SEQ ID NO: 325870 - RNA, 64 nt, hsa
aggagcagggguuggagaaaggcaucccaaagcuucgauggagagcagggaagggggacccaag

SEQ ID NO: 325871 - RNA, 64 nt, hsa
gguaggaggaugcauggaugaguggaugaguggaucgauggauguauugauaaauagauagaac

SEQ ID NO: 325872 - RNA, 64 nt, hsa
cccuuguuugagugucuuaucccugagcaaucuuucgauggauggagaugaucauuagguacuu

SEQ ID NO: 325873 - RNA, 64 nt, hsa
ugugcccuguugaaacuuagguuuuuccacgcaaucgauggauuguguccuaggaagacuuuuc

SEQ ID NO: 325874 - RNA, 64 nt, hsa
uuuccaccagcugccagucaagggcagugggaucucgauggagccuccccccccccccacccau

SEQ ID NO: 325875 - RNA, 64 nt, hsa
ccucccaccgccuugccucacuggcaaucuggacucgauggagaacauccccccaccuccauuu

SEQ ID NO: 325876 - RNA, 64 nt, hsa
gagaagcaaaucugagaguaaaacccuuaccccuuauucuuaagaauagugcuuguuuauucag

SEQ ID NO: 325877 - RNA, 64 nt, hsa
uauuuauuguacaagagcccaagucccugaauuauauucuuaauaagugcuuucuugcauucau

SEQ ID NO: 325878 - RNA, 64 nt, hsa
aaguccacaagaaugaucaaguaagauuuguuuuuauucuuacagacaucacccguguucaagu

SEQ ID NO: 325879 - RNA, 64 nt, hsa
aaauauuucauuaaaaaugaugcacacauagauauauucuuacaaauuuugcuguauugcuguu

SEQ ID NO: 325880 - RNA, 64 nt, hsa
gcaguucccucucguaaugauguaacuuuacaacuauucuuaaugcuugaacauguauuuaggg

SEQ ID NO: 325881 - RNA, 64 nt, hsa
ggcaguuguuucuuugaauaugccuaaauaacaguauucuuaaaaucugacagacaaguaacau

SEQ ID NO: 325882 - RNA, 64 nt, hsa
aagacaaaaaauauugauagucacuagaguaauguauucuuaaccuuuguaagaacugaucuca

SEQ ID NO: 325883 - RNA, 64 nt, hsa
auucuuaaccuuuguaagaacugaucucagcauguauucuuaaaccuuuguaauuaccuauggu

SEQ ID NO: 325884 - RNA, 64 nt, hsa
guaacaguuuguuaucaaaaugccugauaaaauauauucuuaauaaaagucuucauuucauaau

SEQ ID NO: 325885 - RNA, 64 nt, hsa
uuugucucaaauauaccuugauggaggacuuuuuuauucuuauggaaauagugaauuccaacaa

SEQ ID NO: 325886 - RNA, 64 nt, hsa
ccaaaauguuguuaugcaggcaugacuguaguuguauucuuaagauuuuucaguucuuguguuu

SEQ ID NO: 325887 - RNA, 64 nt, hsa
uuuuuuuauauaaauuagagcgucaauucccuuuuauucuuacauucucuugccaaaauggauc

SEQ ID NO: 325888 - RNA, 64 nt, hsa
uccauuuggcagauagauggucucuagccuauuguauucuuagaccaaaaaucauaaccugcug

SEQ ID NO: 325889 - RNA, 64 nt, hsa
auaaugacuauguaaucucaaaaaacaaauaaaauauucuuaacauggacucuuaaggguauuu

SEQ ID NO: 325890 - RNA, 64 nt, hsa
uuauucuuacauuuuaucauauuuauacuauuuauauucuuauauaacaaauguuugccuuuac

SEQ ID NO: 325891 - RNA, 64 nt, hsa
ucccuaagauguuauuuauuuuuacucauuuauuuauucuuacauuuuaucauauuuauacuau

SEQ ID NO: 325892 - RNA, 64 nt, hsa
gaaauguuugucauaugcgugaugucuucugaaauauucuuauaaccuuaaugaccaauugcuu

SEQ ID NO: 325893 - RNA, 64 nt, hsa
gcuuuuagaauauuaauaggagacucaaaguuaauauucuuaacaacuuaaaauuaaaaaaagu

SEQ ID NO: 325894 - RNA, 64 nt, hsa
cucugucuuaaaagagaccaucaaaccuauuaaguauucuuauuguuuaucuuuuuuuaauugc

SEQ ID NO: 325895 - RNA, 64 nt, hsa
aauauaguuucguagaaaaacauuuuauauguacuauucuuaaagaucacaauuauuuuuaaac

SEQ ID NO: 325896 - RNA, 64 nt, hsa
aaguagagaguaacucauauucuaucaauucaaguauucuuacuaugguugcuuucccuauuug

SEQ ID NO: 325897 - RNA, 64 nt, hsa
agagacucuaaaaacuaaccaaacuuggugaguguauucuuauauuaagaauaucuuagucauc

SEQ ID NO: 325898 - RNA, 64 nt, hsa
ucguuuacuugcauaauauaucaucaauuugacauauucuuaaaacuagagggugugagaagca

SEQ ID NO: 325899 - RNA, 64 nt, hsa
ucuuuauaaaaauggcacauuuuacaaaguaguuuauucuuauuauacuuucugcuggagagug

SEQ ID NO: 325900 - RNA, 64 nt, hsa
gagcuuugcuccaggacaggaugacugucuucccuauucuuagggacaagucccaagaugccag

SEQ ID NO: 325901 - RNA, 64 nt, hsa
cagcagguuggggugguuaagucuuauuagugucuauucuuaaaauuaagugggcuggagaaga

SEQ ID NO: 325902 - RNA, 64 nt, hsa
ugaaaguaaaauauacuaugucuugguuuugaggauauuggauacaaaacucucuuccuuuagg

SEQ ID NO: 325903 - RNA, 64 nt, hsa
auggaugagcacuucagaacaggucauuuuccugauauuggaagugacauguggcccuauagga

SEQ ID NO: 325904 - RNA, 64 nt, hsa
uucuaccuguauaugguaauguccaguuuuaaaaauauuggacaucuucaaucuuaaacauuuc

SEQ ID NO: 325905 - RNA, 64 nt, hsa
uuuagaaguucccccaauuacaaacugguuuuaaauauuggacauacugguuuuaauaccugcu

SEQ ID NO: 325906 - RNA, 64 nt, hsa
ugggaaaaguggaaacaaacauguauugaaauacauauuggaaauaaaaaugguuugagcguca

SEQ ID NO: 325907 - RNA, 64 nt, hsa
uugcuugcaacauuuaagacucaaagucacugguauauuggauuaaguuuuuuccuguuaaugc

SEQ ID NO: 325908 - RNA, 64 nt, hsa
guuugugaggaccuuugacucagugacaaucaucauauuggagcaaaacauagaacaaaaucac

SEQ ID NO: 325909 - RNA, 64 nt, hsa
uaauuacagauuuaauauaaaaugaacugauuauauauuggaauuguugcacuuucagccugug

SEQ ID NO: 325910 - RNA, 64 nt, hsa
uagagauaagaaaguauaugaaaauauacuggaaauauuggauucuuggagaaaacuguucagu

SEQ ID NO: 325911 - RNA, 64 nt, hsa
ucuacaugugugccccuaaagacacauuuacucaauauuggagaaguagauaaugaauuaagca

SEQ ID NO: 325912 - RNA, 64 nt, hsa
acugugagacuuuauuguccucuaggauggauguauauuggagaagggugguuagcacauucau

SEQ ID NO: 325913 - RNA, 64 nt, hsa
cuauuauuccagcagucugaaaccuaaauauguuauauuggaaaucaugacugugagacuuuau

SEQ ID NO: 325914 - RNA, 64 nt, hsa
ugauucucauaccuuacuaaauauaagauaauucauauuggagagaaauucuacagaugugaag

SEQ ID NO: 325915 - RNA, 64 nt, hsa
aaaugguugucacacuugauuauagguaauauucauauuggaaaaauuuccuacaaguaagaac

SEQ ID NO: 325916 - RNA, 64 nt, hsa
ggucacucaaacuuuguucaacaucagggaauuuauauuggagagcugucuugcaaauguaaua

SEQ ID NO: 325917 - RNA, 64 nt, hsa
cuucucccuggaugcaaaaccuaugaguauauuaauauuggaaaauuuuucagugauucuucuc

SEQ ID NO: 325918 - RNA, 64 nt, hsa
aauucuggagagaaugccccauugaacaucaucaauauuggagagcuuucuguuuuucuacauu

SEQ ID NO: 325919 - RNA, 64 nt, hsa
acaauuagacugacagcugacuuuuuuaggagcaauauuggaaggcuaaaugcaauagaaagau

SEQ ID NO: 325920 - RNA, 64 nt, hsa
guccuaaucuucucuucuuauaaagacacuagucauauuggauuagggccuccccaugaccuaa

SEQ ID NO: 325921 - RNA, 64 nt, hsa
ggaaaauguuuacccaaaggucugcucuccuuggauauuggagaguucacacuagagaagaguc

SEQ ID NO: 325922 - RNA, 64 nt, hsa
gggcuuaugagugcagugaguccagucucauuaaauauuggagaauacacaccugaguaagauc

SEQ ID NO: 325923 - RNA, 64 nt, hsa
auuagccaguugaggaaguagaaggaauuuccagauauuggaaacaguaugcaugaagacauga

SEQ ID NO: 325924 - RNA, 64 nt, hsa
ugugcaugugaguauguuugcaaaauaauaaaggauauuggagaccuguuuuagaaggagccua

SEQ ID NO: 325925 - RNA, 64 nt, hsa
cucaccuuguucauuucacauagugguuuauuagauauuggaaccuaaagaauucuguccacuu

SEQ ID NO: 325926 - RNA, 64 nt, hsa
gaggaggcuuacaaacagcaaaucaaagaagauaauauuggaaaucagcugcugagaaagaugg

SEQ ID NO: 325927 - RNA, 64 nt, hsa; identical to SEQ ID NO: 60878

SEQ ID NO: 325928 - RNA, 64 nt, hsa; identical to SEQ ID NO: 60879

SEQ ID NO: 325929 - RNA, 64 nt, hsa; identical to SEQ ID NO: 60880

SEQ ID NO: 325930 - RNA, 64 nt, hsa; identical to SEQ ID NO: 60881

SEQ ID NO: 325931 - RNA, 64 nt, hsa; identical to SEQ ID NO: 60882

SEQ ID NO: 325932 - RNA, 64 nt, hsa; identical to SEQ ID NO: 60883

SEQ ID NO: 325933 - RNA, 64 nt, hsa; identical to SEQ ID NO: 60884

SEQ ID NO: 325934 - RNA, 64 nt, hsa; identical to SEQ ID NO: 60885

SEQ ID NO: 325935 - RNA, 64 nt, hsa; identical to SEQ ID NO: 60886

SEQ ID NO: 325936 - RNA, 64 nt, hsa; identical to SEQ ID NO: 60887

SEQ ID NO: 325937 - RNA, 64 nt, hsa; identical to SEQ ID NO: 60888

SEQ ID NO: 325938 - RNA, 64 nt, hsa; identical to SEQ ID NO: 60889

SEQ ID NO: 325939 - RNA, 64 nt, hsa; identical to SEQ ID NO: 60890

SEQ ID NO: 325940 - RNA, 64 nt, hsa; identical to SEQ ID NO: 60891

SEQ ID NO: 325941 - RNA, 64 nt, hsa; identical to SEQ ID NO: 60892

SEQ ID NO: 325942 - RNA, 64 nt, hsa; identical to SEQ ID NO: 60893

SEQ ID NO: 325943 - RNA, 64 nt, hsa; identical to SEQ ID NO: 60894

SEQ ID NO: 325944 - RNA, 64 nt, hsa; identical to SEQ ID NO: 60895

SEQ ID NO: 325945 - RNA, 64 nt, hsa; identical to SEQ ID NO: 60896

SEQ ID NO: 325946 - RNA, 64 nt, hsa; identical to SEQ ID NO: 60897

SEQ ID NO: 325947 - RNA, 64 nt, hsa; identical to SEQ ID NO: 60898

SEQ ID NO: 325948 - RNA, 64 nt, hsa; identical to SEQ ID NO: 60899

SEQ ID NO: 325949 - RNA, 64 nt, hsa; identical to SEQ ID NO: 60900

SEQ ID NO: 325950 - RNA, 64 nt, hsa; identical to SEQ ID NO: 60901

SEQ ID NO: 325951 - RNA, 64 nt, hsa; identical to SEQ ID NO: 60902

SEQ ID NO: 325952 - RNA, 64 nt, hsa; identical to SEQ ID NO: 60903

SEQ ID NO: 325953 - RNA, 64 nt, hsa; identical to SEQ ID NO: 60904

SEQ ID NO: 325954 - RNA, 64 nt, hsa; identical to SEQ ID NO: 60905

SEQ ID NO: 325955 - RNA, 64 nt, hsa; identical to SEQ ID NO: 60906

SEQ ID NO: 325956 - RNA, 64 nt, hsa; identical to SEQ ID NO: 60907

SEQ ID NO: 325957 - RNA, 64 nt, hsa; identical to SEQ ID NO: 60908

SEQ ID NO: 325958 - RNA, 64 nt, hsa; identical to SEQ ID NO: 60909

SEQ ID NO: 325959 - RNA, 64 nt, hsa; identical to SEQ ID NO: 60910

SEQ ID NO: 325960 - RNA, 64 nt, hsa; identical to SEQ ID NO: 60911

SEQ ID NO: 325961 - RNA, 64 nt, hsa; identical to SEQ ID NO: 60912

SEQ ID NO: 325962 - RNA, 64 nt, hsa; identical to SEQ ID NO: 60913

SEQ ID NO: 325963 - RNA, 64 nt, hsa; identical to SEQ ID NO: 60914

SEQ ID NO: 325964 - RNA, 64 nt, hsa; identical to SEQ ID NO: 60915

SEQ ID NO: 325965 - RNA, 64 nt, hsa; identical to SEQ ID NO: 60916

SEQ ID NO: 325966 - RNA, 64 nt, hsa; identical to SEQ ID NO: 60917

SEQ ID NO: 325967 - RNA, 64 nt, hsa; identical to SEQ ID NO: 60918

SEQ ID NO: 325968 - RNA, 64 nt, hsa; identical to SEQ ID NO: 60919

SEQ ID NO: 325969 - RNA, 64 nt, hsa; identical to SEQ ID NO: 60920

SEQ ID NO: 325970 - RNA, 64 nt, hsa; identical to SEQ ID NO: 60921

SEQ ID NO: 325971 - RNA, 64 nt, hsa; identical to SEQ ID NO: 60922

SEQ ID NO: 325972 - RNA, 64 nt, hsa; identical to SEQ ID NO: 60923

SEQ ID NO: 325973 - RNA, 64 nt, hsa; identical to SEQ ID NO: 60924

SEQ ID NO: 325974 - RNA, 64 nt, hsa; identical to SEQ ID NO: 60925

SEQ ID NO: 325975 - RNA, 64 nt, hsa; identical to SEQ ID NO: 60926

SEQ ID NO: 325976 - RNA, 64 nt, hsa; identical to SEQ ID NO: 60927

SEQ ID NO: 325977 - RNA, 64 nt, hsa; identical to SEQ ID NO: 60928

SEQ ID NO: 325978 - RNA, 64 nt, hsa; identical to SEQ ID NO: 60929

SEQ ID NO: 325979 - RNA, 64 nt, hsa; identical to SEQ ID NO: 60930

SEQ ID NO: 325980 - RNA, 64 nt, hsa; identical to SEQ ID NO: 60931

SEQ ID NO: 325981 - RNA, 64 nt, hsa; identical to SEQ ID NO: 60932

SEQ ID NO: 325982 - RNA, 64 nt, hsa; identical to SEQ ID NO: 60933

SEQ ID NO: 325983 - RNA, 64 nt, hsa
agugggcauaccaguuuccacgggguuggguugccggucagagcuuaagaggacuagcacccug

SEQ ID NO: 325984 - RNA, 64 nt, hsa
uuccaccuugcagugaugcagcuugacccuggaacggucagacaaccuccucaaagugggcaua

SEQ ID NO: 325985 - RNA, 64 nt, hsa
cacucuuccagcucccuggggguugaccaggagccggucagagauggaccuggccagaugucug

SEQ ID NO: 325986 - RNA, 64 nt, hsa
cggggaugucucgcuucuguggcacaggggcacacggucagaggcugaaaaggggcacugcacg

SEQ ID NO: 325987 - RNA, 64 nt, hsa; identical to SEQ ID NO: 58312

SEQ ID NO: 325988 - RNA, 64 nt, hsa; identical to SEQ ID NO: 58313

SEQ ID NO: 325989 - RNA, 64 nt, hsa; identical to SEQ ID NO: 58314

SEQ ID NO: 325990 - RNA, 64 nt, hsa; identical to SEQ ID NO: 58315

SEQ ID NO: 325991 - RNA, 64 nt, hsa; identical to SEQ ID NO: 58316

SEQ ID NO: 325992 - RNA, 64 nt, hsa; identical to SEQ ID NO: 58317

SEQ ID NO: 325993 - RNA, 64 nt, hsa; identical to SEQ ID NO: 58318

SEQ ID NO: 325994 - RNA, 64 nt, hsa; identical to SEQ ID NO: 58319

SEQ ID NO: 325995 - RNA, 64 nt, hsa; identical to SEQ ID NO: 58320

SEQ ID NO: 325996 - RNA, 64 nt, hsa; identical to SEQ ID NO: 58321

SEQ ID NO: 325997 - RNA, 64 nt, hsa; identical to SEQ ID NO: 58322

SEQ ID NO: 325998 - RNA, 64 nt, hsa; identical to SEQ ID NO: 58323

SEQ ID NO: 325999 - RNA, 64 nt, hsa; identical to SEQ ID NO: 58324

SEQ ID NO: 326000 - RNA, 64 nt, hsa; identical to SEQ ID NO: 58325

SEQ ID NO: 326001 - RNA, 64 nt, hsa; identical to SEQ ID NO: 58326

SEQ ID NO: 326002 - RNA, 64 nt, hsa; identical to SEQ ID NO: 58327

SEQ ID NO: 326003 - RNA, 64 nt, hsa; identical to SEQ ID NO: 58328

SEQ ID NO: 326004 - RNA, 64 nt, hsa; identical to SEQ ID NO: 58329

SEQ ID NO: 326005 - RNA, 64 nt, hsa; identical to SEQ ID NO: 58330

SEQ ID NO: 326006 - RNA, 64 nt, hsa; identical to SEQ ID NO: 58331

SEQ ID NO: 326007 - RNA, 64 nt, hsa; identical to SEQ ID NO: 58332

SEQ ID NO: 326008 - RNA, 64 nt, hsa; identical to SEQ ID NO: 58333

SEQ ID NO: 326009 - RNA, 64 nt, hsa; identical to SEQ ID NO: 58334

SEQ ID NO: 326010 - RNA, 64 nt, hsa; identical to SEQ ID NO: 58335

SEQ ID NO: 326011 - RNA, 64 nt, hsa; identical to SEQ ID NO: 58336

SEQ ID NO: 326012 - RNA, 64 nt, hsa; identical to SEQ ID NO: 58337

SEQ ID NO: 326013 - RNA, 64 nt, hsa; identical to SEQ ID NO: 58338

SEQ ID NO: 326014 - RNA, 64 nt, hsa; identical to SEQ ID NO: 58339

SEQ ID NO: 326015 - RNA, 64 nt, hsa; identical to SEQ ID NO: 58340

SEQ ID NO: 326016 - RNA, 64 nt, hsa; identical to SEQ ID NO: 58341

SEQ ID NO: 326017 - RNA, 64 nt, hsa; identical to SEQ ID NO: 58342

SEQ ID NO: 326018 - RNA, 64 nt, hsa; identical to SEQ ID NO: 58343

SEQ ID NO: 326019 - RNA, 64 nt, hsa; identical to SEQ ID NO: 58344

SEQ ID NO: 326020 - RNA, 64 nt, hsa; identical to SEQ ID NO: 58345

SEQ ID NO: 326021 - RNA, 64 nt, hsa; identical to SEQ ID NO: 58346

SEQ ID NO: 326022 - RNA, 64 nt, hsa; identical to SEQ ID NO: 58347

SEQ ID NO: 326023 - RNA, 64 nt, hsa; identical to SEQ ID NO: 58348

SEQ ID NO: 326024 - RNA, 64 nt, hsa; identical to SEQ ID NO: 58349

SEQ ID NO: 326025 - RNA, 64 nt, hsa; identical to SEQ ID NO: 58350

SEQ ID NO: 326026 - RNA, 64 nt, hsa; identical to SEQ ID NO: 58351

SEQ ID NO: 326027 - RNA, 64 nt, hsa; identical to SEQ ID NO: 58352

SEQ ID NO: 326028 - RNA, 64 nt, hsa; identical to SEQ ID NO: 58353

SEQ ID NO: 326029 - RNA, 64 nt, hsa; identical to SEQ ID NO: 58354

SEQ ID NO: 326030 - RNA, 64 nt, hsa; identical to SEQ ID NO: 58355

SEQ ID NO: 326031 - RNA, 64 nt, hsa; identical to SEQ ID NO: 58356

SEQ ID NO: 326032 - RNA, 64 nt, hsa; identical to SEQ ID NO: 58357

SEQ ID NO: 326033 - RNA, 64 nt, hsa; identical to SEQ ID NO: 58358

SEQ ID NO: 326034 - RNA, 64 nt, hsa; identical to SEQ ID NO: 58359

SEQ ID NO: 326035 - RNA, 64 nt, hsa; identical to SEQ ID NO: 58360

SEQ ID NO: 326036 - RNA, 64 nt, hsa; identical to SEQ ID NO: 58361

SEQ ID NO: 326037 - RNA, 64 nt, hsa; identical to SEQ ID NO: 58362

SEQ ID NO: 326038 - RNA, 64 nt, hsa; identical to SEQ ID NO: 58363

SEQ ID NO: 326039 - RNA, 64 nt, hsa; identical to SEQ ID NO: 58364

SEQ ID NO: 326040 - RNA, 64 nt, hsa; identical to SEQ ID NO: 58365

SEQ ID NO: 326041 - RNA, 64 nt, hsa; identical to SEQ ID NO: 58366

SEQ ID NO: 326042 - RNA, 64 nt, hsa; identical to SEQ ID NO: 58367

SEQ ID NO: 326043 - RNA, 64 nt, hsa; identical to SEQ ID NO: 58368

SEQ ID NO: 326044 - RNA, 64 nt, hsa; identical to SEQ ID NO: 58369

SEQ ID NO: 326045 - RNA, 64 nt, hsa; identical to SEQ ID NO: 58370

SEQ ID NO: 326046 - RNA, 64 nt, hsa; identical to SEQ ID NO: 58371

SEQ ID NO: 326047 - RNA, 64 nt, hsa; identical to SEQ ID NO: 58372

SEQ ID NO: 326048 - RNA, 64 nt, hsa; identical to SEQ ID NO: 58373

SEQ ID NO: 326049 - RNA, 64 nt, hsa; identical to SEQ ID NO: 58374

SEQ ID NO: 326050 - RNA, 64 nt, hsa; identical to SEQ ID NO: 58375

SEQ ID NO: 326051 - RNA, 64 nt, hsa; identical to SEQ ID NO: 58376

SEQ ID NO: 326052 - RNA, 64 nt, hsa; identical to SEQ ID NO: 58377

SEQ ID NO: 326053 - RNA, 64 nt, hsa; identical to SEQ ID NO: 58378

SEQ ID NO: 326054 - RNA, 64 nt, hsa; identical to SEQ ID NO: 58379

SEQ ID NO: 326055 - RNA, 64 nt, hsa; identical to SEQ ID NO: 58380

SEQ ID NO: 326056 - RNA, 64 nt, hsa; identical to SEQ ID NO: 58381

SEQ ID NO: 326057 - RNA, 64 nt, hsa; identical to SEQ ID NO: 58382

SEQ ID NO: 326058 - RNA, 64 nt, hsa; identical to SEQ ID NO: 58383

SEQ ID NO: 326059 - RNA, 64 nt, hsa; identical to SEQ ID NO: 58384

SEQ ID NO: 326060 - RNA, 64 nt, hsa; identical to SEQ ID NO: 58385

SEQ ID NO: 326061 - RNA, 64 nt, hsa; identical to SEQ ID NO: 58386

SEQ ID NO: 326062 - RNA, 64 nt, hsa; identical to SEQ ID NO: 58387

SEQ ID NO: 326063 - RNA, 64 nt, hsa; identical to SEQ ID NO: 58388

SEQ ID NO: 326064 - RNA, 64 nt, hsa; identical to SEQ ID NO: 58389

SEQ ID NO: 326065 - RNA, 64 nt, hsa; identical to SEQ ID NO: 58390

SEQ ID NO: 326066 - RNA, 64 nt, hsa; identical to SEQ ID NO: 58391

SEQ ID NO: 326067 - RNA, 64 nt, hsa; identical to SEQ ID NO: 58392

SEQ ID NO: 326068 - RNA, 64 nt, hsa; identical to SEQ ID NO: 58393

SEQ ID NO: 326069 - RNA, 64 nt, hsa; identical to SEQ ID NO: 58394

SEQ ID NO: 326070 - RNA, 64 nt, hsa; identical to SEQ ID NO: 58395

SEQ ID NO: 326071 - RNA, 64 nt, hsa; identical to SEQ ID NO: 58396

SEQ ID NO: 326072 - RNA, 64 nt, hsa; identical to SEQ ID NO: 58397

SEQ ID NO: 326073 - RNA, 64 nt, hsa; identical to SEQ ID NO: 58398

SEQ ID NO: 326074 - RNA, 64 nt, hsa; identical to SEQ ID NO: 58399

SEQ ID NO: 326075 - RNA, 64 nt, hsa; identical to SEQ ID NO: 58400

SEQ ID NO: 326076 - RNA, 64 nt, hsa; identical to SEQ ID NO: 58401

SEQ ID NO: 326077 - RNA, 64 nt, hsa; identical to SEQ ID NO: 58402

SEQ ID NO: 326078 - RNA, 64 nt, hsa; identical to SEQ ID NO: 58403

SEQ ID NO: 326079 - RNA, 64 nt, hsa; identical to SEQ ID NO: 58404

SEQ ID NO: 326080 - RNA, 64 nt, hsa; identical to SEQ ID NO: 58405

SEQ ID NO: 326081 - RNA, 64 nt, hsa; identical to SEQ ID NO: 58406

SEQ ID NO: 326082 - RNA, 64 nt, hsa; identical to SEQ ID NO: 58407

SEQ ID NO: 326083 - RNA, 64 nt, hsa; identical to SEQ ID NO: 58408

SEQ ID NO: 326084 - RNA, 64 nt, hsa; identical to SEQ ID NO: 58409

SEQ ID NO: 326085 - RNA, 64 nt, hsa; identical to SEQ ID NO: 58410

SEQ ID NO: 326086 - RNA, 64 nt, hsa; identical to SEQ ID NO: 58411

SEQ ID NO: 326087 - RNA, 64 nt, hsa; identical to SEQ ID NO: 58412

SEQ ID NO: 326088 - RNA, 64 nt, hsa; identical to SEQ ID NO: 58413

SEQ ID NO: 326089 - RNA, 64 nt, hsa; identical to SEQ ID NO: 58414

SEQ ID NO: 326090 - RNA, 64 nt, hsa; identical to SEQ ID NO: 58415

SEQ ID NO: 326091 - RNA, 64 nt, hsa; identical to SEQ ID NO: 58416

SEQ ID NO: 326092 - RNA, 64 nt, hsa; identical to SEQ ID NO: 58417

SEQ ID NO: 326093 - RNA, 64 nt, hsa; identical to SEQ ID NO: 58418

SEQ ID NO: 326094 - RNA, 64 nt, hsa; identical to SEQ ID NO: 58419

SEQ ID NO: 326095 - RNA, 64 nt, hsa; identical to SEQ ID NO: 58420

SEQ ID NO: 326096 - RNA, 64 nt, hsa; identical to SEQ ID NO: 58421

SEQ ID NO: 326097 - RNA, 64 nt, hsa; identical to SEQ ID NO: 58422

SEQ ID NO: 326098 - RNA, 64 nt, hsa; identical to SEQ ID NO: 58423

SEQ ID NO: 326099 - RNA, 64 nt, hsa; identical to SEQ ID NO: 58424

SEQ ID NO: 326100 - RNA, 64 nt, hsa; identical to SEQ ID NO: 58425

SEQ ID NO: 326101 - RNA, 64 nt, hsa; identical to SEQ ID NO: 58426

SEQ ID NO: 326102 - RNA, 64 nt, hsa; identical to SEQ ID NO: 58427

SEQ ID NO: 326103 - RNA, 64 nt, hsa; identical to SEQ ID NO: 58428

SEQ ID NO: 326104 - RNA, 64 nt, hsa; identical to SEQ ID NO: 58429

SEQ ID NO: 326105 - RNA, 64 nt, hsa; identical to SEQ ID NO: 58430

SEQ ID NO: 326106 - RNA, 64 nt, hsa; identical to SEQ ID NO: 58431

SEQ ID NO: 326107 - RNA, 64 nt, hsa; identical to SEQ ID NO: 58432

SEQ ID NO: 326108 - RNA, 64 nt, hsa; identical to SEQ ID NO: 58433

SEQ ID NO: 326109 - RNA, 64 nt, hsa; identical to SEQ ID NO: 58434

SEQ ID NO: 326110 - RNA, 64 nt, hsa; identical to SEQ ID NO: 58435

SEQ ID NO: 326111 - RNA, 50 nt, hsa; identical to SEQ ID NO: 58436

SEQ ID NO: 326112 - RNA, 64 nt, hsa; identical to SEQ ID NO: 58437

SEQ ID NO: 326113 - RNA, 64 nt, hsa; identical to SEQ ID NO: 58438

SEQ ID NO: 326114 - RNA, 64 nt, hsa; identical to SEQ ID NO: 58439

SEQ ID NO: 326115 - RNA, 64 nt, hsa; identical to SEQ ID NO: 58440

SEQ ID NO: 326116 - RNA, 64 nt, hsa; identical to SEQ ID NO: 58441

SEQ ID NO: 326117 - RNA, 64 nt, hsa; identical to SEQ ID NO: 58442

SEQ ID NO: 326118 - RNA, 64 nt, hsa; identical to SEQ ID NO: 58443

SEQ ID NO: 326119 - RNA, 64 nt, hsa; identical to SEQ ID NO: 58444

SEQ ID NO: 326120 - RNA, 64 nt, hsa; identical to SEQ ID NO: 58445

SEQ ID NO: 326121 - RNA, 64 nt, hsa; identical to SEQ ID NO: 58446

SEQ ID NO: 326122 - RNA, 64 nt, hsa; identical to SEQ ID NO: 58447

SEQ ID NO: 326123 - RNA, 64 nt, hsa; identical to SEQ ID NO: 58448

SEQ ID NO: 326124 - RNA, 64 nt, hsa; identical to SEQ ID NO: 58449

SEQ ID NO: 326125 - RNA, 64 nt, hsa; identical to SEQ ID NO: 58450

SEQ ID NO: 326126 - RNA, 64 nt, hsa; identical to SEQ ID NO: 58451

SEQ ID NO: 326127 - RNA, 64 nt, hsa; identical to SEQ ID NO: 58452

SEQ ID NO: 326128 - RNA, 64 nt, hsa; identical to SEQ ID NO: 58453

SEQ ID NO: 326129 - RNA, 64 nt, hsa; identical to SEQ ID NO: 58454

SEQ ID NO: 326130 - RNA, 64 nt, hsa; identical to SEQ ID NO: 58455

SEQ ID NO: 326131 - RNA, 64 nt, hsa; identical to SEQ ID NO: 58456

SEQ ID NO: 326132 - RNA, 64 nt, hsa; identical to SEQ ID NO: 58457

SEQ ID NO: 326133 - RNA, 64 nt, hsa; identical to SEQ ID NO: 58458

SEQ ID NO: 326134 - RNA, 64 nt, hsa; identical to SEQ ID NO: 58459

SEQ ID NO: 326135 - RNA, 64 nt, hsa; identical to SEQ ID NO: 58460

SEQ ID NO: 326136 - RNA, 64 nt, hsa; identical to SEQ ID NO: 58461

SEQ ID NO: 326137 - RNA, 64 nt, hsa; identical to SEQ ID NO: 58462

SEQ ID NO: 326138 - RNA, 64 nt, hsa; identical to SEQ ID NO: 58463

SEQ ID NO: 326139 - RNA, 64 nt, hsa; identical to SEQ ID NO: 58464

SEQ ID NO: 326140 - RNA, 64 nt, hsa; identical to SEQ ID NO: 58465

SEQ ID NO: 326141 - RNA, 64 nt, hsa; identical to SEQ ID NO: 58466

SEQ ID NO: 326142 - RNA, 64 nt, hsa; identical to SEQ ID NO: 58467

SEQ ID NO: 326143 - RNA, 64 nt, hsa; identical to SEQ ID NO: 101929

SEQ ID NO: 326144 - RNA, 64 nt, hsa; identical to SEQ ID NO: 101930

SEQ ID NO: 326145 - RNA, 64 nt, hsa; identical to SEQ ID NO: 101931

SEQ ID NO: 326146 - RNA, 64 nt, hsa; identical to SEQ ID NO: 101932

SEQ ID NO: 326147 - RNA, 64 nt, hsa; identical to SEQ ID NO: 101933

SEQ ID NO: 326148 - RNA, 64 nt, hsa; identical to SEQ ID NO: 101934

SEQ ID NO: 326149 - RNA, 64 nt, hsa; identical to SEQ ID NO: 101935

SEQ ID NO: 326150 - RNA, 64 nt, hsa; identical to SEQ ID NO: 101936

SEQ ID NO: 326151 - RNA, 64 nt, hsa; identical to SEQ ID NO: 101937

SEQ ID NO: 326152 - RNA, 64 nt, hsa; identical to SEQ ID NO: 101938

SEQ ID NO: 326153 - RNA, 64 nt, hsa; identical to SEQ ID NO: 101939

SEQ ID NO: 326154 - RNA, 64 nt, hsa; identical to SEQ ID NO: 101940

SEQ ID NO: 326155 - RNA, 64 nt, hsa; identical to SEQ ID NO: 101941

SEQ ID NO: 326156 - RNA, 64 nt, hsa; identical to SEQ ID NO: 101942

SEQ ID NO: 326157 - RNA, 64 nt, hsa; identical to SEQ ID NO: 101943

SEQ ID NO: 326158 - RNA, 64 nt, hsa; identical to SEQ ID NO: 101944

SEQ ID NO: 326159 - RNA, 64 nt, hsa; identical to SEQ ID NO: 101945

SEQ ID NO: 326160 - RNA, 64 nt, hsa; identical to SEQ ID NO: 101946

SEQ ID NO: 326161 - RNA, 64 nt, hsa; identical to SEQ ID NO: 101947

SEQ ID NO: 326162 - RNA, 64 nt, hsa; identical to SEQ ID NO: 217362

SEQ ID NO: 326163 - RNA, 64 nt, hsa; identical to SEQ ID NO: 217363

SEQ ID NO: 326164 - RNA, 64 nt, hsa; identical to SEQ ID NO: 217364

SEQ ID NO: 326165 - RNA, 64 nt, hsa; identical to SEQ ID NO: 217365

SEQ ID NO: 326166 - RNA, 64 nt, hsa; identical to SEQ ID NO: 217366

SEQ ID NO: 326167 - RNA, 64 nt, hsa; identical to SEQ ID NO: 217367

SEQ ID NO: 326168 - RNA, 64 nt, hsa; identical to SEQ ID NO: 217368

SEQ ID NO: 326169 - RNA, 64 nt, hsa; identical to SEQ ID NO: 217369

SEQ ID NO: 326170 - RNA, 64 nt, hsa; identical to SEQ ID NO: 217370

SEQ ID NO: 326171 - RNA, 64 nt, hsa; identical to SEQ ID NO: 217371

SEQ ID NO: 326172 - RNA, 64 nt, hsa; identical to SEQ ID NO: 217372

SEQ ID NO: 326173 - RNA, 64 nt, hsa; identical to SEQ ID NO: 217373

SEQ ID NO: 326174 - RNA, 64 nt, hsa; identical to SEQ ID NO: 217374

SEQ ID NO: 326175 - RNA, 64 nt, hsa; identical to SEQ ID NO: 217375

SEQ ID NO: 326176 - RNA, 64 nt, hsa; identical to SEQ ID NO: 217376

SEQ ID NO: 326177 - RNA, 64 nt, hsa; identical to SEQ ID NO: 217377

SEQ ID NO: 326178 - RNA, 64 nt, hsa; identical to SEQ ID NO: 217378

SEQ ID NO: 326179 - RNA, 64 nt, hsa; identical to SEQ ID NO: 217379

SEQ ID NO: 326180 - RNA, 64 nt, hsa; identical to SEQ ID NO: 217380

SEQ ID NO: 326181 - RNA, 64 nt, hsa; identical to SEQ ID NO: 217381

SEQ ID NO: 326182 - RNA, 64 nt, hsa; identical to SEQ ID NO: 217382

SEQ ID NO: 326183 - RNA, 64 nt, hsa; identical to SEQ ID NO: 217383

SEQ ID NO: 326184 - RNA, 64 nt, hsa; identical to SEQ ID NO: 217384

SEQ ID NO: 326185 - RNA, 64 nt, hsa; identical to SEQ ID NO: 217385

SEQ ID NO: 326186 - RNA, 55 nt, hsa; identical to SEQ ID NO: 217386

SEQ ID NO: 326187 - RNA, 64 nt, hsa; identical to SEQ ID NO: 217387

SEQ ID NO: 326188 - RNA, 64 nt, hsa; identical to SEQ ID NO: 217388

SEQ ID NO: 326189 - RNA, 64 nt, hsa; identical to SEQ ID NO: 217389

SEQ ID NO: 326190 - RNA, 64 nt, hsa; identical to SEQ ID NO: 217390

SEQ ID NO: 326191 - RNA, 64 nt, hsa; identical to SEQ ID NO: 217391

SEQ ID NO: 326192 - RNA, 64 nt, hsa; identical to SEQ ID NO: 217392

SEQ ID NO: 326193 - RNA, 64 nt, hsa; identical to SEQ ID NO: 217393

SEQ ID NO: 326194 - RNA, 64 nt, hsa; identical to SEQ ID NO: 217394

SEQ ID NO: 326195 - RNA, 64 nt, hsa; identical to SEQ ID NO: 72787

SEQ ID NO: 326196 - RNA, 64 nt, hsa; identical to SEQ ID NO: 72788

SEQ ID NO: 326197 - RNA, 64 nt, hsa; identical to SEQ ID NO: 72789

SEQ ID NO: 326198 - RNA, 64 nt, hsa; identical to SEQ ID NO: 72790

SEQ ID NO: 326199 - RNA, 64 nt, hsa; identical to SEQ ID NO: 72791

SEQ ID NO: 326200 - RNA, 64 nt, hsa; identical to SEQ ID NO: 72792

SEQ ID NO: 326201 - RNA, 64 nt, hsa; identical to SEQ ID NO: 72793

SEQ ID NO: 326202 - RNA, 64 nt, hsa; identical to SEQ ID NO: 72794

SEQ ID NO: 326203 - RNA, 64 nt, hsa; identical to SEQ ID NO: 72795

SEQ ID NO: 326204 - RNA, 64 nt, hsa; identical to SEQ ID NO: 72796

SEQ ID NO: 326205 - RNA, 64 nt, hsa; identical to SEQ ID NO: 72797

SEQ ID NO: 326206 - RNA, 64 nt, hsa; identical to SEQ ID NO: 72798

SEQ ID NO: 326207 - RNA, 64 nt, hsa; identical to SEQ ID NO: 72799

SEQ ID NO: 326208 - RNA, 64 nt, hsa; identical to SEQ ID NO: 72800

SEQ ID NO: 326209 - RNA, 64 nt, hsa; identical to SEQ ID NO: 72801

SEQ ID NO: 326210 - RNA, 64 nt, hsa; identical to SEQ ID NO: 72802

SEQ ID NO: 326211 - RNA, 64 nt, hsa; identical to SEQ ID NO: 72803

SEQ ID NO: 326212 - RNA, 64 nt, hsa; identical to SEQ ID NO: 72804

SEQ ID NO: 326213 - RNA, 64 nt, hsa; identical to SEQ ID NO: 72805

SEQ ID NO: 326214 - RNA, 64 nt, hsa; identical to SEQ ID NO: 72806

SEQ ID NO: 326215 - RNA, 64 nt, hsa; identical to SEQ ID NO: 72807

SEQ ID NO: 326216 - RNA, 64 nt, hsa; identical to SEQ ID NO: 72808

SEQ ID NO: 326217 - RNA, 64 nt, hsa; identical to SEQ ID NO: 72809

SEQ ID NO: 326218 - RNA, 64 nt, hsa; identical to SEQ ID NO: 72810

SEQ ID NO: 326219 - RNA, 64 nt, hsa; identical to SEQ ID NO: 72811

SEQ ID NO: 326220 - RNA, 64 nt, hsa; identical to SEQ ID NO: 72812

SEQ ID NO: 326221 - RNA, 64 nt, hsa; identical to SEQ ID NO: 72813

SEQ ID NO: 326222 - RNA, 64 nt, hsa; identical to SEQ ID NO: 72814

SEQ ID NO: 326223 - RNA, 64 nt, hsa; identical to SEQ ID NO: 72815

SEQ ID NO: 326224 - RNA, 64 nt, hsa; identical to SEQ ID NO: 72816

SEQ ID NO: 326225 - RNA, 64 nt, hsa; identical to SEQ ID NO: 72817

SEQ ID NO: 326226 - RNA, 64 nt, hsa; identical to SEQ ID NO: 72818

SEQ ID NO: 326227 - RNA, 64 nt, hsa; identical to SEQ ID NO: 72819

SEQ ID NO: 326228 - RNA, 64 nt, hsa; identical to SEQ ID NO: 72820

SEQ ID NO: 326229 - RNA, 64 nt, hsa; identical to SEQ ID NO: 72821

SEQ ID NO: 326230 - RNA, 64 nt, hsa; identical to SEQ ID NO: 72822

SEQ ID NO: 326231 - RNA, 64 nt, hsa; identical to SEQ ID NO: 72823

SEQ ID NO: 326232 - RNA, 64 nt, hsa; identical to SEQ ID NO: 72824

SEQ ID NO: 326233 - RNA, 64 nt, hsa; identical to SEQ ID NO: 72825

SEQ ID NO: 326234 - RNA, 64 nt, hsa; identical to SEQ ID NO: 72826

SEQ ID NO: 326235 - RNA, 64 nt, hsa; identical to SEQ ID NO: 72827

SEQ ID NO: 326236 - RNA, 64 nt, hsa; identical to SEQ ID NO: 72828

SEQ ID NO: 326237 - RNA, 64 nt, hsa; identical to SEQ ID NO: 72829

SEQ ID NO: 326238 - RNA, 64 nt, hsa; identical to SEQ ID NO: 72830

SEQ ID NO: 326239 - RNA, 64 nt, hsa; identical to SEQ ID NO: 72831

SEQ ID NO: 326240 - RNA, 64 nt, hsa; identical to SEQ ID NO: 72832

SEQ ID NO: 326241 - RNA, 64 nt, hsa; identical to SEQ ID NO: 72833

SEQ ID NO: 326242 - RNA, 64 nt, hsa; identical to SEQ ID NO: 72834

SEQ ID NO: 326243 - RNA, 64 nt, hsa; identical to SEQ ID NO: 72835

SEQ ID NO: 326244 - RNA, 64 nt, hsa; identical to SEQ ID NO: 72836

SEQ ID NO: 326245 - RNA, 64 nt, hsa; identical to SEQ ID NO: 72837

SEQ ID NO: 326246 - RNA, 64 nt, hsa; identical to SEQ ID NO: 72838

SEQ ID NO: 326247 - RNA, 64 nt, hsa; identical to SEQ ID NO: 72839

SEQ ID NO: 326248 - RNA, 64 nt, hsa; identical to SEQ ID NO: 72840

SEQ ID NO: 326249 - RNA, 64 nt, hsa; identical to SEQ ID NO: 72841

SEQ ID NO: 326250 - RNA, 64 nt, hsa
cccccauccagugggucacccaggaguaaugucccuccagcaacguucccccuauggccuccag

SEQ ID NO: 326251 - RNA, 64 nt, hsa
aguaaugucccuccagcaacguucccccuauggccuccagcagagcugaucugccucucacaca

SEQ ID NO: 326252 - RNA, 64 nt, hsa
gauagaaaggacuucaacgccagugacuguguaccuccagcagaagaaaaucaggugucugguc

SEQ ID NO: 326253 - RNA, 64 nt, hsa
agguucccagcucccccccugcaagccuugaagccuccagcaacgucuaucuccaggagagcag

SEQ ID NO: 326254 - RNA, 64 nt, hsa
cuugguuccuggagagugugccccuccacccucccuccagcagcccugaucacaccaugagagc

SEQ ID NO: 326255 - RNA, 64 nt, hsa
gaagucuaggccucaggggcucccgcccuucuuccuccagcagcgggaacugccacugcucucc

SEQ ID NO: 326256 - RNA, 64 nt, hsa
cucuucccuaagaggcugccggaguuggggccuccuccagcagagacccucggaccccugcagg

SEQ ID NO: 326257 - RNA, 64 nt, hsa
aggcuccacagcuccaccgcuccaccuggcuucacuccagcacccugucccuggagcaccucug

SEQ ID NO: 326258 - RNA, 64 nt, hsa
agacccugcccgccgcccaccugguggugacaagcuccagcagccaguggguccggaccugcuu

SEQ ID NO: 326259 - RNA, 64 nt, hsa
gcaggaagcccaccgugccccaugcaggggcucccuccagcacacagcccucaccccagcacag

SEQ ID NO: 326260 - RNA, 64 nt, hsa
augcugaggccacccacugacccaacugauccugcuccagcagcacaccucagccccacugaca

SEQ ID NO: 326261 - RNA, 64 nt, hsa
cacugguuugccaggccaauguugcugauggccccuccagcacacacacauaagcacugaaauc

SEQ ID NO: 326262 - RNA, 64 nt, hsa
aaacaguuugaaagggacugaggcucacccaggucuccagcaaacggaggacugaacuggggag

SEQ ID NO: 326263 - RNA, 64 nt, hsa
ccggcagagcaggccggacgcagcagcccucuggcuccagcauggggccuggccaggcuauucg

SEQ ID NO: 326264 - RNA, 64 nt, hsa
cuuccguccagagcagucccgggcaggggugaaacuccagcagguggcugggcuggaaaggagg

SEQ ID NO: 326265 - RNA, 64 nt, hsa
aagacacacaccucuaguccggucugccgguggccuccagcagcaccacagagcuccagaccaa

SEQ ID NO: 326266 - RNA, 64 nt, hsa
ugccaugcugcagccucagaaaccaggccucucacuccagcagcaggcagaaccgugucugugg

SEQ ID NO: 326267 - RNA, 64 nt, hsa
acagaaucugcccugugccgccugguuccguggccuccagcaugagccugcaggcagggcgcug

SEQ ID NO: 326268 - RNA, 64 nt, hsa
gggagugcauggucucagaugccauccuucucuucuccagcauuuccacucaccuccguguucu

SEQ ID NO: 326269 - RNA, 64 nt, hsa
gggagugcguggucuuggaugccauccugcucaucuccagcauuuccucucaccuccguguucu

SEQ ID NO: 326270 - RNA, 64 nt, hsa
gggagugcguggugucagaucccauccugcucaucuccagcauuuccucucaccucuguguucu

SEQ ID NO: 326271 - RNA, 64 nt, hsa
gggagugcguggugucagaucccauccugcuccucuccagcauuuccucucaccuccguguucu

SEQ ID NO: 326272 - RNA, 64 nt, hsa
aggaugcagcugccagauccacucacucugcugccuccagcaggacccaaggccacuuucaacu

SEQ ID NO: 326273 - RNA, 64 nt, hsa
cugggcccagacccauccucccagccagguuucccuccagcaggcuccuucccucccugucacc

SEQ ID NO: 326274 - RNA, 64 nt, hsa
ccuucucccgcucccucucccgugccucugcuuucuccagcagcugaggaaagaagggacacgg

SEQ ID NO: 326275 - RNA, 64 nt, hsa
ccugaggcagauccagaggacaagccugccucaccuccagcaccuguaggaacucccggaagag

SEQ ID NO: 326276 - RNA, 64 nt, hsa
uuccccuuccucccuccaugcccacucccccugccuccagcaggccaggaagaaggcacagucc

SEQ ID NO: 326277 - RNA, 64 nt, hsa
uugucuccaccuccucgcuccucugaggcuccuccuccagcaucaggcucugccaaggccccuc

SEQ ID NO: 326278 - RNA, 64 nt, hsa
aaugggccucauggaauggaaugucuccacuucacuccagcaucaacaaguggggaauucugau

SEQ ID NO: 326279 - RNA, 64 nt, hsa
cacuucaguuuauaccuugccuguaguccagucucuccagcaucaauuccaucagcacaaagac

SEQ ID NO: 326280 - RNA, 64 nt, hsa
guuccagagagcugccggaauuccagguuugacucuccagcacagagcagagcuacacagaggu

SEQ ID NO: 326281 - RNA, 64 nt, hsa
gcugucacagcaccuuguaugauggcaggacaggcuccagcagagagaacugcacagugaccac

SEQ ID NO: 326282 - RNA, 64 nt, hsa
ggugacaagugccgugaacaucaugcacagcagccuccagcaaggcaaauuugacacaaaaggc

SEQ ID NO: 326283 - RNA, 64 nt, hsa
uuguuaagaagugcauugggcgggcucuguccagcuccagcauugacugucucugugccaugau

SEQ ID NO: 326284 - RNA, 64 nt, hsa
aagauuauugaagaagcaccugcuacuauugcuacuccagcaguauuugaacacauggaacagg

SEQ ID NO: 326285 - RNA, 64 nt, hsa
aaaauagauucucaacgagauuucacuguggcuucuccagcagaauuuguuacucgcuuugggg

SEQ ID NO: 326286 - RNA, 64 nt, hsa
gcccccuucuuucggcuuucugcuaaagcaacaccuccagcagagauucccuuaagugacucca

SEQ ID NO: 326287 - RNA, 64 nt, hsa
aaaauguuaaaacagacaacugguaaaucucaaacuccagcacuggaauuaaggucucuaaagc

SEQ ID NO: 326288 - RNA, 64 nt, hsa
ucugggucacgucggccaggaguagggugcaggccuccagcagguccuaauccugugugccagg

SEQ ID NO: 326289 - RNA, 64 nt, hsa
gaagcacagaucccagcacuuuucccagcuuucucuccagcaucagucccugcagcagcugggg

SEQ ID NO: 326290 - RNA, 64 nt, hsa
ggugauacccaggcagauauggucuggaguggaccuccagcaaacuccagcagaccugcagccg

SEQ ID NO: 326291 - RNA, 64 nt, hsa
aggcagauauggucuggaguggaccuccagcaaacuccagcagaccugcagccgaggggccuca

SEQ ID NO: 326292 - RNA, 64 nt, hsa
gcagggcuccuuacugcaaggcaucucucagcgccuccagcagccuggaacccacgccuccuga

SEQ ID NO: 326293 - RNA, 64 nt, hsa
uucccgguggaacagaugacaaggucucuagcaucuccagcaggacuccaggaugguucagccc

SEQ ID NO: 326294 - RNA, 64 nt, hsa; identical to SEQ ID NO: 173359

SEQ ID NO: 326295 - RNA, 64 nt, hsa; identical to SEQ ID NO: 173360

SEQ ID NO: 326296 - RNA, 64 nt, hsa; identical to SEQ ID NO: 173361

SEQ ID NO: 326297 - RNA, 64 nt, hsa; identical to SEQ ID NO: 173362

SEQ ID NO: 326298 - RNA, 64 nt, hsa; identical to SEQ ID NO: 42333

SEQ ID NO: 326299 - RNA, 64 nt, hsa; identical to SEQ ID NO: 42334

SEQ ID NO: 326300 - RNA, 64 nt, hsa; identical to SEQ ID NO: 42335

SEQ ID NO: 326301 - RNA, 64 nt, hsa; identical to SEQ ID NO: 42336

SEQ ID NO: 326302 - RNA, 64 nt, hsa; identical to SEQ ID NO: 42337

SEQ ID NO: 326303 - RNA, 64 nt, hsa; identical to SEQ ID NO: 42338

SEQ ID NO: 326304 - RNA, 64 nt, hsa; identical to SEQ ID NO: 42339

SEQ ID NO: 326305 - RNA, 64 nt, hsa; identical to SEQ ID NO: 42340

SEQ ID NO: 326306 - RNA, 64 nt, hsa; identical to SEQ ID NO: 42341

SEQ ID NO: 326307 - RNA, 64 nt, hsa; identical to SEQ ID NO: 42342

SEQ ID NO: 326308 - RNA, 64 nt, hsa; identical to SEQ ID NO: 42343

SEQ ID NO: 326309 - RNA, 64 nt, hsa; identical to SEQ ID NO: 42344

SEQ ID NO: 326310 - RNA, 64 nt, hsa; identical to SEQ ID NO: 42345

SEQ ID NO: 326311 - RNA, 64 nt, hsa; identical to SEQ ID NO: 42346

SEQ ID NO: 326312 - RNA, 64 nt, hsa; identical to SEQ ID NO: 42347

SEQ ID NO: 326313 - RNA, 64 nt, hsa; identical to SEQ ID NO: 42348

SEQ ID NO: 326314 - RNA, 64 nt, hsa; identical to SEQ ID NO: 42349

SEQ ID NO: 326315 - RNA, 64 nt, hsa; identical to SEQ ID NO: 42350

SEQ ID NO: 326316 - RNA, 64 nt, hsa; identical to SEQ ID NO: 42351

SEQ ID NO: 326317 - RNA, 64 nt, hsa; identical to SEQ ID NO: 42352

SEQ ID NO: 326318 - RNA, 64 nt, hsa; identical to SEQ ID NO: 42353

SEQ ID NO: 326319 - RNA, 64 nt, hsa; identical to SEQ ID NO: 42354

SEQ ID NO: 326320 - RNA, 64 nt, hsa; identical to SEQ ID NO: 42355

SEQ ID NO: 326321 - RNA, 64 nt, hsa; identical to SEQ ID NO: 42356

SEQ ID NO: 326322 - RNA, 64 nt, hsa; identical to SEQ ID NO: 42357

SEQ ID NO: 326323 - RNA, 64 nt, hsa; identical to SEQ ID NO: 42358

SEQ ID NO: 326324 - RNA, 64 nt, hsa; identical to SEQ ID NO: 42359

SEQ ID NO: 326325 - RNA, 64 nt, hsa; identical to SEQ ID NO: 42360

SEQ ID NO: 326326 - RNA, 64 nt, hsa; identical to SEQ ID NO: 42361

SEQ ID NO: 326327 - RNA, 64 nt, hsa; identical to SEQ ID NO: 42362

SEQ ID NO: 326328 - RNA, 64 nt, hsa; identical to SEQ ID NO: 42363

SEQ ID NO: 326329 - RNA, 64 nt, hsa; identical to SEQ ID NO: 42364

SEQ ID NO: 326330 - RNA, 64 nt, hsa; identical to SEQ ID NO: 42365

SEQ ID NO: 326331 - RNA, 64 nt, hsa; identical to SEQ ID NO: 42366

SEQ ID NO: 326332 - RNA, 64 nt, hsa; identical to SEQ ID NO: 42367

SEQ ID NO: 326333 - RNA, 64 nt, hsa; identical to SEQ ID NO: 42368

SEQ ID NO: 326334 - RNA, 64 nt, hsa; identical to SEQ ID NO: 42369

SEQ ID NO: 326335 - RNA, 64 nt, hsa; identical to SEQ ID NO: 42370

SEQ ID NO: 326336 - RNA, 64 nt, hsa; identical to SEQ ID NO: 42371

SEQ ID NO: 326337 - RNA, 64 nt, hsa; identical to SEQ ID NO: 42372

SEQ ID NO: 326338 - RNA, 64 nt, hsa; identical to SEQ ID NO: 42373

SEQ ID NO: 326339 - RNA, 64 nt, hsa; identical to SEQ ID NO: 42374

SEQ ID NO: 326340 - RNA, 64 nt, hsa; identical to SEQ ID NO: 42375

SEQ ID NO: 326341 - RNA, 64 nt, hsa; identical to SEQ ID NO: 42376

SEQ ID NO: 326342 - RNA, 64 nt, hsa; identical to SEQ ID NO: 42377

SEQ ID NO: 326343 - RNA, 64 nt, hsa; identical to SEQ ID NO: 42378

SEQ ID NO: 326344 - RNA, 64 nt, hsa; identical to SEQ ID NO: 42379

SEQ ID NO: 326345 - RNA, 64 nt, hsa; identical to SEQ ID NO: 42380

SEQ ID NO: 326346 - RNA, 64 nt, hsa; identical to SEQ ID NO: 42381

SEQ ID NO: 326347 - RNA, 64 nt, hsa; identical to SEQ ID NO: 42382

SEQ ID NO: 326348 - RNA, 64 nt, hsa; identical to SEQ ID NO: 42383

SEQ ID NO: 326349 - RNA, 64 nt, hsa; identical to SEQ ID NO: 42384

SEQ ID NO: 326350 - RNA, 64 nt, hsa; identical to SEQ ID NO: 42385

SEQ ID NO: 326351 - RNA, 64 nt, hsa; identical to SEQ ID NO: 42386

SEQ ID NO: 326352 - RNA, 64 nt, hsa; identical to SEQ ID NO: 42387

SEQ ID NO: 326353 - RNA, 64 nt, hsa; identical to SEQ ID NO: 42388

SEQ ID NO: 326354 - RNA, 64 nt, hsa; identical to SEQ ID NO: 42389

SEQ ID NO: 326355 - RNA, 64 nt, hsa; identical to SEQ ID NO: 42390

SEQ ID NO: 326356 - RNA, 64 nt, hsa; identical to SEQ ID NO: 42391

SEQ ID NO: 326357 - RNA, 64 nt, hsa; identical to SEQ ID NO: 42392

SEQ ID NO: 326358 - RNA, 64 nt, hsa; identical to SEQ ID NO: 42393

SEQ ID NO: 326359 - RNA, 64 nt, hsa; identical to SEQ ID NO: 42394

SEQ ID NO: 326360 - RNA, 64 nt, hsa; identical to SEQ ID NO: 42395

SEQ ID NO: 326361 - RNA, 64 nt, hsa; identical to SEQ ID NO: 42396

SEQ ID NO: 326362 - RNA, 64 nt, hsa; identical to SEQ ID NO: 42397

SEQ ID NO: 326363 - RNA, 64 nt, hsa; identical to SEQ ID NO: 42398

SEQ ID NO: 326364 - RNA, 64 nt, hsa; identical to SEQ ID NO: 42399

SEQ ID NO: 326365 - RNA, 64 nt, hsa; identical to SEQ ID NO: 42400

SEQ ID NO: 326366 - RNA, 64 nt, hsa; identical to SEQ ID NO: 42401

SEQ ID NO: 326367 - RNA, 64 nt, hsa; identical to SEQ ID NO: 42402

SEQ ID NO: 326368 - RNA, 64 nt, hsa; identical to SEQ ID NO: 42403

SEQ ID NO: 326369 - RNA, 64 nt, hsa; identical to SEQ ID NO: 42404

SEQ ID NO: 326370 - RNA, 64 nt, hsa; identical to SEQ ID NO: 42405

SEQ ID NO: 326371 - RNA, 64 nt, hsa; identical to SEQ ID NO: 42406

SEQ ID NO: 326372 - RNA, 64 nt, hsa; identical to SEQ ID NO: 42407

SEQ ID NO: 326373 - RNA, 64 nt, hsa; identical to SEQ ID NO: 42408

SEQ ID NO: 326374 - RNA, 64 nt, hsa; identical to SEQ ID NO: 42409

SEQ ID NO: 326375 - RNA, 64 nt, hsa; identical to SEQ ID NO: 42410

SEQ ID NO: 326376 - RNA, 64 nt, hsa; identical to SEQ ID NO: 42411

SEQ ID NO: 326377 - RNA, 64 nt, hsa; identical to SEQ ID NO: 42412

SEQ ID NO: 326378 - RNA, 64 nt, hsa; identical to SEQ ID NO: 42413

SEQ ID NO: 326379 - RNA, 64 nt, hsa; identical to SEQ ID NO: 42414

SEQ ID NO: 326380 - RNA, 64 nt, hsa; identical to SEQ ID NO: 42415

SEQ ID NO: 326381 - RNA, 64 nt, hsa; identical to SEQ ID NO: 42416

SEQ ID NO: 326382 - RNA, 64 nt, hsa; identical to SEQ ID NO: 42417

SEQ ID NO: 326383 - RNA, 64 nt, hsa; identical to SEQ ID NO: 42418

SEQ ID NO: 326384 - RNA, 64 nt, hsa; identical to SEQ ID NO: 42419

SEQ ID NO: 326385 - RNA, 64 nt, hsa; identical to SEQ ID NO: 42420

SEQ ID NO: 326386 - RNA, 64 nt, hsa; identical to SEQ ID NO: 42421

SEQ ID NO: 326387 - RNA, 64 nt, hsa; identical to SEQ ID NO: 42422

SEQ ID NO: 326388 - RNA, 64 nt, hsa; identical to SEQ ID NO: 42423

SEQ ID NO: 326389 - RNA, 64 nt, hsa; identical to SEQ ID NO: 42424

SEQ ID NO: 326390 - RNA, 64 nt, hsa; identical to SEQ ID NO: 42425

SEQ ID NO: 326391 - RNA, 64 nt, hsa; identical to SEQ ID NO: 42426

SEQ ID NO: 326392 - RNA, 64 nt, hsa; identical to SEQ ID NO: 42427

SEQ ID NO: 326393 - RNA, 64 nt, hsa; identical to SEQ ID NO: 42428

SEQ ID NO: 326394 - RNA, 64 nt, hsa; identical to SEQ ID NO: 42429

SEQ ID NO: 326395 - RNA, 64 nt, hsa; identical to SEQ ID NO: 42430

SEQ ID NO: 326396 - RNA, 64 nt, hsa; identical to SEQ ID NO: 42431

SEQ ID NO: 326397 - RNA, 64 nt, hsa; identical to SEQ ID NO: 42432

SEQ ID NO: 326398 - RNA, 64 nt, hsa; identical to SEQ ID NO: 42433

SEQ ID NO: 326399 - RNA, 64 nt, hsa; identical to SEQ ID NO: 42434

SEQ ID NO: 326400 - RNA, 64 nt, hsa; identical to SEQ ID NO: 42435

SEQ ID NO: 326401 - RNA, 64 nt, hsa; identical to SEQ ID NO: 42436

SEQ ID NO: 326402 - RNA, 64 nt, hsa; identical to SEQ ID NO: 42437

SEQ ID NO: 326403 - RNA, 64 nt, hsa; identical to SEQ ID NO: 42438

SEQ ID NO: 326404 - RNA, 64 nt, hsa; identical to SEQ ID NO: 42439

SEQ ID NO: 326405 - RNA, 64 nt, hsa; identical to SEQ ID NO: 42440

SEQ ID NO: 326406 - RNA, 64 nt, hsa; identical to SEQ ID NO: 42441

SEQ ID NO: 326407 - RNA, 64 nt, hsa; identical to SEQ ID NO: 42442

SEQ ID NO: 326408 - RNA, 64 nt, hsa; identical to SEQ ID NO: 42443

SEQ ID NO: 326409 - RNA, 64 nt, hsa; identical to SEQ ID NO: 42444

SEQ ID NO: 326410 - RNA, 64 nt, hsa; identical to SEQ ID NO: 42445

SEQ ID NO: 326411 - RNA, 64 nt, hsa; identical to SEQ ID NO: 42446

SEQ ID NO: 326412 - RNA, 64 nt, hsa; identical to SEQ ID NO: 42447

SEQ ID NO: 326413 - RNA, 64 nt, hsa; identical to SEQ ID NO: 42448

SEQ ID NO: 326414 - RNA, 64 nt, hsa; identical to SEQ ID NO: 42449

SEQ ID NO: 326415 - RNA, 64 nt, hsa; identical to SEQ ID NO: 42450

SEQ ID NO: 326416 - RNA, 64 nt, hsa; identical to SEQ ID NO: 42451

SEQ ID NO: 326417 - RNA, 64 nt, hsa; identical to SEQ ID NO: 42452

SEQ ID NO: 326418 - RNA, 64 nt, hsa; identical to SEQ ID NO: 42453

SEQ ID NO: 326419 - RNA, 64 nt, hsa; identical to SEQ ID NO: 42454

SEQ ID NO: 326420 - RNA, 64 nt, hsa; identical to SEQ ID NO: 42455

SEQ ID NO: 326421 - RNA, 64 nt, hsa; identical to SEQ ID NO: 42456

SEQ ID NO: 326422 - RNA, 64 nt, hsa; identical to SEQ ID NO: 42457

SEQ ID NO: 326423 - RNA, 64 nt, hsa; identical to SEQ ID NO: 42458

SEQ ID NO: 326424 - RNA, 64 nt, hsa; identical to SEQ ID NO: 42459

SEQ ID NO: 326425 - RNA, 64 nt, hsa; identical to SEQ ID NO: 42460

SEQ ID NO: 326426 - RNA, 64 nt, hsa; identical to SEQ ID NO: 42461

SEQ ID NO: 326427 - RNA, 64 nt, hsa; identical to SEQ ID NO: 42462

SEQ ID NO: 326428 - RNA, 64 nt, hsa; identical to SEQ ID NO: 42463

SEQ ID NO: 326429 - RNA, 64 nt, hsa; identical to SEQ ID NO: 42464

SEQ ID NO: 326430 - RNA, 64 nt, hsa; identical to SEQ ID NO: 42465

SEQ ID NO: 326431 - RNA, 64 nt, hsa; identical to SEQ ID NO: 42466

SEQ ID NO: 326432 - RNA, 64 nt, hsa; identical to SEQ ID NO: 42467

SEQ ID NO: 326433 - RNA, 64 nt, hsa; identical to SEQ ID NO: 42468

SEQ ID NO: 326434 - RNA, 64 nt, hsa; identical to SEQ ID NO: 42469

SEQ ID NO: 326435 - RNA, 64 nt, hsa; identical to SEQ ID NO: 42470

SEQ ID NO: 326436 - RNA, 64 nt, hsa; identical to SEQ ID NO: 42471

SEQ ID NO: 326437 - RNA, 64 nt, hsa; identical to SEQ ID NO: 42472

SEQ ID NO: 326438 - RNA, 64 nt, hsa; identical to SEQ ID NO: 42473

SEQ ID NO: 326439 - RNA, 64 nt, hsa; identical to SEQ ID NO: 42474

SEQ ID NO: 326440 - RNA, 64 nt, hsa; identical to SEQ ID NO: 42475

SEQ ID NO: 326441 - RNA, 64 nt, hsa; identical to SEQ ID NO: 42476

SEQ ID NO: 326442 - RNA, 64 nt, hsa; identical to SEQ ID NO: 42477

SEQ ID NO: 326443 - RNA, 64 nt, hsa; identical to SEQ ID NO: 42478

SEQ ID NO: 326444 - RNA, 64 nt, hsa; identical to SEQ ID NO: 42479

SEQ ID NO: 326445 - RNA, 64 nt, hsa; identical to SEQ ID NO: 42480

SEQ ID NO: 326446 - RNA, 64 nt, hsa; identical to SEQ ID NO: 42481

SEQ ID NO: 326447 - RNA, 64 nt, hsa; identical to SEQ ID NO: 42482

SEQ ID NO: 326448 - RNA, 64 nt, hsa; identical to SEQ ID NO: 42483

SEQ ID NO: 326449 - RNA, 64 nt, hsa; identical to SEQ ID NO: 42484

SEQ ID NO: 326450 - RNA, 64 nt, hsa; identical to SEQ ID NO: 42485

SEQ ID NO: 326451 - RNA, 64 nt, hsa; identical to SEQ ID NO: 42486

SEQ ID NO: 326452 - RNA, 64 nt, hsa; identical to SEQ ID NO: 42487

SEQ ID NO: 326453 - RNA, 64 nt, hsa; identical to SEQ ID NO: 42488

SEQ ID NO: 326454 - RNA, 64 nt, hsa; identical to SEQ ID NO: 42489

SEQ ID NO: 326455 - RNA, 64 nt, hsa; identical to SEQ ID NO: 42490

SEQ ID NO: 326456 - RNA, 64 nt, hsa; identical to SEQ ID NO: 42491

SEQ ID NO: 326457 - RNA, 64 nt, hsa; identical to SEQ ID NO: 42492

SEQ ID NO: 326458 - RNA, 64 nt, hsa; identical to SEQ ID NO: 42493

SEQ ID NO: 326459 - RNA, 64 nt, hsa; identical to SEQ ID NO: 42494

SEQ ID NO: 326460 - RNA, 64 nt, hsa; identical to SEQ ID NO: 42495

SEQ ID NO: 326461 - RNA, 64 nt, hsa; identical to SEQ ID NO: 42496

SEQ ID NO: 326462 - RNA, 64 nt, hsa; identical to SEQ ID NO: 42497

SEQ ID NO: 326463 - RNA, 64 nt, hsa; identical to SEQ ID NO: 42498

SEQ ID NO: 326464 - RNA, 64 nt, hsa; identical to SEQ ID NO: 42499

SEQ ID NO: 326465 - RNA, 64 nt, hsa; identical to SEQ ID NO: 42500

SEQ ID NO: 326466 - RNA, 64 nt, hsa; identical to SEQ ID NO: 42501

SEQ ID NO: 326467 - RNA, 64 nt, hsa; identical to SEQ ID NO: 42502

SEQ ID NO: 326468 - RNA, 64 nt, hsa; identical to SEQ ID NO: 42503

SEQ ID NO: 326469 - RNA, 64 nt, hsa; identical to SEQ ID NO: 42504

SEQ ID NO: 326470 - RNA, 64 nt, hsa; identical to SEQ ID NO: 42505

SEQ ID NO: 326471 - RNA, 64 nt, hsa; identical to SEQ ID NO: 42506

SEQ ID NO: 326472 - RNA, 64 nt, hsa; identical to SEQ ID NO: 42507

SEQ ID NO: 326473 - RNA, 64 nt, hsa; identical to SEQ ID NO: 42508

SEQ ID NO: 326474 - RNA, 64 nt, hsa; identical to SEQ ID NO: 42509

SEQ ID NO: 326475 - RNA, 64 nt, hsa; identical to SEQ ID NO: 42510

SEQ ID NO: 326476 - RNA, 64 nt, hsa; identical to SEQ ID NO: 42511

SEQ ID NO: 326477 - RNA, 64 nt, hsa; identical to SEQ ID NO: 42512

SEQ ID NO: 326478 - RNA, 64 nt, hsa; identical to SEQ ID NO: 42513

SEQ ID NO: 326479 - RNA, 64 nt, hsa; identical to SEQ ID NO: 42514

SEQ ID NO: 326480 - RNA, 64 nt, hsa; identical to SEQ ID NO: 42515

SEQ ID NO: 326481 - RNA, 64 nt, hsa; identical to SEQ ID NO: 42516

SEQ ID NO: 326482 - RNA, 64 nt, hsa; identical to SEQ ID NO: 42517

SEQ ID NO: 326483 - RNA, 64 nt, hsa; identical to SEQ ID NO: 42518

SEQ ID NO: 326484 - RNA, 64 nt, hsa; identical to SEQ ID NO: 42519

SEQ ID NO: 326485 - RNA, 64 nt, hsa; identical to SEQ ID NO: 42520

SEQ ID NO: 326486 - RNA, 64 nt, hsa; identical to SEQ ID NO: 42521

SEQ ID NO: 326487 - RNA, 64 nt, hsa; identical to SEQ ID NO: 42522

SEQ ID NO: 326488 - RNA, 64 nt, hsa; identical to SEQ ID NO: 42523

SEQ ID NO: 326489 - RNA, 64 nt, hsa; identical to SEQ ID NO: 42524

SEQ ID NO: 326490 - RNA, 64 nt, hsa; identical to SEQ ID NO: 42525

SEQ ID NO: 326491 - RNA, 64 nt, hsa; identical to SEQ ID NO: 42526

SEQ ID NO: 326492 - RNA, 64 nt, hsa; identical to SEQ ID NO: 42527

SEQ ID NO: 326493 - RNA, 64 nt, hsa; identical to SEQ ID NO: 42528

SEQ ID NO: 326494 - RNA, 64 nt, hsa; identical to SEQ ID NO: 42529

SEQ ID NO: 326495 - RNA, 64 nt, hsa; identical to SEQ ID NO: 42530

SEQ ID NO: 326496 - RNA, 64 nt, hsa; identical to SEQ ID NO: 42531

SEQ ID NO: 326497 - RNA, 64 nt, hsa; identical to SEQ ID NO: 42532

SEQ ID NO: 326498 - RNA, 64 nt, hsa; identical to SEQ ID NO: 42533

SEQ ID NO: 326499 - RNA, 64 nt, hsa; identical to SEQ ID NO: 42534

SEQ ID NO: 326500 - RNA, 64 nt, hsa; identical to SEQ ID NO: 42535

SEQ ID NO: 326501 - RNA, 64 nt, hsa; identical to SEQ ID NO: 42536

SEQ ID NO: 326502 - RNA, 64 nt, hsa; identical to SEQ ID NO: 42537

SEQ ID NO: 326503 - RNA, 64 nt, hsa; identical to SEQ ID NO: 42538

SEQ ID NO: 326504 - RNA, 64 nt, hsa; identical to SEQ ID NO: 42539

SEQ ID NO: 326505 - RNA, 64 nt, hsa; identical to SEQ ID NO: 42540

SEQ ID NO: 326506 - RNA, 64 nt, hsa; identical to SEQ ID NO: 42541

SEQ ID NO: 326507 - RNA, 64 nt, hsa; identical to SEQ ID NO: 305695

SEQ ID NO: 326508 - RNA, 64 nt, hsa; identical to SEQ ID NO: 305696

SEQ ID NO: 326509 - RNA, 64 nt, hsa; identical to SEQ ID NO: 305697

SEQ ID NO: 326510 - RNA, 64 nt, hsa; identical to SEQ ID NO: 305698

SEQ ID NO: 326511 - RNA, 64 nt, hsa; identical to SEQ ID NO: 305699

SEQ ID NO: 326512 - RNA, 64 nt, hsa; identical to SEQ ID NO: 305700

SEQ ID NO: 326513 - RNA, 64 nt, hsa; identical to SEQ ID NO: 305701

SEQ ID NO: 326514 - RNA, 64 nt, hsa; identical to SEQ ID NO: 305702

SEQ ID NO: 326515 - RNA, 64 nt, hsa; identical to SEQ ID NO: 305703

SEQ ID NO: 326516 - RNA, 64 nt, hsa; identical to SEQ ID NO: 305704

SEQ ID NO: 326517 - RNA, 64 nt, hsa; identical to SEQ ID NO: 305705

SEQ ID NO: 326518 - RNA, 64 nt, hsa; identical to SEQ ID NO: 305706

SEQ ID NO: 326519 - RNA, 64 nt, hsa; identical to SEQ ID NO: 305707

SEQ ID NO: 326520 - RNA, 64 nt, hsa; identical to SEQ ID NO: 305708

SEQ ID NO: 326521 - RNA, 64 nt, hsa; identical to SEQ ID NO: 305709

SEQ ID NO: 326522 - RNA, 64 nt, hsa; identical to SEQ ID NO: 305710

SEQ ID NO: 326523 - RNA, 64 nt, hsa; identical to SEQ ID NO: 305711

SEQ ID NO: 326524 - RNA, 64 nt, hsa; identical to SEQ ID NO: 305712

SEQ ID NO: 326525 - RNA, 64 nt, hsa; identical to SEQ ID NO: 305713

SEQ ID NO: 326526 - RNA, 64 nt, hsa; identical to SEQ ID NO: 305714

SEQ ID NO: 326527 - RNA, 64 nt, hsa; identical to SEQ ID NO: 305715

SEQ ID NO: 326528 - RNA, 64 nt, hsa; identical to SEQ ID NO: 305716

SEQ ID NO: 326529 - RNA, 64 nt, hsa; identical to SEQ ID NO: 305717

SEQ ID NO: 326530 - RNA, 64 nt, hsa; identical to SEQ ID NO: 305718

SEQ ID NO: 326531 - RNA, 64 nt, hsa; identical to SEQ ID NO: 305719

SEQ ID NO: 326532 - RNA, 64 nt, hsa; identical to SEQ ID NO: 305720

SEQ ID NO: 326533 - RNA, 64 nt, hsa; identical to SEQ ID NO: 305721

SEQ ID NO: 326534 - RNA, 64 nt, hsa; identical to SEQ ID NO: 305722

SEQ ID NO: 326535 - RNA, 64 nt, hsa; identical to SEQ ID NO: 305723

SEQ ID NO: 326536 - RNA, 64 nt, hsa; identical to SEQ ID NO: 305724

SEQ ID NO: 326537 - RNA, 64 nt, hsa
accaggcagacagaaccuugcaaacaccuuaacuucuaaccaaagacuuuaaaacucuggcugg

SEQ ID NO: 326538 - RNA, 64 nt, hsa
cucagucuuccgcaggcuuaccugcgccaggaagucuaaccaaggaacaagaaucucacuauca

SEQ ID NO: 326539 - RNA, 64 nt, hsa
aagaggagauaauguggauuaaaaccuuaagaguucuaaccaugccuacuaaauguacagauau

SEQ ID NO: 326540 - RNA, 64 nt, hsa
aaucugauacuuagaccaaaagcaacauucguucucuaaccauucuguauugauuauauaagca

SEQ ID NO: 326541 - RNA, 64 nt, hsa; identical to SEQ ID NO: 206387

SEQ ID NO: 326542 - RNA, 64 nt, hsa; identical to SEQ ID NO: 206388

SEQ ID NO: 326543 - RNA, 64 nt, hsa; identical to SEQ ID NO: 206389

SEQ ID NO: 326544 - RNA, 64 nt, hsa; identical to SEQ ID NO: 206390

SEQ ID NO: 326545 - RNA, 64 nt, hsa; identical to SEQ ID NO: 206391

SEQ ID NO: 326546 - RNA, 64 nt, hsa; identical to SEQ ID NO: 206392

SEQ ID NO: 326547 - RNA, 64 nt, hsa; identical to SEQ ID NO: 206393

SEQ ID NO: 326548 - RNA, 64 nt, hsa; identical to SEQ ID NO: 206394

SEQ ID NO: 326549 - RNA, 64 nt, hsa; identical to SEQ ID NO: 206395

SEQ ID NO: 326550 - RNA, 64 nt, hsa; identical to SEQ ID NO: 206396

SEQ ID NO: 326551 - RNA, 64 nt, hsa; identical to SEQ ID NO: 206397

SEQ ID NO: 326552 - RNA, 64 nt, hsa; identical to SEQ ID NO: 206398

SEQ ID NO: 326553 - RNA, 64 nt, hsa; identical to SEQ ID NO: 206399

SEQ ID NO: 326554 - RNA, 64 nt, hsa; identical to SEQ ID NO: 206400

SEQ ID NO: 326555 - RNA, 64 nt, hsa; identical to SEQ ID NO: 206401

SEQ ID NO: 326556 - RNA, 64 nt, hsa; identical to SEQ ID NO: 206402

SEQ ID NO: 326557 - RNA, 64 nt, hsa; identical to SEQ ID NO: 206403

SEQ ID NO: 326558 - RNA, 64 nt, hsa; identical to SEQ ID NO: 206404

SEQ ID NO: 326559 - RNA, 64 nt, hsa; identical to SEQ ID NO: 206405

SEQ ID NO: 326560 - RNA, 64 nt, hsa; identical to SEQ ID NO: 206406

SEQ ID NO: 326561 - RNA, 64 nt, hsa; identical to SEQ ID NO: 206407

SEQ ID NO: 326562 - RNA, 64 nt, hsa; identical to SEQ ID NO: 206408

SEQ ID NO: 326563 - RNA, 64 nt, hsa; identical to SEQ ID NO: 206409

SEQ ID NO: 326564 - RNA, 64 nt, hsa; identical to SEQ ID NO: 206410

SEQ ID NO: 326565 - RNA, 64 nt, hsa; identical to SEQ ID NO: 206411

SEQ ID NO: 326566 - RNA, 64 nt, hsa; identical to SEQ ID NO: 206412

SEQ ID NO: 326567 - RNA, 64 nt, hsa; identical to SEQ ID NO: 206413

SEQ ID NO: 326568 - RNA, 64 nt, hsa; identical to SEQ ID NO: 206414

SEQ ID NO: 326569 - RNA, 64 nt, hsa; identical to SEQ ID NO: 206415

SEQ ID NO: 326570 - RNA, 64 nt, hsa; identical to SEQ ID NO: 206416

SEQ ID NO: 326571 - RNA, 64 nt, hsa; identical to SEQ ID NO: 206417

SEQ ID NO: 326572 - RNA, 64 nt, hsa; identical to SEQ ID NO: 206418

SEQ ID NO: 326573 - RNA, 64 nt, hsa; identical to SEQ ID NO: 206419

SEQ ID NO: 326574 - RNA, 64 nt, hsa; identical to SEQ ID NO: 206420

SEQ ID NO: 326575 - RNA, 64 nt, hsa; identical to SEQ ID NO: 206421

SEQ ID NO: 326576 - RNA, 64 nt, hsa; identical to SEQ ID NO: 206422

SEQ ID NO: 326577 - RNA, 64 nt, hsa; identical to SEQ ID NO: 206423

SEQ ID NO: 326578 - RNA, 64 nt, hsa
ucauuuauuauuuuauaaauugagaacaaccacaccaccaaaugucacaccuucuuauaaagug

SEQ ID NO: 326579 - RNA, 64 nt, hsa
aagaaauuugaauaguuccugcuuucugcaccucccaccaaaacaaacuuuucaaugaucaaaa

SEQ ID NO: 326580 - RNA, 64 nt, hsa
ggguaagauuugccuuaacaguacuauuuucucgccaccaaaaaaaaaaaaaaaaaaaaaaaaa

SEQ ID NO: 326581 - RNA, 64 nt, hsa
ccuggccaccacaccggccugugccccuugaagcccaccaaagcggcccucacuuguggucagu

SEQ ID NO: 326582 - RNA, 64 nt, hsa
cuugaacccaacagucccuuaugagcgucacugcccaccaaaggucaaugucaagagaggaaga

SEQ ID NO: 326583 - RNA, 64 nt, hsa
gaucauuucugccaugauguuuacaagauggcgaccaccaaagucaaacgacuaaccuaucuau

SEQ ID NO: 326584 - RNA, 64 nt, hsa
aacuguuccguuugucaucugucauggucuccuuccaccaaaucuucaucugggaauagcagcg

SEQ ID NO: 326585 - RNA, 64 nt, hsa
auccguccuuggcucaggauuuggagagcuugcaccaccaaaaauggcaaacaucaccagcucc

SEQ ID NO: 326586 - RNA, 64 nt, hsa
ccaaaaucugugaaaagauuugaaucugauaucuccaccaaagccuugauguuuucucuguaca

SEQ ID NO: 326587 - RNA, 64 nt, hsa
ucagccucucaaguagcgggauuacaggcgcccaccaccaaaaauuagcccagcuaauuuuugu

SEQ ID NO: 326588 - RNA, 64 nt, hsa
uugaccagaaaacaaugauuuuauaauauuuaacccaccaaaaagucccuccaacagcaauauc

SEQ ID NO: 326589 - RNA, 64 nt, hsa
acauucugacacaagaugcaagucugugcaaaacccaccaaaaugcuccuauccaacaauuauu

SEQ ID NO: 326590 - RNA, 64 nt, hsa
cuccugaagccucugggaacuccuccuguggccaccaccaaaggaugaggaaucugaguugcca

SEQ ID NO: 326591 - RNA, 64 nt, hsa
ucacaccccaaaaugacccaacgauguccacacaccaccaaaacccagccaaugggccaccucu

SEQ ID NO: 326592 - RNA, 64 nt, hsa
aauauuccauuuuccuuuccuugugguugaaaaccacagucaguggagagauguuuggaaacca

SEQ ID NO: 326593 - RNA, 64 nt, hsa
gaaaaccacagucaguggagagauguuuggaaaccacagucaguggagccugggugguacccag

SEQ ID NO: 326594 - RNA, 64 nt, hsa
aauccaggacaggacauugugaccaugacccagccacagucaauaccagaaagaugauucagag

SEQ ID NO: 326595 - RNA, 64 nt, hsa
ggggaccugcagagaaccauggcauucccuauuccacagucaucuuuggacagacuuuccucua

SEQ ID NO: 326596 - RNA, 64 nt, hsa
uuuaaaauugccauuauagaugagagcgugcaugcacagucauuuuuguuuaagaguaauauuu

SEQ ID NO: 326597 - RNA, 64 nt, hsa
caaaaaugguuucacguuugcuuaaaugcuucaucacagucacauucaaaauagugacucuaaa

SEQ ID NO: 326598 - RNA, 64 nt, hsa
agagauuuucuuuggccuccuacaggcucacagucacagucaucgcuuuuauagguagacucau

SEQ ID NO: 326599 - RNA, 64 nt, hsa
guuaaaagagauuuucuuuggccuccuacaggcucacagucacagucaucgcuuuuauagguag

SEQ ID NO: 326600 - RNA, 64 nt, hsa
gaaacugagacccagagaggcugaaugacaugcucacagucacacagcaggcaguggcaggcag

SEQ ID NO: 326601 - RNA, 64 nt, hsa
gacugucggccugugaggaugaggacgugucuaucacagucaguaugcccugaaugaaugggug

SEQ ID NO: 326602 - RNA, 64 nt, hsa
cuauaaaccacucaaagauucagcccccagaucccacagucagaacugaaucugcguuguuggg

SEQ ID NO: 326603 - RNA, 64 nt, hsa
guuguuugcuccaggguuauucuccuccucgagucacagucacacgaauaccugccuucucugg

SEQ ID NO: 326604 - RNA, 64 nt, hsa
gucuuucuaaugugguaaaauucuccaucaacaucacagucagcuggcagcugaacuucagaau

SEQ ID NO: 326605 - RNA, 64 nt, hsa
gggaccugccccccaugagccaggacgguccccccacagucagccugugcaaaggccccguggc

SEQ ID NO: 326606 - RNA, 64 nt, hsa
aauuucuucauggaaaucauauacauuagaaaaucacagucagauguuuaaucaauccaaaaug

SEQ ID NO: 326607 - RNA, 64 nt, hsa
aaaacaguccuguguaaacugcuggaaguucuuccacagucaggucaauuuugucaaacccuuc

SEQ ID NO: 326608 - RNA, 64 nt, hsa
gauuagaauucaccuggggacacacacucacacgcacagucacucuuacacauaugccuagucc

SEQ ID NO: 326609 - RNA, 64 nt, hsa
aaacaaacaaaaaaaaucacugaaauuuuucccucacagucaguagcuuuguuugauauuuaac

SEQ ID NO: 326610 - RNA, 64 nt, hsa
gaguuauggcagagguuccacucaucuacaaagucacagucacaugccacauuugaucuccuaa

SEQ ID NO: 326611 - RNA, 64 nt, hsa
uucugcuucaaaaggcucucaacaugaagguuaacacagucaaucaaacuuacauuccugccaa

SEQ ID NO: 326612 - RNA, 64 nt, hsa
ccugagauccagccagagacccuccuccaccauccacagucaauggcugugcuuucccuuccaa

SEQ ID NO: 326613 - RNA, 64 nt, hsa
gggcacaggcugccagagcucccaagccggaguucacagucaucacugugcaggacccagguuc

SEQ ID NO: 326614 - RNA, 64 nt, hsa
uaugaggucagcaaggauaugaugagauuuugcucacagucaugugaaaacaaaaucucagcuc

SEQ ID NO: 326615 - RNA, 64 nt, hsa
aaagccaaguuagugcaggcugagccccuugguucacagucaagccuccuuguuuccuagggug

SEQ ID NO: 326616 - RNA, 64 nt, hsa
guugggcaugauuuguaccauccacccauacccacacagucacagucacacacacauauguauu

SEQ ID NO: 326617 - RNA, 64 nt, hsa
caugauuuguaccauccacccauacccacacagucacagucacacacacauauguauuacuuac

SEQ ID NO: 326618 - RNA, 64 nt, hsa
ccccacaagccugagccaaccugcugccugacgccacagucauuggcagaggucugggcauuau

SEQ ID NO: 326619 - RNA, 64 nt, hsa
ccccugguggcgcuuccuggcgcugcgcccuguccacagucaccuuaggucccuuuggaaacau

SEQ ID NO: 326620 - RNA, 64 nt, hsa
ucugugugguucagcuacuuuccauuugguauuacacagucaaauuuacauuuaucuauuaaaa

SEQ ID NO: 326621 - RNA, 64 nt, hsa
accuuauuggauauuugauauuugguuauuuaaucacagucaucuuuaacagcuuacacugauu

SEQ ID NO: 326622 - RNA, 64 nt, hsa
accgccugcaucuagugcugcuucugcagaucaacacagucaaagcggcucuagcucugauaac

SEQ ID NO: 326623 - RNA, 64 nt, hsa
gcacagcagguuacucagcaguuugugccuccuacacagucaaagaaagagaaaaaagauaaag

SEQ ID NO: 326624 - RNA, 64 nt, hsa
ccgagaaagccugggggacccagacaccuguccccacagucaaagccuggggacccagacaucc

SEQ ID NO: 326625 - RNA, 64 nt, hsa
cagucaaagccuggggacccagacauccuguccccacagucagccuccugucccugcuggugcc

SEQ ID NO: 326626 - RNA, 64 nt, hsa
ugcuagguucucccuucacgccuuuauuaaugcacacagucauugccaugguaucuuucucuca

SEQ ID NO: 326627 - RNA, 64 nt, hsa
ugagauuugagcugugcuggccagcgcauugccucacagucacgccgcagcauggaugugucgc

SEQ ID NO: 326628 - RNA, 64 nt, hsa; identical to SEQ ID NO: 21142

SEQ ID NO: 326629 - RNA, 64 nt, hsa; identical to SEQ ID NO: 21143

SEQ ID NO: 326630 - RNA, 62 nt, hsa
aauuucacuugcuuugaaaguugauuuaauugacugacuaaaugaaaaugccuacccacuca

SEQ ID NO: 326631 - RNA, 62 nt, hsa
aaaauuugcuagugguuugaaaauaauaauguacugacuacauguaugcuguuauugucagu

SEQ ID NO: 326632 - RNA, 64 nt, hsa; identical to SEQ ID NO: 173401

SEQ ID NO: 326633 - RNA, 64 nt, hsa; identical to SEQ ID NO: 173402

SEQ ID NO: 326634 - RNA, 64 nt, hsa; identical to SEQ ID NO: 173403

SEQ ID NO: 326635 - RNA, 64 nt, hsa; identical to SEQ ID NO: 173404

SEQ ID NO: 326636 - RNA, 64 nt, hsa
gagagcucaugcugacugugaugagaaauugcagcaccucuaucucgcagguaauggaguaguu

SEQ ID NO: 326637 - RNA, 64 nt, hsa
uguucuuuggaaugacugcuccacuccacacucacaccucuauucacagaccagcaucuccucu

SEQ ID NO: 326638 - RNA, 64 nt, hsa
accucgucagccuucaggacugaucugccauuuucaccucuaaauccccaugucugaccauuag

SEQ ID NO: 326639 - RNA, 64 nt, hsa
uucagcugccugaaacagccauguccaaguucuucaccucuauccaaagaacuugauuugcaug

SEQ ID NO: 326640 - RNA, 64 nt, hsa
auggcuugacaugugcaauugugagggacaugcucaccucuagccuuaaggggggcagggagug

SEQ ID NO: 326641 - RNA, 64 nt, hsa; identical to SEQ ID NO: 143712

SEQ ID NO: 326642 - RNA, 64 nt, hsa; identical to SEQ ID NO: 143713

SEQ ID NO: 326643 - RNA, 64 nt, hsa; identical to SEQ ID NO: 143714

SEQ ID NO: 326644 - RNA, 64 nt, hsa; identical to SEQ ID NO: 143715

SEQ ID NO: 326645 - RNA, 64 nt, hsa; identical to SEQ ID NO: 143716

SEQ ID NO: 326646 - RNA, 64 nt, hsa; identical to SEQ ID NO: 143717

SEQ ID NO: 326647 - RNA, 64 nt, hsa; identical to SEQ ID NO: 143718

SEQ ID NO: 326648 - RNA, 64 nt, hsa; identical to SEQ ID NO: 143719

SEQ ID NO: 326649 - RNA, 64 nt, hsa; identical to SEQ ID NO: 143720

SEQ ID NO: 326650 - RNA, 64 nt, hsa; identical to SEQ ID NO: 143721

SEQ ID NO: 326651 - RNA, 64 nt, hsa; identical to SEQ ID NO: 143722

SEQ ID NO: 326652 - RNA, 64 nt, hsa; identical to SEQ ID NO: 143723

SEQ ID NO: 326653 - RNA, 64 nt, hsa; identical to SEQ ID NO: 143724

SEQ ID NO: 326654 - RNA, 64 nt, hsa; identical to SEQ ID NO: 143725

SEQ ID NO: 326655 - RNA, 64 nt, hsa; identical to SEQ ID NO: 143726

SEQ ID NO: 326656 - RNA, 64 nt, hsa; identical to SEQ ID NO: 143727

SEQ ID NO: 326657 - RNA, 64 nt, hsa; identical to SEQ ID NO: 143728

SEQ ID NO: 326658 - RNA, 64 nt, hsa; identical to SEQ ID NO: 143729

SEQ ID NO: 326659 - RNA, 64 nt, hsa; identical to SEQ ID NO: 143730

SEQ ID NO: 326660 - RNA, 64 nt, hsa; identical to SEQ ID NO: 143731

SEQ ID NO: 326661 - RNA, 64 nt, hsa; identical to SEQ ID NO: 143732

SEQ ID NO: 326662 - RNA, 64 nt, hsa; identical to SEQ ID NO: 143733

SEQ ID NO: 326663 - RNA, 64 nt, hsa; identical to SEQ ID NO: 143734

SEQ ID NO: 326664 - RNA, 64 nt, hsa; identical to SEQ ID NO: 143735

SEQ ID NO: 326665 - RNA, 64 nt, hsa; identical to SEQ ID NO: 143736

SEQ ID NO: 326666 - RNA, 64 nt, hsa; identical to SEQ ID NO: 143737

SEQ ID NO: 326667 - RNA, 64 nt, hsa; identical to SEQ ID NO: 143738

SEQ ID NO: 326668 - RNA, 64 nt, hsa; identical to SEQ ID NO: 143739

SEQ ID NO: 326669 - RNA, 64 nt, hsa; identical to SEQ ID NO: 143740

SEQ ID NO: 326670 - RNA, 64 nt, hsa; identical to SEQ ID NO: 143741

SEQ ID NO: 326671 - RNA, 64 nt, hsa; identical to SEQ ID NO: 143742

SEQ ID NO: 326672 - RNA, 64 nt, hsa; identical to SEQ ID NO: 143743

SEQ ID NO: 326673 - RNA, 64 nt, hsa; identical to SEQ ID NO: 143744

SEQ ID NO: 326674 - RNA, 64 nt, hsa; identical to SEQ ID NO: 143745

SEQ ID NO: 326675 - RNA, 64 nt, hsa; identical to SEQ ID NO: 143746

SEQ ID NO: 326676 - RNA, 64 nt, hsa; identical to SEQ ID NO: 143747

SEQ ID NO: 326677 - RNA, 64 nt, hsa; identical to SEQ ID NO: 143748

SEQ ID NO: 326678 - RNA, 64 nt, hsa; identical to SEQ ID NO: 143749

SEQ ID NO: 326679 - RNA, 64 nt, hsa; identical to SEQ ID NO: 143750

SEQ ID NO: 326680 - RNA, 64 nt, hsa; identical to SEQ ID NO: 143751

SEQ ID NO: 326681 - RNA, 64 nt, hsa; identical to SEQ ID NO: 143752

SEQ ID NO: 326682 - RNA, 64 nt, hsa; identical to SEQ ID NO: 143753

SEQ ID NO: 326683 - RNA, 64 nt, hsa; identical to SEQ ID NO: 143754

SEQ ID NO: 326684 - RNA, 64 nt, hsa; identical to SEQ ID NO: 143755

SEQ ID NO: 326685 - RNA, 64 nt, hsa; identical to SEQ ID NO: 143756

SEQ ID NO: 326686 - RNA, 64 nt, hsa; identical to SEQ ID NO: 143757

SEQ ID NO: 326687 - RNA, 64 nt, hsa; identical to SEQ ID NO: 143758

SEQ ID NO: 326688 - RNA, 64 nt, hsa; identical to SEQ ID NO: 143759

SEQ ID NO: 326689 - RNA, 64 nt, hsa; identical to SEQ ID NO: 143760

SEQ ID NO: 326690 - RNA, 64 nt, hsa; identical to SEQ ID NO: 143761

SEQ ID NO: 326691 - RNA, 64 nt, hsa; identical to SEQ ID NO: 143762

SEQ ID NO: 326692 - RNA, 64 nt, hsa; identical to SEQ ID NO: 143763

SEQ ID NO: 326693 - RNA, 64 nt, hsa; identical to SEQ ID NO: 143764

SEQ ID NO: 326694 - RNA, 64 nt, hsa; identical to SEQ ID NO: 143765

SEQ ID NO: 326695 - RNA, 64 nt, hsa; identical to SEQ ID NO: 143766

SEQ ID NO: 326696 - RNA, 64 nt, hsa; identical to SEQ ID NO: 143767

SEQ ID NO: 326697 - RNA, 64 nt, hsa; identical to SEQ ID NO: 143768

SEQ ID NO: 326698 - RNA, 64 nt, hsa; identical to SEQ ID NO: 143769

SEQ ID NO: 326699 - RNA, 64 nt, hsa; identical to SEQ ID NO: 143770

SEQ ID NO: 326700 - RNA, 64 nt, hsa; identical to SEQ ID NO: 143771

SEQ ID NO: 326701 - RNA, 64 nt, hsa; identical to SEQ ID NO: 143772

SEQ ID NO: 326702 - RNA, 64 nt, hsa; identical to SEQ ID NO: 143773

SEQ ID NO: 326703 - RNA, 64 nt, hsa; identical to SEQ ID NO: 143774

SEQ ID NO: 326704 - RNA, 64 nt, hsa; identical to SEQ ID NO: 143775

SEQ ID NO: 326705 - RNA, 64 nt, hsa; identical to SEQ ID NO: 143776

SEQ ID NO: 326706 - RNA, 64 nt, hsa; identical to SEQ ID NO: 143777

SEQ ID NO: 326707 - RNA, 64 nt, hsa; identical to SEQ ID NO: 143778

SEQ ID NO: 326708 - RNA, 64 nt, hsa; identical to SEQ ID NO: 143779

SEQ ID NO: 326709 - RNA, 64 nt, hsa; identical to SEQ ID NO: 143780

SEQ ID NO: 326710 - RNA, 64 nt, hsa; identical to SEQ ID NO: 143781

SEQ ID NO: 326711 - RNA, 64 nt, hsa; identical to SEQ ID NO: 143782

SEQ ID NO: 326712 - RNA, 64 nt, hsa; identical to SEQ ID NO: 143783

SEQ ID NO: 326713 - RNA, 64 nt, hsa; identical to SEQ ID NO: 143784

SEQ ID NO: 326714 - RNA, 64 nt, hsa; identical to SEQ ID NO: 143785

SEQ ID NO: 326715 - RNA, 64 nt, hsa; identical to SEQ ID NO: 143786

SEQ ID NO: 326716 - RNA, 64 nt, hsa; identical to SEQ ID NO: 143787

SEQ ID NO: 326717 - RNA, 64 nt, hsa; identical to SEQ ID NO: 143788

SEQ ID NO: 326718 - RNA, 64 nt, hsa; identical to SEQ ID NO: 143789

SEQ ID NO: 326719 - RNA, 57 nt, hsa; identical to SEQ ID NO: 143790

SEQ ID NO: 326720 - RNA, 64 nt, hsa; identical to SEQ ID NO: 143791

SEQ ID NO: 326721 - RNA, 64 nt, hsa; identical to SEQ ID NO: 143792

SEQ ID NO: 326722 - RNA, 64 nt, hsa; identical to SEQ ID NO: 143793

SEQ ID NO: 326723 - RNA, 64 nt, hsa; identical to SEQ ID NO: 143794

SEQ ID NO: 326724 - RNA, 64 nt, hsa; identical to SEQ ID NO: 143795

SEQ ID NO: 326725 - RNA, 64 nt, hsa; identical to SEQ ID NO: 143796

SEQ ID NO: 326726 - RNA, 64 nt, hsa; identical to SEQ ID NO: 143797

SEQ ID NO: 326727 - RNA, 64 nt, hsa; identical to SEQ ID NO: 143798

SEQ ID NO: 326728 - RNA, 64 nt, hsa; identical to SEQ ID NO: 143799

SEQ ID NO: 326729 - RNA, 64 nt, hsa; identical to SEQ ID NO: 143800

SEQ ID NO: 326730 - RNA, 64 nt, hsa; identical to SEQ ID NO: 143801

SEQ ID NO: 326731 - RNA, 64 nt, hsa; identical to SEQ ID NO: 143802

SEQ ID NO: 326732 - RNA, 64 nt, hsa; identical to SEQ ID NO: 143803

SEQ ID NO: 326733 - RNA, 64 nt, hsa; identical to SEQ ID NO: 143804

SEQ ID NO: 326734 - RNA, 64 nt, hsa; identical to SEQ ID NO: 143805

SEQ ID NO: 326735 - RNA, 64 nt, hsa; identical to SEQ ID NO: 143806

SEQ ID NO: 326736 - RNA, 64 nt, hsa; identical to SEQ ID NO: 143807

SEQ ID NO: 326737 - RNA, 64 nt, hsa; identical to SEQ ID NO: 143808

SEQ ID NO: 326738 - RNA, 64 nt, hsa; identical to SEQ ID NO: 143809

SEQ ID NO: 326739 - RNA, 64 nt, hsa; identical to SEQ ID NO: 143810

SEQ ID NO: 326740 - RNA, 64 nt, hsa; identical to SEQ ID NO: 143811

SEQ ID NO: 326741 - RNA, 64 nt, hsa; identical to SEQ ID NO: 143812

SEQ ID NO: 326742 - RNA, 64 nt, hsa; identical to SEQ ID NO: 141176

SEQ ID NO: 326743 - RNA, 64 nt, hsa; identical to SEQ ID NO: 141177

SEQ ID NO: 326744 - RNA, 64 nt, hsa; identical to SEQ ID NO: 141178

SEQ ID NO: 326745 - RNA, 64 nt, hsa; identical to SEQ ID NO: 141179

SEQ ID NO: 326746 - RNA, 64 nt, hsa; identical to SEQ ID NO: 141180

SEQ ID NO: 326747 - RNA, 64 nt, hsa; identical to SEQ ID NO: 141181

SEQ ID NO: 326748 - RNA, 64 nt, hsa; identical to SEQ ID NO: 141182

SEQ ID NO: 326749 - RNA, 64 nt, hsa; identical to SEQ ID NO: 141183

SEQ ID NO: 326750 - RNA, 64 nt, hsa; identical to SEQ ID NO: 141184

SEQ ID NO: 326751 - RNA, 64 nt, hsa; identical to SEQ ID NO: 141185

SEQ ID NO: 326752 - RNA, 64 nt, hsa; identical to SEQ ID NO: 141186

SEQ ID NO: 326753 - RNA, 64 nt, hsa; identical to SEQ ID NO: 141187

SEQ ID NO: 326754 - RNA, 64 nt, hsa; identical to SEQ ID NO: 141188

SEQ ID NO: 326755 - RNA, 64 nt, hsa; identical to SEQ ID NO: 141189

SEQ ID NO: 326756 - RNA, 64 nt, hsa; identical to SEQ ID NO: 141190

SEQ ID NO: 326757 - RNA, 64 nt, hsa; identical to SEQ ID NO: 141191

SEQ ID NO: 326758 - RNA, 64 nt, hsa; identical to SEQ ID NO: 141192

SEQ ID NO: 326759 - RNA, 64 nt, hsa; identical to SEQ ID NO: 141193

SEQ ID NO: 326760 - RNA, 64 nt, hsa; identical to SEQ ID NO: 141194

SEQ ID NO: 326761 - RNA, 64 nt, hsa; identical to SEQ ID NO: 141195

SEQ ID NO: 326762 - RNA, 64 nt, hsa; identical to SEQ ID NO: 141196

SEQ ID NO: 326763 - RNA, 64 nt, hsa; identical to SEQ ID NO: 141197

SEQ ID NO: 326764 - RNA, 64 nt, hsa; identical to SEQ ID NO: 141198

SEQ ID NO: 326765 - RNA, 64 nt, hsa; identical to SEQ ID NO: 141199

SEQ ID NO: 326766 - RNA, 64 nt, hsa; identical to SEQ ID NO: 141200

SEQ ID NO: 326767 - RNA, 64 nt, hsa; identical to SEQ ID NO: 141201

SEQ ID NO: 326768 - RNA, 64 nt, hsa; identical to SEQ ID NO: 141202

SEQ ID NO: 326769 - RNA, 64 nt, hsa; identical to SEQ ID NO: 141203

SEQ ID NO: 326770 - RNA, 64 nt, hsa; identical to SEQ ID NO: 141204

SEQ ID NO: 326771 - RNA, 64 nt, hsa; identical to SEQ ID NO: 141205

SEQ ID NO: 326772 - RNA, 64 nt, hsa; identical to SEQ ID NO: 141206

SEQ ID NO: 326773 - RNA, 64 nt, hsa; identical to SEQ ID NO: 141207

SEQ ID NO: 326774 - RNA, 64 nt, hsa; identical to SEQ ID NO: 141208

SEQ ID NO: 326775 - RNA, 64 nt, hsa; identical to SEQ ID NO: 141209

SEQ ID NO: 326776 - RNA, 64 nt, hsa; identical to SEQ ID NO: 141210

SEQ ID NO: 326777 - RNA, 64 nt, hsa; identical to SEQ ID NO: 141211

SEQ ID NO: 326778 - RNA, 64 nt, hsa; identical to SEQ ID NO: 141212

SEQ ID NO: 326779 - RNA, 64 nt, hsa; identical to SEQ ID NO: 141213

SEQ ID NO: 326780 - RNA, 64 nt, hsa; identical to SEQ ID NO: 141214

SEQ ID NO: 326781 - RNA, 64 nt, hsa; identical to SEQ ID NO: 141215

SEQ ID NO: 326782 - RNA, 64 nt, hsa; identical to SEQ ID NO: 141216

SEQ ID NO: 326783 - RNA, 64 nt, hsa; identical to SEQ ID NO: 141217

SEQ ID NO: 326784 - RNA, 64 nt, hsa; identical to SEQ ID NO: 141218

SEQ ID NO: 326785 - RNA, 64 nt, hsa; identical to SEQ ID NO: 141219

SEQ ID NO: 326786 - RNA, 64 nt, hsa; identical to SEQ ID NO: 141220

SEQ ID NO: 326787 - RNA, 64 nt, hsa; identical to SEQ ID NO: 141221

SEQ ID NO: 326788 - RNA, 64 nt, hsa; identical to SEQ ID NO: 237917

SEQ ID NO: 326789 - RNA, 64 nt, hsa; identical to SEQ ID NO: 237918

SEQ ID NO: 326790 - RNA, 64 nt, hsa; identical to SEQ ID NO: 237919

SEQ ID NO: 326791 - RNA, 64 nt, hsa; identical to SEQ ID NO: 237920

SEQ ID NO: 326792 - RNA, 64 nt, hsa; identical to SEQ ID NO: 237921

SEQ ID NO: 326793 - RNA, 64 nt, hsa; identical to SEQ ID NO: 237922

SEQ ID NO: 326794 - RNA, 64 nt, hsa; identical to SEQ ID NO: 237923

SEQ ID NO: 326795 - RNA, 64 nt, hsa; identical to SEQ ID NO: 237924

SEQ ID NO: 326796 - RNA, 64 nt, hsa; identical to SEQ ID NO: 237925

SEQ ID NO: 326797 - RNA, 64 nt, hsa; identical to SEQ ID NO: 237926

SEQ ID NO: 326798 - RNA, 64 nt, hsa; identical to SEQ ID NO: 237927

SEQ ID NO: 326799 - RNA, 64 nt, hsa; identical to SEQ ID NO: 237928

SEQ ID NO: 326800 - RNA, 64 nt, hsa; identical to SEQ ID NO: 237927

SEQ ID NO: 326801 - RNA, 64 nt, hsa; identical to SEQ ID NO: 237930

SEQ ID NO: 326802 - RNA, 64 nt, hsa; identical to SEQ ID NO: 237931

SEQ ID NO: 326803 - RNA, 64 nt, hsa; identical to SEQ ID NO: 237932

SEQ ID NO: 326804 - RNA, 64 nt, hsa; identical to SEQ ID NO: 237933

SEQ ID NO: 326805 - RNA, 64 nt, hsa; identical to SEQ ID NO: 237934

SEQ ID NO: 326806 - RNA, 64 nt, hsa; identical to SEQ ID NO: 237935

SEQ ID NO: 326807 - RNA, 64 nt, hsa; identical to SEQ ID NO: 237936

SEQ ID NO: 326808 - RNA, 64 nt, hsa; identical to SEQ ID NO: 237937

SEQ ID NO: 326809 - RNA, 64 nt, hsa; identical to SEQ ID NO: 237938

SEQ ID NO: 326810 - RNA, 64 nt, hsa; identical to SEQ ID NO: 237939

SEQ ID NO: 326811 - RNA, 64 nt, hsa; identical to SEQ ID NO: 237940

SEQ ID NO: 326812 - RNA, 64 nt, hsa; identical to SEQ ID NO: 237941

SEQ ID NO: 326813 - RNA, 64 nt, hsa; identical to SEQ ID NO: 237942

SEQ ID NO: 326814 - RNA, 64 nt, hsa; identical to SEQ ID NO: 237943

SEQ ID NO: 326815 - RNA, 64 nt, hsa; identical to SEQ ID NO: 237944

SEQ ID NO: 326816 - RNA, 64 nt, hsa; identical to SEQ ID NO: 237945

SEQ ID NO: 326817 - RNA, 64 nt, hsa; identical to SEQ ID NO: 237946

SEQ ID NO: 326818 - RNA, 64 nt, hsa; identical to SEQ ID NO: 237947

SEQ ID NO: 326819 - RNA, 64 nt, hsa; identical to SEQ ID NO: 237948

SEQ ID NO: 326820 - RNA, 64 nt, hsa; identical to SEQ ID NO: 237949

SEQ ID NO: 326821 - RNA, 64 nt, hsa; identical to SEQ ID NO: 237950

SEQ ID NO: 326822 - RNA, 64 nt, hsa; identical to SEQ ID NO: 237951

SEQ ID NO: 326823 - RNA, 64 nt, hsa; identical to SEQ ID NO: 237952

SEQ ID NO: 326824 - RNA, 64 nt, hsa; identical to SEQ ID NO: 237953

SEQ ID NO: 326825 - RNA, 64 nt, hsa; identical to SEQ ID NO: 237954

SEQ ID NO: 326826 - RNA, 64 nt, hsa; identical to SEQ ID NO: 237955

SEQ ID NO: 326827 - RNA, 64 nt, hsa; identical to SEQ ID NO: 237956

SEQ ID NO: 326828 - RNA, 64 nt, hsa; identical to SEQ ID NO: 237957

SEQ ID NO: 326829 - RNA, 64 nt, hsa; identical to SEQ ID NO: 237958

SEQ ID NO: 326830 - RNA, 64 nt, hsa; identical to SEQ ID NO: 237959

SEQ ID NO: 326831 - RNA, 64 nt, hsa; identical to SEQ ID NO: 237960

SEQ ID NO: 326832 - RNA, 64 nt, hsa; identical to SEQ ID NO: 237961

SEQ ID NO: 326833 - RNA, 64 nt, hsa; identical to SEQ ID NO: 237962

SEQ ID NO: 326834 - RNA, 64 nt, hsa; identical to SEQ ID NO: 237963

SEQ ID NO: 326835 - RNA, 64 nt, hsa; identical to SEQ ID NO: 237964

SEQ ID NO: 326836 - RNA, 64 nt, hsa; identical to SEQ ID NO: 237965

SEQ ID NO: 326837 - RNA, 64 nt, hsa; identical to SEQ ID NO: 237966

SEQ ID NO: 326838 - RNA, 64 nt, hsa; identical to SEQ ID NO: 237967

SEQ ID NO: 326839 - RNA, 63 nt, hsa
uccaccaaauacacagggaagggugaugcagggaagggugacaucaggagucagggcauggac

SEQ ID NO: 326840 - RNA, 63 nt, hsa
cucaaucaagccuuauccaccaaauacacagggaagggugaugcagggaagggugacaucagg

SEQ ID NO: 326841 - RNA, 63 nt, hsa
ccaaaaggagaaagcuauguagaaagauacauuaagggugaaaauagcaauacaguagauuug

SEQ ID NO: 326842 - RNA, 63 nt, hsa
ucauucuggagguccuauuagagaauauuauaaaagggugaccuuguaggaaggaucugaguc

SEQ ID NO: 326843 - RNA, 63 nt, hsa
uuacuuucaaccauaagcgguaauagcagaggaaagggugaagggagucugggcaagcaaagc

SEQ ID NO: 326844 - RNA, 63 nt, hsa
gucuaguagguggaucccauccaguugguuuccaagggugauccugaaacaguguaaaaggag

SEQ ID NO: 326845 - RNA, 63 nt, hsa
cuaggacagcuggcugagaaguggguucaggcgaagggugaagccauguguagcaguuccugc

SEQ ID NO: 326846 - RNA, 63 nt, hsa
auuguauuuguguguuuguguuuguuuuuuuuuaagggugagccaggucuagcccaacagucu

SEQ ID NO: 326847 - RNA, 63 nt, hsa
cuaaucaguugaacuuaacauuuaauaaaaagaaagggugaaauaaacugaagaccauuuuag

SEQ ID NO: 326848 - RNA, 63 nt, hsa
caggacugcacgguuuaacacagcagaguacagaagggugaagaagugagcagaggcuuauga

SEQ ID NO: 326849 - RNA, 63 nt, hsa
uguauaucuggcaugugucccagucacuugcagaagggugacuucuugccagccgcaucgaga

SEQ ID NO: 326850 - RNA, 63 nt, hsa
guggaaggaggucgguuccgaggggguggguguaagggugaggugggggugugugugccgugu

SEQ ID NO: 326851 - RNA, 63 nt, hsa
ugagucaucccuacucccaacaucuggaggggaaagggugauucuggggguccacuugucugu

SEQ ID NO: 326852 - RNA, 63 nt, hsa
aaggaaucaaaugucaucucccaggaguuauucaagggugagcccuuuacuugggauguacag

SEQ ID NO: 326853 - RNA, 64 nt, hsa; identical to SEQ ID NO: 159445

SEQ ID NO: 326854 - RNA, 64 nt, hsa; identical to SEQ ID NO: 159446

SEQ ID NO: 326855 - RNA, 64 nt, hsa; identical to SEQ ID NO: 159447

SEQ ID NO: 326856 - RNA, 64 nt, hsa; identical to SEQ ID NO: 159448

SEQ ID NO: 326857 - RNA, 64 nt, hsa; identical to SEQ ID NO: 159449

SEQ ID NO: 326858 - RNA, 64 nt, hsa; identical to SEQ ID NO: 159450

SEQ ID NO: 326859 - RNA, 64 nt, hsa; identical to SEQ ID NO: 159451

SEQ ID NO: 326860 - RNA, 64 nt, hsa; identical to SEQ ID NO: 159452

SEQ ID NO: 326861 - RNA, 64 nt, hsa; identical to SEQ ID NO: 159453

SEQ ID NO: 326862 - RNA, 64 nt, hsa; identical to SEQ ID NO: 159454

SEQ ID NO: 326863 - RNA, 64 nt, hsa; identical to SEQ ID NO: 159455

SEQ ID NO: 326864 - RNA, 64 nt, hsa; identical to SEQ ID NO: 159456

SEQ ID NO: 326865 - RNA, 64 nt, hsa
ggaauaucaucacugaucccacagaaauacaaacuaccaucagagaauacuacaaacaccucua

SEQ ID NO: 326866 - RNA, 64 nt, hsa
uuaaacuaaagaccuucugcacagcaaaagaaacuaccaucagagucaacaggcaaccuacaaa

SEQ ID NO: 326867 - RNA, 64 nt, hsa
uugauaauacaacuuaaacauguuugcuauaaaauaccaucacaaguaaaugagcuugguguga

SEQ ID NO: 326868 - RNA, 64 nt, hsa
uguguuccucugaacaaagcggagaaaaugaugauaccaucaauauugaaauuaaacuuccaac

SEQ ID NO: 326869 - RNA, 64 nt, hsa; identical to SEQ ID NO: 23640

SEQ ID NO: 326870 - RNA, 64 nt, hsa; identical to SEQ ID NO: 23641

SEQ ID NO: 326871 - RNA, 64 nt, hsa; identical to SEQ ID NO: 23642

SEQ ID NO: 326872 - RNA, 64 nt, hsa; identical to SEQ ID NO: 23643

SEQ ID NO: 326873 - RNA, 64 nt, hsa; identical to SEQ ID NO: 23644

SEQ ID NO: 326874 - RNA, 64 nt, hsa; identical to SEQ ID NO: 23645

SEQ ID NO: 326875 - RNA, 64 nt, hsa; identical to SEQ ID NO: 23646

SEQ ID NO: 326876 - RNA, 64 nt, hsa; identical to SEQ ID NO: 23647

SEQ ID NO: 326877 - RNA, 64 nt, hsa; identical to SEQ ID NO: 23648

SEQ ID NO: 326878 - RNA, 64 nt, hsa; identical to SEQ ID NO: 23649

SEQ ID NO: 326879 - RNA, 64 nt, hsa; identical to SEQ ID NO: 23650

SEQ ID NO: 326880 - RNA, 64 nt, hsa; identical to SEQ ID NO: 23651

SEQ ID NO: 326881 - RNA, 64 nt, hsa; identical to SEQ ID NO: 23652

SEQ ID NO: 326882 - RNA, 64 nt, hsa; identical to SEQ ID NO: 23653

SEQ ID NO: 326883 - RNA, 64 nt, hsa; identical to SEQ ID NO: 23654

SEQ ID NO: 326884 - RNA, 64 nt, hsa; identical to SEQ ID NO: 23655

SEQ ID NO: 326885 - RNA, 64 nt, hsa; identical to SEQ ID NO: 23656

SEQ ID NO: 326886 - RNA, 64 nt, hsa; identical to SEQ ID NO: 23657

SEQ ID NO: 326887 - RNA, 64 nt, hsa; identical to SEQ ID NO: 23658

SEQ ID NO: 326888 - RNA, 64 nt, hsa; identical to SEQ ID NO: 23659

SEQ ID NO: 326889 - RNA, 64 nt, hsa; identical to SEQ ID NO: 23660

SEQ ID NO: 326890 - RNA, 64 nt, hsa; identical to SEQ ID NO: 23661

SEQ ID NO: 326891 - RNA, 64 nt, hsa; identical to SEQ ID NO: 23662

SEQ ID NO: 326892 - RNA, 64 nt, hsa; identical to SEQ ID NO: 23663

SEQ ID NO: 326893 - RNA, 64 nt, hsa; identical to SEQ ID NO: 23664

SEQ ID NO: 326894 - RNA, 64 nt, hsa; identical to SEQ ID NO: 23665

SEQ ID NO: 326895 - RNA, 64 nt, hsa; identical to SEQ ID NO: 23666

SEQ ID NO: 326896 - RNA, 64 nt, hsa; identical to SEQ ID NO: 23667

SEQ ID NO: 326897 - RNA, 64 nt, hsa; identical to SEQ ID NO: 23668

SEQ ID NO: 326898 - RNA, 64 nt, hsa; identical to SEQ ID NO: 23669

SEQ ID NO: 326899 - RNA, 64 nt, hsa; identical to SEQ ID NO: 23670

SEQ ID NO: 326900 - RNA, 64 nt, hsa
gcuguucugaaauuccuaaggaggaauucuuaggaauuccuaaggagaaacagagugaggccuu

SEQ ID NO: 326901 - RNA, 64 nt, hsa
cccaggagaagauacuucagaagggcuguucugaaauuccuaaggaggaauucuuaggaauucc

SEQ ID NO: 326902 - RNA, 64 nt, hsa
ucuaaaauugugguuuaacucacgcaggaaguaaaauuccuauagcaagacauaguuucauuuu

SEQ ID NO: 326903 - RNA, 64 nt, hsa
aaaauaaugaagagaacuuuuaaacuuuuuuaugaauuccuaaacauuaccauuuauguggcag

SEQ ID NO: 326904 - RNA, 64 nt, hsa
aucuaaagcaugaaaccuagcuccucuacacacaaauuccuauggaaauaccuuuguguacagu

SEQ ID NO: 326905 - RNA, 64 nt, hsa
aucaagcucaauacaccaaggaaacuggauccagaauuccuaaacuuuaaaaugguacugucug

SEQ ID NO: 326906 - RNA, 64 nt, hsa
uacuguacuuuuguuuaaauuuaaugaaacaaaaaauuccuaagaaauaccacccuaccacuaa

SEQ ID NO: 326907 - RNA, 64 nt, hsa
uaacuuuauuguuauuauuuauuuucacacauuuaauuccuauuaaguacagccgcaagaaaga

SEQ ID NO: 326908 - RNA, 64 nt, hsa
uggauccaauacacacauuguuacaacuaacacaaauuccuauuaaauauuaaaaguaguucug

SEQ ID NO: 326909 - RNA, 64 nt, hsa
uugaacauaguaaaacuauugaauuucucuuaagaauuccuaauaggucaauagauuuacccuc

SEQ ID NO: 326910 - RNA, 64 nt, hsa
acaggauuauauaacgaaauuuugaauaaacuugaauuccuaaaagauggaaacaggaaaguag

SEQ ID NO: 326911 - RNA, 64 nt, hsa
uugagcauccacgugcuggacgauacuuauuuacaauuccuaaguauuuuugguaccucugaug

SEQ ID NO: 326912 - RNA, 64 nt, hsa
uaccauuccuguaaauguuuugacuuguugcagaaauuccuaucuacuuuauuaagcaguauug

SEQ ID NO: 326913 - RNA, 64 nt, hsa
ggggaaaagggucgaguuagaacaaagcuaaggcaauuccuauugcuuccuugcgcaacuucuc

SEQ ID NO: 326914 - RNA, 64 nt, hsa
gugauggugccugagaccccugccuuagaaacagaauuccuaaggggauugacucucccagcau

SEQ ID NO: 326915 - RNA, 64 nt, hsa
uccauuauugggcagaaucucaguguuuacuuucaauuccuaggauaugugaucgugaaucaga

SEQ ID NO: 326916 - RNA, 64 nt, hsa
uuauuuuguacauguguaauauaucuuuaagguaaauuccuagaaguggaaaugcuagauaaaa

SEQ ID NO: 326917 - RNA, 64 nt, hsa
cuucuugccauucaaaauauguuaaauuucugacaauuccuaauacaaaaaugacccgauuaaa

SEQ ID NO: 326918 - RNA, 64 nt, hsa
guuuugcaauaacuucuauauuuuaauagaaauaaauuccuaaacucccuucccucucucccau

SEQ ID NO: 326919 - RNA, 64 nt, hsa
uucccuuuuaaucaacuguagguuauuuaaaauaaauuccuacaacuuaauggaaacuuaagug

SEQ ID NO: 326920 - RNA, 64 nt, hsa
ugagagagagucagguugcauguucacugccccuaauuccuaaagcaaguuagaaauuuuuagc

SEQ ID NO: 326921 - RNA, 64 nt, hsa
ugagagggauucggguugcguguucacugcccccaauuccuaaagcaaguuagaaguuuuuagc

SEQ ID NO: 326922 - RNA, 64 nt, hsa
ggaaaaacugaguccaacuagauuagcaaauguuaauuccuagcucaaacugugaauaguaagg

SEQ ID NO: 326923 - RNA, 64 nt, hsa
ugaauaaaaggaaaaguuuaucccauauucaaauaauuccuaaggucagccucccuuuuuguaa

SEQ ID NO: 326924 - RNA, 64 nt, hsa
aaaucugcccuacaaaaugcucuucauugguugucucugugagagcacuguccccacccaaccu

SEQ ID NO: 326925 - RNA, 64 nt, hsa
gucucuuacagguauaguuccgugauuaugauagcucugugauuauaagcaacauccccgcccc

SEQ ID NO: 326926 - RNA, 64 nt, hsa
ucccccacuguacccacaggauacaucaucgccccucugugaagguggcuggagcaggccucug

SEQ ID NO: 326927 - RNA, 64 nt, hsa
caugaccuugugaauugugugcuguccuucugugcucugugagaacucgugguacuucaguguc

SEQ ID NO: 326928 - RNA, 64 nt, hsa
acaaggggcuaauccaugagcaguguucuguaggcucugugacaucuuugguuuauaggauuuu

SEQ ID NO: 326929 - RNA, 64 nt, hsa
ugaguuuauuguggaaucuuugaaaggacaaggccucugugaaugaaucagucccagggaagca

SEQ ID NO: 326930 - RNA, 64 nt, hsa
cccuugucuccaguucucucacuacuuuuuccuccucugugagugaccauccaggcagucacca

SEQ ID NO: 326931 - RNA, 64 nt, hsa
cucuccaacugccugcuugcucuuuacagccucucucugugacuggaaucucuccaccucaucg

SEQ ID NO: 326932 - RNA, 64 nt, hsa
gagccacuaucucugcuguccacuuuccuucaggcucugugaauacuucaaccugcugugauuu

SEQ ID NO: 326933 - RNA, 64 nt, hsa
acaagcuacuuaacuugguagccucgauguccuccucugugaaacugggaugauaauaaugccu

SEQ ID NO: 326934 - RNA, 64 nt, hsa
cuuuguaaacuuccaagucauucucaccuaaacccucugugaaauuuguaauauggggaaguag

SEQ ID NO: 326935 - RNA, 64 nt, hsa
ggcagcccagcgucuggaguaucuauaugagaagcucugugaggggacaguaaguacagcuagc

SEQ ID NO: 326936 - RNA, 64 nt, hsa
acugacauacucaggcacagagaaauuucccgagcucugugacaugcugggaacucgcauggaa

SEQ ID NO: 326937 - RNA, 64 nt, hsa
auaacuguccacugcaagagucuggcucucccuucucugugacccggcaugacugggcgccugg

SEQ ID NO: 326938 - RNA, 64 nt, hsa
gacccggcaugacugggcgccuggagcaguuucacucugugaggagugagggaacccuggggcu

SEQ ID NO: 326939 - RNA, 64 nt, hsa
agggcccgcaguguuggcugcugccugccacagccucugugacugcaguggagcggcgaauucc

SEQ ID NO: 326940 - RNA, 64 nt, hsa
ucccucuguaccaucugcuguggaaugcaggacccucugugacauucuuuaucccuucuucccc

SEQ ID NO: 326941 - RNA, 56 nt, hsa
aucgcuacgguuccuacugauccgagcucugugacucaggcuuacgauggugacgg

SEQ ID NO: 326942 - RNA, 64 nt, hsa
acuuccccuccagaaaaacggauggaaggaagcccucugugacacugcuucugagaagaagcau

SEQ ID NO: 326943 - RNA, 64 nt, hsa
gaagcauuuccgggaccgauaucaucugucuggucucugugaacagcaaggaaucuucuugacc

SEQ ID NO: 326944 - RNA, 64 nt, hsa
uucagauuaaucucuucugaaugauguuuuuuuccucugugaugaguuguuucugacuuuuuuc

SEQ ID NO: 326945 - RNA, 64 nt, hsa
uaccucagauuccucugauuuuguaagcugucuucucugugaacguguuuguguguguagggca

SEQ ID NO: 326946 - RNA, 64 nt, hsa
ccuuggccugcacggucuguaguugacuccaagucucugugagcagugacuugaaccaaacaca

SEQ ID NO: 326947 - RNA, 64 nt, hsa
ugucuuaauguucaucucuuuuccacugcccauccucugugaacccauaccucucuagauggag

SEQ ID NO: 326948 - RNA, 64 nt, hsa
cccagcugugugucaccagcagcuuucccagcuucucugugagggucacugcugcccacugcag

SEQ ID NO: 326949 - RNA, 64 nt, hsa
cccagcugugugucaccagaagcuuucccggcuucucugugaggggucccaccagcccagggcu

SEQ ID NO: 326950 - RNA, 64 nt, hsa
ccucugugacgccaguucucccugacucuggaaccucugugauccuuugcagguuuuuuauugg

SEQ ID NO: 326951 - RNA, 64 nt, hsa
agcugcuccucucaguucucccugacucuggaaccucugugacgccaguucucccugacucugg

SEQ ID NO: 326952 - RNA, 64 nt, hsa
cgaggcguguggauugguuuccacccggaacaggcucugugauggcugaauggaaagaaacgua

SEQ ID NO: 326953 - RNA, 64 nt, hsa
cccuggaugaggugaugauuucccgucccaaggacucugugaaguuuagaguacaguuuguugg

SEQ ID NO: 326954 - RNA, 64 nt, hsa
gugguuugaauagauugcuuuuaaggucuuucugcucugugauuccuugauaauacauuucuuu

SEQ ID NO: 326955 - RNA, 64 nt, hsa
ucaccaucuuugcucuguuuugaaagucaggcuucucugugacugugaagccugcuguucccug

SEQ ID NO: 326956 - RNA, 64 nt, hsa
cuuuggaaaccuuuuaaaaaugcauuuuugcaaaacaagauaacauauauugauaaaaagugac

SEQ ID NO: 326957 - RNA, 64 nt, hsa
agagauagugguguuuacugcugcagcauguaucacaagauaagaaaugaaaaaucaaucuuuc

SEQ ID NO: 326958 - RNA, 64 nt, hsa
uuucuuuguguucccagugucuugcccaguagauacaagauaaauauugccagaaucagauauc

SEQ ID NO: 326959 - RNA, 64 nt, hsa
caggccccucccacaacauggaauaaugggagauacaagauauuuggguggagacacagagcca

SEQ ID NO: 326960 - RNA, 64 nt, hsa
auagagcuuggucaaccucuauacuacacauauuacaagauauagcacuuucaaaaugaaucua

SEQ ID NO: 326961 - RNA, 64 nt, hsa
auuaaauaaaaguaguuuagaauuugggccucagacaagauauugaaccucauucaguuucacu

SEQ ID NO: 326962 - RNA, 64 nt, hsa
cuauucaauagcucagagguugaacucugguuaaacaagauaauauguuauuaauaaaaauaga

SEQ ID NO: 326963 - RNA, 64 nt, hsa
aagaagcaaauuuauaccuauuuguguauuaagcacaagauaaagaacagcuguuaauauuuuu

SEQ ID NO: 326964 - RNA, 64 nt, hsa
auaaguacuagaugcaucacuggguguugaucuuacaagauauugaugauaacacuuaaaauug

SEQ ID NO: 326965 - RNA, 64 nt, hsa
aacuucaguugaucuucuucauccaacuuccaagacaagauaccggugcuucuggaaacuacca

SEQ ID NO: 326966 - RNA, 64 nt, hsa
uggacuguaauuuaugauuuuucaaaaucauguuacaagauagacauauucuacuuagacguua

SEQ ID NO: 326967 - RNA, 64 nt, hsa
aagacagacacaaagggcagaaggugcggucucaacaagauaccaggugaauuguucugagugu

SEQ ID NO: 326968 - RNA, 64 nt, hsa; identical to SEQ ID NO: 172960

SEQ ID NO: 326969 - RNA, 64 nt, hsa; identical to SEQ ID NO: 172961

SEQ ID NO: 326970 - RNA, 64 nt, hsa; identical to SEQ ID NO: 172962

SEQ ID NO: 326971 - RNA, 64 nt, hsa; identical to SEQ ID NO: 172963

SEQ ID NO: 326972 - RNA, 64 nt, hsa; identical to SEQ ID NO: 172964

SEQ ID NO: 326973 - RNA, 64 nt, hsa; identical to SEQ ID NO: 172965

SEQ ID NO: 326974 - RNA, 64 nt, hsa; identical to SEQ ID NO: 195921

SEQ ID NO: 326975 - RNA, 64 nt, hsa; identical to SEQ ID NO: 195922

SEQ ID NO: 326976 - RNA, 64 nt, hsa; identical to SEQ ID NO: 195923

SEQ ID NO: 326977 - RNA, 64 nt, hsa; identical to SEQ ID NO: 195924

SEQ ID NO: 326978 - RNA, 64 nt, hsa; identical to SEQ ID NO: 195925

SEQ ID NO: 326979 - RNA, 64 nt, hsa; identical to SEQ ID NO: 195926

SEQ ID NO: 326980 - RNA, 64 nt, hsa; identical to SEQ ID NO: 195927

SEQ ID NO: 326981 - RNA, 64 nt, hsa; identical to SEQ ID NO: 195928

SEQ ID NO: 326982 - RNA, 64 nt, hsa; identical to SEQ ID NO: 195929

SEQ ID NO: 326983 - RNA, 64 nt, hsa; identical to SEQ ID NO: 195930

SEQ ID NO: 326984 - RNA, 64 nt, hsa; identical to SEQ ID NO: 195931

SEQ ID NO: 326985 - RNA, 64 nt, hsa; identical to SEQ ID NO: 195932

SEQ ID NO: 326986 - RNA, 64 nt, hsa; identical to SEQ ID NO: 195933

SEQ ID NO: 326987 - RNA, 64 nt, hsa; identical to SEQ ID NO: 195934

SEQ ID NO: 326988 - RNA, 53 nt, hsa; identical to SEQ ID NO: 244527

SEQ ID NO: 326989 - RNA, 64 nt, hsa; identical to SEQ ID NO: 244528

SEQ ID NO: 326990 - RNA, 64 nt, hsa; identical to SEQ ID NO: 244529

SEQ ID NO: 326991 - RNA, 64 nt, hsa; identical to SEQ ID NO: 244530

SEQ ID NO: 326992 - RNA, 64 nt, hsa; identical to SEQ ID NO: 244531

SEQ ID NO: 326993 - RNA, 64 nt, hsa; identical to SEQ ID NO: 244532

SEQ ID NO: 326994 - RNA, 64 nt, hsa; identical to SEQ ID NO: 244533

SEQ ID NO: 326995 - RNA, 64 nt, hsa; identical to SEQ ID NO: 244534

SEQ ID NO: 326996 - RNA, 64 nt, hsa; identical to SEQ ID NO: 244535

SEQ ID NO: 326997 - RNA, 64 nt, hsa; identical to SEQ ID NO: 244536

SEQ ID NO: 326998 - RNA, 64 nt, hsa; identical to SEQ ID NO: 244537

SEQ ID NO: 326999 - RNA, 64 nt, hsa; identical to SEQ ID NO: 244538

SEQ ID NO: 327000 - RNA, 64 nt, hsa; identical to SEQ ID NO: 244539

SEQ ID NO: 327001 - RNA, 64 nt, hsa; identical to SEQ ID NO: 244540

SEQ ID NO: 327002 - RNA, 64 nt, hsa; identical to SEQ ID NO: 244541

SEQ ID NO: 327003 - RNA, 64 nt, hsa; identical to SEQ ID NO: 229347

SEQ ID NO: 327004 - RNA, 64 nt, hsa; identical to SEQ ID NO: 229348

SEQ ID NO: 327005 - RNA, 64 nt, hsa; identical to SEQ ID NO: 229349

SEQ ID NO: 327006 - RNA, 64 nt, hsa; identical to SEQ ID NO: 229350

SEQ ID NO: 327007 - RNA, 64 nt, hsa; identical to SEQ ID NO: 229351

SEQ ID NO: 327008 - RNA, 64 nt, hsa; identical to SEQ ID NO: 229352

SEQ ID NO: 327009 - RNA, 64 nt, hsa; identical to SEQ ID NO: 229353

SEQ ID NO: 327010 - RNA, 64 nt, hsa; identical to SEQ ID NO: 229354

SEQ ID NO: 327011 - RNA, 64 nt, hsa; identical to SEQ ID NO: 229355

SEQ ID NO: 327012 - RNA, 64 nt, hsa; identical to SEQ ID NO: 229356

SEQ ID NO: 327013 - RNA, 64 nt, hsa; identical to SEQ ID NO: 229357

SEQ ID NO: 327014 - RNA, 64 nt, hsa; identical to SEQ ID NO: 229358

SEQ ID NO: 327015 - RNA, 64 nt, hsa; identical to SEQ ID NO: 229359

SEQ ID NO: 327016 - RNA, 64 nt, hsa; identical to SEQ ID NO: 229360

SEQ ID NO: 327017 - RNA, 64 nt, hsa; identical to SEQ ID NO: 229361

SEQ ID NO: 327018 - RNA, 64 nt, hsa
uguggcuugcuucccccagggcagcacaggcuaagucaggaacaucggaugccagggagggagg

SEQ ID NO: 327019 - RNA, 64 nt, hsa
ucacccacacaguaggugcugagaguuaggacaggucaggaagucccccaggguccacaaaggu

SEQ ID NO: 327020 - RNA, 64 nt, hsa
uaaaccuagaaaaacggguaguaaacuguggauagucaggaaaacacccagcaagggacacagc

SEQ ID NO: 327021 - RNA, 64 nt, hsa
auagucaggaaaacacccagcaagggacacagcugucaggaaaugaaucuuccccccaaccccc

SEQ ID NO: 327022 - RNA, 64 nt, hsa
gggcauugucaguauccguccugaacggggccuagucaggaagcggucuagaaguguacgguca

SEQ ID NO: 327023 - RNA, 64 nt, hsa
gcaaauauucagaagaucuuuugcauuuucuucugucaggaauggggaaggggagugggggcac

SEQ ID NO: 327024 - RNA, 64 nt, hsa
agcaguggcaagggacggagaggucccaacaggagucaggaagagguuugauuauaaccaagaa

SEQ ID NO: 327025 - RNA, 64 nt, hsa
aauuccuguuuucauggguccuguagauguuugagucaggaagguaaggcggggagugacugaa

SEQ ID NO: 327026 - RNA, 64 nt, hsa
cuuggagcacauugauuuuucaaaagccagcucugucaggaaaggaggugcuguuaugagcagc

SEQ ID NO: 327027 - RNA, 64 nt, hsa
aaggauuuuuaaauuuuuuauggguagaauuguagucaggaaaacagaaagggcuugaaauuua

SEQ ID NO: 327028 - RNA, 64 nt, hsa
ugggggcuguaggaggaggcagggauuccagggugucaggaaggcaggggugccaggucccacc

SEQ ID NO: 327029 - RNA, 64 nt, hsa
ugggggcucuaggaggaggcagggacuccagggugucaggaaggcaggggugccgggucccacc

SEQ ID NO: 327030 - RNA, 64 nt, hsa
aaggucugaggugggucugaaauucauacaugaagucaggaaaagaaaagaaacuuaguucuac

SEQ ID NO: 327031 - RNA, 64 nt, hsa
aacaaauucugacuugcagaaaugcagacauacagucaggaaagaacaaacuucaauuaaaugu

SEQ ID NO: 327032 - RNA, 64 nt, hsa
cagagaauucacacuggugagaaacccuuugaaugucaggaauguaggaaggccuuuaggcaga

SEQ ID NO: 327033 - RNA, 64 nt, hsa
cuauagaacucauacuaaugagaaaccuaugaaugucaggaaugcagcaaggccuuuaagcaga

SEQ ID NO: 327034 - RNA, 64 nt, hsa
ucgggccccuccguucugucucccucgacuccaagucaggaauaccgugggcuuccugcccuca

SEQ ID NO: 327035 - RNA, 64 nt, hsa
uuacugcugaggcuucauucaguccugccccuuagucaggaaugcaguuuauucuacuccaaga

SEQ ID NO: 327036 - RNA, 64 nt, hsa; identical to SEQ ID NO: 100727

SEQ ID NO: 327037 - RNA, 64 nt, hsa; identical to SEQ ID NO: 100728

SEQ ID NO: 327038 - RNA, 64 nt, hsa; identical to SEQ ID NO: 100729

SEQ ID NO: 327039 - RNA, 64 nt, hsa; identical to SEQ ID NO: 100730

SEQ ID NO: 327040 - RNA, 64 nt, hsa; identical to SEQ ID NO: 100731

SEQ ID NO: 327041 - RNA, 64 nt, hsa; identical to SEQ ID NO: 100732

SEQ ID NO: 327042 - RNA, 64 nt, hsa; identical to SEQ ID NO: 243458

SEQ ID NO: 327043 - RNA, 64 nt, hsa; identical to SEQ ID NO: 243459

SEQ ID NO: 327044 - RNA, 64 nt, hsa; identical to SEQ ID NO: 243460

SEQ ID NO: 327045 - RNA, 64 nt, hsa; identical to SEQ ID NO: 243461

SEQ ID NO: 327046 - RNA, 64 nt, hsa; identical to SEQ ID NO: 243462

SEQ ID NO: 327047 - RNA, 64 nt, hsa; identical to SEQ ID NO: 256768

SEQ ID NO: 327048 - RNA, 64 nt, hsa; identical to SEQ ID NO: 256769

SEQ ID NO: 327049 - RNA, 64 nt, hsa; identical to SEQ ID NO: 256770

SEQ ID NO: 327050 - RNA, 64 nt, hsa; identical to SEQ ID NO: 256771

SEQ ID NO: 327051 - RNA, 64 nt, hsa; identical to SEQ ID NO: 256772

SEQ ID NO: 327052 - RNA, 64 nt, hsa; identical to SEQ ID NO: 256773

SEQ ID NO: 327053 - RNA, 64 nt, hsa; identical to SEQ ID NO: 256774

SEQ ID NO: 327054 - RNA, 64 nt, hsa; identical to SEQ ID NO: 256775

SEQ ID NO: 327055 - RNA, 64 nt, hsa; identical to SEQ ID NO: 256776

SEQ ID NO: 327056 - RNA, 64 nt, hsa; identical to SEQ ID NO: 256777

SEQ ID NO: 327057 - RNA, 64 nt, hsa; identical to SEQ ID NO: 256778

SEQ ID NO: 327058 - RNA, 64 nt, hsa; identical to SEQ ID NO: 256779

SEQ ID NO: 327059 - RNA, 64 nt, hsa; identical to SEQ ID NO: 256780

SEQ ID NO: 327060 - RNA, 64 nt, hsa; identical to SEQ ID NO: 256781

SEQ ID NO: 327061 - RNA, 64 nt, hsa
caccggugucccccagcagccuggggucugacaauaccucgagccacaaccgaccagaugccag

SEQ ID NO: 327062 - RNA, 64 nt, hsa
ggaagacacaugauuaaugauuuagcucccuccauaccucgaacaucaguugggaucccuccuc

SEQ ID NO: 327063 - RNA, 52 nt, hsa
agcggccugaaggccucugagcuaccucgacuuuggacagaguaaugacucc

SEQ ID NO: 327064 - RNA, 64 nt, hsa
uuucuaggaguuacacauacauuuuauccugucauaccucgagauaaaguggcauguuagugag

SEQ ID NO: 327065 - RNA, 64 nt, hsa
uucuagcucaccugggaaauaacagcagaaccucuaccucgaacuaaagaccuauuggggcugg

SEQ ID NO: 327066 - RNA, 64 nt, hsa
agcgaggagggcaagcggccucccagcucccugguaccucgaggcaccauuccagccagggacg

SEQ ID NO: 327067 - RNA, 64 nt, hsa
ccuuguucuuugauucagcccuuucaaacaugcuuaccucgagugacccagugacaucaguggc

SEQ ID NO: 327068 - RNA, 64 nt, hsa
uugucauuugccuauucagacuuuuaccaaguuguaccucgagaucacauguccguuuucuuuc

SEQ ID NO: 327069 - RNA, 64 nt, hsa
cacuugaugucugaggauaccuuccaucucaaccuaccucgaguggcgaguccagacaccauca

SEQ ID NO: 327070 - RNA, 64 nt, hsa
ucacgccucggccugggagccuggccucuugauauaccucgagcuuccccugugcuccccagcc

SEQ ID NO: 327071 - RNA, 64 nt, hsa
uuuaaccccuagucagagcauuucagccguuugcuaccucgauuccuccuguguuggacagagg

SEQ ID NO: 327072 - RNA, 64 nt, hsa
cccccaaguggugcuuguuggaagagugcuuacuuaccucgagagaauuuacaggaguccacau

SEQ ID NO: 327073 - RNA, 64 nt, hsa
cucauuccucccuaaaauguauaaaaccaagcuguaccucgaccaccuugggcacauguuccca

SEQ ID NO: 327074 - RNA, 64 nt, hsa
cccaugagcaguuguaaaacagguggauaccaacuaccucgaagcaaauuggugaaagaaaagg

SEQ ID NO: 327075 - RNA, 64 nt, hsa
ucauaaucauaaugcggcccccuuccccagagcuuaccucgaaugugaaaucccuacuucuuau

SEQ ID NO: 327076 - RNA, 64 nt, hsa
aaacucagagugggguggggagcauguucauuuguaccucgaguuuuaaacugguuccuaggga

SEQ ID NO: 327077 - RNA, 64 nt, hsa
ggaaaagagaagacuguuuuacaccuggaaaauuuaccucgauuuuuaagaacacacauugcca

SEQ ID NO: 327078 - RNA, 64 nt, hsa
uuuucagccuuguggagccugucagucgccaucauaccucgagugaggcccagcuagauaauga

SEQ ID NO: 327079 - RNA, 64 nt, hsa
ucuaagacaacaguaugcugcuauagccgucugcuaccucgagaagccauggccugccugccuu

SEQ ID NO: 327080 - RNA, 64 nt, hsa
guagggccuggggugaauucccugucccccaugguaccucgagaggggcuggggagcucagcuu

SEQ ID NO: 327081 - RNA, 64 nt, hsa
ccacaaggggaagaaauguacaugaagucuccauuaccucgaauuuuuuucucagucucacugg

SEQ ID NO: 327082 - RNA, 64 nt, hsa
auuaagcuuuugccagaaaauguugcauguguuuuaccucgacuugcuaaaaucgauuagcaga

SEQ ID NO: 327083 - RNA, 64 nt, hsa
uauuaacgcuccaagaguauuauuaacgcugcuguaccucgaucugaaucugccggggccccag

SEQ ID NO: 327084 - RNA, 64 nt, hsa
agucaucccucuuguaugcugggccugguugcccuaccucgaacaagcaccagcuuuucacaca

SEQ ID NO: 327085 - RNA, 60 nt, hsa
gcaucgacugggaggacuaguucguagccauaccucgagucccugcauuggacggcucug

SEQ ID NO: 327086 - RNA, 64 nt, hsa
gaaauuuaaugauguguucaacuccaccagaaauuaccucgagucagcauugacgauauuggag

SEQ ID NO: 327087 - RNA, 64 nt, hsa
uuucuuuccccggagucccuccaccccauaacaauaccucgaauuuccaaaagaggucaccaga

SEQ ID NO: 327088 - RNA, 64 nt, hsa
aagaaacagaaaacgugucucagauggcuggcuuuaccucgauagcauaagagagaccuaagac

SEQ ID NO: 327089 - RNA, 64 nt, hsa
accccacaacuuggggaucuagcugagacauuucuaccucgaacaagucacauguaccacaggu

SEQ ID NO: 327090 - RNA, 64 nt, hsa
ccgccuggccaggccuccuggccgccacgcagaauaccucgaaccaggcgggcugugaaccagc

SEQ ID NO: 327091 - RNA, 64 nt, hsa
ccauccccucacguuucagaacuuccaggcuuucuaccucgacucucaccacagccagcacaua

SEQ ID NO: 327092 - RNA, 64 nt, hsa
aggacuguggagacguaaauguaaacugugacucuaccucgacccuguuucuuauuuuucuucu

SEQ ID NO: 327093 - RNA, 64 nt, hsa
ugccgaggagaagacgggccucgguggcgaccauuaccucgacacccgcuaacaaaugaggccc

SEQ ID NO: 327094 - RNA, 64 nt, hsa
aacugaggucacuggguucuagaacccccacauuuaccucgaggcucuuccauccccaaacugu

SEQ ID NO: 327095 - RNA, 64 nt, hsa
ggcaguugcuugaggcuccagacauacucaccucuaccucgaccacaucaaccccaucaccaag

SEQ ID NO: 327096 - RNA, 64 nt, hsa
uccucaucugucaaaugggguuaauaacagaaccuaccucgaagaguugugaggcuaaaaaggg

SEQ ID NO: 327097 - RNA, 64 nt, hsa
ugcucaucaaccucagagacacugcuuuccaacuuaccucgagucccaggggaggaaaaugaaa

SEQ ID NO: 327098 - RNA, 64 nt, hsa
cuuuugggccacagacaucauugcuguuccccguuaccucgagcugacucuagaggggaaggca

SEQ ID NO: 327099 - RNA, 64 nt, hsa
ggcaugaaaauuguguuacuauaaugccuuauuuuaccucgagaauuguuaccuuaaauuagua

SEQ ID NO: 327100 - RNA, 64 nt, hsa
ggccgcccuagugcgcaggggcuggcgcugcggcuaccucgagugcuccgccaaguacaacugg

SEQ ID NO: 327101 - RNA, 64 nt, hsa
cuguagccuuuuuggauaaaauuggguuuuaacauaccucgaguccaacuaaucucauuaaaca

SEQ ID NO: 327102 - RNA, 64 nt, hsa
ugggagcuacuucucgguucccuccccgauggucuaccucgaagggagggcuggcucccaguua

SEQ ID NO: 327103 - RNA, 64 nt, hsa
aaaaaagaaugcuguuccugcaccugccgguuauuuccaagaagcugaaucuuugggacugauu

SEQ ID NO: 327104 - RNA, 64 nt, hsa
acagaguuuaaacuauuuucuuguccccaccaccuuccaagaaccugcgaggguaguaaucauc

SEQ ID NO: 327105 - RNA, 64 nt, hsa
uuagauacugaaaggugcuaugcuucuguuauuauuccaagacuggagauaggcagggcuaaaa

SEQ ID NO: 327106 - RNA, 64 nt, hsa
aaaauagaaauuagugcccuuuugugaccucucauuccaagauugucaauuaaaaaugaguuua

SEQ ID NO: 327107 - RNA, 64 nt, hsa
auggaggcaaggggaacaaagagcaugagucuuuuuccaagaaaacuggugaguuaaguaagau

SEQ ID NO: 327108 - RNA, 64 nt, hsa
caggauggaaacagucaggcacugacuggggugcuuccaagaggcaugagagugccuacucugg

SEQ ID NO: 327109 - RNA, 64 nt, hsa
caauagcagaaaauuggcaagauguauuuuuacuuuccaagaugccgugugugccaagaauaaa

SEQ ID NO: 327110 - RNA, 64 nt, hsa
aaaagaaaauuguuaguuuaaauuguuuucuuucuuccaagaaagaagccacuuaaauaagcuu

SEQ ID NO: 327111 - RNA, 64 nt, hsa
uaguagucacuuguuuucauuaucauaauugaauuuccaagaacaacuugauaucauucagcug

SEQ ID NO: 327112 - RNA, 64 nt, hsa
auaagaaagggcaaaaaauucauuugaaccaguuuuccaagaacaaaucuugcacaagcaaagu

SEQ ID NO: 327113 - RNA, 64 nt, hsa
caagguuuguacaaauucuacuaccugacauuuauuccaagaagaucuggaaaguuaaauaaau

SEQ ID NO: 327114 - RNA, 64 nt, hsa
auaaaaucccuuaauuugaccucuauaucuuaaauuccaagauguuuaaauuugcuaguugcau

SEQ ID NO: 327115 - RNA, 64 nt, hsa
gccaucagcuaggaagaaacgugggagaugugaauuccaagaguugccuggacagggcaaguca

SEQ ID NO: 327116 - RNA, 64 nt, hsa
uggacagggcaagucauguuagcgugggucacacuuccaagauauuuaaagcaaauacaaaaca

SEQ ID NO: 327117 - RNA, 64 nt, hsa
acuacacccuagcagaucagcugaguguacuuuauuccaagaacuuacuggaucucugguuuuu

SEQ ID NO: 327118 - RNA, 64 nt, hsa
accaccagauggcagagugaccgcgcauaccugcuuccaagaauaaaacaguucugaaaagcaa

SEQ ID NO: 327119 - RNA, 64 nt, hsa
gcacggcggcaaguuuucaagcacugaguuucuauuccaagaucauagacuuacuaaagagagu

SEQ ID NO: 327120 - RNA, 64 nt, hsa
uguuaauuuguuagaauucuaacacacuauauacuuccaagaaguaugucaaugucaauauuuu

SEQ ID NO: 327121 - RNA, 64 nt, hsa
guagcagaaaacuacuuauguccuuuucuugccuuuccaagaaaaauguuuuuuguuuuuuuuu

SEQ ID NO: 327122 - RNA, 64 nt, hsa
agauaaaauagagcacaaacugugaagugcaucuuuccaagaccaucauggaccagguccucua

SEQ ID NO: 327123 - RNA, 64 nt, hsa
gggggcuagaaccaucuuccauauuuccaagauuuuccaagaugaagccagugcuagcugagaa

SEQ ID NO: 327124 - RNA, 64 nt, hsa
uucuguauuugggggcuagaaccaucuuccauauuuccaagauuuuccaagaugaagccagugc

SEQ ID NO: 327125 - RNA, 64 nt, hsa
auugcaauaucugaagcccucccagguguuaacauuccaagacucuagaguccaagguuuaaag

SEQ ID NO: 327126 - RNA, 64 nt, hsa
agggucgaaagcucuagaaucugcaauucaaaaguuccaagagucuaaagauggaguuucuaag

SEQ ID NO: 327127 - RNA, 64 nt, hsa
cagccauacagaacaaaugagaaauuagaagcgauuccaagaacgugugauggugugaaaccca

SEQ ID NO: 327128 - RNA, 64 nt, hsa
gaaacaaagaggggaagauaugggagcgaauuuauuccaagaaucuacaaugacauugaaguug

SEQ ID NO: 327129 - RNA, 64 nt, hsa
ggcuaugcucacgggaggcugggcaccacaguguuuccaagagcaagcuggauccgaguagauu

SEQ ID NO: 327130 - RNA, 64 nt, hsa
gaccuguuuuagaaggagccuaggcugaauuugauuccaagagagcuuaggaugacagcacccc

SEQ ID NO: 327131 - RNA, 64 nt, hsa
gcuaccaacccauucaaagaggacauaugauucuuuccaagaugaacuugaagauuacauaaaa

SEQ ID NO: 327132 - RNA, 64 nt, hsa
gcaguuaccucauucaaagaagacauaugacucuuuccaagaugaacuugaagauuacaucaaa

SEQ ID NO: 327133 - RNA, 64 nt, hsa
aggugccgaggggccacugcuggggguucaugggaucccgaaggagcaagcagucggcagcacc

SEQ ID NO: 327134 - RNA, 64 nt, hsa
aaggucucccauguaccagagaaggaaaagucugaucccgaaacagcuugaacgaaaggugguu

SEQ ID NO: 327135 - RNA, 64 nt, hsa
aggaaagagcaaguuugcucagucaagugaucagaucccgaaucuagauucccaguucuaaggc

SEQ ID NO: 327136 - RNA, 64 nt, hsa
accugauaccaagaagacaacuugagccacuuggaucccgaagugggcuucccgggaaaccucg

SEQ ID NO: 327137 - RNA, 64 nt, hsa
cugcaggcggaguuuucagaggaugcaauuuuggaucccgaauuuugauguaccuuaaacuucc

SEQ ID NO: 327138 - RNA, 64 nt, hsa
cuuacuccauuugaccagauuguuuggcuaacacaucccgaagaaugauuuugucaggaauuau

SEQ ID NO: 327139 - RNA, 64 nt, hsa
ccugugugccugcaguugucagggaccauuugggaucccgaaucucauucucuaaaacugcuuu

SEQ ID NO: 327140 - RNA, 64 nt, hsa
gagcgucucugaaauugagucucggucaugacuuaucccgaaguagagcaauguguuuccucuc

SEQ ID NO: 327141 - RNA, 50 nt, hsa
cccggcaagcacgcaacuaaaucccgaaauacaaaaaguaacacagugga

SEQ ID NO: 327142 - RNA, 64 nt, hsa
agcagccacagccaggcuucugucauacagguagaucccgaagcacagagacauaaaaaagguc

SEQ ID NO: 327143 - RNA, 64 nt, hsa
gggauggggguacucaauggaguaugucugauggaucccgaagaauggagaggaacacaggcgc

SEQ ID NO: 327144 - RNA, 64 nt, hsa
uuucacuuguauacuacucuuacaauggaaaaaaaucccgaaaacuguauacuucugauuaaau

SEQ ID NO: 327145 - RNA, 64 nt, hsa
uacugcuaggcccagcacaaugaacagauuuaccaucccgaagaaccaacuccuacaaaugaga

SEQ ID NO: 327146 - RNA, 64 nt, hsa
auacguauguguuuucuuaguaaaaugguaauuuaucccgaaaaaguguacauagaucuaaaau

SEQ ID NO: 327147 - RNA, 64 nt, hsa
gaggagugagcagccggcacagccuccugggaggaucccgaaguagggacuggggcugagagca

SEQ ID NO: 327148 - RNA, 64 nt, hsa
uacgcauuguucaaacugaaggaaauuucuaauaaucccgaauaaugaacguagaaaucuaucu

SEQ ID NO: 327149 - RNA, 64 nt, hsa
agagucauuuuaauccaaauuuucacagagaagaaucccgaagaauguaacaagaagcaaagcc

SEQ ID NO: 327150 - RNA, 64 nt, hsa
ggacggggguucucucaccaacagcugugauuucaucccgaaguggaagggggucuaaacagaa

SEQ ID NO: 327151 - RNA, 64 nt, hsa
ugucauaaugugcuuuaucugauugacuccaaacaucccgaaaugucaccugcagauuucucgu

SEQ ID NO: 327152 - RNA, 64 nt, hsa
accauaacuaagauuuacauugcacuaugacauaaucccgaaaaaagauacauauacuuaaaua

SEQ ID NO: 327153 - RNA, 64 nt, hsa
aaaggauugguggagacuaugcaugguuaaggccaucccgaacuuuuuaaaguauuuaugaagc

SEQ ID NO: 327154 - RNA, 64 nt, hsa
auguagucuuucaguacgagacaaaguuucuuaaaucccgaagaaaaauauaaguguuccacaa

SEQ ID NO: 327155 - RNA, 64 nt, hsa
cugccuuucaaggguaauugaggcugaaugaaugaucccgaaucuguaaaagcugcuuugauga

SEQ ID NO: 327156 - RNA, 64 nt, hsa
uuccuucuuuccuuuauuuguuuagacgugcuucaucccgaaguggugcuauggucuguuaaac

SEQ ID NO: 327157 - RNA, 64 nt, hsa
acuccccugagcccucuucucuccaggcuaaagaaucccgaaggcaucgaggccauuucugcug

SEQ ID NO: 327158 - RNA, 64 nt, hsa
cuccuccugaccacggacguuuccaucagguuccaucccgaaaaucucucgguuccacgucccc

SEQ ID NO: 327159 - RNA, 62 nt, hsa
gcuccgcccccucccagugaccuucgcuccacaucccgaaacuccacccguucccacugccc

SEQ ID NO: 327160 - RNA, 64 nt, hsa
cuaauuugcuucaagaaacaccagaauuuugaaaaucccgaauuuuugacagccccucaggccu

SEQ ID NO: 327161 - RNA, 64 nt, hsa
agcccaaucauuccaaccaaagcaggguuggggaaucccgaauggccccaauucuugccucauc

SEQ ID NO: 327162 - RNA, 64 nt, hsa
gcccugcauauuuagugaccaaggcaucaaggacaucccgaaacuggaaauucauauccaucug

SEQ ID NO: 327163 - RNA, 64 nt, hsa
cucuugcacaucuaaaaaggcugaacauuuaaguaucccgaauuuucuugaauugcuuucccua

SEQ ID NO: 327164 - RNA, 64 nt, hsa
cucuggugccccuguauauguggaucucgccuacaucccgaaucauugcaguggcaagacugcu

SEQ ID NO: 327165 - RNA, 64 nt, hsa
auugcaaaauuugccuuagcaauuaucuuugaacaucccgaaccagauuuuuaaaucccauuuu

SEQ ID NO: 327166 - RNA, 64 nt, hsa
ucuucugucugugacacaguggccauuguaguuuaucccgaagacgccuauguacguaaguuug

SEQ ID NO: 327167 - RNA, 64 nt, hsa
aggcucccaaucagcuuuuguucuagacuuccccaucccgaagccaucacuucuccccgcagcc

SEQ ID NO: 327168 - RNA, 64 nt, hsa
uucuucucgggucuuaaaguguguggacauuuucaucccgaagccauagagacauuugcuguca

SEQ ID NO: 327169 - RNA, 64 nt, hsa
uugaaaagguccugcagagaaaucaguacagguuaucccgaaagguacaaggacgcacuuguaa

SEQ ID NO: 327170 - RNA, 64 nt, hsa
auuuggagcauacugguuuuccaggugcaugugaaucccgaaggacugaugauauuugaauguu

SEQ ID NO: 327171 - RNA, 64 nt, hsa
gaagaaaccugguccauuccccucauugugaagaaucccgaauccugggccuguccagggucaa

SEQ ID NO: 327172 - RNA, 64 nt, hsa
gucaauacuugaacucccaucacgggcacuuucaaucccgaaugcugggucuuggguuuuuuaa

SEQ ID NO: 327173 - RNA, 64 nt, hsa; identical to SEQ ID NO: 327170

SEQ ID NO: 327174 - RNA, 64 nt, hsa; identical to SEQ ID NO: 197404

SEQ ID NO: 327175 - RNA, 64 nt, hsa; identical to SEQ ID NO: 197405

SEQ ID NO: 327176 - RNA, 64 nt, hsa; identical to SEQ ID NO: 197469

SEQ ID NO: 327177 - RNA, 64 nt, hsa; identical to SEQ ID NO: 197470

SEQ ID NO: 327178 - RNA, 64 nt, hsa; identical to SEQ ID NO: 197517

SEQ ID NO: 327179 - RNA, 64 nt, hsa; identical to SEQ ID NO: 197518

SEQ ID NO: 327180 - RNA, 64 nt, hsa; identical to SEQ ID NO: 197519

SEQ ID NO: 327181 - RNA, 64 nt, hsa; identical to SEQ ID NO: 197520

SEQ ID NO: 327182 - RNA, 64 nt, hsa; identical to SEQ ID NO: 197521

SEQ ID NO: 327183 - RNA, 64 nt, hsa; identical to SEQ ID NO: 197543

SEQ ID NO: 327184 - RNA, 64 nt, hsa; identical to SEQ ID NO: 197544

SEQ ID NO: 327185 - RNA, 64 nt, hsa
cauguauauuucccccugguacacuuggaagacucuuauccaucugugaaacccuauguuguca

SEQ ID NO: 327186 - RNA, 64 nt, hsa
acuugccuaccuuucuggccuuaccuccuagcuacuuauccaucucuugaacuuuauacucuug

SEQ ID NO: 327187 - RNA, 64 nt, hsa
uagccaaagcgaagcuuguacagguugaguaucccuuauccaaaaugcuuggaaccagaagugu

SEQ ID NO: 327188 - RNA, 64 nt, hsa
cuaaacacaaaauucauugaugugucaguuacaccuuauccacauagccugaggguaauuuuau

SEQ ID NO: 327189 - RNA, 64 nt, hsa
gacuauuugccaugucaugaguagguagauguuuugccacaaauaugaauguguuuguuguuuc

SEQ ID NO: 327190 - RNA, 64 nt, hsa
auguuaacaauuuaguguuugacauugcuuccucugccacaaagacaauacucuggugacacau

SEQ ID NO: 327191 - RNA, 64 nt, hsa
ggugcuggccacaccagcccccuuucaccuccagugccacaauaaaccuguacccagcuguguc

SEQ ID NO: 327192 - RNA, 64 nt, hsa
cagcaacaacggcaagacucccgugugucaccagugccacaaggucauccgguggguggccugu

SEQ ID NO: 327193 - RNA, 64 nt, hsa
aacugcgggguccucauggggugagcccaggcccugccacaaccuacagggucacucaguaugc

SEQ ID NO: 327194 - RNA, 64 nt, hsa
cuagugcccaucuuccugaaaggauguuaguuucugccacaaugugaagaaggccuucaccuug

SEQ ID NO: 327195 - RNA, 64 nt, hsa
cauuagcuuuugugaucugguuaagaaguauuagugccacaagccugaaaagacaguucuccug

SEQ ID NO: 327196 - RNA, 64 nt, hsa
auggccuaaaugguguucccuuugaaauaacgcuugccacaaguauauaauaagcuauauuaau

SEQ ID NO: 327197 - RNA, 64 nt, hsa
uaauagauauuuauuaaacuguccagugaaaaggugccacaaugcccaguauuguaaacaacag

SEQ ID NO: 327198 - RNA, 64 nt, hsa
cugcacauaacucuuuuuucacaagaagggucacugccacaacagcacagucagcgggugaauu

SEQ ID NO: 327199 - RNA, 64 nt, hsa; identical to SEQ ID NO: 80199

SEQ ID NO: 327200 - RNA, 64 nt, hsa; identical to SEQ ID NO: 80200

SEQ ID NO: 327201 - RNA, 64 nt, hsa; identical to SEQ ID NO: 80201

SEQ ID NO: 327202 - RNA, 64 nt, hsa; identical to SEQ ID NO: 80202

SEQ ID NO: 327203 - RNA, 64 nt, hsa; identical to SEQ ID NO: 80203

SEQ ID NO: 327204 - RNA, 64 nt, hsa; identical to SEQ ID NO: 80204

SEQ ID NO: 327205 - RNA, 64 nt, hsa; identical to SEQ ID NO: 80205

SEQ ID NO: 327206 - RNA, 64 nt, hsa; identical to SEQ ID NO: 80206

SEQ ID NO: 327207 - RNA, 64 nt, hsa; identical to SEQ ID NO: 80207

SEQ ID NO: 327208 - RNA, 64 nt, hsa; identical to SEQ ID NO: 80208

SEQ ID NO: 327209 - RNA, 64 nt, hsa; identical to SEQ ID NO: 80209

SEQ ID NO: 327210 - RNA, 64 nt, hsa; identical to SEQ ID NO: 80210

SEQ ID NO: 327211 - RNA, 64 nt, hsa; identical to SEQ ID NO: 80211

SEQ ID NO: 327212 - RNA, 64 nt, hsa; identical to SEQ ID NO: 80212

SEQ ID NO: 327213 - RNA, 64 nt, hsa; identical to SEQ ID NO: 80213

SEQ ID NO: 327214 - RNA, 64 nt, hsa; identical to SEQ ID NO: 80214

SEQ ID NO: 327215 - RNA, 64 nt, hsa; identical to SEQ ID NO: 80215

SEQ ID NO: 327216 - RNA, 64 nt, hsa; identical to SEQ ID NO: 80216

SEQ ID NO: 327217 - RNA, 64 nt, hsa; identical to SEQ ID NO: 80217

SEQ ID NO: 327218 - RNA, 64 nt, hsa; identical to SEQ ID NO: 80218

SEQ ID NO: 327219 - RNA, 64 nt, hsa; identical to SEQ ID NO: 80219

SEQ ID NO: 327220 - RNA, 64 nt, hsa; identical to SEQ ID NO: 80220

SEQ ID NO: 327221 - RNA, 64 nt, hsa; identical to SEQ ID NO: 80221

SEQ ID NO: 327222 - RNA, 64 nt, hsa; identical to SEQ ID NO: 80222

SEQ ID NO: 327223 - RNA, 64 nt, hsa; identical to SEQ ID NO: 80223

SEQ ID NO: 327224 - RNA, 64 nt, hsa; identical to SEQ ID NO: 80224

SEQ ID NO: 327225 - RNA, 64 nt, hsa; identical to SEQ ID NO: 80225

SEQ ID NO: 327226 - RNA, 64 nt, hsa; identical to SEQ ID NO: 80226

SEQ ID NO: 327227 - RNA, 64 nt, hsa; identical to SEQ ID NO: 80227

SEQ ID NO: 327228 - RNA, 64 nt, hsa; identical to SEQ ID NO: 80228

SEQ ID NO: 327229 - RNA, 64 nt, hsa; identical to SEQ ID NO: 80229

SEQ ID NO: 327230 - RNA, 64 nt, hsa; identical to SEQ ID NO: 80230

SEQ ID NO: 327231 - RNA, 64 nt, hsa; identical to SEQ ID NO: 80231

SEQ ID NO: 327232 - RNA, 52 nt, hsa; identical to SEQ ID NO: 80232

SEQ ID NO: 327233 - RNA, 64 nt, hsa; identical to SEQ ID NO: 80233

SEQ ID NO: 327234 - RNA, 64 nt, hsa; identical to SEQ ID NO: 80234

SEQ ID NO: 327235 - RNA, 64 nt, hsa; identical to SEQ ID NO: 80235

SEQ ID NO: 327236 - RNA, 64 nt, hsa; identical to SEQ ID NO: 80236

SEQ ID NO: 327237 - RNA, 64 nt, hsa; identical to SEQ ID NO: 80237

SEQ ID NO: 327238 - RNA, 64 nt, hsa; identical to SEQ ID NO: 80238

SEQ ID NO: 327239 - RNA, 64 nt, hsa; identical to SEQ ID NO: 80239

SEQ ID NO: 327240 - RNA, 64 nt, hsa; identical to SEQ ID NO: 80240

SEQ ID NO: 327241 - RNA, 64 nt, hsa; identical to SEQ ID NO: 80241

SEQ ID NO: 327242 - RNA, 64 nt, hsa; identical to SEQ ID NO: 80242

SEQ ID NO: 327243 - RNA, 64 nt, hsa; identical to SEQ ID NO: 80243

SEQ ID NO: 327244 - RNA, 64 nt, hsa; identical to SEQ ID NO: 80244

SEQ ID NO: 327245 - RNA, 64 nt, hsa; identical to SEQ ID NO: 80245

SEQ ID NO: 327246 - RNA, 64 nt, hsa; identical to SEQ ID NO: 80246

SEQ ID NO: 327247 - RNA, 64 nt, hsa; identical to SEQ ID NO: 80247

SEQ ID NO: 327248 - RNA, 64 nt, hsa; identical to SEQ ID NO: 80248

SEQ ID NO: 327249 - RNA, 64 nt, hsa; identical to SEQ ID NO: 80249

SEQ ID NO: 327250 - RNA, 64 nt, hsa; identical to SEQ ID NO: 80250

SEQ ID NO: 327251 - RNA, 64 nt, hsa; identical to SEQ ID NO: 80251

SEQ ID NO: 327252 - RNA, 64 nt, hsa; identical to SEQ ID NO: 80252

SEQ ID NO: 327253 - RNA, 64 nt, hsa; identical to SEQ ID NO: 80253

SEQ ID NO: 327254 - RNA, 64 nt, hsa; identical to SEQ ID NO: 80254

SEQ ID NO: 327255 - RNA, 64 nt, hsa; identical to SEQ ID NO: 80255

SEQ ID NO: 327256 - RNA, 64 nt, hsa; identical to SEQ ID NO: 80256

SEQ ID NO: 327257 - RNA, 64 nt, hsa; identical to SEQ ID NO: 80257

SEQ ID NO: 327258 - RNA, 64 nt, hsa; identical to SEQ ID NO: 80258

SEQ ID NO: 327259 - RNA, 64 nt, hsa; identical to SEQ ID NO: 80259

SEQ ID NO: 327260 - RNA, 64 nt, hsa; identical to SEQ ID NO: 80260

SEQ ID NO: 327261 - RNA, 64 nt, hsa; identical to SEQ ID NO: 80261

SEQ ID NO: 327262 - RNA, 64 nt, hsa; identical to SEQ ID NO: 80262

SEQ ID NO: 327263 - RNA, 64 nt, hsa; identical to SEQ ID NO: 80263

SEQ ID NO: 327264 - RNA, 64 nt, hsa; identical to SEQ ID NO: 80264

SEQ ID NO: 327265 - RNA, 64 nt, hsa; identical to SEQ ID NO: 80265

SEQ ID NO: 327266 - RNA, 64 nt, hsa; identical to SEQ ID NO: 80266

SEQ ID NO: 327267 - RNA, 64 nt, hsa; identical to SEQ ID NO: 80267

SEQ ID NO: 327268 - RNA, 64 nt, hsa; identical to SEQ ID NO: 80268

SEQ ID NO: 327269 - RNA, 64 nt, hsa; identical to SEQ ID NO: 80269

SEQ ID NO: 327270 - RNA, 64 nt, hsa; identical to SEQ ID NO: 80270

SEQ ID NO: 327271 - RNA, 64 nt, hsa; identical to SEQ ID NO: 80271

SEQ ID NO: 327272 - RNA, 64 nt, hsa; identical to SEQ ID NO: 80272

SEQ ID NO: 327273 - RNA, 64 nt, hsa; identical to SEQ ID NO: 80273

SEQ ID NO: 327274 - RNA, 64 nt, hsa; identical to SEQ ID NO: 80274

SEQ ID NO: 327275 - RNA, 64 nt, hsa; identical to SEQ ID NO: 80275

SEQ ID NO: 327276 - RNA, 64 nt, hsa; identical to SEQ ID NO: 80276

SEQ ID NO: 327277 - RNA, 64 nt, hsa; identical to SEQ ID NO: 80277

SEQ ID NO: 327278 - RNA, 64 nt, hsa; identical to SEQ ID NO: 80278

SEQ ID NO: 327279 - RNA, 64 nt, hsa; identical to SEQ ID NO: 80279

SEQ ID NO: 327280 - RNA, 64 nt, hsa; identical to SEQ ID NO: 80280

SEQ ID NO: 327281 - RNA, 64 nt, hsa; identical to SEQ ID NO: 80281

SEQ ID NO: 327282 - RNA, 64 nt, hsa; identical to SEQ ID NO: 80282

SEQ ID NO: 327283 - RNA, 64 nt, hsa; identical to SEQ ID NO: 80283

SEQ ID NO: 327284 - RNA, 64 nt, hsa; identical to SEQ ID NO: 80284

SEQ ID NO: 327285 - RNA, 64 nt, hsa; identical to SEQ ID NO: 80285

SEQ ID NO: 327286 - RNA, 64 nt, hsa; identical to SEQ ID NO: 80286

SEQ ID NO: 327287 - RNA, 64 nt, hsa; identical to SEQ ID NO: 80287

SEQ ID NO: 327288 - RNA, 64 nt, hsa; identical to SEQ ID NO: 80288

SEQ ID NO: 327289 - RNA, 64 nt, hsa; identical to SEQ ID NO: 80289

SEQ ID NO: 327290 - RNA, 64 nt, hsa; identical to SEQ ID NO: 80290

SEQ ID NO: 327291 - RNA, 64 nt, hsa; identical to SEQ ID NO: 80291

SEQ ID NO: 327292 - RNA, 64 nt, hsa; identical to SEQ ID NO: 80292

SEQ ID NO: 327293 - RNA, 64 nt, hsa; identical to SEQ ID NO: 80293

SEQ ID NO: 327294 - RNA, 64 nt, hsa; identical to SEQ ID NO: 80294

SEQ ID NO: 327295 - RNA, 64 nt, hsa; identical to SEQ ID NO: 80295

SEQ ID NO: 327296 - RNA, 64 nt, hsa; identical to SEQ ID NO: 80296

SEQ ID NO: 327297 - RNA, 64 nt, hsa; identical to SEQ ID NO: 80297

SEQ ID NO: 327298 - RNA, 64 nt, hsa; identical to SEQ ID NO: 80298

SEQ ID NO: 327299 - RNA, 64 nt, hsa; identical to SEQ ID NO: 80299

SEQ ID NO: 327300 - RNA, 64 nt, hsa; identical to SEQ ID NO: 80300

SEQ ID NO: 327301 - RNA, 64 nt, hsa; identical to SEQ ID NO: 80301

SEQ ID NO: 327302 - RNA, 64 nt, hsa; identical to SEQ ID NO: 80302

SEQ ID NO: 327303 - RNA, 64 nt, hsa; identical to SEQ ID NO: 80303

SEQ ID NO: 327304 - RNA, 64 nt, hsa; identical to SEQ ID NO: 80304

SEQ ID NO: 327305 - RNA, 64 nt, hsa; identical to SEQ ID NO: 80305

SEQ ID NO: 327306 - RNA, 64 nt, hsa; identical to SEQ ID NO: 80306

SEQ ID NO: 327307 - RNA, 64 nt, hsa; identical to SEQ ID NO: 80307

SEQ ID NO: 327308 - RNA, 64 nt, hsa; identical to SEQ ID NO: 80308

SEQ ID NO: 327309 - RNA, 64 nt, hsa; identical to SEQ ID NO: 80309

SEQ ID NO: 327310 - RNA, 64 nt, hsa; identical to SEQ ID NO: 80310

SEQ ID NO: 327311 - RNA, 64 nt, hsa; identical to SEQ ID NO: 80311

SEQ ID NO: 327312 - RNA, 64 nt, hsa; identical to SEQ ID NO: 80312

SEQ ID NO: 327313 - RNA, 64 nt, hsa; identical to SEQ ID NO: 80313

SEQ ID NO: 327314 - RNA, 64 nt, hsa; identical to SEQ ID NO: 80314

SEQ ID NO: 327315 - RNA, 64 nt, hsa; identical to SEQ ID NO: 80315

SEQ ID NO: 327316 - RNA, 64 nt, hsa; identical to SEQ ID NO: 80316

SEQ ID NO: 327317 - RNA, 64 nt, hsa; identical to SEQ ID NO: 80317

SEQ ID NO: 327318 - RNA, 64 nt, hsa; identical to SEQ ID NO: 80318

SEQ ID NO: 327319 - RNA, 64 nt, hsa; identical to SEQ ID NO: 80319

SEQ ID NO: 327320 - RNA, 64 nt, hsa; identical to SEQ ID NO: 80320

SEQ ID NO: 327321 - RNA, 64 nt, hsa; identical to SEQ ID NO: 80321

SEQ ID NO: 327322 - RNA, 64 nt, hsa; identical to SEQ ID NO: 80322

SEQ ID NO: 327323 - RNA, 64 nt, hsa; identical to SEQ ID NO: 80323

SEQ ID NO: 327324 - RNA, 64 nt, hsa; identical to SEQ ID NO: 80324

SEQ ID NO: 327325 - RNA, 51 nt, hsa; identical to SEQ ID NO: 80325

SEQ ID NO: 327326 - RNA, 64 nt, hsa; identical to SEQ ID NO: 80326

SEQ ID NO: 327327 - RNA, 64 nt, hsa; identical to SEQ ID NO: 80327

SEQ ID NO: 327328 - RNA, 64 nt, hsa; identical to SEQ ID NO: 80328

SEQ ID NO: 327329 - RNA, 64 nt, hsa; identical to SEQ ID NO: 80329

SEQ ID NO: 327330 - RNA, 64 nt, hsa; identical to SEQ ID NO: 80330

SEQ ID NO: 327331 - RNA, 62 nt, hsa; identical to SEQ ID NO: 80331

SEQ ID NO: 327332 - RNA, 64 nt, hsa; identical to SEQ ID NO: 80332

SEQ ID NO: 327333 - RNA, 64 nt, hsa; identical to SEQ ID NO: 80333

SEQ ID NO: 327334 - RNA, 64 nt, hsa; identical to SEQ ID NO: 80334

SEQ ID NO: 327335 - RNA, 54 nt, hsa; identical to SEQ ID NO: 80335

SEQ ID NO: 327336 - RNA, 64 nt, hsa; identical to SEQ ID NO: 80336

SEQ ID NO: 327337 - RNA, 64 nt, hsa; identical to SEQ ID NO: 80337

SEQ ID NO: 327338 - RNA, 64 nt, hsa; identical to SEQ ID NO: 80338

SEQ ID NO: 327339 - RNA, 64 nt, hsa; identical to SEQ ID NO: 80339

SEQ ID NO: 327340 - RNA, 64 nt, hsa; identical to SEQ ID NO: 80340

SEQ ID NO: 327341 - RNA, 64 nt, hsa; identical to SEQ ID NO: 80341

SEQ ID NO: 327342 - RNA, 64 nt, hsa; identical to SEQ ID NO: 80342

SEQ ID NO: 327343 - RNA, 64 nt, hsa; identical to SEQ ID NO: 80343

SEQ ID NO: 327344 - RNA, 64 nt, hsa; identical to SEQ ID NO: 80344

SEQ ID NO: 327345 - RNA, 64 nt, hsa; identical to SEQ ID NO: 80345

SEQ ID NO: 327346 - RNA, 64 nt, hsa; identical to SEQ ID NO: 80346

SEQ ID NO: 327347 - RNA, 64 nt, hsa; identical to SEQ ID NO: 80347

SEQ ID NO: 327348 - RNA, 64 nt, hsa; identical to SEQ ID NO: 80348

SEQ ID NO: 327349 - RNA, 64 nt, hsa; identical to SEQ ID NO: 80349

SEQ ID NO: 327350 - RNA, 64 nt, hsa; identical to SEQ ID NO: 80350

SEQ ID NO: 327351 - RNA, 64 nt, hsa; identical to SEQ ID NO: 80351

SEQ ID NO: 327352 - RNA, 59 nt, hsa; identical to SEQ ID NO: 80352

SEQ ID NO: 327353 - RNA, 64 nt, hsa; identical to SEQ ID NO: 80353

SEQ ID NO: 327354 - RNA, 64 nt, hsa; identical to SEQ ID NO: 80354

SEQ ID NO: 327355 - RNA, 64 nt, hsa; identical to SEQ ID NO: 80355

SEQ ID NO: 327356 - RNA, 64 nt, hsa; identical to SEQ ID NO: 80356

SEQ ID NO: 327357 - RNA, 64 nt, hsa; identical to SEQ ID NO: 80357

SEQ ID NO: 327358 - RNA, 64 nt, hsa; identical to SEQ ID NO: 80358

SEQ ID NO: 327359 - RNA, 64 nt, hsa; identical to SEQ ID NO: 80359

SEQ ID NO: 327360 - RNA, 64 nt, hsa; identical to SEQ ID NO: 80360

SEQ ID NO: 327361 - RNA, 64 nt, hsa; identical to SEQ ID NO: 80361

SEQ ID NO: 327362 - RNA, 64 nt, hsa; identical to SEQ ID NO: 80362

SEQ ID NO: 327363 - RNA, 64 nt, hsa; identical to SEQ ID NO: 80363

SEQ ID NO: 327364 - RNA, 64 nt, hsa; identical to SEQ ID NO: 80364

SEQ ID NO: 327365 - RNA, 64 nt, hsa; identical to SEQ ID NO: 80365

SEQ ID NO: 327366 - RNA, 64 nt, hsa; identical to SEQ ID NO: 80366

SEQ ID NO: 327367 - RNA, 64 nt, hsa; identical to SEQ ID NO: 80367

SEQ ID NO: 327368 - RNA, 64 nt, hsa; identical to SEQ ID NO: 80368

SEQ ID NO: 327369 - RNA, 64 nt, hsa; identical to SEQ ID NO: 80369

SEQ ID NO: 327370 - RNA, 64 nt, hsa; identical to SEQ ID NO: 80370

SEQ ID NO: 327371 - RNA, 64 nt, hsa; identical to SEQ ID NO: 80371

SEQ ID NO: 327372 - RNA, 64 nt, hsa; identical to SEQ ID NO: 80372

SEQ ID NO: 327373 - RNA, 64 nt, hsa; identical to SEQ ID NO: 80373

SEQ ID NO: 327374 - RNA, 64 nt, hsa; identical to SEQ ID NO: 80374

SEQ ID NO: 327375 - RNA, 64 nt, hsa; identical to SEQ ID NO: 80375

SEQ ID NO: 327376 - RNA, 64 nt, hsa; identical to SEQ ID NO: 80376

SEQ ID NO: 327377 - RNA, 64 nt, hsa; identical to SEQ ID NO: 80377

SEQ ID NO: 327378 - RNA, 64 nt, hsa; identical to SEQ ID NO: 80378

SEQ ID NO: 327379 - RNA, 64 nt, hsa; identical to SEQ ID NO: 80379

SEQ ID NO: 327380 - RNA, 64 nt, hsa; identical to SEQ ID NO: 80380

SEQ ID NO: 327381 - RNA, 64 nt, hsa; identical to SEQ ID NO: 80381

SEQ ID NO: 327382 - RNA, 64 nt, hsa; identical to SEQ ID NO: 80382

SEQ ID NO: 327383 - RNA, 64 nt, hsa; identical to SEQ ID NO: 80383

SEQ ID NO: 327384 - RNA, 64 nt, hsa; identical to SEQ ID NO: 80384

SEQ ID NO: 327385 - RNA, 64 nt, hsa; identical to SEQ ID NO: 80385

SEQ ID NO: 327386 - RNA, 64 nt, hsa; identical to SEQ ID NO: 80386

SEQ ID NO: 327387 - RNA, 64 nt, hsa; identical to SEQ ID NO: 80387

SEQ ID NO: 327388 - RNA, 64 nt, hsa; identical to SEQ ID NO: 80388

SEQ ID NO: 327389 - RNA, 64 nt, hsa; identical to SEQ ID NO: 80389

SEQ ID NO: 327390 - RNA, 64 nt, hsa; identical to SEQ ID NO: 80390

SEQ ID NO: 327391 - RNA, 64 nt, hsa; identical to SEQ ID NO: 80391

SEQ ID NO: 327392 - RNA, 53 nt, hsa; identical to SEQ ID NO: 80392

SEQ ID NO: 327393 - RNA, 64 nt, hsa; identical to SEQ ID NO: 80393

SEQ ID NO: 327394 - RNA, 64 nt, hsa; identical to SEQ ID NO: 80394

SEQ ID NO: 327395 - RNA, 64 nt, hsa; identical to SEQ ID NO: 80395

SEQ ID NO: 327396 - RNA, 64 nt, hsa; identical to SEQ ID NO: 80396

SEQ ID NO: 327397 - RNA, 64 nt, hsa; identical to SEQ ID NO: 80397

SEQ ID NO: 327398 - RNA, 64 nt, hsa; identical to SEQ ID NO: 80398

SEQ ID NO: 327399 - RNA, 64 nt, hsa; identical to SEQ ID NO: 80399

SEQ ID NO: 327400 - RNA, 64 nt, hsa; identical to SEQ ID NO: 80400

SEQ ID NO: 327401 - RNA, 64 nt, hsa; identical to SEQ ID NO: 80401

SEQ ID NO: 327402 - RNA, 64 nt, hsa; identical to SEQ ID NO: 80402

SEQ ID NO: 327403 - RNA, 64 nt, hsa; identical to SEQ ID NO: 80403

SEQ ID NO: 327404 - RNA, 64 nt, hsa; identical to SEQ ID NO: 80404

SEQ ID NO: 327405 - RNA, 64 nt, hsa; identical to SEQ ID NO: 80405

SEQ ID NO: 327406 - RNA, 64 nt, hsa; identical to SEQ ID NO: 80406

SEQ ID NO: 327407 - RNA, 64 nt, hsa; identical to SEQ ID NO: 80407

SEQ ID NO: 327408 - RNA, 64 nt, hsa; identical to SEQ ID NO: 80408

SEQ ID NO: 327409 - RNA, 64 nt, hsa; identical to SEQ ID NO: 80409

SEQ ID NO: 327410 - RNA, 64 nt, hsa; identical to SEQ ID NO: 80410

SEQ ID NO: 327411 - RNA, 64 nt, hsa; identical to SEQ ID NO: 80411

SEQ ID NO: 327412 - RNA, 64 nt, hsa; identical to SEQ ID NO: 80412

SEQ ID NO: 327413 - RNA, 64 nt, hsa; identical to SEQ ID NO: 80413

SEQ ID NO: 327414 - RNA, 64 nt, hsa; identical to SEQ ID NO: 80414

SEQ ID NO: 327415 - RNA, 64 nt, hsa; identical to SEQ ID NO: 80415

SEQ ID NO: 327416 - RNA, 64 nt, hsa; identical to SEQ ID NO: 80416

SEQ ID NO: 327417 - RNA, 64 nt, hsa; identical to SEQ ID NO: 80417

SEQ ID NO: 327418 - RNA, 64 nt, hsa; identical to SEQ ID NO: 80418

SEQ ID NO: 327419 - RNA, 64 nt, hsa
ucugauuugaaaucgggagaaacagagcugcugccaaugggaucuuuuagguaacucccucccu

SEQ ID NO: 327420 - RNA, 64 nt, hsa
uccgugugucugugcagugcccaugagcugcugccaaugggaucuuucagguacccccucccca

SEQ ID NO: 327421 - RNA, 64 nt, hsa
aauuuauuuggggggaaauaccuugagcagaauacaaugggaaaagagucucuaccccuuucug

SEQ ID NO: 327422 - RNA, 64 nt, hsa
auucucuccuaaugaugacuugagcccugccacucaaugggagaaucagcagaaccuguaggau

SEQ ID NO: 327423 - RNA, 64 nt, hsa
gggaguggaucgguggugaaccuguugccuucaccaaugggagaagagggcccucucaacgcuc

SEQ ID NO: 327424 - RNA, 64 nt, hsa
auuuugaagaaggcauccagaagcuguaucagugcaaugggaucgccuggaaagccuggagucc

SEQ ID NO: 327425 - RNA, 64 nt, hsa; identical to SEQ ID NO: 52004

SEQ ID NO: 327426 - RNA, 64 nt, hsa; identical to SEQ ID NO: 52005

SEQ ID NO: 327427 - RNA, 64 nt, hsa; identical to SEQ ID NO: 52006

SEQ ID NO: 327428 - RNA, 64 nt, hsa; identical to SEQ ID NO: 52007

SEQ ID NO: 327429 - RNA, 64 nt, hsa; identical to SEQ ID NO: 52008

SEQ ID NO: 327430 - RNA, 64 nt, hsa; identical to SEQ ID NO: 52009

SEQ ID NO: 327431 - RNA, 64 nt, hsa; identical to SEQ ID NO: 52010

SEQ ID NO: 327432 - RNA, 64 nt, hsa; identical to SEQ ID NO: 52011

SEQ ID NO: 327433 - RNA, 64 nt, hsa; identical to SEQ ID NO: 52012

SEQ ID NO: 327434 - RNA, 64 nt, hsa; identical to SEQ ID NO: 52013

SEQ ID NO: 327435 - RNA, 64 nt, hsa; identical to SEQ ID NO: 52014

SEQ ID NO: 327436 - RNA, 64 nt, hsa; identical to SEQ ID NO: 52015

SEQ ID NO: 327437 - RNA, 64 nt, hsa; identical to SEQ ID NO: 52016

SEQ ID NO: 327438 - RNA, 64 nt, hsa; identical to SEQ ID NO: 52017

SEQ ID NO: 327439 - RNA, 64 nt, hsa; identical to SEQ ID NO: 52018

SEQ ID NO: 327440 - RNA, 64 nt, hsa; identical to SEQ ID NO: 52019

SEQ ID NO: 327441 - RNA, 64 nt, hsa; identical to SEQ ID NO: 52020

SEQ ID NO: 327442 - RNA, 64 nt, hsa; identical to SEQ ID NO: 52021

SEQ ID NO: 327443 - RNA, 64 nt, hsa; identical to SEQ ID NO: 52022

SEQ ID NO: 327444 - RNA, 64 nt, hsa; identical to SEQ ID NO: 52023

SEQ ID NO: 327445 - RNA, 64 nt, hsa; identical to SEQ ID NO: 52024

SEQ ID NO: 327446 - RNA, 64 nt, hsa; identical to SEQ ID NO: 52025

SEQ ID NO: 327447 - RNA, 64 nt, hsa; identical to SEQ ID NO: 52026

SEQ ID NO: 327448 - RNA, 64 nt, hsa; identical to SEQ ID NO: 52027

SEQ ID NO: 327449 - RNA, 64 nt, hsa; identical to SEQ ID NO: 52028

SEQ ID NO: 327450 - RNA, 64 nt, hsa; identical to SEQ ID NO: 52029

SEQ ID NO: 327451 - RNA, 64 nt, hsa; identical to SEQ ID NO: 52030

SEQ ID NO: 327452 - RNA, 64 nt, hsa; identical to SEQ ID NO: 52031

SEQ ID NO: 327453 - RNA, 64 nt, hsa; identical to SEQ ID NO: 52032

SEQ ID NO: 327454 - RNA, 64 nt, hsa; identical to SEQ ID NO: 52033

SEQ ID NO: 327455 - RNA, 64 nt, hsa; identical to SEQ ID NO: 52034

SEQ ID NO: 327456 - RNA, 64 nt, hsa; identical to SEQ ID NO: 52035

SEQ ID NO: 327457 - RNA, 64 nt, hsa; identical to SEQ ID NO: 52036

SEQ ID NO: 327458 - RNA, 64 nt, hsa; identical to SEQ ID NO: 52037

SEQ ID NO: 327459 - RNA, 64 nt, hsa; identical to SEQ ID NO: 52038

SEQ ID NO: 327460 - RNA, 64 nt, hsa; identical to SEQ ID NO: 52039

SEQ ID NO: 327461 - RNA, 64 nt, hsa; identical to SEQ ID NO: 52040

SEQ ID NO: 327462 - RNA, 64 nt, hsa; identical to SEQ ID NO: 52041

SEQ ID NO: 327463 - RNA, 64 nt, hsa; identical to SEQ ID NO: 52042

SEQ ID NO: 327464 - RNA, 64 nt, hsa; identical to SEQ ID NO: 52043

SEQ ID NO: 327465 - RNA, 64 nt, hsa; identical to SEQ ID NO: 52044

SEQ ID NO: 327466 - RNA, 64 nt, hsa; identical to SEQ ID NO: 52045

SEQ ID NO: 327467 - RNA, 64 nt, hsa; identical to SEQ ID NO: 52046

SEQ ID NO: 327468 - RNA, 64 nt, hsa; identical to SEQ ID NO: 52047

SEQ ID NO: 327469 - RNA, 64 nt, hsa; identical to SEQ ID NO: 52048

SEQ ID NO: 327470 - RNA, 64 nt, hsa; identical to SEQ ID NO: 52049

SEQ ID NO: 327471 - RNA, 64 nt, hsa; identical to SEQ ID NO: 52050

SEQ ID NO: 327472 - RNA, 64 nt, hsa; identical to SEQ ID NO: 52051

SEQ ID NO: 327473 - RNA, 64 nt, hsa; identical to SEQ ID NO: 52052

SEQ ID NO: 327474 - RNA, 64 nt, hsa; identical to SEQ ID NO: 52053

SEQ ID NO: 327475 - RNA, 64 nt, hsa; identical to SEQ ID NO: 52054

SEQ ID NO: 327476 - RNA, 64 nt, hsa; identical to SEQ ID NO: 52055

SEQ ID NO: 327477 - RNA, 64 nt, hsa; identical to SEQ ID NO: 52056

SEQ ID NO: 327478 - RNA, 64 nt, hsa; identical to SEQ ID NO: 52057

SEQ ID NO: 327479 - RNA, 64 nt, hsa; identical to SEQ ID NO: 52058

SEQ ID NO: 327480 - RNA, 64 nt, hsa; identical to SEQ ID NO: 52059

SEQ ID NO: 327481 - RNA, 64 nt, hsa; identical to SEQ ID NO: 52060

SEQ ID NO: 327482 - RNA, 64 nt, hsa; identical to SEQ ID NO: 52061

SEQ ID NO: 327483 - RNA, 64 nt, hsa; identical to SEQ ID NO: 52062

SEQ ID NO: 327484 - RNA, 64 nt, hsa; identical to SEQ ID NO: 52063

SEQ ID NO: 327485 - RNA, 64 nt, hsa; identical to SEQ ID NO: 52064

SEQ ID NO: 327486 - RNA, 64 nt, hsa; identical to SEQ ID NO: 52065

SEQ ID NO: 327487 - RNA, 64 nt, hsa; identical to SEQ ID NO: 52066

SEQ ID NO: 327488 - RNA, 64 nt, hsa; identical to SEQ ID NO: 52067

SEQ ID NO: 327489 - RNA, 64 nt, hsa; identical to SEQ ID NO: 52068

SEQ ID NO: 327490 - RNA, 64 nt, hsa; identical to SEQ ID NO: 52069

SEQ ID NO: 327491 - RNA, 64 nt, hsa; identical to SEQ ID NO: 52070

SEQ ID NO: 327492 - RNA, 64 nt, hsa; identical to SEQ ID NO: 52071

SEQ ID NO: 327493 - RNA, 64 nt, hsa; identical to SEQ ID NO: 52072

SEQ ID NO: 327494 - RNA, 64 nt, hsa; identical to SEQ ID NO: 52073

SEQ ID NO: 327495 - RNA, 64 nt, hsa; identical to SEQ ID NO: 52074

SEQ ID NO: 327496 - RNA, 64 nt, hsa; identical to SEQ ID NO: 52075

SEQ ID NO: 327497 - RNA, 64 nt, hsa; identical to SEQ ID NO: 52076

SEQ ID NO: 327498 - RNA, 64 nt, hsa; identical to SEQ ID NO: 52077

SEQ ID NO: 327499 - RNA, 64 nt, hsa; identical to SEQ ID NO: 52078

SEQ ID NO: 327500 - RNA, 64 nt, hsa; identical to SEQ ID NO: 52079

SEQ ID NO: 327501 - RNA, 64 nt, hsa; identical to SEQ ID NO: 52080

SEQ ID NO: 327502 - RNA, 64 nt, hsa; identical to SEQ ID NO: 52081

SEQ ID NO: 327503 - RNA, 64 nt, hsa; identical to SEQ ID NO: 52082

SEQ ID NO: 327504 - RNA, 64 nt, hsa; identical to SEQ ID NO: 52083

SEQ ID NO: 327505 - RNA, 64 nt, hsa; identical to SEQ ID NO: 52084

SEQ ID NO: 327506 - RNA, 64 nt, hsa; identical to SEQ ID NO: 52085

SEQ ID NO: 327507 - RNA, 64 nt, hsa; identical to SEQ ID NO: 52086

SEQ ID NO: 327508 - RNA, 64 nt, hsa; identical to SEQ ID NO: 52087

SEQ ID NO: 327509 - RNA, 64 nt, hsa; identical to SEQ ID NO: 52088

SEQ ID NO: 327510 - RNA, 64 nt, hsa; identical to SEQ ID NO: 52089

SEQ ID NO: 327511 - RNA, 64 nt, hsa; identical to SEQ ID NO: 52090

SEQ ID NO: 327512 - RNA, 64 nt, hsa; identical to SEQ ID NO: 52091

SEQ ID NO: 327513 - RNA, 64 nt, hsa; identical to SEQ ID NO: 52092

SEQ ID NO: 327514 - RNA, 64 nt, hsa; identical to SEQ ID NO: 52093

SEQ ID NO: 327515 - RNA, 64 nt, hsa; identical to SEQ ID NO: 52094

SEQ ID NO: 327516 - RNA, 64 nt, hsa; identical to SEQ ID NO: 52095

SEQ ID NO: 327517 - RNA, 64 nt, hsa; identical to SEQ ID NO: 52096

SEQ ID NO: 327518 - RNA, 64 nt, hsa; identical to SEQ ID NO: 52097

SEQ ID NO: 327519 - RNA, 64 nt, hsa; identical to SEQ ID NO: 52098

SEQ ID NO: 327520 - RNA, 64 nt, hsa; identical to SEQ ID NO: 52099

SEQ ID NO: 327521 - RNA, 64 nt, hsa; identical to SEQ ID NO: 52100

SEQ ID NO: 327522 - RNA, 64 nt, hsa; identical to SEQ ID NO: 52101

SEQ ID NO: 327523 - RNA, 64 nt, hsa; identical to SEQ ID NO: 52102

SEQ ID NO: 327524 - RNA, 64 nt, hsa; identical to SEQ ID NO: 52103

SEQ ID NO: 327525 - RNA, 64 nt, hsa; identical to SEQ ID NO: 52104

SEQ ID NO: 327526 - RNA, 64 nt, hsa; identical to SEQ ID NO: 52105

SEQ ID NO: 327527 - RNA, 64 nt, hsa; identical to SEQ ID NO: 52106

SEQ ID NO: 327528 - RNA, 64 nt, hsa; identical to SEQ ID NO: 52107

SEQ ID NO: 327529 - RNA, 64 nt, hsa; identical to SEQ ID NO: 52108

SEQ ID NO: 327530 - RNA, 64 nt, hsa; identical to SEQ ID NO: 52109

SEQ ID NO: 327531 - RNA, 64 nt, hsa; identical to SEQ ID NO: 52110

SEQ ID NO: 327532 - RNA, 64 nt, hsa; identical to SEQ ID NO: 52111

SEQ ID NO: 327533 - RNA, 64 nt, hsa; identical to SEQ ID NO: 52112

SEQ ID NO: 327534 - RNA, 64 nt, hsa; identical to SEQ ID NO: 52113

SEQ ID NO: 327535 - RNA, 64 nt, hsa; identical to SEQ ID NO: 52114

SEQ ID NO: 327536 - RNA, 64 nt, hsa; identical to SEQ ID NO: 52115

SEQ ID NO: 327537 - RNA, 64 nt, hsa; identical to SEQ ID NO: 52116

SEQ ID NO: 327538 - RNA, 64 nt, hsa; identical to SEQ ID NO: 52117

SEQ ID NO: 327539 - RNA, 64 nt, hsa; identical to SEQ ID NO: 52118

SEQ ID NO: 327540 - RNA, 64 nt, hsa; identical to SEQ ID NO: 52119

SEQ ID NO: 327541 - RNA, 64 nt, hsa; identical to SEQ ID NO: 52120

SEQ ID NO: 327542 - RNA, 64 nt, hsa; identical to SEQ ID NO: 52121

SEQ ID NO: 327543 - RNA, 64 nt, hsa; identical to SEQ ID NO: 52122

SEQ ID NO: 327544 - RNA, 64 nt, hsa; identical to SEQ ID NO: 52123

SEQ ID NO: 327545 - RNA, 64 nt, hsa; identical to SEQ ID NO: 52124

SEQ ID NO: 327546 - RNA, 64 nt, hsa; identical to SEQ ID NO: 52125

SEQ ID NO: 327547 - RNA, 64 nt, hsa; identical to SEQ ID NO: 52126

SEQ ID NO: 327548 - RNA, 64 nt, hsa; identical to SEQ ID NO: 52127

SEQ ID NO: 327549 - RNA, 64 nt, hsa; identical to SEQ ID NO: 52128

SEQ ID NO: 327550 - RNA, 64 nt, hsa; identical to SEQ ID NO: 52129

SEQ ID NO: 327551 - RNA, 64 nt, hsa; identical to SEQ ID NO: 52130

SEQ ID NO: 327552 - RNA, 64 nt, hsa; identical to SEQ ID NO: 52131

SEQ ID NO: 327553 - RNA, 64 nt, hsa; identical to SEQ ID NO: 52132

SEQ ID NO: 327554 - RNA, 64 nt, hsa; identical to SEQ ID NO: 52133

SEQ ID NO: 327555 - RNA, 64 nt, hsa; identical to SEQ ID NO: 52134

SEQ ID NO: 327556 - RNA, 64 nt, hsa; identical to SEQ ID NO: 52135

SEQ ID NO: 327557 - RNA, 64 nt, hsa; identical to SEQ ID NO: 52136

SEQ ID NO: 327558 - RNA, 64 nt, hsa; identical to SEQ ID NO: 52137

SEQ ID NO: 327559 - RNA, 64 nt, hsa; identical to SEQ ID NO: 52138

SEQ ID NO: 327560 - RNA, 64 nt, hsa; identical to SEQ ID NO: 52139

SEQ ID NO: 327561 - RNA, 64 nt, hsa; identical to SEQ ID NO: 52140

SEQ ID NO: 327562 - RNA, 64 nt, hsa; identical to SEQ ID NO: 52141

SEQ ID NO: 327563 - RNA, 64 nt, hsa; identical to SEQ ID NO: 52142

SEQ ID NO: 327564 - RNA, 64 nt, hsa; identical to SEQ ID NO: 52143

SEQ ID NO: 327565 - RNA, 64 nt, hsa; identical to SEQ ID NO: 52144

SEQ ID NO: 327566 - RNA, 64 nt, hsa; identical to SEQ ID NO: 52145

SEQ ID NO: 327567 - RNA, 64 nt, hsa; identical to SEQ ID NO: 52146

SEQ ID NO: 327568 - RNA, 64 nt, hsa; identical to SEQ ID NO: 52147

SEQ ID NO: 327569 - RNA, 64 nt, hsa; identical to SEQ ID NO: 52148

SEQ ID NO: 327570 - RNA, 64 nt, hsa; identical to SEQ ID NO: 52149

SEQ ID NO: 327571 - RNA, 64 nt, hsa; identical to SEQ ID NO: 52150

SEQ ID NO: 327572 - RNA, 64 nt, hsa; identical to SEQ ID NO: 52151

SEQ ID NO: 327573 - RNA, 64 nt, hsa; identical to SEQ ID NO: 52152

SEQ ID NO: 327574 - RNA, 64 nt, hsa; identical to SEQ ID NO: 52153

SEQ ID NO: 327575 - RNA, 63 nt, hsa; identical to SEQ ID NO: 52154

SEQ ID NO: 327576 - RNA, 64 nt, hsa; identical to SEQ ID NO: 52155

SEQ ID NO: 327577 - RNA, 64 nt, hsa; identical to SEQ ID NO: 52156

SEQ ID NO: 327578 - RNA, 64 nt, hsa; identical to SEQ ID NO: 52157

SEQ ID NO: 327579 - RNA, 64 nt, hsa; identical to SEQ ID NO: 52158

SEQ ID NO: 327580 - RNA, 64 nt, hsa; identical to SEQ ID NO: 52159

SEQ ID NO: 327581 - RNA, 64 nt, hsa; identical to SEQ ID NO: 52160

SEQ ID NO: 327582 - RNA, 64 nt, hsa; identical to SEQ ID NO: 52161

SEQ ID NO: 327583 - RNA, 64 nt, hsa; identical to SEQ ID NO: 52162

SEQ ID NO: 327584 - RNA, 64 nt, hsa; identical to SEQ ID NO: 52163

SEQ ID NO: 327585 - RNA, 64 nt, hsa; identical to SEQ ID NO: 52164

SEQ ID NO: 327586 - RNA, 64 nt, hsa; identical to SEQ ID NO: 52165

SEQ ID NO: 327587 - RNA, 64 nt, hsa; identical to SEQ ID NO: 52166

SEQ ID NO: 327588 - RNA, 64 nt, hsa; identical to SEQ ID NO: 52167

SEQ ID NO: 327589 - RNA, 64 nt, hsa; identical to SEQ ID NO: 52168

SEQ ID NO: 327590 - RNA, 64 nt, hsa; identical to SEQ ID NO: 52169

SEQ ID NO: 327591 - RNA, 64 nt, hsa; identical to SEQ ID NO: 52170

SEQ ID NO: 327592 - RNA, 64 nt, hsa; identical to SEQ ID NO: 52171

SEQ ID NO: 327593 - RNA, 64 nt, hsa; identical to SEQ ID NO: 52172

SEQ ID NO: 327594 - RNA, 64 nt, hsa; identical to SEQ ID NO: 52173

SEQ ID NO: 327595 - RNA, 64 nt, hsa; identical to SEQ ID NO: 52174

SEQ ID NO: 327596 - RNA, 64 nt, hsa; identical to SEQ ID NO: 52175

SEQ ID NO: 327597 - RNA, 64 nt, hsa; identical to SEQ ID NO: 52176

SEQ ID NO: 327598 - RNA, 64 nt, hsa; identical to SEQ ID NO: 52177

SEQ ID NO: 327599 - RNA, 64 nt, hsa; identical to SEQ ID NO: 52178

SEQ ID NO: 327600 - RNA, 64 nt, hsa; identical to SEQ ID NO: 52179

SEQ ID NO: 327601 - RNA, 64 nt, hsa; identical to SEQ ID NO: 52180

SEQ ID NO: 327602 - RNA, 64 nt, hsa; identical to SEQ ID NO: 52181

SEQ ID NO: 327603 - RNA, 64 nt, hsa; identical to SEQ ID NO: 52182

SEQ ID NO: 327604 - RNA, 64 nt, hsa; identical to SEQ ID NO: 52183

SEQ ID NO: 327605 - RNA, 57 nt, hsa; identical to SEQ ID NO: 52184

SEQ ID NO: 327606 - RNA, 52 nt, hsa; identical to SEQ ID NO: 52185

SEQ ID NO: 327607 - RNA, 64 nt, hsa; identical to SEQ ID NO: 52186

SEQ ID NO: 327608 - RNA, 64 nt, hsa; identical to SEQ ID NO: 52187

SEQ ID NO: 327609 - RNA, 64 nt, hsa; identical to SEQ ID NO: 52188

SEQ ID NO: 327610 - RNA, 64 nt, hsa; identical to SEQ ID NO: 52189

SEQ ID NO: 327611 - RNA, 64 nt, hsa; identical to SEQ ID NO: 52190

SEQ ID NO: 327612 - RNA, 64 nt, hsa; identical to SEQ ID NO: 52191

SEQ ID NO: 327613 - RNA, 64 nt, hsa; identical to SEQ ID NO: 52192

SEQ ID NO: 327614 - RNA, 64 nt, hsa; identical to SEQ ID NO: 52193

SEQ ID NO: 327615 - RNA, 64 nt, hsa; identical to SEQ ID NO: 52194

SEQ ID NO: 327616 - RNA, 64 nt, hsa; identical to SEQ ID NO: 52195

SEQ ID NO: 327617 - RNA, 64 nt, hsa; identical to SEQ ID NO: 52196

SEQ ID NO: 327618 - RNA, 64 nt, hsa; identical to SEQ ID NO: 52197

SEQ ID NO: 327619 - RNA, 64 nt, hsa; identical to SEQ ID NO: 52198

SEQ ID NO: 327620 - RNA, 64 nt, hsa; identical to SEQ ID NO: 52199

SEQ ID NO: 327621 - RNA, 64 nt, hsa; identical to SEQ ID NO: 52200

SEQ ID NO: 327622 - RNA, 64 nt, hsa; identical to SEQ ID NO: 52201

SEQ ID NO: 327623 - RNA, 64 nt, hsa; identical to SEQ ID NO: 52202

SEQ ID NO: 327624 - RNA, 64 nt, hsa; identical to SEQ ID NO: 52203

SEQ ID NO: 327625 - RNA, 64 nt, hsa; identical to SEQ ID NO: 52204

SEQ ID NO: 327626 - RNA, 64 nt, hsa; identical to SEQ ID NO: 52205

SEQ ID NO: 327627 - RNA, 64 nt, hsa; identical to SEQ ID NO: 52206

SEQ ID NO: 327628 - RNA, 64 nt, hsa; identical to SEQ ID NO: 52207

SEQ ID NO: 327629 - RNA, 64 nt, hsa; identical to SEQ ID NO: 52208

SEQ ID NO: 327630 - RNA, 64 nt, hsa; identical to SEQ ID NO: 52209

SEQ ID NO: 327631 - RNA, 64 nt, hsa; identical to SEQ ID NO: 52210

SEQ ID NO: 327632 - RNA, 64 nt, hsa; identical to SEQ ID NO: 52211

SEQ ID NO: 327633 - RNA, 64 nt, hsa; identical to SEQ ID NO: 52212

SEQ ID NO: 327634 - RNA, 64 nt, hsa; identical to SEQ ID NO: 52213

SEQ ID NO: 327635 - RNA, 64 nt, hsa; identical to SEQ ID NO: 52214

SEQ ID NO: 327636 - RNA, 64 nt, hsa; identical to SEQ ID NO: 52215

SEQ ID NO: 327637 - RNA, 64 nt, hsa; identical to SEQ ID NO: 52216

SEQ ID NO: 327638 - RNA, 64 nt, hsa; identical to SEQ ID NO: 52217

SEQ ID NO: 327639 - RNA, 64 nt, hsa; identical to SEQ ID NO: 52218

SEQ ID NO: 327640 - RNA, 64 nt, hsa; identical to SEQ ID NO: 52219

SEQ ID NO: 327641 - RNA, 64 nt, hsa; identical to SEQ ID NO: 52220

SEQ ID NO: 327642 - RNA, 64 nt, hsa; identical to SEQ ID NO: 52221

SEQ ID NO: 327643 - RNA, 64 nt, hsa; identical to SEQ ID NO: 52222

SEQ ID NO: 327644 - RNA, 64 nt, hsa; identical to SEQ ID NO: 52223

SEQ ID NO: 327645 - RNA, 64 nt, hsa; identical to SEQ ID NO: 52224

SEQ ID NO: 327646 - RNA, 64 nt, hsa; identical to SEQ ID NO: 52225

SEQ ID NO: 327647 - RNA, 64 nt, hsa; identical to SEQ ID NO: 52226

SEQ ID NO: 327648 - RNA, 64 nt, hsa; identical to SEQ ID NO: 52227

SEQ ID NO: 327649 - RNA, 64 nt, hsa; identical to SEQ ID NO: 52228

SEQ ID NO: 327650 - RNA, 64 nt, hsa; identical to SEQ ID NO: 52229

SEQ ID NO: 327651 - RNA, 64 nt, hsa; identical to SEQ ID NO: 52230

SEQ ID NO: 327652 - RNA, 64 nt, hsa; identical to SEQ ID NO: 52231

SEQ ID NO: 327653 - RNA, 64 nt, hsa; identical to SEQ ID NO: 52232

SEQ ID NO: 327654 - RNA, 64 nt, hsa; identical to SEQ ID NO: 52233

SEQ ID NO: 327655 - RNA, 64 nt, hsa; identical to SEQ ID NO: 52234

SEQ ID NO: 327656 - RNA, 64 nt, hsa; identical to SEQ ID NO: 52235

SEQ ID NO: 327657 - RNA, 64 nt, hsa
uagaaucaaaaacaagggccagauguauuuaagggguauucagaugccaccuacaugcuuauuu

SEQ ID NO: 327658 - RNA, 64 nt, hsa
guagcagaggacuuggugacuguauaaaguuagugguauucagggacaguguagcaaguagcuu

SEQ ID NO: 327659 - RNA, 64 nt, hsa
guuugguuuaaaaacuucuguacuggcaaauggugguauucagugugggauagugucauaacua

SEQ ID NO: 327660 - RNA, 64 nt, hsa
gguggaggcauaaguagaagagauuguuaagaaggguauucaugugucuuugcucuuucugcuu

SEQ ID NO: 327661 - RNA, 64 nt, hsa
uuuguuuuuuuuuaaucacaguaggucugauagagaauuggagcuaaauuauaauauuuuuguu

SEQ ID NO: 327662 - RNA, 64 nt, hsa
ugagaauaacaaugguaaucguuaguaauauuuagaauuggaauuugccuacugaaauaguuau

SEQ ID NO: 327663 - RNA, 64 nt, hsa
guaagauggauaaucacuuucucauuuggguucugaauuggagacucaguuuuuaugagacaca

SEQ ID NO: 327664 - RNA, 64 nt, hsa
acugaagacauggacuuuauauguucaagugcaggaauuggaaaguuggacuuguuuucuauga

SEQ ID NO: 327665 - RNA, 64 nt, hsa
aauauuauaaaaagagugucauauuccagcauuugaauuggaaagagaagagugaagauccaag

SEQ ID NO: 327666 - RNA, 64 nt, hsa
ucaaagaugauauguggaggaauuaaauauaaaggaauuggagguuuuugcuaaagaaauuaau

SEQ ID NO: 327667 - RNA, 64 nt, hsa
augucaaauuagucacauuaagcuauaguagaaggaauuggacacuucuccagauauuuggcuu

SEQ ID NO: 327668 - RNA, 64 nt, hsa
aaauuaauaacuguggcucuuccaguugaaauaggaauuggagagaaaggauuagaauauuuua

SEQ ID NO: 327669 - RNA, 64 nt, hsa
uuagcauguaaaacaaagaaagauauacaugacugaauuggauaucuuuguuuguuuguuugag

SEQ ID NO: 327670 - RNA, 64 nt, hsa
ugggauuacguguguaagccacagugcccagcccgaauuggauaucuuuaagauaucuguaagu

SEQ ID NO: 327671 - RNA, 64 nt, hsa
ugcuuuaaauagacugacgucgcauacccuuauagaauuggaauaugauuucucaaaaauuaau

SEQ ID NO: 327672 - RNA, 64 nt, hsa
uaauaccccaagcuugcccugaauacuuugauuggaauuggaauauaucaaaaaagguuaguau

SEQ ID NO: 327673 - RNA, 64 nt, hsa
cagcauaaauguugacaugggacauuugcucauggaauuggagcucgugggacagucaccucau

SEQ ID NO: 327674 - RNA, 64 nt, hsa
auggaauuggagcucgugggacagucaccucauggaauuggagcucguggaacaguuaccucug

SEQ ID NO: 327675 - RNA, 64 nt, hsa
gccauuccuucugugaugauaaagcccaguucuggaauuggagccauauuaaggaaugauucuc

SEQ ID NO: 327676 - RNA, 64 nt, hsa
gcccauuacagcuucuagccuguguugugcaaaagaauuggaaggaugugguguguaccuguag

SEQ ID NO: 327677 - RNA, 64 nt, hsa
auugguauagccuuaugugcuuuccuacaaaauggaauuggaggccgggcgcaguggcucacgc

SEQ ID NO: 327678 - RNA, 64 nt, hsa
uagauagauagauagauagauagauagauaaacggaauuggagccauuuugcuuuaagugaaug

SEQ ID NO: 327679 - RNA, 64 nt, hsa
uguaguuuucuagaugagauuucaguaugauuuuaucagcuauuucuuauauaucauaaucugg

SEQ ID NO: 327680 - RNA, 64 nt, hsa
ucaccuuaguuauggugcucaccaaacgaaggguaucagcuauuuuuuuuaaaauucaaaaaga

SEQ ID NO: 327681 - RNA, 64 nt, hsa
uuucaaacuaucucuaguuuuucaauggaaauauaucagcuagggaaaaaccaucaagcucauu

SEQ ID NO: 327682 - RNA, 64 nt, hsa
aaucacugucacccccggacagcagaacgcuggcaucagcuaucuuagcuccuccucuccccuc

SEQ ID NO: 327683 - RNA, 64 nt, hsa
uuuuacagaauucuguagcaaagccaauacaaaaaucagcuaaagcugccacagaagaggcauc

SEQ ID NO: 327684 - RNA, 64 nt, hsa
ucugcccuccugcuccagccccacuucugaaaguaucagcuacugauccagccacuggauauuu

SEQ ID NO: 327685 - RNA, 64 nt, hsa
ccaggcuacucuuauuuuagcuugcuaaguugagaucagcuagaccugcuuucuuuucuccuca

SEQ ID NO: 327686 - RNA, 64 nt, hsa
gcccuuuaucaauacagugcugcaauuucuggauaucagcuacacuuuguuuuuaaguuuguuu

SEQ ID NO: 327687 - RNA, 64 nt, hsa
auggccugaagcucuucucuccaguguuucuacaaucagcuagggacuacuuaauaggugaguu

SEQ ID NO: 327688 - RNA, 64 nt, hsa
uuugucuuaaacaccaguaauauggcucuuguuuaucagcuaaucuugaauuuauucuguggua

SEQ ID NO: 327689 - RNA, 64 nt, hsa
aacucauucagaaaugauucucccaacaaugcguaucagcuauucauugauacuuagagugggu

SEQ ID NO: 327690 - RNA, 64 nt, hsa
gacauuuaaaauggaacuucuuuuaucugacaggaucagcuacaaugcccuguguuaaauuguu

SEQ ID NO: 327691 - RNA, 64 nt, hsa
agcuugccagucuuuuuggcuuugaacacugcccaucagcuacagucauuacuguuccccaacc

SEQ ID NO: 327692 - RNA, 64 nt, hsa
aggauggacucgugucugauuagaaugucaguugaucagcuagauuuguguccacacuaccagu

SEQ ID NO: 327693 - RNA, 64 nt, hsa
cucucuccaaaagccucugcccaggagcaugggcaucagcuaccucacgggaaccagccugcug

SEQ ID NO: 327694 - RNA, 64 nt, hsa
ugucugcucuuucccuccccauccucuggcagaaaucagcuagacgcuauaccguggacucucc

SEQ ID NO: 327695 - RNA, 64 nt, hsa
caguggaugccauucauaaccacugaugaauguuaucagcuauuuauccaaauuacaggaaaug

SEQ ID NO: 327696 - RNA, 64 nt, hsa
aaccaaggcccucgguuauugguuugugugauuuaucagcuaauuuagguagaacagggaagca

SEQ ID NO: 327697 - RNA, 64 nt, hsa
ccuuucuuuuuuuaugaccuggauauauaagcaaaucagcuaggaaauauauaauuguauuuua

SEQ ID NO: 327698 - RNA, 64 nt, hsa
gcugaagaugaauaucccuaauccuucauaaagaaucagcuagaguugucaugauaaagucagc

SEQ ID NO: 327699 - RNA, 64 nt, hsa
augucugcugugacuaauauaaauuucuugcagaaucagcuacacuuaauuauguugcugauag

SEQ ID NO: 327700 - RNA, 64 nt, hsa
gagaaaagcaaagcucuuucuuauuuuccucauaaucagcuacccuggaggggagggagaacuc

SEQ ID NO: 327701 - RNA, 64 nt, hsa
uuugaaucucuucuuugugaaaugaagugagacuaucagcuaguuguggguggaguguguucuc

SEQ ID NO: 327702 - RNA, 64 nt, hsa
aaauugacauuccaucugucuuuauuggugaaucaucagcuaauucucugaaagaugaauucac

SEQ ID NO: 327703 - RNA, 64 nt, hsa
gaacacuuuuuaaaagacguauauucaacauaaaaucagcuaucagacuucagauuagacuuua

SEQ ID NO: 327704 - RNA, 64 nt, hsa
cagaggccaauuucauuaacucugauuaauuagaaucagcuagccagauuaguaaccucuuugu

SEQ ID NO: 327705 - RNA, 64 nt, hsa
ugacuugaaaaaguuugggaagcucuuuagcaauaucagcuaaaaggauaugaaaucacaggug

SEQ ID NO: 327706 - RNA, 64 nt, hsa
aaaauuugaauagcccuauuuauccuuguuaaguaucagcuacaauuguaaacuaguuacuaaa

SEQ ID NO: 327707 - RNA, 64 nt, hsa
aaauuuuauugauuacaaaauauguaagaaaauuaucagcuacaguuuuaaaguuuaaaaugcu

SEQ ID NO: 327708 - RNA, 64 nt, hsa
uacaugaaaaauuauacuugauagcuuaacuauaaucagcuauuuuuguauuuuuguaauauuu

SEQ ID NO: 327709 - RNA, 64 nt, hsa
accugcacugaguacuucauuaggacaagugagaaucagcuauugauaauggccagagauaucc

SEQ ID NO: 327710 - RNA, 63 nt, hsa
gaagaaucauaaucagaauaaagauaaauucuugaucagcuauaacuucuguuucaucuaguu

SEQ ID NO: 327711 - RNA, 64 nt, hsa
ccaaacuugaauuuucacaugaguaugccacucuaucagcuacucugauuaaccugacagucgg

SEQ ID NO: 327712 - RNA, 64 nt, hsa
guaaagacugcuuuuugaaugcauaugauuuugcaucagcuagacugaguugauucugaccaga

SEQ ID NO: 327713 - RNA, 64 nt, hsa
aaggacaaagcccuauuuuuguuuccacauaaagaucagcuacugaauuggugaauuuccugac

SEQ ID NO: 327714 - RNA, 64 nt, hsa
gcuugguacacauaagaaaaacuagagauuugaaaucagcuaugaauuacucuauauaguaucu

SEQ ID NO: 327715 - RNA, 64 nt, hsa
aaaaaaaauuccaugcacucucucucuguuaaagaucagcuauucccuucugaucuuggaaaga

SEQ ID NO: 327716 - RNA, 64 nt, hsa
cuaacagacauagacugcaaaagaauaauuuggaaucagcuaugcaaaucagucucacaauagc

SEQ ID NO: 327717 - RNA, 64 nt, hsa
auauauauuuaaaauaauaauggaaacauaggaaaucagcuauuuaaaccagaucacccuuguu

SEQ ID NO: 327718 - RNA, 64 nt, hsa
uauaaaacucuuugaagaaauaugauuuuuagaaaucagcuacccauuauagcacaaaaucagc

SEQ ID NO: 327719 - RNA, 64 nt, hsa
ucccuguauguggaagcagcaccucauucccgccaucagcuaccucucaucaccccaccuucau

SEQ ID NO: 327720 - RNA, 64 nt, hsa
ugggaaggcuggcugcugcccucagcuccgccucaucagcuaugugaagggguguguguggagu

SEQ ID NO: 327721 - RNA, 64 nt, hsa
uuguauaguuagaugcuaaaugcucauugaaacaaucagcuaauuuauguauagauuuuccagc

SEQ ID NO: 327722 - RNA, 64 nt, hsa
aaguguaaaaguggcucauaucuucuccagccaaaucagcuaggccauggccuugccuugcuuc

SEQ ID NO: 327723 - RNA, 64 nt, hsa
ucacuagacaauaauucaaguuuagaaacagguaaucagcuauuugaucuuaaaaggcaaugaa

SEQ ID NO: 327724 - RNA, 64 nt, hsa
gaggcuuauuaaaaauagugauucuaauguaagaaucagcuaagaugcauuauauauauuuuaa

SEQ ID NO: 327725 - RNA, 64 nt, hsa
aaacugagaaauguucagaauguacggaaagaugaucagcuauuuucaacauaacugaaggcau

SEQ ID NO: 327726 - RNA, 51 nt, hsa
auuccaaagaauuuucaugagaucagcuaaguugcaccaacuuugaagucu

SEQ ID NO: 327727 - RNA, 64 nt, hsa
uguuuuuuaaugcuauaaaauguuagaaugugccaucagcuaaugccaggcuuacguauuucua

SEQ ID NO: 327728 - RNA, 64 nt, hsa
uuagaauacauuguacuuauacaccuuauuaaugaucagcuauauacuauuuauauacaaguga

SEQ ID NO: 327729 - RNA, 64 nt, hsa
guuuuuguuuuguuuuuaaauggagcccugaggcaucagcuauuauacuugggacucuaccucu

SEQ ID NO: 327730 - RNA, 64 nt, hsa
agugauuauaugugugcucaaauaaguguuauguaucagcuagauacugagcuuugauagaaua

SEQ ID NO: 327731 - RNA, 64 nt, hsa
gccugagaggcaaaugcaucccgccuugugauguaucagcuauuuguagauaaauaaauugcag

SEQ ID NO: 327732 - RNA, 64 nt, hsa
guuuuuuaaaaaauaaauuuaaaauuuaacagcaaucagcuaacaggcaaauuaagauuuuuac

SEQ ID NO: 327733 - RNA, 64 nt, hsa
gaagaccacacggaagaguagcuacauacacuucaucagcuauggaucaucaacggcaauuuuu

SEQ ID NO: 327734 - RNA, 64 nt, hsa
auuccuaauaaucauuggauucugagagcugugcaucagcuagaaugacagguuugggaccccu

SEQ ID NO: 327735 - RNA, 64 nt, hsa
guagcugugauauuacauguugucaucacaguccaucagcuauccacccuugaccuugugcauu

SEQ ID NO: 327736 - RNA, 64 nt, hsa
agauugcuguagcucucacagggaagugguaaagaucagcuaaaccuggguuggggugcuuucu

SEQ ID NO: 327737 - RNA, 64 nt, hsa
ggaguacccuggcuguucuccacacucacaagacaucagcuauauacucugcuuggugcauaag

SEQ ID NO: 327738 - RNA, 64 nt, hsa
uuuauacuauuuugaauucauucauuucauugugaucagcuagcuuauucuuguguacuuuuuu

SEQ ID NO: 327739 - RNA, 64 nt, hsa
uuucuuucugauccuaaaucauuuuguuuuauaaaucagcuauagcaucuuucuagaauuaauc

SEQ ID NO: 327740 - RNA, 64 nt, hsa
guggaggauacaaugcaccagcggaaaaggauucaucagcuagaacagcaaguugaaaaacuca

SEQ ID NO: 327741 - RNA, 64 nt, hsa
ccuucccgccaauucuguccacuccucaccucgcaucagcuauaaauuuggaaguacuugucca

SEQ ID NO: 327742 - RNA, 64 nt, hsa
gaccccauguguccaucaccuagcugcaucacuuaucagcuauggucaaccugguuucaucugu

SEQ ID NO: 327743 - RNA, 64 nt, hsa
cacauuauuugccuuauaaaaaucuaaugaauucaucagcuagaauugcaagugcaauucuuau

SEQ ID NO: 327744 - RNA, 64 nt, hsa
uucagaacauugugcugucugucagcauauguauaucagcuacaaaauauauucaacuuugacu

SEQ ID NO: 327745 - RNA, 64 nt, hsa
auaucuaaucauuccucaagucuuacugauuuuuaucagcuagaaucuaucuccuuauuucuac

SEQ ID NO: 327746 - RNA, 64 nt, hsa
cacgcuuuuaaauuuacagcucaucacagaaaucaucagcuauacauuaguaaaaauaaggaca

SEQ ID NO: 327747 - RNA, 64 nt, hsa
aaaaauauagaauagaaauaagugcaggcuuggaaucagcuacaaauccuaaagauggggugug

SEQ ID NO: 327748 - RNA, 64 nt, hsa
aaguguguuaaagaccaaaauucuuggcauaauaaucagcuacauacaaaucacauauaguuua

SEQ ID NO: 327749 - RNA, 64 nt, hsa
aggagcacacccagcccccacauccugugccuccaucagcuaaacaccacgucacuucaugcag

SEQ ID NO: 327750 - RNA, 64 nt, hsa
aaucacccuacuguggugggcguaguagggagccaucagcuaggaagaaacgugggagauguga

SEQ ID NO: 327751 - RNA, 64 nt, hsa
uaaacaaagcgagguuaagguuagacucuugggaaucagcuaguuuucaaucuuauuagggugc

SEQ ID NO: 327752 - RNA, 64 nt, hsa
uacaagauuuuaauucaaauuuuucuucuuaaaaaucagcuauuuagagguggauaaauuggaa

SEQ ID NO: 327753 - RNA, 64 nt, hsa
uuguuaauuuuaaacaaacaaaguaucauuagugaucagcuagcuaccuucuacuuuccauuuu

SEQ ID NO: 327754 - RNA, 64 nt, hsa
agaagcccuuuacauuuccauaaaacacuuuagaaucagcuagucaauuuccacaaaauaaagu

SEQ ID NO: 327755 - RNA, 64 nt, hsa
ugggguauaagcaauaauauccacuaguguuguuaucagcuacuguaaccaaguggcugguuca

SEQ ID NO: 327756 - RNA, 64 nt, hsa
ucagagcaaugaccugcaugcagcaauaucaaacaucagcuaaccgaaagagcuuucugucaag

SEQ ID NO: 327757 - RNA, 64 nt, hsa
guugcauguccauguuagaaaacagaauccagucaucagcuaauacaaaugauuucccagagca

SEQ ID NO: 327758 - RNA, 64 nt, hsa
auguauuuuuggaaauauucuuggcucuagauuuaucagcuauuuuagcauuaaaggcugaugg

SEQ ID NO: 327759 - RNA, 64 nt, hsa
gauaucucucaauuaaagaaauacauugugaacuaucagcuacaaaguuguacugaauaacuau

SEQ ID NO: 327760 - RNA, 64 nt, hsa
ucccuccaagcuugggucaguguguuaacugcuuaucagcuauucagacaucuccaugguuucu

SEQ ID NO: 327761 - RNA, 64 nt, hsa
ugccugcucucgaggcagcaguggguucaggcccaucagcuaccccugcagcuggggaagacuu

SEQ ID NO: 327762 - RNA, 64 nt, hsa
cucaauaaauguuaacuauugugauugcugcugaaucagcuacaugcugaggaaacggccaaac

SEQ ID NO: 327763 - RNA, 64 nt, hsa
gacaaaucacuccaaacaaagcugggcacagagaaucagcuaggagaccaguuauucagggucc

SEQ ID NO: 327764 - RNA, 64 nt, hsa
uugaaacuucuccugugguuacugguauugagaaaucagcuaccaaagugaaaaaggacaagau

SEQ ID NO: 327765 - RNA, 64 nt, hsa
aagccaugcuggcucagucugagcugugggccacaucagcuaguggcucuucucaugcaucagu

SEQ ID NO: 327766 - RNA, 64 nt, hsa
uguaagcauuuuaggucccagaauggaaaaaaaaaucagcuauugguaauauaauaauguccuu

SEQ ID NO: 327767 - RNA, 64 nt, hsa
augaugacuccuacuccauuguuuaccccaaagcaucagcuaggcuggagugauuuguuacaaa

SEQ ID NO: 327768 - RNA, 64 nt, hsa
cggguguaugugcgcucagggucucuguuuaaguaucagcuaaagaugugcuuccuccgugucu

SEQ ID NO: 327769 - RNA, 64 nt, hsa
caguuguuacucucuuaacaucugcauuugagagaucagcuaauacuucucucaacaaaaaugg

SEQ ID NO: 327770 - RNA, 64 nt, hsa
agaggcaggcaguagcaagaaagcagagcguaacaucagcuagaugguaacaugcaaugucagc

SEQ ID NO: 327771 - RNA, 64 nt, hsa
ucaaagcguggacguguguccccauggcuuguggaucagcuaagcucgggaucauuuccauaag

SEQ ID NO: 327772 - RNA, 64 nt, hsa
auacuaugcauacauuaucuuguuuauucuuucuaucagcuagauaauuugcauauuuuauccc

SEQ ID NO: 327773 - RNA, 64 nt, hsa
aaggagcuuuucaaauuacccaguccaccacagaaucagcuaaugugacagaaguaaauauagu

SEQ ID NO: 327774 - RNA, 64 nt, hsa
uuauuuuuuaauaacccuugaaagucaugaacacaucagcuagcaaaagaaguaacaagaguga

SEQ ID NO: 327775 - RNA, 64 nt, hsa
gugggggcagcguagaagugguauauccaaguauaucagcuacuguaguugucacagucuugug

SEQ ID NO: 327776 - RNA, 64 nt, hsa
gagaagcuucagaaaguuccgaggaccugcuaaaaucagcuacuagaaucugcugccagagggg

SEQ ID NO: 327777 - RNA, 64 nt, hsa
uuuuaaaaaucaguuucauuuucauauuucauagaucagcuauugguagcuuuuugauuucccc

SEQ ID NO: 327778 - RNA, 64 nt, hsa
agcaucugcaaagccgauucauguacugaugccaaucagcuagagcaauguaggcuuuuuuuaa

SEQ ID NO: 327779 - RNA, 64 nt, hsa
agacuauagauuuuuuuuuaauauaggauuauaaaucagcuagugaaagaccucagagcaguug

SEQ ID NO: 327780 - RNA, 64 nt, hsa
cucuuauacagugcaacccaaauaccgcgaaugcaucagcuaaagcagcguguaaauaggagug

SEQ ID NO: 327781 - RNA, 64 nt, hsa
uauugauguuuuagaaugguuuucaucaguugggaucagcuauauggcaaauagguaucaucaa

SEQ ID NO: 327782 - RNA, 64 nt, hsa
cccagagccaccccuauacuccagucucccuggcaucagcuacugcaguacugggguacuugcc

SEQ ID NO: 327783 - RNA, 64 nt, hsa
ucuaucuguggccuuguucuucauuucaguguuaaucagcuaaacagaaguuguugcuuaugau

SEQ ID NO: 327784 - RNA, 64 nt, hsa
cagagauauaaauuaccacauuugccuucccuucaucagcuaacacuuaucacuuauacuacca

SEQ ID NO: 327785 - RNA, 64 nt, hsa
uaaaaaucagccaggcgucgugcacaccuguaguaucagcuacuuguaaggcuguggcagaagu

SEQ ID NO: 327786 - RNA, 64 nt, hsa
uuuaaaacauuuuaagauacagcuacucaucaacaucagcuaaauauagcugauauauauauau

SEQ ID NO: 327787 - RNA, 64 nt, hsa
uuucaggaauuucuguucaggcuuccuccuccucaucagcuauuuuacccaucucagaacgucc

SEQ ID NO: 327788 - RNA, 64 nt, hsa
aauuauauaugcugaauauuaagcuacugggguuaucagcuauuugggaagaguguaagugacu

SEQ ID NO: 327789 - RNA, 64 nt, hsa
aaauuagcugggugugguggcacaugccuguaauaucagcuacucaggaggcugaggcaggaga

SEQ ID NO: 327790 - RNA, 64 nt, hsa
auguaacagcauauuaaacuggagacagugaugaaucagcuacaaagguaauauuguauuaaaa

SEQ ID NO: 327791 - RNA, 64 nt, hsa
cccccauuaaucaguucauuagaaauauuuuaaaaucagcuauuuugugaagccaugaguucca

SEQ ID NO: 327792 - RNA, 64 nt, hsa
accugugaaaugaggcaguuucccucacguugccaucagcuaccaggagcgaugcuggugguca

SEQ ID NO: 327793 - RNA, 64 nt, hsa
cacuggaccaugugaacagccauccugaacugccaucagcuaccacacuggacucugcagggca

SEQ ID NO: 327794 - RNA, 64 nt, hsa
cagcacuaagacucucaggucagguaccuuggugaucagcuacuaguucuuccagcccucauug

SEQ ID NO: 327795 - RNA, 64 nt, hsa
agaauguaugaggaagugggaaguaucucagagaaucagcuaaguuuccuaacuuguccaucca

SEQ ID NO: 327796 - RNA, 64 nt, hsa
cauguucauccaaaaguauuaauagaaauucucuaucagcuauucagucuuaauuucacuagua

SEQ ID NO: 327797 - RNA, 64 nt, hsa
gcuuuuuuuucaucacuugauuauuuucuuuaaaaucagcuauuacaggauauuuuuuuauuuu

SEQ ID NO: 327798 - RNA, 64 nt, hsa
cugggggcagagcuucuauuuauggcacauagacaucagcuaggcuuuugggaaucguuugugu

SEQ ID NO: 327799 - RNA, 64 nt, hsa
agcuucgccauaaccaaguagagucuaucuuccuaucagcuauugacauguauggacaucaauu

SEQ ID NO: 327800 - RNA, 64 nt, hsa
aaccauccuaaagcguuaacugcucauaauuuuaaucagcuacaguuaugaaaaaggaagaauu

SEQ ID NO: 327801 - RNA, 64 nt, hsa
aaaauaugagguuuuuagccugaacuucaaauguaucagcuauuuuuaaacauuauuuacucgg

SEQ ID NO: 327802 - RNA, 64 nt, hsa
gguuucuuuaguucuuuacugucacugucauguaaucagcuaauucucuguggauguugcugua

SEQ ID NO: 327803 - RNA, 64 nt, hsa
aggaaaaaaaaagacuucuguucaaaguuaacuuaucagcuacauccucuguaacgugguucau

SEQ ID NO: 327804 - RNA, 64 nt, hsa
agucccucagagauggcccuggcucugaggucacaucagcuagguuugggaggccccucagcuu

SEQ ID NO: 327805 - RNA, 64 nt, hsa
acucagaagaauggcauauucguucucauuaguaaucagcuauuuugucacuuucuuguugacu

SEQ ID NO: 327806 - RNA, 64 nt, hsa
augaguucagcuagaagucauaccacccucaggaaucagcuaaguaauuauuacuugauucuuu

SEQ ID NO: 327807 - RNA, 64 nt, hsa
cacaacaauuaacagucuucaggcaaaacgucgaaucagcuauuuacugccaaagggaaauauc

SEQ ID NO: 327808 - RNA, 64 nt, hsa
ucagcagcaguaagaggaaugucucccuccugauaucagcuaauucagguaaggacucuugguc

SEQ ID NO: 327809 - RNA, 64 nt, hsa
uauaaaauaaguaugaucauuauuauugaacucuaucagcuaugaagcuaaauuuuaaagucaa

SEQ ID NO: 327810 - RNA, 64 nt, hsa
gaugccaaggagcgggcagcagccaaagacaaguaucagcuagcaucaggacagaaaggugucc

SEQ ID NO: 327811 - RNA, 64 nt, hsa
gcaugaaccacccagaguggcccaagacucccagaucagcuaccaggcaggauauuccaagggc

SEQ ID NO: 327812 - RNA, 64 nt, hsa
augagggcucaccaaguguaagccacaaauacacaucagcuauagcacaaauauacuuguguua

SEQ ID NO: 327813 - RNA, 64 nt, hsa
gcaaugcucugugaguacccuuugugagggaaccaucagcuagcagaugagcaccguauauuca

SEQ ID NO: 327814 - RNA, 64 nt, hsa
agccugugauaaacauuauuccuauagauuguagaucagcuauaaguauuccuuaugagaaaga

SEQ ID NO: 327815 - RNA, 64 nt, hsa
acaguuguuuuuauucuuccucaaagcauuugcaaucagcuaccauucaaaauugcuucuucuu

SEQ ID NO: 327816 - RNA, 64 nt, hsa
acaguugcuuucauucuuccucaaaguauuuaccaucagcuacaguccaaaauugcuuuuuguu

SEQ ID NO: 327817 - RNA, 64 nt, hsa
aaaguugcuuugauucuuccucaaaguauuuaaaaucagcuacaguccaaaauugcuuuuucuu

SEQ ID NO: 327818 - RNA, 64 nt, hsa
ugagugcuuuuucuuaauaaguauaaccuuaaacaucagcuaauacaccuggugugcauuuuca

SEQ ID NO: 327819 - RNA, 64 nt, hsa
uggauaaagcuuguaaguuagaaauggcaagauaaucagcuauaugaagaaucucagcugggug

SEQ ID NO: 327820 - RNA, 64 nt, hsa
gugugguguaauuuauaaaauuagaaagcaacuuaucagcuacuuaagagaaauggcaaguuuu

SEQ ID NO: 327821 - RNA, 64 nt, hsa
gugauaaaaaccgacagguuguucaaaggcccagaucagcuaaagcauguauauaagagcacgu

SEQ ID NO: 327822 - RNA, 64 nt, hsa
ccaccuggcuuugaaucugggcccuacuuaacuuaucagcuaugugguuuugggcauaagccac

SEQ ID NO: 327823 - RNA, 64 nt, hsa
uuuucagccugacugcuuuagucacuggacgagcaucagcuacugcggugucagaucacuucuc

SEQ ID NO: 327824 - RNA, 64 nt, hsa
cuuaacugccuaaucuuaauuacaggaacugugcaucagcuauuuaugauucuauaagcuauuu

SEQ ID NO: 327825 - RNA, 64 nt, hsa
ugugauuuauguguuaaccucagucacgagguugaucagcuaauugugggaccaaaaugugccc

SEQ ID NO: 327826 - RNA, 64 nt, hsa
ggcacagagaggugaugucaucugccuggugucaaucagcuagcaagugauggagcccagauuu

SEQ ID NO: 327827 - RNA, 64 nt, hsa
ccugauauagaucacauaacagaaugcaccagucaucagcuauucaguugguaagcuuccagga

SEQ ID NO: 327828 - RNA, 64 nt, hsa
acuugguuuugcacauuaagaggcccauaaguuuaucagcuauuuacaaccuucauuucaucac

SEQ ID NO: 327829 - RNA, 64 nt, hsa
agggguucaagacagagcccaccugaucaagaucaucagcuaccuucaaauuauugaccuggac

SEQ ID NO: 327830 - RNA, 64 nt, hsa
uuuaguuuuguuugcccaaggauuaauugaggaaaucagcuaagaaaauggacuuuagacaaaa

SEQ ID NO: 327831 - RNA, 64 nt, hsa
gcccagggaaggccgauaauuuaaacagucucccaccaccuaccccaagagauacugguuguau

SEQ ID NO: 327832 - RNA, 64 nt, hsa
ugccgaugaccgccugccuagcccugcgccggcaaccaccuaguggcccagggaaggccgauaa

SEQ ID NO: 327833 - RNA, 64 nt, hsa
agugugcugcccaguagcaaaccauggcagacucaccaccuauucugaguuccagggcugcugu

SEQ ID NO: 327834 - RNA, 64 nt, hsa
gaggcugauucuaauugucugguugaggggccacaccaccuauuccccccaccuaacucaugcc

SEQ ID NO: 327835 - RNA, 64 nt, hsa
auugcacuucagccuggugacaugagcaaaacuguugucucaacaaaaugaaauuauggaaccu

SEQ ID NO: 327836 - RNA, 64 nt, hsa
caaguaguaauuaggcugaguuggguggagagguuugucucagccucugcuguucucggaaacu

SEQ ID NO: 327837 - RNA, 64 nt, hsa
gaagguacccaguagacucuuaagccuuuacugcuugucucacuagaaacauuuauuucugacc

SEQ ID NO: 327838 - RNA, 64 nt, hsa
gcauuaguauaucaucauaaaauagacaauguuuuugucucaagaacaagaauaaaauugaaau

SEQ ID NO: 327839 - RNA, 64 nt, hsa
uagguucccucgugcagugccuggugcucucaaauugucucaaaaggaccaagaggaaaagagu

SEQ ID NO: 327840 - RNA, 64 nt, hsa
uccagagaggguacagaaaaagcacacagauggcuugucucaggaguguugaaugugugccccg

SEQ ID NO: 327841 - RNA, 64 nt, hsa
aguggaucuucuuggagcgagcagaugcaaucucuugucucacaugcuagcaacauaccaggua

SEQ ID NO: 327842 - RNA, 64 nt, hsa
gagccguugugcuccagccugggcgacagaagucuugucucaagaagaaaacgaacugggaaaa

SEQ ID NO: 327843 - RNA, 64 nt, hsa
uacuuaaggauaauaggacaagacaaauuacagauugucucagagaaaacaaaugaguuacucu

SEQ ID NO: 327844 - RNA, 64 nt, hsa
cuucugaugauuccaauguguuggaaaguuuaccuugucucagauguaacugguaaaggcugau

SEQ ID NO: 327845 - RNA, 64 nt, hsa
gauauuaauacaugaaauuuuuauaauugucucauugucucauuuagaaacauccauauuuuuc

SEQ ID NO: 327846 - RNA, 64 nt, hsa
cuugucuugauauuaauacaugaaauuuuuauaauugucucauugucucauuuagaaacaucca

SEQ ID NO: 327847 - RNA, 64 nt, hsa
gaaugcugacuauaaguagugauaguggguauucuugucucauccucaaucucagggguggugg

SEQ ID NO: 327848 - RNA, 64 nt, hsa
augcuucccauggaccagagaaaccuggccuggguugucucaaauccuguccacaaggcaacuc

SEQ ID NO: 327849 - RNA, 64 nt, hsa
gaaacugguacaaccugccauaagaugaaaugaauugucucaacaaagcaauauuagaagagcc

SEQ ID NO: 327850 - RNA, 64 nt, hsa
uuuuugcuguggcccugcuuuuccuucuucccacuugucucaugucugugaaacugguacaacc

SEQ ID NO: 327851 - RNA, 64 nt, hsa
cuccacagcguggagacgucccucuaacaagaacuugucucagcacaugcgcacacgcacacuc

SEQ ID NO: 327852 - RNA, 64 nt, hsa
aaaccaccaacgugcacuggcacccucagaaggcuugucucaccuccaccggcauccacacaaa

SEQ ID NO: 327853 - RNA, 64 nt, hsa; identical to SEQ ID NO: 88546

SEQ ID NO: 327854 - RNA, 64 nt, hsa; identical to SEQ ID NO: 88547

SEQ ID NO: 327855 - RNA, 51 nt, hsa; identical to SEQ ID NO: 88548

SEQ ID NO: 327856 - RNA, 64 nt, hsa; identical to SEQ ID NO: 88549

SEQ ID NO: 327857 - RNA, 64 nt, hsa; identical to SEQ ID NO: 88550

SEQ ID NO: 327858 - RNA, 64 nt, hsa; identical to SEQ ID NO: 88551

SEQ ID NO: 327859 - RNA, 64 nt, hsa; identical to SEQ ID NO: 88552

SEQ ID NO: 327860 - RNA, 64 nt, hsa; identical to SEQ ID NO: 88553

SEQ ID NO: 327861 - RNA, 64 nt, hsa; identical to SEQ ID NO: 88554

SEQ ID NO: 327862 - RNA, 64 nt, hsa; identical to SEQ ID NO: 88555

SEQ ID NO: 327863 - RNA, 64 nt, hsa; identical to SEQ ID NO: 88556

SEQ ID NO: 327864 - RNA, 64 nt, hsa; identical to SEQ ID NO: 88557

SEQ ID NO: 327865 - RNA, 64 nt, hsa; identical to SEQ ID NO: 88558

SEQ ID NO: 327866 - RNA, 64 nt, hsa; identical to SEQ ID NO: 88559

SEQ ID NO: 327867 - RNA, 64 nt, hsa; identical to SEQ ID NO: 88560

SEQ ID NO: 327868 - RNA, 64 nt, hsa; identical to SEQ ID NO: 88561

SEQ ID NO: 327869 - RNA, 64 nt, hsa; identical to SEQ ID NO: 88562

SEQ ID NO: 327870 - RNA, 64 nt, hsa; identical to SEQ ID NO: 88563

SEQ ID NO: 327871 - RNA, 64 nt, hsa; identical to SEQ ID NO: 88564

SEQ ID NO: 327872 - RNA, 64 nt, hsa; identical to SEQ ID NO: 88565

SEQ ID NO: 327873 - RNA, 64 nt, hsa; identical to SEQ ID NO: 88566

SEQ ID NO: 327874 - RNA, 64 nt, hsa; identical to SEQ ID NO: 88567

SEQ ID NO: 327875 - RNA, 64 nt, hsa; identical to SEQ ID NO: 88568

SEQ ID NO: 327876 - RNA, 64 nt, hsa; identical to SEQ ID NO: 88569

SEQ ID NO: 327877 - RNA, 64 nt, hsa; identical to SEQ ID NO: 88570

SEQ ID NO: 327878 - RNA, 64 nt, hsa; identical to SEQ ID NO: 88571

SEQ ID NO: 327879 - RNA, 64 nt, hsa; identical to SEQ ID NO: 88572

SEQ ID NO: 327880 - RNA, 64 nt, hsa; identical to SEQ ID NO: 88573

SEQ ID NO: 327881 - RNA, 64 nt, hsa; identical to SEQ ID NO: 88574

SEQ ID NO: 327882 - RNA, 64 nt, hsa; identical to SEQ ID NO: 88575

SEQ ID NO: 327883 - RNA, 64 nt, hsa; identical to SEQ ID NO: 88576

SEQ ID NO: 327884 - RNA, 64 nt, hsa; identical to SEQ ID NO: 88577

SEQ ID NO: 327885 - RNA, 64 nt, hsa; identical to SEQ ID NO: 88578

SEQ ID NO: 327886 - RNA, 64 nt, hsa; identical to SEQ ID NO: 88579

SEQ ID NO: 327887 - RNA, 64 nt, hsa; identical to SEQ ID NO: 88580

SEQ ID NO: 327888 - RNA, 64 nt, hsa; identical to SEQ ID NO: 88581

SEQ ID NO: 327889 - RNA, 64 nt, hsa; identical to SEQ ID NO: 88582

SEQ ID NO: 327890 - RNA, 64 nt, hsa; identical to SEQ ID NO: 88583

SEQ ID NO: 327891 - RNA, 64 nt, hsa; identical to SEQ ID NO: 88584

SEQ ID NO: 327892 - RNA, 64 nt, hsa; identical to SEQ ID NO: 88585

SEQ ID NO: 327893 - RNA, 64 nt, hsa; identical to SEQ ID NO: 88586

SEQ ID NO: 327894 - RNA, 64 nt, hsa; identical to SEQ ID NO: 88587

SEQ ID NO: 327895 - RNA, 64 nt, hsa; identical to SEQ ID NO: 88588

SEQ ID NO: 327896 - RNA, 64 nt, hsa; identical to SEQ ID NO: 88589

SEQ ID NO: 327897 - RNA, 64 nt, hsa; identical to SEQ ID NO: 88590

SEQ ID NO: 327898 - RNA, 64 nt, hsa; identical to SEQ ID NO: 88591

SEQ ID NO: 327899 - RNA, 64 nt, hsa; identical to SEQ ID NO: 88592

SEQ ID NO: 327900 - RNA, 64 nt, hsa; identical to SEQ ID NO: 88593

SEQ ID NO: 327901 - RNA, 62 nt, hsa
gcagaucacgagaucaggaguucaagaccagccuggccaauaugaugaaaccccgucucuac

SEQ ID NO: 327902 - RNA, 62 nt, hsa
ggaucaccugaggucagaaguuugagaccagccuggccaacauggugaaaccccgucucuac

SEQ ID NO: 327903 - RNA, 62 nt, hsa
agugcugggauuacaggcaugagccaccacgccuggccaaaaaaauauguuuuaaauguccc

SEQ ID NO: 327904 - RNA, 62 nt, hsa
ggaucacccaaggucaggaguuugagaccagccuggccaaauggugaaaccccaucucuacg

SEQ ID NO: 327905 - RNA, 62 nt, hsa
uuuguuuaauaccuuccccaagaggggacagucuggccaacuugcuccaguaaugcaauaaa

SEQ ID NO: 327906 - RNA, 62 nt, hsa
cuggauagacugccugcguccuuaccacugaucuggccaagaaugaggcccucccaacacuu

SEQ ID NO: 327907 - RNA, 62 nt, hsa
ggaucaccugaggucaggaauucaagaccagccuggccaacauggugaaaccccgucuccac

SEQ ID NO: 327908 - RNA, 62 nt, hsa
cugggauuacaggugugagccaccgcacccggcuggccaaucuuaucagaagugagcuacca

SEQ ID NO: 327909 - RNA, 62 nt, hsa
agaucaccugaggucaggaguucgagaccacccuggccaacauggugaaaccccaucucuac

SEQ ID NO: 327910 - RNA, 62 nt, hsa
ggaucaccugagguuagaaguuugagaccagccuggccaacauggugaaaccuggccucuac

SEQ ID NO: 327911 - RNA, 62 nt, hsa
ggaucaccugaggucaggaguucgagauuagucuggccaacauggugaaaccccaucucuac

SEQ ID NO: 327912 - RNA, 62 nt, hsa
ugcuacuucagaagccuuauaggauuuucuuucuggccaagauuuccuucuguaucacucca

SEQ ID NO: 327913 - RNA, 62 nt, hsa
acggaucacgaggucaggagaucaagaccauccuggccaacauggugaaaccccaucucuac

SEQ ID NO: 327914 - RNA, 62 nt, hsa
ggaucucuugaggucgggaguuugagaccagccuggccaacauggugaaacccugucuuuac

SEQ ID NO: 327915 - RNA, 62 nt, hsa
ggggaucacgaggucaagagaucgagaccauccuggccaacauggugaaaccccgucucuaa

SEQ ID NO: 327916 - RNA, 62 nt, hsa
acccuccugccuguuuuucucugcaucccaaccuggccaaggccccuccuguggggugccca

SEQ ID NO: 327917 - RNA, 62 nt, hsa
agugcugggauuacagacaugagccaccgagccuggccaauuuuuguguuuuuuguagagac

SEQ ID NO: 327918 - RNA, 62 nt, hsa
gcagaucacgaggucaagagaucaagaccauccuggccaacauggugaaauccugccucuac

SEQ ID NO: 327919 - RNA, 62 nt, hsa
agggcugagauuacaggugugagcuaccucaccuggccaaaacaguuuuuuuagaaaugaag

SEQ ID NO: 327920 - RNA, 62 nt, hsa
gugcuuggcuuuccaaggauacugcggagacucuggccaagcugaugaccuucugaaguguc

SEQ ID NO: 327921 - RNA, 62 nt, hsa
cagaaagccaucaggugcucaaucaucuucuccuggccaaggcucugaccaugcuuaguacu

SEQ ID NO: 327922 - RNA, 62 nt, hsa
ggaccacaugaggucaggaguuugagaucagccuggccaacauggugaaaccccaucucuac

SEQ ID NO: 327923 - RNA, 62 nt, hsa
gcggaucaugaggucaagagaucaagaucauccuggccaacauggugaaacccugucucuac

SEQ ID NO: 327924 - RNA, 62 nt, hsa
gcggaucacaagguccagagaucgagaccauccuggccaacauggugaaaccccgucucuac

SEQ ID NO: 327925 - RNA, 62 nt, hsa
ggaucacuugaggccaggaguucaagaccagccuggccaacauggcaaaaucccaucucuac

SEQ ID NO: 327926 - RNA, 62 nt, hsa
ucuuuugaauauuuuuuauuaagccaccacuccuggccaacuguaguugaacucagguauug

SEQ ID NO: 327927 - RNA, 62 nt, hsa
ggaucacuugaggucaggaguucaaaaccagccuggccaagauggugaaaccccaucucuac

SEQ ID NO: 327928 - RNA, 62 nt, hsa
ggaucaccugaggacaggaguucgagaccagucuggccaacauggggaaaccccgucucuac

SEQ ID NO: 327929 - RNA, 62 nt, hsa
agaucaccugaggucaggaguuugagaccagccuggccaauguggugaaaccccaucucuac

SEQ ID NO: 327930 - RNA, 62 nt, hsa
aaaacacuugagaagacaucuauuggccaucucuggccaauuacacuaagaaacauaucaag

SEQ ID NO: 327931 - RNA, 62 nt, hsa
gccuagacgguucucuuggucuuauucccauccuggccaaugcuuaaauacuauuuguugaa

SEQ ID NO: 327932 - RNA, 62 nt, hsa
aaaucaccugaggucaagaguuugagaccagccuggccaacauggugaaaccccaucucuac

SEQ ID NO: 327933 - RNA, 62 nt, hsa
ggauugcuugaggccaggaguucgagaccagccuggccaacguggugaaacgcugucucuac

SEQ ID NO: 327934 - RNA, 62 nt, hsa
ggucucuauuagucaguaaugaagacgacagccuggccaaccaagggaaaggaaauuaguau

SEQ ID NO: 327935 - RNA, 62 nt, hsa
uggacucgcccagcucuccucggccuggggcucuggccaaggaugggcuggaggucauucag

SEQ ID NO: 327936 - RNA, 62 nt, hsa
gcacuuugggaggccaggaguucgagaccagccuggccaacauggugaaacccggucucuac

SEQ ID NO: 327937 - RNA, 62 nt, hsa
ggaucaccugaggucaggaguuugagaccagccuggccaacauggcaaaaccccgucucuac

SEQ ID NO: 327938 - RNA, 62 nt, hsa
ggaucacuugaggucaggagcucgagaccagccuggccaacacggugaaaccccaucucuac

SEQ ID NO: 327939 - RNA, 62 nt, hsa
ggaucacuugaggucaggagcucaagaccagccuggccaacauggugaaaccccaucucuac

SEQ ID NO: 327940 - RNA, 62 nt, hsa
cucaguucuugucagugaagcuauccaaauaacuggccaacuaguuguuaaaagcuaacagc

SEQ ID NO: 327941 - RNA, 62 nt, hsa
gugcuauuuuguaguuuguuauaugaaagagucuggccaaaacgguaauacgugaaagcaaa

SEQ ID NO: 327942 - RNA, 62 nt, hsa
ggaucaccugagaucaggaguuccagaccagccuggccaacauggcgaaaccccaucucuac

SEQ ID NO: 327943 - RNA, 62 nt, hsa
gcggaucacaaggucaggaguucgagaccagccuggccaauauggugaaaccccaucucuac

SEQ ID NO: 327944 - RNA, 62 nt, hsa
aggccugccaggucuucacguugaggauucaacuggccaaucacaggacagguguccuggcc

SEQ ID NO: 327945 - RNA, 62 nt, hsa
ggaucaccugaagucagguguuugagaccagccuggccaacaugguggaacccaaucucuac

SEQ ID NO: 327946 - RNA, 62 nt, hsa
acugcuaauaauucuguaaggacacaucaaagcuggccaaaauaaugaauuuuuuuuaaaaa

SEQ ID NO: 327947 - RNA, 62 nt, hsa
ggccaagaccaugggaaaaaaagccaugcucacuggccaauaaagagcuugaugcugccugg

SEQ ID NO: 327948 - RNA, 62 nt, hsa
ugcucacuggccaauaaagagcuugaugcugccuggccaaaugaggugacucagauagaauc

SEQ ID NO: 327949 - RNA, 62 nt, hsa
ggaucacucaaggucaggcauuugagaccagccuggccaacauagugaaaccccgucucuau

SEQ ID NO: 327950 - RNA, 62 nt, hsa
agaucaccugaggcuaggaguugcagaccagccuggccaacauggcaaaaccccgucucuac

SEQ ID NO: 327951 - RNA, 62 nt, hsa
ggaucaccugaggucaggaguucaagaccagccuggccaacauggugaaaccccaucucuac

SEQ ID NO: 327952 - RNA, 62 nt, hsa
gcaugcagcuuguggugaguacuguucuaggacuggccaaaaaugggcaaaauguaucacuc

SEQ ID NO: 327953 - RNA, 62 nt, hsa
cagcagcccugucuguuaccaugugagucauacuggccaaagcuuaguccuagcauaugcac

SEQ ID NO: 327954 - RNA, 62 nt, hsa
agcuuaguccuagcauaugcaccugagccaaccuggccaaucagauuguuuugucaauaauu

SEQ ID NO: 327955 - RNA, 62 nt, hsa
cgaucacuugaggucaggaguucaagaccagccuggccaacauggugaaaccccaucucuac

SEQ ID NO: 327956 - RNA, 62 nt, hsa
ggaucacuugaggccaggaguucaagaccagccuggccaacaugaugagaccuccgucucua

SEQ ID NO: 327957 - RNA, 62 nt, hsa
agguggguggaucacuggaguuugagaccacccuggccaacauggugaaaccccaucucuac

SEQ ID NO: 327958 - RNA, 62 nt, hsa
gcggaucacgaggucaggaguucgagaccagccuggccaacauagugaaaccccaucucuac

SEQ ID NO: 327959 - RNA, 62 nt, hsa
aguguugggauuacaggugugagccacagcaccuggccaaccaacacuucucagggccucuu

SEQ ID NO: 327960 - RNA, 62 nt, hsa
guagcugggacuacaggcaugagccaccaugccuggccaacucacauuuuucuuucuauuau

SEQ ID NO: 327961 - RNA, 62 nt, hsa
cccagcagcaccugcacccacuuccagcugcucuggccaaaaucuccgcucggccaggcccc

SEQ ID NO: 327962 - RNA, 62 nt, hsa
acaucaccugaguucaggaguucaagaccagccuggccaacauggugaaaucccgucucuac

SEQ ID NO: 327963 - RNA, 62 nt, hsa
agaucacuugaggucaggaguucaagaccagccuggccaacauggugaaaccccaucucuac

SEQ ID NO: 327964 - RNA, 62 nt, hsa
gaucacuugagguuaggaguuugagaacuggccuggccaacauagcaaaaccucaucucuac

SEQ ID NO: 327965 - RNA, 62 nt, hsa
gcagaucacgaggucaggaguucgagaccauccuggccaacauggugaaaccccgucucuac

SEQ ID NO: 327966 - RNA, 62 nt, hsa
ggauugcuugaggccaggaguuagagaccagccuggccaacaaggcaaaaccccgucucuac

SEQ ID NO: 327967 - RNA, 62 nt, hsa
gcucacgcugaggucaggaguucgagaccagccuggccaaccaacauggugaaaccucgugu

SEQ ID NO: 327968 - RNA, 62 nt, hsa
agaucagcugaggucaggagaucgagaccagccuggccaacauggcgaaaccccgucucuac

SEQ ID NO: 327969 - RNA, 64 nt, hsa
gacggauucaaauguuuucauguaacuauguaaaaagcucuaagcucuagagucuagauccagu

SEQ ID NO: 327970 - RNA, 64 nt, hsa
ucaaauguuuucauguaacuauguaaaaagcucuaagcucuagagucuagauccagucacugac

SEQ ID NO: 327971 - RNA, 64 nt, hsa
cuguuauuucugauacuuuugaaaaacuaauaaaaacuaauaaaagaagcguaaaaagugaguu

SEQ ID NO: 327972 - RNA, 64 nt, hsa
ucccaacauucuguuauuucugauacuuuugaaaaacuaauaaaaacuaauaaaagaagcguaa

SEQ ID NO: 327973 - RNA, 64 nt, hsa
augguuuaaauguuuuauuauccauaaugaucuaaacuaauaagauucaccaaaaaguaaaaau

SEQ ID NO: 327974 - RNA, 64 nt, hsa
ugaguuuaauagcauaacauuaccaagguaaucaaacuaauaaaauuccauauaucuucccugc

SEQ ID NO: 327975 - RNA, 64 nt, hsa
acaaaucagaagaaaaagcaagcauuauaaacaaaacuaauaacuguuuuacugcuuuaagaaa

SEQ ID NO: 327976 - RNA, 64 nt, hsa
agcugagacauuuuaagaucucaaguuuuuauuuaacuaauacucaaaauauggacuuuucaug

SEQ ID NO: 327977 - RNA, 64 nt, hsa
uuacauuaaguuuagcacuguaucagaaugaagaaacuaauauuuuacauaaaaacuaauacuu

SEQ ID NO: 327978 - RNA, 64 nt, hsa
guaucagaaugaagaaacuaauauuuuacauaaaaacuaauacuuucaauuuuuuauauaguaa

SEQ ID NO: 327979 - RNA, 64 nt, hsa
uacgguaugaagucuucuguauaguuuguuuuuaaacuaauauuuguuucaguauuuugucuga

SEQ ID NO: 327980 - RNA, 64 nt, hsa
acuaguuuauuugccuugccauaacacauuuuuuaacuaauaaggcuuagaugaacaugguguu

SEQ ID NO: 327981 - RNA, 64 nt, hsa
ucauuuucaccagcauaauuuuaucuuaaggaauaacuaauaggaaaagucagcuuaauuauuu

SEQ ID NO: 327982 - RNA, 64 nt, hsa
auauucgauagaaaugaaaaucugccguggaauuaacuaauaaguaguaacaauaaacuucaua

SEQ ID NO: 327983 - RNA, 64 nt, hsa
acccauuucgucaagugaccucucaucuucuauaaacuaauacaggaauucuuuccaaagcaau

SEQ ID NO: 327984 - RNA, 64 nt, hsa
aauuaagucuuuaaaauuuaggcacuuuaaggagaacuaauaacuuuuuccauguaucaagauu

SEQ ID NO: 327985 - RNA, 64 nt, hsa
uacacauucuuuucuuaaacuuuaccuguguuuuaacuaauauugugucaguguauuaaaaauu

SEQ ID NO: 327986 - RNA, 64 nt, hsa
augguagcaguuacaaagagccucugccuucccaaacuaauauuuaucacacauggucauuaaa

SEQ ID NO: 327987 - RNA, 64 nt, hsa; identical to SEQ ID NO: 327985

SEQ ID NO: 327988 - RNA, 64 nt, hsa; identical to SEQ ID NO: 327986

SEQ ID NO: 327989 - RNA, 64 nt, hsa; identical to SEQ ID NO: 160506

SEQ ID NO: 327990 - RNA, 64 nt, hsa; identical to SEQ ID NO: 160507

SEQ ID NO: 327991 - RNA, 64 nt, hsa; identical to SEQ ID NO: 160508

SEQ ID NO: 327992 - RNA, 64 nt, hsa; identical to SEQ ID NO: 160509

SEQ ID NO: 327993 - RNA, 64 nt, hsa; identical to SEQ ID NO: 160510

SEQ ID NO: 327994 - RNA, 64 nt, hsa; identical to SEQ ID NO: 160511

SEQ ID NO: 327995 - RNA, 64 nt, hsa; identical to SEQ ID NO: 160512

SEQ ID NO: 327996 - RNA, 64 nt, hsa; identical to SEQ ID NO: 160513

SEQ ID NO: 327997 - RNA, 64 nt, hsa; identical to SEQ ID NO: 160514

SEQ ID NO: 327998 - RNA, 64 nt, hsa; identical to SEQ ID NO: 160515

SEQ ID NO: 327999 - RNA, 64 nt, hsa; identical to SEQ ID NO: 160516

SEQ ID NO: 328000 - RNA, 64 nt, hsa; identical to SEQ ID NO: 160517

SEQ ID NO: 328001 - RNA, 64 nt, hsa
uguacgcuagagcaugcugccugaguauuacuaguggacguaggauauuuucccuaccuaagaa

SEQ ID NO: 328002 - RNA, 64 nt, hsa
gagauaaauaaaagauagcaauaugagacacagguggacguagaguuggccuuuuuacaggcaa

SEQ ID NO: 328003 - RNA, 64 nt, hsa; identical to SEQ ID NO: 246823

SEQ ID NO: 328004 - RNA, 64 nt, hsa; identical to SEQ ID NO: 246824

SEQ ID NO: 328005 - RNA, 64 nt, hsa; identical to SEQ ID NO: 246825

SEQ ID NO: 328006 - RNA, 64 nt, hsa; identical to SEQ ID NO: 246826

SEQ ID NO: 328007 - RNA, 64 nt, hsa; identical to SEQ ID NO: 246827

SEQ ID NO: 328008 - RNA, 64 nt, hsa; identical to SEQ ID NO: 246828

SEQ ID NO: 328009 - RNA, 64 nt, hsa; identical to SEQ ID NO: 246829

SEQ ID NO: 328010 - RNA, 50 nt, hsa; identical to SEQ ID NO: 246830

SEQ ID NO: 328011 - RNA, 64 nt, hsa; identical to SEQ ID NO: 246831

SEQ ID NO: 328012 - RNA, 64 nt, hsa; identical to SEQ ID NO: 246832

SEQ ID NO: 328013 - RNA, 64 nt, hsa; identical to SEQ ID NO: 246833

SEQ ID NO: 328014 - RNA, 64 nt, hsa; identical to SEQ ID NO: 246834

SEQ ID NO: 328015 - RNA, 64 nt, hsa; identical to SEQ ID NO: 246835

SEQ ID NO: 328016 - RNA, 64 nt, hsa; identical to SEQ ID NO: 246836

SEQ ID NO: 328017 - RNA, 64 nt, hsa; identical to SEQ ID NO: 246837

SEQ ID NO: 328018 - RNA, 64 nt, hsa; identical to SEQ ID NO: 246838

SEQ ID NO: 328019 - RNA, 64 nt, hsa; identical to SEQ ID NO: 246839

SEQ ID NO: 328020 - RNA, 64 nt, hsa; identical to SEQ ID NO: 246840

SEQ ID NO: 328021 - RNA, 64 nt, hsa; identical to SEQ ID NO: 246841

SEQ ID NO: 328022 - RNA, 64 nt, hsa; identical to SEQ ID NO: 246842

SEQ ID NO: 328023 - RNA, 64 nt, hsa; identical to SEQ ID NO: 246843

SEQ ID NO: 328024 - RNA, 64 nt, hsa; identical to SEQ ID NO: 246844

SEQ ID NO: 328025 - RNA, 64 nt, hsa; identical to SEQ ID NO: 246845

SEQ ID NO: 328026 - RNA, 64 nt, hsa; identical to SEQ ID NO: 246846

SEQ ID NO: 328027 - RNA, 64 nt, hsa; identical to SEQ ID NO: 246847

SEQ ID NO: 328028 - RNA, 64 nt, hsa; identical to SEQ ID NO: 246848

SEQ ID NO: 328029 - RNA, 64 nt, hsa; identical to SEQ ID NO: 246849

SEQ ID NO: 328030 - RNA, 64 nt, hsa; identical to SEQ ID NO: 246850

SEQ ID NO: 328031 - RNA, 64 nt, hsa; identical to SEQ ID NO: 246851

SEQ ID NO: 328032 - RNA, 64 nt, hsa; identical to SEQ ID NO: 246852

SEQ ID NO: 328033 - RNA, 64 nt, hsa; identical to SEQ ID NO: 246853

SEQ ID NO: 328034 - RNA, 64 nt, hsa; identical to SEQ ID NO: 246854

SEQ ID NO: 328035 - RNA, 64 nt, hsa; identical to SEQ ID NO: 246855

SEQ ID NO: 328036 - RNA, 64 nt, hsa; identical to SEQ ID NO: 246856

SEQ ID NO: 328037 - RNA, 64 nt, hsa; identical to SEQ ID NO: 246857

SEQ ID NO: 328038 - RNA, 64 nt, hsa; identical to SEQ ID NO: 246858

SEQ ID NO: 328039 - RNA, 64 nt, hsa; identical to SEQ ID NO: 246859

SEQ ID NO: 328040 - RNA, 64 nt, hsa; identical to SEQ ID NO: 246860

SEQ ID NO: 328041 - RNA, 64 nt, hsa; identical to SEQ ID NO: 246861

SEQ ID NO: 328042 - RNA, 64 nt, hsa; identical to SEQ ID NO: 246862

SEQ ID NO: 328043 - RNA, 64 nt, hsa; identical to SEQ ID NO: 246863

SEQ ID NO: 328044 - RNA, 64 nt, hsa; identical to SEQ ID NO: 246864

SEQ ID NO: 328045 - RNA, 64 nt, hsa; identical to SEQ ID NO: 246865

SEQ ID NO: 328046 - RNA, 64 nt, hsa; identical to SEQ ID NO: 246866

SEQ ID NO: 328047 - RNA, 64 nt, hsa; identical to SEQ ID NO: 246867

SEQ ID NO: 328048 - RNA, 64 nt, hsa; identical to SEQ ID NO: 246868

SEQ ID NO: 328049 - RNA, 64 nt, hsa; identical to SEQ ID NO: 246869

SEQ ID NO: 328050 - RNA, 64 nt, hsa; identical to SEQ ID NO: 246870

SEQ ID NO: 328051 - RNA, 64 nt, hsa; identical to SEQ ID NO: 246871

SEQ ID NO: 328052 - RNA, 64 nt, hsa; identical to SEQ ID NO: 246872

SEQ ID NO: 328053 - RNA, 64 nt, hsa; identical to SEQ ID NO: 246873

SEQ ID NO: 328054 - RNA, 64 nt, hsa; identical to SEQ ID NO: 246874

SEQ ID NO: 328055 - RNA, 64 nt, hsa; identical to SEQ ID NO: 246875

SEQ ID NO: 328056 - RNA, 64 nt, hsa; identical to SEQ ID NO: 246876

SEQ ID NO: 328057 - RNA, 52 nt, hsa; identical to SEQ ID NO: 246877

SEQ ID NO: 328058 - RNA, 64 nt, hsa; identical to SEQ ID NO: 246878

SEQ ID NO: 328059 - RNA, 64 nt, hsa; identical to SEQ ID NO: 246879

SEQ ID NO: 328060 - RNA, 64 nt, hsa; identical to SEQ ID NO: 246880

SEQ ID NO: 328061 - RNA, 64 nt, hsa; identical to SEQ ID NO: 246881

SEQ ID NO: 328062 - RNA, 64 nt, hsa; identical to SEQ ID NO: 246882

SEQ ID NO: 328063 - RNA, 64 nt, hsa; identical to SEQ ID NO: 246883

SEQ ID NO: 328064 - RNA, 64 nt, hsa; identical to SEQ ID NO: 246884

SEQ ID NO: 328065 - RNA, 64 nt, hsa; identical to SEQ ID NO: 246885

SEQ ID NO: 328066 - RNA, 64 nt, hsa; identical to SEQ ID NO: 246886

SEQ ID NO: 328067 - RNA, 64 nt, hsa; identical to SEQ ID NO: 246887

SEQ ID NO: 328068 - RNA, 64 nt, hsa; identical to SEQ ID NO: 246888

SEQ ID NO: 328069 - RNA, 64 nt, hsa; identical to SEQ ID NO: 246889

SEQ ID NO: 328070 - RNA, 64 nt, hsa; identical to SEQ ID NO: 246890

SEQ ID NO: 328071 - RNA, 64 nt, hsa; identical to SEQ ID NO: 246891

SEQ ID NO: 328072 - RNA, 64 nt, hsa; identical to SEQ ID NO: 246892

SEQ ID NO: 328073 - RNA, 64 nt, hsa; identical to SEQ ID NO: 246893

SEQ ID NO: 328074 - RNA, 64 nt, hsa
gggcagaucacgagaucaggaguucaagaccagccuggccaauaugaugaaaccccgucucuac

SEQ ID NO: 328075 - RNA, 64 nt, hsa
guggaucaccugaggucagaaguuugagaccagccuggccaacauggugaaaccccgucucuac

SEQ ID NO: 328076 - RNA, 64 nt, hsa
aaagugcugggauuacaggcaugagccaccacgccuggccaaaaaaauauguuuuaaauguccc

SEQ ID NO: 328077 - RNA, 64 nt, hsa
guggaucacccaaggucaggaguuugagaccagccuggccaaauggugaaaccccaucucuacg

SEQ ID NO: 328078 - RNA, 64 nt, hsa
uuuuuguuuaauaccuuccccaagaggggacagucuggccaacuugcuccaguaaugcaauaaa

SEQ ID NO: 328079 - RNA, 64 nt, hsa
gccuggauagacugccugcguccuuaccacugaucuggccaagaaugaggcccucccaacacuu

SEQ ID NO: 328080 - RNA, 64 nt, hsa
guggaucaccugaggucaggaauucaagaccagccuggccaacauggugaaaccccgucuccac

SEQ ID NO: 328081 - RNA, 64 nt, hsa
ugcugggauuacaggugugagccaccgcacccggcuggccaaucuuaucagaagugagcuacca

SEQ ID NO: 328082 - RNA, 64 nt, hsa
ccagaucaccugaggucaggaguucgagaccacccuggccaacauggugaaaccccaucucuac

SEQ ID NO: 328083 - RNA, 64 nt, hsa
gcggaucaccugagguuagaaguuugagaccagccuggccaacauggugaaaccuggccucuac

SEQ ID NO: 328084 - RNA, 64 nt, hsa
gcggaucaccugaggucaggaguucgagauuagucuggccaacauggugaaaccccaucucuac

SEQ ID NO: 328085 - RNA, 64 nt, hsa
agugcuacuucagaagccuuauaggauuuucuuucuggccaagauuuccuucuguaucacucca

SEQ ID NO: 328086 - RNA, 64 nt, hsa
aaacggaucacgaggucaggagaucaagaccauccuggccaacauggugaaaccccaucucuac

SEQ ID NO: 328087 - RNA, 64 nt, hsa
guggaucucuugaggucgggaguuugagaccagccuggccaacauggugaaacccugucuuuac

SEQ ID NO: 328088 - RNA, 64 nt, hsa
ggggggaucacgaggucaagagaucgagaccauccuggccaacauggugaaaccccgucucuaa

SEQ ID NO: 328089 - RNA, 64 nt, hsa
acacccuccugccuguuuuucucugcaucccaaccuggccaaggccccuccuguggggugccca

SEQ ID NO: 328090 - RNA, 64 nt, hsa
aaagugcugggauuacagacaugagccaccgagccuggccaauuuuuguguuuuuuguagagac

SEQ ID NO: 328091 - RNA, 64 nt, hsa
gggcagaucacgaggucaagagaucaagaccauccuggccaacauggugaaauccugccucuac

SEQ ID NO: 328092 - RNA, 64 nt, hsa
aaagggcugagauuacaggugugagcuaccucaccuggccaaaacaguuuuuuuagaaaugaag

SEQ ID NO: 328093 - RNA, 64 nt, hsa
gagugcuuggcuuuccaaggauacugcggagacucuggccaagcugaugaccuucugaaguguc

SEQ ID NO: 328094 - RNA, 64 nt, hsa
ggcagaaagccaucaggugcucaaucaucuucuccuggccaaggcucugaccaugcuuaguacu

SEQ ID NO: 328095 - RNA, 64 nt, hsa
guggaccacaugaggucaggaguuugagaucagccuggccaacauggugaaaccccaucucuac

SEQ ID NO: 328096 - RNA, 64 nt, hsa
gggcggaucaugaggucaagagaucaagaucauccuggccaacauggugaaacccugucucuac

SEQ ID NO: 328097 - RNA, 64 nt, hsa
aggcggaucacaagguccagagaucgagaccauccuggccaacauggugaaaccccgucucuac

SEQ ID NO: 328098 - RNA, 64 nt, hsa
gcggaucacuugaggccaggaguucaagaccagccuggccaacauggcaaaaucccaucucuac

SEQ ID NO: 328099 - RNA, 64 nt, hsa
ugucuuuugaauauuuuuuauuaagccaccacuccuggccaacuguaguugaacucagguauug

SEQ ID NO: 328100 - RNA, 64 nt, hsa
gcggaucacuugaggucaggaguucaaaaccagccuggccaagauggugaaaccccaucucuac

SEQ ID NO: 328101 - RNA, 64 nt, hsa
cuggaucaccugaggacaggaguucgagaccagucuggccaacauggggaaaccccgucucuac

SEQ ID NO: 328102 - RNA, 64 nt, hsa
gcagaucaccugaggucaggaguuugagaccagccuggccaauguggugaaaccccaucucuac

SEQ ID NO: 328103 - RNA, 64 nt, hsa
caaaaacacuugagaagacaucuauuggccaucucuggccaauuacacuaagaaacauaucaag

SEQ ID NO: 328104 - RNA, 64 nt, hsa
cugccuagacgguucucuuggucuuauucccauccuggccaaugcuuaaauacuauuuguugaa

SEQ ID NO: 328105 - RNA, 64 nt, hsa
gcaaaucaccugaggucaagaguuugagaccagccuggccaacauggugaaaccccaucucuac

SEQ ID NO: 328106 - RNA, 64 nt, hsa
guggauugcuugaggccaggaguucgagaccagccuggccaacguggugaaacgcugucucuac

SEQ ID NO: 328107 - RNA, 64 nt, hsa
uuggucucuauuagucaguaaugaagacgacagccuggccaaccaagggaaaggaaauuaguau

SEQ ID NO: 328108 - RNA, 64 nt, hsa
cauggacucgcccagcucuccucggccuggggcucuggccaaggaugggcuggaggucauucag

SEQ ID NO: 328109 - RNA, 64 nt, hsa
cagcacuuugggaggccaggaguucgagaccagccuggccaacauggugaaacccggucucuac

SEQ ID NO: 328110 - RNA, 64 nt, hsa
gcggaucaccugaggucaggaguuugagaccagccuggccaacauggcaaaaccccgucucuac

SEQ ID NO: 328111 - RNA, 64 nt, hsa
gcggaucacuugaggucaggagcucgagaccagccuggccaacacggugaaaccccaucucuac

SEQ ID NO: 328112 - RNA, 64 nt, hsa
gcggaucacuugaggucaggagcucaagaccagccuggccaacauggugaaaccccaucucuac

SEQ ID NO: 328113 - RNA, 64 nt, hsa
aucucaguucuugucagugaagcuauccaaauaacuggccaacuaguuguuaaaagcuaacagc

SEQ ID NO: 328114 - RNA, 64 nt, hsa
uggugcuauuuuguaguuuguuauaugaaagagucuggccaaaacgguaauacgugaaagcaaa

SEQ ID NO: 328115 - RNA, 64 nt, hsa
aaggaucaccugagaucaggaguuccagaccagccuggccaacauggcgaaaccccaucucuac

SEQ ID NO: 328116 - RNA, 64 nt, hsa
gggcggaucacaaggucaggaguucgagaccagccuggccaauauggugaaaccccaucucuac

SEQ ID NO: 328117 - RNA, 64 nt, hsa
ccaggccugccaggucuucacguugaggauucaacuggccaaucacaggacagguguccuggcc

SEQ ID NO: 328118 - RNA, 64 nt, hsa
guggaucaccugaagucagguguuugagaccagccuggccaacaugguggaacccaaucucuac

SEQ ID NO: 328119 - RNA, 64 nt, hsa
ucacugcuaauaauucuguaaggacacaucaaagcuggccaaaauaaugaauuuuuuuuaaaaa

SEQ ID NO: 328120 - RNA, 64 nt, hsa
caggccaagaccaugggaaaaaaagccaugcucacuggccaauaaagagcuugaugcugccugg

SEQ ID NO: 328121 - RNA, 64 nt, hsa
caugcucacuggccaauaaagagcuugaugcugccuggccaaaugaggugacucagauagaauc

SEQ ID NO: 328122 - RNA, 64 nt, hsa
guggaucacucaaggucaggcauuugagaccagccuggccaacauagugaaaccccgucucuau

SEQ ID NO: 328123 - RNA, 64 nt, hsa
gcagaucaccugaggcuaggaguugcagaccagccuggccaacauggcaaaaccccgucucuac

SEQ ID NO: 328124 - RNA, 64 nt, hsa
gcggaucaccugaggucaggaguucaagaccagccuggccaacauggugaaaccccaucucuac

SEQ ID NO: 328125 - RNA, 64 nt, hsa
uggcaugcagcuuguggugaguacuguucuaggacuggccaaaaaugggcaaaauguaucacuc

SEQ ID NO: 328126 - RNA, 64 nt, hsa
cccagcagcccugucuguuaccaugugagucauacuggccaaagcuuaguccuagcauaugcac

SEQ ID NO: 328127 - RNA, 64 nt, hsa
aaagcuuaguccuagcauaugcaccugagccaaccuggccaaucagauuguuuugucaauaauu

SEQ ID NO: 328128 - RNA, 64 nt, hsa
gccgaucacuugaggucaggaguucaagaccagccuggccaacauggugaaaccccaucucuac

SEQ ID NO: 328129 - RNA, 64 nt, hsa
guggaucacuugaggccaggaguucaagaccagccuggccaacaugaugagaccuccgucucua

SEQ ID NO: 328130 - RNA, 64 nt, hsa
ugagguggguggaucacuggaguuugagaccacccuggccaacauggugaaaccccaucucuac

SEQ ID NO: 328131 - RNA, 64 nt, hsa
gggcggaucacgaggucaggaguucgagaccagccuggccaacauagugaaaccccaucucuac

SEQ ID NO: 328132 - RNA, 64 nt, hsa
aaaguguugggauuacaggugugagccacagcaccuggccaaccaacacuucucagggccucuu

SEQ ID NO: 328133 - RNA, 64 nt, hsa
gaguagcugggacuacaggcaugagccaccaugccuggccaacucacauuuuucuuucuauuau

SEQ ID NO: 328134 - RNA, 64 nt, hsa
ggcccagcagcaccugcacccacuuccagcugcucuggccaaaaucuccgcucggccaggcccc

SEQ ID NO: 328135 - RNA, 64 nt, hsa
gcacaucaccugaguucaggaguucaagaccagccuggccaacauggugaaaucccgucucuac

SEQ ID NO: 328136 - RNA, 64 nt, hsa
gcagaucacuugaggucaggaguucaagaccagccuggccaacauggugaaaccccaucucuac

SEQ ID NO: 328137 - RNA, 64 nt, hsa
cagaucacuugagguuaggaguuugagaacuggccuggccaacauagcaaaaccucaucucuac

SEQ ID NO: 328138 - RNA, 64 nt, hsa
aggcagaucacgaggucaggaguucgagaccauccuggccaacauggugaaaccccgucucuac

SEQ ID NO: 328139 - RNA, 64 nt, hsa
guggauugcuugaggccaggaguuagagaccagccuggccaacaaggcaaaaccccgucucuac

SEQ ID NO: 328140 - RNA, 64 nt, hsa
uggcucacgcugaggucaggaguucgagaccagccuggccaaccaacauggugaaaccucgugu

SEQ ID NO: 328141 - RNA, 64 nt, hsa
gcagaucagcugaggucaggagaucgagaccagccuggccaacauggcgaaaccccgucucuac

SEQ ID NO: 328142 - RNA, 64 nt, hsa; identical to SEQ ID NO: 193740

SEQ ID NO: 328143 - RNA, 64 nt, hsa; identical to SEQ ID NO: 193741

SEQ ID NO: 328144 - RNA, 64 nt, hsa; identical to SEQ ID NO: 193742

SEQ ID NO: 328145 - RNA, 64 nt, hsa; identical to SEQ ID NO: 193743

SEQ ID NO: 328146 - RNA, 64 nt, hsa; identical to SEQ ID NO: 193744

SEQ ID NO: 328147 - RNA, 64 nt, hsa; identical to SEQ ID NO: 193745

SEQ ID NO: 328148 - RNA, 61 nt, hsa
aauaggacaguaaaucuguguggggcuagaacaaaauuaagacauguuuggcaauauuuca

SEQ ID NO: 328149 - RNA, 61 nt, hsa
ucauuguuuuaaguuuuucuucugaguaaaacaaaauuauagaaaacaaaugcaacaaugu

SEQ ID NO: 328150 - RNA, 61 nt, hsa
uagcaaaagagccagucauuuuaugaaaaaucaaaauuauaagugauuuuaaaaaccagaa

SEQ ID NO: 328151 - RNA, 61 nt, hsa
auuugcucauacagcuugaacguuguauuugcaaaauuaagccuucgauuuuuauaaaugu

SEQ ID NO: 328152 - RNA, 61 nt, hsa
uucuaauauuguccaguugaaaacuguaugccaaaauuaguuguuuaagugaaguuuugug

SEQ ID NO: 328153 - RNA, 61 nt, hsa
ugugucaauggcuugaaacuggcaagauuaacaaaauuaggccgggcaugguggcucacgc

SEQ ID NO: 328154 - RNA, 61 nt, hsa
cauugucuuggaccuccugcaucagccuauucaaaauuaucucucucucuagcuuuccaca

SEQ ID NO: 328155 - RNA, 61 nt, hsa
ggagacaugugauuaugaucaggaaacugcacaaaauuauuguuuucagcccccguguuau

SEQ ID NO: 328156 - RNA, 61 nt, hsa
gaauaugucaggaaauaaggucacuuuaugucaaaauuauuugaguacuaugggaccuggc

SEQ ID NO: 328157 - RNA, 61 nt, hsa
caacaacaacaacaacaacaacaacaaaccacaaaauuauuugaguacugugaaggauuau

SEQ ID NO: 328158 - RNA, 61 nt, hsa
gggaaaaaaaacccaaaauuaugugaacaagcaaaauuaaaauuucauuuuaggcuauugg

SEQ ID NO: 328159 - RNA, 61 nt, hsa
gaagucagaacagagaaggggaaaaaaaacccaaaauuaugugaacaagcaaaauuaaaau

SEQ ID NO: 328160 - RNA, 61 nt, hsa
uugucacuaaacgguuuuguguuagaaccaccaaaauuauagcuuuuaagagcuuccuuug

SEQ ID NO: 328161 - RNA, 61 nt, hsa
uuguuauuucuguaggagcaacuucucugaucaaaauuacuuuucuggguaugugcugauu

SEQ ID NO: 328162 - RNA, 61 nt, hsa
auuacuuuuaucuuuugucuucauuuguggccaaaauuauguuuacuagaggaaauuuggg

SEQ ID NO: 328163 - RNA, 61 nt, hsa
aguaggacagcuaagaaauuaauauuaauaucaaaauuauugauaaucuuaaauuauugau

SEQ ID NO: 328164 - RNA, 61 nt, hsa
cauggugaaaccccgucucuacuaaaaauaccaaaauuagccaggcgugauggugggcgcc

SEQ ID NO: 328165 - RNA, 61 nt, hsa
caaguguuugaauuugugaucugaaauaacacaaaauuaaaaacaugauuucucuaauuuu

SEQ ID NO: 328166 - RNA, 61 nt, hsa
caaugguaaaacaagcauucaagcacuuuuacaaaauuaccaaauucuuaaaaugaagcca

SEQ ID NO: 328167 - RNA, 61 nt, hsa
acacggugaaaccccaucucuacuaaaaauacaaaauuagcugggcgugguggccggcgcc

SEQ ID NO: 328168 - RNA, 61 nt, hsa
uaauauuuuauuuaucuucgaauuccauggacaaaauuaggcucacuuaaauuaauuuuug

SEQ ID NO: 328169 - RNA, 61 nt, hsa
cuuucaauguuuuuaaugcuaacauagaccccaaaauuagauauaaagaauugggaaggau

SEQ ID NO: 328170 - RNA, 61 nt, hsa
ggccccaugauuucauuuugugcugagcccucaaaauuaugucuguuucguggugggaaau

SEQ ID NO: 328171 - RNA, 61 nt, hsa
aaacagugaaaccccgucucuacuaaaaauacaaaauuagccagaugugguggcgcacacc

SEQ ID NO: 328172 - RNA, 61 nt, hsa
augaaaaugaaacagaucuauaguuuugggacaaaauuauaaaaugaaauguguagguaac

SEQ ID NO: 328173 - RNA, 61 nt, hsa
ccuuaaaugguagaauauuuagaaauuugcacaaaauuaaaaaaauaaacauugucuugga

SEQ ID NO: 328174 - RNA, 61 nt, hsa
cuguagacuguuuuaaauugccaagacugcacaaaauuacagugcuaauguauaugguugc

SEQ ID NO: 328175 - RNA, 61 nt, hsa
aaguauuauuaguuaaagauguaaaccuagccaaaauuaccaguuuauuaauaauuaggau

SEQ ID NO: 328176 - RNA, 61 nt, hsa
gacuucuguuguaaaauaauccagaacacuucaaaauuauuccuaaaucauuaagauuuuc

SEQ ID NO: 328177 - RNA, 61 nt, hsa
uucaaucuuaaaauauaauacaacaaucuugcaaaauuauggugucaguuacacaagcucu

SEQ ID NO: 328178 - RNA, 61 nt, hsa
ucaucaaagaucaccagggcauaauuauaaucaaaauuaguuuuauugaugcuugcugcag

SEQ ID NO: 328179 - RNA, 61 nt, hsa
caauuacagauccugauauauagaaguuauucaaaauuauacaguuuucaaaaaaucaaga

SEQ ID NO: 328180 - RNA, 61 nt, hsa
gcuuuuagaaaagggaguuuaaaaaugguaucaaaauuacauauacuacagucaagauaga

SEQ ID NO: 328181 - RNA, 61 nt, hsa
auugaauggugcauuguauagauauaaugaacaaaauuauuuguaagauauuugcaguuuu

SEQ ID NO: 328182 - RNA, 61 nt, hsa
aagcaaaaguauggagcaagaccuguagugacaaaauuacacaguagugguuaguccacug

SEQ ID NO: 328183 - RNA, 61 nt, hsa
caacauacugauaaaaugacuuuguacuccacaaaauuaugacugaaagguuuauuaaaau

SEQ ID NO: 328184 - RNA, 61 nt, hsa
gacaauuuacacacccaacacauacuguuuccaaaauuauuucuauaugacacaaaguaug

SEQ ID NO: 328185 - RNA, 61 nt, hsa
cgauguuggaauuuagcagaacuaucaaauccaaaauuauuuucaaaucaagauguuuaaa

SEQ ID NO: 328186 - RNA, 61 nt, hsa
aaaauuauucaaauucucacgccuuccaacucaaaauuagcaaucuaaaguaauuuccaua

SEQ ID NO: 328187 - RNA, 61 nt, hsa
ucaguuaucuuaaauauuccaauacuauuuacaaaauuauucaaauucucacgccuuccaa

SEQ ID NO: 328188 - RNA, 61 nt, hsa
cuaaucuuuuugccucagaauaccaaaacaacaaaauuauaaagcuguauuuggacaacua

SEQ ID NO: 328189 - RNA, 61 nt, hsa
agguacuaaggacccaaggcauacagauucacaaaauuaacuaaucuuuuugccucagaau

SEQ ID NO: 328190 - RNA, 61 nt, hsa
uggaacucaauguggaacuuuaaacauuuugcaaaauuacauuuagagaaacccaauuuuu

SEQ ID NO: 328191 - RNA, 61 nt, hsa
uuucaaaguuuaagaaauauacaaaguaugacaaaauuaucuucauaagaacaugcugcau

SEQ ID NO: 328192 - RNA, 61 nt, hsa
caacuuuugucauagauuugauuuauuaaaccaaaauuauacauauuaaaauuauaucaca

SEQ ID NO: 328193 - RNA, 61 nt, hsa
ucaguccauuccgcaaacucuugugaucuuccaaaauuagcucugauuagcuuucacuucc

SEQ ID NO: 328194 - RNA, 61 nt, hsa
ugcuugguacuuagucuguguccaugugauccaaaauuaccuuccuauugcauuuccuacu

SEQ ID NO: 328195 - RNA, 61 nt, hsa
ugaauuuguucaguauaagcucguucuugugcaaaauuaaauaaauauuucucuuaccuua

SEQ ID NO: 328196 - RNA, 61 nt, hsa
ugacaaaaucacaaaaggaaaauuacuggggcaaaauuagaccucaagucugccucuacug

SEQ ID NO: 328197 - RNA, 61 nt, hsa
caguauagaucucagcccaccaaugccaagacaaaauuauuuuucuuauacuuauuuuuua

SEQ ID NO: 328198 - RNA, 61 nt, hsa
uuacuugcauaucuguucaaaacacuuuuaacaaaauuaauucauuaaaguccaguuguug

SEQ ID NO: 328199 - RNA, 61 nt, hsa
ccaaaugcaauuugauugacugcccauucaccaaaauuauccugaacucuucugcaaaaau

SEQ ID NO: 328200 - RNA, 61 nt, hsa
uuuuuucauagagauuugucuaauugcaucucaaaauuauucugcccuccuuaauuuggga

SEQ ID NO: 328201 - RNA, 61 nt, hsa
uggcauguucaaagccacauuauuucuaguccaaaauuacaaguaaucaagggucauuaug

SEQ ID NO: 328202 - RNA, 61 nt, hsa
accuuuuuguuuggggcaccaaaucugaagacaaaauuaauuugcaccaguaaacuucaag

SEQ ID NO: 328203 - RNA, 61 nt, hsa
uaauaguauacuugccauuugagccucacugcaaaauuagugcagaggagaaaacaauuuu

SEQ ID NO: 328204 - RNA, 61 nt, hsa
uagcuuuaaaauaauuuuuuaguaauuauuacaaaauuaaggaaaaucucuauuaccguua

SEQ ID NO: 328205 - RNA, 61 nt, hsa
uuugguaaagcaaauuucacaggaaaauagacaaaauuauaagagauuccuggagacaaca

SEQ ID NO: 328206 - RNA, 61 nt, hsa
uuaagaauuugauguauuucaauacacuguucaaaauuaaauuguuuaauuuuauguauga

SEQ ID NO: 328207 - RNA, 61 nt, hsa
uuugucuguuuuacucuagucuuuaguacuucaaaauuaccuuuucauauccaugaucuug

SEQ ID NO: 328208 - RNA, 61 nt, hsa
uuuuuuuauuguuuaaagcugcauucaacgucaaaauuaccuuggguaacuuuugauaacu

SEQ ID NO: 328209 - RNA, 61 nt, hsa
ccaaaaguuugcucagcaucacacuacaucucaaaauuaauguugccaacuuaauuuugug

SEQ ID NO: 328210 - RNA, 61 nt, hsa
acacugagaaaccccaucucuauuaaagauacaaaauuagccaggcaugguggugcaugcc

SEQ ID NO: 328211 - RNA, 61 nt, hsa
auuucaauaauaaaauguuuaaaaucaaaaccaaaauuauagacuauguagaaaugaauga

SEQ ID NO: 328212 - RNA, 61 nt, hsa
cuacauauaugaauuguaaaacuagaaucaucaaaauuauuuguuguugaagcagucauaa

SEQ ID NO: 328213 - RNA, 61 nt, hsa
augagauguaugaggauuugaaauuaagagacaaaauuaucauuuuugugauguuuugcua

SEQ ID NO: 328214 - RNA, 61 nt, hsa
uuucuuuuuuaguaaaaaccuguauaaaaaccaaaauuauaggauuuuuuuuucuucuuuu

SEQ ID NO: 328215 - RNA, 61 nt, hsa
uuucuuuuuuaguaaaaaccuauaugaaaaccaaaauuauaggauuuuuuucuuuuuuagu

SEQ ID NO: 328216 - RNA, 61 nt, hsa
uuucuuuuuuaguaaaaaccuauauaaaaaccaaaauuauaggauuuuuucuuuuuuagua

SEQ ID NO: 328217 - RNA, 61 nt, hsa
uuucuuuuuuaguaaaaaccgguaucaaaaccaaaauuauaggauuuuuuucuuuuuuagu

SEQ ID NO: 328218 - RNA, 61 nt, hsa
gccacuggugaguaaaaaccuauauaaaaaccaaaauuauaggauuuuuucuuuuuuagua

SEQ ID NO: 328219 - RNA, 61 nt, hsa
uacuccccaaagcagagauagauugauuuaucaaaauuauuaucuggccaacagugugacu

SEQ ID NO: 328220 - RNA, 61 nt, hsa
auauacaacuuucaccauauauauaagccugcaaaauuagaguagugaaagucaugcuagu

SEQ ID NO: 328221 - RNA, 61 nt, hsa
cuaugacccauuuaauuucuauuguguuucacaaaauuaaguguuguucauuauacucucu

SEQ ID NO: 328222 - RNA, 61 nt, hsa
cuuaaccuaggcuucagggagcauaugaaaccaaaauuauauggaacauuuucugugugua

SEQ ID NO: 328223 - RNA, 61 nt, hsa
auuaacugcuuaaauguuuugucggggcaaacaaaauuaugugaauuguguuguuuucuug

SEQ ID NO: 328224 - RNA, 61 nt, hsa
guucuucaaaaacaaacaaaacaaaacaaaacaaaauuaacugcuuaaauguuuugucggg

SEQ ID NO: 328225 - RNA, 64 nt, hsa
ucccuuccuuauuuuaagcauugugaguaaaucagauguugaauucuuuugccaagggaauuau

SEQ ID NO: 328226 - RNA, 64 nt, hsa
ccuugauuggggaauuaaaagucauuuaacugaagauguugagaaaccugggcucugguuuuag

SEQ ID NO: 328227 - RNA, 64 nt, hsa
accagcuuucaagaaaaagcccuaucuaguacuugauguugauguuuuuauuuugcugagcaaa

SEQ ID NO: 328228 - RNA, 64 nt, hsa
aacuacaguucaccuuuccaaauuugguccuauggauguugagcauagggaagcaacucucagu

SEQ ID NO: 328229 - RNA, 64 nt, hsa
ccccagggggugcccccaggcugaucucauuucugauguugagggcuguuuggcucugucugua

SEQ ID NO: 328230 - RNA, 64 nt, hsa
guggccuccagacguagccauuuccugacaucaagauguugaauguaaucuggucugagcuggg

SEQ ID NO: 328231 - RNA, 64 nt, hsa
gcucaucugcuuuguguaacaugaccccugauaagauguugaaacuguuauucacaaagacucc

SEQ ID NO: 328232 - RNA, 64 nt, hsa
gccucacgcaccaucccccucuuuccaccagauggauguugacuuggugucugggaguucccga

SEQ ID NO: 328233 - RNA, 64 nt, hsa
gcuggacaacuaagaagcuaugguagcaaacagugauguugauggaaugagaaucaugaacuuu

SEQ ID NO: 328234 - RNA, 64 nt, hsa
cauuuuuuuccuuuggcuggcagcucuucccagugauguugagagcaccugcagcaaucugguc

SEQ ID NO: 328235 - RNA, 64 nt, hsa
uaaauggaaaacuuauuuuaaguugggacaagaugauguugaaagugaugcacaggacaggugu

SEQ ID NO: 328236 - RNA, 64 nt, hsa
cuuucuauuuuguuuaggauuuccaugaugacuggauguugaauuuugugaaaugcuuuuucuc

SEQ ID NO: 328237 - RNA, 64 nt, hsa
aaaguuuauuauaaaauauaaacagauauauaaagauguugacucuuaccugugauuuugcaug

SEQ ID NO: 328238 - RNA, 64 nt, hsa
augcaaauuaaaaugcagggaaaauaacuuuucugauguugaugcaugucuuugggaaacacau

SEQ ID NO: 328239 - RNA, 64 nt, hsa
cacaaauaaaacagugaaguuuuaaugaauaaaguuuaaucaauuaguaauggcggaaacuguc

SEQ ID NO: 328240 - RNA, 64 nt, hsa
aauuauuagcugcugauauuauggaaguauuuuuuuuaaucaucaguggaaauuuuuauucuuc

SEQ ID NO: 328241 - RNA, 64 nt, hsa
cauaacuugaaggaaaaguuuaaagacaguucaauuuaaucaucagaaugcauucuuuuuuuuu

SEQ ID NO: 328242 - RNA, 64 nt, hsa
cauuauuccuauuuuggaauaaaaacugaccuucuuuaaucauauacuugucuuuuguaaauag

SEQ ID NO: 328243 - RNA, 64 nt, hsa
augcuuuugauucugaaaauugggggaaaaaacuuuuaaucacaauuuucuucaauacaagggg

SEQ ID NO: 328244 - RNA, 64 nt, hsa
cuuuuaagauacgaguuuuguguaauuugguauuuuuaaucauuuauguuauuuuaaaagcuca

SEQ ID NO: 328245 - RNA, 64 nt, hsa
ggugguggggcuuucuuacuaauacacaaauaaauuuaaucauuucaaaggcauucuauuuggu

SEQ ID NO: 328246 - RNA, 64 nt, hsa
auucuauuuuauuauuuuuacuguuauguauguuuuuaaucauauuucuuaggaaguauaggcu

SEQ ID NO: 328247 - RNA, 64 nt, hsa
gucugaaaaccuuugaauagaauggcaugaagauuuuaaucaauuacuuauaaacaaagucuua

SEQ ID NO: 328248 - RNA, 64 nt, hsa
ugccagaaucucaggugccugcuuagaguauuucuuuaaucacagucacugggaaguaaggaga

SEQ ID NO: 328249 - RNA, 64 nt, hsa
gaaaucauauacauuagaaaaucacagucagauguuuaaucaauccaaaauguccacuauuucu

SEQ ID NO: 328250 - RNA, 64 nt, hsa
uuagucuacauguuucuaaacauauaaaugugaauuuaaucaauuccuuucauaguuuuauaau

SEQ ID NO: 328251 - RNA, 64 nt, hsa
uucuuccccaaggauuucaagaugaauugaaauuuuuaaucaagauagugugcuuuauucuguu

SEQ ID NO: 328252 - RNA, 64 nt, hsa
uuuuuuuuuuuuaaagaaaaaaagguagugaauuuuuaaucaucuggacuuuaagaaggauucu

SEQ ID NO: 328253 - RNA, 64 nt, hsa
auuccacuucaauugauagacccaaaaaauauaauuuaaucaaaguucuagaguuuuuguuugu

SEQ ID NO: 328254 - RNA, 64 nt, hsa
ugucuuucagcuccagaauuauuguuacucauauuuuaaucaguaagucauuuaagcuaugaca

SEQ ID NO: 328255 - RNA, 64 nt, hsa
ccagucaccccaaauaugguuaaaagauuuuuuuuuuaaucaugaagagaaaauuaguagcauu

SEQ ID NO: 328256 - RNA, 64 nt, hsa
gaaccaaguguuuuuaaggaaacaaaacuauuuuuuuaaucaucagauuuauacuagcuauaug

SEQ ID NO: 328257 - RNA, 64 nt, hsa
uauuguaguccugucauuuaaguuauguaaaaaauuuaaucauuauuuugaugcuuuaaacauu

SEQ ID NO: 328258 - RNA, 64 nt, hsa
gaucugaggucucaagcuaggagagacugagaauuuuaaucaguuugggcauauaguuuggacu

SEQ ID NO: 328259 - RNA, 64 nt, hsa
aauguacaugcuucaugucaugucuuuaaaauaauuuaaucaacuuuauugucuuaguauuuag

SEQ ID NO: 328260 - RNA, 64 nt, hsa
aauggauucuuuuauaaguuauuaauuuuuaugguuuaaucagucuaauuguuuugacuguuau

SEQ ID NO: 328261 - RNA, 64 nt, hsa
ucuuuuaauccuucauuguuucauguaugaaguuuuuaaucacccccuaacccccaaaaaagau

SEQ ID NO: 328262 - RNA, 64 nt, hsa
ggagccuccugaaugugaugaauacggcaaagccuuuaaucacaucucagcccuuagcaucgga

SEQ ID NO: 328263 - RNA, 64 nt, hsa
agugacacaagcacuuuaauggccuggagggacuuuuaaucagugaagaugcaaucagacaagu

SEQ ID NO: 328264 - RNA, 64 nt, hsa
uuugucaguuugguugggcuauagcacacaguuauuuaaucaaacaguaaucuagguguggcug

SEQ ID NO: 328265 - RNA, 64 nt, hsa
aguuuguuuuuaaaaaguuuucucuguagaaaauuuuaaucauucauacccuuuaccuuuaggu

SEQ ID NO: 328266 - RNA, 64 nt, hsa
auaacauuccaguguauacaaagaaggcaaauucuuuaaucaaauaaagcgcauuauaaaauga

SEQ ID NO: 328267 - RNA, 64 nt, hsa
ucucuuuuugugugucuacugugauuuaaguauuuuuaaucaucagccaagcauuguuaguagu

SEQ ID NO: 328268 - RNA, 64 nt, hsa
guuggcuucuaggaaauaauuaaauuagugauauuuuaaucagguuuuacuaucugcuaggccc

SEQ ID NO: 328269 - RNA, 64 nt, hsa
ugauguuguaugguuuauguuaaauguauauucuuuuaaucaaugaauaaagcauuaaaaauga

SEQ ID NO: 328270 - RNA, 64 nt, hsa
uuucaguagugugaauuaauccuuuugugcuguguuuaaucaguauuagcuuuauagaauuaua

SEQ ID NO: 328271 - RNA, 64 nt, hsa
aaaaugauuuuucacaacuaacuuguaaauauauuuuaaucauuacuucuuuuuuucuagucca

SEQ ID NO: 328272 - RNA, 64 nt, hsa
gugaauuuuauucugagggugauuugugaucaaguuuaaucacaaaucucuuaauauuuauaaa

SEQ ID NO: 328273 - RNA, 64 nt, hsa
ucugguaacccggaauauuuuuuaaucauagagcuuuaaucaaguaguauuguuuuaauagagu

SEQ ID NO: 328274 - RNA, 64 nt, hsa
uuaacgaacuuucuucugguaacccggaauauuuuuuaaucauagagcuuuaaucaaguaguau

SEQ ID NO: 328275 - RNA, 64 nt, hsa
uuaaguugcaauauguuuuugguuuuuuucauuuuuuaaucauugcaguuaagagaaauggaaa

SEQ ID NO: 328276 - RNA, 64 nt, hsa
gguguguauguaacuuaucacuggaccacuuuaguuuaaucagaaauuccuuuuagcugacaac

SEQ ID NO: 328277 - RNA, 64 nt, hsa
ccuuguaggccuccaccaucauguuuuccaucacuuuaaucaaucauuuugaccuaaguauauu

SEQ ID NO: 328278 - RNA, 64 nt, hsa
uaugaauauuaucagcaaugggcuacuucaaauguuuaaucacacacaacauauucgaauugag

SEQ ID NO: 328279 - RNA, 64 nt, hsa
aaaauguucaguuacuuguaacuacugagcagaauuuaaucaauccuuuauuaaauucagaaca

SEQ ID NO: 328280 - RNA, 64 nt, hsa
ggauauaauucuuaacuaucauuauuuaccugauuuuaaucaucagauucgaaauucugugcca

SEQ ID NO: 328281 - RNA, 64 nt, hsa
caaucaguauggauuguauguguauuuauauguuuuuaaucauuuugaucaauguuuguagauu

SEQ ID NO: 328282 - RNA, 64 nt, hsa
gaaacccuacaaguguaaugaauguggcauaguuuuuaaucaacagucacaccuugcaagucau

SEQ ID NO: 328283 - RNA, 64 nt, hsa
gaaacuuuacaaguguaaugaauguggcaagguuuuuaaucaaaaaacaacccuugcacgucau

SEQ ID NO: 328284 - RNA, 64 nt, hsa
aucaguaugggauuuauaucuauuuauacauguuuuuaaucauuuugaucaauguuuauagauu

SEQ ID NO: 328285 - RNA, 64 nt, hsa
gaaaccuuacaagcacaaugaaugugacaugguuuuuaaucaacaaucacaccuugcaagucau

SEQ ID NO: 328286 - RNA, 64 nt, hsa
gaaaccuuacaagcauaaugaauguggcaagguuuuuaaucaaaaagcaaccuuugcacaucac

SEQ ID NO: 328287 - RNA, 64 nt, hsa
gcacuugaaagggcuccccgguuuguaaaauaucuuuaaucauucacauuagguaccucggagu

SEQ ID NO: 328288 - RNA, 64 nt, hsa
uccauuccauuuucuaaaacugucauaaacuauuuuuaaucauuuuaaauaaauguaaaagaaa

SEQ ID NO: 328289 - RNA, 64 nt, hsa
uggcagacuuuuugcuggcucugggagccaugauuuuaaucacauucugcaaggugacaaaugu

SEQ ID NO: 328290 - RNA, 64 nt, hsa
aaaucaagagcugcagauuaucagcaaaaaugcuuuuaaucauuuucccccuuuuauugguucu

SEQ ID NO: 328291 - RNA, 64 nt, hsa; identical to SEQ ID NO: 53544

SEQ ID NO: 328292 - RNA, 64 nt, hsa; identical to SEQ ID NO: 53545

SEQ ID NO: 328293 - RNA, 64 nt, hsa; identical to SEQ ID NO: 53546

SEQ ID NO: 328294 - RNA, 64 nt, hsa; identical to SEQ ID NO: 53547

SEQ ID NO: 328295 - RNA, 64 nt, hsa; identical to SEQ ID NO: 53548

SEQ ID NO: 328296 - RNA, 64 nt, hsa; identical to SEQ ID NO: 53549

SEQ ID NO: 328297 - RNA, 64 nt, hsa; identical to SEQ ID NO: 53550

SEQ ID NO: 328298 - RNA, 64 nt, hsa; identical to SEQ ID NO: 53551

SEQ ID NO: 328299 - RNA, 64 nt, hsa; identical to SEQ ID NO: 53552

SEQ ID NO: 328300 - RNA, 64 nt, hsa; identical to SEQ ID NO: 53553

SEQ ID NO: 328301 - RNA, 64 nt, hsa; identical to SEQ ID NO: 53554

SEQ ID NO: 328302 - RNA, 64 nt, hsa; identical to SEQ ID NO: 53555

SEQ ID NO: 328303 - RNA, 64 nt, hsa; identical to SEQ ID NO: 53556

SEQ ID NO: 328304 - RNA, 64 nt, hsa; identical to SEQ ID NO: 53557

SEQ ID NO: 328305 - RNA, 64 nt, hsa; identical to SEQ ID NO: 53558

SEQ ID NO: 328306 - RNA, 64 nt, hsa; identical to SEQ ID NO: 53559

SEQ ID NO: 328307 - RNA, 64 nt, hsa; identical to SEQ ID NO: 53560

SEQ ID NO: 328308 - RNA, 64 nt, hsa; identical to SEQ ID NO: 53561

SEQ ID NO: 328309 - RNA, 64 nt, hsa; identical to SEQ ID NO: 53562

SEQ ID NO: 328310 - RNA, 64 nt, hsa; identical to SEQ ID NO: 53563

SEQ ID NO: 328311 - RNA, 64 nt, hsa; identical to SEQ ID NO: 53564

SEQ ID NO: 328312 - RNA, 64 nt, hsa; identical to SEQ ID NO: 53565

SEQ ID NO: 328313 - RNA, 64 nt, hsa; identical to SEQ ID NO: 53566

SEQ ID NO: 328314 - RNA, 64 nt, hsa; identical to SEQ ID NO: 53567

SEQ ID NO: 328315 - RNA, 64 nt, hsa; identical to SEQ ID NO: 53568

SEQ ID NO: 328316 - RNA, 64 nt, hsa; identical to SEQ ID NO: 53569

SEQ ID NO: 328317 - RNA, 64 nt, hsa; identical to SEQ ID NO: 53570

SEQ ID NO: 328318 - RNA, 64 nt, hsa; identical to SEQ ID NO: 53571

SEQ ID NO: 328319 - RNA, 64 nt, hsa; identical to SEQ ID NO: 53572

SEQ ID NO: 328320 - RNA, 64 nt, hsa; identical to SEQ ID NO: 53573

SEQ ID NO: 328321 - RNA, 64 nt, hsa; identical to SEQ ID NO: 53574

SEQ ID NO: 328322 - RNA, 64 nt, hsa; identical to SEQ ID NO: 53575

SEQ ID NO: 328323 - RNA, 64 nt, hsa; identical to SEQ ID NO: 53576

SEQ ID NO: 328324 - RNA, 64 nt, hsa; identical to SEQ ID NO: 53577

SEQ ID NO: 328325 - RNA, 64 nt, hsa; identical to SEQ ID NO: 53578

SEQ ID NO: 328326 - RNA, 64 nt, hsa; identical to SEQ ID NO: 53579

SEQ ID NO: 328327 - RNA, 64 nt, hsa; identical to SEQ ID NO: 53580

SEQ ID NO: 328328 - RNA, 64 nt, hsa; identical to SEQ ID NO: 53580

SEQ ID NO: 328329 - RNA, 64 nt, hsa; identical to SEQ ID NO: 53582

SEQ ID NO: 328330 - RNA, 64 nt, hsa; identical to SEQ ID NO: 53583

SEQ ID NO: 328331 - RNA, 64 nt, hsa; identical to SEQ ID NO: 53584

SEQ ID NO: 328332 - RNA, 64 nt, hsa; identical to SEQ ID NO: 53585

SEQ ID NO: 328333 - RNA, 64 nt, hsa; identical to SEQ ID NO: 53586

SEQ ID NO: 328334 - RNA, 64 nt, hsa; identical to SEQ ID NO: 193740

SEQ ID NO: 328335 - RNA, 64 nt, hsa; identical to SEQ ID NO: 193741

SEQ ID NO: 328336 - RNA, 64 nt, hsa; identical to SEQ ID NO: 193742

SEQ ID NO: 328337 - RNA, 64 nt, hsa; identical to SEQ ID NO: 193743

SEQ ID NO: 328338 - RNA, 64 nt, hsa; identical to SEQ ID NO: 193744

SEQ ID NO: 328339 - RNA, 64 nt, hsa; identical to SEQ ID NO: 193745

SEQ ID NO: 328340 - RNA, 64 nt, hsa; identical to SEQ ID NO: 155572

SEQ ID NO: 328341 - RNA, 64 nt, hsa; identical to SEQ ID NO: 155573

SEQ ID NO: 328342 - RNA, 64 nt, hsa
gauaaguuagagaaaacacccaaauuauacuugcacuauggaaagacgacaugaauauguugac

SEQ ID NO: 328343 - RNA, 64 nt, hsa
auaucuauaugugggaaccauucugaaguucaaaacuauggaaaauugaauuuucuucagacaa

SEQ ID NO: 328344 - RNA, 64 nt, hsa
auucaaccacugucugaccaucacugugaccuagacuauggauuuauuuaagggaucaguuauc

SEQ ID NO: 328345 - RNA, 64 nt, hsa
cccucacuuuuaaauccaccauacugaaugccacacuauggaaugcagcuaccugccaagcaag

SEQ ID NO: 328346 - RNA, 64 nt, hsa
acacguuauagaugccagccaccuccugguagucacuauggacaacuaaugagaugcaaagucu

SEQ ID NO: 328347 - RNA, 64 nt, hsa
uguaugguuaguuuuuaacaguuuuuuaaaauaaacuauggauaugacaaauauucuguguuuu

SEQ ID NO: 328348 - RNA, 64 nt, hsa
gacugacucuugggccaccucuguuacuuacuguacuauggaagcuccuggugaauguuuacaa

SEQ ID NO: 328349 - RNA, 64 nt, hsa
uucuggcccucagcagugggcauuguaagcaugaacuauggaagaggcgccgguucaccaauuc

SEQ ID NO: 328350 - RNA, 64 nt, hsa
gcugagggauuggacagcucugacuuuccucgagacuauggauauaguccuucucagauuagcu

SEQ ID NO: 328351 - RNA, 64 nt, hsa; identical to SEQ ID NO: 168101

SEQ ID NO: 328352 - RNA, 64 nt, hsa; identical to SEQ ID NO: 168102

SEQ ID NO: 328353 - RNA, 64 nt, hsa; identical to SEQ ID NO: 168103

SEQ ID NO: 328354 - RNA, 64 nt, hsa; identical to SEQ ID NO: 168104

SEQ ID NO: 328355 - RNA, 64 nt, hsa; identical to SEQ ID NO: 168105

SEQ ID NO: 328356 - RNA, 64 nt, hsa; identical to SEQ ID NO: 168106

SEQ ID NO: 328357 - RNA, 64 nt, hsa; identical to SEQ ID NO: 168107

SEQ ID NO: 328358 - RNA, 64 nt, hsa; identical to SEQ ID NO: 168108

SEQ ID NO: 328359 - RNA, 64 nt, hsa; identical to SEQ ID NO: 168109

SEQ ID NO: 328360 - RNA, 64 nt, hsa; identical to SEQ ID NO: 168110

SEQ ID NO: 328361 - RNA, 64 nt, hsa; identical to SEQ ID NO: 168111

SEQ ID NO: 328362 - RNA, 64 nt, hsa; identical to SEQ ID NO: 168112

SEQ ID NO: 328363 - RNA, 64 nt, hsa; identical to SEQ ID NO: 168113

SEQ ID NO: 328364 - RNA, 64 nt, hsa; identical to SEQ ID NO: 168114

SEQ ID NO: 328365 - RNA, 64 nt, hsa; identical to SEQ ID NO: 168115

SEQ ID NO: 328366 - RNA, 64 nt, hsa; identical to SEQ ID NO: 168116

SEQ ID NO: 328367 - RNA, 64 nt, hsa; identical to SEQ ID NO: 168117

SEQ ID NO: 328368 - RNA, 64 nt, hsa; identical to SEQ ID NO: 168118

SEQ ID NO: 328369 - RNA, 64 nt, hsa; identical to SEQ ID NO: 168119

SEQ ID NO: 328370 - RNA, 64 nt, hsa; identical to SEQ ID NO: 168120

SEQ ID NO: 328371 - RNA, 64 nt, hsa; identical to SEQ ID NO: 168121

SEQ ID NO: 328372 - RNA, 64 nt, hsa; identical to SEQ ID NO: 168122

SEQ ID NO: 328373 - RNA, 64 nt, hsa; identical to SEQ ID NO: 296589

SEQ ID NO: 328374 - RNA, 64 nt, hsa; identical to SEQ ID NO: 296590

SEQ ID NO: 328375 - RNA, 64 nt, hsa; identical to SEQ ID NO: 296591

SEQ ID NO: 328376 - RNA, 64 nt, hsa; identical to SEQ ID NO: 296592

SEQ ID NO: 328377 - RNA, 64 nt, hsa; identical to SEQ ID NO: 296593

SEQ ID NO: 328378 - RNA, 64 nt, hsa; identical to SEQ ID NO: 296594

SEQ ID NO: 328379 - RNA, 64 nt, hsa; identical to SEQ ID NO: 296595

SEQ ID NO: 328380 - RNA, 64 nt, hsa; identical to SEQ ID NO: 296596

SEQ ID NO: 328381 - RNA, 64 nt, hsa; identical to SEQ ID NO: 296597

SEQ ID NO: 328382 - RNA, 64 nt, hsa; identical to SEQ ID NO: 296598

SEQ ID NO: 328383 - RNA, 64 nt, hsa
auguucaaagcuucccuaauuuuuuucuuauuuguagccacauaaguuucaagaauaacauggc

SEQ ID NO: 328384 - RNA, 64 nt, hsa
cuuaguucuaaauuuuuuuaugguaacauauacauagccacauuuacaguuuuaaccauuuuaa

SEQ ID NO: 328385 - RNA, 64 nt, hsa
gcuacaagugacgacaaagauucuguuucaaauauagccacagaaauaaaggagggaccaauau

SEQ ID NO: 328386 - RNA, 64 nt, hsa
gcuacaagugacgagaaagauucuguuucaaauauagccacagaaauaaagaagggacaacaau

SEQ ID NO: 328387 - RNA, 64 nt, hsa
gcuacaacugacgaggaagacucuguuucgaauauagccacagaaauaaaggauggagaaaaau

SEQ ID NO: 328388 - RNA, 64 nt, hsa
gcuacaacugaugagaaagauucuguuucgaacauagccacagaaauaaaggauggagaaaaau

SEQ ID NO: 328389 - RNA, 64 nt, hsa
ccuagccacagagucugagauucugaguucagccuagccacagagucuaagauucuguauccuc

SEQ ID NO: 328390 - RNA, 64 nt, hsa
gcuauuucaaagccacagcauaagaaugucagccuagccacagagucugagauucugaguucag

SEQ ID NO: 328391 - RNA, 64 nt, hsa
aaauuuaguuuaaaauccaguuuucgaauuacauuagccacauugucaaguguucaaaucacag

SEQ ID NO: 328392 - RNA, 64 nt, hsa
caaacgucuacaacuacaauguccaaugagccacuagccacaugaggcuauuuaaguaaauuua

SEQ ID NO: 328393 - RNA, 64 nt, hsa
ucgcagcuacugcuaugguuucaggaggccuguuuagccacauggugagaccguggugaaaggg

SEQ ID NO: 328394 - RNA, 64 nt, hsa
gugcuggugaaaagguagggcugagugauuaccuuagccacaggguggcugagcaggaacuuua

SEQ ID NO: 328395 - RNA, 64 nt, hsa
cagggagcugccuagcaucuggccuggaguguacuagccacauucccaaggucccaaggagaag

SEQ ID NO: 328396 - RNA, 64 nt, hsa
uuucaguguccauaaacaaaauguuauuagagcauagccacacccauucauuuaugguauuguc

SEQ ID NO: 328397 - RNA, 64 nt, hsa
agcuuuggcuucagggagugacagccaucacaaauagccacauucugcucuacucuccaacaua

SEQ ID NO: 328398 - RNA, 64 nt, hsa
ccgugucaacaaugugacuacauguucuccagauuagccacacaugcaaacaucaguguccuuc

SEQ ID NO: 328399 - RNA, 64 nt, hsa
ggccaacagcauugccaaccugagacugaaggccaaggaauauaguuuacagaggaaccaggug

SEQ ID NO: 328400 - RNA, 64 nt, hsa
cugaucuaucaugggaauugcaguuagagagaguaaggaauaccauuuagucaucuauccguuc

SEQ ID NO: 328401 - RNA, 64 nt, hsa
cauaugauacccacuuggacuuuuaacaaaaguaaaggaauaaauuugcauauaggcuuggaaa

SEQ ID NO: 328402 - RNA, 64 nt, hsa
agucagccuuuugaccaccuggugccagcuauauaaggaauaaaguugauucauaucaacauua

SEQ ID NO: 328403 - RNA, 64 nt, hsa
agaccauaagcaaacugguuauuuaaaauguaaaaaggaauaugaaagucuuauuaaaacacuu

SEQ ID NO: 328404 - RNA, 64 nt, hsa
acuauuuggcaacuacugggacucuucagcacaaaaggaauagaucuaugauugacccugauuu

SEQ ID NO: 328405 - RNA, 64 nt, hsa
cuuagagaagaccaagggacaguauuuuuuaucaaaggaauacuauuuuuucacacuacgucaa

SEQ ID NO: 328406 - RNA, 64 nt, hsa
uuuuucugugcauuguuuuuuuuuuuccuccuaaaaggaauaucacgguuuuuugaaacacuca

SEQ ID NO: 328407 - RNA, 64 nt, hsa
gagcuucuuagaguaguauauuuugggggcagucaaggaauaaacuacaguguaaacauauccc

SEQ ID NO: 328408 - RNA, 64 nt, hsa
auagucuaaaaaaugaucaaaacaaaugauuuucaaggaauauucaauauucugccuuucagaa

SEQ ID NO: 328409 - RNA, 64 nt, hsa
gaauugugccagagaaaucugauuucuaguacaaaaggaauacuuagccagggccucaagcuca

SEQ ID NO: 328410 - RNA, 64 nt, hsa
cuacuauaaagaaaugucuucgagauguagaaauaaggaauauucugaaaauaaaaauuauaca

SEQ ID NO: 328411 - RNA, 64 nt, hsa
aguucuggccagaccccguuccccuuccucuaugaaggaauaaguuggaccaagggaagucggg

SEQ ID NO: 328412 - RNA, 64 nt, hsa
uaauguaaugccguauuuauuguuuuuaaaaugaaaggaauacuaauaagucuuaaaaguuccu

SEQ ID NO: 328413 - RNA, 64 nt, hsa
ccaaaggauuuaagaguuuuguuguuguuaauaaaaggaauacuccuuuuccuuuuggaucaua

SEQ ID NO: 328414 - RNA, 64 nt, hsa
guuaguguaucaguaagaaacagaccuaguuuaaaaggaauaaucaacaauuuuauaaaggaga

SEQ ID NO: 328415 - RNA, 64 nt, hsa
cagaggauuacugauauuaugggcugaucucagaaaggaauaaggaugaggcagagaggaguac

SEQ ID NO: 328416 - RNA, 64 nt, hsa
uuaacuuuccaucagucuucaguguuuuuaaucuaaggaauaauuaucuuccugcauuuugauu

SEQ ID NO: 328417 - RNA, 64 nt, hsa
guauuaaguuccuguaacucaaaccagaauuuuuaaggaauagaacuccaagccuuuucuccac

SEQ ID NO: 328418 - RNA, 64 nt, hsa
uauacguaaucaucuaguucugucaucuuacugaaaggaauaacacuucuaaagaucaccauuu

SEQ ID NO: 328419 - RNA, 64 nt, hsa
aagcuagaaauacucuucauucauucauucauuuaaggaauauuaguugaguaugacaggcacu

SEQ ID NO: 328420 - RNA, 64 nt, hsa
cuuuuggauuaggguacaauauuagagcucuaaaaaggaauaguagaauaacuuagcucagccu

SEQ ID NO: 328421 - RNA, 64 nt, hsa
caaggacuguuucagugugagucagaaugugaaaaaggaauaaaaaauacuguugggcucaaac

SEQ ID NO: 328422 - RNA, 64 nt, hsa
acauguauugacaacaguuuuauaauuuaauaaaaaggaauacauugcaauccguaauuuucuu

SEQ ID NO: 328423 - RNA, 64 nt, hsa
cauaggaggaaaagaaauucgcuuuucaaguaggaaggaauacagcuagcaagaaagcaauuua

SEQ ID NO: 328424 - RNA, 64 nt, hsa
aagcacuuuagugguaguauuagcuguuuuuaagaaggaauagcaaguuuaauuauauacaagg

SEQ ID NO: 328425 - RNA, 64 nt, hsa
cuugauaaauuugccuauaaaguuuuauaaagaaaaggaauauuuuguuuucauaaagaggaaa

SEQ ID NO: 328426 - RNA, 64 nt, hsa
gucacuaaaguauccugacaaguuccuaggaaaaaaggaauaaaguuuuuuuccuuaaaaaaaa

SEQ ID NO: 328427 - RNA, 64 nt, hsa
agugaauauacuucgcagcucuuuguucagcaauaaggaauauucuuucaauuccugcucuuca

SEQ ID NO: 328428 - RNA, 64 nt, hsa
uuuuuguaggcaaaaagaacauuucuaaagucucaaggaauagcuuccuaaaguguugaguaaa

SEQ ID NO: 328429 - RNA, 64 nt, hsa
uuucuuuugcauggacaugggccagguuuuucaaaaggaauauaaacaggaucucaaacuugau

SEQ ID NO: 328430 - RNA, 64 nt, hsa
gauaaaaagcuauaccauaauaaaaucuaaaauuaaggaauaucaugggaccaaauaauuccau

SEQ ID NO: 328431 - RNA, 64 nt, hsa
uuuaucauuuuauauuuugaaaggauuauuuuguaaggaauaacuuuuaauacuauaguuucac

SEQ ID NO: 328432 - RNA, 64 nt, hsa
uugucaaauauuaaaagaaagauauucuuccuguaaggaauacaguuuuuagucaaaguggcca

SEQ ID NO: 328433 - RNA, 64 nt, hsa
guucuuuaaucuuccucuagcaggcaugcaguccaaggaauaucaaaauucugguuguauuggg

SEQ ID NO: 328434 - RNA, 64 nt, hsa
gcucuuuaauuuuccucuagcaggcaugcaguccaaggaauaucaaaauucugauuguauggga

SEQ ID NO: 328435 - RNA, 64 nt, hsa
cuaacauauggaaagccuuuuguccuccaaagaugaguacuagggaucauguguuuaaaaaaag

SEQ ID NO: 328436 - RNA, 64 nt, hsa
augcaucacaacuuacaaugcugcucauuguugugaguacuaugagauucaaauuuuucuaaca

SEQ ID NO: 328437 - RNA, 64 nt, hsa; identical to SEQ ID NO: 233973

SEQ ID NO: 328438 - RNA, 64 nt, hsa; identical to SEQ ID NO: 233974

SEQ ID NO: 328439 - RNA, 64 nt, hsa; identical to SEQ ID NO: 233975

SEQ ID NO: 328440 - RNA, 64 nt, hsa; identical to SEQ ID NO: 233976

SEQ ID NO: 328441 - RNA, 64 nt, hsa; identical to SEQ ID NO: 233977

SEQ ID NO: 328442 - RNA, 64 nt, hsa; identical to SEQ ID NO: 233978

SEQ ID NO: 328443 - RNA, 64 nt, hsa; identical to SEQ ID NO: 233979

SEQ ID NO: 328444 - RNA, 64 nt, hsa; identical to SEQ ID NO: 233980

SEQ ID NO: 328445 - RNA, 64 nt, hsa; identical to SEQ ID NO: 233981

SEQ ID NO: 328446 - RNA, 64 nt, hsa; identical to SEQ ID NO: 233982

SEQ ID NO: 328447 - RNA, 64 nt, hsa; identical to SEQ ID NO: 233983

SEQ ID NO: 328448 - RNA, 64 nt, hsa; identical to SEQ ID NO: 233984

SEQ ID NO: 328449 - RNA, 64 nt, hsa; identical to SEQ ID NO: 233985

SEQ ID NO: 328450 - RNA, 64 nt, hsa; identical to SEQ ID NO: 233986

SEQ ID NO: 328451 - RNA, 64 nt, hsa; identical to SEQ ID NO: 233987

SEQ ID NO: 328452 - RNA, 64 nt, hsa; identical to SEQ ID NO: 233988

SEQ ID NO: 328453 - RNA, 64 nt, hsa; identical to SEQ ID NO: 233989

SEQ ID NO: 328454 - RNA, 58 nt, hsa; identical to SEQ ID NO: 233990

SEQ ID NO: 328455 - RNA, 64 nt, hsa; identical to SEQ ID NO: 233991

SEQ ID NO: 328456 - RNA, 64 nt, hsa; identical to SEQ ID NO: 233992

SEQ ID NO: 328457 - RNA, 64 nt, hsa; identical to SEQ ID NO: 233993

SEQ ID NO: 328458 - RNA, 64 nt, hsa; identical to SEQ ID NO: 233994

SEQ ID NO: 328459 - RNA, 64 nt, hsa; identical to SEQ ID NO: 233995

SEQ ID NO: 328460 - RNA, 64 nt, hsa; identical to SEQ ID NO: 233996

SEQ ID NO: 328461 - RNA, 64 nt, hsa; identical to SEQ ID NO: 233997

SEQ ID NO: 328462 - RNA, 64 nt, hsa; identical to SEQ ID NO: 233998

SEQ ID NO: 328463 - RNA, 64 nt, hsa; identical to SEQ ID NO: 233999

SEQ ID NO: 328464 - RNA, 64 nt, hsa; identical to SEQ ID NO: 234000

SEQ ID NO: 328465 - RNA, 64 nt, hsa; identical to SEQ ID NO: 234001

SEQ ID NO: 328466 - RNA, 64 nt, hsa; identical to SEQ ID NO: 234002

SEQ ID NO: 328467 - RNA, 64 nt, hsa; identical to SEQ ID NO: 234003

SEQ ID NO: 328468 - RNA, 64 nt, hsa; identical to SEQ ID NO: 234004

SEQ ID NO: 328469 - RNA, 64 nt, hsa; identical to SEQ ID NO: 234005

SEQ ID NO: 328470 - RNA, 64 nt, hsa; identical to SEQ ID NO: 234006

SEQ ID NO: 328471 - RNA, 64 nt, hsa; identical to SEQ ID NO: 234007

SEQ ID NO: 328472 - RNA, 64 nt, hsa; identical to SEQ ID NO: 234008

SEQ ID NO: 328473 - RNA, 64 nt, hsa; identical to SEQ ID NO: 234009

SEQ ID NO: 328474 - RNA, 64 nt, hsa; identical to SEQ ID NO: 234010

SEQ ID NO: 328475 - RNA, 64 nt, hsa; identical to SEQ ID NO: 234011

SEQ ID NO: 328476 - RNA, 64 nt, hsa; identical to SEQ ID NO: 234012

SEQ ID NO: 328477 - RNA, 64 nt, hsa; identical to SEQ ID NO: 234013

SEQ ID NO: 328478 - RNA, 64 nt, hsa; identical to SEQ ID NO: 234014

SEQ ID NO: 328479 - RNA, 64 nt, hsa; identical to SEQ ID NO: 234015

SEQ ID NO: 328480 - RNA, 64 nt, hsa; identical to SEQ ID NO: 234016

SEQ ID NO: 328481 - RNA, 64 nt, hsa; identical to SEQ ID NO: 234017

SEQ ID NO: 328482 - RNA, 64 nt, hsa; identical to SEQ ID NO: 234018

SEQ ID NO: 328483 - RNA, 64 nt, hsa; identical to SEQ ID NO: 234019

SEQ ID NO: 328484 - RNA, 64 nt, hsa; identical to SEQ ID NO: 234020

SEQ ID NO: 328485 - RNA, 64 nt, hsa; identical to SEQ ID NO: 234021

SEQ ID NO: 328486 - RNA, 64 nt, hsa; identical to SEQ ID NO: 234022

SEQ ID NO: 328487 - RNA, 64 nt, hsa; identical to SEQ ID NO: 234023

SEQ ID NO: 328488 - RNA, 64 nt, hsa; identical to SEQ ID NO: 234024

SEQ ID NO: 328489 - RNA, 64 nt, hsa; identical to SEQ ID NO: 234025

SEQ ID NO: 328490 - RNA, 64 nt, hsa; identical to SEQ ID NO: 234026

SEQ ID NO: 328491 - RNA, 64 nt, hsa; identical to SEQ ID NO: 234027

SEQ ID NO: 328492 - RNA, 64 nt, hsa; identical to SEQ ID NO: 234028

SEQ ID NO: 328493 - RNA, 64 nt, hsa; identical to SEQ ID NO: 234029

SEQ ID NO: 328494 - RNA, 64 nt, hsa; identical to SEQ ID NO: 234030

SEQ ID NO: 328495 - RNA, 64 nt, hsa; identical to SEQ ID NO: 234031

SEQ ID NO: 328496 - RNA, 64 nt, hsa; identical to SEQ ID NO: 234032

SEQ ID NO: 328497 - RNA, 64 nt, hsa; identical to SEQ ID NO: 234033

SEQ ID NO: 328498 - RNA, 64 nt, hsa; identical to SEQ ID NO: 234034

SEQ ID NO: 328499 - RNA, 64 nt, hsa; identical to SEQ ID NO: 234035

SEQ ID NO: 328500 - RNA, 64 nt, hsa; identical to SEQ ID NO: 234036

SEQ ID NO: 328501 - RNA, 64 nt, hsa; identical to SEQ ID NO: 234037

SEQ ID NO: 328502 - RNA, 64 nt, hsa; identical to SEQ ID NO: 234038

SEQ ID NO: 328503 - RNA, 64 nt, hsa; identical to SEQ ID NO: 234039

SEQ ID NO: 328504 - RNA, 64 nt, hsa; identical to SEQ ID NO: 234040

SEQ ID NO: 328505 - RNA, 64 nt, hsa; identical to SEQ ID NO: 234041

SEQ ID NO: 328506 - RNA, 64 nt, hsa; identical to SEQ ID NO: 234042

SEQ ID NO: 328507 - RNA, 64 nt, hsa; identical to SEQ ID NO: 234043

SEQ ID NO: 328508 - RNA, 64 nt, hsa; identical to SEQ ID NO: 234044

SEQ ID NO: 328509 - RNA, 64 nt, hsa; identical to SEQ ID NO: 234045

SEQ ID NO: 328510 - RNA, 64 nt, hsa; identical to SEQ ID NO: 234046

SEQ ID NO: 328511 - RNA, 64 nt, hsa; identical to SEQ ID NO: 234047

SEQ ID NO: 328512 - RNA, 64 nt, hsa; identical to SEQ ID NO: 131208

SEQ ID NO: 328513 - RNA, 64 nt, hsa; identical to SEQ ID NO: 131209

SEQ ID NO: 328514 - RNA, 64 nt, hsa; identical to SEQ ID NO: 131210

SEQ ID NO: 328515 - RNA, 64 nt, hsa; identical to SEQ ID NO: 131211

SEQ ID NO: 328516 - RNA, 64 nt, hsa; identical to SEQ ID NO: 131212

SEQ ID NO: 328517 - RNA, 64 nt, hsa; identical to SEQ ID NO: 131213

SEQ ID NO: 328518 - RNA, 62 nt, hsa
cugcaaaacaggcugauuucaauuaggcagcacuucccaaagugcacugaggaagguggccc

SEQ ID NO: 328519 - RNA, 62 nt, hsa
uccugaccucaggcgauccacccccaccucggcuucccaaagugcugagauuacagguguga

SEQ ID NO: 328520 - RNA, 62 nt, hsa
ucuucauucugcauauucuuucccuaggguuucuucccaacaccaaaggacuuaccaucugu

SEQ ID NO: 328521 - RNA, 62 nt, hsa
ucagcuuaaauuuugccuccucagagagaugccuucccaaacuccccaucugaagcuggccu

SEQ ID NO: 328522 - RNA, 62 nt, hsa
aaaggugaggucacguggccucccaggccugacuucccaaccuacagcauugacgccaacuu

SEQ ID NO: 328523 - RNA, 62 nt, hsa
uuauucauauuuauguucaugguugauuguaccuucccaagcccgcccagugggaugggagg

SEQ ID NO: 328524 - RNA, 62 nt, hsa
ugacccagaggguggaaccggccuggacuccucuucccaacuuccuccaggucauuucccag

SEQ ID NO: 328525 - RNA, 62 nt, hsa
acuuguggaucauuccuuccucccugcaggagcuucccaagcuggucacagagucuccuggg

SEQ ID NO: 328526 - RNA, 62 nt, hsa
cccuaaaucugagucaguaauucucuuacauccuucccaaaaaucagugucuagggacuagu

SEQ ID NO: 328527 - RNA, 62 nt, hsa
ccuaaaucugagucaguaauucucuaaaaauccuucccaaaaaucagugucuagggacuggu

SEQ ID NO: 328528 - RNA, 62 nt, hsa
gacgagccuugccugaccucuucggugcugaccuucccaaagugaugccuuacugguuuugu

SEQ ID NO: 328529 - RNA, 62 nt, hsa
auguugaguuaccaauggaagccaaaaguucucuucccaaacugccaagaaugauacaggcc

SEQ ID NO: 328530 - RNA, 62 nt, hsa
uaacaugggaccuucuguuuagcuuccucuugcuucccaaagauuuuaagcauuuuguaaau

SEQ ID NO: 328531 - RNA, 62 nt, hsa
uucagugggggagaagcugaaagaccaagacucuucccaaguuagcuugucuccucuccugu

SEQ ID NO: 328532 - RNA, 62 nt, hsa
accguucuggguuuugaaagccucaggccaaccuucccaacugcugcgugagcagacaccuu

SEQ ID NO: 328533 - RNA, 62 nt, hsa
cacagcacucugaacaggcacagcccucccaucuucccaaugaggaaacggauucaggaaga

SEQ ID NO: 328534 - RNA, 62 nt, hsa
caaucaguaaaaguuugauaaucaguauaucccuucccaacccccauugugacaguuucuuu

SEQ ID NO: 328535 - RNA, 62 nt, hsa
uuuuuccuaccaagaucauucuugaucaucagcuucccaaacuaguaagucugugcaucauu

SEQ ID NO: 328536 - RNA, 62 nt, hsa
guuggagacugucuggccccccugguccccuccuucccaagugagucucucugggccuuagg

SEQ ID NO: 328537 - RNA, 62 nt, hsa
guggcccuugaguccccauugaggcuugguuccuucccaauccaguggacuucgcaguccac

SEQ ID NO: 328538 - RNA, 62 nt, hsa
gcccugaggacagaugccuccuuccucuuuuccuucccaaagcaagcaagaggccguggcug

SEQ ID NO: 328539 - RNA, 62 nt, hsa
cugcguccucuguccccggguuucagagacaacuucccaaagcacaaagcaguuuuuccccc

SEQ ID NO: 328540 - RNA, 62 nt, hsa
uccacaccccccuuggggccuccccuccacuccuucccaaaucugucuccccagaagacaca

SEQ ID NO: 328541 - RNA, 62 nt, hsa
cagcaucuguccccagaaucaggcagaauccacuucccaaacagagccccacgcagguucac

SEQ ID NO: 328542 - RNA, 62 nt, hsa
ugguuuugaaaccagcuguuucccaaacucugcuucccaagggcaaccguugcuguucacac

SEQ ID NO: 328543 - RNA, 62 nt, hsa
gguggcaugauuguggauccccugagaucuggcuucccaagagcacuuauugacccuuccuc

SEQ ID NO: 328544 - RNA, 62 nt, hsa
gcuccuccccuuucaccaccagcuccucuccacuucccaagggagacuccggcaaccuucag

SEQ ID NO: 328545 - RNA, 62 nt, hsa
ccucccagccacgugccaguggccacagcccacuucccaacccacuguuguacccaggccuc

SEQ ID NO: 328546 - RNA, 62 nt, hsa
acuccugaccucaggugauccucccaccccggcuucccaaaguucugggauuauaggcguga

SEQ ID NO: 328547 - RNA, 64 nt, hsa
ugagguuaucggaccaugggcugagcucaggcacuuucuguaggagacuguuauuucuguaaag

SEQ ID NO: 328548 - RNA, 64 nt, hsa
gcugagcucaggcacuuucuguaggagacuguuauuucuguaaagaugguuauuuaacccuccu

SEQ ID NO: 328549 - RNA, 64 nt, hsa
agauuuaaucuuauuaaauguuuuuaucuuacucuuucuguacagauauaucaaaucacaugaa

SEQ ID NO: 328550 - RNA, 64 nt, hsa
ggagguuagcccuuaaucucuucauugcauuucauuucuguaaaucagauuaaguccuuaauau

SEQ ID NO: 328551 - RNA, 64 nt, hsa
aaauuuugacuuaaaacaucugcugaauuccaaauuucuguaauagcuacuguaucugugauaa

SEQ ID NO: 328552 - RNA, 64 nt, hsa
ucuauuaugcugccucuccaguguaauauuugccuuucuguaaaugggauuaaauaugauuugu

SEQ ID NO: 328553 - RNA, 64 nt, hsa
caaccugggaacaaauuuuaguuuucauuuuagguuucuguacuuucuguaguuucuguguaaa

SEQ ID NO: 328554 - RNA, 64 nt, hsa
aacaaauuuuaguuuucauuuuagguuucuguacuuucuguaguuucuguguaaacugccauau

SEQ ID NO: 328555 - RNA, 64 nt, hsa
uuuauuuuugacuguuuuguuuucuuguuggccauuucuguauugcuggcaucugugcuaagcu

SEQ ID NO: 328556 - RNA, 64 nt, hsa
gaaaaaaucacuguuuguuuuuaaaaagcaaaucuuucuguaaacagaauaaaaguuccucucc

SEQ ID NO: 328557 - RNA, 64 nt, hsa
cuagguuuagucagagcuuucacaaguaauaaccuuucuguauuaaaaucagaguaacccuuuc

SEQ ID NO: 328558 - RNA, 64 nt, hsa
uaauaaccuuucuguauuaaaaucagaguaacccuuucuguauugagugcaguguuuuuuacuc

SEQ ID NO: 328559 - RNA, 64 nt, hsa
augcugaucuaugaucaccugcuucaguagaauuuuucuguagaguguuguuugaauuuugagc

SEQ ID NO: 328560 - RNA, 64 nt, hsa
uauuuucacaaucuaaauauugucacaaucuaaauuucuguaguagagagagccguagcccuuu

SEQ ID NO: 328561 - RNA, 64 nt, hsa
uuuccucugccauucuuguguugauuggagaauuuuucuguauguaauuagaaaaaaauguaaa

SEQ ID NO: 328562 - RNA, 64 nt, hsa
auuuuuauauacauuuccaaaauauuaagauaacuuucuguaagagucaaugauucuguucgac

SEQ ID NO: 328563 - RNA, 64 nt, hsa
acgguagggaaaagaacugcugggugggggccuguuucuguaacuuucucccccucuacugaga

SEQ ID NO: 328564 - RNA, 64 nt, hsa
acuuaaauuuauuaaucuuaaaucauguacuuuuuuucuguaauagaacucggauucuuuugca

SEQ ID NO: 328565 - RNA, 64 nt, hsa
ucucuccuccccaacuuuuuucugaaagccuugauuucuguagacagaacuaugguuuuuggca

SEQ ID NO: 328566 - RNA, 64 nt, hsa
agguuuguaaucaugccacucacuaacgauuuuauuucuguagcagaaucauuuuuucuaugua

SEQ ID NO: 328567 - RNA, 64 nt, hsa
uacugccuauuguuuauguuaaaccuuaauuuuuuuucuguaaucacuuuuaacacugcuaaua

SEQ ID NO: 328568 - RNA, 64 nt, hsa
aacucagcuguuucacacuguauauguacauuguuuucuguaggaauaggauaaugauauauag

SEQ ID NO: 328569 - RNA, 64 nt, hsa
uuacaaucaauuuuaaagcuacaucuguauaaaauuucuguauaaagguguauuucuuuuuuau

SEQ ID NO: 328570 - RNA, 64 nt, hsa
ccuucugugauuaugauuuccucuccuauaauuauuucuguagcacuccacacugaucuuugga

SEQ ID NO: 328571 - RNA, 64 nt, hsa
uucucuggcaguuacuuuugaagcuucacucugcuuucuguauaaagggcagucuguggucacg

SEQ ID NO: 328572 - RNA, 64 nt, hsa
cauuugggccgauggccucuuggaggcuuaaaguuuucuguaccuugugaugaauguuaauagg

SEQ ID NO: 328573 - RNA, 64 nt, hsa
aaauaacagaaauguaugguuuguuuuaccuucauuucuguacaaguaaagcuuauuagucuaa

SEQ ID NO: 328574 - RNA, 64 nt, hsa
uguaauauuaaagcaacuaguuucuaauucccaguuucuguauagaaucgcacaagugguuuau

SEQ ID NO: 328575 - RNA, 64 nt, hsa
caggaaauuauugaguuuuggaaagcuacaguaauuucuguauuacaucauuuauaugugaaaa

SEQ ID NO: 328576 - RNA, 64 nt, hsa
uguauuacaucauuuauaugugaaaaguuggacauuucuguaaguuuuuaaaauuauccauuug

SEQ ID NO: 328577 - RNA, 64 nt, hsa
ggucauagcucaagaauuguuagcaaaugacagauuucuguaagccuauauauauagucaaauc

SEQ ID NO: 328578 - RNA, 64 nt, hsa
gauucugccuauguaaaaugaauugaaaaacaauuuucuguaaucuuuuauuuaaguagugggc

SEQ ID NO: 328579 - RNA, 64 nt, hsa
aauguaacaauuuccuuaaaaaugacuuauccaauuucuguauuucaccuuuaggguuaaaaaa

SEQ ID NO: 328580 - RNA, 64 nt, hsa
uuuagcuuaaaagugaaagugguaauacuguugguuucuguaaauguugcaggguuuuaaacuu

SEQ ID NO: 328581 - RNA, 64 nt, hsa
aguaauuuuaaacucacuggcuugaaaugugugcuuucuguacaaugaaguuauugcuuuccau

SEQ ID NO: 328582 - RNA, 64 nt, hsa
ccaggagaagaaaguuaggggaaaucucauuuucuuucuguaauucauucaguggugccaaagc

SEQ ID NO: 328583 - RNA, 64 nt, hsa
acacugauacacuugaaggaccauuuacuguuuuuuucuguagcaccagagaauccauccaaag

SEQ ID NO: 328584 - RNA, 64 nt, hsa
ggcggcugugcaucagugggaucccagacauuuguuucuguaagauuuuccauuguauccucuu

SEQ ID NO: 328585 - RNA, 64 nt, hsa
uaacacauguaauuucuuaaugugccuaaguuaauuucuguaucaauucaauaaauggaauuga

SEQ ID NO: 328586 - RNA, 64 nt, hsa
aaaccaagaacuaguuugaaaucguuuauauucauuucuguagcaugacagggauuucaaucac

SEQ ID NO: 328587 - RNA, 64 nt, hsa
auucugugacauguuuauauucacccauguacauuuucuguaaauaccaaacgcuacugauucc

SEQ ID NO: 328588 - RNA, 64 nt, hsa
guuguggaaaguuaacacuagcuuuguauuuuuuuuucuguaaaacugugaacugauauauuuu

SEQ ID NO: 328589 - RNA, 64 nt, hsa
uuuuaaaaauaucuuuagcguuuggucuuuuuuuuuucuguaaacauuuaauuuggucugagaa

SEQ ID NO: 328590 - RNA, 64 nt, hsa
cgagcaaguuauauaacaacuaacaacauugcacuuucuguauaugaaaucaauauuuaaauaa

SEQ ID NO: 328591 - RNA, 64 nt, hsa
uucuacaagguaauuuucaaaaagaaauaaaacauuucuguaaacuuaaauguggauuaagugg

SEQ ID NO: 328592 - RNA, 64 nt, hsa
uucaaagaaucucuucuugccucccauugcugauuuucuguauugauggacucauuucucucaa

SEQ ID NO: 328593 - RNA, 64 nt, hsa
aguccuuuacuauaagguuaauauuuauuuucauuuucuguauuauauaugaaaaguaaauuaa

SEQ ID NO: 328594 - RNA, 64 nt, hsa
auauauaugcaagcacaacuugaagcugaauucauuucuguauuauauucucaacucguuaucu

SEQ ID NO: 328595 - RNA, 64 nt, hsa
agaauacaagauacuuuggcauucucaugugaacuuucuguacucuuuaaggauuauuuuauua

SEQ ID NO: 328596 - RNA, 64 nt, hsa
aaucauccaacuucuuugcauuacuuaaaagagauuucuguaauacaggaaugacuaugaaggu

SEQ ID NO: 328597 - RNA, 64 nt, hsa
uaaacuaaauuacuguuuuauguugaucugcauauuucuguauauuugucaugacagugcuugc

SEQ ID NO: 328598 - RNA, 64 nt, hsa
uauuuaaaaacaaaaagcaacaguaaucuauguguuucuguaacaaauugggaucugucuuggc

SEQ ID NO: 328599 - RNA, 64 nt, hsa
auuuuaagguggaguacaguaagauguguggguuuuucuguauuuuucuuuucuggaacagugg

SEQ ID NO: 328600 - RNA, 55 nt, hsa
ugggcucccagccaucauagcagcauuucuguaucuugaaaaaauguaauuuauu

SEQ ID NO: 328601 - RNA, 64 nt, hsa
ccuugagggaagcauuguuuuuggagagauuuucuuucuguacuucguuuuacuuuucuuuuuu

SEQ ID NO: 328602 - RNA, 64 nt, hsa
gaaggcccacgggcggcacggaguuccugagcccuuucuguagugggggaaagguggcuggacc

SEQ ID NO: 328603 - RNA, 64 nt, hsa
gacaagcuuccucgcugcuuaugcccacaggguuuuucuguaugacacaccucagaggagccug

SEQ ID NO: 328604 - RNA, 64 nt, hsa
ucuuucuuguuucauggcuguguuuuugcuuuuguuucuguaggagcgccucuuccaagcagug

SEQ ID NO: 328605 - RNA, 64 nt, hsa
auuuucauuaauggaugaaaacuucagggcuucuuuucuguauauaacaaauuaagucuguaca

SEQ ID NO: 328606 - RNA, 64 nt, hsa
uacaugguguuuaaagaaugguaagcauuguuaauuucuguaaugaacauuuucaauuaaauuu

SEQ ID NO: 328607 - RNA, 64 nt, hsa
aacauuuucaaugagaaaaaugugggaaguaacuuuucuguacccagaggcuaaguauaagucu

SEQ ID NO: 328608 - RNA, 64 nt, hsa
guaagugaugcuuguagauucucucacaggcuguuuucuguaguaugcagggaaauggggaaca

SEQ ID NO: 328609 - RNA, 64 nt, hsa
uaacauauuuuuucuuuauggaaaucuauaaaacuuucuguaguaaaauguuuucauuuuacug

SEQ ID NO: 328610 - RNA, 64 nt, hsa
gaagauuuggcaacguggcuuaauuguucugcuuuuucuguaguucaauuucauguuucuugac

SEQ ID NO: 328611 - RNA, 64 nt, hsa
uuguaaauaauuuauuacaguuuacucuaucgcauuucuguaacaugaaaugcaugcccuucuu

SEQ ID NO: 328612 - RNA, 64 nt, hsa
agaauacaguucucuggccacagcugaugagggcuuucuguacugcacacagauuguguacugc

SEQ ID NO: 328613 - RNA, 64 nt, hsa
uucuuuuuauaaccaguuuuugauugguaauuguuuucuguauuguuuaaaacggaucaaaaau

SEQ ID NO: 328614 - RNA, 64 nt, hsa
ccucuugcacuuuuagaugcaaaucaguuuuucauuucuguaauagaaaauuauucacguauuu

SEQ ID NO: 328615 - RNA, 64 nt, hsa
agaaaauauaaucaaaauucaaagauuuuuuuuguuucuguaacuggaacuaaaucaaaugauu

SEQ ID NO: 328616 - RNA, 64 nt, hsa
gugaaaagugaaaccuuaauuuuaucaaaagaaauuucuguaaaugguaugucuccuuagaaua

SEQ ID NO: 328617 - RNA, 64 nt, hsa
gaaacaggacuuacuaaaagucagugggacuggguuucuguagccaagccagacuugacuguuu

SEQ ID NO: 328618 - RNA, 64 nt, hsa
gacuggguuucuguagccaagccagacuugacuguuucuguagagcacuaucucgggcaggcca

SEQ ID NO: 328619 - RNA, 64 nt, hsa
uugugagguuuguuagagauuaauauagguuuucuuucuguauuauaaaaugcaccaagcaauu

SEQ ID NO: 328620 - RNA, 64 nt, hsa
uucccacuggugcuauuuuuauuuccaauggauauuucuguauuacuagggaggcauuuacagu

SEQ ID NO: 328621 - RNA, 64 nt, hsa
aucuuaaccaagaaauugaagggagaggcugugauuucuguauuugucgaccuacagguaggcu

SEQ ID NO: 328622 - RNA, 64 nt, hsa
uugauaaaaugcugagaacuagugauuauauauuuuucuguauuuaccugacauuuauuuuaau

SEQ ID NO: 328623 - RNA, 64 nt, hsa
acaaucaguguuuaaacuuacuguauauuuaugcuuucuguauuuaccagcuauuuuaaaugag

SEQ ID NO: 328624 - RNA, 64 nt, hsa
auaauucugggauuugagaggaucuaaaacuauuuuucuguauaaauauuauuugccaaaaguu

SEQ ID NO: 328625 - RNA, 64 nt, hsa
ucagccauaccacugguaacauuucuacuaaaucuuucuguaacacuuaaagaauucccucauu

SEQ ID NO: 328626 - RNA, 64 nt, hsa
gaacugauuuggcuaugagguuuaacauuauaauuuucuguaagcuuucccacaaaaaaacauu

SEQ ID NO: 328627 - RNA, 64 nt, hsa
aaggaaauuaauaucagucauccagaaguacacguuucuguauuuuaaaaaauacuuugaugca

SEQ ID NO: 328628 - RNA, 64 nt, hsa
ucuaaguucuuaacauguuaugucccuaguggcuuuucuguagucccugagcuuggaaauuacu

SEQ ID NO: 328629 - RNA, 57 nt, hsa
augaccccacgaucccaugagccuguuuuucuguaccugcugcucuuugucccacag

SEQ ID NO: 328630 - RNA, 64 nt, hsa
uuuucuguaauuuucagcacuuauguauacacuuuuucuguacuuacuagguuaaggcagauuu

SEQ ID NO: 328631 - RNA, 64 nt, hsa
aaaugugaacauuuuugcuuauucauugaauauuuuucuguaauuuucagcacuuauguauaca

SEQ ID NO: 328632 - RNA, 64 nt, hsa
uccucacaaacuucuuugugaagagugaaauguguuucuguaccucuggguuucacuuacgggc

SEQ ID NO: 328633 - RNA, 64 nt, hsa
uucuaaaaugugaguucaauucaauaaauuugaauuucuguaggaagaaucaaaucaccgauuu

SEQ ID NO: 328634 - RNA, 64 nt, hsa; identical to SEQ ID NO: 328633

SEQ ID NO: 328635 - RNA, 64 nt, hsa; identical to SEQ ID NO: 328632

SEQ ID NO: 328636 - RNA, 64 nt, hsa
cucgaauauuucuagaguacuugagccacauguauuucuguauuuaaagaauugcugacuaacu

SEQ ID NO: 328637 - RNA, 64 nt, hsa
ugggggugggaugaauuuaaaaguuauaccaaaauuucuguaaagucuuugaaagucuaggagu

SEQ ID NO: 328638 - RNA, 64 nt, hsa
gcaugaccuuuuggccuuuguaagacacacagccuuucuguaucaagccccugucuaaccuacg

SEQ ID NO: 328639 - RNA, 64 nt, hsa
aaccuacgaccccagagugacugacggcuguguauuucuguagaaugcuguagaauccgguuuu

SEQ ID NO: 328640 - RNA, 64 nt, hsa
uguucacacguggcaucagcccaugcaagauagguuucuguauuuauauauuaaaauacaaaaa

SEQ ID NO: 328641 - RNA, 64 nt, hsa
uauuucagugaacaguguacuuguucuuucaacuuuucuguauguuuggaauuuuucuuaauaa

SEQ ID NO: 328642 - RNA, 64 nt, hsa
acuguuauaaaaacuuuuuuaauuucuguauuuuuuucuguauuguaucuucaugggacauuag

SEQ ID NO: 328643 - RNA, 64 nt, hsa
agauuuagaaauacuguuauaaaaacuuuuuuaauuucuguauuuuuuucuguauuguaucuuc

SEQ ID NO: 328644 - RNA, 64 nt, hsa
ccagagcgcaagggcucucuugaaagaaaaguaguuucuguaccaauuaaaggauugacguggu

SEQ ID NO: 328645 - RNA, 64 nt, hsa
uucaaaucuuuuugauacuuuuuagagcaggauuuuucuguaugugaacuuggguggggggguu

SEQ ID NO: 328646 - RNA, 64 nt, hsa
uaagggggggagugggaggggacggaaccaacuuuuucuguauuuuguauuguauguuuucuuc

SEQ ID NO: 328647 - RNA, 64 nt, hsa
aucauaggccggagugagucauuccaccugcaccuuucuguacaaauacuaauucaauuuuaag

SEQ ID NO: 328648 - RNA, 64 nt, hsa
auuaaagggcaaaaaacacuguaucagcauagccuuucuguauuuaagaaacuuaagcagccgg

SEQ ID NO: 328649 - RNA, 64 nt, hsa
gugccuccuggugccugcggcauccuucugccuguuucuguaagcaaaugccacaggccaccua

SEQ ID NO: 328650 - RNA, 64 nt, hsa
uuuugcuuaugaauauucuguauuauaaccauuguuucuguaguuuaauuaaaacauuuucuug

SEQ ID NO: 328651 - RNA, 64 nt, hsa
auugggccuuuuaaaaacauggcuggguggaacauuucuguacccuacugguuugaccagagcc

SEQ ID NO: 328652 - RNA, 64 nt, hsa
cuuacuuuugguuggcauaauuguucagcaacgauuucuguacaucaccaaguaucuuuggcau

SEQ ID NO: 328653 - RNA, 64 nt, hsa
cccccacauggcaaugcagaguuguauuuacuuguuucuguacucaccuacucccaccccaagg

SEQ ID NO: 328654 - RNA, 64 nt, hsa
ggaagaaacccugacuaacgcauugagaaaagccuuucuguaaagaaugguacaagacagguug

SEQ ID NO: 328655 - RNA, 64 nt, hsa
cagauuaggaauacccaaccuguauguacguauauuucuguaucuauguauguauauauaugca

SEQ ID NO: 328656 - RNA, 64 nt, hsa
agcugcuuccauuuaugagacuuuagaguuugaguuucuguagggcugaaugacucuuuuuccu

SEQ ID NO: 328657 - RNA, 64 nt, hsa
uacuguagcucuucugagguaucugccaggcuguuuucuguagccucagauugccuaucugcuu

SEQ ID NO: 328658 - RNA, 64 nt, hsa
gauuccaaacauuuucgacaguguaauggaaauuuuucuguaauuuucuuaccaucggguauuu

SEQ ID NO: 328659 - RNA, 64 nt, hsa
gcaguauaauguauuuugcaacgaauuuguaauuuuucuguacgauaguuuugauaauuuauag

SEQ ID NO: 328660 - RNA, 64 nt, hsa
uuuauucuuuucagauaggcuuaacaaauggagcuuucuguauauaaauguggagauuagaguu

SEQ ID NO: 328661 - RNA, 64 nt, hsa
aagaguucucagugucuacauguagacuauuccuuuucuguauaaaguucacucuaggauuuca

SEQ ID NO: 328662 - RNA, 64 nt, hsa
augcucuuauuuaaagaagacuuugagcuauuuuuuucuguacccuguaaaauauugaaaacua

SEQ ID NO: 328663 - RNA, 64 nt, hsa
uuaauccuugugcauaugugucauaauacaacuauuucuguaaagaaaggacacuauuacauau

SEQ ID NO: 328664 - RNA, 64 nt, hsa
agaaauucugaauuuugguaaaucacacugaaacuuucuguauaacuuguauuauuagacucuc

SEQ ID NO: 328665 - RNA, 64 nt, hsa
ccgacauacaucauucugugauuaaaucuccagauuucuguaaaugauaccuacauucuaaaga

SEQ ID NO: 328666 - RNA, 64 nt, hsa; identical to SEQ ID NO: 328664

SEQ ID NO: 328667 - RNA, 64 nt, hsa; identical to SEQ ID NO: 328665

SEQ ID NO: 328668 - RNA, 60 nt, hsa
uugucauugccuccgugugagccacugagugguuaucaccucagugaaucuucccagggc

SEQ ID NO: 328669 - RNA, 64 nt, hsa
agccacauuacugucuguguagugccaggugaaggguuaucagaaggcugguugguuuuaauaa

SEQ ID NO: 328670 - RNA, 64 nt, hsa
cauauaugcgaucuggccuaaccauggagauauugguuaucaguuugcagaugaauacacaguu

SEQ ID NO: 328671 - RNA, 64 nt, hsa
aagaggcggcagaggcaacaguguuuaggauuuggguuaucauaagguguuaagagucccuugu

SEQ ID NO: 328672 - RNA, 64 nt, hsa
ugagauguucuuucuaccaaucuauaugucuuucgguuaucaaguguuucugcaugguaauguc

SEQ ID NO: 328673 - RNA, 64 nt, hsa
uuuaguguuguauaucacucagucauuuaauauugguuaucaccauacaguuuaauauuuguau

SEQ ID NO: 328674 - RNA, 64 nt, hsa
ugaugaauuuuguugggaucugacuuggggaaaggguuaucagagccuagaggggcuuaaaaag

SEQ ID NO: 328675 - RNA, 64 nt, hsa
caauuuuuguucuucuccuguaaagaaugucaaugguuaucaccuucaauaguuucaauauguc

SEQ ID NO: 328676 - RNA, 64 nt, hsa
auuauuauaaggccuuuaggcaucagugcaucuggguuaucaacauuuucucaaaugcugucaa

SEQ ID NO: 328677 - RNA, 64 nt, hsa
uauuacauagcauggcccuuaugucuugaguugagguuaucaucucaaugaggcuuaagcuccu

SEQ ID NO: 328678 - RNA, 64 nt, hsa
gaaaucuuuuaaugacaauuuucauuaauuucaggguuaucauuuuugagaaaucuacaccaaa

SEQ ID NO: 328679 - RNA, 64 nt, hsa
uuuugguaaguaccuuaguugaauaaaagcacaagguuaucaccuuuuuuauccguccaccgug

SEQ ID NO: 328680 - RNA, 64 nt, hsa
gcgaaccccugagcagagaaucuuacuaggcuuugguuaucaccaaaacaaccuccaguauaua

SEQ ID NO: 328681 - RNA, 64 nt, hsa
ggauuauggcuucauuaaauuuauugagguauuugguuaucaaagauaaugaaaaugacaauca

SEQ ID NO: 328682 - RNA, 64 nt, hsa
uucuguguugucuuuccauucauacauaauuuuagguuaucauuauccuuuggacuuuugauau

SEQ ID NO: 328683 - RNA, 64 nt, hsa
ccuggaaugcaaggucugcacccauuuccuccuggguuaucacucacacaucauaaaugcugaa

SEQ ID NO: 328684 - RNA, 64 nt, hsa
uauccuauagaucauccuauucuuaugugucuuugguuaucagaucaauuacagaauaauugug

SEQ ID NO: 328685 - RNA, 64 nt, hsa
gcgaugacuggaugucucuguacuguauguaucugguuaucaagaugccucugugcagaaagua

SEQ ID NO: 328686 - RNA, 64 nt, hsa
gguuuuacuggaaguauaugugaugagcagaagagguuaucagcauuaaauuguuuugguucua

SEQ ID NO: 328687 - RNA, 64 nt, hsa
cugacugugcauuguaccuguauuuauaguuuaugguuaucaggaagcucuguaagaaagaaaa

SEQ ID NO: 328688 - RNA, 64 nt, hsa
gguggccauuccuuuuuguauaggcuaagaaacagguuaucagugaaaaguuaauuauggcuuu

SEQ ID NO: 328689 - RNA, 64 nt, hsa
caggaaauuuuuagcauucagucauauaacaucugguuaucaaugcacguuuacacaauaaaua

SEQ ID NO: 328690 - RNA, 64 nt, hsa
gacuguuacuuguagauuuccauguaaucauugagguuaucacccagauuagaaagacauauuu

SEQ ID NO: 328691 - RNA, 64 nt, hsa
ggucagaagucuuucccgggagagagauggccuggguuaucauugcugauagcuuuggcugcau

SEQ ID NO: 328692 - RNA, 64 nt, hsa
cagagaaagagaguuguggguuuagaugaagcaagguuaucaugcagaauuggguaagaaugcu

SEQ ID NO: 328693 - RNA, 64 nt, hsa
cgccauuuuacaauggagaguugugacaaguacagguuaucaaguuugcacuuaacuaugccaa

SEQ ID NO: 328694 - RNA, 64 nt, hsa
cucacacuuggcuggguuucuaccuagguugccagguuaucaucggagccuucuuguguccuca

SEQ ID NO: 328695 - RNA, 64 nt, hsa
aaaauuaugagugauuaagaaaacauugcuuugugguuaucacuuuaaguuuugacaccuagau

SEQ ID NO: 328696 - RNA, 64 nt, hsa
uauuguaugaagcauauguagcacuucacagcaugguuaucauguaagcugcagguagaagcaa

SEQ ID NO: 328697 - RNA, 64 nt, hsa
aguuuagaccaguuaaacccauaggauccuguaugguuaucaaugugaugccuugcuuuucaua

SEQ ID NO: 328698 - RNA, 64 nt, hsa
agaugaugggauaacauggacugcucaguggccagguuaucaguggggggacuuaauucuaauc

SEQ ID NO: 328699 - RNA, 64 nt, hsa
acaagcaauagugacaugagcacuugacucgcuggguuaucaggcuuuggcuccaaauguuugg

SEQ ID NO: 328700 - RNA, 64 nt, hsa
cugccaaaaccaaaaaccauuuugaucucccugugguuaucaauauaacgcacaaucacaagug

SEQ ID NO: 328701 - RNA, 64 nt, hsa
cuagcccauguuuagauccaggucuccaauucaugguuaucagggcauguguucaacaaccccc

SEQ ID NO: 328702 - RNA, 64 nt, hsa
ugcuucuaugaugucaacuuucuuacuaauaacugguuaucaugacaaauguuagguuuaucau

SEQ ID NO: 328703 - RNA, 64 nt, hsa
uuauaauaucccaggccccuugauaaaagcugaggguuaucaugaccuuaaugcuaauucaaug

SEQ ID NO: 328704 - RNA, 64 nt, hsa
gagaaaguggcucauuccugguagaaguaugggugguuaucauuucaaaauuauugugauucuc

SEQ ID NO: 328705 - RNA, 64 nt, hsa
ucaaaaccuacuaugauuuguuuuacugaacaaagguuaucaaccacacauccaguccugacau

SEQ ID NO: 328706 - RNA, 64 nt, hsa
accacagugucucuucacuagucauuuagaacaugguuaucauccaagacuacucuacccugca

SEQ ID NO: 328707 - RNA, 64 nt, hsa
acacuaaaaagguuucaccugaucauauagcguggguuaucaguuaacauuaacaucuauuaua

SEQ ID NO: 328708 - RNA, 64 nt, hsa
aaggaugucuccagacacugccccguguccaugggguuaucacccacugugcugagucaaaggg

SEQ ID NO: 328709 - RNA, 64 nt, hsa
aaaaaaaauuauuuuuccagucuaccgugguccagguuaucagcucuuuaagagcucuauuaau

SEQ ID NO: 328710 - RNA, 64 nt, hsa
ucagugaaugaauguaguaaaauucacuuuggaagguuaucaggcuuuuaaaaaucuaguuuau

SEQ ID NO: 328711 - RNA, 64 nt, hsa
agagggaguuuggaaauguguggguaugauucuugguuaucauaaugaugggggugcuacuggc

SEQ ID NO: 328712 - RNA, 64 nt, hsa
uuuacaguagguauuacucuugugacauuuuuuugguuaucaacaacuaaauauaaauuacuuu

SEQ ID NO: 328713 - RNA, 64 nt, hsa
uuuugaucauuucuuugaugugaaaagcaucuuugguuaucaguuaaauugagguggacauuau

SEQ ID NO: 328714 - RNA, 64 nt, hsa
uaguuucaaaauguuaacaacuugaauuacaaccgguuaucaguuggacaguaagauuuuaucc

SEQ ID NO: 328715 - RNA, 64 nt, hsa
uucaguggugugaagaaaggaagcacaauuggcagguuaucacuuuccagucguuccaauagau

SEQ ID NO: 328716 - RNA, 64 nt, hsa
caggaaacuuuagggcagaugaggagaaugaauugguuaucagaguggaagaccauggcccagg

SEQ ID NO: 328717 - RNA, 64 nt, hsa
cccuggccagaggacauaaauggugcugguaggagguuaucagaguaaggaagguagcagauau

SEQ ID NO: 328718 - RNA, 64 nt, hsa
ucugauucuacagugaugauugaauucuaaaaaugguuaucauuagggcuuuugauuuauaaaa

SEQ ID NO: 328719 - RNA, 64 nt, hsa
uaaaguaugcuuauuucugugccuacuguauaaugguuaucaaacaguugucucagggguacaa

SEQ ID NO: 328720 - RNA, 64 nt, hsa
gccacagcuuuggcgggcacuucugccaagaaaugguuaucagcaccagccgccauggccaagc

SEQ ID NO: 328721 - RNA, 64 nt, hsa
aaaagagaguauauggaucgcaagaaaaaugaaggguuaucauacuugaaagauaagcacauag

SEQ ID NO: 328722 - RNA, 64 nt, hsa
aaucagauggucuagggcagauuuaacucuacaagguuaucaggaacuuuguuuccuucugucu

SEQ ID NO: 328723 - RNA, 64 nt, hsa
cuuaaauaauaaagcuggaaaauauuuuuagucggguuaucaaauuugauuuacaaaaacgcua

SEQ ID NO: 328724 - RNA, 64 nt, hsa
uuaaacuugcuggauucaugcagccagcuuugcagguuaucagagaucaaagauuguaauaaua

SEQ ID NO: 328725 - RNA, 64 nt, hsa
aaguugaacucauagaaggagagaauagaauggugguuaucaagggcugguggggcaguggagg

SEQ ID NO: 328726 - RNA, 64 nt, hsa
ucacacuauggcagccauccaugagaguuucaaagguuaucaaccauaugaauuuacuacuuua

SEQ ID NO: 328727 - RNA, 64 nt, hsa
uuagaaauuuugguauugggacaguggauaagcagguuaucacauagcauagaauucuuaaaag

SEQ ID NO: 328728 - RNA, 64 nt, hsa
gauaaggagugguugaauaaugggagaaugugcggguuaucauuuuucaaagaaaauuauucuc

SEQ ID NO: 328729 - RNA, 64 nt, hsa
auucuaaguugaguaaaugcauccuaccauucaagguuaucauauaauuuaacaaaauuguaca

SEQ ID NO: 328730 - RNA, 64 nt, hsa
augcaauggaaaaaaauggacaaccucuugacuagguuaucaaaauuaaccucaccaauaaagg

SEQ ID NO: 328731 - RNA, 64 nt, hsa
uuugggaagccuacuuauggaguggaaaccaggagguuaucaugguaguugaccuuauaagaaa

SEQ ID NO: 328732 - RNA, 64 nt, hsa
ugcccuauauaccucacuagccaugcuuuauguggguuaucauggaagaaaaggauuuuggaaa

SEQ ID NO: 328733 - RNA, 64 nt, hsa
cuagagggcugcaggacucuauccaccgcccccggguuaucauucagggccccaucaucuugga

SEQ ID NO: 328734 - RNA, 64 nt, hsa
uguugugaaauaccaaacuuauggauuaucacuagguuaucaagcauauauuagucuuuaucag

SEQ ID NO: 328735 - RNA, 64 nt, hsa
caauacuaaacugcuaaacaacuagauguaaucagguuaucaaaggcaaguagaguaauaaauc

SEQ ID NO: 328736 - RNA, 64 nt, hsa
cuuguuuuuuuuuccauagcacaguaaugaaugugguuaucaaucacauacuuuuuuggauuau

SEQ ID NO: 328737 - RNA, 64 nt, hsa
gccauagagcacccuuccuccugggccagagcuggguuaucaugguuggcuuagguaccucagg

SEQ ID NO: 328738 - RNA, 64 nt, hsa
agccauguguuccaaggcauuuuagcggggaggggguuaucaaaaaaaaaaaaaugugacucaa

SEQ ID NO: 328739 - RNA, 64 nt, hsa
guaagccuguuaacagaaaguagaggcuauucaagguuaucaagaaagugcccugugcuaauga

SEQ ID NO: 328740 - RNA, 64 nt, hsa
acuugcaguguagcccaguuugaaauauuuauuugguuaucaacugcccauggaggaggcucuu

SEQ ID NO: 328741 - RNA, 64 nt, hsa
gaacuguuuggaaacuucuuuccaccauucaggagguuaucagaauuaauaaaaguaucuguua

SEQ ID NO: 328742 - RNA, 64 nt, hsa
aauagugucugagacacaagagcuauauguuagagguuaucaucauuauuuguauuuugugaau

SEQ ID NO: 328743 - RNA, 64 nt, hsa
gcaagugcccuuaggaugccgcaugggaaaaaucgguuaucauaauuucaaaguauaaauauau

SEQ ID NO: 328744 - RNA, 64 nt, hsa
ucuugcuguugaauggagacuagaguugggaaaggguuaucaacugcaaugggagaaguaugua

SEQ ID NO: 328745 - RNA, 64 nt, hsa
ucaagccugagcagaugaaugacuccaggaagaagguuaucaugaaacugaacucaccauuucu

SEQ ID NO: 328746 - RNA, 64 nt, hsa
ccccugucuggauccccucccuugugagccccaggguuaucaguugcuggcugugccugagcag

SEQ ID NO: 328747 - RNA, 64 nt, hsa
ucuuacuguguucacugggauuugccugccacuugguuaucauuacuguugggugaaccuguga

SEQ ID NO: 328748 - RNA, 64 nt, hsa
aaaaaacuuacucucuuuuuuccucucuguaauugguuaucaggaagaauuugcuuaaugacua

SEQ ID NO: 328749 - RNA, 64 nt, hsa
gaaugcuacaugauggccagcugcuucccuccuugguuaucauccacugcagcugcuaguuaga

SEQ ID NO: 328750 - RNA, 64 nt, hsa
auaaaauuuucauugucuugccauauaaagccuugguuaucaacagguggaauguagauauugu

SEQ ID NO: 328751 - RNA, 64 nt, hsa
gaacuaauacuggugaaaauuuaccuaaaaccuugguuaucaaauacaucuccaguacauuccg

SEQ ID NO: 328752 - RNA, 64 nt, hsa
acacugcauaggaauuuagaaccuaacuuuuauagguuaucaaaacuguugucaccauugcaca

SEQ ID NO: 328753 - RNA, 64 nt, hsa
uccccugaugaauacagagugguagcuagggguugguuaucaucagaagguggucuccccucag

SEQ ID NO: 328754 - RNA, 52 nt, hsa
ucaaugacuugcaaggauaauggguuaucacaacuucagaguaauauuacac

SEQ ID NO: 328755 - RNA, 64 nt, hsa
uugaucaagaauuugggugggagaaaagaaaguggguuaucaagggugauuugaaauuuucugc

SEQ ID NO: 328756 - RNA, 64 nt, hsa
uaggccaggagacauggaauaccauucaugggaugguuaucacaggaguuuagaaagacucugc

SEQ ID NO: 328757 - RNA, 64 nt, hsa
uuuuaaaccucaccuuugugggguuuuuggagaagguuaucaaaaauuucauggaaggaccaca

SEQ ID NO: 328758 - RNA, 64 nt, hsa
uggagucccaaugacuucucuggaaagacaaagagguuaucacaaaaauuccucccagaggcac

SEQ ID NO: 328759 - RNA, 64 nt, hsa
aauaaaaggccuuuuucuaaccuaccucuaaugggguuaucagauauguuuuuaaaucucucgc

SEQ ID NO: 328760 - RNA, 64 nt, hsa
aaugaauuauauaugcugaauauuaagcuacugggguuaucagcuauuugggaagaguguaagu

SEQ ID NO: 328761 - RNA, 64 nt, hsa
cugcccuggcccucuuucuucugucacuaacccugguuaucauuuuacaggcuuguaacuggau

SEQ ID NO: 328762 - RNA, 64 nt, hsa
uaagcagacuaaauguugcccagaaucaguguuggguuaucaguuuauauuaaauauacugagu

SEQ ID NO: 328763 - RNA, 64 nt, hsa
uaguacccacuuucugcucuuuggagagaacacagguuaucaaguucaucucucuugacuacuc

SEQ ID NO: 328764 - RNA, 64 nt, hsa
aguuuggugugccuauugugauuuaaaacagguggguuaucaagaggaacuugagaucucuuua

SEQ ID NO: 328765 - RNA, 64 nt, hsa
agcuugaaacccguggcgcuuucugcaguuugcagguuaucauugugaacuuuuuuuuuuuaag

SEQ ID NO: 328766 - RNA, 64 nt, hsa
ugaagaaacacccucuuaggcugugcaaggcauggguuaucaggggauugaggucaccugggac

SEQ ID NO: 328767 - RNA, 64 nt, hsa
ucuuccaaaguauggaacacuccaaucagaaaaagguuaucauuggucguugaguuaugggaag

SEQ ID NO: 328768 - RNA, 64 nt, hsa
aaaacaaugugcugcugcuucacuuccgcccuccgguuaucaagcaaaaugucucuuguggccc

SEQ ID NO: 328769 - RNA, 64 nt, hsa
cagaaaaugugugugaucccugcuauggagcagagguuaucaaacuaaagcccauggaccaaau

SEQ ID NO: 328770 - RNA, 64 nt, hsa
augcacugaauaauuguuuuuaacuggagaguuugguuaucaauauaacuuucggauuaguuaa

SEQ ID NO: 328771 - RNA, 64 nt, hsa
agaccuguuccacaucaugcacaugggaaagggugguuaucauuuuccuucuaacaaguaggua

SEQ ID NO: 328772 - RNA, 64 nt, hsa
ucauuuuaggucuuaaagacuucaagaaaauacagguuaucaauuuauuuuaaaucucauuguu

SEQ ID NO: 328773 - RNA, 64 nt, hsa
caccaucauaugccccaaacaacugaaaguuggcgguuaucaccagacugugaguuucuggcaa

SEQ ID NO: 328774 - RNA, 64 nt, hsa
ugaagccaaaucugaacccauguccucacuucaagguuaucaaucuuggauugugaugcuauug

SEQ ID NO: 328775 - RNA, 64 nt, hsa
gucccugcagaguggaugcuucugccuagugacagguuaucaccacguuauauauucccuaccg

SEQ ID NO: 328776 - RNA, 64 nt, hsa
uuuaaaaucuuucaggagcuuuacugaaagacuugguuaucaagucuuuuggggagagaaugac

SEQ ID NO: 328777 - RNA, 64 nt, hsa
aaagaucacuugguaguuagccacauugagaagugguuaucauuguuaaugugguuaaugccaa

SEQ ID NO: 328778 - RNA, 64 nt, hsa
aagaguuugaaauauguuaaacacuagacauccugguuaucaaaaccaaugagcauuacuuuca

SEQ ID NO: 328779 - RNA, 64 nt, hsa
gaaugggaaaucaaggggugacagggaguaaaaggguuaucaucuuacugcaaagccacaagau

SEQ ID NO: 328780 - RNA, 64 nt, hsa
uccccauaauacccuuuuccaaccuaccucacaagguuaucagaaagaucaaauuaaauaauag

SEQ ID NO: 328781 - RNA, 64 nt, hsa
uacuugguccaacugcaacucaucaucggugacugguuaucacaccaucgcuggccccuuuggg

SEQ ID NO: 328782 - RNA, 64 nt, hsa
ugguauauaauuccauguagccuuuaauaugcuggguuaucaaauucuguucacugaguuauga

SEQ ID NO: 328783 - RNA, 64 nt, hsa
ucuaaaugucucaguagaggaguagaauucaucugguuaucaccugguccucugaaguuaacug

SEQ ID NO: 328784 - RNA, 64 nt, hsa
caagucauucaagugcuuucuccacuguacaggugguuaucaaccuuggcugcgcaucagaauc

SEQ ID NO: 328785 - RNA, 64 nt, hsa
uuauagugucaugcagaguauuucuaaaguaauugguuaucaugggaaaguauucucuuuucaa

SEQ ID NO: 328786 - RNA, 64 nt, hsa
gugcuaaccaaauuucugugaagaauguuuucaugguuaucauuauaucuaacuauaaccuccc

SEQ ID NO: 328787 - RNA, 64 nt, hsa
caccuaaaggccuguaggccucuaacucuuucugcccuuucauucaaaccucuccaaaguucuu

SEQ ID NO: 328788 - RNA, 64 nt, hsa
ccuagccuuuucuucuggaucuguccucccucaccccuuucaccugagcuguccacaguaggaa

SEQ ID NO: 328789 - RNA, 64 nt, hsa
ccauuccagccucuuccucugaauagaccagacgcccuuucacuuaguucagugccaguccuuu

SEQ ID NO: 328790 - RNA, 64 nt, hsa
agaaguccuaacguaaccacaguaaagcagacuccccuuucagcaaccucaaagcaaaaaaaaa

SEQ ID NO: 328791 - RNA, 64 nt, hsa
caaguacccguggugucuguucccacaacaauggcccuuucacaagcucuugccucacaacccc

SEQ ID NO: 328792 - RNA, 64 nt, hsa
gcugcugcucuuuaugaacugcccaacuuccugucccuuucaggggcuagacacaggcuucucg

SEQ ID NO: 328793 - RNA, 64 nt, hsa
ucucgacaccuugcaguuuuacuucauuuccugccccuuucagggccugugaggaugcccauga

SEQ ID NO: 328794 - RNA, 64 nt, hsa
uacagggaagaaaucaaguuaauguacuuucauucccuuucaugauuugcaacuuuagaaagaa

SEQ ID NO: 328795 - RNA, 64 nt, hsa
cagcagaguaaaauuacagaagaagcuccugaaucccuuucaguuuguccacacaagacagcag

SEQ ID NO: 328796 - RNA, 64 nt, hsa
aacuacagccaaauugcagaagaaacuccuggaucccuuucacuauguccaugaaaaacagcag

SEQ ID NO: 328797 - RNA, 64 nt, hsa
acauggaauuuuuccauauaaaucucaaugaauucccuuucauuugaauaggcaaacccaaauc

SEQ ID NO: 328798 - RNA, 64 nt, hsa
auagcucaaguugaauuuucuuuccagccaguuacccuuucaaccuacccauacuuuguacaac

SEQ ID NO: 328799 - RNA, 64 nt, hsa
ccaggcuggccugugaaggauugccccagguguccccuuucacgguugucacauuuacagugac

SEQ ID NO: 328800 - RNA, 64 nt, hsa
uacaggucacaaugaccacauuugaaauuguuuucccuuucauuuuacccugugaaagcaucuc

SEQ ID NO: 328801 - RNA, 64 nt, hsa
caaagauuucauccaacuccccuuucaucccacucccuuucaucccauuuuuuucuuucugucc

SEQ ID NO: 328802 - RNA, 64 nt, hsa
agaucugucuuucuccaaagauuucauccaacuccccuuucaucccacucccuuucaucccauu

SEQ ID NO: 328803 - RNA, 64 nt, hsa
uaaaaauaacuccuuugaugagcuuccuuauuaacccuuucagacccagucuguuggagccaug

SEQ ID NO: 328804 - RNA, 64 nt, hsa
uaaaagcgccuccggagccgcccugcggcggggucccuuucaucccacuuaaagugcuucugcc

SEQ ID NO: 328805 - RNA, 64 nt, hsa; identical to SEQ ID NO: 194985

SEQ ID NO: 328806 - RNA, 64 nt, hsa; identical to SEQ ID NO: 194986

SEQ ID NO: 328807 - RNA, 64 nt, hsa; identical to SEQ ID NO: 194987

SEQ ID NO: 328808 - RNA, 64 nt, hsa; identical to SEQ ID NO: 194988

SEQ ID NO: 328809 - RNA, 64 nt, hsa; identical to SEQ ID NO: 194989

SEQ ID NO: 328810 - RNA, 64 nt, hsa; identical to SEQ ID NO: 194990

SEQ ID NO: 328811 - RNA, 64 nt, hsa; identical to SEQ ID NO: 194991

SEQ ID NO: 328812 - RNA, 64 nt, hsa; identical to SEQ ID NO: 194992

SEQ ID NO: 328813 - RNA, 64 nt, hsa; identical to SEQ ID NO: 194993

SEQ ID NO: 328814 - RNA, 64 nt, hsa; identical to SEQ ID NO: 194994

SEQ ID NO: 328815 - RNA, 64 nt, hsa; identical to SEQ ID NO: 194995

SEQ ID NO: 328816 - RNA, 64 nt, hsa; identical to SEQ ID NO: 194996

SEQ ID NO: 328817 - RNA, 64 nt, hsa; identical to SEQ ID NO: 194997

SEQ ID NO: 328818 - RNA, 64 nt, hsa; identical to SEQ ID NO: 194998

SEQ ID NO: 328819 - RNA, 64 nt, hsa; identical to SEQ ID NO: 194999

SEQ ID NO: 328820 - RNA, 64 nt, hsa; identical to SEQ ID NO: 195000

SEQ ID NO: 328821 - RNA, 64 nt, hsa; identical to SEQ ID NO: 195001

SEQ ID NO: 328822 - RNA, 64 nt, hsa; identical to SEQ ID NO: 195002

SEQ ID NO: 328823 - RNA, 64 nt, hsa; identical to SEQ ID NO: 195003

SEQ ID NO: 328824 - RNA, 64 nt, hsa; identical to SEQ ID NO: 195004

SEQ ID NO: 328825 - RNA, 64 nt, hsa; identical to SEQ ID NO: 195005

SEQ ID NO: 328826 - RNA, 64 nt, hsa; identical to SEQ ID NO: 195006

SEQ ID NO: 328827 - RNA, 64 nt, hsa; identical to SEQ ID NO: 195007

SEQ ID NO: 328828 - RNA, 64 nt, hsa; identical to SEQ ID NO: 195008

SEQ ID NO: 328829 - RNA, 64 nt, hsa; identical to SEQ ID NO: 195009

SEQ ID NO: 328830 - RNA, 64 nt, hsa; identical to SEQ ID NO: 195010

SEQ ID NO: 328831 - RNA, 64 nt, hsa; identical to SEQ ID NO: 195011

SEQ ID NO: 328832 - RNA, 64 nt, hsa; identical to SEQ ID NO: 195012

SEQ ID NO: 328833 - RNA, 64 nt, hsa; identical to SEQ ID NO: 195013

SEQ ID NO: 328834 - RNA, 64 nt, hsa; identical to SEQ ID NO: 195014

SEQ ID NO: 328835 - RNA, 64 nt, hsa; identical to SEQ ID NO: 195015

SEQ ID NO: 328836 - RNA, 64 nt, hsa; identical to SEQ ID NO: 195016

SEQ ID NO: 328837 - RNA, 64 nt, hsa; identical to SEQ ID NO: 195017

SEQ ID NO: 328838 - RNA, 64 nt, hsa; identical to SEQ ID NO: 195018

SEQ ID NO: 328839 - RNA, 64 nt, hsa; identical to SEQ ID NO: 195019

SEQ ID NO: 328840 - RNA, 64 nt, hsa; identical to SEQ ID NO: 195020

SEQ ID NO: 328841 - RNA, 64 nt, hsa; identical to SEQ ID NO: 195021

SEQ ID NO: 328842 - RNA, 64 nt, hsa; identical to SEQ ID NO: 195022

SEQ ID NO: 328843 - RNA, 64 nt, hsa; identical to SEQ ID NO: 195023

SEQ ID NO: 328844 - RNA, 64 nt, hsa; identical to SEQ ID NO: 195024

SEQ ID NO: 328845 - RNA, 64 nt, hsa; identical to SEQ ID NO: 195025

SEQ ID NO: 328846 - RNA, 64 nt, hsa; identical to SEQ ID NO: 195026

SEQ ID NO: 328847 - RNA, 64 nt, hsa; identical to SEQ ID NO: 129470

SEQ ID NO: 328848 - RNA, 64 nt, hsa; identical to SEQ ID NO: 129471

SEQ ID NO: 328849 - RNA, 64 nt, hsa; identical to SEQ ID NO: 129472

SEQ ID NO: 328850 - RNA, 64 nt, hsa; identical to SEQ ID NO: 129473

SEQ ID NO: 328851 - RNA, 64 nt, hsa; identical to SEQ ID NO: 129474

SEQ ID NO: 328852 - RNA, 64 nt, hsa; identical to SEQ ID NO: 129475

SEQ ID NO: 328853 - RNA, 64 nt, hsa; identical to SEQ ID NO: 129476

SEQ ID NO: 328854 - RNA, 64 nt, hsa; identical to SEQ ID NO: 129477

SEQ ID NO: 328855 - RNA, 64 nt, hsa; identical to SEQ ID NO: 129478

SEQ ID NO: 328856 - RNA, 64 nt, hsa; identical to SEQ ID NO: 129479

SEQ ID NO: 328857 - RNA, 64 nt, hsa
ucuucugcuucaauuacaccaguucuggggcaaagacacugaugaaacaacacccauaccugaa

SEQ ID NO: 328858 - RNA, 64 nt, hsa
cugccucugaguuuugaugcuguauuugcugccagacacugagcuucugagacaucccugauuc

SEQ ID NO: 328859 - RNA, 64 nt, hsa
aagcugcaaaucugauggccuuaauuuccuuuuugacacugaaaguuuuguaaaagaaaucaug

SEQ ID NO: 328860 - RNA, 64 nt, hsa
uguccauacacuuuguugcaagaugugaauuauugacacugaacuuaauaacuguguacuguuc

SEQ ID NO: 328861 - RNA, 64 nt, hsa
uacucuagccuuuucaugacacugauauuuucgugacacugacuuauaguucacuguuuaccug

SEQ ID NO: 328862 - RNA, 64 nt, hsa
uaucuucccccuccauguacucuagccuuuucaugacacugauauuuucgugacacugacuuau

SEQ ID NO: 328863 - RNA, 64 nt, hsa
uaauuaacuuaaagacugauuuuaaucugacuaugacacugagcauauucuuuaaauuacucau

SEQ ID NO: 328864 - RNA, 64 nt, hsa
uugcuguaaagugcaaggaaauuuuaaauucugggacacugaguuagaugguaaauacugacuu

SEQ ID NO: 328865 - RNA, 64 nt, hsa
aaugaucauggcuauguuuuaauaaaacuuuauggacacugagcuugaacuucauauaucaguc

SEQ ID NO: 328866 - RNA, 64 nt, hsa
aaugaucauggcuauguuuuaauaaaacuuuacagacacugaacuugaacuuccauugugauau

SEQ ID NO: 328867 - RNA, 64 nt, hsa
cuggacucugcuagugucuucugaggacacugaugacacugauuaaugauacagaccuuugcag

SEQ ID NO: 328868 - RNA, 64 nt, hsa
cgcaucacccuggacucugcuagugucuucugaggacacugaugacacugauuaaugauacaga

SEQ ID NO: 328869 - RNA, 64 nt, hsa; identical to SEQ ID NO: 109235

SEQ ID NO: 328870 - RNA, 64 nt, hsa; identical to SEQ ID NO: 109236

SEQ ID NO: 328871 - RNA, 64 nt, hsa; identical to SEQ ID NO: 109237

SEQ ID NO: 328872 - RNA, 64 nt, hsa; identical to SEQ ID NO: 109238

SEQ ID NO: 328873 - RNA, 64 nt, hsa; identical to SEQ ID NO: 109239

SEQ ID NO: 328874 - RNA, 64 nt, hsa; identical to SEQ ID NO: 109240

SEQ ID NO: 328875 - RNA, 64 nt, hsa; identical to SEQ ID NO: 109241

SEQ ID NO: 328876 - RNA, 64 nt, hsa; identical to SEQ ID NO: 109242

SEQ ID NO: 328877 - RNA, 64 nt, hsa; identical to SEQ ID NO: 109243

SEQ ID NO: 328878 - RNA, 64 nt, hsa; identical to SEQ ID NO: 109244

SEQ ID NO: 328879 - RNA, 64 nt, hsa; identical to SEQ ID NO: 109245

SEQ ID NO: 328880 - RNA, 64 nt, hsa; identical to SEQ ID NO: 109246

SEQ ID NO: 328881 - RNA, 64 nt, hsa; identical to SEQ ID NO: 109247

SEQ ID NO: 328882 - RNA, 64 nt, hsa; identical to SEQ ID NO: 109248

SEQ ID NO: 328883 - RNA, 64 nt, hsa; identical to SEQ ID NO: 109249

SEQ ID NO: 328884 - RNA, 64 nt, hsa; identical to SEQ ID NO: 109250

SEQ ID NO: 328885 - RNA, 64 nt, hsa; identical to SEQ ID NO: 39347

SEQ ID NO: 328886 - RNA, 64 nt, hsa; identical to SEQ ID NO: 39348

SEQ ID NO: 328887 - RNA, 64 nt, hsa; identical to SEQ ID NO: 39349

SEQ ID NO: 328888 - RNA, 64 nt, hsa; identical to SEQ ID NO: 39350

SEQ ID NO: 328889 - RNA, 64 nt, hsa; identical to SEQ ID NO: 39351

SEQ ID NO: 328890 - RNA, 64 nt, hsa; identical to SEQ ID NO: 39352

SEQ ID NO: 328891 - RNA, 64 nt, hsa; identical to SEQ ID NO: 39353

SEQ ID NO: 328892 - RNA, 64 nt, hsa; identical to SEQ ID NO: 39354

SEQ ID NO: 328893 - RNA, 64 nt, hsa; identical to SEQ ID NO: 39355

SEQ ID NO: 328894 - RNA, 64 nt, hsa; identical to SEQ ID NO: 39356

SEQ ID NO: 328895 - RNA, 64 nt, hsa; identical to SEQ ID NO: 39357

SEQ ID NO: 328896 - RNA, 64 nt, hsa; identical to SEQ ID NO: 39358

SEQ ID NO: 328897 - RNA, 64 nt, hsa; identical to SEQ ID NO: 39359

SEQ ID NO: 328898 - RNA, 64 nt, hsa; identical to SEQ ID NO: 39360

SEQ ID NO: 328899 - RNA, 64 nt, hsa; identical to SEQ ID NO: 39361

SEQ ID NO: 328900 - RNA, 64 nt, hsa; identical to SEQ ID NO: 39362

SEQ ID NO: 328901 - RNA, 64 nt, hsa; identical to SEQ ID NO: 39363

SEQ ID NO: 328902 - RNA, 64 nt, hsa; identical to SEQ ID NO: 39364

SEQ ID NO: 328903 - RNA, 64 nt, hsa; identical to SEQ ID NO: 39365

SEQ ID NO: 328904 - RNA, 64 nt, hsa; identical to SEQ ID NO: 39366

SEQ ID NO: 328905 - RNA, 64 nt, hsa; identical to SEQ ID NO: 39367

SEQ ID NO: 328906 - RNA, 64 nt, hsa; identical to SEQ ID NO: 39368

SEQ ID NO: 328907 - RNA, 64 nt, hsa; identical to SEQ ID NO: 39369

SEQ ID NO: 328908 - RNA, 64 nt, hsa; identical to SEQ ID NO: 39370

SEQ ID NO: 328909 - RNA, 64 nt, hsa; identical to SEQ ID NO: 39371

SEQ ID NO: 328910 - RNA, 64 nt, hsa; identical to SEQ ID NO: 39372

SEQ ID NO: 328911 - RNA, 64 nt, hsa; identical to SEQ ID NO: 39373

SEQ ID NO: 328912 - RNA, 64 nt, hsa; identical to SEQ ID NO: 39374

SEQ ID NO: 328913 - RNA, 64 nt, hsa; identical to SEQ ID NO: 39375

SEQ ID NO: 328914 - RNA, 64 nt, hsa; identical to SEQ ID NO: 39376

SEQ ID NO: 328915 - RNA, 64 nt, hsa; identical to SEQ ID NO: 39377

SEQ ID NO: 328916 - RNA, 64 nt, hsa; identical to SEQ ID NO: 39378

SEQ ID NO: 328917 - RNA, 64 nt, hsa; identical to SEQ ID NO: 39379

SEQ ID NO: 328918 - RNA, 64 nt, hsa; identical to SEQ ID NO: 39380

SEQ ID NO: 328919 - RNA, 64 nt, hsa; identical to SEQ ID NO: 39381

SEQ ID NO: 328920 - RNA, 64 nt, hsa; identical to SEQ ID NO: 39382

SEQ ID NO: 328921 - RNA, 64 nt, hsa; identical to SEQ ID NO: 39383

SEQ ID NO: 328922 - RNA, 64 nt, hsa; identical to SEQ ID NO: 39384

SEQ ID NO: 328923 - RNA, 64 nt, hsa; identical to SEQ ID NO: 39385

SEQ ID NO: 328924 - RNA, 64 nt, hsa; identical to SEQ ID NO: 39386

SEQ ID NO: 328925 - RNA, 64 nt, hsa; identical to SEQ ID NO: 39387

SEQ ID NO: 328926 - RNA, 64 nt, hsa; identical to SEQ ID NO: 39388

SEQ ID NO: 328927 - RNA, 64 nt, hsa; identical to SEQ ID NO: 39389

SEQ ID NO: 328928 - RNA, 64 nt, hsa; identical to SEQ ID NO: 39390

SEQ ID NO: 328929 - RNA, 64 nt, hsa; identical to SEQ ID NO: 39391

SEQ ID NO: 328930 - RNA, 64 nt, hsa; identical to SEQ ID NO: 39392

SEQ ID NO: 328931 - RNA, 64 nt, hsa; identical to SEQ ID NO: 39393

SEQ ID NO: 328932 - RNA, 64 nt, hsa; identical to SEQ ID NO: 39394

SEQ ID NO: 328933 - RNA, 64 nt, hsa; identical to SEQ ID NO: 39395

SEQ ID NO: 328934 - RNA, 64 nt, hsa; identical to SEQ ID NO: 39396

SEQ ID NO: 328935 - RNA, 64 nt, hsa; identical to SEQ ID NO: 39397

SEQ ID NO: 328936 - RNA, 64 nt, hsa; identical to SEQ ID NO: 39398

SEQ ID NO: 328937 - RNA, 64 nt, hsa; identical to SEQ ID NO: 39399

SEQ ID NO: 328938 - RNA, 64 nt, hsa; identical to SEQ ID NO: 39400

SEQ ID NO: 328939 - RNA, 64 nt, hsa; identical to SEQ ID NO: 39401

SEQ ID NO: 328940 - RNA, 64 nt, hsa; identical to SEQ ID NO: 39402

SEQ ID NO: 328941 - RNA, 64 nt, hsa; identical to SEQ ID NO: 39403

SEQ ID NO: 328942 - RNA, 64 nt, hsa; identical to SEQ ID NO: 39404

SEQ ID NO: 328943 - RNA, 64 nt, hsa; identical to SEQ ID NO: 39405

SEQ ID NO: 328944 - RNA, 64 nt, hsa; identical to SEQ ID NO: 39406

SEQ ID NO: 328945 - RNA, 64 nt, hsa; identical to SEQ ID NO: 39407

SEQ ID NO: 328946 - RNA, 64 nt, hsa; identical to SEQ ID NO: 39408

SEQ ID NO: 328947 - RNA, 64 nt, hsa; identical to SEQ ID NO: 39409

SEQ ID NO: 328948 - RNA, 64 nt, hsa; identical to SEQ ID NO: 39410

SEQ ID NO: 328949 - RNA, 64 nt, hsa; identical to SEQ ID NO: 39411

SEQ ID NO: 328950 - RNA, 64 nt, hsa; identical to SEQ ID NO: 39412

SEQ ID NO: 328951 - RNA, 64 nt, hsa; identical to SEQ ID NO: 39413

SEQ ID NO: 328952 - RNA, 64 nt, hsa; identical to SEQ ID NO: 39414

SEQ ID NO: 328953 - RNA, 64 nt, hsa; identical to SEQ ID NO: 39415

SEQ ID NO: 328954 - RNA, 64 nt, hsa; identical to SEQ ID NO: 39416

SEQ ID NO: 328955 - RNA, 64 nt, hsa; identical to SEQ ID NO: 39417

SEQ ID NO: 328956 - RNA, 64 nt, hsa; identical to SEQ ID NO: 39418

SEQ ID NO: 328957 - RNA, 64 nt, hsa; identical to SEQ ID NO: 39419

SEQ ID NO: 328958 - RNA, 64 nt, hsa; identical to SEQ ID NO: 39420

SEQ ID NO: 328959 - RNA, 64 nt, hsa; identical to SEQ ID NO: 39421

SEQ ID NO: 328960 - RNA, 64 nt, hsa; identical to SEQ ID NO: 39422

SEQ ID NO: 328961 - RNA, 64 nt, hsa; identical to SEQ ID NO: 39423

SEQ ID NO: 328962 - RNA, 64 nt, hsa; identical to SEQ ID NO: 39424

SEQ ID NO: 328963 - RNA, 64 nt, hsa; identical to SEQ ID NO: 39425

SEQ ID NO: 328964 - RNA, 64 nt, hsa; identical to SEQ ID NO: 39426

SEQ ID NO: 328965 - RNA, 64 nt, hsa; identical to SEQ ID NO: 39427

SEQ ID NO: 328966 - RNA, 64 nt, hsa; identical to SEQ ID NO: 39428

SEQ ID NO: 328967 - RNA, 64 nt, hsa; identical to SEQ ID NO: 39429

SEQ ID NO: 328968 - RNA, 64 nt, hsa; identical to SEQ ID NO: 39430

SEQ ID NO: 328969 - RNA, 64 nt, hsa; identical to SEQ ID NO: 39431

SEQ ID NO: 328970 - RNA, 64 nt, hsa; identical to SEQ ID NO: 39432

SEQ ID NO: 328971 - RNA, 64 nt, hsa; identical to SEQ ID NO: 39433

SEQ ID NO: 328972 - RNA, 64 nt, hsa; identical to SEQ ID NO: 39434

SEQ ID NO: 328973 - RNA, 64 nt, hsa; identical to SEQ ID NO: 39435

SEQ ID NO: 328974 - RNA, 64 nt, hsa; identical to SEQ ID NO: 39436

SEQ ID NO: 328975 - RNA, 64 nt, hsa; identical to SEQ ID NO: 39437

SEQ ID NO: 328976 - RNA, 64 nt, hsa; identical to SEQ ID NO: 39438

SEQ ID NO: 328977 - RNA, 64 nt, hsa; identical to SEQ ID NO: 39439

SEQ ID NO: 328978 - RNA, 64 nt, hsa; identical to SEQ ID NO: 39440

SEQ ID NO: 328979 - RNA, 64 nt, hsa; identical to SEQ ID NO: 39441

SEQ ID NO: 328980 - RNA, 64 nt, hsa; identical to SEQ ID NO: 39442

SEQ ID NO: 328981 - RNA, 64 nt, hsa; identical to SEQ ID NO: 39443

SEQ ID NO: 328982 - RNA, 64 nt, hsa; identical to SEQ ID NO: 39444

SEQ ID NO: 328983 - RNA, 64 nt, hsa; identical to SEQ ID NO: 39445

SEQ ID NO: 328984 - RNA, 64 nt, hsa; identical to SEQ ID NO: 39446

SEQ ID NO: 328985 - RNA, 64 nt, hsa; identical to SEQ ID NO: 39447

SEQ ID NO: 328986 - RNA, 64 nt, hsa; identical to SEQ ID NO: 39448

SEQ ID NO: 328987 - RNA, 64 nt, hsa; identical to SEQ ID NO: 39449

SEQ ID NO: 328988 - RNA, 64 nt, hsa; identical to SEQ ID NO: 39450

SEQ ID NO: 328989 - RNA, 64 nt, hsa; identical to SEQ ID NO: 39451

SEQ ID NO: 328990 - RNA, 64 nt, hsa; identical to SEQ ID NO: 39452

SEQ ID NO: 328991 - RNA, 64 nt, hsa; identical to SEQ ID NO: 39453

SEQ ID NO: 328992 - RNA, 64 nt, hsa; identical to SEQ ID NO: 39454

SEQ ID NO: 328993 - RNA, 64 nt, hsa; identical to SEQ ID NO: 39455

SEQ ID NO: 328994 - RNA, 64 nt, hsa; identical to SEQ ID NO: 39456

SEQ ID NO: 328995 - RNA, 64 nt, hsa; identical to SEQ ID NO: 39457

SEQ ID NO: 328996 - RNA, 64 nt, hsa; identical to SEQ ID NO: 39458

SEQ ID NO: 328997 - RNA, 64 nt, hsa; identical to SEQ ID NO: 39459

SEQ ID NO: 328998 - RNA, 64 nt, hsa; identical to SEQ ID NO: 39460

SEQ ID NO: 328999 - RNA, 64 nt, hsa; identical to SEQ ID NO: 39461

SEQ ID NO: 329000 - RNA, 64 nt, hsa; identical to SEQ ID NO: 39462

SEQ ID NO: 329001 - RNA, 64 nt, hsa; identical to SEQ ID NO: 39463

SEQ ID NO: 329002 - RNA, 64 nt, hsa; identical to SEQ ID NO: 39464

SEQ ID NO: 329003 - RNA, 64 nt, hsa; identical to SEQ ID NO: 39465

SEQ ID NO: 329004 - RNA, 64 nt, hsa; identical to SEQ ID NO: 39466

SEQ ID NO: 329005 - RNA, 64 nt, hsa; identical to SEQ ID NO: 39467

SEQ ID NO: 329006 - RNA, 64 nt, hsa; identical to SEQ ID NO: 39468

SEQ ID NO: 329007 - RNA, 64 nt, hsa; identical to SEQ ID NO: 39469

SEQ ID NO: 329008 - RNA, 64 nt, hsa; identical to SEQ ID NO: 39470

SEQ ID NO: 329009 - RNA, 64 nt, hsa; identical to SEQ ID NO: 39471

SEQ ID NO: 329010 - RNA, 64 nt, hsa; identical to SEQ ID NO: 39472

SEQ ID NO: 329011 - RNA, 64 nt, hsa; identical to SEQ ID NO: 39473

SEQ ID NO: 329012 - RNA, 64 nt, hsa; identical to SEQ ID NO: 39474

SEQ ID NO: 329013 - RNA, 64 nt, hsa; identical to SEQ ID NO: 39475

SEQ ID NO: 329014 - RNA, 64 nt, hsa; identical to SEQ ID NO: 39476

SEQ ID NO: 329015 - RNA, 64 nt, hsa; identical to SEQ ID NO: 39477

SEQ ID NO: 329016 - RNA, 64 nt, hsa; identical to SEQ ID NO: 39478

SEQ ID NO: 329017 - RNA, 64 nt, hsa; identical to SEQ ID NO: 39479

SEQ ID NO: 329018 - RNA, 64 nt, hsa; identical to SEQ ID NO: 39480

SEQ ID NO: 329019 - RNA, 64 nt, hsa; identical to SEQ ID NO: 39481

SEQ ID NO: 329020 - RNA, 64 nt, hsa; identical to SEQ ID NO: 39482

SEQ ID NO: 329021 - RNA, 64 nt, hsa; identical to SEQ ID NO: 39483

SEQ ID NO: 329022 - RNA, 64 nt, hsa; identical to SEQ ID NO: 39484

SEQ ID NO: 329023 - RNA, 64 nt, hsa; identical to SEQ ID NO: 39485

SEQ ID NO: 329024 - RNA, 64 nt, hsa; identical to SEQ ID NO: 39486

SEQ ID NO: 329025 - RNA, 64 nt, hsa; identical to SEQ ID NO: 39487

SEQ ID NO: 329026 - RNA, 64 nt, hsa; identical to SEQ ID NO: 39488

SEQ ID NO: 329027 - RNA, 64 nt, hsa; identical to SEQ ID NO: 39489

SEQ ID NO: 329028 - RNA, 64 nt, hsa; identical to SEQ ID NO: 39490

SEQ ID NO: 329029 - RNA, 64 nt, hsa; identical to SEQ ID NO: 39491

SEQ ID NO: 329030 - RNA, 64 nt, hsa; identical to SEQ ID NO: 39492

SEQ ID NO: 329031 - RNA, 64 nt, hsa; identical to SEQ ID NO: 39493

SEQ ID NO: 329032 - RNA, 64 nt, hsa; identical to SEQ ID NO: 39494

SEQ ID NO: 329033 - RNA, 64 nt, hsa; identical to SEQ ID NO: 39495

SEQ ID NO: 329034 - RNA, 64 nt, hsa; identical to SEQ ID NO: 39496

SEQ ID NO: 329035 - RNA, 64 nt, hsa; identical to SEQ ID NO: 39497

SEQ ID NO: 329036 - RNA, 64 nt, hsa; identical to SEQ ID NO: 39498

SEQ ID NO: 329037 - RNA, 64 nt, hsa; identical to SEQ ID NO: 39499

SEQ ID NO: 329038 - RNA, 64 nt, hsa; identical to SEQ ID NO: 39500

SEQ ID NO: 329039 - RNA, 64 nt, hsa; identical to SEQ ID NO: 39501

SEQ ID NO: 329040 - RNA, 64 nt, hsa; identical to SEQ ID NO: 39502

SEQ ID NO: 329041 - RNA, 64 nt, hsa; identical to SEQ ID NO: 39503

SEQ ID NO: 329042 - RNA, 64 nt, hsa; identical to SEQ ID NO: 39504

SEQ ID NO: 329043 - RNA, 64 nt, hsa; identical to SEQ ID NO: 39505

SEQ ID NO: 329044 - RNA, 64 nt, hsa; identical to SEQ ID NO: 39506

SEQ ID NO: 329045 - RNA, 64 nt, hsa; identical to SEQ ID NO: 39507

SEQ ID NO: 329046 - RNA, 64 nt, hsa; identical to SEQ ID NO: 39508

SEQ ID NO: 329047 - RNA, 64 nt, hsa; identical to SEQ ID NO: 39509

SEQ ID NO: 329048 - RNA, 64 nt, hsa; identical to SEQ ID NO: 39510

SEQ ID NO: 329049 - RNA, 64 nt, hsa; identical to SEQ ID NO: 39511

SEQ ID NO: 329050 - RNA, 64 nt, hsa; identical to SEQ ID NO: 39512

SEQ ID NO: 329051 - RNA, 64 nt, hsa; identical to SEQ ID NO: 39513

SEQ ID NO: 329052 - RNA, 64 nt, hsa; identical to SEQ ID NO: 39514

SEQ ID NO: 329053 - RNA, 64 nt, hsa; identical to SEQ ID NO: 39515

SEQ ID NO: 329054 - RNA, 64 nt, hsa; identical to SEQ ID NO: 39516

SEQ ID NO: 329055 - RNA, 64 nt, hsa; identical to SEQ ID NO: 39517

SEQ ID NO: 329056 - RNA, 64 nt, hsa; identical to SEQ ID NO: 39518

SEQ ID NO: 329057 - RNA, 64 nt, hsa; identical to SEQ ID NO: 39519

SEQ ID NO: 329058 - RNA, 64 nt, hsa; identical to SEQ ID NO: 39520

SEQ ID NO: 329059 - RNA, 64 nt, hsa; identical to SEQ ID NO: 39521

SEQ ID NO: 329060 - RNA, 64 nt, hsa; identical to SEQ ID NO: 39522

SEQ ID NO: 329061 - RNA, 64 nt, hsa; identical to SEQ ID NO: 39523

SEQ ID NO: 329062 - RNA, 64 nt, hsa; identical to SEQ ID NO: 39524

SEQ ID NO: 329063 - RNA, 64 nt, hsa; identical to SEQ ID NO: 39525

SEQ ID NO: 329064 - RNA, 64 nt, hsa; identical to SEQ ID NO: 39526

SEQ ID NO: 329065 - RNA, 64 nt, hsa; identical to SEQ ID NO: 39527

SEQ ID NO: 329066 - RNA, 64 nt, hsa; identical to SEQ ID NO: 39528

SEQ ID NO: 329067 - RNA, 64 nt, hsa; identical to SEQ ID NO: 39529

SEQ ID NO: 329068 - RNA, 64 nt, hsa; identical to SEQ ID NO: 39530

SEQ ID NO: 329069 - RNA, 64 nt, hsa; identical to SEQ ID NO: 39531

SEQ ID NO: 329070 - RNA, 64 nt, hsa; identical to SEQ ID NO: 39532

SEQ ID NO: 329071 - RNA, 64 nt, hsa; identical to SEQ ID NO: 39533

SEQ ID NO: 329072 - RNA, 64 nt, hsa; identical to SEQ ID NO: 39534

SEQ ID NO: 329073 - RNA, 64 nt, hsa; identical to SEQ ID NO: 39535

SEQ ID NO: 329074 - RNA, 64 nt, hsa; identical to SEQ ID NO: 39536

SEQ ID NO: 329075 - RNA, 64 nt, hsa; identical to SEQ ID NO: 39537

SEQ ID NO: 329076 - RNA, 64 nt, hsa; identical to SEQ ID NO: 39538

SEQ ID NO: 329077 - RNA, 64 nt, hsa; identical to SEQ ID NO: 39539

SEQ ID NO: 329078 - RNA, 64 nt, hsa; identical to SEQ ID NO: 39540

SEQ ID NO: 329079 - RNA, 64 nt, hsa; identical to SEQ ID NO: 39541

SEQ ID NO: 329080 - RNA, 64 nt, hsa; identical to SEQ ID NO: 39542

SEQ ID NO: 329081 - RNA, 64 nt, hsa; identical to SEQ ID NO: 39543

SEQ ID NO: 329082 - RNA, 64 nt, hsa; identical to SEQ ID NO: 39544

SEQ ID NO: 329083 - RNA, 64 nt, hsa; identical to SEQ ID NO: 39545

SEQ ID NO: 329084 - RNA, 64 nt, hsa; identical to SEQ ID NO: 39546

SEQ ID NO: 329085 - RNA, 64 nt, hsa; identical to SEQ ID NO: 39547

SEQ ID NO: 329086 - RNA, 64 nt, hsa; identical to SEQ ID NO: 39548

SEQ ID NO: 329087 - RNA, 64 nt, hsa; identical to SEQ ID NO: 39549

SEQ ID NO: 329088 - RNA, 64 nt, hsa; identical to SEQ ID NO: 39550

SEQ ID NO: 329089 - RNA, 64 nt, hsa; identical to SEQ ID NO: 39551

SEQ ID NO: 329090 - RNA, 64 nt, hsa; identical to SEQ ID NO: 39552

SEQ ID NO: 329091 - RNA, 64 nt, hsa; identical to SEQ ID NO: 39553

SEQ ID NO: 329092 - RNA, 64 nt, hsa; identical to SEQ ID NO: 39554

SEQ ID NO: 329093 - RNA, 64 nt, hsa; identical to SEQ ID NO: 39555

SEQ ID NO: 329094 - RNA, 64 nt, hsa; identical to SEQ ID NO: 39556

SEQ ID NO: 329095 - RNA, 64 nt, hsa; identical to SEQ ID NO: 39557

SEQ ID NO: 329096 - RNA, 64 nt, hsa; identical to SEQ ID NO: 39558

SEQ ID NO: 329097 - RNA, 64 nt, hsa; identical to SEQ ID NO: 39559

SEQ ID NO: 329098 - RNA, 64 nt, hsa; identical to SEQ ID NO: 39560

SEQ ID NO: 329099 - RNA, 64 nt, hsa; identical to SEQ ID NO: 39561

SEQ ID NO: 329100 - RNA, 64 nt, hsa; identical to SEQ ID NO: 39562

SEQ ID NO: 329101 - RNA, 64 nt, hsa; identical to SEQ ID NO: 39563

SEQ ID NO: 329102 - RNA, 64 nt, hsa; identical to SEQ ID NO: 39564

SEQ ID NO: 329103 - RNA, 64 nt, hsa; identical to SEQ ID NO: 39565

SEQ ID NO: 329104 - RNA, 64 nt, hsa; identical to SEQ ID NO: 39566

SEQ ID NO: 329105 - RNA, 64 nt, hsa; identical to SEQ ID NO: 39567

SEQ ID NO: 329106 - RNA, 64 nt, hsa; identical to SEQ ID NO: 39568

SEQ ID NO: 329107 - RNA, 64 nt, hsa; identical to SEQ ID NO: 39569

SEQ ID NO: 329108 - RNA, 64 nt, hsa; identical to SEQ ID NO: 39570

SEQ ID NO: 329109 - RNA, 64 nt, hsa; identical to SEQ ID NO: 39571

SEQ ID NO: 329110 - RNA, 64 nt, hsa; identical to SEQ ID NO: 39572

SEQ ID NO: 329111 - RNA, 64 nt, hsa; identical to SEQ ID NO: 39573

SEQ ID NO: 329112 - RNA, 64 nt, hsa; identical to SEQ ID NO: 39574

SEQ ID NO: 329113 - RNA, 64 nt, hsa; identical to SEQ ID NO: 39575

SEQ ID NO: 329114 - RNA, 64 nt, hsa; identical to SEQ ID NO: 39576

SEQ ID NO: 329115 - RNA, 64 nt, hsa; identical to SEQ ID NO: 39577

SEQ ID NO: 329116 - RNA, 64 nt, hsa; identical to SEQ ID NO: 39578

SEQ ID NO: 329117 - RNA, 64 nt, hsa; identical to SEQ ID NO: 39579

SEQ ID NO: 329118 - RNA, 64 nt, hsa; identical to SEQ ID NO: 39580

SEQ ID NO: 329119 - RNA, 64 nt, hsa; identical to SEQ ID NO: 39581

SEQ ID NO: 329120 - RNA, 64 nt, hsa; identical to SEQ ID NO: 39582

SEQ ID NO: 329121 - RNA, 64 nt, hsa; identical to SEQ ID NO: 39583

SEQ ID NO: 329122 - RNA, 64 nt, hsa; identical to SEQ ID NO: 39584

SEQ ID NO: 329123 - RNA, 64 nt, hsa; identical to SEQ ID NO: 39585

SEQ ID NO: 329124 - RNA, 64 nt, hsa; identical to SEQ ID NO: 39586

SEQ ID NO: 329125 - RNA, 64 nt, hsa; identical to SEQ ID NO: 39587

SEQ ID NO: 329126 - RNA, 64 nt, hsa; identical to SEQ ID NO: 39588

SEQ ID NO: 329127 - RNA, 64 nt, hsa; identical to SEQ ID NO: 39589

SEQ ID NO: 329128 - RNA, 64 nt, hsa; identical to SEQ ID NO: 39590

SEQ ID NO: 329129 - RNA, 64 nt, hsa; identical to SEQ ID NO: 39591

SEQ ID NO: 329130 - RNA, 64 nt, hsa; identical to SEQ ID NO: 39592

SEQ ID NO: 329131 - RNA, 64 nt, hsa; identical to SEQ ID NO: 39593

SEQ ID NO: 329132 - RNA, 64 nt, hsa; identical to SEQ ID NO: 39594

SEQ ID NO: 329133 - RNA, 64 nt, hsa; identical to SEQ ID NO: 39595

SEQ ID NO: 329134 - RNA, 64 nt, hsa; identical to SEQ ID NO: 39596

SEQ ID NO: 329135 - RNA, 64 nt, hsa; identical to SEQ ID NO: 39597

SEQ ID NO: 329136 - RNA, 64 nt, hsa; identical to SEQ ID NO: 39598

SEQ ID NO: 329137 - RNA, 64 nt, hsa; identical to SEQ ID NO: 39599

SEQ ID NO: 329138 - RNA, 64 nt, hsa; identical to SEQ ID NO: 39600

SEQ ID NO: 329139 - RNA, 64 nt, hsa; identical to SEQ ID NO: 39601

SEQ ID NO: 329140 - RNA, 64 nt, hsa; identical to SEQ ID NO: 39602

SEQ ID NO: 329141 - RNA, 64 nt, hsa; identical to SEQ ID NO: 39603

SEQ ID NO: 329142 - RNA, 64 nt, hsa; identical to SEQ ID NO: 39604

SEQ ID NO: 329143 - RNA, 64 nt, hsa; identical to SEQ ID NO: 39605

SEQ ID NO: 329144 - RNA, 64 nt, hsa; identical to SEQ ID NO: 39606

SEQ ID NO: 329145 - RNA, 64 nt, hsa; identical to SEQ ID NO: 39607

SEQ ID NO: 329146 - RNA, 64 nt, hsa; identical to SEQ ID NO: 39608

SEQ ID NO: 329147 - RNA, 64 nt, hsa; identical to SEQ ID NO: 39609

SEQ ID NO: 329148 - RNA, 64 nt, hsa; identical to SEQ ID NO: 39610

SEQ ID NO: 329149 - RNA, 64 nt, hsa; identical to SEQ ID NO: 39611

SEQ ID NO: 329150 - RNA, 64 nt, hsa; identical to SEQ ID NO: 39612

SEQ ID NO: 329151 - RNA, 64 nt, hsa; identical to SEQ ID NO: 39613

SEQ ID NO: 329152 - RNA, 64 nt, hsa; identical to SEQ ID NO: 39614

SEQ ID NO: 329153 - RNA, 64 nt, hsa; identical to SEQ ID NO: 39615

SEQ ID NO: 329154 - RNA, 64 nt, hsa; identical to SEQ ID NO: 39616

SEQ ID NO: 329155 - RNA, 64 nt, hsa; identical to SEQ ID NO: 39617

SEQ ID NO: 329156 - RNA, 64 nt, hsa; identical to SEQ ID NO: 39618

SEQ ID NO: 329157 - RNA, 64 nt, hsa; identical to SEQ ID NO: 39619

SEQ ID NO: 329158 - RNA, 64 nt, hsa; identical to SEQ ID NO: 39620

SEQ ID NO: 329159 - RNA, 64 nt, hsa; identical to SEQ ID NO: 39621

SEQ ID NO: 329160 - RNA, 64 nt, hsa; identical to SEQ ID NO: 39622

SEQ ID NO: 329161 - RNA, 64 nt, hsa; identical to SEQ ID NO: 39623

SEQ ID NO: 329162 - RNA, 64 nt, hsa; identical to SEQ ID NO: 39624

SEQ ID NO: 329163 - RNA, 64 nt, hsa; identical to SEQ ID NO: 39625

SEQ ID NO: 329164 - RNA, 64 nt, hsa; identical to SEQ ID NO: 39626

SEQ ID NO: 329165 - RNA, 64 nt, hsa; identical to SEQ ID NO: 39627

SEQ ID NO: 329166 - RNA, 64 nt, hsa; identical to SEQ ID NO: 39628

SEQ ID NO: 329167 - RNA, 64 nt, hsa; identical to SEQ ID NO: 39629

SEQ ID NO: 329168 - RNA, 64 nt, hsa; identical to SEQ ID NO: 39630

SEQ ID NO: 329169 - RNA, 64 nt, hsa; identical to SEQ ID NO: 39631

SEQ ID NO: 329170 - RNA, 64 nt, hsa; identical to SEQ ID NO: 39632

SEQ ID NO: 329171 - RNA, 64 nt, hsa; identical to SEQ ID NO: 39633

SEQ ID NO: 329172 - RNA, 64 nt, hsa; identical to SEQ ID NO: 39634

SEQ ID NO: 329173 - RNA, 64 nt, hsa; identical to SEQ ID NO: 39635

SEQ ID NO: 329174 - RNA, 64 nt, hsa; identical to SEQ ID NO: 39636

SEQ ID NO: 329175 - RNA, 64 nt, hsa; identical to SEQ ID NO: 39637

SEQ ID NO: 329176 - RNA, 64 nt, hsa; identical to SEQ ID NO: 39638

SEQ ID NO: 329177 - RNA, 64 nt, hsa; identical to SEQ ID NO: 39639

SEQ ID NO: 329178 - RNA, 64 nt, hsa; identical to SEQ ID NO: 39640

SEQ ID NO: 329179 - RNA, 64 nt, hsa; identical to SEQ ID NO: 39641

SEQ ID NO: 329180 - RNA, 64 nt, hsa; identical to SEQ ID NO: 39642

SEQ ID NO: 329181 - RNA, 64 nt, hsa; identical to SEQ ID NO: 39643

SEQ ID NO: 329182 - RNA, 64 nt, hsa; identical to SEQ ID NO: 39644

SEQ ID NO: 329183 - RNA, 64 nt, hsa; identical to SEQ ID NO: 39645

SEQ ID NO: 329184 - RNA, 64 nt, hsa; identical to SEQ ID NO: 39646

SEQ ID NO: 329185 - RNA, 64 nt, hsa; identical to SEQ ID NO: 39647

SEQ ID NO: 329186 - RNA, 64 nt, hsa; identical to SEQ ID NO: 39648

SEQ ID NO: 329187 - RNA, 64 nt, hsa; identical to SEQ ID NO: 39649

SEQ ID NO: 329188 - RNA, 64 nt, hsa; identical to SEQ ID NO: 39650

SEQ ID NO: 329189 - RNA, 64 nt, hsa; identical to SEQ ID NO: 39651

SEQ ID NO: 329190 - RNA, 64 nt, hsa; identical to SEQ ID NO: 39652

SEQ ID NO: 329191 - RNA, 64 nt, hsa; identical to SEQ ID NO: 39653

SEQ ID NO: 329192 - RNA, 64 nt, hsa; identical to SEQ ID NO: 39654

SEQ ID NO: 329193 - RNA, 64 nt, hsa; identical to SEQ ID NO: 39655

SEQ ID NO: 329194 - RNA, 64 nt, hsa; identical to SEQ ID NO: 39656

SEQ ID NO: 329195 - RNA, 64 nt, hsa; identical to SEQ ID NO: 39657

SEQ ID NO: 329196 - RNA, 64 nt, hsa; identical to SEQ ID NO: 39658

SEQ ID NO: 329197 - RNA, 64 nt, hsa; identical to SEQ ID NO: 39659

SEQ ID NO: 329198 - RNA, 64 nt, hsa; identical to SEQ ID NO: 39660

SEQ ID NO: 329199 - RNA, 64 nt, hsa; identical to SEQ ID NO: 39661

SEQ ID NO: 329200 - RNA, 64 nt, hsa; identical to SEQ ID NO: 39662

SEQ ID NO: 329201 - RNA, 64 nt, hsa; identical to SEQ ID NO: 39663

SEQ ID NO: 329202 - RNA, 64 nt, hsa; identical to SEQ ID NO: 39664

SEQ ID NO: 329203 - RNA, 64 nt, hsa; identical to SEQ ID NO: 39665

SEQ ID NO: 329204 - RNA, 64 nt, hsa; identical to SEQ ID NO: 39666

SEQ ID NO: 329205 - RNA, 64 nt, hsa; identical to SEQ ID NO: 39667

SEQ ID NO: 329206 - RNA, 64 nt, hsa; identical to SEQ ID NO: 39668

SEQ ID NO: 329207 - RNA, 64 nt, hsa; identical to SEQ ID NO: 39669

SEQ ID NO: 329208 - RNA, 64 nt, hsa; identical to SEQ ID NO: 39670

SEQ ID NO: 329209 - RNA, 64 nt, hsa; identical to SEQ ID NO: 39671

SEQ ID NO: 329210 - RNA, 64 nt, hsa; identical to SEQ ID NO: 39672

SEQ ID NO: 329211 - RNA, 64 nt, hsa; identical to SEQ ID NO: 39673

SEQ ID NO: 329212 - RNA, 64 nt, hsa; identical to SEQ ID NO: 39674

SEQ ID NO: 329213 - RNA, 64 nt, hsa; identical to SEQ ID NO: 39675

SEQ ID NO: 329214 - RNA, 64 nt, hsa; identical to SEQ ID NO: 39676

SEQ ID NO: 329215 - RNA, 64 nt, hsa; identical to SEQ ID NO: 39677

SEQ ID NO: 329216 - RNA, 64 nt, hsa; identical to SEQ ID NO: 39678

SEQ ID NO: 329217 - RNA, 64 nt, hsa; identical to SEQ ID NO: 39679

SEQ ID NO: 329218 - RNA, 64 nt, hsa; identical to SEQ ID NO: 39680

SEQ ID NO: 329219 - RNA, 64 nt, hsa; identical to SEQ ID NO: 39681

SEQ ID NO: 329220 - RNA, 64 nt, hsa; identical to SEQ ID NO: 39682

SEQ ID NO: 329221 - RNA, 64 nt, hsa; identical to SEQ ID NO: 39683

SEQ ID NO: 329222 - RNA, 64 nt, hsa; identical to SEQ ID NO: 39684

SEQ ID NO: 329223 - RNA, 64 nt, hsa; identical to SEQ ID NO: 39685

SEQ ID NO: 329224 - RNA, 64 nt, hsa; identical to SEQ ID NO: 39686

SEQ ID NO: 329225 - RNA, 64 nt, hsa; identical to SEQ ID NO: 39687

SEQ ID NO: 329226 - RNA, 64 nt, hsa; identical to SEQ ID NO: 39688

SEQ ID NO: 329227 - RNA, 64 nt, hsa; identical to SEQ ID NO: 39689

SEQ ID NO: 329228 - RNA, 64 nt, hsa; identical to SEQ ID NO: 39690

SEQ ID NO: 329229 - RNA, 64 nt, hsa; identical to SEQ ID NO: 39691

SEQ ID NO: 329230 - RNA, 64 nt, hsa; identical to SEQ ID NO: 39692

SEQ ID NO: 329231 - RNA, 64 nt, hsa; identical to SEQ ID NO: 39693

SEQ ID NO: 329232 - RNA, 64 nt, hsa; identical to SEQ ID NO: 39694

SEQ ID NO: 329233 - RNA, 64 nt, hsa; identical to SEQ ID NO: 39695

SEQ ID NO: 329234 - RNA, 64 nt, hsa; identical to SEQ ID NO: 39696

SEQ ID NO: 329235 - RNA, 64 nt, hsa; identical to SEQ ID NO: 39697

SEQ ID NO: 329236 - RNA, 64 nt, hsa; identical to SEQ ID NO: 39698

SEQ ID NO: 329237 - RNA, 64 nt, hsa; identical to SEQ ID NO: 39699

SEQ ID NO: 329238 - RNA, 64 nt, hsa; identical to SEQ ID NO: 39700

SEQ ID NO: 329239 - RNA, 64 nt, hsa; identical to SEQ ID NO: 39701

SEQ ID NO: 329240 - RNA, 64 nt, hsa; identical to SEQ ID NO: 39702

SEQ ID NO: 329241 - RNA, 64 nt, hsa; identical to SEQ ID NO: 39703

SEQ ID NO: 329242 - RNA, 64 nt, hsa; identical to SEQ ID NO: 39704

SEQ ID NO: 329243 - RNA, 64 nt, hsa; identical to SEQ ID NO: 39705

SEQ ID NO: 329244 - RNA, 64 nt, hsa; identical to SEQ ID NO: 39706

SEQ ID NO: 329245 - RNA, 64 nt, hsa; identical to SEQ ID NO: 39707

SEQ ID NO: 329246 - RNA, 64 nt, hsa; identical to SEQ ID NO: 39708

SEQ ID NO: 329247 - RNA, 64 nt, hsa; identical to SEQ ID NO: 39709

SEQ ID NO: 329248 - RNA, 64 nt, hsa; identical to SEQ ID NO: 39710

SEQ ID NO: 329249 - RNA, 64 nt, hsa; identical to SEQ ID NO: 39711

SEQ ID NO: 329250 - RNA, 64 nt, hsa; identical to SEQ ID NO: 39712

SEQ ID NO: 329251 - RNA, 64 nt, hsa; identical to SEQ ID NO: 39713

SEQ ID NO: 329252 - RNA, 64 nt, hsa; identical to SEQ ID NO: 39714

SEQ ID NO: 329253 - RNA, 64 nt, hsa; identical to SEQ ID NO: 39715

SEQ ID NO: 329254 - RNA, 64 nt, hsa; identical to SEQ ID NO: 39716

SEQ ID NO: 329255 - RNA, 64 nt, hsa; identical to SEQ ID NO: 39717

SEQ ID NO: 329256 - RNA, 64 nt, hsa; identical to SEQ ID NO: 39718

SEQ ID NO: 329257 - RNA, 64 nt, hsa; identical to SEQ ID NO: 39719

SEQ ID NO: 329258 - RNA, 64 nt, hsa; identical to SEQ ID NO: 39720

SEQ ID NO: 329259 - RNA, 64 nt, hsa; identical to SEQ ID NO: 39721

SEQ ID NO: 329260 - RNA, 64 nt, hsa; identical to SEQ ID NO: 39722

SEQ ID NO: 329261 - RNA, 64 nt, hsa; identical to SEQ ID NO: 39723

SEQ ID NO: 329262 - RNA, 64 nt, hsa; identical to SEQ ID NO: 39724

SEQ ID NO: 329263 - RNA, 64 nt, hsa; identical to SEQ ID NO: 39725

SEQ ID NO: 329264 - RNA, 64 nt, hsa; identical to SEQ ID NO: 39726

SEQ ID NO: 329265 - RNA, 64 nt, hsa; identical to SEQ ID NO: 39727

SEQ ID NO: 329266 - RNA, 64 nt, hsa; identical to SEQ ID NO: 39728

SEQ ID NO: 329267 - RNA, 64 nt, hsa; identical to SEQ ID NO: 39729

SEQ ID NO: 329268 - RNA, 64 nt, hsa; identical to SEQ ID NO: 39730

SEQ ID NO: 329269 - RNA, 64 nt, hsa; identical to SEQ ID NO: 39731

SEQ ID NO: 329270 - RNA, 64 nt, hsa; identical to SEQ ID NO: 39732

SEQ ID NO: 329271 - RNA, 64 nt, hsa; identical to SEQ ID NO: 39733

SEQ ID NO: 329272 - RNA, 64 nt, hsa; identical to SEQ ID NO: 39734

SEQ ID NO: 329273 - RNA, 64 nt, hsa; identical to SEQ ID NO: 39735

SEQ ID NO: 329274 - RNA, 64 nt, hsa; identical to SEQ ID NO: 39736

SEQ ID NO: 329275 - RNA, 64 nt, hsa; identical to SEQ ID NO: 39737

SEQ ID NO: 329276 - RNA, 64 nt, hsa; identical to SEQ ID NO: 39738

SEQ ID NO: 329277 - RNA, 64 nt, hsa; identical to SEQ ID NO: 39739

SEQ ID NO: 329278 - RNA, 64 nt, hsa; identical to SEQ ID NO: 39740

SEQ ID NO: 329279 - RNA, 64 nt, hsa; identical to SEQ ID NO: 39741

SEQ ID NO: 329280 - RNA, 64 nt, hsa; identical to SEQ ID NO: 39742

SEQ ID NO: 329281 - RNA, 64 nt, hsa; identical to SEQ ID NO: 39743

SEQ ID NO: 329282 - RNA, 64 nt, hsa; identical to SEQ ID NO: 39744

SEQ ID NO: 329283 - RNA, 64 nt, hsa; identical to SEQ ID NO: 39745

SEQ ID NO: 329284 - RNA, 64 nt, hsa; identical to SEQ ID NO: 39746

SEQ ID NO: 329285 - RNA, 64 nt, hsa; identical to SEQ ID NO: 39747

SEQ ID NO: 329286 - RNA, 64 nt, hsa; identical to SEQ ID NO: 39748

SEQ ID NO: 329287 - RNA, 64 nt, hsa; identical to SEQ ID NO: 39749

SEQ ID NO: 329288 - RNA, 64 nt, hsa; identical to SEQ ID NO: 39750

SEQ ID NO: 329289 - RNA, 64 nt, hsa; identical to SEQ ID NO: 39751

SEQ ID NO: 329290 - RNA, 64 nt, hsa; identical to SEQ ID NO: 39752

SEQ ID NO: 329291 - RNA, 64 nt, hsa; identical to SEQ ID NO: 39753

SEQ ID NO: 329292 - RNA, 64 nt, hsa; identical to SEQ ID NO: 39754

SEQ ID NO: 329293 - RNA, 64 nt, hsa; identical to SEQ ID NO: 39755

SEQ ID NO: 329294 - RNA, 64 nt, hsa; identical to SEQ ID NO: 39756

SEQ ID NO: 329295 - RNA, 64 nt, hsa; identical to SEQ ID NO: 39757

SEQ ID NO: 329296 - RNA, 64 nt, hsa; identical to SEQ ID NO: 39758

SEQ ID NO: 329297 - RNA, 64 nt, hsa; identical to SEQ ID NO: 39759

SEQ ID NO: 329298 - RNA, 64 nt, hsa; identical to SEQ ID NO: 39760

SEQ ID NO: 329299 - RNA, 64 nt, hsa; identical to SEQ ID NO: 39761

SEQ ID NO: 329300 - RNA, 64 nt, hsa; identical to SEQ ID NO: 39762

SEQ ID NO: 329301 - RNA, 64 nt, hsa; identical to SEQ ID NO: 39763

SEQ ID NO: 329302 - RNA, 64 nt, hsa; identical to SEQ ID NO: 39764

SEQ ID NO: 329303 - RNA, 64 nt, hsa; identical to SEQ ID NO: 39765

SEQ ID NO: 329304 - RNA, 64 nt, hsa; identical to SEQ ID NO: 39766

SEQ ID NO: 329305 - RNA, 64 nt, hsa; identical to SEQ ID NO: 39767

SEQ ID NO: 329306 - RNA, 64 nt, hsa; identical to SEQ ID NO: 39768

SEQ ID NO: 329307 - RNA, 64 nt, hsa; identical to SEQ ID NO: 39769

SEQ ID NO: 329308 - RNA, 64 nt, hsa; identical to SEQ ID NO: 39770

SEQ ID NO: 329309 - RNA, 64 nt, hsa; identical to SEQ ID NO: 39771

SEQ ID NO: 329310 - RNA, 64 nt, hsa; identical to SEQ ID NO: 39772

SEQ ID NO: 329311 - RNA, 64 nt, hsa; identical to SEQ ID NO: 39773

SEQ ID NO: 329312 - RNA, 64 nt, hsa; identical to SEQ ID NO: 39774

SEQ ID NO: 329313 - RNA, 64 nt, hsa; identical to SEQ ID NO: 39775

SEQ ID NO: 329314 - RNA, 64 nt, hsa; identical to SEQ ID NO: 39776

SEQ ID NO: 329315 - RNA, 64 nt, hsa; identical to SEQ ID NO: 39777

SEQ ID NO: 329316 - RNA, 64 nt, hsa; identical to SEQ ID NO: 39778

SEQ ID NO: 329317 - RNA, 64 nt, hsa; identical to SEQ ID NO: 39779

SEQ ID NO: 329318 - RNA, 64 nt, hsa; identical to SEQ ID NO: 39780

SEQ ID NO: 329319 - RNA, 64 nt, hsa; identical to SEQ ID NO: 39781

SEQ ID NO: 329320 - RNA, 64 nt, hsa; identical to SEQ ID NO: 39782

SEQ ID NO: 329321 - RNA, 64 nt, hsa; identical to SEQ ID NO: 39783

SEQ ID NO: 329322 - RNA, 64 nt, hsa; identical to SEQ ID NO: 39784

SEQ ID NO: 329323 - RNA, 64 nt, hsa; identical to SEQ ID NO: 39785

SEQ ID NO: 329324 - RNA, 64 nt, hsa; identical to SEQ ID NO: 39786

SEQ ID NO: 329325 - RNA, 64 nt, hsa; identical to SEQ ID NO: 39787

SEQ ID NO: 329326 - RNA, 64 nt, hsa; identical to SEQ ID NO: 39788

SEQ ID NO: 329327 - RNA, 64 nt, hsa; identical to SEQ ID NO: 39789

SEQ ID NO: 329328 - RNA, 64 nt, hsa; identical to SEQ ID NO: 39790

SEQ ID NO: 329329 - RNA, 64 nt, hsa; identical to SEQ ID NO: 39791

SEQ ID NO: 329330 - RNA, 64 nt, hsa; identical to SEQ ID NO: 39792

SEQ ID NO: 329331 - RNA, 64 nt, hsa; identical to SEQ ID NO: 39793

SEQ ID NO: 329332 - RNA, 64 nt, hsa; identical to SEQ ID NO: 39794

SEQ ID NO: 329333 - RNA, 64 nt, hsa; identical to SEQ ID NO: 39795

SEQ ID NO: 329334 - RNA, 64 nt, hsa; identical to SEQ ID NO: 39796

SEQ ID NO: 329335 - RNA, 64 nt, hsa; identical to SEQ ID NO: 39797

SEQ ID NO: 329336 - RNA, 64 nt, hsa; identical to SEQ ID NO: 39798

SEQ ID NO: 329337 - RNA, 64 nt, hsa; identical to SEQ ID NO: 39799

SEQ ID NO: 329338 - RNA, 64 nt, hsa; identical to SEQ ID NO: 39800

SEQ ID NO: 329339 - RNA, 64 nt, hsa; identical to SEQ ID NO: 39801

SEQ ID NO: 329340 - RNA, 64 nt, hsa; identical to SEQ ID NO: 39802

SEQ ID NO: 329341 - RNA, 64 nt, hsa; identical to SEQ ID NO: 39803

SEQ ID NO: 329342 - RNA, 64 nt, hsa; identical to SEQ ID NO: 39804

SEQ ID NO: 329343 - RNA, 64 nt, hsa; identical to SEQ ID NO: 39805

SEQ ID NO: 329344 - RNA, 64 nt, hsa; identical to SEQ ID NO: 39806

SEQ ID NO: 329345 - RNA, 64 nt, hsa; identical to SEQ ID NO: 39807

SEQ ID NO: 329346 - RNA, 64 nt, hsa; identical to SEQ ID NO: 39808

SEQ ID NO: 329347 - RNA, 64 nt, hsa; identical to SEQ ID NO: 39809

SEQ ID NO: 329348 - RNA, 64 nt, hsa; identical to SEQ ID NO: 39810

SEQ ID NO: 329349 - RNA, 64 nt, hsa; identical to SEQ ID NO: 39811

SEQ ID NO: 329350 - RNA, 64 nt, hsa; identical to SEQ ID NO: 39812

SEQ ID NO: 329351 - RNA, 64 nt, hsa; identical to SEQ ID NO: 39813

SEQ ID NO: 329352 - RNA, 64 nt, hsa; identical to SEQ ID NO: 39814

SEQ ID NO: 329353 - RNA, 64 nt, hsa; identical to SEQ ID NO: 39815

SEQ ID NO: 329354 - RNA, 64 nt, hsa; identical to SEQ ID NO: 39816

SEQ ID NO: 329355 - RNA, 64 nt, hsa; identical to SEQ ID NO: 39817

SEQ ID NO: 329356 - RNA, 64 nt, hsa; identical to SEQ ID NO: 39818

SEQ ID NO: 329357 - RNA, 64 nt, hsa; identical to SEQ ID NO: 39819

SEQ ID NO: 329358 - RNA, 64 nt, hsa; identical to SEQ ID NO: 39820

SEQ ID NO: 329359 - RNA, 64 nt, hsa; identical to SEQ ID NO: 39821

SEQ ID NO: 329360 - RNA, 64 nt, hsa; identical to SEQ ID NO: 39822

SEQ ID NO: 329361 - RNA, 64 nt, hsa; identical to SEQ ID NO: 39823

SEQ ID NO: 329362 - RNA, 64 nt, hsa; identical to SEQ ID NO: 39824

SEQ ID NO: 329363 - RNA, 64 nt, hsa; identical to SEQ ID NO: 39825

SEQ ID NO: 329364 - RNA, 64 nt, hsa; identical to SEQ ID NO: 39826

SEQ ID NO: 329365 - RNA, 64 nt, hsa; identical to SEQ ID NO: 39827

SEQ ID NO: 329366 - RNA, 64 nt, hsa; identical to SEQ ID NO: 39828

SEQ ID NO: 329367 - RNA, 64 nt, hsa; identical to SEQ ID NO: 39829

SEQ ID NO: 329368 - RNA, 64 nt, hsa; identical to SEQ ID NO: 39830

SEQ ID NO: 329369 - RNA, 64 nt, hsa; identical to SEQ ID NO: 39831

SEQ ID NO: 329370 - RNA, 64 nt, hsa; identical to SEQ ID NO: 39832

SEQ ID NO: 329371 - RNA, 64 nt, hsa; identical to SEQ ID NO: 39833

SEQ ID NO: 329372 - RNA, 64 nt, hsa; identical to SEQ ID NO: 39834

SEQ ID NO: 329373 - RNA, 64 nt, hsa; identical to SEQ ID NO: 39835

SEQ ID NO: 329374 - RNA, 64 nt, hsa; identical to SEQ ID NO: 39836

SEQ ID NO: 329375 - RNA, 64 nt, hsa; identical to SEQ ID NO: 39837

SEQ ID NO: 329376 - RNA, 64 nt, hsa; identical to SEQ ID NO: 39838

SEQ ID NO: 329377 - RNA, 64 nt, hsa; identical to SEQ ID NO: 39839

SEQ ID NO: 329378 - RNA, 64 nt, hsa; identical to SEQ ID NO: 39840

SEQ ID NO: 329379 - RNA, 64 nt, hsa; identical to SEQ ID NO: 39841

SEQ ID NO: 329380 - RNA, 64 nt, hsa; identical to SEQ ID NO: 39842

SEQ ID NO: 329381 - RNA, 64 nt, hsa; identical to SEQ ID NO: 39843

SEQ ID NO: 329382 - RNA, 64 nt, hsa; identical to SEQ ID NO: 39844

SEQ ID NO: 329383 - RNA, 64 nt, hsa; identical to SEQ ID NO: 39845

SEQ ID NO: 329384 - RNA, 64 nt, hsa; identical to SEQ ID NO: 39846

SEQ ID NO: 329385 - RNA, 64 nt, hsa; identical to SEQ ID NO: 39847

SEQ ID NO: 329386 - RNA, 64 nt, hsa; identical to SEQ ID NO: 39848

SEQ ID NO: 329387 - RNA, 64 nt, hsa; identical to SEQ ID NO: 39849

SEQ ID NO: 329388 - RNA, 64 nt, hsa; identical to SEQ ID NO: 39850

SEQ ID NO: 329389 - RNA, 64 nt, hsa; identical to SEQ ID NO: 39851

SEQ ID NO: 329390 - RNA, 64 nt, hsa; identical to SEQ ID NO: 39852

SEQ ID NO: 329391 - RNA, 64 nt, hsa; identical to SEQ ID NO: 39853

SEQ ID NO: 329392 - RNA, 64 nt, hsa; identical to SEQ ID NO: 39854

SEQ ID NO: 329393 - RNA, 64 nt, hsa; identical to SEQ ID NO: 39855

SEQ ID NO: 329394 - RNA, 64 nt, hsa; identical to SEQ ID NO: 39856

SEQ ID NO: 329395 - RNA, 64 nt, hsa; identical to SEQ ID NO: 39857

SEQ ID NO: 329396 - RNA, 64 nt, hsa; identical to SEQ ID NO: 39858

SEQ ID NO: 329397 - RNA, 64 nt, hsa; identical to SEQ ID NO: 39859

SEQ ID NO: 329398 - RNA, 64 nt, hsa; identical to SEQ ID NO: 39860

SEQ ID NO: 329399 - RNA, 64 nt, hsa; identical to SEQ ID NO: 39861

SEQ ID NO: 329400 - RNA, 64 nt, hsa; identical to SEQ ID NO: 39862

SEQ ID NO: 329401 - RNA, 64 nt, hsa; identical to SEQ ID NO: 39863

SEQ ID NO: 329402 - RNA, 64 nt, hsa; identical to SEQ ID NO: 39864

SEQ ID NO: 329403 - RNA, 64 nt, hsa; identical to SEQ ID NO: 39865

SEQ ID NO: 329404 - RNA, 64 nt, hsa; identical to SEQ ID NO: 39866

SEQ ID NO: 329405 - RNA, 64 nt, hsa; identical to SEQ ID NO: 39867

SEQ ID NO: 329406 - RNA, 64 nt, hsa; identical to SEQ ID NO: 39868

SEQ ID NO: 329407 - RNA, 64 nt, hsa; identical to SEQ ID NO: 39869

SEQ ID NO: 329408 - RNA, 64 nt, hsa; identical to SEQ ID NO: 39870

SEQ ID NO: 329409 - RNA, 64 nt, hsa; identical to SEQ ID NO: 39871

SEQ ID NO: 329410 - RNA, 64 nt, hsa; identical to SEQ ID NO: 39872

SEQ ID NO: 329411 - RNA, 64 nt, hsa; identical to SEQ ID NO: 39873

SEQ ID NO: 329412 - RNA, 64 nt, hsa; identical to SEQ ID NO: 39874

SEQ ID NO: 329413 - RNA, 64 nt, hsa; identical to SEQ ID NO: 39875

SEQ ID NO: 329414 - RNA, 64 nt, hsa; identical to SEQ ID NO: 39876

SEQ ID NO: 329415 - RNA, 64 nt, hsa; identical to SEQ ID NO: 39877

SEQ ID NO: 329416 - RNA, 64 nt, hsa; identical to SEQ ID NO: 39878

SEQ ID NO: 329417 - RNA, 64 nt, hsa; identical to SEQ ID NO: 39879

SEQ ID NO: 329418 - RNA, 64 nt, hsa; identical to SEQ ID NO: 39880

SEQ ID NO: 329419 - RNA, 64 nt, hsa; identical to SEQ ID NO: 39881

SEQ ID NO: 329420 - RNA, 64 nt, hsa; identical to SEQ ID NO: 39882

SEQ ID NO: 329421 - RNA, 64 nt, hsa; identical to SEQ ID NO: 39883

SEQ ID NO: 329422 - RNA, 64 nt, hsa; identical to SEQ ID NO: 39884

SEQ ID NO: 329423 - RNA, 64 nt, hsa; identical to SEQ ID NO: 39885

SEQ ID NO: 329424 - RNA, 64 nt, hsa; identical to SEQ ID NO: 39886

SEQ ID NO: 329425 - RNA, 64 nt, hsa; identical to SEQ ID NO: 39887

SEQ ID NO: 329426 - RNA, 64 nt, hsa; identical to SEQ ID NO: 39888

SEQ ID NO: 329427 - RNA, 64 nt, hsa; identical to SEQ ID NO: 39889

SEQ ID NO: 329428 - RNA, 64 nt, hsa; identical to SEQ ID NO: 39890

SEQ ID NO: 329429 - RNA, 64 nt, hsa; identical to SEQ ID NO: 39891

SEQ ID NO: 329430 - RNA, 64 nt, hsa; identical to SEQ ID NO: 39892

SEQ ID NO: 329431 - RNA, 64 nt, hsa; identical to SEQ ID NO: 39893

SEQ ID NO: 329432 - RNA, 64 nt, hsa; identical to SEQ ID NO: 39894

SEQ ID NO: 329433 - RNA, 64 nt, hsa; identical to SEQ ID NO: 39895

SEQ ID NO: 329434 - RNA, 64 nt, hsa; identical to SEQ ID NO: 39896

SEQ ID NO: 329435 - RNA, 64 nt, hsa; identical to SEQ ID NO: 39897

SEQ ID NO: 329436 - RNA, 64 nt, hsa; identical to SEQ ID NO: 39898

SEQ ID NO: 329437 - RNA, 64 nt, hsa; identical to SEQ ID NO: 39899

SEQ ID NO: 329438 - RNA, 64 nt, hsa; identical to SEQ ID NO: 39900

SEQ ID NO: 329439 - RNA, 64 nt, hsa; identical to SEQ ID NO: 39901

SEQ ID NO: 329440 - RNA, 64 nt, hsa; identical to SEQ ID NO: 39902

SEQ ID NO: 329441 - RNA, 64 nt, hsa; identical to SEQ ID NO: 39903

SEQ ID NO: 329442 - RNA, 64 nt, hsa; identical to SEQ ID NO: 39904

SEQ ID NO: 329443 - RNA, 64 nt, hsa; identical to SEQ ID NO: 39905

SEQ ID NO: 329444 - RNA, 64 nt, hsa; identical to SEQ ID NO: 39906

SEQ ID NO: 329445 - RNA, 64 nt, hsa; identical to SEQ ID NO: 39907

SEQ ID NO: 329446 - RNA, 64 nt, hsa; identical to SEQ ID NO: 39908

SEQ ID NO: 329447 - RNA, 64 nt, hsa; identical to SEQ ID NO: 39909

SEQ ID NO: 329448 - RNA, 64 nt, hsa; identical to SEQ ID NO: 39910

SEQ ID NO: 329449 - RNA, 64 nt, hsa; identical to SEQ ID NO: 39911

SEQ ID NO: 329450 - RNA, 64 nt, hsa; identical to SEQ ID NO: 39912

SEQ ID NO: 329451 - RNA, 64 nt, hsa; identical to SEQ ID NO: 39913

SEQ ID NO: 329452 - RNA, 64 nt, hsa; identical to SEQ ID NO: 39914

SEQ ID NO: 329453 - RNA, 64 nt, hsa; identical to SEQ ID NO: 39915

SEQ ID NO: 329454 - RNA, 64 nt, hsa; identical to SEQ ID NO: 39916

SEQ ID NO: 329455 - RNA, 64 nt, hsa; identical to SEQ ID NO: 39917

SEQ ID NO: 329456 - RNA, 64 nt, hsa; identical to SEQ ID NO: 39918

SEQ ID NO: 329457 - RNA, 64 nt, hsa; identical to SEQ ID NO: 39919

SEQ ID NO: 329458 - RNA, 64 nt, hsa; identical to SEQ ID NO: 39920

SEQ ID NO: 329459 - RNA, 64 nt, hsa; identical to SEQ ID NO: 39921

SEQ ID NO: 329460 - RNA, 64 nt, hsa; identical to SEQ ID NO: 39922

SEQ ID NO: 329461 - RNA, 64 nt, hsa; identical to SEQ ID NO: 39923

SEQ ID NO: 329462 - RNA, 64 nt, hsa; identical to SEQ ID NO: 39924

SEQ ID NO: 329463 - RNA, 64 nt, hsa; identical to SEQ ID NO: 39925

SEQ ID NO: 329464 - RNA, 64 nt, hsa; identical to SEQ ID NO: 39926

SEQ ID NO: 329465 - RNA, 64 nt, hsa; identical to SEQ ID NO: 39927

SEQ ID NO: 329466 - RNA, 64 nt, hsa; identical to SEQ ID NO: 39928

SEQ ID NO: 329467 - RNA, 64 nt, hsa; identical to SEQ ID NO: 39929

SEQ ID NO: 329468 - RNA, 64 nt, hsa; identical to SEQ ID NO: 39930

SEQ ID NO: 329469 - RNA, 64 nt, hsa; identical to SEQ ID NO: 39931

SEQ ID NO: 329470 - RNA, 64 nt, hsa; identical to SEQ ID NO: 39932

SEQ ID NO: 329471 - RNA, 64 nt, hsa; identical to SEQ ID NO: 39933

SEQ ID NO: 329472 - RNA, 64 nt, hsa; identical to SEQ ID NO: 39934

SEQ ID NO: 329473 - RNA, 64 nt, hsa; identical to SEQ ID NO: 39935

SEQ ID NO: 329474 - RNA, 64 nt, hsa; identical to SEQ ID NO: 39936

SEQ ID NO: 329475 - RNA, 64 nt, hsa; identical to SEQ ID NO: 39937

SEQ ID NO: 329476 - RNA, 64 nt, hsa; identical to SEQ ID NO: 39938

SEQ ID NO: 329477 - RNA, 64 nt, hsa; identical to SEQ ID NO: 39939

SEQ ID NO: 329478 - RNA, 64 nt, hsa; identical to SEQ ID NO: 39940

SEQ ID NO: 329479 - RNA, 64 nt, hsa; identical to SEQ ID NO: 39941

SEQ ID NO: 329480 - RNA, 64 nt, hsa; identical to SEQ ID NO: 39942

SEQ ID NO: 329481 - RNA, 64 nt, hsa; identical to SEQ ID NO: 39943

SEQ ID NO: 329482 - RNA, 64 nt, hsa; identical to SEQ ID NO: 39944

SEQ ID NO: 329483 - RNA, 64 nt, hsa; identical to SEQ ID NO: 39945

SEQ ID NO: 329484 - RNA, 64 nt, hsa; identical to SEQ ID NO: 39946

SEQ ID NO: 329485 - RNA, 64 nt, hsa; identical to SEQ ID NO: 39947

SEQ ID NO: 329486 - RNA, 64 nt, hsa; identical to SEQ ID NO: 39948

SEQ ID NO: 329487 - RNA, 64 nt, hsa; identical to SEQ ID NO: 39949

SEQ ID NO: 329488 - RNA, 64 nt, hsa; identical to SEQ ID NO: 39950

SEQ ID NO: 329489 - RNA, 64 nt, hsa; identical to SEQ ID NO: 39951

SEQ ID NO: 329490 - RNA, 64 nt, hsa; identical to SEQ ID NO: 39952

SEQ ID NO: 329491 - RNA, 64 nt, hsa; identical to SEQ ID NO: 39953

SEQ ID NO: 329492 - RNA, 64 nt, hsa; identical to SEQ ID NO: 39954

SEQ ID NO: 329493 - RNA, 64 nt, hsa; identical to SEQ ID NO: 39955

SEQ ID NO: 329494 - RNA, 64 nt, hsa; identical to SEQ ID NO: 39956

SEQ ID NO: 329495 - RNA, 64 nt, hsa; identical to SEQ ID NO: 39957

SEQ ID NO: 329496 - RNA, 64 nt, hsa; identical to SEQ ID NO: 39958

SEQ ID NO: 329497 - RNA, 64 nt, hsa; identical to SEQ ID NO: 39959

SEQ ID NO: 329498 - RNA, 64 nt, hsa; identical to SEQ ID NO: 39960

SEQ ID NO: 329499 - RNA, 64 nt, hsa; identical to SEQ ID NO: 39961

SEQ ID NO: 329500 - RNA, 64 nt, hsa; identical to SEQ ID NO: 39962

SEQ ID NO: 329501 - RNA, 64 nt, hsa; identical to SEQ ID NO: 39963

SEQ ID NO: 329502 - RNA, 64 nt, hsa; identical to SEQ ID NO: 39964

SEQ ID NO: 329503 - RNA, 64 nt, hsa; identical to SEQ ID NO: 39965

SEQ ID NO: 329504 - RNA, 64 nt, hsa; identical to SEQ ID NO: 39966

SEQ ID NO: 329505 - RNA, 64 nt, hsa; identical to SEQ ID NO: 39967

SEQ ID NO: 329506 - RNA, 64 nt, hsa; identical to SEQ ID NO: 39968

SEQ ID NO: 329507 - RNA, 64 nt, hsa; identical to SEQ ID NO: 39969

SEQ ID NO: 329508 - RNA, 64 nt, hsa; identical to SEQ ID NO: 39970

SEQ ID NO: 329509 - RNA, 64 nt, hsa; identical to SEQ ID NO: 39971

SEQ ID NO: 329510 - RNA, 64 nt, hsa; identical to SEQ ID NO: 39972

SEQ ID NO: 329511 - RNA, 64 nt, hsa; identical to SEQ ID NO: 39973

SEQ ID NO: 329512 - RNA, 64 nt, hsa; identical to SEQ ID NO: 39974

SEQ ID NO: 329513 - RNA, 64 nt, hsa; identical to SEQ ID NO: 39975

SEQ ID NO: 329514 - RNA, 64 nt, hsa; identical to SEQ ID NO: 39976

SEQ ID NO: 329515 - RNA, 64 nt, hsa; identical to SEQ ID NO: 39977

SEQ ID NO: 329516 - RNA, 64 nt, hsa; identical to SEQ ID NO: 39978

SEQ ID NO: 329517 - RNA, 64 nt, hsa; identical to SEQ ID NO: 39979

SEQ ID NO: 329518 - RNA, 64 nt, hsa; identical to SEQ ID NO: 39980

SEQ ID NO: 329519 - RNA, 64 nt, hsa; identical to SEQ ID NO: 39981

SEQ ID NO: 329520 - RNA, 64 nt, hsa; identical to SEQ ID NO: 39982

SEQ ID NO: 329521 - RNA, 64 nt, hsa; identical to SEQ ID NO: 39983

SEQ ID NO: 329522 - RNA, 64 nt, hsa; identical to SEQ ID NO: 39984

SEQ ID NO: 329523 - RNA, 64 nt, hsa; identical to SEQ ID NO: 39985

SEQ ID NO: 329524 - RNA, 64 nt, hsa; identical to SEQ ID NO: 39986

SEQ ID NO: 329525 - RNA, 64 nt, hsa; identical to SEQ ID NO: 39987

SEQ ID NO: 329526 - RNA, 64 nt, hsa; identical to SEQ ID NO: 39988

SEQ ID NO: 329527 - RNA, 64 nt, hsa; identical to SEQ ID NO: 39989

SEQ ID NO: 329528 - RNA, 64 nt, hsa; identical to SEQ ID NO: 39990

SEQ ID NO: 329529 - RNA, 64 nt, hsa; identical to SEQ ID NO: 39991

SEQ ID NO: 329530 - RNA, 64 nt, hsa; identical to SEQ ID NO: 39992

SEQ ID NO: 329531 - RNA, 64 nt, hsa; identical to SEQ ID NO: 39993

SEQ ID NO: 329532 - RNA, 64 nt, hsa; identical to SEQ ID NO: 39994

SEQ ID NO: 329533 - RNA, 64 nt, hsa; identical to SEQ ID NO: 39995

SEQ ID NO: 329534 - RNA, 64 nt, hsa; identical to SEQ ID NO: 39996

SEQ ID NO: 329535 - RNA, 64 nt, hsa; identical to SEQ ID NO: 39997

SEQ ID NO: 329536 - RNA, 64 nt, hsa; identical to SEQ ID NO: 39998

SEQ ID NO: 329537 - RNA, 64 nt, hsa; identical to SEQ ID NO: 39999

SEQ ID NO: 329538 - RNA, 64 nt, hsa; identical to SEQ ID NO: 40000

SEQ ID NO: 329539 - RNA, 64 nt, hsa; identical to SEQ ID NO: 40001

SEQ ID NO: 329540 - RNA, 64 nt, hsa; identical to SEQ ID NO: 40002

SEQ ID NO: 329541 - RNA, 64 nt, hsa; identical to SEQ ID NO: 40003

SEQ ID NO: 329542 - RNA, 64 nt, hsa; identical to SEQ ID NO: 40004

SEQ ID NO: 329543 - RNA, 64 nt, hsa; identical to SEQ ID NO: 40005

SEQ ID NO: 329544 - RNA, 64 nt, hsa; identical to SEQ ID NO: 40006

SEQ ID NO: 329545 - RNA, 64 nt, hsa; identical to SEQ ID NO: 40007

SEQ ID NO: 329546 - RNA, 64 nt, hsa; identical to SEQ ID NO: 40008

SEQ ID NO: 329547 - RNA, 64 nt, hsa; identical to SEQ ID NO: 40009

SEQ ID NO: 329548 - RNA, 64 nt, hsa; identical to SEQ ID NO: 40010

SEQ ID NO: 329549 - RNA, 64 nt, hsa; identical to SEQ ID NO: 40011

SEQ ID NO: 329550 - RNA, 64 nt, hsa; identical to SEQ ID NO: 40012

SEQ ID NO: 329551 - RNA, 64 nt, hsa; identical to SEQ ID NO: 40013

SEQ ID NO: 329552 - RNA, 64 nt, hsa; identical to SEQ ID NO: 40014

SEQ ID NO: 329553 - RNA, 64 nt, hsa; identical to SEQ ID NO: 40015

SEQ ID NO: 329554 - RNA, 64 nt, hsa; identical to SEQ ID NO: 40016

SEQ ID NO: 329555 - RNA, 64 nt, hsa; identical to SEQ ID NO: 40017

SEQ ID NO: 329556 - RNA, 64 nt, hsa; identical to SEQ ID NO: 40018

SEQ ID NO: 329557 - RNA, 64 nt, hsa; identical to SEQ ID NO: 40019

SEQ ID NO: 329558 - RNA, 64 nt, hsa; identical to SEQ ID NO: 40020

SEQ ID NO: 329559 - RNA, 64 nt, hsa; identical to SEQ ID NO: 40021

SEQ ID NO: 329560 - RNA, 64 nt, hsa; identical to SEQ ID NO: 40022

SEQ ID NO: 329561 - RNA, 64 nt, hsa; identical to SEQ ID NO: 40023

SEQ ID NO: 329562 - RNA, 64 nt, hsa; identical to SEQ ID NO: 40024

SEQ ID NO: 329563 - RNA, 64 nt, hsa; identical to SEQ ID NO: 40025

SEQ ID NO: 329564 - RNA, 64 nt, hsa; identical to SEQ ID NO: 40026

SEQ ID NO: 329565 - RNA, 64 nt, hsa; identical to SEQ ID NO: 40027

SEQ ID NO: 329566 - RNA, 64 nt, hsa; identical to SEQ ID NO: 40028

SEQ ID NO: 329567 - RNA, 64 nt, hsa; identical to SEQ ID NO: 40029

SEQ ID NO: 329568 - RNA, 64 nt, hsa; identical to SEQ ID NO: 40030

SEQ ID NO: 329569 - RNA, 64 nt, hsa; identical to SEQ ID NO: 40031

SEQ ID NO: 329570 - RNA, 64 nt, hsa; identical to SEQ ID NO: 40032

SEQ ID NO: 329571 - RNA, 64 nt, hsa; identical to SEQ ID NO: 40033

SEQ ID NO: 329572 - RNA, 64 nt, hsa; identical to SEQ ID NO: 40034

SEQ ID NO: 329573 - RNA, 64 nt, hsa; identical to SEQ ID NO: 40035

SEQ ID NO: 329574 - RNA, 64 nt, hsa; identical to SEQ ID NO: 40036

SEQ ID NO: 329575 - RNA, 64 nt, hsa; identical to SEQ ID NO: 40037

SEQ ID NO: 329576 - RNA, 64 nt, hsa; identical to SEQ ID NO: 40038

SEQ ID NO: 329577 - RNA, 64 nt, hsa; identical to SEQ ID NO: 40039

SEQ ID NO: 329578 - RNA, 64 nt, hsa; identical to SEQ ID NO: 40040

SEQ ID NO: 329579 - RNA, 64 nt, hsa; identical to SEQ ID NO: 40041

SEQ ID NO: 329580 - RNA, 64 nt, hsa; identical to SEQ ID NO: 40042

SEQ ID NO: 329581 - RNA, 64 nt, hsa; identical to SEQ ID NO: 40043

SEQ ID NO: 329582 - RNA, 64 nt, hsa; identical to SEQ ID NO: 40044

SEQ ID NO: 329583 - RNA, 64 nt, hsa; identical to SEQ ID NO: 40045

SEQ ID NO: 329584 - RNA, 64 nt, hsa; identical to SEQ ID NO: 40046

SEQ ID NO: 329585 - RNA, 64 nt, hsa; identical to SEQ ID NO: 40047

SEQ ID NO: 329586 - RNA, 64 nt, hsa; identical to SEQ ID NO: 40048

SEQ ID NO: 329587 - RNA, 64 nt, hsa; identical to SEQ ID NO: 40049

SEQ ID NO: 329588 - RNA, 64 nt, hsa; identical to SEQ ID NO: 40050

SEQ ID NO: 329589 - RNA, 64 nt, hsa; identical to SEQ ID NO: 40051

SEQ ID NO: 329590 - RNA, 64 nt, hsa; identical to SEQ ID NO: 40052

SEQ ID NO: 329591 - RNA, 64 nt, hsa; identical to SEQ ID NO: 40053

SEQ ID NO: 329592 - RNA, 64 nt, hsa; identical to SEQ ID NO: 40054

SEQ ID NO: 329593 - RNA, 64 nt, hsa; identical to SEQ ID NO: 40055

SEQ ID NO: 329594 - RNA, 64 nt, hsa; identical to SEQ ID NO: 40056

SEQ ID NO: 329595 - RNA, 64 nt, hsa; identical to SEQ ID NO: 40057

SEQ ID NO: 329596 - RNA, 64 nt, hsa; identical to SEQ ID NO: 40058

SEQ ID NO: 329597 - RNA, 64 nt, hsa; identical to SEQ ID NO: 40059

SEQ ID NO: 329598 - RNA, 64 nt, hsa; identical to SEQ ID NO: 40060

SEQ ID NO: 329599 - RNA, 64 nt, hsa; identical to SEQ ID NO: 40061

SEQ ID NO: 329600 - RNA, 64 nt, hsa; identical to SEQ ID NO: 40062

SEQ ID NO: 329601 - RNA, 64 nt, hsa; identical to SEQ ID NO: 40063

SEQ ID NO: 329602 - RNA, 64 nt, hsa; identical to SEQ ID NO: 40064

SEQ ID NO: 329603 - RNA, 64 nt, hsa; identical to SEQ ID NO: 40065

SEQ ID NO: 329604 - RNA, 64 nt, hsa; identical to SEQ ID NO: 40066

SEQ ID NO: 329605 - RNA, 64 nt, hsa; identical to SEQ ID NO: 40067

SEQ ID NO: 329606 - RNA, 64 nt, hsa; identical to SEQ ID NO: 40068

SEQ ID NO: 329607 - RNA, 64 nt, hsa; identical to SEQ ID NO: 40069

SEQ ID NO: 329608 - RNA, 64 nt, hsa; identical to SEQ ID NO: 40070

SEQ ID NO: 329609 - RNA, 64 nt, hsa; identical to SEQ ID NO: 40071

SEQ ID NO: 329610 - RNA, 64 nt, hsa; identical to SEQ ID NO: 40072

SEQ ID NO: 329611 - RNA, 64 nt, hsa; identical to SEQ ID NO: 40073

SEQ ID NO: 329612 - RNA, 64 nt, hsa; identical to SEQ ID NO: 40074

SEQ ID NO: 329613 - RNA, 64 nt, hsa; identical to SEQ ID NO: 40075

SEQ ID NO: 329614 - RNA, 64 nt, hsa; identical to SEQ ID NO: 40076

SEQ ID NO: 329615 - RNA, 64 nt, hsa; identical to SEQ ID NO: 40077

SEQ ID NO: 329616 - RNA, 64 nt, hsa; identical to SEQ ID NO: 40078

SEQ ID NO: 329617 - RNA, 64 nt, hsa; identical to SEQ ID NO: 40079

SEQ ID NO: 329618 - RNA, 64 nt, hsa; identical to SEQ ID NO: 40080

SEQ ID NO: 329619 - RNA, 64 nt, hsa; identical to SEQ ID NO: 40081

SEQ ID NO: 329620 - RNA, 64 nt, hsa; identical to SEQ ID NO: 40082

SEQ ID NO: 329621 - RNA, 64 nt, hsa; identical to SEQ ID NO: 40083

SEQ ID NO: 329622 - RNA, 64 nt, hsa; identical to SEQ ID NO: 40084

SEQ ID NO: 329623 - RNA, 64 nt, hsa; identical to SEQ ID NO: 40085

SEQ ID NO: 329624 - RNA, 64 nt, hsa; identical to SEQ ID NO: 40086

SEQ ID NO: 329625 - RNA, 64 nt, hsa; identical to SEQ ID NO: 40087

SEQ ID NO: 329626 - RNA, 64 nt, hsa; identical to SEQ ID NO: 40088

SEQ ID NO: 329627 - RNA, 64 nt, hsa; identical to SEQ ID NO: 40089

SEQ ID NO: 329628 - RNA, 64 nt, hsa; identical to SEQ ID NO: 40090

SEQ ID NO: 329629 - RNA, 64 nt, hsa; identical to SEQ ID NO: 40091

SEQ ID NO: 329630 - RNA, 64 nt, hsa; identical to SEQ ID NO: 40092

SEQ ID NO: 329631 - RNA, 64 nt, hsa; identical to SEQ ID NO: 40093

SEQ ID NO: 329632 - RNA, 64 nt, hsa; identical to SEQ ID NO: 40094

SEQ ID NO: 329633 - RNA, 64 nt, hsa; identical to SEQ ID NO: 40095

SEQ ID NO: 329634 - RNA, 64 nt, hsa; identical to SEQ ID NO: 40096

SEQ ID NO: 329635 - RNA, 64 nt, hsa; identical to SEQ ID NO: 40097

SEQ ID NO: 329636 - RNA, 64 nt, hsa; identical to SEQ ID NO: 40098

SEQ ID NO: 329637 - RNA, 64 nt, hsa; identical to SEQ ID NO: 40099

SEQ ID NO: 329638 - RNA, 64 nt, hsa; identical to SEQ ID NO: 40100

SEQ ID NO: 329639 - RNA, 64 nt, hsa; identical to SEQ ID NO: 40101

SEQ ID NO: 329640 - RNA, 64 nt, hsa; identical to SEQ ID NO: 40102

SEQ ID NO: 329641 - RNA, 64 nt, hsa; identical to SEQ ID NO: 40103

SEQ ID NO: 329642 - RNA, 64 nt, hsa; identical to SEQ ID NO: 40104

SEQ ID NO: 329643 - RNA, 64 nt, hsa; identical to SEQ ID NO: 40105

SEQ ID NO: 329644 - RNA, 64 nt, hsa; identical to SEQ ID NO: 40106

SEQ ID NO: 329645 - RNA, 64 nt, hsa; identical to SEQ ID NO: 40107

SEQ ID NO: 329646 - RNA, 64 nt, hsa; identical to SEQ ID NO: 40108

SEQ ID NO: 329647 - RNA, 64 nt, hsa; identical to SEQ ID NO: 40109

SEQ ID NO: 329648 - RNA, 64 nt, hsa; identical to SEQ ID NO: 40110

SEQ ID NO: 329649 - RNA, 64 nt, hsa; identical to SEQ ID NO: 40111

SEQ ID NO: 329650 - RNA, 64 nt, hsa; identical to SEQ ID NO: 40112

SEQ ID NO: 329651 - RNA, 64 nt, hsa; identical to SEQ ID NO: 40113

SEQ ID NO: 329652 - RNA, 64 nt, hsa; identical to SEQ ID NO: 40114

SEQ ID NO: 329653 - RNA, 64 nt, hsa; identical to SEQ ID NO: 40115

SEQ ID NO: 329654 - RNA, 64 nt, hsa; identical to SEQ ID NO: 40116

SEQ ID NO: 329655 - RNA, 64 nt, hsa; identical to SEQ ID NO: 40117

SEQ ID NO: 329656 - RNA, 64 nt, hsa; identical to SEQ ID NO: 40118

SEQ ID NO: 329657 - RNA, 64 nt, hsa; identical to SEQ ID NO: 40119

SEQ ID NO: 329658 - RNA, 64 nt, hsa; identical to SEQ ID NO: 40120

SEQ ID NO: 329659 - RNA, 64 nt, hsa; identical to SEQ ID NO: 40121

SEQ ID NO: 329660 - RNA, 64 nt, hsa; identical to SEQ ID NO: 40122

SEQ ID NO: 329661 - RNA, 64 nt, hsa; identical to SEQ ID NO: 40123

SEQ ID NO: 329662 - RNA, 64 nt, hsa; identical to SEQ ID NO: 40124

SEQ ID NO: 329663 - RNA, 64 nt, hsa; identical to SEQ ID NO: 40125

SEQ ID NO: 329664 - RNA, 64 nt, hsa; identical to SEQ ID NO: 40126

SEQ ID NO: 329665 - RNA, 64 nt, hsa; identical to SEQ ID NO: 40127

SEQ ID NO: 329666 - RNA, 64 nt, hsa; identical to SEQ ID NO: 40128

SEQ ID NO: 329667 - RNA, 64 nt, hsa; identical to SEQ ID NO: 40129

SEQ ID NO: 329668 - RNA, 64 nt, hsa; identical to SEQ ID NO: 40130

SEQ ID NO: 329669 - RNA, 64 nt, hsa; identical to SEQ ID NO: 40131

SEQ ID NO: 329670 - RNA, 64 nt, hsa; identical to SEQ ID NO: 40132

SEQ ID NO: 329671 - RNA, 64 nt, hsa; identical to SEQ ID NO: 40133

SEQ ID NO: 329672 - RNA, 64 nt, hsa; identical to SEQ ID NO: 40134

SEQ ID NO: 329673 - RNA, 64 nt, hsa; identical to SEQ ID NO: 40135

SEQ ID NO: 329674 - RNA, 64 nt, hsa; identical to SEQ ID NO: 40136

SEQ ID NO: 329675 - RNA, 64 nt, hsa; identical to SEQ ID NO: 40137

SEQ ID NO: 329676 - RNA, 64 nt, hsa; identical to SEQ ID NO: 40138

SEQ ID NO: 329677 - RNA, 64 nt, hsa; identical to SEQ ID NO: 40139

SEQ ID NO: 329678 - RNA, 64 nt, hsa; identical to SEQ ID NO: 40140

SEQ ID NO: 329679 - RNA, 64 nt, hsa; identical to SEQ ID NO: 40141

SEQ ID NO: 329680 - RNA, 64 nt, hsa; identical to SEQ ID NO: 40142

SEQ ID NO: 329681 - RNA, 64 nt, hsa; identical to SEQ ID NO: 40143

SEQ ID NO: 329682 - RNA, 64 nt, hsa; identical to SEQ ID NO: 40144

SEQ ID NO: 329683 - RNA, 64 nt, hsa; identical to SEQ ID NO: 40145

SEQ ID NO: 329684 - RNA, 64 nt, hsa; identical to SEQ ID NO: 40146

SEQ ID NO: 329685 - RNA, 64 nt, hsa; identical to SEQ ID NO: 40147

SEQ ID NO: 329686 - RNA, 64 nt, hsa; identical to SEQ ID NO: 40148

SEQ ID NO: 329687 - RNA, 64 nt, hsa; identical to SEQ ID NO: 40149

SEQ ID NO: 329688 - RNA, 64 nt, hsa; identical to SEQ ID NO: 40150

SEQ ID NO: 329689 - RNA, 64 nt, hsa; identical to SEQ ID NO: 40151

SEQ ID NO: 329690 - RNA, 64 nt, hsa; identical to SEQ ID NO: 40152

SEQ ID NO: 329691 - RNA, 64 nt, hsa; identical to SEQ ID NO: 40153

SEQ ID NO: 329692 - RNA, 64 nt, hsa; identical to SEQ ID NO: 40154

SEQ ID NO: 329693 - RNA, 64 nt, hsa; identical to SEQ ID NO: 40155

SEQ ID NO: 329694 - RNA, 64 nt, hsa; identical to SEQ ID NO: 40156

SEQ ID NO: 329695 - RNA, 64 nt, hsa; identical to SEQ ID NO: 40157

SEQ ID NO: 329696 - RNA, 64 nt, hsa; identical to SEQ ID NO: 40158

SEQ ID NO: 329697 - RNA, 64 nt, hsa; identical to SEQ ID NO: 40159

SEQ ID NO: 329698 - RNA, 64 nt, hsa; identical to SEQ ID NO: 40160

SEQ ID NO: 329699 - RNA, 64 nt, hsa; identical to SEQ ID NO: 40161

SEQ ID NO: 329700 - RNA, 64 nt, hsa; identical to SEQ ID NO: 40162

SEQ ID NO: 329701 - RNA, 64 nt, hsa; identical to SEQ ID NO: 40163

SEQ ID NO: 329702 - RNA, 64 nt, hsa; identical to SEQ ID NO: 40164

SEQ ID NO: 329703 - RNA, 64 nt, hsa; identical to SEQ ID NO: 40165

SEQ ID NO: 329704 - RNA, 64 nt, hsa; identical to SEQ ID NO: 40166

SEQ ID NO: 329705 - RNA, 64 nt, hsa; identical to SEQ ID NO: 40167

SEQ ID NO: 329706 - RNA, 64 nt, hsa; identical to SEQ ID NO: 40168

SEQ ID NO: 329707 - RNA, 64 nt, hsa; identical to SEQ ID NO: 40169

SEQ ID NO: 329708 - RNA, 64 nt, hsa; identical to SEQ ID NO: 40170

SEQ ID NO: 329709 - RNA, 64 nt, hsa; identical to SEQ ID NO: 40171

SEQ ID NO: 329710 - RNA, 64 nt, hsa; identical to SEQ ID NO: 40172

SEQ ID NO: 329711 - RNA, 64 nt, hsa; identical to SEQ ID NO: 40173

SEQ ID NO: 329712 - RNA, 64 nt, hsa; identical to SEQ ID NO: 40174

SEQ ID NO: 329713 - RNA, 64 nt, hsa; identical to SEQ ID NO: 40175

SEQ ID NO: 329714 - RNA, 64 nt, hsa; identical to SEQ ID NO: 40176

SEQ ID NO: 329715 - RNA, 64 nt, hsa; identical to SEQ ID NO: 40177

SEQ ID NO: 329716 - RNA, 64 nt, hsa; identical to SEQ ID NO: 40178

SEQ ID NO: 329717 - RNA, 64 nt, hsa; identical to SEQ ID NO: 40179

SEQ ID NO: 329718 - RNA, 64 nt, hsa; identical to SEQ ID NO: 40180

SEQ ID NO: 329719 - RNA, 64 nt, hsa; identical to SEQ ID NO: 40181

SEQ ID NO: 329720 - RNA, 64 nt, hsa; identical to SEQ ID NO: 40182

SEQ ID NO: 329721 - RNA, 64 nt, hsa; identical to SEQ ID NO: 40183

SEQ ID NO: 329722 - RNA, 64 nt, hsa; identical to SEQ ID NO: 40184

SEQ ID NO: 329723 - RNA, 64 nt, hsa; identical to SEQ ID NO: 40185

SEQ ID NO: 329724 - RNA, 64 nt, hsa; identical to SEQ ID NO: 40186

SEQ ID NO: 329725 - RNA, 64 nt, hsa; identical to SEQ ID NO: 40187

SEQ ID NO: 329726 - RNA, 64 nt, hsa; identical to SEQ ID NO: 40188

SEQ ID NO: 329727 - RNA, 64 nt, hsa; identical to SEQ ID NO: 40189

SEQ ID NO: 329728 - RNA, 64 nt, hsa; identical to SEQ ID NO: 40190

SEQ ID NO: 329729 - RNA, 64 nt, hsa; identical to SEQ ID NO: 40191

SEQ ID NO: 329730 - RNA, 64 nt, hsa; identical to SEQ ID NO: 40192

SEQ ID NO: 329731 - RNA, 64 nt, hsa; identical to SEQ ID NO: 40193

SEQ ID NO: 329732 - RNA, 64 nt, hsa; identical to SEQ ID NO: 40194

SEQ ID NO: 329733 - RNA, 64 nt, hsa; identical to SEQ ID NO: 40195

SEQ ID NO: 329734 - RNA, 64 nt, hsa; identical to SEQ ID NO: 40196

SEQ ID NO: 329735 - RNA, 64 nt, hsa; identical to SEQ ID NO: 40197

SEQ ID NO: 329736 - RNA, 64 nt, hsa; identical to SEQ ID NO: 40198

SEQ ID NO: 329737 - RNA, 64 nt, hsa; identical to SEQ ID NO: 40199

SEQ ID NO: 329738 - RNA, 64 nt, hsa; identical to SEQ ID NO: 40200

SEQ ID NO: 329739 - RNA, 64 nt, hsa; identical to SEQ ID NO: 40201

SEQ ID NO: 329740 - RNA, 64 nt, hsa; identical to SEQ ID NO: 40202

SEQ ID NO: 329741 - RNA, 64 nt, hsa; identical to SEQ ID NO: 40203

SEQ ID NO: 329742 - RNA, 64 nt, hsa; identical to SEQ ID NO: 40204

SEQ ID NO: 329743 - RNA, 64 nt, hsa; identical to SEQ ID NO: 40205

SEQ ID NO: 329744 - RNA, 64 nt, hsa; identical to SEQ ID NO: 40206

SEQ ID NO: 329745 - RNA, 64 nt, hsa; identical to SEQ ID NO: 40207

SEQ ID NO: 329746 - RNA, 64 nt, hsa; identical to SEQ ID NO: 40208

SEQ ID NO: 329747 - RNA, 64 nt, hsa; identical to SEQ ID NO: 40209

SEQ ID NO: 329748 - RNA, 64 nt, hsa; identical to SEQ ID NO: 40210

SEQ ID NO: 329749 - RNA, 64 nt, hsa; identical to SEQ ID NO: 40211

SEQ ID NO: 329750 - RNA, 64 nt, hsa; identical to SEQ ID NO: 40212

SEQ ID NO: 329751 - RNA, 64 nt, hsa; identical to SEQ ID NO: 40213

SEQ ID NO: 329752 - RNA, 64 nt, hsa; identical to SEQ ID NO: 40214

SEQ ID NO: 329753 - RNA, 64 nt, hsa; identical to SEQ ID NO: 40215

SEQ ID NO: 329754 - RNA, 64 nt, hsa; identical to SEQ ID NO: 40216

SEQ ID NO: 329755 - RNA, 64 nt, hsa; identical to SEQ ID NO: 40217

SEQ ID NO: 329756 - RNA, 64 nt, hsa; identical to SEQ ID NO: 40218

SEQ ID NO: 329757 - RNA, 64 nt, hsa; identical to SEQ ID NO: 40219

SEQ ID NO: 329758 - RNA, 64 nt, hsa; identical to SEQ ID NO: 40220

SEQ ID NO: 329759 - RNA, 64 nt, hsa; identical to SEQ ID NO: 40221

SEQ ID NO: 329760 - RNA, 64 nt, hsa; identical to SEQ ID NO: 40222

SEQ ID NO: 329761 - RNA, 64 nt, hsa; identical to SEQ ID NO: 40223

SEQ ID NO: 329762 - RNA, 64 nt, hsa; identical to SEQ ID NO: 40224

SEQ ID NO: 329763 - RNA, 64 nt, hsa; identical to SEQ ID NO: 40225

SEQ ID NO: 329764 - RNA, 64 nt, hsa; identical to SEQ ID NO: 40226

SEQ ID NO: 329765 - RNA, 64 nt, hsa; identical to SEQ ID NO: 40227

SEQ ID NO: 329766 - RNA, 64 nt, hsa; identical to SEQ ID NO: 40228

SEQ ID NO: 329767 - RNA, 64 nt, hsa; identical to SEQ ID NO: 40229

SEQ ID NO: 329768 - RNA, 64 nt, hsa; identical to SEQ ID NO: 40230

SEQ ID NO: 329769 - RNA, 64 nt, hsa; identical to SEQ ID NO: 40231

SEQ ID NO: 329770 - RNA, 64 nt, hsa; identical to SEQ ID NO: 40232

SEQ ID NO: 329771 - RNA, 64 nt, hsa; identical to SEQ ID NO: 40233

SEQ ID NO: 329772 - RNA, 64 nt, hsa; identical to SEQ ID NO: 40234

SEQ ID NO: 329773 - RNA, 64 nt, hsa; identical to SEQ ID NO: 40235

SEQ ID NO: 329774 - RNA, 64 nt, hsa; identical to SEQ ID NO: 40236

SEQ ID NO: 329775 - RNA, 64 nt, hsa; identical to SEQ ID NO: 40237

SEQ ID NO: 329776 - RNA, 64 nt, hsa; identical to SEQ ID NO: 40238

SEQ ID NO: 329777 - RNA, 64 nt, hsa; identical to SEQ ID NO: 40239

SEQ ID NO: 329778 - RNA, 64 nt, hsa; identical to SEQ ID NO: 40240

SEQ ID NO: 329779 - RNA, 64 nt, hsa; identical to SEQ ID NO: 40241

SEQ ID NO: 329780 - RNA, 64 nt, hsa; identical to SEQ ID NO: 40242

SEQ ID NO: 329781 - RNA, 64 nt, hsa; identical to SEQ ID NO: 40243

SEQ ID NO: 329782 - RNA, 64 nt, hsa; identical to SEQ ID NO: 40244

SEQ ID NO: 329783 - RNA, 64 nt, hsa; identical to SEQ ID NO: 40245

SEQ ID NO: 329784 - RNA, 64 nt, hsa; identical to SEQ ID NO: 40246

SEQ ID NO: 329785 - RNA, 64 nt, hsa; identical to SEQ ID NO: 40247

SEQ ID NO: 329786 - RNA, 64 nt, hsa; identical to SEQ ID NO: 40248

SEQ ID NO: 329787 - RNA, 64 nt, hsa; identical to SEQ ID NO: 40249

SEQ ID NO: 329788 - RNA, 64 nt, hsa; identical to SEQ ID NO: 40250

SEQ ID NO: 329789 - RNA, 64 nt, hsa; identical to SEQ ID NO: 40251

SEQ ID NO: 329790 - RNA, 64 nt, hsa; identical to SEQ ID NO: 40252

SEQ ID NO: 329791 - RNA, 64 nt, hsa; identical to SEQ ID NO: 40253

SEQ ID NO: 329792 - RNA, 64 nt, hsa; identical to SEQ ID NO: 40254

SEQ ID NO: 329793 - RNA, 64 nt, hsa; identical to SEQ ID NO: 40255

SEQ ID NO: 329794 - RNA, 64 nt, hsa; identical to SEQ ID NO: 40256

SEQ ID NO: 329795 - RNA, 64 nt, hsa; identical to SEQ ID NO: 40257

SEQ ID NO: 329796 - RNA, 64 nt, hsa; identical to SEQ ID NO: 40258

SEQ ID NO: 329797 - RNA, 64 nt, hsa; identical to SEQ ID NO: 40259

SEQ ID NO: 329798 - RNA, 64 nt, hsa; identical to SEQ ID NO: 40260

SEQ ID NO: 329799 - RNA, 64 nt, hsa; identical to SEQ ID NO: 40261

SEQ ID NO: 329800 - RNA, 64 nt, hsa; identical to SEQ ID NO: 40262

SEQ ID NO: 329801 - RNA, 64 nt, hsa; identical to SEQ ID NO: 40263

SEQ ID NO: 329802 - RNA, 64 nt, hsa; identical to SEQ ID NO: 40264

SEQ ID NO: 329803 - RNA, 64 nt, hsa; identical to SEQ ID NO: 40265

SEQ ID NO: 329804 - RNA, 64 nt, hsa; identical to SEQ ID NO: 40266

SEQ ID NO: 329805 - RNA, 64 nt, hsa; identical to SEQ ID NO: 40267

SEQ ID NO: 329806 - RNA, 64 nt, hsa; identical to SEQ ID NO: 40268

SEQ ID NO: 329807 - RNA, 64 nt, hsa; identical to SEQ ID NO: 40269

SEQ ID NO: 329808 - RNA, 64 nt, hsa; identical to SEQ ID NO: 40270

SEQ ID NO: 329809 - RNA, 64 nt, hsa; identical to SEQ ID NO: 40271

SEQ ID NO: 329810 - RNA, 64 nt, hsa; identical to SEQ ID NO: 40272

SEQ ID NO: 329811 - RNA, 64 nt, hsa; identical to SEQ ID NO: 40273

SEQ ID NO: 329812 - RNA, 64 nt, hsa; identical to SEQ ID NO: 40274

SEQ ID NO: 329813 - RNA, 64 nt, hsa; identical to SEQ ID NO: 40275

SEQ ID NO: 329814 - RNA, 64 nt, hsa; identical to SEQ ID NO: 40276

SEQ ID NO: 329815 - RNA, 64 nt, hsa; identical to SEQ ID NO: 40277

SEQ ID NO: 329816 - RNA, 64 nt, hsa; identical to SEQ ID NO: 40278

SEQ ID NO: 329817 - RNA, 64 nt, hsa; identical to SEQ ID NO: 40279

SEQ ID NO: 329818 - RNA, 64 nt, hsa; identical to SEQ ID NO: 40280

SEQ ID NO: 329819 - RNA, 64 nt, hsa; identical to SEQ ID NO: 40281

SEQ ID NO: 329820 - RNA, 64 nt, hsa; identical to SEQ ID NO: 40282

SEQ ID NO: 329821 - RNA, 64 nt, hsa; identical to SEQ ID NO: 40283

SEQ ID NO: 329822 - RNA, 64 nt, hsa; identical to SEQ ID NO: 40284

SEQ ID NO: 329823 - RNA, 64 nt, hsa; identical to SEQ ID NO: 40285

SEQ ID NO: 329824 - RNA, 64 nt, hsa; identical to SEQ ID NO: 40286

SEQ ID NO: 329825 - RNA, 64 nt, hsa; identical to SEQ ID NO: 40287

SEQ ID NO: 329826 - RNA, 64 nt, hsa; identical to SEQ ID NO: 40288

SEQ ID NO: 329827 - RNA, 64 nt, hsa; identical to SEQ ID NO: 40289

SEQ ID NO: 329828 - RNA, 64 nt, hsa; identical to SEQ ID NO: 40290

SEQ ID NO: 329829 - RNA, 64 nt, hsa; identical to SEQ ID NO: 40291

SEQ ID NO: 329830 - RNA, 64 nt, hsa; identical to SEQ ID NO: 40292

SEQ ID NO: 329831 - RNA, 64 nt, hsa; identical to SEQ ID NO: 40293

SEQ ID NO: 329832 - RNA, 64 nt, hsa; identical to SEQ ID NO: 40294

SEQ ID NO: 329833 - RNA, 64 nt, hsa; identical to SEQ ID NO: 40295

SEQ ID NO: 329834 - RNA, 64 nt, hsa; identical to SEQ ID NO: 40296

SEQ ID NO: 329835 - RNA, 64 nt, hsa; identical to SEQ ID NO: 40297

SEQ ID NO: 329836 - RNA, 64 nt, hsa; identical to SEQ ID NO: 40298

SEQ ID NO: 329837 - RNA, 64 nt, hsa; identical to SEQ ID NO: 40299

SEQ ID NO: 329838 - RNA, 64 nt, hsa; identical to SEQ ID NO: 40300

SEQ ID NO: 329839 - RNA, 64 nt, hsa; identical to SEQ ID NO: 40301

SEQ ID NO: 329840 - RNA, 64 nt, hsa; identical to SEQ ID NO: 40302

SEQ ID NO: 329841 - RNA, 64 nt, hsa; identical to SEQ ID NO: 40303

SEQ ID NO: 329842 - RNA, 64 nt, hsa; identical to SEQ ID NO: 40304

SEQ ID NO: 329843 - RNA, 64 nt, hsa; identical to SEQ ID NO: 40305

SEQ ID NO: 329844 - RNA, 64 nt, hsa; identical to SEQ ID NO: 40306

SEQ ID NO: 329845 - RNA, 64 nt, hsa; identical to SEQ ID NO: 40307

SEQ ID NO: 329846 - RNA, 64 nt, hsa; identical to SEQ ID NO: 40308

SEQ ID NO: 329847 - RNA, 64 nt, hsa; identical to SEQ ID NO: 40309

SEQ ID NO: 329848 - RNA, 64 nt, hsa; identical to SEQ ID NO: 40310

SEQ ID NO: 329849 - RNA, 64 nt, hsa; identical to SEQ ID NO: 40311

SEQ ID NO: 329850 - RNA, 64 nt, hsa; identical to SEQ ID NO: 40312

SEQ ID NO: 329851 - RNA, 64 nt, hsa; identical to SEQ ID NO: 40313

SEQ ID NO: 329852 - RNA, 64 nt, hsa; identical to SEQ ID NO: 40314

SEQ ID NO: 329853 - RNA, 64 nt, hsa; identical to SEQ ID NO: 40315

SEQ ID NO: 329854 - RNA, 64 nt, hsa; identical to SEQ ID NO: 40316

SEQ ID NO: 329855 - RNA, 64 nt, hsa; identical to SEQ ID NO: 40317

SEQ ID NO: 329856 - RNA, 64 nt, hsa; identical to SEQ ID NO: 40318

SEQ ID NO: 329857 - RNA, 64 nt, hsa; identical to SEQ ID NO: 40319

SEQ ID NO: 329858 - RNA, 64 nt, hsa; identical to SEQ ID NO: 40320

SEQ ID NO: 329859 - RNA, 64 nt, hsa; identical to SEQ ID NO: 40321

SEQ ID NO: 329860 - RNA, 64 nt, hsa; identical to SEQ ID NO: 40322

SEQ ID NO: 329861 - RNA, 64 nt, hsa; identical to SEQ ID NO: 40323

SEQ ID NO: 329862 - RNA, 64 nt, hsa; identical to SEQ ID NO: 40324

SEQ ID NO: 329863 - RNA, 64 nt, hsa; identical to SEQ ID NO: 40325

SEQ ID NO: 329864 - RNA, 64 nt, hsa; identical to SEQ ID NO: 40326

SEQ ID NO: 329865 - RNA, 64 nt, hsa; identical to SEQ ID NO: 40327

SEQ ID NO: 329866 - RNA, 64 nt, hsa; identical to SEQ ID NO: 40328

SEQ ID NO: 329867 - RNA, 64 nt, hsa; identical to SEQ ID NO: 40329

SEQ ID NO: 329868 - RNA, 64 nt, hsa; identical to SEQ ID NO: 40330

SEQ ID NO: 329869 - RNA, 64 nt, hsa; identical to SEQ ID NO: 40331

SEQ ID NO: 329870 - RNA, 64 nt, hsa; identical to SEQ ID NO: 40332

SEQ ID NO: 329871 - RNA, 64 nt, hsa; identical to SEQ ID NO: 40333

SEQ ID NO: 329872 - RNA, 64 nt, hsa; identical to SEQ ID NO: 40334

SEQ ID NO: 329873 - RNA, 64 nt, hsa; identical to SEQ ID NO: 40335

SEQ ID NO: 329874 - RNA, 64 nt, hsa; identical to SEQ ID NO: 40336

SEQ ID NO: 329875 - RNA, 64 nt, hsa; identical to SEQ ID NO: 40337

SEQ ID NO: 329876 - RNA, 64 nt, hsa; identical to SEQ ID NO: 40338

SEQ ID NO: 329877 - RNA, 64 nt, hsa; identical to SEQ ID NO: 40339

SEQ ID NO: 329878 - RNA, 64 nt, hsa; identical to SEQ ID NO: 40340

SEQ ID NO: 329879 - RNA, 64 nt, hsa; identical to SEQ ID NO: 40341

SEQ ID NO: 329880 - RNA, 64 nt, hsa; identical to SEQ ID NO: 40342

SEQ ID NO: 329881 - RNA, 64 nt, hsa; identical to SEQ ID NO: 40343

SEQ ID NO: 329882 - RNA, 64 nt, hsa; identical to SEQ ID NO: 40344

SEQ ID NO: 329883 - RNA, 64 nt, hsa; identical to SEQ ID NO: 40345

SEQ ID NO: 329884 - RNA, 64 nt, hsa; identical to SEQ ID NO: 40346

SEQ ID NO: 329885 - RNA, 64 nt, hsa; identical to SEQ ID NO: 40347

SEQ ID NO: 329886 - RNA, 64 nt, hsa; identical to SEQ ID NO: 40348

SEQ ID NO: 329887 - RNA, 64 nt, hsa; identical to SEQ ID NO: 40349

SEQ ID NO: 329888 - RNA, 64 nt, hsa; identical to SEQ ID NO: 40350

SEQ ID NO: 329889 - RNA, 64 nt, hsa; identical to SEQ ID NO: 40351

SEQ ID NO: 329890 - RNA, 64 nt, hsa; identical to SEQ ID NO: 40352

SEQ ID NO: 329891 - RNA, 64 nt, hsa; identical to SEQ ID NO: 40353

SEQ ID NO: 329892 - RNA, 64 nt, hsa; identical to SEQ ID NO: 40354

SEQ ID NO: 329893 - RNA, 64 nt, hsa; identical to SEQ ID NO: 40355

SEQ ID NO: 329894 - RNA, 64 nt, hsa; identical to SEQ ID NO: 40356

SEQ ID NO: 329895 - RNA, 64 nt, hsa; identical to SEQ ID NO: 40357

SEQ ID NO: 329896 - RNA, 64 nt, hsa; identical to SEQ ID NO: 40358

SEQ ID NO: 329897 - RNA, 64 nt, hsa; identical to SEQ ID NO: 40359

SEQ ID NO: 329898 - RNA, 64 nt, hsa; identical to SEQ ID NO: 40360

SEQ ID NO: 329899 - RNA, 64 nt, hsa; identical to SEQ ID NO: 40361

SEQ ID NO: 329900 - RNA, 64 nt, hsa; identical to SEQ ID NO: 40362

SEQ ID NO: 329901 - RNA, 64 nt, hsa; identical to SEQ ID NO: 40363

SEQ ID NO: 329902 - RNA, 64 nt, hsa; identical to SEQ ID NO: 40364

SEQ ID NO: 329903 - RNA, 64 nt, hsa; identical to SEQ ID NO: 40365

SEQ ID NO: 329904 - RNA, 64 nt, hsa; identical to SEQ ID NO: 40366

SEQ ID NO: 329905 - RNA, 64 nt, hsa; identical to SEQ ID NO: 40367

SEQ ID NO: 329906 - RNA, 64 nt, hsa; identical to SEQ ID NO: 40368

SEQ ID NO: 329907 - RNA, 64 nt, hsa; identical to SEQ ID NO: 40369

SEQ ID NO: 329908 - RNA, 64 nt, hsa; identical to SEQ ID NO: 40370

SEQ ID NO: 329909 - RNA, 64 nt, hsa; identical to SEQ ID NO: 40371

SEQ ID NO: 329910 - RNA, 64 nt, hsa; identical to SEQ ID NO: 40372

SEQ ID NO: 329911 - RNA, 64 nt, hsa; identical to SEQ ID NO: 40373

SEQ ID NO: 329912 - RNA, 64 nt, hsa; identical to SEQ ID NO: 40374

SEQ ID NO: 329913 - RNA, 64 nt, hsa; identical to SEQ ID NO: 40375

SEQ ID NO: 329914 - RNA, 64 nt, hsa; identical to SEQ ID NO: 40376

SEQ ID NO: 329915 - RNA, 64 nt, hsa; identical to SEQ ID NO: 40377

SEQ ID NO: 329916 - RNA, 64 nt, hsa; identical to SEQ ID NO: 40378

SEQ ID NO: 329917 - RNA, 64 nt, hsa; identical to SEQ ID NO: 40379

SEQ ID NO: 329918 - RNA, 64 nt, hsa; identical to SEQ ID NO: 40380

SEQ ID NO: 329919 - RNA, 64 nt, hsa; identical to SEQ ID NO: 40381

SEQ ID NO: 329920 - RNA, 64 nt, hsa; identical to SEQ ID NO: 40382

SEQ ID NO: 329921 - RNA, 64 nt, hsa; identical to SEQ ID NO: 40383

SEQ ID NO: 329922 - RNA, 64 nt, hsa; identical to SEQ ID NO: 40384

SEQ ID NO: 329923 - RNA, 64 nt, hsa; identical to SEQ ID NO: 40385

SEQ ID NO: 329924 - RNA, 64 nt, hsa; identical to SEQ ID NO: 40386

SEQ ID NO: 329925 - RNA, 64 nt, hsa; identical to SEQ ID NO: 40387

SEQ ID NO: 329926 - RNA, 64 nt, hsa; identical to SEQ ID NO: 40388

SEQ ID NO: 329927 - RNA, 64 nt, hsa; identical to SEQ ID NO: 40389

SEQ ID NO: 329928 - RNA, 64 nt, hsa; identical to SEQ ID NO: 40390

SEQ ID NO: 329929 - RNA, 64 nt, hsa; identical to SEQ ID NO: 40391

SEQ ID NO: 329930 - RNA, 64 nt, hsa; identical to SEQ ID NO: 40392

SEQ ID NO: 329931 - RNA, 64 nt, hsa; identical to SEQ ID NO: 40393

SEQ ID NO: 329932 - RNA, 64 nt, hsa; identical to SEQ ID NO: 40394

SEQ ID NO: 329933 - RNA, 64 nt, hsa; identical to SEQ ID NO: 40395

SEQ ID NO: 329934 - RNA, 64 nt, hsa; identical to SEQ ID NO: 40396

SEQ ID NO: 329935 - RNA, 64 nt, hsa; identical to SEQ ID NO: 40397

SEQ ID NO: 329936 - RNA, 64 nt, hsa; identical to SEQ ID NO: 40398

SEQ ID NO: 329937 - RNA, 64 nt, hsa; identical to SEQ ID NO: 40399

SEQ ID NO: 329938 - RNA, 64 nt, hsa; identical to SEQ ID NO: 40400

SEQ ID NO: 329939 - RNA, 64 nt, hsa; identical to SEQ ID NO: 40401

SEQ ID NO: 329940 - RNA, 64 nt, hsa; identical to SEQ ID NO: 40402

SEQ ID NO: 329941 - RNA, 64 nt, hsa; identical to SEQ ID NO: 40403

SEQ ID NO: 329942 - RNA, 64 nt, hsa; identical to SEQ ID NO: 40404

SEQ ID NO: 329943 - RNA, 64 nt, hsa; identical to SEQ ID NO: 40405

SEQ ID NO: 329944 - RNA, 64 nt, hsa; identical to SEQ ID NO: 40406

SEQ ID NO: 329945 - RNA, 64 nt, hsa; identical to SEQ ID NO: 40407

SEQ ID NO: 329946 - RNA, 64 nt, hsa; identical to SEQ ID NO: 40408

SEQ ID NO: 329947 - RNA, 64 nt, hsa; identical to SEQ ID NO: 40409

SEQ ID NO: 329948 - RNA, 64 nt, hsa; identical to SEQ ID NO: 40410

SEQ ID NO: 329949 - RNA, 64 nt, hsa; identical to SEQ ID NO: 40411

SEQ ID NO: 329950 - RNA, 64 nt, hsa; identical to SEQ ID NO: 40412

SEQ ID NO: 329951 - RNA, 64 nt, hsa; identical to SEQ ID NO: 40413

SEQ ID NO: 329952 - RNA, 64 nt, hsa; identical to SEQ ID NO: 40414

SEQ ID NO: 329953 - RNA, 64 nt, hsa; identical to SEQ ID NO: 40415

SEQ ID NO: 329954 - RNA, 64 nt, hsa; identical to SEQ ID NO: 40416

SEQ ID NO: 329955 - RNA, 64 nt, hsa; identical to SEQ ID NO: 40417

SEQ ID NO: 329956 - RNA, 64 nt, hsa; identical to SEQ ID NO: 40418

SEQ ID NO: 329957 - RNA, 64 nt, hsa; identical to SEQ ID NO: 40419

SEQ ID NO: 329958 - RNA, 64 nt, hsa; identical to SEQ ID NO: 40420

SEQ ID NO: 329959 - RNA, 64 nt, hsa; identical to SEQ ID NO: 40421

SEQ ID NO: 329960 - RNA, 64 nt, hsa; identical to SEQ ID NO: 40422

SEQ ID NO: 329961 - RNA, 64 nt, hsa; identical to SEQ ID NO: 40423

SEQ ID NO: 329962 - RNA, 64 nt, hsa; identical to SEQ ID NO: 40424

SEQ ID NO: 329963 - RNA, 64 nt, hsa; identical to SEQ ID NO: 40425

SEQ ID NO: 329964 - RNA, 64 nt, hsa; identical to SEQ ID NO: 40426

SEQ ID NO: 329965 - RNA, 64 nt, hsa; identical to SEQ ID NO: 40427

SEQ ID NO: 329966 - RNA, 64 nt, hsa; identical to SEQ ID NO: 40428

SEQ ID NO: 329967 - RNA, 64 nt, hsa; identical to SEQ ID NO: 40429

SEQ ID NO: 329968 - RNA, 64 nt, hsa; identical to SEQ ID NO: 40430

SEQ ID NO: 329969 - RNA, 64 nt, hsa; identical to SEQ ID NO: 40431

SEQ ID NO: 329970 - RNA, 64 nt, hsa; identical to SEQ ID NO: 40432

SEQ ID NO: 329971 - RNA, 64 nt, hsa; identical to SEQ ID NO: 40433

SEQ ID NO: 329972 - RNA, 64 nt, hsa; identical to SEQ ID NO: 40434

SEQ ID NO: 329973 - RNA, 64 nt, hsa; identical to SEQ ID NO: 40435

SEQ ID NO: 329974 - RNA, 64 nt, hsa; identical to SEQ ID NO: 40436

SEQ ID NO: 329975 - RNA, 64 nt, hsa; identical to SEQ ID NO: 40437

SEQ ID NO: 329976 - RNA, 64 nt, hsa; identical to SEQ ID NO: 40438

SEQ ID NO: 329977 - RNA, 64 nt, hsa; identical to SEQ ID NO: 40439

SEQ ID NO: 329978 - RNA, 64 nt, hsa; identical to SEQ ID NO: 40440

SEQ ID NO: 329979 - RNA, 64 nt, hsa; identical to SEQ ID NO: 40441

SEQ ID NO: 329980 - RNA, 64 nt, hsa; identical to SEQ ID NO: 40442

SEQ ID NO: 329981 - RNA, 64 nt, hsa; identical to SEQ ID NO: 40443

SEQ ID NO: 329982 - RNA, 64 nt, hsa; identical to SEQ ID NO: 40444

SEQ ID NO: 329983 - RNA, 64 nt, hsa; identical to SEQ ID NO: 40445

SEQ ID NO: 329984 - RNA, 64 nt, hsa; identical to SEQ ID NO: 40446

SEQ ID NO: 329985 - RNA, 64 nt, hsa; identical to SEQ ID NO: 40447

SEQ ID NO: 329986 - RNA, 64 nt, hsa; identical to SEQ ID NO: 40448

SEQ ID NO: 329987 - RNA, 64 nt, hsa; identical to SEQ ID NO: 40449

SEQ ID NO: 329988 - RNA, 64 nt, hsa; identical to SEQ ID NO: 40450

SEQ ID NO: 329989 - RNA, 64 nt, hsa; identical to SEQ ID NO: 40451

SEQ ID NO: 329990 - RNA, 64 nt, hsa; identical to SEQ ID NO: 40452

SEQ ID NO: 329991 - RNA, 64 nt, hsa; identical to SEQ ID NO: 40453

SEQ ID NO: 329992 - RNA, 64 nt, hsa; identical to SEQ ID NO: 40454

SEQ ID NO: 329993 - RNA, 64 nt, hsa; identical to SEQ ID NO: 40455

SEQ ID NO: 329994 - RNA, 64 nt, hsa; identical to SEQ ID NO: 40456

SEQ ID NO: 329995 - RNA, 64 nt, hsa; identical to SEQ ID NO: 40457

SEQ ID NO: 329996 - RNA, 64 nt, hsa; identical to SEQ ID NO: 40458

SEQ ID NO: 329997 - RNA, 64 nt, hsa; identical to SEQ ID NO: 40459

SEQ ID NO: 329998 - RNA, 64 nt, hsa; identical to SEQ ID NO: 40460

SEQ ID NO: 329999 - RNA, 64 nt, hsa; identical to SEQ ID NO: 40461

SEQ ID NO: 330000 - RNA, 64 nt, hsa; identical to SEQ ID NO: 40462

SEQ ID NO: 330001 - RNA, 64 nt, hsa; identical to SEQ ID NO: 40463

SEQ ID NO: 330002 - RNA, 64 nt, hsa; identical to SEQ ID NO: 40464

SEQ ID NO: 330003 - RNA, 64 nt, hsa; identical to SEQ ID NO: 40465

SEQ ID NO: 330004 - RNA, 64 nt, hsa; identical to SEQ ID NO: 40466

SEQ ID NO: 330005 - RNA, 64 nt, hsa; identical to SEQ ID NO: 40467

SEQ ID NO: 330006 - RNA, 64 nt, hsa; identical to SEQ ID NO: 40468

SEQ ID NO: 330007 - RNA, 64 nt, hsa; identical to SEQ ID NO: 40469

SEQ ID NO: 330008 - RNA, 64 nt, hsa; identical to SEQ ID NO: 40470

SEQ ID NO: 330009 - RNA, 64 nt, hsa; identical to SEQ ID NO: 40471

SEQ ID NO: 330010 - RNA, 64 nt, hsa; identical to SEQ ID NO: 40472

SEQ ID NO: 330011 - RNA, 64 nt, hsa; identical to SEQ ID NO: 40473

SEQ ID NO: 330012 - RNA, 64 nt, hsa; identical to SEQ ID NO: 40474

SEQ ID NO: 330013 - RNA, 64 nt, hsa; identical to SEQ ID NO: 40475

SEQ ID NO: 330014 - RNA, 64 nt, hsa; identical to SEQ ID NO: 40476

SEQ ID NO: 330015 - RNA, 64 nt, hsa; identical to SEQ ID NO: 40477

SEQ ID NO: 330016 - RNA, 64 nt, hsa; identical to SEQ ID NO: 40478

SEQ ID NO: 330017 - RNA, 64 nt, hsa; identical to SEQ ID NO: 40479

SEQ ID NO: 330018 - RNA, 64 nt, hsa; identical to SEQ ID NO: 40480

SEQ ID NO: 330019 - RNA, 64 nt, hsa; identical to SEQ ID NO: 40481

SEQ ID NO: 330020 - RNA, 64 nt, hsa; identical to SEQ ID NO: 40482

SEQ ID NO: 330021 - RNA, 64 nt, hsa; identical to SEQ ID NO: 40483

SEQ ID NO: 330022 - RNA, 64 nt, hsa; identical to SEQ ID NO: 40484

SEQ ID NO: 330023 - RNA, 64 nt, hsa; identical to SEQ ID NO: 40485

SEQ ID NO: 330024 - RNA, 64 nt, hsa; identical to SEQ ID NO: 40486

SEQ ID NO: 330025 - RNA, 64 nt, hsa; identical to SEQ ID NO: 40487

SEQ ID NO: 330026 - RNA, 64 nt, hsa; identical to SEQ ID NO: 40488

SEQ ID NO: 330027 - RNA, 64 nt, hsa; identical to SEQ ID NO: 40489

SEQ ID NO: 330028 - RNA, 64 nt, hsa; identical to SEQ ID NO: 40490

SEQ ID NO: 330029 - RNA, 64 nt, hsa; identical to SEQ ID NO: 40491

SEQ ID NO: 330030 - RNA, 64 nt, hsa; identical to SEQ ID NO: 40492

SEQ ID NO: 330031 - RNA, 64 nt, hsa; identical to SEQ ID NO: 40493

SEQ ID NO: 330032 - RNA, 64 nt, hsa; identical to SEQ ID NO: 40494

SEQ ID NO: 330033 - RNA, 64 nt, hsa; identical to SEQ ID NO: 40495

SEQ ID NO: 330034 - RNA, 64 nt, hsa; identical to SEQ ID NO: 40496

SEQ ID NO: 330035 - RNA, 64 nt, hsa; identical to SEQ ID NO: 40497

SEQ ID NO: 330036 - RNA, 64 nt, hsa; identical to SEQ ID NO: 40498

SEQ ID NO: 330037 - RNA, 64 nt, hsa; identical to SEQ ID NO: 40499

SEQ ID NO: 330038 - RNA, 64 nt, hsa; identical to SEQ ID NO: 40500

SEQ ID NO: 330039 - RNA, 64 nt, hsa; identical to SEQ ID NO: 40501

SEQ ID NO: 330040 - RNA, 64 nt, hsa; identical to SEQ ID NO: 40502

SEQ ID NO: 330041 - RNA, 64 nt, hsa; identical to SEQ ID NO: 40503

SEQ ID NO: 330042 - RNA, 64 nt, hsa; identical to SEQ ID NO: 40504

SEQ ID NO: 330043 - RNA, 64 nt, hsa; identical to SEQ ID NO: 40505

SEQ ID NO: 330044 - RNA, 64 nt, hsa; identical to SEQ ID NO: 40506

SEQ ID NO: 330045 - RNA, 64 nt, hsa; identical to SEQ ID NO: 40507

SEQ ID NO: 330046 - RNA, 64 nt, hsa; identical to SEQ ID NO: 40508

SEQ ID NO: 330047 - RNA, 64 nt, hsa; identical to SEQ ID NO: 40509

SEQ ID NO: 330048 - RNA, 64 nt, hsa; identical to SEQ ID NO: 40510

SEQ ID NO: 330049 - RNA, 64 nt, hsa; identical to SEQ ID NO: 40511

SEQ ID NO: 330050 - RNA, 64 nt, hsa; identical to SEQ ID NO: 40512

SEQ ID NO: 330051 - RNA, 64 nt, hsa; identical to SEQ ID NO: 40513

SEQ ID NO: 330052 - RNA, 64 nt, hsa; identical to SEQ ID NO: 40514

SEQ ID NO: 330053 - RNA, 64 nt, hsa; identical to SEQ ID NO: 40515

SEQ ID NO: 330054 - RNA, 64 nt, hsa; identical to SEQ ID NO: 40516

SEQ ID NO: 330055 - RNA, 64 nt, hsa; identical to SEQ ID NO: 40517

SEQ ID NO: 330056 - RNA, 64 nt, hsa; identical to SEQ ID NO: 40518

SEQ ID NO: 330057 - RNA, 64 nt, hsa; identical to SEQ ID NO: 40519

SEQ ID NO: 330058 - RNA, 64 nt, hsa; identical to SEQ ID NO: 40520

SEQ ID NO: 330059 - RNA, 64 nt, hsa; identical to SEQ ID NO: 40521

SEQ ID NO: 330060 - RNA, 64 nt, hsa; identical to SEQ ID NO: 40522

SEQ ID NO: 330061 - RNA, 64 nt, hsa; identical to SEQ ID NO: 40523

SEQ ID NO: 330062 - RNA, 64 nt, hsa; identical to SEQ ID NO: 40524

SEQ ID NO: 330063 - RNA, 64 nt, hsa; identical to SEQ ID NO: 40525

SEQ ID NO: 330064 - RNA, 64 nt, hsa; identical to SEQ ID NO: 40526

SEQ ID NO: 330065 - RNA, 64 nt, hsa; identical to SEQ ID NO: 40527

SEQ ID NO: 330066 - RNA, 64 nt, hsa; identical to SEQ ID NO: 40528

SEQ ID NO: 330067 - RNA, 64 nt, hsa; identical to SEQ ID NO: 40529

SEQ ID NO: 330068 - RNA, 64 nt, hsa; identical to SEQ ID NO: 40530

SEQ ID NO: 330069 - RNA, 64 nt, hsa; identical to SEQ ID NO: 40531

SEQ ID NO: 330070 - RNA, 64 nt, hsa; identical to SEQ ID NO: 40532

SEQ ID NO: 330071 - RNA, 64 nt, hsa; identical to SEQ ID NO: 40533

SEQ ID NO: 330072 - RNA, 64 nt, hsa; identical to SEQ ID NO: 40534

SEQ ID NO: 330073 - RNA, 64 nt, hsa; identical to SEQ ID NO: 40535

SEQ ID NO: 330074 - RNA, 64 nt, hsa; identical to SEQ ID NO: 40536

SEQ ID NO: 330075 - RNA, 64 nt, hsa; identical to SEQ ID NO: 40537

SEQ ID NO: 330076 - RNA, 64 nt, hsa; identical to SEQ ID NO: 40538

SEQ ID NO: 330077 - RNA, 64 nt, hsa; identical to SEQ ID NO: 40539

SEQ ID NO: 330078 - RNA, 64 nt, hsa; identical to SEQ ID NO: 40540

SEQ ID NO: 330079 - RNA, 64 nt, hsa; identical to SEQ ID NO: 40541

SEQ ID NO: 330080 - RNA, 64 nt, hsa; identical to SEQ ID NO: 40542

SEQ ID NO: 330081 - RNA, 64 nt, hsa; identical to SEQ ID NO: 40543

SEQ ID NO: 330082 - RNA, 64 nt, hsa; identical to SEQ ID NO: 40544

SEQ ID NO: 330083 - RNA, 64 nt, hsa; identical to SEQ ID NO: 40545

SEQ ID NO: 330084 - RNA, 64 nt, hsa; identical to SEQ ID NO: 40546

SEQ ID NO: 330085 - RNA, 64 nt, hsa; identical to SEQ ID NO: 40547

SEQ ID NO: 330086 - RNA, 64 nt, hsa; identical to SEQ ID NO: 40548

SEQ ID NO: 330087 - RNA, 64 nt, hsa; identical to SEQ ID NO: 40549

SEQ ID NO: 330088 - RNA, 64 nt, hsa; identical to SEQ ID NO: 40550

SEQ ID NO: 330089 - RNA, 64 nt, hsa; identical to SEQ ID NO: 40551

SEQ ID NO: 330090 - RNA, 64 nt, hsa; identical to SEQ ID NO: 40552

SEQ ID NO: 330091 - RNA, 64 nt, hsa; identical to SEQ ID NO: 40553

SEQ ID NO: 330092 - RNA, 64 nt, hsa; identical to SEQ ID NO: 40554

SEQ ID NO: 330093 - RNA, 64 nt, hsa; identical to SEQ ID NO: 40555

SEQ ID NO: 330094 - RNA, 64 nt, hsa; identical to SEQ ID NO: 40556

SEQ ID NO: 330095 - RNA, 64 nt, hsa; identical to SEQ ID NO: 40557

SEQ ID NO: 330096 - RNA, 64 nt, hsa; identical to SEQ ID NO: 40558

SEQ ID NO: 330097 - RNA, 64 nt, hsa; identical to SEQ ID NO: 40559

SEQ ID NO: 330098 - RNA, 64 nt, hsa; identical to SEQ ID NO: 40560

SEQ ID NO: 330099 - RNA, 64 nt, hsa; identical to SEQ ID NO: 40561

SEQ ID NO: 330100 - RNA, 64 nt, hsa; identical to SEQ ID NO: 40562

SEQ ID NO: 330101 - RNA, 64 nt, hsa; identical to SEQ ID NO: 40563

SEQ ID NO: 330102 - RNA, 64 nt, hsa; identical to SEQ ID NO: 40564

SEQ ID NO: 330103 - RNA, 64 nt, hsa; identical to SEQ ID NO: 40565

SEQ ID NO: 330104 - RNA, 64 nt, hsa; identical to SEQ ID NO: 40566

SEQ ID NO: 330105 - RNA, 64 nt, hsa; identical to SEQ ID NO: 40567

SEQ ID NO: 330106 - RNA, 64 nt, hsa; identical to SEQ ID NO: 40568

SEQ ID NO: 330107 - RNA, 64 nt, hsa; identical to SEQ ID NO: 40569

SEQ ID NO: 330108 - RNA, 64 nt, hsa; identical to SEQ ID NO: 40570

SEQ ID NO: 330109 - RNA, 64 nt, hsa; identical to SEQ ID NO: 40571

SEQ ID NO: 330110 - RNA, 64 nt, hsa; identical to SEQ ID NO: 40572

SEQ ID NO: 330111 - RNA, 64 nt, hsa; identical to SEQ ID NO: 40573

SEQ ID NO: 330112 - RNA, 64 nt, hsa; identical to SEQ ID NO: 40574

SEQ ID NO: 330113 - RNA, 64 nt, hsa; identical to SEQ ID NO: 40575

SEQ ID NO: 330114 - RNA, 64 nt, hsa; identical to SEQ ID NO: 40576

SEQ ID NO: 330115 - RNA, 64 nt, hsa; identical to SEQ ID NO: 40577

SEQ ID NO: 330116 - RNA, 64 nt, hsa; identical to SEQ ID NO: 40578

SEQ ID NO: 330117 - RNA, 64 nt, hsa; identical to SEQ ID NO: 40579

SEQ ID NO: 330118 - RNA, 64 nt, hsa; identical to SEQ ID NO: 40580

SEQ ID NO: 330119 - RNA, 64 nt, hsa; identical to SEQ ID NO: 40581

SEQ ID NO: 330120 - RNA, 64 nt, hsa; identical to SEQ ID NO: 40582

SEQ ID NO: 330121 - RNA, 64 nt, hsa; identical to SEQ ID NO: 40583

SEQ ID NO: 330122 - RNA, 64 nt, hsa; identical to SEQ ID NO: 40584

SEQ ID NO: 330123 - RNA, 64 nt, hsa; identical to SEQ ID NO: 40585

SEQ ID NO: 330124 - RNA, 64 nt, hsa; identical to SEQ ID NO: 40586

SEQ ID NO: 330125 - RNA, 64 nt, hsa; identical to SEQ ID NO: 40587

SEQ ID NO: 330126 - RNA, 64 nt, hsa; identical to SEQ ID NO: 40588

SEQ ID NO: 330127 - RNA, 64 nt, hsa; identical to SEQ ID NO: 40589

SEQ ID NO: 330128 - RNA, 64 nt, hsa; identical to SEQ ID NO: 40590

SEQ ID NO: 330129 - RNA, 64 nt, hsa; identical to SEQ ID NO: 40591

SEQ ID NO: 330130 - RNA, 64 nt, hsa; identical to SEQ ID NO: 40592

SEQ ID NO: 330131 - RNA, 64 nt, hsa; identical to SEQ ID NO: 40593

SEQ ID NO: 330132 - RNA, 64 nt, hsa; identical to SEQ ID NO: 40594

SEQ ID NO: 330133 - RNA, 64 nt, hsa; identical to SEQ ID NO: 40595

SEQ ID NO: 330134 - RNA, 64 nt, hsa; identical to SEQ ID NO: 40596

SEQ ID NO: 330135 - RNA, 64 nt, hsa; identical to SEQ ID NO: 40597

SEQ ID NO: 330136 - RNA, 64 nt, hsa; identical to SEQ ID NO: 40598

SEQ ID NO: 330137 - RNA, 64 nt, hsa; identical to SEQ ID NO: 40599

SEQ ID NO: 330138 - RNA, 64 nt, hsa; identical to SEQ ID NO: 40600

SEQ ID NO: 330139 - RNA, 64 nt, hsa; identical to SEQ ID NO: 40601

SEQ ID NO: 330140 - RNA, 64 nt, hsa; identical to SEQ ID NO: 40602

SEQ ID NO: 330141 - RNA, 64 nt, hsa; identical to SEQ ID NO: 40603

SEQ ID NO: 330142 - RNA, 64 nt, hsa; identical to SEQ ID NO: 40604

SEQ ID NO: 330143 - RNA, 64 nt, hsa; identical to SEQ ID NO: 40605

SEQ ID NO: 330144 - RNA, 64 nt, hsa; identical to SEQ ID NO: 40606

SEQ ID NO: 330145 - RNA, 64 nt, hsa; identical to SEQ ID NO: 40607

SEQ ID NO: 330146 - RNA, 64 nt, hsa; identical to SEQ ID NO: 40608

SEQ ID NO: 330147 - RNA, 64 nt, hsa; identical to SEQ ID NO: 40609

SEQ ID NO: 330148 - RNA, 64 nt, hsa; identical to SEQ ID NO: 40610

SEQ ID NO: 330149 - RNA, 64 nt, hsa; identical to SEQ ID NO: 40611

SEQ ID NO: 330150 - RNA, 64 nt, hsa; identical to SEQ ID NO: 40612

SEQ ID NO: 330151 - RNA, 64 nt, hsa; identical to SEQ ID NO: 40613

SEQ ID NO: 330152 - RNA, 64 nt, hsa; identical to SEQ ID NO: 40614

SEQ ID NO: 330153 - RNA, 64 nt, hsa; identical to SEQ ID NO: 40615

SEQ ID NO: 330154 - RNA, 64 nt, hsa; identical to SEQ ID NO: 40616

SEQ ID NO: 330155 - RNA, 64 nt, hsa; identical to SEQ ID NO: 40617

SEQ ID NO: 330156 - RNA, 64 nt, hsa; identical to SEQ ID NO: 40618

SEQ ID NO: 330157 - RNA, 64 nt, hsa; identical to SEQ ID NO: 40619

SEQ ID NO: 330158 - RNA, 64 nt, hsa; identical to SEQ ID NO: 40620

SEQ ID NO: 330159 - RNA, 64 nt, hsa; identical to SEQ ID NO: 40621

SEQ ID NO: 330160 - RNA, 64 nt, hsa; identical to SEQ ID NO: 40622

SEQ ID NO: 330161 - RNA, 64 nt, hsa; identical to SEQ ID NO: 40623

SEQ ID NO: 330162 - RNA, 64 nt, hsa; identical to SEQ ID NO: 40624

SEQ ID NO: 330163 - RNA, 64 nt, hsa; identical to SEQ ID NO: 40625

SEQ ID NO: 330164 - RNA, 64 nt, hsa; identical to SEQ ID NO: 40626

SEQ ID NO: 330165 - RNA, 64 nt, hsa; identical to SEQ ID NO: 40627

SEQ ID NO: 330166 - RNA, 64 nt, hsa; identical to SEQ ID NO: 40628

SEQ ID NO: 330167 - RNA, 64 nt, hsa; identical to SEQ ID NO: 40629

SEQ ID NO: 330168 - RNA, 64 nt, hsa; identical to SEQ ID NO: 40630

SEQ ID NO: 330169 - RNA, 64 nt, hsa; identical to SEQ ID NO: 40631

SEQ ID NO: 330170 - RNA, 64 nt, hsa; identical to SEQ ID NO: 40632

SEQ ID NO: 330171 - RNA, 64 nt, hsa; identical to SEQ ID NO: 40633

SEQ ID NO: 330172 - RNA, 64 nt, hsa; identical to SEQ ID NO: 40634

SEQ ID NO: 330173 - RNA, 64 nt, hsa; identical to SEQ ID NO: 40635

SEQ ID NO: 330174 - RNA, 64 nt, hsa; identical to SEQ ID NO: 40636

SEQ ID NO: 330175 - RNA, 64 nt, hsa; identical to SEQ ID NO: 40637

SEQ ID NO: 330176 - RNA, 64 nt, hsa; identical to SEQ ID NO: 40638

SEQ ID NO: 330177 - RNA, 64 nt, hsa; identical to SEQ ID NO: 40639

SEQ ID NO: 330178 - RNA, 64 nt, hsa; identical to SEQ ID NO: 40640

SEQ ID NO: 330179 - RNA, 64 nt, hsa; identical to SEQ ID NO: 40641

SEQ ID NO: 330180 - RNA, 64 nt, hsa; identical to SEQ ID NO: 40642

SEQ ID NO: 330181 - RNA, 64 nt, hsa; identical to SEQ ID NO: 40643

SEQ ID NO: 330182 - RNA, 64 nt, hsa; identical to SEQ ID NO: 40644

SEQ ID NO: 330183 - RNA, 64 nt, hsa; identical to SEQ ID NO: 40645

SEQ ID NO: 330184 - RNA, 64 nt, hsa; identical to SEQ ID NO: 40646

SEQ ID NO: 330185 - RNA, 64 nt, hsa; identical to SEQ ID NO: 40647

SEQ ID NO: 330186 - RNA, 64 nt, hsa; identical to SEQ ID NO: 40648

SEQ ID NO: 330187 - RNA, 64 nt, hsa; identical to SEQ ID NO: 40649

SEQ ID NO: 330188 - RNA, 64 nt, hsa; identical to SEQ ID NO: 40650

SEQ ID NO: 330189 - RNA, 64 nt, hsa; identical to SEQ ID NO: 40651

SEQ ID NO: 330190 - RNA, 64 nt, hsa; identical to SEQ ID NO: 40652

SEQ ID NO: 330191 - RNA, 64 nt, hsa; identical to SEQ ID NO: 40653

SEQ ID NO: 330192 - RNA, 64 nt, hsa; identical to SEQ ID NO: 40654

SEQ ID NO: 330193 - RNA, 64 nt, hsa; identical to SEQ ID NO: 40655

SEQ ID NO: 330194 - RNA, 64 nt, hsa; identical to SEQ ID NO: 40656

SEQ ID NO: 330195 - RNA, 64 nt, hsa; identical to SEQ ID NO: 40657

SEQ ID NO: 330196 - RNA, 64 nt, hsa; identical to SEQ ID NO: 40658

SEQ ID NO: 330197 - RNA, 64 nt, hsa; identical to SEQ ID NO: 40659

SEQ ID NO: 330198 - RNA, 64 nt, hsa; identical to SEQ ID NO: 40660

SEQ ID NO: 330199 - RNA, 64 nt, hsa; identical to SEQ ID NO: 40661

SEQ ID NO: 330200 - RNA, 64 nt, hsa; identical to SEQ ID NO: 40662

SEQ ID NO: 330201 - RNA, 64 nt, hsa; identical to SEQ ID NO: 40663

SEQ ID NO: 330202 - RNA, 64 nt, hsa; identical to SEQ ID NO: 40664

SEQ ID NO: 330203 - RNA, 64 nt, hsa; identical to SEQ ID NO: 40665

SEQ ID NO: 330204 - RNA, 64 nt, hsa; identical to SEQ ID NO: 40666

SEQ ID NO: 330205 - RNA, 64 nt, hsa; identical to SEQ ID NO: 40667

SEQ ID NO: 330206 - RNA, 64 nt, hsa; identical to SEQ ID NO: 40668

SEQ ID NO: 330207 - RNA, 64 nt, hsa; identical to SEQ ID NO: 40669

SEQ ID NO: 330208 - RNA, 64 nt, hsa; identical to SEQ ID NO: 40670

SEQ ID NO: 330209 - RNA, 64 nt, hsa; identical to SEQ ID NO: 40671

SEQ ID NO: 330210 - RNA, 64 nt, hsa; identical to SEQ ID NO: 40672

SEQ ID NO: 330211 - RNA, 64 nt, hsa; identical to SEQ ID NO: 40673

SEQ ID NO: 330212 - RNA, 64 nt, hsa; identical to SEQ ID NO: 40674

SEQ ID NO: 330213 - RNA, 64 nt, hsa; identical to SEQ ID NO: 40675

SEQ ID NO: 330214 - RNA, 64 nt, hsa; identical to SEQ ID NO: 40676

SEQ ID NO: 330215 - RNA, 64 nt, hsa; identical to SEQ ID NO: 40677

SEQ ID NO: 330216 - RNA, 64 nt, hsa; identical to SEQ ID NO: 40678

SEQ ID NO: 330217 - RNA, 64 nt, hsa; identical to SEQ ID NO: 40679

SEQ ID NO: 330218 - RNA, 64 nt, hsa; identical to SEQ ID NO: 40680

SEQ ID NO: 330219 - RNA, 64 nt, hsa; identical to SEQ ID NO: 40681

SEQ ID NO: 330220 - RNA, 64 nt, hsa; identical to SEQ ID NO: 40682

SEQ ID NO: 330221 - RNA, 64 nt, hsa; identical to SEQ ID NO: 40683

SEQ ID NO: 330222 - RNA, 64 nt, hsa; identical to SEQ ID NO: 40684

SEQ ID NO: 330223 - RNA, 64 nt, hsa; identical to SEQ ID NO: 40685

SEQ ID NO: 330224 - RNA, 64 nt, hsa; identical to SEQ ID NO: 40686

SEQ ID NO: 330225 - RNA, 64 nt, hsa; identical to SEQ ID NO: 40687

SEQ ID NO: 330226 - RNA, 64 nt, hsa; identical to SEQ ID NO: 40688

SEQ ID NO: 330227 - RNA, 64 nt, hsa; identical to SEQ ID NO: 40689

SEQ ID NO: 330228 - RNA, 64 nt, hsa; identical to SEQ ID NO: 40690

SEQ ID NO: 330229 - RNA, 64 nt, hsa; identical to SEQ ID NO: 40691

SEQ ID NO: 330230 - RNA, 64 nt, hsa; identical to SEQ ID NO: 40692

SEQ ID NO: 330231 - RNA, 64 nt, hsa; identical to SEQ ID NO: 40693

SEQ ID NO: 330232 - RNA, 64 nt, hsa; identical to SEQ ID NO: 40694

SEQ ID NO: 330233 - RNA, 64 nt, hsa; identical to SEQ ID NO: 40695

SEQ ID NO: 330234 - RNA, 64 nt, hsa; identical to SEQ ID NO: 40696

SEQ ID NO: 330235 - RNA, 64 nt, hsa; identical to SEQ ID NO: 40697

SEQ ID NO: 330236 - RNA, 64 nt, hsa; identical to SEQ ID NO: 40698

SEQ ID NO: 330237 - RNA, 64 nt, hsa; identical to SEQ ID NO: 40699

SEQ ID NO: 330238 - RNA, 64 nt, hsa; identical to SEQ ID NO: 40700

SEQ ID NO: 330239 - RNA, 64 nt, hsa; identical to SEQ ID NO: 40701

SEQ ID NO: 330240 - RNA, 64 nt, hsa; identical to SEQ ID NO: 40702

SEQ ID NO: 330241 - RNA, 64 nt, hsa; identical to SEQ ID NO: 40703

SEQ ID NO: 330242 - RNA, 64 nt, hsa; identical to SEQ ID NO: 40704

SEQ ID NO: 330243 - RNA, 64 nt, hsa; identical to SEQ ID NO: 40705

SEQ ID NO: 330244 - RNA, 64 nt, hsa; identical to SEQ ID NO: 40706

SEQ ID NO: 330245 - RNA, 64 nt, hsa; identical to SEQ ID NO: 40707

SEQ ID NO: 330246 - RNA, 64 nt, hsa; identical to SEQ ID NO: 40708

SEQ ID NO: 330247 - RNA, 64 nt, hsa; identical to SEQ ID NO: 40709

SEQ ID NO: 330248 - RNA, 64 nt, hsa; identical to SEQ ID NO: 40710

SEQ ID NO: 330249 - RNA, 64 nt, hsa; identical to SEQ ID NO: 40711

SEQ ID NO: 330250 - RNA, 64 nt, hsa; identical to SEQ ID NO: 40712

SEQ ID NO: 330251 - RNA, 64 nt, hsa; identical to SEQ ID NO: 40713

SEQ ID NO: 330252 - RNA, 64 nt, hsa; identical to SEQ ID NO: 40714

SEQ ID NO: 330253 - RNA, 64 nt, hsa; identical to SEQ ID NO: 40715

SEQ ID NO: 330254 - RNA, 64 nt, hsa; identical to SEQ ID NO: 40716

SEQ ID NO: 330255 - RNA, 64 nt, hsa; identical to SEQ ID NO: 40717

SEQ ID NO: 330256 - RNA, 64 nt, hsa; identical to SEQ ID NO: 40718

SEQ ID NO: 330257 - RNA, 64 nt, hsa; identical to SEQ ID NO: 40719

SEQ ID NO: 330258 - RNA, 64 nt, hsa; identical to SEQ ID NO: 40720

SEQ ID NO: 330259 - RNA, 64 nt, hsa; identical to SEQ ID NO: 40721

SEQ ID NO: 330260 - RNA, 64 nt, hsa; identical to SEQ ID NO: 40722

SEQ ID NO: 330261 - RNA, 64 nt, hsa; identical to SEQ ID NO: 40723

SEQ ID NO: 330262 - RNA, 64 nt, hsa; identical to SEQ ID NO: 40724

SEQ ID NO: 330263 - RNA, 64 nt, hsa; identical to SEQ ID NO: 40725

SEQ ID NO: 330264 - RNA, 64 nt, hsa; identical to SEQ ID NO: 40726

SEQ ID NO: 330265 - RNA, 64 nt, hsa; identical to SEQ ID NO: 40727

SEQ ID NO: 330266 - RNA, 64 nt, hsa; identical to SEQ ID NO: 40728

SEQ ID NO: 330267 - RNA, 64 nt, hsa; identical to SEQ ID NO: 40729

SEQ ID NO: 330268 - RNA, 64 nt, hsa; identical to SEQ ID NO: 40730

SEQ ID NO: 330269 - RNA, 64 nt, hsa; identical to SEQ ID NO: 40731

SEQ ID NO: 330270 - RNA, 64 nt, hsa; identical to SEQ ID NO: 40732

SEQ ID NO: 330271 - RNA, 64 nt, hsa; identical to SEQ ID NO: 40733

SEQ ID NO: 330272 - RNA, 64 nt, hsa; identical to SEQ ID NO: 40734

SEQ ID NO: 330273 - RNA, 64 nt, hsa; identical to SEQ ID NO: 40735

SEQ ID NO: 330274 - RNA, 64 nt, hsa; identical to SEQ ID NO: 40736

SEQ ID NO: 330275 - RNA, 64 nt, hsa; identical to SEQ ID NO: 40737

SEQ ID NO: 330276 - RNA, 64 nt, hsa; identical to SEQ ID NO: 40738

SEQ ID NO: 330277 - RNA, 64 nt, hsa; identical to SEQ ID NO: 40739

SEQ ID NO: 330278 - RNA, 64 nt, hsa; identical to SEQ ID NO: 40740

SEQ ID NO: 330279 - RNA, 64 nt, hsa; identical to SEQ ID NO: 40741

SEQ ID NO: 330280 - RNA, 64 nt, hsa; identical to SEQ ID NO: 40742

SEQ ID NO: 330281 - RNA, 64 nt, hsa; identical to SEQ ID NO: 40743

SEQ ID NO: 330282 - RNA, 64 nt, hsa; identical to SEQ ID NO: 40744

SEQ ID NO: 330283 - RNA, 64 nt, hsa; identical to SEQ ID NO: 40745

SEQ ID NO: 330284 - RNA, 64 nt, hsa; identical to SEQ ID NO: 40746

SEQ ID NO: 330285 - RNA, 64 nt, hsa; identical to SEQ ID NO: 40747

SEQ ID NO: 330286 - RNA, 64 nt, hsa; identical to SEQ ID NO: 40748

SEQ ID NO: 330287 - RNA, 64 nt, hsa; identical to SEQ ID NO: 40749

SEQ ID NO: 330288 - RNA, 64 nt, hsa; identical to SEQ ID NO: 40750

SEQ ID NO: 330289 - RNA, 64 nt, hsa; identical to SEQ ID NO: 40751

SEQ ID NO: 330290 - RNA, 64 nt, hsa; identical to SEQ ID NO: 40752

SEQ ID NO: 330291 - RNA, 64 nt, hsa; identical to SEQ ID NO: 40753

SEQ ID NO: 330292 - RNA, 64 nt, hsa; identical to SEQ ID NO: 40754

SEQ ID NO: 330293 - RNA, 64 nt, hsa; identical to SEQ ID NO: 40755

SEQ ID NO: 330294 - RNA, 64 nt, hsa; identical to SEQ ID NO: 40756

SEQ ID NO: 330295 - RNA, 64 nt, hsa; identical to SEQ ID NO: 40757

SEQ ID NO: 330296 - RNA, 64 nt, hsa; identical to SEQ ID NO: 40758

SEQ ID NO: 330297 - RNA, 64 nt, hsa; identical to SEQ ID NO: 40759

SEQ ID NO: 330298 - RNA, 64 nt, hsa; identical to SEQ ID NO: 40760

SEQ ID NO: 330299 - RNA, 64 nt, hsa; identical to SEQ ID NO: 40761

SEQ ID NO: 330300 - RNA, 64 nt, hsa; identical to SEQ ID NO: 40762

SEQ ID NO: 330301 - RNA, 64 nt, hsa; identical to SEQ ID NO: 40763

SEQ ID NO: 330302 - RNA, 64 nt, hsa; identical to SEQ ID NO: 40764

SEQ ID NO: 330303 - RNA, 64 nt, hsa; identical to SEQ ID NO: 40765

SEQ ID NO: 330304 - RNA, 64 nt, hsa; identical to SEQ ID NO: 40766

SEQ ID NO: 330305 - RNA, 64 nt, hsa; identical to SEQ ID NO: 40767

SEQ ID NO: 330306 - RNA, 64 nt, hsa; identical to SEQ ID NO: 40768

SEQ ID NO: 330307 - RNA, 64 nt, hsa; identical to SEQ ID NO: 40769

SEQ ID NO: 330308 - RNA, 64 nt, hsa; identical to SEQ ID NO: 40770

SEQ ID NO: 330309 - RNA, 64 nt, hsa; identical to SEQ ID NO: 40771

SEQ ID NO: 330310 - RNA, 64 nt, hsa; identical to SEQ ID NO: 40772

SEQ ID NO: 330311 - RNA, 64 nt, hsa; identical to SEQ ID NO: 40773

SEQ ID NO: 330312 - RNA, 64 nt, hsa; identical to SEQ ID NO: 40774

SEQ ID NO: 330313 - RNA, 64 nt, hsa; identical to SEQ ID NO: 40775

SEQ ID NO: 330314 - RNA, 64 nt, hsa; identical to SEQ ID NO: 40776

SEQ ID NO: 330315 - RNA, 64 nt, hsa; identical to SEQ ID NO: 40777

SEQ ID NO: 330316 - RNA, 64 nt, hsa; identical to SEQ ID NO: 40778

SEQ ID NO: 330317 - RNA, 64 nt, hsa; identical to SEQ ID NO: 40779

SEQ ID NO: 330318 - RNA, 64 nt, hsa; identical to SEQ ID NO: 40780

SEQ ID NO: 330319 - RNA, 64 nt, hsa; identical to SEQ ID NO: 40781

SEQ ID NO: 330320 - RNA, 64 nt, hsa; identical to SEQ ID NO: 40782

SEQ ID NO: 330321 - RNA, 64 nt, hsa; identical to SEQ ID NO: 40783

SEQ ID NO: 330322 - RNA, 64 nt, hsa; identical to SEQ ID NO: 40784

SEQ ID NO: 330323 - RNA, 64 nt, hsa; identical to SEQ ID NO: 40785

SEQ ID NO: 330324 - RNA, 64 nt, hsa; identical to SEQ ID NO: 40786

SEQ ID NO: 330325 - RNA, 64 nt, hsa; identical to SEQ ID NO: 40787

SEQ ID NO: 330326 - RNA, 64 nt, hsa; identical to SEQ ID NO: 40788

SEQ ID NO: 330327 - RNA, 64 nt, hsa; identical to SEQ ID NO: 40789

SEQ ID NO: 330328 - RNA, 64 nt, hsa; identical to SEQ ID NO: 40790

SEQ ID NO: 330329 - RNA, 64 nt, hsa; identical to SEQ ID NO: 40791

SEQ ID NO: 330330 - RNA, 64 nt, hsa; identical to SEQ ID NO: 40792

SEQ ID NO: 330331 - RNA, 64 nt, hsa; identical to SEQ ID NO: 40793

SEQ ID NO: 330332 - RNA, 64 nt, hsa; identical to SEQ ID NO: 40794

SEQ ID NO: 330333 - RNA, 64 nt, hsa; identical to SEQ ID NO: 40795

SEQ ID NO: 330334 - RNA, 64 nt, hsa; identical to SEQ ID NO: 40796

SEQ ID NO: 330335 - RNA, 64 nt, hsa; identical to SEQ ID NO: 40797

SEQ ID NO: 330336 - RNA, 64 nt, hsa; identical to SEQ ID NO: 40798

SEQ ID NO: 330337 - RNA, 64 nt, hsa; identical to SEQ ID NO: 40799

SEQ ID NO: 330338 - RNA, 64 nt, hsa; identical to SEQ ID NO: 40800

SEQ ID NO: 330339 - RNA, 64 nt, hsa; identical to SEQ ID NO: 40801

SEQ ID NO: 330340 - RNA, 64 nt, hsa; identical to SEQ ID NO: 40802

SEQ ID NO: 330341 - RNA, 64 nt, hsa; identical to SEQ ID NO: 40803

SEQ ID NO: 330342 - RNA, 64 nt, hsa; identical to SEQ ID NO: 40804

SEQ ID NO: 330343 - RNA, 64 nt, hsa; identical to SEQ ID NO: 40805

SEQ ID NO: 330344 - RNA, 64 nt, hsa; identical to SEQ ID NO: 40806

SEQ ID NO: 330345 - RNA, 64 nt, hsa; identical to SEQ ID NO: 40807

SEQ ID NO: 330346 - RNA, 64 nt, hsa; identical to SEQ ID NO: 40808

SEQ ID NO: 330347 - RNA, 64 nt, hsa; identical to SEQ ID NO: 40809

SEQ ID NO: 330348 - RNA, 64 nt, hsa; identical to SEQ ID NO: 40810

SEQ ID NO: 330349 - RNA, 64 nt, hsa; identical to SEQ ID NO: 40811

SEQ ID NO: 330350 - RNA, 64 nt, hsa; identical to SEQ ID NO: 40812

SEQ ID NO: 330351 - RNA, 64 nt, hsa; identical to SEQ ID NO: 40813

SEQ ID NO: 330352 - RNA, 64 nt, hsa; identical to SEQ ID NO: 40814

SEQ ID NO: 330353 - RNA, 64 nt, hsa; identical to SEQ ID NO: 40815

SEQ ID NO: 330354 - RNA, 64 nt, hsa; identical to SEQ ID NO: 40816

SEQ ID NO: 330355 - RNA, 64 nt, hsa; identical to SEQ ID NO: 40817

SEQ ID NO: 330356 - RNA, 64 nt, hsa; identical to SEQ ID NO: 40818

SEQ ID NO: 330357 - RNA, 64 nt, hsa; identical to SEQ ID NO: 40819

SEQ ID NO: 330358 - RNA, 64 nt, hsa; identical to SEQ ID NO: 40820

SEQ ID NO: 330359 - RNA, 64 nt, hsa; identical to SEQ ID NO: 40821

SEQ ID NO: 330360 - RNA, 64 nt, hsa; identical to SEQ ID NO: 40822

SEQ ID NO: 330361 - RNA, 64 nt, hsa; identical to SEQ ID NO: 40823

SEQ ID NO: 330362 - RNA, 64 nt, hsa; identical to SEQ ID NO: 40824

SEQ ID NO: 330363 - RNA, 64 nt, hsa; identical to SEQ ID NO: 40825

SEQ ID NO: 330364 - RNA, 64 nt, hsa; identical to SEQ ID NO: 40826

SEQ ID NO: 330365 - RNA, 64 nt, hsa; identical to SEQ ID NO: 40827

SEQ ID NO: 330366 - RNA, 64 nt, hsa; identical to SEQ ID NO: 40828

SEQ ID NO: 330367 - RNA, 64 nt, hsa; identical to SEQ ID NO: 40829

SEQ ID NO: 330368 - RNA, 64 nt, hsa; identical to SEQ ID NO: 40830

SEQ ID NO: 330369 - RNA, 64 nt, hsa; identical to SEQ ID NO: 40831

SEQ ID NO: 330370 - RNA, 64 nt, hsa; identical to SEQ ID NO: 40832

SEQ ID NO: 330371 - RNA, 64 nt, hsa; identical to SEQ ID NO: 40833

SEQ ID NO: 330372 - RNA, 64 nt, hsa; identical to SEQ ID NO: 40834

SEQ ID NO: 330373 - RNA, 64 nt, hsa; identical to SEQ ID NO: 40835

SEQ ID NO: 330374 - RNA, 64 nt, hsa; identical to SEQ ID NO: 40836

SEQ ID NO: 330375 - RNA, 64 nt, hsa; identical to SEQ ID NO: 40837

SEQ ID NO: 330376 - RNA, 64 nt, hsa; identical to SEQ ID NO: 40838

SEQ ID NO: 330377 - RNA, 64 nt, hsa; identical to SEQ ID NO: 40839

SEQ ID NO: 330378 - RNA, 64 nt, hsa; identical to SEQ ID NO: 40840

SEQ ID NO: 330379 - RNA, 64 nt, hsa; identical to SEQ ID NO: 40841

SEQ ID NO: 330380 - RNA, 64 nt, hsa; identical to SEQ ID NO: 40842

SEQ ID NO: 330381 - RNA, 64 nt, hsa; identical to SEQ ID NO: 40843

SEQ ID NO: 330382 - RNA, 64 nt, hsa; identical to SEQ ID NO: 40844

SEQ ID NO: 330383 - RNA, 64 nt, hsa; identical to SEQ ID NO: 40845

SEQ ID NO: 330384 - RNA, 64 nt, hsa; identical to SEQ ID NO: 40846

SEQ ID NO: 330385 - RNA, 64 nt, hsa; identical to SEQ ID NO: 40847

SEQ ID NO: 330386 - RNA, 64 nt, hsa; identical to SEQ ID NO: 40848

SEQ ID NO: 330387 - RNA, 64 nt, hsa; identical to SEQ ID NO: 40849

SEQ ID NO: 330388 - RNA, 64 nt, hsa; identical to SEQ ID NO: 40850

SEQ ID NO: 330389 - RNA, 64 nt, hsa; identical to SEQ ID NO: 40851

SEQ ID NO: 330390 - RNA, 64 nt, hsa; identical to SEQ ID NO: 40852

SEQ ID NO: 330391 - RNA, 64 nt, hsa; identical to SEQ ID NO: 40853

SEQ ID NO: 330392 - RNA, 64 nt, hsa; identical to SEQ ID NO: 40854

SEQ ID NO: 330393 - RNA, 64 nt, hsa; identical to SEQ ID NO: 40855

SEQ ID NO: 330394 - RNA, 64 nt, hsa; identical to SEQ ID NO: 40856

SEQ ID NO: 330395 - RNA, 64 nt, hsa; identical to SEQ ID NO: 40857

SEQ ID NO: 330396 - RNA, 64 nt, hsa; identical to SEQ ID NO: 40858

SEQ ID NO: 330397 - RNA, 64 nt, hsa; identical to SEQ ID NO: 40859

SEQ ID NO: 330398 - RNA, 64 nt, hsa; identical to SEQ ID NO: 40860

SEQ ID NO: 330399 - RNA, 64 nt, hsa; identical to SEQ ID NO: 40861

SEQ ID NO: 330400 - RNA, 64 nt, hsa; identical to SEQ ID NO: 40862

SEQ ID NO: 330401 - RNA, 64 nt, hsa; identical to SEQ ID NO: 40863

SEQ ID NO: 330402 - RNA, 64 nt, hsa; identical to SEQ ID NO: 40864

SEQ ID NO: 330403 - RNA, 64 nt, hsa; identical to SEQ ID NO: 40865

SEQ ID NO: 330404 - RNA, 64 nt, hsa; identical to SEQ ID NO: 40866

SEQ ID NO: 330405 - RNA, 64 nt, hsa; identical to SEQ ID NO: 40867

SEQ ID NO: 330406 - RNA, 64 nt, hsa; identical to SEQ ID NO: 40868

SEQ ID NO: 330407 - RNA, 64 nt, hsa; identical to SEQ ID NO: 40869

SEQ ID NO: 330408 - RNA, 64 nt, hsa; identical to SEQ ID NO: 40870

SEQ ID NO: 330409 - RNA, 64 nt, hsa; identical to SEQ ID NO: 40871

SEQ ID NO: 330410 - RNA, 64 nt, hsa; identical to SEQ ID NO: 40872

SEQ ID NO: 330411 - RNA, 64 nt, hsa; identical to SEQ ID NO: 40873

SEQ ID NO: 330412 - RNA, 64 nt, hsa; identical to SEQ ID NO: 40874

SEQ ID NO: 330413 - RNA, 64 nt, hsa; identical to SEQ ID NO: 40875

SEQ ID NO: 330414 - RNA, 64 nt, hsa; identical to SEQ ID NO: 40876

SEQ ID NO: 330415 - RNA, 64 nt, hsa; identical to SEQ ID NO: 40877

SEQ ID NO: 330416 - RNA, 64 nt, hsa; identical to SEQ ID NO: 40878

SEQ ID NO: 330417 - RNA, 64 nt, hsa; identical to SEQ ID NO: 40879

SEQ ID NO: 330418 - RNA, 64 nt, hsa; identical to SEQ ID NO: 40880

SEQ ID NO: 330419 - RNA, 64 nt, hsa; identical to SEQ ID NO: 40881

SEQ ID NO: 330420 - RNA, 64 nt, hsa; identical to SEQ ID NO: 40882

SEQ ID NO: 330421 - RNA, 64 nt, hsa; identical to SEQ ID NO: 40883

SEQ ID NO: 330422 - RNA, 64 nt, hsa; identical to SEQ ID NO: 40884

SEQ ID NO: 330423 - RNA, 64 nt, hsa; identical to SEQ ID NO: 40885

SEQ ID NO: 330424 - RNA, 64 nt, hsa; identical to SEQ ID NO: 40886

SEQ ID NO: 330425 - RNA, 64 nt, hsa; identical to SEQ ID NO: 40887

SEQ ID NO: 330426 - RNA, 64 nt, hsa; identical to SEQ ID NO: 40888

SEQ ID NO: 330427 - RNA, 64 nt, hsa; identical to SEQ ID NO: 40889

SEQ ID NO: 330428 - RNA, 64 nt, hsa; identical to SEQ ID NO: 40890

SEQ ID NO: 330429 - RNA, 64 nt, hsa; identical to SEQ ID NO: 40891

SEQ ID NO: 330430 - RNA, 64 nt, hsa; identical to SEQ ID NO: 40892

SEQ ID NO: 330431 - RNA, 64 nt, hsa; identical to SEQ ID NO: 40893

SEQ ID NO: 330432 - RNA, 64 nt, hsa; identical to SEQ ID NO: 40894

SEQ ID NO: 330433 - RNA, 64 nt, hsa; identical to SEQ ID NO: 40895

SEQ ID NO: 330434 - RNA, 64 nt, hsa; identical to SEQ ID NO: 40896

SEQ ID NO: 330435 - RNA, 64 nt, hsa; identical to SEQ ID NO: 40897

SEQ ID NO: 330436 - RNA, 64 nt, hsa; identical to SEQ ID NO: 40898

SEQ ID NO: 330437 - RNA, 64 nt, hsa; identical to SEQ ID NO: 40899

SEQ ID NO: 330438 - RNA, 64 nt, hsa; identical to SEQ ID NO: 40900

SEQ ID NO: 330439 - RNA, 64 nt, hsa; identical to SEQ ID NO: 40901

SEQ ID NO: 330440 - RNA, 64 nt, hsa; identical to SEQ ID NO: 40902

SEQ ID NO: 330441 - RNA, 64 nt, hsa; identical to SEQ ID NO: 40903

SEQ ID NO: 330442 - RNA, 64 nt, hsa; identical to SEQ ID NO: 40904

SEQ ID NO: 330443 - RNA, 64 nt, hsa; identical to SEQ ID NO: 40905

SEQ ID NO: 330444 - RNA, 64 nt, hsa; identical to SEQ ID NO: 40906

SEQ ID NO: 330445 - RNA, 64 nt, hsa; identical to SEQ ID NO: 40907

SEQ ID NO: 330446 - RNA, 64 nt, hsa; identical to SEQ ID NO: 40908

SEQ ID NO: 330447 - RNA, 64 nt, hsa; identical to SEQ ID NO: 40909

SEQ ID NO: 330448 - RNA, 64 nt, hsa; identical to SEQ ID NO: 40910

SEQ ID NO: 330449 - RNA, 64 nt, hsa; identical to SEQ ID NO: 40911

SEQ ID NO: 330450 - RNA, 64 nt, hsa; identical to SEQ ID NO: 40912

SEQ ID NO: 330451 - RNA, 64 nt, hsa; identical to SEQ ID NO: 40913

SEQ ID NO: 330452 - RNA, 64 nt, hsa; identical to SEQ ID NO: 40914

SEQ ID NO: 330453 - RNA, 64 nt, hsa; identical to SEQ ID NO: 40915

SEQ ID NO: 330454 - RNA, 64 nt, hsa; identical to SEQ ID NO: 40916

SEQ ID NO: 330455 - RNA, 64 nt, hsa; identical to SEQ ID NO: 40917

SEQ ID NO: 330456 - RNA, 64 nt, hsa; identical to SEQ ID NO: 40918

SEQ ID NO: 330457 - RNA, 64 nt, hsa; identical to SEQ ID NO: 40919

SEQ ID NO: 330458 - RNA, 64 nt, hsa; identical to SEQ ID NO: 40920

SEQ ID NO: 330459 - RNA, 64 nt, hsa; identical to SEQ ID NO: 40921

SEQ ID NO: 330460 - RNA, 64 nt, hsa; identical to SEQ ID NO: 40922

SEQ ID NO: 330461 - RNA, 64 nt, hsa; identical to SEQ ID NO: 40923

SEQ ID NO: 330462 - RNA, 64 nt, hsa; identical to SEQ ID NO: 40924

SEQ ID NO: 330463 - RNA, 64 nt, hsa; identical to SEQ ID NO: 40925

SEQ ID NO: 330464 - RNA, 64 nt, hsa; identical to SEQ ID NO: 40926

SEQ ID NO: 330465 - RNA, 64 nt, hsa; identical to SEQ ID NO: 40927

SEQ ID NO: 330466 - RNA, 64 nt, hsa; identical to SEQ ID NO: 40928

SEQ ID NO: 330467 - RNA, 64 nt, hsa; identical to SEQ ID NO: 40929

SEQ ID NO: 330468 - RNA, 64 nt, hsa; identical to SEQ ID NO: 40930

SEQ ID NO: 330469 - RNA, 64 nt, hsa; identical to SEQ ID NO: 40931

SEQ ID NO: 330470 - RNA, 64 nt, hsa; identical to SEQ ID NO: 40932

SEQ ID NO: 330471 - RNA, 64 nt, hsa; identical to SEQ ID NO: 40933

SEQ ID NO: 330472 - RNA, 64 nt, hsa; identical to SEQ ID NO: 40934

SEQ ID NO: 330473 - RNA, 64 nt, hsa; identical to SEQ ID NO: 40935

SEQ ID NO: 330474 - RNA, 64 nt, hsa; identical to SEQ ID NO: 40936

SEQ ID NO: 330475 - RNA, 64 nt, hsa; identical to SEQ ID NO: 40937

SEQ ID NO: 330476 - RNA, 64 nt, hsa; identical to SEQ ID NO: 40938

SEQ ID NO: 330477 - RNA, 64 nt, hsa; identical to SEQ ID NO: 40939

SEQ ID NO: 330478 - RNA, 64 nt, hsa; identical to SEQ ID NO: 40940

SEQ ID NO: 330479 - RNA, 64 nt, hsa; identical to SEQ ID NO: 40941

SEQ ID NO: 330480 - RNA, 64 nt, hsa; identical to SEQ ID NO: 40942

SEQ ID NO: 330481 - RNA, 64 nt, hsa; identical to SEQ ID NO: 40943

SEQ ID NO: 330482 - RNA, 64 nt, hsa; identical to SEQ ID NO: 40944

SEQ ID NO: 330483 - RNA, 64 nt, hsa; identical to SEQ ID NO: 40945

SEQ ID NO: 330484 - RNA, 64 nt, hsa; identical to SEQ ID NO: 40946

SEQ ID NO: 330485 - RNA, 64 nt, hsa; identical to SEQ ID NO: 40947

SEQ ID NO: 330486 - RNA, 64 nt, hsa; identical to SEQ ID NO: 40948

SEQ ID NO: 330487 - RNA, 64 nt, hsa; identical to SEQ ID NO: 40949

SEQ ID NO: 330488 - RNA, 64 nt, hsa; identical to SEQ ID NO: 40950

SEQ ID NO: 330489 - RNA, 64 nt, hsa; identical to SEQ ID NO: 40951

SEQ ID NO: 330490 - RNA, 64 nt, hsa; identical to SEQ ID NO: 40952

SEQ ID NO: 330491 - RNA, 64 nt, hsa; identical to SEQ ID NO: 40953

SEQ ID NO: 330492 - RNA, 64 nt, hsa; identical to SEQ ID NO: 40954

SEQ ID NO: 330493 - RNA, 64 nt, hsa; identical to SEQ ID NO: 40955

SEQ ID NO: 330494 - RNA, 64 nt, hsa; identical to SEQ ID NO: 40956

SEQ ID NO: 330495 - RNA, 64 nt, hsa; identical to SEQ ID NO: 40957

SEQ ID NO: 330496 - RNA, 64 nt, hsa; identical to SEQ ID NO: 40958

SEQ ID NO: 330497 - RNA, 64 nt, hsa; identical to SEQ ID NO: 40959

SEQ ID NO: 330498 - RNA, 64 nt, hsa; identical to SEQ ID NO: 40960

SEQ ID NO: 330499 - RNA, 64 nt, hsa; identical to SEQ ID NO: 40961

SEQ ID NO: 330500 - RNA, 64 nt, hsa; identical to SEQ ID NO: 40962

SEQ ID NO: 330501 - RNA, 64 nt, hsa; identical to SEQ ID NO: 40963

SEQ ID NO: 330502 - RNA, 64 nt, hsa; identical to SEQ ID NO: 40964

SEQ ID NO: 330503 - RNA, 64 nt, hsa; identical to SEQ ID NO: 40965

SEQ ID NO: 330504 - RNA, 64 nt, hsa; identical to SEQ ID NO: 40966

SEQ ID NO: 330505 - RNA, 64 nt, hsa; identical to SEQ ID NO: 40967

SEQ ID NO: 330506 - RNA, 64 nt, hsa; identical to SEQ ID NO: 40968

SEQ ID NO: 330507 - RNA, 64 nt, hsa; identical to SEQ ID NO: 40969

SEQ ID NO: 330508 - RNA, 64 nt, hsa; identical to SEQ ID NO: 40970

SEQ ID NO: 330509 - RNA, 64 nt, hsa; identical to SEQ ID NO: 40971

SEQ ID NO: 330510 - RNA, 64 nt, hsa; identical to SEQ ID NO: 40972

SEQ ID NO: 330511 - RNA, 64 nt, hsa; identical to SEQ ID NO: 40973

SEQ ID NO: 330512 - RNA, 64 nt, hsa; identical to SEQ ID NO: 40974

SEQ ID NO: 330513 - RNA, 64 nt, hsa; identical to SEQ ID NO: 40975

SEQ ID NO: 330514 - RNA, 64 nt, hsa; identical to SEQ ID NO: 40976

SEQ ID NO: 330515 - RNA, 64 nt, hsa; identical to SEQ ID NO: 40977

SEQ ID NO: 330516 - RNA, 64 nt, hsa; identical to SEQ ID NO: 40978

SEQ ID NO: 330517 - RNA, 64 nt, hsa; identical to SEQ ID NO: 40979

SEQ ID NO: 330518 - RNA, 64 nt, hsa; identical to SEQ ID NO: 40980

SEQ ID NO: 330519 - RNA, 64 nt, hsa; identical to SEQ ID NO: 40981

SEQ ID NO: 330520 - RNA, 64 nt, hsa; identical to SEQ ID NO: 40982

SEQ ID NO: 330521 - RNA, 64 nt, hsa; identical to SEQ ID NO: 40983

SEQ ID NO: 330522 - RNA, 64 nt, hsa; identical to SEQ ID NO: 40984

SEQ ID NO: 330523 - RNA, 64 nt, hsa; identical to SEQ ID NO: 40985

SEQ ID NO: 330524 - RNA, 64 nt, hsa; identical to SEQ ID NO: 40986

SEQ ID NO: 330525 - RNA, 64 nt, hsa; identical to SEQ ID NO: 40987

SEQ ID NO: 330526 - RNA, 64 nt, hsa; identical to SEQ ID NO: 40988

SEQ ID NO: 330527 - RNA, 64 nt, hsa; identical to SEQ ID NO: 40989

SEQ ID NO: 330528 - RNA, 64 nt, hsa; identical to SEQ ID NO: 40990

SEQ ID NO: 330529 - RNA, 64 nt, hsa; identical to SEQ ID NO: 40991

SEQ ID NO: 330530 - RNA, 64 nt, hsa; identical to SEQ ID NO: 40992

SEQ ID NO: 330531 - RNA, 64 nt, hsa; identical to SEQ ID NO: 40993

SEQ ID NO: 330532 - RNA, 64 nt, hsa; identical to SEQ ID NO: 40994

SEQ ID NO: 330533 - RNA, 64 nt, hsa; identical to SEQ ID NO: 40995

SEQ ID NO: 330534 - RNA, 64 nt, hsa; identical to SEQ ID NO: 40996

SEQ ID NO: 330535 - RNA, 64 nt, hsa; identical to SEQ ID NO: 40997

SEQ ID NO: 330536 - RNA, 64 nt, hsa; identical to SEQ ID NO: 40998

SEQ ID NO: 330537 - RNA, 64 nt, hsa; identical to SEQ ID NO: 40999

SEQ ID NO: 330538 - RNA, 64 nt, hsa; identical to SEQ ID NO: 41000

SEQ ID NO: 330539 - RNA, 64 nt, hsa; identical to SEQ ID NO: 41001

SEQ ID NO: 330540 - RNA, 64 nt, hsa; identical to SEQ ID NO: 41002

SEQ ID NO: 330541 - RNA, 64 nt, hsa; identical to SEQ ID NO: 41003

SEQ ID NO: 330542 - RNA, 64 nt, hsa; identical to SEQ ID NO: 41004

SEQ ID NO: 330543 - RNA, 64 nt, hsa; identical to SEQ ID NO: 41005

SEQ ID NO: 330544 - RNA, 64 nt, hsa; identical to SEQ ID NO: 41006

SEQ ID NO: 330545 - RNA, 63 nt, hsa; identical to SEQ ID NO: 41007

SEQ ID NO: 330546 - RNA, 64 nt, hsa; identical to SEQ ID NO: 41008

SEQ ID NO: 330547 - RNA, 64 nt, hsa; identical to SEQ ID NO: 41009

SEQ ID NO: 330548 - RNA, 64 nt, hsa; identical to SEQ ID NO: 41010

SEQ ID NO: 330549 - RNA, 64 nt, hsa; identical to SEQ ID NO: 41011

SEQ ID NO: 330550 - RNA, 64 nt, hsa; identical to SEQ ID NO: 41012

SEQ ID NO: 330551 - RNA, 64 nt, hsa; identical to SEQ ID NO: 41013

SEQ ID NO: 330552 - RNA, 64 nt, hsa; identical to SEQ ID NO: 41014

SEQ ID NO: 330553 - RNA, 64 nt, hsa; identical to SEQ ID NO: 41015

SEQ ID NO: 330554 - RNA, 64 nt, hsa; identical to SEQ ID NO: 41016

SEQ ID NO: 330555 - RNA, 64 nt, hsa; identical to SEQ ID NO: 41017

SEQ ID NO: 330556 - RNA, 64 nt, hsa; identical to SEQ ID NO: 41018

SEQ ID NO: 330557 - RNA, 64 nt, hsa; identical to SEQ ID NO: 41019

SEQ ID NO: 330558 - RNA, 64 nt, hsa; identical to SEQ ID NO: 41020

SEQ ID NO: 330559 - RNA, 64 nt, hsa; identical to SEQ ID NO: 41021

SEQ ID NO: 330560 - RNA, 64 nt, hsa; identical to SEQ ID NO: 41022

SEQ ID NO: 330561 - RNA, 64 nt, hsa; identical to SEQ ID NO: 41023

SEQ ID NO: 330562 - RNA, 64 nt, hsa; identical to SEQ ID NO: 41024

SEQ ID NO: 330563 - RNA, 64 nt, hsa; identical to SEQ ID NO: 41025

SEQ ID NO: 330564 - RNA, 64 nt, hsa; identical to SEQ ID NO: 41026

SEQ ID NO: 330565 - RNA, 64 nt, hsa; identical to SEQ ID NO: 41027

SEQ ID NO: 330566 - RNA, 64 nt, hsa; identical to SEQ ID NO: 41028

SEQ ID NO: 330567 - RNA, 64 nt, hsa; identical to SEQ ID NO: 41029

SEQ ID NO: 330568 - RNA, 64 nt, hsa; identical to SEQ ID NO: 41030

SEQ ID NO: 330569 - RNA, 64 nt, hsa; identical to SEQ ID NO: 41031

SEQ ID NO: 330570 - RNA, 64 nt, hsa; identical to SEQ ID NO: 41032

SEQ ID NO: 330571 - RNA, 64 nt, hsa; identical to SEQ ID NO: 41033

SEQ ID NO: 330572 - RNA, 64 nt, hsa; identical to SEQ ID NO: 41034

SEQ ID NO: 330573 - RNA, 64 nt, hsa; identical to SEQ ID NO: 41035

SEQ ID NO: 330574 - RNA, 64 nt, hsa; identical to SEQ ID NO: 41036

SEQ ID NO: 330575 - RNA, 64 nt, hsa; identical to SEQ ID NO: 41037

SEQ ID NO: 330576 - RNA, 64 nt, hsa; identical to SEQ ID NO: 41038

SEQ ID NO: 330577 - RNA, 64 nt, hsa; identical to SEQ ID NO: 41039

SEQ ID NO: 330578 - RNA, 64 nt, hsa; identical to SEQ ID NO: 41040

SEQ ID NO: 330579 - RNA, 64 nt, hsa; identical to SEQ ID NO: 41041

SEQ ID NO: 330580 - RNA, 64 nt, hsa; identical to SEQ ID NO: 41042

SEQ ID NO: 330581 - RNA, 64 nt, hsa; identical to SEQ ID NO: 41043

SEQ ID NO: 330582 - RNA, 64 nt, hsa; identical to SEQ ID NO: 41044

SEQ ID NO: 330583 - RNA, 64 nt, hsa; identical to SEQ ID NO: 41045

SEQ ID NO: 330584 - RNA, 64 nt, hsa; identical to SEQ ID NO: 41046

SEQ ID NO: 330585 - RNA, 64 nt, hsa; identical to SEQ ID NO: 41047

SEQ ID NO: 330586 - RNA, 64 nt, hsa; identical to SEQ ID NO: 41048

SEQ ID NO: 330587 - RNA, 64 nt, hsa; identical to SEQ ID NO: 41049

SEQ ID NO: 330588 - RNA, 64 nt, hsa; identical to SEQ ID NO: 41050

SEQ ID NO: 330589 - RNA, 64 nt, hsa; identical to SEQ ID NO: 41051

SEQ ID NO: 330590 - RNA, 64 nt, hsa; identical to SEQ ID NO: 41052

SEQ ID NO: 330591 - RNA, 64 nt, hsa; identical to SEQ ID NO: 41053

SEQ ID NO: 330592 - RNA, 64 nt, hsa; identical to SEQ ID NO: 41054

SEQ ID NO: 330593 - RNA, 64 nt, hsa; identical to SEQ ID NO: 41055

SEQ ID NO: 330594 - RNA, 64 nt, hsa; identical to SEQ ID NO: 41056

SEQ ID NO: 330595 - RNA, 64 nt, hsa; identical to SEQ ID NO: 41057

SEQ ID NO: 330596 - RNA, 64 nt, hsa; identical to SEQ ID NO: 41058

SEQ ID NO: 330597 - RNA, 64 nt, hsa; identical to SEQ ID NO: 41059

SEQ ID NO: 330598 - RNA, 64 nt, hsa; identical to SEQ ID NO: 41060

SEQ ID NO: 330599 - RNA, 64 nt, hsa; identical to SEQ ID NO: 41061

SEQ ID NO: 330600 - RNA, 64 nt, hsa; identical to SEQ ID NO: 41062

SEQ ID NO: 330601 - RNA, 64 nt, hsa; identical to SEQ ID NO: 41063

SEQ ID NO: 330602 - RNA, 64 nt, hsa; identical to SEQ ID NO: 41064

SEQ ID NO: 330603 - RNA, 64 nt, hsa; identical to SEQ ID NO: 41065

SEQ ID NO: 330604 - RNA, 64 nt, hsa; identical to SEQ ID NO: 41066

SEQ ID NO: 330605 - RNA, 64 nt, hsa; identical to SEQ ID NO: 41067

SEQ ID NO: 330606 - RNA, 64 nt, hsa; identical to SEQ ID NO: 41068

SEQ ID NO: 330607 - RNA, 64 nt, hsa; identical to SEQ ID NO: 41069

SEQ ID NO: 330608 - RNA, 64 nt, hsa; identical to SEQ ID NO: 41070

SEQ ID NO: 330609 - RNA, 64 nt, hsa; identical to SEQ ID NO: 41071

SEQ ID NO: 330610 - RNA, 64 nt, hsa; identical to SEQ ID NO: 41072

SEQ ID NO: 330611 - RNA, 64 nt, hsa; identical to SEQ ID NO: 41073

SEQ ID NO: 330612 - RNA, 64 nt, hsa; identical to SEQ ID NO: 41074

SEQ ID NO: 330613 - RNA, 64 nt, hsa; identical to SEQ ID NO: 41075

SEQ ID NO: 330614 - RNA, 64 nt, hsa; identical to SEQ ID NO: 41076

SEQ ID NO: 330615 - RNA, 64 nt, hsa; identical to SEQ ID NO: 41077

SEQ ID NO: 330616 - RNA, 64 nt, hsa; identical to SEQ ID NO: 41078

SEQ ID NO: 330617 - RNA, 64 nt, hsa; identical to SEQ ID NO: 41079

SEQ ID NO: 330618 - RNA, 64 nt, hsa; identical to SEQ ID NO: 41080

SEQ ID NO: 330619 - RNA, 64 nt, hsa; identical to SEQ ID NO: 41081

SEQ ID NO: 330620 - RNA, 64 nt, hsa; identical to SEQ ID NO: 41082

SEQ ID NO: 330621 - RNA, 64 nt, hsa; identical to SEQ ID NO: 41083

SEQ ID NO: 330622 - RNA, 64 nt, hsa; identical to SEQ ID NO: 41084

SEQ ID NO: 330623 - RNA, 64 nt, hsa; identical to SEQ ID NO: 41085

SEQ ID NO: 330624 - RNA, 64 nt, hsa; identical to SEQ ID NO: 41086

SEQ ID NO: 330625 - RNA, 64 nt, hsa; identical to SEQ ID NO: 41087

SEQ ID NO: 330626 - RNA, 64 nt, hsa; identical to SEQ ID NO: 41088

SEQ ID NO: 330627 - RNA, 64 nt, hsa; identical to SEQ ID NO: 41089

SEQ ID NO: 330628 - RNA, 64 nt, hsa; identical to SEQ ID NO: 41090

SEQ ID NO: 330629 - RNA, 64 nt, hsa; identical to SEQ ID NO: 41091

SEQ ID NO: 330630 - RNA, 64 nt, hsa; identical to SEQ ID NO: 41092

SEQ ID NO: 330631 - RNA, 64 nt, hsa; identical to SEQ ID NO: 41093

SEQ ID NO: 330632 - RNA, 64 nt, hsa; identical to SEQ ID NO: 41094

SEQ ID NO: 330633 - RNA, 64 nt, hsa; identical to SEQ ID NO: 41095

SEQ ID NO: 330634 - RNA, 64 nt, hsa; identical to SEQ ID NO: 41096

SEQ ID NO: 330635 - RNA, 64 nt, hsa; identical to SEQ ID NO: 41097

SEQ ID NO: 330636 - RNA, 64 nt, hsa; identical to SEQ ID NO: 41098

SEQ ID NO: 330637 - RNA, 64 nt, hsa; identical to SEQ ID NO: 41099

SEQ ID NO: 330638 - RNA, 64 nt, hsa; identical to SEQ ID NO: 41100

SEQ ID NO: 330639 - RNA, 64 nt, hsa; identical to SEQ ID NO: 41101

SEQ ID NO: 330640 - RNA, 64 nt, hsa; identical to SEQ ID NO: 41102

SEQ ID NO: 330641 - RNA, 64 nt, hsa; identical to SEQ ID NO: 41103

SEQ ID NO: 330642 - RNA, 64 nt, hsa; identical to SEQ ID NO: 41104

SEQ ID NO: 330643 - RNA, 64 nt, hsa; identical to SEQ ID NO: 41105

SEQ ID NO: 330644 - RNA, 64 nt, hsa; identical to SEQ ID NO: 41106

SEQ ID NO: 330645 - RNA, 64 nt, hsa; identical to SEQ ID NO: 41107

SEQ ID NO: 330646 - RNA, 64 nt, hsa; identical to SEQ ID NO: 41108

SEQ ID NO: 330647 - RNA, 64 nt, hsa; identical to SEQ ID NO: 41109

SEQ ID NO: 330648 - RNA, 64 nt, hsa; identical to SEQ ID NO: 41110

SEQ ID NO: 330649 - RNA, 64 nt, hsa; identical to SEQ ID NO: 41111

SEQ ID NO: 330650 - RNA, 64 nt, hsa; identical to SEQ ID NO: 41112

SEQ ID NO: 330651 - RNA, 64 nt, hsa; identical to SEQ ID NO: 41113

SEQ ID NO: 330652 - RNA, 64 nt, hsa; identical to SEQ ID NO: 41114

SEQ ID NO: 330653 - RNA, 64 nt, hsa; identical to SEQ ID NO: 41115

SEQ ID NO: 330654 - RNA, 64 nt, hsa; identical to SEQ ID NO: 41116

SEQ ID NO: 330655 - RNA, 64 nt, hsa; identical to SEQ ID NO: 41117

SEQ ID NO: 330656 - RNA, 64 nt, hsa; identical to SEQ ID NO: 41118

SEQ ID NO: 330657 - RNA, 64 nt, hsa; identical to SEQ ID NO: 41119

SEQ ID NO: 330658 - RNA, 64 nt, hsa; identical to SEQ ID NO: 41120

SEQ ID NO: 330659 - RNA, 64 nt, hsa; identical to SEQ ID NO: 41121

SEQ ID NO: 330660 - RNA, 64 nt, hsa; identical to SEQ ID NO: 41122

SEQ ID NO: 330661 - RNA, 64 nt, hsa; identical to SEQ ID NO: 41123

SEQ ID NO: 330662 - RNA, 64 nt, hsa; identical to SEQ ID NO: 41124

SEQ ID NO: 330663 - RNA, 64 nt, hsa; identical to SEQ ID NO: 41125

SEQ ID NO: 330664 - RNA, 64 nt, hsa; identical to SEQ ID NO: 41126

SEQ ID NO: 330665 - RNA, 64 nt, hsa; identical to SEQ ID NO: 41127

SEQ ID NO: 330666 - RNA, 64 nt, hsa; identical to SEQ ID NO: 41128

SEQ ID NO: 330667 - RNA, 64 nt, hsa; identical to SEQ ID NO: 41129

SEQ ID NO: 330668 - RNA, 64 nt, hsa; identical to SEQ ID NO: 41130

SEQ ID NO: 330669 - RNA, 64 nt, hsa; identical to SEQ ID NO: 41131

SEQ ID NO: 330670 - RNA, 64 nt, hsa; identical to SEQ ID NO: 41132

SEQ ID NO: 330671 - RNA, 64 nt, hsa; identical to SEQ ID NO: 41133

SEQ ID NO: 330672 - RNA, 64 nt, hsa; identical to SEQ ID NO: 41134

SEQ ID NO: 330673 - RNA, 64 nt, hsa; identical to SEQ ID NO: 41135

SEQ ID NO: 330674 - RNA, 64 nt, hsa; identical to SEQ ID NO: 41136

SEQ ID NO: 330675 - RNA, 64 nt, hsa; identical to SEQ ID NO: 41137

SEQ ID NO: 330676 - RNA, 64 nt, hsa; identical to SEQ ID NO: 41138

SEQ ID NO: 330677 - RNA, 64 nt, hsa; identical to SEQ ID NO: 41139

SEQ ID NO: 330678 - RNA, 64 nt, hsa; identical to SEQ ID NO: 41140

SEQ ID NO: 330679 - RNA, 64 nt, hsa; identical to SEQ ID NO: 41141

SEQ ID NO: 330680 - RNA, 64 nt, hsa; identical to SEQ ID NO: 41142

SEQ ID NO: 330681 - RNA, 64 nt, hsa; identical to SEQ ID NO: 41143

SEQ ID NO: 330682 - RNA, 64 nt, hsa; identical to SEQ ID NO: 41144

SEQ ID NO: 330683 - RNA, 64 nt, hsa; identical to SEQ ID NO: 41145

SEQ ID NO: 330684 - RNA, 64 nt, hsa; identical to SEQ ID NO: 41146

SEQ ID NO: 330685 - RNA, 64 nt, hsa; identical to SEQ ID NO: 41147

SEQ ID NO: 330686 - RNA, 64 nt, hsa; identical to SEQ ID NO: 41148

SEQ ID NO: 330687 - RNA, 64 nt, hsa; identical to SEQ ID NO: 41149

SEQ ID NO: 330688 - RNA, 64 nt, hsa; identical to SEQ ID NO: 41150

SEQ ID NO: 330689 - RNA, 64 nt, hsa; identical to SEQ ID NO: 41151

SEQ ID NO: 330690 - RNA, 64 nt, hsa; identical to SEQ ID NO: 41152

SEQ ID NO: 330691 - RNA, 64 nt, hsa; identical to SEQ ID NO: 41153

SEQ ID NO: 330692 - RNA, 64 nt, hsa; identical to SEQ ID NO: 41154

SEQ ID NO: 330693 - RNA, 64 nt, hsa; identical to SEQ ID NO: 41155

SEQ ID NO: 330694 - RNA, 64 nt, hsa; identical to SEQ ID NO: 41156

SEQ ID NO: 330695 - RNA, 64 nt, hsa; identical to SEQ ID NO: 41157

SEQ ID NO: 330696 - RNA, 64 nt, hsa; identical to SEQ ID NO: 41158

SEQ ID NO: 330697 - RNA, 64 nt, hsa; identical to SEQ ID NO: 41159

SEQ ID NO: 330698 - RNA, 64 nt, hsa; identical to SEQ ID NO: 41160

SEQ ID NO: 330699 - RNA, 64 nt, hsa; identical to SEQ ID NO: 41161

SEQ ID NO: 330700 - RNA, 64 nt, hsa; identical to SEQ ID NO: 41162

SEQ ID NO: 330701 - RNA, 64 nt, hsa; identical to SEQ ID NO: 41163

SEQ ID NO: 330702 - RNA, 64 nt, hsa; identical to SEQ ID NO: 41164

SEQ ID NO: 330703 - RNA, 64 nt, hsa; identical to SEQ ID NO: 41165

SEQ ID NO: 330704 - RNA, 64 nt, hsa; identical to SEQ ID NO: 41166

SEQ ID NO: 330705 - RNA, 64 nt, hsa; identical to SEQ ID NO: 41167

SEQ ID NO: 330706 - RNA, 64 nt, hsa; identical to SEQ ID NO: 41168

SEQ ID NO: 330707 - RNA, 64 nt, hsa; identical to SEQ ID NO: 41169

SEQ ID NO: 330708 - RNA, 64 nt, hsa; identical to SEQ ID NO: 41170

SEQ ID NO: 330709 - RNA, 64 nt, hsa; identical to SEQ ID NO: 41171

SEQ ID NO: 330710 - RNA, 64 nt, hsa; identical to SEQ ID NO: 41172

SEQ ID NO: 330711 - RNA, 64 nt, hsa; identical to SEQ ID NO: 41173

SEQ ID NO: 330712 - RNA, 64 nt, hsa; identical to SEQ ID NO: 41174

SEQ ID NO: 330713 - RNA, 64 nt, hsa; identical to SEQ ID NO: 41175

SEQ ID NO: 330714 - RNA, 64 nt, hsa; identical to SEQ ID NO: 41176

SEQ ID NO: 330715 - RNA, 64 nt, hsa; identical to SEQ ID NO: 41177

SEQ ID NO: 330716 - RNA, 64 nt, hsa; identical to SEQ ID NO: 41178

SEQ ID NO: 330717 - RNA, 64 nt, hsa; identical to SEQ ID NO: 41179

SEQ ID NO: 330718 - RNA, 64 nt, hsa; identical to SEQ ID NO: 41180

SEQ ID NO: 330719 - RNA, 64 nt, hsa; identical to SEQ ID NO: 41181

SEQ ID NO: 330720 - RNA, 64 nt, hsa; identical to SEQ ID NO: 41182

SEQ ID NO: 330721 - RNA, 64 nt, hsa; identical to SEQ ID NO: 41183

SEQ ID NO: 330722 - RNA, 64 nt, hsa; identical to SEQ ID NO: 41184

SEQ ID NO: 330723 - RNA, 64 nt, hsa; identical to SEQ ID NO: 41185

SEQ ID NO: 330724 - RNA, 64 nt, hsa; identical to SEQ ID NO: 41186

SEQ ID NO: 330725 - RNA, 64 nt, hsa; identical to SEQ ID NO: 41187

SEQ ID NO: 330726 - RNA, 64 nt, hsa; identical to SEQ ID NO: 41188

SEQ ID NO: 330727 - RNA, 64 nt, hsa; identical to SEQ ID NO: 41189

SEQ ID NO: 330728 - RNA, 64 nt, hsa; identical to SEQ ID NO: 41190

SEQ ID NO: 330729 - RNA, 64 nt, hsa; identical to SEQ ID NO: 41191

SEQ ID NO: 330730 - RNA, 64 nt, hsa; identical to SEQ ID NO: 41192

SEQ ID NO: 330731 - RNA, 64 nt, hsa; identical to SEQ ID NO: 41193

SEQ ID NO: 330732 - RNA, 64 nt, hsa; identical to SEQ ID NO: 41194

SEQ ID NO: 330733 - RNA, 64 nt, hsa; identical to SEQ ID NO: 41195

SEQ ID NO: 330734 - RNA, 64 nt, hsa; identical to SEQ ID NO: 41196

SEQ ID NO: 330735 - RNA, 64 nt, hsa; identical to SEQ ID NO: 41197

SEQ ID NO: 330736 - RNA, 64 nt, hsa; identical to SEQ ID NO: 41198

SEQ ID NO: 330737 - RNA, 64 nt, hsa; identical to SEQ ID NO: 41199

SEQ ID NO: 330738 - RNA, 64 nt, hsa; identical to SEQ ID NO: 41200

SEQ ID NO: 330739 - RNA, 64 nt, hsa; identical to SEQ ID NO: 41201

SEQ ID NO: 330740 - RNA, 64 nt, hsa; identical to SEQ ID NO: 41202

SEQ ID NO: 330741 - RNA, 64 nt, hsa; identical to SEQ ID NO: 41203

SEQ ID NO: 330742 - RNA, 64 nt, hsa; identical to SEQ ID NO: 41204

SEQ ID NO: 330743 - RNA, 64 nt, hsa; identical to SEQ ID NO: 41205

SEQ ID NO: 330744 - RNA, 64 nt, hsa; identical to SEQ ID NO: 41206

SEQ ID NO: 330745 - RNA, 64 nt, hsa; identical to SEQ ID NO: 41207

SEQ ID NO: 330746 - RNA, 64 nt, hsa; identical to SEQ ID NO: 41208

SEQ ID NO: 330747 - RNA, 64 nt, hsa; identical to SEQ ID NO: 41209

SEQ ID NO: 330748 - RNA, 64 nt, hsa; identical to SEQ ID NO: 41210

SEQ ID NO: 330749 - RNA, 64 nt, hsa; identical to SEQ ID NO: 41211

SEQ ID NO: 330750 - RNA, 64 nt, hsa; identical to SEQ ID NO: 41212

SEQ ID NO: 330751 - RNA, 64 nt, hsa; identical to SEQ ID NO: 41213

SEQ ID NO: 330752 - RNA, 64 nt, hsa; identical to SEQ ID NO: 41214

SEQ ID NO: 330753 - RNA, 64 nt, hsa; identical to SEQ ID NO: 41215

SEQ ID NO: 330754 - RNA, 64 nt, hsa; identical to SEQ ID NO: 41216

SEQ ID NO: 330755 - RNA, 64 nt, hsa; identical to SEQ ID NO: 41217

SEQ ID NO: 330756 - RNA, 64 nt, hsa; identical to SEQ ID NO: 41218

SEQ ID NO: 330757 - RNA, 64 nt, hsa; identical to SEQ ID NO: 41219

SEQ ID NO: 330758 - RNA, 64 nt, hsa; identical to SEQ ID NO: 41220

SEQ ID NO: 330759 - RNA, 64 nt, hsa; identical to SEQ ID NO: 41221

SEQ ID NO: 330760 - RNA, 64 nt, hsa; identical to SEQ ID NO: 41222

SEQ ID NO: 330761 - RNA, 64 nt, hsa; identical to SEQ ID NO: 41223

SEQ ID NO: 330762 - RNA, 64 nt, hsa; identical to SEQ ID NO: 41224

SEQ ID NO: 330763 - RNA, 64 nt, hsa; identical to SEQ ID NO: 41225

SEQ ID NO: 330764 - RNA, 64 nt, hsa; identical to SEQ ID NO: 41226

SEQ ID NO: 330765 - RNA, 64 nt, hsa; identical to SEQ ID NO: 41227

SEQ ID NO: 330766 - RNA, 64 nt, hsa; identical to SEQ ID NO: 41228

SEQ ID NO: 330767 - RNA, 64 nt, hsa; identical to SEQ ID NO: 41229

SEQ ID NO: 330768 - RNA, 64 nt, hsa; identical to SEQ ID NO: 41230

SEQ ID NO: 330769 - RNA, 64 nt, hsa; identical to SEQ ID NO: 41231

SEQ ID NO: 330770 - RNA, 64 nt, hsa; identical to SEQ ID NO: 41232

SEQ ID NO: 330771 - RNA, 64 nt, hsa; identical to SEQ ID NO: 41233

SEQ ID NO: 330772 - RNA, 64 nt, hsa; identical to SEQ ID NO: 41234

SEQ ID NO: 330773 - RNA, 64 nt, hsa; identical to SEQ ID NO: 41235

SEQ ID NO: 330774 - RNA, 62 nt, hsa; identical to SEQ ID NO: 41236

SEQ ID NO: 330775 - RNA, 60 nt, hsa; identical to SEQ ID NO: 41237

SEQ ID NO: 330776 - RNA, 58 nt, hsa; identical to SEQ ID NO: 41238

SEQ ID NO: 330777 - RNA, 56 nt, hsa; identical to SEQ ID NO: 41239

SEQ ID NO: 330778 - RNA, 54 nt, hsa; identical to SEQ ID NO: 41240

SEQ ID NO: 330779 - RNA, 64 nt, hsa; identical to SEQ ID NO: 41241

SEQ ID NO: 330780 - RNA, 64 nt, hsa; identical to SEQ ID NO: 41242

SEQ ID NO: 330781 - RNA, 64 nt, hsa; identical to SEQ ID NO: 41243

SEQ ID NO: 330782 - RNA, 64 nt, hsa; identical to SEQ ID NO: 41244

SEQ ID NO: 330783 - RNA, 64 nt, hsa; identical to SEQ ID NO: 41245

SEQ ID NO: 330784 - RNA, 64 nt, hsa; identical to SEQ ID NO: 41246

SEQ ID NO: 330785 - RNA, 64 nt, hsa; identical to SEQ ID NO: 41247

SEQ ID NO: 330786 - RNA, 64 nt, hsa; identical to SEQ ID NO: 41248

SEQ ID NO: 330787 - RNA, 64 nt, hsa; identical to SEQ ID NO: 41249

SEQ ID NO: 330788 - RNA, 64 nt, hsa; identical to SEQ ID NO: 41250

SEQ ID NO: 330789 - RNA, 64 nt, hsa; identical to SEQ ID NO: 41251

SEQ ID NO: 330790 - RNA, 64 nt, hsa; identical to SEQ ID NO: 41252

SEQ ID NO: 330791 - RNA, 64 nt, hsa; identical to SEQ ID NO: 41253

SEQ ID NO: 330792 - RNA, 64 nt, hsa; identical to SEQ ID NO: 41254

SEQ ID NO: 330793 - RNA, 64 nt, hsa; identical to SEQ ID NO: 41255

SEQ ID NO: 330794 - RNA, 64 nt, hsa; identical to SEQ ID NO: 41256

SEQ ID NO: 330795 - RNA, 64 nt, hsa; identical to SEQ ID NO: 41257

SEQ ID NO: 330796 - RNA, 64 nt, hsa; identical to SEQ ID NO: 41258

SEQ ID NO: 330797 - RNA, 64 nt, hsa; identical to SEQ ID NO: 41259

SEQ ID NO: 330798 - RNA, 64 nt, hsa; identical to SEQ ID NO: 41260

SEQ ID NO: 330799 - RNA, 64 nt, hsa; identical to SEQ ID NO: 41261

SEQ ID NO: 330800 - RNA, 64 nt, hsa; identical to SEQ ID NO: 41262

SEQ ID NO: 330801 - RNA, 64 nt, hsa; identical to SEQ ID NO: 41263

SEQ ID NO: 330802 - RNA, 64 nt, hsa; identical to SEQ ID NO: 41264

SEQ ID NO: 330803 - RNA, 64 nt, hsa; identical to SEQ ID NO: 41265

SEQ ID NO: 330804 - RNA, 64 nt, hsa; identical to SEQ ID NO: 41266

SEQ ID NO: 330805 - RNA, 64 nt, hsa; identical to SEQ ID NO: 41267

SEQ ID NO: 330806 - RNA, 64 nt, hsa; identical to SEQ ID NO: 41268

SEQ ID NO: 330807 - RNA, 64 nt, hsa; identical to SEQ ID NO: 41269

SEQ ID NO: 330808 - RNA, 64 nt, hsa; identical to SEQ ID NO: 41270

SEQ ID NO: 330809 - RNA, 64 nt, hsa; identical to SEQ ID NO: 41271

SEQ ID NO: 330810 - RNA, 64 nt, hsa; identical to SEQ ID NO: 41272

SEQ ID NO: 330811 - RNA, 64 nt, hsa; identical to SEQ ID NO: 41273

SEQ ID NO: 330812 - RNA, 64 nt, hsa; identical to SEQ ID NO: 41274

SEQ ID NO: 330813 - RNA, 64 nt, hsa; identical to SEQ ID NO: 41275

SEQ ID NO: 330814 - RNA, 64 nt, hsa; identical to SEQ ID NO: 41276

SEQ ID NO: 330815 - RNA, 64 nt, hsa; identical to SEQ ID NO: 41277

SEQ ID NO: 330816 - RNA, 64 nt, hsa; identical to SEQ ID NO: 41278

SEQ ID NO: 330817 - RNA, 64 nt, hsa; identical to SEQ ID NO: 41279

SEQ ID NO: 330818 - RNA, 64 nt, hsa; identical to SEQ ID NO: 41280

SEQ ID NO: 330819 - RNA, 64 nt, hsa; identical to SEQ ID NO: 41281

SEQ ID NO: 330820 - RNA, 64 nt, hsa; identical to SEQ ID NO: 41282

SEQ ID NO: 330821 - RNA, 64 nt, hsa; identical to SEQ ID NO: 41283

SEQ ID NO: 330822 - RNA, 64 nt, hsa; identical to SEQ ID NO: 41284

SEQ ID NO: 330823 - RNA, 64 nt, hsa; identical to SEQ ID NO: 41285

SEQ ID NO: 330824 - RNA, 64 nt, hsa; identical to SEQ ID NO: 41286

SEQ ID NO: 330825 - RNA, 64 nt, hsa; identical to SEQ ID NO: 41287

SEQ ID NO: 330826 - RNA, 64 nt, hsa; identical to SEQ ID NO: 41288

SEQ ID NO: 330827 - RNA, 64 nt, hsa; identical to SEQ ID NO: 41289

SEQ ID NO: 330828 - RNA, 64 nt, hsa; identical to SEQ ID NO: 41290

SEQ ID NO: 330829 - RNA, 64 nt, hsa; identical to SEQ ID NO: 41291

SEQ ID NO: 330830 - RNA, 64 nt, hsa; identical to SEQ ID NO: 41292

SEQ ID NO: 330831 - RNA, 64 nt, hsa; identical to SEQ ID NO: 41293

SEQ ID NO: 330832 - RNA, 64 nt, hsa; identical to SEQ ID NO: 41294

SEQ ID NO: 330833 - RNA, 64 nt, hsa; identical to SEQ ID NO: 41295

SEQ ID NO: 330834 - RNA, 64 nt, hsa; identical to SEQ ID NO: 41296

SEQ ID NO: 330835 - RNA, 64 nt, hsa; identical to SEQ ID NO: 41297

SEQ ID NO: 330836 - RNA, 64 nt, hsa; identical to SEQ ID NO: 41298

SEQ ID NO: 330837 - RNA, 64 nt, hsa; identical to SEQ ID NO: 41299

SEQ ID NO: 330838 - RNA, 64 nt, hsa; identical to SEQ ID NO: 41300

SEQ ID NO: 330839 - RNA, 64 nt, hsa; identical to SEQ ID NO: 41301

SEQ ID NO: 330840 - RNA, 64 nt, hsa; identical to SEQ ID NO: 41302

SEQ ID NO: 330841 - RNA, 64 nt, hsa; identical to SEQ ID NO: 41303

SEQ ID NO: 330842 - RNA, 64 nt, hsa; identical to SEQ ID NO: 41304

SEQ ID NO: 330843 - RNA, 64 nt, hsa; identical to SEQ ID NO: 41305

SEQ ID NO: 330844 - RNA, 64 nt, hsa; identical to SEQ ID NO: 41306

SEQ ID NO: 330845 - RNA, 64 nt, hsa; identical to SEQ ID NO: 41307

SEQ ID NO: 330846 - RNA, 64 nt, hsa; identical to SEQ ID NO: 41308

SEQ ID NO: 330847 - RNA, 64 nt, hsa; identical to SEQ ID NO: 41309

SEQ ID NO: 330848 - RNA, 64 nt, hsa; identical to SEQ ID NO: 41310

SEQ ID NO: 330849 - RNA, 64 nt, hsa; identical to SEQ ID NO: 41311

SEQ ID NO: 330850 - RNA, 64 nt, hsa; identical to SEQ ID NO: 41312

SEQ ID NO: 330851 - RNA, 64 nt, hsa; identical to SEQ ID NO: 41313

SEQ ID NO: 330852 - RNA, 64 nt, hsa; identical to SEQ ID NO: 41314

SEQ ID NO: 330853 - RNA, 64 nt, hsa; identical to SEQ ID NO: 41315

SEQ ID NO: 330854 - RNA, 64 nt, hsa; identical to SEQ ID NO: 41316

SEQ ID NO: 330855 - RNA, 64 nt, hsa; identical to SEQ ID NO: 41317

SEQ ID NO: 330856 - RNA, 64 nt, hsa; identical to SEQ ID NO: 41318

SEQ ID NO: 330857 - RNA, 64 nt, hsa; identical to SEQ ID NO: 41319

SEQ ID NO: 330858 - RNA, 64 nt, hsa; identical to SEQ ID NO: 41320

SEQ ID NO: 330859 - RNA, 64 nt, hsa; identical to SEQ ID NO: 41321

SEQ ID NO: 330860 - RNA, 64 nt, hsa; identical to SEQ ID NO: 41322

SEQ ID NO: 330861 - RNA, 64 nt, hsa; identical to SEQ ID NO: 41323

SEQ ID NO: 330862 - RNA, 64 nt, hsa; identical to SEQ ID NO: 41324

SEQ ID NO: 330863 - RNA, 64 nt, hsa; identical to SEQ ID NO: 41325

SEQ ID NO: 330864 - RNA, 64 nt, hsa; identical to SEQ ID NO: 41326

SEQ ID NO: 330865 - RNA, 64 nt, hsa; identical to SEQ ID NO: 41327

SEQ ID NO: 330866 - RNA, 64 nt, hsa; identical to SEQ ID NO: 41328

SEQ ID NO: 330867 - RNA, 64 nt, hsa; identical to SEQ ID NO: 41329

SEQ ID NO: 330868 - RNA, 64 nt, hsa; identical to SEQ ID NO: 41330

SEQ ID NO: 330869 - RNA, 64 nt, hsa; identical to SEQ ID NO: 41331

SEQ ID NO: 330870 - RNA, 64 nt, hsa; identical to SEQ ID NO: 41332

SEQ ID NO: 330871 - RNA, 64 nt, hsa; identical to SEQ ID NO: 41333

SEQ ID NO: 330872 - RNA, 64 nt, hsa; identical to SEQ ID NO: 41334

SEQ ID NO: 330873 - RNA, 64 nt, hsa; identical to SEQ ID NO: 41335

SEQ ID NO: 330874 - RNA, 64 nt, hsa; identical to SEQ ID NO: 41336

SEQ ID NO: 330875 - RNA, 64 nt, hsa; identical to SEQ ID NO: 41337

SEQ ID NO: 330876 - RNA, 64 nt, hsa; identical to SEQ ID NO: 41338

SEQ ID NO: 330877 - RNA, 64 nt, hsa; identical to SEQ ID NO: 41339

SEQ ID NO: 330878 - RNA, 64 nt, hsa; identical to SEQ ID NO: 41340

SEQ ID NO: 330879 - RNA, 64 nt, hsa; identical to SEQ ID NO: 41341

SEQ ID NO: 330880 - RNA, 64 nt, hsa; identical to SEQ ID NO: 41342

SEQ ID NO: 330881 - RNA, 64 nt, hsa; identical to SEQ ID NO: 41343

SEQ ID NO: 330882 - RNA, 64 nt, hsa; identical to SEQ ID NO: 41344

SEQ ID NO: 330883 - RNA, 64 nt, hsa; identical to SEQ ID NO: 41345

SEQ ID NO: 330884 - RNA, 64 nt, hsa; identical to SEQ ID NO: 41346

SEQ ID NO: 330885 - RNA, 64 nt, hsa; identical to SEQ ID NO: 41347

SEQ ID NO: 330886 - RNA, 64 nt, hsa; identical to SEQ ID NO: 41348

SEQ ID NO: 330887 - RNA, 64 nt, hsa; identical to SEQ ID NO: 41349

SEQ ID NO: 330888 - RNA, 64 nt, hsa; identical to SEQ ID NO: 41350

SEQ ID NO: 330889 - RNA, 64 nt, hsa; identical to SEQ ID NO: 41351

SEQ ID NO: 330890 - RNA, 64 nt, hsa; identical to SEQ ID NO: 41352

SEQ ID NO: 330891 - RNA, 64 nt, hsa; identical to SEQ ID NO: 41353

SEQ ID NO: 330892 - RNA, 64 nt, hsa; identical to SEQ ID NO: 41354

SEQ ID NO: 330893 - RNA, 64 nt, hsa; identical to SEQ ID NO: 41355

SEQ ID NO: 330894 - RNA, 64 nt, hsa; identical to SEQ ID NO: 41356

SEQ ID NO: 330895 - RNA, 64 nt, hsa; identical to SEQ ID NO: 41357

SEQ ID NO: 330896 - RNA, 64 nt, hsa; identical to SEQ ID NO: 41358

SEQ ID NO: 330897 - RNA, 64 nt, hsa; identical to SEQ ID NO: 41359

SEQ ID NO: 330898 - RNA, 64 nt, hsa; identical to SEQ ID NO: 41360

SEQ ID NO: 330899 - RNA, 64 nt, hsa; identical to SEQ ID NO: 41361

SEQ ID NO: 330900 - RNA, 64 nt, hsa; identical to SEQ ID NO: 41362

SEQ ID NO: 330901 - RNA, 64 nt, hsa; identical to SEQ ID NO: 41363

SEQ ID NO: 330902 - RNA, 64 nt, hsa; identical to SEQ ID NO: 41364

SEQ ID NO: 330903 - RNA, 64 nt, hsa; identical to SEQ ID NO: 41365

SEQ ID NO: 330904 - RNA, 64 nt, hsa; identical to SEQ ID NO: 41366

SEQ ID NO: 330905 - RNA, 64 nt, hsa; identical to SEQ ID NO: 41367

SEQ ID NO: 330906 - RNA, 64 nt, hsa; identical to SEQ ID NO: 41368

SEQ ID NO: 330907 - RNA, 64 nt, hsa; identical to SEQ ID NO: 41369

SEQ ID NO: 330908 - RNA, 64 nt, hsa; identical to SEQ ID NO: 41370

SEQ ID NO: 330909 - RNA, 64 nt, hsa; identical to SEQ ID NO: 41371

SEQ ID NO: 330910 - RNA, 64 nt, hsa; identical to SEQ ID NO: 41372

SEQ ID NO: 330911 - RNA, 64 nt, hsa; identical to SEQ ID NO: 41373

SEQ ID NO: 330912 - RNA, 64 nt, hsa; identical to SEQ ID NO: 41374

SEQ ID NO: 330913 - RNA, 64 nt, hsa; identical to SEQ ID NO: 41375

SEQ ID NO: 330914 - RNA, 64 nt, hsa; identical to SEQ ID NO: 41376

SEQ ID NO: 330915 - RNA, 64 nt, hsa; identical to SEQ ID NO: 41377

SEQ ID NO: 330916 - RNA, 64 nt, hsa; identical to SEQ ID NO: 41378

SEQ ID NO: 330917 - RNA, 64 nt, hsa; identical to SEQ ID NO: 41379

SEQ ID NO: 330918 - RNA, 64 nt, hsa; identical to SEQ ID NO: 41380

SEQ ID NO: 330919 - RNA, 64 nt, hsa; identical to SEQ ID NO: 41381

SEQ ID NO: 330920 - RNA, 64 nt, hsa; identical to SEQ ID NO: 41382

SEQ ID NO: 330921 - RNA, 64 nt, hsa; identical to SEQ ID NO: 41383

SEQ ID NO: 330922 - RNA, 64 nt, hsa; identical to SEQ ID NO: 41384

SEQ ID NO: 330923 - RNA, 64 nt, hsa; identical to SEQ ID NO: 41385

SEQ ID NO: 330924 - RNA, 64 nt, hsa; identical to SEQ ID NO: 41386

SEQ ID NO: 330925 - RNA, 64 nt, hsa; identical to SEQ ID NO: 41387

SEQ ID NO: 330926 - RNA, 64 nt, hsa; identical to SEQ ID NO: 41388

SEQ ID NO: 330927 - RNA, 64 nt, hsa; identical to SEQ ID NO: 41389

SEQ ID NO: 330928 - RNA, 64 nt, hsa; identical to SEQ ID NO: 41390

SEQ ID NO: 330929 - RNA, 64 nt, hsa; identical to SEQ ID NO: 41391

SEQ ID NO: 330930 - RNA, 64 nt, hsa; identical to SEQ ID NO: 41392

SEQ ID NO: 330931 - RNA, 64 nt, hsa; identical to SEQ ID NO: 41393

SEQ ID NO: 330932 - RNA, 64 nt, hsa; identical to SEQ ID NO: 41394

SEQ ID NO: 330933 - RNA, 64 nt, hsa; identical to SEQ ID NO: 41395

SEQ ID NO: 330934 - RNA, 64 nt, hsa; identical to SEQ ID NO: 41396

SEQ ID NO: 330935 - RNA, 64 nt, hsa; identical to SEQ ID NO: 41397

SEQ ID NO: 330936 - RNA, 64 nt, hsa; identical to SEQ ID NO: 41398

SEQ ID NO: 330937 - RNA, 64 nt, hsa; identical to SEQ ID NO: 41399

SEQ ID NO: 330938 - RNA, 64 nt, hsa; identical to SEQ ID NO: 41400

SEQ ID NO: 330939 - RNA, 64 nt, hsa; identical to SEQ ID NO: 41401

SEQ ID NO: 330940 - RNA, 64 nt, hsa; identical to SEQ ID NO: 41402

SEQ ID NO: 330941 - RNA, 64 nt, hsa; identical to SEQ ID NO: 41403

SEQ ID NO: 330942 - RNA, 64 nt, hsa; identical to SEQ ID NO: 41404

SEQ ID NO: 330943 - RNA, 64 nt, hsa; identical to SEQ ID NO: 41405

SEQ ID NO: 330944 - RNA, 64 nt, hsa; identical to SEQ ID NO: 41406

SEQ ID NO: 330945 - RNA, 64 nt, hsa; identical to SEQ ID NO: 41407

SEQ ID NO: 330946 - RNA, 64 nt, hsa; identical to SEQ ID NO: 41408

SEQ ID NO: 330947 - RNA, 64 nt, hsa; identical to SEQ ID NO: 41409

SEQ ID NO: 330948 - RNA, 64 nt, hsa; identical to SEQ ID NO: 41410

SEQ ID NO: 330949 - RNA, 64 nt, hsa; identical to SEQ ID NO: 41411

SEQ ID NO: 330950 - RNA, 64 nt, hsa; identical to SEQ ID NO: 41412

SEQ ID NO: 330951 - RNA, 64 nt, hsa; identical to SEQ ID NO: 41413

SEQ ID NO: 330952 - RNA, 64 nt, hsa; identical to SEQ ID NO: 41414

SEQ ID NO: 330953 - RNA, 64 nt, hsa; identical to SEQ ID NO: 41415

SEQ ID NO: 330954 - RNA, 64 nt, hsa; identical to SEQ ID NO: 41416

SEQ ID NO: 330955 - RNA, 64 nt, hsa; identical to SEQ ID NO: 41417

SEQ ID NO: 330956 - RNA, 64 nt, hsa; identical to SEQ ID NO: 41418

SEQ ID NO: 330957 - RNA, 64 nt, hsa; identical to SEQ ID NO: 41419

SEQ ID NO: 330958 - RNA, 64 nt, hsa; identical to SEQ ID NO: 41420

SEQ ID NO: 330959 - RNA, 64 nt, hsa; identical to SEQ ID NO: 41421

SEQ ID NO: 330960 - RNA, 64 nt, hsa; identical to SEQ ID NO: 41422

SEQ ID NO: 330961 - RNA, 64 nt, hsa; identical to SEQ ID NO: 41423

SEQ ID NO: 330962 - RNA, 64 nt, hsa; identical to SEQ ID NO: 41424

SEQ ID NO: 330963 - RNA, 64 nt, hsa; identical to SEQ ID NO: 41425

SEQ ID NO: 330964 - RNA, 64 nt, hsa; identical to SEQ ID NO: 41426

SEQ ID NO: 330965 - RNA, 64 nt, hsa; identical to SEQ ID NO: 41427

SEQ ID NO: 330966 - RNA, 64 nt, hsa; identical to SEQ ID NO: 41428

SEQ ID NO: 330967 - RNA, 64 nt, hsa; identical to SEQ ID NO: 41429

SEQ ID NO: 330968 - RNA, 64 nt, hsa; identical to SEQ ID NO: 41430

SEQ ID NO: 330969 - RNA, 64 nt, hsa; identical to SEQ ID NO: 41431

SEQ ID NO: 330970 - RNA, 64 nt, hsa; identical to SEQ ID NO: 41432

SEQ ID NO: 330971 - RNA, 64 nt, hsa; identical to SEQ ID NO: 41433

SEQ ID NO: 330972 - RNA, 64 nt, hsa; identical to SEQ ID NO: 41434

SEQ ID NO: 330973 - RNA, 64 nt, hsa; identical to SEQ ID NO: 41435

SEQ ID NO: 330974 - RNA, 64 nt, hsa; identical to SEQ ID NO: 41436

SEQ ID NO: 330975 - RNA, 64 nt, hsa; identical to SEQ ID NO: 41437

SEQ ID NO: 330976 - RNA, 64 nt, hsa; identical to SEQ ID NO: 41438

SEQ ID NO: 330977 - RNA, 64 nt, hsa; identical to SEQ ID NO: 41439

SEQ ID NO: 330978 - RNA, 64 nt, hsa; identical to SEQ ID NO: 41440

SEQ ID NO: 330979 - RNA, 64 nt, hsa; identical to SEQ ID NO: 41441

SEQ ID NO: 330980 - RNA, 64 nt, hsa; identical to SEQ ID NO: 41442

SEQ ID NO: 330981 - RNA, 64 nt, hsa; identical to SEQ ID NO: 41443

SEQ ID NO: 330982 - RNA, 64 nt, hsa; identical to SEQ ID NO: 41444

SEQ ID NO: 330983 - RNA, 64 nt, hsa; identical to SEQ ID NO: 41445

SEQ ID NO: 330984 - RNA, 64 nt, hsa; identical to SEQ ID NO: 41446

SEQ ID NO: 330985 - RNA, 64 nt, hsa; identical to SEQ ID NO: 41447

SEQ ID NO: 330986 - RNA, 64 nt, hsa; identical to SEQ ID NO: 41448

SEQ ID NO: 330987 - RNA, 64 nt, hsa; identical to SEQ ID NO: 41449

SEQ ID NO: 330988 - RNA, 64 nt, hsa; identical to SEQ ID NO: 41450

SEQ ID NO: 330989 - RNA, 64 nt, hsa; identical to SEQ ID NO: 41451

SEQ ID NO: 330990 - RNA, 64 nt, hsa; identical to SEQ ID NO: 41452

SEQ ID NO: 330991 - RNA, 64 nt, hsa; identical to SEQ ID NO: 41453

SEQ ID NO: 330992 - RNA, 64 nt, hsa; identical to SEQ ID NO: 41454

SEQ ID NO: 330993 - RNA, 64 nt, hsa; identical to SEQ ID NO: 41455

SEQ ID NO: 330994 - RNA, 64 nt, hsa; identical to SEQ ID NO: 41456

SEQ ID NO: 330995 - RNA, 64 nt, hsa; identical to SEQ ID NO: 41457

SEQ ID NO: 330996 - RNA, 64 nt, hsa; identical to SEQ ID NO: 41458

SEQ ID NO: 330997 - RNA, 64 nt, hsa; identical to SEQ ID NO: 41459

SEQ ID NO: 330998 - RNA, 64 nt, hsa; identical to SEQ ID NO: 41460

SEQ ID NO: 330999 - RNA, 64 nt, hsa; identical to SEQ ID NO: 41461

SEQ ID NO: 331000 - RNA, 64 nt, hsa; identical to SEQ ID NO: 41462

SEQ ID NO: 331001 - RNA, 64 nt, hsa; identical to SEQ ID NO: 41463

SEQ ID NO: 331002 - RNA, 64 nt, hsa; identical to SEQ ID NO: 41464

SEQ ID NO: 331003 - RNA, 64 nt, hsa; identical to SEQ ID NO: 41465

SEQ ID NO: 331004 - RNA, 64 nt, hsa; identical to SEQ ID NO: 41466

SEQ ID NO: 331005 - RNA, 64 nt, hsa; identical to SEQ ID NO: 41467

SEQ ID NO: 331006 - RNA, 64 nt, hsa; identical to SEQ ID NO: 41468

SEQ ID NO: 331007 - RNA, 64 nt, hsa; identical to SEQ ID NO: 41469

SEQ ID NO: 331008 - RNA, 64 nt, hsa; identical to SEQ ID NO: 41470

SEQ ID NO: 331009 - RNA, 64 nt, hsa; identical to SEQ ID NO: 41471

SEQ ID NO: 331010 - RNA, 64 nt, hsa; identical to SEQ ID NO: 41472

SEQ ID NO: 331011 - RNA, 64 nt, hsa; identical to SEQ ID NO: 41473

SEQ ID NO: 331012 - RNA, 64 nt, hsa; identical to SEQ ID NO: 41474

SEQ ID NO: 331013 - RNA, 64 nt, hsa; identical to SEQ ID NO: 41475

SEQ ID NO: 331014 - RNA, 64 nt, hsa; identical to SEQ ID NO: 41476

SEQ ID NO: 331015 - RNA, 64 nt, hsa; identical to SEQ ID NO: 41477

SEQ ID NO: 331016 - RNA, 64 nt, hsa; identical to SEQ ID NO: 41478

SEQ ID NO: 331017 - RNA, 64 nt, hsa; identical to SEQ ID NO: 41479

SEQ ID NO: 331018 - RNA, 64 nt, hsa; identical to SEQ ID NO: 41480

SEQ ID NO: 331019 - RNA, 64 nt, hsa; identical to SEQ ID NO: 41481

SEQ ID NO: 331020 - RNA, 64 nt, hsa; identical to SEQ ID NO: 41482

SEQ ID NO: 331021 - RNA, 64 nt, hsa; identical to SEQ ID NO: 41483

SEQ ID NO: 331022 - RNA, 64 nt, hsa; identical to SEQ ID NO: 41484

SEQ ID NO: 331023 - RNA, 64 nt, hsa; identical to SEQ ID NO: 41485

SEQ ID NO: 331024 - RNA, 64 nt, hsa; identical to SEQ ID NO: 41486

SEQ ID NO: 331025 - RNA, 64 nt, hsa; identical to SEQ ID NO: 41487

SEQ ID NO: 331026 - RNA, 64 nt, hsa; identical to SEQ ID NO: 41488

SEQ ID NO: 331027 - RNA, 64 nt, hsa; identical to SEQ ID NO: 41489

SEQ ID NO: 331028 - RNA, 64 nt, hsa; identical to SEQ ID NO: 41490

SEQ ID NO: 331029 - RNA, 64 nt, hsa; identical to SEQ ID NO: 41491

SEQ ID NO: 331030 - RNA, 64 nt, hsa; identical to SEQ ID NO: 41492

SEQ ID NO: 331031 - RNA, 64 nt, hsa; identical to SEQ ID NO: 41493

SEQ ID NO: 331032 - RNA, 64 nt, hsa; identical to SEQ ID NO: 41494

SEQ ID NO: 331033 - RNA, 64 nt, hsa; identical to SEQ ID NO: 41495

SEQ ID NO: 331034 - RNA, 64 nt, hsa; identical to SEQ ID NO: 41496

SEQ ID NO: 331035 - RNA, 64 nt, hsa; identical to SEQ ID NO: 41497

SEQ ID NO: 331036 - RNA, 64 nt, hsa; identical to SEQ ID NO: 41498

SEQ ID NO: 331037 - RNA, 64 nt, hsa; identical to SEQ ID NO: 41499

SEQ ID NO: 331038 - RNA, 64 nt, hsa; identical to SEQ ID NO: 41500

SEQ ID NO: 331039 - RNA, 64 nt, hsa; identical to SEQ ID NO: 41501

SEQ ID NO: 331040 - RNA, 64 nt, hsa; identical to SEQ ID NO: 41502

SEQ ID NO: 331041 - RNA, 64 nt, hsa; identical to SEQ ID NO: 41503

SEQ ID NO: 331042 - RNA, 64 nt, hsa; identical to SEQ ID NO: 41504

SEQ ID NO: 331043 - RNA, 64 nt, hsa; identical to SEQ ID NO: 41505

SEQ ID NO: 331044 - RNA, 64 nt, hsa; identical to SEQ ID NO: 41506

SEQ ID NO: 331045 - RNA, 64 nt, hsa; identical to SEQ ID NO: 41507

SEQ ID NO: 331046 - RNA, 64 nt, hsa; identical to SEQ ID NO: 41508

SEQ ID NO: 331047 - RNA, 64 nt, hsa; identical to SEQ ID NO: 41509

SEQ ID NO: 331048 - RNA, 64 nt, hsa; identical to SEQ ID NO: 41510

SEQ ID NO: 331049 - RNA, 64 nt, hsa; identical to SEQ ID NO: 41511

SEQ ID NO: 331050 - RNA, 64 nt, hsa; identical to SEQ ID NO: 41512

SEQ ID NO: 331051 - RNA, 64 nt, hsa; identical to SEQ ID NO: 41513

SEQ ID NO: 331052 - RNA, 64 nt, hsa; identical to SEQ ID NO: 41514

SEQ ID NO: 331053 - RNA, 64 nt, hsa; identical to SEQ ID NO: 41515

SEQ ID NO: 331054 - RNA, 64 nt, hsa; identical to SEQ ID NO: 41516

SEQ ID NO: 331055 - RNA, 64 nt, hsa; identical to SEQ ID NO: 41517

SEQ ID NO: 331056 - RNA, 64 nt, hsa; identical to SEQ ID NO: 41518

SEQ ID NO: 331057 - RNA, 64 nt, hsa; identical to SEQ ID NO: 41519

SEQ ID NO: 331058 - RNA, 64 nt, hsa; identical to SEQ ID NO: 41520

SEQ ID NO: 331059 - RNA, 64 nt, hsa; identical to SEQ ID NO: 41521

SEQ ID NO: 331060 - RNA, 64 nt, hsa; identical to SEQ ID NO: 41522

SEQ ID NO: 331061 - RNA, 64 nt, hsa; identical to SEQ ID NO: 41523

SEQ ID NO: 331062 - RNA, 64 nt, hsa; identical to SEQ ID NO: 41524

SEQ ID NO: 331063 - RNA, 64 nt, hsa; identical to SEQ ID NO: 41525

SEQ ID NO: 331064 - RNA, 64 nt, hsa; identical to SEQ ID NO: 41526

SEQ ID NO: 331065 - RNA, 64 nt, hsa; identical to SEQ ID NO: 41527

SEQ ID NO: 331066 - RNA, 64 nt, hsa; identical to SEQ ID NO: 41528

SEQ ID NO: 331067 - RNA, 64 nt, hsa; identical to SEQ ID NO: 41529

SEQ ID NO: 331068 - RNA, 64 nt, hsa; identical to SEQ ID NO: 41530

SEQ ID NO: 331069 - RNA, 64 nt, hsa; identical to SEQ ID NO: 41531

SEQ ID NO: 331070 - RNA, 64 nt, hsa; identical to SEQ ID NO: 41532

SEQ ID NO: 331071 - RNA, 64 nt, hsa; identical to SEQ ID NO: 41533

SEQ ID NO: 331072 - RNA, 64 nt, hsa; identical to SEQ ID NO: 41534

SEQ ID NO: 331073 - RNA, 64 nt, hsa; identical to SEQ ID NO: 41535

SEQ ID NO: 331074 - RNA, 64 nt, hsa; identical to SEQ ID NO: 41536

SEQ ID NO: 331075 - RNA, 64 nt, hsa; identical to SEQ ID NO: 41537

SEQ ID NO: 331076 - RNA, 64 nt, hsa; identical to SEQ ID NO: 41538

SEQ ID NO: 331077 - RNA, 64 nt, hsa; identical to SEQ ID NO: 41539

SEQ ID NO: 331078 - RNA, 64 nt, hsa; identical to SEQ ID NO: 41540

SEQ ID NO: 331079 - RNA, 64 nt, hsa; identical to SEQ ID NO: 41541

SEQ ID NO: 331080 - RNA, 64 nt, hsa; identical to SEQ ID NO: 41542

SEQ ID NO: 331081 - RNA, 64 nt, hsa; identical to SEQ ID NO: 41543

SEQ ID NO: 331082 - RNA, 64 nt, hsa; identical to SEQ ID NO: 41544

SEQ ID NO: 331083 - RNA, 64 nt, hsa; identical to SEQ ID NO: 41545

SEQ ID NO: 331084 - RNA, 64 nt, hsa; identical to SEQ ID NO: 41546

SEQ ID NO: 331085 - RNA, 64 nt, hsa; identical to SEQ ID NO: 41547

SEQ ID NO: 331086 - RNA, 64 nt, hsa; identical to SEQ ID NO: 41548

SEQ ID NO: 331087 - RNA, 64 nt, hsa; identical to SEQ ID NO: 41549

SEQ ID NO: 331088 - RNA, 64 nt, hsa; identical to SEQ ID NO: 41550

SEQ ID NO: 331089 - RNA, 64 nt, hsa; identical to SEQ ID NO: 41551

SEQ ID NO: 331090 - RNA, 64 nt, hsa; identical to SEQ ID NO: 41552

SEQ ID NO: 331091 - RNA, 64 nt, hsa; identical to SEQ ID NO: 41553

SEQ ID NO: 331092 - RNA, 64 nt, hsa; identical to SEQ ID NO: 41554

SEQ ID NO: 331093 - RNA, 64 nt, hsa; identical to SEQ ID NO: 41555

SEQ ID NO: 331094 - RNA, 64 nt, hsa; identical to SEQ ID NO: 41556

SEQ ID NO: 331095 - RNA, 64 nt, hsa; identical to SEQ ID NO: 41557

SEQ ID NO: 331096 - RNA, 64 nt, hsa; identical to SEQ ID NO: 41558

SEQ ID NO: 331097 - RNA, 64 nt, hsa; identical to SEQ ID NO: 41559

SEQ ID NO: 331098 - RNA, 64 nt, hsa; identical to SEQ ID NO: 41560

SEQ ID NO: 331099 - RNA, 64 nt, hsa; identical to SEQ ID NO: 41561

SEQ ID NO: 331100 - RNA, 64 nt, hsa; identical to SEQ ID NO: 41562

SEQ ID NO: 331101 - RNA, 64 nt, hsa; identical to SEQ ID NO: 41563

SEQ ID NO: 331102 - RNA, 64 nt, hsa; identical to SEQ ID NO: 41564

SEQ ID NO: 331103 - RNA, 64 nt, hsa; identical to SEQ ID NO: 41565

SEQ ID NO: 331104 - RNA, 64 nt, hsa; identical to SEQ ID NO: 41566

SEQ ID NO: 331105 - RNA, 64 nt, hsa; identical to SEQ ID NO: 41567

SEQ ID NO: 331106 - RNA, 64 nt, hsa; identical to SEQ ID NO: 41568

SEQ ID NO: 331107 - RNA, 64 nt, hsa; identical to SEQ ID NO: 41569

SEQ ID NO: 331108 - RNA, 64 nt, hsa; identical to SEQ ID NO: 41570

SEQ ID NO: 331109 - RNA, 64 nt, hsa; identical to SEQ ID NO: 41571

SEQ ID NO: 331110 - RNA, 64 nt, hsa; identical to SEQ ID NO: 41572

SEQ ID NO: 331111 - RNA, 64 nt, hsa; identical to SEQ ID NO: 41573

SEQ ID NO: 331112 - RNA, 64 nt, hsa; identical to SEQ ID NO: 41574

SEQ ID NO: 331113 - RNA, 64 nt, hsa; identical to SEQ ID NO: 41575

SEQ ID NO: 331114 - RNA, 64 nt, hsa; identical to SEQ ID NO: 41576

SEQ ID NO: 331115 - RNA, 64 nt, hsa; identical to SEQ ID NO: 41577

SEQ ID NO: 331116 - RNA, 64 nt, hsa; identical to SEQ ID NO: 41578

SEQ ID NO: 331117 - RNA, 64 nt, hsa; identical to SEQ ID NO: 41579

SEQ ID NO: 331118 - RNA, 64 nt, hsa; identical to SEQ ID NO: 41580

SEQ ID NO: 331119 - RNA, 64 nt, hsa; identical to SEQ ID NO: 41581

SEQ ID NO: 331120 - RNA, 64 nt, hsa; identical to SEQ ID NO: 41582

SEQ ID NO: 331121 - RNA, 64 nt, hsa; identical to SEQ ID NO: 41583

SEQ ID NO: 331122 - RNA, 64 nt, hsa; identical to SEQ ID NO: 41584

SEQ ID NO: 331123 - RNA, 64 nt, hsa; identical to SEQ ID NO: 41585

SEQ ID NO: 331124 - RNA, 64 nt, hsa; identical to SEQ ID NO: 41586

SEQ ID NO: 331125 - RNA, 64 nt, hsa; identical to SEQ ID NO: 41587

SEQ ID NO: 331126 - RNA, 64 nt, hsa; identical to SEQ ID NO: 41588

SEQ ID NO: 331127 - RNA, 64 nt, hsa; identical to SEQ ID NO: 41589

SEQ ID NO: 331128 - RNA, 64 nt, hsa; identical to SEQ ID NO: 41590

SEQ ID NO: 331129 - RNA, 64 nt, hsa; identical to SEQ ID NO: 41591

SEQ ID NO: 331130 - RNA, 64 nt, hsa; identical to SEQ ID NO: 41592

SEQ ID NO: 331131 - RNA, 64 nt, hsa; identical to SEQ ID NO: 41593

SEQ ID NO: 331132 - RNA, 64 nt, hsa; identical to SEQ ID NO: 41594

SEQ ID NO: 331133 - RNA, 64 nt, hsa; identical to SEQ ID NO: 41595

SEQ ID NO: 331134 - RNA, 64 nt, hsa; identical to SEQ ID NO: 41596

SEQ ID NO: 331135 - RNA, 64 nt, hsa; identical to SEQ ID NO: 41597

SEQ ID NO: 331136 - RNA, 64 nt, hsa; identical to SEQ ID NO: 41598

SEQ ID NO: 331137 - RNA, 64 nt, hsa; identical to SEQ ID NO: 41599

SEQ ID NO: 331138 - RNA, 64 nt, hsa; identical to SEQ ID NO: 41600

SEQ ID NO: 331139 - RNA, 64 nt, hsa; identical to SEQ ID NO: 41601

SEQ ID NO: 331140 - RNA, 64 nt, hsa; identical to SEQ ID NO: 41602

SEQ ID NO: 331141 - RNA, 64 nt, hsa; identical to SEQ ID NO: 41603

SEQ ID NO: 331142 - RNA, 64 nt, hsa; identical to SEQ ID NO: 41604

SEQ ID NO: 331143 - RNA, 64 nt, hsa; identical to SEQ ID NO: 41605

SEQ ID NO: 331144 - RNA, 64 nt, hsa; identical to SEQ ID NO: 41606

SEQ ID NO: 331145 - RNA, 64 nt, hsa; identical to SEQ ID NO: 41607

SEQ ID NO: 331146 - RNA, 64 nt, hsa; identical to SEQ ID NO: 41608

SEQ ID NO: 331147 - RNA, 64 nt, hsa; identical to SEQ ID NO: 41609

SEQ ID NO: 331148 - RNA, 64 nt, hsa; identical to SEQ ID NO: 41610

SEQ ID NO: 331149 - RNA, 64 nt, hsa; identical to SEQ ID NO: 41611

SEQ ID NO: 331150 - RNA, 64 nt, hsa; identical to SEQ ID NO: 41612

SEQ ID NO: 331151 - RNA, 64 nt, hsa; identical to SEQ ID NO: 41613

SEQ ID NO: 331152 - RNA, 64 nt, hsa; identical to SEQ ID NO: 41614

SEQ ID NO: 331153 - RNA, 64 nt, hsa; identical to SEQ ID NO: 41615

SEQ ID NO: 331154 - RNA, 64 nt, hsa; identical to SEQ ID NO: 41616

SEQ ID NO: 331155 - RNA, 64 nt, hsa; identical to SEQ ID NO: 41617

SEQ ID NO: 331156 - RNA, 64 nt, hsa; identical to SEQ ID NO: 41618

SEQ ID NO: 331157 - RNA, 64 nt, hsa; identical to SEQ ID NO: 41619

SEQ ID NO: 331158 - RNA, 64 nt, hsa; identical to SEQ ID NO: 41620

SEQ ID NO: 331159 - RNA, 64 nt, hsa; identical to SEQ ID NO: 41621

SEQ ID NO: 331160 - RNA, 63 nt, hsa; identical to SEQ ID NO: 41622

SEQ ID NO: 331161 - RNA, 64 nt, hsa; identical to SEQ ID NO: 41623

SEQ ID NO: 331162 - RNA, 64 nt, hsa; identical to SEQ ID NO: 41624

SEQ ID NO: 331163 - RNA, 64 nt, hsa; identical to SEQ ID NO: 41625

SEQ ID NO: 331164 - RNA, 64 nt, hsa; identical to SEQ ID NO: 41626

SEQ ID NO: 331165 - RNA, 64 nt, hsa; identical to SEQ ID NO: 41627

SEQ ID NO: 331166 - RNA, 64 nt, hsa; identical to SEQ ID NO: 41628

SEQ ID NO: 331167 - RNA, 64 nt, hsa; identical to SEQ ID NO: 41629

SEQ ID NO: 331168 - RNA, 64 nt, hsa; identical to SEQ ID NO: 41630

SEQ ID NO: 331169 - RNA, 64 nt, hsa; identical to SEQ ID NO: 41631

SEQ ID NO: 331170 - RNA, 64 nt, hsa; identical to SEQ ID NO: 41632

SEQ ID NO: 331171 - RNA, 64 nt, hsa; identical to SEQ ID NO: 41633

SEQ ID NO: 331172 - RNA, 64 nt, hsa; identical to SEQ ID NO: 41634

SEQ ID NO: 331173 - RNA, 64 nt, hsa; identical to SEQ ID NO: 41635

SEQ ID NO: 331174 - RNA, 64 nt, hsa; identical to SEQ ID NO: 41636

SEQ ID NO: 331175 - RNA, 64 nt, hsa; identical to SEQ ID NO: 41637

SEQ ID NO: 331176 - RNA, 64 nt, hsa; identical to SEQ ID NO: 41638

SEQ ID NO: 331177 - RNA, 64 nt, hsa; identical to SEQ ID NO: 41639

SEQ ID NO: 331178 - RNA, 64 nt, hsa; identical to SEQ ID NO: 41640

SEQ ID NO: 331179 - RNA, 64 nt, hsa; identical to SEQ ID NO: 41641

SEQ ID NO: 331180 - RNA, 64 nt, hsa; identical to SEQ ID NO: 41642

SEQ ID NO: 331181 - RNA, 64 nt, hsa; identical to SEQ ID NO: 41643

SEQ ID NO: 331182 - RNA, 64 nt, hsa; identical to SEQ ID NO: 41644

SEQ ID NO: 331183 - RNA, 64 nt, hsa; identical to SEQ ID NO: 41645

SEQ ID NO: 331184 - RNA, 64 nt, hsa; identical to SEQ ID NO: 41646

SEQ ID NO: 331185 - RNA, 64 nt, hsa; identical to SEQ ID NO: 41647

SEQ ID NO: 331186 - RNA, 64 nt, hsa; identical to SEQ ID NO: 41648

SEQ ID NO: 331187 - RNA, 64 nt, hsa; identical to SEQ ID NO: 41649

SEQ ID NO: 331188 - RNA, 64 nt, hsa; identical to SEQ ID NO: 41650

SEQ ID NO: 331189 - RNA, 64 nt, hsa; identical to SEQ ID NO: 41651

SEQ ID NO: 331190 - RNA, 64 nt, hsa; identical to SEQ ID NO: 41652

SEQ ID NO: 331191 - RNA, 64 nt, hsa; identical to SEQ ID NO: 41653

SEQ ID NO: 331192 - RNA, 64 nt, hsa; identical to SEQ ID NO: 41654

SEQ ID NO: 331193 - RNA, 64 nt, hsa; identical to SEQ ID NO: 41655

SEQ ID NO: 331194 - RNA, 64 nt, hsa; identical to SEQ ID NO: 41656

SEQ ID NO: 331195 - RNA, 64 nt, hsa; identical to SEQ ID NO: 41657

SEQ ID NO: 331196 - RNA, 64 nt, hsa; identical to SEQ ID NO: 41658

SEQ ID NO: 331197 - RNA, 64 nt, hsa; identical to SEQ ID NO: 41659

SEQ ID NO: 331198 - RNA, 64 nt, hsa; identical to SEQ ID NO: 41660

SEQ ID NO: 331199 - RNA, 64 nt, hsa; identical to SEQ ID NO: 41661

SEQ ID NO: 331200 - RNA, 64 nt, hsa; identical to SEQ ID NO: 41662

SEQ ID NO: 331201 - RNA, 64 nt, hsa; identical to SEQ ID NO: 41663

SEQ ID NO: 331202 - RNA, 64 nt, hsa; identical to SEQ ID NO: 41664

SEQ ID NO: 331203 - RNA, 64 nt, hsa; identical to SEQ ID NO: 41665

SEQ ID NO: 331204 - RNA, 64 nt, hsa; identical to SEQ ID NO: 41666

SEQ ID NO: 331205 - RNA, 64 nt, hsa; identical to SEQ ID NO: 41667

SEQ ID NO: 331206 - RNA, 64 nt, hsa; identical to SEQ ID NO: 41668

SEQ ID NO: 331207 - RNA, 64 nt, hsa; identical to SEQ ID NO: 41669

SEQ ID NO: 331208 - RNA, 64 nt, hsa; identical to SEQ ID NO: 41670

SEQ ID NO: 331209 - RNA, 64 nt, hsa; identical to SEQ ID NO: 41671

SEQ ID NO: 331210 - RNA, 64 nt, hsa; identical to SEQ ID NO: 41672

SEQ ID NO: 331211 - RNA, 64 nt, hsa; identical to SEQ ID NO: 41673

SEQ ID NO: 331212 - RNA, 64 nt, hsa; identical to SEQ ID NO: 41674

SEQ ID NO: 331213 - RNA, 64 nt, hsa; identical to SEQ ID NO: 41675

SEQ ID NO: 331214 - RNA, 64 nt, hsa; identical to SEQ ID NO: 41676

SEQ ID NO: 331215 - RNA, 64 nt, hsa; identical to SEQ ID NO: 41677

SEQ ID NO: 331216 - RNA, 64 nt, hsa; identical to SEQ ID NO: 41678

SEQ ID NO: 331217 - RNA, 64 nt, hsa; identical to SEQ ID NO: 41679

SEQ ID NO: 331218 - RNA, 64 nt, hsa; identical to SEQ ID NO: 41680

SEQ ID NO: 331219 - RNA, 64 nt, hsa; identical to SEQ ID NO: 41681

SEQ ID NO: 331220 - RNA, 64 nt, hsa; identical to SEQ ID NO: 41682

SEQ ID NO: 331221 - RNA, 64 nt, hsa; identical to SEQ ID NO: 41683

SEQ ID NO: 331222 - RNA, 64 nt, hsa; identical to SEQ ID NO: 41684

SEQ ID NO: 331223 - RNA, 64 nt, hsa; identical to SEQ ID NO: 41685

SEQ ID NO: 331224 - RNA, 64 nt, hsa; identical to SEQ ID NO: 41686

SEQ ID NO: 331225 - RNA, 64 nt, hsa; identical to SEQ ID NO: 41687

SEQ ID NO: 331226 - RNA, 64 nt, hsa; identical to SEQ ID NO: 41688

SEQ ID NO: 331227 - RNA, 64 nt, hsa; identical to SEQ ID NO: 41689

SEQ ID NO: 331228 - RNA, 64 nt, hsa; identical to SEQ ID NO: 41690

SEQ ID NO: 331229 - RNA, 64 nt, hsa; identical to SEQ ID NO: 41691

SEQ ID NO: 331230 - RNA, 64 nt, hsa; identical to SEQ ID NO: 41692

SEQ ID NO: 331231 - RNA, 64 nt, hsa; identical to SEQ ID NO: 41693

SEQ ID NO: 331232 - RNA, 64 nt, hsa; identical to SEQ ID NO: 41694

SEQ ID NO: 331233 - RNA, 64 nt, hsa; identical to SEQ ID NO: 41695

SEQ ID NO: 331234 - RNA, 64 nt, hsa; identical to SEQ ID NO: 41696

SEQ ID NO: 331235 - RNA, 64 nt, hsa; identical to SEQ ID NO: 41697

SEQ ID NO: 331236 - RNA, 64 nt, hsa; identical to SEQ ID NO: 41698

SEQ ID NO: 331237 - RNA, 64 nt, hsa; identical to SEQ ID NO: 41699

SEQ ID NO: 331238 - RNA, 64 nt, hsa; identical to SEQ ID NO: 41700

SEQ ID NO: 331239 - RNA, 64 nt, hsa; identical to SEQ ID NO: 41701

SEQ ID NO: 331240 - RNA, 64 nt, hsa; identical to SEQ ID NO: 41702

SEQ ID NO: 331241 - RNA, 64 nt, hsa; identical to SEQ ID NO: 41703

SEQ ID NO: 331242 - RNA, 64 nt, hsa; identical to SEQ ID NO: 41704

SEQ ID NO: 331243 - RNA, 64 nt, hsa; identical to SEQ ID NO: 41705

SEQ ID NO: 331244 - RNA, 64 nt, hsa; identical to SEQ ID NO: 41706

SEQ ID NO: 331245 - RNA, 64 nt, hsa; identical to SEQ ID NO: 41707

SEQ ID NO: 331246 - RNA, 64 nt, hsa; identical to SEQ ID NO: 41708

SEQ ID NO: 331247 - RNA, 64 nt, hsa; identical to SEQ ID NO: 41709

SEQ ID NO: 331248 - RNA, 64 nt, hsa; identical to SEQ ID NO: 41710

SEQ ID NO: 331249 - RNA, 64 nt, hsa; identical to SEQ ID NO: 41711

SEQ ID NO: 331250 - RNA, 64 nt, hsa; identical to SEQ ID NO: 41712

SEQ ID NO: 331251 - RNA, 64 nt, hsa; identical to SEQ ID NO: 41713

SEQ ID NO: 331252 - RNA, 64 nt, hsa; identical to SEQ ID NO: 41714

SEQ ID NO: 331253 - RNA, 64 nt, hsa; identical to SEQ ID NO: 41715

SEQ ID NO: 331254 - RNA, 64 nt, hsa; identical to SEQ ID NO: 41716

SEQ ID NO: 331255 - RNA, 64 nt, hsa; identical to SEQ ID NO: 41717

SEQ ID NO: 331256 - RNA, 64 nt, hsa; identical to SEQ ID NO: 41718

SEQ ID NO: 331257 - RNA, 64 nt, hsa; identical to SEQ ID NO: 41719

SEQ ID NO: 331258 - RNA, 64 nt, hsa; identical to SEQ ID NO: 41720

SEQ ID NO: 331259 - RNA, 64 nt, hsa; identical to SEQ ID NO: 41721

SEQ ID NO: 331260 - RNA, 64 nt, hsa; identical to SEQ ID NO: 41722

SEQ ID NO: 331261 - RNA, 64 nt, hsa; identical to SEQ ID NO: 41723

SEQ ID NO: 331262 - RNA, 64 nt, hsa; identical to SEQ ID NO: 41724

SEQ ID NO: 331263 - RNA, 64 nt, hsa; identical to SEQ ID NO: 41725

SEQ ID NO: 331264 - RNA, 64 nt, hsa; identical to SEQ ID NO: 41726

SEQ ID NO: 331265 - RNA, 64 nt, hsa; identical to SEQ ID NO: 41727

SEQ ID NO: 331266 - RNA, 64 nt, hsa; identical to SEQ ID NO: 41728

SEQ ID NO: 331267 - RNA, 64 nt, hsa; identical to SEQ ID NO: 41729

SEQ ID NO: 331268 - RNA, 64 nt, hsa; identical to SEQ ID NO: 41730

SEQ ID NO: 331269 - RNA, 64 nt, hsa; identical to SEQ ID NO: 41731

SEQ ID NO: 331270 - RNA, 64 nt, hsa; identical to SEQ ID NO: 41732

SEQ ID NO: 331271 - RNA, 64 nt, hsa; identical to SEQ ID NO: 41733

SEQ ID NO: 331272 - RNA, 64 nt, hsa; identical to SEQ ID NO: 41734

SEQ ID NO: 331273 - RNA, 64 nt, hsa; identical to SEQ ID NO: 41735

SEQ ID NO: 331274 - RNA, 64 nt, hsa; identical to SEQ ID NO: 41736

SEQ ID NO: 331275 - RNA, 64 nt, hsa; identical to SEQ ID NO: 41737

SEQ ID NO: 331276 - RNA, 64 nt, hsa; identical to SEQ ID NO: 41738

SEQ ID NO: 331277 - RNA, 64 nt, hsa; identical to SEQ ID NO: 41739

SEQ ID NO: 331278 - RNA, 64 nt, hsa; identical to SEQ ID NO: 41740

SEQ ID NO: 331279 - RNA, 64 nt, hsa; identical to SEQ ID NO: 41741

SEQ ID NO: 331280 - RNA, 64 nt, hsa; identical to SEQ ID NO: 41742

SEQ ID NO: 331281 - RNA, 64 nt, hsa; identical to SEQ ID NO: 41743

SEQ ID NO: 331282 - RNA, 64 nt, hsa; identical to SEQ ID NO: 41744

SEQ ID NO: 331283 - RNA, 64 nt, hsa; identical to SEQ ID NO: 41745

SEQ ID NO: 331284 - RNA, 64 nt, hsa; identical to SEQ ID NO: 41746

SEQ ID NO: 331285 - RNA, 64 nt, hsa; identical to SEQ ID NO: 41747

SEQ ID NO: 331286 - RNA, 64 nt, hsa; identical to SEQ ID NO: 41748

SEQ ID NO: 331287 - RNA, 64 nt, hsa; identical to SEQ ID NO: 41749

SEQ ID NO: 331288 - RNA, 64 nt, hsa; identical to SEQ ID NO: 41750

SEQ ID NO: 331289 - RNA, 64 nt, hsa; identical to SEQ ID NO: 41751

SEQ ID NO: 331290 - RNA, 64 nt, hsa; identical to SEQ ID NO: 41752

SEQ ID NO: 331291 - RNA, 64 nt, hsa; identical to SEQ ID NO: 41753

SEQ ID NO: 331292 - RNA, 64 nt, hsa; identical to SEQ ID NO: 41754

SEQ ID NO: 331293 - RNA, 64 nt, hsa; identical to SEQ ID NO: 41755

SEQ ID NO: 331294 - RNA, 64 nt, hsa; identical to SEQ ID NO: 41756

SEQ ID NO: 331295 - RNA, 64 nt, hsa; identical to SEQ ID NO: 41757

SEQ ID NO: 331296 - RNA, 64 nt, hsa; identical to SEQ ID NO: 41758

SEQ ID NO: 331297 - RNA, 64 nt, hsa; identical to SEQ ID NO: 41759

SEQ ID NO: 331298 - RNA, 64 nt, hsa; identical to SEQ ID NO: 41760

SEQ ID NO: 331299 - RNA, 64 nt, hsa; identical to SEQ ID NO: 41761

SEQ ID NO: 331300 - RNA, 64 nt, hsa; identical to SEQ ID NO: 41762

SEQ ID NO: 331301 - RNA, 64 nt, hsa; identical to SEQ ID NO: 41763

SEQ ID NO: 331302 - RNA, 64 nt, hsa; identical to SEQ ID NO: 41764

SEQ ID NO: 331303 - RNA, 64 nt, hsa; identical to SEQ ID NO: 41765

SEQ ID NO: 331304 - RNA, 64 nt, hsa; identical to SEQ ID NO: 41766

SEQ ID NO: 331305 - RNA, 64 nt, hsa; identical to SEQ ID NO: 41767

SEQ ID NO: 331306 - RNA, 64 nt, hsa; identical to SEQ ID NO: 41768

SEQ ID NO: 331307 - RNA, 64 nt, hsa; identical to SEQ ID NO: 41769

SEQ ID NO: 331308 - RNA, 64 nt, hsa; identical to SEQ ID NO: 41770

SEQ ID NO: 331309 - RNA, 64 nt, hsa; identical to SEQ ID NO: 41771

SEQ ID NO: 331310 - RNA, 64 nt, hsa; identical to SEQ ID NO: 41772

SEQ ID NO: 331311 - RNA, 64 nt, hsa; identical to SEQ ID NO: 41773

SEQ ID NO: 331312 - RNA, 64 nt, hsa; identical to SEQ ID NO: 41774

SEQ ID NO: 331313 - RNA, 64 nt, hsa; identical to SEQ ID NO: 41775

SEQ ID NO: 331314 - RNA, 64 nt, hsa; identical to SEQ ID NO: 41776

SEQ ID NO: 331315 - RNA, 64 nt, hsa; identical to SEQ ID NO: 41777

SEQ ID NO: 331316 - RNA, 64 nt, hsa; identical to SEQ ID NO: 41778

SEQ ID NO: 331317 - RNA, 64 nt, hsa; identical to SEQ ID NO: 41779

SEQ ID NO: 331318 - RNA, 64 nt, hsa; identical to SEQ ID NO: 41780

SEQ ID NO: 331319 - RNA, 64 nt, hsa; identical to SEQ ID NO: 41781

SEQ ID NO: 331320 - RNA, 64 nt, hsa; identical to SEQ ID NO: 41782

SEQ ID NO: 331321 - RNA, 64 nt, hsa; identical to SEQ ID NO: 41783

SEQ ID NO: 331322 - RNA, 64 nt, hsa; identical to SEQ ID NO: 41784

SEQ ID NO: 331323 - RNA, 64 nt, hsa; identical to SEQ ID NO: 41785

SEQ ID NO: 331324 - RNA, 64 nt, hsa; identical to SEQ ID NO: 41786

SEQ ID NO: 331325 - RNA, 64 nt, hsa; identical to SEQ ID NO: 41787

SEQ ID NO: 331326 - RNA, 64 nt, hsa; identical to SEQ ID NO: 41788

SEQ ID NO: 331327 - RNA, 64 nt, hsa; identical to SEQ ID NO: 41789

SEQ ID NO: 331328 - RNA, 64 nt, hsa; identical to SEQ ID NO: 41790

SEQ ID NO: 331329 - RNA, 64 nt, hsa; identical to SEQ ID NO: 41791

SEQ ID NO: 331330 - RNA, 64 nt, hsa; identical to SEQ ID NO: 41792

SEQ ID NO: 331331 - RNA, 64 nt, hsa; identical to SEQ ID NO: 41793

SEQ ID NO: 331332 - RNA, 64 nt, hsa; identical to SEQ ID NO: 41794

SEQ ID NO: 331333 - RNA, 64 nt, hsa; identical to SEQ ID NO: 41795

SEQ ID NO: 331334 - RNA, 64 nt, hsa; identical to SEQ ID NO: 41796

SEQ ID NO: 331335 - RNA, 64 nt, hsa; identical to SEQ ID NO: 41797

SEQ ID NO: 331336 - RNA, 64 nt, hsa; identical to SEQ ID NO: 41798

SEQ ID NO: 331337 - RNA, 64 nt, hsa; identical to SEQ ID NO: 41799

SEQ ID NO: 331338 - RNA, 64 nt, hsa; identical to SEQ ID NO: 41800

SEQ ID NO: 331339 - RNA, 64 nt, hsa; identical to SEQ ID NO: 41801

SEQ ID NO: 331340 - RNA, 64 nt, hsa; identical to SEQ ID NO: 41802

SEQ ID NO: 331341 - RNA, 64 nt, hsa; identical to SEQ ID NO: 41803

SEQ ID NO: 331342 - RNA, 64 nt, hsa; identical to SEQ ID NO: 41804

SEQ ID NO: 331343 - RNA, 64 nt, hsa; identical to SEQ ID NO: 41805

SEQ ID NO: 331344 - RNA, 64 nt, hsa; identical to SEQ ID NO: 41806

SEQ ID NO: 331345 - RNA, 64 nt, hsa; identical to SEQ ID NO: 41807

SEQ ID NO: 331346 - RNA, 64 nt, hsa; identical to SEQ ID NO: 41808

SEQ ID NO: 331347 - RNA, 64 nt, hsa; identical to SEQ ID NO: 41809

SEQ ID NO: 331348 - RNA, 64 nt, hsa; identical to SEQ ID NO: 41810

SEQ ID NO: 331349 - RNA, 64 nt, hsa; identical to SEQ ID NO: 41811

SEQ ID NO: 331350 - RNA, 64 nt, hsa; identical to SEQ ID NO: 41812

SEQ ID NO: 331351 - RNA, 64 nt, hsa; identical to SEQ ID NO: 41813

SEQ ID NO: 331352 - RNA, 64 nt, hsa; identical to SEQ ID NO: 41814

SEQ ID NO: 331353 - RNA, 64 nt, hsa; identical to SEQ ID NO: 41815

SEQ ID NO: 331354 - RNA, 64 nt, hsa; identical to SEQ ID NO: 41816

SEQ ID NO: 331355 - RNA, 64 nt, hsa; identical to SEQ ID NO: 41817

SEQ ID NO: 331356 - RNA, 64 nt, hsa; identical to SEQ ID NO: 41818

SEQ ID NO: 331357 - RNA, 64 nt, hsa; identical to SEQ ID NO: 41819

SEQ ID NO: 331358 - RNA, 64 nt, hsa; identical to SEQ ID NO: 41820

SEQ ID NO: 331359 - RNA, 64 nt, hsa; identical to SEQ ID NO: 41821

SEQ ID NO: 331360 - RNA, 64 nt, hsa; identical to SEQ ID NO: 41822

SEQ ID NO: 331361 - RNA, 64 nt, hsa; identical to SEQ ID NO: 41823

SEQ ID NO: 331362 - RNA, 64 nt, hsa; identical to SEQ ID NO: 41824

SEQ ID NO: 331363 - RNA, 64 nt, hsa; identical to SEQ ID NO: 41825

SEQ ID NO: 331364 - RNA, 64 nt, hsa; identical to SEQ ID NO: 41826

SEQ ID NO: 331365 - RNA, 64 nt, hsa; identical to SEQ ID NO: 41827

SEQ ID NO: 331366 - RNA, 64 nt, hsa; identical to SEQ ID NO: 41828

SEQ ID NO: 331367 - RNA, 64 nt, hsa; identical to SEQ ID NO: 41829

SEQ ID NO: 331368 - RNA, 64 nt, hsa; identical to SEQ ID NO: 41830

SEQ ID NO: 331369 - RNA, 64 nt, hsa; identical to SEQ ID NO: 41831

SEQ ID NO: 331370 - RNA, 64 nt, hsa; identical to SEQ ID NO: 41832

SEQ ID NO: 331371 - RNA, 64 nt, hsa; identical to SEQ ID NO: 41833

SEQ ID NO: 331372 - RNA, 64 nt, hsa; identical to SEQ ID NO: 41834

SEQ ID NO: 331373 - RNA, 64 nt, hsa; identical to SEQ ID NO: 41835

SEQ ID NO: 331374 - RNA, 64 nt, hsa; identical to SEQ ID NO: 41836

SEQ ID NO: 331375 - RNA, 64 nt, hsa; identical to SEQ ID NO: 41837

SEQ ID NO: 331376 - RNA, 64 nt, hsa; identical to SEQ ID NO: 41838

SEQ ID NO: 331377 - RNA, 64 nt, hsa; identical to SEQ ID NO: 41839

SEQ ID NO: 331378 - RNA, 64 nt, hsa; identical to SEQ ID NO: 41840

SEQ ID NO: 331379 - RNA, 64 nt, hsa; identical to SEQ ID NO: 41841

SEQ ID NO: 331380 - RNA, 64 nt, hsa; identical to SEQ ID NO: 41842

SEQ ID NO: 331381 - RNA, 64 nt, hsa; identical to SEQ ID NO: 41843

SEQ ID NO: 331382 - RNA, 64 nt, hsa; identical to SEQ ID NO: 41844

SEQ ID NO: 331383 - RNA, 64 nt, hsa; identical to SEQ ID NO: 41845

SEQ ID NO: 331384 - RNA, 64 nt, hsa; identical to SEQ ID NO: 41846

SEQ ID NO: 331385 - RNA, 64 nt, hsa; identical to SEQ ID NO: 41847

SEQ ID NO: 331386 - RNA, 64 nt, hsa; identical to SEQ ID NO: 41848

SEQ ID NO: 331387 - RNA, 64 nt, hsa; identical to SEQ ID NO: 41849

SEQ ID NO: 331388 - RNA, 64 nt, hsa; identical to SEQ ID NO: 41850

SEQ ID NO: 331389 - RNA, 64 nt, hsa; identical to SEQ ID NO: 41851

SEQ ID NO: 331390 - RNA, 64 nt, hsa; identical to SEQ ID NO: 41852

SEQ ID NO: 331391 - RNA, 64 nt, hsa; identical to SEQ ID NO: 41853

SEQ ID NO: 331392 - RNA, 64 nt, hsa; identical to SEQ ID NO: 41854

SEQ ID NO: 331393 - RNA, 64 nt, hsa; identical to SEQ ID NO: 41855

SEQ ID NO: 331394 - RNA, 64 nt, hsa; identical to SEQ ID NO: 41856

SEQ ID NO: 331395 - RNA, 64 nt, hsa; identical to SEQ ID NO: 41857

SEQ ID NO: 331396 - RNA, 64 nt, hsa; identical to SEQ ID NO: 41858

SEQ ID NO: 331397 - RNA, 64 nt, hsa; identical to SEQ ID NO: 41859

SEQ ID NO: 331398 - RNA, 64 nt, hsa; identical to SEQ ID NO: 41860

SEQ ID NO: 331399 - RNA, 64 nt, hsa; identical to SEQ ID NO: 41861

SEQ ID NO: 331400 - RNA, 64 nt, hsa; identical to SEQ ID NO: 41862

SEQ ID NO: 331401 - RNA, 64 nt, hsa; identical to SEQ ID NO: 41863

SEQ ID NO: 331402 - RNA, 64 nt, hsa; identical to SEQ ID NO: 41864

SEQ ID NO: 331403 - RNA, 64 nt, hsa; identical to SEQ ID NO: 41865

SEQ ID NO: 331404 - RNA, 64 nt, hsa; identical to SEQ ID NO: 41866

SEQ ID NO: 331405 - RNA, 64 nt, hsa; identical to SEQ ID NO: 41867

SEQ ID NO: 331406 - RNA, 64 nt, hsa; identical to SEQ ID NO: 41868

SEQ ID NO: 331407 - RNA, 64 nt, hsa; identical to SEQ ID NO: 41869

SEQ ID NO: 331408 - RNA, 64 nt, hsa; identical to SEQ ID NO: 41870

SEQ ID NO: 331409 - RNA, 64 nt, hsa; identical to SEQ ID NO: 41871

SEQ ID NO: 331410 - RNA, 64 nt, hsa; identical to SEQ ID NO: 41872

SEQ ID NO: 331411 - RNA, 64 nt, hsa; identical to SEQ ID NO: 41873

SEQ ID NO: 331412 - RNA, 64 nt, hsa; identical to SEQ ID NO: 41874

SEQ ID NO: 331413 - RNA, 64 nt, hsa; identical to SEQ ID NO: 41875

SEQ ID NO: 331414 - RNA, 64 nt, hsa; identical to SEQ ID NO: 41876

SEQ ID NO: 331415 - RNA, 64 nt, hsa; identical to SEQ ID NO: 41877

SEQ ID NO: 331416 - RNA, 64 nt, hsa; identical to SEQ ID NO: 41878

SEQ ID NO: 331417 - RNA, 64 nt, hsa; identical to SEQ ID NO: 41879

SEQ ID NO: 331418 - RNA, 64 nt, hsa; identical to SEQ ID NO: 41880

SEQ ID NO: 331419 - RNA, 64 nt, hsa; identical to SEQ ID NO: 41881

SEQ ID NO: 331420 - RNA, 64 nt, hsa; identical to SEQ ID NO: 41882

SEQ ID NO: 331421 - RNA, 64 nt, hsa; identical to SEQ ID NO: 41883

SEQ ID NO: 331422 - RNA, 64 nt, hsa; identical to SEQ ID NO: 41884

SEQ ID NO: 331423 - RNA, 64 nt, hsa; identical to SEQ ID NO: 41885

SEQ ID NO: 331424 - RNA, 64 nt, hsa; identical to SEQ ID NO: 41886

SEQ ID NO: 331425 - RNA, 64 nt, hsa; identical to SEQ ID NO: 41887

SEQ ID NO: 331426 - RNA, 64 nt, hsa; identical to SEQ ID NO: 41888

SEQ ID NO: 331427 - RNA, 64 nt, hsa; identical to SEQ ID NO: 41889

SEQ ID NO: 331428 - RNA, 64 nt, hsa; identical to SEQ ID NO: 41890

SEQ ID NO: 331429 - RNA, 64 nt, hsa; identical to SEQ ID NO: 41891

SEQ ID NO: 331430 - RNA, 64 nt, hsa; identical to SEQ ID NO: 41892

SEQ ID NO: 331431 - RNA, 64 nt, hsa; identical to SEQ ID NO: 41893

SEQ ID NO: 331432 - RNA, 64 nt, hsa; identical to SEQ ID NO: 41894

SEQ ID NO: 331433 - RNA, 64 nt, hsa; identical to SEQ ID NO: 41895

SEQ ID NO: 331434 - RNA, 64 nt, hsa; identical to SEQ ID NO: 41896

SEQ ID NO: 331435 - RNA, 64 nt, hsa; identical to SEQ ID NO: 41897

SEQ ID NO: 331436 - RNA, 64 nt, hsa; identical to SEQ ID NO: 41898

SEQ ID NO: 331437 - RNA, 64 nt, hsa; identical to SEQ ID NO: 41899

SEQ ID NO: 331438 - RNA, 64 nt, hsa; identical to SEQ ID NO: 41900

SEQ ID NO: 331439 - RNA, 64 nt, hsa; identical to SEQ ID NO: 41901

SEQ ID NO: 331440 - RNA, 64 nt, hsa; identical to SEQ ID NO: 41902

SEQ ID NO: 331441 - RNA, 64 nt, hsa; identical to SEQ ID NO: 41903

SEQ ID NO: 331442 - RNA, 64 nt, hsa; identical to SEQ ID NO: 41904

SEQ ID NO: 331443 - RNA, 64 nt, hsa; identical to SEQ ID NO: 41905

SEQ ID NO: 331444 - RNA, 64 nt, hsa; identical to SEQ ID NO: 41906

SEQ ID NO: 331445 - RNA, 64 nt, hsa; identical to SEQ ID NO: 41907

SEQ ID NO: 331446 - RNA, 64 nt, hsa; identical to SEQ ID NO: 41908

SEQ ID NO: 331447 - RNA, 64 nt, hsa; identical to SEQ ID NO: 41909

SEQ ID NO: 331448 - RNA, 64 nt, hsa; identical to SEQ ID NO: 41910

SEQ ID NO: 331449 - RNA, 64 nt, hsa; identical to SEQ ID NO: 41911

SEQ ID NO: 331450 - RNA, 64 nt, hsa; identical to SEQ ID NO: 41912

SEQ ID NO: 331451 - RNA, 64 nt, hsa; identical to SEQ ID NO: 41913

SEQ ID NO: 331452 - RNA, 64 nt, hsa; identical to SEQ ID NO: 41914

SEQ ID NO: 331453 - RNA, 64 nt, hsa; identical to SEQ ID NO: 41915

SEQ ID NO: 331454 - RNA, 64 nt, hsa; identical to SEQ ID NO: 41916

SEQ ID NO: 331455 - RNA, 64 nt, hsa; identical to SEQ ID NO: 41917

SEQ ID NO: 331456 - RNA, 64 nt, hsa; identical to SEQ ID NO: 41918

SEQ ID NO: 331457 - RNA, 64 nt, hsa; identical to SEQ ID NO: 41919

SEQ ID NO: 331458 - RNA, 64 nt, hsa; identical to SEQ ID NO: 41920

SEQ ID NO: 331459 - RNA, 64 nt, hsa; identical to SEQ ID NO: 41921

SEQ ID NO: 331460 - RNA, 64 nt, hsa; identical to SEQ ID NO: 41922

SEQ ID NO: 331461 - RNA, 64 nt, hsa; identical to SEQ ID NO: 41923

SEQ ID NO: 331462 - RNA, 64 nt, hsa; identical to SEQ ID NO: 41924

SEQ ID NO: 331463 - RNA, 64 nt, hsa; identical to SEQ ID NO: 41925

SEQ ID NO: 331464 - RNA, 64 nt, hsa; identical to SEQ ID NO: 41926

SEQ ID NO: 331465 - RNA, 64 nt, hsa; identical to SEQ ID NO: 41927

SEQ ID NO: 331466 - RNA, 64 nt, hsa; identical to SEQ ID NO: 41928

SEQ ID NO: 331467 - RNA, 64 nt, hsa; identical to SEQ ID NO: 41929

SEQ ID NO: 331468 - RNA, 64 nt, hsa; identical to SEQ ID NO: 41930

SEQ ID NO: 331469 - RNA, 64 nt, hsa; identical to SEQ ID NO: 41931

SEQ ID NO: 331470 - RNA, 64 nt, hsa; identical to SEQ ID NO: 41932

SEQ ID NO: 331471 - RNA, 64 nt, hsa; identical to SEQ ID NO: 41933

SEQ ID NO: 331472 - RNA, 64 nt, hsa; identical to SEQ ID NO: 41934

SEQ ID NO: 331473 - RNA, 64 nt, hsa; identical to SEQ ID NO: 41935

SEQ ID NO: 331474 - RNA, 64 nt, hsa; identical to SEQ ID NO: 41936

SEQ ID NO: 331475 - RNA, 64 nt, hsa; identical to SEQ ID NO: 41937

SEQ ID NO: 331476 - RNA, 64 nt, hsa; identical to SEQ ID NO: 41938

SEQ ID NO: 331477 - RNA, 64 nt, hsa; identical to SEQ ID NO: 41939

SEQ ID NO: 331478 - RNA, 64 nt, hsa; identical to SEQ ID NO: 41940

SEQ ID NO: 331479 - RNA, 64 nt, hsa; identical to SEQ ID NO: 41941

SEQ ID NO: 331480 - RNA, 64 nt, hsa; identical to SEQ ID NO: 41942

SEQ ID NO: 331481 - RNA, 64 nt, hsa; identical to SEQ ID NO: 41943

SEQ ID NO: 331482 - RNA, 64 nt, hsa; identical to SEQ ID NO: 41944

SEQ ID NO: 331483 - RNA, 64 nt, hsa; identical to SEQ ID NO: 41945

SEQ ID NO: 331484 - RNA, 64 nt, hsa; identical to SEQ ID NO: 41946

SEQ ID NO: 331485 - RNA, 64 nt, hsa; identical to SEQ ID NO: 41947

SEQ ID NO: 331486 - RNA, 64 nt, hsa; identical to SEQ ID NO: 41948

SEQ ID NO: 331487 - RNA, 64 nt, hsa; identical to SEQ ID NO: 41949

SEQ ID NO: 331488 - RNA, 64 nt, hsa; identical to SEQ ID NO: 41950

SEQ ID NO: 331489 - RNA, 64 nt, hsa; identical to SEQ ID NO: 41951

SEQ ID NO: 331490 - RNA, 64 nt, hsa; identical to SEQ ID NO: 41952

SEQ ID NO: 331491 - RNA, 64 nt, hsa; identical to SEQ ID NO: 41953

SEQ ID NO: 331492 - RNA, 64 nt, hsa; identical to SEQ ID NO: 41954

SEQ ID NO: 331493 - RNA, 64 nt, hsa; identical to SEQ ID NO: 41955

SEQ ID NO: 331494 - RNA, 64 nt, hsa; identical to SEQ ID NO: 41956

SEQ ID NO: 331495 - RNA, 64 nt, hsa; identical to SEQ ID NO: 41957

SEQ ID NO: 331496 - RNA, 64 nt, hsa; identical to SEQ ID NO: 41958

SEQ ID NO: 331497 - RNA, 64 nt, hsa; identical to SEQ ID NO: 41959

SEQ ID NO: 331498 - RNA, 64 nt, hsa; identical to SEQ ID NO: 41960

SEQ ID NO: 331499 - RNA, 64 nt, hsa; identical to SEQ ID NO: 41961

SEQ ID NO: 331500 - RNA, 64 nt, hsa; identical to SEQ ID NO: 41962

SEQ ID NO: 331501 - RNA, 64 nt, hsa; identical to SEQ ID NO: 41963

SEQ ID NO: 331502 - RNA, 64 nt, hsa; identical to SEQ ID NO: 41964

SEQ ID NO: 331503 - RNA, 64 nt, hsa; identical to SEQ ID NO: 41965

SEQ ID NO: 331504 - RNA, 64 nt, hsa; identical to SEQ ID NO: 41966

SEQ ID NO: 331505 - RNA, 64 nt, hsa; identical to SEQ ID NO: 41967

SEQ ID NO: 331506 - RNA, 64 nt, hsa; identical to SEQ ID NO: 41968

SEQ ID NO: 331507 - RNA, 64 nt, hsa; identical to SEQ ID NO: 41969

SEQ ID NO: 331508 - RNA, 64 nt, hsa; identical to SEQ ID NO: 41970

SEQ ID NO: 331509 - RNA, 64 nt, hsa; identical to SEQ ID NO: 41971

SEQ ID NO: 331510 - RNA, 64 nt, hsa; identical to SEQ ID NO: 41972

SEQ ID NO: 331511 - RNA, 64 nt, hsa; identical to SEQ ID NO: 41973

SEQ ID NO: 331512 - RNA, 64 nt, hsa; identical to SEQ ID NO: 41974

SEQ ID NO: 331513 - RNA, 64 nt, hsa; identical to SEQ ID NO: 41975

SEQ ID NO: 331514 - RNA, 64 nt, hsa; identical to SEQ ID NO: 41976

SEQ ID NO: 331515 - RNA, 64 nt, hsa; identical to SEQ ID NO: 41977

SEQ ID NO: 331516 - RNA, 64 nt, hsa; identical to SEQ ID NO: 41978

SEQ ID NO: 331517 - RNA, 64 nt, hsa; identical to SEQ ID NO: 41979

SEQ ID NO: 331518 - RNA, 64 nt, hsa; identical to SEQ ID NO: 41980

SEQ ID NO: 331519 - RNA, 64 nt, hsa; identical to SEQ ID NO: 41981

SEQ ID NO: 331520 - RNA, 64 nt, hsa; identical to SEQ ID NO: 41982

SEQ ID NO: 331521 - RNA, 64 nt, hsa; identical to SEQ ID NO: 41983

SEQ ID NO: 331522 - RNA, 64 nt, hsa; identical to SEQ ID NO: 41984

SEQ ID NO: 331523 - RNA, 64 nt, hsa; identical to SEQ ID NO: 41985

SEQ ID NO: 331524 - RNA, 64 nt, hsa; identical to SEQ ID NO: 41986

SEQ ID NO: 331525 - RNA, 64 nt, hsa; identical to SEQ ID NO: 41987

SEQ ID NO: 331526 - RNA, 64 nt, hsa; identical to SEQ ID NO: 41988

SEQ ID NO: 331527 - RNA, 64 nt, hsa; identical to SEQ ID NO: 41989

SEQ ID NO: 331528 - RNA, 64 nt, hsa; identical to SEQ ID NO: 41990

SEQ ID NO: 331529 - RNA, 64 nt, hsa; identical to SEQ ID NO: 41991

SEQ ID NO: 331530 - RNA, 64 nt, hsa; identical to SEQ ID NO: 41992

SEQ ID NO: 331531 - RNA, 64 nt, hsa; identical to SEQ ID NO: 41993

SEQ ID NO: 331532 - RNA, 64 nt, hsa; identical to SEQ ID NO: 41994

SEQ ID NO: 331533 - RNA, 64 nt, hsa; identical to SEQ ID NO: 41995

SEQ ID NO: 331534 - RNA, 64 nt, hsa; identical to SEQ ID NO: 41996

SEQ ID NO: 331535 - RNA, 64 nt, hsa; identical to SEQ ID NO: 41997

SEQ ID NO: 331536 - RNA, 64 nt, hsa; identical to SEQ ID NO: 41998

SEQ ID NO: 331537 - RNA, 64 nt, hsa; identical to SEQ ID NO: 41999

SEQ ID NO: 331538 - RNA, 64 nt, hsa; identical to SEQ ID NO: 42000

SEQ ID NO: 331539 - RNA, 64 nt, hsa; identical to SEQ ID NO: 42001

SEQ ID NO: 331540 - RNA, 64 nt, hsa; identical to SEQ ID NO: 42002

SEQ ID NO: 331541 - RNA, 64 nt, hsa; identical to SEQ ID NO: 42003

SEQ ID NO: 331542 - RNA, 64 nt, hsa; identical to SEQ ID NO: 42004

SEQ ID NO: 331543 - RNA, 64 nt, hsa; identical to SEQ ID NO: 42005

SEQ ID NO: 331544 - RNA, 64 nt, hsa; identical to SEQ ID NO: 42006

SEQ ID NO: 331545 - RNA, 64 nt, hsa; identical to SEQ ID NO: 42007

SEQ ID NO: 331546 - RNA, 64 nt, hsa; identical to SEQ ID NO: 42008

SEQ ID NO: 331547 - RNA, 64 nt, hsa; identical to SEQ ID NO: 42009

SEQ ID NO: 331548 - RNA, 64 nt, hsa; identical to SEQ ID NO: 42010

SEQ ID NO: 331549 - RNA, 64 nt, hsa; identical to SEQ ID NO: 42011

SEQ ID NO: 331550 - RNA, 64 nt, hsa; identical to SEQ ID NO: 42012

SEQ ID NO: 331551 - RNA, 64 nt, hsa; identical to SEQ ID NO: 42013

SEQ ID NO: 331552 - RNA, 64 nt, hsa; identical to SEQ ID NO: 42014

SEQ ID NO: 331553 - RNA, 64 nt, hsa; identical to SEQ ID NO: 42015

SEQ ID NO: 331554 - RNA, 64 nt, hsa; identical to SEQ ID NO: 42016

SEQ ID NO: 331555 - RNA, 64 nt, hsa; identical to SEQ ID NO: 42017

SEQ ID NO: 331556 - RNA, 64 nt, hsa; identical to SEQ ID NO: 42018

SEQ ID NO: 331557 - RNA, 64 nt, hsa; identical to SEQ ID NO: 42019

SEQ ID NO: 331558 - RNA, 64 nt, hsa; identical to SEQ ID NO: 42020

SEQ ID NO: 331559 - RNA, 64 nt, hsa; identical to SEQ ID NO: 42021

SEQ ID NO: 331560 - RNA, 64 nt, hsa; identical to SEQ ID NO: 42022

SEQ ID NO: 331561 - RNA, 64 nt, hsa; identical to SEQ ID NO: 42023

SEQ ID NO: 331562 - RNA, 64 nt, hsa; identical to SEQ ID NO: 42024

SEQ ID NO: 331563 - RNA, 64 nt, hsa; identical to SEQ ID NO: 42025

SEQ ID NO: 331564 - RNA, 64 nt, hsa; identical to SEQ ID NO: 42026

SEQ ID NO: 331565 - RNA, 64 nt, hsa; identical to SEQ ID NO: 42027

SEQ ID NO: 331566 - RNA, 64 nt, hsa; identical to SEQ ID NO: 42028

SEQ ID NO: 331567 - RNA, 64 nt, hsa; identical to SEQ ID NO: 42029

SEQ ID NO: 331568 - RNA, 64 nt, hsa; identical to SEQ ID NO: 42030

SEQ ID NO: 331569 - RNA, 64 nt, hsa; identical to SEQ ID NO: 42031

SEQ ID NO: 331570 - RNA, 64 nt, hsa; identical to SEQ ID NO: 42032

SEQ ID NO: 331571 - RNA, 64 nt, hsa; identical to SEQ ID NO: 42033

SEQ ID NO: 331572 - RNA, 64 nt, hsa; identical to SEQ ID NO: 42034

SEQ ID NO: 331573 - RNA, 64 nt, hsa; identical to SEQ ID NO: 42035

SEQ ID NO: 331574 - RNA, 64 nt, hsa; identical to SEQ ID NO: 42036

SEQ ID NO: 331575 - RNA, 64 nt, hsa; identical to SEQ ID NO: 42037

SEQ ID NO: 331576 - RNA, 64 nt, hsa; identical to SEQ ID NO: 42038

SEQ ID NO: 331577 - RNA, 64 nt, hsa; identical to SEQ ID NO: 42039

SEQ ID NO: 331578 - RNA, 64 nt, hsa; identical to SEQ ID NO: 42040

SEQ ID NO: 331579 - RNA, 64 nt, hsa; identical to SEQ ID NO: 42041

SEQ ID NO: 331580 - RNA, 64 nt, hsa; identical to SEQ ID NO: 42042

SEQ ID NO: 331581 - RNA, 64 nt, hsa; identical to SEQ ID NO: 42043

SEQ ID NO: 331582 - RNA, 64 nt, hsa; identical to SEQ ID NO: 42044

SEQ ID NO: 331583 - RNA, 64 nt, hsa; identical to SEQ ID NO: 42045

SEQ ID NO: 331584 - RNA, 64 nt, hsa; identical to SEQ ID NO: 42046

SEQ ID NO: 331585 - RNA, 64 nt, hsa; identical to SEQ ID NO: 42047

SEQ ID NO: 331586 - RNA, 64 nt, hsa; identical to SEQ ID NO: 42048

SEQ ID NO: 331587 - RNA, 64 nt, hsa; identical to SEQ ID NO: 42049

SEQ ID NO: 331588 - RNA, 64 nt, hsa; identical to SEQ ID NO: 42050

SEQ ID NO: 331589 - RNA, 64 nt, hsa; identical to SEQ ID NO: 42051

SEQ ID NO: 331590 - RNA, 64 nt, hsa; identical to SEQ ID NO: 42052

SEQ ID NO: 331591 - RNA, 64 nt, hsa; identical to SEQ ID NO: 42053

SEQ ID NO: 331592 - RNA, 64 nt, hsa; identical to SEQ ID NO: 42054

SEQ ID NO: 331593 - RNA, 64 nt, hsa; identical to SEQ ID NO: 42055

SEQ ID NO: 331594 - RNA, 64 nt, hsa; identical to SEQ ID NO: 42056

SEQ ID NO: 331595 - RNA, 64 nt, hsa; identical to SEQ ID NO: 42057

SEQ ID NO: 331596 - RNA, 64 nt, hsa; identical to SEQ ID NO: 42058

SEQ ID NO: 331597 - RNA, 64 nt, hsa; identical to SEQ ID NO: 42059

SEQ ID NO: 331598 - RNA, 64 nt, hsa; identical to SEQ ID NO: 42060

SEQ ID NO: 331599 - RNA, 64 nt, hsa; identical to SEQ ID NO: 42061

SEQ ID NO: 331600 - RNA, 64 nt, hsa; identical to SEQ ID NO: 42062

SEQ ID NO: 331601 - RNA, 64 nt, hsa; identical to SEQ ID NO: 42063

SEQ ID NO: 331602 - RNA, 64 nt, hsa; identical to SEQ ID NO: 42064

SEQ ID NO: 331603 - RNA, 64 nt, hsa; identical to SEQ ID NO: 42065

SEQ ID NO: 331604 - RNA, 64 nt, hsa; identical to SEQ ID NO: 42066

SEQ ID NO: 331605 - RNA, 64 nt, hsa; identical to SEQ ID NO: 42067

SEQ ID NO: 331606 - RNA, 64 nt, hsa; identical to SEQ ID NO: 42068

SEQ ID NO: 331607 - RNA, 64 nt, hsa; identical to SEQ ID NO: 42069

SEQ ID NO: 331608 - RNA, 64 nt, hsa; identical to SEQ ID NO: 42070

SEQ ID NO: 331609 - RNA, 64 nt, hsa; identical to SEQ ID NO: 42071

SEQ ID NO: 331610 - RNA, 64 nt, hsa; identical to SEQ ID NO: 42072

SEQ ID NO: 331611 - RNA, 64 nt, hsa; identical to SEQ ID NO: 42073

SEQ ID NO: 331612 - RNA, 64 nt, hsa; identical to SEQ ID NO: 42074

SEQ ID NO: 331613 - RNA, 64 nt, hsa; identical to SEQ ID NO: 42075

SEQ ID NO: 331614 - RNA, 64 nt, hsa; identical to SEQ ID NO: 42076

SEQ ID NO: 331615 - RNA, 64 nt, hsa; identical to SEQ ID NO: 42077

SEQ ID NO: 331616 - RNA, 64 nt, hsa; identical to SEQ ID NO: 42078

SEQ ID NO: 331617 - RNA, 64 nt, hsa; identical to SEQ ID NO: 42079

SEQ ID NO: 331618 - RNA, 64 nt, hsa; identical to SEQ ID NO: 42080

SEQ ID NO: 331619 - RNA, 64 nt, hsa; identical to SEQ ID NO: 42081

SEQ ID NO: 331620 - RNA, 64 nt, hsa; identical to SEQ ID NO: 42082

SEQ ID NO: 331621 - RNA, 64 nt, hsa; identical to SEQ ID NO: 42083

SEQ ID NO: 331622 - RNA, 64 nt, hsa; identical to SEQ ID NO: 42084

SEQ ID NO: 331623 - RNA, 64 nt, hsa; identical to SEQ ID NO: 42085

SEQ ID NO: 331624 - RNA, 64 nt, hsa; identical to SEQ ID NO: 42086

SEQ ID NO: 331625 - RNA, 64 nt, hsa; identical to SEQ ID NO: 42087

SEQ ID NO: 331626 - RNA, 64 nt, hsa; identical to SEQ ID NO: 42088

SEQ ID NO: 331627 - RNA, 64 nt, hsa; identical to SEQ ID NO: 42089

SEQ ID NO: 331628 - RNA, 64 nt, hsa; identical to SEQ ID NO: 42090

SEQ ID NO: 331629 - RNA, 64 nt, hsa; identical to SEQ ID NO: 42091

SEQ ID NO: 331630 - RNA, 64 nt, hsa; identical to SEQ ID NO: 42092

SEQ ID NO: 331631 - RNA, 64 nt, hsa; identical to SEQ ID NO: 42093

SEQ ID NO: 331632 - RNA, 64 nt, hsa; identical to SEQ ID NO: 42094

SEQ ID NO: 331633 - RNA, 64 nt, hsa; identical to SEQ ID NO: 42095

SEQ ID NO: 331634 - RNA, 64 nt, hsa; identical to SEQ ID NO: 42096

SEQ ID NO: 331635 - RNA, 64 nt, hsa; identical to SEQ ID NO: 42097

SEQ ID NO: 331636 - RNA, 64 nt, hsa; identical to SEQ ID NO: 42098

SEQ ID NO: 331637 - RNA, 64 nt, hsa; identical to SEQ ID NO: 42099

SEQ ID NO: 331638 - RNA, 64 nt, hsa; identical to SEQ ID NO: 42100

SEQ ID NO: 331639 - RNA, 64 nt, hsa; identical to SEQ ID NO: 42101

SEQ ID NO: 331640 - RNA, 64 nt, hsa; identical to SEQ ID NO: 41907

SEQ ID NO: 331641 - RNA, 64 nt, hsa; identical to SEQ ID NO: 41906

SEQ ID NO: 331642 - RNA, 64 nt, hsa; identical to SEQ ID NO: 41905

SEQ ID NO: 331643 - RNA, 64 nt, hsa; identical to SEQ ID NO: 41904

SEQ ID NO: 331644 - RNA, 64 nt, hsa; identical to SEQ ID NO: 42106

SEQ ID NO: 331645 - RNA, 64 nt, hsa; identical to SEQ ID NO: 42107

SEQ ID NO: 331646 - RNA, 64 nt, hsa; identical to SEQ ID NO: 42108

SEQ ID NO: 331647 - RNA, 64 nt, hsa; identical to SEQ ID NO: 42109

SEQ ID NO: 331648 - RNA, 64 nt, hsa; identical to SEQ ID NO: 42110

SEQ ID NO: 331649 - RNA, 64 nt, hsa; identical to SEQ ID NO: 42111

SEQ ID NO: 331650 - RNA, 64 nt, hsa; identical to SEQ ID NO: 42112

SEQ ID NO: 331651 - RNA, 64 nt, hsa; identical to SEQ ID NO: 42113

SEQ ID NO: 331652 - RNA, 64 nt, hsa; identical to SEQ ID NO: 42114

SEQ ID NO: 331653 - RNA, 64 nt, hsa; identical to SEQ ID NO: 42115

SEQ ID NO: 331654 - RNA, 64 nt, hsa; identical to SEQ ID NO: 42116

SEQ ID NO: 331655 - RNA, 64 nt, hsa; identical to SEQ ID NO: 42117

SEQ ID NO: 331656 - RNA, 64 nt, hsa; identical to SEQ ID NO: 42118

SEQ ID NO: 331657 - RNA, 64 nt, hsa; identical to SEQ ID NO: 42119

SEQ ID NO: 331658 - RNA, 64 nt, hsa; identical to SEQ ID NO: 42120

SEQ ID NO: 331659 - RNA, 64 nt, hsa; identical to SEQ ID NO: 42121

SEQ ID NO: 331660 - RNA, 64 nt, hsa; identical to SEQ ID NO: 42122

SEQ ID NO: 331661 - RNA, 64 nt, hsa; identical to SEQ ID NO: 42123

SEQ ID NO: 331662 - RNA, 64 nt, hsa; identical to SEQ ID NO: 42124

SEQ ID NO: 331663 - RNA, 64 nt, hsa; identical to SEQ ID NO: 42125

SEQ ID NO: 331664 - RNA, 64 nt, hsa; identical to SEQ ID NO: 42126

SEQ ID NO: 331665 - RNA, 64 nt, hsa; identical to SEQ ID NO: 42127

SEQ ID NO: 331666 - RNA, 64 nt, hsa; identical to SEQ ID NO: 42128

SEQ ID NO: 331667 - RNA, 64 nt, hsa; identical to SEQ ID NO: 42129

SEQ ID NO: 331668 - RNA, 64 nt, hsa; identical to SEQ ID NO: 42130

SEQ ID NO: 331669 - RNA, 64 nt, hsa; identical to SEQ ID NO: 42131

SEQ ID NO: 331670 - RNA, 64 nt, hsa; identical to SEQ ID NO: 42132

SEQ ID NO: 331671 - RNA, 64 nt, hsa; identical to SEQ ID NO: 42133

SEQ ID NO: 331672 - RNA, 64 nt, hsa; identical to SEQ ID NO: 42134

SEQ ID NO: 331673 - RNA, 64 nt, hsa; identical to SEQ ID NO: 42135

SEQ ID NO: 331674 - RNA, 64 nt, hsa; identical to SEQ ID NO: 42136

SEQ ID NO: 331675 - RNA, 64 nt, hsa; identical to SEQ ID NO: 42137

SEQ ID NO: 331676 - RNA, 64 nt, hsa; identical to SEQ ID NO: 42138

SEQ ID NO: 331677 - RNA, 64 nt, hsa; identical to SEQ ID NO: 42139

SEQ ID NO: 331678 - RNA, 64 nt, hsa; identical to SEQ ID NO: 42140

SEQ ID NO: 331679 - RNA, 64 nt, hsa; identical to SEQ ID NO: 42141

SEQ ID NO: 331680 - RNA, 64 nt, hsa; identical to SEQ ID NO: 42142

SEQ ID NO: 331681 - RNA, 64 nt, hsa; identical to SEQ ID NO: 42143

SEQ ID NO: 331682 - RNA, 64 nt, hsa; identical to SEQ ID NO: 42144

SEQ ID NO: 331683 - RNA, 64 nt, hsa; identical to SEQ ID NO: 42145

SEQ ID NO: 331684 - RNA, 64 nt, hsa; identical to SEQ ID NO: 42146

SEQ ID NO: 331685 - RNA, 64 nt, hsa; identical to SEQ ID NO: 42147

SEQ ID NO: 331686 - RNA, 64 nt, hsa; identical to SEQ ID NO: 42148

SEQ ID NO: 331687 - RNA, 64 nt, hsa; identical to SEQ ID NO: 42149

SEQ ID NO: 331688 - RNA, 64 nt, hsa; identical to SEQ ID NO: 42150

SEQ ID NO: 331689 - RNA, 64 nt, hsa; identical to SEQ ID NO: 42151

SEQ ID NO: 331690 - RNA, 64 nt, hsa; identical to SEQ ID NO: 42152

SEQ ID NO: 331691 - RNA, 64 nt, hsa; identical to SEQ ID NO: 42153

SEQ ID NO: 331692 - RNA, 64 nt, hsa; identical to SEQ ID NO: 42154

SEQ ID NO: 331693 - RNA, 64 nt, hsa; identical to SEQ ID NO: 42155

SEQ ID NO: 331694 - RNA, 64 nt, hsa; identical to SEQ ID NO: 42156

SEQ ID NO: 331695 - RNA, 64 nt, hsa; identical to SEQ ID NO: 42157

SEQ ID NO: 331696 - RNA, 64 nt, hsa; identical to SEQ ID NO: 42158

SEQ ID NO: 331697 - RNA, 64 nt, hsa; identical to SEQ ID NO: 42159

SEQ ID NO: 331698 - RNA, 64 nt, hsa; identical to SEQ ID NO: 42160

SEQ ID NO: 331699 - RNA, 64 nt, hsa; identical to SEQ ID NO: 42161

SEQ ID NO: 331700 - RNA, 64 nt, hsa; identical to SEQ ID NO: 42162

SEQ ID NO: 331701 - RNA, 64 nt, hsa; identical to SEQ ID NO: 42163

SEQ ID NO: 331702 - RNA, 64 nt, hsa; identical to SEQ ID NO: 42164

SEQ ID NO: 331703 - RNA, 64 nt, hsa; identical to SEQ ID NO: 42165

SEQ ID NO: 331704 - RNA, 64 nt, hsa; identical to SEQ ID NO: 42166

SEQ ID NO: 331705 - RNA, 64 nt, hsa; identical to SEQ ID NO: 42167

SEQ ID NO: 331706 - RNA, 64 nt, hsa; identical to SEQ ID NO: 42168

SEQ ID NO: 331707 - RNA, 64 nt, hsa; identical to SEQ ID NO: 42169

SEQ ID NO: 331708 - RNA, 64 nt, hsa; identical to SEQ ID NO: 42170

SEQ ID NO: 331709 - RNA, 64 nt, hsa; identical to SEQ ID NO: 42171

SEQ ID NO: 331710 - RNA, 64 nt, hsa; identical to SEQ ID NO: 42172

SEQ ID NO: 331711 - RNA, 64 nt, hsa; identical to SEQ ID NO: 42173

SEQ ID NO: 331712 - RNA, 64 nt, hsa; identical to SEQ ID NO: 42174

SEQ ID NO: 331713 - RNA, 64 nt, hsa; identical to SEQ ID NO: 42175

SEQ ID NO: 331714 - RNA, 64 nt, hsa; identical to SEQ ID NO: 42176

SEQ ID NO: 331715 - RNA, 64 nt, hsa; identical to SEQ ID NO: 42177

SEQ ID NO: 331716 - RNA, 64 nt, hsa; identical to SEQ ID NO: 42178

SEQ ID NO: 331717 - RNA, 64 nt, hsa; identical to SEQ ID NO: 42179

SEQ ID NO: 331718 - RNA, 64 nt, hsa; identical to SEQ ID NO: 42180

SEQ ID NO: 331719 - RNA, 64 nt, hsa; identical to SEQ ID NO: 42181

SEQ ID NO: 331720 - RNA, 64 nt, hsa; identical to SEQ ID NO: 42182

SEQ ID NO: 331721 - RNA, 64 nt, hsa; identical to SEQ ID NO: 42183

SEQ ID NO: 331722 - RNA, 64 nt, hsa; identical to SEQ ID NO: 42184

SEQ ID NO: 331723 - RNA, 64 nt, hsa; identical to SEQ ID NO: 42185

SEQ ID NO: 331724 - RNA, 64 nt, hsa; identical to SEQ ID NO: 42186

SEQ ID NO: 331725 - RNA, 64 nt, hsa; identical to SEQ ID NO: 42187

SEQ ID NO: 331726 - RNA, 64 nt, hsa; identical to SEQ ID NO: 42188

SEQ ID NO: 331727 - RNA, 64 nt, hsa; identical to SEQ ID NO: 42189

SEQ ID NO: 331728 - RNA, 64 nt, hsa; identical to SEQ ID NO: 42190

SEQ ID NO: 331729 - RNA, 64 nt, hsa; identical to SEQ ID NO: 42191

SEQ ID NO: 331730 - RNA, 64 nt, hsa; identical to SEQ ID NO: 42192

SEQ ID NO: 331731 - RNA, 64 nt, hsa; identical to SEQ ID NO: 42193

SEQ ID NO: 331732 - RNA, 64 nt, hsa; identical to SEQ ID NO: 42194

SEQ ID NO: 331733 - RNA, 64 nt, hsa; identical to SEQ ID NO: 42195

SEQ ID NO: 331734 - RNA, 64 nt, hsa; identical to SEQ ID NO: 42196

SEQ ID NO: 331735 - RNA, 64 nt, hsa; identical to SEQ ID NO: 42197

SEQ ID NO: 331736 - RNA, 64 nt, hsa; identical to SEQ ID NO: 42198

SEQ ID NO: 331737 - RNA, 64 nt, hsa; identical to SEQ ID NO: 42199

SEQ ID NO: 331738 - RNA, 64 nt, hsa; identical to SEQ ID NO: 42200

SEQ ID NO: 331739 - RNA, 64 nt, hsa; identical to SEQ ID NO: 42201

SEQ ID NO: 331740 - RNA, 64 nt, hsa; identical to SEQ ID NO: 42202

SEQ ID NO: 331741 - RNA, 64 nt, hsa; identical to SEQ ID NO: 42203

SEQ ID NO: 331742 - RNA, 64 nt, hsa; identical to SEQ ID NO: 42204

SEQ ID NO: 331743 - RNA, 64 nt, hsa; identical to SEQ ID NO: 42205

SEQ ID NO: 331744 - RNA, 64 nt, hsa; identical to SEQ ID NO: 42206

SEQ ID NO: 331745 - RNA, 64 nt, hsa; identical to SEQ ID NO: 42207

SEQ ID NO: 331746 - RNA, 64 nt, hsa; identical to SEQ ID NO: 42208

SEQ ID NO: 331747 - RNA, 64 nt, hsa; identical to SEQ ID NO: 42209

SEQ ID NO: 331748 - RNA, 64 nt, hsa; identical to SEQ ID NO: 42210

SEQ ID NO: 331749 - RNA, 64 nt, hsa; identical to SEQ ID NO: 42211

SEQ ID NO: 331750 - RNA, 64 nt, hsa; identical to SEQ ID NO: 42212

SEQ ID NO: 331751 - RNA, 64 nt, hsa; identical to SEQ ID NO: 42213

SEQ ID NO: 331752 - RNA, 64 nt, hsa; identical to SEQ ID NO: 42214

SEQ ID NO: 331753 - RNA, 64 nt, hsa; identical to SEQ ID NO: 42215

SEQ ID NO: 331754 - RNA, 64 nt, hsa; identical to SEQ ID NO: 42216

SEQ ID NO: 331755 - RNA, 64 nt, hsa; identical to SEQ ID NO: 42217

SEQ ID NO: 331756 - RNA, 64 nt, hsa; identical to SEQ ID NO: 42218

SEQ ID NO: 331757 - RNA, 64 nt, hsa; identical to SEQ ID NO: 42219

SEQ ID NO: 331758 - RNA, 64 nt, hsa; identical to SEQ ID NO: 42220

SEQ ID NO: 331759 - RNA, 64 nt, hsa; identical to SEQ ID NO: 42221

SEQ ID NO: 331760 - RNA, 64 nt, hsa; identical to SEQ ID NO: 42222

SEQ ID NO: 331761 - RNA, 64 nt, hsa; identical to SEQ ID NO: 42223

SEQ ID NO: 331762 - RNA, 64 nt, hsa; identical to SEQ ID NO: 42224

SEQ ID NO: 331763 - RNA, 64 nt, hsa; identical to SEQ ID NO: 42225

SEQ ID NO: 331764 - RNA, 64 nt, hsa; identical to SEQ ID NO: 42226

SEQ ID NO: 331765 - RNA, 64 nt, hsa; identical to SEQ ID NO: 42227

SEQ ID NO: 331766 - RNA, 64 nt, hsa; identical to SEQ ID NO: 42228

SEQ ID NO: 331767 - RNA, 64 nt, hsa; identical to SEQ ID NO: 42229

SEQ ID NO: 331768 - RNA, 64 nt, hsa; identical to SEQ ID NO: 42230

SEQ ID NO: 331769 - RNA, 64 nt, hsa; identical to SEQ ID NO: 42231

SEQ ID NO: 331770 - RNA, 64 nt, hsa; identical to SEQ ID NO: 42232

SEQ ID NO: 331771 - RNA, 64 nt, hsa; identical to SEQ ID NO: 42233

SEQ ID NO: 331772 - RNA, 64 nt, hsa; identical to SEQ ID NO: 42234

SEQ ID NO: 331773 - RNA, 64 nt, hsa; identical to SEQ ID NO: 42235

SEQ ID NO: 331774 - RNA, 64 nt, hsa; identical to SEQ ID NO: 297889

SEQ ID NO: 331775 - RNA, 64 nt, hsa; identical to SEQ ID NO: 297890

SEQ ID NO: 331776 - RNA, 64 nt, hsa; identical to SEQ ID NO: 297891

SEQ ID NO: 331777 - RNA, 64 nt, hsa; identical to SEQ ID NO: 297892

SEQ ID NO: 331778 - RNA, 64 nt, hsa; identical to SEQ ID NO: 297893

SEQ ID NO: 331779 - RNA, 64 nt, hsa; identical to SEQ ID NO: 297894

SEQ ID NO: 331780 - RNA, 64 nt, hsa; identical to SEQ ID NO: 297895

SEQ ID NO: 331781 - RNA, 64 nt, hsa; identical to SEQ ID NO: 297896

SEQ ID NO: 331782 - RNA, 64 nt, hsa; identical to SEQ ID NO: 297897

SEQ ID NO: 331783 - RNA, 64 nt, hsa; identical to SEQ ID NO: 297898

SEQ ID NO: 331784 - RNA, 64 nt, hsa; identical to SEQ ID NO: 297899

SEQ ID NO: 331785 - RNA, 64 nt, hsa; identical to SEQ ID NO: 297900

SEQ ID NO: 331786 - RNA, 64 nt, hsa; identical to SEQ ID NO: 297901

SEQ ID NO: 331787 - RNA, 64 nt, hsa; identical to SEQ ID NO: 297902

SEQ ID NO: 331788 - RNA, 64 nt, hsa; identical to SEQ ID NO: 297903

SEQ ID NO: 331789 - RNA, 64 nt, hsa; identical to SEQ ID NO: 297904

SEQ ID NO: 331790 - RNA, 64 nt, hsa; identical to SEQ ID NO: 297905

SEQ ID NO: 331791 - RNA, 64 nt, hsa; identical to SEQ ID NO: 297906

SEQ ID NO: 331792 - RNA, 64 nt, hsa; identical to SEQ ID NO: 297907

SEQ ID NO: 331793 - RNA, 64 nt, hsa; identical to SEQ ID NO: 297908

SEQ ID NO: 331794 - RNA, 64 nt, hsa; identical to SEQ ID NO: 297909

SEQ ID NO: 331795 - RNA, 64 nt, hsa; identical to SEQ ID NO: 297910

SEQ ID NO: 331796 - RNA, 57 nt, hsa; identical to SEQ ID NO: 50763

SEQ ID NO: 331797 - RNA, 64 nt, hsa; identical to SEQ ID NO: 50764

SEQ ID NO: 331798 - RNA, 64 nt, hsa; identical to SEQ ID NO: 50765

SEQ ID NO: 331799 - RNA, 64 nt, hsa; identical to SEQ ID NO: 50766

SEQ ID NO: 331800 - RNA, 64 nt, hsa; identical to SEQ ID NO: 50767

SEQ ID NO: 331801 - RNA, 64 nt, hsa; identical to SEQ ID NO: 50768

SEQ ID NO: 331802 - RNA, 64 nt, hsa; identical to SEQ ID NO: 50769

SEQ ID NO: 331803 - RNA, 64 nt, hsa; identical to SEQ ID NO: 50770

SEQ ID NO: 331804 - RNA, 64 nt, hsa; identical to SEQ ID NO: 50771

SEQ ID NO: 331805 - RNA, 64 nt, hsa; identical to SEQ ID NO: 50772

SEQ ID NO: 331806 - RNA, 64 nt, hsa; identical to SEQ ID NO: 50773

SEQ ID NO: 331807 - RNA, 64 nt, hsa; identical to SEQ ID NO: 50774

SEQ ID NO: 331808 - RNA, 64 nt, hsa; identical to SEQ ID NO: 50775

SEQ ID NO: 331809 - RNA, 64 nt, hsa; identical to SEQ ID NO: 50776

SEQ ID NO: 331810 - RNA, 64 nt, hsa; identical to SEQ ID NO: 50777

SEQ ID NO: 331811 - RNA, 64 nt, hsa; identical to SEQ ID NO: 50778

SEQ ID NO: 331812 - RNA, 64 nt, hsa; identical to SEQ ID NO: 50779

SEQ ID NO: 331813 - RNA, 64 nt, hsa; identical to SEQ ID NO: 50780

SEQ ID NO: 331814 - RNA, 64 nt, hsa; identical to SEQ ID NO: 50781

SEQ ID NO: 331815 - RNA, 64 nt, hsa; identical to SEQ ID NO: 50782

SEQ ID NO: 331816 - RNA, 64 nt, hsa; identical to SEQ ID NO: 50783

SEQ ID NO: 331817 - RNA, 64 nt, hsa; identical to SEQ ID NO: 50784

SEQ ID NO: 331818 - RNA, 64 nt, hsa; identical to SEQ ID NO: 50785

SEQ ID NO: 331819 - RNA, 64 nt, hsa; identical to SEQ ID NO: 50786

SEQ ID NO: 331820 - RNA, 64 nt, hsa; identical to SEQ ID NO: 50787

SEQ ID NO: 331821 - RNA, 64 nt, hsa; identical to SEQ ID NO: 50788

SEQ ID NO: 331822 - RNA, 64 nt, hsa; identical to SEQ ID NO: 50789

SEQ ID NO: 331823 - RNA, 64 nt, hsa; identical to SEQ ID NO: 50790

SEQ ID NO: 331824 - RNA, 64 nt, hsa; identical to SEQ ID NO: 50791

SEQ ID NO: 331825 - RNA, 64 nt, hsa; identical to SEQ ID NO: 50792

SEQ ID NO: 331826 - RNA, 64 nt, hsa; identical to SEQ ID NO: 50793

SEQ ID NO: 331827 - RNA, 64 nt, hsa; identical to SEQ ID NO: 50794

SEQ ID NO: 331828 - RNA, 64 nt, hsa; identical to SEQ ID NO: 50795

SEQ ID NO: 331829 - RNA, 64 nt, hsa; identical to SEQ ID NO: 50796

SEQ ID NO: 331830 - RNA, 64 nt, hsa; identical to SEQ ID NO: 50797

SEQ ID NO: 331831 - RNA, 64 nt, hsa; identical to SEQ ID NO: 50798

SEQ ID NO: 331832 - RNA, 64 nt, hsa; identical to SEQ ID NO: 50799

SEQ ID NO: 331833 - RNA, 64 nt, hsa; identical to SEQ ID NO: 50800

SEQ ID NO: 331834 - RNA, 64 nt, hsa; identical to SEQ ID NO: 50801

SEQ ID NO: 331835 - RNA, 64 nt, hsa; identical to SEQ ID NO: 50802

SEQ ID NO: 331836 - RNA, 64 nt, hsa; identical to SEQ ID NO: 50803

SEQ ID NO: 331837 - RNA, 64 nt, hsa; identical to SEQ ID NO: 50804

SEQ ID NO: 331838 - RNA, 64 nt, hsa; identical to SEQ ID NO: 50805

SEQ ID NO: 331839 - RNA, 64 nt, hsa; identical to SEQ ID NO: 50806

SEQ ID NO: 331840 - RNA, 64 nt, hsa; identical to SEQ ID NO: 50807

SEQ ID NO: 331841 - RNA, 64 nt, hsa; identical to SEQ ID NO: 50808

SEQ ID NO: 331842 - RNA, 64 nt, hsa; identical to SEQ ID NO: 50809

SEQ ID NO: 331843 - RNA, 64 nt, hsa; identical to SEQ ID NO: 50810

SEQ ID NO: 331844 - RNA, 64 nt, hsa; identical to SEQ ID NO: 50811

SEQ ID NO: 331845 - RNA, 64 nt, hsa; identical to SEQ ID NO: 50812

SEQ ID NO: 331846 - RNA, 64 nt, hsa; identical to SEQ ID NO: 50813

SEQ ID NO: 331847 - RNA, 64 nt, hsa; identical to SEQ ID NO: 50814

SEQ ID NO: 331848 - RNA, 64 nt, hsa; identical to SEQ ID NO: 50815

SEQ ID NO: 331849 - RNA, 64 nt, hsa; identical to SEQ ID NO: 50816

SEQ ID NO: 331850 - RNA, 64 nt, hsa; identical to SEQ ID NO: 50817

SEQ ID NO: 331851 - RNA, 64 nt, hsa; identical to SEQ ID NO: 50818

SEQ ID NO: 331852 - RNA, 64 nt, hsa; identical to SEQ ID NO: 50819

SEQ ID NO: 331853 - RNA, 64 nt, hsa; identical to SEQ ID NO: 50820

SEQ ID NO: 331854 - RNA, 64 nt, hsa; identical to SEQ ID NO: 50821

SEQ ID NO: 331855 - RNA, 64 nt, hsa; identical to SEQ ID NO: 50822

SEQ ID NO: 331856 - RNA, 64 nt, hsa; identical to SEQ ID NO: 50823

SEQ ID NO: 331857 - RNA, 64 nt, hsa; identical to SEQ ID NO: 50824

SEQ ID NO: 331858 - RNA, 64 nt, hsa; identical to SEQ ID NO: 50825

SEQ ID NO: 331859 - RNA, 64 nt, hsa; identical to SEQ ID NO: 50826

SEQ ID NO: 331860 - RNA, 64 nt, hsa; identical to SEQ ID NO: 50827

SEQ ID NO: 331861 - RNA, 64 nt, hsa; identical to SEQ ID NO: 50828

SEQ ID NO: 331862 - RNA, 64 nt, hsa; identical to SEQ ID NO: 50829

SEQ ID NO: 331863 - RNA, 64 nt, hsa; identical to SEQ ID NO: 50830

SEQ ID NO: 331864 - RNA, 64 nt, hsa; identical to SEQ ID NO: 50831

SEQ ID NO: 331865 - RNA, 64 nt, hsa; identical to SEQ ID NO: 50832

SEQ ID NO: 331866 - RNA, 64 nt, hsa; identical to SEQ ID NO: 50833

SEQ ID NO: 331867 - RNA, 64 nt, hsa; identical to SEQ ID NO: 50834

SEQ ID NO: 331868 - RNA, 64 nt, hsa; identical to SEQ ID NO: 50835

SEQ ID NO: 331869 - RNA, 64 nt, hsa; identical to SEQ ID NO: 50836

SEQ ID NO: 331870 - RNA, 64 nt, hsa; identical to SEQ ID NO: 50837

SEQ ID NO: 331871 - RNA, 64 nt, hsa; identical to SEQ ID NO: 50838

SEQ ID NO: 331872 - RNA, 64 nt, hsa; identical to SEQ ID NO: 50839

SEQ ID NO: 331873 - RNA, 64 nt, hsa; identical to SEQ ID NO: 50840

SEQ ID NO: 331874 - RNA, 64 nt, hsa; identical to SEQ ID NO: 50841

SEQ ID NO: 331875 - RNA, 64 nt, hsa; identical to SEQ ID NO: 50842

SEQ ID NO: 331876 - RNA, 64 nt, hsa; identical to SEQ ID NO: 50843

SEQ ID NO: 331877 - RNA, 64 nt, hsa; identical to SEQ ID NO: 50844

SEQ ID NO: 331878 - RNA, 64 nt, hsa; identical to SEQ ID NO: 50845

SEQ ID NO: 331879 - RNA, 64 nt, hsa
auugacuuuuaggagccguucuccccacaagacaccacaugacaagggguauaagccccagccc

SEQ ID NO: 331880 - RNA, 64 nt, hsa
uauuuuaauuugagaaauaaagauuuccuccaagccacaugaggacucuggcacccacccacaa

SEQ ID NO: 331881 - RNA, 64 nt, hsa
acgucuacaacuacaauguccaaugagccacuagccacaugaggcuauuuaaguaaauuuaguu

SEQ ID NO: 331882 - RNA, 64 nt, hsa
caaaguuccagcuuguguagucucuuuuuauugaccacaugaaucgaaaacacucaucacaauu

SEQ ID NO: 331883 - RNA, 64 nt, hsa
aacuauuugaccaugauaauucaguuuauauucaccacaugaaagaaaaauggguaacagaaga

SEQ ID NO: 331884 - RNA, 64 nt, hsa
gaauagaugauaacaauuaauauuacuaaaagucccacaugagaguccugacgcccucuccaug

SEQ ID NO: 331885 - RNA, 64 nt, hsa
uguuucccucauggccgaccagggcggggauagcaugcccaauuuuagcccugaagcagggcug

SEQ ID NO: 331886 - RNA, 64 nt, hsa
ggccccuuccccuuuauggggcuucccccaucugaugcccaagagggcuccucugcaaugacug

SEQ ID NO: 331887 - RNA, 64 nt, hsa
acacacacucucucucucucucaaacacacacaaaugcccaaccagcucuaagagggcacugaa

SEQ ID NO: 331888 - RNA, 64 nt, hsa
uuccaggauccccugcagaugccaaaauacauggaugcccaaguccucagcuaaaaauagcgua

SEQ ID NO: 331889 - RNA, 64 nt, hsa
gugcaggacacaauccaaaucauaaaccuggcucaugcccaacacauuucugcuaauagggaga

SEQ ID NO: 331890 - RNA, 64 nt, hsa
ugaggggcccugccuuccucaguagggagucaacaugcccaagucauuugcaccuuuaccucuc

SEQ ID NO: 331891 - RNA, 64 nt, hsa
gggcaagggcuggggcugggaugggagggugaagaugcccaagcugaagaugccuuccuuuggg

SEQ ID NO: 331892 - RNA, 64 nt, hsa
gauggaauuuggcuucaagaugcccaagaugaccaugcccaagcuagggagggcagagucccca

SEQ ID NO: 331893 - RNA, 64 nt, hsa
agaacaggcagaagggauggaauuuggcuucaagaugcccaagaugaccaugcccaagcuaggg

SEQ ID NO: 331894 - RNA, 63 nt, hsa; identical to SEQ ID NO: 57603

SEQ ID NO: 331895 - RNA, 64 nt, hsa; identical to SEQ ID NO: 57604

SEQ ID NO: 331896 - RNA, 64 nt, hsa; identical to SEQ ID NO: 57605

SEQ ID NO: 331897 - RNA, 64 nt, hsa; identical to SEQ ID NO: 57606

SEQ ID NO: 331898 - RNA, 64 nt, hsa; identical to SEQ ID NO: 57607

SEQ ID NO: 331899 - RNA, 64 nt, hsa; identical to SEQ ID NO: 57608

SEQ ID NO: 331900 - RNA, 64 nt, hsa; identical to SEQ ID NO: 57609

SEQ ID NO: 331901 - RNA, 64 nt, hsa; identical to SEQ ID NO: 57610

SEQ ID NO: 331902 - RNA, 64 nt, hsa; identical to SEQ ID NO: 57611

SEQ ID NO: 331903 - RNA, 64 nt, hsa; identical to SEQ ID NO: 57612

SEQ ID NO: 331904 - RNA, 64 nt, hsa; identical to SEQ ID NO: 57613

SEQ ID NO: 331905 - RNA, 64 nt, hsa; identical to SEQ ID NO: 57614

SEQ ID NO: 331906 - RNA, 64 nt, hsa; identical to SEQ ID NO: 97744

SEQ ID NO: 331907 - RNA, 64 nt, hsa; identical to SEQ ID NO: 97745

SEQ ID NO: 331908 - RNA, 64 nt, hsa; identical to SEQ ID NO: 97746

SEQ ID NO: 331909 - RNA, 64 nt, hsa; identical to SEQ ID NO: 97747

SEQ ID NO: 331910 - RNA, 64 nt, hsa; identical to SEQ ID NO: 97748

SEQ ID NO: 331911 - RNA, 64 nt, hsa; identical to SEQ ID NO: 97749

SEQ ID NO: 331912 - RNA, 64 nt, hsa; identical to SEQ ID NO: 97750

SEQ ID NO: 331913 - RNA, 64 nt, hsa; identical to SEQ ID NO: 97751

SEQ ID NO: 331914 - RNA, 64 nt, hsa; identical to SEQ ID NO: 97752

SEQ ID NO: 331915 - RNA, 64 nt, hsa; identical to SEQ ID NO: 97753

SEQ ID NO: 331916 - RNA, 64 nt, hsa; identical to SEQ ID NO: 97754

SEQ ID NO: 331917 - RNA, 64 nt, hsa; identical to SEQ ID NO: 97755

SEQ ID NO: 331918 - RNA, 64 nt, hsa; identical to SEQ ID NO: 97756

SEQ ID NO: 331919 - RNA, 64 nt, hsa; identical to SEQ ID NO: 97757

SEQ ID NO: 331920 - RNA, 64 nt, hsa; identical to SEQ ID NO: 97758

SEQ ID NO: 331921 - RNA, 64 nt, hsa; identical to SEQ ID NO: 97759

SEQ ID NO: 331922 - RNA, 64 nt, hsa; identical to SEQ ID NO: 97760

SEQ ID NO: 331923 - RNA, 64 nt, hsa; identical to SEQ ID NO: 97761

SEQ ID NO: 331924 - RNA, 64 nt, hsa; identical to SEQ ID NO: 97762

SEQ ID NO: 331925 - RNA, 64 nt, hsa; identical to SEQ ID NO: 97763

SEQ ID NO: 331926 - RNA, 64 nt, hsa; identical to SEQ ID NO: 97764

SEQ ID NO: 331927 - RNA, 64 nt, hsa; identical to SEQ ID NO: 97765

SEQ ID NO: 331928 - RNA, 64 nt, hsa; identical to SEQ ID NO: 97766

SEQ ID NO: 331929 - RNA, 64 nt, hsa; identical to SEQ ID NO: 97767

SEQ ID NO: 331930 - RNA, 64 nt, hsa; identical to SEQ ID NO: 97768

SEQ ID NO: 331931 - RNA, 64 nt, hsa; identical to SEQ ID NO: 97769

SEQ ID NO: 331932 - RNA, 64 nt, hsa; identical to SEQ ID NO: 97770

SEQ ID NO: 331933 - RNA, 64 nt, hsa; identical to SEQ ID NO: 97771

SEQ ID NO: 331934 - RNA, 64 nt, hsa; identical to SEQ ID NO: 97772

SEQ ID NO: 331935 - RNA, 64 nt, hsa; identical to SEQ ID NO: 97773

SEQ ID NO: 331936 - RNA, 64 nt, hsa; identical to SEQ ID NO: 97774

SEQ ID NO: 331937 - RNA, 64 nt, hsa; identical to SEQ ID NO: 97775

SEQ ID NO: 331938 - RNA, 64 nt, hsa; identical to SEQ ID NO: 97776

SEQ ID NO: 331939 - RNA, 64 nt, hsa; identical to SEQ ID NO: 97777

SEQ ID NO: 331940 - RNA, 64 nt, hsa; identical to SEQ ID NO: 97778

SEQ ID NO: 331941 - RNA, 64 nt, hsa; identical to SEQ ID NO: 97779

SEQ ID NO: 331942 - RNA, 64 nt, hsa; identical to SEQ ID NO: 97780

SEQ ID NO: 331943 - RNA, 64 nt, hsa; identical to SEQ ID NO: 97781

SEQ ID NO: 331944 - RNA, 64 nt, hsa; identical to SEQ ID NO: 97782

SEQ ID NO: 331945 - RNA, 64 nt, hsa; identical to SEQ ID NO: 97783

SEQ ID NO: 331946 - RNA, 64 nt, hsa; identical to SEQ ID NO: 97784

SEQ ID NO: 331947 - RNA, 64 nt, hsa; identical to SEQ ID NO: 97785

SEQ ID NO: 331948 - RNA, 64 nt, hsa
acaauucuuuugucaaaaaguguguauauauguuugcaucuacauauauuuguacaucuauaug

SEQ ID NO: 331949 - RNA, 64 nt, hsa
gaacagaccuaacuagugaauguauuaaugaaaaugcaucuauuucagagcugacaugaagagu

SEQ ID NO: 331950 - RNA, 64 nt, hsa
augucaaagugcuuacagugcagguagugauaugugcaucuacugcagugaaggcacuuguagc

SEQ ID NO: 331951 - RNA, 64 nt, hsa
ggccugcugauguugagugcuuuuuguucuaaggugcaucuagugcagauagugaaguagauua

SEQ ID NO: 331952 - RNA, 64 nt, hsa
agcccugugucuuuccauagucagggucaggcccugcaucuauuccaaggggcacucaguacac

SEQ ID NO: 331953 - RNA, 64 nt, hsa
cccugaguuaacccguaaggccuuccguguaaccugcaucuagaguuuaagaagcuucugcugu

SEQ ID NO: 331954 - RNA, 64 nt, hsa
caaaacaaaacaaaacaaacaaacaaacaaaacuugcaucuaaccaaaaagucuugguuuuauc

SEQ ID NO: 331955 - RNA, 64 nt, hsa
gauaacgaagugcacuuacacuuauaaaauaacuugcaucuaggcugggcguggcggcucacgc

SEQ ID NO: 331956 - RNA, 64 nt, hsa; identical to SEQ ID NO: 221340

SEQ ID NO: 331957 - RNA, 64 nt, hsa; identical to SEQ ID NO: 221341

SEQ ID NO: 331958 - RNA, 64 nt, hsa; identical to SEQ ID NO: 221342

SEQ ID NO: 331959 - RNA, 64 nt, hsa; identical to SEQ ID NO: 221343

SEQ ID NO: 331960 - RNA, 64 nt, hsa; identical to SEQ ID NO: 221344

SEQ ID NO: 331961 - RNA, 64 nt, hsa; identical to SEQ ID NO: 221345

SEQ ID NO: 331962 - RNA, 64 nt, hsa; identical to SEQ ID NO: 221346

SEQ ID NO: 331963 - RNA, 64 nt, hsa; identical to SEQ ID NO: 221347

SEQ ID NO: 331964 - RNA, 64 nt, hsa; identical to SEQ ID NO: 221348

SEQ ID NO: 331965 - RNA, 64 nt, hsa; identical to SEQ ID NO: 221349

SEQ ID NO: 331966 - RNA, 64 nt, hsa; identical to SEQ ID NO: 221350

SEQ ID NO: 331967 - RNA, 64 nt, hsa; identical to SEQ ID NO: 221351

SEQ ID NO: 331968 - RNA, 64 nt, hsa; identical to SEQ ID NO: 221352

SEQ ID NO: 331969 - RNA, 64 nt, hsa; identical to SEQ ID NO: 221353

SEQ ID NO: 331970 - RNA, 64 nt, hsa; identical to SEQ ID NO: 221354

SEQ ID NO: 331971 - RNA, 64 nt, hsa; identical to SEQ ID NO: 221355

SEQ ID NO: 331972 - RNA, 64 nt, hsa; identical to SEQ ID NO: 221356

SEQ ID NO: 331973 - RNA, 64 nt, hsa; identical to SEQ ID NO: 221357

SEQ ID NO: 331974 - RNA, 64 nt, hsa; identical to SEQ ID NO: 221358

SEQ ID NO: 331975 - RNA, 64 nt, hsa; identical to SEQ ID NO: 221359

SEQ ID NO: 331976 - RNA, 64 nt, hsa; identical to SEQ ID NO: 221360

SEQ ID NO: 331977 - RNA, 64 nt, hsa; identical to SEQ ID NO: 221361

SEQ ID NO: 331978 - RNA, 64 nt, hsa; identical to SEQ ID NO: 221362

SEQ ID NO: 331979 - RNA, 64 nt, hsa; identical to SEQ ID NO: 221363

SEQ ID NO: 331980 - RNA, 64 nt, hsa; identical to SEQ ID NO: 221364

SEQ ID NO: 331981 - RNA, 64 nt, hsa; identical to SEQ ID NO: 221365

SEQ ID NO: 331982 - RNA, 64 nt, hsa; identical to SEQ ID NO: 221366

SEQ ID NO: 331983 - RNA, 64 nt, hsa; identical to SEQ ID NO: 221367

SEQ ID NO: 331984 - RNA, 64 nt, hsa; identical to SEQ ID NO: 221368

SEQ ID NO: 331985 - RNA, 64 nt, hsa; identical to SEQ ID NO: 221369

SEQ ID NO: 331986 - RNA, 64 nt, hsa; identical to SEQ ID NO: 221370

SEQ ID NO: 331987 - RNA, 64 nt, hsa; identical to SEQ ID NO: 221371

SEQ ID NO: 331988 - RNA, 64 nt, hsa; identical to SEQ ID NO: 221372

SEQ ID NO: 331989 - RNA, 64 nt, hsa; identical to SEQ ID NO: 221373

SEQ ID NO: 331990 - RNA, 64 nt, hsa; identical to SEQ ID NO: 221374

SEQ ID NO: 331991 - RNA, 64 nt, hsa; identical to SEQ ID NO: 221375

SEQ ID NO: 331992 - RNA, 64 nt, hsa; identical to SEQ ID NO: 221376

SEQ ID NO: 331993 - RNA, 64 nt, hsa; identical to SEQ ID NO: 221377

SEQ ID NO: 331994 - RNA, 64 nt, hsa; identical to SEQ ID NO: 221378

SEQ ID NO: 331995 - RNA, 64 nt, hsa; identical to SEQ ID NO: 221379

SEQ ID NO: 331996 - RNA, 64 nt, hsa; identical to SEQ ID NO: 221380

SEQ ID NO: 331997 - RNA, 64 nt, hsa; identical to SEQ ID NO: 221381

SEQ ID NO: 331998 - RNA, 64 nt, hsa; identical to SEQ ID NO: 221382

SEQ ID NO: 331999 - RNA, 64 nt, hsa; identical to SEQ ID NO: 221383

SEQ ID NO: 332000 - RNA, 64 nt, hsa; identical to SEQ ID NO: 221384

SEQ ID NO: 332001 - RNA, 64 nt, hsa; identical to SEQ ID NO: 221385

SEQ ID NO: 332002 - RNA, 64 nt, hsa; identical to SEQ ID NO: 221386

SEQ ID NO: 332003 - RNA, 64 nt, hsa; identical to SEQ ID NO: 221387

SEQ ID NO: 332004 - RNA, 64 nt, hsa
ggccagagacugagcucuggucaccuguucauuccucgguuagcuggaacuuugccccguuucc

SEQ ID NO: 332005 - RNA, 64 nt, hsa
aauuggguguuuguaccagaauggaauuuugcuucucgguuauccugugcuucagaugauuaua

SEQ ID NO: 332006 - RNA, 64 nt, hsa
aauaguguggaaagccacaucacaaaaaaagccacaucacaaaaaaaagccagugccuauugag

SEQ ID NO: 332007 - RNA, 64 nt, hsa
ggauucuggacuucuacaauaguguggaaagccacaucacaaaaaaagccacaucacaaaaaaa

SEQ ID NO: 332008 - RNA, 64 nt, hsa
cagcuggccgcccaguuugagaauugguguaagacaucacaaucccauuauucagagcgcguau

SEQ ID NO: 332009 - RNA, 64 nt, hsa; identical to SEQ ID NO: 332008

SEQ ID NO: 332010 - RNA, 64 nt, hsa
accaacccacuggcacauuuuucucuuguuuucucucuccgauuuugcucugucuccucaguua

SEQ ID NO: 332011 - RNA, 64 nt, hsa
ugaaagaaaagcagugauaccugaauaaugcuggcucuccgauugauccugugaggaugaauuu

SEQ ID NO: 332012 - RNA, 64 nt, hsa
aaauuugcgccucgguaucuggcuucccuggaagcucuccgagcucuggugcuuuaguuagguc

SEQ ID NO: 332013 - RNA, 64 nt, hsa
cucagccagggcugccagccaggccacucggcaccucuccgagccaugugagcccccugaugcc

SEQ ID NO: 332014 - RNA, 64 nt, hsa
uugagugguuacagucuagggcagugguucccaacucuccgaucagaaucaucugggaagcauu

SEQ ID NO: 332015 - RNA, 64 nt, hsa
uuuuaccgccagugugcugucguucccccucccccucuccgaguccucguggggacacggcggg

SEQ ID NO: 332016 - RNA, 64 nt, hsa
uuguucugccugaacauuaauggcaagucuagaacucuccgaauccuacagcuuuguaauuuuu

SEQ ID NO: 332017 - RNA, 64 nt, hsa
gggagguaggaguggaagagaggugugaagaaaccucuccgaacaaaugaaccagcaguaaguu

SEQ ID NO: 332018 - RNA, 64 nt, hsa
ugcuccaguuucaccucuuugcucccugaguucacucuccgaagucugaucccugccaaaaagu

SEQ ID NO: 332019 - RNA, 64 nt, hsa
uuuauaaucucaaaugcuaguaagcagaaagaugcucuccgagguccaacuauauccuucccug

SEQ ID NO: 332020 - RNA, 64 nt, hsa
uaggauuucccgaccccguacaaaccaaguugcccucuccgagcuaggcccggccgagagcgcc

SEQ ID NO: 332021 - RNA, 64 nt, hsa
aggaugccucuguagcaggcagagcuuaccaagucucuccgaacucaaauggaagaaauaccuu

SEQ ID NO: 332022 - RNA, 64 nt, hsa
uuuuaauccucauucccuauguccacuugccuuccucuccgaggcaacuacucuaaugcauuug

SEQ ID NO: 332023 - RNA, 64 nt, hsa
ccgggacugcccucucgacugucaguggggcagccucuccgacucugcacccgccucgaccucc

SEQ ID NO: 332024 - RNA, 64 nt, hsa
aacagacuugaucacgcacacacaauaagucuuucucuccgaaaccggaaguaaaucuauaucu

SEQ ID NO: 332025 - RNA, 64 nt, hsa
cagcugggggaccccucagcuccgucucagagugcucuccgagacgcugaagagcuucugccug

SEQ ID NO: 332026 - RNA, 64 nt, hsa
uuugggggccgggccccuccccacaauaaagaugcucuccgaccuuccugcuuggguggcuccc

SEQ ID NO: 332027 - RNA, 64 nt, hsa
gcuucugacggaucuuggugcucaggcugccuggcucuccgagugaggacgcagccuccauauu

SEQ ID NO: 332028 - RNA, 64 nt, hsa
caggaagagaagaauccacaaggaccucuuuacucucuccgauuugcuuuuuuuuuuuuuuuuu

SEQ ID NO: 332029 - RNA, 64 nt, hsa
augucuuaacuuuugcuucacuucacagucaggccucuccgaguauuuuuuacacauauccugg

SEQ ID NO: 332030 - RNA, 64 nt, hsa
gaagagggccaucugccugaauguaaccugcuagcucuccgaaggcccugcgggccuggcuugu

SEQ ID NO: 332031 - RNA, 64 nt, hsa
gggguacaaacuccagaugaucgaggugcccguccucuccgacgacucagugccuaucggcaug

SEQ ID NO: 332032 - RNA, 64 nt, hsa
agggaggggcacagugaagaagggagcccaccaccucuccgaagaggaaagccacguagagugg

SEQ ID NO: 332033 - RNA, 64 nt, hsa
agcccucugccagccucuugggggcaguuccggccucuccgacuuccccacuggccacacucca

SEQ ID NO: 332034 - RNA, 64 nt, hsa
ggugacuugagcuugagcucugacaggcaugggccucuccgaccuucaucacuauucuuaggau

SEQ ID NO: 332035 - RNA, 64 nt, hsa
ccugaaggaagcccuccuggacugcuucuuuuggcucuccgacaacuccggccaauaaacacuu

SEQ ID NO: 332036 - RNA, 64 nt, hsa
cuugggacucagacaccgaagucuuuuuuuuuuucucuccgauccuuggacaccuccucugucu

SEQ ID NO: 332037 - RNA, 64 nt, hsa
uugccuauccucuccuggccucuagucuucccugcucuccgagguagagcuggguauggaugcu

SEQ ID NO: 332038 - RNA, 64 nt, hsa
ccgggcggaccgcuggacagacgcacccacucaccucuccgauccgcaccccgccccacgggag

SEQ ID NO: 332039 - RNA, 64 nt, hsa
ccgugccaguggagugggcuccgcguugcucauucucuccgacagguugucagccucugucccc

SEQ ID NO: 332040 - RNA, 64 nt, hsa
gugccgcucucucugagggggugggggugcugcucucuccgagggguggaaugccgcugucucu

SEQ ID NO: 332041 - RNA, 60 nt, hsa
aaaagcccggugaccuuuaaccccagcccccucuccgaguccuucacaauuccuuagguu

SEQ ID NO: 332042 - RNA, 64 nt, hsa
cgcgcugcuguuagacacuccgccauuccugguucucuccgaaccguucuuuguacaguaaaug

SEQ ID NO: 332043 - RNA, 53 nt, hsa
ucauccucuccacaaaguagacccucuccgagcccaccagccacagaauauua

SEQ ID NO: 332044 - RNA, 64 nt, hsa
caccgggccacagagaaaguacuucuccacccugcucuccgaccagacaccuugacagggcaca

SEQ ID NO: 332045 - RNA, 64 nt, hsa
aacccucuguuccuucccugugccuccucccucccucuccgacucacaccacuagccucagggg

SEQ ID NO: 332046 - RNA, 64 nt, hsa
acaccauggaaaaaacccuguaaguauuauggcacucuccgaauccuccugaaggcauuuccuc

SEQ ID NO: 332047 - RNA, 64 nt, hsa
ggagccgaccaauuagucacugcugcuacugccccucuccgaaagaagacacagaaccaacaaa

SEQ ID NO: 332048 - RNA, 64 nt, hsa
cgggcugcauccacagaguuuguguccacacuuucucuccgagcaugugggucucgcugagcag

SEQ ID NO: 332049 - RNA, 64 nt, hsa
ggcggguccgcuccucuugucugcggcaucugugcucuccgagagaaaaccaaggugugucaaa

SEQ ID NO: 332050 - RNA, 64 nt, hsa
uacaccuucccccaggacccucagcucagcggcucucuccgagagcaccacccuccccgacaca

SEQ ID NO: 332051 - RNA, 64 nt, hsa
uccaacccgcugccuccauuucucuagaucugugcucuccgauguggcagucaguaaccauagg

SEQ ID NO: 332052 - RNA, 64 nt, hsa
aggacauuaguccaccaucuucuugguuugcuggcucuccgaaauaaagucccuuuccuugcuc

SEQ ID NO: 332053 - RNA, 64 nt, hsa
ucucuccaccugccucuggcuucucaggccucugcucuccgaccucucuccucugaaacccucc

SEQ ID NO: 332054 - RNA, 64 nt, hsa
guaguaaucauuuuauuuugaagucucauacaagcucuccgauagagaacuuucaggcagaucc

SEQ ID NO: 332055 - RNA, 64 nt, hsa
ggaagaggacuagaaaaggcuuccccugccuauccucuccgaucaccaagguggaagggagcua

SEQ ID NO: 332056 - RNA, 64 nt, hsa
cauguccacuuccuuucuccugaaaccuaauaaucucuccgagggagaaagggguucucugcgg

SEQ ID NO: 332057 - RNA, 64 nt, hsa
uuggaacacugaauuacagagcuuuuuucuguugcucuccgagacuggggggggauuguuucuu

SEQ ID NO: 332058 - RNA, 64 nt, hsa
gaggccucacugaagagcugcuuucgagacccggcucuccgaaccgugccccugauucauaccg

SEQ ID NO: 332059 - RNA, 64 nt, hsa
uuuccaggcggguuuguuuugcauuucuuggagccucuccgagcagcaaccagacgggagauuu

SEQ ID NO: 332060 - RNA, 64 nt, hsa
cgccgcgacucugggguggugcucgccuaccugccucuccgagcuccucaauucucccccaccc

SEQ ID NO: 332061 - RNA, 64 nt, hsa
uggcccaugugcuggaagaugacacaguugccuucucuccgaggaaccugcccccucuccuuuc

SEQ ID NO: 332062 - RNA, 64 nt, hsa
cagccuauaucaaacaugcacacgggcgagcuuucucuccgacuuccccugggcaagagauggg

SEQ ID NO: 332063 - RNA, 64 nt, hsa
uaagccaccuccaggguccaggggcuuucucucucucuccgaagccccuggaccuguuuccuug

SEQ ID NO: 332064 - RNA, 64 nt, hsa
gaagaugcuggaagugcugguggugaagcucccucucuccgagcacugggcccugccuggggua

SEQ ID NO: 332065 - RNA, 64 nt, hsa
guguuagcgaaaccugucuaccugcuauagcacacucuccgauuugggccauuuaugcaccccg

SEQ ID NO: 332066 - RNA, 64 nt, hsa
gacccagccggcggcugaccacaggcaccccggccucuccgagacggccuccugccugcgcagc

SEQ ID NO: 332067 - RNA, 64 nt, hsa
ugaaaaauacccuucugaacaaaacauguacuuacucuccgaaaggcaucuaucugugcuauug

SEQ ID NO: 332068 - RNA, 64 nt, hsa
cucgcuucugagcuugguggccuguucccuccaucucuccgaaccuggcuucgccugucccuuu

SEQ ID NO: 332069 - RNA, 64 nt, hsa
uagacagauuuguucauagacccucucaagugcccucuccgagcugguaggcauuccagcuccu

SEQ ID NO: 332070 - RNA, 64 nt, hsa
guuuucuuaagaccugucgucaaacuuaaaagguuuugcagagggcaguaucaaaagaaagugg

SEQ ID NO: 332071 - RNA, 64 nt, hsa
cuacagcagaggccaugcaguauuauauauucauuuugcagaaucugcaccuacagcucaauac

SEQ ID NO: 332072 - RNA, 64 nt, hsa
uuucuggaaauacugucuucuguuuccuuuugccuuugcagaaugugcuuuagccuuugucuga

SEQ ID NO: 332073 - RNA, 64 nt, hsa
aucugcauaugagugauaugugaucaugauucauuuugcagauuuacauuuugcuuguguggaa

SEQ ID NO: 332074 - RNA, 64 nt, hsa
uuaaaggggucuaaaaagauuuuggcaaaacauauuugcagauguagauuagcuggugaagaaa

SEQ ID NO: 332075 - RNA, 64 nt, hsa
ggagcucuuuugcuuggauucccaucauggccccuuugcagaaaauugucuaggauuucagcaa

SEQ ID NO: 332076 - RNA, 64 nt, hsa
uuggccagaaaugaagaagaaguuugcagauguauuugcagagaagacgaaggcagaguggugu

SEQ ID NO: 332077 - RNA, 64 nt, hsa
gagcauggaugauuggccagaaaugaagaagaaguuugcagauguauuugcagagaagacgaag

SEQ ID NO: 332078 - RNA, 64 nt, hsa
gaacaggcuuuuuugcuuugggcucugcuauuuguuugcagaacacccaagagcgagcaaacau

SEQ ID NO: 332079 - RNA, 64 nt, hsa
gcauuugggccagugcacuguuuacuuccaucuguuugcagacacauuugugcccggcguuugg

SEQ ID NO: 332080 - RNA, 64 nt, hsa
uuacccaaccuuggucauaagugugccuggcugguuugcagauauuuguucugcuuuguaaaaa

SEQ ID NO: 332081 - RNA, 64 nt, hsa
ugacccgacucucagauggggucagucccgucgcuuugcagacugacccuggaaaucuacaaaa

SEQ ID NO: 332082 - RNA, 64 nt, hsa
caauuaucuugccuuauccaggaauaauugccccuuugcagagaaaaaaaaaaacuuaaaaaaa

SEQ ID NO: 332083 - RNA, 64 nt, hsa
uaguccucuacugcuaaauaaguuaauuuugcauuuugcagaaagaaacauugauugcuaaauc

SEQ ID NO: 332084 - RNA, 64 nt, hsa
caggcagacuggcuaaggaccagcccagggcaauuuugcagaaaugaucauuugcacagaaugg

SEQ ID NO: 332085 - RNA, 64 nt, hsa
aagaaaaggcccacuuuuuaaaaagugaaacaaguuugcagauacgguucucuuccuggacucc

SEQ ID NO: 332086 - RNA, 64 nt, hsa
auuggaaaauauuugacccccuuggcugaauucuuuugcagaacuacugugugucuguucacua

SEQ ID NO: 332087 - RNA, 64 nt, hsa
uuuauuuuugcaugaauuaagacguuuuaauuucuuugcagacaaggucuagaugcggagucag

SEQ ID NO: 332088 - RNA, 64 nt, hsa
cccagguacccaugaaugugagcuuaccagggucuuugcagauguaauuaguuaaguuaaggug

SEQ ID NO: 332089 - RNA, 64 nt, hsa
uccuccgugaaaauauguuuggaauauuccacuauuugcagaggcuuauucaguucuuacacau

SEQ ID NO: 332090 - RNA, 64 nt, hsa
aguauaauuuuucuauuuuuguuuuugguuuuaauuugcagagauuugcugccaggaaucaauu

SEQ ID NO: 332091 - RNA, 64 nt, hsa
auaaagguuuguuguaguugucuuaugugcugaauuugcagaugaucagaugcugugcagaauu

SEQ ID NO: 332092 - RNA, 64 nt, hsa
cucaguugccaguucccauuaucgauacucuuucuuugcagaauaccuuagaaccguuauuucc

SEQ ID NO: 332093 - RNA, 64 nt, hsa
gacaaauagugucuacuaucucaacccuccaaaauuugcagaguguugggacugucauuuguga

SEQ ID NO: 332094 - RNA, 64 nt, hsa
guuucauaugcagauuuuauucucaccugggccauuugcagaugagacuguaguuugcagauga

SEQ ID NO: 332095 - RNA, 64 nt, hsa
uucucaccugggccauuugcagaugagacuguaguuugcagaugagacuguaguuugcagaugg

SEQ ID NO: 332096 - RNA, 64 nt, hsa
cagaugagacuguaguuugcagaugagacuguaguuugcagauggcguggaagcauucaucagg

SEQ ID NO: 332097 - RNA, 64 nt, hsa
cuguaaaaccugcccaggaacuuacagaauuuacuuugcagaagcguuaucauacuccauuuac

SEQ ID NO: 332098 - RNA, 64 nt, hsa
aaaauuuaccuagaugucuauuuaugggauuacuuuugcagaaucauaauuuagcaaccauuua

SEQ ID NO: 332099 - RNA, 64 nt, hsa
gugcauggcauguuuuguuacagguuguagaguauuugcagaaggaaaccauuucugguuauuu

SEQ ID NO: 332100 - RNA, 64 nt, hsa
aaaugaaguaucuuguacauauaaauuuauuucuuuugcagagcauuauauuacuggauguuua

SEQ ID NO: 332101 - RNA, 64 nt, hsa
gugaaaugaaguacccuuuuguaaauagcauuuuuuugcagaaggugaaaauuccacucucuac

SEQ ID NO: 332102 - RNA, 64 nt, hsa
gugucugcaagauaaauuagaucgcccugugggguuugcagaauuagugaaggguccaggacga

SEQ ID NO: 332103 - RNA, 64 nt, hsa
cugagcguguacguuaaugugaauguauauagucuuugcagagguccaaaugauauucaugaug

SEQ ID NO: 332104 - RNA, 64 nt, hsa
gccccaccgcagcuacuccccuuucuuccaaacuuuugcagaaaaaacaaaaaaacuacaaaca

SEQ ID NO: 332105 - RNA, 64 nt, hsa
gauccaacaaagaagccaugaccaguuaaagauauuugcagaguuacaccuuggucauaagucc

SEQ ID NO: 332106 - RNA, 64 nt, hsa
ccacaggugcgugucaccaugcuuggcuaauuuuuuugcagaaacgaggccucacuauauuguc

SEQ ID NO: 332107 - RNA, 64 nt, hsa
guccacgcugcuuucuucccaaaggacauguauauuugcagagcuccacauacagaaacacauu

SEQ ID NO: 332108 - RNA, 64 nt, hsa
uauuugcagagcuccacauacagaaacacauuauuuugcagaaauagguguuuuuaagaaguuu

SEQ ID NO: 332109 - RNA, 64 nt, hsa
caccuccaggaacugucauggauguccaaauggcuuugcagaaaggaaaugagaugacaguauu

SEQ ID NO: 332110 - RNA, 64 nt, hsa
caguuacauguaugccugcccaguucccuuuuuauuugcagaagcugugaguuuuguucacaau

SEQ ID NO: 332111 - RNA, 64 nt, hsa
gcaguugcauauucccagacugaggcagggcagguuugcagagagagacccagagugcacguga

SEQ ID NO: 332112 - RNA, 64 nt, hsa
uaccuucaaugugaccuaauugggaaauagagucuuugcagaugaucuaguugagaugagguca

SEQ ID NO: 332113 - RNA, 64 nt, hsa
ccaggagugggcaccccauaaggguuuaggccacuuugcagaggauggaggucaaaaaccacuc

SEQ ID NO: 332114 - RNA, 64 nt, hsa
guagcccacccuccaccccgcuguuuuucuuaaauuugcagaacuucaaauuggcuauuccucu

SEQ ID NO: 332115 - RNA, 64 nt, hsa
gccugugguggucucccuguccaagcgggaccgcuuugcagagaccagaggcauaucgcggcuu

SEQ ID NO: 332116 - RNA, 64 nt, hsa
acaaugggacggaauccacccacaacgcgcuugguuugcagaugucaaagaaucugcagagggu

SEQ ID NO: 332117 - RNA, 64 nt, hsa; identical to SEQ ID NO: 246269

SEQ ID NO: 332118 - RNA, 64 nt, hsa; identical to SEQ ID NO: 246270

SEQ ID NO: 332119 - RNA, 64 nt, hsa; identical to SEQ ID NO: 246271

SEQ ID NO: 332120 - RNA, 64 nt, hsa; identical to SEQ ID NO: 246272

SEQ ID NO: 332121 - RNA, 64 nt, hsa; identical to SEQ ID NO: 246273

SEQ ID NO: 332122 - RNA, 64 nt, hsa; identical to SEQ ID NO: 246274

SEQ ID NO: 332123 - RNA, 64 nt, hsa; identical to SEQ ID NO: 246275

SEQ ID NO: 332124 - RNA, 64 nt, hsa; identical to SEQ ID NO: 246276

SEQ ID NO: 332125 - RNA, 51 nt, hsa; identical to SEQ ID NO: 246277

SEQ ID NO: 332126 - RNA, 64 nt, hsa; identical to SEQ ID NO: 246278

SEQ ID NO: 332127 - RNA, 64 nt, hsa; identical to SEQ ID NO: 246279

SEQ ID NO: 332128 - RNA, 56 nt, hsa; identical to SEQ ID NO: 246280

SEQ ID NO: 332129 - RNA, 64 nt, hsa; identical to SEQ ID NO: 246281

SEQ ID NO: 332130 - RNA, 64 nt, hsa; identical to SEQ ID NO: 246282

SEQ ID NO: 332131 - RNA, 64 nt, hsa; identical to SEQ ID NO: 246283

SEQ ID NO: 332132 - RNA, 64 nt, hsa; identical to SEQ ID NO: 246284

SEQ ID NO: 332133 - RNA, 64 nt, hsa; identical to SEQ ID NO: 246285

SEQ ID NO: 332134 - RNA, 64 nt, hsa; identical to SEQ ID NO: 246286

SEQ ID NO: 332135 - RNA, 64 nt, hsa; identical to SEQ ID NO: 246287

SEQ ID NO: 332136 - RNA, 64 nt, hsa; identical to SEQ ID NO: 246288

SEQ ID NO: 332137 - RNA, 64 nt, hsa; identical to SEQ ID NO: 246289

SEQ ID NO: 332138 - RNA, 64 nt, hsa; identical to SEQ ID NO: 246290

SEQ ID NO: 332139 - RNA, 64 nt, hsa; identical to SEQ ID NO: 246291

SEQ ID NO: 332140 - RNA, 64 nt, hsa; identical to SEQ ID NO: 246292

SEQ ID NO: 332141 - RNA, 64 nt, hsa; identical to SEQ ID NO: 246293

SEQ ID NO: 332142 - RNA, 64 nt, hsa; identical to SEQ ID NO: 246294

SEQ ID NO: 332143 - RNA, 64 nt, hsa; identical to SEQ ID NO: 246295

SEQ ID NO: 332144 - RNA, 64 nt, hsa; identical to SEQ ID NO: 246296

SEQ ID NO: 332145 - RNA, 64 nt, hsa; identical to SEQ ID NO: 246297

SEQ ID NO: 332146 - RNA, 64 nt, hsa; identical to SEQ ID NO: 246298

SEQ ID NO: 332147 - RNA, 64 nt, hsa; identical to SEQ ID NO: 246299

SEQ ID NO: 332148 - RNA, 64 nt, hsa; identical to SEQ ID NO: 246300

SEQ ID NO: 332149 - RNA, 64 nt, hsa; identical to SEQ ID NO: 246301

SEQ ID NO: 332150 - RNA, 61 nt, hsa
caaaaugcuaaagacucacacugcagcaaucaucccagaugauuaaauucaaagaaauagg

SEQ ID NO: 332151 - RNA, 61 nt, hsa
guuccuucaucaucgaaauagugauuaagugaucccagaacaaggaauacuagaguaaaaa

SEQ ID NO: 332152 - RNA, 61 nt, hsa
gacaccugcugcacucaucugauguaaaaccaucccagagcuggcgagaggauggagcugg

SEQ ID NO: 332153 - RNA, 61 nt, hsa
ggguucccagugcccagcacuuuguagucucaucccagauuacuaacccuuccugauccug

SEQ ID NO: 332154 - RNA, 61 nt, hsa
aaacgcaaaucuguagauucucuccucucccaucccagaaaacaaaacaaaauaaugcuuu

SEQ ID NO: 332155 - RNA, 61 nt, hsa
ucucuucccuaaccaaugaagcuaagugguuaucccagaaacuugucuucuaaaagggagg

SEQ ID NO: 332156 - RNA, 61 nt, hsa
uugagaaucagcauaguaaauuacauuucuaaucccagaggacuuaauauuuucuuuuguc

SEQ ID NO: 332157 - RNA, 61 nt, hsa
ugaacuucuaauuggggccaguguaaggucgaucccagaggcugaucugcaaaucaagcua

SEQ ID NO: 332158 - RNA, 61 nt, hsa
ucuuuuuuuuuuuuuuuuuuuaagccaugacaucccagaagaggacagugaauuacuccua

SEQ ID NO: 332159 - RNA, 61 nt, hsa
guugaacuuuuuaaaaagugcuacuuuuaaaaucccagauacucugaauuuuagaaaacaa

SEQ ID NO: 332160 - RNA, 61 nt, hsa
ccacauugcaacagcaaguugauuucuugugaucccagaauuuucuaagaggaugaguuga

SEQ ID NO: 332161 - RNA, 61 nt, hsa
cagcaucacuugggagcuuauugaaaugcagaucccagagucaguaaaucugccugugaag

SEQ ID NO: 332162 - RNA, 61 nt, hsa
ugguuuguaaauggugaggggacuugggggcaucccagagugcucccuccaggccugcuuc

SEQ ID NO: 332163 - RNA, 61 nt, hsa
aauaaauagcauuaguagcuucuguggggggaucccagagccccuguauuuauuuucccug

SEQ ID NO: 332164 - RNA, 61 nt, hsa
guggaguuggcuguuacgacaucccugugugaucccagaggaggggcaguagcugggcaga

SEQ ID NO: 332165 - RNA, 61 nt, hsa
aaccauuuccccuuccaguagcuugguguccaucccagagcauucaugaagucuucccgcc

SEQ ID NO: 332166 - RNA, 61 nt, hsa
guaucccucaucccagaagaggcaucuccauaucccagaaaagaagauccuaucaugaaua

SEQ ID NO: 332167 - RNA, 61 nt, hsa
cacauuuggcacuguuaucuugguaucccucaucccagaagaggcaucuccauaucccaga

SEQ ID NO: 332168 - RNA, 61 nt, hsa
gagguccgugagcuggaacugggcacacgccaucccagagggcucaggaugccccaggaag

SEQ ID NO: 332169 - RNA, 61 nt, hsa
ugauggcagccucagaggcuuacucuaacccaucccagaauaaauggagacuucauguguu

SEQ ID NO: 332170 - RNA, 61 nt, hsa
aagcacuacgccuuccacccccaggcacuggaucccagauucccaagccuucacccaccag

SEQ ID NO: 332171 - RNA, 61 nt, hsa
aaugccuggauccuggggcccccaucacuggaucccagauccccucacuccacccacugga

SEQ ID NO: 332172 - RNA, 61 nt, hsa
ggucaugcgauccccacccuucagccacuagaucccagaucccccuguaaccauaacugug

SEQ ID NO: 332173 - RNA, 64 nt, hsa
ggcuaagacuugcuuuucuaacuaagagaaugugcucaugcauugcuuguguaguagaaacuag

SEQ ID NO: 332174 - RNA, 64 nt, hsa
ccaaaaauuuuuuuuaauuagcugugcgcaauugcucaugcauagucccagcuacccaggaggc

SEQ ID NO: 332175 - RNA, 64 nt, hsa
auugcagagcugcagaguacaguguaacaguacucucaugcaauuuuuuucaggaugcaaaggc

SEQ ID NO: 332176 - RNA, 64 nt, hsa
ugcugucuguaauucaguuugcguguauuuuaugcucaugcaccaacccauacagaguaaaucu

SEQ ID NO: 332177 - RNA, 64 nt, hsa
gaggagaguggggugcagaaaugccucagcauggcucaugcacacagcauucucccguggggca

SEQ ID NO: 332178 - RNA, 64 nt, hsa
augcacacagcauucucccguggggcaggguucccucaugcaacaggccucccuguggccagcc

SEQ ID NO: 332179 - RNA, 64 nt, hsa
gaacugggcggguuuaguggccccaggcccacuccucaugcagcagugugcuggggcgacagcu

SEQ ID NO: 332180 - RNA, 64 nt, hsa
aggacaggcccagccuuucuccacugccacgucccucaugcacaucacucaucuccugcugcag

SEQ ID NO: 332181 - RNA, 64 nt, hsa
guguuggauccauuucccuggucuuggccucacucucaugcaggcuuuccucuuguguuggcaa

SEQ ID NO: 332182 - RNA, 64 nt, hsa
uugacaugagugcauuaguaaugacucuuauguacucaugcauggaucuuuaugcaauuuuuuu

SEQ ID NO: 332183 - RNA, 64 nt, hsa
uuucaaaauugguuuguucaguguggaguauauucagcaguauuuuugacauuuuucuuuagaa

SEQ ID NO: 332184 - RNA, 64 nt, hsa
aauuuugcauuuuagcacuugcacuauuacucagcagcaguaacaugguaacacuuaaaauggu

SEQ ID NO: 332185 - RNA, 64 nt, hsa
gguuuauuucaaauuaaaacaaaaaaaucaacgacagcaguagacacaggcaccacauuccuuu

SEQ ID NO: 332186 - RNA, 64 nt, hsa
gaggccaccagaagacacuuccaucccucgggcccagcaguacacacuugguuuccagagcucc

SEQ ID NO: 332187 - RNA, 64 nt, hsa
uacaaauccugcaaaagacaucaugagaaaauaccagcaguaucuaucaugaauguagaaauaa

SEQ ID NO: 332188 - RNA, 64 nt, hsa
acauaagcauaagugagugccaaugaaucccuaccagcaguaguuauuauccuuuuuaaaaaug

SEQ ID NO: 332189 - RNA, 64 nt, hsa
aaacaaagcuggaauagaaacuacacacuagacacagcaguagucauagucuucacagguuuag

SEQ ID NO: 332190 - RNA, 64 nt, hsa
auuacuuaucuuccuucucugcuuugugacucaccagcaguaacacacacaauccacaucuugu

SEQ ID NO: 332191 - RNA, 64 nt, hsa
uggccucaaaacagaagcagcuucuuuugucucccagcaguagugagccacucagucucuucca

SEQ ID NO: 332192 - RNA, 64 nt, hsa
caguaacuuauguacaaggaugaaagaaaggucgcagcaguagcuuuggggaaagggaggaaga

SEQ ID NO: 332193 - RNA, 64 nt, hsa
gagguucuaaucauuucagcaguagcgucuuaaacagcaguauuacuauaagcaguugcuucaa

SEQ ID NO: 332194 - RNA, 64 nt, hsa
uuuauauugugcuuuuuggagguucuaaucauuucagcaguagcgucuuaaacagcaguauuac

SEQ ID NO: 332195 - RNA, 64 nt, hsa; identical to SEQ ID NO: 277109

SEQ ID NO: 332196 - RNA, 64 nt, hsa; identical to SEQ ID NO: 277110

SEQ ID NO: 332197 - RNA, 64 nt, hsa; identical to SEQ ID NO: 277111

SEQ ID NO: 332198 - RNA, 64 nt, hsa; identical to SEQ ID NO: 277112

SEQ ID NO: 332199 - RNA, 64 nt, hsa; identical to SEQ ID NO: 277113

SEQ ID NO: 332200 - RNA, 64 nt, hsa; identical to SEQ ID NO: 277114

SEQ ID NO: 332201 - RNA, 64 nt, hsa; identical to SEQ ID NO: 277115

SEQ ID NO: 332202 - RNA, 64 nt, hsa; identical to SEQ ID NO: 277116

SEQ ID NO: 332203 - RNA, 64 nt, hsa; identical to SEQ ID NO: 277117

SEQ ID NO: 332204 - RNA, 64 nt, hsa; identical to SEQ ID NO: 277118

SEQ ID NO: 332205 - RNA, 64 nt, hsa; identical to SEQ ID NO: 277119

SEQ ID NO: 332206 - RNA, 64 nt, hsa; identical to SEQ ID NO: 277120

SEQ ID NO: 332207 - RNA, 64 nt, hsa; identical to SEQ ID NO: 277121

SEQ ID NO: 332208 - RNA, 64 nt, hsa; identical to SEQ ID NO: 277122

SEQ ID NO: 332209 - RNA, 64 nt, hsa; identical to SEQ ID NO: 277123

SEQ ID NO: 332210 - RNA, 64 nt, hsa; identical to SEQ ID NO: 277124

SEQ ID NO: 332211 - RNA, 64 nt, hsa; identical to SEQ ID NO: 277125

SEQ ID NO: 332212 - RNA, 64 nt, hsa; identical to SEQ ID NO: 277126

SEQ ID NO: 332213 - RNA, 64 nt, hsa; identical to SEQ ID NO: 277127

SEQ ID NO: 332214 - RNA, 65 nt, hsa
gccaaccuacgugccaggccccaugcugggucccagggaugcagaagggucaaaacccaucaucc

SEQ ID NO: 332215 - RNA, 65 nt, hsa
gggcagucagguccacaccuauguccagggcaccagggaugcaauuccauguggaugucaccaaa

SEQ ID NO: 332216 - RNA, 65 nt, hsa
gagcagugugauggagagucucugccgugccaucugggaugcaaaccgucccuguguuccccacg

SEQ ID NO: 332217 - RNA, 65 nt, hsa
uuugccccugcacauuccagaagcccucaugggaagggaugcagccaggcagacuccugccagau

SEQ ID NO: 332218 - RNA, 64 nt, hsa; identical to SEQ ID NO: 236791

SEQ ID NO: 332219 - RNA, 64 nt, hsa; identical to SEQ ID NO: 236792

SEQ ID NO: 332220 - RNA, 64 nt, hsa; identical to SEQ ID NO: 236793

SEQ ID NO: 332221 - RNA, 64 nt, hsa; identical to SEQ ID NO: 236794

SEQ ID NO: 332222 - RNA, 64 nt, hsa; identical to SEQ ID NO: 236795

SEQ ID NO: 332223 - RNA, 64 nt, hsa; identical to SEQ ID NO: 236796

SEQ ID NO: 332224 - RNA, 64 nt, hsa; identical to SEQ ID NO: 236797

SEQ ID NO: 332225 - RNA, 64 nt, hsa; identical to SEQ ID NO: 236798

SEQ ID NO: 332226 - RNA, 64 nt, hsa; identical to SEQ ID NO: 236799

SEQ ID NO: 332227 - RNA, 64 nt, hsa; identical to SEQ ID NO: 236800

SEQ ID NO: 332228 - RNA, 64 nt, hsa; identical to SEQ ID NO: 236801

SEQ ID NO: 332229 - RNA, 64 nt, hsa; identical to SEQ ID NO: 236802

SEQ ID NO: 332230 - RNA, 64 nt, hsa; identical to SEQ ID NO: 236803

SEQ ID NO: 332231 - RNA, 64 nt, hsa; identical to SEQ ID NO: 236804

SEQ ID NO: 332232 - RNA, 64 nt, hsa; identical to SEQ ID NO: 236805

SEQ ID NO: 332233 - RNA, 64 nt, hsa; identical to SEQ ID NO: 236806

SEQ ID NO: 332234 - RNA, 64 nt, hsa; identical to SEQ ID NO: 236807

SEQ ID NO: 332235 - RNA, 64 nt, hsa; identical to SEQ ID NO: 236808

SEQ ID NO: 332236 - RNA, 64 nt, hsa; identical to SEQ ID NO: 236809

SEQ ID NO: 332237 - RNA, 64 nt, hsa; identical to SEQ ID NO: 236810

SEQ ID NO: 332238 - RNA, 64 nt, hsa; identical to SEQ ID NO: 236811

SEQ ID NO: 332239 - RNA, 64 nt, hsa; identical to SEQ ID NO: 236812

SEQ ID NO: 332240 - RNA, 64 nt, hsa; identical to SEQ ID NO: 236813

SEQ ID NO: 332241 - RNA, 64 nt, hsa; identical to SEQ ID NO: 236814

SEQ ID NO: 332242 - RNA, 64 nt, hsa; identical to SEQ ID NO: 236815

SEQ ID NO: 332243 - RNA, 64 nt, hsa; identical to SEQ ID NO: 236816

SEQ ID NO: 332244 - RNA, 64 nt, hsa; identical to SEQ ID NO: 236817

SEQ ID NO: 332245 - RNA, 64 nt, hsa; identical to SEQ ID NO: 236818

SEQ ID NO: 332246 - RNA, 64 nt, hsa; identical to SEQ ID NO: 236819

SEQ ID NO: 332247 - RNA, 64 nt, hsa; identical to SEQ ID NO: 236820

SEQ ID NO: 332248 - RNA, 64 nt, hsa; identical to SEQ ID NO: 236821

SEQ ID NO: 332249 - RNA, 64 nt, hsa; identical to SEQ ID NO: 236822

SEQ ID NO: 332250 - RNA, 64 nt, hsa; identical to SEQ ID NO: 236823

SEQ ID NO: 332251 - RNA, 64 nt, hsa; identical to SEQ ID NO: 236824

SEQ ID NO: 332252 - RNA, 64 nt, hsa; identical to SEQ ID NO: 236825

SEQ ID NO: 332253 - RNA, 64 nt, hsa; identical to SEQ ID NO: 236826

SEQ ID NO: 332254 - RNA, 64 nt, hsa; identical to SEQ ID NO: 236827

SEQ ID NO: 332255 - RNA, 64 nt, hsa; identical to SEQ ID NO: 236828

SEQ ID NO: 332256 - RNA, 64 nt, hsa; identical to SEQ ID NO: 236829

SEQ ID NO: 332257 - RNA, 64 nt, hsa; identical to SEQ ID NO: 236830

SEQ ID NO: 332258 - RNA, 64 nt, hsa; identical to SEQ ID NO: 236831

SEQ ID NO: 332259 - RNA, 64 nt, hsa; identical to SEQ ID NO: 236832

SEQ ID NO: 332260 - RNA, 64 nt, hsa; identical to SEQ ID NO: 236833

SEQ ID NO: 332261 - RNA, 64 nt, hsa; identical to SEQ ID NO: 236834

SEQ ID NO: 332262 - RNA, 64 nt, hsa; identical to SEQ ID NO: 236835

SEQ ID NO: 332263 - RNA, 64 nt, hsa; identical to SEQ ID NO: 236836

SEQ ID NO: 332264 - RNA, 64 nt, hsa; identical to SEQ ID NO: 236837

SEQ ID NO: 332265 - RNA, 64 nt, hsa; identical to SEQ ID NO: 236838

SEQ ID NO: 332266 - RNA, 64 nt, hsa; identical to SEQ ID NO: 236839

SEQ ID NO: 332267 - RNA, 64 nt, hsa; identical to SEQ ID NO: 236840

SEQ ID NO: 332268 - RNA, 64 nt, hsa; identical to SEQ ID NO: 236841

SEQ ID NO: 332269 - RNA, 64 nt, hsa; identical to SEQ ID NO: 236842

SEQ ID NO: 332270 - RNA, 64 nt, hsa; identical to SEQ ID NO: 236843

SEQ ID NO: 332271 - RNA, 64 nt, hsa; identical to SEQ ID NO: 236844

SEQ ID NO: 332272 - RNA, 64 nt, hsa; identical to SEQ ID NO: 236845

SEQ ID NO: 332273 - RNA, 64 nt, hsa; identical to SEQ ID NO: 236846

SEQ ID NO: 332274 - RNA, 64 nt, hsa; identical to SEQ ID NO: 236847

SEQ ID NO: 332275 - RNA, 64 nt, hsa; identical to SEQ ID NO: 236848

SEQ ID NO: 332276 - RNA, 64 nt, hsa; identical to SEQ ID NO: 236849

SEQ ID NO: 332277 - RNA, 64 nt, hsa; identical to SEQ ID NO: 236850

SEQ ID NO: 332278 - RNA, 64 nt, hsa; identical to SEQ ID NO: 236851

SEQ ID NO: 332279 - RNA, 64 nt, hsa; identical to SEQ ID NO: 236852

SEQ ID NO: 332280 - RNA, 64 nt, hsa; identical to SEQ ID NO: 236853

SEQ ID NO: 332281 - RNA, 64 nt, hsa; identical to SEQ ID NO: 236854

SEQ ID NO: 332282 - RNA, 64 nt, hsa; identical to SEQ ID NO: 236855

SEQ ID NO: 332283 - RNA, 64 nt, hsa; identical to SEQ ID NO: 236856

SEQ ID NO: 332284 - RNA, 64 nt, hsa; identical to SEQ ID NO: 236857

SEQ ID NO: 332285 - RNA, 64 nt, hsa; identical to SEQ ID NO: 236858

SEQ ID NO: 332286 - RNA, 64 nt, hsa; identical to SEQ ID NO: 236859

SEQ ID NO: 332287 - RNA, 64 nt, hsa; identical to SEQ ID NO: 236860

SEQ ID NO: 332288 - RNA, 64 nt, hsa; identical to SEQ ID NO: 236861

SEQ ID NO: 332289 - RNA, 64 nt, hsa; identical to SEQ ID NO: 236862

SEQ ID NO: 332290 - RNA, 64 nt, hsa; identical to SEQ ID NO: 236863

SEQ ID NO: 332291 - RNA, 64 nt, hsa; identical to SEQ ID NO: 236864

SEQ ID NO: 332292 - RNA, 64 nt, hsa; identical to SEQ ID NO: 236865

SEQ ID NO: 332293 - RNA, 64 nt, hsa; identical to SEQ ID NO: 236866

SEQ ID NO: 332294 - RNA, 64 nt, hsa; identical to SEQ ID NO: 236867

SEQ ID NO: 332295 - RNA, 64 nt, hsa; identical to SEQ ID NO: 236868

SEQ ID NO: 332296 - RNA, 64 nt, hsa; identical to SEQ ID NO: 236869

SEQ ID NO: 332297 - RNA, 64 nt, hsa; identical to SEQ ID NO: 236870

SEQ ID NO: 332298 - RNA, 64 nt, hsa; identical to SEQ ID NO: 236871

SEQ ID NO: 332299 - RNA, 64 nt, hsa; identical to SEQ ID NO: 236872

SEQ ID NO: 332300 - RNA, 64 nt, hsa; identical to SEQ ID NO: 236873

SEQ ID NO: 332301 - RNA, 64 nt, hsa; identical to SEQ ID NO: 236874

SEQ ID NO: 332302 - RNA, 64 nt, hsa; identical to SEQ ID NO: 236875

SEQ ID NO: 332303 - RNA, 64 nt, hsa; identical to SEQ ID NO: 236876

SEQ ID NO: 332304 - RNA, 64 nt, hsa; identical to SEQ ID NO: 236877

SEQ ID NO: 332305 - RNA, 64 nt, hsa; identical to SEQ ID NO: 236878

SEQ ID NO: 332306 - RNA, 64 nt, hsa; identical to SEQ ID NO: 236879

SEQ ID NO: 332307 - RNA, 64 nt, hsa; identical to SEQ ID NO: 236880

SEQ ID NO: 332308 - RNA, 64 nt, hsa; identical to SEQ ID NO: 236881

SEQ ID NO: 332309 - RNA, 64 nt, hsa; identical to SEQ ID NO: 236882

SEQ ID NO: 332310 - RNA, 64 nt, hsa; identical to SEQ ID NO: 236883

SEQ ID NO: 332311 - RNA, 64 nt, hsa; identical to SEQ ID NO: 236884

SEQ ID NO: 332312 - RNA, 64 nt, hsa; identical to SEQ ID NO: 236885

SEQ ID NO: 332313 - RNA, 64 nt, hsa; identical to SEQ ID NO: 236886

SEQ ID NO: 332314 - RNA, 64 nt, hsa; identical to SEQ ID NO: 236887

SEQ ID NO: 332315 - RNA, 64 nt, hsa; identical to SEQ ID NO: 236888

SEQ ID NO: 332316 - RNA, 64 nt, hsa; identical to SEQ ID NO: 236889

SEQ ID NO: 332317 - RNA, 64 nt, hsa; identical to SEQ ID NO: 236890

SEQ ID NO: 332318 - RNA, 64 nt, hsa; identical to SEQ ID NO: 236891

SEQ ID NO: 332319 - RNA, 64 nt, hsa; identical to SEQ ID NO: 236892

SEQ ID NO: 332320 - RNA, 64 nt, hsa; identical to SEQ ID NO: 236893

SEQ ID NO: 332321 - RNA, 64 nt, hsa; identical to SEQ ID NO: 236894

SEQ ID NO: 332322 - RNA, 64 nt, hsa; identical to SEQ ID NO: 236895

SEQ ID NO: 332323 - RNA, 64 nt, hsa; identical to SEQ ID NO: 236896

SEQ ID NO: 332324 - RNA, 64 nt, hsa; identical to SEQ ID NO: 236897

SEQ ID NO: 332325 - RNA, 64 nt, hsa; identical to SEQ ID NO: 236898

SEQ ID NO: 332326 - RNA, 64 nt, hsa; identical to SEQ ID NO: 236899

SEQ ID NO: 332327 - RNA, 64 nt, hsa; identical to SEQ ID NO: 236900

SEQ ID NO: 332328 - RNA, 64 nt, hsa; identical to SEQ ID NO: 236901

SEQ ID NO: 332329 - RNA, 64 nt, hsa; identical to SEQ ID NO: 236902

SEQ ID NO: 332330 - RNA, 64 nt, hsa; identical to SEQ ID NO: 236903

SEQ ID NO: 332331 - RNA, 64 nt, hsa; identical to SEQ ID NO: 236904

SEQ ID NO: 332332 - RNA, 64 nt, hsa; identical to SEQ ID NO: 236905

SEQ ID NO: 332333 - RNA, 64 nt, hsa; identical to SEQ ID NO: 236906

SEQ ID NO: 332334 - RNA, 64 nt, hsa; identical to SEQ ID NO: 236907

SEQ ID NO: 332335 - RNA, 64 nt, hsa; identical to SEQ ID NO: 236908

SEQ ID NO: 332336 - RNA, 64 nt, hsa; identical to SEQ ID NO: 236909

SEQ ID NO: 332337 - RNA, 64 nt, hsa; identical to SEQ ID NO: 236910

SEQ ID NO: 332338 - RNA, 64 nt, hsa; identical to SEQ ID NO: 236911

SEQ ID NO: 332339 - RNA, 64 nt, hsa; identical to SEQ ID NO: 236912

SEQ ID NO: 332340 - RNA, 64 nt, hsa; identical to SEQ ID NO: 236913

SEQ ID NO: 332341 - RNA, 64 nt, hsa; identical to SEQ ID NO: 236914

SEQ ID NO: 332342 - RNA, 64 nt, hsa; identical to SEQ ID NO: 236915

SEQ ID NO: 332343 - RNA, 64 nt, hsa; identical to SEQ ID NO: 236916

SEQ ID NO: 332344 - RNA, 64 nt, hsa; identical to SEQ ID NO: 236917

SEQ ID NO: 332345 - RNA, 64 nt, hsa; identical to SEQ ID NO: 236918

SEQ ID NO: 332346 - RNA, 64 nt, hsa; identical to SEQ ID NO: 236919

SEQ ID NO: 332347 - RNA, 64 nt, hsa; identical to SEQ ID NO: 236920

SEQ ID NO: 332348 - RNA, 64 nt, hsa; identical to SEQ ID NO: 236921

SEQ ID NO: 332349 - RNA, 64 nt, hsa; identical to SEQ ID NO: 236922

SEQ ID NO: 332350 - RNA, 64 nt, hsa; identical to SEQ ID NO: 236923

SEQ ID NO: 332351 - RNA, 64 nt, hsa; identical to SEQ ID NO: 236924

SEQ ID NO: 332352 - RNA, 64 nt, hsa; identical to SEQ ID NO: 236925

SEQ ID NO: 332353 - RNA, 64 nt, hsa; identical to SEQ ID NO: 236926

SEQ ID NO: 332354 - RNA, 64 nt, hsa; identical to SEQ ID NO: 236927

SEQ ID NO: 332355 - RNA, 64 nt, hsa; identical to SEQ ID NO: 236928

SEQ ID NO: 332356 - RNA, 64 nt, hsa; identical to SEQ ID NO: 236929

SEQ ID NO: 332357 - RNA, 64 nt, hsa; identical to SEQ ID NO: 236930

SEQ ID NO: 332358 - RNA, 64 nt, hsa; identical to SEQ ID NO: 236931

SEQ ID NO: 332359 - RNA, 64 nt, hsa; identical to SEQ ID NO: 236932

SEQ ID NO: 332360 - RNA, 64 nt, hsa; identical to SEQ ID NO: 236933

SEQ ID NO: 332361 - RNA, 64 nt, hsa; identical to SEQ ID NO: 236934

SEQ ID NO: 332362 - RNA, 64 nt, hsa; identical to SEQ ID NO: 244143

SEQ ID NO: 332363 - RNA, 64 nt, hsa; identical to SEQ ID NO: 244144

SEQ ID NO: 332364 - RNA, 64 nt, hsa; identical to SEQ ID NO: 244145

SEQ ID NO: 332365 - RNA, 64 nt, hsa; identical to SEQ ID NO: 244146

SEQ ID NO: 332366 - RNA, 64 nt, hsa; identical to SEQ ID NO: 244147

SEQ ID NO: 332367 - RNA, 64 nt, hsa; identical to SEQ ID NO: 244148

SEQ ID NO: 332368 - RNA, 64 nt, hsa; identical to SEQ ID NO: 244149

SEQ ID NO: 332369 - RNA, 64 nt, hsa; identical to SEQ ID NO: 244150

SEQ ID NO: 332370 - RNA, 64 nt, hsa; identical to SEQ ID NO: 244151

SEQ ID NO: 332371 - RNA, 64 nt, hsa; identical to SEQ ID NO: 244151

SEQ ID NO: 332372 - RNA, 64 nt, hsa; identical to SEQ ID NO: 244150

SEQ ID NO: 332373 - RNA, 64 nt, hsa; identical to SEQ ID NO: 244154

SEQ ID NO: 332374 - RNA, 64 nt, hsa; identical to SEQ ID NO: 244155

SEQ ID NO: 332375 - RNA, 64 nt, hsa; identical to SEQ ID NO: 244156

SEQ ID NO: 332376 - RNA, 64 nt, hsa; identical to SEQ ID NO: 244157

SEQ ID NO: 332377 - RNA, 64 nt, hsa; identical to SEQ ID NO: 244158

SEQ ID NO: 332378 - RNA, 64 nt, hsa; identical to SEQ ID NO: 244159

SEQ ID NO: 332379 - RNA, 64 nt, hsa; identical to SEQ ID NO: 244160

SEQ ID NO: 332380 - RNA, 64 nt, hsa; identical to SEQ ID NO: 244161

SEQ ID NO: 332381 - RNA, 64 nt, hsa; identical to SEQ ID NO: 244162

SEQ ID NO: 332382 - RNA, 64 nt, hsa; identical to SEQ ID NO: 244163

SEQ ID NO: 332383 - RNA, 64 nt, hsa; identical to SEQ ID NO: 244164

SEQ ID NO: 332384 - RNA, 64 nt, hsa; identical to SEQ ID NO: 244165

SEQ ID NO: 332385 - RNA, 64 nt, hsa; identical to SEQ ID NO: 244166

SEQ ID NO: 332386 - RNA, 64 nt, hsa; identical to SEQ ID NO: 244167

SEQ ID NO: 332387 - RNA, 64 nt, hsa; identical to SEQ ID NO: 244168

SEQ ID NO: 332388 - RNA, 64 nt, hsa; identical to SEQ ID NO: 244169

SEQ ID NO: 332389 - RNA, 64 nt, hsa; identical to SEQ ID NO: 244170

SEQ ID NO: 332390 - RNA, 64 nt, hsa; identical to SEQ ID NO: 244171

SEQ ID NO: 332391 - RNA, 64 nt, hsa
ccaguuuauaauagaucccuaguaaaaagcuuugauucaacacaauuguucaucuucacauccc

SEQ ID NO: 332392 - RNA, 64 nt, hsa
uuauuuuuaaaugaaaguguaagaaugcuuucugauucaacaaauuuguuaucaaacuguuucc

SEQ ID NO: 332393 - RNA, 64 nt, hsa
gaacaaacagaaacgagauuugccaaaaacuaaaauucaacaaaugauguugagugggagauug

SEQ ID NO: 332394 - RNA, 64 nt, hsa
guucugggucagcuugaauguccccauucuauaaauucaacacuuauuuucugaauucauaaaa

SEQ ID NO: 332395 - RNA, 64 nt, hsa
gggaagcgaucacaucuggugaccaggcugcuucauucaacacuguguaaacaccaaagccuua

SEQ ID NO: 332396 - RNA, 64 nt, hsa
auagccuugccuacugaagauagguucucuauguauucaacaauaaugcaacuuuagaaguauu

SEQ ID NO: 332397 - RNA, 64 nt, hsa
aaacucuauaagccagaagagagugggggccaauauucaacauucuuaaagaaaagaauuuuca

SEQ ID NO: 332398 - RNA, 64 nt, hsa
gagacaaggccauuauauaaugguaaauggaucaauucaacaagaagagauaacuauccuaaau

SEQ ID NO: 332399 - RNA, 64 nt, hsa
ucaucucuuuagaugcagaaagguuuuuaauaaaauucaacaucccuucauuuuaaaaacccuc

SEQ ID NO: 332400 - RNA, 64 nt, hsa
gaaaaugacagggaugaccacucucaccacuccgauucaacauaguacuggaaguccuaagcuu

SEQ ID NO: 332401 - RNA, 64 nt, hsa
uugugugaaauccuuuagccagcguuucaaccucauucaacaccagaaaguucacaguggaaaa

SEQ ID NO: 332402 - RNA, 64 nt, hsa
cagauggaaauccguuagccacaccuccagucucauucaacacuggacaguuuacaauguggac

SEQ ID NO: 332403 - RNA, 64 nt, hsa
uauggaaaaagguuucagccaaaggccuaacccuauucaacaccagaaaguuuacacuggagaa

SEQ ID NO: 332404 - RNA, 64 nt, hsa
uuguaaaaaagcuuuucuuuguuauucaacauuuauucaacacuauagaacucauacuaaugag

SEQ ID NO: 332405 - RNA, 64 nt, hsa
gaauguaaagauuguaaaaaagcuuuucuuuguuauucaacauuuauucaacacuauagaacuc

SEQ ID NO: 332406 - RNA, 64 nt, hsa
cacaagacucagaauccacagugucccauuuuccgacuaggagacaucuuccgagaaacaggcg

SEQ ID NO: 332407 - RNA, 64 nt, hsa
cuacaugaaugcaaaacauuucauuaugaggucagacuaggauaauguccaacuaaaaacaaac

SEQ ID NO: 332408 - RNA, 64 nt, hsa; identical to SEQ ID NO: 259559

SEQ ID NO: 332409 - RNA, 64 nt, hsa; identical to SEQ ID NO: 259560

SEQ ID NO: 332410 - RNA, 64 nt, hsa; identical to SEQ ID NO: 259561

SEQ ID NO: 332411 - RNA, 64 nt, hsa; identical to SEQ ID NO: 259562

SEQ ID NO: 332412 - RNA, 64 nt, hsa; identical to SEQ ID NO: 259563

SEQ ID NO: 332413 - RNA, 64 nt, hsa; identical to SEQ ID NO: 259564

SEQ ID NO: 332414 - RNA, 64 nt, hsa; identical to SEQ ID NO: 259565

SEQ ID NO: 332415 - RNA, 64 nt, hsa; identical to SEQ ID NO: 259566

SEQ ID NO: 332416 - RNA, 64 nt, hsa; identical to SEQ ID NO: 259567

SEQ ID NO: 332417 - RNA, 64 nt, hsa; identical to SEQ ID NO: 259568

SEQ ID NO: 332418 - RNA, 64 nt, hsa; identical to SEQ ID NO: 259569

SEQ ID NO: 332419 - RNA, 64 nt, hsa; identical to SEQ ID NO: 259570

SEQ ID NO: 332420 - RNA, 64 nt, hsa; identical to SEQ ID NO: 259571

SEQ ID NO: 332421 - RNA, 64 nt, hsa; identical to SEQ ID NO: 259572

SEQ ID NO: 332422 - RNA, 64 nt, hsa; identical to SEQ ID NO: 259573

SEQ ID NO: 332423 - RNA, 64 nt, hsa; identical to SEQ ID NO: 259574

SEQ ID NO: 332424 - RNA, 64 nt, hsa; identical to SEQ ID NO: 259575

SEQ ID NO: 332425 - RNA, 64 nt, hsa; identical to SEQ ID NO: 259576

SEQ ID NO: 332426 - RNA, 64 nt, hsa; identical to SEQ ID NO: 259577

SEQ ID NO: 332427 - RNA, 64 nt, hsa; identical to SEQ ID NO: 259578

SEQ ID NO: 332428 - RNA, 64 nt, hsa; identical to SEQ ID NO: 259579

SEQ ID NO: 332429 - RNA, 64 nt, hsa; identical to SEQ ID NO: 259580

SEQ ID NO: 332430 - RNA, 64 nt, hsa
uuaauuggugucuuccccccucauuugcucucuucccuaaaaugugucccagaugccuucauuu

SEQ ID NO: 332431 - RNA, 64 nt, hsa
cugcuaugaaaauccacaaauuuuucagauagugcccuaaaaacaauuuuauaugccucacugg

SEQ ID NO: 332432 - RNA, 64 nt, hsa
ugagacuaaacacaaaaacaguagauaaaucucucccuaaaagauggauucccccacauaccca

SEQ ID NO: 332433 - RNA, 64 nt, hsa
auguccuucuagugguuugaaaauguuaaaacaucccuaaaaucuaaaucauauaaucagaauu

SEQ ID NO: 332434 - RNA, 64 nt, hsa
auaaauaccuuucaagugugagcuuagacgucaacccuaaaauacuuaaccguaaugcuaauug

SEQ ID NO: 332435 - RNA, 64 nt, hsa
uucugcaguuauuucucuuguucuggccaaacaacccuaaaaauccuuaccauuccacaaaguu

SEQ ID NO: 332436 - RNA, 64 nt, hsa
ugagcucuuccuaucccucuccuaacugccagcccccuaaaagcacuccugcuuaaucuucaaa

SEQ ID NO: 332437 - RNA, 64 nt, hsa
uaaauccuuuuaccuuuuuuuuuucuugguaauccccuaaaauaacaguaugugggauauugaa

SEQ ID NO: 332438 - RNA, 64 nt, hsa
guuaccaucaccgaugaauaccuccuaggcuuaucccuaaaaaugcucgcucagagaauuaauu

SEQ ID NO: 332439 - RNA, 64 nt, hsa
aacauuguuuauauuuuuucuauucaauaaaaagcccuaaaacaacuaaaaugauuuguauacc

SEQ ID NO: 332440 - RNA, 64 nt, hsa
aauagggaaaaacaucuaccuaaaagaugguugucccuaaaaaacuggaaacaucugaaaugcu

SEQ ID NO: 332441 - RNA, 64 nt, hsa
auuuauauguauuuuuaccacaauaaacaaaaaacccuaaaaaaacuuuaaugaaagguggaaa

SEQ ID NO: 332442 - RNA, 64 nt, hsa
aaaaaaauugauuuccauauuuuauuuuucaaaacccuaaaauauuacaaaauaagucccgcau

SEQ ID NO: 332443 - RNA, 64 nt, hsa
caaggaaggaaaagaaagaagagaaggggagaaacccuaaaaagagaagaaucuuaaugaacac

SEQ ID NO: 332444 - RNA, 64 nt, hsa
uucucccugaguugauugauaggcuuaauggucacccuaaaaacacccacauaugcuuuucgau

SEQ ID NO: 332445 - RNA, 64 nt, hsa
gcauucaucauaauaauuccagacauuuucaucacccuaaaaggaaacccugaaacccauuagc

SEQ ID NO: 332446 - RNA, 64 nt, hsa
caaguuuacuuucauuccuuccuauguuuuaauccccuaaaauucucccuguagucaauguucc

SEQ ID NO: 332447 - RNA, 64 nt, hsa
ggggaggaugcuacuuuacuggaguugagacacccccuaaaauucucacccucagcuauuuugu

SEQ ID NO: 332448 - RNA, 64 nt, hsa
ccuagaaaacagcugcaaaugccagaaagaugaucccuaaaaauguugagggacuucuguucau

SEQ ID NO: 332449 - RNA, 64 nt, hsa
auauauauauauaaaacuuagaguuuuuaucuuccccuaaaagaggccgugauauuugcagcag

SEQ ID NO: 332450 - RNA, 64 nt, hsa
ucguguaugacagguagcuagggagcucuuggagauguagcaguugggauugugggagauuacu

SEQ ID NO: 332451 - RNA, 64 nt, hsa
auuaagugaaaaaaguuuaaucccagaagaguaaauguagcaugaugcccuuucuaaaugaaag

SEQ ID NO: 332452 - RNA, 64 nt, hsa
uaaagaccuccaaggguacuucuuuggaaaugaaauguagcacaaucuuagccuacguuaccag

SEQ ID NO: 332453 - RNA, 64 nt, hsa
uuagugacccacaggacaguauagauguuuguggauguagcacugaguggugauacccagacca

SEQ ID NO: 332454 - RNA, 64 nt, hsa
gcagcucuuccugccacugaaugcguucugcagcauguagcaugcccaccuagcucccuggcca

SEQ ID NO: 332455 - RNA, 64 nt, hsa
ugacucucccggcucugccacuguuuucugagaaauguagcauccgcugcagcuggccacacug

SEQ ID NO: 332456 - RNA, 64 nt, hsa
aaugaaaauuguugagguuaucucccauucaaucauguagcaagaacuuaaagaaauucacuac

SEQ ID NO: 332457 - RNA, 64 nt, hsa
gaaaauagagaauuuaauauauggugauugggauauguagcauucaaaaaaagugaauugccaa

SEQ ID NO: 332458 - RNA, 64 nt, hsa
uuggcucucuacacauggcauuucaggguauaagauguagcauuucaauguguaagauauaugu

SEQ ID NO: 332459 - RNA, 64 nt, hsa
uucagcuuucuuuaacuuaauuguggucguguuaauguagcacaaaaaauauauuuuaaugaag

SEQ ID NO: 332460 - RNA, 64 nt, hsa
aaugcuaugguuuccauguggacauacagugccuauguagcaggcacuuagaguaaauggacuu

SEQ ID NO: 332461 - RNA, 64 nt, hsa
auaaaagcaugcccucagcuuuuaaugaacuuaaauguagcacauauggcuuaaucucuuagac

SEQ ID NO: 332462 - RNA, 64 nt, hsa
uuuuaaaaaggcuuuggcuuaugcugaauuauacauguagcaccaaaauguuacaacucuacua

SEQ ID NO: 332463 - RNA, 64 nt, hsa
uggcaauuuauaauuuauuacuacuuuaaaucaaauguagcauuaucacacuguauuuaaauug

SEQ ID NO: 332464 - RNA, 64 nt, hsa
ccagaggggaacuugauucaaaaauuugggauucauguagcagagacagagcuagacuguaaag

SEQ ID NO: 332465 - RNA, 64 nt, hsa
uuugaguuaaaaauggcacuuuugauaugagacaauguagcagaauaccaggcagacagaaccu

SEQ ID NO: 332466 - RNA, 64 nt, hsa
gcacucuuaaaugaucugccucuaaaagcguuggauguagcauuaugcaauuagguuuuuccuu

SEQ ID NO: 332467 - RNA, 64 nt, hsa
auuguacuaccuguguauauaguuuuuaccuuuuauguagcacauaaacuuuggggaagggagg

SEQ ID NO: 332468 - RNA, 64 nt, hsa
uucaugagggagucaauauguaguggaaagaagcauguagcaaaaaagacaaccuugaucuuua

SEQ ID NO: 332469 - RNA, 64 nt, hsa
aaaaagcagaacccacuggaguagaaaaggaagcauguagcauauacucaguagugaaauuuaa

SEQ ID NO: 332470 - RNA, 64 nt, hsa
auugucuugguugccaguaguaccuuguuuugccauguagcagacaacacacaaaauaaugcag

SEQ ID NO: 332471 - RNA, 64 nt, hsa
gccucagcucauagugaacacagcagaccuagaaauguagcagcagccuacugaguagcuuuca

SEQ ID NO: 332472 - RNA, 64 nt, hsa; identical to SEQ ID NO: 311703

SEQ ID NO: 332473 - RNA, 64 nt, hsa; identical to SEQ ID NO: 311704

SEQ ID NO: 332474 - RNA, 64 nt, hsa; identical to SEQ ID NO: 311705

SEQ ID NO: 332475 - RNA, 64 nt, hsa; identical to SEQ ID NO: 311706

SEQ ID NO: 332476 - RNA, 64 nt, hsa; identical to SEQ ID NO: 311707

SEQ ID NO: 332477 - RNA, 64 nt, hsa; identical to SEQ ID NO: 311708

SEQ ID NO: 332478 - RNA, 64 nt, hsa; identical to SEQ ID NO: 311709

SEQ ID NO: 332479 - RNA, 64 nt, hsa; identical to SEQ ID NO: 311710

SEQ ID NO: 332480 - RNA, 64 nt, hsa; identical to SEQ ID NO: 311711

SEQ ID NO: 332481 - RNA, 64 nt, hsa; identical to SEQ ID NO: 311712

SEQ ID NO: 332482 - RNA, 64 nt, hsa; identical to SEQ ID NO: 311713

SEQ ID NO: 332483 - RNA, 64 nt, hsa; identical to SEQ ID NO: 311714

SEQ ID NO: 332484 - RNA, 64 nt, hsa; identical to SEQ ID NO: 311713

SEQ ID NO: 332485 - RNA, 64 nt, hsa; identical to SEQ ID NO: 311714

SEQ ID NO: 332486 - RNA, 64 nt, hsa; identical to SEQ ID NO: 189259

SEQ ID NO: 332487 - RNA, 64 nt, hsa; identical to SEQ ID NO: 189260

SEQ ID NO: 332488 - RNA, 64 nt, hsa; identical to SEQ ID NO: 189261

SEQ ID NO: 332489 - RNA, 64 nt, hsa; identical to SEQ ID NO: 189262

SEQ ID NO: 332490 - RNA, 56 nt, hsa; identical to SEQ ID NO: 189263

SEQ ID NO: 332491 - RNA, 64 nt, hsa; identical to SEQ ID NO: 189264

SEQ ID NO: 332492 - RNA, 64 nt, hsa; identical to SEQ ID NO: 189265

SEQ ID NO: 332493 - RNA, 64 nt, hsa; identical to SEQ ID NO: 189266

SEQ ID NO: 332494 - RNA, 64 nt, hsa; identical to SEQ ID NO: 189267

SEQ ID NO: 332495 - RNA, 64 nt, hsa; identical to SEQ ID NO: 189268

SEQ ID NO: 332496 - RNA, 64 nt, hsa; identical to SEQ ID NO: 189269

SEQ ID NO: 332497 - RNA, 64 nt, hsa; identical to SEQ ID NO: 189270

SEQ ID NO: 332498 - RNA, 64 nt, hsa; identical to SEQ ID NO: 189271

SEQ ID NO: 332499 - RNA, 64 nt, hsa; identical to SEQ ID NO: 189272

SEQ ID NO: 332500 - RNA, 64 nt, hsa; identical to SEQ ID NO: 189273

SEQ ID NO: 332501 - RNA, 64 nt, hsa; identical to SEQ ID NO: 189274

SEQ ID NO: 332502 - RNA, 64 nt, hsa; identical to SEQ ID NO: 189275

SEQ ID NO: 332503 - RNA, 64 nt, hsa; identical to SEQ ID NO: 189276

SEQ ID NO: 332504 - RNA, 64 nt, hsa; identical to SEQ ID NO: 189277

SEQ ID NO: 332505 - RNA, 64 nt, hsa; identical to SEQ ID NO: 189278

SEQ ID NO: 332506 - RNA, 64 nt, hsa; identical to SEQ ID NO: 189279

SEQ ID NO: 332507 - RNA, 64 nt, hsa; identical to SEQ ID NO: 189280

SEQ ID NO: 332508 - RNA, 64 nt, hsa; identical to SEQ ID NO: 52376

SEQ ID NO: 332509 - RNA, 64 nt, hsa; identical to SEQ ID NO: 52377

SEQ ID NO: 332510 - RNA, 64 nt, hsa; identical to SEQ ID NO: 52378

SEQ ID NO: 332511 - RNA, 64 nt, hsa; identical to SEQ ID NO: 52379

SEQ ID NO: 332512 - RNA, 64 nt, hsa; identical to SEQ ID NO: 52380

SEQ ID NO: 332513 - RNA, 64 nt, hsa; identical to SEQ ID NO: 52381

SEQ ID NO: 332514 - RNA, 64 nt, hsa; identical to SEQ ID NO: 52382

SEQ ID NO: 332515 - RNA, 64 nt, hsa; identical to SEQ ID NO: 52383

SEQ ID NO: 332516 - RNA, 64 nt, hsa; identical to SEQ ID NO: 52384

SEQ ID NO: 332517 - RNA, 64 nt, hsa; identical to SEQ ID NO: 52385

SEQ ID NO: 332518 - RNA, 64 nt, hsa; identical to SEQ ID NO: 52386

SEQ ID NO: 332519 - RNA, 64 nt, hsa; identical to SEQ ID NO: 52387

SEQ ID NO: 332520 - RNA, 64 nt, hsa; identical to SEQ ID NO: 52388

SEQ ID NO: 332521 - RNA, 64 nt, hsa; identical to SEQ ID NO: 52389

SEQ ID NO: 332522 - RNA, 64 nt, hsa; identical to SEQ ID NO: 52390

SEQ ID NO: 332523 - RNA, 64 nt, hsa; identical to SEQ ID NO: 52391

SEQ ID NO: 332524 - RNA, 64 nt, hsa; identical to SEQ ID NO: 52392

SEQ ID NO: 332525 - RNA, 64 nt, hsa
aaaaggcguaagggaacucauaaaggcuagcagcaugcgguauuuuaacuuucugccucggccu

SEQ ID NO: 332526 - RNA, 64 nt, hsa
augguuuuauaaucuucugggaccaccauuguauaugcgguacaucauugaccaaaacaucguu

SEQ ID NO: 332527 - RNA, 64 nt, hsa
uggugggacacacugggguugggggugggggaagaugcgguaaugaaaccgguuagucaguguu

SEQ ID NO: 332528 - RNA, 64 nt, hsa
cugaaaucauauuaaauacccacauuugacauaaaugcgguacccuuuacuacacucaugagug

SEQ ID NO: 332529 - RNA, 64 nt, hsa
ccugaagaccugccacggcaaguggagcugcuggaugcgguaagccaagcugcucagaaguacg

SEQ ID NO: 332530 - RNA, 64 nt, hsa
agaaacuuuuacuugugauacucuaccaugaaggaugcgguaauggcaggaauagcagaauaau

SEQ ID NO: 332531 - RNA, 64 nt, hsa
gggacaaacuccauccagguugacucucucuggaaugcgguaauaagagcuggcaaguaaggcu

SEQ ID NO: 332532 - RNA, 64 nt, hsa
gggauagcugggaguauggccacccugcuccacgaugcgguaaugaauccagcagaagguaaug

SEQ ID NO: 332533 - RNA, 64 nt, hsa
ccgaacucugacucuaguucugcggaagaaaaggaugcgguauuugcuuuugccaugaucccuu

SEQ ID NO: 332534 - RNA, 64 nt, hsa
cucugggccuggcucccagucagugguggccacgaugcgguacagggcaucccuccuucccauc

SEQ ID NO: 332535 - RNA, 64 nt, hsa
accccggagcuccuucuagcuuggccuucuuuggaugcgguaucacaugaggccugucccuaac

SEQ ID NO: 332536 - RNA, 64 nt, hsa
caggggggcaggggccagucuugugcuccuggacaugcgguacugaggugcagacaagggucuc

SEQ ID NO: 332537 - RNA, 64 nt, hsa
uccccuucaaggcagacguucaguacaaacauuuaugcgguaggcucagaugucguaauuugca

SEQ ID NO: 332538 - RNA, 64 nt, hsa
aggugagcaagauaggacuuggcuuucuuacaugaugcgguaacuugugacuugagucuuuuuc

SEQ ID NO: 332539 - RNA, 64 nt, hsa
ccaccucaacaaccagcucuaugacaucauuaccaugcgguacgcagacaaacacaugaacauc

SEQ ID NO: 332540 - RNA, 64 nt, hsa
gcgcuauccuacacucugagggaguuggcaacgcaugcgguauaguggagugggaagaguugag

SEQ ID NO: 332541 - RNA, 64 nt, hsa
uauacauuuuuaaaagccauuuuacugguuuggcaugcgguauggaaauucuaagagagaaagu

SEQ ID NO: 332542 - RNA, 64 nt, hsa
uggcggaacacacugggggugggggcgggggaagaugcgguaaugaaaccgguuagucaauuuu

SEQ ID NO: 332543 - RNA, 64 nt, hsa
uccgagcaugugggucucgcugagcagucauggaaugcgguagagccaggggacccugucugcc

SEQ ID NO: 332544 - RNA, 64 nt, hsa
acuguacaagugcguacaaugugaccuucucuaaaugcgguagauucaaacaaagaugcucugu

SEQ ID NO: 332545 - RNA, 64 nt, hsa
ggccacaucaaagaggcugaggcuggcacaggacaugcgguagccagcacacagggcagugagg

SEQ ID NO: 332546 - RNA, 64 nt, hsa
gaagggcuuuucagaaaucgguuugaaguuagaaaugcgguaaaacuccuccaggcagcugaca

SEQ ID NO: 332547 - RNA, 64 nt, hsa
gaguuugggugggguggcaguuggcacagcgcagaugcgguagagaugggaggaaacccagcuc

SEQ ID NO: 332548 - RNA, 64 nt, hsa
ucgauucauccauaaauaauauaaggaaaaacuuaugcgguagccugcauuagggcuuuuugau

SEQ ID NO: 332549 - RNA, 64 nt, hsa; identical to SEQ ID NO: 89025

SEQ ID NO: 332550 - RNA, 64 nt, hsa; identical to SEQ ID NO: 89026

SEQ ID NO: 332551 - RNA, 64 nt, hsa; identical to SEQ ID NO: 89027

SEQ ID NO: 332552 - RNA, 64 nt, hsa; identical to SEQ ID NO: 89028

SEQ ID NO: 332553 - RNA, 64 nt, hsa; identical to SEQ ID NO: 89029

SEQ ID NO: 332554 - RNA, 64 nt, hsa; identical to SEQ ID NO: 89030

SEQ ID NO: 332555 - RNA, 64 nt, hsa; identical to SEQ ID NO: 89031

SEQ ID NO: 332556 - RNA, 64 nt, hsa; identical to SEQ ID NO: 89032

SEQ ID NO: 332557 - RNA, 64 nt, hsa; identical to SEQ ID NO: 89033

SEQ ID NO: 332558 - RNA, 64 nt, hsa; identical to SEQ ID NO: 89034

SEQ ID NO: 332559 - RNA, 64 nt, hsa; identical to SEQ ID NO: 89035

SEQ ID NO: 332560 - RNA, 64 nt, hsa; identical to SEQ ID NO: 89036

SEQ ID NO: 332561 - RNA, 64 nt, hsa; identical to SEQ ID NO: 89037

SEQ ID NO: 332562 - RNA, 64 nt, hsa; identical to SEQ ID NO: 89038

SEQ ID NO: 332563 - RNA, 64 nt, hsa; identical to SEQ ID NO: 89039

SEQ ID NO: 332564 - RNA, 64 nt, hsa; identical to SEQ ID NO: 89040

SEQ ID NO: 332565 - RNA, 64 nt, hsa; identical to SEQ ID NO: 288407

SEQ ID NO: 332566 - RNA, 64 nt, hsa; identical to SEQ ID NO: 288408

SEQ ID NO: 332567 - RNA, 64 nt, hsa; identical to SEQ ID NO: 288409

SEQ ID NO: 332568 - RNA, 64 nt, hsa; identical to SEQ ID NO: 288410

SEQ ID NO: 332569 - RNA, 64 nt, hsa; identical to SEQ ID NO: 288411

SEQ ID NO: 332570 - RNA, 64 nt, hsa; identical to SEQ ID NO: 288412

SEQ ID NO: 332571 - RNA, 64 nt, hsa; identical to SEQ ID NO: 288413

SEQ ID NO: 332572 - RNA, 64 nt, hsa; identical to SEQ ID NO: 288414

SEQ ID NO: 332573 - RNA, 64 nt, hsa; identical to SEQ ID NO: 288415

SEQ ID NO: 332574 - RNA, 64 nt, hsa; identical to SEQ ID NO: 288416

SEQ ID NO: 332575 - RNA, 64 nt, hsa; identical to SEQ ID NO: 288417

SEQ ID NO: 332576 - RNA, 64 nt, hsa; identical to SEQ ID NO: 288418

SEQ ID NO: 332577 - RNA, 64 nt, hsa; identical to SEQ ID NO: 288419

SEQ ID NO: 332578 - RNA, 64 nt, hsa; identical to SEQ ID NO: 288420

SEQ ID NO: 332579 - RNA, 64 nt, hsa; identical to SEQ ID NO: 288421

SEQ ID NO: 332580 - RNA, 64 nt, hsa; identical to SEQ ID NO: 288422

SEQ ID NO: 332581 - RNA, 64 nt, hsa; identical to SEQ ID NO: 288423

SEQ ID NO: 332582 - RNA, 64 nt, hsa; identical to SEQ ID NO: 288424

SEQ ID NO: 332583 - RNA, 64 nt, hsa; identical to SEQ ID NO: 288425

SEQ ID NO: 332584 - RNA, 64 nt, hsa; identical to SEQ ID NO: 288426

SEQ ID NO: 332585 - RNA, 64 nt, hsa; identical to SEQ ID NO: 288427

SEQ ID NO: 332586 - RNA, 64 nt, hsa; identical to SEQ ID NO: 288428

SEQ ID NO: 332587 - RNA, 64 nt, hsa; identical to SEQ ID NO: 288429

SEQ ID NO: 332588 - RNA, 64 nt, hsa; identical to SEQ ID NO: 288430

SEQ ID NO: 332589 - RNA, 64 nt, hsa; identical to SEQ ID NO: 288431

SEQ ID NO: 332590 - RNA, 64 nt, hsa; identical to SEQ ID NO: 288432

SEQ ID NO: 332591 - RNA, 64 nt, hsa; identical to SEQ ID NO: 288433

SEQ ID NO: 332592 - RNA, 64 nt, hsa; identical to SEQ ID NO: 288434

SEQ ID NO: 332593 - RNA, 64 nt, hsa; identical to SEQ ID NO: 288435

SEQ ID NO: 332594 - RNA, 64 nt, hsa; identical to SEQ ID NO: 288436

SEQ ID NO: 332595 - RNA, 64 nt, hsa; identical to SEQ ID NO: 288437

SEQ ID NO: 332596 - RNA, 64 nt, hsa; identical to SEQ ID NO: 288438

SEQ ID NO: 332597 - RNA, 64 nt, hsa; identical to SEQ ID NO: 288439

SEQ ID NO: 332598 - RNA, 64 nt, hsa; identical to SEQ ID NO: 288440

SEQ ID NO: 332599 - RNA, 64 nt, hsa; identical to SEQ ID NO: 288441

SEQ ID NO: 332600 - RNA, 64 nt, hsa; identical to SEQ ID NO: 288442

SEQ ID NO: 332601 - RNA, 64 nt, hsa; identical to SEQ ID NO: 288443

SEQ ID NO: 332602 - RNA, 64 nt, hsa; identical to SEQ ID NO: 288444

SEQ ID NO: 332603 - RNA, 64 nt, hsa; identical to SEQ ID NO: 288445

SEQ ID NO: 332604 - RNA, 64 nt, hsa; identical to SEQ ID NO: 288446

SEQ ID NO: 332605 - RNA, 64 nt, hsa; identical to SEQ ID NO: 288447

SEQ ID NO: 332606 - RNA, 64 nt, hsa; identical to SEQ ID NO: 288448

SEQ ID NO: 332607 - RNA, 64 nt, hsa; identical to SEQ ID NO: 288449

SEQ ID NO: 332608 - RNA, 64 nt, hsa; identical to SEQ ID NO: 288450

SEQ ID NO: 332609 - RNA, 64 nt, hsa; identical to SEQ ID NO: 288451

SEQ ID NO: 332610 - RNA, 64 nt, hsa
uuuuguaacagaaauugcuuauaaguuuuuuaucaguaaggaccaugaucaccauuuguacaua

SEQ ID NO: 332611 - RNA, 64 nt, hsa
aggcacacuccuuggccugcagaaaugugauugaaguaaggaguaauuugggaaauggaguauc

SEQ ID NO: 332612 - RNA, 64 nt, hsa
auaaggaguugagucgcuuugugguauagaagggaguaaggaauaaaagauauagaauaguaau

SEQ ID NO: 332613 - RNA, 64 nt, hsa
acauguuuugacucuggcuugcagcaccauucggaguaaggaugacagcaggcccagaaggugu

SEQ ID NO: 332614 - RNA, 64 nt, hsa
accuguugaaucuugacuauaaaaugaucugagaaguaaggaaggcugggcugauguguggcuc

SEQ ID NO: 332615 - RNA, 64 nt, hsa
uggaggugaggcggaggaaaggcagguaggaaggaguaaggauggagaugcucagaaucaagag

SEQ ID NO: 332616 - RNA, 64 nt, hsa
gcuuagaguauuucuuuaaucacagucacugggaaguaaggagauguauauauguguauauaug

SEQ ID NO: 332617 - RNA, 64 nt, hsa
ggccuggcauugcacaugguguuacauggcuacaaguaaggaaaaaaucagaaagugaaagaac

SEQ ID NO: 332618 - RNA, 64 nt, hsa
augaugggcuuucuacagccugcuuaccacuaacaguaaggaaucuuucauaaacacaccucag

SEQ ID NO: 332619 - RNA, 64 nt, hsa
gucuuccaugaacugauuaugcuuaauuaagcaaaguaaggaaauuaguuucauggaagccuaa

SEQ ID NO: 332620 - RNA, 64 nt, hsa
cauuuuggggagccaccugaagguugauguauaaaguaaggauuagagaaagaggucguuguga

SEQ ID NO: 332621 - RNA, 64 nt, hsa
ggggaugucuguccuaaaagcugacugcuaggauaguaaggaucaucuugccugggcuaugcca

SEQ ID NO: 332622 - RNA, 64 nt, hsa
gguaacuaguaggauagaaacacugugucccgagaguaaggagagaagcuacuauugauuagag

SEQ ID NO: 332623 - RNA, 64 nt, hsa
gaugaggucccugguuuuucauggcaacuugaucaguaaggauuucaccucuguuuguaacuaa

SEQ ID NO: 332624 - RNA, 64 nt, hsa; identical to SEQ ID NO: 75363

SEQ ID NO: 332625 - RNA, 64 nt, hsa; identical to SEQ ID NO: 75364

SEQ ID NO: 332626 - RNA, 64 nt, hsa; identical to SEQ ID NO: 75365

SEQ ID NO: 332627 - RNA, 53 nt, hsa; identical to SEQ ID NO: 75366

SEQ ID NO: 332628 - RNA, 64 nt, hsa; identical to SEQ ID NO: 75367

SEQ ID NO: 332629 - RNA, 64 nt, hsa; identical to SEQ ID NO: 75368

SEQ ID NO: 332630 - RNA, 64 nt, hsa; identical to SEQ ID NO: 75369

SEQ ID NO: 332631 - RNA, 64 nt, hsa; identical to SEQ ID NO: 75370

SEQ ID NO: 332632 - RNA, 64 nt, hsa; identical to SEQ ID NO: 75371

SEQ ID NO: 332633 - RNA, 64 nt, hsa; identical to SEQ ID NO: 75372

SEQ ID NO: 332634 - RNA, 64 nt, hsa; identical to SEQ ID NO: 75373

SEQ ID NO: 332635 - RNA, 64 nt, hsa; identical to SEQ ID NO: 75374

SEQ ID NO: 332636 - RNA, 64 nt, hsa; identical to SEQ ID NO: 75375

SEQ ID NO: 332637 - RNA, 64 nt, hsa; identical to SEQ ID NO: 75376

SEQ ID NO: 332638 - RNA, 64 nt, hsa; identical to SEQ ID NO: 75377

SEQ ID NO: 332639 - RNA, 64 nt, hsa; identical to SEQ ID NO: 75378

SEQ ID NO: 332640 - RNA, 64 nt, hsa; identical to SEQ ID NO: 75379

SEQ ID NO: 332641 - RNA, 64 nt, hsa; identical to SEQ ID NO: 75380

SEQ ID NO: 332642 - RNA, 64 nt, hsa; identical to SEQ ID NO: 75381

SEQ ID NO: 332643 - RNA, 64 nt, hsa; identical to SEQ ID NO: 102070

SEQ ID NO: 332644 - RNA, 64 nt, hsa; identical to SEQ ID NO: 102071

SEQ ID NO: 332645 - RNA, 64 nt, hsa; identical to SEQ ID NO: 102072

SEQ ID NO: 332646 - RNA, 64 nt, hsa; identical to SEQ ID NO: 102073

SEQ ID NO: 332647 - RNA, 64 nt, hsa; identical to SEQ ID NO: 102074

SEQ ID NO: 332648 - RNA, 64 nt, hsa; identical to SEQ ID NO: 102075

SEQ ID NO: 332649 - RNA, 64 nt, hsa; identical to SEQ ID NO: 102076

SEQ ID NO: 332650 - RNA, 64 nt, hsa; identical to SEQ ID NO: 102077

SEQ ID NO: 332651 - RNA, 64 nt, hsa; identical to SEQ ID NO: 102078

SEQ ID NO: 332652 - RNA, 64 nt, hsa; identical to SEQ ID NO: 102079

SEQ ID NO: 332653 - RNA, 64 nt, hsa; identical to SEQ ID NO: 102080

SEQ ID NO: 332654 - RNA, 64 nt, hsa; identical to SEQ ID NO: 102081

SEQ ID NO: 332655 - RNA, 64 nt, hsa; identical to SEQ ID NO: 102082

SEQ ID NO: 332656 - RNA, 64 nt, hsa
aaagguaguuaagaugaaauuuauaugaaagcauuuuuaucacaaaauaaaaaagguuugccaa

SEQ ID NO: 332657 - RNA, 64 nt, hsa
acauucugucagccucuuucauagugugcaaacauuuuaucauucuaaauggugacucucugcc

SEQ ID NO: 332658 - RNA, 64 nt, hsa
caggaaagaaaggagaguagaacauuuuuccucauuuuaucaaauccucucuugcccucccuca

SEQ ID NO: 332659 - RNA, 64 nt, hsa
uaacauuccugaagcuguucccacucccagaugguuuuaucaauagccuagagguaaagaacug

SEQ ID NO: 332660 - RNA, 64 nt, hsa
gugucuccuuaugguacacuccagcgguugccuuuuuuaucauuucuacugaaguugggaaauu

SEQ ID NO: 332661 - RNA, 64 nt, hsa
uuacacagcaauuuuguauccauuuaaacuaaccuuuuaucaauaaagcacuauuguuuagaua

SEQ ID NO: 332662 - RNA, 64 nt, hsa
gacaaaauuuuaguccaaauaacaaguaccaaaguuuuaucaaguuugggucugugcugcuguu

SEQ ID NO: 332663 - RNA, 64 nt, hsa
aagacucuauucucaaaguuuccuaaucagaaauuuuuaucaguuuccagucucaaaaauacaa

SEQ ID NO: 332664 - RNA, 64 nt, hsa
gccugcugguacugugaugcauuucaaguggcaguuuuaucacguuugaaucuaccauucauag

SEQ ID NO: 332665 - RNA, 64 nt, hsa
aguuucaauuuuuguuuguaaaacuaaauuuuaauuuuaucaucaugaacuagugucuaaauac

SEQ ID NO: 332666 - RNA, 64 nt, hsa
guaaaucugcaaaaggcaaugaaaaugccuuaaauuuuaucaauaacagaauuauuguauuuaa

SEQ ID NO: 332667 - RNA, 64 nt, hsa
cuuuaaaauaguaaauaggauuuuaaacagagaauuuuaucaguaauaggugucaguuuuuaaa

SEQ ID NO: 332668 - RNA, 64 nt, hsa
guggaucauucuaguaggaaaggacaauaagauuuuuuaucaaaaugugucaugccaguaagag

SEQ ID NO: 332669 - RNA, 64 nt, hsa
uugagcacuuuuacuuaaacuugcuuguaguugcuuuuaucacugccgcaaaacagccaucaag

SEQ ID NO: 332670 - RNA, 64 nt, hsa
ucugguauagacuuugggaguaugugugugaaguuuuuaucaaacuguaauauuugugaaugga

SEQ ID NO: 332671 - RNA, 64 nt, hsa
agaaguuuagcauuaauaguuguucugaaacguguuuuaucagguuuagagcccauguugaguc

SEQ ID NO: 332672 - RNA, 64 nt, hsa
ccugaauuuugcuguguuuccauuuuuuagagauuuuuaucauuuuuuucucucucggcauucu

SEQ ID NO: 332673 - RNA, 64 nt, hsa
augcuucuagaugucauggcagucuuuuuaaucuuuuuaucauaugcuuucuugugaauuuuuu

SEQ ID NO: 332674 - RNA, 64 nt, hsa
ugugguagcaauuuuauaaauguugcuuucugauuuuuaucagagugagaaaauuaaaauuauu

SEQ ID NO: 332675 - RNA, 64 nt, hsa
cuggucuuuucuauauagucuuuugaaggauaauuuuuaucaauagccaacuuuggguauuuuu

SEQ ID NO: 332676 - RNA, 64 nt, hsa
uuccuuguagcugauaucucauggaaaaaugacauuuuaucauaaauaaauauagagacaaaau

SEQ ID NO: 332677 - RNA, 64 nt, hsa
agugcuguuguggagugcgucuguaaagugcuuguuuuaucauacuuccugccucuccccuccc

SEQ ID NO: 332678 - RNA, 64 nt, hsa
uccauauuugcauuccucuuaugcuuuaccuguauuuuaucauuuguaagcagaacucuagcua

SEQ ID NO: 332679 - RNA, 64 nt, hsa
uaguauccuaguuccagcauauauucaacaugaauuuuaucauucuccuccuaauggaaugucu

SEQ ID NO: 332680 - RNA, 64 nt, hsa
aauuuaguuuucaaaaaaaaaaugcaggaaacuguuuuaucagggagcccaaacacccagcaua

SEQ ID NO: 332681 - RNA, 64 nt, hsa
ucuuuuugccuguuugcuaauuuaaaaauauuuauuuuaucauuuuaauguuuucauggacuuu

SEQ ID NO: 332682 - RNA, 64 nt, hsa
uaguuaaagcccucccccaaaaguuauaaaaccauuuuaucagggcccaacauguggcaugcaa

SEQ ID NO: 332683 - RNA, 64 nt, hsa
uaaugacuuuuaaaacauaugcauuuuuccuuccuuuuaucacauugcuaaaugaguucugcuu

SEQ ID NO: 332684 - RNA, 64 nt, hsa
aaagauauuugaaguguuuuuauaggagauguauuuuuaucauaguaaaugaucacaauuuuaa

SEQ ID NO: 332685 - RNA, 64 nt, hsa
acaaacacacuauauacuuccucaccacugacuauuuuaucaaauuugccuuaaaauaaugaaa

SEQ ID NO: 332686 - RNA, 64 nt, hsa
gguguaucugagcaaaauauauauuuggguuaguuuuuaucacauuaucacguuugucuuuaua

SEQ ID NO: 332687 - RNA, 64 nt, hsa
uuuguaauucuaagaaaauguaugucagaaaguauuuuaucagauguuuaaaaaucucugccug

SEQ ID NO: 332688 - RNA, 64 nt, hsa
augauuaaagaauaacuaaaugacucugauuuuguuuuaucaaucauaauguguuaaagcccuc

SEQ ID NO: 332689 - RNA, 64 nt, hsa
gccgaggcguccauagcauuucccuaauaaauaguuuuaucagggacacuccaugggguggcuu

SEQ ID NO: 332690 - RNA, 64 nt, hsa
ccucccuuaggagcauugguccucuguuguccauuuuuaucaccagauguuuuccacugaagca

SEQ ID NO: 332691 - RNA, 64 nt, hsa
agccuagcagacuuaaaggacaagguaguaaauguuuuaucacucaaaaauccauuagaaguuu

SEQ ID NO: 332692 - RNA, 64 nt, hsa
caaauagaaucauguuuauuuuuucagcucucccuuuuaucauuauucacacuccucugcccuc

SEQ ID NO: 332693 - RNA, 64 nt, hsa
uugggaaugugauuuugcucccacccuaaggaauuuuuaucaccaaaaugaauguuaaugaauu

SEQ ID NO: 332694 - RNA, 64 nt, hsa
cagcugugccaguaauaaggaugcuaacaauuaauuuuaucaaaccuaacugugacagcuguga

SEQ ID NO: 332695 - RNA, 64 nt, hsa
ucuaacggucuuguaguuagagaucuaaaugacauuuuaucauguuuuccugcagcaggugcau

SEQ ID NO: 332696 - RNA, 64 nt, hsa
agcauuuuaccccuggauuauagcacaucucauguuuuaucauuuggauggaguaauuuaaaau

SEQ ID NO: 332697 - RNA, 64 nt, hsa
gaaucaugccuuccaauaaaggccuuuacacauguuuuaucaauaugauuaucaaaucacagca

SEQ ID NO: 332698 - RNA, 64 nt, hsa
ucauaguucugaugcuuuuggucacagagcaucauuuuaucacuucuggaaaauguuuauucca

SEQ ID NO: 332699 - RNA, 64 nt, hsa
uguuuaaaugcaaauguucauaucucauuucuuuuuuuaucauguuaaauaaauguugauguuc

SEQ ID NO: 332700 - RNA, 64 nt, hsa
auuaggucuaucuagccaccaccaccuuucaacuuuuuaucacucacaaguaguguacuguuca

SEQ ID NO: 332701 - RNA, 64 nt, hsa
aaaugguccuggaguugguagauugcuguugaucuuuuaucaauaauguucuauagaaaagaaa

SEQ ID NO: 332702 - RNA, 64 nt, hsa
aaauagugugguaagaguacccaugauuauaguuuuuuaucagaauuugauaagauuuucuguu

SEQ ID NO: 332703 - RNA, 64 nt, hsa
aauuauuuuaaauauuuuucuuuuaaaaauaacuuuuuaucaguacagaaaaaccuaagggaug

SEQ ID NO: 332704 - RNA, 64 nt, hsa
ucagggguucaaauuuccuucuaccauucaaauguuuuaucaacagcaaacuucagccguuuca

SEQ ID NO: 332705 - RNA, 64 nt, hsa
uuuuaaaaaccagaauauguagucuacggauauuuuuuaucauaaaaaugaucuuuggcuaaac

SEQ ID NO: 332706 - RNA, 64 nt, hsa
cuuauauugugagaacacauuuagucaguuuggguuuuaucaauccuguuaaugcuuguccuug

SEQ ID NO: 332707 - RNA, 64 nt, hsa
gauuuuugcgcagacuuauacaugucuaggauccuuuuaucaaggcaguuaugaucaucguuuu

SEQ ID NO: 332708 - RNA, 64 nt, hsa
auuucaaaaggacagugaacaagcugagaaauuauuuuaucaaagggcugaguugagaacacug

SEQ ID NO: 332709 - RNA, 64 nt, hsa
ucauuucaguuugguuuguaauuauuugaugcaauuuuaucauaagaguaacucagauucauuu

SEQ ID NO: 332710 - RNA, 64 nt, hsa
uggcuauucugcuuccuuuguguuucuauguaaauuuuaucaucagugugucuauuucuacaaa

SEQ ID NO: 332711 - RNA, 64 nt, hsa
uauaccccuguauuuauuuguuuucuugaauuucuuuuaucauuguuuuguaguuuucaccaug

SEQ ID NO: 332712 - RNA, 64 nt, hsa
auauauuuuugaaccuuuuaaguacuaauuuucuuuuuaucaaguagaaaaaaaaauguauuug

SEQ ID NO: 332713 - RNA, 64 nt, hsa
cuggugcauauuuuugaguuaaaauauuucccuauuuuaucaugauuacuaagugaguaguaua

SEQ ID NO: 332714 - RNA, 64 nt, hsa
ugauuugauuauacuguaaaguuugacagucucauuuuaucacugcguuuguaucuauuacuaa

SEQ ID NO: 332715 - RNA, 64 nt, hsa
ucacauaguguuguauuugaaacauaguucaugguuuuaucaaagaacugaagaugagaauacu

SEQ ID NO: 332716 - RNA, 64 nt, hsa
gagggacaugacuaauuuaucgauuuuuaucaauuuuuaucaguuuuauauuuauaagccuuau

SEQ ID NO: 332717 - RNA, 64 nt, hsa
caguuccuuggagggacaugacuaauuuaucgauuuuuaucaauuuuuaucaguuuuauauuua

SEQ ID NO: 332718 - RNA, 64 nt, hsa
acaauguuguguccacuguuuaauuccagagaauuuuuaucacccaaauaagaaacaaagcacc

SEQ ID NO: 332719 - RNA, 64 nt, hsa
accuucauguuguaaaguuaauagagauaaauauuuuuaucaaaaauuuuauaaacacagccuu

SEQ ID NO: 332720 - RNA, 64 nt, hsa
uggaaccacccuccccagaggcugcauugaggagacuccacagacugaaaagugaguuugcaga

SEQ ID NO: 332721 - RNA, 64 nt, hsa
agugggucgagcgccugagauccuguucaccaggacuccacagagcuggcucugcucagaagcc

SEQ ID NO: 332722 - RNA, 64 nt, hsa
gaccaagagcaggcaaagacacgggaacugaaaaacuccacaggguuuggagaauagaaaugaa

SEQ ID NO: 332723 - RNA, 64 nt, hsa
ggacauuccaucugagguccuuccugaacaugucacuccacagcagaggaccgguugcagcuua

SEQ ID NO: 332724 - RNA, 64 nt, hsa
aggccaggcugaccccaccagccagucagcuacaacuccacaucaacuccacaugcgcccagcu

SEQ ID NO: 332725 - RNA, 64 nt, hsa
accccaccagccagucagcuacaacuccacaucaacuccacaugcgcccagcucgagacugaug

SEQ ID NO: 332726 - RNA, 64 nt, hsa; identical to SEQ ID NO: 284671

SEQ ID NO: 332727 - RNA, 64 nt, hsa; identical to SEQ ID NO: 284672

SEQ ID NO: 332728 - RNA, 64 nt, hsa; identical to SEQ ID NO: 284673

SEQ ID NO: 332729 - RNA, 64 nt, hsa; identical to SEQ ID NO: 284674

SEQ ID NO: 332730 - RNA, 64 nt, hsa; identical to SEQ ID NO: 284675

SEQ ID NO: 332731 - RNA, 64 nt, hsa; identical to SEQ ID NO: 284676

SEQ ID NO: 332732 - RNA, 64 nt, hsa; identical to SEQ ID NO: 284677

SEQ ID NO: 332733 - RNA, 64 nt, hsa; identical to SEQ ID NO: 284678

SEQ ID NO: 332734 - RNA, 64 nt, hsa; identical to SEQ ID NO: 284679

SEQ ID NO: 332735 - RNA, 64 nt, hsa; identical to SEQ ID NO: 284680

SEQ ID NO: 332736 - RNA, 64 nt, hsa; identical to SEQ ID NO: 284681

SEQ ID NO: 332737 - RNA, 64 nt, hsa; identical to SEQ ID NO: 284682

SEQ ID NO: 332738 - RNA, 64 nt, hsa
gccuaugaaugccuucuuaaaaucauguuuuuaaaugcauaaaauauauaggauuacaaaggaa

SEQ ID NO: 332739 - RNA, 64 nt, hsa
aacacauauuuuuauauuauguuaaaguaaagaaaugcauaaaagacaagcacuuuggaagaau

SEQ ID NO: 332740 - RNA, 64 nt, hsa
cuagcaaaacucccuuuuuucucuugccuuuuuuaugcauaaauggaggucaauuugauugucc

SEQ ID NO: 332741 - RNA, 64 nt, hsa
aaaccagaagacuuugaaguuguauauucuugcaaugcauaaaaugacauuauaaucaacaaac

SEQ ID NO: 332742 - RNA, 64 nt, hsa
gugauuuguaauaaauuuauugugguacaguaauaugcauaaaauaaacccauuuuaaugugca

SEQ ID NO: 332743 - RNA, 64 nt, hsa
gcuucccaauuguagcaccauguucugugugaauaugcauaaccagagugaccccccccagcac

SEQ ID NO: 332744 - RNA, 64 nt, hsa
auauucaauguauugagaaccaaagcaaccacaaaugcauaaaugcauaauuuauggucuucaa

SEQ ID NO: 332745 - RNA, 64 nt, hsa
uguauugagaaccaaagcaaccacaaaugcauaaaugcauaauuuauggucuucaaccaaggcc

SEQ ID NO: 332746 - RNA, 64 nt, hsa
agccaauuaucugauuaagcauucuuuccacugaaugcauaauguuuaaauagcauaaaaugaa

SEQ ID NO: 332747 - RNA, 64 nt, hsa
agauaauaaugauggucaacaauaagccacgucaaugcauaaguuguauaggcuaaauguugcu

SEQ ID NO: 332748 - RNA, 64 nt, hsa
auuuuuaauggaaagagcauguuagagcaaacaaaugcauaagcaagacugagcagcauuauaa

SEQ ID NO: 332749 - RNA, 64 nt, hsa
cagauaacacuguaguuccuaaaaaaaaaauuaaaugcauaagcauaagguagaaauuaaaaua

SEQ ID NO: 332750 - RNA, 64 nt, hsa
guugcaguaacauugacuauguuucaaaacucagaugcauaaaacguaagguauauaaaaauac

SEQ ID NO: 332751 - RNA, 64 nt, hsa
uuccuccauggaccagaguaauuggcacauuuuaaugcauaagcuggggguuucauuuucccag

SEQ ID NO: 332752 - RNA, 64 nt, hsa
cacagcaaugaauggcacacaaguaauccacauaaugcauaagccacaccaaaaccagacucaa

SEQ ID NO: 332753 - RNA, 64 nt, hsa
aaccuuucucccuucucaaaaugcuugccucauaaugcauaacuuucacuuugacucuggucuu

SEQ ID NO: 332754 - RNA, 64 nt, hsa
ugacaaaagaacuugaaccuauguuauaugauacaugcauaacuugagcuacacuaaaccacau

SEQ ID NO: 332755 - RNA, 64 nt, hsa
ugguaacacaauacguucuuauaaaauacaacacaugcauaaaaauagaagacaaucugcuugu

SEQ ID NO: 332756 - RNA, 64 nt, hsa; identical to SEQ ID NO: 22256

SEQ ID NO: 332757 - RNA, 64 nt, hsa; identical to SEQ ID NO: 22257

SEQ ID NO: 332758 - RNA, 64 nt, hsa; identical to SEQ ID NO: 22258

SEQ ID NO: 332759 - RNA, 64 nt, hsa; identical to SEQ ID NO: 22259

SEQ ID NO: 332760 - RNA, 64 nt, hsa; identical to SEQ ID NO: 22260

SEQ ID NO: 332761 - RNA, 64 nt, hsa; identical to SEQ ID NO: 22261

SEQ ID NO: 332762 - RNA, 64 nt, hsa; identical to SEQ ID NO: 22262

SEQ ID NO: 332763 - RNA, 64 nt, hsa; identical to SEQ ID NO: 22263

SEQ ID NO: 332764 - RNA, 64 nt, hsa; identical to SEQ ID NO: 22264

SEQ ID NO: 332765 - RNA, 64 nt, hsa; identical to SEQ ID NO: 22265

SEQ ID NO: 332766 - RNA, 64 nt, hsa; identical to SEQ ID NO: 22266

SEQ ID NO: 332767 - RNA, 64 nt, hsa; identical to SEQ ID NO: 22267

SEQ ID NO: 332768 - RNA, 64 nt, hsa; identical to SEQ ID NO: 22268

SEQ ID NO: 332769 - RNA, 64 nt, hsa; identical to SEQ ID NO: 22269

SEQ ID NO: 332770 - RNA, 64 nt, hsa; identical to SEQ ID NO: 22270

SEQ ID NO: 332771 - RNA, 64 nt, hsa; identical to SEQ ID NO: 22271

SEQ ID NO: 332772 - RNA, 64 nt, hsa; identical to SEQ ID NO: 22272

SEQ ID NO: 332773 - RNA, 64 nt, hsa; identical to SEQ ID NO: 22273

SEQ ID NO: 332774 - RNA, 64 nt, hsa; identical to SEQ ID NO: 22274

SEQ ID NO: 332775 - RNA, 64 nt, hsa; identical to SEQ ID NO: 22275

SEQ ID NO: 332776 - RNA, 64 nt, hsa; identical to SEQ ID NO: 22276

SEQ ID NO: 332777 - RNA, 64 nt, hsa; identical to SEQ ID NO: 22277

SEQ ID NO: 332778 - RNA, 64 nt, hsa; identical to SEQ ID NO: 166381

SEQ ID NO: 332779 - RNA, 64 nt, hsa; identical to SEQ ID NO: 166382

SEQ ID NO: 332780 - RNA, 64 nt, hsa; identical to SEQ ID NO: 166383

SEQ ID NO: 332781 - RNA, 64 nt, hsa; identical to SEQ ID NO: 166384

SEQ ID NO: 332782 - RNA, 64 nt, hsa; identical to SEQ ID NO: 166385

SEQ ID NO: 332783 - RNA, 64 nt, hsa; identical to SEQ ID NO: 166386

SEQ ID NO: 332784 - RNA, 64 nt, hsa; identical to SEQ ID NO: 166387

SEQ ID NO: 332785 - RNA, 64 nt, hsa; identical to SEQ ID NO: 166388

SEQ ID NO: 332786 - RNA, 64 nt, hsa; identical to SEQ ID NO: 166389

SEQ ID NO: 332787 - RNA, 64 nt, hsa; identical to SEQ ID NO: 166390

SEQ ID NO: 332788 - RNA, 64 nt, hsa; identical to SEQ ID NO: 166391

SEQ ID NO: 332789 - RNA, 64 nt, hsa; identical to SEQ ID NO: 166392

SEQ ID NO: 332790 - RNA, 64 nt, hsa; identical to SEQ ID NO: 166393

SEQ ID NO: 332791 - RNA, 64 nt, hsa; identical to SEQ ID NO: 166394

SEQ ID NO: 332792 - RNA, 64 nt, hsa; identical to SEQ ID NO: 166395

SEQ ID NO: 332793 - RNA, 64 nt, hsa; identical to SEQ ID NO: 166396

SEQ ID NO: 332794 - RNA, 64 nt, hsa; identical to SEQ ID NO: 166397

SEQ ID NO: 332795 - RNA, 64 nt, hsa
aaggaaaaccaucuagagaguuuucuuuagaagugacucccauuagccuggugugguggugugu

SEQ ID NO: 332796 - RNA, 64 nt, hsa
gacccugugucuaaguaaagaaaaagccagaagugacucccacugcuucuguugaucggccaua

SEQ ID NO: 332797 - RNA, 64 nt, hsa
cuccuccaaccuuuuuuugccaagguuuguacacgacucccaucuaggcugaaaaccuagaagu

SEQ ID NO: 332798 - RNA, 64 nt, hsa
caugggggugggagggcccccagcuggaagagcagacucccagcugcuacccccucccuuccca

SEQ ID NO: 332799 - RNA, 64 nt, hsa; identical to SEQ ID NO: 58517

SEQ ID NO: 332800 - RNA, 64 nt, hsa; identical to SEQ ID NO: 58518

SEQ ID NO: 332801 - RNA, 64 nt, hsa; identical to SEQ ID NO: 58519

SEQ ID NO: 332802 - RNA, 64 nt, hsa; identical to SEQ ID NO: 58520

SEQ ID NO: 332803 - RNA, 64 nt, hsa; identical to SEQ ID NO: 58521

SEQ ID NO: 332804 - RNA, 64 nt, hsa; identical to SEQ ID NO: 58522

SEQ ID NO: 332805 - RNA, 64 nt, hsa; identical to SEQ ID NO: 58523

SEQ ID NO: 332806 - RNA, 64 nt, hsa; identical to SEQ ID NO: 58524

SEQ ID NO: 332807 - RNA, 64 nt, hsa; identical to SEQ ID NO: 58525

SEQ ID NO: 332808 - RNA, 64 nt, hsa; identical to SEQ ID NO: 58526

SEQ ID NO: 332809 - RNA, 64 nt, hsa; identical to SEQ ID NO: 58527

SEQ ID NO: 332810 - RNA, 64 nt, hsa; identical to SEQ ID NO: 58528

SEQ ID NO: 332811 - RNA, 64 nt, hsa; identical to SEQ ID NO: 58529

SEQ ID NO: 332812 - RNA, 64 nt, hsa; identical to SEQ ID NO: 58530

SEQ ID NO: 332813 - RNA, 64 nt, hsa; identical to SEQ ID NO: 58531

SEQ ID NO: 332814 - RNA, 64 nt, hsa; identical to SEQ ID NO: 58532

SEQ ID NO: 332815 - RNA, 64 nt, hsa
uccagcacagacacuacaguuaacgcugaacugcagcugcaaguaauagcaugaacagucagaa

SEQ ID NO: 332816 - RNA, 64 nt, hsa
aucuagcaccaacuaccauuagcacuauguuaggagcugcaaggccccaaaguagaagaugugc

SEQ ID NO: 332817 - RNA, 64 nt, hsa
ucaaagguuuuguaaaacuuuugaaaaugaacuuagcugcaaaauauagcuaaccacuuuccau

SEQ ID NO: 332818 - RNA, 64 nt, hsa
acgucgucauucuuguuacaucacucauacuuuuagcugcaaccacacuaauucacauuuuuau

SEQ ID NO: 332819 - RNA, 64 nt, hsa
aucugcagcaguuuguugugugcaguuugauggcagcugcaaacuggaggugaggcggaggaaa

SEQ ID NO: 332820 - RNA, 64 nt, hsa
caaccacuacgagcauaccccaugcccaccguggagcugcaacuccucgacagcacugaguuug

SEQ ID NO: 332821 - RNA, 64 nt, hsa
gugcugguuacugaugaauaugggccccuuauagagcugcaaaacacacacaugcguauagaca

SEQ ID NO: 332822 - RNA, 64 nt, hsa
caggagcagaacucaguauccagagcuuacaaggagcugcaaggguuugccgagggcugcccag

SEQ ID NO: 332823 - RNA, 64 nt, hsa
augaucaaauaacuuucaggauguauuuuaaaugagcugcaagagagaaaaaucugacaggaga

SEQ ID NO: 332824 - RNA, 64 nt, hsa
aaaacaagagaaaagaaacuugccauauuuuacaagcugcaauuuuagaaaagcuuuaacuuaa

SEQ ID NO: 332825 - RNA, 64 nt, hsa
uaccuaaagcuuccugccaauaaugcaagaagccagcugcaauuucccagaagcauuugucucu

SEQ ID NO: 332826 - RNA, 64 nt, hsa
cucauggguuaaaaccuagacauuugccacaucuagcugcaaagaaggcuagggaaugucuuua

SEQ ID NO: 332827 - RNA, 64 nt, hsa
cucccuccacuaccgcuauuucuccuuggauggcaccauccacccugcaggcuugggaacugua

SEQ ID NO: 332828 - RNA, 64 nt, hsa
cagcuuuuucucucaggguucugagucagaggacaccauccaagaauguuguuagcuuuucagu

SEQ ID NO: 332829 - RNA, 64 nt, hsa
auguccuuugcgccugugaccaccaccccaacaaaccauccagugacaaaccauccaguggagg

SEQ ID NO: 332830 - RNA, 64 nt, hsa
gugaccaccaccccaacaaaccauccagugacaaaccauccaguggagguuugucgggcaccag

SEQ ID NO: 332831 - RNA, 64 nt, hsa
aaaaccuuaaaugucaaaaaaaaauaauauuuucaccauccagacgucaccauuauaaauucuu

SEQ ID NO: 332832 - RNA, 64 nt, hsa
uggugccauaaauuauguggcucauaguaggugcaccauccaaggagaaggucccuuuuuccaa

SEQ ID NO: 332833 - RNA, 64 nt, hsa
uguggucacccacgauuucauuugucuuauacccaggugaaaggggaagggugaaugggacugg

SEQ ID NO: 332834 - RNA, 64 nt, hsa
ggcacucggcacucauuggcacagugguaguuagaggugaaaaguagagcugucaagcccaagg

SEQ ID NO: 332835 - RNA, 64 nt, hsa
auaauaaagcugaucauguuuugcuacaguuugcaggugaaaaaaaauaaauauuauaaaauau

SEQ ID NO: 332836 - RNA, 64 nt, hsa
uuauucuuuauuaugccucuagguaauuaaguaaaggugaaauugcauacacagauauguagua

SEQ ID NO: 332837 - RNA, 64 nt, hsa
cuuaucaccuuucaaaaauugauuguggugccucaggugaaaugagaagcuaucaguaacagcu

SEQ ID NO: 332838 - RNA, 64 nt, hsa
gggcuguauuacugaaggcuuuuuauuuuuugagaggugaaaaaaagagaaaacaaguuagacu

SEQ ID NO: 332839 - RNA, 64 nt, hsa
ucauuaccaaaaauagcagguacuucuaccauuaaggugaaaucauggaucagauauuccuuac

SEQ ID NO: 332840 - RNA, 64 nt, hsa
uuuuuuaauugcuguaggauccuguucuuucagcaggugaaaaauaaaacgcaguucaaauuuc

SEQ ID NO: 332841 - RNA, 64 nt, hsa
ggaauaaucuuaccugcucuggauugccaugagcaggugaaaaugaaggcucugauauugugug

SEQ ID NO: 332842 - RNA, 64 nt, hsa
uagauagucuggucagggagggccucaacugagaaggugaaaugugagcaaagacgugaaggaa

SEQ ID NO: 332843 - RNA, 64 nt, hsa
acugcugauuugauggagcuacuuuaagauuuguaggugaaaguguaauacuguugguugaacu

SEQ ID NO: 332844 - RNA, 64 nt, hsa
uuuucuuaaucaagaauauucaaauguaauuaugaggugaaacaauuauuguacacuaacauau

SEQ ID NO: 332845 - RNA, 64 nt, hsa
guauguguuuaaaaaacaacaacaguaaugugcaaggugaaaugcuuuuggauaaacguaagcc

SEQ ID NO: 332846 - RNA, 64 nt, hsa
uaaaauuccaaaugaguugcucuagauucuaaaaaggugaaacuuuggcuguugaaaguuucag

SEQ ID NO: 332847 - RNA, 64 nt, hsa
aucuauuuuuuuuaccuguuuaucacauuugugaaggugaaauuauucauggagugaauaagaa

SEQ ID NO: 332848 - RNA, 64 nt, hsa
ggcuagaggagagcuggauauaagcagagaucguaggugaaaaaagaugggccauuaaggauuc

SEQ ID NO: 332849 - RNA, 64 nt, hsa
aaguugcacacauugugcccuaaagaaggcccucaggugaaagagcagagcugugaagaacuau

SEQ ID NO: 332850 - RNA, 64 nt, hsa
guuacaggugaggaguguaauccuaggaagcaucaggugaaaagcaggagaccaaagaaguggu

SEQ ID NO: 332851 - RNA, 64 nt, hsa
cucuauauugaauaggugaaagauaacuguagucaggugaaaggcauucauuauuuuuaagcug

SEQ ID NO: 332852 - RNA, 64 nt, hsa
gcuauaggcaucauucauuaucucuauauugaauaggugaaagauaacuguagucaggugaaag

SEQ ID NO: 332853 - RNA, 64 nt, hsa
ugaacuaagaagaagucagcaagcaaacugagagaggugaaauccauguuaaugaugcuuaaga

SEQ ID NO: 332854 - RNA, 64 nt, hsa
uugugguucuucugaaucuuaauauuucaaagccaggugaaaaucugaacuagauauucuuugu

SEQ ID NO: 332855 - RNA, 64 nt, hsa
aaguacccuuuuguaaauagcauuuuuuugcagaaggugaaaauuccacucucuaccaccgggc

SEQ ID NO: 332856 - RNA, 64 nt, hsa
augcuaguuucaaauuugauucaaaauauuucuuaggugaaagaacuagcagaaagucaaaaac

SEQ ID NO: 332857 - RNA, 64 nt, hsa
ggaaaagcaaggaccguguuugacuuucuuggagaggugaaagaggugaaagaacaaguugugu

SEQ ID NO: 332858 - RNA, 64 nt, hsa
aggaccguguuugacuuucuuggagaggugaaagaggugaaagaacaaguugugugcuagaaaa

SEQ ID NO: 332859 - RNA, 64 nt, hsa
gggaaaaaggccucugucccggaagagucaugggaggugaaaggggcacguuugaagaugcgag

SEQ ID NO: 332860 - RNA, 64 nt, hsa
gaugauucuggcugaaaaaggccaguggaaauucaggugaaaauguucaucaauucccauugca

SEQ ID NO: 332861 - RNA, 64 nt, hsa
cacuuguuccagcucuuugaaauagucugugugaaggugaaagugcaguucaguaauaaacugu

SEQ ID NO: 332862 - RNA, 64 nt, hsa
gcuccucaugguggguucaggggacucagcccugaggugaaagggagcuaucaggaacagcuau

SEQ ID NO: 332863 - RNA, 64 nt, hsa
gagagaguuagaaaaauuuuugguagagagaaucaggugaaagagaugcccuaaagaggacuga

SEQ ID NO: 332864 - RNA, 64 nt, hsa
cugacaggugggucacacucagaccuggggacagaggugaaaugcacaagcugcuggagaaggg

SEQ ID NO: 332865 - RNA, 64 nt, hsa
ugaaaaggugacaagccuggguuucucccaggauaggugaaaggguuaaaaugaguaaagcagu

SEQ ID NO: 332866 - RNA, 64 nt, hsa
uaggguccccaggggggccgggcuggggcugcguaggugaaaaggcagaacacuccgcgcuucu

SEQ ID NO: 332867 - RNA, 64 nt, hsa
aauuuccuugucuauuuugcucgcuuguucuuucaggugaaauuuauuauuuuauuaauguugc

SEQ ID NO: 332868 - RNA, 64 nt, hsa
agacaucaaacagccgucauguaucauugguuugaggugaaauagcaauaaaauuaauagaaug

SEQ ID NO: 332869 - RNA, 64 nt, hsa; identical to SEQ ID NO: 131663

SEQ ID NO: 332870 - RNA, 64 nt, hsa; identical to SEQ ID NO: 131664

SEQ ID NO: 332871 - RNA, 64 nt, hsa; identical to SEQ ID NO: 131665

SEQ ID NO: 332872 - RNA, 64 nt, hsa; identical to SEQ ID NO: 131666

SEQ ID NO: 332873 - RNA, 64 nt, hsa; identical to SEQ ID NO: 131667

SEQ ID NO: 332874 - RNA, 64 nt, hsa; identical to SEQ ID NO: 131668

SEQ ID NO: 332875 - RNA, 64 nt, hsa; identical to SEQ ID NO: 131669

SEQ ID NO: 332876 - RNA, 64 nt, hsa; identical to SEQ ID NO: 131670

SEQ ID NO: 332877 - RNA, 64 nt, hsa; identical to SEQ ID NO: 131671

SEQ ID NO: 332878 - RNA, 64 nt, hsa; identical to SEQ ID NO: 131672

SEQ ID NO: 332879 - RNA, 64 nt, hsa; identical to SEQ ID NO: 131673

SEQ ID NO: 332880 - RNA, 64 nt, hsa; identical to SEQ ID NO: 131674

SEQ ID NO: 332881 - RNA, 64 nt, hsa; identical to SEQ ID NO: 131675

SEQ ID NO: 332882 - RNA, 64 nt, hsa; identical to SEQ ID NO: 131676

SEQ ID NO: 332883 - RNA, 64 nt, hsa; identical to SEQ ID NO: 131677

SEQ ID NO: 332884 - RNA, 64 nt, hsa; identical to SEQ ID NO: 131678

SEQ ID NO: 332885 - RNA, 64 nt, hsa; identical to SEQ ID NO: 131679

SEQ ID NO: 332886 - RNA, 63 nt, hsa
auccaaaacaaauuccuccuucaaccuuauuuuuacuugaaauuugcuagaagaaauagcaaa

SEQ ID NO: 332887 - RNA, 63 nt, hsa
acagucagaacaugcaaacuuuuuugaagaaauuacuugaauaaguaguuuucauguuuucaa

SEQ ID NO: 332888 - RNA, 63 nt, hsa
ggauuaagggacuuaaucugcuaggaacaccuguacuugaaguggaggaggcuagggggccac

SEQ ID NO: 332889 - RNA, 63 nt, hsa
gucaacugucauuuugcuacuuuucaaauaaaauacuugaaaacugucauuuaaugguaaaca

SEQ ID NO: 332890 - RNA, 53 nt, hsa; identical to SEQ ID NO: 55194

SEQ ID NO: 332891 - RNA, 63 nt, hsa
uuaauuuuauaccaaaauguuaaauauuuguauuacuugaauuuugcucuuguauggcaaaau

SEQ ID NO: 332892 - RNA, 63 nt, hsa
ugcauauacuggcaauaaaacuguacauaacauuacuugaaaaaguuaauaauguauaucagu

SEQ ID NO: 332893 - RNA, 63 nt, hsa
ggaaccugguuuccuuuuaccaugaaauugucuuacuugaaaauauugauccugaugagagag

SEQ ID NO: 332894 - RNA, 63 nt, hsa
uuucauguuacauaauaacccaaaacaaauaauuacuugaauauguuuguagagauacuauuu

SEQ ID NO: 332895 - RNA, 63 nt, hsa
acuaaaaauacaauucaaauuuauuagcucuacuacuugaaugauuuuggaauuuuaugucau

SEQ ID NO: 332896 - RNA, 63 nt, hsa
ucuucacugaagcuaauguuuggaaaaaauauauacuugaagaaccaauccaagugugugccc

SEQ ID NO: 332897 - RNA, 63 nt, hsa
aucacuuuaccuagcguuuuagaaauauuaauuuacuugaagagauguagaauguagcaaauu

SEQ ID NO: 332898 - RNA, 63 nt, hsa
guauggucauauuaguagcuauuuguugcaagauacuugaagccaaauguuugcaguauaggu

SEQ ID NO: 332899 - RNA, 63 nt, hsa
uguuugauauuuaacaauaaguauauggugauauacuugaaauuuauguccagaaugucacug

SEQ ID NO: 332900 - RNA, 63 nt, hsa
gaauuguuuaacaaauuagaauuuguuuacaacuacuugaauuuuuaaauuaugucaaaacuu

SEQ ID NO: 332901 - RNA, 63 nt, hsa
aaucaguuuuuucauggauuuguguucuuacaguacuugaaaauauuuaaggaagagaugaag

SEQ ID NO: 332902 - RNA, 63 nt, hsa
cucccuacugguaggaaccauaguuguguccuauacuugaagaggcuggaaaguagcccauaa

SEQ ID NO: 332903 - RNA, 63 nt, hsa
ucacauauauacaguagcagcuguaaauaagcuuacuugaacuaauuacuugaaaacuggugg

SEQ ID NO: 332904 - RNA, 63 nt, hsa
guagcagcuguaaauaagcuuacuugaacuaauuacuugaaaacugguggaaaaaagagacca

SEQ ID NO: 332905 - RNA, 63 nt, hsa
cagcccucgauuagcccugccugaaucaguagauacuugaacgaguccccagucugcgggagg

SEQ ID NO: 332906 - RNA, 63 nt, hsa
caaaaauacacacacguguguuuuucuuugcaauacuugaaauauugccacugugcuuggacu

SEQ ID NO: 332907 - RNA, 63 nt, hsa
auaaaaauaucuuuaccuuauuaauauuauacauacuugaaaaaaauuucauuuagaaaccua

SEQ ID NO: 332908 - RNA, 63 nt, hsa
auaacuuaauguuagagaugguaaagcugcacuuacuugaacagcccaaaagcauuaaaaauc

SEQ ID NO: 332909 - RNA, 63 nt, hsa
gcgccccaacccccugcccgccucuccgcacaauacuugaacauucaucuguacugaaguguu

SEQ ID NO: 332910 - RNA, 63 nt, hsa
acaauacuugaacauucaucuguacugaaguguuacuugaaccgggggaaucucggaccuggg

SEQ ID NO: 332911 - RNA, 63 nt, hsa
cugauaaaauaaaggcagggaaacaagcugaauuacuugaaauuacuugaauuuucuugucuu

SEQ ID NO: 332912 - RNA, 63 nt, hsa
aaaggcagggaaacaagcugaauuacuugaaauuacuugaauuuucuugucuuaaaacugaaa

SEQ ID NO: 332913 - RNA, 64 nt, hsa; identical to SEQ ID NO: 23330

SEQ ID NO: 332914 - RNA, 64 nt, hsa; identical to SEQ ID NO: 23331

SEQ ID NO: 332915 - RNA, 64 nt, hsa; identical to SEQ ID NO: 23332

SEQ ID NO: 332916 - RNA, 64 nt, hsa; identical to SEQ ID NO: 23333

SEQ ID NO: 332917 - RNA, 64 nt, hsa; identical to SEQ ID NO: 23334

SEQ ID NO: 332918 - RNA, 64 nt, hsa; identical to SEQ ID NO: 23335

SEQ ID NO: 332919 - RNA, 64 nt, hsa; identical to SEQ ID NO: 23336

SEQ ID NO: 332920 - RNA, 64 nt, hsa; identical to SEQ ID NO: 23337

SEQ ID NO: 332921 - RNA, 64 nt, hsa; identical to SEQ ID NO: 23338

SEQ ID NO: 332922 - RNA, 64 nt, hsa; identical to SEQ ID NO: 23339

SEQ ID NO: 332923 - RNA, 64 nt, hsa
aaauucacugagaauuccaaaaguauauuaaaaaagaagauagcuaugaguucagaucuaucuu

SEQ ID NO: 332924 - RNA, 64 nt, hsa
gacguuuaaaguauauauauuuugucaagaggaaagaagauaaaacuaugccaguuuuauauca

SEQ ID NO: 332925 - RNA, 64 nt, hsa
uuuuucuuaacaucgguggcucaguuaaggaaugagaagauagaggguccuccacuuucagcuc

SEQ ID NO: 332926 - RNA, 64 nt, hsa
cauguucuacuugucagggcuggaacuauuguauagaagauaauaugauugugacuucuaguuc

SEQ ID NO: 332927 - RNA, 64 nt, hsa
guuuguugaucaagugacuguccccguaaaaaguagaagauaaguuuguuaaaguauuuuuuau

SEQ ID NO: 332928 - RNA, 64 nt, hsa
cuauaucauaacucugaccuuugugguucuuggaagaagauauuuuaagaaccaguuauccuaa

SEQ ID NO: 332929 - RNA, 64 nt, hsa
guccuaucuguaccaacaagcaaggccacuuuucagaagauaagaguucacugaaugcaccuau

SEQ ID NO: 332930 - RNA, 64 nt, hsa
cgacauaggccuacagaauuagacuuucauacuuagaagauaagguacacucuucuucuuuuau

SEQ ID NO: 332931 - RNA, 64 nt, hsa
uacuuguugaugccacuguuaucauccuccuagcagaagauaguccuacugagaaaaugagcac

SEQ ID NO: 332932 - RNA, 64 nt, hsa
ccccugggucccucccacaacaugugggaauuccagaagauaaauucaaguugcaauuucagug

SEQ ID NO: 332933 - RNA, 64 nt, hsa
uuguuaauuugaggacugggcugucuuggggcucagaagauaaagaacuauuugagcagaugug

SEQ ID NO: 332934 - RNA, 64 nt, hsa
uuacuguacaguuagaaagcaaaguguuaaauggagaagauacuuguuuuuauuaaacauuuug

SEQ ID NO: 332935 - RNA, 64 nt, hsa
uaaaacuauacaguuacaucuuaauuccauccaaagaagauacaguuugaagacagaaguguac

SEQ ID NO: 332936 - RNA, 64 nt, hsa
cccuuaauccaauaugacugguguuccuuauaagagaagauagggcgggcaugguggcucacgc

SEQ ID NO: 332937 - RNA, 64 nt, hsa
ucugucucaaaaaaaaaaaaaaaaaggaagaaagagaagauagagacacaggggagaaugccac

SEQ ID NO: 332938 - RNA, 64 nt, hsa
gcagagauuggagugauacauugugggaacccucagaagauaggaaaaaagcauggaauagauu

SEQ ID NO: 332939 - RNA, 64 nt, hsa
auggaggaaaggacuugaauagacauuucuccaaagaagauacccagauggccaauaagcacgu

SEQ ID NO: 332940 - RNA, 64 nt, hsa
cuagcuuugcccuucaccaugagagggugcagugagaagauagcuaucuuugaaccgggaagca

SEQ ID NO: 332941 - RNA, 64 nt, hsa; identical to SEQ ID NO: 119429

SEQ ID NO: 332942 - RNA, 64 nt, hsa; identical to SEQ ID NO: 119430

SEQ ID NO: 332943 - RNA, 64 nt, hsa; identical to SEQ ID NO: 119431

SEQ ID NO: 332944 - RNA, 64 nt, hsa; identical to SEQ ID NO: 119432

SEQ ID NO: 332945 - RNA, 64 nt, hsa; identical to SEQ ID NO: 119433

SEQ ID NO: 332946 - RNA, 64 nt, hsa; identical to SEQ ID NO: 119434

SEQ ID NO: 332947 - RNA, 64 nt, hsa; identical to SEQ ID NO: 119435

SEQ ID NO: 332948 - RNA, 64 nt, hsa; identical to SEQ ID NO: 119436

SEQ ID NO: 332949 - RNA, 64 nt, hsa
gccacacuguacucugcacuggugugagggccccugccuggacugugggacccuccuggugcug

SEQ ID NO: 332950 - RNA, 64 nt, hsa
uccuccccaugugaacauggggaacuucgggcccugccuggaguccuugaccgcucucuguggg

SEQ ID NO: 332951 - RNA, 64 nt, hsa
ugcaggaucugccauaaaggacaauaugaacugaugccuggacuaucaguaaccccacugcaca

SEQ ID NO: 332952 - RNA, 64 nt, hsa
ugcacaggcacacgaugcucugggacauaacuggugccuggaaaucaccaugguccucauaucu

SEQ ID NO: 332953 - RNA, 64 nt, hsa
gaaccuguguccgguauucgauacugcgacuuucugccuggaguguaugacugcacaugacucg

SEQ ID NO: 332954 - RNA, 64 nt, hsa
ugugcugggagcuccacucugcuucucugacuucugccuggagacuuagggcaccagggguuuc

SEQ ID NO: 332955 - RNA, 64 nt, hsa
uagccccuggacacacacacacagacacacacacugccuggaugcauguaugcacacacaugcg

SEQ ID NO: 332956 - RNA, 64 nt, hsa
gaacauacacacgcacacccaugcgcagaugugcugccuggacacacacacacacacggauaug

SEQ ID NO: 332957 - RNA, 64 nt, hsa
uaugguauccggacacacacgugcacagauaugcugccuggacacacagauaaugcugccuuga

SEQ ID NO: 332958 - RNA, 64 nt, hsa
auaaugcugccuugacacacacaugcacggauauugccuggacacacacacacacacgugugca

SEQ ID NO: 332959 - RNA, 64 nt, hsa
ugcugucuggacacgcacacacaugcagauaugcugccuggacacacacuuccagacacacgug

SEQ ID NO: 332960 - RNA, 64 nt, hsa
acuuccagacacacgugcacaggcgcagauaugcugccuggacacacgcagauaugcugucuag

SEQ ID NO: 332961 - RNA, 64 nt, hsa
ugcuguccggacacacacacgcacgcagauaugcugccuggacacacacacagauaaugcugcc

SEQ ID NO: 332962 - RNA, 64 nt, hsa
aaugcugccucaacacucacacacgugcagauauugccuggacacacacaugugcacagauaug

SEQ ID NO: 332963 - RNA, 64 nt, hsa
ccggacacacaugcacacacaggugcagauaugcugccuggacacacgcagacugacgugcuuu

SEQ ID NO: 332964 - RNA, 64 nt, hsa
agcuccucacaccacagccaggagagaccuuuucugccuggagagaaacuuucagaccagcccc

SEQ ID NO: 332965 - RNA, 64 nt, hsa
agccccacacaccacagccaggagaggccguuccugccuggagagaagcuuccagaccagcccu

SEQ ID NO: 332966 - RNA, 64 nt, hsa
acagaaccugcccugcaggcuguagggggcauggugccuggagcugaggggcauccgaacgcgu

SEQ ID NO: 332967 - RNA, 64 nt, hsa
uucaggggucaucuggcaaacagccccugggcugugccuggaucccccucuagcuccugcucac

SEQ ID NO: 332968 - RNA, 64 nt, hsa
cccuccaggagcaggccuggugcagcccacucugugccuggacaucccccgcaggccgccgcgu

SEQ ID NO: 332969 - RNA, 64 nt, hsa
uccauucccgcuccuggaacacuuccugcagcugugccuggaggcagucggccugcagugccag

SEQ ID NO: 332970 - RNA, 64 nt, hsa
uacagagagggguccaaauggugaaugcucauccugccuggauucaaggaauuagcucagagau

SEQ ID NO: 332971 - RNA, 64 nt, hsa
uugaucuuagggauuuccaaaguaaccugcuuuuugccuggauaggguuaaaauagaccuuucu

SEQ ID NO: 332972 - RNA, 64 nt, hsa
ugcaguggggggacucgacccccugacauggggcugccuggagcaggccgcgugacguggggcu

SEQ ID NO: 332973 - RNA, 64 nt, hsa
cuaaaauaauggaaaauuuuaacaauuuguauagugccuggaucauuacuagugccauaacccu

SEQ ID NO: 332974 - RNA, 64 nt, hsa
uccuuuucuuuuuuuacgcauagcuccgucaagcugccuggaugagcgcccaugcagcaaggcu

SEQ ID NO: 332975 - RNA, 64 nt, hsa
gucccugugagaguucugcagagugcugggcaugugccuggaacuaccgaguaggagccauuuc

SEQ ID NO: 332976 - RNA, 64 nt, hsa
gcuucgaucucacacacacagaaacauacauucgugccuggagacccugcaggccagaguccaa

SEQ ID NO: 332977 - RNA, 64 nt, hsa
gagucagccaguugguugcugugguuacagccagugccuggaauuccuccuuagggcccuggga

SEQ ID NO: 332978 - RNA, 53 nt, hsa
ucacccccucuucagguugauacugccuggauggucaccucuggugcgcagca

SEQ ID NO: 332979 - RNA, 64 nt, hsa
caacugaauggcgucuguccugucauccauauggugccuggaaauauuuaccagucaaggucaa

SEQ ID NO: 332980 - RNA, 64 nt, hsa
ugccuguccuccaggcuggggcagguucuuaguuugccuggaauuguucuguaccucuuuguag

SEQ ID NO: 332981 - RNA, 64 nt, hsa
ccuccaaccaccacacacucccugcuguuuucccugccuggaacuuucccuccugccccaccaa

SEQ ID NO: 332982 - RNA, 64 nt, hsa
auggcucuaacauuacugccuucaguaucaaggcugccuggagaaaggauggcagccucagggc

SEQ ID NO: 332983 - RNA, 64 nt, hsa
aacauucauucaacagcugaugcccuauaaccccugccuggauuucuuccuauuaggcuauaag

SEQ ID NO: 332984 - RNA, 64 nt, hsa
ucagcccgacuggaucgccaucugcuacaacaacugccuggagauacucagaguguaguguugg

SEQ ID NO: 332985 - RNA, 64 nt, hsa
uccucccucuuugcaccuucuucucuucccucagugccuggagcugguacugggccccuggccc

SEQ ID NO: 332986 - RNA, 64 nt, hsa
ccgagacaugaauacuauccauguaauaagcacuugccuggaauaaaauauaaaacugaaauaa

SEQ ID NO: 332987 - RNA, 64 nt, hsa
guugguuccuuggggggccaaagaaggcagggaaugccuggaggguaacuggggggccaccaug

SEQ ID NO: 332988 - RNA, 64 nt, hsa
aaaaaaagaaagaaagaaaaggaaacccaagagcugccuggacacacggaaacccaacugagaa

SEQ ID NO: 332989 - RNA, 64 nt, hsa
ggagccaagggaacccagaugacacccuugcccaugccuggaccuugcuucuggccagggaggg

SEQ ID NO: 332990 - RNA, 64 nt, hsa
gcucugcagaucagaacaacggaggauagcuuugugccuggacccagagagugugggacucccc

SEQ ID NO: 332991 - RNA, 64 nt, hsa
gcugacccucgucuuuguggcagcaaaaccaggaugccuggagcuguggccugagggccugcug

SEQ ID NO: 332992 - RNA, 64 nt, hsa
cccgaguagcagggauuaccggugugcaccaccaugccuggauaacuuuuuuuuuuauuucuau

SEQ ID NO: 332993 - RNA, 64 nt, hsa
cuaccacccuaacguggacacccaggguaacauaugccuggacauccugaaggagaaguggucu

SEQ ID NO: 332994 - RNA, 64 nt, hsa
ccacugcuaccuuaugugagcccucauugccucuugccuggauuauagccggggucuccuuccu

SEQ ID NO: 332995 - RNA, 64 nt, hsa
cauacauuuucccacuuaugugccuuuguaccugugccuggaacccuccucuucuuuuucuuuu

SEQ ID NO: 332996 - RNA, 64 nt, hsa; identical to SEQ ID NO: 138992

SEQ ID NO: 332997 - RNA, 64 nt, hsa; identical to SEQ ID NO: 138993

SEQ ID NO: 332998 - RNA, 64 nt, hsa; identical to SEQ ID NO: 138994

SEQ ID NO: 332999 - RNA, 64 nt, hsa; identical to SEQ ID NO: 138995

SEQ ID NO: 333000 - RNA, 64 nt, hsa; identical to SEQ ID NO: 138996

SEQ ID NO: 333001 - RNA, 64 nt, hsa; identical to SEQ ID NO: 138997

SEQ ID NO: 333002 - RNA, 64 nt, hsa; identical to SEQ ID NO: 138998

SEQ ID NO: 333003 - RNA, 64 nt, hsa; identical to SEQ ID NO: 138999

SEQ ID NO: 333004 - RNA, 64 nt, hsa; identical to SEQ ID NO: 139000

SEQ ID NO: 333005 - RNA, 64 nt, hsa; identical to SEQ ID NO: 139001

SEQ ID NO: 333006 - RNA, 64 nt, hsa; identical to SEQ ID NO: 139002

SEQ ID NO: 333007 - RNA, 64 nt, hsa; identical to SEQ ID NO: 139003

SEQ ID NO: 333008 - RNA, 64 nt, hsa; identical to SEQ ID NO: 139004

SEQ ID NO: 333009 - RNA, 64 nt, hsa; identical to SEQ ID NO: 139005

SEQ ID NO: 333010 - RNA, 64 nt, hsa; identical to SEQ ID NO: 139006

SEQ ID NO: 333011 - RNA, 64 nt, hsa; identical to SEQ ID NO: 139007

SEQ ID NO: 333012 - RNA, 64 nt, hsa; identical to SEQ ID NO: 139008

SEQ ID NO: 333013 - RNA, 64 nt, hsa; identical to SEQ ID NO: 139009

SEQ ID NO: 333014 - RNA, 64 nt, hsa; identical to SEQ ID NO: 139010

SEQ ID NO: 333015 - RNA, 64 nt, hsa; identical to SEQ ID NO: 139011

SEQ ID NO: 333016 - RNA, 64 nt, hsa; identical to SEQ ID NO: 139012

SEQ ID NO: 333017 - RNA, 64 nt, hsa; identical to SEQ ID NO: 139013

SEQ ID NO: 333018 - RNA, 64 nt, hsa; identical to SEQ ID NO: 139014

SEQ ID NO: 333019 - RNA, 64 nt, hsa; identical to SEQ ID NO: 139015

SEQ ID NO: 333020 - RNA, 64 nt, hsa; identical to SEQ ID NO: 139016

SEQ ID NO: 333021 - RNA, 64 nt, hsa; identical to SEQ ID NO: 139017

SEQ ID NO: 333022 - RNA, 64 nt, hsa; identical to SEQ ID NO: 139018

SEQ ID NO: 333023 - RNA, 64 nt, hsa; identical to SEQ ID NO: 139019

SEQ ID NO: 333024 - RNA, 64 nt, hsa; identical to SEQ ID NO: 139020

SEQ ID NO: 333025 - RNA, 64 nt, hsa; identical to SEQ ID NO: 139021

SEQ ID NO: 333026 - RNA, 64 nt, hsa; identical to SEQ ID NO: 139022

SEQ ID NO: 333027 - RNA, 64 nt, hsa; identical to SEQ ID NO: 139023

SEQ ID NO: 333028 - RNA, 64 nt, hsa; identical to SEQ ID NO: 139024

SEQ ID NO: 333029 - RNA, 64 nt, hsa; identical to SEQ ID NO: 139025

SEQ ID NO: 333030 - RNA, 64 nt, hsa; identical to SEQ ID NO: 139026

SEQ ID NO: 333031 - RNA, 64 nt, hsa; identical to SEQ ID NO: 139027

SEQ ID NO: 333032 - RNA, 64 nt, hsa; identical to SEQ ID NO: 139028

SEQ ID NO: 333033 - RNA, 64 nt, hsa
cauucuggugauucugaaccuugccucauagcuuaaaguauaaaaaagauucaagagcagugag

SEQ ID NO: 333034 - RNA, 64 nt, hsa
cauccuuuauaaauagucaagguuugggccacacaaaguauauuuuuaucauggaaaaauuuca

SEQ ID NO: 333035 - RNA, 64 nt, hsa
caguauauugcuggcagcuauuguauuaaaaaauaaaguauauuuucacuaucauaaaggauuc

SEQ ID NO: 333036 - RNA, 64 nt, hsa
uccuguguaguuuacacccagagcagauacucauaaaguauaaaguaaaaacuuuuaaccauua

SEQ ID NO: 333037 - RNA, 64 nt, hsa
auggacagcuuauugaaauaguauugauuuagaaaaaguauauugcauuucuaaaaaacaucua

SEQ ID NO: 333038 - RNA, 64 nt, hsa
uccuauuuguuccaauacaaacucacuuuauucuaaaguauauuaaugaaaccaguuccuguga

SEQ ID NO: 333039 - RNA, 64 nt, hsa
aaauguuucaagcgcuuaacucccccucauucacaaaguauaacaauuaaaaucucaacuauaa

SEQ ID NO: 333040 - RNA, 64 nt, hsa
uuacuuuuaacuauuuuuuuaguuaauauuuuuaaaaguauacaugucaauggccucuuugucc

SEQ ID NO: 333041 - RNA, 64 nt, hsa
agaaagagcaaauaaaaagcagugguaaugauccaaaguauaguacaaccacagcucagaauuc

SEQ ID NO: 333042 - RNA, 64 nt, hsa
cagacauacugaccaaaaccacaaucuagacuacaaaguauauuguuuuagaguacucaaauug

SEQ ID NO: 333043 - RNA, 64 nt, hsa
aguugccacuugucauuuuuguuucugaaaaauaaaaguauaacuuauucacauuuuuagugcu

SEQ ID NO: 333044 - RNA, 64 nt, hsa
guauaauuuuuugugguuuuuguuuuguugaguuaaaguauauuauugugagauuuauuuaaua

SEQ ID NO: 333045 - RNA, 64 nt, hsa
uuugggcaagcaaacaaauucacugagaauuccaaaaguauauuaaaaaagaagauagcuauga

SEQ ID NO: 333046 - RNA, 64 nt, hsa
uuuguacuuugugaagggagaugaaaggacguuuaaaguauauauauuuugucaagaggaaaga

SEQ ID NO: 333047 - RNA, 64 nt, hsa
cuccuaagucagugaggcaucacuuuguuugcauaaaguauacgguuuguuaaggccuuuguuc

SEQ ID NO: 333048 - RNA, 64 nt, hsa
aauuacacaaggaccuagaguaccuauaggacaaaaaguauagaauaaaaauaugccuuuaguc

SEQ ID NO: 333049 - RNA, 64 nt, hsa
uaaagucagaaguuuuacuccagguuauugcaauaaaguauaauguuuauuaaaugcuucauuu

SEQ ID NO: 333050 - RNA, 64 nt, hsa
ccaagauuggucucccauaugcagaaauagacaaaaaguauauuaaacaaaguuucagaguaua

SEQ ID NO: 333051 - RNA, 64 nt, hsa
aauaaaauuccucgguguauuaaucuaagguuucaaaguauaaaaguauaugggguaggccggg

SEQ ID NO: 333052 - RNA, 64 nt, hsa
uccucgguguauuaaucuaagguuucaaaguauaaaaguauaugggguaggccgggugcagugg

SEQ ID NO: 333053 - RNA, 64 nt, hsa
ucaaauaguguuuuacguuuuuuauccugcugaaaaaguauauauaaaauaucuaacauuacag

SEQ ID NO: 333054 - RNA, 64 nt, hsa
uaauugaccuuuuuguggaacauguaguuuauagaaaguauacucuaaagggaauuugccgaag

SEQ ID NO: 333055 - RNA, 64 nt, hsa
acucucaagcagacgugagugugacuuuuugaaaaaaguauaggauaaauuacauuaaaauagc

SEQ ID NO: 333056 - RNA, 64 nt, hsa
uuucuucauuucucuugcucaccaagaaguaacaaaaguauaguuuugacagaguugguguuca

SEQ ID NO: 333057 - RNA, 64 nt, hsa
uuaaaauauguauucuauaaugauuucauauauaaaaguauauuuauugacuguaauaaaauaa

SEQ ID NO: 333058 - RNA, 64 nt, hsa
accucucauguuuuaaugugucaaauuagagagcaaaguauaacaggugccuucacuuuugaga

SEQ ID NO: 333059 - RNA, 64 nt, hsa
aagaugugaucauuugugauguuacuuguaaaaaaaaguauauauacauaucuuuugaaguguu

SEQ ID NO: 333060 - RNA, 64 nt, hsa
uguugacauauuucuuuauaagagaauagaggcaaaaguauagaacugaggaucauuuguauuu

SEQ ID NO: 333061 - RNA, 64 nt, hsa
auaaaauaaacuugguaacuguuuuacaaauauaaaaguauaauaaauaugcagcccaguuaaa

SEQ ID NO: 333062 - RNA, 64 nt, hsa
auuaacucgaauuguaaauuaagcaaaaauuuaaaaaguauauguugaugggacaagaagaaua

SEQ ID NO: 333063 - RNA, 64 nt, hsa
aacccacuggaagucuuuagagguauuuugauuuaaaguauacuuaaauuaggauuucuuaaag

SEQ ID NO: 333064 - RNA, 64 nt, hsa
gucacuguuguuuucuuguaacaugauauggaauaaaguauagcagaaucuccguacauguucu

SEQ ID NO: 333065 - RNA, 64 nt, hsa
uuuuaucaaauuugccuuaaaauaaugaaaaagaaaaguauaguuaaugguuucaaauaugcua

SEQ ID NO: 333066 - RNA, 64 nt, hsa
gaaccaguuuuccaagaacaaaucuugcacaagcaaaguauaagaauuauccuaaaaauagggg

SEQ ID NO: 333067 - RNA, 64 nt, hsa
caaacaaaugccaaaugaauugccuaauugcugcaaaguauaacccagauaggaaaucauaugu

SEQ ID NO: 333068 - RNA, 64 nt, hsa
aaccacuaauauuuaccugaagauaaccaugaguaaaguauacuuuugcauuaauuuuuugagc

SEQ ID NO: 333069 - RNA, 64 nt, hsa
uuacuauaguuaauuuucuaggguucucuuaugaaaaguauauguaaacacauucauuuaaaaa

SEQ ID NO: 333070 - RNA, 64 nt, hsa
ucauaguaccccaaguauuucaauuagacuuauaaaaguauaagucaaucuauggucagugucu

SEQ ID NO: 333071 - RNA, 64 nt, hsa
uuacugccaaauaauuguaaaauuuguaaaguauaaaguauauaaaguagauacuaaauacaga

SEQ ID NO: 333072 - RNA, 64 nt, hsa
cagaaaauuacugccaaauaauuguaaaauuuguaaaguauaaaguauauaaaguagauacuaa

SEQ ID NO: 333073 - RNA, 64 nt, hsa
guuauauauaugggaugguuugguuggucccagcaaaguauaugaaaauuaaaguucugugaua

SEQ ID NO: 333074 - RNA, 64 nt, hsa
gcuuccugauuuauauaaaugaaaucucauuuauaaaguauaauaaagaugacuguaagacaaa

SEQ ID NO: 333075 - RNA, 64 nt, hsa
cuauuucccuuauaacucaauaguaccuuaacacaaaguauaacucuguagaguuggugaauau

SEQ ID NO: 333076 - RNA, 64 nt, hsa
uaaauauuguaacuggggaguauagaguagaaaaaaaguauaguuaaaacauuuguucuacaaa

SEQ ID NO: 333077 - RNA, 64 nt, hsa
ucuuuaggauauauuuacauuuucacucaucuaaaaaguauacaaaaauaaaaaguggaaaaag

SEQ ID NO: 333078 - RNA, 64 nt, hsa
ggccauuuaauacaguguugagugguucucuguaaaaguauaagugcuaacacuacgaagaaau

SEQ ID NO: 333079 - RNA, 64 nt, hsa
uaccuaagaguauaguaaggucaagaagaguaucaaaguauaauaaaauaaaaauuguauacuc

SEQ ID NO: 333080 - RNA, 64 nt, hsa
auuuuuuaagauaaauuaauauacuguauuuuuuaaaguauagguuuagguuuacagaauaaua

SEQ ID NO: 333081 - RNA, 64 nt, hsa
agggggagacuaaaaucgaauauaacuuaaaaugaaaguauacuuuuuauaauuuuucuuuuua

SEQ ID NO: 333082 - RNA, 64 nt, hsa
aaugcagucagcaaguuugcuggggaguuugauaaaaguauaaaacaaaacaaaaaaagccucg

SEQ ID NO: 333083 - RNA, 64 nt, hsa
aaccugcacauucagcacauguaucccagaacuuaaaguauaauaaaaauaaauaaauaauuuc

SEQ ID NO: 333084 - RNA, 64 nt, hsa
aauauuaaauauuuucuuauuuauuuuuuugauuaaaguauaaauuaagacacccuauugacuu

SEQ ID NO: 333085 - RNA, 64 nt, hsa
cacuuagcuauauucugagacuuugaagaguuauaaaguauaacuauaaaacuaauuuuucuua

SEQ ID NO: 333086 - RNA, 64 nt, hsa
uugauuaaauguuagaccacagaaguggaauuugaaaguauaaugcaguacauuaauauucaug

SEQ ID NO: 333087 - RNA, 64 nt, hsa
caguuaucacuguagaugagcaacucaucuuuuuaaaguauaguuacugaacugauucugagaa

SEQ ID NO: 333088 - RNA, 64 nt, hsa
ugcacaauuaugaaaccugguuguacauguuaugaaaguauacuaaguaaguuaguuuuuauua

SEQ ID NO: 333089 - RNA, 64 nt, hsa
uuuuguaagaauauuuauuuuuauaaaaaaguauaaaguauacagugggauguuuugauauaca

SEQ ID NO: 333090 - RNA, 64 nt, hsa
ccuguccuuuuguaagaauauuuauuuuuauaaaaaaguauaaaguauacagugggauguuuug

SEQ ID NO: 333091 - RNA, 64 nt, hsa
ucuagccauuugcaguuuuguuuuagaugauuggaaaguauaucaccaaaaaaaguauauagug

SEQ ID NO: 333092 - RNA, 64 nt, hsa
uuguuuuagaugauuggaaaguauaucaccaaaaaaaguauauagugacauuuuuaguaugaaa

SEQ ID NO: 333093 - RNA, 64 nt, hsa
acaguacagucgcuagucaagugguuuuuaaaguaaaguauauucauaagguaacaguuauucu

SEQ ID NO: 333094 - RNA, 64 nt, hsa
gcuuaaguagacuauacaguuguaugaauuuguaaaaguauaugaacaccuagugagauuucaa

SEQ ID NO: 333095 - RNA, 64 nt, hsa
gggguucaaauugaguggaauaaaguauagauuaaaaguauacaauccuuagcacguuaucuca

SEQ ID NO: 333096 - RNA, 64 nt, hsa
agacuuauuaugugggguucaaauugaguggaauaaaguauagauuaaaaguauacaauccuua

SEQ ID NO: 333097 - RNA, 64 nt, hsa
gugagauuuaaaauaaauaggaugagguugaagaaaaguauauuggagcgcagauaaauauaaa

SEQ ID NO: 333098 - RNA, 64 nt, hsa
gauuuuauuuugugaaguucaaagauucuuuccuaaaguauaacguguuguuaaaaaguagugg

SEQ ID NO: 333099 - RNA, 64 nt, hsa
acugcacuccggccuaggcaacgagagcaaaacuccaauacaaacaaacaaacaaacaccugug

SEQ ID NO: 333100 - RNA, 64 nt, hsa
uaggucagucuggcacguaagaugaacaucccuaccaauacagagcucaccaucucuuauacuu

SEQ ID NO: 333101 - RNA, 64 nt, hsa
gugcuccuguuggauggugaggucacuccauaugccaauacaaacaacaaugcgguggauugca

SEQ ID NO: 333102 - RNA, 64 nt, hsa
aggugacuuaguauauuuguaauugguuuuaaaaccaauacaccauacuuucuuucugcaaaca

SEQ ID NO: 333103 - RNA, 64 nt, hsa
acugccccuucgccauccuagagugaggcucuguccaauacauggcucugcccuccagaacuuc

SEQ ID NO: 333104 - RNA, 58 nt, hsa
acuucucccucaaggagugaggcuugguccaauacauggcucugccccccagaacuua

SEQ ID NO: 333105 - RNA, 61 nt, hsa
gaugguaaaacccagguuagucaucaguaaccuucucuauuauuauuauuuuuuagaaacu

SEQ ID NO: 333106 - RNA, 61 nt, hsa
aacaaaucugauaaauuguguaaccuagucucuucucuacauggugaugcauuucagcaau

SEQ ID NO: 333107 - RNA, 61 nt, hsa
cuuucauuuucuccucccagcccccugcugccuucucuaugcagccugcccuccaucaucc

SEQ ID NO: 333108 - RNA, 61 nt, hsa
uuugcuuucuucugacugacauuuauucagccuucucuacaggaaucucuuauguuccccc

SEQ ID NO: 333109 - RNA, 61 nt, hsa
cuuuacuucuaucaucccaaaucaaagaacucuucucuauuauguuuaaucaauugcaagc

SEQ ID NO: 333110 - RNA, 61 nt, hsa
auuuacugugggauccaauuuaaacuucuuucuucucuagccuuuaaauuacacaacuuug

SEQ ID NO: 333111 - RNA, 61 nt, hsa
aucacaagggaggagagaggaaaacaauuaucuucucuacuuggauuaugagauaaccuuu

SEQ ID NO: 333112 - RNA, 61 nt, hsa
cccacuaaauguauguuauugaaugccaguacuucucuaguggaugcacacuuguuaaaua

SEQ ID NO: 333113 - RNA, 61 nt, hsa
cucccugcaugucuuaaguaucuuucccuuccuucucuacccucaccuccauccugucuac

SEQ ID NO: 333114 - RNA, 61 nt, hsa
cuucauauaaauugcucaggcccucccaccccuucucuaacacuagcuucaaggcagaagc

SEQ ID NO: 333115 - RNA, 61 nt, hsa
uucucuauuugagaaucucuaccaccauucccuucucuauuugggaaacaauacucucuua

SEQ ID NO: 333116 - RNA, 61 nt, hsa
aauggaggcugagaaucucuaccaccauucccuucucuauuugagaaucucuaccaccauu

SEQ ID NO: 333117 - RNA, 61 nt, hsa
cuguagagaacuuaaugaaccugaacccaggcuucucuagcucugguaacgugugauuguu

SEQ ID NO: 333118 - RNA, 61 nt, hsa
cuugcagagguacuuuucuugauuaaauagccuucucuagcaacaucauuuucagacuaac

SEQ ID NO: 333119 - RNA, 61 nt, hsa
caaagccagauuaccuagguucggagacccgcuucucuaccuacuacuaauaguuggguca

SEQ ID NO: 333120 - RNA, 61 nt, hsa
auaguccucuuuccaaguguguuagcauagacuucucuauauguuucuacuagaccuaggg

SEQ ID NO: 333121 - RNA, 61 nt, hsa
gcggggcuguggcagccagcgguuuuccucucuucucuaucuguagcuacuuucucugggc

SEQ ID NO: 333122 - RNA, 61 nt, hsa
ugucgggcaguguggaagucaggaccuugcucuucucuauuggaggccccgggaucucucg

SEQ ID NO: 333123 - RNA, 61 nt, hsa
cuuuuccccuacaaacuguuguugaacagugcuucucuaaaaugcaauaauaaugggccag

SEQ ID NO: 333124 - RNA, 61 nt, hsa
caagaccagccuggccaacauggugaaaccccuucucuacuaaaauacacaaauuagcuag

SEQ ID NO: 333125 - RNA, 61 nt, hsa
uugagauggagucuucugaaaauuuucucaucuucucuaacccgguucaugacagacccuu

SEQ ID NO: 333126 - RNA, 61 nt, hsa
aagaccagccugggcagaauggugaaaccaccuucucuacaaaaaauacauaaauuagcug

SEQ ID NO: 333127 - RNA, 61 nt, hsa
ucuuuucucccauauuggcauggauuucugucuucucuaacaccuugugaccuucucuaua

SEQ ID NO: 333128 - RNA, 61 nt, hsa
uggauuucugucuucucuaacaccuugugaccuucucuauaucaugcuuuaaaguguaaua

SEQ ID NO: 333129 - RNA, 61 nt, hsa
ccagcugccuucucugcccugugcccacucccuucucuacucuuccccagcaccaugccaa

SEQ ID NO: 333130 - RNA, 61 nt, hsa
gacugcuccuuuccgcucacccauucccugccuucucuaggaacccuggcuuuuaucuucu

SEQ ID NO: 333131 - RNA, 64 nt, hsa; identical to SEQ ID NO: 211620

SEQ ID NO: 333132 - RNA, 64 nt, hsa; identical to SEQ ID NO: 211621

SEQ ID NO: 333133 - RNA, 64 nt, hsa; identical to SEQ ID NO: 211622

SEQ ID NO: 333134 - RNA, 64 nt, hsa; identical to SEQ ID NO: 211623

SEQ ID NO: 333135 - RNA, 64 nt, hsa; identical to SEQ ID NO: 211624

SEQ ID NO: 333136 - RNA, 64 nt, hsa; identical to SEQ ID NO: 211625

SEQ ID NO: 333137 - RNA, 64 nt, hsa; identical to SEQ ID NO: 211626

SEQ ID NO: 333138 - RNA, 64 nt, hsa; identical to SEQ ID NO: 211627

SEQ ID NO: 333139 - RNA, 64 nt, hsa; identical to SEQ ID NO: 211628

SEQ ID NO: 333140 - RNA, 64 nt, hsa; identical to SEQ ID NO: 211629

SEQ ID NO: 333141 - RNA, 64 nt, hsa; identical to SEQ ID NO: 211630

SEQ ID NO: 333142 - RNA, 64 nt, hsa; identical to SEQ ID NO: 211631

SEQ ID NO: 333143 - RNA, 64 nt, hsa; identical to SEQ ID NO: 211632

SEQ ID NO: 333144 - RNA, 64 nt, hsa; identical to SEQ ID NO: 211633

SEQ ID NO: 333145 - RNA, 64 nt, hsa; identical to SEQ ID NO: 211634

SEQ ID NO: 333146 - RNA, 64 nt, hsa; identical to SEQ ID NO: 211635

SEQ ID NO: 333147 - RNA, 64 nt, hsa; identical to SEQ ID NO: 211636

SEQ ID NO: 333148 - RNA, 64 nt, hsa; identical to SEQ ID NO: 211637

SEQ ID NO: 333149 - RNA, 64 nt, hsa; identical to SEQ ID NO: 211638

SEQ ID NO: 333150 - RNA, 64 nt, hsa
ugaaagagguuauaaaacucauucaggguugcucaguuaguaaguuauagaguugaaauuggag

SEQ ID NO: 333151 - RNA, 64 nt, hsa
cucuuccucuucuacuuguaaucaguaccacccaaguuaguauuuaauuaugugccaucuuaua

SEQ ID NO: 333152 - RNA, 64 nt, hsa
ggugauuauggagggaaucaaaaauacugcuuucaguuaguagcuagcuuuaagucaggaguua

SEQ ID NO: 333153 - RNA, 64 nt, hsa
acugcuuucaguuaguagcuagcuuuaagucaggaguuaguaaugagaaauuuuauaaaugugu

SEQ ID NO: 333154 - RNA, 64 nt, hsa
uccagauuguagucauuuugagagguacaaagcucauaauuaccaugacaacaugguaaugucc

SEQ ID NO: 333155 - RNA, 64 nt, hsa
uuuuucagguaaacauuuuucauuuggcaaauggcauaauuauuugaaagugacaggaaucucc

SEQ ID NO: 333156 - RNA, 64 nt, hsa
uaacucuaaauuuaaugcucuacaucuuaucagucauaauuauauauacuguggaacaguaucu

SEQ ID NO: 333157 - RNA, 64 nt, hsa
cuuuaaagcauuaugugcaauuaaguuguuaugacauaauuauauugccuaauuguugggucuu

SEQ ID NO: 333158 - RNA, 64 nt, hsa
ucuuuaggggaggagggcugaggaagaaggcauacauaauuacuucaguguaauccuuuauauc

SEQ ID NO: 333159 - RNA, 64 nt, hsa
cucuuuacauguuaacaccuugcuacuaccaaggcauaauuacuuaacaugcuucgaggcugua

SEQ ID NO: 333160 - RNA, 64 nt, hsa
uuccauuguaaugauuccuuuuuauuuguagcagcauaauuauuuccaaagaccccaguauuug

SEQ ID NO: 333161 - RNA, 64 nt, hsa
cccuuuaaccauauaauuaaauuacaaagguauacauaauuaaucuaauaaaggaucaugagga

SEQ ID NO: 333162 - RNA, 64 nt, hsa
ccuauguuuguguauagacaugacucuacuagggcauaauuagaguuuguguauuauuuuucca

SEQ ID NO: 333163 - RNA, 64 nt, hsa
uuguuaauuauuuuuauggaaauuauuacucugucauaauuaaaucauagcuaguauaacuuua

SEQ ID NO: 333164 - RNA, 64 nt, hsa
aucgcaguuacgcuguacuuuuauuaauauuuaacauaauuaaagauggacccauaagagugac

SEQ ID NO: 333165 - RNA, 64 nt, hsa
auuuucaguacauauuuuacuauuccacaccaaccauaauuacaacaagggauuuuucuuaugc

SEQ ID NO: 333166 - RNA, 64 nt, hsa
uguacuaggcuuaguuauaugaaucuuuauaacacauaauuacuaacuuuguagccauauaugu

SEQ ID NO: 333167 - RNA, 64 nt, hsa
ggaauuacagauugagaaaugauggaauaauagacauaauuaauucaauacacuacuguuaaaa

SEQ ID NO: 333168 - RNA, 64 nt, hsa
ggggagcuggucuucuaagaaacggauaaagccacauaauuaaagcaguugaacuauagggaaa

SEQ ID NO: 333169 - RNA, 64 nt, hsa
aacugccagcaacacaacuggaguuuccauuuaucauaauuaguuuuucuaaauagacccuuau

SEQ ID NO: 333170 - RNA, 64 nt, hsa
agugauuuuauauauggcauaaacuuuguuuuaacauaauuaguacuguuuucccccaaaagua

SEQ ID NO: 333171 - RNA, 64 nt, hsa
auccuacuggcuccuuagcagcugauugguguuacauaauuaacuuaauuggagaugcauuagg

SEQ ID NO: 333172 - RNA, 64 nt, hsa
cugaacuucagcuagugcuagagaacuauuuucuaugacuuaacucuaaccaaguuuuauuuua

SEQ ID NO: 333173 - RNA, 64 nt, hsa
aagauagaaguugcugaaguuuucugaauuaauaaugacuuagauugugaccuuuuagauucgg

SEQ ID NO: 333174 - RNA, 64 nt, hsa
aagggaaaguuacccugaucuuaguuuguagcuuaugacuuauuuaaugaauggaugcccagcc

SEQ ID NO: 333175 - RNA, 64 nt, hsa
uggaucaugagauguaaagaaaacaauaauggcaaugacuuauauucaaaucuguauuuguuuc

SEQ ID NO: 333176 - RNA, 64 nt, hsa
accaacaggugaucaauguuuggaaaauacaacaaugacuuauuuaaaaauuacccuuccugcu

SEQ ID NO: 333177 - RNA, 64 nt, hsa
uuuacuuuagaacaugagaauagcaguuuugcucaugacuuaccauuccagcugcaugggaaag

SEQ ID NO: 333178 - RNA, 64 nt, hsa
agcuuaagaaaacauugccauuuugguuagggauaugacuuaaugugcuauuauuucugguucu

SEQ ID NO: 333179 - RNA, 64 nt, hsa
cacauacagcauuuccuaggauaaaaauaaacaaaugacuuacagccucauccucccuaacucc

SEQ ID NO: 333180 - RNA, 64 nt, hsa
aacacauuguuaagcuguggauuuguacucaauaaugacuuaggauaaacauuuauuuucauuc

SEQ ID NO: 333181 - RNA, 64 nt, hsa
guugguuuguuuacuauuuuauugguaaauuaacaugacuuaauuugaacaaagugaugauuug

SEQ ID NO: 333182 - RNA, 64 nt, hsa
ggcacuggcuagggaggggcaggccuccuuccugccccucgagacacucuugggagaugcauuu

SEQ ID NO: 333183 - RNA, 64 nt, hsa; identical to SEQ ID NO: 333182

SEQ ID NO: 333184 - RNA, 64 nt, hsa
ugcgacccaacuucauuuguuuacuugaaaauucccccucgagguugagagaaccucugaggug

SEQ ID NO: 333185 - RNA, 64 nt, hsa
cacuguugcugacuacuacucugccaaucggcuaccccucgacucagcaccacauugccucauu

SEQ ID NO: 333186 - RNA, 64 nt, hsa
ggcauccugcccgccgccugcucucugcccccauccccucgacgacccccgccccugccccccc

SEQ ID NO: 333187 - RNA, 64 nt, hsa
uugaauugcuucauucaacacccccacccucccuccccucgaggugguaccuaagcuguggauu

SEQ ID NO: 333188 - RNA, 64 nt, hsa
ugccacaggcuggcaggggccucugggggccccuccccucgacccccagccuggguagagccac

SEQ ID NO: 333189 - RNA, 64 nt, hsa
cucgcucgauuccuuuucccgcgcuccaugccucccccucgacucccggugcugcggaagaacu

SEQ ID NO: 333190 - RNA, 64 nt, hsa
gugcuucuaaagucagaacagguucuccaaggauccccucgagacuacucuguuaccagucaug

SEQ ID NO: 333191 - RNA, 64 nt, hsa
gcuggauucaguccauggaccauagauugcugucccccucgacggacuuauaauguuucaggug

SEQ ID NO: 333192 - RNA, 64 nt, hsa
ugcacaucagcaaaugucuuuagaucuccaucucccccucgagcuggaccauuugguuacccuc

SEQ ID NO: 333193 - RNA, 64 nt, hsa
cuccccccagcucccugcaccgccgcagaagcagccccucgaggccuacagaggaggccucaaa

SEQ ID NO: 333194 - RNA, 64 nt, hsa
uagaccuugaggugaucagcauaagaggccagauccccucgagucaucuacaccuagcuucacc

SEQ ID NO: 333195 - RNA, 64 nt, hsa
gagacacugcuggugggagcaggaaggagcagugccccucgagcagccaggaagccugcggauc

SEQ ID NO: 333196 - RNA, 64 nt, hsa
uauaaaucagcagucucuugggcagaggagcaagccccucgaacaugauuucaaacaagcaggu

SEQ ID NO: 333197 - RNA, 64 nt, hsa
gcagugagauuagucuguguccacaagcagaggcccccucgaugggagggaguggcaggcagga

SEQ ID NO: 333198 - RNA, 64 nt, hsa
cgggguggcucacagcuuugaaccugccaaaggaccccucgacuggccacagcccagcccagcc

SEQ ID NO: 333199 - RNA, 64 nt, hsa
caaagguaacucgagguggaggguagcccuggggccccucgacaucaccgucauugauggagcc

SEQ ID NO: 333200 - RNA, 64 nt, hsa
aaucuugccaagcuguccgugagagacacgggcuccccucgagggagacuugcaaaugcuccau

SEQ ID NO: 333201 - RNA, 64 nt, hsa
cugcucaaaggagggguuggcggugcaggggcaaccccucgaaagcggggugucuucucuuuuc

SEQ ID NO: 333202 - RNA, 64 nt, hsa
gacugggcuccuucccuugacuuccagggagcacccccucgauuugggcagaugguggagucaa

SEQ ID NO: 333203 - RNA, 64 nt, hsa
gcacaggacugaggauccucuccuccagaaaagcccccucgaggaaauaaauuagugcgguucu

SEQ ID NO: 333204 - RNA, 64 nt, hsa
ccuaaaaacgccccugguccggccccacucugcgccccucgaucucccaggcucuuucugcagu

SEQ ID NO: 333205 - RNA, 64 nt, hsa
cuguccuguguguugugggaggggaugggaggcgccccucgagugugcguguaucagggggucu

SEQ ID NO: 333206 - RNA, 64 nt, hsa
auccccguuccccccagguggccugggagguggcccccucgaggaugacuccacuagcgcccug

SEQ ID NO: 333207 - RNA, 64 nt, hsa
aaaacaagagcuggguaguuuagccaaacggcacccccucgaguucacugcagacccuucguuc

SEQ ID NO: 333208 - RNA, 64 nt, hsa
cugcagacgacccccgcagccuuucccucggaccccccucgaagcccccuggacugauucccac

SEQ ID NO: 333209 - RNA, 64 nt, hsa
caccucauuguuucccccacgucucccucuauacccccucgaagacucgagagggggagggggu

SEQ ID NO: 333210 - RNA, 64 nt, hsa
cccaacccacauaccuccauuccacuugugacacccccucgacucccuggugacgcuccuccca

SEQ ID NO: 333211 - RNA, 64 nt, hsa
cuccugcaggggaagcccugguccagcugggugcccccucgagcuccgggcggacucgcacaca

SEQ ID NO: 333212 - RNA, 64 nt, hsa
ggagagaaggggagugcggagccccgucucccuaccccucgagcaccugggccagcggcugagc

SEQ ID NO: 333213 - RNA, 64 nt, hsa
cggcccuuugugacucuuggcauccggagacuuuccccucgacccaguggagccgucaggccgg

SEQ ID NO: 333214 - RNA, 64 nt, hsa
guuuagccuccccacccccucugaaugcuugaauccccucgacaauuuaugaugccaccagcaa

SEQ ID NO: 333215 - RNA, 64 nt, hsa
ggggaagccccaauagcuggacagaccucggccuccccucgaagacaccucaauucacagacuc

SEQ ID NO: 333216 - RNA, 64 nt, hsa
uuaagaaaauaaaugucaccagguacuugagaaaccccucgauugucuaccucgaucguacuuc

SEQ ID NO: 333217 - RNA, 64 nt, hsa
ccaucccacgacccccgcaacccuucacaucaccccccucgaaggucggacaggacggguggag

SEQ ID NO: 333218 - RNA, 64 nt, hsa
ggagcaggcugccaccccuucuaccucaccacugccccucgaagaauuuugcaaauggccccuu

SEQ ID NO: 333219 - RNA, 64 nt, hsa
ucggcgggcgcuggaaguagagaggccagaaaggccccucgaggcagagacccuccgcccucuu

SEQ ID NO: 333220 - RNA, 64 nt, hsa
gagccccgucuugcuucucuuccaggugcucuauccccucgagacccucuggugccaggcuugc

SEQ ID NO: 333221 - RNA, 64 nt, hsa
cccccuuugccacaaugguaugauggcuugguagccccucgaggcagaugcaccugacuugcug

SEQ ID NO: 333222 - RNA, 64 nt, hsa
ggaacagguagagacaaacguugcacuggugccuccccucgaaccgccaagcagaaaccggacc

SEQ ID NO: 333223 - RNA, 64 nt, hsa
ugcucucuggguuacugaggggcucaggaaggggccccucgagccuuccuggaguacccgagug

SEQ ID NO: 333224 - RNA, 64 nt, hsa
cccugcuucucugguauuuauuuuagaggggagcccccucgaaaugcagaaaaggacuuguggu

SEQ ID NO: 333225 - RNA, 64 nt, hsa
aagcaggagcuagcagccgccuacuuggugcuaaccccucgauguacauagcuuuucucagcug

SEQ ID NO: 333226 - RNA, 64 nt, hsa
cuggaagaaagcagucaguacccucccaacggccccccucgaaggucuccacucuccucugggc

SEQ ID NO: 333227 - RNA, 64 nt, hsa
uaacacugugcaucuuauugugaggccagcuuguccccucgaacccucuuuggccagguaaaca

SEQ ID NO: 333228 - RNA, 64 nt, hsa
uuugagaucuuuggaaaggacucuaucucauccuccccucgacaagccaagaaugagaauuggg

SEQ ID NO: 333229 - RNA, 64 nt, hsa
ggcuucaugguuucugcucagucugucccccuucccccucgacccccgcaaugagugggcacca

SEQ ID NO: 333230 - RNA, 64 nt, hsa
gaaaaaaauuagcaaaccgaaguuucuucaaugaccccucgagaacuuugggaccaguuuccua

SEQ ID NO: 333231 - RNA, 64 nt, hsa
ucauacacaugaguuucccaaauguguaccuggaccccucgaaacagaggacucuacgaaauga

SEQ ID NO: 333232 - RNA, 64 nt, hsa
gggaccagugaauaagaagaccccacuucaacuuccccucgaagacguugugccucacagcgag

SEQ ID NO: 333233 - RNA, 64 nt, hsa
gaauguggggaucgagcagccuucuucuuugggaccccucgauaucccauggaaugcucgcacg

SEQ ID NO: 333234 - RNA, 64 nt, hsa
acuccugagguagcuucuggaaauggggacaaguccccucgaaggaaaggaaaugacuagagua

SEQ ID NO: 333235 - RNA, 64 nt, hsa
uggaagagaacucgaggggcugugcugcaggccuccccucgaaagacacugggaggucagcaug

SEQ ID NO: 333236 - RNA, 64 nt, hsa
ugcagaauguuguugguuacuguugcuccccgagccccucgacucgucccguggccgccuguuu

SEQ ID NO: 333237 - RNA, 64 nt, hsa
cuggucuccccgcagucgucccaggcugccggcuccccucgacagcucucugggcacccggucc

SEQ ID NO: 333238 - RNA, 64 nt, hsa
gcccagagcccuggaggagccaccaccccgccggccccucgaccccucggccccucggccccuc

SEQ ID NO: 333239 - RNA, 64 nt, hsa
cauccucucccacacacauuccagaagucagggcccccucgaggagcacccgcugcagggaugc

SEQ ID NO: 333240 - RNA, 64 nt, hsa
ggguuaccauguccaucccccaaggggggcccugccccucgagucgauggugucccgcaucuac

SEQ ID NO: 333241 - RNA, 52 nt, hsa
uggaggagauugccugcugacaccccucgagucacccagcacucccuccaaa

SEQ ID NO: 333242 - RNA, 64 nt, hsa
agcauccccuguuccuguuucacucucagcuucuccccucgaagggacucucuggccaccuccu

SEQ ID NO: 333243 - RNA, 64 nt, hsa
agaagcccggccuggacaccccucggccuggacaccccucgaaggagagggcgcuuccuugagu

SEQ ID NO: 333244 - RNA, 64 nt, hsa
cucccuccugccccuugcuagggucugagccaagccccucgacucccucacuguguugacacuu

SEQ ID NO: 333245 - RNA, 64 nt, hsa
ugauaagugauaguacucaaaaaccugaaucccaccccucgaccaauccuccacaaacuucagu

SEQ ID NO: 333246 - RNA, 64 nt, hsa
gccaggggaggaagugaggcccaggcaccugcugccccucgagggggcccugccugccgcgggg

SEQ ID NO: 333247 - RNA, 64 nt, hsa
acucgccccaaagaucccgagggcauaggccaccccccucgaaguucagguucagcuccuggau

SEQ ID NO: 333248 - RNA, 62 nt, hsa
cgcgcugcaugacuugcugaacggcacagggaccccucgaggaacaagguugcacaccagcu

SEQ ID NO: 333249 - RNA, 64 nt, hsa
uuggcagagggucauuuuaggagagcugccccagccccucgaacgccuggcuuggggugucauu

SEQ ID NO: 333250 - RNA, 64 nt, hsa
ccccugccagcucaccgugcccagccuccugcauccccucgaagagccuggccagagagggaag

SEQ ID NO: 333251 - RNA, 64 nt, hsa
ugugcacaagugagugagagauuucgaacgcccaccccucgacuuugaaaucugagcaaaacaa

SEQ ID NO: 333252 - RNA, 64 nt, hsa
cagccccugcuccgcacgccccaugcucuucccuccccucgaguguggguagggcugggacugc

SEQ ID NO: 333253 - RNA, 64 nt, hsa
ccgcaguggggcccugacgcccaccucccaggugccccucgagcaaaaaccucuggcgccucca

SEQ ID NO: 333254 - RNA, 64 nt, hsa
cuguguuucugcaccauuuccgaggacgacgcagccccucgagcccccccaccggccccggccg

SEQ ID NO: 333255 - RNA, 64 nt, hsa
guggccuaggcugcucccaucgcuucccaccuguccccucgaggcuucugaccuuugauccgcu

SEQ ID NO: 333256 - RNA, 64 nt, hsa
gagggggagggaguugggagaagcccagccccucccccucgagaccccucccaugucccuuccu

SEQ ID NO: 333257 - RNA, 64 nt, hsa
gcuguggggagacgggggucuuccuucaccagcuccccucgacucaagcccuuguccucauuau

SEQ ID NO: 333258 - RNA, 64 nt, hsa
cuccacugugucugucuuuucuucccuggggcucccccucgaggcgaggggccaugcaugucug

SEQ ID NO: 333259 - RNA, 64 nt, hsa
ggagcaagaauaccaagacaaauucaaaagacugccccucgagauuuuggaauucgugcaggaa

SEQ ID NO: 333260 - RNA, 64 nt, hsa
gagcauccuaugccuuugacaaagauugcaguggccccucgagugcagaggucaucccaggugu

SEQ ID NO: 333261 - RNA, 64 nt, hsa
uguaaaucugcccacacccagcuggccauauccaccccucgacgccgggaugagccggcucugc

SEQ ID NO: 333262 - RNA, 64 nt, hsa
uacaggaguccuccuuucugagcuccagccccagccccucgaaccaccuguaaucuaggcaccu

SEQ ID NO: 333263 - RNA, 61 nt, hsa
ugaaguugaugcguuggugaggaggaaugggccccucgaagugggccgggccggccccacc

SEQ ID NO: 333264 - RNA, 58 nt, hsa
ccugagguuaggaguucgagaccagccuggccaacaugguaaaaccccaucucuacua

SEQ ID NO: 333265 - RNA, 58 nt, hsa
aauuuuuuaaaaaaguaaguaccacucaggccaacaagccaacgacaaagccaaacuc

SEQ ID NO: 333266 - RNA, 58 nt, hsa
ccugaggucaggaguucgagaccacccuggccaacauggugaaaccccaucucuacag

SEQ ID NO: 333267 - RNA, 58 nt, hsa
ccugagguuagaaguuugagaccagccuggccaacauggugaaaccuggccucuacua

SEQ ID NO: 333268 - RNA, 58 nt, hsa
cacgaggucaggagaucaagaccauccuggccaacauggugaaaccccaucucuacug

SEQ ID NO: 333269 - RNA, 58 nt, hsa
cuugaggucgggaguuugagaccagccuggccaacauggugaaacccugucuuuacua

SEQ ID NO: 333270 - RNA, 58 nt, hsa
caugaggucaggaguuugagaucagccuggccaacauggugaaaccccaucucuacua

SEQ ID NO: 333271 - RNA, 58 nt, hsa
caugaggucaagagaucaagaucauccuggccaacauggugaaacccugucucuacua

SEQ ID NO: 333272 - RNA, 58 nt, hsa
cuugaggucagaaguuugagaccagccaggccaacauggugaaacuucaucucuacua

SEQ ID NO: 333273 - RNA, 58 nt, hsa
cacaaggucaagagaucgagaccauccuggccaacauggugaaacccugucucuauua

SEQ ID NO: 333274 - RNA, 58 nt, hsa
gcuacuugcugcaaacaagcccuacuuuggccaacauccugcuuauuucucaaaaaag

SEQ ID NO: 333275 - RNA, 58 nt, hsa
cugaggucaggaguuuugagaccagccuggccaacaugguaaaaucccgucucuacua

SEQ ID NO: 333276 - RNA, 58 nt, hsa
cuugaggccaggaguuggagaccagccuggccaacauggugaaacccugucucuacua

SEQ ID NO: 333277 - RNA, 58 nt, hsa
uucccacagaggcaggaguccuaccucgggccaacacucuuucuccuugguggaaacu

SEQ ID NO: 333278 - RNA, 58 nt, hsa
cacaagguccagagaucgagaccauccuggccaacauggugaaaccccgucucuacua

SEQ ID NO: 333279 - RNA, 58 nt, hsa
cuugaggccaggaguucaagaccagccuggccaacauggcaaaaucccaucucuacua

SEQ ID NO: 333280 - RNA, 58 nt, hsa
ugggaggccaggaguucgagaccagccuggccaacauggugaaacccggucucuacua

SEQ ID NO: 333281 - RNA, 58 nt, hsa
ccugaggucaggaguuugagaccagccuggccaacauggcaaaaccccgucucuacaa

SEQ ID NO: 333282 - RNA, 58 nt, hsa
cuugaggucaggagcucgagaccagccuggccaacacggugaaaccccaucucuacua

SEQ ID NO: 333283 - RNA, 58 nt, hsa
cuugaggucaggagcucaagaccagccuggccaacauggugaaaccccaucucuacua

SEQ ID NO: 333284 - RNA, 58 nt, hsa
cucaaggucaggcauuugagaccagccuggccaacauagugaaaccccgucucuauua

SEQ ID NO: 333285 - RNA, 58 nt, hsa
ccugaggcuaggaguugcagaccagccuggccaacauggcaaaaccccgucucuacua

SEQ ID NO: 333286 - RNA, 58 nt, hsa
gcugaggucaggaguuggagaccagcguggccaacauggugaaaccccgucucuacua

SEQ ID NO: 333287 - RNA, 58 nt, hsa
cacgaggucaggagaucgagaccauccuggccaacacggugaaaccucgucuccacua

SEQ ID NO: 333288 - RNA, 58 nt, hsa
cuugaggucaggaguucaagaccagccuggccaacauggugaaaccccaucucuacua

SEQ ID NO: 333289 - RNA, 58 nt, hsa
cuugaggccaggaguucaagaccagccuggccaacaugaugagaccuccgucucuacu

SEQ ID NO: 333290 - RNA, 58 nt, hsa
gcagcgggagccagcagggggcagcagaggccaacagggagcucgcaggccgggcccc

SEQ ID NO: 333291 - RNA, 58 nt, hsa
cacaaggucaggaguucgagaccagccuggccaacacggugaaaccccgacucuacua

SEQ ID NO: 333292 - RNA, 58 nt, hsa
guggaucacuggaguuugagaccacccuggccaacauggugaaaccccaucucuacua

SEQ ID NO: 333293 - RNA, 58 nt, hsa
cacgaggucaggaguucgagaccagccuggccaacauagugaaaccccaucucuacua

SEQ ID NO: 333294 - RNA, 58 nt, hsa; identical to SEQ ID NO: 333288

SEQ ID NO: 333295 - RNA, 58 nt, hsa
uugagguuaggaguuugagaacuggccuggccaacauagcaaaaccucaucucuacua

SEQ ID NO: 333296 - RNA, 58 nt, hsa
cacgaggucaggaguucgagaccauccuggccaacauggugaaaccccgucucuacua

SEQ ID NO: 333297 - RNA, 58 nt, hsa
cuugaggccaggaguuagagaccagccuggccaacaaggcaaaaccccgucucuacua

SEQ ID NO: 333298 - RNA, 64 nt, hsa
cgcccacggcgccucagauuucaggacccuccuccucgcccacggcgccucagaccucaggacc

SEQ ID NO: 333299 - RNA, 64 nt, hsa
aggaccugacccuggcgugugcuuggcccuccuccucgcccacggcgccucagauuucaggacc

SEQ ID NO: 333300 - RNA, 64 nt, hsa
ccguacgacacgcguccucgggcgccaccgggcgcucgcccaggacuccccgggccucgggccc

SEQ ID NO: 333301 - RNA, 64 nt, hsa
aucggccgcccacggggggccacagcagcggccgcucgcccaggauggagaggcgggucccagg

SEQ ID NO: 333302 - RNA, 64 nt, hsa
aacagccuuuuuacccuuaggaacagcuuuuugcccuuagcacuaugcuugggggccauuuuaa

SEQ ID NO: 333303 - RNA, 64 nt, hsa
uauucucggcucuucuccugggguuggggggcugccuuagcagccaaaggucacuucucccaaa

SEQ ID NO: 333304 - RNA, 64 nt, hsa
accccauugucagcaccccagccaugcggccaccccuuagcacaccugcucgucccauuuagcu

SEQ ID NO: 333305 - RNA, 64 nt, hsa
ucuucuugcuugacucaaucuacccagagaugccccuuagcacaccuagagggcagggaccaua

SEQ ID NO: 333306 - RNA, 64 nt, hsa
agggaugacucagcagagaugacucagcacugucccuuagcagggaugacacagcaaggaugac

SEQ ID NO: 333307 - RNA, 64 nt, hsa
aggcaugacucugcagagaugacucagcacugucccuuagcagggaugacacagcaaggaugac

SEQ ID NO: 333308 - RNA, 64 nt, hsa
agggaugacucagcagggaugacucagcacugucccuuagcagugaugacacagcaaggaugac

SEQ ID NO: 333309 - RNA, 64 nt, hsa
agggaugacucagcagggaugacucagcagugucccuuagcagcgaugacacagcaaggaugac

SEQ ID NO: 333310 - RNA, 64 nt, hsa; identical to SEQ ID NO: 45399

SEQ ID NO: 333311 - RNA, 64 nt, hsa; identical to SEQ ID NO: 45400

SEQ ID NO: 333312 - RNA, 64 nt, hsa; identical to SEQ ID NO: 45401

SEQ ID NO: 333313 - RNA, 64 nt, hsa; identical to SEQ ID NO: 45402

SEQ ID NO: 333314 - RNA, 64 nt, hsa; identical to SEQ ID NO: 45403

SEQ ID NO: 333315 - RNA, 64 nt, hsa; identical to SEQ ID NO: 45404

SEQ ID NO: 333316 - RNA, 64 nt, hsa; identical to SEQ ID NO: 45405

SEQ ID NO: 333317 - RNA, 64 nt, hsa; identical to SEQ ID NO: 45406

SEQ ID NO: 333318 - RNA, 64 nt, hsa; identical to SEQ ID NO: 45407

SEQ ID NO: 333319 - RNA, 64 nt, hsa; identical to SEQ ID NO: 45408

SEQ ID NO: 333320 - RNA, 64 nt, hsa; identical to SEQ ID NO: 45409

SEQ ID NO: 333321 - RNA, 64 nt, hsa; identical to SEQ ID NO: 45410

SEQ ID NO: 333322 - RNA, 64 nt, hsa; identical to SEQ ID NO: 45411

SEQ ID NO: 333323 - RNA, 64 nt, hsa; identical to SEQ ID NO: 45412

SEQ ID NO: 333324 - RNA, 64 nt, hsa; identical to SEQ ID NO: 45413

SEQ ID NO: 333325 - RNA, 64 nt, hsa; identical to SEQ ID NO: 45414

SEQ ID NO: 333326 - RNA, 64 nt, hsa; identical to SEQ ID NO: 45415

SEQ ID NO: 333327 - RNA, 64 nt, hsa; identical to SEQ ID NO: 45416

SEQ ID NO: 333328 - RNA, 64 nt, hsa; identical to SEQ ID NO: 45417

SEQ ID NO: 333329 - RNA, 64 nt, hsa; identical to SEQ ID NO: 45418

SEQ ID NO: 333330 - RNA, 64 nt, hsa; identical to SEQ ID NO: 45419

SEQ ID NO: 333331 - RNA, 64 nt, hsa; identical to SEQ ID NO: 45420

SEQ ID NO: 333332 - RNA, 64 nt, hsa; identical to SEQ ID NO: 45421

SEQ ID NO: 333333 - RNA, 64 nt, hsa; identical to SEQ ID NO: 45422

SEQ ID NO: 333334 - RNA, 64 nt, hsa; identical to SEQ ID NO: 45423

SEQ ID NO: 333335 - RNA, 64 nt, hsa; identical to SEQ ID NO: 45424

SEQ ID NO: 333336 - RNA, 64 nt, hsa
uaaccacaaacugcaaaaagcuagguaagcuauuuuguugcagcucauaagguggugaaaagga

SEQ ID NO: 333337 - RNA, 64 nt, hsa
caaaggcccugcauucagaggucuuguaaucuacuuguugcaggagaaagaagguaaaaaauga

SEQ ID NO: 333338 - RNA, 64 nt, hsa
aucuuaaggagugugguaaauaugugcuccgcuuuuguugcaucacuaugugaaguacuguguu

SEQ ID NO: 333339 - RNA, 64 nt, hsa
gaaauacacuaaggagagguaguaaaugugaaccuuguugcaguguauaagguggaagccuaaa

SEQ ID NO: 333340 - RNA, 64 nt, hsa
uccaaacaacugaauguaaaacacuccuagccaguuguugcauucccuauauuuauuuacuucc

SEQ ID NO: 333341 - RNA, 64 nt, hsa
aaaccuaaggugcuuuucaaaagaguaacugaaauuguugcaggccaaaacagcaauaugauau

SEQ ID NO: 333342 - RNA, 64 nt, hsa
auuagugaucucuucuacuauguucuuuaccaaauuguugcaucugguucugaaaaaguauagc

SEQ ID NO: 333343 - RNA, 64 nt, hsa
aggaacaagugaacacgcaaaugacaugaaguauuuguugcagagcugaggaacagagcaaaug

SEQ ID NO: 333344 - RNA, 64 nt, hsa
agucucacagaaaacuuuugacuguauuuauuuauuguugcaaaaaagacgcuuuuuuauugcu

SEQ ID NO: 333345 - RNA, 64 nt, hsa
uauauaaauauauaugggcuuaaucauuuaaaauuuguugcagcaagaacuuuccuaccuguag

SEQ ID NO: 333346 - RNA, 64 nt, hsa
uauaaauacuacuaaggugaccuaguuguucuccuuguugcaauaauuaauaacucuuugcaaa

SEQ ID NO: 333347 - RNA, 64 nt, hsa
uuuuuguaaagacaaguuuauuccuuuacgcuucuuguugcauuaguucuccuguauguuccuu

SEQ ID NO: 333348 - RNA, 64 nt, hsa
caugagcaguccagagcuucagggcugggcagguccuggggaggcugagacugcagaggagcca

SEQ ID NO: 333349 - RNA, 64 nt, hsa
auuucugauauuugcuggagugcuggcuccacgcccuggggagugagcuuggugcgguaggugc

SEQ ID NO: 333350 - RNA, 64 nt, hsa
uccaggauggggaggggcucugcguuggcuucucccuggggacggggcuccccuggacagaggc

SEQ ID NO: 333351 - RNA, 64 nt, hsa
ugggguuugaccacccaccugaccaggggcccuaccuggggaaagccugaagggccucccagcc

SEQ ID NO: 333352 - RNA, 64 nt, hsa
acugaaguugggcucuaagaaugaggggaaagagccuggggaggagcuuaaaacucaaccacuc

SEQ ID NO: 333353 - RNA, 64 nt, hsa
ggaucuuuaccucugauagaggucagaaugagguccuggggagaaucuaagcccuccgaugugu

SEQ ID NO: 333354 - RNA, 64 nt, hsa
gauugggccugauuuuuuuggugggaaaggcugcccuggggaucaacuuuccuucugugugugg

SEQ ID NO: 333355 - RNA, 64 nt, hsa
cgauuccuaggaaggcuggcagacacccuggaacccuggggagcuacuggcaaacucuccugga

SEQ ID NO: 333356 - RNA, 64 nt, hsa
uuguugagagugggcgugggcuucuucacauaagccuggggaaggaagaaaaaacggcuuucau

SEQ ID NO: 333357 - RNA, 64 nt, hsa
gcccuguccucaaacuggucauaggcucuagucaccuggggagcuguagaaaacacuugcagag

SEQ ID NO: 333358 - RNA, 64 nt, hsa
uggacuuugaucuugccaucauuccccaguaaaaccuggggaguucugcguugaguggacggac

SEQ ID NO: 333359 - RNA, 64 nt, hsa
gcauauggcauguguucacuaagaggccuuuaauccuggggaguaaggggcgaaggcccuuaga

SEQ ID NO: 333360 - RNA, 64 nt, hsa
ugaggcuugggcccaguagccccaauaugguggcccuggggaagaggccuugggggucugcucu

SEQ ID NO: 333361 - RNA, 64 nt, hsa
ccagcccggcugaccaacauucaaaagcacaaacccuggggacucugcuuggcuguccccucca

SEQ ID NO: 333362 - RNA, 64 nt, hsa
uucugggacuacaggcaugaaauacugugccuggccuggggaccaggugcauuuuaagguuccu

SEQ ID NO: 333363 - RNA, 64 nt, hsa
uuaacgccuucauuuauagaugaggcagcugaggccuggggaugugaacaaccugcucacaguc

SEQ ID NO: 333364 - RNA, 64 nt, hsa
gugcacucucuuccuuggguguuuggugcuggcuccuggggacuacaaaucccagagugcggug

SEQ ID NO: 333365 - RNA, 64 nt, hsa
aacaucacagaugaacugccucuccuccucccugccuggggagcccaguggccagggaggggag

SEQ ID NO: 333366 - RNA, 64 nt, hsa
gggcagcccuguucccuucgccucuacugcgaggccuggggagauguuguuuucaugcugcuuc

SEQ ID NO: 333367 - RNA, 64 nt, hsa
ccagcacggcaccuguggggaugggcuccugcagccuggggaggagugugacgacgguaacagc

SEQ ID NO: 333368 - RNA, 64 nt, hsa
cagggcccacguggcgguccgcuggcaggcugguccuggggagcauucugcggacccggucacg

SEQ ID NO: 333369 - RNA, 64 nt, hsa
ggcaaagggccucgugcaguguguucagauugccccuggggaucuucugugucuucagcgccca

SEQ ID NO: 333370 - RNA, 64 nt, hsa
ggaggcugggcuuggccaggggcccgaauuuccgccuggggaguguuggauccacaucccggug

SEQ ID NO: 333371 - RNA, 64 nt, hsa
aggccgcggggagcacguggaaaguuggcugcugccuggggaagcuucuccuccccaaggcggc

SEQ ID NO: 333372 - RNA, 64 nt, hsa
ccacccaagagcugcacucuugugccacagcugcccuggggaaaccggggaaccccaacuggga

SEQ ID NO: 333373 - RNA, 64 nt, hsa
cagggccaggccugcccagcagccucugcucccuccuggggacccacagcagacgucugcaagc

SEQ ID NO: 333374 - RNA, 64 nt, hsa
ucgccagcagagguccauuccguucccagcugcuccuggggaggccgcuuccugguaggaggga

SEQ ID NO: 333375 - RNA, 64 nt, hsa
aggaggcugcaugccugaaggcugggccuucgacccuggggaugggccacagggcaccaaacac

SEQ ID NO: 333376 - RNA, 64 nt, hsa
caaaggguagagcuggguaauaaaugucuauucuccuggggaggagggauucuaaacuuuccuu

SEQ ID NO: 333377 - RNA, 64 nt, hsa
ccuuucacuccauuuggcaagcucugagggggagccuggggacggguuuggguccccaggagga

SEQ ID NO: 333378 - RNA, 64 nt, hsa
gcuucguggcuccuuuaggaugucaccucaccggccuggggaaggcggggggugcccaagccca

SEQ ID NO: 333379 - RNA, 64 nt, hsa
ucuggagucuaccugcggaugagccugcggcaguccuggggaaacuuuuccagagccuguuagc

SEQ ID NO: 333380 - RNA, 64 nt, hsa
ugcaccuggggagaagccggcgcuccugcucccuccuggggaggcugacggguguggccacccg

SEQ ID NO: 333381 - RNA, 64 nt, hsa
acacacccaggcggcccgcccuugccugucugcaccuggggagaagccggcgcuccugcucccu

SEQ ID NO: 333382 - RNA, 64 nt, hsa
gaaaccaagcguaucugcucuaaaaugacuuguuccuggggaaugccuucaaccaaaacacagc

SEQ ID NO: 333383 - RNA, 64 nt, hsa
ugggggaaaccuuauacccagaggaaaauacacaccuggggaguacauuugacaaauuucccuu

SEQ ID NO: 333384 - RNA, 64 nt, hsa
uacugggaaguccauuugcaagcugagcgccaggccuggggaggaagaggcuugggcugcagau

SEQ ID NO: 333385 - RNA, 64 nt, hsa
cgggagauuuccuccccucagucaacccccauaaccuggggauugggcaguguggaagaacgug

SEQ ID NO: 333386 - RNA, 64 nt, hsa
ggcuaaggccagcccuggacauuguccaggaaggccuggggaggaggagugaagucugugcaua

SEQ ID NO: 333387 - RNA, 64 nt, hsa
gaggcucacucaguaacguuguuuaauucucugcccuggggaaggaggauggauugagagaaug

SEQ ID NO: 333388 - RNA, 64 nt, hsa
uuucucgucccccucccugcccaaacuccccuucccuggggagcccucaggcuccccagaacug

SEQ ID NO: 333389 - RNA, 64 nt, hsa
gggagcccucaggcuccccagaacuggcugggccccuggggacagagccaccccaugagcucgg

SEQ ID NO: 333390 - RNA, 64 nt, hsa
aggugucuacugaccuggagugacuggaauagcaccuggggauaaaugugacaacugugcauug

SEQ ID NO: 333391 - RNA, 64 nt, hsa
ccccacagcccaguguucuccuugggggcaggaaccuggggaggggcccagagcaaagggcauc

SEQ ID NO: 333392 - RNA, 64 nt, hsa
gggcggggacccggacagccaggugacuaccaguccuggggacacacucaccauaaacacaucc

SEQ ID NO: 333393 - RNA, 64 nt, hsa
cacccggugauggagccccggggggacagucgugccuggggaggagcaggguacagcccauucc

SEQ ID NO: 333394 - RNA, 64 nt, hsa
caucuguuugccauguaccuggaugcgacgggccccuggggacaggcccuugccccauccaucc

SEQ ID NO: 333395 - RNA, 64 nt, hsa
uuguggggugugacauacaagugacugaacacuuccuggggagcuacaggggcacuuaacccac

SEQ ID NO: 333396 - RNA, 64 nt, hsa
cucgggcccaggcccuggcagagaaacagggaggccuggggagagcuacccgccagcuugggcu

SEQ ID NO: 333397 - RNA, 64 nt, hsa
aggagcgcagcaccaugucccugccccccgggcuccuggggaacagcuggggcgaaggagcacc

SEQ ID NO: 333398 - RNA, 64 nt, hsa
cagacuucacaccucauugcuuuacccccuggggccuggggaaaugucuguacuuugggaaguc

SEQ ID NO: 333399 - RNA, 64 nt, hsa
uugcuucucaucggacacuuguggagcgcaggggccuggggagcagcgcuaacccuggaggcag

SEQ ID NO: 333400 - RNA, 64 nt, hsa
accagaccaugggccaagagccgccguggcuauaccuggggacuugauguuccuuccagauugu

SEQ ID NO: 333401 - RNA, 64 nt, hsa
uccucgugggccguguggcacacaccguggccuaccuggggaagcugcgggcacccauccgcuc

SEQ ID NO: 333402 - RNA, 64 nt, hsa
ccuagagcuccugugaccgagagcgccacggaagccuggggaugacgucgggcagcuuuauucu

SEQ ID NO: 333403 - RNA, 64 nt, hsa
cacacauuuugguuugacgcccuguuuucaguggccuggggagguccacacuggaagucgaauu

SEQ ID NO: 333404 - RNA, 64 nt, hsa
cugcugccaagagccccucaagagaagggcugaaccuggggagaugucacugccagggugaggu

SEQ ID NO: 333405 - RNA, 64 nt, hsa
ugagcccaggcaccccagugcccgcugggcccagccuggggacagggaaccugccgggcucaca

SEQ ID NO: 333406 - RNA, 64 nt, hsa
gacaugggagagaugguguuuuuccucuccaccaccuggggauacgaugagaagauggccaccu

SEQ ID NO: 333407 - RNA, 64 nt, hsa
ugaguuaagaaaauucuuuaucauguuugccuucccuggggaaacauucaggcaguaaaaugac

SEQ ID NO: 333408 - RNA, 64 nt, hsa
acccucugcuucaccaaagcccgagcccucagccccuggggagaacaaauggcugagcuuugau

SEQ ID NO: 333409 - RNA, 64 nt, hsa
gguggggguggggguuguuaaggaugcuggggggccuggggaaggaaggaguucagaggaaggg

SEQ ID NO: 333410 - RNA, 64 nt, hsa
uugacaacacacaggaauggaauggacaggcucaccuggggauuugggggugggguggucagcu

SEQ ID NO: 333411 - RNA, 64 nt, hsa
uucuucugcaggaucuucuucccucccaggucucccuggggagguagaggcacgggauaagggg

SEQ ID NO: 333412 - RNA, 64 nt, hsa
ccucccacacaagcucgguggugacucuucggccccuggggaaaaacaaaaagauauugcugag

SEQ ID NO: 333413 - RNA, 64 nt, hsa
gacgaggccagugagggacggcguggcugugcuuccuggggaaaugaacccccuccccacagac

SEQ ID NO: 333414 - RNA, 64 nt, hsa
agcuggguuuucugucuaggucaccacucccaauccuggggauuggagaggccuggggcugugg

SEQ ID NO: 333415 - RNA, 64 nt, hsa
gcgggugcuggugggaggacagugccaaccuccuccuggggaucccauguuggagacucuaagg

SEQ ID NO: 333416 - RNA, 64 nt, hsa
ccaauaacugguucaguggcuggaguauuaggggccuggggauuggagaacggagaagaaguug

SEQ ID NO: 333417 - RNA, 64 nt, hsa
cacgagagggcugggacgguggaagaccaagacaccuggggauugcgucuggggccuccagaac

SEQ ID NO: 333418 - RNA, 64 nt, hsa
auucccgggcacaccuauggcuccuucgguaucaccuggggaagccccggaaucuuaguucuuc

SEQ ID NO: 333419 - RNA, 64 nt, hsa
gagcgcagagagguggguggucaggcccugauguccuggggauuucuuguccucagugccaccc

SEQ ID NO: 333420 - RNA, 64 nt, hsa
gcccuagcccucagcccaccuggggaguuuacuaccuggggaccccccuugcccaugccuccag

SEQ ID NO: 333421 - RNA, 64 nt, hsa
acccaccugaggcucagcccuagcccucagcccaccuggggaguuuacuaccuggggacccccc

SEQ ID NO: 333422 - RNA, 64 nt, hsa
ugaaagucagccugccccucucacgagaaaagaaccuggggauaccucucagccuccagcguug

SEQ ID NO: 333423 - RNA, 64 nt, hsa
uuggguguuaaugguggccuggguugugucuuccccuggggaugaggguuggguguccauggug

SEQ ID NO: 333424 - RNA, 64 nt, hsa
uuggguguccaagaugcccugggcuguguccuucccuggggaugaggguuggauguccaagaug

SEQ ID NO: 333425 - RNA, 64 nt, hsa
cuggguguccaagauacccugggcuguguccuccccuggggaugaggguuggguguccauggug

SEQ ID NO: 333426 - RNA, 64 nt, hsa
uuggguguccauggugcccugggcuguguccuccccuggggaugacgguuggguguccauggug

SEQ ID NO: 333427 - RNA, 64 nt, hsa
ggacuggcccagggaggaggaagccagcagcacaccuggggaauggggucccggccgggaggcu

SEQ ID NO: 333428 - RNA, 64 nt, hsa
ucaccuggcucuggagggcugcccugcagcugggccuggggacaggucggcuguggggcagcuc

SEQ ID NO: 333429 - RNA, 64 nt, hsa
ucugugauccuuggugcugugugccccacuccagccuggggaccccacuucagaagguaggggc

SEQ ID NO: 333430 - RNA, 64 nt, hsa
cuucacagcgucugcucauaggaccugcauccuuccuggggacgaauuccacucguccaaggga

SEQ ID NO: 333431 - RNA, 64 nt, hsa
acuugcugggcugaguccagcccuggggaagauuccuggggaauuuauuugcugcuucucccag

SEQ ID NO: 333432 - RNA, 64 nt, hsa
ggcaccccagucuacuugcugggcugaguccagcccuggggaagauuccuggggaauuuauuug

SEQ ID NO: 333433 - RNA, 64 nt, hsa
uguggguugauggagcgucccugaagcccccagcccuggggauggggaaggacauggagccuga

SEQ ID NO: 333434 - RNA, 64 nt, hsa
agagaaccagcucugaguccugaggagacacaggccuggggacaggaagggaugggggucccug

SEQ ID NO: 333435 - RNA, 64 nt, hsa
gcggcaccgcuccccugugacugcaucccgccucccuggggaccugccuguggcaggaaggaau

SEQ ID NO: 333436 - RNA, 64 nt, hsa
cugugcaaggccaacagggcaggggaggggaagaccuggggaaggaagaaugaggacagucccg

SEQ ID NO: 333437 - RNA, 64 nt, hsa
uccccugcggaagccuggccugcuggggaugucuccuggggacuuugccuacuggggaccucgg

SEQ ID NO: 333438 - RNA, 64 nt, hsa
ugccugggacggucaccuguugcagcuucaccugccuggggauucaccuaccuggguccucacu

SEQ ID NO: 333439 - RNA, 64 nt, hsa
agagaaccagcucugaguccugaggagacacaggccuggggacagggagggaugggagucccug

SEQ ID NO: 333440 - RNA, 64 nt, hsa
uguggguugauggagcguccccaaagcucccagcccuggggacggggaaggacauggagccuga

SEQ ID NO: 333441 - RNA, 64 nt, hsa
guccccuccccagggaaccacccccaguaaccauccuggggaguuuaaggucucucuccuuggu

SEQ ID NO: 333442 - RNA, 64 nt, hsa
acuccagcccauccuguuggugaccgucuauaucccuggggaaauuuccaccccaguccccucc

SEQ ID NO: 333443 - RNA, 64 nt, hsa
ucuccuagucuccgugugauggaggagggagaugccuggggaggggcuccuggaauccaggcca

SEQ ID NO: 333444 - RNA, 64 nt, hsa
agggauaaaccaucccuucuuggggcuuuaagucccuggggagcuuucccuguaggucuccugg

SEQ ID NO: 333445 - RNA, 64 nt, hsa
cagggccuuuaggggcugcaggacggaauggccgccuggggagccuguguggcugugccgggca

SEQ ID NO: 333446 - RNA, 64 nt, hsa
ggucuuucucuuugacccugcugaguguaagcugccuggggaggggcuacaaggaguaauugug

SEQ ID NO: 333447 - RNA, 64 nt, hsa
aacuuuugguucuuacuuugcugcucguuuagucccuggggauuucagaucuuaggcuguuguu

SEQ ID NO: 333448 - RNA, 64 nt, hsa
cagggccgagggggcucccagaaggaccccaggcccuggggaggguggcugugggaggccaagu

SEQ ID NO: 333449 - RNA, 64 nt, hsa
caagggccuguucugccccagcuguuccuccuccccuggggacagccccaccuccgggucccuc

SEQ ID NO: 333450 - RNA, 64 nt, hsa
ggaaacucgcuccuucuguuggcagaggacagccccuggggaaccccaggcccaacucuguccg

SEQ ID NO: 333451 - RNA, 64 nt, hsa
gagugcucuggaaagccaaagcagcucaucccuuccuggggaccacacugcucugcuccaccag

SEQ ID NO: 333452 - RNA, 64 nt, hsa
gggucucauuccaagaaggaagagggucaggagaccuggggagucucauauuccaaguucuucu

SEQ ID NO: 333453 - RNA, 64 nt, hsa
caguggcggggacagggccagauuucauguugacccuggggaugcugugaauuucuccugcagg

SEQ ID NO: 333454 - RNA, 64 nt, hsa
uggaaaaccugucccaguuuaucaggaacgcaggccuggggagcccccaguggcggggacaggg

SEQ ID NO: 333455 - RNA, 55 nt, hsa
auaagagacugagccgcuagcagcgccuggggaccagacagacgcauguggcaaa

SEQ ID NO: 333456 - RNA, 64 nt, hsa
uuugccuuuguggcccaugaaagucuuacugggcccuggggaagguauccuacccuggugaagc

SEQ ID NO: 333457 - RNA, 64 nt, hsa
aggaggccaguucugaaaggcgagcagaacucccccuggggaggaagcucaccaaaaguuuuuc

SEQ ID NO: 333458 - RNA, 64 nt, hsa
acugaaagcugccgaagcagccacuggaaagaacccuggggacccuaauguuggacucucggcg

SEQ ID NO: 333459 - RNA, 64 nt, hsa
guuggggggcaaggugggggagccuggagccccugugugggagggcgaggcgggggagccugga

SEQ ID NO: 333460 - RNA, 64 nt, hsa
gugggagggcgaggcgggggagccuggagccccugugugggagggcgaggcgggggauccugga

SEQ ID NO: 333461 - RNA, 64 nt, hsa
uugcuuuggggagaaaaguauucaggaagugggugugugggaaaccugaagauggcgugcacag

SEQ ID NO: 333462 - RNA, 64 nt, hsa
ggugcgccgcugugcugggagcugcagugguaaugugugggacaccuugaccaaaggggagcuu

SEQ ID NO: 333463 - RNA, 64 nt, hsa
cagggugugcucggugggcagugugggacugggggugugggaguuggugagagcaggaggagag

SEQ ID NO: 333464 - RNA, 64 nt, hsa
uuagggccuucucccagggugugcucggugggcagugugggacugggggugugggaguugguga

SEQ ID NO: 333465 - RNA, 64 nt, hsa
cgcccgccaccugcuccccgcaggaugugucugugugugggaauugguaucuugcacccguggg

SEQ ID NO: 333466 - RNA, 64 nt, hsa
ucugccuuagcaggggccugcgugagugggcacggugugggaggucgccugcgugggguggugu

SEQ ID NO: 333467 - RNA, 64 nt, hsa
cuggcucaagcaacuacucuggaugcacuuugcugugugggaugaacuaaaagugucugaauuu

SEQ ID NO: 333468 - RNA, 64 nt, hsa
aauucuggucauuucaagaggauggaggccucaagugugggaacuuccccuacucccuggaugu

SEQ ID NO: 333469 - RNA, 64 nt, hsa
gcucuucaguggcuccucugacaagaccaucaaggugugggacacauguaccaccuacaagugu

SEQ ID NO: 333470 - RNA, 64 nt, hsa
acucuacagcggcucugcagacugcaccaucauugugugggacauccagaaccugcagaaggug

SEQ ID NO: 333471 - RNA, 64 nt, hsa
cauugucuguggcaccuacgagaaccucauccacgugugggacauugaguccaaggagcaggug

SEQ ID NO: 333472 - RNA, 64 nt, hsa
ucuggucacuuggagaagggcauguguggggugugugugggauguggguuguguguauaucugg

SEQ ID NO: 333473 - RNA, 64 nt, hsa
ggugugugugggaugcguguguauaagggggugugugugggaugcguguguauaagggggugug

SEQ ID NO: 333474 - RNA, 64 nt, hsa
gugguguguguccuagucacuuggagaagggugugugugggaugcguguguauaagggggugug

SEQ ID NO: 333475 - RNA, 64 nt, hsa
gaacccuccaccccgcagaccaggcgucgugugugugugggagagaaggaggcccguguugagc

SEQ ID NO: 333476 - RNA, 64 nt, hsa
ggaugcacugacugaccgucuggggcucaggcuggugugggaugcagccggccgaugagaaaau

SEQ ID NO: 333477 - RNA, 64 nt, hsa
acacuggagagaagaaacucuaugaaugcaagcagugugggaaagcguuaucucauagcucaag

SEQ ID NO: 333478 - RNA, 64 nt, hsa
ugcagcauggagauggaccuuauaaauguaaguugugugggaaagcauuuuucuggcccaguuu

SEQ ID NO: 333479 - RNA, 64 nt, hsa
aggggaagugucgcuucagguguguccuacggacgugugggagguggcaggcgccagccuccga

SEQ ID NO: 333480 - RNA, 64 nt, hsa
ucuucuguuccaugggugcccagccagccaggccgugugggauccagcgagaggccagggcuug

SEQ ID NO: 333481 - RNA, 64 nt, hsa
cugcucucugcuggguuuucuauguucuuuucgagugugggaaaaggguuuuaguagaagggug

SEQ ID NO: 333482 - RNA, 64 nt, hsa
ccucgacccguacaguugagagccaggggcuggugugugggagcugcuaccuggcaguuucucg

SEQ ID NO: 333483 - RNA, 64 nt, hsa
cucaggguguggacggggcagcgggcaugggucugugugggagacgugggguggggcgguguga

SEQ ID NO: 333484 - RNA, 64 nt, hsa
auggacuccaacaagcaugugacugugagauugugugugggaaaauguauuuaacuacucugug

SEQ ID NO: 333485 - RNA, 64 nt, hsa
uuauugugccagggauggggaaaugggggggguugugugggaagaguacuuauuauuguguuuu

SEQ ID NO: 333486 - RNA, 64 nt, hsa; identical to SEQ ID NO: 102083

SEQ ID NO: 333487 - RNA, 64 nt, hsa; identical to SEQ ID NO: 102084

SEQ ID NO: 333488 - RNA, 64 nt, hsa
ucuuauuguugaucaaaggaggcaaaagaauuuagaggcaaaugacaagcgauaggcuauugca

SEQ ID NO: 333489 - RNA, 64 nt, hsa
augaagccaaauauccucuuauuguugaucaaaggaggcaaaagaauuuagaggcaaaugacaa

SEQ ID NO: 333490 - RNA, 64 nt, hsa
agccaagaagaauuuauuacaaaucagaacuuuggaggcaaaucuuucugcaugaccaaaguga

SEQ ID NO: 333491 - RNA, 54 nt, hsa
gcgggaaagacuacgugugacacagaggcaaaaggagaaaaucauguugaaaca

SEQ ID NO: 333492 - RNA, 64 nt, hsa
uacuuguuucuuaagacuauuucacaaguccugugaggcaaaaaaacaaaacaaaacaaaacaa

SEQ ID NO: 333493 - RNA, 64 nt, hsa
aguuucauccuauccgagggaugagauuaaggcagaggcaaaaguuucacacaaaguuucugca

SEQ ID NO: 333494 - RNA, 64 nt, hsa
gccuguuaggagaagcugcauccagaggcaaacggaggcaaagcuggcucaccuuccgcacgcg

SEQ ID NO: 333495 - RNA, 64 nt, hsa
agcaucaccugccuguuaggagaagcugcauccagaggcaaacggaggcaaagcuggcucaccu

SEQ ID NO: 333496 - RNA, 64 nt, hsa
uggggagagggggguaucaggcagggagggggcagaggcaaaucaccgggcagagggaggggag

SEQ ID NO: 333497 - RNA, 64 nt, hsa
gaggccuuuuggcaaacagugucuauuuuacagagaggcaaaccaagccuccuuagugcccugg

SEQ ID NO: 333498 - RNA, 64 nt, hsa
cugaugccaagaaagugaggauuuaggcaacaaggaggcaaaagcaaaucucagagaagucauc

SEQ ID NO: 333499 - RNA, 64 nt, hsa
aaccacccacaugcuuagccccagcuuuuuggaagaggcaaauggcuggucugaggaugacaca

SEQ ID NO: 333500 - RNA, 64 nt, hsa
ugugguaucuuuugccacauccagggcgaggguugaggcaaaccagcccucccucugacuuccu

SEQ ID NO: 333501 - RNA, 64 nt, hsa
agcagccuagacagaaccugcagcucuguggaaagaggcaaaguccugaaaaggcaaaggguug

SEQ ID NO: 333502 - RNA, 64 nt, hsa; identical to SEQ ID NO: 76468

SEQ ID NO: 333503 - RNA, 64 nt, hsa; identical to SEQ ID NO: 76469

SEQ ID NO: 333504 - RNA, 64 nt, hsa; identical to SEQ ID NO: 76470

SEQ ID NO: 333505 - RNA, 64 nt, hsa; identical to SEQ ID NO: 76471

SEQ ID NO: 333506 - RNA, 64 nt, hsa; identical to SEQ ID NO: 76472

SEQ ID NO: 333507 - RNA, 64 nt, hsa; identical to SEQ ID NO: 76473

SEQ ID NO: 333508 - RNA, 64 nt, hsa; identical to SEQ ID NO: 126039

SEQ ID NO: 333509 - RNA, 64 nt, hsa; identical to SEQ ID NO: 126040

SEQ ID NO: 333510 - RNA, 64 nt, hsa; identical to SEQ ID NO: 126041

SEQ ID NO: 333511 - RNA, 64 nt, hsa; identical to SEQ ID NO: 126042

SEQ ID NO: 333512 - RNA, 64 nt, hsa; identical to SEQ ID NO: 111844

SEQ ID NO: 333513 - RNA, 64 nt, hsa; identical to SEQ ID NO: 111845

SEQ ID NO: 333514 - RNA, 62 nt, hsa; identical to SEQ ID NO: 111846

SEQ ID NO: 333515 - RNA, 64 nt, hsa; identical to SEQ ID NO: 111847

SEQ ID NO: 333516 - RNA, 64 nt, hsa; identical to SEQ ID NO: 111848

SEQ ID NO: 333517 - RNA, 64 nt, hsa; identical to SEQ ID NO: 111849

SEQ ID NO: 333518 - RNA, 64 nt, hsa; identical to SEQ ID NO: 111850

SEQ ID NO: 333519 - RNA, 64 nt, hsa; identical to SEQ ID NO: 111851

SEQ ID NO: 333520 - RNA, 64 nt, hsa; identical to SEQ ID NO: 111852

SEQ ID NO: 333521 - RNA, 64 nt, hsa; identical to SEQ ID NO: 111853

SEQ ID NO: 333522 - RNA, 64 nt, hsa; identical to SEQ ID NO: 111854

SEQ ID NO: 333523 - RNA, 64 nt, hsa; identical to SEQ ID NO: 111855

SEQ ID NO: 333524 - RNA, 64 nt, hsa; identical to SEQ ID NO: 111856

SEQ ID NO: 333525 - RNA, 64 nt, hsa; identical to SEQ ID NO: 111857

SEQ ID NO: 333526 - RNA, 64 nt, hsa; identical to SEQ ID NO: 111858

SEQ ID NO: 333527 - RNA, 64 nt, hsa; identical to SEQ ID NO: 111859

SEQ ID NO: 333528 - RNA, 64 nt, hsa
aguaaauaguaaaaagguaauguugggacuuuuaaaccuugaauccauuagccaggcuugggau

SEQ ID NO: 333529 - RNA, 64 nt, hsa
guguguacauuuauaauguucuaaccaagucucaaaccuugaugaaaaacacaaaauuuuucca

SEQ ID NO: 333530 - RNA, 64 nt, hsa
uuugaaaguuuugaauauauccacauucuauugaaaccuugaaacuaaaaauuuagacucuuau

SEQ ID NO: 333531 - RNA, 64 nt, hsa
ggacagggacaguuaaauugggagccuuucuuacaaccuugaugggauuuuuccccccaaguuu

SEQ ID NO: 333532 - RNA, 64 nt, hsa
cuggccucccacaacuccccuucuggcugccuguaaccuugaggggcauucaggaggccagcgu

SEQ ID NO: 333533 - RNA, 64 nt, hsa
agcccaggccaagcacagggucuggcucguggcaaaccuugaauaaauauuuguuggcugaaug

SEQ ID NO: 333534 - RNA, 64 nt, hsa
guggcauaaugcagucugaguccaaaggccagguaaccuugaguucugacguccacgggcagga

SEQ ID NO: 333535 - RNA, 64 nt, hsa
auugaucuuuugacugugccaccuuuuucaaggaaaccuugacuuauaccuagcugucauauga

SEQ ID NO: 333536 - RNA, 64 nt, hsa
cuucccaaaucauuuugugaggccaggauuacccuaauaccaaagccaggcaaaaacauuacaa

SEQ ID NO: 333537 - RNA, 64 nt, hsa
gcuagauuaagaaaaaacagaagacaaauacugcuaauaccaaaagugaaagaggccaucauag

SEQ ID NO: 333538 - RNA, 64 nt, hsa
uaguuauucuacauuuucuugaaauuugggagguuaauaccaaguauucauuucaugauguaaa

SEQ ID NO: 333539 - RNA, 64 nt, hsa; identical to SEQ ID NO: 333538

SEQ ID NO: 333540 - RNA, 64 nt, hsa
gccccccacucugccgugcucacacagacacacccagcugcacacaugaggcaucccacaugac

SEQ ID NO: 333541 - RNA, 64 nt, hsa
ugauggggcugggcugagccagggaggaaggacccagcugcaccuaggagacaccuuuguucuu

SEQ ID NO: 333542 - RNA, 64 nt, hsa
ucugcguagcccacagagggcccaggccccugcccagcugcagucucccagccuccacuuucag

SEQ ID NO: 333543 - RNA, 64 nt, hsa
uacccaguuuguguguuugagcucugcauucaggcagcugcaacauuccaguguuugaacuguc

SEQ ID NO: 333544 - RNA, 64 nt, hsa
ucacugucacagcagagucaccuuagaaauuggacagcugcauguucugugcucuccaguuugu

SEQ ID NO: 333545 - RNA, 64 nt, hsa
gccguuggcacaccagcucagacaggggccugcgcagcugcaggggacagacgccaaucacugu

SEQ ID NO: 333546 - RNA, 54 nt, hsa
aaggcuccucccagggcugagggccagcugcagggcugcagcgcugugggggua

SEQ ID NO: 333547 - RNA, 64 nt, hsa
aaggaagacaggaacuaaaccuccaggucagcugcagcugcaaaaugacuacagccugaagggc

SEQ ID NO: 333548 - RNA, 60 nt, hsa
ccaaggaagacaggaacuaaaccuccaggucagcugcagcugcaaaaugacuacagccug

SEQ ID NO: 333549 - RNA, 64 nt, hsa
aguggggucgccguaccaggggcccuggcagggucagcugcaagaacaucaaaccagagugccc

SEQ ID NO: 333550 - RNA, 64 nt, hsa
gccucgguugucucugcggcuccuuagggcagaacagcugcauguggcacuugugacacucacu

SEQ ID NO: 333551 - RNA, 64 nt, hsa
gaacugaaucagccuggaauggcugcugagagcucagcugcaaguugcugguccaucuggggcc

SEQ ID NO: 333552 - RNA, 64 nt, hsa
aggguuagaggguggggaggugagagcaaaggcccagcugcagcccucagcuagaguccaagac

SEQ ID NO: 333553 - RNA, 64 nt, hsa
ucaggaauggugucccaaguuggaggcuuugugucagcugcaaauccuaccaguuauguccaag

SEQ ID NO: 333554 - RNA, 64 nt, hsa
gccucugcuuccagcuuuguguaauucucuuugccagcugcacaaagcugauuuuuuccaaagu

SEQ ID NO: 333555 - RNA, 64 nt, hsa
cccacagggcgggugggucagcguugacucuuuccagcugcacacucauaugccgugugucuua

SEQ ID NO: 333556 - RNA, 64 nt, hsa
ccggcccacucagcggcccacauuggccagcauucagcugcacgugugugcugcgugcuucaca

SEQ ID NO: 333557 - RNA, 64 nt, hsa
acugagccacuaccugggcaucagucuggaucugcagcugcaguuggagcagcuccgagggagg

SEQ ID NO: 333558 - RNA, 64 nt, hsa
gugcuguggacuggacccaggagccccggcggcgcagcugcaagguugccaggacccacccuca

SEQ ID NO: 333559 - RNA, 64 nt, hsa
acugcugcccaacaugagcagugaucuccaaggccagcugcagggccugcucguacacuugcuc

SEQ ID NO: 333560 - RNA, 64 nt, hsa
cucuccacucgacacagccugcgguuugcagugccagcugcacguuggagucuccugggaagcu

SEQ ID NO: 333561 - RNA, 64 nt, hsa
aggacggccggcugccccgcaccaucccucuccccagcugcaaacugagugugccggacccuga

SEQ ID NO: 333562 - RNA, 64 nt, hsa
cccucuccugccacacagacccgcuggaccaaagcagcugcagccgccuccucguuccucuccu

SEQ ID NO: 333563 - RNA, 64 nt, hsa
gggaggacgggacccugagccugugugugucgggcagcugcaggguaggcguguguggacauug

SEQ ID NO: 333564 - RNA, 64 nt, hsa
gagcuaaucuguggccagggugcuggcaugguggcagcugcaaauguccaugcacccagguggc

SEQ ID NO: 333565 - RNA, 64 nt, hsa
cuccuccccuuagugaccccaagucuguuucccucagcugcauaaggaggcgauauaguuugaa

SEQ ID NO: 333566 - RNA, 64 nt, hsa
gcugggccugccuggggaaagguggaaggagaaacagcugcaggaggggggagcugaaaggaau

SEQ ID NO: 333567 - RNA, 64 nt, hsa
cucugccuccuaaugcuagguuucuagagucuuccagcugcaucuucaugccggcagcauuuug

SEQ ID NO: 333568 - RNA, 64 nt, hsa
uggggucuaccucagagcucucccugucaaaaagcagcugcaagccucgcaaggguggaguggg

SEQ ID NO: 333569 - RNA, 64 nt, hsa
accuucaaaagugugagcccugcuucgggcugagcagcugcagggagcccccuuucugaugaug

SEQ ID NO: 333570 - RNA, 64 nt, hsa
ugaguccuugcuucccucagaaauaaaaggagcucagcugcagcguugcauugggcuucuuggc

SEQ ID NO: 333571 - RNA, 64 nt, hsa
guguggucaagagccgucugagccuaaugagucccagcugcauuagguuaagagacucuuccag

SEQ ID NO: 333572 - RNA, 64 nt, hsa
cgaggccacgcaccagcggaagcuccggcagaagcagcugcagcagcaguuccgggagcggaug

SEQ ID NO: 333573 - RNA, 64 nt, hsa
cagcugccgaccgaacauggcccugggacacccacagcugcagcaggugaccuccccuuccaga

SEQ ID NO: 333574 - RNA, 64 nt, hsa
gaggcagaggguggggcugcacagaggggaacaucagcugcagcucugcaccaggccggucccu

SEQ ID NO: 333575 - RNA, 64 nt, hsa
cugcuuugggaggauuucucaggcuaugccauggcagcugcagaggcccagggagagguaaccu

SEQ ID NO: 333576 - RNA, 64 nt, hsa
ugucaggugggaagaggaguacacggugcggauccagcugcaagaccguguaaaugagcuccag

SEQ ID NO: 333577 - RNA, 64 nt, hsa
auucacauugaccgcaacucacacauucccccaccagcugcagccccuugcucucagcugccaa

SEQ ID NO: 333578 - RNA, 64 nt, hsa
aagaaugaacccaagagcaagggcuugauggugacagcugcaagccagggaugaagaaagacuc

SEQ ID NO: 333579 - RNA, 64 nt, hsa
ccccucacugaagaagcagauugccaagugccagcagcugcagcaagaauacagccgcaaggag

SEQ ID NO: 333580 - RNA, 64 nt, hsa
gcuggaggaucugauuggcaagcuuaccagucuucagcugcaacaccuguuuaugauccuggcc

SEQ ID NO: 333581 - RNA, 64 nt, hsa
ucuagaaauucuacugcacugccuggcucagcugcagcugcagacauuucugcaggaggagcag

SEQ ID NO: 333582 - RNA, 64 nt, hsa
agucuuucuagaaauucuacugcacugccuggcucagcugcagcugcagacauuucugcaggag

SEQ ID NO: 333583 - RNA, 64 nt, hsa
cugggcugcucugcacccacgggagaggcuggcccagcugcagacugcuuagggacuucugugu

SEQ ID NO: 333584 - RNA, 64 nt, hsa
accucagugccugagacuuuucuaccaagccacacagcugcagcaacugcagauacugcgggcu

SEQ ID NO: 333585 - RNA, 64 nt, hsa
augaggucaccuuccgaaagccuaccuucugcgacagcugcaguggcuucgugagcaccccacc

SEQ ID NO: 333586 - RNA, 64 nt, hsa
cuggacaaguucauucacguggcacaggcuccaccagcugcagaauuucaacacgcugauggca

SEQ ID NO: 333587 - RNA, 64 nt, hsa
cgacaugaaguguaccuuuucuaaagacgguuuccagcugcaacggcuccacuuugcaggcuug

SEQ ID NO: 333588 - RNA, 64 nt, hsa
gaacgugcuucuuauuccuggcaggcuucaagaacagcugcacaugugccgcuaacugaccgcg

SEQ ID NO: 333589 - RNA, 64 nt, hsa
cccuccccugcuagucaccuaccaggugucugagcagcugcaugcucccuggcucaagugggca

SEQ ID NO: 333590 - RNA, 64 nt, hsa
uuaaagaugagaaaagccaccccaucuggcaccacagcugcaucuugcuugugagaaaugggga

SEQ ID NO: 333591 - RNA, 64 nt, hsa; identical to SEQ ID NO: 275773

SEQ ID NO: 333592 - RNA, 64 nt, hsa; identical to SEQ ID NO: 275774

SEQ ID NO: 333593 - RNA, 64 nt, hsa
cauucaagauuaauauuugauucucuaucucuuaacuguagauuuuauuggccuguuuuuuuuu

SEQ ID NO: 333594 - RNA, 64 nt, hsa
uaucugggcggugaggguauugauuuacauaaaaacuguagacaaacacaguacgagucucagc

SEQ ID NO: 333595 - RNA, 64 nt, hsa
acuaaaucauugagauagaaaaagauucccauugacuguagacuucuucccauuuugucuuccc

SEQ ID NO: 333596 - RNA, 64 nt, hsa
uuaguguuacagagaagcagccgauagcaaaucgacuguagagacuuggcggcgguggcauugc

SEQ ID NO: 333597 - RNA, 64 nt, hsa
uuuccuguuugaaggcuuacuguagaaguggcuuacuguagaagcagcuugcugagccccuccg

SEQ ID NO: 333598 - RNA, 64 nt, hsa
uucauuuuaugcuuuauuuccuguuugaaggcuuacuguagaaguggcuuacuguagaagcagc

SEQ ID NO: 333599 - RNA, 64 nt, hsa
uagauauggcauguacuuuacacuauuuauaaugacuguagauacuugaauguucuacuugcua

SEQ ID NO: 333600 - RNA, 64 nt, hsa
agaacucauuuucccauguuuauacucuucccacacuguagauauggcauguacuuuacacuau

SEQ ID NO: 333601 - RNA, 64 nt, hsa
cuuagaguuucggguguuuuucuccagucuuguuacuguagacuguagaaagcacgggccccag

SEQ ID NO: 333602 - RNA, 64 nt, hsa
uuucggguguuuuucuccagucuuguuacuguagacuguagaaagcacgggccccaggcucuga

SEQ ID NO: 333603 - RNA, 64 nt, hsa
gccccgccugcaggcgguguagauacauguagauacuguagauacuguagauaccgccccggcg

SEQ ID NO: 333604 - RNA, 64 nt, hsa
gcaggcgguguagauacauguagauacuguagauacuguagauaccgccccggcgccgacuuga

SEQ ID NO: 333605 - RNA, 64 nt, hsa; identical to SEQ ID NO: 245412

SEQ ID NO: 333606 - RNA, 64 nt, hsa; identical to SEQ ID NO: 245413

SEQ ID NO: 333607 - RNA, 64 nt, hsa; identical to SEQ ID NO: 245414

SEQ ID NO: 333608 - RNA, 64 nt, hsa; identical to SEQ ID NO: 245415

SEQ ID NO: 333609 - RNA, 64 nt, hsa; identical to SEQ ID NO: 245416

SEQ ID NO: 333610 - RNA, 64 nt, hsa; identical to SEQ ID NO: 245417

SEQ ID NO: 333611 - RNA, 64 nt, hsa; identical to SEQ ID NO: 245418

SEQ ID NO: 333612 - RNA, 64 nt, hsa; identical to SEQ ID NO: 245419

SEQ ID NO: 333613 - RNA, 64 nt, hsa; identical to SEQ ID NO: 245420

SEQ ID NO: 333614 - RNA, 64 nt, hsa; identical to SEQ ID NO: 245421

SEQ ID NO: 333615 - RNA, 64 nt, hsa; identical to SEQ ID NO: 245422

SEQ ID NO: 333616 - RNA, 64 nt, hsa; identical to SEQ ID NO: 245423

SEQ ID NO: 333617 - RNA, 64 nt, hsa; identical to SEQ ID NO: 245424

SEQ ID NO: 333618 - RNA, 50 nt, hsa; identical to SEQ ID NO: 245425

SEQ ID NO: 333619 - RNA, 64 nt, hsa; identical to SEQ ID NO: 245426

SEQ ID NO: 333620 - RNA, 64 nt, hsa; identical to SEQ ID NO: 245427

SEQ ID NO: 333621 - RNA, 64 nt, hsa; identical to SEQ ID NO: 245428

SEQ ID NO: 333622 - RNA, 64 nt, hsa; identical to SEQ ID NO: 245429

SEQ ID NO: 333623 - RNA, 64 nt, hsa; identical to SEQ ID NO: 245430

SEQ ID NO: 333624 - RNA, 64 nt, hsa; identical to SEQ ID NO: 245431

SEQ ID NO: 333625 - RNA, 64 nt, hsa; identical to SEQ ID NO: 245432

SEQ ID NO: 333626 - RNA, 64 nt, hsa; identical to SEQ ID NO: 245433

SEQ ID NO: 333627 - RNA, 64 nt, hsa; identical to SEQ ID NO: 245434

SEQ ID NO: 333628 - RNA, 64 nt, hsa; identical to SEQ ID NO: 245435

SEQ ID NO: 333629 - RNA, 64 nt, hsa; identical to SEQ ID NO: 245436

SEQ ID NO: 333630 - RNA, 64 nt, hsa; identical to SEQ ID NO: 245437

SEQ ID NO: 333631 - RNA, 64 nt, hsa; identical to SEQ ID NO: 245438

SEQ ID NO: 333632 - RNA, 64 nt, hsa; identical to SEQ ID NO: 245439

SEQ ID NO: 333633 - RNA, 64 nt, hsa; identical to SEQ ID NO: 245440

SEQ ID NO: 333634 - RNA, 53 nt, hsa; identical to SEQ ID NO: 245441

SEQ ID NO: 333635 - RNA, 64 nt, hsa; identical to SEQ ID NO: 245442

SEQ ID NO: 333636 - RNA, 64 nt, hsa; identical to SEQ ID NO: 245443

SEQ ID NO: 333637 - RNA, 64 nt, hsa; identical to SEQ ID NO: 245444

SEQ ID NO: 333638 - RNA, 64 nt, hsa; identical to SEQ ID NO: 245445

SEQ ID NO: 333639 - RNA, 64 nt, hsa; identical to SEQ ID NO: 245446

SEQ ID NO: 333640 - RNA, 64 nt, hsa; identical to SEQ ID NO: 245447

SEQ ID NO: 333641 - RNA, 64 nt, hsa; identical to SEQ ID NO: 245448

SEQ ID NO: 333642 - RNA, 64 nt, hsa; identical to SEQ ID NO: 245449

SEQ ID NO: 333643 - RNA, 64 nt, hsa; identical to SEQ ID NO: 245450

SEQ ID NO: 333644 - RNA, 64 nt, hsa; identical to SEQ ID NO: 245451

SEQ ID NO: 333645 - RNA, 64 nt, hsa; identical to SEQ ID NO: 245452

SEQ ID NO: 333646 - RNA, 64 nt, hsa; identical to SEQ ID NO: 245453

SEQ ID NO: 333647 - RNA, 64 nt, hsa; identical to SEQ ID NO: 245454

SEQ ID NO: 333648 - RNA, 64 nt, hsa; identical to SEQ ID NO: 245455

SEQ ID NO: 333649 - RNA, 64 nt, hsa; identical to SEQ ID NO: 245456

SEQ ID NO: 333650 - RNA, 64 nt, hsa; identical to SEQ ID NO: 245457

SEQ ID NO: 333651 - RNA, 64 nt, hsa; identical to SEQ ID NO: 245458

SEQ ID NO: 333652 - RNA, 64 nt, hsa; identical to SEQ ID NO: 245459

SEQ ID NO: 333653 - RNA, 64 nt, hsa; identical to SEQ ID NO: 245460

SEQ ID NO: 333654 - RNA, 64 nt, hsa; identical to SEQ ID NO: 245461

SEQ ID NO: 333655 - RNA, 64 nt, hsa; identical to SEQ ID NO: 245462

SEQ ID NO: 333656 - RNA, 64 nt, hsa; identical to SEQ ID NO: 245463

SEQ ID NO: 333657 - RNA, 64 nt, hsa; identical to SEQ ID NO: 245464

SEQ ID NO: 333658 - RNA, 64 nt, hsa; identical to SEQ ID NO: 245465

SEQ ID NO: 333659 - RNA, 64 nt, hsa; identical to SEQ ID NO: 245466

SEQ ID NO: 333660 - RNA, 64 nt, hsa; identical to SEQ ID NO: 245467

SEQ ID NO: 333661 - RNA, 64 nt, hsa; identical to SEQ ID NO: 245468

SEQ ID NO: 333662 - RNA, 64 nt, hsa; identical to SEQ ID NO: 245469

SEQ ID NO: 333663 - RNA, 64 nt, hsa; identical to SEQ ID NO: 245470

SEQ ID NO: 333664 - RNA, 64 nt, hsa; identical to SEQ ID NO: 245471

SEQ ID NO: 333665 - RNA, 64 nt, hsa; identical to SEQ ID NO: 245472

SEQ ID NO: 333666 - RNA, 64 nt, hsa; identical to SEQ ID NO: 245473

SEQ ID NO: 333667 - RNA, 64 nt, hsa; identical to SEQ ID NO: 245474

SEQ ID NO: 333668 - RNA, 64 nt, hsa; identical to SEQ ID NO: 245475

SEQ ID NO: 333669 - RNA, 64 nt, hsa; identical to SEQ ID NO: 245476

SEQ ID NO: 333670 - RNA, 64 nt, hsa; identical to SEQ ID NO: 245477

SEQ ID NO: 333671 - RNA, 64 nt, hsa; identical to SEQ ID NO: 245478

SEQ ID NO: 333672 - RNA, 64 nt, hsa; identical to SEQ ID NO: 245479

SEQ ID NO: 333673 - RNA, 64 nt, hsa; identical to SEQ ID NO: 245480

SEQ ID NO: 333674 - RNA, 64 nt, hsa; identical to SEQ ID NO: 245481

SEQ ID NO: 333675 - RNA, 64 nt, hsa; identical to SEQ ID NO: 245482

SEQ ID NO: 333676 - RNA, 64 nt, hsa; identical to SEQ ID NO: 245483

SEQ ID NO: 333677 - RNA, 64 nt, hsa; identical to SEQ ID NO: 245484

SEQ ID NO: 333678 - RNA, 64 nt, hsa; identical to SEQ ID NO: 245485

SEQ ID NO: 333679 - RNA, 64 nt, hsa; identical to SEQ ID NO: 245486

SEQ ID NO: 333680 - RNA, 64 nt, hsa; identical to SEQ ID NO: 245487

SEQ ID NO: 333681 - RNA, 64 nt, hsa; identical to SEQ ID NO: 245488

SEQ ID NO: 333682 - RNA, 64 nt, hsa; identical to SEQ ID NO: 245489

SEQ ID NO: 333683 - RNA, 64 nt, hsa; identical to SEQ ID NO: 245490

SEQ ID NO: 333684 - RNA, 64 nt, hsa; identical to SEQ ID NO: 245491

SEQ ID NO: 333685 - RNA, 64 nt, hsa; identical to SEQ ID NO: 245492

SEQ ID NO: 333686 - RNA, 64 nt, hsa; identical to SEQ ID NO: 245493

SEQ ID NO: 333687 - RNA, 64 nt, hsa; identical to SEQ ID NO: 245494

SEQ ID NO: 333688 - RNA, 64 nt, hsa; identical to SEQ ID NO: 245495

SEQ ID NO: 333689 - RNA, 64 nt, hsa; identical to SEQ ID NO: 245496

SEQ ID NO: 333690 - RNA, 64 nt, hsa; identical to SEQ ID NO: 245497

SEQ ID NO: 333691 - RNA, 64 nt, hsa; identical to SEQ ID NO: 245498

SEQ ID NO: 333692 - RNA, 64 nt, hsa; identical to SEQ ID NO: 245499

SEQ ID NO: 333693 - RNA, 64 nt, hsa; identical to SEQ ID NO: 245500

SEQ ID NO: 333694 - RNA, 64 nt, hsa; identical to SEQ ID NO: 245501

SEQ ID NO: 333695 - RNA, 64 nt, hsa; identical to SEQ ID NO: 245502

SEQ ID NO: 333696 - RNA, 64 nt, hsa; identical to SEQ ID NO: 245503

SEQ ID NO: 333697 - RNA, 64 nt, hsa; identical to SEQ ID NO: 245504

SEQ ID NO: 333698 - RNA, 64 nt, hsa; identical to SEQ ID NO: 245505

SEQ ID NO: 333699 - RNA, 64 nt, hsa; identical to SEQ ID NO: 245506

SEQ ID NO: 333700 - RNA, 64 nt, hsa; identical to SEQ ID NO: 245507

SEQ ID NO: 333701 - RNA, 64 nt, hsa; identical to SEQ ID NO: 245508

SEQ ID NO: 333702 - RNA, 64 nt, hsa; identical to SEQ ID NO: 245509

SEQ ID NO: 333703 - RNA, 64 nt, hsa; identical to SEQ ID NO: 245510

SEQ ID NO: 333704 - RNA, 64 nt, hsa; identical to SEQ ID NO: 245511

SEQ ID NO: 333705 - RNA, 64 nt, hsa; identical to SEQ ID NO: 245512

SEQ ID NO: 333706 - RNA, 64 nt, hsa; identical to SEQ ID NO: 245513

SEQ ID NO: 333707 - RNA, 64 nt, hsa; identical to SEQ ID NO: 245514

SEQ ID NO: 333708 - RNA, 64 nt, hsa; identical to SEQ ID NO: 245515

SEQ ID NO: 333709 - RNA, 64 nt, hsa; identical to SEQ ID NO: 245516

SEQ ID NO: 333710 - RNA, 64 nt, hsa; identical to SEQ ID NO: 245517

SEQ ID NO: 333711 - RNA, 64 nt, hsa; identical to SEQ ID NO: 245518

SEQ ID NO: 333712 - RNA, 64 nt, hsa; identical to SEQ ID NO: 245519

SEQ ID NO: 333713 - RNA, 64 nt, hsa; identical to SEQ ID NO: 245520

SEQ ID NO: 333714 - RNA, 64 nt, hsa; identical to SEQ ID NO: 245521

SEQ ID NO: 333715 - RNA, 64 nt, hsa; identical to SEQ ID NO: 245522

SEQ ID NO: 333716 - RNA, 64 nt, hsa; identical to SEQ ID NO: 245523

SEQ ID NO: 333717 - RNA, 64 nt, hsa; identical to SEQ ID NO: 245524

SEQ ID NO: 333718 - RNA, 64 nt, hsa; identical to SEQ ID NO: 245525

SEQ ID NO: 333719 - RNA, 64 nt, hsa; identical to SEQ ID NO: 245526

SEQ ID NO: 333720 - RNA, 64 nt, hsa; identical to SEQ ID NO: 245527

SEQ ID NO: 333721 - RNA, 64 nt, hsa; identical to SEQ ID NO: 245528

SEQ ID NO: 333722 - RNA, 64 nt, hsa; identical to SEQ ID NO: 245529

SEQ ID NO: 333723 - RNA, 64 nt, hsa; identical to SEQ ID NO: 245530

SEQ ID NO: 333724 - RNA, 64 nt, hsa; identical to SEQ ID NO: 245531

SEQ ID NO: 333725 - RNA, 64 nt, hsa; identical to SEQ ID NO: 245532

SEQ ID NO: 333726 - RNA, 64 nt, hsa; identical to SEQ ID NO: 245533

SEQ ID NO: 333727 - RNA, 64 nt, hsa; identical to SEQ ID NO: 245534

SEQ ID NO: 333728 - RNA, 64 nt, hsa; identical to SEQ ID NO: 245535

SEQ ID NO: 333729 - RNA, 64 nt, hsa; identical to SEQ ID NO: 245536

SEQ ID NO: 333730 - RNA, 64 nt, hsa; identical to SEQ ID NO: 245537

SEQ ID NO: 333731 - RNA, 64 nt, hsa; identical to SEQ ID NO: 245538

SEQ ID NO: 333732 - RNA, 64 nt, hsa; identical to SEQ ID NO: 245539

SEQ ID NO: 333733 - RNA, 64 nt, hsa; identical to SEQ ID NO: 245540

SEQ ID NO: 333734 - RNA, 64 nt, hsa; identical to SEQ ID NO: 245541

SEQ ID NO: 333735 - RNA, 64 nt, hsa; identical to SEQ ID NO: 245542

SEQ ID NO: 333736 - RNA, 64 nt, hsa; identical to SEQ ID NO: 245543

SEQ ID NO: 333737 - RNA, 64 nt, hsa; identical to SEQ ID NO: 245544

SEQ ID NO: 333738 - RNA, 64 nt, hsa; identical to SEQ ID NO: 245545

SEQ ID NO: 333739 - RNA, 64 nt, hsa; identical to SEQ ID NO: 245546

SEQ ID NO: 333740 - RNA, 64 nt, hsa; identical to SEQ ID NO: 245547

SEQ ID NO: 333741 - RNA, 64 nt, hsa; identical to SEQ ID NO: 245548

SEQ ID NO: 333742 - RNA, 64 nt, hsa; identical to SEQ ID NO: 245549

SEQ ID NO: 333743 - RNA, 64 nt, hsa; identical to SEQ ID NO: 245550

SEQ ID NO: 333744 - RNA, 64 nt, hsa; identical to SEQ ID NO: 245551

SEQ ID NO: 333745 - RNA, 64 nt, hsa; identical to SEQ ID NO: 245552

SEQ ID NO: 333746 - RNA, 64 nt, hsa; identical to SEQ ID NO: 245553

SEQ ID NO: 333747 - RNA, 64 nt, hsa; identical to SEQ ID NO: 245554

SEQ ID NO: 333748 - RNA, 64 nt, hsa; identical to SEQ ID NO: 245555

SEQ ID NO: 333749 - RNA, 64 nt, hsa; identical to SEQ ID NO: 245556

SEQ ID NO: 333750 - RNA, 64 nt, hsa; identical to SEQ ID NO: 245557

SEQ ID NO: 333751 - RNA, 64 nt, hsa; identical to SEQ ID NO: 245558

SEQ ID NO: 333752 - RNA, 64 nt, hsa; identical to SEQ ID NO: 245559

SEQ ID NO: 333753 - RNA, 64 nt, hsa; identical to SEQ ID NO: 245560

SEQ ID NO: 333754 - RNA, 64 nt, hsa; identical to SEQ ID NO: 245561

SEQ ID NO: 333755 - RNA, 64 nt, hsa; identical to SEQ ID NO: 245562

SEQ ID NO: 333756 - RNA, 64 nt, hsa; identical to SEQ ID NO: 245563

SEQ ID NO: 333757 - RNA, 64 nt, hsa; identical to SEQ ID NO: 245564

SEQ ID NO: 333758 - RNA, 64 nt, hsa; identical to SEQ ID NO: 245565

SEQ ID NO: 333759 - RNA, 64 nt, hsa; identical to SEQ ID NO: 245566

SEQ ID NO: 333760 - RNA, 64 nt, hsa; identical to SEQ ID NO: 245567

SEQ ID NO: 333761 - RNA, 64 nt, hsa; identical to SEQ ID NO: 245568

SEQ ID NO: 333762 - RNA, 64 nt, hsa; identical to SEQ ID NO: 245569

SEQ ID NO: 333763 - RNA, 64 nt, hsa; identical to SEQ ID NO: 245570

SEQ ID NO: 333764 - RNA, 64 nt, hsa; identical to SEQ ID NO: 245571

SEQ ID NO: 333765 - RNA, 64 nt, hsa; identical to SEQ ID NO: 245572

SEQ ID NO: 333766 - RNA, 64 nt, hsa; identical to SEQ ID NO: 245573

SEQ ID NO: 333767 - RNA, 64 nt, hsa; identical to SEQ ID NO: 245574

SEQ ID NO: 333768 - RNA, 64 nt, hsa; identical to SEQ ID NO: 245575

SEQ ID NO: 333769 - RNA, 64 nt, hsa; identical to SEQ ID NO: 245576

SEQ ID NO: 333770 - RNA, 64 nt, hsa; identical to SEQ ID NO: 245577

SEQ ID NO: 333771 - RNA, 64 nt, hsa; identical to SEQ ID NO: 245578

SEQ ID NO: 333772 - RNA, 50 nt, hsa; identical to SEQ ID NO: 245579

SEQ ID NO: 333773 - RNA, 64 nt, hsa; identical to SEQ ID NO: 245580

SEQ ID NO: 333774 - RNA, 64 nt, hsa; identical to SEQ ID NO: 245581

SEQ ID NO: 333775 - RNA, 64 nt, hsa; identical to SEQ ID NO: 245582

SEQ ID NO: 333776 - RNA, 64 nt, hsa; identical to SEQ ID NO: 245583

SEQ ID NO: 333777 - RNA, 64 nt, hsa; identical to SEQ ID NO: 245584

SEQ ID NO: 333778 - RNA, 64 nt, hsa; identical to SEQ ID NO: 245585

SEQ ID NO: 333779 - RNA, 64 nt, hsa; identical to SEQ ID NO: 245586

SEQ ID NO: 333780 - RNA, 64 nt, hsa; identical to SEQ ID NO: 245587

SEQ ID NO: 333781 - RNA, 64 nt, hsa; identical to SEQ ID NO: 245588

SEQ ID NO: 333782 - RNA, 64 nt, hsa; identical to SEQ ID NO: 245589

SEQ ID NO: 333783 - RNA, 64 nt, hsa; identical to SEQ ID NO: 245590

SEQ ID NO: 333784 - RNA, 64 nt, hsa; identical to SEQ ID NO: 245591

SEQ ID NO: 333785 - RNA, 64 nt, hsa; identical to SEQ ID NO: 245592

SEQ ID NO: 333786 - RNA, 64 nt, hsa; identical to SEQ ID NO: 245593

SEQ ID NO: 333787 - RNA, 64 nt, hsa; identical to SEQ ID NO: 245594

SEQ ID NO: 333788 - RNA, 64 nt, hsa; identical to SEQ ID NO: 245595

SEQ ID NO: 333789 - RNA, 64 nt, hsa; identical to SEQ ID NO: 245596

SEQ ID NO: 333790 - RNA, 64 nt, hsa; identical to SEQ ID NO: 245597

SEQ ID NO: 333791 - RNA, 64 nt, hsa; identical to SEQ ID NO: 245598

SEQ ID NO: 333792 - RNA, 64 nt, hsa; identical to SEQ ID NO: 245599

SEQ ID NO: 333793 - RNA, 64 nt, hsa; identical to SEQ ID NO: 245600

SEQ ID NO: 333794 - RNA, 64 nt, hsa; identical to SEQ ID NO: 245601

SEQ ID NO: 333795 - RNA, 64 nt, hsa; identical to SEQ ID NO: 245602

SEQ ID NO: 333796 - RNA, 64 nt, hsa; identical to SEQ ID NO: 245603

SEQ ID NO: 333797 - RNA, 64 nt, hsa; identical to SEQ ID NO: 245604

SEQ ID NO: 333798 - RNA, 64 nt, hsa; identical to SEQ ID NO: 245605

SEQ ID NO: 333799 - RNA, 64 nt, hsa; identical to SEQ ID NO: 245606

SEQ ID NO: 333800 - RNA, 64 nt, hsa; identical to SEQ ID NO: 245607

SEQ ID NO: 333801 - RNA, 64 nt, hsa; identical to SEQ ID NO: 245608

SEQ ID NO: 333802 - RNA, 64 nt, hsa; identical to SEQ ID NO: 245609

SEQ ID NO: 333803 - RNA, 64 nt, hsa; identical to SEQ ID NO: 245610

SEQ ID NO: 333804 - RNA, 64 nt, hsa; identical to SEQ ID NO: 245611

SEQ ID NO: 333805 - RNA, 64 nt, hsa; identical to SEQ ID NO: 245612

SEQ ID NO: 333806 - RNA, 64 nt, hsa; identical to SEQ ID NO: 245613

SEQ ID NO: 333807 - RNA, 64 nt, hsa; identical to SEQ ID NO: 245614

SEQ ID NO: 333808 - RNA, 64 nt, hsa; identical to SEQ ID NO: 245615

SEQ ID NO: 333809 - RNA, 64 nt, hsa; identical to SEQ ID NO: 245616

SEQ ID NO: 333810 - RNA, 64 nt, hsa; identical to SEQ ID NO: 245617

SEQ ID NO: 333811 - RNA, 64 nt, hsa; identical to SEQ ID NO: 245618

SEQ ID NO: 333812 - RNA, 64 nt, hsa; identical to SEQ ID NO: 245619

SEQ ID NO: 333813 - RNA, 64 nt, hsa; identical to SEQ ID NO: 245620

SEQ ID NO: 333814 - RNA, 64 nt, hsa; identical to SEQ ID NO: 245621

SEQ ID NO: 333815 - RNA, 64 nt, hsa; identical to SEQ ID NO: 245622

SEQ ID NO: 333816 - RNA, 64 nt, hsa; identical to SEQ ID NO: 245623

SEQ ID NO: 333817 - RNA, 64 nt, hsa; identical to SEQ ID NO: 245624

SEQ ID NO: 333818 - RNA, 64 nt, hsa; identical to SEQ ID NO: 245625

SEQ ID NO: 333819 - RNA, 64 nt, hsa; identical to SEQ ID NO: 245626

SEQ ID NO: 333820 - RNA, 64 nt, hsa; identical to SEQ ID NO: 245627

SEQ ID NO: 333821 - RNA, 64 nt, hsa; identical to SEQ ID NO: 245628

SEQ ID NO: 333822 - RNA, 64 nt, hsa; identical to SEQ ID NO: 245629

SEQ ID NO: 333823 - RNA, 64 nt, hsa; identical to SEQ ID NO: 245630

SEQ ID NO: 333824 - RNA, 64 nt, hsa; identical to SEQ ID NO: 245631

SEQ ID NO: 333825 - RNA, 64 nt, hsa; identical to SEQ ID NO: 245632

SEQ ID NO: 333826 - RNA, 64 nt, hsa; identical to SEQ ID NO: 245633

SEQ ID NO: 333827 - RNA, 64 nt, hsa; identical to SEQ ID NO: 245634

SEQ ID NO: 333828 - RNA, 64 nt, hsa; identical to SEQ ID NO: 245635

SEQ ID NO: 333829 - RNA, 64 nt, hsa; identical to SEQ ID NO: 245636

SEQ ID NO: 333830 - RNA, 64 nt, hsa; identical to SEQ ID NO: 245637

SEQ ID NO: 333831 - RNA, 64 nt, hsa; identical to SEQ ID NO: 134190

SEQ ID NO: 333832 - RNA, 64 nt, hsa; identical to SEQ ID NO: 134191

SEQ ID NO: 333833 - RNA, 64 nt, hsa; identical to SEQ ID NO: 134192

SEQ ID NO: 333834 - RNA, 64 nt, hsa; identical to SEQ ID NO: 134193

SEQ ID NO: 333835 - RNA, 64 nt, hsa; identical to SEQ ID NO: 134194

SEQ ID NO: 333836 - RNA, 64 nt, hsa; identical to SEQ ID NO: 134195

SEQ ID NO: 333837 - RNA, 64 nt, hsa; identical to SEQ ID NO: 134196

SEQ ID NO: 333838 - RNA, 64 nt, hsa; identical to SEQ ID NO: 134197

SEQ ID NO: 333839 - RNA, 64 nt, hsa; identical to SEQ ID NO: 134198

SEQ ID NO: 333840 - RNA, 64 nt, hsa; identical to SEQ ID NO: 134199

SEQ ID NO: 333841 - RNA, 64 nt, hsa; identical to SEQ ID NO: 134200

SEQ ID NO: 333842 - RNA, 64 nt, hsa; identical to SEQ ID NO: 134201

SEQ ID NO: 333843 - RNA, 64 nt, hsa; identical to SEQ ID NO: 134202

SEQ ID NO: 333844 - RNA, 64 nt, hsa; identical to SEQ ID NO: 134203

SEQ ID NO: 333845 - RNA, 64 nt, hsa; identical to SEQ ID NO: 134204

SEQ ID NO: 333846 - RNA, 64 nt, hsa; identical to SEQ ID NO: 134205

SEQ ID NO: 333847 - RNA, 64 nt, hsa; identical to SEQ ID NO: 134206

SEQ ID NO: 333848 - RNA, 64 nt, hsa; identical to SEQ ID NO: 134207

SEQ ID NO: 333849 - RNA, 64 nt, hsa; identical to SEQ ID NO: 134208

SEQ ID NO: 333850 - RNA, 64 nt, hsa; identical to SEQ ID NO: 134209

SEQ ID NO: 333851 - RNA, 64 nt, hsa; identical to SEQ ID NO: 134210

SEQ ID NO: 333852 - RNA, 64 nt, hsa; identical to SEQ ID NO: 134211

SEQ ID NO: 333853 - RNA, 64 nt, hsa; identical to SEQ ID NO: 134212

SEQ ID NO: 333854 - RNA, 64 nt, hsa; identical to SEQ ID NO: 134213

SEQ ID NO: 333855 - RNA, 64 nt, hsa; identical to SEQ ID NO: 134214

SEQ ID NO: 333856 - RNA, 64 nt, hsa; identical to SEQ ID NO: 134215

SEQ ID NO: 333857 - RNA, 64 nt, hsa; identical to SEQ ID NO: 134216

SEQ ID NO: 333858 - RNA, 64 nt, hsa; identical to SEQ ID NO: 134217

SEQ ID NO: 333859 - RNA, 64 nt, hsa; identical to SEQ ID NO: 134218

SEQ ID NO: 333860 - RNA, 64 nt, hsa; identical to SEQ ID NO: 134219

SEQ ID NO: 333861 - RNA, 64 nt, hsa; identical to SEQ ID NO: 134220

SEQ ID NO: 333862 - RNA, 64 nt, hsa; identical to SEQ ID NO: 134221

SEQ ID NO: 333863 - RNA, 64 nt, hsa; identical to SEQ ID NO: 134222

SEQ ID NO: 333864 - RNA, 64 nt, hsa; identical to SEQ ID NO: 134223

SEQ ID NO: 333865 - RNA, 64 nt, hsa; identical to SEQ ID NO: 134224

SEQ ID NO: 333866 - RNA, 64 nt, hsa; identical to SEQ ID NO: 134225

SEQ ID NO: 333867 - RNA, 64 nt, hsa; identical to SEQ ID NO: 134226

SEQ ID NO: 333868 - RNA, 64 nt, hsa; identical to SEQ ID NO: 134227

SEQ ID NO: 333869 - RNA, 64 nt, hsa; identical to SEQ ID NO: 134228

SEQ ID NO: 333870 - RNA, 64 nt, hsa; identical to SEQ ID NO: 195094

SEQ ID NO: 333871 - RNA, 64 nt, hsa; identical to SEQ ID NO: 195095

SEQ ID NO: 333872 - RNA, 64 nt, hsa; identical to SEQ ID NO: 195096

SEQ ID NO: 333873 - RNA, 64 nt, hsa; identical to SEQ ID NO: 195097

SEQ ID NO: 333874 - RNA, 64 nt, hsa; identical to SEQ ID NO: 195098

SEQ ID NO: 333875 - RNA, 64 nt, hsa; identical to SEQ ID NO: 195099

SEQ ID NO: 333876 - RNA, 64 nt, hsa
uuucaccauguuggucaggcuggucucaaacuccugaccucaggugauccgcccaccucagccu

SEQ ID NO: 333877 - RNA, 64 nt, hsa
uuucaccauguuggccaggcuguucucgaacuccugaccucaggugaucugcccgccucggucu

SEQ ID NO: 333878 - RNA, 64 nt, hsa
uuuccccauguuggccgggcuagucucgaacuccugaccucaggugauccaccagccucggccu

SEQ ID NO: 333879 - RNA, 64 nt, hsa
ucuguguagggaggggaggcuuauucaauucuucugaccucagaacuggcagaaggucagaugu

SEQ ID NO: 333880 - RNA, 64 nt, hsa
uaaacccccaguugugaaaacugcaguuuagcagugaccucagcaaccccuccuuuuuauuuuu

SEQ ID NO: 333881 - RNA, 64 nt, hsa
guuauuuuuuuaaaaguuuaggugccuuugcggaugaccucauuuugacguugaaaaaaugauu

SEQ ID NO: 333882 - RNA, 64 nt, hsa
uuuuaucauguuggccaggcuggucucgaacuccugaccucaggugaucugcccaccuuggccu

SEQ ID NO: 333883 - RNA, 64 nt, hsa
uuucaccauguuggccaggcuggucuugaacuccugaccucaacugauccgcccaccuuggccu

SEQ ID NO: 333884 - RNA, 64 nt, hsa
cacaucugaaauauaugccgaaaauugacgucuuugaccucagggagagcaccuguccaggucu

SEQ ID NO: 333885 - RNA, 64 nt, hsa
cuucauuucuaaaaugggggugaugcuuucauauugaccucaccccauacuaccucacagaugu

SEQ ID NO: 333886 - RNA, 64 nt, hsa
uuucaccauguuggccaggcuggucucaaacuccugaccucaagugauccacccacuucagcuu

SEQ ID NO: 333887 - RNA, 64 nt, hsa
ccaauucuucuguggcuuuuccugccuuuccuuuugaccucaguaguccuaucccugggaaggc

SEQ ID NO: 333888 - RNA, 64 nt, hsa
uuucacuauguuggucaggcuagucucgaacuccugaccucaggugauccgccugccucggccu

SEQ ID NO: 333889 - RNA, 64 nt, hsa
cagucgcagaaauaauuaaugagauucgcuccugugaccucagcaaauggacaggaaauaaguc

SEQ ID NO: 333890 - RNA, 64 nt, hsa
augauuacaguaucucauuuuauccggauuacagugaccucaucugauguuagagauuugagaa

SEQ ID NO: 333891 - RNA, 64 nt, hsa
gccuucugggugcaaggagcuuuagaguagauuuugaccucagcugaaccuggaacucugaucu

SEQ ID NO: 333892 - RNA, 64 nt, hsa
ggguuucacuguguuggccaggcuggucuugaacugaccucaugauccaccugccucagccucc

SEQ ID NO: 333893 - RNA, 64 nt, hsa
uuucaccauguuggccaggauggucucgaucucuugaccucaugauccacccgccucgaccucc

SEQ ID NO: 333894 - RNA, 64 nt, hsa
accaucacaaguuuuuacccucuuccuucaugccugaccucaaccccgcucuccucauccuauu

SEQ ID NO: 333895 - RNA, 64 nt, hsa
uuccuuaaauguuauuuggaggaaacuaaguucuugaccucaguaauuuuauuuuuguuuuucc

SEQ ID NO: 333896 - RNA, 64 nt, hsa
gacaauuugggcuagaggcaggaaggaagugggaugaccucaggaggucaccuuuucuugauuc

SEQ ID NO: 333897 - RNA, 64 nt, hsa
gauuccagaaacauaugggcugauaaacccggggugaccucaugaaaugaguugcagcagaagu

SEQ ID NO: 333898 - RNA, 64 nt, hsa
auggggaguucuguccugcccuucugugucugcgugaccucacccagccuaggagggaggugca

SEQ ID NO: 333899 - RNA, 64 nt, hsa
gggggaccugcuggcggccucuuccugggagccaugaccucagaccccacccacacuccagauc

SEQ ID NO: 333900 - RNA, 64 nt, hsa
gccaacggggacgacagggaucuucaggaacuucugaccucaccaagucaaguggaccacucuc

SEQ ID NO: 333901 - RNA, 64 nt, hsa
uuucaccguguuggucaggcuggucucaaacuccugaccucaggugauccgcccgccucagccu

SEQ ID NO: 333902 - RNA, 64 nt, hsa
uuucaucgucccgucauuguuucugaugucuuucugaccucacaucauauuugguucuccuacu

SEQ ID NO: 333903 - RNA, 64 nt, hsa
ccuuugaucuaguuugaccuuugaaauuugcaugugaccucaucuagcuaugaauucugggaag

SEQ ID NO: 333904 - RNA, 64 nt, hsa
uuucaccauguugaccaggcuagucucgaacuucugaccucaggugauccaccugccucagccu

SEQ ID NO: 333905 - RNA, 64 nt, hsa
aaauguuuaacacauucuaccugacgggagguggugaccucauucagucgguuaagagccugag

SEQ ID NO: 333906 - RNA, 64 nt, hsa
cagccuugggaguuccuggugugcucugacaucaugaccucaaaucuaaauccuccaaucccaa

SEQ ID NO: 333907 - RNA, 64 nt, hsa
uuucaccauguuggccaggcuagucucgaacuccugaccucaggugauccaccugccuuggccu

SEQ ID NO: 333908 - RNA, 64 nt, hsa
caaauacaaaggaagaacaucuggauuucauccuugaccucauuuacaaagcaaaaagagaugc

SEQ ID NO: 333909 - RNA, 64 nt, hsa
uuucaccacauuggccgggcuggucuugaacuccugaccucagguaauccgcccaucucggcuu

SEQ ID NO: 333910 - RNA, 64 nt, hsa
uugcaccauauuggucagccuggucucaaacuccugaccucaggugauccaccugccucagccu

SEQ ID NO: 333911 - RNA, 64 nt, hsa
uuucaccacguuagccaugauggucucaaacuucugaccucauaauccacccaccuuggccucc

SEQ ID NO: 333912 - RNA, 64 nt, hsa
agaggaggauagcucuuuccagaauccacacuucugaccucagccucggucucaugaacacccg

SEQ ID NO: 333913 - RNA, 64 nt, hsa
uguuuacuagcuugccugugucugguacaucucaugaccucaauucccucaccugaaauaggaa

SEQ ID NO: 333914 - RNA, 64 nt, hsa
caauggcuaugaaaaugcaaguaguuuccucgcgugaccucaccaugauucacauacgugccac

SEQ ID NO: 333915 - RNA, 64 nt, hsa
uuucgccaugucggccaggcuggucuugaacuccugaccucaggugguccacccgccucggccu

SEQ ID NO: 333916 - RNA, 64 nt, hsa
gccccuccuggggccagccuccuugccucugcucugaccucagcagcuacaccuaaccccaccg

SEQ ID NO: 333917 - RNA, 64 nt, hsa
ugucugcaugagaaaggauggcaagucucugaggugaccucaggguggaauucucuguuaaguc

SEQ ID NO: 333918 - RNA, 64 nt, hsa
aggagugcccauuggcagauuacacauguaaauaugaccucagacaaaaaggaaccagaggccc

SEQ ID NO: 333919 - RNA, 64 nt, hsa
uuucaucauguuggccaggccggucucaaacuccugaccucaggugaugcacccaccucagccu

SEQ ID NO: 333920 - RNA, 64 nt, hsa
uuucaccauguuagccaggcuggucucgaacuccugaccucaggugauccacccgccucagccu

SEQ ID NO: 333921 - RNA, 64 nt, hsa
gcuggacugugcuucgggcuccucuguggggcucugaccucagggcucccagcucggggccugu

SEQ ID NO: 333922 - RNA, 64 nt, hsa
uggacauagacacguggucccaggccguucagccugaccucaggcagcaggcaccaagcugcca

SEQ ID NO: 333923 - RNA, 64 nt, hsa
uuucaccauguuggccaggcuggucucgaacucuugaccucaggugaucugcccgccuuggccu

SEQ ID NO: 333924 - RNA, 64 nt, hsa
uuucgccauguuggccaggcuggucucgaacuccugaccucaggugauccgcccaccucggccu

SEQ ID NO: 333925 - RNA, 64 nt, hsa
uuucaccauguuggccaggcuggucucgaacuccugaccucaggugauccaccugccucggccu

SEQ ID NO: 333926 - RNA, 64 nt, hsa
uuuugccaugcuggccaggcucgucucgaacuccugaccucaggugauccgcccaccuuggccu

SEQ ID NO: 333927 - RNA, 64 nt, hsa
guuuaccauguuggccaggcaggucuccaacuccugaccucaagugauauguucaccucagccu

SEQ ID NO: 333928 - RNA, 64 nt, hsa
uuucaccacguuggccacacuggucucaaacuccugaccucaggcgauccaucugccucagccu

SEQ ID NO: 333929 - RNA, 64 nt, hsa
uuuuaccauguuggccaggcuggucucaaacuccugaccucaagugauccacccaccuugacuc

SEQ ID NO: 333930 - RNA, 64 nt, hsa
ggguuucaccaugcuggccaggcuuguuaugaacugaccucaagugaucugccugccucagcuu

SEQ ID NO: 333931 - RNA, 64 nt, hsa
uuucaccauguuggccaggcuggucuugaacuccugaccucagguaauccaccugccuuggccu

SEQ ID NO: 333932 - RNA, 64 nt, hsa
uuucaccauguugaccaggcugaucuuaaacucuugaccucaaaugauccacccaccuuggccu

SEQ ID NO: 333933 - RNA, 64 nt, hsa
uuucuccauguuggucaggcuggucucaaacuccugaccucaggugaucugccugccucggccu

SEQ ID NO: 333934 - RNA, 64 nt, hsa
ugacaacucuuaugccagcacaacuuugaccugaugaccucaucccagcccuugaucgccauca

SEQ ID NO: 333935 - RNA, 64 nt, hsa
aggcugcaccaccucauccuggcccgccgaaccuugaccucaccccugccccuacccgaaggcc

SEQ ID NO: 333936 - RNA, 64 nt, hsa
ucuugcaaaauuccugacgagauaagcaguuaugugaccucacgugcaaagccaccaacagcca

SEQ ID NO: 333937 - RNA, 64 nt, hsa
uuucaccauguuggccaggcugcucucaaaccccugaccucaaaugaugugccugcuucagccu

SEQ ID NO: 333938 - RNA, 64 nt, hsa
ucucaccagcuguguccggcccaguuuuggggugugaccucaauuucaauuuugucuguacuug

SEQ ID NO: 333939 - RNA, 64 nt, hsa
aguggcccaacaggggcuccaugccagccgaccuugaccucacucagaaguccagagucuagcg

SEQ ID NO: 333940 - RNA, 64 nt, hsa; identical to SEQ ID NO: 275363

SEQ ID NO: 333941 - RNA, 64 nt, hsa; identical to SEQ ID NO: 275364

SEQ ID NO: 333942 - RNA, 64 nt, hsa; identical to SEQ ID NO: 275365

SEQ ID NO: 333943 - RNA, 64 nt, hsa; identical to SEQ ID NO: 275366

SEQ ID NO: 333944 - RNA, 64 nt, hsa; identical to SEQ ID NO: 275367

SEQ ID NO: 333945 - RNA, 64 nt, hsa; identical to SEQ ID NO: 275368

SEQ ID NO: 333946 - RNA, 64 nt, hsa
aacgaaauaccacccuuuccauuuuauagaccucauccccuauuucugucagacaguuauauga

SEQ ID NO: 333947 - RNA, 64 nt, hsa
cagggaugugccugaaagagucaacaguccccugauccccuaccucugccugcccuccagcccc

SEQ ID NO: 333948 - RNA, 64 nt, hsa
ccaugcccuugaggagccggccaccagaugcugaauccccuaucccauucugcguaugaguccc

SEQ ID NO: 333949 - RNA, 64 nt, hsa
gaagagaggggauuucuuggaaaaggagagaggaauccccuagagcagggaaagcagugccugc

SEQ ID NO: 333950 - RNA, 64 nt, hsa
auuggucauugguguuugcucuugccucuccuccauccccuagaaguacacccccgucuuauua

SEQ ID NO: 333951 - RNA, 64 nt, hsa
agucuucagagauaggccugugggccagauugccauccccuauggaccagaagccaaggaucuc

SEQ ID NO: 333952 - RNA, 64 nt, hsa
ggcagugccugaacauggcagucuagggugaacaauccccuaacacaaguuuacuugucuuuga

SEQ ID NO: 333953 - RNA, 64 nt, hsa
uagaaucccaggcggacacccuuucucaaaagauauccccuaagaguccuuucugcuuucuuca

SEQ ID NO: 333954 - RNA, 64 nt, hsa
aggcaaagguggaaguccuccagggauccgcuacauccccuaacugcaugcagauguggaaagg

SEQ ID NO: 333955 - RNA, 64 nt, hsa
agaagaggcuuccaaucaguguggaaagugacaaauccccuaucaacacucccagcccuugcug

SEQ ID NO: 333956 - RNA, 64 nt, hsa
ccuauaguuacaaaaauaaaaacuauaaaaacccauccccuaucuacuuaauccagauagccug

SEQ ID NO: 333957 - RNA, 64 nt, hsa
ggcacauuccuacgauugaagaaggggucuugagauccccuaaacuugcauacccaguuuuuug

SEQ ID NO: 333958 - RNA, 64 nt, hsa
uguuuuaaguauuuaauguccucauaguguggaaauccccuaaauugauuagaaauuguauuuu

SEQ ID NO: 333959 - RNA, 64 nt, hsa
aaaccacacgauuguuccacugucuggaagcaccauccccuaucgcaggacuccugggccacaa

SEQ ID NO: 333960 - RNA, 64 nt, hsa
caaaauuuuccagaauucccaaaaugaaccagauauccccuagaaaauuauacuauugagaaau

SEQ ID NO: 333961 - RNA, 64 nt, hsa
caccaaccugaggaaucuucuaggcuucucuagcauccccuaagacuguggcuauuucacgucu

SEQ ID NO: 333962 - RNA, 64 nt, hsa
uuuaaauucaggcaaagccuacaacgcugagacaauccccuaacaacaugguaguaacuaaaga

SEQ ID NO: 333963 - RNA, 64 nt, hsa
uguaagcaauucuaagugagauguuuggcaagaaauccccuaacugauuuccauccaaaccuac

SEQ ID NO: 333964 - RNA, 64 nt, hsa
caaaaaacauuaccauccccacccauaccacagcauccccuagagagagugaggugcagggacc

SEQ ID NO: 333965 - RNA, 64 nt, hsa
aaaguagaugacaucauguguuagccuguuccuaauccccuagaauuguaaugugugggauaua

SEQ ID NO: 333966 - RNA, 64 nt, hsa
ccuaggacucuguggccgacuauaggcgucucccauccccuacaccuucccccagccacagcca

SEQ ID NO: 333967 - RNA, 64 nt, hsa
agucauucccagauaauagaacuggaaaugauaaauccccuaaugccaagggucuaguguguuc

SEQ ID NO: 333968 - RNA, 64 nt, hsa
cauuaaauccuuuuaccuuuuuuuuuucuugguaauccccuaaaauaacaguaugugggauauu

SEQ ID NO: 333969 - RNA, 64 nt, hsa
uuuauccaguucuugcuccuaaaguuaaguuugaauccccuauuuuugcacaggggcagcagau

SEQ ID NO: 333970 - RNA, 64 nt, hsa
ccucugccgauacuguuugucuuucuacuguuucauccccuaacuucccccaacccucaaauua

SEQ ID NO: 333971 - RNA, 64 nt, hsa
acccagauuucuuucuuuauguacaagauggaaaauccccuaccccucaaaaacagguugaguu

SEQ ID NO: 333972 - RNA, 64 nt, hsa
aacaaggagugaaagaaaauauaagaagaaaaaaauccccuacauuuuauuggcacagaaaagu

SEQ ID NO: 333973 - RNA, 64 nt, hsa
uuagaagggaucuuagagguagauuauccaggccauccccuacugcuuacauuccccucccccu

SEQ ID NO: 333974 - RNA, 64 nt, hsa
aagaugguagcacuagucuuaaauuguauaaaauauccccuaacauguuuaaauguccauuuuu

SEQ ID NO: 333975 - RNA, 64 nt, hsa
uacaauuuacagaucaugaguucaauaugcuugaauccccuagaccuaauuuuuccuugauccc

SEQ ID NO: 333976 - RNA, 64 nt, hsa
auuucacuggagugacuuauucuaagccucaucuauccccuaccuauuucucaaaaucauucua

SEQ ID NO: 333977 - RNA, 64 nt, hsa
ucccaggcagucugaccccagaguggcccagcucauccccuacucuguuauuugcuuguuaaug

SEQ ID NO: 333978 - RNA, 64 nt, hsa
agaacagggaggauacagaaguauugcagcccagauccccuaucagggggacagcuggugggca

SEQ ID NO: 333979 - RNA, 64 nt, hsa
ggccaggcuuggguggagccugugucccagacagauccccuaggccuaucugagacccauacag

SEQ ID NO: 333980 - RNA, 64 nt, hsa
gcuuaauuucuuuuuucuuauuccccacuuguauauccccuaccaguaccgggaucugcacaca

SEQ ID NO: 333981 - RNA, 64 nt, hsa
auugugaugucaccaauuuuccuuccaucuccacauccccuaacaucugauucacgacuuaaug

SEQ ID NO: 333982 - RNA, 64 nt, hsa
acuuaauucuaguucccgacaagccaguugcaauauccccuaagaugcuuuuugagcugucuua

SEQ ID NO: 333983 - RNA, 64 nt, hsa
cagguaaccccaggcugaaggggcccugcuccccauccccuaccaugggcacccaugugcuggc

SEQ ID NO: 333984 - RNA, 64 nt, hsa
ccugguacacaaaggggucaagguggugauggacauccccuaugagcuguggaacgagacuucu

SEQ ID NO: 333985 - RNA, 64 nt, hsa
cuauaggaauacaaggggcacacagggaaggcagauccccuaguuggcaagacuauuuuaacuu

SEQ ID NO: 333986 - RNA, 64 nt, hsa
uaugcaaaaguggguacuuggaagggcaaaaaucauccccuauuuuacuuauuuccaagaaaug

SEQ ID NO: 333987 - RNA, 64 nt, hsa
aaucaccucccaccauaaucccugucuucuuuccauccccuagaaauccugggaggcaggaucc

SEQ ID NO: 333988 - RNA, 64 nt, hsa
aagcugccugcgauggccugaaauuccaccuuucauccccuauggaugacggagagcuuacaga

SEQ ID NO: 333989 - RNA, 64 nt, hsa
uaccuuaucaagaacgaaaaaucguaugggaagaauccccuauuuaucacugcuauauuaaaau

SEQ ID NO: 333990 - RNA, 64 nt, hsa
aaauacuugaauauucaaauuuaaaagacacuguauccccuaaaauauuucugauggugcacua

SEQ ID NO: 333991 - RNA, 64 nt, hsa
gcuacuauauugcuuuugucccaaagugaguaaaauccccuagagcagagagagagagagagag

SEQ ID NO: 333992 - RNA, 64 nt, hsa
acugagccagaccuucggagaguaaugccaccagauccccuaggaaagaggaggcaaauggcac

SEQ ID NO: 333993 - RNA, 64 nt, hsa
gcccccuccuugcccuccacgcccugcccccugcauccccuagagacagcugacuagcagcugc

SEQ ID NO: 333994 - RNA, 64 nt, hsa
aaaccauucuuuucaaugcagaagaaaucuagauauccccuacugugaccaaauuucuguauua

SEQ ID NO: 333995 - RNA, 64 nt, hsa
aagagaguucaacuguuacucuuuucuuucaucaauccccuaucaguuagaacugcaggccagu

SEQ ID NO: 333996 - RNA, 64 nt, hsa
cgaagggggcugcuuaggguuucaccuuuuuuuaauccccuaagcuccauuauaugacauugga

SEQ ID NO: 333997 - RNA, 64 nt, hsa
uuguaaacuuccuggaaagcugucuucacuaaguauccccuagucucuauauaugugguuagua

SEQ ID NO: 333998 - RNA, 64 nt, hsa
ucaaugacauuagccaaaguuggguuugccauucauccccuaggcaugguaaaucuuguguugu

SEQ ID NO: 333999 - RNA, 64 nt, hsa
cuugacucucccacaugcucuguuaugggagagaauccccuacccuacucugauguauagacca

SEQ ID NO: 334000 - RNA, 64 nt, hsa
uuucuaaguggaaguuaaauuuguuauacugcccauccccuaaagccaacagagauuuguagau

SEQ ID NO: 334001 - RNA, 64 nt, hsa
caguccuuugggauuggaagugaaacagucugugauccccuaccuucuagggaacuaggaccua

SEQ ID NO: 334002 - RNA, 64 nt, hsa
guguuuuuaguugguugaguuuauccauucuucaauccccuaaagccuucagcuauucuuucau

SEQ ID NO: 334003 - RNA, 64 nt, hsa
auguuguucggucagcccuucccuaauuacaccuauccccuacacauacaugcacauagacaca

SEQ ID NO: 334004 - RNA, 64 nt, hsa
augucccagccuuuuuaaggagacacacucauucauccccuacuaugugcuggcagcuuuaccu

SEQ ID NO: 334005 - RNA, 64 nt, hsa
cugcgcuuccuccugauggucgccagagggcagcauccccuaacuaauaccguaaccgcgcagu

SEQ ID NO: 334006 - RNA, 64 nt, hsa
ggaccccaucugugaauaagccauucugacucauauccccuauuuaacagggucucuagugcug

SEQ ID NO: 334007 - RNA, 64 nt, hsa
aguaccuauuucuaaacaaugauuuaaagucuauauccccuaagcggaguuguuguuuuucucc

SEQ ID NO: 334008 - RNA, 64 nt, hsa
gaucaggugcccugcagacccagagccaguuccuauccccuaaccuaaacacuuauaggugagg

SEQ ID NO: 334009 - RNA, 64 nt, hsa
ugcccagguaacugauaggaguuuucuucaaaccauccccuaaggagaaaugaucuuagacacu

SEQ ID NO: 334010 - RNA, 64 nt, hsa
ccauuccugggaaauauucccuagaaacuuccaaauccccuaagcagaccacugauaaaaccau

SEQ ID NO: 334011 - RNA, 64 nt, hsa
gaguggagaggggcaccugccccccgcccuccccauccccuacucccacugcucagcgcgggcc

SEQ ID NO: 334012 - RNA, 64 nt, hsa
gggugagaugagaucauggagagagaacacagccauccccuauagaaaggcacagcuuuugggc

SEQ ID NO: 334013 - RNA, 64 nt, hsa
uguaaauaaugaaccuuauuuuuuauuauugccaauccccuaagauauuguauuuuacaaaucu

SEQ ID NO: 334014 - RNA, 64 nt, hsa
gcuaaguguuuaauucaugaauauuguauacugcauccccuaccacaauuuacacaauccugug

SEQ ID NO: 334015 - RNA, 64 nt, hsa
ccucccucccccaacacucccuaccaacccccuaauccccuacucccuccacccccccuccacu

SEQ ID NO: 334016 - RNA, 64 nt, hsa
caucauuuuccuacggcguuagcacuuuaagcacauccccuaggggagggggugagugaggggc

SEQ ID NO: 334017 - RNA, 64 nt, hsa
agaucucaagugucaaccuugaggucccagcuccauccccuaguugcagacucaucaccauggu

SEQ ID NO: 334018 - RNA, 64 nt, hsa
ugagaacaggccaucucagcccuacacacuugccauccccuacagcacagaggaagagugaugg

SEQ ID NO: 334019 - RNA, 64 nt, hsa
ggaguaguacccccagcucugagaaagaggcggcauccccuaggccaaguggaaagaggcuggg

SEQ ID NO: 334020 - RNA, 64 nt, hsa
agaggaaaucuuaagauuacaagauaaaaaacgaauccccuaaacaaaaagaacaauagaacug

SEQ ID NO: 334021 - RNA, 64 nt, hsa
ugauuucuuaccguuuuuggcucuguuuugcuauauccccuaauuuguugguugugcuaaucuu

SEQ ID NO: 334022 - RNA, 64 nt, hsa
ccagcuguaagagaaaugcagucaggagcacagcauccccuacuuacuaucacuacaagaaaac

SEQ ID NO: 334023 - RNA, 64 nt, hsa
aaaaaagcaagugucuuugguguuggaggacaaaauccccuaccauuuucacguugugcuacua

SEQ ID NO: 334024 - RNA, 64 nt, hsa
gggaacuuaaguacacagauccuuaucucuccccauccccuagccucacaaaacacaguugaga

SEQ ID NO: 334025 - RNA, 64 nt, hsa
auuuucacuccugagaagugcuccccuaacucagauccccuaacuuagauuuggcccccaacuc

SEQ ID NO: 334026 - RNA, 64 nt, hsa
uaguuguggaaagagucucauagaucauaguccaauccccuagacccaaaggcccagacacgca

SEQ ID NO: 334027 - RNA, 64 nt, hsa
uccaugaacagaaaauuaaggccucuaaaaucagauccccuaguuacuccucuguucugaaucu

SEQ ID NO: 334028 - RNA, 64 nt, hsa
aagaggacggugcuucuuucuauuaaagugcuccauccccuaccaucuacacauuagcauuguc

SEQ ID NO: 334029 - RNA, 64 nt, hsa
agaccuagaugauaccccugaggauaaaaccuccauccccuaaaaugauuuuuuuuaaauacca

SEQ ID NO: 334030 - RNA, 64 nt, hsa
uugcaaguuuacuuucauuccuuccuauguuuuaauccccuaaaauucucccuguagucaaugu

SEQ ID NO: 334031 - RNA, 64 nt, hsa
caucuugaucccagccugacugcugcuacaucuaauccccuaccaaugccuccugucccuaaac

SEQ ID NO: 334032 - RNA, 64 nt, hsa
cgagugcauuuaucccaaaacgaggcaucuugacauccccuauccccacccccuaaauucccaa

SEQ ID NO: 334033 - RNA, 64 nt, hsa
accugcuccaaacuagugacuaggauagaauuugauccccuaacucacugucugcggugcucau

SEQ ID NO: 334034 - RNA, 64 nt, hsa
cucagugcccuuagcuagccugacuaagucccagauccccuacagcuuccuucggugugguauc

SEQ ID NO: 334035 - RNA, 64 nt, hsa
gacgggccucauccuccuuuuuuaauccagcagcauccccuaccccaggcugucaacccuuucu

SEQ ID NO: 334036 - RNA, 64 nt, hsa
cauuucauuugaaaucuaggagucaaauggaaagauccccuaauaauacaccuauuucacuaac

SEQ ID NO: 334037 - RNA, 64 nt, hsa
agcaccagacuuuuuuucuuuuuuuccuaaagaaauccccuaagccccccgccuguaggcggga

SEQ ID NO: 334038 - RNA, 64 nt, hsa
ccuagugcuugucggaugcagagacaauguugaaauccccuaaacacaguucucaguggcaaaa

SEQ ID NO: 334039 - RNA, 64 nt, hsa
ccuaggggugucugucuccagaggggagggacaaauccccuacuggggccauuucaauggggua

SEQ ID NO: 334040 - RNA, 64 nt, hsa
aaaugcccugagacgguucucuguucgauuuuucauccccuaugaaccugggucuuauucuguc

SEQ ID NO: 334041 - RNA, 64 nt, hsa
ugcggccucuccaccucucacccacucucuccuaauccccuacuuaaguagggcuugccccacu

SEQ ID NO: 334042 - RNA, 64 nt, hsa
uaaccugucuucccagccaauugguggugcuggaauccccuaggagccuucagucugggagaaa

SEQ ID NO: 334043 - RNA, 64 nt, hsa
guagugcauguggccaagccuuuaguuaucaccaauccccuacuguuaaucagagaugucccac

SEQ ID NO: 334044 - RNA, 64 nt, hsa
uaauuuuaagccucaguuucuuucaaauacaguuauccccuaauauuugcaggagcgugguucu

SEQ ID NO: 334045 - RNA, 64 nt, hsa
guaaagccuuaagauguuucuuuugaauaugguuauccccuaaccauaugcaggggauugguuc

SEQ ID NO: 334046 - RNA, 64 nt, hsa
uuccuggggccauaacucaugggaaaacagaauuauccccuaggacuccuuucuaagccccuaa

SEQ ID NO: 334047 - RNA, 64 nt, hsa
ccuguccccaugguacgucccacccuguccccagauccccuauucccuccacaauaacagaaac

SEQ ID NO: 334048 - RNA, 64 nt, hsa
ucugccuggaggaucccuccauccggcuccugucauccccuacacuuuggccaagcaagaggug

SEQ ID NO: 334049 - RNA, 64 nt, hsa
gcgacaagggauuugcucgcacggcauuggcuccauccccuagucgcuggacagcucuuuuuuu

SEQ ID NO: 334050 - RNA, 64 nt, hsa
acugaguuguauccgagagggugggaacagcagcauccccuaauugcaguacacgguuccuuuu

SEQ ID NO: 334051 - RNA, 64 nt, hsa
cacuuuuguagcugagaccucucuggagacccagauccccuagagcaggucagagaccauccag

SEQ ID NO: 334052 - RNA, 64 nt, hsa
aaaugaaaggcaugcccacguccgucaccuccccauccccuaguccccaccuugaacaucauga

SEQ ID NO: 334053 - RNA, 64 nt, hsa
aacacauugauaaagcaucauguucccuuugauuauccccuauaaccaacacucaacuacaaau

SEQ ID NO: 334054 - RNA, 64 nt, hsa
aaaaaaaagcagcaccugugggccauacuaaaagauccccuacuuacguucugguugucauguu

SEQ ID NO: 334055 - RNA, 64 nt, hsa
ugucucuagacauugccaaaugucccgugugaacauccccuauugagacccacugcuuuagcga

SEQ ID NO: 334056 - RNA, 64 nt, hsa
cuauuuuaaguuuagaccaaaaaaauacagagucauccccuacccccaccccucuagagacccu

SEQ ID NO: 334057 - RNA, 64 nt, hsa
gaccuacaacaugauccaguacuaucagaaugacauccccuacugaggaggggaccuucgaggg

SEQ ID NO: 334058 - RNA, 64 nt, hsa
agugggaguggggggccuugcuccacccccccccauccccuacugugacuugcuuuaggguguc

SEQ ID NO: 334059 - RNA, 64 nt, hsa
ugggugucaugaaacucaauaaauagcaaaaugaauccccuagccuuuguccucaccuacccua

SEQ ID NO: 334060 - RNA, 64 nt, hsa
uagccaguccuaacuccguacucugugucagcccauccccuagacacccucuguuuccuuuccc

SEQ ID NO: 334061 - RNA, 64 nt, hsa
gucaugcuuucuacucauguccuucacaaggcacauccccuacauuuggaagaauccccaaucu

SEQ ID NO: 334062 - RNA, 64 nt, hsa
aacccugccaccuuggggaauccagccuggaggcauccccuaagcagccagccauggccugggu

SEQ ID NO: 334063 - RNA, 64 nt, hsa
ugagggcaagaucccaguggaggccuucaagcaaauccccuaaaaggagcccuuugaugucauc

SEQ ID NO: 334064 - RNA, 64 nt, hsa
cuuguacuaguguuguaacuuuccaaguaaaaguauccccuaaaggccacuuccuaucugauuu

SEQ ID NO: 334065 - RNA, 64 nt, hsa
uguacaaagcuauguauuuugauuuacuuucauuucuugcuauguauauguacuuuucuuaaaa

SEQ ID NO: 334066 - RNA, 64 nt, hsa
uauauguacuuuucuuaaaaugccaagaacuuucucuugcuaucauugcuccuuuugaaacaau

SEQ ID NO: 334067 - RNA, 64 nt, hsa
auuucacuggucagucauuuucaucuuguuuucuucuugcuaagucuuaccauguaccugcuuu

SEQ ID NO: 334068 - RNA, 64 nt, hsa
aaccacaguuaggguguuuuguuuauuuuauuguucuugcuauuguugauauucuauguaguug

SEQ ID NO: 334069 - RNA, 64 nt, hsa
ccaaaauguauaauuacguaaacacauauucaauucuugcuaacauagcaguacuuugcuguga

SEQ ID NO: 334070 - RNA, 64 nt, hsa
aaguauuuugaacuggaaauaguaacacgugccuucuugcuacucuaaacugucuccaacacau

SEQ ID NO: 334071 - RNA, 64 nt, hsa
guuuuauuacacauuuauguaauuuuauuuacauucuugcuaauucucagcagaaauuuaaaua

SEQ ID NO: 334072 - RNA, 64 nt, hsa
aauuuuuaauuuuuaauuuuuugucaagacaaggucuugcuauguugcccaggcuggucuugaa

SEQ ID NO: 334073 - RNA, 64 nt, hsa
cuccugcccuguuuauuucauccucgaugggaauucuugcuagguaagcacuaauaacucggca

SEQ ID NO: 334074 - RNA, 64 nt, hsa
uaugagaaggccucccuuccuaagccaccucuggucuugcuaagucuugaucuugcuuccugcc

SEQ ID NO: 334075 - RNA, 64 nt, hsa
gggccagggcagccucccuauaauuuucuucaucucuugcuaaucucuauaauaagguugcuuu

SEQ ID NO: 334076 - RNA, 64 nt, hsa
caucaguuucccccucugagcaacagacugcuugucuugcuaggagaggaggauggggggcuga

SEQ ID NO: 334077 - RNA, 64 nt, hsa
gcagucuugcuauugcuguuugucuauuuugcagucuugcuaaauuuguuuguucuugaaaauu

SEQ ID NO: 334078 - RNA, 64 nt, hsa
acugggauaaccuugcuguuugucuauuuugcagucuugcuauugcuguuugucuauuuugcag

SEQ ID NO: 334079 - RNA, 64 nt, hsa; identical to SEQ ID NO: 82929

SEQ ID NO: 334080 - RNA, 64 nt, hsa; identical to SEQ ID NO: 82930

SEQ ID NO: 334081 - RNA, 64 nt, hsa; identical to SEQ ID NO: 82931

SEQ ID NO: 334082 - RNA, 64 nt, hsa; identical to SEQ ID NO: 82932

SEQ ID NO: 334083 - RNA, 64 nt, hsa; identical to SEQ ID NO: 82933

SEQ ID NO: 334084 - RNA, 64 nt, hsa; identical to SEQ ID NO: 82934

SEQ ID NO: 334085 - RNA, 64 nt, hsa; identical to SEQ ID NO: 82935

SEQ ID NO: 334086 - RNA, 64 nt, hsa; identical to SEQ ID NO: 82936

SEQ ID NO: 334087 - RNA, 64 nt, hsa; identical to SEQ ID NO: 82937

SEQ ID NO: 334088 - RNA, 64 nt, hsa; identical to SEQ ID NO: 82938

SEQ ID NO: 334089 - RNA, 64 nt, hsa; identical to SEQ ID NO: 82939

SEQ ID NO: 334090 - RNA, 64 nt, hsa; identical to SEQ ID NO: 82940

SEQ ID NO: 334091 - RNA, 64 nt, hsa; identical to SEQ ID NO: 82941

SEQ ID NO: 334092 - RNA, 64 nt, hsa; identical to SEQ ID NO: 82942

SEQ ID NO: 334093 - RNA, 64 nt, hsa; identical to SEQ ID NO: 82943

SEQ ID NO: 334094 - RNA, 64 nt, hsa; identical to SEQ ID NO: 82944

SEQ ID NO: 334095 - RNA, 64 nt, hsa; identical to SEQ ID NO: 82945

SEQ ID NO: 334096 - RNA, 64 nt, hsa; identical to SEQ ID NO: 82946

SEQ ID NO: 334097 - RNA, 64 nt, hsa; identical to SEQ ID NO: 82947

SEQ ID NO: 334098 - RNA, 64 nt, hsa; identical to SEQ ID NO: 82948

SEQ ID NO: 334099 - RNA, 64 nt, hsa; identical to SEQ ID NO: 82949

SEQ ID NO: 334100 - RNA, 64 nt, hsa; identical to SEQ ID NO: 82950

SEQ ID NO: 334101 - RNA, 64 nt, hsa; identical to SEQ ID NO: 82951

SEQ ID NO: 334102 - RNA, 64 nt, hsa; identical to SEQ ID NO: 82952

SEQ ID NO: 334103 - RNA, 64 nt, hsa; identical to SEQ ID NO: 82953

SEQ ID NO: 334104 - RNA, 64 nt, hsa; identical to SEQ ID NO: 82954

SEQ ID NO: 334105 - RNA, 64 nt, hsa; identical to SEQ ID NO: 82955

SEQ ID NO: 334106 - RNA, 64 nt, hsa; identical to SEQ ID NO: 82956

SEQ ID NO: 334107 - RNA, 64 nt, hsa; identical to SEQ ID NO: 82957

SEQ ID NO: 334108 - RNA, 64 nt, hsa; identical to SEQ ID NO: 82958

SEQ ID NO: 334109 - RNA, 64 nt, hsa; identical to SEQ ID NO: 82959

SEQ ID NO: 334110 - RNA, 64 nt, hsa; identical to SEQ ID NO: 82960

SEQ ID NO: 334111 - RNA, 64 nt, hsa; identical to SEQ ID NO: 82961

SEQ ID NO: 334112 - RNA, 64 nt, hsa; identical to SEQ ID NO: 82962

SEQ ID NO: 334113 - RNA, 64 nt, hsa; identical to SEQ ID NO: 82963

SEQ ID NO: 334114 - RNA, 64 nt, hsa; identical to SEQ ID NO: 82964

SEQ ID NO: 334115 - RNA, 64 nt, hsa; identical to SEQ ID NO: 82965

SEQ ID NO: 334116 - RNA, 64 nt, hsa; identical to SEQ ID NO: 82966

SEQ ID NO: 334117 - RNA, 64 nt, hsa; identical to SEQ ID NO: 82967

SEQ ID NO: 334118 - RNA, 64 nt, hsa; identical to SEQ ID NO: 82968

SEQ ID NO: 334119 - RNA, 64 nt, hsa; identical to SEQ ID NO: 82969

SEQ ID NO: 334120 - RNA, 64 nt, hsa; identical to SEQ ID NO: 82970

SEQ ID NO: 334121 - RNA, 64 nt, hsa; identical to SEQ ID NO: 82971

SEQ ID NO: 334122 - RNA, 64 nt, hsa; identical to SEQ ID NO: 82972

SEQ ID NO: 334123 - RNA, 64 nt, hsa; identical to SEQ ID NO: 82973

SEQ ID NO: 334124 - RNA, 64 nt, hsa; identical to SEQ ID NO: 82974

SEQ ID NO: 334125 - RNA, 64 nt, hsa; identical to SEQ ID NO: 82975

SEQ ID NO: 334126 - RNA, 64 nt, hsa; identical to SEQ ID NO: 82976

SEQ ID NO: 334127 - RNA, 64 nt, hsa; identical to SEQ ID NO: 82977

SEQ ID NO: 334128 - RNA, 64 nt, hsa; identical to SEQ ID NO: 82978

SEQ ID NO: 334129 - RNA, 64 nt, hsa; identical to SEQ ID NO: 82979

SEQ ID NO: 334130 - RNA, 64 nt, hsa; identical to SEQ ID NO: 82980

SEQ ID NO: 334131 - RNA, 64 nt, hsa; identical to SEQ ID NO: 82981

SEQ ID NO: 334132 - RNA, 64 nt, hsa; identical to SEQ ID NO: 82982

SEQ ID NO: 334133 - RNA, 64 nt, hsa
gccucguguccugcuagcugucucucuuguugauuuccgugaaaaugcaaguguuugaagucug

SEQ ID NO: 334134 - RNA, 64 nt, hsa
uguuucucauccuucuugcucugccuuugaguuguuccgugaucacuucugaauaagcaguuug

SEQ ID NO: 334135 - RNA, 64 nt, hsa
gccagggggccugggccagaccagggcucuguccuuccgugacuuuauuaaagcaacauuugcc

SEQ ID NO: 334136 - RNA, 64 nt, hsa
cuaauauaccaaaauaaaaugaaaaauugaguuuuuccgugaacuuuauacuguccagcucugu

SEQ ID NO: 334137 - RNA, 64 nt, hsa
ccgggucucggccgucuccccucuucugcgucuguuccgugacuucgccugggugggauguacc

SEQ ID NO: 334138 - RNA, 64 nt, hsa
agcuuagcugcugcugacacccagcaggccuggguuccgugagcgcgaacuccguggugguggg

SEQ ID NO: 334139 - RNA, 64 nt, hsa
acguuuucaaacacaaggucucuuacagguauaguuccgugauuaugauagcucugugauuaua

SEQ ID NO: 334140 - RNA, 64 nt, hsa
ucgggaaccuccccugcugaggguggugucaggguuccgugacuccagugggccagugguagcc

SEQ ID NO: 334141 - RNA, 64 nt, hsa
aaugauguaaugacagagaaggcagacaacauguuuccgugacucaucuagucagagcaauuau

SEQ ID NO: 334142 - RNA, 64 nt, hsa
acucaucauuaaccagaacaccucuccccucaaauuccgugaccaaguugugcagcuugagcaa

SEQ ID NO: 334143 - RNA, 64 nt, hsa
cauuaacauuuuauaacagauuuauauuuuugaguuccgugauugcaaauuaugaccucaaauu

SEQ ID NO: 334144 - RNA, 64 nt, hsa
uuauuuuuuucucuuuugaauauguuggugauaauuccgugacaguuggaagaugggguucauu

SEQ ID NO: 334145 - RNA, 64 nt, hsa
ucuuuuucuuccuugcacuccuugaucuuugggcuuccgugauguccucagggucccccccucc

SEQ ID NO: 334146 - RNA, 64 nt, hsa
gcccagcggcccucuuuccugucuguguaaauuguuccgugaagccgcgcucuguuuugggaau

SEQ ID NO: 334147 - RNA, 64 nt, hsa
gaaggugaacaggauggccuggcagcagggauguuuccgugagccacaaauaccagaaacugag

SEQ ID NO: 334148 - RNA, 64 nt, hsa
uccucuaacucauucuucacggaugccguagcguuuccgugagcucaaacuggccuugguguaa

SEQ ID NO: 334149 - RNA, 64 nt, hsa
cagggugauagcucagggaacaacaaaaaaggaauuccgugaaaacauuuuuuuuucuuugaug

SEQ ID NO: 334150 - RNA, 64 nt, hsa
ccucaguccuucaccuugccaggugccguuucucuuccgugaaggccacugcccagguccccag

SEQ ID NO: 334151 - RNA, 64 nt, hsa
ugcuuuuaaaucugcagcacauugauaagaugguuuccgugagcuaugauaagauugaaauucc

SEQ ID NO: 334152 - RNA, 64 nt, hsa
cccaauguaggagcugccuuggcucagacauguuuuccgugaaaacggagcugaacaauaggcu

SEQ ID NO: 334153 - RNA, 64 nt, hsa
cuggggagcgaaaguuucuuggucucagcuucauuuccgugaagggcaccgagaacucgaagcc

SEQ ID NO: 334154 - RNA, 64 nt, hsa
ugaucauuuucugccauaccaaggucauaauuccuuccgugagaaauauuuuagugggguaaca

SEQ ID NO: 334155 - RNA, 64 nt, hsa
gucauuaggcaccguauugcauaaaauagaaggcuuccgugaugaaaauaccagugaaaagauu

SEQ ID NO: 334156 - RNA, 64 nt, hsa
ggaugacucuacugcguggaugguuacauuugcuuuccgugaaaugcucagaaaaugucaggac

SEQ ID NO: 334157 - RNA, 64 nt, hsa
auagacaggagugagagggagagugggugacacuuuccgugacacuuaauguaggaagacaugg

SEQ ID NO: 334158 - RNA, 64 nt, hsa
agccugucgcggcccggccgccugcggcacugccuuccgugacgucgccguugcacuauggaca

SEQ ID NO: 334159 - RNA, 64 nt, hsa
ucaagccaccacauuuuguaaugcagaguuuuuuuuccgugaaagauuucuuaaaauauuacuu

SEQ ID NO: 334160 - RNA, 64 nt, hsa
accagcuacacucagaccaacagauggccagcccuuccgugacagccagcaucgaacaugagac

SEQ ID NO: 334161 - RNA, 64 nt, hsa
cuggcugcagaugacuggaaacaaggaaggacauuuccgugagagucaucucaaacacugcuua

SEQ ID NO: 334162 - RNA, 64 nt, hsa
agaggggcaggcuuucugugugacucgggaguucuuccgugagggcugccaggggguggugugc

SEQ ID NO: 334163 - RNA, 64 nt, hsa
acuuccugcagacuuuccgccgugggcugcuggguuccgugaugcuggaccucgacguccugcg

SEQ ID NO: 334164 - RNA, 64 nt, hsa
ugaaccacgucuucaagaaagaagccaaaaauauuuccgugagguuuuuaacuaccucugaauc

SEQ ID NO: 334165 - RNA, 64 nt, hsa
ugucaggcgggacuggaacguucuagaugguauguuccgugauauuaacaacucuaacccagga

SEQ ID NO: 334166 - RNA, 64 nt, hsa
auuaauuugucuuccauuugaugauaccgcaaaauuccgugaguccauuccuuuggcauggcac

SEQ ID NO: 334167 - RNA, 64 nt, hsa
uagcacagaucagucugucaauaaauggccaauguuccgugauuauuacccugaccuccaucau

SEQ ID NO: 334168 - RNA, 64 nt, hsa
caccugagcaacaaugauuaugagagaggauggcuuccgugaaagaccaugccuggucuguccu

SEQ ID NO: 334169 - RNA, 64 nt, hsa
ucucggguggcuagucagagagaguguuuggggguuccgugauguaggguaaggugccuucuua

SEQ ID NO: 334170 - RNA, 64 nt, hsa
gcccuggacaggucccaaaguuccaagcaguccuuuccgugaaagcagggguuugcaugugcua

SEQ ID NO: 334171 - RNA, 64 nt, hsa
gaaugaucuuucucuaguuucauuuagaacugauuuccgugagacaaugacagaaacccuaccu

SEQ ID NO: 334172 - RNA, 64 nt, hsa
ugggacuccggcucccuaccccaaacugaagcgcuuccgugaacacccccguccuccguagggg

SEQ ID NO: 334173 - RNA, 64 nt, hsa
ccugcugcucauggggguggggguucccaacccuuuccgugaaagggaccgugaguaguggaaa

SEQ ID NO: 334174 - RNA, 64 nt, hsa
caacauaucagguuccccuacuacugaaguagccuuccgugagaacacaccacauguuaggacu

SEQ ID NO: 334175 - RNA, 64 nt, hsa
ccgugugucauugaucagcaccauuugugguauguuccgugaugagcguuuagugagccugcug

SEQ ID NO: 334176 - RNA, 64 nt, hsa
gcaccuaaaccuugagggggagggugcucuggguuuccgugagguaaccaccuuaaaugggagg

SEQ ID NO: 334177 - RNA, 64 nt, hsa
uauuccacaaagaagggcugccguuuggucccucuuccgugaggacuggcggcaccagcaccuu

SEQ ID NO: 334178 - RNA, 64 nt, hsa
ggaaagggcucucaagggcucuucugcucaucucuuccgugagauuugcucccagacccucuga

SEQ ID NO: 334179 - RNA, 64 nt, hsa
aaacagccacgccucucaggaacccaccuggcgguuccgugagcucaggcaggccugacccggc

SEQ ID NO: 334180 - RNA, 64 nt, hsa
acuuuccgagccuccaguccaaagccggcuugauuuccgugaacucuggugcuccugcaucuca

SEQ ID NO: 334181 - RNA, 64 nt, hsa
aaucaaacgucuuaacgcguauagagagaucacguuccgugagcagacacaaaacgguggcagg

SEQ ID NO: 334182 - RNA, 64 nt, hsa
uuggccacucucucagauucccucuucauaaagcuuccgugacuucuaaaccaucaggucggug

SEQ ID NO: 334183 - RNA, 64 nt, hsa
gagccccgcuguuaaccagccgagucugcacagguuccgugagguggcugcccaauguccucug

SEQ ID NO: 334184 - RNA, 64 nt, hsa
accuucuccaucgugucagcuguguuucucuugauuccgugacacccgguuuauuaguucaaaa

SEQ ID NO: 334185 - RNA, 64 nt, hsa
cucucuguccgaucugugcauguuauuuuucuuuuuccgugagucaaagucugaccuuuauuuu

SEQ ID NO: 334186 - RNA, 50 nt, hsa
ccaguaagcuuccaccguaguuccgugagcaucaauauaucuuuucuugg

SEQ ID NO: 334187 - RNA, 64 nt, hsa
gugauaucagagauuacuaugaauguuaguuucauuccgugaaacauuacuuccauauaaagac

SEQ ID NO: 334188 - RNA, 64 nt, hsa
ccucccaaauuugauuuuguuauuagaaaaaugauuccgugaacacagauguguuuugaagaag

SEQ ID NO: 334189 - RNA, 64 nt, hsa
uuguuucuuucccgucccacucuuuaaaaacugguuccgugaggaaaggcagaagccguuccgu

SEQ ID NO: 334190 - RNA, 64 nt, hsa
uggguguccggggcagacaucacaugucgguagguuccgugaugccccacaagccgcaaaaacc

SEQ ID NO: 334191 - RNA, 64 nt, hsa
acauccagacuaacauaguuguuacccaauguauuuccgugaggccuguugcauugagauucuc

SEQ ID NO: 334192 - RNA, 64 nt, hsa
cccgccauuaucucccccuaguuagagacaguccuuccgugaggccuggggggcaucugugccu

SEQ ID NO: 334193 - RNA, 64 nt, hsa
gagcuguaaggcaugugccuucugccaccugacuuuccgugaggggacuaaaauuuacuaauug

SEQ ID NO: 334194 - RNA, 64 nt, hsa
ggugauuagagggaggagaaugagccucggccucuuccgugacgucacuggaccacugggcaau

SEQ ID NO: 334195 - RNA, 64 nt, hsa
gaccggagcucaccgcccagagcguggacagggcuuccgugagacgccaccgugagaggccagg

SEQ ID NO: 334196 - RNA, 64 nt, hsa
ggccuccgcucccugcacacacacggacaggaauuuccgugacugugguguggagacuggagcc

SEQ ID NO: 334197 - RNA, 64 nt, hsa
acaguuuuccuccauguuauuuaugaauuuuauauuccgugaauguauauugucuuguaauguu

SEQ ID NO: 334198 - RNA, 64 nt, hsa
cuccuucugcuaggcagagagcgcacccuacucuuuccgugacgaugagggcggcaaaaacaga

SEQ ID NO: 334199 - RNA, 64 nt, hsa
uauguggcaugaucuugacgugaagcauggguguuuccgugacuuagcugugucccuguagcuc

SEQ ID NO: 334200 - RNA, 64 nt, hsa
caggaauagcacccucuccccgggaggcccuagcuuccgugaggggccaucaccagccauuccu

SEQ ID NO: 334201 - RNA, 64 nt, hsa
agcauaacuaaacaaagauuaugagcucuacuuauuccgugagaauacccugcaccaaaggugu

SEQ ID NO: 334202 - RNA, 64 nt, hsa; identical to SEQ ID NO: 70765

SEQ ID NO: 334203 - RNA, 64 nt, hsa; identical to SEQ ID NO: 70766

SEQ ID NO: 334204 - RNA, 64 nt, hsa; identical to SEQ ID NO: 70767

SEQ ID NO: 334205 - RNA, 64 nt, hsa; identical to SEQ ID NO: 70768

SEQ ID NO: 334206 - RNA, 64 nt, hsa; identical to SEQ ID NO: 70769

SEQ ID NO: 334207 - RNA, 64 nt, hsa; identical to SEQ ID NO: 70770

SEQ ID NO: 334208 - RNA, 64 nt, hsa; identical to SEQ ID NO: 70771

SEQ ID NO: 334209 - RNA, 64 nt, hsa; identical to SEQ ID NO: 70772

SEQ ID NO: 334210 - RNA, 64 nt, hsa; identical to SEQ ID NO: 70773

SEQ ID NO: 334211 - RNA, 64 nt, hsa; identical to SEQ ID NO: 70774

SEQ ID NO: 334212 - RNA, 64 nt, hsa; identical to SEQ ID NO: 70775

SEQ ID NO: 334213 - RNA, 64 nt, hsa; identical to SEQ ID NO: 70776

SEQ ID NO: 334214 - RNA, 64 nt, hsa; identical to SEQ ID NO: 70777

SEQ ID NO: 334215 - RNA, 64 nt, hsa; identical to SEQ ID NO: 70778

SEQ ID NO: 334216 - RNA, 64 nt, hsa; identical to SEQ ID NO: 70779

SEQ ID NO: 334217 - RNA, 64 nt, hsa; identical to SEQ ID NO: 70780

SEQ ID NO: 334218 - RNA, 64 nt, hsa; identical to SEQ ID NO: 70781

SEQ ID NO: 334219 - RNA, 64 nt, hsa; identical to SEQ ID NO: 70782

SEQ ID NO: 334220 - RNA, 64 nt, hsa; identical to SEQ ID NO: 70783

SEQ ID NO: 334221 - RNA, 64 nt, hsa; identical to SEQ ID NO: 70784

SEQ ID NO: 334222 - RNA, 64 nt, hsa; identical to SEQ ID NO: 70785

SEQ ID NO: 334223 - RNA, 64 nt, hsa; identical to SEQ ID NO: 70786

SEQ ID NO: 334224 - RNA, 64 nt, hsa; identical to SEQ ID NO: 70787

SEQ ID NO: 334225 - RNA, 64 nt, hsa; identical to SEQ ID NO: 70788

SEQ ID NO: 334226 - RNA, 64 nt, hsa; identical to SEQ ID NO: 70789

SEQ ID NO: 334227 - RNA, 64 nt, hsa; identical to SEQ ID NO: 70790

SEQ ID NO: 334228 - RNA, 64 nt, hsa; identical to SEQ ID NO: 70791

SEQ ID NO: 334229 - RNA, 64 nt, hsa; identical to SEQ ID NO: 70792

SEQ ID NO: 334230 - RNA, 64 nt, hsa; identical to SEQ ID NO: 70793

SEQ ID NO: 334231 - RNA, 64 nt, hsa; identical to SEQ ID NO: 70794

SEQ ID NO: 334232 - RNA, 64 nt, hsa; identical to SEQ ID NO: 70795

SEQ ID NO: 334233 - RNA, 64 nt, hsa; identical to SEQ ID NO: 70796

SEQ ID NO: 334234 - RNA, 64 nt, hsa; identical to SEQ ID NO: 70797

SEQ ID NO: 334235 - RNA, 64 nt, hsa; identical to SEQ ID NO: 70798

SEQ ID NO: 334236 - RNA, 64 nt, hsa; identical to SEQ ID NO: 70799

SEQ ID NO: 334237 - RNA, 64 nt, hsa; identical to SEQ ID NO: 70800

SEQ ID NO: 334238 - RNA, 64 nt, hsa; identical to SEQ ID NO: 70801

SEQ ID NO: 334239 - RNA, 64 nt, hsa; identical to SEQ ID NO: 70802

SEQ ID NO: 334240 - RNA, 64 nt, hsa; identical to SEQ ID NO: 70803

SEQ ID NO: 334241 - RNA, 64 nt, hsa; identical to SEQ ID NO: 70804

SEQ ID NO: 334242 - RNA, 64 nt, hsa; identical to SEQ ID NO: 70805

SEQ ID NO: 334243 - RNA, 64 nt, hsa; identical to SEQ ID NO: 70806

SEQ ID NO: 334244 - RNA, 64 nt, hsa; identical to SEQ ID NO: 70807

SEQ ID NO: 334245 - RNA, 64 nt, hsa; identical to SEQ ID NO: 70808

SEQ ID NO: 334246 - RNA, 64 nt, hsa; identical to SEQ ID NO: 70809

SEQ ID NO: 334247 - RNA, 64 nt, hsa; identical to SEQ ID NO: 70810

SEQ ID NO: 334248 - RNA, 64 nt, hsa; identical to SEQ ID NO: 70811

SEQ ID NO: 334249 - RNA, 64 nt, hsa; identical to SEQ ID NO: 70812

SEQ ID NO: 334250 - RNA, 64 nt, hsa; identical to SEQ ID NO: 70813

SEQ ID NO: 334251 - RNA, 64 nt, hsa; identical to SEQ ID NO: 70814

SEQ ID NO: 334252 - RNA, 64 nt, hsa; identical to SEQ ID NO: 70814

SEQ ID NO: 334253 - RNA, 64 nt, hsa; identical to SEQ ID NO: 70816

SEQ ID NO: 334254 - RNA, 64 nt, hsa; identical to SEQ ID NO: 70817

SEQ ID NO: 334255 - RNA, 64 nt, hsa; identical to SEQ ID NO: 70818

SEQ ID NO: 334256 - RNA, 64 nt, hsa; identical to SEQ ID NO: 70819

SEQ ID NO: 334257 - RNA, 64 nt, hsa; identical to SEQ ID NO: 70820

SEQ ID NO: 334258 - RNA, 64 nt, hsa; identical to SEQ ID NO: 70821

SEQ ID NO: 334259 - RNA, 64 nt, hsa; identical to SEQ ID NO: 70822

SEQ ID NO: 334260 - RNA, 64 nt, hsa; identical to SEQ ID NO: 70823

SEQ ID NO: 334261 - RNA, 64 nt, hsa; identical to SEQ ID NO: 70824

SEQ ID NO: 334262 - RNA, 64 nt, hsa; identical to SEQ ID NO: 70825

SEQ ID NO: 334263 - RNA, 64 nt, hsa; identical to SEQ ID NO: 70826

SEQ ID NO: 334264 - RNA, 64 nt, hsa; identical to SEQ ID NO: 70827

SEQ ID NO: 334265 - RNA, 64 nt, hsa; identical to SEQ ID NO: 70828

SEQ ID NO: 334266 - RNA, 64 nt, hsa; identical to SEQ ID NO: 70829

SEQ ID NO: 334267 - RNA, 64 nt, hsa
aaagucuccaccccuacacaaggacagaacccuccaccccuacccccaacccucagacagacuu

SEQ ID NO: 334268 - RNA, 64 nt, hsa
caugcacccuggacuucucuaauagaaaagucuccaccccuacacaaggacagaacccuccacc

SEQ ID NO: 334269 - RNA, 64 nt, hsa
cacucaggccugugcccacucccuaucuccuucccaccccuacacacacacucccugcuugcag

SEQ ID NO: 334270 - RNA, 64 nt, hsa
aaugcuggggcagggggugaagaacccucugucccaccccuagccaccaguguccuccaagugc

SEQ ID NO: 334271 - RNA, 64 nt, hsa
caucuggaaugcuccaguuugaucucccuucugccaccccuaccucaccccuagucacucauau

SEQ ID NO: 334272 - RNA, 64 nt, hsa
cuccaguuugaucucccuucugccaccccuaccucaccccuagucacucauaucggagccugga

SEQ ID NO: 334273 - RNA, 64 nt, hsa
aacuccaggggggacaauaugugccaaucaauagcaccccuacucacauacacacacaccuagc

SEQ ID NO: 334274 - RNA, 64 nt, hsa
uguuuacuuuuuugguacuauaaaagcuuucugccaccccuaaacuccaggggggacaauaugu

SEQ ID NO: 334275 - RNA, 64 nt, hsa
cucccuaucccugcagccugagggucccuucagccaccccuaaguccccaccugggcuccugcc

SEQ ID NO: 334276 - RNA, 64 nt, hsa
ggcgcccgcggucccccagcaccugcccaagccacaccccuagcuucccucccuaucccugcag

SEQ ID NO: 334277 - RNA, 64 nt, hsa
guugcugagagaaacaaaaaauuuccuaaugcaucugagagauaagcuucggcaguaucacaag

SEQ ID NO: 334278 - RNA, 64 nt, hsa
uaucaaagucuagaaacagauguuuucaguguugcugagagaaacaaaaaauuuccuaaugcau

SEQ ID NO: 334279 - RNA, 64 nt, hsa
gcauucuccuguuuuuacagauuguauccugaggcugagagaguuaagugaaugucuaagguca

SEQ ID NO: 334280 - RNA, 64 nt, hsa
ggcacagagagagucaacugaggccaaaagaggccugagagaaacugaggucaagauuucagga

SEQ ID NO: 334281 - RNA, 64 nt, hsa
cugccaggaaguguuuauuugccucuaauugggccugagagaccauagggagguuggggcucac

SEQ ID NO: 334282 - RNA, 64 nt, hsa
cuaguuaccacuaggcuaccaggucucuaggggccugagagaggcccucuagagaauccaggga

SEQ ID NO: 334283 - RNA, 64 nt, hsa
uuccucccaguaagaagggaaggugggugggcaccugagagauuaagacuauucucccaguccc

SEQ ID NO: 334284 - RNA, 64 nt, hsa
ugagggcucaggccuccaccugagagguuauaaccugagagacagcucuacccuuccucccagu

SEQ ID NO: 334285 - RNA, 64 nt, hsa
ggguguggguaaagacagggaugaaggauagaggcugagagaagaaggaagaaucagcccagca

SEQ ID NO: 334286 - RNA, 64 nt, hsa
gcucugccccaucacagccagcaugacugcuucucugagagaacuugcccaucaggggcuggga

SEQ ID NO: 334287 - RNA, 64 nt, hsa
cagcccauugguucccacuggcagcaugguagagcugagagaaacaggcucucaggguaccuga

SEQ ID NO: 334288 - RNA, 64 nt, hsa
uaggugaaaauuccuuauaaauccaggauuggcucugagagaacuggcuaagauucaggaagaa

SEQ ID NO: 334289 - RNA, 64 nt, hsa
uaucuuggcugacagcaggcaagcuucaguuugggcuguggacgcugccacacaagccugagua

SEQ ID NO: 334290 - RNA, 64 nt, hsa
gacaccugagauuagaggcuggggcucacugcaggcuguggagaggucaugcugguccacagga

SEQ ID NO: 334291 - RNA, 64 nt, hsa
aacccagggccagcuggaaguguggagcacacaugcuguggagcacacaugcuguggagauugc

SEQ ID NO: 334292 - RNA, 64 nt, hsa
gaaguguggagcacacaugcuguggagcacacaugcuguggagauugcagugugucugagguuu

SEQ ID NO: 334293 - RNA, 64 nt, hsa
gaacacaaugacuaucauuacugaugcagaccuggcuguggagagcagcuaauguguggcccag

SEQ ID NO: 334294 - RNA, 64 nt, hsa
cugggaggagcugccagagagaagcaaaaaggcggcuguggaucgcccugggcugggcaccagu

SEQ ID NO: 334295 - RNA, 64 nt, hsa
caccaccacguccugcagaacgagcccugccuuggcuguggagaagcacuccaggccgcuagca

SEQ ID NO: 334296 - RNA, 64 nt, hsa
cccucuggacuagaguagaaaugcaggggaaacugcuguggauuugagaggcaaaguuggcuca

SEQ ID NO: 334297 - RNA, 64 nt, hsa
acuaaccugugagaggggcccgagagaaggaacagcuguggaacaggcuuuuuacaccccaagu

SEQ ID NO: 334298 - RNA, 64 nt, hsa
ggugagagacuuuggcccccucccucccuauaaggcuguggaaccugaggaaguagauacuuga

SEQ ID NO: 334299 - RNA, 64 nt, hsa
uauaagaaucuuuuaugagauuauagauuucaaugcuguggauagugucuugcacccaaacaag

SEQ ID NO: 334300 - RNA, 64 nt, hsa
gauuuuuaccaccuguguuugcauauuuauauaugcuguggaugaaaauaacuuacuagagaau

SEQ ID NO: 334301 - RNA, 64 nt, hsa
cugggugugcugccugucugagcaagcuucccuagcuguggaaccccgggcccccugcugcggg

SEQ ID NO: 334302 - RNA, 64 nt, hsa
cuccccauucaggccugguggcaggaagggacaagcuguggagcuggcugagucacagccaccu

SEQ ID NO: 334303 - RNA, 64 nt, hsa
ucccagcccuucucgcugccaaggcagcaguggugcuguggaugggcuggggacugcgggacag

SEQ ID NO: 334304 - RNA, 64 nt, hsa
gagaaggaguguucucugucugccuggcaaaggugcuguggaauaggcuuggcaugccacccug

SEQ ID NO: 334305 - RNA, 64 nt, hsa
cagaaauguggccuuugaagagguugcugaggcugcuguggaccaguugcugcagucccaugaa

SEQ ID NO: 334306 - RNA, 64 nt, hsa
cagggaauuuuggagaaacuacagcaucauggaugcuguggacauggccaucgcaugggaggag

SEQ ID NO: 334307 - RNA, 64 nt, hsa
aauguaugcuacacaucuugggcucacaagugaggcuguggaggccaggagguucaaguaugga

SEQ ID NO: 334308 - RNA, 64 nt, hsa
ggagcaauugagaccccucaggaguuuccacacugcuguggacgggauagccagggcagaccug

SEQ ID NO: 334309 - RNA, 64 nt, hsa
agccaggcuggaggcggcaggcggcaggcagcaggcuguggaggaggccccucggucagggagc

SEQ ID NO: 334310 - RNA, 64 nt, hsa
ccagugaaacaacagcagagaaucauguuccuuugcuguggaacacauaagccccacaguuuuc

SEQ ID NO: 334311 - RNA, 64 nt, hsa
ggugugagagggacagcucacgaggcuuggaccugcuguggagggugcccagcagggggcugag

SEQ ID NO: 334312 - RNA, 64 nt, hsa
ggcgugagagggacggcucacgaggcuuggaccugcuguggagggugcccagcagacguggugu

SEQ ID NO: 334313 - RNA, 64 nt, hsa
cccacccacgguccucaccuggagcuguggccuggcuguggagggccgggugguggcucugagg

SEQ ID NO: 334314 - RNA, 64 nt, hsa
cuugggcagcagcucagcaugggcagacaugggggcuguggauucuuccagggcggggauggca

SEQ ID NO: 334315 - RNA, 64 nt, hsa
gacaaggagcggcaggaaucaccacccaucuccagcuguggagcccuguggaggggaaggggaa

SEQ ID NO: 334316 - RNA, 64 nt, hsa
uuaccuugaacucuccucucuggcuuugcggugggcuguggaggcugguuuugaccaaaaguga

SEQ ID NO: 334317 - RNA, 64 nt, hsa
gaaagcacccaaagugguggucaggagggucgcugcuguggaaggggucuccguucuuggugcu

SEQ ID NO: 334318 - RNA, 64 nt, hsa
ucuugauuccaaauccuaaaccaggaagaguugggcuguggaaggacaucuucaccgucuccau

SEQ ID NO: 334319 - RNA, 64 nt, hsa
uguacucgagcggcuccgggcggagaacaagucggcuguggagaugcggaaagcccugacggac

SEQ ID NO: 334320 - RNA, 64 nt, hsa
accaguuggcuaggggagcagggggcccaccagagcuguggagaggggacccuaagacuccucg

SEQ ID NO: 334321 - RNA, 64 nt, hsa
gccuuaaauguuuaaguaaacucugucucaguuuuaggauuaaaauacccaccgguggugugau

SEQ ID NO: 334322 - RNA, 64 nt, hsa
uuucuuuuuuuaacuggaugaaaaaucuucauguuaggauuaauuuucuuaaucaccuccacac

SEQ ID NO: 334323 - RNA, 64 nt, hsa
uaguacauaaauuuucuacucaacaauuccgagauaggauuaugccuaguuugucauaucacag

SEQ ID NO: 334324 - RNA, 64 nt, hsa
uaggguaggagugcuguaaggguacugggagaaguaggauuaguuaggggcagaucuugaauuc

SEQ ID NO: 334325 - RNA, 64 nt, hsa
caagcaguucucaugucucaacaucccagguagcuaggauuacaggcgugccaccaugccuggc

SEQ ID NO: 334326 - RNA, 64 nt, hsa
acaaccagaaacaaugugucuauuucugaaagaauaggauuaaugaucauacaaauggguuaau

SEQ ID NO: 334327 - RNA, 64 nt, hsa
ugaauucugguuguaaaucugguuacagcauaacuaggauuauaaugcugccucauuuucacag

SEQ ID NO: 334328 - RNA, 64 nt, hsa
cauuucuaguuccuuugacauuccauauaauuuuuaggauuaguuuguacuuauuuacaaaaca

SEQ ID NO: 334329 - RNA, 64 nt, hsa
gcgcucccuggugcuugcccagcuuuuugaucuguaggauuaugccuuuugcaaaauuugggga

SEQ ID NO: 334330 - RNA, 64 nt, hsa
uuucuuuuugugaaauuuccuguacagccuuuuguaggauuacuacagguuaaugugaguugag

SEQ ID NO: 334331 - RNA, 64 nt, hsa
guuuuauauccuagagucaaggaacaaauuuccuuaggauuauaguauuacaugccauaaaaua

SEQ ID NO: 334332 - RNA, 64 nt, hsa
gcugggucuuuggccauaagaaguaaagauuugaagacagaaggaagaaacucaggaguaagcu

SEQ ID NO: 334333 - RNA, 64 nt, hsa
aagggcccuacuacacuggcuuuuuuaggcuuagagacagaaacuuuagcauuggcccaguagu

SEQ ID NO: 334334 - RNA, 64 nt, hsa
gaaaauguuuucuuugugcucauugaguaguuccagacagaagaagaauauacucuuuaaaaug

SEQ ID NO: 334335 - RNA, 64 nt, hsa
ccccacacccaccaauaccuaaaucuguuaaggaagacagaaaauguuuucuuugugcucauug

SEQ ID NO: 334336 - RNA, 64 nt, hsa
accugucuguucuuaaagauuucaugguuggcucagacagaacaaucaucuguuugacuucuuu

SEQ ID NO: 334337 - RNA, 64 nt, hsa
uuugacuucuuugguuccucaugcagcagaaggaagacagaaagauagaaauugauuauuuuua

SEQ ID NO: 334338 - RNA, 64 nt, hsa
gauacaggguugguucucauuucgugccgaaaugagacagaaauucagugacgaaggugcguug

SEQ ID NO: 334339 - RNA, 64 nt, hsa
uacagcaguuucaaaaaugacaaagucaguuuggagacagaaaaagacaaaagguccagucuca

SEQ ID NO: 334340 - RNA, 64 nt, hsa
cagcacaggaccuggugacaugacauaaacuccaagacagaaccucaguuuacagcacacgaaa

SEQ ID NO: 334341 - RNA, 64 nt, hsa
ggggggacugggggagggguagcugcuaucuuugagacagaaagaugcaggacagcauuucaua

SEQ ID NO: 334342 - RNA, 64 nt, hsa
uuaaauggcacuauguaguaauuaagagcuaaggagacagaaagacaguagaugagaauagaag

SEQ ID NO: 334343 - RNA, 64 nt, hsa
aggcguuguggugaauaugcaggaaucauucaugagacagaauguauuuuguuguaugacagaa

SEQ ID NO: 334344 - RNA, 64 nt, hsa
aauacuaugccauaguguucuccaucucuagugaagacagaaccagagggaauaaggaucuuuu

SEQ ID NO: 334345 - RNA, 64 nt, hsa
gauaaauucagugauagcccaagcuggucaggagagacagaagugcuggcuaggaggucucagc

SEQ ID NO: 334346 - RNA, 64 nt, hsa
aaagacaaacagaaauagacacacacaccagcagagacagaaacagcaauagccaggacuccug

SEQ ID NO: 334347 - RNA, 64 nt, hsa
agacugcucuaccaauagaucuuuguuuguuuugagacagaaucuugaucuguuacccaggcug

SEQ ID NO: 334348 - RNA, 64 nt, hsa
gaccagccggagcagccggagcugaagcggaucaagacagaagacggcgagggcaucgucauug

SEQ ID NO: 334349 - RNA, 64 nt, hsa
aacccaaaacccagcuggccuuaacacuccuuaaagacagaagucacacuugaacaaaacccac

SEQ ID NO: 334350 - RNA, 64 nt, hsa
acuuaaacaccccacugucaacauuagaucaaugagacagaaaguuaacaaggauauccaggaa

SEQ ID NO: 334351 - RNA, 64 nt, hsa
caauaaauguaauccagcauauaaacagaaccaaagacagaaaccacaugauuaucucaauaga

SEQ ID NO: 334352 - RNA, 64 nt, hsa
aaacucagacacguggacagggauagacagaaagagacagaagcuggggcuacguccaugugga

SEQ ID NO: 334353 - RNA, 64 nt, hsa
cugguuggccaaacucagacacguggacagggauagacagaaagagacagaagcuggggcuacg

SEQ ID NO: 334354 - RNA, 64 nt, hsa
cugucaguuuggguccuccaaaugaaaaaugucaagacagaauuggacaugcaaaagauugacu

SEQ ID NO: 334355 - RNA, 64 nt, hsa
ugagguauuuauuuauucauuugaguaacaaagcagacagaauacauagccaccauugguagua

SEQ ID NO: 334356 - RNA, 64 nt, hsa
ccuagguuuugagauuuagagcaaugcauucuggagacagaaccagcagaacagccauuuuuca

SEQ ID NO: 334357 - RNA, 64 nt, hsa
acugcuguauucaugaaucuugagaguguuccugagacagaauuaauggucauuugggaaaacu

SEQ ID NO: 334358 - RNA, 64 nt, hsa
uuuuaaauaguggcaacuugggauucauucuggugauucugaaccuugccucauagcuuaaagu

SEQ ID NO: 334359 - RNA, 64 nt, hsa
gagauuggagucugaauggaucuguuuuccaagagauucugagaaauuuuuguauucagcaguu

SEQ ID NO: 334360 - RNA, 64 nt, hsa
uaaaauagaguuaaauguauguaagauugauucugauucugaagucuuaacugccagcagaaaa

SEQ ID NO: 334361 - RNA, 64 nt, hsa
caucuguaaaauagaguuaaauguauguaagauugauucugauucugaagucuuaacugccagc

SEQ ID NO: 334362 - RNA, 64 nt, hsa
gauaagccggcugggcaggagugccacaccuuuugauucugagcauuugauucugacuucugua

SEQ ID NO: 334363 - RNA, 64 nt, hsa
gcaggagugccacaccuuuugauucugagcauuugauucugacuucuguacucugguggccacu

SEQ ID NO: 334364 - RNA, 64 nt, hsa
gaguucuagggaggacagcaaauggagccauucugauucugacaaaaaguccagaacccauaaa

SEQ ID NO: 334365 - RNA, 64 nt, hsa
aaagaaaaacaaguguucagggcauaacaacagugauucugaagagaaggacaagucuaagaag

SEQ ID NO: 334366 - RNA, 64 nt, hsa
uggugaagcugaguuucuguccaaugagcaggaagauucugagacauuucgccugagauauaag

SEQ ID NO: 334367 - RNA, 64 nt, hsa
cacccccugccugggccauggccagcucuagguggauucugauucacugucaaugcuggguugc

SEQ ID NO: 334368 - RNA, 64 nt, hsa
aaugagggaguuguaccacaaacaguacuacaaugauucugaagcacaguguauucagacagau

SEQ ID NO: 334369 - RNA, 64 nt, hsa
aaugcauaugauuuugcaucagcuagacugaguugauucugaccagacuugaugguuuuaaguc

SEQ ID NO: 334370 - RNA, 64 nt, hsa
uaguauuucacaguuuuugcuaauagaaaaugcugauucugauucugagaucaauuugugggaa

SEQ ID NO: 334371 - RNA, 64 nt, hsa
uucacaguuuuugcuaauagaaaaugcugauucugauucugagaucaauuugugggaauuuuac

SEQ ID NO: 334372 - RNA, 64 nt, hsa
gugucagccaaagccaugucacucugagagaacugauucugaggacaaguuagccaucuaccac

SEQ ID NO: 334373 - RNA, 64 nt, hsa
aaaacauuagauaaaauaaaagauucaccggauggauucugaugaaaacgaaaacaaaguaaaa

SEQ ID NO: 334374 - RNA, 64 nt, hsa
guccuguggggagauucugaccacugucccauaggauucugauuuuaggauguccauguccuca

SEQ ID NO: 334375 - RNA, 64 nt, hsa
caaagccaggauucugaggaaaguccuguggggagauucugaccacugucccauaggauucuga

SEQ ID NO: 334376 - RNA, 64 nt, hsa
cagaccucagaaucagaaacgucuccaaagccaggauucugaggaaaguccuguggggagauuc

SEQ ID NO: 334377 - RNA, 64 nt, hsa
cacucuaauggcauuugaacauguaaucaccagagauucugaaaugacugguuuauguuaagcu

SEQ ID NO: 334378 - RNA, 64 nt, hsa
caaaaauaaaacaaaauauugcauucuuuguuuggauucugagaaaugucugggcuucccauug

SEQ ID NO: 334379 - RNA, 64 nt, hsa
agaccaaaaccacugacagauggcaaggcucggcgauucugauuucccuucucaaaucugcuca

SEQ ID NO: 334380 - RNA, 64 nt, hsa
uuuugaagguagaguuuuagaaggcuggauggaagauucugagccuggaauuaggaccccaugg

SEQ ID NO: 334381 - RNA, 64 nt, hsa
uuuuuauuuguuaauaauacuuugcccucagaaagauucugauacccugccuugacaacaugaa

SEQ ID NO: 334382 - RNA, 64 nt, hsa
gcugagcagaggugucucauauuucccagcacaugauucugaacuugaugcuucguggaaugcu

SEQ ID NO: 334383 - RNA, 64 nt, hsa
gaggaggggauucuggaacugaauggcgcuucgggauucugaguagcaggggcagcaugcccag

SEQ ID NO: 334384 - RNA, 64 nt, hsa
cccgggagggauuccggaauugaggggcacgcaggauucugagcaccaggggcagaggcggcca

SEQ ID NO: 334385 - RNA, 64 nt, hsa
uagacauuggacagauauuuuuaguucagauggugauucugaagcuuacaucucccuuaaaaaa

SEQ ID NO: 334386 - RNA, 64 nt, hsa
gucauaaggauaauauauuuuccccaucaaugcugauucugagaaaagagcaauuuaucaaaau

SEQ ID NO: 334387 - RNA, 64 nt, hsa
gauggguucguguccagucccgggggucugauauggccaucacaggcuggguguucccagcagc

SEQ ID NO: 334388 - RNA, 64 nt, hsa
ggcuugggggcuugacgcccuuccccuugccccaggccaucaucuccccaccucuccuccccuc

SEQ ID NO: 334389 - RNA, 64 nt, hsa
ccacaugacaguguccugccugguuggcagcgggggccaucaccuguggccucugagaccgccc

SEQ ID NO: 334390 - RNA, 64 nt, hsa
guucucugugcccucagggacuggcagagcaagaggccaucagaaggacgaggugcuguuggca

SEQ ID NO: 334391 - RNA, 64 nt, hsa
agcugggagaggcugaggauggcagggcuggaagggccaucagcgugacccucauuuucaagaa

SEQ ID NO: 334392 - RNA, 64 nt, hsa
ugauguucagguagaccugggcgccugggaacgaggccaucagcugccaugcacauaacaaaga

SEQ ID NO: 334393 - RNA, 64 nt, hsa
ggcugaccccaugcucagccucuaggggacggcaggccaucaggcugggggcugugcuaugugg

SEQ ID NO: 334394 - RNA, 64 nt, hsa
ccggacacaggcuucugggggaagggucucccuuggccaucacgggaauggaguccaugcuaga

SEQ ID NO: 334395 - RNA, 64 nt, hsa
cagaaaaaggacaaggacaugagacaguggugauggccaucagacagagacuucaaaugcugau

SEQ ID NO: 334396 - RNA, 64 nt, hsa
gagccaucuuggacucuccuccccagguuugaaaggccaucagauuagcagggacgggguguag

SEQ ID NO: 334397 - RNA, 64 nt, hsa
uauuuacaagcaauggcuuuuguggccaucauuuggccaucauuuguuauaauaaauauaaauu

SEQ ID NO: 334398 - RNA, 64 nt, hsa
ugaauuauaauuauuuacaagcaauggcuuuuguggccaucauuuggccaucauuuguuauaau

SEQ ID NO: 334399 - RNA, 64 nt, hsa
gucacuguuccacccgguguaauaucucucaugacagugacaccaagggaaguugacuaaguca

SEQ ID NO: 334400 - RNA, 57 nt, hsa
uuuaucucugcccaguauaguaugcuccagugacagauggauuagggugugucauac

SEQ ID NO: 334401 - RNA, 64 nt, hsa
gacaaagucucacugugucacccagacuggaaugcagugacacaaucucggcucacugaaaccu

SEQ ID NO: 334402 - RNA, 64 nt, hsa
ccuacuguccucagaggcgugcugguccccuccucagugacaucaaagccuggccuaauuguuc

SEQ ID NO: 334403 - RNA, 64 nt, hsa
ggaagccaguacagaucuuugagaggucuguguacagugacagguauaucuuugcaaagaaucu

SEQ ID NO: 334404 - RNA, 64 nt, hsa
ucuuugcaaagaaucuuuuugaaaaugguucccucagugacaucgaguggcauaucuaucagga

SEQ ID NO: 334405 - RNA, 64 nt, hsa
uggacuggagaccaggauucaugcuggucuggaacagugacauugccaacuuaagacacacaaa

SEQ ID NO: 334406 - RNA, 64 nt, hsa
gccugaggaagacgagaugucacagagguccacucagugacaaacacacacugaaggccugagg

SEQ ID NO: 334407 - RNA, 64 nt, hsa
aaguuaaaaauacuuauauauuucuauuacaaagcagugacaaaugaugcccugugugacuugg

SEQ ID NO: 334408 - RNA, 64 nt, hsa
ucaacgucaaugccaaaagccaaggggaauuuugcagugacaggauuuuagucucuuacuauga

SEQ ID NO: 334409 - RNA, 64 nt, hsa
uacggggucuugcucugucucccaggcuggagugcagugacacaaucucagcucacugugaccu

SEQ ID NO: 334410 - RNA, 64 nt, hsa
ugaggagaauugcggcgagacaagcauggaaaaucagugacaucugauuggcagaugagcuuau

SEQ ID NO: 334411 - RNA, 64 nt, hsa
acucagauuuugugagcagugaaguuuaacagagcagugacauuuaacaaagcagugaaguuua

SEQ ID NO: 334412 - RNA, 64 nt, hsa
augagaaacugagccaaggccacauagcuaccuacagugacagaaucaaaauucaaacucaggu

SEQ ID NO: 334413 - RNA, 64 nt, hsa
gacuugaguagucuuugguccagguaaaaugggucagugacacugaaacaguagaguaggaguc

SEQ ID NO: 334414 - RNA, 64 nt, hsa
agaauaauucaauugaauauccaucacuuaaauacagugacaggacagcaacuucagggaucug

SEQ ID NO: 334415 - RNA, 64 nt, hsa
ggucuguugaugcaugccagugcugguuacuagucagugacagagaacacagagagggacaaac

SEQ ID NO: 334416 - RNA, 64 nt, hsa
agacgagaaccgucuuuacccgggccugggagcucagugacauaaaugcugaagagacaggcau

SEQ ID NO: 334417 - RNA, 64 nt, hsa
cccuuuaccugccaagacaagcagggcuauauuucagugacagcugauauuuguuuugaaagug

SEQ ID NO: 334418 - RNA, 64 nt, hsa
gaauaaaaugacaauaacuaaagcuaguuaaugucagugacauuaaacuaacuccaggauucag

SEQ ID NO: 334419 - RNA, 64 nt, hsa
caccacaguaauaggcacuggguccagccuugaucagugacagcgaaggaaguuaucugcuggg

SEQ ID NO: 334420 - RNA, 64 nt, hsa
cacugucaugugcgaacacagugacacguuuggccagugacauuucaaucacugaaaaugugcu

SEQ ID NO: 334421 - RNA, 64 nt, hsa
ggaguggauccagcuucacugucaugugcgaacacagugacacguuuggccagugacauuucaa

SEQ ID NO: 334422 - RNA, 64 nt, hsa
gguuaaagcugugugucccucccaguggcuguggcagugacagugacacccacacccacaguaa

SEQ ID NO: 334423 - RNA, 64 nt, hsa
agcugugugucccucccaguggcuguggcagugacagugacacccacacccacaguaaagagga

SEQ ID NO: 334424 - RNA, 64 nt, hsa
acucagccuaguaaggaagugaaaacuuagcagucagugacauggggaaauaguuauagaaaau

SEQ ID NO: 334425 - RNA, 64 nt, hsa
cuucauaaggaguaacgacugacauuagcauguccagugacaagucacauccgguguaaaaaaa

SEQ ID NO: 334426 - RNA, 64 nt, hsa
ccccaggcaccucacaggccccaggaaaggcccagccaccgaagccgccuguggacagccugag

SEQ ID NO: 334427 - RNA, 64 nt, hsa
ucagccucccaaaaugcugggauuacaggcgugagccaccgagccuggccgguuaacaucuuuu

SEQ ID NO: 334428 - RNA, 64 nt, hsa
agaccugugggugugagccuggccguccuccggggccaccgaccgcagccagccccuccccagg

SEQ ID NO: 334429 - RNA, 64 nt, hsa
cggcaggagucccacuccuccuggggugcugccugccaccgagagcucccccaccuguaccacc

SEQ ID NO: 334430 - RNA, 64 nt, hsa
agcaguauagccacccggccuggccgccaccaccgccaccgagagccccgccuccagcagccgg

SEQ ID NO: 334431 - RNA, 64 nt, hsa
gggcccuaggguacagggugcugcccagcaggucgccaccgagugucuucucauuuuauuucag

SEQ ID NO: 334432 - RNA, 64 nt, hsa
gaaugacuaaaacaucuuaaguaaaugaggaauagccaccgagaugcucagagauaauauaagc

SEQ ID NO: 334433 - RNA, 64 nt, hsa
gaagcaccucuccgagccaugugagcccccugaugccaccgagcaggggcagcuucaugaccga

SEQ ID NO: 334434 - RNA, 64 nt, hsa
caagauggcuaaggagaacaggggggaugauggggccaccgagaggccgaagaaggccaaggag

SEQ ID NO: 334435 - RNA, 64 nt, hsa
ucauuuucauuaaaaaugaaagccaaauuuauaugccaccgauugcaggacacaagcacaguuu

SEQ ID NO: 334436 - RNA, 64 nt, hsa
ccgggcuccgcgugccccgcccgcuggagcaccugccaccgaggcgcgcguggggccacugccg

SEQ ID NO: 334437 - RNA, 64 nt, hsa
aucucgcuucaggaagaaaaguaccucauccucggccaccgaaaccacgugagugagaugagcc

SEQ ID NO: 334438 - RNA, 64 nt, hsa
gugaguacucauaaaggacacuggaucaaguucagccaccgaauugcuuuuaucaguguuaaag

SEQ ID NO: 334439 - RNA, 64 nt, hsa
uugaccucccaaagugcugggauuacagacaugagccaccgagccuggccaauuuuuguguuuu

SEQ ID NO: 334440 - RNA, 64 nt, hsa
cucucccacugcagaacauggccucuagauuaaugccaccgauucaggaacaccuccgacaguc

SEQ ID NO: 334441 - RNA, 64 nt, hsa
gggcaagaggagcucaagucggucugggcccguugccaccgacucccaccuccagcacccaugc

SEQ ID NO: 334442 - RNA, 64 nt, hsa
guacucccuggucagggacaaguguuuccugucagccaccgagugccugcagaagaucauguga

SEQ ID NO: 334443 - RNA, 64 nt, hsa
cuucuccucugagaaggcucccggcugccuccccgccaccgagcuuguagccugaaugccuggc

SEQ ID NO: 334444 - RNA, 64 nt, hsa
gccccggguggugagcgggcaggaaccuggcgccgccaccgagacugagccuccugcagacggg

SEQ ID NO: 334445 - RNA, 64 nt, hsa
uggagcugagagacaguaaaauaauaacugacaugccaccgaaguacaaaguaaaauaaauaaa

SEQ ID NO: 334446 - RNA, 64 nt, hsa
aauaagccucagcuuucuaagaucuaacaagauagccaccgagauccuuaucgaaacucauuuu

SEQ ID NO: 334447 - RNA, 64 nt, hsa
ucggccuaccgaagugcuaggauuacagacguaagccaccgagccuggucuaguuugcauuuuu

SEQ ID NO: 334448 - RNA, 64 nt, hsa
ucugccucccaaagugcugggaucacaggcaugagccaccgaacccagccuuauucugcuuaaa

SEQ ID NO: 334449 - RNA, 64 nt, hsa
guugccaucgugcugggacgacaccagcucuauugccaccgaugaguagcugaggucagugugc

SEQ ID NO: 334450 - RNA, 64 nt, hsa
cacagaccagacucgcuucccauggugggaaacagccaccgagaagguucuagcucuagaaagg

SEQ ID NO: 334451 - RNA, 55 nt, hsa
agaacugcauuagccgcugaggagagccaccgaaggccccaacaggggaugcuca

SEQ ID NO: 334452 - RNA, 64 nt, hsa
gggacuguguuucuuuaaggaugcugaccuggaggccaccgagaggcuggggcuggggcugacc

SEQ ID NO: 334453 - RNA, 64 nt, hsa
uucccugugcuggcuggaguccccagagauaucagccaccgagucuccuggucugucuccaggc

SEQ ID NO: 334454 - RNA, 52 nt, hsa
agaugcccaugccuguguagccgccaccgagggacagccgagggaccgaugg

SEQ ID NO: 334455 - RNA, 64 nt, hsa
gaccgggcggugcggcuguuucacaacacuccuggccaccgagccaugguggaggagaugcagg

SEQ ID NO: 334456 - RNA, 64 nt, hsa
cacagacagguugucaucagcuugucccauucaagccaccgagcucaccacagacacaguggag

SEQ ID NO: 334457 - RNA, 64 nt, hsa
gccccucagcagaggaaggggaguccccuccuccgccaccgagaguccugugcuucggaaugaa

SEQ ID NO: 334458 - RNA, 64 nt, hsa
gaggagagcaaauaucauuauaugaaaguccucugccaccgaguuccuaauuuucuuuguucaa

SEQ ID NO: 334459 - RNA, 64 nt, hsa
uguucuggaaaccaggcucgccggagcuggccaagccaccgacuugcuucucaaauucacuuca

SEQ ID NO: 334460 - RNA, 64 nt, hsa
acuugucuggaggcccagcugggcacuaaugucugccaccgacuauguuacaguguauaaauga

SEQ ID NO: 334461 - RNA, 64 nt, hsa
cgugccuuugauuucggacagauugggccucacagccaccgauucagcugccagggucccugga

SEQ ID NO: 334462 - RNA, 64 nt, hsa
ggguaagggcaggccccuccaacaggugcucacagccaccgaggcaggggcugcagccacccac

SEQ ID NO: 334463 - RNA, 64 nt, hsa
aaagugugggcagaauuacaauuacaaagugccagccaccgaauaaagauaaaaguucaguucu

SEQ ID NO: 334464 - RNA, 64 nt, hsa
aaaugaccauaaacaguaucaauguaucacugaggccaccgaaaaggacauuucuaccuaggca

SEQ ID NO: 334465 - RNA, 64 nt, hsa
gucauuuuuagcucgaccacaucaucaggucuuugccaccgaggcauaguguagaacagucccg
